United States Patent 7,709,616 (MICRORNAS AND USES THEREOF) - sequence listing, part 7

SEQ ID NO: 171071 - RNA, 64 nt, hsa
ccccagccauggcacgugaguugggggaugggauccuagguagggccaggggaggagacccaua

SEQ ID NO: 171072 - RNA, 64 nt, hsa
gauuuauugcauaauacuauucuuuaauugcaauccuagguaucuauagcaugaguggccuuag

SEQ ID NO: 171073 - RNA, 64 nt, hsa
aacaaaccccacacgagggcucucaccuccuucuccuagguaguauuuauuuucagcaccuguu

SEQ ID NO: 171074 - RNA, 64 nt, hsa
ccccuccaauaucccagaaugaauaagaacaaucccuagguauuuuuauuuacccaaguguuca

SEQ ID NO: 171075 - RNA, 64 nt, hsa
cccaaaccccagacugagauacugcucccaggggccuagguagcugccaguccgugauuuuaau

SEQ ID NO: 171076 - RNA, 64 nt, hsa
cuuccacuacccaucuugugagcagaguaaauguccuagguaauaccacuaucaggccuguagg

SEQ ID NO: 171077 - RNA, 64 nt, hsa
uccccuucacaaugagaaguguuuucuggcaggcccuagguaaagggucgggggaggggggagc

SEQ ID NO: 171078 - RNA, 64 nt, hsa
cgguugucaccugauaaucagaccagacuacccaccuagguagggcacacucuguccugaagcu

SEQ ID NO: 171079 - RNA, 64 nt, hsa
uagggugggguggccagcucacauagggguaggcccuagguaaaucagacaccgccuucucaag

SEQ ID NO: 171080 - RNA, 64 nt, hsa
aauaaaauggcauuuuaagaaauaagguggaacuccuagguauugacagacuugagacaucagu

SEQ ID NO: 171081 - RNA, 64 nt, hsa
auuacauaguauuaccuagacauagacaguauuaccuagguagaugcacugcucaccugcgccc

SEQ ID NO: 171082 - RNA, 64 nt, hsa
ccugcgguguguacacgaacucggcuucuuuuguccuagguacgccaagggcagguuucuggag

SEQ ID NO: 171083 - RNA, 64 nt, hsa
gggaggaucaauugaggccagaguuugaaaccagccuagguaacauagugagacccccuaucuc

SEQ ID NO: 171084 - RNA, 64 nt, hsa
gaccccugaagcccagaacucugaucuucacagcccuagguauggccccagcaccccacugccc

SEQ ID NO: 171085 - RNA, 63 nt, hsa
uuuaauuggccccuugaacugucauuaaagaacaccuagguacagucugggggguugccucuc

SEQ ID NO: 171086 - RNA, 64 nt, hsa
gggaaauauaguuguaauauuuuuacaggauauuccuagguaaaugaaggagccuucaguugua

SEQ ID NO: 171087 - RNA, 64 nt, hsa
aguaaaggggcaggugcuugggcuccagagagacccuagguacugccuucuaacuccugcaucc

SEQ ID NO: 171088 - RNA, 64 nt, hsa
acuacuaguacuuuguuccuguuguaugcauucuccuagguagagccuccaucuucaguugugu

SEQ ID NO: 171089 - RNA, 64 nt, hsa
ugcagugagcugugaugacaccacugcacuccaaccuagguaacagagagacaccucugucucu

SEQ ID NO: 171090 - RNA, 64 nt, hsa
ugugaagagcaagagagcagcaaggucuugcucuccuagguagcccccucuucccugguaagaa

SEQ ID NO: 171091 - RNA, 64 nt, hsa; identical to SEQ ID NO: 170977

SEQ ID NO: 171092 - RNA, 64 nt, hsa; identical to SEQ ID NO: 170978

SEQ ID NO: 171093 - RNA, 64 nt, hsa; identical to SEQ ID NO: 170979

SEQ ID NO: 171094 - RNA, 64 nt, hsa; identical to SEQ ID NO: 170980

SEQ ID NO: 171095 - RNA, 64 nt, hsa; identical to SEQ ID NO: 170981

SEQ ID NO: 171096 - RNA, 64 nt, hsa; identical to SEQ ID NO: 170982

SEQ ID NO: 171097 - RNA, 64 nt, hsa; identical to SEQ ID NO: 170983

SEQ ID NO: 171098 - RNA, 64 nt, hsa; identical to SEQ ID NO: 170984

SEQ ID NO: 171099 - RNA, 64 nt, hsa; identical to SEQ ID NO: 170985

SEQ ID NO: 171100 - RNA, 64 nt, hsa; identical to SEQ ID NO: 170986

SEQ ID NO: 171101 - RNA, 64 nt, hsa; identical to SEQ ID NO: 170987

SEQ ID NO: 171102 - RNA, 64 nt, hsa; identical to SEQ ID NO: 170988

SEQ ID NO: 171103 - RNA, 64 nt, hsa; identical to SEQ ID NO: 170989

SEQ ID NO: 171104 - RNA, 64 nt, hsa; identical to SEQ ID NO: 170990

SEQ ID NO: 171105 - RNA, 64 nt, hsa; identical to SEQ ID NO: 170991

SEQ ID NO: 171106 - RNA, 64 nt, hsa; identical to SEQ ID NO: 170992

SEQ ID NO: 171107 - RNA, 64 nt, hsa; identical to SEQ ID NO: 170993

SEQ ID NO: 171108 - RNA, 64 nt, hsa; identical to SEQ ID NO: 170994

SEQ ID NO: 171109 - RNA, 64 nt, hsa; identical to SEQ ID NO: 170995

SEQ ID NO: 171110 - RNA, 64 nt, hsa; identical to SEQ ID NO: 170996

SEQ ID NO: 171111 - RNA, 64 nt, hsa; identical to SEQ ID NO: 170997

SEQ ID NO: 171112 - RNA, 64 nt, hsa; identical to SEQ ID NO: 170998

SEQ ID NO: 171113 - RNA, 64 nt, hsa; identical to SEQ ID NO: 170999

SEQ ID NO: 171114 - RNA, 64 nt, hsa; identical to SEQ ID NO: 171000

SEQ ID NO: 171115 - RNA, 64 nt, hsa; identical to SEQ ID NO: 171001

SEQ ID NO: 171116 - RNA, 64 nt, hsa; identical to SEQ ID NO: 171002

SEQ ID NO: 171117 - RNA, 64 nt, hsa; identical to SEQ ID NO: 171003

SEQ ID NO: 171118 - RNA, 64 nt, hsa; identical to SEQ ID NO: 171004

SEQ ID NO: 171119 - RNA, 64 nt, hsa; identical to SEQ ID NO: 171005

SEQ ID NO: 171120 - RNA, 64 nt, hsa; identical to SEQ ID NO: 171006

SEQ ID NO: 171121 - RNA, 64 nt, hsa; identical to SEQ ID NO: 171007

SEQ ID NO: 171122 - RNA, 64 nt, hsa; identical to SEQ ID NO: 171008

SEQ ID NO: 171123 - RNA, 64 nt, hsa; identical to SEQ ID NO: 171009

SEQ ID NO: 171124 - RNA, 64 nt, hsa; identical to SEQ ID NO: 171010

SEQ ID NO: 171125 - RNA, 64 nt, hsa; identical to SEQ ID NO: 171011

SEQ ID NO: 171126 - RNA, 64 nt, hsa; identical to SEQ ID NO: 171012

SEQ ID NO: 171127 - RNA, 64 nt, hsa; identical to SEQ ID NO: 171013

SEQ ID NO: 171128 - RNA, 64 nt, hsa; identical to SEQ ID NO: 171014

SEQ ID NO: 171129 - RNA, 64 nt, hsa; identical to SEQ ID NO: 171015

SEQ ID NO: 171130 - RNA, 64 nt, hsa; identical to SEQ ID NO: 171016

SEQ ID NO: 171131 - RNA, 64 nt, hsa; identical to SEQ ID NO: 171017

SEQ ID NO: 171132 - RNA, 64 nt, hsa; identical to SEQ ID NO: 171018

SEQ ID NO: 171133 - RNA, 64 nt, hsa; identical to SEQ ID NO: 171019

SEQ ID NO: 171134 - RNA, 64 nt, hsa; identical to SEQ ID NO: 171020

SEQ ID NO: 171135 - RNA, 64 nt, hsa; identical to SEQ ID NO: 171021

SEQ ID NO: 171136 - RNA, 64 nt, hsa; identical to SEQ ID NO: 171022

SEQ ID NO: 171137 - RNA, 64 nt, hsa; identical to SEQ ID NO: 171023

SEQ ID NO: 171138 - RNA, 64 nt, hsa; identical to SEQ ID NO: 171024

SEQ ID NO: 171139 - RNA, 64 nt, hsa; identical to SEQ ID NO: 171025

SEQ ID NO: 171140 - RNA, 64 nt, hsa; identical to SEQ ID NO: 171026

SEQ ID NO: 171141 - RNA, 64 nt, hsa; identical to SEQ ID NO: 171027

SEQ ID NO: 171142 - RNA, 64 nt, hsa; identical to SEQ ID NO: 171028

SEQ ID NO: 171143 - RNA, 64 nt, hsa; identical to SEQ ID NO: 171029

SEQ ID NO: 171144 - RNA, 64 nt, hsa; identical to SEQ ID NO: 171030

SEQ ID NO: 171145 - RNA, 64 nt, hsa; identical to SEQ ID NO: 171031

SEQ ID NO: 171146 - RNA, 64 nt, hsa; identical to SEQ ID NO: 171032

SEQ ID NO: 171147 - RNA, 64 nt, hsa; identical to SEQ ID NO: 171033

SEQ ID NO: 171148 - RNA, 64 nt, hsa; identical to SEQ ID NO: 171034

SEQ ID NO: 171149 - RNA, 64 nt, hsa; identical to SEQ ID NO: 171035

SEQ ID NO: 171150 - RNA, 64 nt, hsa; identical to SEQ ID NO: 171036

SEQ ID NO: 171151 - RNA, 64 nt, hsa; identical to SEQ ID NO: 171037

SEQ ID NO: 171152 - RNA, 64 nt, hsa; identical to SEQ ID NO: 171038

SEQ ID NO: 171153 - RNA, 64 nt, hsa; identical to SEQ ID NO: 171039

SEQ ID NO: 171154 - RNA, 64 nt, hsa; identical to SEQ ID NO: 171040

SEQ ID NO: 171155 - RNA, 64 nt, hsa; identical to SEQ ID NO: 171041

SEQ ID NO: 171156 - RNA, 64 nt, hsa; identical to SEQ ID NO: 171042

SEQ ID NO: 171157 - RNA, 64 nt, hsa; identical to SEQ ID NO: 171043

SEQ ID NO: 171158 - RNA, 64 nt, hsa; identical to SEQ ID NO: 171044

SEQ ID NO: 171159 - RNA, 64 nt, hsa; identical to SEQ ID NO: 171045

SEQ ID NO: 171160 - RNA, 64 nt, hsa; identical to SEQ ID NO: 171046

SEQ ID NO: 171161 - RNA, 64 nt, hsa; identical to SEQ ID NO: 171047

SEQ ID NO: 171162 - RNA, 64 nt, hsa; identical to SEQ ID NO: 171048

SEQ ID NO: 171163 - RNA, 64 nt, hsa; identical to SEQ ID NO: 171049

SEQ ID NO: 171164 - RNA, 64 nt, hsa; identical to SEQ ID NO: 171050

SEQ ID NO: 171165 - RNA, 64 nt, hsa; identical to SEQ ID NO: 171051

SEQ ID NO: 171166 - RNA, 64 nt, hsa; identical to SEQ ID NO: 171052

SEQ ID NO: 171167 - RNA, 64 nt, hsa; identical to SEQ ID NO: 171053

SEQ ID NO: 171168 - RNA, 64 nt, hsa; identical to SEQ ID NO: 171054

SEQ ID NO: 171169 - RNA, 64 nt, hsa; identical to SEQ ID NO: 171055

SEQ ID NO: 171170 - RNA, 64 nt, hsa; identical to SEQ ID NO: 171056

SEQ ID NO: 171171 - RNA, 64 nt, hsa; identical to SEQ ID NO: 171057

SEQ ID NO: 171172 - RNA, 64 nt, hsa; identical to SEQ ID NO: 171058

SEQ ID NO: 171173 - RNA, 64 nt, hsa; identical to SEQ ID NO: 171059

SEQ ID NO: 171174 - RNA, 64 nt, hsa; identical to SEQ ID NO: 171060

SEQ ID NO: 171175 - RNA, 64 nt, hsa; identical to SEQ ID NO: 171061

SEQ ID NO: 171176 - RNA, 64 nt, hsa; identical to SEQ ID NO: 171062

SEQ ID NO: 171177 - RNA, 64 nt, hsa; identical to SEQ ID NO: 171063

SEQ ID NO: 171178 - RNA, 64 nt, hsa; identical to SEQ ID NO: 171064

SEQ ID NO: 171179 - RNA, 64 nt, hsa; identical to SEQ ID NO: 171065

SEQ ID NO: 171180 - RNA, 64 nt, hsa; identical to SEQ ID NO: 171066

SEQ ID NO: 171181 - RNA, 64 nt, hsa; identical to SEQ ID NO: 171067

SEQ ID NO: 171182 - RNA, 64 nt, hsa; identical to SEQ ID NO: 171068

SEQ ID NO: 171183 - RNA, 64 nt, hsa; identical to SEQ ID NO: 171069

SEQ ID NO: 171184 - RNA, 64 nt, hsa; identical to SEQ ID NO: 171070

SEQ ID NO: 171185 - RNA, 64 nt, hsa; identical to SEQ ID NO: 171071

SEQ ID NO: 171186 - RNA, 64 nt, hsa; identical to SEQ ID NO: 171072

SEQ ID NO: 171187 - RNA, 64 nt, hsa; identical to SEQ ID NO: 171073

SEQ ID NO: 171188 - RNA, 64 nt, hsa; identical to SEQ ID NO: 171074

SEQ ID NO: 171189 - RNA, 64 nt, hsa; identical to SEQ ID NO: 171075

SEQ ID NO: 171190 - RNA, 64 nt, hsa; identical to SEQ ID NO: 171076

SEQ ID NO: 171191 - RNA, 64 nt, hsa; identical to SEQ ID NO: 171077

SEQ ID NO: 171192 - RNA, 64 nt, hsa; identical to SEQ ID NO: 171078

SEQ ID NO: 171193 - RNA, 64 nt, hsa; identical to SEQ ID NO: 171079

SEQ ID NO: 171194 - RNA, 64 nt, hsa; identical to SEQ ID NO: 171080

SEQ ID NO: 171195 - RNA, 64 nt, hsa; identical to SEQ ID NO: 171081

SEQ ID NO: 171196 - RNA, 64 nt, hsa; identical to SEQ ID NO: 171082

SEQ ID NO: 171197 - RNA, 64 nt, hsa; identical to SEQ ID NO: 171083

SEQ ID NO: 171198 - RNA, 64 nt, hsa; identical to SEQ ID NO: 171084

SEQ ID NO: 171199 - RNA, 63 nt, hsa; identical to SEQ ID NO: 171085

SEQ ID NO: 171200 - RNA, 64 nt, hsa; identical to SEQ ID NO: 171086

SEQ ID NO: 171201 - RNA, 64 nt, hsa; identical to SEQ ID NO: 171087

SEQ ID NO: 171202 - RNA, 64 nt, hsa; identical to SEQ ID NO: 171088

SEQ ID NO: 171203 - RNA, 64 nt, hsa; identical to SEQ ID NO: 171089

SEQ ID NO: 171204 - RNA, 64 nt, hsa; identical to SEQ ID NO: 171090

SEQ ID NO: 171205 - RNA, 64 nt, hsa
cgucugcaccugaaaagugacccgcggaaacucuauggcggauuuuuuuuuuaacuuucuucuu

SEQ ID NO: 171206 - RNA, 64 nt, hsa
gaaguuuuaaugaauaaaguuuaaucaauuaguaauggcggaaacugucgcugaagcacuuaag

SEQ ID NO: 171207 - RNA, 64 nt, hsa
ccagggugagcagggcccucagaggaaaggcaguauggcggaggccaugggggccccucggcau

SEQ ID NO: 171208 - RNA, 64 nt, hsa
gccagcucgggugaggggugaguggaggagacccauggcggacaaucacucucucugcucucag

SEQ ID NO: 171209 - RNA, 64 nt, hsa
gacuuugcagaggcguaggaaugaggcuggacagauggcggaagcagagguucccugcgaagac

SEQ ID NO: 171210 - RNA, 64 nt, hsa
cacagguccgcguggcuggggaggcuucacaaucauggcggaaggugaaaggcaugucuuacgu

SEQ ID NO: 171211 - RNA, 64 nt, hsa
aggaguaaggauggagaugcucagaaucaagagcauggcggaguaggagaagaagcccugcaca

SEQ ID NO: 171212 - RNA, 64 nt, hsa
cacaccccaacacuuccagcauuuagcuggccacauggcggagaguuuuaauuuuuaacuuauu

SEQ ID NO: 171213 - RNA, 64 nt, hsa
cgggacgauggcuuugccagcuuaaaguaaccggauggcggacaccuggcccccgagguccccc

SEQ ID NO: 171214 - RNA, 64 nt, hsa
gugcccuggaggggccugacaguggguuccuuccauggcggauacucccuugaaauuucacauu

SEQ ID NO: 171215 - RNA, 64 nt, hsa
cagcgguggagucuguguugcaccuaggacugccauggcggaugcugaggccacagcuggugaa

SEQ ID NO: 171216 - RNA, 64 nt, hsa
ucucuacuaaaaauacaaaaauuagccgggcgugauggcggacgccuguagucccagcuacucg

SEQ ID NO: 171217 - RNA, 64 nt, hsa
agucauuagcuuagaauaugaagcauaucuacccauggcggaaaaugaagucagaaagauuugu

SEQ ID NO: 171218 - RNA, 64 nt, hsa
uguacgguuuuggaccuauauuguucacguuuugauggcggagaggggugguccuggaggccca

SEQ ID NO: 171219 - RNA, 64 nt, hsa
ugagaccagggcagcguucagcacacuccugggcauggcggaagcaggaagcagacuccagagg

SEQ ID NO: 171220 - RNA, 64 nt, hsa
gugugcugugacgacugucaaagaguaucuggccauggcggacacucagcauuuguugauugaa

SEQ ID NO: 171221 - RNA, 64 nt, hsa
auuuuauucugcuuuguccaauuaaauuauuccaauggcggaugguaauauucaccaucucuaa

SEQ ID NO: 171222 - RNA, 64 nt, hsa
cccugccugccccgacacccagcccagcuugccaauggcggacucaaacgccgcugacugccac

SEQ ID NO: 171223 - RNA, 64 nt, hsa
cugaggucaggaguucgagaccagccuggccaacauggcggaaccccaucuccacuaaaaguac

SEQ ID NO: 171224 - RNA, 64 nt, hsa
caaaucucuuuaccgggaccuucucucaauuuucauggcggaaugucucccccagcugccacac

SEQ ID NO: 171225 - RNA, 64 nt, hsa
cuuggggucaggguuugagaccagccuggccaacauggcggaacccugucucuaccaaaauuac

SEQ ID NO: 171226 - RNA, 64 nt, hsa
uucuuuccuaaauugcauugaauugauaggaaggauggcggaaucuuaaagugauacaugcuaa

SEQ ID NO: 171227 - RNA, 64 nt, hsa
auguuuuuuuaaaaaaaaaugcaaaaaaauucuuauggcggaguuuuuuguuuguuuauuuuag

SEQ ID NO: 171228 - RNA, 64 nt, hsa
uuccgcccucccuuggaucuccauguuuuuccagauggcggaagagcaugugccacccccuuuc

SEQ ID NO: 171229 - RNA, 64 nt, hsa
ugcugcuuaaaaucuucaguacauugauguuuugauggcggacuacauaagcguuaaaaauugu

SEQ ID NO: 171230 - RNA, 64 nt, hsa
auuucugguucugagcgucaacucuccagcugugauggcggaacugacugcuugcugccuuuaa

SEQ ID NO: 171231 - RNA, 64 nt, hsa
gaguccugcacuaccaaaauggccuggccauuugauggcggagcuccaggggccuuggcuuucu

SEQ ID NO: 171232 - RNA, 64 nt, hsa
ucccugaagugacucagccaggcagacaugagacauggcggaguguccaaauggauccuuuauu

SEQ ID NO: 171233 - RNA, 64 nt, hsa
gcaggggguccaggugggccacacaggggccaggauggcggaagauacggguggggagggaaga

SEQ ID NO: 171234 - RNA, 64 nt, hsa
cuuccccagcuccaauauguagcagucucucuggauggcggagagugaaggagacggagaaacg

SEQ ID NO: 171235 - RNA, 64 nt, hsa
gagggaccacuuggggccagccagacuggccucaauggcggacucagucacauugacugacggg

SEQ ID NO: 171236 - RNA, 64 nt, hsa
gcgcaaggaggagcugcguggcggcgguggcgacauggcggagcccuccgaggcgggugacgcg

SEQ ID NO: 171237 - RNA, 64 nt, hsa
guagagagacucugugaaaguaaagaagguagucauggcggagaagguuucagccagauugcaa

SEQ ID NO: 171238 - RNA, 64 nt, hsa
uugggagaggggcgcagcuaagacugggggcaggauggcggaaaggaaggggcgugguggcuag

SEQ ID NO: 171239 - RNA, 64 nt, hsa
aaggacagugcccgccagggaccauguauguaucauggcggaagaguuggcccugaccuggaau

SEQ ID NO: 171240 - RNA, 64 nt, hsa
auuaauauauaauguauaaauucugcacugagccauggcggagcugggcagccccuagguuaga

SEQ ID NO: 171241 - RNA, 64 nt, hsa
cugcccccguccuaggugccgaccaacccccaggauggcggaagcucaccaggccguggccuuc

SEQ ID NO: 171242 - RNA, 64 nt, hsa
acuagccaacggccccagcuucucagcucgcuggauggcggaagcugcuacucgugagcgccag

SEQ ID NO: 171243 - RNA, 64 nt, hsa
ccuauucucuaucuauuuugaaagauuuuggcacuauauuuaauuggaagguaaaauauuguac

SEQ ID NO: 171244 - RNA, 64 nt, hsa
ccuuuagugaauuagaggauuuggcuacccugaguauauuuauauucauuucuucuguucuccu

SEQ ID NO: 171245 - RNA, 64 nt, hsa
agcagauaacuuuuuugagucauugacuucauuuuauauuuaaaaaauuauggaauaucaucug

SEQ ID NO: 171246 - RNA, 64 nt, hsa
cucuaggaacagaccucgcacuuucuguucuaaauauauuuauuccuacuauacaguaaaauac

SEQ ID NO: 171247 - RNA, 64 nt, hsa
gggucucauuuaauggcccuguuuuuuucauuauuauauuuaaugauagggcaggauuucguau

SEQ ID NO: 171248 - RNA, 64 nt, hsa
accacuuuuccuucuuguagacucagcucaccuguauauuuaaacuguucuuggcaucuugaaa

SEQ ID NO: 171249 - RNA, 64 nt, hsa
ggauagugagaugcacacuuauauauauacuguauauauuuauauauuuauauauauauuucau

SEQ ID NO: 171250 - RNA, 64 nt, hsa
agaugcacacuuauauauauacuguauauauuuauauauuuauauauauauuucauauauauau

SEQ ID NO: 171251 - RNA, 64 nt, hsa
cgugcuuucucagguuacuguauaacuguuauaauauauuuaauauauaaaauuaagacuuuug

SEQ ID NO: 171252 - RNA, 64 nt, hsa
ucauaaauucaggaagcacaauauauaccaaacauauauuuaaauaaaauccaggccuagacuc

SEQ ID NO: 171253 - RNA, 64 nt, hsa
cuuccugaaacaaguucucaagaagucuuuacauuauauuuauaacucauauaaaaauuauauu

SEQ ID NO: 171254 - RNA, 64 nt, hsa
gucuuuacauuauauuuauaacucauauaaaaauuauauuuagaauuuuuaaacauguacaaag

SEQ ID NO: 171255 - RNA, 64 nt, hsa
aaugcugucaauauuuuacuguaauuuauguucuuauauuuauguauauuuguuaaaacuguaa

SEQ ID NO: 171256 - RNA, 64 nt, hsa
uauaagauuuuuguaauaucuuucugcuauuggauauauuuauuaguuaauauauuuauuuauu

SEQ ID NO: 171257 - RNA, 64 nt, hsa
uaucuuucugcuauuggauauauuuauuaguuaauauauuuauuuauuuuuugcuauuuaaugu

SEQ ID NO: 171258 - RNA, 64 nt, hsa
acuuggacaugaaacuuuaaaaaaauucacagauuauauuuauaaccugacuagagcaggugau

SEQ ID NO: 171259 - RNA, 64 nt, hsa
cuugugcuguggggcugggggaugcccucuuuucuauauuuauuucauagaaagucuccugcgg

SEQ ID NO: 171260 - RNA, 64 nt, hsa
gaaaaccuucaccucaucuuaaaccgaacucaaauauauuuauuuuuuuaccauaccaacuucu

SEQ ID NO: 171261 - RNA, 64 nt, hsa
uguucugcacuggugcuaaugucuaauauaauuuuauauuuacacacauacgugcuacccagag

SEQ ID NO: 171262 - RNA, 64 nt, hsa
uagguucaaauuauaacugauuuacauuuucagcuauauuuacuuuuuaaaugcuugaguuucc

SEQ ID NO: 171263 - RNA, 64 nt, hsa
aauuuacaaaaugucuuuuugaauguaucaaggauauauuuaguuugaguggaauuugucagca

SEQ ID NO: 171264 - RNA, 64 nt, hsa
aauauauuaaaauguguaauauaccacagguugguauauuuaguuuuaaauacuuaccauaaag

SEQ ID NO: 171265 - RNA, 64 nt, hsa
uaguaguauguauuacucuuauacauuagauaccuauauuuaaaugaaaggcccaauuuguaaa

SEQ ID NO: 171266 - RNA, 64 nt, hsa
cagugguggaauuucugaagggaagugaugaaauuauauuuauuucagugggcacuuuuccauu

SEQ ID NO: 171267 - RNA, 64 nt, hsa
uauuucgggugguuuacguuuaugccaguuccuuuauauuuaaauuucuuguuuuauauauuuu

SEQ ID NO: 171268 - RNA, 64 nt, hsa
gucuauauuuaagguuucugggaguaguuuugucuauauuuaauccauagaugugcuccuaguc

SEQ ID NO: 171269 - RNA, 64 nt, hsa
uuuuggcuuccuacauaaauuaauaaagucugucuauauuuaagguuucugggaguaguuuugu

SEQ ID NO: 171270 - RNA, 64 nt, hsa
auagaaguauagauuaaugacuggaaaguuuuaauauauuuagcccaaagguuacuuugaauug

SEQ ID NO: 171271 - RNA, 64 nt, hsa
aagcugcaucuuucuaccacauuuuaacaucuaauauauuuaauuucuuugaagaggguucugu

SEQ ID NO: 171272 - RNA, 64 nt, hsa
ugauuuaaguuguuucuuagggguuuuuugccuauauauuuaugacuguguuaaugaguaguga

SEQ ID NO: 171273 - RNA, 64 nt, hsa
uaagugugcauuauuuuacaugugcaaaucagaauauauuuaaaaaaaagcaaaagaaauucaa

SEQ ID NO: 171274 - RNA, 64 nt, hsa
auucauuguugagcagugauuuauauuuaguuauuauauuuaggaauagaaaauagaauuaaau

SEQ ID NO: 171275 - RNA, 64 nt, hsa
gaguuccaccuuuauucauuguugagcagugauuuauauuuaguuauuauauuuaggaauagaa

SEQ ID NO: 171276 - RNA, 64 nt, hsa
guauugugccacugcagaacuuuagugcagaguuuauauuuagcuaaacuguuauguuaauuaa

SEQ ID NO: 171277 - RNA, 64 nt, hsa
uacugcuucuuaaaccagcauugcugaccagcauuauauuuauuuuucuuuuauuauucagaug

SEQ ID NO: 171278 - RNA, 64 nt, hsa
auguauaaagauuguacuuagccaguucaaaguguauauuuauucauaaugaauuauaacaguu

SEQ ID NO: 171279 - RNA, 64 nt, hsa
aguggcacaaaaaaauaucagacaagcacuauuuuauauuuaaaaauuguuucuugacaagcug

SEQ ID NO: 171280 - RNA, 64 nt, hsa
acuagucaccugccauaagucauggaauaguuuuuauauuuacagcuuuuauauuuaaaacuug

SEQ ID NO: 171281 - RNA, 64 nt, hsa
uaagucauggaauaguuuuuauauuuacagcuuuuauauuuaaaacuuguaagaguuuuuuuaa

SEQ ID NO: 171282 - RNA, 64 nt, hsa
aauaaaaaaaaaaaaacuucaguuuucuaaaaauuauauuuaaaauuguaaucaaaauguaccu

SEQ ID NO: 171283 - RNA, 64 nt, hsa
auaauuaaccacauguuguaguaacuggucuuuuuauauuuaagcagaauccuguaagauugcu

SEQ ID NO: 171284 - RNA, 64 nt, hsa
aagauggggaaaauuuuguuuuaagugguauggauauauuuagcauauugaaccacacaagugc

SEQ ID NO: 171285 - RNA, 64 nt, hsa
cuuacauacccaaaagaaauucaguuauuuauuguauauuuauuguauucuaauauaauugaaa

SEQ ID NO: 171286 - RNA, 64 nt, hsa
ggauugggaaguggugggugauggaggaccuggauauauuuaucaaauaaaggguuaccagaag

SEQ ID NO: 171287 - RNA, 64 nt, hsa
accuuuauacauuuucugaaaacaaugaaaagaguauauuuaaccuuuucuggcuguaaauggu

SEQ ID NO: 171288 - RNA, 64 nt, hsa
cccauaaguuauuuauuccuuuuuucuguguaaauauauuuauuuuacuguggagcgcuaacau

SEQ ID NO: 171289 - RNA, 64 nt, hsa
uuguuaugcagauggcuucuuuaggaauaacuuuuauauuuauuuaaaaauuuuuaaauuaugg

SEQ ID NO: 171290 - RNA, 64 nt, hsa
auuuauaaauauauuuaagauaauuauaauauacuauauuuaugggaaccccuucauccucuga

SEQ ID NO: 171291 - RNA, 64 nt, hsa
uuuuuuaauuauuauuuauauauguauuuauaaauauauuuaagauaauuauaauauacuauau

SEQ ID NO: 171292 - RNA, 64 nt, hsa
guuaguuuguacuuauugaucaugaauacaaguauauauuuaauuuugcaaacuuuucacuugu

SEQ ID NO: 171293 - RNA, 64 nt, hsa
uuuacaggcauugcccaaacauuucuuugagaucuauauuuauaagcagccauggaauuccuau

SEQ ID NO: 171294 - RNA, 64 nt, hsa
uaaguguaaggcuuaacaaauaaguaauacaugcuauauuuauucaagugucuauugcuuaauu

SEQ ID NO: 171295 - RNA, 64 nt, hsa
ggauuaaggaauacagacuauuagagaagauccuuauauuuacaucuaguauauaugugguaag

SEQ ID NO: 171296 - RNA, 64 nt, hsa
uccuaagggguuaauauaaaucaaggaggaaguuuauauuuaaggaagaauuggagugacguau

SEQ ID NO: 171297 - RNA, 64 nt, hsa
uuuacauauguccuuauaugcauauuuuuuauuauauauuuaguguuuuauagaauuuuuuaaa

SEQ ID NO: 171298 - RNA, 64 nt, hsa
gcuuacaaauaauauaacuuuucaaccuucuaguuauauuuauccaauaaagucauaaucggga

SEQ ID NO: 171299 - RNA, 64 nt, hsa
guuguuggaggaaacugguugcuagucaauguucuauauuuaaugaaugugugauaaaucaucc

SEQ ID NO: 171300 - RNA, 64 nt, hsa
guguguguguguguguguguguguguaugaaugguauauuuauuacauuauuuugaaagagaau

SEQ ID NO: 171301 - RNA, 64 nt, hsa
aaaguauuuuuuguuuauucucuuaaaagaucacuauauuuaaauaaaagugaaggucagcaac

SEQ ID NO: 171302 - RNA, 64 nt, hsa
uaacuugguaaucaugaaagcaucugagcuaacuuauauuuauuuauguuauauuuauuaaauu

SEQ ID NO: 171303 - RNA, 64 nt, hsa
gaaagcaucugagcuaacuuauauuuauuuauguuauauuuauuaaauuauuuaucaaguguau

SEQ ID NO: 171304 - RNA, 64 nt, hsa
uguaagcaaaguccagguccauuuaguuuuuggauauauuuaauguuugucuccugaaguuugu

SEQ ID NO: 171305 - RNA, 64 nt, hsa
gauuacuguuuacugagccuuaauccaccaaguuuauauuuagaauuuuauuuuuuuaagguac

SEQ ID NO: 171306 - RNA, 64 nt, hsa
acauauguuugaaaaauccgugaguauuccaaaauauauuuaauaauggaauaucugcauuaau

SEQ ID NO: 171307 - RNA, 64 nt, hsa
agaaaaacagaccauuuaaaaacucagacaagauuauauuuaauauauuaauuacuaaaaaggc

SEQ ID NO: 171308 - RNA, 64 nt, hsa
gaauuuucacauuuauauuuaaacuucaauuuuuuauauuuaaacuucaauuuuuuagcaacag

SEQ ID NO: 171309 - RNA, 64 nt, hsa
auaucuggggaaaaaagguccgaauuuucacauuuauauuuaaacuucaauuuuuuauauuuaa

SEQ ID NO: 171310 - RNA, 64 nt, hsa
ucucccccugacacagagaaggggccuugguauuuauauuuaagaaaugaagauaauauuaaua

SEQ ID NO: 171311 - RNA, 64 nt, hsa
uguaauuuuauguagaguuugagcugaagccccguauauuuaauuuauuuuguuaaacaugaaa

SEQ ID NO: 171312 - RNA, 64 nt, hsa
augucaguguguguauucuguauguaaauauguuuauauuuauagagcaucaaucaauauaagc

SEQ ID NO: 171313 - RNA, 64 nt, hsa
auuaagauucauccuuaugcuccugcaaguuucuuauauuuauguauuucuauucugauuucug

SEQ ID NO: 171314 - RNA, 64 nt, hsa
cuacaaguucuauauauguagaaaugaauaaauauauauuuaaguacaguuuucaugaggaagu

SEQ ID NO: 171315 - RNA, 64 nt, hsa
cauuucagaaaauucuucauagugguauuggccuuauauuuaacuuuuuuuuuauuuuuuuuuu

SEQ ID NO: 171316 - RNA, 64 nt, hsa
uucaauuuccuccaggcaugacuagguauaaacauauauuuacaugauuaauccacauuuuaaa

SEQ ID NO: 171317 - RNA, 64 nt, hsa
uaaaauuagguccaguaacaccuguauauauguauauauuuaauaaagaguacuuguacaaaaa

SEQ ID NO: 171318 - RNA, 64 nt, hsa
gaaguugaaacacuauauuuaucuugucaguuuuuauauuuaaagaaagaauacauuguaaaaa

SEQ ID NO: 171319 - RNA, 64 nt, hsa
gaaaaaucacaaauaggcuaagaaguugaaacacuauauuuaucuugucaguuuuuauauuuaa

SEQ ID NO: 171320 - RNA, 64 nt, hsa
uuauauauuauauauuuauauauaauauauauuauauauuuagcauugcugagcuuuuuagaug

SEQ ID NO: 171321 - RNA, 64 nt, hsa
auuucuugguaaaaacguauguauuuauauauuauauauuuauauauaauauauauuauauauu

SEQ ID NO: 171322 - RNA, 64 nt, hsa
aaaguugucuacaaaucugagccuuguaaugauguauauuuaaguuauuuuuguuuuuauagau

SEQ ID NO: 171323 - RNA, 64 nt, hsa
agaaaguuauccucucauuuuuucacugcuaugauauauuuauuauaaaauagggaaugaauga

SEQ ID NO: 171324 - RNA, 64 nt, hsa
guguuuguuuagcuaugguuacuaauauguuuguuauauuuauuuucggggagaggaucuuguu

SEQ ID NO: 171325 - RNA, 64 nt, hsa
uuuuuuuucuagguggugauuuuucaauuucuuuuauauuuacggaaguagaaaaaauguucug

SEQ ID NO: 171326 - RNA, 64 nt, hsa
cauuucaaucaaacauuuccuauauaacaauuauuauauuuacaauuugguuucugcaauauuu

SEQ ID NO: 171327 - RNA, 64 nt, hsa
ccuguauaucuauuaaaaauuucaacuucccacauauauuuacuaagaugauuaagacuuacau

SEQ ID NO: 171328 - RNA, 64 nt, hsa
auauuucuugccauaaugguaaaggacugauugauauauuuaagaguuaauaaauuugugauuu

SEQ ID NO: 171329 - RNA, 64 nt, hsa
uucugauaauuauuacacaauuuaaaacaacauauauauuuaaaauaaauauauacaguaaaua

SEQ ID NO: 171330 - RNA, 64 nt, hsa
cuaauguugaguuuccaugacugaacaaagagaauauauuuauucagcuucacuugcagaucac

SEQ ID NO: 171331 - RNA, 64 nt, hsa
cuuuguaugugugucauuuuaauaagcaagaagauauauuuagauuagaaaugguuuggucugc

SEQ ID NO: 171332 - RNA, 64 nt, hsa
aguaugaucaaguaugaaaggaacuuuaaauucuuauauuuacuuuucucucaguaaauuguua

SEQ ID NO: 171333 - RNA, 64 nt, hsa
cacucagcaaaagauuggcauuuguuaaguguucuauauuuaguacuaaaaucacagucaugaa

SEQ ID NO: 171334 - RNA, 64 nt, hsa
uaauguugcauguuucaguggguuggaaguuuuguauauuuauuguauuaacacagagugucau

SEQ ID NO: 171335 - RNA, 64 nt, hsa
aaaaaaggaacaguauucuuuauuuucuggguguuauauuuaaaaaagcaaguuuggauuuuua

SEQ ID NO: 171336 - RNA, 64 nt, hsa
uaccuuuuuaaccccucugauuggcuauuauuacuauauuuauuauuauuuauugaaaccuuag

SEQ ID NO: 171337 - RNA, 64 nt, hsa
cgucauucuuuaaacaaaaauacucaagaucauuuauauuuauuuggagagaaaacuguccuaa

SEQ ID NO: 171338 - RNA, 64 nt, hsa
gguguauauuuuuuuucaaaaauucuguaacaaauauauuuaauguguugccauaaugucauuu

SEQ ID NO: 171339 - RNA, 64 nt, hsa
gaaccuucuuggucaaauuguaauuagcuagcauuauauuuauauacagggucuuuuuucuuua

SEQ ID NO: 171340 - RNA, 64 nt, hsa
uaauauuugugguucauguauauuuugaccagaguauauuuaaguauauaauuucagcuuccuu

SEQ ID NO: 171341 - RNA, 64 nt, hsa
auaggucucaggcuuacuugauuuuuggcuauuuuauauuuaguguacacagggcuuugaaaua

SEQ ID NO: 171342 - RNA, 64 nt, hsa
ucauccuggugccaggaauauaaaaaagaguggauauauuuaaccauaacauacugugauucau

SEQ ID NO: 171343 - RNA, 64 nt, hsa
agauaugcaaagaagcuauuaccuacauaagagguauauuuaaagauuuuuuuuuucauccugg

SEQ ID NO: 171344 - RNA, 64 nt, hsa
guugcuaaagauuucucuauaauaagccacacauuauauuuagacuauauuaagggaccuuggu

SEQ ID NO: 171345 - RNA, 64 nt, hsa
uucuaaauuucaugugcaaauaauuauauauaaauauauuuaaaaaugcuauauauaguauaug

SEQ ID NO: 171346 - RNA, 64 nt, hsa
uggcccaauuauuacauaucagguuuuccugauuuauauuuacauguuugaaaaguucauuaua

SEQ ID NO: 171347 - RNA, 64 nt, hsa
auagguuaaaagaaaaacaccauaaaagugguaguauauuuaaguggaaaauuauguauuuuaa

SEQ ID NO: 171348 - RNA, 64 nt, hsa
caguuuacugaaggaauauauuuaauuauauucauauauuuaacaaauaaaaauauguugaauu

SEQ ID NO: 171349 - RNA, 64 nt, hsa
cucuaguuuuguccaguucaguuuacugaaggaauauauuuaauuauauucauauauuuaacaa

SEQ ID NO: 171350 - RNA, 64 nt, hsa
uaauauuaaaaauauggaacuucuaauauauuuuuauauuuaguuauaguuucagauauauauc

SEQ ID NO: 171351 - RNA, 64 nt, hsa
auagcuauuacugucugguuuuaacaauuuccuuuauauuuagugaacuacgcuugcucauuuu

SEQ ID NO: 171352 - RNA, 64 nt, hsa
uuguauauuagggaggaaaagcuuccuauauuuuuauauuuaccuuuaauuaguuuguaucuca

SEQ ID NO: 171353 - RNA, 64 nt, hsa
uaauaugaagaaacuagguugugacagacuagauuauauuuaguaggggaaaaauugggcucaa

SEQ ID NO: 171354 - RNA, 64 nt, hsa
agguguaacaguuucccaguuaacuuugaauuuauauauuuagauuuaaaggauuaaaaaaaag

SEQ ID NO: 171355 - RNA, 64 nt, hsa
uuaaaaacauuucuauaaauauaaagcuuuucuuuauauuuaagacaaaauauaaaggcuagaa

SEQ ID NO: 171356 - RNA, 64 nt, hsa
ugugcuuuagaaaaaaaauucaaauuuauaguaguauauuuacauuuuuguuguuguuguuguu

SEQ ID NO: 171357 - RNA, 64 nt, hsa
gcugggauuacaggcaugagccacugcaccuggcuauauuuacauuuaauagaaacauaucuag

SEQ ID NO: 171358 - RNA, 64 nt, hsa
aagaaaacugucaaaaucaguauauacuauuaguuauauuuaaaaauauuuuuuuaaauucuuu

SEQ ID NO: 171359 - RNA, 64 nt, hsa
ugugcuaccuaaagcacuuagcacacaguuaaauuauauuuacauccuagacccaaauaaauag

SEQ ID NO: 171360 - RNA, 64 nt, hsa
uuuucauaucauuuuuaaguggccugccucaauguauauuuauuucuuuugaaacaaaaagguu

SEQ ID NO: 171361 - RNA, 64 nt, hsa
gcuuguggggaaaauaaaaacgcagagauccuuauauauuuauguuaaaguaauauuuuauuau

SEQ ID NO: 171362 - RNA, 64 nt, hsa
cauguugguguucaaaguguagcaaaaaaugauguauauuuauaaaucuauuuauaccacuaua

SEQ ID NO: 171363 - RNA, 64 nt, hsa
auaaaucuauuuauaccacuauaucauauguauauauauuuauaaccacuuaaauugugagcca

SEQ ID NO: 171364 - RNA, 64 nt, hsa
cuagcugggaucauuuuugauccauugucauauuuauauuuaauuauuaaauguaucugaugau

SEQ ID NO: 171365 - RNA, 64 nt, hsa
gacuuaauuccugaucaguauagacaggacuauauauauuuaaucagagaauuacauuauaucu

SEQ ID NO: 171366 - RNA, 64 nt, hsa
caaguguaaauaugucuauauggagaaagcacauuauauuuauugguuacuuacauuccuuuuu

SEQ ID NO: 171367 - RNA, 64 nt, hsa
auauuaaagcaucaacauuucaugccacauaaauuauauuuaauaagaaccagauugaaaugag

SEQ ID NO: 171368 - RNA, 64 nt, hsa
ugggaggugcugugugauccuuggaugaaaaacauauauuuaaagaaauggagaguguuuauuu

SEQ ID NO: 171369 - RNA, 64 nt, hsa
ugugcuaugugaauagcuauguuuguuauuuaaauauauuuauagaaguucaaauuacuagugu

SEQ ID NO: 171370 - RNA, 64 nt, hsa
gacacaaauuaaaaagacaaauuaaaccugaaauuauauuuaaaauauauuugagacaugaaau

SEQ ID NO: 171371 - RNA, 64 nt, hsa
acagaauaauuuugaaguuuuagaauaaauguaauauauuuacuauaauucuaaauguuuaaau

SEQ ID NO: 171372 - RNA, 64 nt, hsa
uugaauuguaaaauauuuaaaaguaugaauaaaauauauuuauagguauuuaucagagaugauu

SEQ ID NO: 171373 - RNA, 64 nt, hsa
auuucacuuuaaacaauuugauauagcuauuaaauauauuuaaggguuuuuuuuuuuugacaaa

SEQ ID NO: 171374 - RNA, 64 nt, hsa
uaauuugaaacuuaagaaaaugaauuuauucuguuauauuuauguaacuuauuuccuggaaguu

SEQ ID NO: 171375 - RNA, 64 nt, hsa
aauauaucagggcagugcauguaaaucauccugauauauuuaauauauuuauuauauugucccc

SEQ ID NO: 171376 - RNA, 64 nt, hsa
gggcagugcauguaaaucauccugauauauuuaauauauuuauuauauugucccccgagguggg

SEQ ID NO: 171377 - RNA, 64 nt, hsa
uucaauaucccaguaaacccauguauauuaucacuauauuuaauaaucacagucuagagauguu

SEQ ID NO: 171378 - RNA, 64 nt, hsa
uaaugguagaaugcuuuuuuaugugcuagacuauuauauuuaguaguaugucauuguaacuagc

SEQ ID NO: 171379 - RNA, 64 nt, hsa
uuuauauuuagauuuauauaacugguuaugugaauauauuuaaauacuggggaaauugcuucac

SEQ ID NO: 171380 - RNA, 64 nt, hsa
gagugccaucuuaaaacuuacuggagauugguuuuauauuuagauuuauauaacugguuaugug

SEQ ID NO: 171381 - RNA, 64 nt, hsa
uagugguuacauugccauuugguagcaucauguauauauuuaugcuuauaaguuugcauuauga

SEQ ID NO: 171382 - RNA, 64 nt, hsa
guacuguauaucuguauauauguauauauguauguauauuuaaggaaguccagaaaucauacug

SEQ ID NO: 171383 - RNA, 64 nt, hsa
uuuuuaaggugguaccaaaaaugaaugucugucauauauuuauauuacaaauacauuauauuua

SEQ ID NO: 171384 - RNA, 64 nt, hsa
gaaugucugucauauauuuauauuacaaauacauuauauuuauguucuauucaucuuuugaaug

SEQ ID NO: 171385 - RNA, 64 nt, hsa
ugauuggauacuauucaucauauugccuauaauauauauuuaccgauaagcagugaguguaaaa

SEQ ID NO: 171386 - RNA, 64 nt, hsa
auucauuuuuagugaacccuguaauuuauucguguauauuuacuaaacagcuguaucuuugaaa

SEQ ID NO: 171387 - RNA, 64 nt, hsa
uuucuucacugagauuccaguguacaugagaacauauauuuauugcaugauuuucuagauacac

SEQ ID NO: 171388 - RNA, 64 nt, hsa
uggguaguauuugggagagggaaaggcuguacuauauauuuauuucuaaauguuuugacugggc

SEQ ID NO: 171389 - RNA, 64 nt, hsa
aaacuuucuaaccuauguauucaacuucuguauuuauauuuaaucagugguucauguuauauaa

SEQ ID NO: 171390 - RNA, 64 nt, hsa
auaaucuauuuucauaaucaauaugugccuaaauuauauuuaaaucauuucacucuguacuaua

SEQ ID NO: 171391 - RNA, 64 nt, hsa
gauuuuaauuuauggaaagcacaacauaugcaauuauauuuauugaauuccuagaugcaguaug

SEQ ID NO: 171392 - RNA, 64 nt, hsa
aauugauauuucuguguaguauuuauauuuaaauuauauuuaccuuuuugcuuauuuuacaaau

SEQ ID NO: 171393 - RNA, 64 nt, hsa
agcucuaugucaauugauauuucuguguaguauuuauauuuaaauuauauuuaccuuuuugcuu

SEQ ID NO: 171394 - RNA, 64 nt, hsa
aaaaaaucuguuaauuagguaaaccacuauuauuuauauuuauaauuuacuuuuuuuuacuuuu

SEQ ID NO: 171395 - RNA, 64 nt, hsa
uguuauacuguauuauggcugauuuucuuuuuaauauauuuagccaagugaugcacuuuaugau

SEQ ID NO: 171396 - RNA, 64 nt, hsa
aaauacuuuuuaaaguuuaccaucaagucuuuuuuauauuuaugugucuguauucuaccccuuu

SEQ ID NO: 171397 - RNA, 64 nt, hsa
auuuacucuaaaaacugauugaaugauauauaaauauauuuauagccugaguaaaguuaaaaga

SEQ ID NO: 171398 - RNA, 64 nt, hsa
uuagcacauuuauuaugugugacugcaucugauuuauauuuaaauuggcagguuuugagggauu

SEQ ID NO: 171399 - RNA, 64 nt, hsa
agccuugaaaauggaguguuguuguuucuaaacauauauuuaugucauuuauuaaguacaguuc

SEQ ID NO: 171400 - RNA, 64 nt, hsa
aaaacuugcagaguauuguguugggguuguguuuuauauuuaggcauugggggaugggguggga

SEQ ID NO: 171401 - RNA, 64 nt, hsa
uauauauauauauaaauauagcagguuacauauauauauuuauaaugugucuuuuuauuaacca

SEQ ID NO: 171402 - RNA, 64 nt, hsa
cugaaaagagacguaguaaauuaaauagaagaaauauauuuauaaagcuuagugaaacacaaaa

SEQ ID NO: 171403 - RNA, 64 nt, hsa
gaucuugauccuguugugggacuaauacaagaucuauauuuaaguuuuaaagcauguuuacuuu

SEQ ID NO: 171404 - RNA, 64 nt, hsa
acuuuuauaugugugggauaucaauguguauauuuauauuuaaaguguauuuauuguuacaagu

SEQ ID NO: 171405 - RNA, 64 nt, hsa
agcaugacuuuuauaugugugggauaucaauguguauauuuauauuuaaaguguauuuauuguu

SEQ ID NO: 171406 - RNA, 64 nt, hsa
gaagagcccgcauaaugaguggacggcagacagcuauauuuaguggugccucgacacucacgaa

SEQ ID NO: 171407 - RNA, 64 nt, hsa
acaccucuggggauaagcugaggugacuaaaugauauauuuauauuauaagauuaaacugacuu

SEQ ID NO: 171408 - RNA, 64 nt, hsa
cuaggaugcugaguaucuacauggauacauuaaauauauuuaugcgaguugcaacuaugcuggc

SEQ ID NO: 171409 - RNA, 64 nt, hsa
ugagacauuuguaaguucuuugauacagaagaguuauauuuagaagucuuuaaugaagggaaag

SEQ ID NO: 171410 - RNA, 64 nt, hsa
uacaggauguaauaggucagguauuugguuuacuuauauuuaacaaugucuuaugaauuuuuuu

SEQ ID NO: 171411 - RNA, 64 nt, hsa
uuuguaaacauuuuguggguacauaguacauguauauauuuacgggguaugugagauguuuuga

SEQ ID NO: 171412 - RNA, 64 nt, hsa
augaauuuaaucgggcccuugguggaaacauuuauauauuuaaugcagaugcauaguguuuuuc

SEQ ID NO: 171413 - RNA, 64 nt, hsa
auauaauaucaacuauucuaaauacagguaaugguauauuuaaggcuaccauaacauccuauuu

SEQ ID NO: 171414 - RNA, 64 nt, hsa
gggugguuuuuugcaguauauuuauuuugugcauuauauuuauauguuaagagccugagcuuag

SEQ ID NO: 171415 - RNA, 64 nt, hsa
auacagcaauuuguaggugggugguuuuuugcaguauauuuauuuugugcauuauauuuauaug

SEQ ID NO: 171416 - RNA, 64 nt, hsa
gaauaccauauaagaauauuuucucugcaguauuuauauuuauacuauuuugcuaugaguggcc

SEQ ID NO: 171417 - RNA, 64 nt, hsa
cauaauaauuuuaugaaaguuaagaucaagaaauuauauuuauaugaaguaaaucacuugacaa

SEQ ID NO: 171418 - RNA, 64 nt, hsa
ccgggaccuggcuggcaaaugacuuagcuauuaguauauuuaaaaacuguucaaaagcaaaaga

SEQ ID NO: 171419 - RNA, 64 nt, hsa
ggaaaaaucgguuaucauaauuucaaaguauaaauauauuuauuaaguagcgcugcggcuaaga

SEQ ID NO: 171420 - RNA, 64 nt, hsa
agguacaaaaaaaugcugcagaucuagaaaugcauauauuuagcggguauuugaaagauagaag

SEQ ID NO: 171421 - RNA, 64 nt, hsa
uagcuaauuaaucugcauaugaagcauuuucugauauauuuaauaagagguauagaagcucuuc

SEQ ID NO: 171422 - RNA, 64 nt, hsa
ucaaaauuuuuaucuuuaaaucugagacaaguauuauauuuaaaacuagaucuauuaauacauu

SEQ ID NO: 171423 - RNA, 64 nt, hsa
gaaugaauauaauuauuuauuuguauuuauaauuuauauuuacaaguugucacaaaaauagauu

SEQ ID NO: 171424 - RNA, 64 nt, hsa
ucugacuuguaaauguagcugcuaaaguaugagguauauuuaagaagaauagauuaguuucauu

SEQ ID NO: 171425 - RNA, 64 nt, hsa
ccugauaguccaaggaaccaccuuucucccuugauauauuuaacuccgucuuuggccugacaac

SEQ ID NO: 171426 - RNA, 64 nt, hsa
ugcugcuauacaacugcuuugcaacaguugcugguauauuuaaaucauuaaauuucagcauuua

SEQ ID NO: 171427 - RNA, 64 nt, hsa
ugauuuuacuugaaaacaagcuccaucccuuuucuauauuuauaagaagagaagaucuugagug

SEQ ID NO: 171428 - RNA, 64 nt, hsa
agguucuuugccagcaccaugccaagugaaauaauauauuuacucucucuauuauacaccagug

SEQ ID NO: 171429 - RNA, 64 nt, hsa
guggucaguugaaccuuacaguaaaguauagaaauauauuuaauguggaaugucaaugccagga

SEQ ID NO: 171430 - RNA, 50 nt, hsa
uaagaagaaauagaagauaauauauuuaauggcacugagaaacaugcaag

SEQ ID NO: 171431 - RNA, 64 nt, hsa
caaauaguaauguauuuuucugcauucacuuggauauauuuagaaucacuuuuuuccuccugua

SEQ ID NO: 171432 - RNA, 64 nt, hsa
ugcauuuucaaaagaagauuuguaagaauuaaacuauauuuaugaguaaacuuuugagguuucu

SEQ ID NO: 171433 - RNA, 64 nt, hsa
uuuuagaacccagcaguuaccuuaaagcugaauuuauauuuaguaacuucuguguuaauacugg

SEQ ID NO: 171434 - RNA, 64 nt, hsa
gaaauggggauuauuauagcaaccauuuuggggcuauauuuacaugcuacuaaauuuuuauaau

SEQ ID NO: 171435 - RNA, 64 nt, hsa
ucagugcuaaucuagccaaauuacauauguauaauauauuuauaaaggauucugggagaugguc

SEQ ID NO: 171436 - RNA, 64 nt, hsa
augcuucugauguggaauaauuuucagcugcucauauauuuaguuauuuaaacaaacugggggg

SEQ ID NO: 171437 - RNA, 64 nt, hsa
uuugaaaaaaaucugccaaauagcaucuuuaggauauauuuacauuuucacucaucuaaaaagu

SEQ ID NO: 171438 - RNA, 64 nt, hsa
auauucaauagauuuuuguaaauguuaaaacaucuauauuuaaauguuaaaacacuaaauauag

SEQ ID NO: 171439 - RNA, 64 nt, hsa
uuguauaggaccagugucuuauuaauaugauuaauauauuuagaagagccacgugaaacccaug

SEQ ID NO: 171440 - RNA, 64 nt, hsa
guuucauuuuauucuaccuguugugugaguuuaguauauuuaauuuacuuuuuguuacucuuua

SEQ ID NO: 171441 - RNA, 64 nt, hsa
uucuguguguuacuuucuuuuuauauagcuauaguauauuuaaacaauaauacuaucuuuuaua

SEQ ID NO: 171442 - RNA, 64 nt, hsa
auguaauuucaguuuggagcuuuuaggcauuauguauauuuaaaaaauauauucuucaaaaaug

SEQ ID NO: 171443 - RNA, 64 nt, hsa
uuaacuguguuauuucugcuuugagaugaaaauauauauuuaucuuugcuuauuuuaucccaga

SEQ ID NO: 171444 - RNA, 64 nt, hsa
cucaaggaaauacagaucggaagugcugaugaguuauauuuauugaaaacccaacuuuuaagga

SEQ ID NO: 171445 - RNA, 64 nt, hsa
aaauaaauuuauguuguccugugccauaaagugauauauuuaauauuuuuauucuuugguuuug

SEQ ID NO: 171446 - RNA, 64 nt, hsa
uauguauacacauauauauacacacacacauauauauauuuagaaacgugaguguuaaagauag

SEQ ID NO: 171447 - RNA, 64 nt, hsa
aagagaucuugcaggaagagauuguauuagauauuauauuuauuucauuuaagauaauuuucaa

SEQ ID NO: 171448 - RNA, 64 nt, hsa
cagcuuuaacauauaauauuuugaauauuuuagcuauauuuaguggcuuucugcaagcaacuag

SEQ ID NO: 171449 - RNA, 64 nt, hsa
uauuaauguauuaaaaagaaaauacaacaaaauguauauuuagacacgagcuuacauggcauac

SEQ ID NO: 171450 - RNA, 64 nt, hsa
auuuuaaucauuauuuuaaaagcuuugcaaccuauauauuuauauaacuuuguaauauaacaug

SEQ ID NO: 171451 - RNA, 64 nt, hsa
agacgaguuccaaauuacguucuuaaaccguaacuauauuuaauuauuuguuuugguaggacag

SEQ ID NO: 171452 - RNA, 64 nt, hsa
cggugccuaagaaguuauuuucuuguuuaacauauauauuuauuaauuuauuugucguguugga

SEQ ID NO: 171453 - RNA, 64 nt, hsa
gggaacaucacccuauauauaauuugaguguauauauauuuauauauaugauguggacauaugu

SEQ ID NO: 171454 - RNA, 64 nt, hsa
guuuugaauccuuugccugccuggugugccucaguauauuuaaacucaagacaaugcaccuagc

SEQ ID NO: 171455 - RNA, 64 nt, hsa
aaacacgaaacuuguuauugugaaugauucauguuauauuuaaugcauuaaaccugucuccacu

SEQ ID NO: 171456 - RNA, 64 nt, hsa
uauuguugguaauuauuuugguacuuuuaugauguauauuuauuaaacagauuuuuacaaauga

SEQ ID NO: 171457 - RNA, 64 nt, hsa
agguuaucaaaaauuucauggaaggaccacauuuuauauuuauugugcuucgagugacugaccc

SEQ ID NO: 171458 - RNA, 64 nt, hsa
acuuauuuuucuaaacacuaugcuaaauaaacuuuauauuuauacauaccuugcauugaaaauu

SEQ ID NO: 171459 - RNA, 64 nt, hsa
agagcaccuguguuguacugcuuuauaucucauguauauuuauaguaaugaaaagacuuuuuaa

SEQ ID NO: 171460 - RNA, 64 nt, hsa
uccaacuaaaagggauuaauuuuuggcauuuuuguauauuuaugcauuaggugaugggacuuuu

SEQ ID NO: 171461 - RNA, 64 nt, hsa
uugaaagcaguuuuauguauaaauaacaaauguuuauauuuaacuaaauguaagguacgaauua

SEQ ID NO: 171462 - RNA, 64 nt, hsa
ucugucuguaaaauacuuuuuuuaagaaagcauuuauauuuauaugacagcuugaacugacaac

SEQ ID NO: 171463 - RNA, 64 nt, hsa
uauagaugucaaaacauuaaccagauuaaaguaauauauuuaagaguaaauuuugcuugcaugu

SEQ ID NO: 171464 - RNA, 64 nt, hsa
cuacuggugguuuugauauuguuuguuuaagauguauauuuagaaugacaucaucuaagaagcu

SEQ ID NO: 171465 - RNA, 64 nt, hsa
uuucauaugaaucacagcuguugacaaugucccauauauuuaagaaauuauaucauacugauac

SEQ ID NO: 171466 - RNA, 64 nt, hsa
aauauuaaaauugugaagcaaaggucaauaggcuuauauuuaauuaaagccuuacugaagaaua

SEQ ID NO: 171467 - RNA, 64 nt, hsa
uuaauuuuaugaaaauuaugcucaauaagaguuguauauuuaauauauuugcagugaacacaga

SEQ ID NO: 171468 - RNA, 64 nt, hsa
ucugacaagguagagguccagguucaccuuuauauauauuuaaaacaauuaguacugaauugga

SEQ ID NO: 171469 - RNA, 64 nt, hsa
ugcaaguguacagaucuguguagaggaauguguguauauuuaccucuucguuugcucaaacaug

SEQ ID NO: 171470 - RNA, 64 nt, hsa
gucauaaggagacuauaacucuacagauugugaauauauuuauuuucaaguugcauucuuuguc

SEQ ID NO: 171471 - RNA, 64 nt, hsa
acagaaagcacacaccuaugcaauauggcuuaucuauauuuauuuguaaaaauccaagcauagu

SEQ ID NO: 171472 - RNA, 64 nt, hsa
cuuagauaguauuaauauacugagccuuggauuauauauuuaauauaggaccuauuuugaauau

SEQ ID NO: 171473 - RNA, 64 nt, hsa
uuucugaucuguacuuuguguuuagcuaccuuuuuauauuuaaaaaauuaaaaaugaaaauuac

SEQ ID NO: 171474 - RNA, 64 nt, hsa
ugcaguuucauguauguauauaaucaugcucauguauauuuaguuacguauaaugcuuucugag

SEQ ID NO: 171475 - RNA, 64 nt, hsa
auuaaaacaguauuugaguuuaaaagaguuuguauauauuuaaaugaauaacuuuuuauacucu

SEQ ID NO: 171476 - RNA, 64 nt, hsa
agccacccggguuuaguucagccauuucaagaaguauauuuaacgucgguaguucugcuuuauu

SEQ ID NO: 171477 - RNA, 64 nt, hsa
uggaaacauuuuuauugcuugcuuauuuugaagguauauuuaucuguuaacauuuagggcauag

SEQ ID NO: 171478 - RNA, 64 nt, hsa
caagaagaugacauuucagaaaaucaaacaaaucuauauuuaauggauggacucuucaaaacuu

SEQ ID NO: 171479 - RNA, 64 nt, hsa
ugagcuuuucuuuccugggguauauuaauuuaguuauauuuagcagaagaggaauauaaccaaa

SEQ ID NO: 171480 - RNA, 64 nt, hsa
uacagcaaggugcucuaaguaauauucgauaaaauauauuuaauagaaauuugcguuugauauu

SEQ ID NO: 171481 - RNA, 64 nt, hsa
ucuauuuuauucuaacauaaaaaaacuuccauuauauauuuacuaaguauauuuaauucacuua

SEQ ID NO: 171482 - RNA, 64 nt, hsa
aacauaaaaaaacuuccauuauauauuuacuaaguauauuuaauucacuuaacucugucuuuau

SEQ ID NO: 171483 - RNA, 64 nt, hsa
auuuacuucucccccaauuuuaaagaaguauguguauauuuaauaggggaagguaguuuaugga

SEQ ID NO: 171484 - RNA, 64 nt, hsa
gguuuugugguccugaugggcccacaaguuuuucuauauuuaacuggaaauaugcuuugauuuu

SEQ ID NO: 171485 - RNA, 64 nt, hsa
auuauguggcuaaagugcucuauuuauuaagaacuauauuuaauaccaccaacaaauauagggg

SEQ ID NO: 171486 - RNA, 64 nt, hsa
uugaaaugggaacaauaucaauauggugucuugauauauuuauaaauaugugauuaucauuuau

SEQ ID NO: 171487 - RNA, 64 nt, hsa
gaaaggagaaauguuagauucuuuauuauuuuauuauauuuauauggaaagcucgacucucccu

SEQ ID NO: 171488 - RNA, 64 nt, hsa
auuuuaauuguaugauuuggucauaaguaaggacuauauuuaugucaccauuauuagauauaug

SEQ ID NO: 171489 - RNA, 64 nt, hsa
uguugauagaauaucauaugcacugggaguuaaauauauuuaauuuaaugaucauuauauaugu

SEQ ID NO: 171490 - RNA, 64 nt, hsa
uucuacucccaggaugaaauuauccaacuacauauauauuuagaggaagaaagugaaggggaaa

SEQ ID NO: 171491 - RNA, 64 nt, hsa
gaaguacuaugugugaguuauagaucucucgaauuauauuuauagaugcaguguccugcccagu

SEQ ID NO: 171492 - RNA, 64 nt, hsa
agaaaauauuucuauuaaugguuuaauuucuuuguauauuuaaaaauaaauaugaaaaaccccu

SEQ ID NO: 171493 - RNA, 64 nt, hsa
accagcuccauucuuuucaugaauaguaaguugauauauuuauuuaucagguaucuugcaguug

SEQ ID NO: 171494 - RNA, 64 nt, hsa
uuaaaauuauuuuuuugucuuacaauucagggaauauauuuauauuuuucuaugaaaaguuaug

SEQ ID NO: 171495 - RNA, 64 nt, hsa
augauguauauuuaauguuaauauugugcaaacuuauauuuaaaacuugccugguuucuaaacc

SEQ ID NO: 171496 - RNA, 64 nt, hsa
aucaguuuuauauuuauaagccuuauuuaugauguauauuuaauguuaauauugugcaaacuua

SEQ ID NO: 171497 - RNA, 64 nt, hsa
uaauuuaucgauuuuuaucaauuuuuaucaguuuuauauuuauaagccuuauuuaugauguaua

SEQ ID NO: 171498 - RNA, 64 nt, hsa
ucauaaaauaguauguuaauauguuuuuacuuuauauauuuauauauuaaaauauauuuaauau

SEQ ID NO: 171499 - RNA, 64 nt, hsa
auauguuuuuacuuuauauauuuauauauuaaaauauauuuaauauguuuugccuuuguggccc

SEQ ID NO: 171500 - RNA, 64 nt, hsa
aagccucaggcaucaugucaauggguguuucccucaagcuuaguuggcagcacucuccacacuu

SEQ ID NO: 171501 - RNA, 64 nt, hsa
uuuacugugacugcacgugguggaaagggacuagcaagcuuaccccauucaugagggcucuccc

SEQ ID NO: 171502 - RNA, 64 nt, hsa; identical to SEQ ID NO: 117373

SEQ ID NO: 171503 - RNA, 64 nt, hsa; identical to SEQ ID NO: 117374

SEQ ID NO: 171504 - RNA, 64 nt, hsa; identical to SEQ ID NO: 117375

SEQ ID NO: 171505 - RNA, 64 nt, hsa; identical to SEQ ID NO: 117376

SEQ ID NO: 171506 - RNA, 64 nt, hsa; identical to SEQ ID NO: 117377

SEQ ID NO: 171507 - RNA, 64 nt, hsa; identical to SEQ ID NO: 117378

SEQ ID NO: 171508 - RNA, 64 nt, hsa; identical to SEQ ID NO: 117379

SEQ ID NO: 171509 - RNA, 64 nt, hsa; identical to SEQ ID NO: 117380

SEQ ID NO: 171510 - RNA, 64 nt, hsa; identical to SEQ ID NO: 117381

SEQ ID NO: 171511 - RNA, 64 nt, hsa; identical to SEQ ID NO: 117382

SEQ ID NO: 171512 - RNA, 64 nt, hsa; identical to SEQ ID NO: 117383

SEQ ID NO: 171513 - RNA, 64 nt, hsa; identical to SEQ ID NO: 117384

SEQ ID NO: 171514 - RNA, 64 nt, hsa; identical to SEQ ID NO: 117385

SEQ ID NO: 171515 - RNA, 64 nt, hsa; identical to SEQ ID NO: 117386

SEQ ID NO: 171516 - RNA, 64 nt, hsa; identical to SEQ ID NO: 117387

SEQ ID NO: 171517 - RNA, 64 nt, hsa; identical to SEQ ID NO: 117388

SEQ ID NO: 171518 - RNA, 64 nt, hsa; identical to SEQ ID NO: 117389

SEQ ID NO: 171519 - RNA, 64 nt, hsa; identical to SEQ ID NO: 117390

SEQ ID NO: 171520 - RNA, 64 nt, hsa; identical to SEQ ID NO: 117391

SEQ ID NO: 171521 - RNA, 64 nt, hsa; identical to SEQ ID NO: 117392

SEQ ID NO: 171522 - RNA, 64 nt, hsa; identical to SEQ ID NO: 117393

SEQ ID NO: 171523 - RNA, 64 nt, hsa; identical to SEQ ID NO: 117394

SEQ ID NO: 171524 - RNA, 64 nt, hsa
aaguauucuucagucaguggauuuuagcaaggggagguaggaguggaagagaggugugaagaaa

SEQ ID NO: 171525 - RNA, 64 nt, hsa
cagcccaucaugagauuuugguggauuuaauggcagguaggaacuuauuuauaguggauugaua

SEQ ID NO: 171526 - RNA, 64 nt, hsa
uacagccaaaguggauguuucuauuuggcaaggaagguaggauuucugaaacucaggccuuaac

SEQ ID NO: 171527 - RNA, 64 nt, hsa
uuagcuauuuauauuagguacagcuauuaaaacaagguaggaaugaggcuagaccuuuaacuuc

SEQ ID NO: 171528 - RNA, 64 nt, hsa
ccuagccugucauuuuucagcugcauguaaaaggagguaggaugaauugaucauuauaaagauu

SEQ ID NO: 171529 - RNA, 64 nt, hsa
ccuugguuucuaggaugguuuuguguggagggggagguaggacugggcuggaugagagagcaca

SEQ ID NO: 171530 - RNA, 64 nt, hsa
ggguaagguugcgauuauggguaagauuggccagagguaggaauguggggagaaggagaggcug

SEQ ID NO: 171531 - RNA, 64 nt, hsa
gggggcccccuuccaugacucuguccccugggggagguaggacagggcugggcuucccucucau

SEQ ID NO: 171532 - RNA, 64 nt, hsa
uuucucuguacauaguuuucuggcgggauaggggagguaggauggaugggguuuggggugggua

SEQ ID NO: 171533 - RNA, 64 nt, hsa
gguuggcuugcccaaggucaccugcuagcuuguaagguaggaauagggcucaaaguaaaacuuu

SEQ ID NO: 171534 - RNA, 64 nt, hsa
gaucuaguugaucgguagaggaagcuugugaaguagguaggacagguuaugaugucuucacugu

SEQ ID NO: 171535 - RNA, 64 nt, hsa
cugcaguguggaguucaccuuggaagggcguucuagguaggaagagcccgcagggccaugcaga

SEQ ID NO: 171536 - RNA, 64 nt, hsa
ccugugccucugaaguucuagccaugagguuuccagguaggacagcugcuccccaagccuccug

SEQ ID NO: 171537 - RNA, 64 nt, hsa
guacuguacuggagaauaacagaugggaugcuucagguaggacaucaaggaaagccucuaagga

SEQ ID NO: 171538 - RNA, 64 nt, hsa
uuguuucugcaaaauaccuagaaaagugaugcugagguaggaucagcagauaugggccaucugu

SEQ ID NO: 171539 - RNA, 64 nt, hsa
uagugaugugggauaaccuucaguuuauguuauuagguaggaaaaauaagguugaggacaguga

SEQ ID NO: 171540 - RNA, 64 nt, hsa
auauaacagugguaacagugcgugggcagguaggagguaggauguuuccuagaccauuuggggu

SEQ ID NO: 171541 - RNA, 64 nt, hsa
accauagauauaacagugguaacagugcgugggcagguaggagguaggauguuuccuagaccau

SEQ ID NO: 171542 - RNA, 64 nt, hsa
uucuucaguucacugcccaugugauacugauugccacauuaagguugaacagcauggcucagag

SEQ ID NO: 171543 - RNA, 64 nt, hsa
uucuucaguucacuacucaugugauacugauucccacauuaagguugaacaacauggcucagag

SEQ ID NO: 171544 - RNA, 64 nt, hsa
aauagcauguccuaaugcuugcugcugauuuaaacacauuaaagguacuuugcaggaaauccuu

SEQ ID NO: 171545 - RNA, 64 nt, hsa
guccccucuccuccacauuuguuuugccaauuugcacauuaaaugacucuucccucaaaugugu

SEQ ID NO: 171546 - RNA, 64 nt, hsa
ucuuaggaauugccucaggcauuuuuuuuuuuuacacauuaacuaaagggcuauucgaaaucuu

SEQ ID NO: 171547 - RNA, 64 nt, hsa
gcagcccauggcacaacuaacaccuacugauauucacauuaaauaguaugguuuccaaaauaug

SEQ ID NO: 171548 - RNA, 64 nt, hsa
acauuuucccaccauaaacucuguuugcuuauuccacauuaauuuacuuuucucuauaccaaau

SEQ ID NO: 171549 - RNA, 64 nt, hsa
guuuaauauuuaaauaucaaccaguguaauucagcacauuaauaaaguaaaaaagaaaaccaua

SEQ ID NO: 171550 - RNA, 64 nt, hsa
auuuguuuauuucccauuagguuuaguggagcuacacauuaauauguaucgccuuagagcaaga

SEQ ID NO: 171551 - RNA, 64 nt, hsa
acuggauuuuugcugcagaaauauaucaguggcccacauuaaacauaccaguuggaucaugaua

SEQ ID NO: 171552 - RNA, 64 nt, hsa
ucccucgauauuuuuaaagaucuguaaguaacuucacauuaaaaaaugaaauauuuuuuaauuu

SEQ ID NO: 171553 - RNA, 64 nt, hsa
uuguaaugugugaaaaagaugccaauuauuguuacacauuaaguaaucaauaaagaaaacuucc

SEQ ID NO: 171554 - RNA, 64 nt, hsa
ugauagaauucauaacacauuaaagagaaaauuucacauuaaaggaagguuuaaaaaucuauuu

SEQ ID NO: 171555 - RNA, 64 nt, hsa
aauccuaaaugguuauauuugauagaauucauaacacauuaaagagaaaauuucacauuaaagg

SEQ ID NO: 171556 - RNA, 64 nt, hsa
ggcuacaggauggugggcaggaucucaagccagcccccuccagcucaugacacuguuuggccuu

SEQ ID NO: 171557 - RNA, 64 nt, hsa
gggugacgcccagcuccgccugcugggaagagcuccccuccacagcugcagcugauccauagga

SEQ ID NO: 171558 - RNA, 64 nt, hsa
caccacucacagaggcuccuggccuugaucccugccccuccagguguccaggguaaaguguaac

SEQ ID NO: 171559 - RNA, 64 nt, hsa
gguggccgaccucacugcacagaccccacuccagccccuccaccccuucuucaugcacagcugc

SEQ ID NO: 171560 - RNA, 64 nt, hsa
gcagugcauguggaaaguaucagaguaaggcucuccccuccagagcccugaguuucuuggcugc

SEQ ID NO: 171561 - RNA, 64 nt, hsa
gcugcuuuccuagauccacacuuucaaagagaaaccccuccagaacucccacccugacagccca

SEQ ID NO: 171562 - RNA, 64 nt, hsa
agaguguggggcaggcuccguccucccugggagaccccuccagccaccgggugccacuuaaugc

SEQ ID NO: 171563 - RNA, 64 nt, hsa
gggcccuccuggaggaguccuguugccucuccugccccuccaggccacugaguguuuuggccac

SEQ ID NO: 171564 - RNA, 64 nt, hsa
aaaagcacaaacccuggggacucugcuuggcuguccccuccaucuggggauggagaaugccagc

SEQ ID NO: 171565 - RNA, 64 nt, hsa
ucacccagaaggaacccggucccaggccgcauggccccuccaggaacauucccacauaauacau

SEQ ID NO: 171566 - RNA, 64 nt, hsa
ugaagugacugaggcuggggugccucucccuggcccccuccaacugccaaauucugcuucccuc

SEQ ID NO: 171567 - RNA, 64 nt, hsa
auuguucagguggcuccaucgucuauucugugguccccuccaugagccuuugccccaggguggg

SEQ ID NO: 171568 - RNA, 64 nt, hsa
ccagggugcucccccgcccaucacccucccggggccccuccacugccuggcucagcgggccgga

SEQ ID NO: 171569 - RNA, 64 nt, hsa
cgugggggcgguguggcugcagccucagucccugccccuccagcccacagcccccaucccguag

SEQ ID NO: 171570 - RNA, 64 nt, hsa
aacccugggggcggccauguuguccaggcccaggccccuccaggacuguggcugccuccccucc

SEQ ID NO: 171571 - RNA, 64 nt, hsa
ccaggcccaggccccuccaggacuguggcugccuccccuccacggccuccagggcggcuggcug

SEQ ID NO: 171572 - RNA, 64 nt, hsa
caccccggcccggccuccagggcgcagaggcgccccccuccauccucccccaucccgggggcca

SEQ ID NO: 171573 - RNA, 64 nt, hsa
ggacacacuuaaaccuuccaaguagcacagaagcccccuccacgucagaggcccccuggccgcg

SEQ ID NO: 171574 - RNA, 64 nt, hsa
gaccccacauccucccugcuccucagacucacagccccuccauguuaccucccgcaccuccucc

SEQ ID NO: 171575 - RNA, 64 nt, hsa
cagccccucugcagaucuccucuggccacugcagccccuccaaugggcuuuuucucucaugcau

SEQ ID NO: 171576 - RNA, 64 nt, hsa
guuucuccagguuggguugggggcacugcuguccccccuccagcuaggacccagcccaucccca

SEQ ID NO: 171577 - RNA, 64 nt, hsa
ggggcugcauggccaggguggcaggaagacauccccccuccaucccagcccacuggaccagaac

SEQ ID NO: 171578 - RNA, 64 nt, hsa
ggugggcaaagagcgcucaauccagcuccuugaaccccuccagcccgcuucagccugggcauca

SEQ ID NO: 171579 - RNA, 64 nt, hsa
cacaaccccuguaccucccaccccuguauccccaccccuccacccaccccucucccaaccucuc

SEQ ID NO: 171580 - RNA, 64 nt, hsa
cuccuccaccccugccucuccuccaccccugccuccccuccaccccugccucuccuccacccgc

SEQ ID NO: 171581 - RNA, 64 nt, hsa
cuccuccaccccugccucuccuccaccccugccuccccuccaccugccccagugcccagaccaa

SEQ ID NO: 171582 - RNA, 64 nt, hsa
aaggacacugccacagggacgccuucccuccccuccccuccagcccaccccugcacagccccuc

SEQ ID NO: 171583 - RNA, 64 nt, hsa
ugguccccagcaggagagccuaguccucccccagccccuccagccaccaggguguccucuagga

SEQ ID NO: 171584 - RNA, 64 nt, hsa
gcgcccgguggugaugacuccuacaucuaaguggccccuccacccucucccccagccgcacggg

SEQ ID NO: 171585 - RNA, 64 nt, hsa
cagucauugagauacaaguuuccgaacaggagccccccuccacagguaagccccccuccacagg

SEQ ID NO: 171586 - RNA, 64 nt, hsa
cugccugugcagaccuccacccuucuuuccuccaccccuccaucccccaaugcuuguagaccuu

SEQ ID NO: 171587 - RNA, 64 nt, hsa
gggagcucgagagccagacggccagacaggcagaccccuccagaggcccgccaggugggcaugg

SEQ ID NO: 171588 - RNA, 64 nt, hsa
acucuccucuucaucucagcauucuccaucacuuccccuccagaaaaacggauggaaggaagcc

SEQ ID NO: 171589 - RNA, 64 nt, hsa
aacucagugcagguugcccuuaauuuuccccaaaccccuccaucggcaagucuaguugcccuuu

SEQ ID NO: 171590 - RNA, 64 nt, hsa
uccuuaugcggagugcccgcaaggcugggguagcccccuccaguacaccccaaagugaaaggga

SEQ ID NO: 171591 - RNA, 64 nt, hsa
cuggcccugcccccggccccugccccugcccgccccccuccaguccaggcagucgagcuccacc

SEQ ID NO: 171592 - RNA, 64 nt, hsa
aaaacagauaccauuuucucaauggaaucaguucccccuccacccauccccuucuguacauagc

SEQ ID NO: 171593 - RNA, 64 nt, hsa
ccaaaaccccaccucccuuuauugacuccacauuccccuccaguguucccuccuugagagcuga

SEQ ID NO: 171594 - RNA, 64 nt, hsa
aaaauaacuugacaugagcaccuuuagaucccuuccccuccaugggcuuugggccacagaauga

SEQ ID NO: 171595 - RNA, 64 nt, hsa
accuuuguccccuggcugcugcccucccauucucccccuccaguaguagcugggugagaccugu

SEQ ID NO: 171596 - RNA, 64 nt, hsa
uaaaggaaagaguuguuggugccauugcaggugcccccuccaggccugacuggcuccgccaggc

SEQ ID NO: 171597 - RNA, 64 nt, hsa
cugcuccuccccacacugagcuccuuuguuccucccccuccagccuuugccugggaacuggucc

SEQ ID NO: 171598 - RNA, 64 nt, hsa
ggcgagcauccugcugggcucucugcccggcccaccccuccaaggggcuggccugugagccuug

SEQ ID NO: 171599 - RNA, 64 nt, hsa
cugggaagcaccgucugcccgggcccaagcccugccccuccagaguccagagccaggaaggggc

SEQ ID NO: 171600 - RNA, 64 nt, hsa
gcccuugcagcugcagcccaucccugggccauguccccuccaucgagugcccggugcuuggggg

SEQ ID NO: 171601 - RNA, 64 nt, hsa
ggugguggauuuguuccaaagccucaaucccuacccccuccaaggggcagguuuccaguccagc

SEQ ID NO: 171602 - RNA, 64 nt, hsa
uggaggggccaggcuggacgcuuccugugggaguccccuccagaccuggcuggccccugcagcc

SEQ ID NO: 171603 - RNA, 64 nt, hsa
cucccuguucuuggugaccccaguugggcuuuggccccuccagcaaccuugugucccagcccug

SEQ ID NO: 171604 - RNA, 64 nt, hsa
ccguaggaggugagacaugggguucugucaugccccccuccacugagccuuggcuacaucugug

SEQ ID NO: 171605 - RNA, 64 nt, hsa
guaaagaugaugggguuuagaucccucaggcucuccccuccagacuccgcccuucccucccucc

SEQ ID NO: 171606 - RNA, 64 nt, hsa
ccugggagggaggggaggaugagcacgcccagcuccccuccagggugugacuuggccccucugg

SEQ ID NO: 171607 - RNA, 64 nt, hsa
ccaguguccaggggcuuggagagaccugcgcccaccccuccacucucccaggagucgcugauca

SEQ ID NO: 171608 - RNA, 64 nt, hsa
ccagccgugggcaaacccugaagacaccccugccccccuccagagagugaggagggggccugag

SEQ ID NO: 171609 - RNA, 64 nt, hsa
guccccagcgaggacacacacuccacgagagcagccccuccacucugcccaggagaggggccga

SEQ ID NO: 171610 - RNA, 64 nt, hsa
agaccagcucagggcggaaggucaggcuccccgcccccuccacguggagacauggccuaggggg

SEQ ID NO: 171611 - RNA, 64 nt, hsa
gucugccggugcccugccccccagcacugcccuaccccuccacuccgagcugggggggaaucug

SEQ ID NO: 171612 - RNA, 64 nt, hsa
gcauccgccccuuccaguucacauagugagacccccccuccagggugggucuggggaggggaca

SEQ ID NO: 171613 - RNA, 64 nt, hsa
cggccacgcuccccguccuuggccgccccuccacccccuccaacucugcuccucuagggccgcc

SEQ ID NO: 171614 - RNA, 64 nt, hsa
cgaauaccccggccacgcuccccguccuuggccgccccuccacccccuccaacucugcuccucu

SEQ ID NO: 171615 - RNA, 64 nt, hsa
auccuuccccugcaaccagacagucuacaacugcccccuccagcccauuuucugccgugaaacc

SEQ ID NO: 171616 - RNA, 64 nt, hsa
auagacccuuccacugacacccucgcucucacacccccuccagcuuuccgaccccacaccgaca

SEQ ID NO: 171617 - RNA, 64 nt, hsa
gagcgcuggaggaaaccagcccuuuagccagcagccccuccaccacaggcacugcuguguggaa

SEQ ID NO: 171618 - RNA, 64 nt, hsa
ugacaaggauuucacaugcagaagagaaaaggccccccuccaccccccgcauucccugccgagu

SEQ ID NO: 171619 - RNA, 64 nt, hsa
auaaggagacugaggcuuagagagaggaggcagcccccuccacaccaguggccucgugguuauu

SEQ ID NO: 171620 - RNA, 64 nt, hsa
cagagcuggguggggacagugauaggcccaagguccccuccacaucccagcagcccaagcuuaa

SEQ ID NO: 171621 - RNA, 64 nt, hsa
ccccuccugcaaggggcucaacccccuaccccgaccccuccacguaucuuuccuaggcagauca

SEQ ID NO: 171622 - RNA, 64 nt, hsa
cccugaugcugccaggccugggaccucccacugcccccuccacuggaggggucuccucugcagc

SEQ ID NO: 171623 - RNA, 64 nt, hsa
cuuuccauuucgagaacauaaauagauugcccagccccuccaguacaaucccacuggaagaaaa

SEQ ID NO: 171624 - RNA, 64 nt, hsa
cucagggcaucugacucccucuucaguguucuucccccuccauguugccugccccugaagaccu

SEQ ID NO: 171625 - RNA, 64 nt, hsa
gcugcccugugcuccuccccgcaggacauggcucccccuccaccugcucugugcccacccucca

SEQ ID NO: 171626 - RNA, 64 nt, hsa
ccaggcccccaaccccccauuucuuccccaccaaccccuccaaugcuguuaucccugccugguc

SEQ ID NO: 171627 - RNA, 64 nt, hsa
uagccauagcagccccugcuucagccccaccgcaccccuccagggggccugccuuucccugaca

SEQ ID NO: 171628 - RNA, 64 nt, hsa
aaauaucacaacccaccaaaaauagaugccucucccccuccagcccuagccgagcugguccuag

SEQ ID NO: 171629 - RNA, 61 nt, hsa
gggacuuggccaaggcaaaagcuggggagaugccagugacaacauacaguucaugacuagg

SEQ ID NO: 171630 - RNA, 61 nt, hsa
uuuuuccaaaguagaaaggaagcacuucugagccagugaccacugaaagguaugugcuaug

SEQ ID NO: 171631 - RNA, 61 nt, hsa
cccccaaaccaaaguugucccaacagaggaggccagugaggcagagacagagcucucccac

SEQ ID NO: 171632 - RNA, 61 nt, hsa
ggggaggccuacaacaggacgaccauucugagccagugagucuauugcaugguguuuugag

SEQ ID NO: 171633 - RNA, 61 nt, hsa
aaaguggcuaauguuagcuacuaugaauggugccagugaagacacugaaaaauaagugauu

SEQ ID NO: 171634 - RNA, 61 nt, hsa
augaaaaucuuugcacucacagagcuuacaugccagugagugaagaucgaugauaaauaaa

SEQ ID NO: 171635 - RNA, 61 nt, hsa
auuuccuucuguucuccuuguucuguucugggccagugaagguccuuguucugauuuugaa

SEQ ID NO: 171636 - RNA, 61 nt, hsa
uguucugauuuugaaacgaucugcaggucuugccagugaaccccuggacaacugaccacac

SEQ ID NO: 171637 - RNA, 61 nt, hsa
agccuaaugaaagggaaagucagcuuucagagccagugaaggagccacgugaauggcccua

SEQ ID NO: 171638 - RNA, 61 nt, hsa
aagcuuaaauugcuuuuguugugacuuuuuagccagugacuuuuucugagcuuuucaugga

SEQ ID NO: 171639 - RNA, 61 nt, hsa
uccuagccguuccccuucugccccagucugagccagugagggguagcuuuuuaaaaccauu

SEQ ID NO: 171640 - RNA, 61 nt, hsa
ucccugguggguaacacccucaagucucuuugccagugaggccccaccacaucggugugag

SEQ ID NO: 171641 - RNA, 61 nt, hsa
aaauguggguagcuuauacuuucaaacuaaugccagugacuagagagagguuucauucaug

SEQ ID NO: 171642 - RNA, 61 nt, hsa
acuggucaucacauucagcuuauucuuacgugccagugaggcccuaaggucucagugcaua

SEQ ID NO: 171643 - RNA, 61 nt, hsa
ucucaacgcgcccacccuggacguggauggcgccagugacuccggcagcggcgaugagggc

SEQ ID NO: 171644 - RNA, 61 nt, hsa
guucuacacccuccaggaaaugacagcaggugccagugacuacuucucccuggugagugua

SEQ ID NO: 171645 - RNA, 61 nt, hsa
agacugcacccuccagcaacaacagaugaaagccagugagccuacuaaccgugccaucuug

SEQ ID NO: 171646 - RNA, 61 nt, hsa
ggcauuguaauugugaacagcucuuacuugugccagugacagaugcaguggucuccuuucc

SEQ ID NO: 171647 - RNA, 61 nt, hsa
ccagcccugguucuggcuguggucagcagaugccagugaaggguuuuguguguuuaggccu

SEQ ID NO: 171648 - RNA, 61 nt, hsa
uuuuggguggcauagagguuuuguauugagggccagugaugauguuuugauauuuauuucc

SEQ ID NO: 171649 - RNA, 61 nt, hsa
acugcagggaagcuaccggaccugccugggagccagugaagggcgagucagggcacgcguc

SEQ ID NO: 171650 - RNA, 61 nt, hsa
auugucagccuuggccugggguuuugaccuugccagugaaguuucgguuuugaagugauua

SEQ ID NO: 171651 - RNA, 61 nt, hsa
acuuuagggaaaccuuugcuuaccuuguuuugccagugauaagagcaguggguuggagggc

SEQ ID NO: 171652 - RNA, 61 nt, hsa
cucuaaaagccuuggagauuagcccuuccuugccagugagaacggugaccgccuccugcuc

SEQ ID NO: 171653 - RNA, 61 nt, hsa
gacucugccuagaaacaguguuugcccuuuggccagugacgugguucaucccggcccaugu

SEQ ID NO: 171654 - RNA, 64 nt, hsa
gggcacagcauccucaguucugugcccagccaagggugagcaucucugcugagacaguccuuuu

SEQ ID NO: 171655 - RNA, 64 nt, hsa
ugaagaugucuugagcucugcaaagaucagagcaggugagcauccacuuugacaugaaggacaa

SEQ ID NO: 171656 - RNA, 63 nt, hsa
cagggauaugcuguauuuuauaaaauuggcaaaauuagagaaauauaguucacaaugaaauua

SEQ ID NO: 171657 - RNA, 63 nt, hsa
uucacauuugauuuuuucaaauuuaauauuuauauuagagaucuauauauguauaaauaugua

SEQ ID NO: 171658 - RNA, 63 nt, hsa
aacaucucuuucucauuagagaucugaaaacucauuagagauguugagucuuaucaaauaaaa

SEQ ID NO: 171659 - RNA, 63 nt, hsa
uuuuucugaauuuuuuuuuaacaucucuuucucauuagagaucugaaaacucauuagagaugu

SEQ ID NO: 171660 - RNA, 63 nt, hsa
uccagaaagggugagaggaucauuagagaguucauuagagaguauuuauuccuaauaagucag

SEQ ID NO: 171661 - RNA, 63 nt, hsa
ugccucucacuuuccagaaagggugagaggaucauuagagaguucauuagagaguauuuauuc

SEQ ID NO: 171662 - RNA, 63 nt, hsa
guucauuuuucaacuaaucuuauguggaauugaauuagagaacaaggcauuauucuuuuaggg

SEQ ID NO: 171663 - RNA, 63 nt, hsa
agggaaugggcugguagacuuuuucgaaaacaaauuagagaaaguaacuuacaaccacccauu

SEQ ID NO: 171664 - RNA, 63 nt, hsa
cugaguauucauauuaaguguuuuauuuuccauauuagagaugggaagggaaccuuaugugua

SEQ ID NO: 171665 - RNA, 63 nt, hsa
uaaugugaaauacaguuuuccugcaaaauuagcauuagagaauugauuuuagauaacagauuu

SEQ ID NO: 171666 - RNA, 63 nt, hsa
uuauugguguucauuuuucuuuugauuuaaaggauuagagaaaucuacaaauguaugucauaa

SEQ ID NO: 171667 - RNA, 63 nt, hsa
cuggagagaacacauaaaugauuuuggcauaccauuagagaaaccauuuguaaaacucaaaug

SEQ ID NO: 171668 - RNA, 63 nt, hsa
agaacucauuauucuggguacccuccaaugagaauuagagagguuaaauaccuuuuccuagau

SEQ ID NO: 171669 - RNA, 63 nt, hsa
auuugugccagcuaacacuacaaaauagacuuaauuagagaaauuuagacccagaauugcagc

SEQ ID NO: 171670 - RNA, 64 nt, hsa
guuuggcuccacugguggcacacguggccuccgugguauggaccugguggcuucuccaucccac

SEQ ID NO: 171671 - RNA, 64 nt, hsa
ccugguggcuucuccaucccacuguggccucugugguauggaccugguggcuucuccauccuac

SEQ ID NO: 171672 - RNA, 64 nt, hsa
uagaauuuccaucauggaaggugguauggaagaagguauggaaauacuuuguauucuaaaaacu

SEQ ID NO: 171673 - RNA, 64 nt, hsa
aaauuguccuguuagaauuuccaucauggaaggugguauggaagaagguauggaaauacuuugu

SEQ ID NO: 171674 - RNA, 64 nt, hsa
cuguucuuugguauggaauuuuucucucuucuuugguauggaauuuuucccuucagugacugag

SEQ ID NO: 171675 - RNA, 64 nt, hsa
aggacggagguucccugggggaagucuguucuuugguauggaauuuuucucucuucuuugguau

SEQ ID NO: 171676 - RNA, 64 nt, hsa
ggucccuuugcaagugaacccugcagcucacccauucauucacccaacuuccuucauucagcag

SEQ ID NO: 171677 - RNA, 64 nt, hsa
cccugcagcucacccauucauucacccaacuuccuucauucagcaggagguccuauuacccucu

SEQ ID NO: 171678 - RNA, 64 nt, hsa
aagagcugugguuuccugugcucucauuuguccauucauucauucauucauucauucagcaaau

SEQ ID NO: 171679 - RNA, 64 nt, hsa
gcugugguuuccugugcucucauuuguccauucauucauucauucauucauucagcaaauaauc

SEQ ID NO: 171680 - RNA, 64 nt, hsa
ugguuuccugugcucucauuuguccauucauucauucauucauucauucagcaaauaaucugaa

SEQ ID NO: 171681 - RNA, 64 nt, hsa
uuccugugcucucauuuguccauucauucauucauucauucauucagcaaauaaucugaaaucc

SEQ ID NO: 171682 - RNA, 64 nt, hsa
ugugcucucauuuguccauucauucauucauucauucauucagcaaauaaucugaaauccaguc

SEQ ID NO: 171683 - RNA, 64 nt, hsa
uugggaacauuugccucauucuccugcuauccucuucauucaccccugccacuguaauaucuau

SEQ ID NO: 171684 - RNA, 64 nt, hsa
aaaaaaaaauguguagccccuuuuuaaccuaguguucauucaaaaaaaaauugaugcaaaucuu

SEQ ID NO: 171685 - RNA, 64 nt, hsa
uauuccuuauguuggugaccuaaagagaauuacuuucauucauuucauuucccccguagcagau

SEQ ID NO: 171686 - RNA, 64 nt, hsa
cuuguuuacaaaauuugauucuaaguugaauugcuucauucaacacccccacccucccuccccu

SEQ ID NO: 171687 - RNA, 64 nt, hsa
uggguguucugccaacaauugcuaguggugugaauucauucauauuugccaguauugcucacuu

SEQ ID NO: 171688 - RNA, 64 nt, hsa
ucuagucuuguauuuccuccuucuguugcucucuuucauucacacacucucaguuucucauauu

SEQ ID NO: 171689 - RNA, 64 nt, hsa
aaaacauauauagggguuccaggaaucucauucauucauucaguauuuauugagcaucuaguau

SEQ ID NO: 171690 - RNA, 64 nt, hsa
gcccaaaacauauauagggguuccaggaaucucauucauucauucaguauuuauugagcaucua

SEQ ID NO: 171691 - RNA, 64 nt, hsa
uguagugugauucuagauaaaucaucauuagcaauucauucagauggucaauaacuugaaauuu

SEQ ID NO: 171692 - RNA, 64 nt, hsa
uauguaacuuuuucagggaauaguuuaagcuuuauucauucaugcaauacuaaagagaaauaag

SEQ ID NO: 171693 - RNA, 64 nt, hsa
cccuguccucugucccucacaccccuuugcuccguucauucauucaaaaaaacauuucuugagc

SEQ ID NO: 171694 - RNA, 64 nt, hsa
guccucugucccucacaccccuuugcuccguucauucauucaaaaaaacauuucuugagcaccu

SEQ ID NO: 171695 - RNA, 64 nt, hsa
acuuuacaauaauuuguauucauucauucauucauucauucauauucuaaugugcuuauucuag

SEQ ID NO: 171696 - RNA, 64 nt, hsa
uuuuacuuuacaauaauuuguauucauucauucauucauucauucauauucuaaugugcuuauu

SEQ ID NO: 171697 - RNA, 64 nt, hsa
gaauuuuuacuuuacaauaauuuguauucauucauucauucauucauucauauucuaaugugcu

SEQ ID NO: 171698 - RNA, 64 nt, hsa
uuaugaauuuuuacuuuacaauaauuuguauucauucauucauucauucauucauauucuaaug

SEQ ID NO: 171699 - RNA, 64 nt, hsa
ugccuuaugaauuuuuacuuuacaauaauuuguauucauucauucauucauucauucauauucu

SEQ ID NO: 171700 - RNA, 64 nt, hsa
ucaguguggaaaagacuacagauuacacacucuuuucauucacacuuguacauauagacagcaa

SEQ ID NO: 171701 - RNA, 64 nt, hsa
gcaugaaauggccaacuguggcuguuacaguucuuucauucaauuauaacuuguaaaccaguga

SEQ ID NO: 171702 - RNA, 64 nt, hsa
aauugcuugaagcaauuguucugaaugauacuuuuucauucacauucaagaauuaauuuuuuga

SEQ ID NO: 171703 - RNA, 64 nt, hsa
ucccucuuuacaucacuuaucuuucucacugagguucauucacuggaauuuacucacgcaaucu

SEQ ID NO: 171704 - RNA, 64 nt, hsa
ugauuauuauuuaguuggaggccuuuagauauuauucauucauuuacucauucauuuauucauu

SEQ ID NO: 171705 - RNA, 64 nt, hsa
uuagauauuauucauucauuuacucauucauuuauucauucauucaucgaguaacuuuaaaaaa

SEQ ID NO: 171706 - RNA, 64 nt, hsa
auauuauucauucauuuacucauucauuuauucauucauucaucgaguaacuuuaaaaaaauca

SEQ ID NO: 171707 - RNA, 64 nt, hsa
guguaaaacacucaugugauauuuuuggacuucauucauucaagcaaaagaauuauuaacucug

SEQ ID NO: 171708 - RNA, 61 nt, hsa
aguguaaaacacucaugugauauuuuuggacuucauucauucaagcaaaagaauuauuaac

SEQ ID NO: 171709 - RNA, 64 nt, hsa
uuuuggaaucuuccuccugacugugagguggguguucauucauuuccuccauaaacaccaacuu

SEQ ID NO: 171710 - RNA, 64 nt, hsa
gacaugacuguggagucuuacaguucaggguucuuucauucacgucccuuccugucucggucug

SEQ ID NO: 171711 - RNA, 64 nt, hsa
uguuguuugcuuuccuuaacugaauuucaucaaauucauucagugauuuuuauuuuggucauua

SEQ ID NO: 171712 - RNA, 64 nt, hsa
uuuaacucauuguaugaauucuuuuucaugguaguucauucaguuauguguuuauuuacuacau

SEQ ID NO: 171713 - RNA, 64 nt, hsa
guuaaugcuacuggucuaacuucauucaguaugcuucauucaccgaacuuugugcucaaaaugc

SEQ ID NO: 171714 - RNA, 64 nt, hsa
ucucugcaucacuuguuaaugcuacuggucuaacuucauucaguaugcuucauucaccgaacuu

SEQ ID NO: 171715 - RNA, 64 nt, hsa
ucauuuggagauugaacucugaauuaacacaguauucauucaucuguguuauuuuguaaaaaua

SEQ ID NO: 171716 - RNA, 64 nt, hsa
gggggcagguuaauuccuggcauugccaguuuucuucauucagaaucuguuuguugaucaagug

SEQ ID NO: 171717 - RNA, 64 nt, hsa
uaaacuugaauaaaggggacaaagcuagaacuuauucauucauucauucacuuauggaguuguu

SEQ ID NO: 171718 - RNA, 64 nt, hsa
cuugaauaaaggggacaaagcuagaacuuauucauucauucauucacuuauggaguuguuacug

SEQ ID NO: 171719 - RNA, 64 nt, hsa
aauaaaggggacaaagcuagaacuuauucauucauucauucacuuauggaguuguuacugauuu

SEQ ID NO: 171720 - RNA, 64 nt, hsa
ucccagucucgacucuacauuuguuugugcagcauucauucagcaaagacuuuugggguuugug

SEQ ID NO: 171721 - RNA, 64 nt, hsa
uuugaugaugacacuggcacauuauucuaaacuauucauucagcaugccuauaauuacauaaau

SEQ ID NO: 171722 - RNA, 64 nt, hsa
gagacuuuuuguugcaaaggacacauuuaucauauucauucacacauauuauaugugauagcug

SEQ ID NO: 171723 - RNA, 64 nt, hsa
aaguuuguguggggauuaaaugagcuaaugcagauucauucauucagaaaaauuuuugaauggc

SEQ ID NO: 171724 - RNA, 64 nt, hsa
uuguguggggauuaaaugagcuaaugcagauucauucauucagaaaaauuuuugaauggcacgu

SEQ ID NO: 171725 - RNA, 64 nt, hsa
acagacaaaagccuuugccuucaugaagcauacauucauucagggguagacacacaaaaaauga

SEQ ID NO: 171726 - RNA, 64 nt, hsa
cugaaacacauucuugaagcccagcuuucauaucuucauucaacaaauaauuucugagugugua

SEQ ID NO: 171727 - RNA, 64 nt, hsa
auccuuuuauuaaucauggucauucauucauucauucauucacaaaauauuuaugauguauuua

SEQ ID NO: 171728 - RNA, 64 nt, hsa
cuauauccuuuuauuaaucauggucauucauucauucauucauucacaaaauauuuaugaugua

SEQ ID NO: 171729 - RNA, 64 nt, hsa
gcagcuauauccuuuuauuaaucauggucauucauucauucauucauucacaaaauauuuauga

SEQ ID NO: 171730 - RNA, 64 nt, hsa
cugagcagcuauauccuuuuauuaaucauggucauucauucauucauucauucacaaaauauuu

SEQ ID NO: 171731 - RNA, 64 nt, hsa
caucucuguuauuuaucccucauucauccauccguucauucauucagccuucaaucaacaucuc

SEQ ID NO: 171732 - RNA, 64 nt, hsa
ucuguuauuuaucccucauucauccauccguucauucauucagccuucaaucaacaucucuuga

SEQ ID NO: 171733 - RNA, 64 nt, hsa
uccagccauucugguauuccuuuauguaucuaauuucauucaaaccucacaacagucuugugag

SEQ ID NO: 171734 - RNA, 64 nt, hsa
aaauuacuaguuguauuauuuauccuaugauucauucauucaauaagcuuuuacugcauaaacu

SEQ ID NO: 171735 - RNA, 64 nt, hsa
uaagaaauuacuaguuguauuauuuauccuaugauucauucauucaauaagcuuuuacugcaua

SEQ ID NO: 171736 - RNA, 64 nt, hsa
cauugcuucacuuacacuucacccacagcuggaguucauucaacucuugcuuuucacaaaauag

SEQ ID NO: 171737 - RNA, 64 nt, hsa
ugucuucuuguucuacucagggccuuuagguguguucauucacgguauggaaauacaguaaaug

SEQ ID NO: 171738 - RNA, 64 nt, hsa
uaagaugucugagagaccaucuccuaucuuuuauuucauucauauccuccgcccuuuuuguccu

SEQ ID NO: 171739 - RNA, 64 nt, hsa
gaaacguccaucucucucccuuacuauucccacuuucauucaaucaaccugcacuucauaucua

SEQ ID NO: 171740 - RNA, 64 nt, hsa
uggcccucacgucucugguuuuaccuuuccuuacuucauucauucacucacccaguccuuacga

SEQ ID NO: 171741 - RNA, 64 nt, hsa
ccucacgucucugguuuuaccuuuccuuacuucauucauucacucacccaguccuuacgaauca

SEQ ID NO: 171742 - RNA, 64 nt, hsa
aauagccuggaaagcuagaaauacucuucauucauucauucauuuaaggaauauuaguugagua

SEQ ID NO: 171743 - RNA, 64 nt, hsa
cuugaauagccuggaaagcuagaaauacucuucauucauucauucauuuaaggaauauuaguug

SEQ ID NO: 171744 - RNA, 64 nt, hsa
agcccuugaauagccuggaaagcuagaaauacucuucauucauucauucauuuaaggaauauua

SEQ ID NO: 171745 - RNA, 64 nt, hsa
uagaaauaacagauucucugcacaaaaccacccauucauucauuuauucauucacagcacuagc

SEQ ID NO: 171746 - RNA, 64 nt, hsa
auucucugcacaaaaccacccauucauucauuuauucauucacagcacuagcaagugcugccua

SEQ ID NO: 171747 - RNA, 64 nt, hsa
aaccaaagcucaaauaaaaauaaaauaauuuucauucauucacucauuuauugucaacauuuau

SEQ ID NO: 171748 - RNA, 64 nt, hsa
gcagaaccaaagcucaaauaaaaauaaaauaauuuucauucauucacucauuuauugucaacau

SEQ ID NO: 171749 - RNA, 64 nt, hsa
uccguguacuucauucaaauguguaaaugucauauucauucagauuuauaaagcuaguagugua

SEQ ID NO: 171750 - RNA, 64 nt, hsa
guaauaagcaucuggaauggacccauccguguacuucauucaaauguguaaaugucauauucau

SEQ ID NO: 171751 - RNA, 64 nt, hsa
ucuuuucuaagcucaguguggaugauugcauuacuucauucacugaaguuuuugcccaaaaauu

SEQ ID NO: 171752 - RNA, 64 nt, hsa
agucuugauguacggacauuaaaagccagauuucuucauucaauucuguuaucucuguuuuacu

SEQ ID NO: 171753 - RNA, 64 nt, hsa
ggucaaccccuaugcaaauuaccacagcaaagguuucauucaggagauucuuccaucugggcaa

SEQ ID NO: 171754 - RNA, 64 nt, hsa
uugaggacacuuuugcaaaugccagaauguaagauucauucagugugcucccugggccuuuaug

SEQ ID NO: 171755 - RNA, 64 nt, hsa
gguugacaggauuuguuuauuuucuaaaauuagcuucauucaauauuuaucauccuccuuuccc

SEQ ID NO: 171756 - RNA, 64 nt, hsa
aagaaauagaaacuucaggcagaacauccauucauucauucauuggauuguauaucauuguugc

SEQ ID NO: 171757 - RNA, 64 nt, hsa
aagaaagaaauagaaacuucaggcagaacauccauucauucauucauuggauuguauaucauug

SEQ ID NO: 171758 - RNA, 64 nt, hsa
gugaguuuguuuaguucauuaauugguuuauucauucauucaacaaucauauacugauuagcua

SEQ ID NO: 171759 - RNA, 64 nt, hsa
uauugugaguuuguuuaguucauuaauugguuuauucauucauucaacaaucauauacugauua

SEQ ID NO: 171760 - RNA, 64 nt, hsa
aucgcuucccuucaugcauccauuguucuguucauucauucauccauacauccaccugccucug

SEQ ID NO: 171761 - RNA, 64 nt, hsa
ccccaucgcuucccuucaugcauccauuguucuguucauucauucauccauacauccaccugcc

SEQ ID NO: 171762 - RNA, 64 nt, hsa
uauuucuaaaugagacgaaaugcugauguauccuuucauucagcuaacaaacuagaaaagguua

SEQ ID NO: 171763 - RNA, 64 nt, hsa
aaggugcuuuucuucggcuugaguucaccaucucuucauucaaacugcacuuuuagccagagau

SEQ ID NO: 171764 - RNA, 64 nt, hsa
uauuuuuugguuuugggggauauuuuuuauuuguuucauucauucuguucuguuucucuacugg

SEQ ID NO: 171765 - RNA, 64 nt, hsa
aauaccuauuagucauaccuaaauuuuucagcacuucauucaauuaaaauacaugaauuuuaaa

SEQ ID NO: 171766 - RNA, 64 nt, hsa
uuaaaguaguaaauucauauccauagauaguucauucauucaacaaauauuuaccaaguuccua

SEQ ID NO: 171767 - RNA, 64 nt, hsa
caaauuaaaguaguaaauucauauccauagauaguucauucauucaacaaauauuuaccaaguu

SEQ ID NO: 171768 - RNA, 64 nt, hsa
uguucuggcagcugugucauaaaaugcugcuggguucauucauucauuccauaagaaacuuaau

SEQ ID NO: 171769 - RNA, 64 nt, hsa
cuggcagcugugucauaaaaugcugcuggguucauucauucauuccauaagaaacuuaauacca

SEQ ID NO: 171770 - RNA, 64 nt, hsa
gacacuaugaauuuauauauaggcaagauauucauucauucauaaacuauugccuacacuuuga

SEQ ID NO: 171771 - RNA, 64 nt, hsa
uuuagacacuaugaauuuauauauaggcaagauauucauucauucauaaacuauugccuacacu

SEQ ID NO: 171772 - RNA, 64 nt, hsa
gguuuuccucauuuuuauauucauuuauucaucauucauucauucaccuaacuuucauuaaaua

SEQ ID NO: 171773 - RNA, 64 nt, hsa
uuccucauuuuuauauucauuuauucaucauucauucauucaccuaacuuucauuaaauagcug

SEQ ID NO: 171774 - RNA, 64 nt, hsa
acacacacccacuaaggagaaagaaguugauuccuucauucacuucgccauucauucauacuuc

SEQ ID NO: 171775 - RNA, 64 nt, hsa
gagaaagaaguugauuccuucauucacuucgccauucauucauacuuccguccauccauucaga

SEQ ID NO: 171776 - RNA, 64 nt, hsa
gcauguugucaacuaaagacaacaaacuaucagauucauucauucagugaagcagccucugauu

SEQ ID NO: 171777 - RNA, 64 nt, hsa
guugucaacuaaagacaacaaacuaucagauucauucauucagugaagcagccucugauucucu

SEQ ID NO: 171778 - RNA, 64 nt, hsa
ucagagguaagucuguuguucugauuaaucugcauucauucagcgaaugcucaagacaagccag

SEQ ID NO: 171779 - RNA, 64 nt, hsa
cuucacguacuuccuuucuuucuucccucuguuauucauucaucaagcagguuaaagccauugu

SEQ ID NO: 171780 - RNA, 64 nt, hsa
aucauuaagaguaugagaauuaccauuuucaguuuucauucagcaaacaaauuuaccaagugcc

SEQ ID NO: 171781 - RNA, 64 nt, hsa
gaaugaauaaugcauucuuuuuuauucaauuuauuucauucaguuuauucuuggcaaucaaaca

SEQ ID NO: 171782 - RNA, 64 nt, hsa
auacuguaauauauuuauuaauauuugaaaggcauucauucaguggacagugggaauuaacucu

SEQ ID NO: 171783 - RNA, 64 nt, hsa
aaaacauaagaaacuacacccccaaaauaagacuuucauucacauucacaaagcaaacaucuag

SEQ ID NO: 171784 - RNA, 64 nt, hsa
aggauuacaugcauguuugguuaaacccaugagauucauucaguuaaaaauccagauggcaaau

SEQ ID NO: 171785 - RNA, 64 nt, hsa
ggcuuucuggcugcuggaggcuggggagaagguguucauucacuugcauuucuuugcccugggg

SEQ ID NO: 171786 - RNA, 64 nt, hsa
aaggugugggacaagaagaaaggguauuuauucauucauucaacagagguuuauguagggcacu

SEQ ID NO: 171787 - RNA, 64 nt, hsa
gaagaaggugugggacaagaagaaaggguauuuauucauucauucaacagagguuuauguaggg

SEQ ID NO: 171788 - RNA, 64 nt, hsa
cagcccuuccccagccccuccucuuguuucuucauucauucaacaaaauuuggcuggaaucugg

SEQ ID NO: 171789 - RNA, 64 nt, hsa
cuuccagcccuuccccagccccuccucuuguuucuucauucauucaacaaaauuuggcuggaau

SEQ ID NO: 171790 - RNA, 64 nt, hsa
uguucauuacuuuguucacuccuucuuccauuuauucauucaauaaacauuuauugggaaccug

SEQ ID NO: 171791 - RNA, 64 nt, hsa
gggagaugcguuguaugggacuggaagcaagagguucauucaaagagaaacucaugggauuugu

SEQ ID NO: 171792 - RNA, 64 nt, hsa
cauucuauaauaguaggaccaguacccugucuguuucauucaccacagucagcaugccccaagu

SEQ ID NO: 171793 - RNA, 64 nt, hsa
cacacucucaguuuugguauuuuguguuuuuguuuucauucaucucaaaguauuuucuaauuuc

SEQ ID NO: 171794 - RNA, 64 nt, hsa
cuggcacaaaugaaaaguaggacggaaagcuccuuucauucaguuuaucuuuccaggauauaug

SEQ ID NO: 171795 - RNA, 64 nt, hsa
gacuagccucacucuguccucgaaagccugagcuuucauucaacucccuauuuccaugcaaaga

SEQ ID NO: 171796 - RNA, 64 nt, hsa
gccguccagacaauucucccaguccauucauuucuucauucauuuguucauucaguaguuauug

SEQ ID NO: 171797 - RNA, 64 nt, hsa
auucucccaguccauucauuucuucauucauuuguucauucaguaguuauugagugcuuauuuc

SEQ ID NO: 171798 - RNA, 64 nt, hsa
uaccugaaacugccuucauucacucauuuguguauucauucauuuauguauucaucagacacau

SEQ ID NO: 171799 - RNA, 64 nt, hsa
ucauaggagucuuaggcaguuaccugaaacugccuucauucacucauuuguguauucauucauu

SEQ ID NO: 171800 - RNA, 64 nt, hsa
cuggggcaugugugccuguggcagaaaagaggagacccuggaauucagcacccugggugccauu

SEQ ID NO: 171801 - RNA, 64 nt, hsa
agcuggaaggcagggcagagggaauguucccugcacccuggaaaggggaguugagucacaagag

SEQ ID NO: 171802 - RNA, 64 nt, hsa
aaaauuauagauguuuguuguaaaauuuuggaaaacccuggaaauuauagagaaaauaaacaua

SEQ ID NO: 171803 - RNA, 64 nt, hsa
gggguccugaguggcuuccaggagagcgggaugaacccuggaccuggaguaggagacccggaug

SEQ ID NO: 171804 - RNA, 64 nt, hsa
uuuaguccuuuaaaaugaguagaagcaaccuguuacccuggaaagagcacuggacauagaccua

SEQ ID NO: 171805 - RNA, 64 nt, hsa
ucacaaauguagaccuccaugaacucauuggaugacccuggacagagcggggcuauucccauuu

SEQ ID NO: 171806 - RNA, 64 nt, hsa
gcagcuuuaccuuugucauuucauccucauggccacccuggagguggcauuguguaaccucauc

SEQ ID NO: 171807 - RNA, 64 nt, hsa
ggagggaggaggaagggaagaccccaguggugggacccuggaccaggccauggaugaaggacaa

SEQ ID NO: 171808 - RNA, 64 nt, hsa
acucucagucuggccccugugcuccccuguguguacccuggaguuucuguguccaauuguuggc

SEQ ID NO: 171809 - RNA, 64 nt, hsa
ccuuuccucagccccuuguucuucccuguccuccacccuggaccccagccggcugcuggagccc

SEQ ID NO: 171810 - RNA, 64 nt, hsa
cuacucgggagguuuaggcaggagaaucgcuugaacccuggagguggagguggagguugcagug

SEQ ID NO: 171811 - RNA, 64 nt, hsa
gggcccuagaaauuccacagcucccguccuggccacccuggaagcucaucaggccaagacccgg

SEQ ID NO: 171812 - RNA, 64 nt, hsa
agugggggugcuccugucuguccuuuucccccacacccuggacugugcuuggcuguuggugcac

SEQ ID NO: 171813 - RNA, 64 nt, hsa
uuuucccaugugcagggugagguuuuuuuuugccacccuggacacauguuggcccccucaaaga

SEQ ID NO: 171814 - RNA, 64 nt, hsa
ucucccaccuccuccccucucccucccccuggagacccuggaagugguguguucacauacagug

SEQ ID NO: 171815 - RNA, 64 nt, hsa
cagacuuaggcgcgcccgguagccccggcugcccacccuggagggcugcgcccgcgccaggcgc

SEQ ID NO: 171816 - RNA, 64 nt, hsa
ccaggcauagggggcaagcucuuggggcaucaggacccuggagcaccagguccuuccuggaaua

SEQ ID NO: 171817 - RNA, 64 nt, hsa
ugccccagacacagugcccaacaccccgucguauacccuggaugaacgaauuaauuaccuggca

SEQ ID NO: 171818 - RNA, 64 nt, hsa
ucacagacccacaagagaagcugauggggaguaaacccuggaguccgaggcccaggcagcagcc

SEQ ID NO: 171819 - RNA, 64 nt, hsa
accaccccugggugcucaguuucuaccaacaugagccagcaaguccuugugguagcccuggggu

SEQ ID NO: 171820 - RNA, 64 nt, hsa
guaguagacucggguccuguccacagcccuagcugccagcaaugcuguccucacagaggcauag

SEQ ID NO: 171821 - RNA, 64 nt, hsa
aggccaaugcaagaggccaaggcuggagaggcgugccagcaaggccagggauggccggagggcu

SEQ ID NO: 171822 - RNA, 64 nt, hsa
uggucagaaacaaagggcuggucaccugauuuaggccagcaaccagggaagcucuuagaauccc

SEQ ID NO: 171823 - RNA, 64 nt, hsa
ugagucacugcuaagagacagagcacauuuucaggccagcaacuauccuugccagaguuuuuuc

SEQ ID NO: 171824 - RNA, 64 nt, hsa
uuaaauaacucgaucuguacccagcuggguagcagccagcaaaggccaucagacaaccagaagc

SEQ ID NO: 171825 - RNA, 64 nt, hsa
ccaacacacucagcaucccugggaacugagaggugccagcaauugcugaagguggcgaugaaca

SEQ ID NO: 171826 - RNA, 64 nt, hsa
gagugugugggguauggggcagcagaggcagccagccagcaaagaggggccacugagcaccagg

SEQ ID NO: 171827 - RNA, 64 nt, hsa
aggaggcagcgcccugcagccucccguccacacugccagcaaugccccuggcccagugagccca

SEQ ID NO: 171828 - RNA, 64 nt, hsa
aggacucccaacccuggcuuggggucaagaaacagccagcaagaguuaggggccuuagggcacu

SEQ ID NO: 171829 - RNA, 64 nt, hsa
cugucccacccccuucccccagcccauccauuaggccagcaacgcuuguagaacucacucuggg

SEQ ID NO: 171830 - RNA, 64 nt, hsa
gugggaaguaguacugcuagucauggucucaccccgagcugaccccucugccugggcuuugugc

SEQ ID NO: 171831 - RNA, 64 nt, hsa
aaggaguugggggguagaggcaggaaaugggaaccgagcugaagcagaggcugaguuagggggc

SEQ ID NO: 171832 - RNA, 64 nt, hsa
acuuucagcauccaguagaugggaccucgaggcucgagcugaagcaggcgagagagaaacagcu

SEQ ID NO: 171833 - RNA, 64 nt, hsa
uggggagugguagaagcaacugaacggaugcgugcgagcugaggacagggcgggaggagggggc

SEQ ID NO: 171834 - RNA, 64 nt, hsa
acgcggagccagcgccgucggagaccgcgccggccgagcugaggacugcacgccgcugugcgga

SEQ ID NO: 171835 - RNA, 64 nt, hsa
acuccaaacacggaacgaauucagacuuccagcacgagcugacugacaucacuguuuguaccaa

SEQ ID NO: 171836 - RNA, 64 nt, hsa
gcgaggacaccguguacaggagcggguugaugaccgagcugagguagaaaaacgucuccgagaa

SEQ ID NO: 171837 - RNA, 64 nt, hsa
auucugaauuuuuugagggccuuuuaacacuccccgagcugauuguuugcaaguguguuuguuc

SEQ ID NO: 171838 - RNA, 64 nt, hsa
uuccuccacuguguccaguuuuauuuacacaaagcgagcugagaccacagguucuugcucugga

SEQ ID NO: 171839 - RNA, 64 nt, hsa
ugaugagaagaauacagacaacucagaggacagucgagcugaagacaauuuuaacuuggaaaag

SEQ ID NO: 171840 - RNA, 64 nt, hsa
gcaucccuggguggccuuuccugcugacacuccacgagcugacccagcagaauucucuguguag

SEQ ID NO: 171841 - RNA, 61 nt, hsa
ucgaguccuccaagaucugaggccagcagagcgagcugacagcagcaacacugucagaagg

SEQ ID NO: 171842 - RNA, 64 nt, hsa
gacaagagguagaggggagagguagagguagccacgagcugauaauuacagacaagagaugcgg

SEQ ID NO: 171843 - RNA, 54 nt, hsa
gagaggcaguggcacacugaugggcgagcugagcgcagagcugcgaaggggaac

SEQ ID NO: 171844 - RNA, 64 nt, hsa
ggaggggcccgguggcggcagggccaggcugguccgagcugaggacucugcaagugucuggagc

SEQ ID NO: 171845 - RNA, 64 nt, hsa
aucagcuuccagguguagggaccccuugaggggccgagcugacauccaaggcugaggaccccag

SEQ ID NO: 171846 - RNA, 64 nt, hsa
auugcacagagcuagacucgggcagccagagcggcgagcugaguaacagggguaacaccucccu

SEQ ID NO: 171847 - RNA, 64 nt, hsa
aauuucuuuuuuaugaaaagggauauaaaggcaccgagcugaugcaguauuuguaauauuaagu

SEQ ID NO: 171848 - RNA, 64 nt, hsa
cacagcuuggccauuugaggcaaaggcagcuucccgagcugaugcuaaagaagacagacuuucc

SEQ ID NO: 171849 - RNA, 64 nt, hsa
ggcucucuagucugaaggcaccgccggcuugcgccgagcugagugccggguuucccuauuccaa

SEQ ID NO: 171850 - RNA, 64 nt, hsa
ggccaucacuucugaggagcagaguugagggagccgagcugagccacgcugggaggccagagcc

SEQ ID NO: 171851 - RNA, 64 nt, hsa
cucgacugcacaggagcccgagacaauacaccuccgagcugaauaugaaaagucagaaaugcua

SEQ ID NO: 171852 - RNA, 64 nt, hsa
agcagaauguuucccuucaugugcacuaugaaaacgagcugacagcacacucccaggagaaaug

SEQ ID NO: 171853 - RNA, 64 nt, hsa
agaaucacuugaacgugggaggcggagguugcagcgagcugagaucaugccguuguacuccagc

SEQ ID NO: 171854 - RNA, 64 nt, hsa
aggaucacuugggcccaggaggucaagccugcagcgagcugagaucacaccacugcacuccagc

SEQ ID NO: 171855 - RNA, 64 nt, hsa
ggagucuccaaagcacagaguggcaaacaaaacccgagcugagcaucaggaccuugccucgaau

SEQ ID NO: 171856 - RNA, 64 nt, hsa
aaaauccugggcacuucugcagggcugcugguuccgagcugacacccgucuuaacaaaaggccc

SEQ ID NO: 171857 - RNA, 64 nt, hsa
ucuuuuucagaacuguuaaaguuuugauguacaucgagcugaauucuguuuuuaccaguuucaa

SEQ ID NO: 171858 - RNA, 64 nt, hsa
uaucuuuccuuggcagguucagaaccucauggcccgagcugaauacuugaaggagcaggucaag

SEQ ID NO: 171859 - RNA, 64 nt, hsa
agcagccaaggcccuguccuuucuugaaugguggcgagcugaaucuggucgguuuccuagcuuu

SEQ ID NO: 171860 - RNA, 64 nt, hsa
ggccggacgaaggaugcuuucuuccuagaggcuccgagcugagcugcgaacucgccccccgccc

SEQ ID NO: 171861 - RNA, 64 nt, hsa
uccccgcucacaacuuggguucuucucagcggggcgagcugagaagcggucaugagcaccuggg

SEQ ID NO: 171862 - RNA, 64 nt, hsa
agaauugcuugaacacaggaggcagagguugcagcgagcugagaucacgccacugugcuccagc

SEQ ID NO: 171863 - RNA, 64 nt, hsa
acccucuaguggaggcgggggugaauucuuaggucgagcugaugcaagaaacuccgguagccag

SEQ ID NO: 171864 - RNA, 64 nt, hsa
cucaggggccagucccugugucucuggugcccagcgagcugagcaccagugggugaccggggag

SEQ ID NO: 171865 - RNA, 64 nt, hsa
gacuucuccuuuuucucucccuccagagcucccacgagcugaugcacccccaggcuucaaacca

SEQ ID NO: 171866 - RNA, 64 nt, hsa
agaaucacuugagcccaggagguggagguuucagcgagcugagaucacaccacugcacuccagc

SEQ ID NO: 171867 - RNA, 64 nt, hsa
uccaggauucugggaggcuucaguuaccgcuggccgagcugaagaacuggguaugaggcugggg

SEQ ID NO: 171868 - RNA, 64 nt, hsa
uugagcugcuucagugaauguacagugcccggcacgagcugaaccucauguguuccacucccaa

SEQ ID NO: 171869 - RNA, 64 nt, hsa
auaggcagggaaccgagcagcaggucagagcaggcgagcugacauucugcagccuggacggcca

SEQ ID NO: 171870 - RNA, 64 nt, hsa
ccaguggaagaaacaggccaggagaagugcgugccgagcugaggcagauguucccacagugacc

SEQ ID NO: 171871 - RNA, 64 nt, hsa
acuggaccauuccaugugguuccacgcccccuuccgagcugaccacuggaugcucuaugaaugc

SEQ ID NO: 171872 - RNA, 64 nt, hsa
gggccacagacaucauugcuguuccccguuaccucgagcugacucuagaggggaaggcagagcu

SEQ ID NO: 171873 - RNA, 64 nt, hsa
ugagggcaccgccuauugguguccugugggagggcgagcugagaacacauggacuagcugagug

SEQ ID NO: 171874 - RNA, 64 nt, hsa
ggaggcuuuugaacccaggaggcagagguugcagcgagcugagaucgcgccacugcacuccagc

SEQ ID NO: 171875 - RNA, 64 nt, hsa
uuucccuuuucucugguggccuguuguggugcaacgagcugauggcauuugaucuugccccauu

SEQ ID NO: 171876 - RNA, 64 nt, hsa; identical to SEQ ID NO: 153609

SEQ ID NO: 171877 - RNA, 64 nt, hsa; identical to SEQ ID NO: 153610

SEQ ID NO: 171878 - RNA, 64 nt, hsa; identical to SEQ ID NO: 153611

SEQ ID NO: 171879 - RNA, 64 nt, hsa; identical to SEQ ID NO: 153612

SEQ ID NO: 171880 - RNA, 64 nt, hsa; identical to SEQ ID NO: 153613

SEQ ID NO: 171881 - RNA, 64 nt, hsa; identical to SEQ ID NO: 153614

SEQ ID NO: 171882 - RNA, 64 nt, hsa; identical to SEQ ID NO: 153615

SEQ ID NO: 171883 - RNA, 64 nt, hsa; identical to SEQ ID NO: 153616

SEQ ID NO: 171884 - RNA, 64 nt, hsa; identical to SEQ ID NO: 153617

SEQ ID NO: 171885 - RNA, 64 nt, hsa; identical to SEQ ID NO: 153618

SEQ ID NO: 171886 - RNA, 64 nt, hsa; identical to SEQ ID NO: 153619

SEQ ID NO: 171887 - RNA, 64 nt, hsa; identical to SEQ ID NO: 153620

SEQ ID NO: 171888 - RNA, 64 nt, hsa; identical to SEQ ID NO: 153621

SEQ ID NO: 171889 - RNA, 64 nt, hsa; identical to SEQ ID NO: 153622

SEQ ID NO: 171890 - RNA, 64 nt, hsa; identical to SEQ ID NO: 153623

SEQ ID NO: 171891 - RNA, 64 nt, hsa; identical to SEQ ID NO: 153624

SEQ ID NO: 171892 - RNA, 64 nt, hsa; identical to SEQ ID NO: 153625

SEQ ID NO: 171893 - RNA, 64 nt, hsa; identical to SEQ ID NO: 153626

SEQ ID NO: 171894 - RNA, 64 nt, hsa; identical to SEQ ID NO: 153627

SEQ ID NO: 171895 - RNA, 64 nt, hsa
gaaaaacccaaguucauucccacccaaagucagaaucccucauuggccuuaagguagcagucau

SEQ ID NO: 171896 - RNA, 64 nt, hsa
agaaggagcagaaauaguuauuuucguaucuucuaucccucaaagcaucagacaugggaaaauu

SEQ ID NO: 171897 - RNA, 64 nt, hsa
ggaacaggaaggaugugcuuuaaaaaaagguggaaucccucaaaaaauucuauagggagacagc

SEQ ID NO: 171898 - RNA, 64 nt, hsa
uauauguagauggauauagcaguacugguugaguaucccucaucugaaaugcuuaggaccagga

SEQ ID NO: 171899 - RNA, 64 nt, hsa
ccaucccccaucuaagaauccuaagaggcaggcgaucccucaccugcuuacucacucagcaguu

SEQ ID NO: 171900 - RNA, 64 nt, hsa
caggaauggggggugcugagucaucucacgaagaaucccucacucuucccggguucagcccaga

SEQ ID NO: 171901 - RNA, 64 nt, hsa; identical to SEQ ID NO: 72506

SEQ ID NO: 171902 - RNA, 64 nt, hsa; identical to SEQ ID NO: 72507

SEQ ID NO: 171903 - RNA, 64 nt, hsa; identical to SEQ ID NO: 72508

SEQ ID NO: 171904 - RNA, 64 nt, hsa; identical to SEQ ID NO: 72509

SEQ ID NO: 171905 - RNA, 64 nt, hsa; identical to SEQ ID NO: 72510

SEQ ID NO: 171906 - RNA, 64 nt, hsa; identical to SEQ ID NO: 72511

SEQ ID NO: 171907 - RNA, 64 nt, hsa; identical to SEQ ID NO: 72512

SEQ ID NO: 171908 - RNA, 64 nt, hsa; identical to SEQ ID NO: 72513

SEQ ID NO: 171909 - RNA, 64 nt, hsa; identical to SEQ ID NO: 72514

SEQ ID NO: 171910 - RNA, 64 nt, hsa; identical to SEQ ID NO: 72515

SEQ ID NO: 171911 - RNA, 64 nt, hsa; identical to SEQ ID NO: 72516

SEQ ID NO: 171912 - RNA, 64 nt, hsa; identical to SEQ ID NO: 72517

SEQ ID NO: 171913 - RNA, 64 nt, hsa; identical to SEQ ID NO: 72518

SEQ ID NO: 171914 - RNA, 64 nt, hsa; identical to SEQ ID NO: 72519

SEQ ID NO: 171915 - RNA, 64 nt, hsa; identical to SEQ ID NO: 72520

SEQ ID NO: 171916 - RNA, 64 nt, hsa; identical to SEQ ID NO: 72521

SEQ ID NO: 171917 - RNA, 64 nt, hsa; identical to SEQ ID NO: 72522

SEQ ID NO: 171918 - RNA, 64 nt, hsa; identical to SEQ ID NO: 72523

SEQ ID NO: 171919 - RNA, 64 nt, hsa; identical to SEQ ID NO: 72524

SEQ ID NO: 171920 - RNA, 64 nt, hsa; identical to SEQ ID NO: 72525

SEQ ID NO: 171921 - RNA, 64 nt, hsa; identical to SEQ ID NO: 72526

SEQ ID NO: 171922 - RNA, 64 nt, hsa; identical to SEQ ID NO: 72527

SEQ ID NO: 171923 - RNA, 64 nt, hsa; identical to SEQ ID NO: 72528

SEQ ID NO: 171924 - RNA, 64 nt, hsa; identical to SEQ ID NO: 72529

SEQ ID NO: 171925 - RNA, 64 nt, hsa; identical to SEQ ID NO: 72530

SEQ ID NO: 171926 - RNA, 64 nt, hsa; identical to SEQ ID NO: 72531

SEQ ID NO: 171927 - RNA, 64 nt, hsa; identical to SEQ ID NO: 72532

SEQ ID NO: 171928 - RNA, 64 nt, hsa; identical to SEQ ID NO: 72533

SEQ ID NO: 171929 - RNA, 64 nt, hsa; identical to SEQ ID NO: 72534

SEQ ID NO: 171930 - RNA, 64 nt, hsa; identical to SEQ ID NO: 72535

SEQ ID NO: 171931 - RNA, 64 nt, hsa; identical to SEQ ID NO: 72536

SEQ ID NO: 171932 - RNA, 64 nt, hsa; identical to SEQ ID NO: 72537

SEQ ID NO: 171933 - RNA, 64 nt, hsa; identical to SEQ ID NO: 72538

SEQ ID NO: 171934 - RNA, 64 nt, hsa; identical to SEQ ID NO: 72539

SEQ ID NO: 171935 - RNA, 64 nt, hsa; identical to SEQ ID NO: 72540

SEQ ID NO: 171936 - RNA, 64 nt, hsa; identical to SEQ ID NO: 72541

SEQ ID NO: 171937 - RNA, 64 nt, hsa; identical to SEQ ID NO: 72542

SEQ ID NO: 171938 - RNA, 64 nt, hsa; identical to SEQ ID NO: 72543

SEQ ID NO: 171939 - RNA, 64 nt, hsa; identical to SEQ ID NO: 72544

SEQ ID NO: 171940 - RNA, 64 nt, hsa; identical to SEQ ID NO: 72545

SEQ ID NO: 171941 - RNA, 64 nt, hsa; identical to SEQ ID NO: 72546

SEQ ID NO: 171942 - RNA, 64 nt, hsa; identical to SEQ ID NO: 72547

SEQ ID NO: 171943 - RNA, 64 nt, hsa; identical to SEQ ID NO: 72548

SEQ ID NO: 171944 - RNA, 64 nt, hsa; identical to SEQ ID NO: 72549

SEQ ID NO: 171945 - RNA, 64 nt, hsa; identical to SEQ ID NO: 72550

SEQ ID NO: 171946 - RNA, 64 nt, hsa; identical to SEQ ID NO: 72551

SEQ ID NO: 171947 - RNA, 64 nt, hsa; identical to SEQ ID NO: 72552

SEQ ID NO: 171948 - RNA, 64 nt, hsa; identical to SEQ ID NO: 72553

SEQ ID NO: 171949 - RNA, 64 nt, hsa; identical to SEQ ID NO: 72554

SEQ ID NO: 171950 - RNA, 64 nt, hsa; identical to SEQ ID NO: 72555

SEQ ID NO: 171951 - RNA, 64 nt, hsa; identical to SEQ ID NO: 72556

SEQ ID NO: 171952 - RNA, 64 nt, hsa; identical to SEQ ID NO: 72557

SEQ ID NO: 171953 - RNA, 64 nt, hsa; identical to SEQ ID NO: 72558

SEQ ID NO: 171954 - RNA, 64 nt, hsa; identical to SEQ ID NO: 72559

SEQ ID NO: 171955 - RNA, 64 nt, hsa; identical to SEQ ID NO: 72560

SEQ ID NO: 171956 - RNA, 64 nt, hsa; identical to SEQ ID NO: 72561

SEQ ID NO: 171957 - RNA, 64 nt, hsa; identical to SEQ ID NO: 72562

SEQ ID NO: 171958 - RNA, 64 nt, hsa; identical to SEQ ID NO: 72563

SEQ ID NO: 171959 - RNA, 64 nt, hsa; identical to SEQ ID NO: 72564

SEQ ID NO: 171960 - RNA, 64 nt, hsa; identical to SEQ ID NO: 72565

SEQ ID NO: 171961 - RNA, 64 nt, hsa; identical to SEQ ID NO: 72566

SEQ ID NO: 171962 - RNA, 64 nt, hsa; identical to SEQ ID NO: 72567

SEQ ID NO: 171963 - RNA, 64 nt, hsa; identical to SEQ ID NO: 72568

SEQ ID NO: 171964 - RNA, 64 nt, hsa; identical to SEQ ID NO: 72569

SEQ ID NO: 171965 - RNA, 64 nt, hsa; identical to SEQ ID NO: 72570

SEQ ID NO: 171966 - RNA, 64 nt, hsa; identical to SEQ ID NO: 72571

SEQ ID NO: 171967 - RNA, 64 nt, hsa; identical to SEQ ID NO: 72572

SEQ ID NO: 171968 - RNA, 64 nt, hsa; identical to SEQ ID NO: 72573

SEQ ID NO: 171969 - RNA, 64 nt, hsa; identical to SEQ ID NO: 72574

SEQ ID NO: 171970 - RNA, 64 nt, hsa; identical to SEQ ID NO: 72575

SEQ ID NO: 171971 - RNA, 64 nt, hsa; identical to SEQ ID NO: 72576

SEQ ID NO: 171972 - RNA, 64 nt, hsa; identical to SEQ ID NO: 72577

SEQ ID NO: 171973 - RNA, 64 nt, hsa; identical to SEQ ID NO: 72578

SEQ ID NO: 171974 - RNA, 64 nt, hsa; identical to SEQ ID NO: 72579

SEQ ID NO: 171975 - RNA, 64 nt, hsa; identical to SEQ ID NO: 72580

SEQ ID NO: 171976 - RNA, 64 nt, hsa; identical to SEQ ID NO: 72581

SEQ ID NO: 171977 - RNA, 64 nt, hsa; identical to SEQ ID NO: 72582

SEQ ID NO: 171978 - RNA, 64 nt, hsa; identical to SEQ ID NO: 72583

SEQ ID NO: 171979 - RNA, 64 nt, hsa; identical to SEQ ID NO: 72584

SEQ ID NO: 171980 - RNA, 64 nt, hsa; identical to SEQ ID NO: 72585

SEQ ID NO: 171981 - RNA, 64 nt, hsa; identical to SEQ ID NO: 72586

SEQ ID NO: 171982 - RNA, 64 nt, hsa; identical to SEQ ID NO: 72587

SEQ ID NO: 171983 - RNA, 64 nt, hsa; identical to SEQ ID NO: 72588

SEQ ID NO: 171984 - RNA, 64 nt, hsa; identical to SEQ ID NO: 72589

SEQ ID NO: 171985 - RNA, 64 nt, hsa; identical to SEQ ID NO: 72590

SEQ ID NO: 171986 - RNA, 64 nt, hsa; identical to SEQ ID NO: 72591

SEQ ID NO: 171987 - RNA, 64 nt, hsa; identical to SEQ ID NO: 72592

SEQ ID NO: 171988 - RNA, 64 nt, hsa; identical to SEQ ID NO: 72593

SEQ ID NO: 171989 - RNA, 64 nt, hsa; identical to SEQ ID NO: 72594

SEQ ID NO: 171990 - RNA, 64 nt, hsa; identical to SEQ ID NO: 72595

SEQ ID NO: 171991 - RNA, 64 nt, hsa; identical to SEQ ID NO: 72596

SEQ ID NO: 171992 - RNA, 64 nt, hsa; identical to SEQ ID NO: 72597

SEQ ID NO: 171993 - RNA, 64 nt, hsa; identical to SEQ ID NO: 72598

SEQ ID NO: 171994 - RNA, 64 nt, hsa; identical to SEQ ID NO: 72599

SEQ ID NO: 171995 - RNA, 64 nt, hsa; identical to SEQ ID NO: 72600

SEQ ID NO: 171996 - RNA, 64 nt, hsa; identical to SEQ ID NO: 72601

SEQ ID NO: 171997 - RNA, 64 nt, hsa
ucagacguccugggauugaaagaaugugugugaagggguagaauuugugcgguaaagacuuaaa

SEQ ID NO: 171998 - RNA, 64 nt, hsa
aagugaggaaacaggaagaaguauggugggggcugggguagacuccccuggagccaagccuauc

SEQ ID NO: 171999 - RNA, 64 nt, hsa
gaggguagaaaguaagaagcacuuuugaauuugugggguagaacuucaacaauaagucaguucu

SEQ ID NO: 172000 - RNA, 64 nt, hsa
uuagcagauuggaugggcagguggagaaugccuggggguagaaauguuagaucuugcaacauca

SEQ ID NO: 172001 - RNA, 64 nt, hsa
agcuucaaucaggguucccacuacccccucuuuggggguagaguggcucauggaacucagagaa

SEQ ID NO: 172002 - RNA, 64 nt, hsa
uuagaaaggcaagggaagauuagaguccugcuuugggguagaugaaaggaaaggagagagauuc

SEQ ID NO: 172003 - RNA, 64 nt, hsa
gagcuccugauagcaggcgucuuugagccuagcugggguagaggcacugcccaucucuucucca

SEQ ID NO: 172004 - RNA, 64 nt, hsa
aagucugauggaaagaaaaagauaaaccauccgugggguagaugcaauaagcccacguauuuuu

SEQ ID NO: 172005 - RNA, 64 nt, hsa
accacaccucuacggcuggggagaucaggcccagccccauaaaggagaaucuacgcugguccuc

SEQ ID NO: 172006 - RNA, 64 nt, hsa
caggacaggcaggagagauucuuccuaaagccucccccauaaaaagggagcuguggauccacuu

SEQ ID NO: 172007 - RNA, 64 nt, hsa
uaucugcaugauagcuuuauucucaguuaucuuuccccauaauaaaaaauaucugccaccuucu

SEQ ID NO: 172008 - RNA, 64 nt, hsa
cuacucucuguucuugucccugccaacccccaccccccauaaucugacucacaacuucaccauc

SEQ ID NO: 172009 - RNA, 64 nt, hsa
acuucacuccucauuugcccaaugggcucaaguaccccauaagauuuaccagccaucagcucua

SEQ ID NO: 172010 - RNA, 64 nt, hsa
auuuucauauuuauaaaggagucuuaauguucugccccauaagacuuucaaccuugugguuggg

SEQ ID NO: 172011 - RNA, 64 nt, hsa
agcugagcaccucccauccugcucacacguccuuccccauaacuauggaaauggcccuaauuuc

SEQ ID NO: 172012 - RNA, 64 nt, hsa
ggcagccugcagcuguguccaggcccaggccccaccccauaacagguggccucagccacacagu

SEQ ID NO: 172013 - RNA, 64 nt, hsa
uuagcugguaaaugaauuugaaucgacauaguagccccauaagcaucagcccuguagagugagg

SEQ ID NO: 172014 - RNA, 64 nt, hsa
uuuaaaauuaacacacacaugaacugcacaccuuccccauaaaauuuggagguggggugggaga

SEQ ID NO: 172015 - RNA, 64 nt, hsa
uggugguagauggaaggaucccuggauguuccaaccccauaaaucucacggcucuuaaguucuu

SEQ ID NO: 172016 - RNA, 64 nt, hsa
gagggaaaggacauuugagggaaacaucaaauuuccccauaaauaaaugaauggaguuugcagg

SEQ ID NO: 172017 - RNA, 64 nt, hsa
aaugguccugacauaauaaggaucuuugauuaacccccauaaggcauguguguguauacaaaua

SEQ ID NO: 172018 - RNA, 64 nt, hsa
cucacuucaggagcuuuuaaaaauacugagacccccccauaaccagagauucagauucaaagac

SEQ ID NO: 172019 - RNA, 64 nt, hsa
cuuguaaaaauuaaaaguuaugguacuauguuagccccauaauuuuuuuuuuccuuuuaaaaca

SEQ ID NO: 172020 - RNA, 64 nt, hsa
acaugcaugcugcuaaacuagaacuuuaauuuuuccccauaacuuuuauaagucccauuuauaa

SEQ ID NO: 172021 - RNA, 64 nt, hsa
ucugucaucuccagagauaaucuggcuugguuuaccccauaaucuaauuucagaaaagaaagcu

SEQ ID NO: 172022 - RNA, 64 nt, hsa
accauauaaccuucgauugugcuucucaacuccaccccauaauuucucccagagaccaucuauc

SEQ ID NO: 172023 - RNA, 64 nt, hsa
uugggaucaggagcccccaacacaggcaaguccaccccauaauaacccugccagugccagggug

SEQ ID NO: 172024 - RNA, 64 nt, hsa
cacuaauacuacuguaccuuucauuggcgcauuaccccauaaaacuuuuugagacgaggugaga

SEQ ID NO: 172025 - RNA, 64 nt, hsa
guaagagcuuugaauuugaagugaguuuuuuuccccccauaaguuauuuauuccuuuuuucugu

SEQ ID NO: 172026 - RNA, 64 nt, hsa
aguggauuuaaaauauauauauacguaacccaagccccauaaccccuaacuggacaaaugaggu

SEQ ID NO: 172027 - RNA, 64 nt, hsa
gaugcaaauucugguaauaauucuugcauuuuuuccccauaaccugguuaaaauaaauacgcca

SEQ ID NO: 172028 - RNA, 64 nt, hsa
ggucauuuguauucagaguaaaucagugguccacccccauaaaacuguaagacaagccuccugu

SEQ ID NO: 172029 - RNA, 64 nt, hsa
cuuuuccugucccucuuccauccccaagaugugaccccauaaaaauuuuuccugaguuggccag

SEQ ID NO: 172030 - RNA, 64 nt, hsa
cucugguaagcuuucaucucccaugaacucauuuccccauaaaugaaauggguaaauaaugccc

SEQ ID NO: 172031 - RNA, 64 nt, hsa
uggcucuucccucccucacuuuuacuuucccuucccccauaaguuggaggauaaaauggguauc

SEQ ID NO: 172032 - RNA, 64 nt, hsa
aaccucaaaguggauucacuuucugauaguuaacccccauaaaugugcacguaccugugucuua

SEQ ID NO: 172033 - RNA, 64 nt, hsa
ucugagggagagacagugagcugcaagacugccuccccauaacaacaggcaacucagagaagag

SEQ ID NO: 172034 - RNA, 64 nt, hsa
agacuuaguauauuuucuuuuccucugucccuucccccauaagccuccauuuaguucuuuguua

SEQ ID NO: 172035 - RNA, 64 nt, hsa
ugagguaccuuuccacccagacccuccuuccccaccccauaagcccugagacucccgccuuuga

SEQ ID NO: 172036 - RNA, 64 nt, hsa
ccauaucugcaauguguaccaaaguuauaucaugccccauaaugcuacugucaaguguuacaac

SEQ ID NO: 172037 - RNA, 64 nt, hsa
gcccacacaggguccguugcuggcaacuggacuuccccauaagccuuggguauccugugauggg

SEQ ID NO: 172038 - RNA, 64 nt, hsa
cacauugcaugccuauaucaaaacaucucauguaccccauaaauauauacaccuaauacccaca

SEQ ID NO: 172039 - RNA, 64 nt, hsa
ugaguauuugcuaauguugauugaaccucccuuuccccauaaugugggcagauuuggcucagcu

SEQ ID NO: 172040 - RNA, 64 nt, hsa
aauaaggguuaacauucuaggcaguauaaacacaccccauaaugcaaguaauagguaaucuaga

SEQ ID NO: 172041 - RNA, 64 nt, hsa
uaugaacacuuuauaauuguauguucuuuuuagaccccauaaauccuguauacaucaaagagaa

SEQ ID NO: 172042 - RNA, 64 nt, hsa
cugguuugcgggagauuuccuccccucagucaacccccauaaccuggggauugggcagugugga

SEQ ID NO: 172043 - RNA, 64 nt, hsa
accuuuuaaacuuuucacuuugugagcaaaguaaccccauaaguuuauuucccuauuucauggu

SEQ ID NO: 172044 - RNA, 64 nt, hsa
gacauucuauuuauuuucgcaguaauucucauguccccauaagcagagcugucacagugugcac

SEQ ID NO: 172045 - RNA, 64 nt, hsa
agaauuggaagccugcuuaaaaaauguaguugagccccauaauuuuacaaaugggcgaacuuuu

SEQ ID NO: 172046 - RNA, 64 nt, hsa
ccaaacucauccuuguguauagucucacacccuuccccauaaguauaaaugggcccauauuuaa

SEQ ID NO: 172047 - RNA, 64 nt, hsa
guuggggugcuuguauauguaucuuccucaauuuccccauaaaugagguaucuuuuugucacac

SEQ ID NO: 172048 - RNA, 64 nt, hsa
gcauuuuucuacaagaagcagucagccuucucucccccauaaggacuggcuguaaccuuaagcc

SEQ ID NO: 172049 - RNA, 64 nt, hsa
gcuggcacuuuacucauugcacuugaguuuauugccccauaacuaaaggaucaggaugauggua

SEQ ID NO: 172050 - RNA, 64 nt, hsa
gaauuaccauuuguuaauaucacucauuaauuaaccccauaauuagauccauuaauuuaaauga

SEQ ID NO: 172051 - RNA, 64 nt, hsa
aguaauauuuuguauaaaacauagcaguuuagguccccauaauccucaaaaauagucacaaaua

SEQ ID NO: 172052 - RNA, 64 nt, hsa
aaguggaaaauuucaggauacaaagcacauaacaccccauaagagaugauuauguuuuuagaag

SEQ ID NO: 172053 - RNA, 64 nt, hsa
gaugcgcaggauuuaggauaagcugucacccaguccccauaacaaaaccacuguccaacacugg

SEQ ID NO: 172054 - RNA, 64 nt, hsa
cugagaacaaaccucaagacuaucagugugaccuccccauaacaagagaaccccauauauaguu

SEQ ID NO: 172055 - RNA, 64 nt, hsa
aguauaacagauauucuaauucuucuuaauauucccccauaaugccagaaauuggcuuaaugau

SEQ ID NO: 172056 - RNA, 64 nt, hsa
ccagaaaggacagaaucucucccccacucccuugccccauaaccaaacauaagcuagcuagucu

SEQ ID NO: 172057 - RNA, 64 nt, hsa
cccggccaccacgcauggcaugcugugcuuggcuccccauaagacguccucuuugggugcacgg

SEQ ID NO: 172058 - RNA, 64 nt, hsa
aucuuugcuugcagcccuccguccugcugaaaacccccauaagccagugaacacagagcagcua

SEQ ID NO: 172059 - RNA, 64 nt, hsa
augugauuuugggguacuaaagcacaaaaaaaucccccauaaaauaaaccuuccugaaaagacu

SEQ ID NO: 172060 - RNA, 64 nt, hsa
uacacauagcuuuaaugaggagccugucauguuuccccauaaauuuauugccugagaacuuagu

SEQ ID NO: 172061 - RNA, 64 nt, hsa
uuuggaaacauuuaggaauauuuuucucccccuaccccauaaauuguguagcacuuuuuauucc

SEQ ID NO: 172062 - RNA, 64 nt, hsa
agaggcaaaguggaccuggcaaccacaagacccuccccauaagcaggggaccagcauacccggg

SEQ ID NO: 172063 - RNA, 64 nt, hsa
uaauuuagugauucugugagucacugugugcauaccccauaaccuuuccuugggauugccccua

SEQ ID NO: 172064 - RNA, 64 nt, hsa
caucgguuugaccccugaccuauaagccaagauaccccauaaacacacucagaaagcagagaaa

SEQ ID NO: 172065 - RNA, 64 nt, hsa
ccccauggccccucuccacaccucaaaacuccugccccauaacguccuccgcauccacuuucca

SEQ ID NO: 172066 - RNA, 64 nt, hsa
agugcgcucauuuuaggccuccucucugccaccaccccauaaucucauucaaagaauacuagaa

SEQ ID NO: 172067 - RNA, 64 nt, hsa
agccacuucauuccccugaugggcccugacucuuccccauaaucacugaccagccuugacacuc

SEQ ID NO: 172068 - RNA, 64 nt, hsa
uccaauuaucuucuaggauugaaaggugcauuuuccccauaaaaaaggcgaggaaaacccaugg

SEQ ID NO: 172069 - RNA, 64 nt, hsa
auauaaagauuuuaaaacugcauuaugaccuagcccccauaauugggauuuaucauuuuggagg

SEQ ID NO: 172070 - RNA, 64 nt, hsa
aauggcugcuuugaacuuacucaggaaagccagcccccauaauauuguauuaccaaacaguauc

SEQ ID NO: 172071 - RNA, 64 nt, hsa
accaaauucgcccuuuaacagcuugcucuggcaaccccauaaaugacaccugagguccguagaa

SEQ ID NO: 172072 - RNA, 64 nt, hsa
guugacuuuccucccauuuuaccacuuuaaacacccccauaacaauucccccauccuucaguga

SEQ ID NO: 172073 - RNA, 64 nt, hsa
ccugagugccucccuugccucacucugauccuggccccauaauguccucaguggaaggugaugg

SEQ ID NO: 172074 - RNA, 64 nt, hsa
accaaugccgcgguggaaacgggcuuggagcuggccccauaagggcuggcggcuuccuccgacg

SEQ ID NO: 172075 - RNA, 64 nt, hsa
ccgcuucugugugcuuguccuccuccuccucccaccccauaacuguuccuaagccuucaccgga

SEQ ID NO: 172076 - RNA, 64 nt, hsa
gaaacaugagggaggugagguguccguccacuucccccauaaaggugugcauuucaguuaggcu

SEQ ID NO: 172077 - RNA, 64 nt, hsa
agccccgccccuuucuuuccccggagucccuccaccccauaacaauaccucgaauuuccaaaag

SEQ ID NO: 172078 - RNA, 64 nt, hsa
uguagaugauauguuucguggguugaauugugucccccauaaaagauauguugaaguucuaacc

SEQ ID NO: 172079 - RNA, 64 nt, hsa
cugcacuuggugcugcuuuggcugacugggaacaccccauaacuacagagucugacaggaagac

SEQ ID NO: 172080 - RNA, 64 nt, hsa
uuuauuuguuuuucauucaucccauuaaucauuuccccauaacucaauggccuaaaacuggccu

SEQ ID NO: 172081 - RNA, 64 nt, hsa
aguugaauuguuuucugccuacaccguucaucagccccauaacccaggaaggaacaggcauugu

SEQ ID NO: 172082 - RNA, 64 nt, hsa
uacacguuagauuugccguaccaaucucugaaugccccauaauuauuauuuccaguguuuggga

SEQ ID NO: 172083 - RNA, 64 nt, hsa
caggcaaagacacccuuagcucaccuuuaauagaccccauaacccacuaugccuuccuguccuu

SEQ ID NO: 172084 - RNA, 64 nt, hsa
cuuuaaaucucuuuaaugagugaauccaugcaagccccauaaaacaguuccuagcaugcagaaa

SEQ ID NO: 172085 - RNA, 64 nt, hsa
acauguaauaaauaaaacaauaugagcauaauugccccauaaagaacucauguccugaauuaau

SEQ ID NO: 172086 - RNA, 64 nt, hsa
uauccuauuauuucugaauauauguccucaaaauccccauaaauauccaucccuuccuagaugg

SEQ ID NO: 172087 - RNA, 64 nt, hsa
uaagauccaaguuauuuuccccaacucuuguuucccccauaaaguuaggcaugaggaggagcac

SEQ ID NO: 172088 - RNA, 64 nt, hsa
ucugccauaauucugagaagaaaaugaccuauauccccauaagaacugaaacucagucuagguc

SEQ ID NO: 172089 - RNA, 64 nt, hsa
uacucugccccuaagcuggcuguaccuguuccucccccauaaaaugauccugccaaucuaaugu

SEQ ID NO: 172090 - RNA, 64 nt, hsa
cuacaacaagcucucccucaaugaggaaggaaucccccauaaccccauggucaaugcuggugcc

SEQ ID NO: 172091 - RNA, 64 nt, hsa
cugcuguauaagguaauaaaacucugcaccuaauccccauaacuuccaguaucauuuuccaauu

SEQ ID NO: 172092 - RNA, 64 nt, hsa
ggguccacgcccauguaccugaaacauuuggaagccccauaauuguucuaguuagaaaggguuc

SEQ ID NO: 172093 - RNA, 64 nt, hsa
aaauucauauuuagccauaguauaugauagauugccccauaacauaguuuuucaucaagaguuu

SEQ ID NO: 172094 - RNA, 64 nt, hsa
caccuucuaugcaugcaacaaaaugccacguguaccccauaaauauguagaaauauuauaugua

SEQ ID NO: 172095 - RNA, 64 nt, hsa
uaauucuaaauaaaccucuucccauacaccuuucccccauaagaugugucuucaacacuauaaa

SEQ ID NO: 172096 - RNA, 64 nt, hsa
uauaagcaugacauguuuacuauaaaccuuuugcccccauaauuucuuuuuuuaaaggaaauua

SEQ ID NO: 172097 - RNA, 64 nt, hsa
gcagaggaugagaggaagguguuaguuccaucagccccauaaaauuaugaaccuuuuugcaacu

SEQ ID NO: 172098 - RNA, 64 nt, hsa
aaagauccccuucagcccccugccagagucacugccccauaaucaccaugucagaagggacccu

SEQ ID NO: 172099 - RNA, 64 nt, hsa
aauccauucuugacauucaguuaguccagaucugccccauaauuugcuuuaguaaagucacuuu

SEQ ID NO: 172100 - RNA, 64 nt, hsa
cagguuguuuucuacuuugccccuuucaguauguccccauaagacaaacacugccauauugugu

SEQ ID NO: 172101 - RNA, 64 nt, hsa
gccccuuggaugugaugguacacagugggugggcccccauaauaaguuccuaaagcaugggauc

SEQ ID NO: 172102 - RNA, 64 nt, hsa
cuuccuuuuccucacugaauucccagcuccccauccccauaaaugcauacacauacaugcacac

SEQ ID NO: 172103 - RNA, 64 nt, hsa
acuuugccacugacuucucccacccuucugucucccccauaauaguuuauuugguuggucugga

SEQ ID NO: 172104 - RNA, 64 nt, hsa
guguccucacccaaauuucaucucgaauuguaauccccauaauccccaugugucuagggagaga

SEQ ID NO: 172105 - RNA, 64 nt, hsa
ccagcauccuaggcucagcuuaccgggugauaggccccauaagacacacacaugagcaggguga

SEQ ID NO: 172106 - RNA, 64 nt, hsa
gguauuggcauuugaggucggaaacccucuacugccccauaagccaggaaaagugaaaagagaa

SEQ ID NO: 172107 - RNA, 64 nt, hsa
cuguaccugcaguguaguaaagguuuagacgaaaccccauaauuauaguggcauacugucacuu

SEQ ID NO: 172108 - RNA, 64 nt, hsa
ccuggacuuggggagaaugacuuucccuuuuuugccccauaagggcuagcauaagcugagguag

SEQ ID NO: 172109 - RNA, 64 nt, hsa
guccagcccugaugauuggccccaccuccugcugccccauaacccucucuucauuucggcuuuu

SEQ ID NO: 172110 - RNA, 64 nt, hsa
uaaaaugccagcaauuuaaaacuaggacuuuuccccccauaagccaaggagguagaauuacuaa

SEQ ID NO: 172111 - RNA, 64 nt, hsa
gccacggugcugugaguauuccuccguuagcuuuccccauaagguugggaguaucugcuuuugu

SEQ ID NO: 172112 - RNA, 64 nt, hsa
agauaucauccuuuucuucugccucgccugaaucccccauaaacaccagaugauugagucuacc

SEQ ID NO: 172113 - RNA, 64 nt, hsa
cccagcgauuuuuccuuggaggucagcccguuacccccauaacugauuuaccuacuuaccauac

SEQ ID NO: 172114 - RNA, 64 nt, hsa
gcugcccccccacguagccuggacaucgucuuauccccauaauccuugccaucccuacaaggcc

SEQ ID NO: 172115 - RNA, 64 nt, hsa
uccccacccccggucccccauugaggcccgccacccccauaacuuugggagcgagggcccagcc

SEQ ID NO: 172116 - RNA, 64 nt, hsa
augugagaguugugaaauuuuagugucucacuggccccauaaauuccacgcuucaggaaguugu

SEQ ID NO: 172117 - RNA, 64 nt, hsa
agucaucccccguggugucugcacaucacuccagccccauaaagagugucauguuagcugaguc

SEQ ID NO: 172118 - RNA, 64 nt, hsa
acagcggcugccugucccuucuucacccccucacccccauaauuugucuagaucuauuuccaua

SEQ ID NO: 172119 - RNA, 64 nt, hsa
ugugcuuguuagcagguuuuucuguuaguuuuucccccauaacauuuaauuauuacuaaaauug

SEQ ID NO: 172120 - RNA, 64 nt, hsa
ggaaaagcaugcuaaaaauagucuuauauuuucaccccauaaaugcagaaucaguaauuccuug

SEQ ID NO: 172121 - RNA, 64 nt, hsa
uggcucgaugauguuaacaguauuaaaaauuaaaccccauaaaccaacuaagccuuauggaauu

SEQ ID NO: 172122 - RNA, 64 nt, hsa
cacaaauuuugugaguuuaguacucuacagauugccccauaagagcaguagcuuuugaaacuca

SEQ ID NO: 172123 - RNA, 64 nt, hsa
ccacccccucggggcagaguuugcacaaagucccccccauaauacagggggagccacuugggca

SEQ ID NO: 172124 - RNA, 64 nt, hsa
uauuaccuggaggccuguccagcacccacccuacccccauaaagcauuguuuacaccugugucu

SEQ ID NO: 172125 - RNA, 64 nt, hsa
ucuuuaacccaacuuuuuauacgaugccccaguuccccauaacuuugcacacaagcuucugugu

SEQ ID NO: 172126 - RNA, 64 nt, hsa
acugaguuuauccaccgccauccaccucuauccaccccauaaggucccuacagcaagugggaca

SEQ ID NO: 172127 - RNA, 64 nt, hsa
uauucgaugagguuuccauguauuuacuuacagaccccauaauguaaaggcucuaauaauagaa

SEQ ID NO: 172128 - RNA, 64 nt, hsa
cccacuccuugggccccuaggaugacccaacuacccccauaacuuucugcuucccacagguuuu

SEQ ID NO: 172129 - RNA, 64 nt, hsa
acguuguauacauguacugcaauauugcuguccaccccauaaauauguacaauucuguauacau

SEQ ID NO: 172130 - RNA, 64 nt, hsa
ugucauucuuagcccccuacuguggcccccauagccccauaacccagagagggagcuggacuuc

SEQ ID NO: 172131 - RNA, 64 nt, hsa
aagcuagauccaaauaaaagaaaguucaguuuucccccauaacuauucuugggucaugaacuuu

SEQ ID NO: 172132 - RNA, 64 nt, hsa
uagagcuaaaauaugaucuuuuuuaauuucucaaccccauaauuugagccauugccuugcuuaa

SEQ ID NO: 172133 - RNA, 64 nt, hsa
gcagcagcuagaaagagaaaaagcccucuucaauccccauaaugcuucuuuccucuuaaugucu

SEQ ID NO: 172134 - RNA, 64 nt, hsa
guguccccuccccuccaucucucuuccccauagaccccauaaccccagaccaaagagguucucu

SEQ ID NO: 172135 - RNA, 64 nt, hsa
ggucugagggcccuaggucauggagagccucaguccccauaaugaggacaggguaccaugccca

SEQ ID NO: 172136 - RNA, 64 nt, hsa
gcuccuugaguuuucaagaugaaauaaggagaaaccccauaacuuuuuagcucucuuuuaaaaa

SEQ ID NO: 172137 - RNA, 64 nt, hsa
uaauguuuuuaaggaugguugugaaucccccuggccccauaauaaauuguaauuuuauacugcu

SEQ ID NO: 172138 - RNA, 64 nt, hsa
cuccagcugggcucggucccccacagucagggacccccauaaaggacacccccuucucucuaga

SEQ ID NO: 172139 - RNA, 64 nt, hsa
guuuagggauaaauguuucuggaacccuguggucccccauaauguugauagaauaucauaugca

SEQ ID NO: 172140 - RNA, 64 nt, hsa
uugucaugaggagaacugaccagcccucaucauuccccauaaaaccacggacagcgucugugug

SEQ ID NO: 172141 - RNA, 64 nt, hsa
cacucauccaccugcccuccaccaggagugggcaccccauaaggguuuaggccacuuugcagag

SEQ ID NO: 172142 - RNA, 64 nt, hsa
uuucacccugcuggucccaggucggcacacacauccccauaauggcauuucuccuuucugugca

SEQ ID NO: 172143 - RNA, 64 nt, hsa
agagcuuucacacagugagaaauagagcaggcugccccauaaauggguaacauauuccuaaucu

SEQ ID NO: 172144 - RNA, 64 nt, hsa
agcacuacaacuuaauugcucuaugccucaguuuccccauaauacccuuuuccaaccuaccuca

SEQ ID NO: 172145 - RNA, 64 nt, hsa
auuguggggcagaggccucucugcucuuguuuaaccccauaaagaaauaaaugguaagacuuga

SEQ ID NO: 172146 - RNA, 64 nt, hsa
auagcaggcacugucacagaguaauggcauuaauccccauaauaauccugugaaggugauauuc

SEQ ID NO: 172147 - RNA, 64 nt, hsa
uccagucuuaaaucucuccgcuaaaguggacauuccccauaaaaauuguccagcugccuggcuc

SEQ ID NO: 172148 - RNA, 64 nt, hsa
auauucaaauuauagaacauguuuuuucccuuugccccauaaucaguauuugccaaauuacaug

SEQ ID NO: 172149 - RNA, 64 nt, hsa
gcugggcuggaagguuccauaacuggccagcugcccccauaacuggcagcauucccagacccag

SEQ ID NO: 172150 - RNA, 64 nt, hsa
accacacaauaggaucccccuucuugcccuccacccccauaagauugugaaggguuuacugcuc

SEQ ID NO: 172151 - RNA, 64 nt, hsa
uccaauguuaaaugccucuacuaaaguggggauuccccauaaaaauuguccagcuaccugacuc

SEQ ID NO: 172152 - RNA, 64 nt, hsa
acagcuggcccuacuuuccucccucugcugcuuggucccucaccuugaugauguggcuucgccc

SEQ ID NO: 172153 - RNA, 64 nt, hsa
aggguggcagagccugcuuagccaggaggccgaggucccucaguccuccccugucccuuccaag

SEQ ID NO: 172154 - RNA, 64 nt, hsa
ugcuguauggagaaauucuucaaggggagucagggucccucaggcuucccuugugucucccugg

SEQ ID NO: 172155 - RNA, 64 nt, hsa
cugcuaguaucuauuuuacaaaaugcagagccaggucccucagcccagacucagucagacaugu

SEQ ID NO: 172156 - RNA, 64 nt, hsa
aguugcuauuuaggaugaguuaagugccuggggagucccucaaaagguuaaagggauucccauc

SEQ ID NO: 172157 - RNA, 64 nt, hsa
aauuaaauacuuuuuucccuuuauuacuguuguagucccucacuuggauauaccucuguuuuca

SEQ ID NO: 172158 - RNA, 64 nt, hsa
cugaugugagcaauuuacacacuugucucagaaagucccucaggguuuguagaggacugcaggg

SEQ ID NO: 172159 - RNA, 64 nt, hsa
gagcugggcgugaggugcuugggguccauucuuugucccucagcuucucagaguccggccagcc

SEQ ID NO: 172160 - RNA, 64 nt, hsa
cgauaggagccacaacuuggggugggaagaacuugucccucaggcuuguugcccucugcaguug

SEQ ID NO: 172161 - RNA, 64 nt, hsa
ggcugcaggaacuaggcacaagcucucugagccagucccucagccacugaagucccccuuucuc

SEQ ID NO: 172162 - RNA, 64 nt, hsa
ccugcuagaggcaugucuccuugcgugucuaaaggucccucauccuguuuguuuuaggaauccu

SEQ ID NO: 172163 - RNA, 64 nt, hsa
aaggugcugaacccucagcaggagggcaguuugagucccucaccuuugacauggaguugaccuc

SEQ ID NO: 172164 - RNA, 64 nt, hsa
aauccagccccggagaagcaagugaaaagggugggucccucauaggcuagaaugugcagcucuu

SEQ ID NO: 172165 - RNA, 64 nt, hsa
guguggaaguguaaggccuaagaugcucacagaggucccucaugaccucccuuccccaacuccc

SEQ ID NO: 172166 - RNA, 62 nt, hsa
ccagcucauuucaacaaaggagcuccgaugugaggggcaaggcugcccccugccccagggcu

SEQ ID NO: 172167 - RNA, 62 nt, hsa
ggcaagguugggacaaagccaucugggcagucaggggcaaggacuguuggaggagaguuagc

SEQ ID NO: 172168 - RNA, 62 nt, hsa
uggaugaaguuaucuggcuucaaauauuaugcaggggcaaacaccugcugauguggcaacug

SEQ ID NO: 172169 - RNA, 62 nt, hsa
ccuagccaaguuuaagaggcaaguaaaaauauaggggcaaugucagaugaagucuuguucag

SEQ ID NO: 172170 - RNA, 62 nt, hsa
uuugagcagaggacccuccaacuuauggcaucaggggcaaaaagucacagcuuaucccaggc

SEQ ID NO: 172171 - RNA, 62 nt, hsa
ccugcagccucauauggcucaauaaaacagaaaggggcaaguauagaagauuaggaugacua

SEQ ID NO: 172172 - RNA, 62 nt, hsa
gggacuuugggggcagugagagagagcuggaaaggggcaacccugagcagcaggugugcccc

SEQ ID NO: 172173 - RNA, 62 nt, hsa
aaacuguucuucugguuccugcacaaccucagaggggcaaaaacccuccccaggaaggagga

SEQ ID NO: 172174 - RNA, 62 nt, hsa
uuggggauccaggugucagagguaggggaaccaggggcaagcuggggcugagcuggaggugg

SEQ ID NO: 172175 - RNA, 62 nt, hsa
gccgcuugggggagggaagaggcagcccggcgaggggcaagcgggggacccagccgggcugg

SEQ ID NO: 172176 - RNA, 62 nt, hsa
gcucugagcccaucuguucucccccugcaagaaggggcaaugcucuuguguugucccucugu

SEQ ID NO: 172177 - RNA, 62 nt, hsa
ccagagcgaaugagggcagagaugcccggggcaggggcaaacgcccuccgcucccucugcuc

SEQ ID NO: 172178 - RNA, 62 nt, hsa
gcugcuugucaagaagcauuucccggcaagagaggggcaagucuggggcuccaacuggguac

SEQ ID NO: 172179 - RNA, 62 nt, hsa
auguccugggcuccuucaggagcucucuacccaggggcaaggagagcccagagagaagcgcc

SEQ ID NO: 172180 - RNA, 62 nt, hsa
uccggcugugucugguggucuggcugcggggaaggggcaagaaggcgggcaggccuucacug

SEQ ID NO: 172181 - RNA, 62 nt, hsa
ggagcugaugaagcaggugccagggcugugggaggggcaagcuacggccugggcuaggugag

SEQ ID NO: 172182 - RNA, 62 nt, hsa
gggaagaagccaggaaaaccucugaguguugaaggggcaacccaaggcaucacaguucacag

SEQ ID NO: 172183 - RNA, 62 nt, hsa
ucuugccuugaggcucugcaguggcaaaugguaggggcaauagcgcucccuuuucaccugaa

SEQ ID NO: 172184 - RNA, 64 nt, hsa
agaugagaaaacccaacagauccaucccuugagcuguaaacacucagaacuccuuucauaucaa

SEQ ID NO: 172185 - RNA, 64 nt, hsa
uuuaaaaaagguagcauuuuguugacaguuauuuuguaaacauaagcaaauaagggcuuggagg

SEQ ID NO: 172186 - RNA, 64 nt, hsa
aaauguguguguugcuaauuuuuuccauaagaauuguaaacauugaacugaacaaauuaccuau

SEQ ID NO: 172187 - RNA, 64 nt, hsa
agcugcauaauaguauuuauuaaagaaucacaacuguaaacaugagaauaauuuaaggauucua

SEQ ID NO: 172188 - RNA, 64 nt, hsa
aguuaugaaaaguugaaggcuucuaagggaauacuguaaacaugacccacuuauauuuaucaca

SEQ ID NO: 172189 - RNA, 64 nt, hsa
aucccuucauguccuuuaaguaugcuccucaauguguaaacaggaacaacuuuaugauuugaaa

SEQ ID NO: 172190 - RNA, 64 nt, hsa
ucguuucaacucuuaaagacaucuuaauccugaauguaaacaauuguuauguguuuagaaucag

SEQ ID NO: 172191 - RNA, 64 nt, hsa
agccuccgauuugugaugcaguguuuguaguccuuguaaacaauauauacagacuauacaagaa

SEQ ID NO: 172192 - RNA, 64 nt, hsa
guguacaggucuuucuguagggaaaauuauuccauguaaacauuucaacucuguaugaaaaugu

SEQ ID NO: 172193 - RNA, 64 nt, hsa
aaauaagaauggaaauacaagggaaaaccugcguuguaaacaugaggauuugggaacagaucua

SEQ ID NO: 172194 - RNA, 64 nt, hsa
cuuuauaugagcugucccaccagcaacuuauauauguaaacauacauauauacacauaugcaug

SEQ ID NO: 172195 - RNA, 64 nt, hsa
uaaacauacauauauacacauaugcauguguguguguaaacauaaaaguccuuuauuauuaaaa

SEQ ID NO: 172196 - RNA, 64 nt, hsa
aucccaaaauaauggaaaauguccaguuguguuuuguaaacaccuauguaacucaucuuuuagu

SEQ ID NO: 172197 - RNA, 64 nt, hsa
acuucuuugcaguucauuauaguaaggcuuaaccuguaaacaguaucugauggcccaccuauaa

SEQ ID NO: 172198 - RNA, 64 nt, hsa
auuucaguuguuuguaauaaguagaauacacuacuguaaacauacgaccuuuguuuuugucuua

SEQ ID NO: 172199 - RNA, 64 nt, hsa
ugccuuacuguauccugugucauguccaaucaguuguaaacaauggcaucuuugaacaguguga

SEQ ID NO: 172200 - RNA, 64 nt, hsa
ccucagcuacuacucacauucauuuaaugguuucuguaaacauuuuuaagacaguugggauguc

SEQ ID NO: 172201 - RNA, 64 nt, hsa
aaucauugaugcuugaaugauagaauuuuaguacuguaaacaggcuuuagucauuaaugugaga

SEQ ID NO: 172202 - RNA, 64 nt, hsa
gggaaaugcugaauuaaagugaauuguugacaaauguaaacauuuucagaaauauucaugaagc

SEQ ID NO: 172203 - RNA, 64 nt, hsa
aaaaaaaaaaaaaaaaaaaaggaaagaacugucauguaaacauaccaacauguuuaaaccugac

SEQ ID NO: 172204 - RNA, 64 nt, hsa
gcaaauuugacugugacuuuaaucuaaauuacuauguaaacaaaaaguagauaguuucacuuuu

SEQ ID NO: 172205 - RNA, 64 nt, hsa
cacuuaaagaauucccucauucauuaccuuacaguguaaacaggagucuaauuuguaucaauac

SEQ ID NO: 172206 - RNA, 64 nt, hsa
auucauguguacaccacaaaugaguucccagacguguaaacacacgugcacacaucguacacau

SEQ ID NO: 172207 - RNA, 64 nt, hsa
acacacguguacaccacaaacgagcucccagacauguaaacacacgucucccacacgugagcuc

SEQ ID NO: 172208 - RNA, 64 nt, hsa
acaucuggugaccaggcugcuucauucaacacuguguaaacaccaaagccuuaacuuagcaaac

SEQ ID NO: 172209 - RNA, 64 nt, hsa
uuuuucaaugaaguacaauaaugugaacugcauguguaaacagcaucacauuauuaccaccucu

SEQ ID NO: 172210 - RNA, 64 nt, hsa
cuguccagugaaaaggugccacaaugcccaguauuguaaacaacagguuugcauucaugaagcu

SEQ ID NO: 172211 - RNA, 64 nt, hsa
uuugauauucacuuuaauaauuagaaauggaucuuguaaacagggcauauaucaaagaugaccu

SEQ ID NO: 172212 - RNA, 64 nt, hsa
cugucaaguuguaaagauugagagggcaaacagauguaaacaucacuuguaggugauuaaaaag

SEQ ID NO: 172213 - RNA, 64 nt, hsa
gaaaaugacaggacugggcaaauuaacaaauguuuguaaacaugaauguucaggaacuacugau

SEQ ID NO: 172214 - RNA, 64 nt, hsa
ucuguccugugaaagacucaaugagcuguuauguuguaaacaggaagcauuucacauccaaacg

SEQ ID NO: 172215 - RNA, 64 nt, hsa
acaggaagcauuucacauccaaacgagaaaaucauguaaacaugugucuuuucuguagagcaua

SEQ ID NO: 172216 - RNA, 64 nt, hsa
cacagccauaagacaggacuggaccagaugcuccuguaaacauccaggggugugccaggcccac

SEQ ID NO: 172217 - RNA, 64 nt, hsa
uuuucucugaauugaagggaaagccaaugguguuuguaaacaaaugcuucugagagcaaagaaa

SEQ ID NO: 172218 - RNA, 64 nt, hsa
ucacacucaugugacaugaccaaagaugauacucuguaaacaaggcccuucugaccggacucag

SEQ ID NO: 172219 - RNA, 64 nt, hsa
cacaaauaacccuccauuuuucaauaucugcuacuguaaacaugaauauugaauacugacaaga

SEQ ID NO: 172220 - RNA, 64 nt, hsa
auaagucuuagaggcgagugaggaauaaaauggauguaaacauuuacaugggaugcauuagaau

SEQ ID NO: 172221 - RNA, 64 nt, hsa
uuaccaagaacuggucagaccuugcgaguuuauuuguaaacacuggacagauggaguuaaaaag

SEQ ID NO: 172222 - RNA, 64 nt, hsa
gcaacucauuuauuucauuuuggucuuaaugcuuuguaaacaggucaaaaaauacugucauacu

SEQ ID NO: 172223 - RNA, 64 nt, hsa
cuugcguugacaaaggaggaggaaacgauuacucuguaaacaaaguuauccuuacuugggagau

SEQ ID NO: 172224 - RNA, 64 nt, hsa
aaaaugaguaaaaucuauuugaagguaucuuguuuguaaacauuugucagauucuaauuuuuuu

SEQ ID NO: 172225 - RNA, 64 nt, hsa
gguuuguuuguuucuuccacguaaggaaaaguaguguaaacaguagcgagaaaauggaaaccac

SEQ ID NO: 172226 - RNA, 64 nt, hsa
acacuuuuaauguauauguuuguuauaauguccauguaaacaugcccuauguuugugccuuuua

SEQ ID NO: 172227 - RNA, 64 nt, hsa
cauuacuauuucuaaucccaaggaaucacuuuauuguaaacacuagcagaacucuucucccuau

SEQ ID NO: 172228 - RNA, 64 nt, hsa
auauuguguggcugaucugaagucagucggaauuuguaaacaggguagcaaacaagauauuuuu

SEQ ID NO: 172229 - RNA, 64 nt, hsa
uugcauaagauuuaacagcauuuuuuauaaugaauguaaacauuuuaacuuaaugguacuuaaa

SEQ ID NO: 172230 - RNA, 64 nt, hsa
cuaacggauagcauuuguaaauacucuagguaucuguaaacacucugaugaagucuguauagug

SEQ ID NO: 172231 - RNA, 64 nt, hsa
ugaaagaacccacacuggagagaaaccuuaugaauguaaacagugugguaaagccuucaguagu

SEQ ID NO: 172232 - RNA, 64 nt, hsa
ugaaaggaaucacacuguacagaaacgcuaugaauguaaacaauguggaaaaaccuacauaucu

SEQ ID NO: 172233 - RNA, 64 nt, hsa
ugucagguuauauuuaauaagaaagaaaguaucauguaaacagcccaguaauaaaauuuuacaa

SEQ ID NO: 172234 - RNA, 64 nt, hsa
cgaaagaauucccacuggugagaaacaguaugaauguaaacauugugauuaagccuucaguuga

SEQ ID NO: 172235 - RNA, 64 nt, hsa
caauuuuuuuucugaacaaaagcagguuuuuauauguaaacagugagaaaagaaaggcuaaaca

SEQ ID NO: 172236 - RNA, 64 nt, hsa
uacuacacaguuugguuacaggacuucugugcauuguaaacauaaacagcauggaaaagguuaa

SEQ ID NO: 172237 - RNA, 64 nt, hsa
augauuuucuauuggucagacauugauguggagauguaaacacauguaggguuggugagaagga

SEQ ID NO: 172238 - RNA, 64 nt, hsa
uaagcuauuuaaucuugggaacugaagccagucauguaaacauacuauaccaaucuagucccua

SEQ ID NO: 172239 - RNA, 64 nt, hsa
ugaguugucaagacugaucauucuguuuuuucuguacacagaaguuuagaugcuuugugacuua

SEQ ID NO: 172240 - RNA, 64 nt, hsa
aucaaagaaaacauagcacuagcauucaggguuauacacagaaaagggagcuaaauugaauaca

SEQ ID NO: 172241 - RNA, 64 nt, hsa
cagccccuccccgccacagagacacaccauuacauacacagacacacacagaaagacacacaca

SEQ ID NO: 172242 - RNA, 64 nt, hsa
cuuccggccacagaaacacaccauuacacacacauacacagaaagacacacacagacacacaau

SEQ ID NO: 172243 - RNA, 64 nt, hsa
cacacccuccccgccacagagacacaccauuacauacacagacacgcaaucgcagauacgcccu

SEQ ID NO: 172244 - RNA, 64 nt, hsa
cacacacccuccccgccacagagacaccauuacauacacagacacacacagaaagacacagaca

SEQ ID NO: 172245 - RNA, 64 nt, hsa
cacacccccuccccaccacagagacaccauuacauacacagacacacacagaaagacacacaca

SEQ ID NO: 172246 - RNA, 64 nt, hsa
acccagaggccacccagaagcccucagauguacauacacagaugccagucagcuccugggguug

SEQ ID NO: 172247 - RNA, 64 nt, hsa
aggcugugauucugccuuuggauggauguugcuguacacagaugcuacagacuuguacuaacac

SEQ ID NO: 172248 - RNA, 64 nt, hsa
ucuuuuuuucuaaaggagagaaagacuuagaacauacacagauccuaaguagaaccagguaauu

SEQ ID NO: 172249 - RNA, 64 nt, hsa
uguuuuucucuaaaugagagaaagacuuagaauguacacagauccaaaauagaaucagauuauc

SEQ ID NO: 172250 - RNA, 64 nt, hsa
acaguccagccaguaaaaaacacuuccaaaaagauacacagaagaggaacuaaaugacugcgaa

SEQ ID NO: 172251 - RNA, 64 nt, hsa
caucaacaucuguuuuauuaccgaagacaauuaguacacagacaugaacuguucuuaaacagaa

SEQ ID NO: 172252 - RNA, 64 nt, hsa
aaacuuuauagaaguacaguauuaaagucagugguacacagacauucuguacauauccugugaa

SEQ ID NO: 172253 - RNA, 64 nt, hsa
aacugaucccgcuuuuauuaauuuuuugaagaaguacacagaauuuuuacagaauguaguauuu

SEQ ID NO: 172254 - RNA, 64 nt, hsa
aggcacugcuaaaaugauucacagggagaguggccaguuggaagaaggauccuaaggaugugac

SEQ ID NO: 172255 - RNA, 64 nt, hsa
uaggccgugaagauuuucauccucaucccacucucaguuggauuuucuggcacucuuccugcau

SEQ ID NO: 172256 - RNA, 64 nt, hsa
gcccauugauacaaggcugcugaggccuggucuccaguuggaaauauaauuaaggguggcaagg

SEQ ID NO: 172257 - RNA, 64 nt, hsa
uggaaauauaauuaaggguggcaaggacuggagucaguuggagagugcauagccagucugugaa

SEQ ID NO: 172258 - RNA, 64 nt, hsa
uuaagacauuuaggagaaccugcuguaucuaacccaguuggauuuucuuucaugcuuaacacag

SEQ ID NO: 172259 - RNA, 64 nt, hsa
cuguguacaagucauuuugugauaugauucugaacaguuggaauagaaucauaguuaaguggua

SEQ ID NO: 172260 - RNA, 64 nt, hsa
uucuaucaaagcacauaaaaccaguuauaggacacaguuggaagcagagccagucuuccuccuc

SEQ ID NO: 172261 - RNA, 64 nt, hsa
guauuauuauuugaauggaugcugcuggaggaaucaguuggaauugaagacacguucuugccag

SEQ ID NO: 172262 - RNA, 64 nt, hsa
gauggagaaguuaucaacugguguuuucagaccucaguuggaugaacccauuccacuguaugag

SEQ ID NO: 172263 - RNA, 64 nt, hsa
uggaggccacuggguaacaacagaagaaaaccuucaguuggauccuccagauagccacugccuu

SEQ ID NO: 172264 - RNA, 64 nt, hsa
uauggacagcuaaaaugugauuauuuuccaagcucaguuggaccuccagacccaucacugacca

SEQ ID NO: 172265 - RNA, 64 nt, hsa
aaaacaccuuggggggugaagcugucaaugccaccaguuggaccuccauacauucugagcuaac

SEQ ID NO: 172266 - RNA, 64 nt, hsa
gcccuuauuuccagagaaccagacguuuguuucccaguuggaaagaagacaguugagcacuuca

SEQ ID NO: 172267 - RNA, 64 nt, hsa
gacugggcaaacuuuacagcugauagugaauauuuugcuuuauacaggaauugacacugauuug

SEQ ID NO: 172268 - RNA, 64 nt, hsa
agugaauccuuugcauuugaagccuuaacaugcauugcuuuaauuuugcccagggacaaauuuu

SEQ ID NO: 172269 - RNA, 64 nt, hsa
caaauaagcaugagagagaaaaaaacaugauauauugcuuuacuuaauagguugaauaugguag

SEQ ID NO: 172270 - RNA, 64 nt, hsa
ugaaaauaugaugauucaauuuucucaauuuucuuugcuuuaaccaaaauucuaaaugcaguuu

SEQ ID NO: 172271 - RNA, 64 nt, hsa
uaaacaacagaacaacuuguaaaacaaauuguguuugcuuuaagaaaaauguuuauugcacuca

SEQ ID NO: 172272 - RNA, 64 nt, hsa
gccuuauaaaaucuucauuaugaaauauuaucaguugcuuuauaaacucacucuuuuuauggau

SEQ ID NO: 172273 - RNA, 64 nt, hsa
uuuuaaaaguaacuaaauauacuucagcacuuuuuugcuuuaaacuagaucaucuuagacuugu

SEQ ID NO: 172274 - RNA, 64 nt, hsa
uuaugcuuacaagacuucauaaugauuuuaugucuugcuuuaaagauaguaccugcagaauagu

SEQ ID NO: 172275 - RNA, 64 nt, hsa
cuaugauuuuuugccaaucuuagccuaaaagaaauugcuuuagcuucuggucagcacugauuaa

SEQ ID NO: 172276 - RNA, 64 nt, hsa
ccaauuaagcuugagauuguucugaaaguaucaauugcuuuaaaacuguuguaaguacaguugg

SEQ ID NO: 172277 - RNA, 64 nt, hsa
uggacuguuuagggcauaggacagauuccccaaauugcuuuaugcuuccacauaacuagagcac

SEQ ID NO: 172278 - RNA, 64 nt, hsa
ugaaaggaucacauuuguuguggugcugccaguuuugcuuuauucuaaauuuuguaccaaagca

SEQ ID NO: 172279 - RNA, 64 nt, hsa
uuuguucuuccaacugaaagccguaaaaccuuuguugcuuuaauugaaugucugugcuuaugag

SEQ ID NO: 172280 - RNA, 64 nt, hsa
cagcguguuuccugagccuccugugaguuuccacuugcuuuacauccaugcaacaugucauuuu

SEQ ID NO: 172281 - RNA, 64 nt, hsa
agauauccacagcuuggaggagcccagagaccguuugcuuuauacccacacagcaacuggucca

SEQ ID NO: 172282 - RNA, 64 nt, hsa
uuuauucuucccacacacuuaccuuacuaagucuuugcuuuaauaaaugagcaacccuggguau

SEQ ID NO: 172283 - RNA, 64 nt, hsa
cacacuccuucaguucagcaagacauaaagccuuuugcuuuaugcuugagggauauuuagaacu

SEQ ID NO: 172284 - RNA, 64 nt, hsa
uuaccaaaauugaacuagcuaccauauaagcagauugcuuuaauuugaugggaaaauaguacac

SEQ ID NO: 172285 - RNA, 64 nt, hsa
uguuuuauuaauguuaauuuaaaucuguaaauaauugcuuuauugugaugugauacagaacaaa

SEQ ID NO: 172286 - RNA, 64 nt, hsa
ucuuauggacagucugugguaaagaagcaacucuuugcuuuagaguuaaauauuccuaucuuaa

SEQ ID NO: 172287 - RNA, 64 nt, hsa
accauauacugacugaaacaugagccagagccgauugcuuuauuaagcuaauaaugaauguuaa

SEQ ID NO: 172288 - RNA, 64 nt, hsa
ccuaaaucuuuaguugaaugauuaguguucaauauugcuuuaaucaccauauaaaaggaaaaaa

SEQ ID NO: 172289 - RNA, 64 nt, hsa
uuuaauccugacauuagcugacuugcuagugagcuugcuuuaaaaaucuacacucuugcauucu

SEQ ID NO: 172290 - RNA, 64 nt, hsa
gagucagcugggaauauuguucuuguguaccucauugcuuuagcuggucacuuggaacuuugga

SEQ ID NO: 172291 - RNA, 64 nt, hsa
acuauuuuagagucuuaaugccaagucagcagauuugcuuuaugaauuacagggacuagaaaug

SEQ ID NO: 172292 - RNA, 64 nt, hsa
accucgcucuguauuuaauuaauugugcuauauguugcuuuaacaacccauugagcagucaggg

SEQ ID NO: 172293 - RNA, 64 nt, hsa
ugaaaaacaaauaaaugcuuuggaaauguuucaguugcuuuagaaacauuagugccugccugga

SEQ ID NO: 172294 - RNA, 64 nt, hsa
aacaucacuccuaaauuaauaaaguauuccucuguugcuuuaguauuuauuacaauaaaaaggg

SEQ ID NO: 172295 - RNA, 64 nt, hsa
guggcaggacccuuaggaaucuaguacaaccuuguugcuuuaggugagucacacucagaaaaug

SEQ ID NO: 172296 - RNA, 64 nt, hsa
cugaaauuggugggaagcaagcaggggucguaccuugcuuuagaguagauguuuggaaaagcua

SEQ ID NO: 172297 - RNA, 64 nt, hsa
cagaacugcuaccaugaagugaaaaugccacauuuugcuuuauaauuucuacccauguugggaa

SEQ ID NO: 172298 - RNA, 64 nt, hsa
caaagucaguaggagaggaugcacaguuugcuauuugcuuuagagacagggacuguauaaacaa

SEQ ID NO: 172299 - RNA, 64 nt, hsa
uaccaaaaugugugaucguagaucucaaaggaucuugcuuuaacuuucaacacuuagaaaaucu

SEQ ID NO: 172300 - RNA, 64 nt, hsa
gaugaagauuguauuuuugcaccuuaacuccacauugcuuuauugguuaauuuauauucuuucc

SEQ ID NO: 172301 - RNA, 64 nt, hsa
ggaaagguuccacgauacauaaaucauuucucauuugcuuuaaaaaauuuaaaaguguaaaaau

SEQ ID NO: 172302 - RNA, 64 nt, hsa
uuuguuguuuucuuuugcuuaagcacuucaucaauugcuuuauucuguaucugcgaaguaaucu

SEQ ID NO: 172303 - RNA, 64 nt, hsa
ugggaucuauucuucagauauucaaaaacauuuuuugcuuuaaaaugcauaucuuuaauugggu

SEQ ID NO: 172304 - RNA, 64 nt, hsa
ugaccaggauaaaugagguauguugaucauggcuuugcuuuauaucuugauauuaaagcugguu

SEQ ID NO: 172305 - RNA, 64 nt, hsa
uuuaacucauaugaucucccuucagcaacuuauuuugcuuuaauugcuuuaaaucuuaagcaau

SEQ ID NO: 172306 - RNA, 64 nt, hsa
uaugaucucccuucagcaacuuauuuugcuuuaauugcuuuaaaucuuaagcaauauuuuuuau

SEQ ID NO: 172307 - RNA, 64 nt, hsa
accccuuuuucuugcuuuauuuuucaguguuuuauugcuuuaugaacuguuuaacccugaaauc

SEQ ID NO: 172308 - RNA, 64 nt, hsa
uuuuugguaaaauauuacuucaaaccccuuuuucuugcuuuauuuuucaguguuuuauugcuuu

SEQ ID NO: 172309 - RNA, 64 nt, hsa
auauguacauuucuaagucaaacacuugugacuuuugcuuuaauuccaugaauguuccugccuc

SEQ ID NO: 172310 - RNA, 64 nt, hsa
gaucaguaguuugcauuucagaaagccuuucauuuugcuuuaauuuuagcaaagcggguuauaa

SEQ ID NO: 172311 - RNA, 64 nt, hsa
uugugauuucacaagauucucuacuuaugugauaggaggguauggccaguuauucaucuaacug

SEQ ID NO: 172312 - RNA, 64 nt, hsa
caacaguugaucuuuuggcuaugacaauuuguauggaggguacgaucuaaguuaagugugucaa

SEQ ID NO: 172313 - RNA, 64 nt, hsa
gggcagaauauacacaacagaugcugaaggagaaggaggguaguguuuugcaaaagaaaaagaa

SEQ ID NO: 172314 - RNA, 64 nt, hsa
uuuguuuuuuuuucuccuuuuauuuuuuugcgggggaggguagggagugggugggggggagggg

SEQ ID NO: 172315 - RNA, 64 nt, hsa
cccaugagaugaugccaugggcccucucagcaggggaggguagagcggagaaaggaagggcugc

SEQ ID NO: 172316 - RNA, 64 nt, hsa
ugagugagggaacagagagguuaagguggguacgggaggguaaggcugugggucgcgugaugcg

SEQ ID NO: 172317 - RNA, 64 nt, hsa
acggaguuugccaagugcauuaaagaggucacguggaggguacguucauaugaaacaaucugca

SEQ ID NO: 172318 - RNA, 64 nt, hsa
agugaguagguuugguuucugacgaaaguagacuggaggguagcauuguaugccucaaaugucu

SEQ ID NO: 172319 - RNA, 64 nt, hsa; identical to SEQ ID NO: 123248

SEQ ID NO: 172320 - RNA, 64 nt, hsa; identical to SEQ ID NO: 123249

SEQ ID NO: 172321 - RNA, 64 nt, hsa; identical to SEQ ID NO: 123250

SEQ ID NO: 172322 - RNA, 64 nt, hsa; identical to SEQ ID NO: 123251

SEQ ID NO: 172323 - RNA, 64 nt, hsa; identical to SEQ ID NO: 123252

SEQ ID NO: 172324 - RNA, 64 nt, hsa; identical to SEQ ID NO: 123253

SEQ ID NO: 172325 - RNA, 64 nt, hsa; identical to SEQ ID NO: 123254

SEQ ID NO: 172326 - RNA, 64 nt, hsa; identical to SEQ ID NO: 123255

SEQ ID NO: 172327 - RNA, 64 nt, hsa; identical to SEQ ID NO: 123256

SEQ ID NO: 172328 - RNA, 64 nt, hsa; identical to SEQ ID NO: 123257

SEQ ID NO: 172329 - RNA, 64 nt, hsa; identical to SEQ ID NO: 123258

SEQ ID NO: 172330 - RNA, 64 nt, hsa; identical to SEQ ID NO: 123259

SEQ ID NO: 172331 - RNA, 64 nt, hsa; identical to SEQ ID NO: 123260

SEQ ID NO: 172332 - RNA, 64 nt, hsa; identical to SEQ ID NO: 123261

SEQ ID NO: 172333 - RNA, 64 nt, hsa; identical to SEQ ID NO: 123262

SEQ ID NO: 172334 - RNA, 64 nt, hsa; identical to SEQ ID NO: 123263

SEQ ID NO: 172335 - RNA, 64 nt, hsa; identical to SEQ ID NO: 123264

SEQ ID NO: 172336 - RNA, 64 nt, hsa; identical to SEQ ID NO: 123265

SEQ ID NO: 172337 - RNA, 64 nt, hsa; identical to SEQ ID NO: 123266

SEQ ID NO: 172338 - RNA, 64 nt, hsa; identical to SEQ ID NO: 123267

SEQ ID NO: 172339 - RNA, 64 nt, hsa; identical to SEQ ID NO: 123268

SEQ ID NO: 172340 - RNA, 64 nt, hsa; identical to SEQ ID NO: 123269

SEQ ID NO: 172341 - RNA, 64 nt, hsa; identical to SEQ ID NO: 123270

SEQ ID NO: 172342 - RNA, 64 nt, hsa; identical to SEQ ID NO: 123271

SEQ ID NO: 172343 - RNA, 64 nt, hsa; identical to SEQ ID NO: 123272

SEQ ID NO: 172344 - RNA, 64 nt, hsa; identical to SEQ ID NO: 123273

SEQ ID NO: 172345 - RNA, 64 nt, hsa; identical to SEQ ID NO: 123274

SEQ ID NO: 172346 - RNA, 64 nt, hsa; identical to SEQ ID NO: 123275

SEQ ID NO: 172347 - RNA, 64 nt, hsa; identical to SEQ ID NO: 123276

SEQ ID NO: 172348 - RNA, 64 nt, hsa; identical to SEQ ID NO: 123277

SEQ ID NO: 172349 - RNA, 64 nt, hsa; identical to SEQ ID NO: 123278

SEQ ID NO: 172350 - RNA, 64 nt, hsa; identical to SEQ ID NO: 123279

SEQ ID NO: 172351 - RNA, 64 nt, hsa; identical to SEQ ID NO: 123280

SEQ ID NO: 172352 - RNA, 64 nt, hsa; identical to SEQ ID NO: 123281

SEQ ID NO: 172353 - RNA, 64 nt, hsa; identical to SEQ ID NO: 123282

SEQ ID NO: 172354 - RNA, 64 nt, hsa; identical to SEQ ID NO: 123283

SEQ ID NO: 172355 - RNA, 64 nt, hsa; identical to SEQ ID NO: 123284

SEQ ID NO: 172356 - RNA, 64 nt, hsa; identical to SEQ ID NO: 123285

SEQ ID NO: 172357 - RNA, 64 nt, hsa; identical to SEQ ID NO: 123286

SEQ ID NO: 172358 - RNA, 64 nt, hsa; identical to SEQ ID NO: 123287

SEQ ID NO: 172359 - RNA, 64 nt, hsa; identical to SEQ ID NO: 123288

SEQ ID NO: 172360 - RNA, 64 nt, hsa; identical to SEQ ID NO: 123289

SEQ ID NO: 172361 - RNA, 64 nt, hsa; identical to SEQ ID NO: 123290

SEQ ID NO: 172362 - RNA, 64 nt, hsa; identical to SEQ ID NO: 123291

SEQ ID NO: 172363 - RNA, 64 nt, hsa
cagaugggcaaaaagauuuucaugcuaaucuucaaagguucaugcucaauauugugaaaagcuu

SEQ ID NO: 172364 - RNA, 64 nt, hsa
gugauuggucuaaaauauuuguaauguauauuaaaagguucaaaaauauuuguauaaaucuaag

SEQ ID NO: 172365 - RNA, 64 nt, hsa
gagaucuggggacacaguggcuuccaaguuuucuaagguucaugugaaaccugaguacauuuac

SEQ ID NO: 172366 - RNA, 64 nt, hsa
aaagucaaugcacuuuuucuucaaaagcuaagugaagguucaauaugagggauguguuuuauua

SEQ ID NO: 172367 - RNA, 64 nt, hsa
auuuguagacuuguauguacauuuuucuggggagaagguucaagagauucauaagauugucaaa

SEQ ID NO: 172368 - RNA, 64 nt, hsa
guucaagagauucauaagauugucaaacuccuugaagguucagaaccucugcagggaaggggga

SEQ ID NO: 172369 - RNA, 64 nt, hsa
agguaucgaaugugagaaugccuucauuuauccuauaacucacucagagacacaugguaacaca

SEQ ID NO: 172370 - RNA, 64 nt, hsa
cugcaguuguuccagugguauuugaugguauaacauaacucauucuagagaaaaacuuuaugaa

SEQ ID NO: 172371 - RNA, 64 nt, hsa
uuacagauuuaaugagaauauaucaaaguacuuuauaacucacaaaaauauaaacuuauauaau

SEQ ID NO: 172372 - RNA, 64 nt, hsa
uuuuuuuccuaugugaaaguugaggacaauuuauauaacucacuuuuugucauguaaaaaaggu

SEQ ID NO: 172373 - RNA, 64 nt, hsa
ucucgaaggcaucaagacaaauugaaagaaagcaauaacucaccaaagcucaacgcugccccug

SEQ ID NO: 172374 - RNA, 64 nt, hsa
cauggcuacuuucuaagcuacaaaccauuagaaaauaacucaaaaagauggcagaggcaaaucc

SEQ ID NO: 172375 - RNA, 64 nt, hsa
uuuuucucaagcugcuuucaggagcuagcagaaaauaacucaaaguugaagacucuggaagauu

SEQ ID NO: 172376 - RNA, 64 nt, hsa
acaguucugcaguuccaucacaguauuuuuuuaaauaacucagguguaugagaagaaauuagaa

SEQ ID NO: 172377 - RNA, 64 nt, hsa
aaacuggaaauucauauccaucugguaugaauauauaacucagcuggcaaaugaauguguuugu

SEQ ID NO: 172378 - RNA, 64 nt, hsa
ccuugacauuucaauuaaaacaugaauuguaguuauaacucaaugcaaauucaacaguuguauu

SEQ ID NO: 172379 - RNA, 64 nt, hsa
gcauaaacugaggguguggguucuggcuuuguacauaacucauuuucucccuugcuuuuucucu

SEQ ID NO: 172380 - RNA, 64 nt, hsa
uaguagguucagcagaauaaacucuuuacaauuaauaacucaguggaaaaugauguucagaugg

SEQ ID NO: 172381 - RNA, 64 nt, hsa; identical to SEQ ID NO: 78937

SEQ ID NO: 172382 - RNA, 64 nt, hsa; identical to SEQ ID NO: 78938

SEQ ID NO: 172383 - RNA, 64 nt, hsa; identical to SEQ ID NO: 78939

SEQ ID NO: 172384 - RNA, 64 nt, hsa; identical to SEQ ID NO: 78940

SEQ ID NO: 172385 - RNA, 64 nt, hsa; identical to SEQ ID NO: 78941

SEQ ID NO: 172386 - RNA, 64 nt, hsa; identical to SEQ ID NO: 78942

SEQ ID NO: 172387 - RNA, 64 nt, hsa; identical to SEQ ID NO: 78943

SEQ ID NO: 172388 - RNA, 64 nt, hsa; identical to SEQ ID NO: 78944

SEQ ID NO: 172389 - RNA, 64 nt, hsa; identical to SEQ ID NO: 78945

SEQ ID NO: 172390 - RNA, 64 nt, hsa; identical to SEQ ID NO: 78946

SEQ ID NO: 172391 - RNA, 64 nt, hsa; identical to SEQ ID NO: 78947

SEQ ID NO: 172392 - RNA, 64 nt, hsa; identical to SEQ ID NO: 78948

SEQ ID NO: 172393 - RNA, 64 nt, hsa; identical to SEQ ID NO: 78949

SEQ ID NO: 172394 - RNA, 64 nt, hsa; identical to SEQ ID NO: 78950

SEQ ID NO: 172395 - RNA, 64 nt, hsa; identical to SEQ ID NO: 78951

SEQ ID NO: 172396 - RNA, 64 nt, hsa; identical to SEQ ID NO: 78952

SEQ ID NO: 172397 - RNA, 64 nt, hsa; identical to SEQ ID NO: 78953

SEQ ID NO: 172398 - RNA, 64 nt, hsa; identical to SEQ ID NO: 78954

SEQ ID NO: 172399 - RNA, 64 nt, hsa; identical to SEQ ID NO: 78955

SEQ ID NO: 172400 - RNA, 64 nt, hsa; identical to SEQ ID NO: 78956

SEQ ID NO: 172401 - RNA, 64 nt, hsa; identical to SEQ ID NO: 78957

SEQ ID NO: 172402 - RNA, 64 nt, hsa; identical to SEQ ID NO: 78958

SEQ ID NO: 172403 - RNA, 64 nt, hsa; identical to SEQ ID NO: 78959

SEQ ID NO: 172404 - RNA, 64 nt, hsa; identical to SEQ ID NO: 78960

SEQ ID NO: 172405 - RNA, 64 nt, hsa; identical to SEQ ID NO: 78961

SEQ ID NO: 172406 - RNA, 64 nt, hsa; identical to SEQ ID NO: 78962

SEQ ID NO: 172407 - RNA, 64 nt, hsa; identical to SEQ ID NO: 78963

SEQ ID NO: 172408 - RNA, 64 nt, hsa; identical to SEQ ID NO: 78964

SEQ ID NO: 172409 - RNA, 64 nt, hsa; identical to SEQ ID NO: 78965

SEQ ID NO: 172410 - RNA, 64 nt, hsa; identical to SEQ ID NO: 78966

SEQ ID NO: 172411 - RNA, 64 nt, hsa; identical to SEQ ID NO: 78967

SEQ ID NO: 172412 - RNA, 64 nt, hsa; identical to SEQ ID NO: 78968

SEQ ID NO: 172413 - RNA, 64 nt, hsa; identical to SEQ ID NO: 78969

SEQ ID NO: 172414 - RNA, 64 nt, hsa; identical to SEQ ID NO: 78970

SEQ ID NO: 172415 - RNA, 64 nt, hsa; identical to SEQ ID NO: 78971

SEQ ID NO: 172416 - RNA, 64 nt, hsa; identical to SEQ ID NO: 78972

SEQ ID NO: 172417 - RNA, 64 nt, hsa; identical to SEQ ID NO: 78973

SEQ ID NO: 172418 - RNA, 64 nt, hsa; identical to SEQ ID NO: 78974

SEQ ID NO: 172419 - RNA, 64 nt, hsa; identical to SEQ ID NO: 78975

SEQ ID NO: 172420 - RNA, 64 nt, hsa; identical to SEQ ID NO: 78976

SEQ ID NO: 172421 - RNA, 64 nt, hsa; identical to SEQ ID NO: 78977

SEQ ID NO: 172422 - RNA, 64 nt, hsa; identical to SEQ ID NO: 78978

SEQ ID NO: 172423 - RNA, 64 nt, hsa; identical to SEQ ID NO: 78979

SEQ ID NO: 172424 - RNA, 64 nt, hsa; identical to SEQ ID NO: 78980

SEQ ID NO: 172425 - RNA, 64 nt, hsa; identical to SEQ ID NO: 78981

SEQ ID NO: 172426 - RNA, 64 nt, hsa; identical to SEQ ID NO: 78982

SEQ ID NO: 172427 - RNA, 64 nt, hsa; identical to SEQ ID NO: 78983

SEQ ID NO: 172428 - RNA, 64 nt, hsa; identical to SEQ ID NO: 78984

SEQ ID NO: 172429 - RNA, 64 nt, hsa; identical to SEQ ID NO: 78985

SEQ ID NO: 172430 - RNA, 64 nt, hsa; identical to SEQ ID NO: 78986

SEQ ID NO: 172431 - RNA, 64 nt, hsa; identical to SEQ ID NO: 78987

SEQ ID NO: 172432 - RNA, 64 nt, hsa; identical to SEQ ID NO: 78988

SEQ ID NO: 172433 - RNA, 64 nt, hsa; identical to SEQ ID NO: 78989

SEQ ID NO: 172434 - RNA, 64 nt, hsa; identical to SEQ ID NO: 78990

SEQ ID NO: 172435 - RNA, 64 nt, hsa; identical to SEQ ID NO: 78991

SEQ ID NO: 172436 - RNA, 64 nt, hsa; identical to SEQ ID NO: 78992

SEQ ID NO: 172437 - RNA, 64 nt, hsa; identical to SEQ ID NO: 78993

SEQ ID NO: 172438 - RNA, 64 nt, hsa; identical to SEQ ID NO: 78994

SEQ ID NO: 172439 - RNA, 64 nt, hsa; identical to SEQ ID NO: 78995

SEQ ID NO: 172440 - RNA, 64 nt, hsa; identical to SEQ ID NO: 78996

SEQ ID NO: 172441 - RNA, 64 nt, hsa; identical to SEQ ID NO: 78997

SEQ ID NO: 172442 - RNA, 64 nt, hsa; identical to SEQ ID NO: 78998

SEQ ID NO: 172443 - RNA, 64 nt, hsa; identical to SEQ ID NO: 78999

SEQ ID NO: 172444 - RNA, 64 nt, hsa; identical to SEQ ID NO: 79000

SEQ ID NO: 172445 - RNA, 64 nt, hsa; identical to SEQ ID NO: 79001

SEQ ID NO: 172446 - RNA, 64 nt, hsa; identical to SEQ ID NO: 79002

SEQ ID NO: 172447 - RNA, 64 nt, hsa; identical to SEQ ID NO: 79003

SEQ ID NO: 172448 - RNA, 64 nt, hsa; identical to SEQ ID NO: 79004

SEQ ID NO: 172449 - RNA, 64 nt, hsa; identical to SEQ ID NO: 79005

SEQ ID NO: 172450 - RNA, 64 nt, hsa; identical to SEQ ID NO: 79006

SEQ ID NO: 172451 - RNA, 64 nt, hsa; identical to SEQ ID NO: 79007

SEQ ID NO: 172452 - RNA, 64 nt, hsa; identical to SEQ ID NO: 79008

SEQ ID NO: 172453 - RNA, 64 nt, hsa; identical to SEQ ID NO: 79009

SEQ ID NO: 172454 - RNA, 64 nt, hsa; identical to SEQ ID NO: 79010

SEQ ID NO: 172455 - RNA, 64 nt, hsa; identical to SEQ ID NO: 79011

SEQ ID NO: 172456 - RNA, 64 nt, hsa; identical to SEQ ID NO: 79012

SEQ ID NO: 172457 - RNA, 64 nt, hsa; identical to SEQ ID NO: 79013

SEQ ID NO: 172458 - RNA, 64 nt, hsa; identical to SEQ ID NO: 79014

SEQ ID NO: 172459 - RNA, 64 nt, hsa; identical to SEQ ID NO: 79015

SEQ ID NO: 172460 - RNA, 64 nt, hsa; identical to SEQ ID NO: 79016

SEQ ID NO: 172461 - RNA, 64 nt, hsa; identical to SEQ ID NO: 79017

SEQ ID NO: 172462 - RNA, 64 nt, hsa; identical to SEQ ID NO: 79018

SEQ ID NO: 172463 - RNA, 64 nt, hsa; identical to SEQ ID NO: 79019

SEQ ID NO: 172464 - RNA, 64 nt, hsa; identical to SEQ ID NO: 79020

SEQ ID NO: 172465 - RNA, 64 nt, hsa; identical to SEQ ID NO: 79021

SEQ ID NO: 172466 - RNA, 64 nt, hsa; identical to SEQ ID NO: 79022

SEQ ID NO: 172467 - RNA, 64 nt, hsa; identical to SEQ ID NO: 79023

SEQ ID NO: 172468 - RNA, 64 nt, hsa; identical to SEQ ID NO: 79024

SEQ ID NO: 172469 - RNA, 64 nt, hsa; identical to SEQ ID NO: 79025

SEQ ID NO: 172470 - RNA, 64 nt, hsa; identical to SEQ ID NO: 79026

SEQ ID NO: 172471 - RNA, 64 nt, hsa; identical to SEQ ID NO: 79027

SEQ ID NO: 172472 - RNA, 64 nt, hsa; identical to SEQ ID NO: 79028

SEQ ID NO: 172473 - RNA, 64 nt, hsa; identical to SEQ ID NO: 79029

SEQ ID NO: 172474 - RNA, 64 nt, hsa; identical to SEQ ID NO: 79030

SEQ ID NO: 172475 - RNA, 64 nt, hsa; identical to SEQ ID NO: 79031

SEQ ID NO: 172476 - RNA, 64 nt, hsa; identical to SEQ ID NO: 79032

SEQ ID NO: 172477 - RNA, 64 nt, hsa; identical to SEQ ID NO: 79033

SEQ ID NO: 172478 - RNA, 64 nt, hsa; identical to SEQ ID NO: 79034

SEQ ID NO: 172479 - RNA, 64 nt, hsa; identical to SEQ ID NO: 79035

SEQ ID NO: 172480 - RNA, 64 nt, hsa; identical to SEQ ID NO: 79036

SEQ ID NO: 172481 - RNA, 64 nt, hsa; identical to SEQ ID NO: 79037

SEQ ID NO: 172482 - RNA, 64 nt, hsa; identical to SEQ ID NO: 79038

SEQ ID NO: 172483 - RNA, 64 nt, hsa; identical to SEQ ID NO: 79039

SEQ ID NO: 172484 - RNA, 64 nt, hsa; identical to SEQ ID NO: 79040

SEQ ID NO: 172485 - RNA, 64 nt, hsa; identical to SEQ ID NO: 79041

SEQ ID NO: 172486 - RNA, 64 nt, hsa; identical to SEQ ID NO: 79042

SEQ ID NO: 172487 - RNA, 64 nt, hsa; identical to SEQ ID NO: 79043

SEQ ID NO: 172488 - RNA, 64 nt, hsa; identical to SEQ ID NO: 79044

SEQ ID NO: 172489 - RNA, 64 nt, hsa; identical to SEQ ID NO: 79045

SEQ ID NO: 172490 - RNA, 64 nt, hsa; identical to SEQ ID NO: 79046

SEQ ID NO: 172491 - RNA, 64 nt, hsa; identical to SEQ ID NO: 79047

SEQ ID NO: 172492 - RNA, 64 nt, hsa; identical to SEQ ID NO: 79048

SEQ ID NO: 172493 - RNA, 64 nt, hsa; identical to SEQ ID NO: 79049

SEQ ID NO: 172494 - RNA, 64 nt, hsa; identical to SEQ ID NO: 79050

SEQ ID NO: 172495 - RNA, 64 nt, hsa
uuaguuaauucaaccuuauagaucauacuuaugaaggugauaacugacacguguucacugaauu

SEQ ID NO: 172496 - RNA, 64 nt, hsa
ggcccuaaguugaugaagaaaaagucaaggaaggaggugauacaauuggaaauauucccaucaa

SEQ ID NO: 172497 - RNA, 64 nt, hsa
cagcggcuguuacacuguucuuugccacugugccuaugcucagaauaugcucacugcuaagcua

SEQ ID NO: 172498 - RNA, 64 nt, hsa
acacuguucuuugccacugugccuaugcucagaauaugcucacugcuaagcuacaaacucggac

SEQ ID NO: 172499 - RNA, 63 nt, hsa
ccagggauuaggaauuaagaucgugcacaaaaguuuccuuaaaauuccuggauggcugcagau

SEQ ID NO: 172500 - RNA, 63 nt, hsa
acauucaacuguaguauccauauguugcuuaaauuuccuuaugagccccaugauggaaagacu

SEQ ID NO: 172501 - RNA, 63 nt, hsa
uuuagcuccagccacuuguggcaaacaaccucguuuccuuacaaauuccagcaugugacuuug

SEQ ID NO: 172502 - RNA, 63 nt, hsa
gaaucauaaaaugaaguuggugcuuguaugguguuuccuuagccuaaagaaugaucuguuguu

SEQ ID NO: 172503 - RNA, 63 nt, hsa
ugauccagccacuggauauuuuauauccucccuuuuccuuaagcacaaugucagaccaaauug

SEQ ID NO: 172504 - RNA, 63 nt, hsa
caaauguuguacccuugccauuuaggacugaacuuuccuuagcccaagggacccagugacagu

SEQ ID NO: 172505 - RNA, 63 nt, hsa
uuugcaaaauauguuugaaagcauugguagugcuuuccuuaucaguaacuggaguucuccugc

SEQ ID NO: 172506 - RNA, 63 nt, hsa
caguccaacacuguguuuacauacacucgugcuuuuccuuaucugacuucucauuuuguauca

SEQ ID NO: 172507 - RNA, 63 nt, hsa
acuugaacaagucacuuaacuucuacaagcuuguuuccuuauuugucaaauuagauuacacua

SEQ ID NO: 172508 - RNA, 63 nt, hsa
aaagcaaacuauaggggucccuaauuuuggauuuuuccuuaaguguaagaaacaaugcuucaa

SEQ ID NO: 172509 - RNA, 63 nt, hsa
ucagcuucuacccccuccugccuuuccuuccucuuuccuuacuuccuucccuucccucggcuu

SEQ ID NO: 172510 - RNA, 63 nt, hsa
ggacucagcugagaaaggacaacuggguuccgcuuuccuuaacccuacacccuuuagcuggau

SEQ ID NO: 172511 - RNA, 63 nt, hsa
ugaacuuuccaagguuauuucugaauguaacaauuuccuuaaaaaugacuuauccaauuucug

SEQ ID NO: 172512 - RNA, 63 nt, hsa
acuuuagucuccagaacuaaacaagucccuaaguuuccuuauuuuaauuuacugugacuagau

SEQ ID NO: 172513 - RNA, 63 nt, hsa
ugaguguuucacaccuuaucuauguagaauauauuuccuuauucagaauuucuaaaaguuuaa

SEQ ID NO: 172514 - RNA, 63 nt, hsa
auuuuaauguuucuuggggaauauguuagagaauuuccuuacucuugauugugggauacuauu

SEQ ID NO: 172515 - RNA, 63 nt, hsa
aagggagcuaacauuaauuaugcauguacuauauuuccuuaauaugagagauaauuuuuuaau

SEQ ID NO: 172516 - RNA, 63 nt, hsa
aucuauuuggagauucagugcauaacuaaguauuuuccuuaauacuaaagauuuuaaauaaua

SEQ ID NO: 172517 - RNA, 63 nt, hsa
uuaugcagguuaggggaucugauuaauguuuccuuuccuuacaacagcuagagaaaacaucuc

SEQ ID NO: 172518 - RNA, 63 nt, hsa
gcaacucuucaagauguugcaaaagcuuacauuuuuccuuaaaaggaaaacugaaacccaguc

SEQ ID NO: 172519 - RNA, 63 nt, hsa
caggucuaaauuacaaugaaguuaagguuaggauuuccuuaguucuuaaugucucaguuuuug

SEQ ID NO: 172520 - RNA, 63 nt, hsa
cacuuauacugacuuucaucugguaguagaugauuuccuuaauuuuuauuagguacguaacua

SEQ ID NO: 172521 - RNA, 63 nt, hsa
uagcuuauucuucuauaucuacauaugcaaagcuuuccuuaacaguaaaggguacauaugcau

SEQ ID NO: 172522 - RNA, 63 nt, hsa
ggggcuggaggaagauguaaaagaugaaaauguuuuccuuaucacuuuucuuucuccacccac

SEQ ID NO: 172523 - RNA, 63 nt, hsa
uuguguauaacugcaauggccuuuuuuuccagauuuccuuauugacuuuuuguuugccuuacc

SEQ ID NO: 172524 - RNA, 63 nt, hsa
cacacguaggccaguuaacuuagagaaaaucuauuuccuuaccucuagccagucacuuccuuu

SEQ ID NO: 172525 - RNA, 63 nt, hsa
gcuguuuuaaaauucauuucaaauuggacucgauuuccuuauaucuaauauauaucugggaga

SEQ ID NO: 172526 - RNA, 63 nt, hsa
uaccccacuauauaaaagucauauuauuauaaauuuccuuauuauauaaacuuuauauacuau

SEQ ID NO: 172527 - RNA, 63 nt, hsa
uaggucauuuaauauugguuuauggugcuuuuauuuccuuaacuugaaaacaucuuucugaga

SEQ ID NO: 172528 - RNA, 63 nt, hsa
gugcuaagaaagugcauuagaauggaauugcccuuuccuuaaggagacaguuugggcucuccc

SEQ ID NO: 172529 - RNA, 63 nt, hsa
gggguugggaggaagcauguaagagagggaacauuuccuuagauguuacccagaugguucugg

SEQ ID NO: 172530 - RNA, 63 nt, hsa
guggguggagaggaagcauauguggaaggagcauuuccuuagaagucauccagaugcuucugg

SEQ ID NO: 172531 - RNA, 63 nt, hsa
uuuaccguguagguuguauacuuacauuuuuucuuuccuuaauuuauacaugauccuuuuucc

SEQ ID NO: 172532 - RNA, 63 nt, hsa
auuuuuucuuuccuuaauuuauacaugauccuuuuuccuuaauuuauacaugauccaggcaca

SEQ ID NO: 172533 - RNA, 63 nt, hsa
uaaaccuguugguuaugaaaauuugaagaucauuuuccuuaaauuaucucagcuuuuaacuuc

SEQ ID NO: 172534 - RNA, 63 nt, hsa
uguaaacaggguacgugaagagcuggcauuuauuuuccuuacgagaagguuuucguagagaau

SEQ ID NO: 172535 - RNA, 63 nt, hsa
cagaauuaauuguuauuauuuuccuaggcgcaauuuccuuaaacguacaguuuaaauucaagg

SEQ ID NO: 172536 - RNA, 63 nt, hsa
guguguguguauguguguguguguguguguguguuuccuuauugucauuccauuauauaucca

SEQ ID NO: 172537 - RNA, 63 nt, hsa
uccaaaagucacaauuuguacaagaaccuuugcuuuccuuagacuuguucugcauuuuauuuu

SEQ ID NO: 172538 - RNA, 63 nt, hsa
auguauauccagugcaaucaacugucauuucuuuuuccuuaaaacauaugaguauauagaaag

SEQ ID NO: 172539 - RNA, 63 nt, hsa
agaaaagccaaauuagaaaauccuauguccuaguuuccuuaccaaggauaauuaaauauauca

SEQ ID NO: 172540 - RNA, 63 nt, hsa
agaauagauggcuaacaagagguuagaaauacuuuuccuuaauuuuaauccacaguauguuac

SEQ ID NO: 172541 - RNA, 63 nt, hsa
agauuuauucuauucuuacuguuguguauuuuguuuccuuauagccauuaaagaaagcacuaa

SEQ ID NO: 172542 - RNA, 63 nt, hsa
aacaaacaaaaauccuuugcccucagaagugcauuuccuuauucuuuaguguaauuguaauuu

SEQ ID NO: 172543 - RNA, 63 nt, hsa
ugguaaagagcaggaccagaggaagaauccagauuuccuuaugcuugggccucacacuagcuc

SEQ ID NO: 172544 - RNA, 63 nt, hsa
caauucuguguuugcuuuuagcagauaugaagauuuccuuauuucuuuguaauugugcagaua

SEQ ID NO: 172545 - RNA, 64 nt, hsa
gggaguggucugaaugaacacagcugaccccuuucccgcgcacugaaagggcagaguaggccga

SEQ ID NO: 172546 - RNA, 64 nt, hsa
cgcacacacacacacacgcacacaugcgugugcacccgcgcacgcacauacacacacacauaua

SEQ ID NO: 172547 - RNA, 64 nt, hsa
agaaagcaaacccggggagcaggcggcugccgcacccgcgcaccccgggcccucaccacgcccu

SEQ ID NO: 172548 - RNA, 64 nt, hsa
acacuacuccaaaucaaaaccacuaagaguuccucccgcgcagacugcugccccuucagcugcc

SEQ ID NO: 172549 - RNA, 64 nt, hsa
guuaggacgaacaucugccccuucagggaggacccccgcgcacaccagaaccucuggcaagccg

SEQ ID NO: 172550 - RNA, 64 nt, hsa
gcgccccgcaucucgcgccugcuacaucaaagggcccgcgcacaaagcaguguuucuucgccac

SEQ ID NO: 172551 - RNA, 64 nt, hsa
uuccuuuaggugcuauacauuauucaaaaagucucccgcgcauuugcacuaaugauggcugcau

SEQ ID NO: 172552 - RNA, 64 nt, hsa
uuccacggcuccggccgcuaggacccugccaggucccgcgcaccaucccugcccugcccacgug

SEQ ID NO: 172553 - RNA, 64 nt, hsa
cagcccucccucgauggccucuagcccagagaagcccgcgcaucuuggacccaccaagcaggcc

SEQ ID NO: 172554 - RNA, 64 nt, hsa
gaggcgcgagugcgugugagaagaaccgacccaccccgcgcaaggggaagccuccugucucccc

SEQ ID NO: 172555 - RNA, 64 nt, hsa
gaaaagaccgagcaggccacagaggcucggucuccccgcgcacagcguaggcacccgguguacu

SEQ ID NO: 172556 - RNA, 64 nt, hsa
ccaucaccgaggccuccccagcgcacugaauguccccgcgcagagcagagggaaggcagcggaa

SEQ ID NO: 172557 - RNA, 64 nt, hsa
gcucgggucaguccucaucgcucccccuccccaccccgcgcaggccacugagacggugggacac

SEQ ID NO: 172558 - RNA, 64 nt, hsa
ugguguggagccccuuggccagggccaugggagucccgcgcagucagcuccacauuggccucug

SEQ ID NO: 172559 - RNA, 64 nt, hsa
agguuuccacaccccuccccugggccgcugaggccccgcgcaccugugccuuaaucuucccucc

SEQ ID NO: 172560 - RNA, 64 nt, hsa
gcuugcagaagggggagaucccaguucgaagacucccgcgcagagccuguggcccucucugcca

SEQ ID NO: 172561 - RNA, 64 nt, hsa
gaacgaccccugaauauauaaaacacacacacaccccgcgcacucucacuccuuuuccagguuu

SEQ ID NO: 172562 - RNA, 64 nt, hsa
uuggagggcugcaggucguccucucuguaugugccccgcgcauuuccuuggccucaucugagau

SEQ ID NO: 172563 - RNA, 64 nt, hsa
gcucuggacugcugcccuuguccccgaggagugucccgcgcagccacaccuggcaacagcagug

SEQ ID NO: 172564 - RNA, 64 nt, hsa
cugggugcugcccugcgcccugccgcacccgcggcccgcgcagcugccuaggauguucugggcu

SEQ ID NO: 172565 - RNA, 64 nt, hsa
ggaagccgagugcccgccgccgcgccagccucagcccgcgcagaaugugcucgcugccccgcgg

SEQ ID NO: 172566 - RNA, 64 nt, hsa
gggggcucgggcgcggacuaagcaggggggaucucccgcgcaggggcggcggcggcggggaccg

SEQ ID NO: 172567 - RNA, 64 nt, hsa
ugagugagcugugcugccagccaucgcagaggagcccgcgcacgacugugguggggccgucggu

SEQ ID NO: 172568 - RNA, 64 nt, hsa
ccucaccggacugagcucacaggaggagccugcacccgcgcagaaggggagccggggccgagcc

SEQ ID NO: 172569 - RNA, 64 nt, hsa
gccauugugggugagggucgagggccaccgaggucccgcgcaccgcugccugcccugcaguggc

SEQ ID NO: 172570 - RNA, 64 nt, hsa
cgcccccugaggacgccuccacgccauucgccaucccgcgcaccuccagccuagcucgggccaa

SEQ ID NO: 172571 - RNA, 64 nt, hsa
ccucuuccccuauaccuguucccacaaauggcaucccgcgcaugcuugcccuauuaaaggcagc

SEQ ID NO: 172572 - RNA, 64 nt, hsa
gggccccucggaggccgaggcuggcaccccaucucccgcgcagccugcccccuccuggacgugc

SEQ ID NO: 172573 - RNA, 64 nt, hsa
auuaacaaaaggacguaugccauggagaaacacacccgcgcacacagcugcucucuacagaggc

SEQ ID NO: 172574 - RNA, 64 nt, hsa
gcgcccgacggccaggaucucgcuguaggucaggcccgcgcagccuccugcgcccagaagccca

SEQ ID NO: 172575 - RNA, 64 nt, hsa
gcggccgugguggaggccuccaccccaggagcaccccgcgcacccucggaggacgggcuucggc

SEQ ID NO: 172576 - RNA, 53 nt, hsa
gauucuucagccaucgcugaucucccgcgcagaccguuguuucccccaaggcc

SEQ ID NO: 172577 - RNA, 64 nt, hsa
ucugagggccgggcacggucacacggccacccgccccgcgcaccccacgcccuguucacgcuca

SEQ ID NO: 172578 - RNA, 64 nt, hsa
ucccggaggagguugggagguggaggcccagcaucccgcgcagaugacaccaucaaccgccaga

SEQ ID NO: 172579 - RNA, 64 nt, hsa
cuccaucugguguggaaacacugcccagggagaaaggaggaagcucacuguggacagucuucuu

SEQ ID NO: 172580 - RNA, 64 nt, hsa
ucccagcuucgcuccuuaucacugcauugugaagaggaggaaaagugaaucacggagagagaaa

SEQ ID NO: 172581 - RNA, 64 nt, hsa
gagaugggcgcucccgacacagcgcagacccaccaggaggaaagaggcccagcucucagcugac

SEQ ID NO: 172582 - RNA, 64 nt, hsa
guuagcugcgggcugcccugugggcuggugcuucaggaggaauccagagaaguguucagaugcc

SEQ ID NO: 172583 - RNA, 64 nt, hsa
acuuggauaggcaguagauauuuuugcccaccugaggaggaacucagucaagcuguugcuuaac

SEQ ID NO: 172584 - RNA, 64 nt, hsa
auuuguucuuuccagagcuaacugauaagaguggaggaggaaugccuucuccuaagagucaguu

SEQ ID NO: 172585 - RNA, 64 nt, hsa
ugccucagaggcaguaagaaagagaggccgacccaggaggaaacaaagggugaaugaagaagaa

SEQ ID NO: 172586 - RNA, 64 nt, hsa
ggugaaugaagaagaacaaucaugaaauggaagaaggaggaagagcaugaaggaucuuauaaga

SEQ ID NO: 172587 - RNA, 64 nt, hsa
cuguauguccagcaaacucuugcauguggccacuaggaggaauguguaagaauguucauaguua

SEQ ID NO: 172588 - RNA, 64 nt, hsa
uaaaccaaaauugagcauaguaauuacccacagaaggaggaaguggaagggacaggagcacaua

SEQ ID NO: 172589 - RNA, 64 nt, hsa
gagcaggaggaggaagaggaggaggaggaggaggaggaggaaggcgaggacaguggcacuucag

SEQ ID NO: 172590 - RNA, 64 nt, hsa
cugcagagccuggaagaggaggaggaugagcaggaggaggaagaggaggaggaggaggaggagg

SEQ ID NO: 172591 - RNA, 64 nt, hsa
gccguguagacacuaaaccucaugcccuaaggacaggaggaaagacccucuguuuggagcauua

SEQ ID NO: 172592 - RNA, 64 nt, hsa
aaguuggguggacauaaaugagucaagugacaacaggaggaaauagacuuagacgaaagaaagg

SEQ ID NO: 172593 - RNA, 64 nt, hsa
accaugaagaggagaagaugggggucuuggaggaaggaggaaaaggcaaggaggcugcaggcag

SEQ ID NO: 172594 - RNA, 64 nt, hsa
cccaaaaaaaagaaaaagaaaaggaggcagaaagaggaggaagaagcuacagcaucugaaagga

SEQ ID NO: 172595 - RNA, 64 nt, hsa
ccagaggaucaugaagacugggcuuccaauggggaggaggaaagaugcaauaugucucuuacac

SEQ ID NO: 172596 - RNA, 64 nt, hsa
uuuaauaugaaucaaagcuuauauguaaacuucaaggaggaaugguaaaauguucagcccuccu

SEQ ID NO: 172597 - RNA, 64 nt, hsa
ggagaaguuccuuagcagggaggaggaagaggagaggaggaagcaaagaaucacaaggaaccuc

SEQ ID NO: 172598 - RNA, 64 nt, hsa
acauuuguaccccuggagaaguuccuuagcagggaggaggaagaggagaggaggaagcaaagaa

SEQ ID NO: 172599 - RNA, 64 nt, hsa
acugugcgcuagacacugccaggcccgggccucgaggaggaaaagacaguagggaagacauuau

SEQ ID NO: 172600 - RNA, 64 nt, hsa
uccccacuuuacagauguggauauuuaggccaaaaggaggaagugacuuguccaggggcagaca

SEQ ID NO: 172601 - RNA, 64 nt, hsa
guggggagucaggggugggaggagaaggaggaagaggaggaaggccagacuggccugcccuuuc

SEQ ID NO: 172602 - RNA, 64 nt, hsa
guugguuggguggggagucaggggugggaggagaaggaggaagaggaggaaggccagacuggcc

SEQ ID NO: 172603 - RNA, 64 nt, hsa
cagccccugacagaaaaaggaucucugagccuaaaggaggaaaagucccaccaacuaccagacc

SEQ ID NO: 172604 - RNA, 64 nt, hsa
uccuagccacgucccuugggaccggugggacuggaggaggaacggucacccuccucccccaugg

SEQ ID NO: 172605 - RNA, 64 nt, hsa
aucaggggagagccugcagcugaguucagcagaaaggaggaauccuggcccucaggaagaagau

SEQ ID NO: 172606 - RNA, 64 nt, hsa
gagcaggcaagggaaacuggggagauggggauggaggaggaaggcugauauccucuggggagca

SEQ ID NO: 172607 - RNA, 64 nt, hsa
uauccucuggggagcacaucaccugaaggugccaaggaggaaggcugagaggggggccacccca

SEQ ID NO: 172608 - RNA, 64 nt, hsa
aaagaacucucccaacccuggggccuagcuguauaggaggaauugccuaaggguggcccacucu

SEQ ID NO: 172609 - RNA, 64 nt, hsa
uucauaaacacucaccuggcuggcuuugccuuccaggaggaagcuggcugaagcaagggugugg

SEQ ID NO: 172610 - RNA, 64 nt, hsa
aggcucaucuugagaagcaggcggguugggugggaggaggaagaaagggaagaauuagguuuga

SEQ ID NO: 172611 - RNA, 64 nt, hsa
uuguugccacugagaagcaggcggguugggugggaggaggaagaaagggaagaauuagguuuga

SEQ ID NO: 172612 - RNA, 64 nt, hsa
caacuaaauuuuaaugaacgaaugaaugacagagaggaggaaaaaagaugaggauugcauacau

SEQ ID NO: 172613 - RNA, 64 nt, hsa
uauuuaaguggauugaauaacugagucuacauggaggaggaaaugcuagagaacagcaggucua

SEQ ID NO: 172614 - RNA, 64 nt, hsa
caaagagggauguuuggaaaaaacucugaaggagaggaggaauuaguugggaugccaauuuccu

SEQ ID NO: 172615 - RNA, 64 nt, hsa
ugcucucagcuggcagugcaaugcuuguagaaguaggaggaaacaguucucacugggaagaagc

SEQ ID NO: 172616 - RNA, 64 nt, hsa
cucucaggagaagccagaggcccuggccaaagauaggaggaagaaagagaacucuccauagaau

SEQ ID NO: 172617 - RNA, 64 nt, hsa
ccaagagcccuccccuuucuccaucccuccagcuaggaggaaauggagcaagaugaacaggcag

SEQ ID NO: 172618 - RNA, 64 nt, hsa
ucuucuuggaugguucugcuuagaaugagugucaaggaggaaagagagggagauggaggaugug

SEQ ID NO: 172619 - RNA, 64 nt, hsa
agaaauagagaaaagagaccauguuuauuuggguaggaggaagccuugccuugcgccuuaggug

SEQ ID NO: 172620 - RNA, 64 nt, hsa
gaguaugcagaaguuggguagagagguuaagaagaggaggaagugagacggggaagggaggagc

SEQ ID NO: 172621 - RNA, 64 nt, hsa
ugaaguuugggauuuggaacuuucuguaucucuuaggaggaacaaguaaaaaccaaaugguuac

SEQ ID NO: 172622 - RNA, 64 nt, hsa
caggccucauccuccuggacccagcaggggcagaaggaggaagggacugguccaggcauggguc

SEQ ID NO: 172623 - RNA, 64 nt, hsa
cugguucuccauccccauguguuucagguggaacaggaggaacugguccaggccaggccucauc

SEQ ID NO: 172624 - RNA, 64 nt, hsa
cauuuuagacacugggagaagagaaccucaaacuaggaggaaaagacagagccuccacuuaguu

SEQ ID NO: 172625 - RNA, 64 nt, hsa
auaacaacagccacccugcccagucuggaagaagaggaggaagacucuggagccaaggcagagg

SEQ ID NO: 172626 - RNA, 64 nt, hsa
gccggacgaguucauggggaucugggggguggggaggaggaagccguugaaucugggagggaag

SEQ ID NO: 172627 - RNA, 64 nt, hsa
uauuuagcucuguggaauucagugacaaaaugggaggaggaaagagaguuuguaaggucaugcu

SEQ ID NO: 172628 - RNA, 64 nt, hsa
agcugcuuucacgguaaaauuauguugguuugaaaggaggaaauagcaagguuaagauguguga

SEQ ID NO: 172629 - RNA, 64 nt, hsa
uagaagcgcaaugagagaagcagcaguggguacaaggaggaagaaaaagggcuugcagagagug

SEQ ID NO: 172630 - RNA, 64 nt, hsa
gaagaagugaccaugggcugggaggagguggaggaggaggaagaggagaaggaaaagugacgaa

SEQ ID NO: 172631 - RNA, 64 nt, hsa
ccgagcuuuuuugugaaacucagaucagccacccaggaggaagagcgggcugaggaaacccaga

SEQ ID NO: 172632 - RNA, 64 nt, hsa
uauugggugaggggacgagaugggguucaugugaaggaggaagcgaugccgagguaggaaaggc

SEQ ID NO: 172633 - RNA, 64 nt, hsa
cacugagugaaggcacauaaagcaauugaggaggaggaggaaccccucgucccccuaggagcag

SEQ ID NO: 172634 - RNA, 64 nt, hsa
auucccagugaccccuucugggugccaacuacugaggaggaauacuugcacuuuggggagaagg

SEQ ID NO: 172635 - RNA, 64 nt, hsa
gaacaaggagcaagugaucuggcaaaagagggacaggaggaaaaugaaaccuguucugguggaa

SEQ ID NO: 172636 - RNA, 64 nt, hsa
cccuggugaagggcuggaccugacccauggaggcaggaggaagaccuggcuuucuugguuuguc

SEQ ID NO: 172637 - RNA, 64 nt, hsa
guggcccaccuguggagaggacuggcugcccuggaggaggaaagggaggaagucuacacagagg

SEQ ID NO: 172638 - RNA, 64 nt, hsa
gauauugaacaauaaaggagaaugguaccgaugcaggaggaagcaagcgugucuuccccugcag

SEQ ID NO: 172639 - RNA, 64 nt, hsa
cccugcagcacacagcgacuugcguugacaaaggaggaggaaacgauuacucuguaaacaaagu

SEQ ID NO: 172640 - RNA, 64 nt, hsa
aaacugcucagcgcgucucagcucagugccgaggaggaggaagaaaaacaggccgagugaaggu

SEQ ID NO: 172641 - RNA, 64 nt, hsa
aggcaccaggaaaggggugguagucagaggagggaggaggaauaaggggaaggaagagagaggg

SEQ ID NO: 172642 - RNA, 64 nt, hsa
accggaagaccuugccucugugccgcggagguccaggaggaaacggggcggccgcuaggccuca

SEQ ID NO: 172643 - RNA, 64 nt, hsa
aaggcacacgcucaaugccccacgugccuucuccaggaggaacgaagcaggguuugaggguugg

SEQ ID NO: 172644 - RNA, 64 nt, hsa
uuuccacgugagaaauggggagaacgcugcuguuaggaggaaguuguguccaguucagggugcc

SEQ ID NO: 172645 - RNA, 64 nt, hsa
caccauggugcccaucguguuacuccauugucagaggaggaaacggggucaggcaggaaagcaa

SEQ ID NO: 172646 - RNA, 64 nt, hsa
ccaagggaaggccccauuccggggcuguuccccgaggaggaagggaaggggcucugugugcccc

SEQ ID NO: 172647 - RNA, 64 nt, hsa
cgaggaggaagggaaggggcucugugugccccccaggaggaagaggcccugaguccugggauca

SEQ ID NO: 172648 - RNA, 64 nt, hsa
gucuaggccaugguacaggagaacuguggcguguaggaggaauacuucaggaugagugaaggcu

SEQ ID NO: 172649 - RNA, 64 nt, hsa
ugaggggcuucacuguuaccaggcauguaacagaaggaggaagacuaacacacacccccugccc

SEQ ID NO: 172650 - RNA, 64 nt, hsa
cuccucauccggacugaggaagacgaggacagggaggaggaaaaggaggaagaggaggacaaaa

SEQ ID NO: 172651 - RNA, 64 nt, hsa
cggacugaggaagacgaggacagggaggaggaaaaggaggaagaggaggacaaaaagggggagg

SEQ ID NO: 172652 - RNA, 64 nt, hsa
gacaaaaagggggaggagaagguucuucguccaaaggaggaaggagaagaaguagaaagugcga

SEQ ID NO: 172653 - RNA, 50 nt, hsa
acagauucucccgacgauaaacugaggacuugccuuggaaauggaaucug

SEQ ID NO: 172654 - RNA, 64 nt, hsa
cuuuagaauucugaagaugugaagccucugucucacugaggauuuuaaaggucaauuauacuuu

SEQ ID NO: 172655 - RNA, 64 nt, hsa
cuaagaaguccccaggucaugcugcuguugcuggacugaggaccacacuuugagaaccugugcu

SEQ ID NO: 172656 - RNA, 64 nt, hsa
acuuggaagucguuucaggacauggggcauagaaacugaggaguagcugagaggaagaugaaga

SEQ ID NO: 172657 - RNA, 64 nt, hsa
aaaggugguucauguucauucucaucagugugaaacugaggagucugcaauuuggaauauggag

SEQ ID NO: 172658 - RNA, 64 nt, hsa
gcugauuucaauuaggcagcacuucccaaagugcacugaggaagguggccccaagagaagcucu

SEQ ID NO: 172659 - RNA, 64 nt, hsa
cuuugugguagaggggcccuggaauugcagcuguacugaggaugauguuauucacagccccugg

SEQ ID NO: 172660 - RNA, 64 nt, hsa
cagagucaggaucucacauuucaccccaggcucaacugaggauguggcuuauuaaacacggaag

SEQ ID NO: 172661 - RNA, 64 nt, hsa
gcgagaggaacagagccaaugauguguggguuacacugaggagccaaggacagggccucagguc

SEQ ID NO: 172662 - RNA, 64 nt, hsa
gaguacagauguaaucacaaguaaugcaagacucacugaggaauacaagccaagcugaugaggc

SEQ ID NO: 172663 - RNA, 64 nt, hsa
ugaaaaucugaacauaggggagugagguauggccacugaggauuuuugcuugcuuaagaaugau

SEQ ID NO: 172664 - RNA, 64 nt, hsa
gugaaggugagcuggagcugguuggacuaaugagacugaggaagcagcuuuuccuacgaucugc

SEQ ID NO: 172665 - RNA, 64 nt, hsa
auuguugaaagguaauuugagagaaauaugaagaacugaggaggaaaaaaaaaaaaaagaaaag

SEQ ID NO: 172666 - RNA, 64 nt, hsa
uugcuggaauaaguucaaauucuucugaacucaaacugaggaauuucaccuguaaaccugaguc

SEQ ID NO: 172667 - RNA, 64 nt, hsa
aauagcaucugacuuugagucacagaaaccuuaaacugaggagacaauaguucagaaccuuuuu

SEQ ID NO: 172668 - RNA, 64 nt, hsa
gagccauuugcucuugccaaagugagauagauguacugaggagauaauugaaaagucagacucu

SEQ ID NO: 172669 - RNA, 64 nt, hsa
gaaaguaguagucagaaugaauuaugguuggaaaacugaggaaucuucugguugcaggugcaaa

SEQ ID NO: 172670 - RNA, 64 nt, hsa
ugaugaagagaaaaaaaagucucccucagaaaguacugaggagaaagcuaacggaacacaucca

SEQ ID NO: 172671 - RNA, 64 nt, hsa
cucuuggaugguuaccuuauuucuaagaaacgccacugaggaacaggauccacuuugaacaguc

SEQ ID NO: 172672 - RNA, 64 nt, hsa
aagacucagguaccuauuauuguucccuggugaaacugaggagaaaaguuaaucaaccagguua

SEQ ID NO: 172673 - RNA, 64 nt, hsa
cuuugcacaggaugcuggccuuugcucuuacuacacugaggagagauucccgcggguuccgcag

SEQ ID NO: 172674 - RNA, 64 nt, hsa
cuuaggcccuagcggcagaaaggaaaaccugaagacugaggacaaaguggaggagggccgaggu

SEQ ID NO: 172675 - RNA, 64 nt, hsa
auagacuggagacagguuuuuggcuuaucacagcacugaggaaaauacaaaugcacagacuguc

SEQ ID NO: 172676 - RNA, 64 nt, hsa
ggcuugcagauuugcuuucguugauguccacguuacugaggauugacugaguauagacuggaga

SEQ ID NO: 172677 - RNA, 64 nt, hsa
gacagugacacaagguggacacucucuacagaucacugaggauaagcuggagccacaaugcaug

SEQ ID NO: 172678 - RNA, 64 nt, hsa
aaggauguaugauaauauguacaaaguaauuccaacugaggaagcucaccugauccuuaguguc

SEQ ID NO: 172679 - RNA, 64 nt, hsa
guggaaagcucagguggcagcggacucugacuccacugaggaacugccucagaagcugcgauca

SEQ ID NO: 172680 - RNA, 64 nt, hsa
uggcugggggaugacagugugggagcugugggguacugaggaagacaccauuccuugacggugu

SEQ ID NO: 172681 - RNA, 64 nt, hsa; identical to SEQ ID NO: 55647

SEQ ID NO: 172682 - RNA, 64 nt, hsa; identical to SEQ ID NO: 55648

SEQ ID NO: 172683 - RNA, 64 nt, hsa; identical to SEQ ID NO: 55649

SEQ ID NO: 172684 - RNA, 64 nt, hsa; identical to SEQ ID NO: 55650

SEQ ID NO: 172685 - RNA, 64 nt, hsa; identical to SEQ ID NO: 55651

SEQ ID NO: 172686 - RNA, 64 nt, hsa; identical to SEQ ID NO: 55652

SEQ ID NO: 172687 - RNA, 64 nt, hsa; identical to SEQ ID NO: 55653

SEQ ID NO: 172688 - RNA, 64 nt, hsa; identical to SEQ ID NO: 55654

SEQ ID NO: 172689 - RNA, 64 nt, hsa; identical to SEQ ID NO: 55655

SEQ ID NO: 172690 - RNA, 64 nt, hsa; identical to SEQ ID NO: 55656

SEQ ID NO: 172691 - RNA, 64 nt, hsa; identical to SEQ ID NO: 55657

SEQ ID NO: 172692 - RNA, 64 nt, hsa; identical to SEQ ID NO: 55658

SEQ ID NO: 172693 - RNA, 64 nt, hsa; identical to SEQ ID NO: 55659

SEQ ID NO: 172694 - RNA, 64 nt, hsa; identical to SEQ ID NO: 55660

SEQ ID NO: 172695 - RNA, 64 nt, hsa; identical to SEQ ID NO: 55661

SEQ ID NO: 172696 - RNA, 64 nt, hsa; identical to SEQ ID NO: 55662

SEQ ID NO: 172697 - RNA, 64 nt, hsa; identical to SEQ ID NO: 55663

SEQ ID NO: 172698 - RNA, 64 nt, hsa; identical to SEQ ID NO: 55664

SEQ ID NO: 172699 - RNA, 64 nt, hsa; identical to SEQ ID NO: 55665

SEQ ID NO: 172700 - RNA, 64 nt, hsa; identical to SEQ ID NO: 55666

SEQ ID NO: 172701 - RNA, 50 nt, hsa; identical to SEQ ID NO: 172653

SEQ ID NO: 172702 - RNA, 64 nt, hsa; identical to SEQ ID NO: 172654

SEQ ID NO: 172703 - RNA, 64 nt, hsa; identical to SEQ ID NO: 172655

SEQ ID NO: 172704 - RNA, 64 nt, hsa; identical to SEQ ID NO: 172656

SEQ ID NO: 172705 - RNA, 64 nt, hsa; identical to SEQ ID NO: 172657

SEQ ID NO: 172706 - RNA, 64 nt, hsa; identical to SEQ ID NO: 172658

SEQ ID NO: 172707 - RNA, 64 nt, hsa; identical to SEQ ID NO: 172659

SEQ ID NO: 172708 - RNA, 64 nt, hsa; identical to SEQ ID NO: 172660

SEQ ID NO: 172709 - RNA, 64 nt, hsa; identical to SEQ ID NO: 172661

SEQ ID NO: 172710 - RNA, 64 nt, hsa; identical to SEQ ID NO: 172662

SEQ ID NO: 172711 - RNA, 64 nt, hsa; identical to SEQ ID NO: 172663

SEQ ID NO: 172712 - RNA, 64 nt, hsa; identical to SEQ ID NO: 172664

SEQ ID NO: 172713 - RNA, 64 nt, hsa; identical to SEQ ID NO: 172665

SEQ ID NO: 172714 - RNA, 64 nt, hsa; identical to SEQ ID NO: 172666

SEQ ID NO: 172715 - RNA, 64 nt, hsa; identical to SEQ ID NO: 172667

SEQ ID NO: 172716 - RNA, 64 nt, hsa; identical to SEQ ID NO: 172668

SEQ ID NO: 172717 - RNA, 64 nt, hsa; identical to SEQ ID NO: 172669

SEQ ID NO: 172718 - RNA, 64 nt, hsa; identical to SEQ ID NO: 172670

SEQ ID NO: 172719 - RNA, 64 nt, hsa; identical to SEQ ID NO: 172671

SEQ ID NO: 172720 - RNA, 64 nt, hsa; identical to SEQ ID NO: 172672

SEQ ID NO: 172721 - RNA, 64 nt, hsa; identical to SEQ ID NO: 172673

SEQ ID NO: 172722 - RNA, 64 nt, hsa; identical to SEQ ID NO: 172674

SEQ ID NO: 172723 - RNA, 64 nt, hsa; identical to SEQ ID NO: 172675

SEQ ID NO: 172724 - RNA, 64 nt, hsa; identical to SEQ ID NO: 172676

SEQ ID NO: 172725 - RNA, 64 nt, hsa; identical to SEQ ID NO: 172677

SEQ ID NO: 172726 - RNA, 64 nt, hsa; identical to SEQ ID NO: 172678

SEQ ID NO: 172727 - RNA, 64 nt, hsa; identical to SEQ ID NO: 172679

SEQ ID NO: 172728 - RNA, 64 nt, hsa; identical to SEQ ID NO: 172680

SEQ ID NO: 172729 - RNA, 64 nt, hsa; identical to SEQ ID NO: 55647

SEQ ID NO: 172730 - RNA, 64 nt, hsa; identical to SEQ ID NO: 55648

SEQ ID NO: 172731 - RNA, 64 nt, hsa; identical to SEQ ID NO: 55649

SEQ ID NO: 172732 - RNA, 64 nt, hsa; identical to SEQ ID NO: 55650

SEQ ID NO: 172733 - RNA, 64 nt, hsa; identical to SEQ ID NO: 55651

SEQ ID NO: 172734 - RNA, 64 nt, hsa; identical to SEQ ID NO: 55652

SEQ ID NO: 172735 - RNA, 64 nt, hsa; identical to SEQ ID NO: 55653

SEQ ID NO: 172736 - RNA, 64 nt, hsa; identical to SEQ ID NO: 55654

SEQ ID NO: 172737 - RNA, 64 nt, hsa; identical to SEQ ID NO: 55655

SEQ ID NO: 172738 - RNA, 64 nt, hsa; identical to SEQ ID NO: 55656

SEQ ID NO: 172739 - RNA, 64 nt, hsa; identical to SEQ ID NO: 55657

SEQ ID NO: 172740 - RNA, 64 nt, hsa; identical to SEQ ID NO: 55658

SEQ ID NO: 172741 - RNA, 64 nt, hsa; identical to SEQ ID NO: 55659

SEQ ID NO: 172742 - RNA, 64 nt, hsa; identical to SEQ ID NO: 55660

SEQ ID NO: 172743 - RNA, 64 nt, hsa; identical to SEQ ID NO: 55661

SEQ ID NO: 172744 - RNA, 64 nt, hsa; identical to SEQ ID NO: 55662

SEQ ID NO: 172745 - RNA, 64 nt, hsa; identical to SEQ ID NO: 55663

SEQ ID NO: 172746 - RNA, 64 nt, hsa; identical to SEQ ID NO: 55664

SEQ ID NO: 172747 - RNA, 64 nt, hsa; identical to SEQ ID NO: 55665

SEQ ID NO: 172748 - RNA, 64 nt, hsa; identical to SEQ ID NO: 55666

SEQ ID NO: 172749 - RNA, 64 nt, hsa
gaugccagggguacugaaucugcaaagcaaaugagcagccaaggaccagcaucuguccgcauuu

SEQ ID NO: 172750 - RNA, 64 nt, hsa
ucuacuuccugucugcaugcccaaggcuucugaagcagccaaugucgaugcaacaacauuugua

SEQ ID NO: 172751 - RNA, 64 nt, hsa
guuaacacaucuuugucagagaagacuggcgucagcagccaaaacaccaggaaacacauuucug

SEQ ID NO: 172752 - RNA, 64 nt, hsa
cuggccacaccacucagugcauggcggccgaugggcagccaacccaaacccgcgccuuuccuug

SEQ ID NO: 172753 - RNA, 64 nt, hsa
ccuuccuucuuaauaaaggcugacaguucuguuggcagccaagaacccacaccaugaagacagg

SEQ ID NO: 172754 - RNA, 64 nt, hsa
ugcaacagaaaccaccugcguccacacccucacugcagccaaaggugcaauuacuugaccugca

SEQ ID NO: 172755 - RNA, 64 nt, hsa
cguggcaaccauagagaucgagcuucaggacagagcagccaaugaaaacggccgccugaaccca

SEQ ID NO: 172756 - RNA, 64 nt, hsa
uguguggccaauggagacagaggcuuagugcagagcagccaauggguacugagcuggcugagcc

SEQ ID NO: 172757 - RNA, 64 nt, hsa
ggguucuguggcaguugcagggcaauguuauggagcagccaacggccuggcagaggagcccaag

SEQ ID NO: 172758 - RNA, 64 nt, hsa; identical to SEQ ID NO: 109624

SEQ ID NO: 172759 - RNA, 64 nt, hsa; identical to SEQ ID NO: 109625

SEQ ID NO: 172760 - RNA, 64 nt, hsa; identical to SEQ ID NO: 109626

SEQ ID NO: 172761 - RNA, 64 nt, hsa; identical to SEQ ID NO: 109627

SEQ ID NO: 172762 - RNA, 64 nt, hsa; identical to SEQ ID NO: 109628

SEQ ID NO: 172763 - RNA, 64 nt, hsa; identical to SEQ ID NO: 109629

SEQ ID NO: 172764 - RNA, 64 nt, hsa; identical to SEQ ID NO: 109630

SEQ ID NO: 172765 - RNA, 64 nt, hsa; identical to SEQ ID NO: 109631

SEQ ID NO: 172766 - RNA, 64 nt, hsa; identical to SEQ ID NO: 109632

SEQ ID NO: 172767 - RNA, 64 nt, hsa; identical to SEQ ID NO: 109633

SEQ ID NO: 172768 - RNA, 64 nt, hsa; identical to SEQ ID NO: 109634

SEQ ID NO: 172769 - RNA, 64 nt, hsa; identical to SEQ ID NO: 109635

SEQ ID NO: 172770 - RNA, 64 nt, hsa; identical to SEQ ID NO: 109636

SEQ ID NO: 172771 - RNA, 64 nt, hsa; identical to SEQ ID NO: 109637

SEQ ID NO: 172772 - RNA, 64 nt, hsa
aggaaauguuuaauuaaugcuuuuuaguuuaaauaaauugaaucauuuauaauaaucaguguua

SEQ ID NO: 172773 - RNA, 64 nt, hsa
ucugucaagaaacagcaguaauuauuacugaguuaaauugaaaaguccaguggaccaggcauuu

SEQ ID NO: 172774 - RNA, 64 nt, hsa
agguuuuuguagcuauuugcuugccugagaaaugaaauugaaaacauaccccugcgugucuguc

SEQ ID NO: 172775 - RNA, 64 nt, hsa
augugggaaccauucugaaguucaaaacuauggaaaauugaauuuucuucagacaaaacugcuc

SEQ ID NO: 172776 - RNA, 64 nt, hsa
gaaaaacauguuggcuuuucucuugacgugggagaaauugaaaagaaggggaaggggaagaaaa

SEQ ID NO: 172777 - RNA, 64 nt, hsa
caacagcguauuggcuuggcuguugacauggaugaaauugaaaaguaccaagaaguggaagaag

SEQ ID NO: 172778 - RNA, 64 nt, hsa
uuuuuuagcagauagcaguuagcacuuaaucuguaaauugaauaauuuaucaagugcaggaaug

SEQ ID NO: 172779 - RNA, 64 nt, hsa
ccuaagauucaauauuacguuauacaaauuuuuaaaauugaaauuaggaauuugaauuuacaag

SEQ ID NO: 172780 - RNA, 64 nt, hsa
aaaaauaucuguuacaaauuuauaauuucaagacaaauugaaucuuauuuuauaauacuuuugg

SEQ ID NO: 172781 - RNA, 64 nt, hsa
acuuuuaagucuaauuuuacagauagaauaauggaaauugaaaauuuaacccuuuauuccgaua

SEQ ID NO: 172782 - RNA, 64 nt, hsa
auucgauaauauaguaacucagaauuuucauauaaaauugaauucuacucauuagaguacuuuu

SEQ ID NO: 172783 - RNA, 64 nt, hsa
gaaaagcuacaguaugaaaucugaaaagcaacagaaauugaaagugaccuuaaagaauaaauuu

SEQ ID NO: 172784 - RNA, 62 nt, hsa
cccaugaaaauucuauuuaguauuuucagagaaaauugaagguuuuuuuaaacaucacugga

SEQ ID NO: 172785 - RNA, 64 nt, hsa
auauucuggugaaacauguaaaauacuuuaaguaaaauugaacauuuuuauuugaauuuuugcu

SEQ ID NO: 172786 - RNA, 64 nt, hsa
guugagcaaggggagugaaaccacagaaacuguuaaauugaacguaaauaacuuuggaaaacag

SEQ ID NO: 172787 - RNA, 64 nt, hsa
uacucagucccuuuaccuuagguggaaucuucuuaaauugaaauuuuugguaaggaauucauuu

SEQ ID NO: 172788 - RNA, 64 nt, hsa
uacuuaagggaaaaguugcaagaaugcugaaaaaaaauugaacacaaucucauugaggagcauu

SEQ ID NO: 172789 - RNA, 64 nt, hsa
uugcccaaaguuuuauuuuuuuuaaacaaugauuaaauugaauguguaaugugcaaaagcccug

SEQ ID NO: 172790 - RNA, 64 nt, hsa
aauuguccgauuuauguguauuacuuaaagcuauaaauugaacuagaucuugccgugcucugua

SEQ ID NO: 172791 - RNA, 64 nt, hsa
ggagggauuuacuuuuaagaggcaaaaugugaguaaauugaaaccaagaaaacuuguuuuuaga

SEQ ID NO: 172792 - RNA, 64 nt, hsa
aaauugggaugagcccuaauggaggaagucgggcaaauugaaaguauaaaugaaugggccauga

SEQ ID NO: 172793 - RNA, 64 nt, hsa
ggacugguuauuucugguuuugaaguaaucgaacaaauugaaaaucugaagaccgaugcugcaa

SEQ ID NO: 172794 - RNA, 64 nt, hsa
ucuuaaaagagaacacaccaaaaaagugaaagagaaauugaaagggaaaaaagacaaaaagcau

SEQ ID NO: 172795 - RNA, 64 nt, hsa
uuuacuuuuuguauguuaccuguacuuaggcuucaaauugaagccuguuuuauguguaaaauca

SEQ ID NO: 172796 - RNA, 64 nt, hsa
aaucaugauggccuguaacaguugaagcaucuaaaaauugaaauaaauauauauuuuuaacaua

SEQ ID NO: 172797 - RNA, 64 nt, hsa
ugaucagcuuuuaauaucugucaaauaaaaauugaaauugaagaugguauauaagauuucagga

SEQ ID NO: 172798 - RNA, 64 nt, hsa
uuuuccugaucagcuuuuaauaucugucaaauaaaaauugaaauugaagaugguauauaagauu

SEQ ID NO: 172799 - RNA, 64 nt, hsa
acauucuguuugcaggauuuuuuuuguaaccaugaaauugaacauuuccaaauuauaaacuaug

SEQ ID NO: 172800 - RNA, 64 nt, hsa
cugcacucaaaaucuuccuuuguguaggacaagaaaauugaaccaaagcuugcuuguugcaaug

SEQ ID NO: 172801 - RNA, 64 nt, hsa
uuuuggugcacaaauacaaaguggaaacuuaccaaaauugaacuagcuaccauauaagcagauu

SEQ ID NO: 172802 - RNA, 64 nt, hsa
uaauguuuaaauagcauaaaaugaaaugcuacaaaaauugaacuaauuuauacuuuaaaguauu

SEQ ID NO: 172803 - RNA, 64 nt, hsa
auucaacuugcaaaagagacaacugauaagaagaaaauugaaaugagaaucuguggauaagugu

SEQ ID NO: 172804 - RNA, 64 nt, hsa
ucuacaacauauguuagcacggcaaagaaccuucaaauugaagacugagauuuuucuguauaua

SEQ ID NO: 172805 - RNA, 64 nt, hsa
ggucuguuaguguuugccaagaaccauugcaaauaaauugaacaucaaagauccaaguuuguac

SEQ ID NO: 172806 - RNA, 64 nt, hsa
auaauugaaaaugaaacauguucuuauuuuccuuaaauugaagaaaacccuuuaguugucuaca

SEQ ID NO: 172807 - RNA, 64 nt, hsa
caagaauuguuacuuuacaauguucccuuaagcaaaauugaauuugcuuugaacuuuuaguuau

SEQ ID NO: 172808 - RNA, 64 nt, hsa
uuuuuuuaaauuuaaauacagaaacaacuggcaaaaauugaacuaagauuuacuuuuuuuucca

SEQ ID NO: 172809 - RNA, 64 nt, hsa
cucacuggucguguaaacuuuuuuuuuuuuuuggaaauugaagcuguagagugcugcccgaaau

SEQ ID NO: 172810 - RNA, 64 nt, hsa
caaaugaccuccagccucucgaaggcaucaagacaaauugaaagaaagcaauaacucaccaaag

SEQ ID NO: 172811 - RNA, 64 nt, hsa
uuguaaacuauauuugaacgacauuccccccgaaaaauugaaauguaaagaugaggcagagaau

SEQ ID NO: 172812 - RNA, 64 nt, hsa
caaaagguuuaugaaggggcucacagagcgguugaaauugaagcucuaacaccacacuccagcu

SEQ ID NO: 172813 - RNA, 64 nt, hsa
aauguucauaauguuucugcauucaucuguucuuaaauugaaaaacauauaauuuacuucuuau

SEQ ID NO: 172814 - RNA, 64 nt, hsa
ucuuaaauugaaaaacauauaauuuacuucuuauaaauugaagucuuaaaugugaaaccaagaa

SEQ ID NO: 172815 - RNA, 64 nt, hsa
augaaacccaaaacucucugcauguacacauuacaaauugaauuguuugcuuacccuuaaccuu

SEQ ID NO: 172816 - RNA, 64 nt, hsa
uacaacaaaguuuacaucauuguuucaccaaaaaaaauugaaaagcuggaaagaacucaaauga

SEQ ID NO: 172817 - RNA, 64 nt, hsa
ugccaagguggacaacaacacagcauugguugacaaauugaagcguuuccagcaggagaaugaa

SEQ ID NO: 172818 - RNA, 64 nt, hsa
ugaucugaagagugaaaaugaugcuuuaaaugaaaaauugaaaucagaagaacaaaaaagaaga

SEQ ID NO: 172819 - RNA, 64 nt, hsa
aacuuaaaugcugcgcaugaaaccucuaaguuggaaauugaagcuagccacucagagaaacuug

SEQ ID NO: 172820 - RNA, 64 nt, hsa
cuucauaucaucacaacauuauuugauuuaaauaaaauugaaaguaauauuugugcaacuucau

SEQ ID NO: 172821 - RNA, 64 nt, hsa
uuuuuauuaaaacaugagucacuaugggaugagaaaauugaaauaaagcuacugggccuccucu

SEQ ID NO: 172822 - RNA, 64 nt, hsa
agacuccgucucaaaaaaaaaaaaaaaaaaaaagaaauugaauugggggagucauggucagggg

SEQ ID NO: 172823 - RNA, 64 nt, hsa
ggcauggguggguggggagucagucaugucacugaaauugaaugggggaggcccaaugaggugg

SEQ ID NO: 172824 - RNA, 64 nt, hsa
ccacuugacuaugaaguuuuuuuaaagcacagauaaauugaauaaucagggcaauagcauuaag

SEQ ID NO: 172825 - RNA, 64 nt, hsa
guaaccugaaaaaacauuagaguaaaaaucauugaaauugaaaagagaaaaucgauaaaaccca

SEQ ID NO: 172826 - RNA, 64 nt, hsa
gguagaucucaguaggcauauauaucuauuaaauaaauugaagcaguaauuaauaaccuuccaa

SEQ ID NO: 172827 - RNA, 64 nt, hsa
guaaccuggaaaaaaauuagaguaaaaaucagugaaauugaaaagagaaaaucaauaaaaccca

SEQ ID NO: 172828 - RNA, 64 nt, hsa
cacuugacuaugaagcuuuuuguaaagcauagauaaauugaauaaucagggcaacagcauuaag

SEQ ID NO: 172829 - RNA, 64 nt, hsa
caguuugauacucaaggaaaggggguuauucaagaaauugaaaauuucaucuuggaccucagug

SEQ ID NO: 172830 - RNA, 64 nt, hsa
aacugucccauauguuaguaaauuacauauguacaaauugaaacuguaaauugugaacacugga

SEQ ID NO: 172831 - RNA, 64 nt, hsa
auggaacauucuuucuuggucuucaccaucugacaaauugaauggcaagagguggauuuugcca

SEQ ID NO: 172832 - RNA, 64 nt, hsa
uauuucauuuucccaauuugacaaucguauuuuaaaauugaaacugauggaacauucuuucuug

SEQ ID NO: 172833 - RNA, 64 nt, hsa
uugcuguagcagagcuuuauugcaggcauuuuaaaaauugaauaaccaugugaaauaauuuggg

SEQ ID NO: 172834 - RNA, 64 nt, hsa
uuaauuguugcgcucuaauacaacugaccauuuaaaauugaacaaguuuauuguuuuguaacaa

SEQ ID NO: 172835 - RNA, 64 nt, hsa
uugaauauugcaggguucagucuagauugucauuaaauugaagagucuacauucagaacauaaa

SEQ ID NO: 172836 - RNA, 64 nt, hsa
uuguuucaaacugaaguuuacugagagauccaucaaauugaacaaucuguuguaauuuaaaauu

SEQ ID NO: 172837 - RNA, 64 nt, hsa
aauuacacaccuacuuuuacugacuauucaacauaaauugaaucuuuaacaugacuuuaaaggc

SEQ ID NO: 172838 - RNA, 64 nt, hsa
aaacacauggaaucuguuuaagauagcccuuguaaaauugaacauuuaccuguauuguaaguac

SEQ ID NO: 172839 - RNA, 64 nt, hsa
aauguuugauaaggaaagcauuuuuuuuuuguuaaaauugaauugucaguacuuuacuuuuuuc

SEQ ID NO: 172840 - RNA, 64 nt, hsa
cucagaauugaaaauuacuacuuaaaaucuuugcaaauugaauaauuacagaaaagggcuacau

SEQ ID NO: 172841 - RNA, 64 nt, hsa
agagaugggguuuggccaugauggccaggcuggaaaauugaaacauaauuucacaauuauuccu

SEQ ID NO: 172842 - RNA, 64 nt, hsa
uuuuucugagaaaaaaaaguucuuaaauacaauaaaauugaaauguugaaauauaucucucaaa

SEQ ID NO: 172843 - RNA, 64 nt, hsa
accuuuauuagauaaaucaugaagugucccugugaaauugaagugaaacuaucucuguaggacu

SEQ ID NO: 172844 - RNA, 64 nt, hsa
gccuuggaauuuucauuuugaugcagaaauuuugaaauugaaaaugugcauguuuuggugcaca

SEQ ID NO: 172845 - RNA, 64 nt, hsa
ggggagggaaaauuggaaugguucccuuuuuuagaaauugaaguggucuucauaugucaacuac

SEQ ID NO: 172846 - RNA, 64 nt, hsa
uucauaugucaacuacagaaaaggaaaaaaauagaaauugaaggauuuuuaugaaauuauauug

SEQ ID NO: 172847 - RNA, 64 nt, hsa
uaauaaccugcauuguugcugucugccaaauauuaaauugaaaucuucauuucaauuuuauuau

SEQ ID NO: 172848 - RNA, 64 nt, hsa
acuauucauuggagaguuuacccauacauuuagcaaauugaauggccaaaacauuugacuccag

SEQ ID NO: 172849 - RNA, 64 nt, hsa
auguauuucagguucugaauaacaauauuuuuccaaauugaaaguaaauauuccagaaguugau

SEQ ID NO: 172850 - RNA, 64 nt, hsa
guugucccuauuaacaaaaaaguauuuuaauaaaaaauugaaaugagugagucauauuuuuugu

SEQ ID NO: 172851 - RNA, 64 nt, hsa
cgucaaagagccaguuaucuuuagcagauauuaaaaauugaaaacuuuggagaacucauuucaa

SEQ ID NO: 172852 - RNA, 64 nt, hsa
aauauugauuucugcccucagcuucaaauaaaguaaauugaaaugggaacaauaucaauauggu

SEQ ID NO: 172853 - RNA, 64 nt, hsa
uuaaacuaaaggcuaagaauauaggcuugaugggaaauugaagguaggcugaguauugggaauc

SEQ ID NO: 172854 - RNA, 64 nt, hsa
gggaaauugaagguaggcugaguauugggaauccaaauugaauuuugauucuccuuggcaguga

SEQ ID NO: 172855 - RNA, 64 nt, hsa
aguacauuacuuaaauguugcuuuuagcuuugauaaauugaaaauauuuuaauguguuguauuu

SEQ ID NO: 172856 - RNA, 64 nt, hsa
uaaauugaaaauauuuuaauguguuguauuuuugaaauugaaaacacuguaaaauagauugaug

SEQ ID NO: 172857 - RNA, 64 nt, hsa
gcuucucacaaugauugugcaaaaagucacguguaaauugaacuuuuguaaaucaaauuguauu

SEQ ID NO: 172858 - RNA, 64 nt, hsa
ccugaacagucugagcagccaacccauuucaacaaaauugaacacaggacucuucugcucagca

SEQ ID NO: 172859 - RNA, 64 nt, hsa
agaauguuaagauuuaucugcaaggauuuuuaaaaaauugaaacuugcauuuuaaguguuuaaa

SEQ ID NO: 172860 - RNA, 64 nt, hsa
uuagaauucccaagaaggcuuuauuacaccucagaaauugaaagcaccaugacuuuguccauua

SEQ ID NO: 172861 - RNA, 64 nt, hsa; identical to SEQ ID NO: 172859

SEQ ID NO: 172862 - RNA, 64 nt, hsa; identical to SEQ ID NO: 172860

SEQ ID NO: 172863 - RNA, 64 nt, hsa
agagcguguauuauuaucuaguagaaaaagcauucccaaagacuugguccaugcagauaaggau

SEQ ID NO: 172864 - RNA, 64 nt, hsa
gucugaguuguuuguuuggacuucccugucuucccccaaagaguugaaaucuuaaaucuauuua

SEQ ID NO: 172865 - RNA, 64 nt, hsa
agugagccucuugcuaagugucacacacacucuucccaaagacgugaugaguuaaaguuguauu

SEQ ID NO: 172866 - RNA, 64 nt, hsa
uaugaucugacuggaaaacaauccuguauccccucccaaagaaucaugggcuuuuuuuuugaau

SEQ ID NO: 172867 - RNA, 64 nt, hsa
ggccuggcugccuggccguggcuucucuuuggcucccaaagagaaggacaguguugggaguauc

SEQ ID NO: 172868 - RNA, 64 nt, hsa
uguugggaguaucugccguggcuucucuuuggcucccaaagagaaggacaguguugggaguauc

SEQ ID NO: 172869 - RNA, 64 nt, hsa
ucuuucaagcaucuacaaucuggcaaacccuuggcccaaagacucaccaggugggacguggcag

SEQ ID NO: 172870 - RNA, 64 nt, hsa
uggccucaccccacccauggaauaccugccucaucccaaagaucagguaugggcugaaugcagc

SEQ ID NO: 172871 - RNA, 64 nt, hsa
gauugugcgcacacucguuuccgaacugccucuccccaaagaaugugaggcauugucaccuugu

SEQ ID NO: 172872 - RNA, 64 nt, hsa
gaaauguucucaauugagcaauucagucccucuccccaaagacuagacgugaccuggcagauua

SEQ ID NO: 172873 - RNA, 64 nt, hsa
uucuacgaugguuuguuugguccuuuugaaccaccccaaagaacucaacauggcaaagcaaaug

SEQ ID NO: 172874 - RNA, 64 nt, hsa
auggugaaaggauaaccucgaugauguaaauccacccaaagauacuguucuacaaaaaguaggg

SEQ ID NO: 172875 - RNA, 64 nt, hsa
ucaggucauuaucaggcauaggcagccuauagggcccaaagaaggcaaaaagauaagauuuacu

SEQ ID NO: 172876 - RNA, 64 nt, hsa
cuuugguagucagguuuggcuacuuugcagcucgcccaaagagauacaaccuaauccccaaccu

SEQ ID NO: 172877 - RNA, 64 nt, hsa
ccugcaccaccgugacucccuggcugcuccuugccccaaagaacccucuuccugcaugggagag

SEQ ID NO: 172878 - RNA, 64 nt, hsa
ccuacuguucuuugccucguccaggucucuaucucccaaagaccugcccaccuccugggcucuc

SEQ ID NO: 172879 - RNA, 64 nt, hsa
ccagaauuuuuuaucuagagaccagcauguucuccccaaagaccaagauauucugccaaaauau

SEQ ID NO: 172880 - RNA, 64 nt, hsa
ccagaauuuuuugucuagagaccagcauguucuccccaaagaccagaauauucuaccuaaauau

SEQ ID NO: 172881 - RNA, 64 nt, hsa
ccaggacuuuuuaucuagagaccagcauguucuccccaaagacuggaauauucuacccaaaugu

SEQ ID NO: 172882 - RNA, 64 nt, hsa
ccaggauuuucuacccagagaccaagguguucuucccaaagaccaaaauauucuacccauaugu

SEQ ID NO: 172883 - RNA, 64 nt, hsa
uaguuuacacccgggcagcagcaccacacaugaacccaaagacauguucuuuuuaaagcuguuu

SEQ ID NO: 172884 - RNA, 64 nt, hsa
ccagcuccauccuccacuuauucugccuguuucccccaaagacaauggcuggacccugcaugca

SEQ ID NO: 172885 - RNA, 64 nt, hsa
cccuaaaucugcuuccgcaccaccuggucuuagccccaaagaugggccuucucucucccagaua

SEQ ID NO: 172886 - RNA, 64 nt, hsa
aaguugguccucccucugccuuuccucucaagcccccaaagagcaaaggcaacagcaagaccag

SEQ ID NO: 172887 - RNA, 64 nt, hsa
uuccccuccuugagaagaccagaagucaacccaucccaaagacaaacugcaugaaaaggguaca

SEQ ID NO: 172888 - RNA, 64 nt, hsa
ucaggagccaaggcccuuuccaaguccagguguucccaaagagcugaaucaaagacagcuuggc

SEQ ID NO: 172889 - RNA, 64 nt, hsa
guccaggccccgcccccaaaggaccaggacucgccccaaagaucccgagggcauaggccacccc

SEQ ID NO: 172890 - RNA, 64 nt, hsa
ucagacccuuguaagccccuuccuuccucccuugcccaaagauccuuugcugaguguucuguuu

SEQ ID NO: 172891 - RNA, 64 nt, hsa
uggaggcaugccugcagaaggacuguugaugcgacccaaagauacagcggugggaucucugcug

SEQ ID NO: 172892 - RNA, 64 nt, hsa
guccuugcagaccugcugccucccccacgacaggcccaaagauggacccccccuggccuuguga

SEQ ID NO: 172893 - RNA, 64 nt, hsa
aaggguauaaaugcauguuccugaggugcccucccccaaagaauguaccugcacucaaaccagg

SEQ ID NO: 172894 - RNA, 64 nt, hsa
ucgccccccacccaucucuggagagcccucugcacccaaagaggacuagagaugccgagcggcc

SEQ ID NO: 172895 - RNA, 64 nt, hsa
agccaagauagcucccaugcaccggaauuccuuugggaugaaucagcaucauuuuaaacaaagu

SEQ ID NO: 172896 - RNA, 64 nt, hsa
gugccaggcugucuucuguccauguugggcauaagggaugaaaacuuggccgagacuaaugugu

SEQ ID NO: 172897 - RNA, 64 nt, hsa
uuaagaauacuuuuuuuuuaagcugagaaguauagggaugaaaaagauguuauauuguguuuga

SEQ ID NO: 172898 - RNA, 64 nt, hsa
uuuuuaggucugggagggcaaaaaagaggugggugggaugaaacauguuuuggggggggaugca

SEQ ID NO: 172899 - RNA, 64 nt, hsa
ugggcccugagcccucagguccccagcuccuugagggaugaaccugggagcccaagagccagug

SEQ ID NO: 172900 - RNA, 64 nt, hsa
cccacgccuguaucuggcacugcuggugugugcagggaugaaacccagcaucagagagguuuuc

SEQ ID NO: 172901 - RNA, 64 nt, hsa
uagucagaggccccacccccaggaagcauggauggggaugaaggcacaggcgucuccaaccuca

SEQ ID NO: 172902 - RNA, 64 nt, hsa
uuucaagagguaacagcacugggauccaagcagggggaugaaaaacucagcagagaaauucgag

SEQ ID NO: 172903 - RNA, 60 nt, hsa
cacacuaaacuauaaaugucuccaaagucacacauucagaacugucucuggcagucgaau

SEQ ID NO: 172904 - RNA, 60 nt, hsa
ggcuucuuuccaucacaaaacggguagaaacacauucacugcuucaggguucuaaucugu

SEQ ID NO: 172905 - RNA, 60 nt, hsa
cugccugccgccccgcgggaccugugcaagcacauucaccaagugcaucgguagcccugc

SEQ ID NO: 172906 - RNA, 60 nt, hsa
uuuuuuucuuuuaugugaucuuugggaaaacacauucagaauuauaucucguuucuacuu

SEQ ID NO: 172907 - RNA, 60 nt, hsa
uguuugugauauuuuaaauaucuacuacagcacauucagccaauaaagaaucugccuuua

SEQ ID NO: 172908 - RNA, 60 nt, hsa
gagcuguagaccagccgcaugcacuugccccacauucacugcugacuggcuucacuggaa

SEQ ID NO: 172909 - RNA, 60 nt, hsa
gaaaguaggcucaaaagagaauauaucuuucacauucacauucagaacccagcaaccugg

SEQ ID NO: 172910 - RNA, 60 nt, hsa
aggcucaaaagagaauauaucuuucacauucacauucagaacccagcaaccuggagucca

SEQ ID NO: 172911 - RNA, 60 nt, hsa
uuccgaagcacugaugaucaaaauugaagacacauucagagguuugauugguugagauua

SEQ ID NO: 172912 - RNA, 60 nt, hsa
ugcauugucagugucugcucucagaguuuacacauucaauugcuuccaagggugaaucuc

SEQ ID NO: 172913 - RNA, 60 nt, hsa
cgacagagugaccagaaacccuuuuacagucacauucagagucgcugcuggccucaggca

SEQ ID NO: 172914 - RNA, 60 nt, hsa
uacuuugagccucuuaggcagaaaaccuaccacauucacuacugcaaaauguguccuguc

SEQ ID NO: 172915 - RNA, 60 nt, hsa
cuagacucgcgcuaauacagugcuggacaacacauucaccuuuucugugaacaggcagcc

SEQ ID NO: 172916 - RNA, 60 nt, hsa
ccugauaauuugaaaauucauuugcuuuaccacauucaagacagaaacauacaguuuccu

SEQ ID NO: 172917 - RNA, 64 nt, hsa
agagaggauuuuagcuaggauuugaacacuuggugcugggaaccucaggguauugcuugccacu

SEQ ID NO: 172918 - RNA, 64 nt, hsa
ccccaugccuguggcugcgcuuccuauuucuagggcugggaaacacuccuugcaucaagggguc

SEQ ID NO: 172919 - RNA, 64 nt, hsa
cagugcugccaugccacugccaggcaccuggccugcugggaaccccgcagcccgugaagcagug

SEQ ID NO: 172920 - RNA, 64 nt, hsa
caaaugcacaagcucagaauagaucugauggugagcugggaagcuguacucagagcagagcaaa

SEQ ID NO: 172921 - RNA, 64 nt, hsa
ccucugcccugacccucugcauuggaugcaggaagcugggaaagacugauguugauuuggaaac

SEQ ID NO: 172922 - RNA, 64 nt, hsa
gcaagaacagucugaagauggccuuuuaacaaacgcugggaauuuugcuugucauauccagacu

SEQ ID NO: 172923 - RNA, 64 nt, hsa
uauggcuagugaccagcacugaccaccaucccaagcugggaagagcaauuggugaagagugugu

SEQ ID NO: 172924 - RNA, 64 nt, hsa
gucuggauggaggcugcccuggaagcagccccgggcugggaaagggcugagugucaacaggccu

SEQ ID NO: 172925 - RNA, 64 nt, hsa
uaguuccuaugaaagaaccagagcugggaagauggcugggaagccaggccaaagugggggcaac

SEQ ID NO: 172926 - RNA, 64 nt, hsa
ggaagcaauaacuaguuccuaugaaagaaccagagcugggaagauggcugggaagccaggccaa

SEQ ID NO: 172927 - RNA, 64 nt, hsa
gaggcagggccugugaguggacagagcaccccuggcugggaagaagaagaugggguaggaggag

SEQ ID NO: 172928 - RNA, 64 nt, hsa
gcaaacuucgagcccaucagcaggucaacccuaugcugggaaagugaggauuugggauuucugu

SEQ ID NO: 172929 - RNA, 64 nt, hsa
cucaguggagccuuauuaauauccaagacuuagagcugggaaucuuuuugauaccuguagugga

SEQ ID NO: 172930 - RNA, 64 nt, hsa
aaaaacuuccuucaaucuucauuuuggaggcagggcugggaagggagcgcucucuugauucugg

SEQ ID NO: 172931 - RNA, 64 nt, hsa
aggggacucaggaagcaggggguccccauccccagcugggaagaacaugcuauccaaucucauc

SEQ ID NO: 172932 - RNA, 64 nt, hsa
gcauuuucuaugguuacaaggggcugcugcugcugcugggaaucuuccuugcuuaugagaccaa

SEQ ID NO: 172933 - RNA, 64 nt, hsa
agcacaggugagggggugccugcuguggcacagagcugggaaggccuuacagaagaggugacau

SEQ ID NO: 172934 - RNA, 64 nt, hsa
aaacaacagaaauuuauguuuuacaguucuggaggcugggaaguccaagaugagggugucaaca

SEQ ID NO: 172935 - RNA, 64 nt, hsa
uucugggccuaccaagguucaacaagagaacggagcugggaaugugacugcuggagccugagag

SEQ ID NO: 172936 - RNA, 64 nt, hsa
cuugcuucucggugcggacuaaugucagcuuguggcugggaaagagggaugugcagugacgugg

SEQ ID NO: 172937 - RNA, 64 nt, hsa
cauuguccaggaaagaaacuugcagcuuuaaccugcugggaauggcaaacgauuuuacuagacu

SEQ ID NO: 172938 - RNA, 64 nt, hsa
ugagcuggggagcuguugaucuuucacuauacaggcugggaaguguguugaugaccacugagcc

SEQ ID NO: 172939 - RNA, 64 nt, hsa
uuuuuuuaaaagucccccaacaaauaggauucuugcugggaaaggaaguucgguaaggaaaugu

SEQ ID NO: 172940 - RNA, 64 nt, hsa
uccagccuccagagaccgagcagcuguggggccugcugggaaaccaaggucgguuuccgcccuc

SEQ ID NO: 172941 - RNA, 64 nt, hsa
agcaugucuggaaucccgaggguuauauuuaggagcugggaagauuacccccaaagauguucuc

SEQ ID NO: 172942 - RNA, 64 nt, hsa
agcaaaugaaaauaccagaccaagaaaugagugagcugggaaguguuuccaaauacaguuagug

SEQ ID NO: 172943 - RNA, 64 nt, hsa
ugggauaagcccaggugcaaggggaggagggcaggcugggaacagagcggagaaugcccauggc

SEQ ID NO: 172944 - RNA, 64 nt, hsa
agaaaaccuggccacugguaggagcuagggaggggcugggaagauggcagcucacucaguacug

SEQ ID NO: 172945 - RNA, 64 nt, hsa
aggaggcccagaaguuggaaagagauggaauguggcugggaacauugcaucccaaagagcuucu

SEQ ID NO: 172946 - RNA, 64 nt, hsa
ucuugauggccuacgagaggccaaguuccacugggcugggaaaagucacuuugucugucuuguu

SEQ ID NO: 172947 - RNA, 64 nt, hsa
cauccauucagaaguuuuguuguuuuacucuaaagcugggaaaggaaaugagagggaaaagacc

SEQ ID NO: 172948 - RNA, 64 nt, hsa
gucaccaagcaggagaguuaaggauucaccaugagcugggaaaugcuuuugccaugaguaugag

SEQ ID NO: 172949 - RNA, 64 nt, hsa
uagagggguuaaacaacuugucuuaggcuccacagcugggaacaaguggggcugggaagcugac

SEQ ID NO: 172950 - RNA, 64 nt, hsa
cuugucuuaggcuccacagcugggaacaaguggggcugggaagcugacuucgugcucuucacca

SEQ ID NO: 172951 - RNA, 64 nt, hsa
aucguaucaaggucacuggguuuuacuggcuggugcugggaaaaugaagcuaagugaggagcuu

SEQ ID NO: 172952 - RNA, 64 nt, hsa
ccugccuccugggcuauuccucuccacccagaaggcugggaaucccagcugauucccugacagg

SEQ ID NO: 172953 - RNA, 64 nt, hsa
ggcuccuagaauccuuagagucugaauuccuuuagcugggaacagcugucauggucaccccugg

SEQ ID NO: 172954 - RNA, 64 nt, hsa
agaacagaggggacaugaacuccuuggaggcagggcugggaagggacccugggcugugucuccu

SEQ ID NO: 172955 - RNA, 64 nt, hsa
gcaaugaaaccuguucaugucuaagagcagcugggcugggaaucuuccccuuuguucaaggccu

SEQ ID NO: 172956 - RNA, 64 nt, hsa
gggacuaaagaaaugggugucccccaccccaucagcugggaaagcccaggccgcaggaguggga

SEQ ID NO: 172957 - RNA, 64 nt, hsa
uaaccccgccuuccagcacuuucugucauuccaggcugggaaagucuagagcccccuuuggccc

SEQ ID NO: 172958 - RNA, 64 nt, hsa
ccugggcgucaucuccuacauccugugagugaccgcugggaaggcuugucuccugccugccugc

SEQ ID NO: 172959 - RNA, 64 nt, hsa
cauggucucugacuuuggacucuccaaaauccaggcugggaacaugcuaggcaccgccuguggg

SEQ ID NO: 172960 - RNA, 64 nt, hsa
uaaggugaaauacgaaguccuuggucugauauaaagccccuauuggauucuucggaugcguaaa

SEQ ID NO: 172961 - RNA, 64 nt, hsa
caauggcaccuugguggcuucccucugccaugacagccccuaggccaggaaccaucaggggggc

SEQ ID NO: 172962 - RNA, 64 nt, hsa
gucccaccuccagcccgggagccuaggaccacucagccccuaggaguauauuuccgcacuucag

SEQ ID NO: 172963 - RNA, 64 nt, hsa
acgcuggguccuaauuaccagucuuuaaaggcccagccccuagaaacccaagcuccuccucgga

SEQ ID NO: 172964 - RNA, 64 nt, hsa
gaaacucccaacuguccuuacccaccgacaucacagccccuaugaagaaaguagccacaaucuc

SEQ ID NO: 172965 - RNA, 64 nt, hsa
ccaguaauuuuuuauaaaucuucagauuauaaacagccccuaaaaacuuuacaacguuuacaca

SEQ ID NO: 172966 - RNA, 64 nt, hsa
caaagggaauauggaauuuuuuugacuuucuuuugagcaauaaaauaauugucuugccauuacu

SEQ ID NO: 172967 - RNA, 64 nt, hsa
caguucuccauuauaucaaggcuacaaggucuaugagcaauaaugugauuucuggacauugccc

SEQ ID NO: 172968 - RNA, 64 nt, hsa
uaccaacugcauguacuuuuggccuggcugcaaggagcaauauugguuuacucucguauccuua

SEQ ID NO: 172969 - RNA, 64 nt, hsa
cuccugcagacaagcauggucugaaacauucuuugagcaauauuuauugagugccuacuaugug

SEQ ID NO: 172970 - RNA, 64 nt, hsa
gccuccccuuccccucccugccccaggacuuaaagagcaauaguuugccccuuuuggaaugauc

SEQ ID NO: 172971 - RNA, 64 nt, hsa
aaugaucucugaauauauaaaacacacacacaaagagcaauaguuugccccuuuuggaacgacc

SEQ ID NO: 172972 - RNA, 64 nt, hsa
uaaaguacuggugucacccuuugccuauaugguagagcaauaaugcuuuuuaaaaauaaacuuc

SEQ ID NO: 172973 - RNA, 64 nt, hsa
ucuaauauauggaguuucgaagaauaaaauaugagagcaauauuuaaauucucaggaauugacu

SEQ ID NO: 172974 - RNA, 64 nt, hsa
gggagagaggguggaggguuuuauaaacaaacuuaacagcaauauugaaaggaggugggggauu

SEQ ID NO: 172975 - RNA, 64 nt, hsa
guguuggagggccagagacuaguccugagauggaaacagcaacuuguacaguggcugagaaaau

SEQ ID NO: 172976 - RNA, 64 nt, hsa
gagaaaaaccgauucaaaucaacuuguacauggaaacagcaagcauuauggucaaacagcaaag

SEQ ID NO: 172977 - RNA, 64 nt, hsa
aacuuguacauggaaacagcaagcauuauggucaaacagcaaaggccauaaccuuuugggauuu

SEQ ID NO: 172978 - RNA, 64 nt, hsa
ucauaaacagcugugaacccuccccugagggauuaacagcaaugaugggcagucguggaguugg

SEQ ID NO: 172979 - RNA, 64 nt, hsa
cauauccauacacaggugaaacacauacagacucaacagcaaucaugcaguuccagagacacau

SEQ ID NO: 172980 - RNA, 64 nt, hsa
uaaaugcaauaauaugcauguuaacaacauuaaaaacagcaaacagcaaucuaaguacagaaaa

SEQ ID NO: 172981 - RNA, 64 nt, hsa
aauaauaugcauguuaacaacauuaaaaacagcaaacagcaaucuaaguacagaaaagcuuuuu

SEQ ID NO: 172982 - RNA, 64 nt, hsa
aaaauuucaaaguuuaauuaauauaauuaaaagcaacagcaagcagcagccugugaagauuuug

SEQ ID NO: 172983 - RNA, 64 nt, hsa
guuuguuugaauguguagaagaggaaaaagcaacaacagcaacaacacgaagaugauaccaaaa

SEQ ID NO: 172984 - RNA, 64 nt, hsa
aaaccaauuucuacuucauacugauguuuuuggaaacagcaauuaaaguuuuucuuccaugagu

SEQ ID NO: 172985 - RNA, 64 nt, hsa
uugcagauucucugggauuuuaaggaacugagaaaacagcaaaguugacuaaauuuuauauuuc

SEQ ID NO: 172986 - RNA, 64 nt, hsa
ucaggaacgcaccuuccagagccugaugaauagcaacagcaauuuccgggaggucuuggagaag

SEQ ID NO: 172987 - RNA, 64 nt, hsa
caucgagucaagacugccaaacuacagcugguggaacagcaagccuaagucuucucugagagga

SEQ ID NO: 172988 - RNA, 64 nt, hsa
acuucuguauagaacuaacagcaaaaaggcguuaaacagcaagugucaucuacauccuagccuu

SEQ ID NO: 172989 - RNA, 54 nt, hsa
cacuucguacuucuguauagaacuaacagcaaaaaggcguuaaacagcaagugu

SEQ ID NO: 172990 - RNA, 64 nt, hsa
guaaacuuugucaugguuuccauuuacuaacagcaacagcaagaaauaaaucagagagcaaggc

SEQ ID NO: 172991 - RNA, 64 nt, hsa
gcuaauguaaacuuugucaugguuuccauuuacuaacagcaacagcaagaaauaaaucagagag

SEQ ID NO: 172992 - RNA, 64 nt, hsa
aguugaaagcaagagucccugaguauaaaggaaaaacagcaaaacaaaaagcaaacaaaaaaaa

SEQ ID NO: 172993 - RNA, 64 nt, hsa
auuaaugcuuuugccauuauaccuaauuuuugagaacagcaagcccuauuugaccacucucuuc

SEQ ID NO: 172994 - RNA, 64 nt, hsa
aagcaccaccagauggcuaccaaaugauaagaacaacagcaacaaaaggcuccaaaacacacau

SEQ ID NO: 172995 - RNA, 64 nt, hsa
aauuguaugaucguaacauuauuuauuaccacaaaacagcaaaaucuucaaugucuaagaaaac

SEQ ID NO: 172996 - RNA, 64 nt, hsa
cccaagcugcacuauugggaauggauuguggcugaacagcaaaucaaaacaccagaaauauuuu

SEQ ID NO: 172997 - RNA, 64 nt, hsa
gagaagaaaaaaggcuuaucuagauucgaaaauuaacagcaauuauaguaauauauccccuccu

SEQ ID NO: 172998 - RNA, 64 nt, hsa
ucauaaagggagcaccauuguacagucuagcauaaacagcaaauuuuaaagaggacauauuuaa

SEQ ID NO: 172999 - RNA, 64 nt, hsa
caaagaaaaacagauacuaaaagucucuucugaaaacagcaauccagguaagacuuauaacagu

SEQ ID NO: 173000 - RNA, 64 nt, hsa
cucacaccacuguuacuugguguacaugagcaaaaacagcaaguggugaaauucuuaaucaaga

SEQ ID NO: 173001 - RNA, 64 nt, hsa
ucuccagcccaucaucuucguuucggacagagcaaacagcaacaaggagcuggguguggaccag

SEQ ID NO: 173002 - RNA, 64 nt, hsa
ccacagccuggcagcucugaucaggaaagugaggaacagcaacaauuccggaacauuuucaagc

SEQ ID NO: 173003 - RNA, 64 nt, hsa
ucaagcaucacgccuagcaguuucugguuccuuuaacagcaaaaggaaagagagguucugauuc

SEQ ID NO: 173004 - RNA, 64 nt, hsa
cuugccuguuuucuuuauuaguccaaaggaaaacaacagcaacaaaaucuguuuuuaaaauguc

SEQ ID NO: 173005 - RNA, 61 nt, hsa
ccaucuaugaauuccggugacaacgguucagaacagcaaccaaauaaaacugaacuuggca

SEQ ID NO: 173006 - RNA, 64 nt, hsa
auucagaauuacauuuuaucguuuucacauugaaaacagcaaauguugacuuaguaauuuuuau

SEQ ID NO: 173007 - RNA, 64 nt, hsa
uuuagcauuugugccgccuccuuuugcuacucaaaacagcaaugcuuggcggcagccuuccaug

SEQ ID NO: 173008 - RNA, 64 nt, hsa
ucuucacaucuuguuuucauaaacacuagagaggaacagcaauggauaaaaaaacagaugguag

SEQ ID NO: 173009 - RNA, 64 nt, hsa
gccaccacgucuugucccccgcugcauauuauuuaacagcaaaggcaucauaggggcuggcaca

SEQ ID NO: 173010 - RNA, 64 nt, hsa
uuucagauauuucauaauuucuaaccucuguucucucaguaaacagaaugucugaucgaucaug

SEQ ID NO: 173011 - RNA, 64 nt, hsa
auuacauauuugaaacagaagauauuauguuaugcucaguaaauaauuaagagauggcauugug

SEQ ID NO: 173012 - RNA, 64 nt, hsa
caggcagugcagcauuuaggaaagcagugcaguacucaguaaggcagugcaguacucaguaaca

SEQ ID NO: 173013 - RNA, 64 nt, hsa
aaagcagugcaguacucaguaaggcagugcaguacucaguaacacaauacaguacucaggcagu

SEQ ID NO: 173014 - RNA, 64 nt, hsa
caguaacacaauacaguacucaggcagugcaguacucaguaagacagugcagugcucaguaagg

SEQ ID NO: 173015 - RNA, 64 nt, hsa
caggcagugcaguacucaguaagacagugcagugcucaguaaggcagugcaauacucaguaaca

SEQ ID NO: 173016 - RNA, 64 nt, hsa
aagacagugcagugcucaguaaggcagugcaauacucaguaacaguguaguacucaguaacagu

SEQ ID NO: 173017 - RNA, 64 nt, hsa
guaaggcagugcaauacucaguaacaguguaguacucaguaacagugaaguacucaguaauaca

SEQ ID NO: 173018 - RNA, 64 nt, hsa
caguaacaguguaguacucaguaacagugaaguacucaguaauacaguacaguauucaguaagg

SEQ ID NO: 173019 - RNA, 64 nt, hsa
aauacaguacaguauucaguaaggcagugaaguacucaguaauacaauacaguacucaguuagg

SEQ ID NO: 173020 - RNA, 64 nt, hsa
acaguacucaggcagugcaauacucagugcgguacucaguaacacagugcaguacucaguaaca

SEQ ID NO: 173021 - RNA, 64 nt, hsa
uacucagugcgguacucaguaacacagugcaguacucaguaacagugcaguacucaguaacagu

SEQ ID NO: 173022 - RNA, 64 nt, hsa
guaacacagugcaguacucaguaacagugcaguacucaguaacagugcaguacucaguaaggca

SEQ ID NO: 173023 - RNA, 64 nt, hsa
caguaacagugcaguacucaguaacagugcaguacucaguaaggcagugcaguacucaguaaca

SEQ ID NO: 173024 - RNA, 64 nt, hsa
guaacagugcaguacucaguaaggcagugcaguacucaguaacacagugcaguacucaguaaua

SEQ ID NO: 173025 - RNA, 64 nt, hsa
aaggcagugcaguacucaguaacacagugcaguacucaguaauacaguacaguacucaguaagg

SEQ ID NO: 173026 - RNA, 64 nt, hsa
aacacagugcaguacucaguaauacaguacaguacucaguaaggcaguaugguacucaguaaag

SEQ ID NO: 173027 - RNA, 64 nt, hsa
aauacaguacaguacucaguaaggcaguaugguacucaguaaagcaaugcaaugcucaguaaca

SEQ ID NO: 173028 - RNA, 64 nt, hsa
aaggcaguaugguacucaguaaagcaaugcaaugcucaguaacacagugcagugcucaauaagg

SEQ ID NO: 173029 - RNA, 64 nt, hsa
aacacagugcagugcucaauaaggcagugcagugcucaguaaggcagugaauugcuuaguaaca

SEQ ID NO: 173030 - RNA, 64 nt, hsa
aacacaguguagugcucaguaggacagcauaguacucaguaacacagggcagcuaguacucagu

SEQ ID NO: 173031 - RNA, 64 nt, hsa
auaaguacugaguacuuauauaggcaauguaguacucaguaaaucagugcaguacucaguaaug

SEQ ID NO: 173032 - RNA, 64 nt, hsa
uaggcaauguaguacucaguaaaucagugcaguacucaguaaugcaagggcauuucaggcuccu

SEQ ID NO: 173033 - RNA, 64 nt, hsa
cuuggcuuucaggccuggccuuuccuacagggagcucaguaaccuggacggcucuaaggcugga

SEQ ID NO: 173034 - RNA, 64 nt, hsa
gugugucuauaauuguuaaaucuaagugcuuccucucaguaaagccuccuggcaccaggccuuc

SEQ ID NO: 173035 - RNA, 64 nt, hsa
gcacagcugcucaaaguaaagccugagcaguguucucaguaauguauuugaaggaaaaauaccc

SEQ ID NO: 173036 - RNA, 64 nt, hsa
gaauaguaacauuaugaaugccagggacagugugcucaguaaagucuuccauccaaaaggggca

SEQ ID NO: 173037 - RNA, 64 nt, hsa
gcugaagaaggugacugaauuuugaaacuacacccucaguaaagcaaacaggaguuguagauaa

SEQ ID NO: 173038 - RNA, 64 nt, hsa
ggucauacuggacuggcuucguucucuuaauauacucaguaaugacucaagccucuggcuauua

SEQ ID NO: 173039 - RNA, 64 nt, hsa
auuauugugauuaguuguugcuuauuauuuuauacucaguaauaaugugguacacuguuaauuu

SEQ ID NO: 173040 - RNA, 64 nt, hsa
acuuuuuuguuugaaugaaugucacauagguauccucaguaacacagaacgaaauuaccuuugu

SEQ ID NO: 173041 - RNA, 64 nt, hsa
ucuaacauguggguacugugucaucacaaaaucucucaguaaggcuauaugugauccucauuuu

SEQ ID NO: 173042 - RNA, 64 nt, hsa
uuguuuccucaugaaacauugcagaguuugaauccucaguaacucucauugacuggauuagagg

SEQ ID NO: 173043 - RNA, 64 nt, hsa
guuuaagaucacacagcuagugcaguuacccccucucaguaauuauguuuggcaaauaugaaau

SEQ ID NO: 173044 - RNA, 64 nt, hsa
auuagggacauggaugaaauuggaaaucuucauucucaguaaacuaucgcaaggacaaaaaacc

SEQ ID NO: 173045 - RNA, 64 nt, hsa
aucaggguagcugaccauguuuggcagauacuauaauggagacacagaagugugcauggcccaa

SEQ ID NO: 173046 - RNA, 64 nt, hsa
gcugcuuuugauauguucccugacacauaucuugaauggagaccucccuaccaagugaugaaag

SEQ ID NO: 173047 - RNA, 64 nt, hsa
uuccuuucaccaucauuuagaaaugguuugccuuaauggagacaauagcagauccuguaguauu

SEQ ID NO: 173048 - RNA, 64 nt, hsa
aagcugggcagcgucugcucuguguucuguguggaauggagaaaaaaacgccugcccugcugcc

SEQ ID NO: 173049 - RNA, 64 nt, hsa
aguccaaaugaugaaggaaauguuuuaauucacaaauggagauuuguauguguuaucagguuca

SEQ ID NO: 173050 - RNA, 64 nt, hsa
uucgcuauuaaauaaagaaaauuggaugcaagacaauggagaaacuuuaaaacuaaacaggacc

SEQ ID NO: 173051 - RNA, 64 nt, hsa
cuagagacagaggaggccuggcaggggugauaaaaauggagauugaaaugaagagaaauagcca

SEQ ID NO: 173052 - RNA, 64 nt, hsa
uuuaaagacuacaagauuugcuagauaaacuggaaauggagaaguuauugcagacagucaugaa

SEQ ID NO: 173053 - RNA, 64 nt, hsa
auucaccaauuuccuuuaaaacauaagcuaccugaauggagaauacaucuuguuucugaguuuc

SEQ ID NO: 173054 - RNA, 64 nt, hsa
ucuuccauuaagaacacuaaaaaguccuugcaagaauggagauaugcauucaagagaggugcua

SEQ ID NO: 173055 - RNA, 64 nt, hsa
gaccccucucuccccaguauuaucuuacuugcaaaauggagaccaaauucuauccugugaggcu

SEQ ID NO: 173056 - RNA, 64 nt, hsa
uaaagucacugguacuauggacaacuccauagugaauggagauacuugcagagcuugucaugca

SEQ ID NO: 173057 - RNA, 64 nt, hsa
ugucacauagcagcauuccgauucuauguaacugaauggagaugauaagugcuuuccccucuuu

SEQ ID NO: 173058 - RNA, 64 nt, hsa
uuuauaacagucauucuuugauagucaacucuuaaauggagacuugagaugcuuaaauauugua

SEQ ID NO: 173059 - RNA, 59 nt, hsa
uucaggaaaauucaaacugagaccuacaaaauggagaauugacauaucacgugaaugaa

SEQ ID NO: 173060 - RNA, 64 nt, hsa
accagcaccagcucccugucucuucuagccacuuaauggagacacaauggagagguaagacaga

SEQ ID NO: 173061 - RNA, 64 nt, hsa
cucccugucucuucuagccacuuaauggagacacaauggagagguaagacagaccacaaacuag

SEQ ID NO: 173062 - RNA, 64 nt, hsa
caggguuauaggccucuccuuucacauuccagacaauggagaguguuuaugguuucaggaaaag

SEQ ID NO: 173063 - RNA, 64 nt, hsa
uaagaauguuaucagaaucuggucuacuuaggacaauggagacuuuuucaguuuuauaaaggga

SEQ ID NO: 173064 - RNA, 53 nt, hsa
cagacaaagcggagcucuagaguaauggagagugauggaaacaaaguguacuu

SEQ ID NO: 173065 - RNA, 64 nt, hsa
uugacuagaucaagaacuguuuauagcuuuagcaaauggagacagcuuugugaaacuucuucac

SEQ ID NO: 173066 - RNA, 64 nt, hsa
gagccaccgugccuggccaggccccuucucuuuuaauggagacagggucuugcacuaucaccca

SEQ ID NO: 173067 - RNA, 64 nt, hsa
agaaacauuuucucugaaauauauuauuaagggcaauggagauaaauuaauaguagaugugguu

SEQ ID NO: 173068 - RNA, 64 nt, hsa
gugggaucaacaaugauuuucuugaaugggcaugaauggagaugcccgcacaguaauguagaaa

SEQ ID NO: 173069 - RNA, 64 nt, hsa
caagaauuucuggaagaaaggcuguggaagggccaauggagaaaaugaauggacaaagcucagg

SEQ ID NO: 173070 - RNA, 64 nt, hsa
uaugugugcagacaauucucccugagguuagcccaauggagaaaugaagcagaggaaggaaaca

SEQ ID NO: 173071 - RNA, 64 nt, hsa
uacuaugggcagggccccccaccaagcugagccgaauggagacagcugagcugaggccugacuu

SEQ ID NO: 173072 - RNA, 64 nt, hsa
cuaggucuccuuggaaaccaggccugggccucaaaauggagauggaucccaggucuugugggac

SEQ ID NO: 173073 - RNA, 64 nt, hsa
gaagccaaagcugggcucaguggggaaggucaggaauggagaaauugccuuuucucguuagccu

SEQ ID NO: 173074 - RNA, 64 nt, hsa
uuggagaucauuauucuaagugaaauaacucaggaauggagaaccaaauauuguacauccucac

SEQ ID NO: 173075 - RNA, 64 nt, hsa
ugccaagauccuuugaauacaugcaagaacacacaauggagagaaacccuaugaauguaaagaa

SEQ ID NO: 173076 - RNA, 64 nt, hsa
gggaggccgaggcgggcggaucacuaggucaggaaauggagaccauccuggccaacacagugaa

SEQ ID NO: 173077 - RNA, 64 nt, hsa
ugagguuugugaaacaguaggauucucuuuuggcaauggagaauugcaucugaugguucaagug

SEQ ID NO: 173078 - RNA, 64 nt, hsa
uguggcuuuuguugaguuaaauaagaugcuauauaauggagaagaauuugaaaaugcacaaaaa

SEQ ID NO: 173079 - RNA, 64 nt, hsa; identical to SEQ ID NO: 106228

SEQ ID NO: 173080 - RNA, 64 nt, hsa; identical to SEQ ID NO: 106229

SEQ ID NO: 173081 - RNA, 64 nt, hsa; identical to SEQ ID NO: 106230

SEQ ID NO: 173082 - RNA, 64 nt, hsa; identical to SEQ ID NO: 106231

SEQ ID NO: 173083 - RNA, 64 nt, hsa; identical to SEQ ID NO: 106232

SEQ ID NO: 173084 - RNA, 64 nt, hsa; identical to SEQ ID NO: 106233

SEQ ID NO: 173085 - RNA, 64 nt, hsa; identical to SEQ ID NO: 106234

SEQ ID NO: 173086 - RNA, 64 nt, hsa; identical to SEQ ID NO: 106235

SEQ ID NO: 173087 - RNA, 64 nt, hsa; identical to SEQ ID NO: 106236

SEQ ID NO: 173088 - RNA, 64 nt, hsa; identical to SEQ ID NO: 106237

SEQ ID NO: 173089 - RNA, 64 nt, hsa; identical to SEQ ID NO: 106238

SEQ ID NO: 173090 - RNA, 64 nt, hsa; identical to SEQ ID NO: 106239

SEQ ID NO: 173091 - RNA, 64 nt, hsa; identical to SEQ ID NO: 106240

SEQ ID NO: 173092 - RNA, 64 nt, hsa; identical to SEQ ID NO: 106241

SEQ ID NO: 173093 - RNA, 64 nt, hsa; identical to SEQ ID NO: 106242

SEQ ID NO: 173094 - RNA, 64 nt, hsa; identical to SEQ ID NO: 106243

SEQ ID NO: 173095 - RNA, 64 nt, hsa; identical to SEQ ID NO: 106244

SEQ ID NO: 173096 - RNA, 64 nt, hsa; identical to SEQ ID NO: 106245

SEQ ID NO: 173097 - RNA, 64 nt, hsa; identical to SEQ ID NO: 106246

SEQ ID NO: 173098 - RNA, 64 nt, hsa; identical to SEQ ID NO: 106247

SEQ ID NO: 173099 - RNA, 64 nt, hsa; identical to SEQ ID NO: 106248

SEQ ID NO: 173100 - RNA, 64 nt, hsa; identical to SEQ ID NO: 106249

SEQ ID NO: 173101 - RNA, 64 nt, hsa; identical to SEQ ID NO: 106250

SEQ ID NO: 173102 - RNA, 64 nt, hsa; identical to SEQ ID NO: 106251

SEQ ID NO: 173103 - RNA, 64 nt, hsa; identical to SEQ ID NO: 106252

SEQ ID NO: 173104 - RNA, 64 nt, hsa; identical to SEQ ID NO: 106253

SEQ ID NO: 173105 - RNA, 64 nt, hsa; identical to SEQ ID NO: 106254

SEQ ID NO: 173106 - RNA, 64 nt, hsa; identical to SEQ ID NO: 106255

SEQ ID NO: 173107 - RNA, 64 nt, hsa; identical to SEQ ID NO: 106256

SEQ ID NO: 173108 - RNA, 64 nt, hsa; identical to SEQ ID NO: 106257

SEQ ID NO: 173109 - RNA, 64 nt, hsa; identical to SEQ ID NO: 106258

SEQ ID NO: 173110 - RNA, 64 nt, hsa; identical to SEQ ID NO: 106259

SEQ ID NO: 173111 - RNA, 64 nt, hsa; identical to SEQ ID NO: 106260

SEQ ID NO: 173112 - RNA, 64 nt, hsa; identical to SEQ ID NO: 106261

SEQ ID NO: 173113 - RNA, 64 nt, hsa; identical to SEQ ID NO: 106262

SEQ ID NO: 173114 - RNA, 64 nt, hsa; identical to SEQ ID NO: 106263

SEQ ID NO: 173115 - RNA, 64 nt, hsa; identical to SEQ ID NO: 106264

SEQ ID NO: 173116 - RNA, 64 nt, hsa; identical to SEQ ID NO: 106265

SEQ ID NO: 173117 - RNA, 64 nt, hsa; identical to SEQ ID NO: 106266

SEQ ID NO: 173118 - RNA, 64 nt, hsa; identical to SEQ ID NO: 106267

SEQ ID NO: 173119 - RNA, 64 nt, hsa; identical to SEQ ID NO: 106268

SEQ ID NO: 173120 - RNA, 64 nt, hsa; identical to SEQ ID NO: 106269

SEQ ID NO: 173121 - RNA, 64 nt, hsa; identical to SEQ ID NO: 106270

SEQ ID NO: 173122 - RNA, 64 nt, hsa; identical to SEQ ID NO: 106271

SEQ ID NO: 173123 - RNA, 64 nt, hsa; identical to SEQ ID NO: 106272

SEQ ID NO: 173124 - RNA, 64 nt, hsa; identical to SEQ ID NO: 106273

SEQ ID NO: 173125 - RNA, 64 nt, hsa; identical to SEQ ID NO: 106274

SEQ ID NO: 173126 - RNA, 64 nt, hsa; identical to SEQ ID NO: 106275

SEQ ID NO: 173127 - RNA, 64 nt, hsa; identical to SEQ ID NO: 106276

SEQ ID NO: 173128 - RNA, 64 nt, hsa; identical to SEQ ID NO: 106277

SEQ ID NO: 173129 - RNA, 64 nt, hsa; identical to SEQ ID NO: 106278

SEQ ID NO: 173130 - RNA, 64 nt, hsa; identical to SEQ ID NO: 106279

SEQ ID NO: 173131 - RNA, 64 nt, hsa; identical to SEQ ID NO: 106280

SEQ ID NO: 173132 - RNA, 64 nt, hsa; identical to SEQ ID NO: 106281

SEQ ID NO: 173133 - RNA, 64 nt, hsa; identical to SEQ ID NO: 106282

SEQ ID NO: 173134 - RNA, 64 nt, hsa; identical to SEQ ID NO: 106283

SEQ ID NO: 173135 - RNA, 64 nt, hsa; identical to SEQ ID NO: 106284

SEQ ID NO: 173136 - RNA, 64 nt, hsa; identical to SEQ ID NO: 106285

SEQ ID NO: 173137 - RNA, 64 nt, hsa; identical to SEQ ID NO: 106286

SEQ ID NO: 173138 - RNA, 64 nt, hsa; identical to SEQ ID NO: 106287

SEQ ID NO: 173139 - RNA, 64 nt, hsa; identical to SEQ ID NO: 106288

SEQ ID NO: 173140 - RNA, 64 nt, hsa; identical to SEQ ID NO: 106289

SEQ ID NO: 173141 - RNA, 64 nt, hsa; identical to SEQ ID NO: 106290

SEQ ID NO: 173142 - RNA, 64 nt, hsa; identical to SEQ ID NO: 106291

SEQ ID NO: 173143 - RNA, 64 nt, hsa; identical to SEQ ID NO: 106292

SEQ ID NO: 173144 - RNA, 64 nt, hsa; identical to SEQ ID NO: 106293

SEQ ID NO: 173145 - RNA, 64 nt, hsa; identical to SEQ ID NO: 106294

SEQ ID NO: 173146 - RNA, 64 nt, hsa; identical to SEQ ID NO: 106295

SEQ ID NO: 173147 - RNA, 64 nt, hsa; identical to SEQ ID NO: 106296

SEQ ID NO: 173148 - RNA, 64 nt, hsa; identical to SEQ ID NO: 106297

SEQ ID NO: 173149 - RNA, 64 nt, hsa; identical to SEQ ID NO: 106298

SEQ ID NO: 173150 - RNA, 64 nt, hsa; identical to SEQ ID NO: 106299

SEQ ID NO: 173151 - RNA, 64 nt, hsa; identical to SEQ ID NO: 106300

SEQ ID NO: 173152 - RNA, 64 nt, hsa; identical to SEQ ID NO: 106301

SEQ ID NO: 173153 - RNA, 64 nt, hsa; identical to SEQ ID NO: 106302

SEQ ID NO: 173154 - RNA, 64 nt, hsa; identical to SEQ ID NO: 106303

SEQ ID NO: 173155 - RNA, 64 nt, hsa; identical to SEQ ID NO: 106304

SEQ ID NO: 173156 - RNA, 64 nt, hsa; identical to SEQ ID NO: 106305

SEQ ID NO: 173157 - RNA, 64 nt, hsa; identical to SEQ ID NO: 106306

SEQ ID NO: 173158 - RNA, 64 nt, hsa; identical to SEQ ID NO: 106307

SEQ ID NO: 173159 - RNA, 64 nt, hsa; identical to SEQ ID NO: 106308

SEQ ID NO: 173160 - RNA, 64 nt, hsa; identical to SEQ ID NO: 106309

SEQ ID NO: 173161 - RNA, 64 nt, hsa; identical to SEQ ID NO: 106310

SEQ ID NO: 173162 - RNA, 64 nt, hsa; identical to SEQ ID NO: 106311

SEQ ID NO: 173163 - RNA, 64 nt, hsa; identical to SEQ ID NO: 106312

SEQ ID NO: 173164 - RNA, 64 nt, hsa; identical to SEQ ID NO: 106313

SEQ ID NO: 173165 - RNA, 64 nt, hsa; identical to SEQ ID NO: 106314

SEQ ID NO: 173166 - RNA, 64 nt, hsa; identical to SEQ ID NO: 106315

SEQ ID NO: 173167 - RNA, 64 nt, hsa; identical to SEQ ID NO: 106316

SEQ ID NO: 173168 - RNA, 55 nt, hsa; identical to SEQ ID NO: 106317

SEQ ID NO: 173169 - RNA, 64 nt, hsa; identical to SEQ ID NO: 106318

SEQ ID NO: 173170 - RNA, 64 nt, hsa; identical to SEQ ID NO: 106319

SEQ ID NO: 173171 - RNA, 64 nt, hsa; identical to SEQ ID NO: 106320

SEQ ID NO: 173172 - RNA, 64 nt, hsa; identical to SEQ ID NO: 106321

SEQ ID NO: 173173 - RNA, 64 nt, hsa; identical to SEQ ID NO: 106322

SEQ ID NO: 173174 - RNA, 64 nt, hsa; identical to SEQ ID NO: 106323

SEQ ID NO: 173175 - RNA, 64 nt, hsa; identical to SEQ ID NO: 106324

SEQ ID NO: 173176 - RNA, 64 nt, hsa; identical to SEQ ID NO: 106325

SEQ ID NO: 173177 - RNA, 64 nt, hsa; identical to SEQ ID NO: 106326

SEQ ID NO: 173178 - RNA, 64 nt, hsa; identical to SEQ ID NO: 106327

SEQ ID NO: 173179 - RNA, 64 nt, hsa; identical to SEQ ID NO: 106328

SEQ ID NO: 173180 - RNA, 64 nt, hsa; identical to SEQ ID NO: 106329

SEQ ID NO: 173181 - RNA, 64 nt, hsa; identical to SEQ ID NO: 106330

SEQ ID NO: 173182 - RNA, 64 nt, hsa; identical to SEQ ID NO: 106331

SEQ ID NO: 173183 - RNA, 64 nt, hsa; identical to SEQ ID NO: 106332

SEQ ID NO: 173184 - RNA, 64 nt, hsa; identical to SEQ ID NO: 106333

SEQ ID NO: 173185 - RNA, 64 nt, hsa; identical to SEQ ID NO: 106334

SEQ ID NO: 173186 - RNA, 64 nt, hsa; identical to SEQ ID NO: 106335

SEQ ID NO: 173187 - RNA, 64 nt, hsa; identical to SEQ ID NO: 106336

SEQ ID NO: 173188 - RNA, 64 nt, hsa; identical to SEQ ID NO: 106337

SEQ ID NO: 173189 - RNA, 64 nt, hsa; identical to SEQ ID NO: 106338

SEQ ID NO: 173190 - RNA, 64 nt, hsa; identical to SEQ ID NO: 106339

SEQ ID NO: 173191 - RNA, 64 nt, hsa; identical to SEQ ID NO: 106340

SEQ ID NO: 173192 - RNA, 64 nt, hsa; identical to SEQ ID NO: 106341

SEQ ID NO: 173193 - RNA, 64 nt, hsa; identical to SEQ ID NO: 106342

SEQ ID NO: 173194 - RNA, 64 nt, hsa; identical to SEQ ID NO: 106343

SEQ ID NO: 173195 - RNA, 64 nt, hsa; identical to SEQ ID NO: 106344

SEQ ID NO: 173196 - RNA, 64 nt, hsa; identical to SEQ ID NO: 106345

SEQ ID NO: 173197 - RNA, 64 nt, hsa; identical to SEQ ID NO: 106346

SEQ ID NO: 173198 - RNA, 64 nt, hsa; identical to SEQ ID NO: 106347

SEQ ID NO: 173199 - RNA, 64 nt, hsa; identical to SEQ ID NO: 106348

SEQ ID NO: 173200 - RNA, 64 nt, hsa; identical to SEQ ID NO: 106349

SEQ ID NO: 173201 - RNA, 64 nt, hsa; identical to SEQ ID NO: 106350

SEQ ID NO: 173202 - RNA, 64 nt, hsa; identical to SEQ ID NO: 106351

SEQ ID NO: 173203 - RNA, 64 nt, hsa; identical to SEQ ID NO: 106352

SEQ ID NO: 173204 - RNA, 64 nt, hsa; identical to SEQ ID NO: 106353

SEQ ID NO: 173205 - RNA, 64 nt, hsa; identical to SEQ ID NO: 106354

SEQ ID NO: 173206 - RNA, 64 nt, hsa; identical to SEQ ID NO: 106355

SEQ ID NO: 173207 - RNA, 64 nt, hsa; identical to SEQ ID NO: 106356

SEQ ID NO: 173208 - RNA, 64 nt, hsa; identical to SEQ ID NO: 106357

SEQ ID NO: 173209 - RNA, 64 nt, hsa; identical to SEQ ID NO: 106358

SEQ ID NO: 173210 - RNA, 64 nt, hsa; identical to SEQ ID NO: 106359

SEQ ID NO: 173211 - RNA, 64 nt, hsa; identical to SEQ ID NO: 106360

SEQ ID NO: 173212 - RNA, 64 nt, hsa; identical to SEQ ID NO: 106361

SEQ ID NO: 173213 - RNA, 64 nt, hsa; identical to SEQ ID NO: 106362

SEQ ID NO: 173214 - RNA, 64 nt, hsa; identical to SEQ ID NO: 106363

SEQ ID NO: 173215 - RNA, 64 nt, hsa; identical to SEQ ID NO: 106364

SEQ ID NO: 173216 - RNA, 64 nt, hsa; identical to SEQ ID NO: 106365

SEQ ID NO: 173217 - RNA, 64 nt, hsa; identical to SEQ ID NO: 106366

SEQ ID NO: 173218 - RNA, 64 nt, hsa; identical to SEQ ID NO: 106367

SEQ ID NO: 173219 - RNA, 64 nt, hsa; identical to SEQ ID NO: 106368

SEQ ID NO: 173220 - RNA, 64 nt, hsa; identical to SEQ ID NO: 106369

SEQ ID NO: 173221 - RNA, 64 nt, hsa; identical to SEQ ID NO: 106370

SEQ ID NO: 173222 - RNA, 64 nt, hsa; identical to SEQ ID NO: 106371

SEQ ID NO: 173223 - RNA, 64 nt, hsa; identical to SEQ ID NO: 106372

SEQ ID NO: 173224 - RNA, 64 nt, hsa; identical to SEQ ID NO: 106373

SEQ ID NO: 173225 - RNA, 64 nt, hsa; identical to SEQ ID NO: 106374

SEQ ID NO: 173226 - RNA, 64 nt, hsa; identical to SEQ ID NO: 106375

SEQ ID NO: 173227 - RNA, 61 nt, hsa; identical to SEQ ID NO: 106376

SEQ ID NO: 173228 - RNA, 64 nt, hsa; identical to SEQ ID NO: 106377

SEQ ID NO: 173229 - RNA, 64 nt, hsa; identical to SEQ ID NO: 106378

SEQ ID NO: 173230 - RNA, 64 nt, hsa; identical to SEQ ID NO: 106379

SEQ ID NO: 173231 - RNA, 64 nt, hsa; identical to SEQ ID NO: 106380

SEQ ID NO: 173232 - RNA, 64 nt, hsa; identical to SEQ ID NO: 106381

SEQ ID NO: 173233 - RNA, 64 nt, hsa; identical to SEQ ID NO: 106382

SEQ ID NO: 173234 - RNA, 64 nt, hsa; identical to SEQ ID NO: 106383

SEQ ID NO: 173235 - RNA, 64 nt, hsa; identical to SEQ ID NO: 106384

SEQ ID NO: 173236 - RNA, 64 nt, hsa; identical to SEQ ID NO: 106385

SEQ ID NO: 173237 - RNA, 64 nt, hsa; identical to SEQ ID NO: 106386

SEQ ID NO: 173238 - RNA, 64 nt, hsa; identical to SEQ ID NO: 106387

SEQ ID NO: 173239 - RNA, 64 nt, hsa; identical to SEQ ID NO: 106388

SEQ ID NO: 173240 - RNA, 64 nt, hsa; identical to SEQ ID NO: 106389

SEQ ID NO: 173241 - RNA, 64 nt, hsa; identical to SEQ ID NO: 106390

SEQ ID NO: 173242 - RNA, 64 nt, hsa; identical to SEQ ID NO: 106391

SEQ ID NO: 173243 - RNA, 64 nt, hsa; identical to SEQ ID NO: 106392

SEQ ID NO: 173244 - RNA, 64 nt, hsa; identical to SEQ ID NO: 106393

SEQ ID NO: 173245 - RNA, 64 nt, hsa; identical to SEQ ID NO: 106394

SEQ ID NO: 173246 - RNA, 64 nt, hsa; identical to SEQ ID NO: 106395

SEQ ID NO: 173247 - RNA, 64 nt, hsa; identical to SEQ ID NO: 106396

SEQ ID NO: 173248 - RNA, 64 nt, hsa; identical to SEQ ID NO: 106397

SEQ ID NO: 173249 - RNA, 64 nt, hsa; identical to SEQ ID NO: 106398

SEQ ID NO: 173250 - RNA, 64 nt, hsa; identical to SEQ ID NO: 106399

SEQ ID NO: 173251 - RNA, 64 nt, hsa; identical to SEQ ID NO: 106400

SEQ ID NO: 173252 - RNA, 64 nt, hsa; identical to SEQ ID NO: 106401

SEQ ID NO: 173253 - RNA, 64 nt, hsa; identical to SEQ ID NO: 106402

SEQ ID NO: 173254 - RNA, 64 nt, hsa; identical to SEQ ID NO: 106403

SEQ ID NO: 173255 - RNA, 64 nt, hsa; identical to SEQ ID NO: 106404

SEQ ID NO: 173256 - RNA, 64 nt, hsa; identical to SEQ ID NO: 106405

SEQ ID NO: 173257 - RNA, 64 nt, hsa; identical to SEQ ID NO: 106406

SEQ ID NO: 173258 - RNA, 64 nt, hsa; identical to SEQ ID NO: 106407

SEQ ID NO: 173259 - RNA, 64 nt, hsa; identical to SEQ ID NO: 106408

SEQ ID NO: 173260 - RNA, 64 nt, hsa; identical to SEQ ID NO: 106409

SEQ ID NO: 173261 - RNA, 64 nt, hsa; identical to SEQ ID NO: 106410

SEQ ID NO: 173262 - RNA, 64 nt, hsa; identical to SEQ ID NO: 106411

SEQ ID NO: 173263 - RNA, 64 nt, hsa; identical to SEQ ID NO: 106412

SEQ ID NO: 173264 - RNA, 64 nt, hsa; identical to SEQ ID NO: 106413

SEQ ID NO: 173265 - RNA, 64 nt, hsa; identical to SEQ ID NO: 106414

SEQ ID NO: 173266 - RNA, 64 nt, hsa; identical to SEQ ID NO: 106415

SEQ ID NO: 173267 - RNA, 64 nt, hsa; identical to SEQ ID NO: 106416

SEQ ID NO: 173268 - RNA, 64 nt, hsa; identical to SEQ ID NO: 106417

SEQ ID NO: 173269 - RNA, 64 nt, hsa; identical to SEQ ID NO: 106418

SEQ ID NO: 173270 - RNA, 64 nt, hsa; identical to SEQ ID NO: 106419

SEQ ID NO: 173271 - RNA, 64 nt, hsa; identical to SEQ ID NO: 106420

SEQ ID NO: 173272 - RNA, 64 nt, hsa; identical to SEQ ID NO: 106421

SEQ ID NO: 173273 - RNA, 64 nt, hsa; identical to SEQ ID NO: 106422

SEQ ID NO: 173274 - RNA, 64 nt, hsa; identical to SEQ ID NO: 106423

SEQ ID NO: 173275 - RNA, 64 nt, hsa; identical to SEQ ID NO: 106424

SEQ ID NO: 173276 - RNA, 64 nt, hsa; identical to SEQ ID NO: 106425

SEQ ID NO: 173277 - RNA, 64 nt, hsa; identical to SEQ ID NO: 106426

SEQ ID NO: 173278 - RNA, 64 nt, hsa; identical to SEQ ID NO: 106426

SEQ ID NO: 173279 - RNA, 64 nt, hsa; identical to SEQ ID NO: 106425

SEQ ID NO: 173280 - RNA, 64 nt, hsa; identical to SEQ ID NO: 106429

SEQ ID NO: 173281 - RNA, 64 nt, hsa; identical to SEQ ID NO: 106430

SEQ ID NO: 173282 - RNA, 64 nt, hsa; identical to SEQ ID NO: 106431

SEQ ID NO: 173283 - RNA, 64 nt, hsa; identical to SEQ ID NO: 106432

SEQ ID NO: 173284 - RNA, 64 nt, hsa; identical to SEQ ID NO: 106433

SEQ ID NO: 173285 - RNA, 64 nt, hsa; identical to SEQ ID NO: 106434

SEQ ID NO: 173286 - RNA, 64 nt, hsa; identical to SEQ ID NO: 106435

SEQ ID NO: 173287 - RNA, 64 nt, hsa; identical to SEQ ID NO: 106436

SEQ ID NO: 173288 - RNA, 64 nt, hsa; identical to SEQ ID NO: 106437

SEQ ID NO: 173289 - RNA, 64 nt, hsa; identical to SEQ ID NO: 106438

SEQ ID NO: 173290 - RNA, 64 nt, hsa; identical to SEQ ID NO: 106439

SEQ ID NO: 173291 - RNA, 64 nt, hsa; identical to SEQ ID NO: 106440

SEQ ID NO: 173292 - RNA, 64 nt, hsa; identical to SEQ ID NO: 106441

SEQ ID NO: 173293 - RNA, 64 nt, hsa; identical to SEQ ID NO: 106442

SEQ ID NO: 173294 - RNA, 64 nt, hsa; identical to SEQ ID NO: 106443

SEQ ID NO: 173295 - RNA, 64 nt, hsa; identical to SEQ ID NO: 106444

SEQ ID NO: 173296 - RNA, 64 nt, hsa; identical to SEQ ID NO: 106445

SEQ ID NO: 173297 - RNA, 64 nt, hsa; identical to SEQ ID NO: 106446

SEQ ID NO: 173298 - RNA, 64 nt, hsa; identical to SEQ ID NO: 106447

SEQ ID NO: 173299 - RNA, 64 nt, hsa; identical to SEQ ID NO: 106448

SEQ ID NO: 173300 - RNA, 64 nt, hsa
uagacacuuauugccaggguuaaacauaugcucuggcaccaaguucaaaucuuuccuccccauu

SEQ ID NO: 173301 - RNA, 64 nt, hsa
agccuuugguccauuucuuaugauuuccuuuaaaggcaccaaaucuuaucuggaaauaaauugu

SEQ ID NO: 173302 - RNA, 64 nt, hsa
gugcucauagugaucagcugugcaggagccaugaggcaccaaccucuccccgcagggcaaagcc

SEQ ID NO: 173303 - RNA, 64 nt, hsa
uuugaacccugugagccugagacagagagggccaggcaccaaccacaaggcgggaaaguccaug

SEQ ID NO: 173304 - RNA, 64 nt, hsa
gaaguaaaacuuggccuccuccagccccucucauggcaccaauggaaguguccuccuguucucu

SEQ ID NO: 173305 - RNA, 64 nt, hsa
gcgguaagaggagggggagccaggcucaaguauuggcaccaaguuaggucucagaggaaagaau

SEQ ID NO: 173306 - RNA, 64 nt, hsa
gaggccucugggccuccucuaacaggggcuggugggcaccaagagccaauggaguagaccccug

SEQ ID NO: 173307 - RNA, 64 nt, hsa
ggagcacaaaagccucucaucccccauuaaccagggcaccaagcccacagguguccccagccca

SEQ ID NO: 173308 - RNA, 65 nt, hsa
uaaugagcauuuaaaugcaacagauaucauuucaggugacuuaacaugaaugaauaaaagucaau

SEQ ID NO: 173309 - RNA, 65 nt, hsa
uuuuggugugggaguugucaugaggcuguguugaagugacuuaucuaugugggauauugaguauc

SEQ ID NO: 173310 - RNA, 65 nt, hsa
uggcuguuggcugucaucuugaacucuauuugaaugugacuuaaaucacaaguaacguguuuugu

SEQ ID NO: 173311 - RNA, 65 nt, hsa
cccauucagcuguuuuaacacagaaauucaaaauagugacuuaacauggaagcuauuucucucuu

SEQ ID NO: 173312 - RNA, 65 nt, hsa
uaagccauuggauaauacugaaucuguuucccuaagugacuuaaccuuagagcaagcacaacauc

SEQ ID NO: 173313 - RNA, 65 nt, hsa
uggcugugccugugacuccagaguccuaucuuacugugacuuaaaguuugauggagagaaagcug

SEQ ID NO: 173314 - RNA, 64 nt, hsa
auuguuaucaauuaacuguuuuucuccauuucauaauucucaagauuuuucuaaauacagccuu

SEQ ID NO: 173315 - RNA, 64 nt, hsa
uugacacggauuauuuguugcuuuuauguuucuaaauucucaauuaaaaagaaguguauccuua

SEQ ID NO: 173316 - RNA, 64 nt, hsa
uaaguagaacuguaacuacguuggcacugguacgaauucucagugagaaugcaaugaaacaguc

SEQ ID NO: 173317 - RNA, 64 nt, hsa
guaugaaaguuguuaccacauaggcacugguacgaauucucaauaagaaugcaguggaacaguu

SEQ ID NO: 173318 - RNA, 64 nt, hsa
aguucuucuccaauccuaucacugauaguguccaaauucucaccaaauugcuccuaagcuucaa

SEQ ID NO: 173319 - RNA, 64 nt, hsa
cacuacauuagaacacugcauuagagcccauuucaauucucaaaagaaaaggcaaaaccuggga

SEQ ID NO: 173320 - RNA, 64 nt, hsa
guuuuuaagcuacacgagaauuuuuuuuuuaauuaauucucacuguuuguucagucugucuuca

SEQ ID NO: 173321 - RNA, 64 nt, hsa
cuccugauaccuuugcuuaauuaaacuagaugauaauucucagguacugauaaacaccuguugu

SEQ ID NO: 173322 - RNA, 64 nt, hsa
uuuauaugguugagucuccugaauauuuugaaugaauucucaacaaaaugugcuagccacuggg

SEQ ID NO: 173323 - RNA, 64 nt, hsa
auuuuauagugagggagguuggcauggagacuaaaauucucaggaaaaugagauccguguuaga

SEQ ID NO: 173324 - RNA, 64 nt, hsa
guauuuucaagaaaaggcagaacaaauaaugcaaaauucucaguaauagugauacauggauaua

SEQ ID NO: 173325 - RNA, 64 nt, hsa
caguaauagugauacauggauauacuuccuuuuaaauucucagcugcaaaauaauuguagacaa

SEQ ID NO: 173326 - RNA, 64 nt, hsa
aacuuaauuggauacuuuuagcaaauaggaacuuaauucucagcacugaacaugaauuacuucc

SEQ ID NO: 173327 - RNA, 64 nt, hsa
gaguagccacugguugcauaauaauagagaccuaaauucucaaauagggaaagagguuuuaaaa

SEQ ID NO: 173328 - RNA, 64 nt, hsa
acuguggucuugguguuuuacauagacugucucuaauucucacaacucugcaaaauauauauau

SEQ ID NO: 173329 - RNA, 64 nt, hsa
aauguggacuuuauugagaagcauggauguuagugaaaguuacuacaguguggaguguugagac

SEQ ID NO: 173330 - RNA, 64 nt, hsa
gauucauuuugcagauuuacauuuugcuuguguggaaaguuacguucacuucaaccuacagacc

SEQ ID NO: 173331 - RNA, 64 nt, hsa
uuuugauggccuuuuaaacaagacuccaguaugugaaaguuaauugcugugcuccacagaucuu

SEQ ID NO: 173332 - RNA, 64 nt, hsa
ugugcuccacagaucuugucuauuggccccuguagaaaguuaaccuuuguuguuuuccuuuuau

SEQ ID NO: 173333 - RNA, 64 nt, hsa
uuuagaguagucuucacuguuaucuauauaccuagaaaguuaacugggagcuuugacucuuacu

SEQ ID NO: 173334 - RNA, 64 nt, hsa
ggaagauuacucuuuggucaagggcauacaaauagaaaguuaauaaaggggaaugguguugaaa

SEQ ID NO: 173335 - RNA, 64 nt, hsa
aguagcugcucaugugcaucuuuguauguuucuagaaaguuauauuuuaaacaaguucucugau

SEQ ID NO: 173336 - RNA, 64 nt, hsa
uaaaaaucggcgauuuuguacuugaagagaacaugaaaguuauugcuaaaguagcugcucaugu

SEQ ID NO: 173337 - RNA, 64 nt, hsa
uucuacuaccugacauuuauuccaagaagaucuggaaaguuaaauaaauuuauaaauuuaauaa

SEQ ID NO: 173338 - RNA, 64 nt, hsa
caauuccuauucccaaaaugaacauauuacuggggaaaguuaguugagaaucagagcauauguu

SEQ ID NO: 173339 - RNA, 64 nt, hsa
accuaaugaggcaucucggaagucaaagaagagggaaaguuaaccuuuucuacugauuucguag

SEQ ID NO: 173340 - RNA, 64 nt, hsa
uaggauuagagcuagaauuggguuaggugagaaagaaaguuaagguuaaggcuagaguugucuu

SEQ ID NO: 173341 - RNA, 64 nt, hsa
aaaaaaaaaaagaacgugggaaauaugaaccuuugaaaguuaaucugugaauugaaaguuuaac

SEQ ID NO: 173342 - RNA, 64 nt, hsa
aucuacauuucagugcuuuuucccuaagcuguuugaaaguuacgcuuuucuguuguucuagagc

SEQ ID NO: 173343 - RNA, 64 nt, hsa
cauaguaaucccaaaggauuguguuacuccccgugaaaguuauuacuuuuccuuuaaaaauggu

SEQ ID NO: 173344 - RNA, 64 nt, hsa
uugggggagcaaauguuuuucagccuucagaaaugaaaguuaaggauuuuagcacuagguaaaa

SEQ ID NO: 173345 - RNA, 64 nt, hsa; identical to SEQ ID NO: 109624

SEQ ID NO: 173346 - RNA, 64 nt, hsa; identical to SEQ ID NO: 109625

SEQ ID NO: 173347 - RNA, 64 nt, hsa; identical to SEQ ID NO: 109626

SEQ ID NO: 173348 - RNA, 64 nt, hsa; identical to SEQ ID NO: 109627

SEQ ID NO: 173349 - RNA, 64 nt, hsa; identical to SEQ ID NO: 109628

SEQ ID NO: 173350 - RNA, 64 nt, hsa; identical to SEQ ID NO: 109629

SEQ ID NO: 173351 - RNA, 64 nt, hsa; identical to SEQ ID NO: 109630

SEQ ID NO: 173352 - RNA, 64 nt, hsa; identical to SEQ ID NO: 109631

SEQ ID NO: 173353 - RNA, 64 nt, hsa; identical to SEQ ID NO: 109632

SEQ ID NO: 173354 - RNA, 64 nt, hsa; identical to SEQ ID NO: 109633

SEQ ID NO: 173355 - RNA, 64 nt, hsa; identical to SEQ ID NO: 109634

SEQ ID NO: 173356 - RNA, 64 nt, hsa; identical to SEQ ID NO: 109635

SEQ ID NO: 173357 - RNA, 64 nt, hsa; identical to SEQ ID NO: 109636

SEQ ID NO: 173358 - RNA, 64 nt, hsa; identical to SEQ ID NO: 109637

SEQ ID NO: 173359 - RNA, 64 nt, hsa
uuuuccucuggagagacagaucugaauguucaguucuagccaagguagauuuuacuuucaacuu

SEQ ID NO: 173360 - RNA, 64 nt, hsa
gcccugugugucuugguuuaguuaugguuucauuucuagccauacaauugaugaauuguguaca

SEQ ID NO: 173361 - RNA, 64 nt, hsa
aaagguuuguuucccagauuuguaaugguccugcucuagccauuugcaguuuuguuuuagauga

SEQ ID NO: 173362 - RNA, 64 nt, hsa
ggaauggagucuccugucccaaucauuuucaaaaucuagccaggcaaauuucuguuauauuuca

SEQ ID NO: 173363 - RNA, 64 nt, hsa
ccuccucugggagggggucccccugccuggccucgcccccgagucucccugcugcuguagagcc

SEQ ID NO: 173364 - RNA, 64 nt, hsa
ucccccucguggguggcaggagagcggacuuagagcccccgagggccccucagcagaggaaggg

SEQ ID NO: 173365 - RNA, 64 nt, hsa
cagcgcucaaagggaacggaagccuuccccucccgcccccgaucuuguccucuuucccccuucu

SEQ ID NO: 173366 - RNA, 64 nt, hsa
uggcaaggacucaggucuaggucccuucccagaagcccccgagccucauuugacuguguggcuc

SEQ ID NO: 173367 - RNA, 54 nt, hsa
aaugcugcuccaucaugugagccggcccccgagaccccggcccccaccccacac

SEQ ID NO: 173368 - RNA, 64 nt, hsa
gcuauaacccccucugcuucuggugugugacgaggcccccgauguucuugauuuucccagagaa

SEQ ID NO: 173369 - RNA, 64 nt, hsa
gucuccggcuuccacccagacggcacucaagccugcccccgaggcgugcuuccuuccugauugu

SEQ ID NO: 173370 - RNA, 64 nt, hsa
ucagcuagcuuagagugcguggcacgggccccccgcccccgagaucuggagcccagggacuuuc

SEQ ID NO: 173371 - RNA, 64 nt, hsa
cgacccagagccgagcuccacuucugcuccggcugcccccgaaggcgcugcccaccccgcugag

SEQ ID NO: 173372 - RNA, 60 nt, hsa
uccucuugcucuugcaguaauuucuaugcagcccccgacccagagccgagcuccacuucu

SEQ ID NO: 173373 - RNA, 64 nt, hsa; identical to SEQ ID NO: 153164

SEQ ID NO: 173374 - RNA, 64 nt, hsa; identical to SEQ ID NO: 153165

SEQ ID NO: 173375 - RNA, 64 nt, hsa; identical to SEQ ID NO: 153166

SEQ ID NO: 173376 - RNA, 64 nt, hsa; identical to SEQ ID NO: 153167

SEQ ID NO: 173377 - RNA, 63 nt, hsa; identical to SEQ ID NO: 153168

SEQ ID NO: 173378 - RNA, 64 nt, hsa; identical to SEQ ID NO: 153169

SEQ ID NO: 173379 - RNA, 64 nt, hsa; identical to SEQ ID NO: 153170

SEQ ID NO: 173380 - RNA, 64 nt, hsa; identical to SEQ ID NO: 153171

SEQ ID NO: 173381 - RNA, 64 nt, hsa; identical to SEQ ID NO: 153172

SEQ ID NO: 173382 - RNA, 64 nt, hsa; identical to SEQ ID NO: 153173

SEQ ID NO: 173383 - RNA, 64 nt, hsa; identical to SEQ ID NO: 153174

SEQ ID NO: 173384 - RNA, 64 nt, hsa; identical to SEQ ID NO: 153175

SEQ ID NO: 173385 - RNA, 64 nt, hsa; identical to SEQ ID NO: 153176

SEQ ID NO: 173386 - RNA, 64 nt, hsa; identical to SEQ ID NO: 153177

SEQ ID NO: 173387 - RNA, 64 nt, hsa; identical to SEQ ID NO: 153178

SEQ ID NO: 173388 - RNA, 64 nt, hsa; identical to SEQ ID NO: 153179

SEQ ID NO: 173389 - RNA, 64 nt, hsa; identical to SEQ ID NO: 153180

SEQ ID NO: 173390 - RNA, 64 nt, hsa; identical to SEQ ID NO: 153181

SEQ ID NO: 173391 - RNA, 64 nt, hsa; identical to SEQ ID NO: 153182

SEQ ID NO: 173392 - RNA, 64 nt, hsa; identical to SEQ ID NO: 153183

SEQ ID NO: 173393 - RNA, 64 nt, hsa; identical to SEQ ID NO: 153184

SEQ ID NO: 173394 - RNA, 64 nt, hsa; identical to SEQ ID NO: 153185

SEQ ID NO: 173395 - RNA, 64 nt, hsa; identical to SEQ ID NO: 153186

SEQ ID NO: 173396 - RNA, 64 nt, hsa; identical to SEQ ID NO: 153187

SEQ ID NO: 173397 - RNA, 64 nt, hsa; identical to SEQ ID NO: 153188

SEQ ID NO: 173398 - RNA, 64 nt, hsa; identical to SEQ ID NO: 153189

SEQ ID NO: 173399 - RNA, 64 nt, hsa; identical to SEQ ID NO: 153190

SEQ ID NO: 173400 - RNA, 64 nt, hsa; identical to SEQ ID NO: 153191

SEQ ID NO: 173401 - RNA, 64 nt, hsa
ucauggagcuuacauucuacagggagaaagagauagccaauacauaggaauaaauauauacaag

SEQ ID NO: 173402 - RNA, 64 nt, hsa
gcaguggucaaauaucuagauuuauuuugaaaagagccaauaggauuugcugagaguuugaaug

SEQ ID NO: 173403 - RNA, 64 nt, hsa
cuuccaggugcuaccauauggagccuaaggauaaagccaauaccaaagaaaacagugacuaaac

SEQ ID NO: 173404 - RNA, 64 nt, hsa
aagcagagcuaccucagaacuuuucagcuaugugagccaauaaacaucugucaaacgaguuaga

SEQ ID NO: 173405 - RNA, 64 nt, hsa
cacaggcagaguaguugaucucacacaacgggugaucucacaaaacugguaaguuucuuaugcu

SEQ ID NO: 173406 - RNA, 64 nt, hsa
ggauuggcauacguguucacaggcagaguaguugaucucacacaacgggugaucucacaaaacu

SEQ ID NO: 173407 - RNA, 64 nt, hsa
cuccacuucucaaacuuuauuugagauuuauuuuaucucacagguuuguguaauuguuggaaaa

SEQ ID NO: 173408 - RNA, 64 nt, hsa
ugcacacagauaacaugcaugcuauuuaugucacaucucacauuaaauuauuuuaaaauaagca

SEQ ID NO: 173409 - RNA, 64 nt, hsa
ugauaugguauccuuuugagugagguauauacucaucucacaagugaagugccuacugauauua

SEQ ID NO: 173410 - RNA, 64 nt, hsa
gaguucuguuaggaauaaaagaugaaacuauuguaucucacaaaaaaucuuauuucagaaugga

SEQ ID NO: 173411 - RNA, 64 nt, hsa; identical to SEQ ID NO: 124393

SEQ ID NO: 173412 - RNA, 64 nt, hsa; identical to SEQ ID NO: 124394

SEQ ID NO: 173413 - RNA, 64 nt, hsa; identical to SEQ ID NO: 124395

SEQ ID NO: 173414 - RNA, 54 nt, hsa; identical to SEQ ID NO: 124396

SEQ ID NO: 173415 - RNA, 64 nt, hsa; identical to SEQ ID NO: 124397

SEQ ID NO: 173416 - RNA, 64 nt, hsa; identical to SEQ ID NO: 124398

SEQ ID NO: 173417 - RNA, 64 nt, hsa; identical to SEQ ID NO: 124399

SEQ ID NO: 173418 - RNA, 64 nt, hsa; identical to SEQ ID NO: 124400

SEQ ID NO: 173419 - RNA, 64 nt, hsa; identical to SEQ ID NO: 124401

SEQ ID NO: 173420 - RNA, 64 nt, hsa
aguuccgauggugcccguggucaaaagcgaaaaacauggacaauuccuauucauucuuagcacu

SEQ ID NO: 173421 - RNA, 64 nt, hsa
ugugucaagcccucguuagcugaugagguaaaugcauggacaacuuccuaggacuucucggcuc

SEQ ID NO: 173422 - RNA, 64 nt, hsa
augggucagacuuuuggauuaaaaaguauuauaucauggacauacauuuuuuaaaguaccaaag

SEQ ID NO: 173423 - RNA, 64 nt, hsa
ccuguguuaccacgaaugaggcacaacuauacuacauggacagaguacugcauugcaccaugag

SEQ ID NO: 173424 - RNA, 64 nt, hsa
caugaguaugagcaaauucccucuuucccugaaucauggacauucuagauuaaaagaacauuuu

SEQ ID NO: 173425 - RNA, 64 nt, hsa
aaaaccugaaugugaugugcacauuuucaucccacauggacaauguauguguuuuaauaaaugg

SEQ ID NO: 173426 - RNA, 64 nt, hsa
uaccgcaaucucuaaacacaaauugugaagauuucauggacacugaucacuuccccaaucaaua

SEQ ID NO: 173427 - RNA, 64 nt, hsa
agccauggcagaagaacguggauugugaagauuucauggacauuuauuaguuccccaaauuaau

SEQ ID NO: 173428 - RNA, 64 nt, hsa
accacacagcccugaccgggccuuggaggagagccauggacaggcuccuccaugccgucuuucc

SEQ ID NO: 173429 - RNA, 64 nt, hsa
gaggagacugagcguccccagccccaccuggcggcauggacacagaaaagcuacgccggcuggc

SEQ ID NO: 173430 - RNA, 64 nt, hsa
acuaccacaccaggccaauuuuuguuuuuuuuuuuugguagaaacgggucuguuuugcccaggc

SEQ ID NO: 173431 - RNA, 64 nt, hsa
gccaccaugcuugacuaauuuuugugauuuuuuuuugguagagaccagggguuucacuauguug

SEQ ID NO: 173432 - RNA, 64 nt, hsa
gcaucacagggcuucacugcacacacuguguucagggcaagauuucaucauuuacugacugcau

SEQ ID NO: 173433 - RNA, 64 nt, hsa
gagcacaggaguuugaggcugcagugagcagccugggcaagagagugagacuccguuuugugcc

SEQ ID NO: 173434 - RNA, 64 nt, hsa
ugucaggauuauaccaagagucuugcuaccaggagggcaagaagaccaaaacagacagacaagu

SEQ ID NO: 173435 - RNA, 64 nt, hsa
aaaguguugaaaaacuuaauaacaaaugcuuguugggcaagaaugggauugaggauuaucuucu

SEQ ID NO: 173436 - RNA, 64 nt, hsa
auuggaaauccagcugccuaguggccaguggguggggcaagacugucaacgagauuuacagcug

SEQ ID NO: 173437 - RNA, 64 nt, hsa
uccucuucccagccucaucccuguuuuucuguuagggcaagacucuuccauaagccugcuaaaa

SEQ ID NO: 173438 - RNA, 64 nt, hsa
uuggcauguggauuacaaguccugcuuugacacugggcaagaauuuaagauuguucuaucucua

SEQ ID NO: 173439 - RNA, 64 nt, hsa
gccaaacacauuuacccuuuggccccacuuugaagggcaagaaauggcgucugcucugguggcu

SEQ ID NO: 173440 - RNA, 64 nt, hsa
auauuaaaacacuuuuuuaaaggacaguugaaaagggcaagaggaaaccagggcaguucuagag

SEQ ID NO: 173441 - RNA, 64 nt, hsa
ccccuuauucuuccuugaagugcccgagcauguagggcaagaaggaaggcugaagcgcuguccc

SEQ ID NO: 173442 - RNA, 64 nt, hsa
aagaucacacuauugcacuccagccugggcgacagggcaagacucugucucaaaaaaaauaaaa

SEQ ID NO: 173443 - RNA, 64 nt, hsa
gggagccucgccuuacaacuaauuccugccuuucguccaguaccaagucccccguugcuucugg

SEQ ID NO: 173444 - RNA, 64 nt, hsa
cgacacguccacauauguauuuguguauguuaauguccaguaucacaucacccaugaaagucgu

SEQ ID NO: 173445 - RNA, 64 nt, hsa
ccgucucaaguuccgcauccucaggcgccagccuguccaguagcaugaacaccgcgaacagccu

SEQ ID NO: 173446 - RNA, 64 nt, hsa
ugcagucugacaagcucaucacugaauucugcuaguccaguagcaaugucuuccucuuaugacc

SEQ ID NO: 173447 - RNA, 64 nt, hsa
ucuucagcgugucugguaccuuggauguucaaacagggaacacugucagggcugaggagaacag

SEQ ID NO: 173448 - RNA, 64 nt, hsa
gauccagaacaugacaacagagagcugcguccacagggaacaaagcccugaccucucucuccac

SEQ ID NO: 173449 - RNA, 64 nt, hsa
ugaaaaaguuccauagaaaaggcgugcaguacuaagggaacaauccaugugauuaauguuuuca

SEQ ID NO: 173450 - RNA, 64 nt, hsa
cuuugacuucuugcuucagucaucagccagcaagagggaacaaaacuguucuuuugcauuuugc

SEQ ID NO: 173451 - RNA, 64 nt, hsa
gcccuugcaauuuuuaauuaacaagcaaggcccaagggaacacauguccucaaaaguuuuucug

SEQ ID NO: 173452 - RNA, 64 nt, hsa
uucuguucacucaacaaugccagaugaauggaagagggaacacacugagaugacuuagacucug

SEQ ID NO: 173453 - RNA, 64 nt, hsa
ucuuaauggggagacauuaucauggcaugacuuaagggaacauugguuugugaaggaaaaacag

SEQ ID NO: 173454 - RNA, 64 nt, hsa
uucauaaauuuacuugagguugccucaagaacucagggaacaauacuguaaacugucuuccuga

SEQ ID NO: 173455 - RNA, 64 nt, hsa
auuauucauaacaaugagugucuuuuagugucacagggaacaguuauuagguuugaagcaaccu

SEQ ID NO: 173456 - RNA, 64 nt, hsa
gccuguccccagggucugcuccgccugccaggcaagggaacagguccucccaagggccucugcc

SEQ ID NO: 173457 - RNA, 64 nt, hsa
uucauuuuaaaaacccucaacaaauuacacauugagggaacauacuucaauaagaaccaucuau

SEQ ID NO: 173458 - RNA, 64 nt, hsa
ggagcuaaacauugauuacacauggacucaaagaagggaacaguagacacgggcuuaugggugg

SEQ ID NO: 173459 - RNA, 64 nt, hsa
cuguagaagucugucuuucuauagaaauauugugcuuacucaaguguuaaauuauuuuuucuau

SEQ ID NO: 173460 - RNA, 64 nt, hsa
gcauagaggccaagguauucuauucuaauaacugcuuacucaacacuaccaccuuuuccuuaua

SEQ ID NO: 173461 - RNA, 64 nt, hsa
uaaaaccucucaacacagaaggaauacaggagaacuuacucaauuugauaaagaacuacuacaa

SEQ ID NO: 173462 - RNA, 64 nt, hsa
aagaaaucgauguuaccuugcuaguagaugcagacuuacucagauuuugcuaugguuugcgugc

SEQ ID NO: 173463 - RNA, 64 nt, hsa
guguuauuaugccacagacauuaaccuauuccaccuuacucaaggguguacguaaaacauggua

SEQ ID NO: 173464 - RNA, 64 nt, hsa
agacugugaaaaagccauuaauacaugcucacaucuuacucaacaucagagaguucauacucaa

SEQ ID NO: 173465 - RNA, 64 nt, hsa
ggaauguaggaaggccuuuaggcagagggcgcaucuuacucaacaucaaagaauuccuacuggu

SEQ ID NO: 173466 - RNA, 64 nt, hsa
agaaugugggaagguuuuuaauaauuauccaacucuuacucaacaucaaagaauucauaccagu

SEQ ID NO: 173467 - RNA, 64 nt, hsa
gggagaccagcugggccuccaaguaggauaaccccucacugagcaccacauucucuagcuucuu

SEQ ID NO: 173468 - RNA, 64 nt, hsa
cucacucaucccuccuguacccuggccagaacaucucacugauacucgaauucuuuuggcaaac

SEQ ID NO: 173469 - RNA, 64 nt, hsa
ucacccagacuggaaugcagugacacaaucucggcucacugaaaccucugccuuccagguucaa

SEQ ID NO: 173470 - RNA, 64 nt, hsa
gaaagaagccacagcucuucuuggcguauuuauacucacugagucuuaacuuuucaccaggggu

SEQ ID NO: 173471 - RNA, 64 nt, hsa
uuaugggauucagaacaaugagaucauaauaauucucacugaccaaagcugggacuccauccug

SEQ ID NO: 173472 - RNA, 64 nt, hsa
cacucauacagccagcccaccagcccaccauuaacucacugaacaaugagacaauguugaggac

SEQ ID NO: 173473 - RNA, 64 nt, hsa
uaaagucaugcuuaaguacaaauuccaugaaaagcucacugauccuaauucuuucccuuugagg

SEQ ID NO: 173474 - RNA, 64 nt, hsa
uucaagagucagagcagugagcucagaggcccuucucacugagacagcaacauuuaaaccaaac

SEQ ID NO: 173475 - RNA, 64 nt, hsa
cacugaaauugaagaugaggaaaguagcuguacacucacugaaugcucccccuuacuagauauu

SEQ ID NO: 173476 - RNA, 64 nt, hsa
cccuguuuugaguauggaagccagugccuguguacucacugaaauugaagaugaggaaaguagc

SEQ ID NO: 173477 - RNA, 64 nt, hsa
uucugaaaagaugccauuuguuuccuucugaucucucacugaauaauguuuacuguacagucuu

SEQ ID NO: 173478 - RNA, 64 nt, hsa
uugaauuucuuugggaagaaaguaaaucugauggcucacugauuuuugaaaagccugaauaaaa

SEQ ID NO: 173479 - RNA, 64 nt, hsa
ucauccaugcacagccacuaucauacccuuuauucucacugaaaggcagaacucagaaccuguu

SEQ ID NO: 173480 - RNA, 64 nt, hsa
aagugaggggcccuuugcauagcucuccuucccccucacugaagcuggguagccuauugggguu

SEQ ID NO: 173481 - RNA, 64 nt, hsa
ucccuugagacuuugggguaguuuggcugccauucucacugacaaaauguauaucagcccccac

SEQ ID NO: 173482 - RNA, 64 nt, hsa
cugguggguauuaaauaugcacaauauuccauagcucacugaggauuuuaaaauuauaagcaua

SEQ ID NO: 173483 - RNA, 64 nt, hsa
aaccuuucucugccucucccacacucucccagagcucacugauuagacagcacaagggucucag

SEQ ID NO: 173484 - RNA, 64 nt, hsa
aagcuacugccuucuagagacaaccggcagugaccucacugaagacaaaaacugcccuagccag

SEQ ID NO: 173485 - RNA, 64 nt, hsa
ugugacccucagucagguuggugggggcugaguccucacugagcagccacuuuccacaucugcu

SEQ ID NO: 173486 - RNA, 64 nt, hsa
uccugcccucagcugcgcgaagcgcucggcccagcucacugaagcugcccugccuccgggccgg

SEQ ID NO: 173487 - RNA, 64 nt, hsa
ugcccaccugugaaauggggcugauaccaccuaccucacugaagucccaggguucaagugugug

SEQ ID NO: 173488 - RNA, 64 nt, hsa
ugacggcguguguuggucccaucucucagaccagcucacugaggcagaggaguugcucagaggc

SEQ ID NO: 173489 - RNA, 64 nt, hsa
ggaagaaccaagcggugccagccacgagacgucaccaagaaaacaugcaacucaaacgacggaa

SEQ ID NO: 173490 - RNA, 64 nt, hsa
uccaacucccucugggaaggugaccuggccagagccaagaaacacuuucagaaaaacaaaugug

SEQ ID NO: 173491 - RNA, 64 nt, hsa
ucuucagacacauuugguacauccagaaauagauccaagaaauggggugguugaguggguccgc

SEQ ID NO: 173492 - RNA, 64 nt, hsa
guuuuaaaggaagaaauauuuucaaauucuuaauccaagaaaauacugaguuggaaucuuagac

SEQ ID NO: 173493 - RNA, 64 nt, hsa
ccaggauccugggccacaggcugggaugguccuuccaagaaagggucauuucagacgcagcccu

SEQ ID NO: 173494 - RNA, 64 nt, hsa
ggauacagguccugauuugguaggaauauuauucccaagaaauacccgcuccucaccuacuccc

SEQ ID NO: 173495 - RNA, 64 nt, hsa
cucccaaugggagcccacggaacuaaguagggucccaagaaaaaaaacgggagcuauuucacag

SEQ ID NO: 173496 - RNA, 64 nt, hsa
ugggguuccugguggauuucuuacuaccuaacgcccaagaaaaccaacuaaggacucucaaacc

SEQ ID NO: 173497 - RNA, 64 nt, hsa
cauuucaugggggcugaggcagaacccaggagcuccaagaaaggccacccauagagcucauccu

SEQ ID NO: 173498 - RNA, 64 nt, hsa
guguuacguugaagccagagucuuauaacaccucccaagaaagauaggggaagaagccagaacc

SEQ ID NO: 173499 - RNA, 64 nt, hsa
agcccuccucucccaagaaauccaggcuccucucccaagaaauccaggugcuuuccagacucca

SEQ ID NO: 173500 - RNA, 64 nt, hsa
aagaacugauuggggcuuccacagcccuccucucccaagaaauccaggcuccucucccaagaaa

SEQ ID NO: 173501 - RNA, 64 nt, hsa
ggguccuacagacaagguggcaucucaaccucacccaagaaacccccgggacuuuaccccagca

SEQ ID NO: 173502 - RNA, 64 nt, hsa
uaaaguaauauuuuuuagaaauacauguaaaauaccaagaaauaaugucugcgccucugccacc

SEQ ID NO: 173503 - RNA, 64 nt, hsa
ccaaaggagugcauggccacagccaccuccacccccaagaaaccuccauccugccaggagcagc

SEQ ID NO: 173504 - RNA, 64 nt, hsa
ccccaagaaaccuccauccugccaggagcagccuccaagaaacuuuuaaaaaauagauuugcaa

SEQ ID NO: 173505 - RNA, 64 nt, hsa
caagucugggcaccgaaagagagcaucaaaaucaccaagaaaaacagcuucucaguuaagugaa

SEQ ID NO: 173506 - RNA, 64 nt, hsa
ugaaguaagaaagacagcacgcuuaaaccguagaccaagaaaucaggagaguucaagugaugag

SEQ ID NO: 173507 - RNA, 64 nt, hsa
aaaugugauaaugacaugauuucccaccugcccuccaagaaaauggugacucacucucaaguca

SEQ ID NO: 173508 - RNA, 64 nt, hsa
cucaaagcaucagacaugggaaaauugguuuauaccaagaaagcuuccucuguggaaaucuguc

SEQ ID NO: 173509 - RNA, 64 nt, hsa
ucccuccccaccucaguguuuugucuguccgcgcccaagaaagauaagcaaguauuuccugcug

SEQ ID NO: 173510 - RNA, 64 nt, hsa
uuuguuggcauucacugagaccuuguauuagcauccaagaaaugaugagagagagagaaauuau

SEQ ID NO: 173511 - RNA, 64 nt, hsa
uuuuacuggaaacauagcaaaccuugauuuagcuccaagaaauugaguagggaaauauuuguuu

SEQ ID NO: 173512 - RNA, 64 nt, hsa
acaaugcacagcagaaagcugcagggaccucugcccaagaaagccuggguauuguccaagguuu

SEQ ID NO: 173513 - RNA, 64 nt, hsa
aucgagacggccauucuuguuuacaaaacacuuaccaagaaagcacuuuguaggggaacuuuag

SEQ ID NO: 173514 - RNA, 64 nt, hsa
gugcgcaugauucuacauaugagaauucuuuaggccaagaaacuguccuuggcucagagguguu

SEQ ID NO: 173515 - RNA, 64 nt, hsa
augcuuuaauaucacaauaauuuugauuuguaaaccaagaaauuaauccuguguuuaucuaacu

SEQ ID NO: 173516 - RNA, 64 nt, hsa
auguaccucuuuucaugaucuuuuucuuuccuucccaagaaacugaggaauguuuaauaugaaa

SEQ ID NO: 173517 - RNA, 64 nt, hsa
gacaaggaaaacauucguuuuccucaugggucuuccaagaaaugagcuauuuuauugaugccau

SEQ ID NO: 173518 - RNA, 64 nt, hsa
uauaugaacacucaaaucuuuuacuguaacgaaaccaagaaacuuguuuagaaugugauaggca

SEQ ID NO: 173519 - RNA, 64 nt, hsa
uucaacccaggaagcgucuuuggugcuugggagaccaagaaaccaagaaauuaacaacugaaag

SEQ ID NO: 173520 - RNA, 64 nt, hsa
aggaagcgucuuuggugcuugggagaccaagaaaccaagaaauuaacaacugaaagcauuuuaa

SEQ ID NO: 173521 - RNA, 64 nt, hsa
aauguuuagagagcuuggccaacuguaaucuuaaccaagaaauugaagggagaggcugugauuu

SEQ ID NO: 173522 - RNA, 64 nt, hsa
auuuuaacagauuucagaucagaaccacagcuacccaagaaaacccaucuccaaauuguguaug

SEQ ID NO: 173523 - RNA, 64 nt, hsa
uuaauacuaucauaguaauauuauuauugucaucccaagaaaaaauauauuaaaaagauauuug

SEQ ID NO: 173524 - RNA, 64 nt, hsa
uuaauacuaucauguuaauacuauuauugucaucccaagaaaaaagauauuuuaaaaauuuauu

SEQ ID NO: 173525 - RNA, 64 nt, hsa
gcugcuggcuggcccaagcagagagcugaggcauccaagaaauguuccauuggggggugggggu

SEQ ID NO: 173526 - RNA, 64 nt, hsa
uaacaauagcaauaguucuagugaaugugugaaaccaagaaacacucuguacugugugcggacc

SEQ ID NO: 173527 - RNA, 64 nt, hsa
cuaacuuucagguaaccagacccaucucaaagaaccaagaaaaggcuuuagcaugaaauaucuu

SEQ ID NO: 173528 - RNA, 64 nt, hsa
acuguuguauaucauauuguaaaguaucauacugccaagaaaauaacuccuagaaaggcauuau

SEQ ID NO: 173529 - RNA, 64 nt, hsa
accauuauuuacagaugcauggaaaacaaagucuccaagaaaacacuucugucuugauggucua

SEQ ID NO: 173530 - RNA, 64 nt, hsa
gguagaguucuuucaucuaugguugaaucagaaaccaagaaacacuacuauuaaacugcaucaa

SEQ ID NO: 173531 - RNA, 64 nt, hsa
ggcuuuugaucuuaagcuuaugggucgauucuaaccaagaaaaguccaugagaucagugcuuca

SEQ ID NO: 173532 - RNA, 64 nt, hsa
uuugauggacacaacugauaccuguucuuucuuuccaagaaaugugaauuauuugacugugaga

SEQ ID NO: 173533 - RNA, 64 nt, hsa; identical to SEQ ID NO: 95336

SEQ ID NO: 173534 - RNA, 64 nt, hsa; identical to SEQ ID NO: 95337

SEQ ID NO: 173535 - RNA, 64 nt, hsa; identical to SEQ ID NO: 95338

SEQ ID NO: 173536 - RNA, 64 nt, hsa; identical to SEQ ID NO: 95339

SEQ ID NO: 173537 - RNA, 64 nt, hsa; identical to SEQ ID NO: 95340

SEQ ID NO: 173538 - RNA, 64 nt, hsa; identical to SEQ ID NO: 95341

SEQ ID NO: 173539 - RNA, 64 nt, hsa; identical to SEQ ID NO: 95342

SEQ ID NO: 173540 - RNA, 64 nt, hsa; identical to SEQ ID NO: 95343

SEQ ID NO: 173541 - RNA, 64 nt, hsa; identical to SEQ ID NO: 95344

SEQ ID NO: 173542 - RNA, 64 nt, hsa; identical to SEQ ID NO: 95345

SEQ ID NO: 173543 - RNA, 64 nt, hsa; identical to SEQ ID NO: 95346

SEQ ID NO: 173544 - RNA, 64 nt, hsa; identical to SEQ ID NO: 95347

SEQ ID NO: 173545 - RNA, 64 nt, hsa; identical to SEQ ID NO: 95348

SEQ ID NO: 173546 - RNA, 64 nt, hsa; identical to SEQ ID NO: 95349

SEQ ID NO: 173547 - RNA, 64 nt, hsa; identical to SEQ ID NO: 95350

SEQ ID NO: 173548 - RNA, 64 nt, hsa; identical to SEQ ID NO: 95351

SEQ ID NO: 173549 - RNA, 64 nt, hsa; identical to SEQ ID NO: 95352

SEQ ID NO: 173550 - RNA, 64 nt, hsa; identical to SEQ ID NO: 95353

SEQ ID NO: 173551 - RNA, 64 nt, hsa; identical to SEQ ID NO: 95354

SEQ ID NO: 173552 - RNA, 64 nt, hsa; identical to SEQ ID NO: 95355

SEQ ID NO: 173553 - RNA, 64 nt, hsa; identical to SEQ ID NO: 95356

SEQ ID NO: 173554 - RNA, 64 nt, hsa; identical to SEQ ID NO: 95357

SEQ ID NO: 173555 - RNA, 64 nt, hsa; identical to SEQ ID NO: 95358

SEQ ID NO: 173556 - RNA, 64 nt, hsa; identical to SEQ ID NO: 95359

SEQ ID NO: 173557 - RNA, 64 nt, hsa; identical to SEQ ID NO: 95360

SEQ ID NO: 173558 - RNA, 64 nt, hsa; identical to SEQ ID NO: 95361

SEQ ID NO: 173559 - RNA, 64 nt, hsa; identical to SEQ ID NO: 95362

SEQ ID NO: 173560 - RNA, 64 nt, hsa; identical to SEQ ID NO: 95363

SEQ ID NO: 173561 - RNA, 64 nt, hsa; identical to SEQ ID NO: 95364

SEQ ID NO: 173562 - RNA, 64 nt, hsa; identical to SEQ ID NO: 95365

SEQ ID NO: 173563 - RNA, 64 nt, hsa; identical to SEQ ID NO: 95366

SEQ ID NO: 173564 - RNA, 64 nt, hsa; identical to SEQ ID NO: 95367

SEQ ID NO: 173565 - RNA, 64 nt, hsa; identical to SEQ ID NO: 95368

SEQ ID NO: 173566 - RNA, 64 nt, hsa; identical to SEQ ID NO: 95369

SEQ ID NO: 173567 - RNA, 64 nt, hsa; identical to SEQ ID NO: 95370

SEQ ID NO: 173568 - RNA, 64 nt, hsa; identical to SEQ ID NO: 95371

SEQ ID NO: 173569 - RNA, 64 nt, hsa; identical to SEQ ID NO: 95372

SEQ ID NO: 173570 - RNA, 64 nt, hsa; identical to SEQ ID NO: 95373

SEQ ID NO: 173571 - RNA, 64 nt, hsa; identical to SEQ ID NO: 95374

SEQ ID NO: 173572 - RNA, 64 nt, hsa; identical to SEQ ID NO: 95375

SEQ ID NO: 173573 - RNA, 64 nt, hsa; identical to SEQ ID NO: 95376

SEQ ID NO: 173574 - RNA, 64 nt, hsa; identical to SEQ ID NO: 95377

SEQ ID NO: 173575 - RNA, 64 nt, hsa; identical to SEQ ID NO: 95378

SEQ ID NO: 173576 - RNA, 64 nt, hsa; identical to SEQ ID NO: 95379

SEQ ID NO: 173577 - RNA, 64 nt, hsa; identical to SEQ ID NO: 95380

SEQ ID NO: 173578 - RNA, 64 nt, hsa; identical to SEQ ID NO: 95381

SEQ ID NO: 173579 - RNA, 64 nt, hsa; identical to SEQ ID NO: 95382

SEQ ID NO: 173580 - RNA, 64 nt, hsa; identical to SEQ ID NO: 95383

SEQ ID NO: 173581 - RNA, 64 nt, hsa; identical to SEQ ID NO: 95384

SEQ ID NO: 173582 - RNA, 64 nt, hsa; identical to SEQ ID NO: 95385

SEQ ID NO: 173583 - RNA, 64 nt, hsa; identical to SEQ ID NO: 95386

SEQ ID NO: 173584 - RNA, 64 nt, hsa; identical to SEQ ID NO: 95387

SEQ ID NO: 173585 - RNA, 64 nt, hsa; identical to SEQ ID NO: 95388

SEQ ID NO: 173586 - RNA, 64 nt, hsa; identical to SEQ ID NO: 95389

SEQ ID NO: 173587 - RNA, 64 nt, hsa; identical to SEQ ID NO: 95390

SEQ ID NO: 173588 - RNA, 64 nt, hsa; identical to SEQ ID NO: 95391

SEQ ID NO: 173589 - RNA, 64 nt, hsa; identical to SEQ ID NO: 95392

SEQ ID NO: 173590 - RNA, 64 nt, hsa; identical to SEQ ID NO: 95393

SEQ ID NO: 173591 - RNA, 64 nt, hsa; identical to SEQ ID NO: 95394

SEQ ID NO: 173592 - RNA, 64 nt, hsa; identical to SEQ ID NO: 95395

SEQ ID NO: 173593 - RNA, 64 nt, hsa; identical to SEQ ID NO: 95396

SEQ ID NO: 173594 - RNA, 64 nt, hsa; identical to SEQ ID NO: 95397

SEQ ID NO: 173595 - RNA, 64 nt, hsa; identical to SEQ ID NO: 95398

SEQ ID NO: 173596 - RNA, 64 nt, hsa; identical to SEQ ID NO: 95399

SEQ ID NO: 173597 - RNA, 64 nt, hsa; identical to SEQ ID NO: 95400

SEQ ID NO: 173598 - RNA, 64 nt, hsa; identical to SEQ ID NO: 95401

SEQ ID NO: 173599 - RNA, 64 nt, hsa; identical to SEQ ID NO: 95402

SEQ ID NO: 173600 - RNA, 64 nt, hsa; identical to SEQ ID NO: 95403

SEQ ID NO: 173601 - RNA, 64 nt, hsa; identical to SEQ ID NO: 95404

SEQ ID NO: 173602 - RNA, 64 nt, hsa; identical to SEQ ID NO: 95405

SEQ ID NO: 173603 - RNA, 64 nt, hsa; identical to SEQ ID NO: 95406

SEQ ID NO: 173604 - RNA, 64 nt, hsa; identical to SEQ ID NO: 95407

SEQ ID NO: 173605 - RNA, 64 nt, hsa; identical to SEQ ID NO: 95408

SEQ ID NO: 173606 - RNA, 64 nt, hsa; identical to SEQ ID NO: 95409

SEQ ID NO: 173607 - RNA, 64 nt, hsa; identical to SEQ ID NO: 95410

SEQ ID NO: 173608 - RNA, 64 nt, hsa; identical to SEQ ID NO: 95411

SEQ ID NO: 173609 - RNA, 64 nt, hsa; identical to SEQ ID NO: 95412

SEQ ID NO: 173610 - RNA, 64 nt, hsa; identical to SEQ ID NO: 95413

SEQ ID NO: 173611 - RNA, 64 nt, hsa; identical to SEQ ID NO: 95414

SEQ ID NO: 173612 - RNA, 64 nt, hsa; identical to SEQ ID NO: 95415

SEQ ID NO: 173613 - RNA, 64 nt, hsa; identical to SEQ ID NO: 95416

SEQ ID NO: 173614 - RNA, 64 nt, hsa; identical to SEQ ID NO: 95417

SEQ ID NO: 173615 - RNA, 64 nt, hsa; identical to SEQ ID NO: 95418

SEQ ID NO: 173616 - RNA, 64 nt, hsa; identical to SEQ ID NO: 95419

SEQ ID NO: 173617 - RNA, 64 nt, hsa; identical to SEQ ID NO: 95420

SEQ ID NO: 173618 - RNA, 64 nt, hsa; identical to SEQ ID NO: 95421

SEQ ID NO: 173619 - RNA, 64 nt, hsa; identical to SEQ ID NO: 95422

SEQ ID NO: 173620 - RNA, 64 nt, hsa; identical to SEQ ID NO: 95423

SEQ ID NO: 173621 - RNA, 64 nt, hsa; identical to SEQ ID NO: 95424

SEQ ID NO: 173622 - RNA, 64 nt, hsa; identical to SEQ ID NO: 95425

SEQ ID NO: 173623 - RNA, 64 nt, hsa; identical to SEQ ID NO: 95426

SEQ ID NO: 173624 - RNA, 64 nt, hsa; identical to SEQ ID NO: 95427

SEQ ID NO: 173625 - RNA, 64 nt, hsa; identical to SEQ ID NO: 95428

SEQ ID NO: 173626 - RNA, 64 nt, hsa; identical to SEQ ID NO: 95429

SEQ ID NO: 173627 - RNA, 64 nt, hsa; identical to SEQ ID NO: 95430

SEQ ID NO: 173628 - RNA, 64 nt, hsa; identical to SEQ ID NO: 95431

SEQ ID NO: 173629 - RNA, 64 nt, hsa; identical to SEQ ID NO: 95432

SEQ ID NO: 173630 - RNA, 64 nt, hsa; identical to SEQ ID NO: 95433

SEQ ID NO: 173631 - RNA, 64 nt, hsa; identical to SEQ ID NO: 95434

SEQ ID NO: 173632 - RNA, 64 nt, hsa; identical to SEQ ID NO: 95435

SEQ ID NO: 173633 - RNA, 64 nt, hsa; identical to SEQ ID NO: 95436

SEQ ID NO: 173634 - RNA, 64 nt, hsa; identical to SEQ ID NO: 95437

SEQ ID NO: 173635 - RNA, 64 nt, hsa; identical to SEQ ID NO: 95438

SEQ ID NO: 173636 - RNA, 64 nt, hsa; identical to SEQ ID NO: 95439

SEQ ID NO: 173637 - RNA, 64 nt, hsa; identical to SEQ ID NO: 95440

SEQ ID NO: 173638 - RNA, 63 nt, hsa
ccaccuaccaccagaggccugcagccucccacaugccuuaaggggaccguggcccccaccagg

SEQ ID NO: 173639 - RNA, 63 nt, hsa
cagagguggcagggauggcuccgaagccagaaaugccuuaaacugcaacgucccgucccuucc

SEQ ID NO: 173640 - RNA, 63 nt, hsa
ggacagagucucucauggaugccggcacaaaacugccuuaaaauauucauaguuaauacaggu

SEQ ID NO: 173641 - RNA, 63 nt, hsa
caucuuugcuacuuuccuagagaacccggcuguugccuuaaaugugugagagggacuuggcca

SEQ ID NO: 173642 - RNA, 63 nt, hsa
agaaucacaaaagaagugaaaagggccgguuccugccuuaacugaugacauuccaccauugug

SEQ ID NO: 173643 - RNA, 63 nt, hsa
cacuuaccuuauuuaaaauaaaucaauaaagcuugccuuaaauuauuuuuauaugacuguugg

SEQ ID NO: 173644 - RNA, 63 nt, hsa
gguuauuauggaugauaguuauagcccuuauaaugccuuaacuaaggaagaaaagauguuauu

SEQ ID NO: 173645 - RNA, 63 nt, hsa
ggcuucaccauacuguaagcauuuuagguagauugccuuaaagguuaugggagggcaugaggg

SEQ ID NO: 173646 - RNA, 63 nt, hsa
uuucuucugguguauuuugcacagacaagcaucugccuuaaaauauauacacuuguacaaaaa

SEQ ID NO: 173647 - RNA, 63 nt, hsa
uuuuuuuuuuccuuucaacuuaguugacauacgugccuuaaaaaggaaaacuaguguugcuau

SEQ ID NO: 173648 - RNA, 63 nt, hsa
cugacaaauaaauaugucauccugaauuaauaaugccuuaauaaaaguacauccuccugcuaa

SEQ ID NO: 173649 - RNA, 63 nt, hsa
acuggaaguuuuucaugauaacuuauuuuaagaugccuuaaaaaucuuaaagucacaaaagga

SEQ ID NO: 173650 - RNA, 63 nt, hsa
uuucucucauuucccauggaaggacuucggaaaugccuuaaguuccccucuuuauccugccca

SEQ ID NO: 173651 - RNA, 63 nt, hsa
aauuuuggagguuggggugcaaucuuuagaauaugccuuaaaaggccgggcgcgguggcucac

SEQ ID NO: 173652 - RNA, 63 nt, hsa
gauaugaauaugccuuauaugcugauaugaauaugccuuaaaauaaaguguuccccaccccug

SEQ ID NO: 173653 - RNA, 63 nt, hsa
uuccuuuucccugcuuccaggaaacuccacaucugccuuaaaaccaaagagggcuuccucuag

SEQ ID NO: 173654 - RNA, 63 nt, hsa
ugcccugccccucuggccacugcugcagacaccugccuuaacacacacaccucuaggacucca

SEQ ID NO: 173655 - RNA, 63 nt, hsa
cuuaacacacacaccucuaggacuccacaguuuugccuuaaaggaccuucccaagucucccuu

SEQ ID NO: 173656 - RNA, 63 nt, hsa
aaacauuccuuucaccaucauuuagaaaugguuugccuuaauggagacaauagcagauccugu

SEQ ID NO: 173657 - RNA, 63 nt, hsa
ugaguucuaaaaggcaugcccacaucucuuucgugccuuaaggauagugagaugcacacuuau

SEQ ID NO: 173658 - RNA, 63 nt, hsa
aguucccugcugaagccccuagcacacacugcaugccuuaacaagugugugcaagccccucag

SEQ ID NO: 173659 - RNA, 63 nt, hsa
ucaaaaacagagcccauucuuaagaucacuuggugccuuaaagacacgcauuccaaaguggaa

SEQ ID NO: 173660 - RNA, 63 nt, hsa
aagaauguggauacucuuaggcgugaauguaaaugccuuaauauugaagguccugguuagaag

SEQ ID NO: 173661 - RNA, 63 nt, hsa
ggaccuuuuauaugugccuucacuuuagcuguuugccuuaaucucuacagccuugcucuccgg

SEQ ID NO: 173662 - RNA, 63 nt, hsa
aggcuguguguccaaggauggugcugaaaucacugccuuaaggucucugcugugcagaaugag

SEQ ID NO: 173663 - RNA, 63 nt, hsa
auuuaaauuggaucuugaaagaugaauaaggccugccuuaaguucugcuaaaggccauguugu

SEQ ID NO: 173664 - RNA, 63 nt, hsa
agcccccgcccagcucaucagucugaauggaguugccuuaaauuggcaggugguaccguacuc

SEQ ID NO: 173665 - RNA, 63 nt, hsa
cucugauuuugugcuacuccuuuguaaagucacugccuuaagggggcugauggcgccaccugu

SEQ ID NO: 173666 - RNA, 63 nt, hsa
ucuugaugauccucaaggaaauacaaccuagggugccuuaaaaauaacaacaacaaaaaaccu

SEQ ID NO: 173667 - RNA, 63 nt, hsa
aaccaagucauuacaugucaaauucaauuuuucugccuuaagaaugaauguccuucauaaaau

SEQ ID NO: 173668 - RNA, 63 nt, hsa
agucccuugugcuggccagauggcguggcugguugccuuaauaugucccaggaccccugacag

SEQ ID NO: 173669 - RNA, 63 nt, hsa
uuuuuuucuuucauuuuucucucauuccauuucugccuuaacuuuaguuuguucacagggagg

SEQ ID NO: 173670 - RNA, 63 nt, hsa
aaagguucaagcaccuuuuccaaauuuaaaucuugccuuaaauucucucuaccacacugccuu

SEQ ID NO: 173671 - RNA, 63 nt, hsa
cagcacuauggugcucucuguaaugccucuuacugccuuaagucuuuccucuguugcugacca

SEQ ID NO: 173672 - RNA, 63 nt, hsa
aauuaccagccccaccuguuucagcucaagagaugccuuaagauaauuaugugaggccacuug

SEQ ID NO: 173673 - RNA, 63 nt, hsa
gcuaaaagggcuguacaguuauuucccccucccugccuuaaaacuugggagaggagcacucag

SEQ ID NO: 173674 - RNA, 63 nt, hsa
uaaaauauguguauauuuuaucagauuugguuuugccuuaaauauuauccccaauugcuucag

SEQ ID NO: 173675 - RNA, 63 nt, hsa
aaagggcacucauuuggauugccuuacuucucuugccuuaaauauaucccauauauuuaauau

SEQ ID NO: 173676 - RNA, 63 nt, hsa
gacuguucuacaguuucuuugacuccuggcauuugccuuaaggaccuauagcaagcuguuucu

SEQ ID NO: 173677 - RNA, 63 nt, hsa
agcuuuuaauagugucauaaagauuauaauaugugccuuaaguuuuagucuuuagaacucuag

SEQ ID NO: 173678 - RNA, 63 nt, hsa
ggacucccacuccccgcucccuuccagccaagcugccuuaacucgccccucggggcuccccca

SEQ ID NO: 173679 - RNA, 63 nt, hsa
caggaauacauauucacugcuuagaggugaccuugccuuaauauauuugugaaguuaaaauuu

SEQ ID NO: 173680 - RNA, 63 nt, hsa
gaauuuauaacagguuagcuaaaauugggagcaugccuuaaaacuuaaagauuguaugcauau

SEQ ID NO: 173681 - RNA, 63 nt, hsa
ccacuccacuuuccuccacagaugccucuucugugccuuaagcagagucaggagaccccaagg

SEQ ID NO: 173682 - RNA, 63 nt, hsa
uuucauaaagcuggcucuuuauguugcuuuacaugccuuaauauauguuuuauggagauuaua

SEQ ID NO: 173683 - RNA, 63 nt, hsa
uuucuugcaauuuaaugccaaaaguuugccaugugccuuaaacauauuacuauauauuuuccc

SEQ ID NO: 173684 - RNA, 63 nt, hsa
ucagauauuugagaauaggggauuuuuuugaugugccuuaaauuauaccaaagauuacuaauu

SEQ ID NO: 173685 - RNA, 63 nt, hsa
uuuguaccaaaacaguccuucaacuuugcacugugccuuaaguaauuacuaacaaaagguacu

SEQ ID NO: 173686 - RNA, 63 nt, hsa
cccaguuuuuguggcucaaggcuggaauauuuaugccuuaauauaucuauggcagacauuuaa

SEQ ID NO: 173687 - RNA, 63 nt, hsa
augucaaaaaaaaaaaaaaaaaaaaaaaaguccugccuuaacuaacuccucugcgcuuguuca

SEQ ID NO: 173688 - RNA, 63 nt, hsa
auaaauguacuacauuugcaugccuuuuggguuugccuuaauucuuaccucauuugcauccua

SEQ ID NO: 173689 - RNA, 63 nt, hsa
auguuugagucucuuaacugauggaugcccacuugccuuaaagcagcauacuuauuuuuuguu

SEQ ID NO: 173690 - RNA, 63 nt, hsa
acaguauuacagcuuugcauuuggggguuuuacugccuuaacuuucaaugcuuguuaugggaa

SEQ ID NO: 173691 - RNA, 63 nt, hsa
cugcucaucugacuguuuuguacaugugacaauugccuuaaaaccuagcacaguccucagaaa

SEQ ID NO: 173692 - RNA, 63 nt, hsa
cccgcagaccugccuccagagcaaggagaauucugccuuaaucuguugggcuccagucuccgg

SEQ ID NO: 173693 - RNA, 63 nt, hsa
cagccaagguggacguaccucuccaggagccuuugccuuaauguaucucugccuggacaacuu

SEQ ID NO: 173694 - RNA, 63 nt, hsa
cucgggagacuuuucugugcuccuuucuacacaugccuuaaaccuuccuuccuguggggugcc

SEQ ID NO: 173695 - RNA, 63 nt, hsa
uuaguguuuuaaaacaccucugcuuucugauguugccuuaauauucugcuauugcagcaauua

SEQ ID NO: 173696 - RNA, 63 nt, hsa
ggugguuugcuuucuuuaccauaagcaaucccuugccuuaacucaucacccuuuuucacuaug

SEQ ID NO: 173697 - RNA, 63 nt, hsa
aaguaaugcuuuuccugagcuggaucccaguguugccuuaacagggugucugucgugccgcag

SEQ ID NO: 173698 - RNA, 63 nt, hsa
gaaggcuaugacucccaagaggcagugaaccauugccuuaaauuaauagcagccucucaaguc

SEQ ID NO: 173699 - RNA, 63 nt, hsa
cuauauggcaccuaauuauuuuuucuuuuaaaaugccuuaaguugcagucucauuuugauaau

SEQ ID NO: 173700 - RNA, 63 nt, hsa
ucagaaccuguuccaucuguaugccauuguucaugccuuaagaaaugcaaagauguacaauaa

SEQ ID NO: 173701 - RNA, 63 nt, hsa
aguuaauaauuuuuaaauuuuuuucuaauuuuaugccuuaaaauagguuucugauuacauaaa

SEQ ID NO: 173702 - RNA, 63 nt, hsa
gauaacuaaacuucauuucaguuuacuuuguuaugccuuaauauucugugucuuuugcaauua

SEQ ID NO: 173703 - RNA, 63 nt, hsa
cccugcaucauccaagcaaugaccucagacuucugccuuaaccagccccggggcuuggcuccc

SEQ ID NO: 173704 - RNA, 63 nt, hsa
ggccccagcagcccuauggugaccgccacacugugccuuaaugucugccgggggcccaggcug

SEQ ID NO: 173705 - RNA, 63 nt, hsa
cuuaugccacuuccuuguucaaaauaaaguaacugccuuaaucuuauacucauggcuuggagu

SEQ ID NO: 173706 - RNA, 63 nt, hsa
uuugaccuauguauggaacuuacuuuuacuuuuugccuuaaauuuuuaaugaaaugcaaauuu

SEQ ID NO: 173707 - RNA, 63 nt, hsa
uagagagaaauuaacuuuuccaaaugaaugucuugccuuaaacccucuauuuccuaaaauauu

SEQ ID NO: 173708 - RNA, 63 nt, hsa
ugcuucaugauaggcaacuuuacccauuuugaaugccuuaauuuaauuuuuuucaaagucuca

SEQ ID NO: 173709 - RNA, 63 nt, hsa
caaaauaaggcacagcuuuaauucauuauugaaugccuuaaaugucccagguauugagaauaa

SEQ ID NO: 173710 - RNA, 63 nt, hsa
gauguacauguugagauauuuggacaaugaaaaugccuuaaaaggaaugcauauggauaaagu

SEQ ID NO: 173711 - RNA, 63 nt, hsa
uugaauaaagcuucgcuucuagguggcacuguuugccuuaauacccugacaguucaucuuccu

SEQ ID NO: 173712 - RNA, 63 nt, hsa
agauccacaaaagaagugaaaauagccaguuccugccuuaacugaugacauuccaccauugug

SEQ ID NO: 173713 - RNA, 63 nt, hsa
caacagcaccggauccacagaauguuucuucucugccuuaaagagcuauucacuaauaacaua

SEQ ID NO: 173714 - RNA, 63 nt, hsa
ucccauuagagguacuuuuuuuugauggcaugcugccuuaaaagagccauuuauuuuuagaga

SEQ ID NO: 173715 - RNA, 63 nt, hsa
gaagugucuuauccuuuucuaugaauuccaauuugccuuaacucuuuugaugcuguagcuguu

SEQ ID NO: 173716 - RNA, 63 nt, hsa
uuauaauuuauaguaauuuuuugaucuuuuuuuugccuuaagaguugaauaugcugcuuuaga

SEQ ID NO: 173717 - RNA, 63 nt, hsa
gagagguuucugguauucacagaaagcuagauaugccuuaaaacauacucugccgaucuaauu

SEQ ID NO: 173718 - RNA, 63 nt, hsa
aguuugcaacaugucuguaccaagaugguacuuugccuuaaccguuuauaugcacuuucaugg

SEQ ID NO: 173719 - RNA, 63 nt, hsa
aucacagaagaugcaacaucuuuucugaaagauugccuuaagagagcuccaguccuacucuug

SEQ ID NO: 173720 - RNA, 63 nt, hsa
aaucccuuaaucuaugugcaccguugggaccaaugccuuaauuaaagaauuuaaaaaaguugu

SEQ ID NO: 173721 - RNA, 63 nt, hsa
uuguggcuggguuuucugaagucugaggaacaaugccuuaagaaaaaacaaacagcaggaauc

SEQ ID NO: 173722 - RNA, 63 nt, hsa
agucucacaagaccuauaggaaaguuuaccaucugccuuaaauauuaaaauauccaucuguua

SEQ ID NO: 173723 - RNA, 63 nt, hsa
uuccacaggcuacaagcccugggaccaucuuucugccuuaagggcaggagcccacuucugugg

SEQ ID NO: 173724 - RNA, 63 nt, hsa
aauauguagguaagguuuaucuugaaucuuaauugccuuaauuuuaaggacgucaaaggcucu

SEQ ID NO: 173725 - RNA, 63 nt, hsa
aucccuucuacuucacuccucaggggagugaagugccuuaagaaacaaagcccuguccuaauu

SEQ ID NO: 173726 - RNA, 63 nt, hsa
uuauuuggaaaaguagucauuaaaugaacccacugccuuaaaugucuugaauguugcagucaa

SEQ ID NO: 173727 - RNA, 63 nt, hsa
caauguccuaacugaaagaugaucauuuguaguugccuuaaaauaaugaauacauuuccaaaa

SEQ ID NO: 173728 - RNA, 63 nt, hsa
caagugaagaguuugccuguacucuuaucugggugccuuaaggagagagauuguguucuuccu

SEQ ID NO: 173729 - RNA, 63 nt, hsa
ggccuguggucagcagcuacugaugguuuuuucugccuuaaaccguguguguguccaucauca

SEQ ID NO: 173730 - RNA, 63 nt, hsa
uuccauuuuauaaauguauugauucauugguacugccuuaaagauacaguaccccucuagcuu

SEQ ID NO: 173731 - RNA, 63 nt, hsa
aaguggcauaaagcauauccauucagaaugaagugccuuaaauauagcaguagucuuuuuugg

SEQ ID NO: 173732 - RNA, 63 nt, hsa
aaguccaauaagacacucaaauaugaguacaaaugccuuaaaauggaauugaaaaacucuuua

SEQ ID NO: 173733 - RNA, 63 nt, hsa
cagcucaacaacuagaaaaauaaacuguuuaccugccuuaauuauuuaucuuuaguuccuuau

SEQ ID NO: 173734 - RNA, 63 nt, hsa
ggcuuggagggaaauacauuuuaggaggaguuuugccuuaauuuuuuaaguacugcaccaaaa

SEQ ID NO: 173735 - RNA, 63 nt, hsa
uucuacagaugaaucuguaagccaguuacaguuugccuuaacucauagacaucaaucagagag

SEQ ID NO: 173736 - RNA, 63 nt, hsa
cacagguuucuuuaaagcuguguuaacauaucuugccuuaaaauguguguguguguuuuugcu

SEQ ID NO: 173737 - RNA, 63 nt, hsa
uuuggguggaugaguuuuauuuucuuuuaaagcugccuuaauuccauuuuuauuuugcauuuu

SEQ ID NO: 173738 - RNA, 63 nt, hsa
cuuaacuucuccccauuucccccaucuuuugguugccuuaaaagaaaucucuagcucagauaa

SEQ ID NO: 173739 - RNA, 63 nt, hsa
uuaagcuuuagaauaaugcgcaauuucauguuaugccuuaaguccaaaaagguaaacuuugaa

SEQ ID NO: 173740 - RNA, 63 nt, hsa
agaagaaaaguauuuaaaagaaauaccagugagugccuuaaaguuggagaaguaacugcccau

SEQ ID NO: 173741 - RNA, 63 nt, hsa
aggaguuacagaugcagccacagauugaucaucugccuuaacgugaucggagaugcuuuguaa

SEQ ID NO: 173742 - RNA, 63 nt, hsa
aauuuacuacauauauugauuuuuaaauaaaguugccuuaaauaaguguauguaagcaguagu

SEQ ID NO: 173743 - RNA, 63 nt, hsa
uugucuauacauauauauauauauauauggcuuugccuuaauauacccccuuuuuuguuugug

SEQ ID NO: 173744 - RNA, 63 nt, hsa
uagaaugccauuccagaggacaagccacaaaaaugccuuaauuugagcucguauuuaccccug

SEQ ID NO: 173745 - RNA, 63 nt, hsa
ugugacauuuggagagggggccugggacuuccaugccuuaaaccuaccucccacacucccaag

SEQ ID NO: 173746 - RNA, 63 nt, hsa
uccgagcccugugcauggacuuggugagacuguugccuuaaugacauccugcaccguguauaa

SEQ ID NO: 173747 - RNA, 63 nt, hsa
aggucagggagugcuggcucacaguacagcaugugccuuaaugcuucauaugaggaggauguc

SEQ ID NO: 173748 - RNA, 63 nt, hsa
uuaauuuuggaggggguggggaaauaguucuggugccuuaacgcauggcuggaauuuauagag

SEQ ID NO: 173749 - RNA, 63 nt, hsa
gcauuaauauaccauccauguguuuuuaccauuugccuuaauauugaauauacuguuuaccuc

SEQ ID NO: 173750 - RNA, 63 nt, hsa
uauagcaggaaauacgaagaguuacacaguguaugccuuaaaaggcuguuucuuaaagguguu

SEQ ID NO: 173751 - RNA, 63 nt, hsa
gaaaacaaaaaaaauguuaagaaauggguuucuugccuuaaccagucucucaagugaugagac

SEQ ID NO: 173752 - RNA, 63 nt, hsa
acuuaaauuuaguggucagaaauguauuugaagugccuuaaagaugaucaugguucagaauau

SEQ ID NO: 173753 - RNA, 63 nt, hsa
cuaauagaaaaacagguaagaauaaagcaauguugccuuaauuucaaaagcugcuauuuuaga

SEQ ID NO: 173754 - RNA, 63 nt, hsa
agguagauccccaauauuuuggaauaccaaaauugccuuaaaaauucccuucuguuucuuaca

SEQ ID NO: 173755 - RNA, 63 nt, hsa
ugacuaacuuaaaaaaauagauuguaauugaugugccuuaauuugcauaaaucauaaauguau

SEQ ID NO: 173756 - RNA, 63 nt, hsa
uuguagaacuuucuuuuuaaggugaauaagucaugccuuaacauccaaauaagaguucaucuu

SEQ ID NO: 173757 - RNA, 63 nt, hsa
uugucuauuucuuaauuuuaaaauaugcugauaugccuuaaacuguaguuguagauccuuguc

SEQ ID NO: 173758 - RNA, 63 nt, hsa
aguuaugaguaaaucugcaaaaggcaaugaaaaugccuuaaauuuuaucaauaacagaauuau

SEQ ID NO: 173759 - RNA, 63 nt, hsa
gcugaguaauucuaaucucuucuguguuuuccuugccuuaaccacaaauuguggugcuuuuug

SEQ ID NO: 173760 - RNA, 63 nt, hsa
acaauguauguccucagugguaccuauuauugaugccuuaaauguauugauaaggugacuagu

SEQ ID NO: 173761 - RNA, 63 nt, hsa
uucauuuguugguacauauuacacaaaacauugugccuuaaaaugagucauacaucuuuuaaa

SEQ ID NO: 173762 - RNA, 63 nt, hsa
uaccacauauuauuuuuauauuaauucaacauuugccuuaaguguguuguuaaaugaaaguac

SEQ ID NO: 173763 - RNA, 63 nt, hsa
guuuuuauauuaaaucauaaggaaggaacuacuugccuuaaauguuaauaucaaaagaguuuu

SEQ ID NO: 173764 - RNA, 63 nt, hsa
uuauuaguucacuucccugcugccaugaaacuuugccuuaagaaggugcuggauuccaagguu

SEQ ID NO: 173765 - RNA, 63 nt, hsa
uuuuuuaaaucuguauguucagaauaauuucacugccuuaauguguucuggagagcgugcuca

SEQ ID NO: 173766 - RNA, 63 nt, hsa
cauagacguaguuuucgcauccuugaauuaaacugccuuaacuccuuuugugguauaagcaaa

SEQ ID NO: 173767 - RNA, 63 nt, hsa
aaggcuuuuugguuaagaccucacuuuuaaaacugccuuaaguauaaauaguaccuuuggaau

SEQ ID NO: 173768 - RNA, 63 nt, hsa
aguauaacaggugccuucacuuuugagacuuagugccuuaaaauauguauucuauaaugauuu

SEQ ID NO: 173769 - RNA, 63 nt, hsa
aaauguuuuaaaguuuaaugccuagcagagaacugccuuaaaaaaaaaaaaaaaaaguucaug

SEQ ID NO: 173770 - RNA, 63 nt, hsa
ccggaagugacugcccgcugcccagaagaacuuugccuuaaguuucccuguguuguuccacac

SEQ ID NO: 173771 - RNA, 63 nt, hsa
uaagaaacguuuauuguaacaguaauuaaaugcugccuuaauugaagggguuuggguggauuu

SEQ ID NO: 173772 - RNA, 63 nt, hsa
ugauuguagaggguccaccacagaauuaugggaugccuuaagugcuguuacuagguugcucac

SEQ ID NO: 173773 - RNA, 63 nt, hsa
aauguuuuauuucuguuaguaugaacaauagacugccuuaacaaaguuuuuuuuuaaacaaaa

SEQ ID NO: 173774 - RNA, 63 nt, hsa
ucaaaucacugcagucaugaaauacugaacaauugccuuaagucuuugcuugacucacuggga

SEQ ID NO: 173775 - RNA, 63 nt, hsa
uuauuuuauggagcuuugcccuugaugcacugaugccuuaaaaauuaacaaggucauucagaa

SEQ ID NO: 173776 - RNA, 63 nt, hsa
augccucaccagcagaagaacagaauaucaggaugccuuaaauuuauaguaguagacuguaaa

SEQ ID NO: 173777 - RNA, 63 nt, hsa
ccaucucuguucaaagagggggaaaugugccuaugccuuaagucaaugcacucagcaaggaga

SEQ ID NO: 173778 - RNA, 63 nt, hsa
acuuuucuugacuugccuguuuuggccauuagcugccuuaaacguuaacagcacauuugaaug

SEQ ID NO: 173779 - RNA, 63 nt, hsa
gaggaaccacgcugccaccaaagcagccggaagugccuuaacuuguggaaccaacacuaaucg

SEQ ID NO: 173780 - RNA, 63 nt, hsa
guuuccaaagcuuuacuacucuuagaggacacaugccuuaaaaaaggaggggaggaaccacgc

SEQ ID NO: 173781 - RNA, 63 nt, hsa
caucugggggccaaacacauguuccgucuugauugccuuaagaguuacuagcgaggucagugu

SEQ ID NO: 173782 - RNA, 63 nt, hsa
ucuauauuucuaucuuuaacagcacuucaguccugccuuaaguuauaguuauguauagauacc

SEQ ID NO: 173783 - RNA, 63 nt, hsa
gccuauguagcaggcacuuagaguaaauggacuugccuuaauuuauaaaggagggaagaggua

SEQ ID NO: 173784 - RNA, 63 nt, hsa
aaacauagcugcaggucuuuggucccagggcugugccuuaacuuuaaccaauauuuucuucug

SEQ ID NO: 173785 - RNA, 63 nt, hsa
ugccucagacugaaaagcuaguccuaacgucuuugccuuaauucuguucauuuuuucaagucc

SEQ ID NO: 173786 - RNA, 63 nt, hsa
ccgcccugcaaguuaaccccccauugcaaugguugccuuaagguguuugcuaguuguguacau

SEQ ID NO: 173787 - RNA, 63 nt, hsa
ccuauuuucugacguuucuuaaugcaaacucuuugccuuaaaugguagaauauuuagaaauuu

SEQ ID NO: 173788 - RNA, 63 nt, hsa
aauugaguauuguggguccccuaauucugugggugccuuaagugagaauuucuaaaugauuuu

SEQ ID NO: 173789 - RNA, 63 nt, hsa
aaauguauauugaaugcuuuccuuuuuuauaccugccuuaaauaauuuggcaaucagaauuaa

SEQ ID NO: 173790 - RNA, 63 nt, hsa
uacagacaucaguuccaugguguuaauuugaaaugccuuaauggcaggcaaaaaccagucauu

SEQ ID NO: 173791 - RNA, 63 nt, hsa
cuguuguauuaccaaagcaggguccauguuugcugccuuaacccugucuccucucuguuacuc

SEQ ID NO: 173792 - RNA, 63 nt, hsa
uucaucaaaagugacugccuuaauaagaaugguugccuuaaagaaagucgaauuaauagcuuu

SEQ ID NO: 173793 - RNA, 51 nt, hsa
uucuguuucaucaaaagugacugccuuaauaagaaugguugccuuaaagaa

SEQ ID NO: 173794 - RNA, 63 nt, hsa
cacccacuuaguuucuuuuucauuccugcucccugccuuaacuccuccucccacugccccuga

SEQ ID NO: 173795 - RNA, 63 nt, hsa
uggcacauggguggacacggaucugcugggcucugccuuaaacacacauugcagcuucaacuu

SEQ ID NO: 173796 - RNA, 63 nt, hsa
ggcccugcauuucuggguagggcuggcaaugguugccuuaacccuggcuccuggcccgagccu

SEQ ID NO: 173797 - RNA, 63 nt, hsa
auuucacuuggcuagaaauuacacugugcucaaugccuuaauaaaucccugaaagaaauaaaa

SEQ ID NO: 173798 - RNA, 63 nt, hsa
aggaagaugaauuuuuaaaaucuccaucaaacgugccuuaaagcuaaagcauuuugacaggag

SEQ ID NO: 173799 - RNA, 63 nt, hsa
ugcgcgggaggccacagcccgugccgauuccagugccuuaacuacuuaccggaucccuccaua

SEQ ID NO: 173800 - RNA, 63 nt, hsa
cacacauucugccuuggauuccuagauuacaucugccuuaaaaaaacacggaagcacaguugg

SEQ ID NO: 173801 - RNA, 63 nt, hsa
cuuuacugagauuucugaguauacuuuucauauugccuuaauguagcaguaauguguuuaugc

SEQ ID NO: 173802 - RNA, 63 nt, hsa
caaauccuuuggccugagaacuaauauguuaauugccuuaaauaaauuaauagaaaucuaguc

SEQ ID NO: 173803 - RNA, 63 nt, hsa
uugacaguauauuugaaacuguaaauauguuugugccuuaaaaggagagaagaaaguguagau

SEQ ID NO: 173804 - RNA, 63 nt, hsa
auaaguauuugccuaaaaccauaaaauaggaauugccuuaaggaucuaguaguuuauaaugcc

SEQ ID NO: 173805 - RNA, 63 nt, hsa
cugucuuugcuuucuuuuuuuuuuucuuuuugaugccuuaauguagauaucuuuaucauucug

SEQ ID NO: 173806 - RNA, 59 nt, hsa
aggugugggcauuugauugaaauucagacugccuuaaaauauaacauuaaaaagacugg

SEQ ID NO: 173807 - RNA, 63 nt, hsa
uuuggcaaacagaauguucauacugauguguugugccuuaaagacaagacagcauuugugugu

SEQ ID NO: 173808 - RNA, 63 nt, hsa
gggagacagaaacugugguugauagccagucacugccuuaagaacauuugaugcaagauggcc

SEQ ID NO: 173809 - RNA, 63 nt, hsa
gaccgcugcugcugcugccgcuacugcugcugcugccuuaaguaggaagagagggaaggacac

SEQ ID NO: 173810 - RNA, 63 nt, hsa
uucauaauugcuuucuagcaaucagcuuuuauuugccuuaauauaagcuuuuaagcaguuauc

SEQ ID NO: 173811 - RNA, 63 nt, hsa
ugucccuuuuuaagccuuaccugagaggaacaaugccuuaaaauaaaaaagcauuaaugagau

SEQ ID NO: 173812 - RNA, 63 nt, hsa
caugacauauugugguuaauuuuaaaacuacugugccuuaacguguuucuuaaacuuuuguag

SEQ ID NO: 173813 - RNA, 63 nt, hsa
gcagaagauaacagcagcaucucgaccagccucugccuuaaaggaaaucuuuauuaaucacgu

SEQ ID NO: 173814 - RNA, 63 nt, hsa
ugcccgucucugagacagucucuguguggaauuugccuuaaacugaaguaaauuugguucuuu

SEQ ID NO: 173815 - RNA, 63 nt, hsa
uguucaucucuuaggcuuccauuuggaugggccugccuuaacauuguuugaaaugcagcguga

SEQ ID NO: 173816 - RNA, 63 nt, hsa
ggauuggggagcccaggaggcagccuucccuuuugccuuaagucacccaucuuccaguaagca

SEQ ID NO: 173817 - RNA, 63 nt, hsa
uuagugcuggaguaaaaggucaaguccaacaccugccuuaaauuuaaaucaugugauuuauag

SEQ ID NO: 173818 - RNA, 63 nt, hsa
aucucuauaugguacauuugccucacuuaugguugccuuaaaggcaagagggaaggucaccau

SEQ ID NO: 173819 - RNA, 63 nt, hsa
uuguacaauguuguuaugguagagaaacacacaugccuuaaaauuuaaaaagcagggcccaaa

SEQ ID NO: 173820 - RNA, 63 nt, hsa
aaguuagugcaucaacgggauacaguuccauauugccuuaaaccuccuuguuuuagacacacu

SEQ ID NO: 173821 - RNA, 63 nt, hsa
ugcacauuuguacauauacuuaauguuuucaagugccuuaauuguuuaaaaucucuggcuuca

SEQ ID NO: 173822 - RNA, 63 nt, hsa
uuuuaaucugacaagcaguaacuucauaugguuugccuuaauauauauuuguuuuagucauga

SEQ ID NO: 173823 - RNA, 63 nt, hsa
auuuuuauaaaguacuguuuaguuggaaaaaguugccuuaauguuugaaaugugugaaauuuu

SEQ ID NO: 173824 - RNA, 63 nt, hsa
acuacacugcaccauguuaguaauaaacagaucugccuuaaagaaaagaaaauuuuagaaaga

SEQ ID NO: 173825 - RNA, 63 nt, hsa
ugguguaaacuuguacauggaauuuuuugaauaugccuuaauuuagaaacugaaaaauaucug

SEQ ID NO: 173826 - RNA, 63 nt, hsa
acauaugguuuauuuugaaacuucaaguauuauugccuuaaugucucuuaacccuguuacacg

SEQ ID NO: 173827 - RNA, 63 nt, hsa
aggcauucuagaaaauaugaauuaguuuccaaaugccuuaauuuuaaacuuuggccugaacag

SEQ ID NO: 173828 - RNA, 63 nt, hsa
uuggcagcuuauuccaguugaucucuucacaucugccuuaaaagugcuauguagagauacauu

SEQ ID NO: 173829 - RNA, 63 nt, hsa
ucucccugaggacugagggugaacuucgcucuuugccuuaaaccucuuuauuucauugcagua

SEQ ID NO: 173830 - RNA, 63 nt, hsa
cgugaggcuccccagccacagcccccucuuacuugccuuaaaacuggagagaggaaucuagua

SEQ ID NO: 173831 - RNA, 63 nt, hsa
uugaccaaauaaguuuccugagggcuggaauuaugccuuaacuauaucuauaguauuuaacag

SEQ ID NO: 173832 - RNA, 63 nt, hsa
auacuuccucaccacugacuauuuuaucaaauuugccuuaaaauaaugaaaaagaaaaguaua

SEQ ID NO: 173833 - RNA, 63 nt, hsa
uuacaaaugaaauuuaaaguauucuuaaagcuuugccuuaaauacugcuugcauacugauuua

SEQ ID NO: 173834 - RNA, 63 nt, hsa
gagcaguucuaauaaugcagaauaaauacauguugccuuaaaggguuaucuaguauccuucau

SEQ ID NO: 173835 - RNA, 63 nt, hsa
auaggguuaaaauagaccuuucuugccuauccuugccuuaaccuaucugccugagguuggccu

SEQ ID NO: 173836 - RNA, 63 nt, hsa
cuguccugcugguaacugcuacgggguaagauuugccuuaacaguacuauuuucucgccacca

SEQ ID NO: 173837 - RNA, 63 nt, hsa
gggugcugagauaagcaauuagcucuagccuucugccuuaagaaugcacucuacuggggauuu

SEQ ID NO: 173838 - RNA, 63 nt, hsa
ugggaauaaaaauuugugcaagucagagaagggugccuuaaaaauguuguggccaagccacau

SEQ ID NO: 173839 - RNA, 63 nt, hsa
agcucguacauguggguucuuauccugauccugugccuuaaaguaggaagguguuuccaaguu

SEQ ID NO: 173840 - RNA, 63 nt, hsa
uguuugauucgccuuccuuuuuugacauauguaugccuuaauucuuaaaucugagggaccaug

SEQ ID NO: 173841 - RNA, 63 nt, hsa
gaggagcccuccuggagcucaggaggccgaggcugccuuaagcugugaucaugccacugcauu

SEQ ID NO: 173842 - RNA, 63 nt, hsa
aacaaaagcucagguuuguccuggucaugcacaugccuuaagccaguuccgucuucccuagac

SEQ ID NO: 173843 - RNA, 63 nt, hsa
cugcagugagcuaugauugcaccacuguacuccugccuuaaaaaaaaaaaaaaaaucccaaua

SEQ ID NO: 173844 - RNA, 63 nt, hsa
uuaaaggauaguaauuauucuuguuuauaacagugccuuaagguaugauguauuucugaugga

SEQ ID NO: 173845 - RNA, 63 nt, hsa
acaccuccaguuaucaggaauacauuuuuuuacugccuuaaccuguagugcguagaauaugca

SEQ ID NO: 173846 - RNA, 63 nt, hsa
aaacugauuucaugcagguccugaauuuuacuuugccuuaagaagugcccuccccacaaugca

SEQ ID NO: 173847 - RNA, 63 nt, hsa
gaucccccguuacuuccuagcauuuucuccucuugccuuaaaaguucccuguaugugaaacgg

SEQ ID NO: 173848 - RNA, 63 nt, hsa
gacuagagccuucuugagguuuauuuucuagguugccuuaauauuugaacauaauagcuauuc

SEQ ID NO: 173849 - RNA, 63 nt, hsa
cauaggaagagaucugccagacgcgaacucaggugccuuaaaaaguauuccaaguuuacucca

SEQ ID NO: 173850 - RNA, 63 nt, hsa
ugaauccaaaucuuuuucauagguaaugacagaugccuuaaugugaagcuuauuuauaauagc

SEQ ID NO: 173851 - RNA, 63 nt, hsa
uaccaguuucaaacuuggugacuugauccacuaugccuuaaugguuuccuccauuugagaaaa

SEQ ID NO: 173852 - RNA, 63 nt, hsa
ccaggaggccgugugaggaucccgcaauaaagaugccuuaagucucccgguucuggggacgca

SEQ ID NO: 173853 - RNA, 63 nt, hsa
cuauguacugccuuagugcugaugccuguguacugccuuaaauguaccuauggcaauuuagcu

SEQ ID NO: 173854 - RNA, 63 nt, hsa
aacuccauaccaucggccgggugugguggcucaugccuuaaucccagcacuuugggaggucaa

SEQ ID NO: 173855 - RNA, 63 nt, hsa
uuucuucccuucucuaucuguugccccugauuuugccuuaaguucuugccugagugaucuccc

SEQ ID NO: 173856 - RNA, 63 nt, hsa
auugcagcauuucacuuggcuacuucauacccaugccuuaaagaggggcaguuucucaaaagc

SEQ ID NO: 173857 - RNA, 63 nt, hsa
auagccuaagugcuauaucgaucgucccggaugugccuuaagaaccgugaccucaucagucgc

SEQ ID NO: 173858 - RNA, 63 nt, hsa
aaaaaaaagauacaaagucugcauuugauauaaugccuuaauuacugggucuacaauuaaugu

SEQ ID NO: 173859 - RNA, 63 nt, hsa
agguuaggaaaaauuccacacaaccaaacagucugccuuaaaagugacccacauuuuuccaua

SEQ ID NO: 173860 - RNA, 63 nt, hsa
ggucccucgcauucuuuuacuguaaacaaacaaugccuuaaauugugucuuguuuucuguucc

SEQ ID NO: 173861 - RNA, 63 nt, hsa
guagccauagaugugauuauguccacaccgggcugccuuaaucuguccugcuuggagagugac

SEQ ID NO: 173862 - RNA, 63 nt, hsa
uuucaucaaugucuuuguaaagcacaaauuaucugccuuaaaggggcucugggucggggaauc

SEQ ID NO: 173863 - RNA, 63 nt, hsa
ucuaugacaauauauuuuaacugacuuucuagaugccuuaauauuugcaugauaagcuaguuu

SEQ ID NO: 173864 - RNA, 63 nt, hsa
ucuuucuguccgcagauccugacuuuuccaaagugccuuaaaagaaaucagacaaaugcccug

SEQ ID NO: 173865 - RNA, 63 nt, hsa
uugcccuccugccacccuuccccuuguagauacugccuuaacacucccuccucucucagcugu

SEQ ID NO: 173866 - RNA, 63 nt, hsa
acguuguagaaauguacaaaugcauuuccaaacugccuuaaacguuguauuuuuauagacaug

SEQ ID NO: 173867 - RNA, 63 nt, hsa
uuuugcaccacuggucauagcaucuaucuccuuugccuuaauuuacugaaauacaucauuuua

SEQ ID NO: 173868 - RNA, 63 nt, hsa
ggugagcagccacugugcaguucaacguaagugugccuuaauugcacagagguacugccccca

SEQ ID NO: 173869 - RNA, 63 nt, hsa
ugugaggcucaaaugagccaaagguuauaaacuugccuuaaaacuauaguccuauacaaaaau

SEQ ID NO: 173870 - RNA, 63 nt, hsa
ugcucuucugucuauaaauuuugaaugauacugugccuuaauugguuuucauaguuuaagugu

SEQ ID NO: 173871 - RNA, 63 nt, hsa
agcagaacaaauguguuuuucuauauaguuccuugccuuaauaaauauguaauauaaauuuaa

SEQ ID NO: 173872 - RNA, 63 nt, hsa
gcaauaauuuguacaaugguuuauucccaaguaugccuuaagcagaacaaauguguuuuucua

SEQ ID NO: 173873 - RNA, 63 nt, hsa
cuaaccuaccaaacaucauagcuuagccuagccugccuuaaacaugcucagaacacuuacauu

SEQ ID NO: 173874 - RNA, 63 nt, hsa
uaauagauccaguguuuuucagauuccuuucacugccuuaaucuuugcaacaggguggaaguu

SEQ ID NO: 173875 - RNA, 63 nt, hsa
gagccacugagggauguuuuccccccuugcuugugccuuaaaggcagagaagcgaggcggaug

SEQ ID NO: 173876 - RNA, 63 nt, hsa
ggccagcaccucccuccuccaucgcucgcugugugccuuaaacuccaucucaugucccucccc

SEQ ID NO: 173877 - RNA, 63 nt, hsa
ccggcccgggcugcguacacccuugcccugcuuugccuuaaagccucggggucugcccggccc

SEQ ID NO: 173878 - RNA, 63 nt, hsa
cgagcuaagucugugugcagcauuaguacccgcugccuuaaaacucaaguuuacauuauucau

SEQ ID NO: 173879 - RNA, 63 nt, hsa
ucuuauaauuuaucuuuauuuaaaagcuuagccugccuuaaaacuagagaucaacuuucucag

SEQ ID NO: 173880 - RNA, 63 nt, hsa
aauggaagagcccagaugggugaagauugauuuugccuuaacucaagagaauuccuguucucc

SEQ ID NO: 173881 - RNA, 63 nt, hsa
guucuacuuaaaaugugaauuguacuucugagcugccuuaaugcaaggucauuuauauuuguu

SEQ ID NO: 173882 - RNA, 63 nt, hsa
aauaugaacauguacagcgugcauagggacucuugccuuaaggaguguaaacuugaucugcau

SEQ ID NO: 173883 - RNA, 57 nt, hsa
auuaugcuaauuucaaaugaagauuccugccuuaaaauauuuuuuaauuuaaugguc

SEQ ID NO: 173884 - RNA, 63 nt, hsa
aucuucccuaauuucuuuguauauauuuuguuaugccuuaaaggccaccugcuauacaguugu

SEQ ID NO: 173885 - RNA, 63 nt, hsa
ggggcuuugguuccaaaacuuggacaaaccugaugccuuaaggaaaagguuaagaugagaggg

SEQ ID NO: 173886 - RNA, 63 nt, hsa
uggauauuaugcuuugaagucaugagugggaguugccuuaaauguuaaaaugaaaacuuugug

SEQ ID NO: 173887 - RNA, 63 nt, hsa
gcacgguuuggguauucuuaaugaccaggcaaaugccuuaaguaaacaaacaagaaaugucuu

SEQ ID NO: 173888 - RNA, 63 nt, hsa
ugcugugugugugcaugugugugucugcauucaugccuuaacucggguuacugcacaacuuua

SEQ ID NO: 173889 - RNA, 63 nt, hsa
cuugagcccucuaugguguggcaaagccuucauugccuuaacuggagccccaucagcuccagc

SEQ ID NO: 173890 - RNA, 63 nt, hsa
aggguaaugugcuugguuugcacauguuguuauugccuuaauucuaauuuuauuuuguucucu

SEQ ID NO: 173891 - RNA, 63 nt, hsa
ucagugacagggcuucuuguaauuugugguaugugccuuaaaccugaaugucuguagccaaaa

SEQ ID NO: 173892 - RNA, 63 nt, hsa
gcgagguauaaaaguacgcaguuuucauguccuugccuuaaagagcucucuagucuaacgguc

SEQ ID NO: 173893 - RNA, 59 nt, hsa
ggaacuuguaggugacaugacaugagaauugccuuaaaauacucaaggaaaaaaauccu

SEQ ID NO: 173894 - RNA, 63 nt, hsa
caagauaaaugguaccagcguccucuuaaaagaugccuuaauccauuccuugaggacagaccu

SEQ ID NO: 173895 - RNA, 63 nt, hsa
auuacuacucauuucaguguuuaguacagaaauugccuuaaaaauugcuauuaauugaaauau

SEQ ID NO: 173896 - RNA, 63 nt, hsa
uaauuaaaauguuugccacauuaacuuuucugaugccuuaaaagugaacuucuuuaaagaacc

SEQ ID NO: 173897 - RNA, 63 nt, hsa
ccuccccugggccgcugaggccccgcgcaccugugccuuaaucuucccuccccugugcugccc

SEQ ID NO: 173898 - RNA, 63 nt, hsa
caccagucauacuggcucagggcccaccgcuaaugccuuaaugaaaucauuuuaacauuauau

SEQ ID NO: 173899 - RNA, 63 nt, hsa
uuuugguugaaauugaacauacucuagugaaugugccuuaaaaaucaagacacuaguucagag

SEQ ID NO: 173900 - RNA, 63 nt, hsa
guaguuguucauuucagccucuggauggcuggcugccuuaaacacaaucaauuucaaagcucc

SEQ ID NO: 173901 - RNA, 63 nt, hsa
gugcaauucuggaacauauuaauuaaaauaauaugccuuaacauauagugaauuucuaauucu

SEQ ID NO: 173902 - RNA, 63 nt, hsa
cacuuccgaaaaguuuacauucacuuggaaggcugccuuaaaguauaucucuuaucuaugacc

SEQ ID NO: 173903 - RNA, 63 nt, hsa
uauuauugacuauagccaacuacagauggcauaugccuuaaagaugcauuuuucuauguauuu

SEQ ID NO: 173904 - RNA, 63 nt, hsa
uggaaaaauugucccgucugucacuuguuuuguugccuuaauaagcaucugaauguuugguug

SEQ ID NO: 173905 - RNA, 63 nt, hsa
cuucagcuucuuacguuuucugagcauccauugugccuuaacauuuucugcuuguccuuuggg

SEQ ID NO: 173906 - RNA, 63 nt, hsa
cugaacuccggccugggugacagaaggaggcucugccuuaaaaaaaaaaaaaaaaaaaaccuc

SEQ ID NO: 173907 - RNA, 63 nt, hsa
acacuugccaaaacauuaagagaacuuugauucugccuuaagaggguauaaaacuaaaccauu

SEQ ID NO: 173908 - RNA, 63 nt, hsa
aguugugccuuggugccuuguccgccucagcugugccuuaaggacuaauucuggcaccccuuu

SEQ ID NO: 173909 - RNA, 63 nt, hsa
gucuuaauauaucuuaggcuucaauuauuugggugccuuaaaaacucaaugagaaucauggua

SEQ ID NO: 173910 - RNA, 63 nt, hsa
uucguccagcccaugugcaaagucaacaguauuugccuuaagauuucauauauauauauuuuu

SEQ ID NO: 173911 - RNA, 63 nt, hsa
ggugcugguucacucugcccagcccugaaugugugccuuaaaggcccccuacaaggggcccca

SEQ ID NO: 173912 - RNA, 63 nt, hsa
acugcuuugcaaugacauuuauuuauuaauucaugccuuaaaaaaauaggaagggaagcuuuu

SEQ ID NO: 173913 - RNA, 63 nt, hsa
gaaccccuuuaucccaggaaguccucuuccuugugccuuaacauacaggacaaauaggcucua

SEQ ID NO: 173914 - RNA, 63 nt, hsa
caaggucaccaaacaacuugguugugaaccaacugccuuaaccuucugggggagggggauuag

SEQ ID NO: 173915 - RNA, 63 nt, hsa
ugaggggccagcuugccaggcuuaagccaaaucugccuuaaauuggggguggggagggguaag

SEQ ID NO: 173916 - RNA, 63 nt, hsa
uaucuuaaaacgugugcccuuuuauauuauuuaugccuuaaauguuuucuuccccauuccuuc

SEQ ID NO: 173917 - RNA, 63 nt, hsa
ucuagcugggugaaacccuuauuuucccagagaugccuuaaccuuuguugguuuuggcuuuag

SEQ ID NO: 173918 - RNA, 63 nt, hsa
ccagcuguauuauuuugaucuuuuggaugcaggugccuuaaugaagcucucaaaauauuuuag

SEQ ID NO: 173919 - RNA, 63 nt, hsa
auuggaugaaauuagcugcugagauugaguuucugccuuaaaaucugaaacaaaaaaagggac

SEQ ID NO: 173920 - RNA, 63 nt, hsa
cccuuuccuaaucuggcuuuuacauuuauuuugugccuuaaagauuaacuacaaagauaaaca

SEQ ID NO: 173921 - RNA, 63 nt, hsa
gggcuauuuggacucaggugggcccucugaacuugccuuaaacacucaccuucuagucuuggc

SEQ ID NO: 173922 - RNA, 63 nt, hsa
ccccugaagccuaacacaguuccuaauguguuuugccuuaaccucuuuucucuucccacauug

SEQ ID NO: 173923 - RNA, 63 nt, hsa
uccauuucuuuuuucccaaacccucaaacagagugccuuaaaaaauuguuuuaucaggauaau

SEQ ID NO: 173924 - RNA, 63 nt, hsa
aaagaaggaacauuuccuauggugcugucucacugccuuaaaacagauuucuaugacaguuua

SEQ ID NO: 173925 - RNA, 63 nt, hsa
auaagccaaagccauguggaauuuuuguuuagaugccuuaacugugccacaccccacaacccc

SEQ ID NO: 173926 - RNA, 63 nt, hsa
ugucuugagggaaggaagaggucuguucuguauugccuuaaguugauugagguuuguaggaga

SEQ ID NO: 173927 - RNA, 63 nt, hsa
aguuuuauuuuugcaaacuaaauacacaaagcaugccuuaaacccagugaagcaacugaguac

SEQ ID NO: 173928 - RNA, 63 nt, hsa
aauguaaagaacuuaaauuauguuuuaaacacaugccuuaaauuuguuuaauuaaauuuaacu

SEQ ID NO: 173929 - RNA, 63 nt, hsa
agcaauugacagagaauaacucagaauauugucugccuuaaagcaguaccccccuaccacaca

SEQ ID NO: 173930 - RNA, 63 nt, hsa
uaacaggaccccaaggaccugccuccccggaagugccuuaaccuagagggucggggaggaggu

SEQ ID NO: 173931 - RNA, 63 nt, hsa
uacuacauuucuuccacuccccuuuccccuaccugccuuaaccaaggcucauacuguccuguc

SEQ ID NO: 173932 - RNA, 63 nt, hsa
uccuccuccaucuuucuacagagauuacuuugcugccuuaaugacauuccccucccaccucuc

SEQ ID NO: 173933 - RNA, 63 nt, hsa
gccucccaaaaaggagccccaccucagcaucacugccuuaaucguggccucccuggggugggu

SEQ ID NO: 173934 - RNA, 63 nt, hsa
gaaucuguuucagagcucuccuaccuugcucacugccuuaaucagaccgauuuccugcccacc

SEQ ID NO: 173935 - RNA, 63 nt, hsa
gacuuucuuuggcuaauuuuacuuugcaugauaugccuuaauaugccuucauaaauaaccauu

SEQ ID NO: 173936 - RNA, 63 nt, hsa
cuacuuggcagcuaguaaguuuaaagcaggaccugccuuaacugcuccuggccacuuggaagu

SEQ ID NO: 173937 - RNA, 63 nt, hsa
cuucagcugcuaagauccaagaaaacgccucacugccuuaaccuuaacuguucuuccuggcgc

SEQ ID NO: 173938 - RNA, 63 nt, hsa
cuauuuugaaucaccuuuaauuacaugucagaaugccuuaacuacccuaacuugacaaaacag

SEQ ID NO: 173939 - RNA, 63 nt, hsa
gugauggaauaacaagggucagauuuccucuccugccuuaaacaacuggaagcuauacaauac

SEQ ID NO: 173940 - RNA, 63 nt, hsa
uagcaacuuagauaagugaaaguuuuucuaacaugccuuaaaaauauuaugguuugauccaaa

SEQ ID NO: 173941 - RNA, 63 nt, hsa
caauuuuccaccucgcaguaguuaguauuuacuugccuuaaacuaacuuugaagcaaguaaug

SEQ ID NO: 173942 - RNA, 63 nt, hsa
guuuuaaucucuaacaguggacaaaguuaccagugccuuaaacucuguuacacuuuuuggaag

SEQ ID NO: 173943 - RNA, 63 nt, hsa
uaaaaauaaccuuaggaacuguagccauuucauugccuuaauuuuaagaggaaaauacaaaaa

SEQ ID NO: 173944 - RNA, 63 nt, hsa
gauucacagaagcacuacuccagagcagaaugaugccuuaaucuuaaguguccauuugugcag

SEQ ID NO: 173945 - RNA, 63 nt, hsa
aaaauuauauacugaaaacaccaaaaauuuagaugccuuaauaguauauacgugaaauacuca

SEQ ID NO: 173946 - RNA, 63 nt, hsa
aaauuucacuggauuguauaaauuuuuaucuauugccuuaaacauuuacaugauucucaauau

SEQ ID NO: 173947 - RNA, 63 nt, hsa
ccuugcugcuagagugggaggagaaagaugucuugccuuaaaaguuuacuguuucuucuguuc

SEQ ID NO: 173948 - RNA, 63 nt, hsa
caaaaaccugagggggagaaaauacuuugcuuuugccuuaacacaucaucuggucacguuaga

SEQ ID NO: 173949 - RNA, 63 nt, hsa
ccauaucuccagggauguuguugauccccacacugccuuaagguauauuauagaaacaguuuu

SEQ ID NO: 173950 - RNA, 63 nt, hsa
ccccccuccgccuccaggaagaaagaauguuacugccuuaauaaaaaaugaaaagagaaugau

SEQ ID NO: 173951 - RNA, 63 nt, hsa
auuaauaucuucaggaauauuuugggauaggguugccuuaaaacauuuuacuuggcuuauuca

SEQ ID NO: 173952 - RNA, 63 nt, hsa
ccauuucuuuuuuaagaucugauaugcuaucauugccuuaauaauggaacaaaauagaagcau

SEQ ID NO: 173953 - RNA, 63 nt, hsa
ggccaccaguuaaaugccgucuaucagguuuugugccuuaagagacuacagagucaaagcuca

SEQ ID NO: 173954 - RNA, 56 nt, hsa
ugggauucaauaauauguaaagaaaaugccuuaauauaaacugacucaguugaaua

SEQ ID NO: 173955 - RNA, 63 nt, hsa
aaaaaggauuaccuuuccuuguaaagaggaugcugccuuaagaauugcauguuguaaaaaauc

SEQ ID NO: 173956 - RNA, 63 nt, hsa
agaugaauacuaaaugguugucugggucaauacugccuuaaugagaacauuuacacauucuca

SEQ ID NO: 173957 - RNA, 63 nt, hsa
gguuauaaaaauguuaauucagaauuaguuuaaugccuuaauuaaacuaauuaauagcuuugg

SEQ ID NO: 173958 - RNA, 63 nt, hsa
uccauggcucuaaaauuuggaauuaacuucucuugccuuaagagcugcuuguacauaugugga

SEQ ID NO: 173959 - RNA, 63 nt, hsa
ugggaaaaaauccuaaaaggugacuuaauuugaugccuuaaauucacaagugaggaagcuaag

SEQ ID NO: 173960 - RNA, 63 nt, hsa
auuucugaagaaaagcaaaugcauuaguauguuugccuuaaacuuguagacuaaaccaaguau

SEQ ID NO: 173961 - RNA, 63 nt, hsa
aggguggggcccacuccaugaagacagcagucaugccuuaagaagcagagcuaccuuacgugc

SEQ ID NO: 173962 - RNA, 63 nt, hsa
uguguguguuuuuaauauucacacugagacaugugccuuaaacagacuuuuuaguccaaaauu

SEQ ID NO: 173963 - RNA, 63 nt, hsa
gaugccacauagucuugcauaaaaaaggguucuugccuuaaaagugaaaccuucauggauagu

SEQ ID NO: 173964 - RNA, 63 nt, hsa
cagcugauucugagacaggccccugcagagggaugccuuaaagcugucccuggcuggaggagc

SEQ ID NO: 173965 - RNA, 63 nt, hsa
ggcuguuccgucugauagauggaaggguaacauugccuuaaaacagaaauaugcaggcguugg

SEQ ID NO: 173966 - RNA, 63 nt, hsa
cgacacuuugucgacacugaaauaucgauuaagugccuuaaaaccucuuuagacauagcuaug

SEQ ID NO: 173967 - RNA, 63 nt, hsa
auuagacauacuguuuuuauaauguuuuacuucugccuuaagauuuagguuuuuuaaauguau

SEQ ID NO: 173968 - RNA, 63 nt, hsa
gugaacagaaguccuuaagcagaggaauuggugugccuuaaagauacaaucugggauaguuug

SEQ ID NO: 173969 - RNA, 63 nt, hsa
auuuuccauuauucuggacaugaauuucuaaaaugccuuaauagguuuauguaguugaguaaa

SEQ ID NO: 173970 - RNA, 63 nt, hsa
aacaguaugguacugcuucugugacaaauaucgugccuuaacaauguggcuguccuuuuccac

SEQ ID NO: 173971 - RNA, 63 nt, hsa
auaguuaauccguaaagguuuccaguuaauucaugccuuaaaaggcacugcaauuuuauuuuu

SEQ ID NO: 173972 - RNA, 63 nt, hsa
agagacuaaggauucuucucuuuuauagcuauuugccuuaagaacuuacuuuagauucuuauu

SEQ ID NO: 173973 - RNA, 63 nt, hsa
uuauuauguagaaugaaugaggguacugucaccugccuuaauguagguaggcccagagucuua

SEQ ID NO: 173974 - RNA, 63 nt, hsa
caggguauuaaucccuuugucaccuaccauugaugccuuaaguuuucugagucucaauuaaaa

SEQ ID NO: 173975 - RNA, 63 nt, hsa
guuuuguggggucugagguuuacgagauuuggcugccuuaagaauacaaaaacagaaaugcag

SEQ ID NO: 173976 - RNA, 63 nt, hsa
ggauggucugcucaaguggcccacacuggucauugccuuaagccaccuccccaggacuuacgg

SEQ ID NO: 173977 - RNA, 63 nt, hsa
gggguggaauauaucaggaauuuauaauaaaauugccuuaaucucuacaacaguaucuuaauu

SEQ ID NO: 173978 - RNA, 60 nt, hsa
agauauugaagaaaaaaugaaucaggaucaugccuuaaaaagaaaacuuuuguuaaagua

SEQ ID NO: 173979 - RNA, 63 nt, hsa
acacucuguaguaaccauuacagaaaauacuucugccuuaaaaaauaugauaugccagagaug

SEQ ID NO: 173980 - RNA, 63 nt, hsa
uuauaccagaaaguuaaauucucagaucaaaugugccuuaauaaauuuguuuucauuuagauu

SEQ ID NO: 173981 - RNA, 63 nt, hsa
uugaucaauucccuugaauagggaaguaacauuugccuuaaauuuuuucgaccucgucuuucu

SEQ ID NO: 173982 - RNA, 63 nt, hsa
gggugugaauagccguaacuugccugcaccugcugccuuaacaguggaguuggccaggcgcag

SEQ ID NO: 173983 - RNA, 63 nt, hsa
aacuuugagccaugcuaggagguaacuagucuaugccuuaacuccugaccuuuccugcauuag

SEQ ID NO: 173984 - RNA, 63 nt, hsa
aucaucuuuucuaaauucaucuccauuaaaacuugccuuaagcuaccagauugcuuuugccac

SEQ ID NO: 173985 - RNA, 63 nt, hsa
cuaaguucagaagguacuuuguuuuuccucccuugccuuaaguccuugguauuuauaaucaau

SEQ ID NO: 173986 - RNA, 63 nt, hsa
acuuagaauuucauuauguuuuagaaucaucacugccuuaauauucaagcaucuauuuaaguc

SEQ ID NO: 173987 - RNA, 63 nt, hsa
cuugaacguacucauaaauaugacuuauuguauugccuuaaguuuucacucauugucuuuuga

SEQ ID NO: 173988 - RNA, 56 nt, hsa
ucuuaaagccccaggauuaagauggaugccuuaagcgauggcccaggggugcuugg

SEQ ID NO: 173989 - RNA, 63 nt, hsa
uccggcucagacugaauaagaagagauaaaauuugccuuaaaacuuaccuggcaguggcuuug

SEQ ID NO: 173990 - RNA, 63 nt, hsa
gccagaaagccaacagcuccccucguggggccuugccuuaaacuugccugguuuguacauuuu

SEQ ID NO: 173991 - RNA, 63 nt, hsa
aaaaugucaaaauaaugagaacugacacaacuuugccuuaaagaguacuagacuggaccuucu

SEQ ID NO: 173992 - RNA, 63 nt, hsa
cugcacuccagccugggcaaccaagcgagacucugccuuaaaaaaaaaaaaaagaaaaugugg

SEQ ID NO: 173993 - RNA, 63 nt, hsa
uaacagaaacauuugaaauagaauuugcaugucugccuuaauuaacuuaaagacugauuuuaa

SEQ ID NO: 173994 - RNA, 63 nt, hsa
uuuuuuuuuuacucccccucuaaacacugcugcugccuuaauuuuagaaagcagcuuacuagu

SEQ ID NO: 173995 - RNA, 63 nt, hsa
acauaacuguggucaucucuguaguuuacuaacugccuuaaaauugcaugguucuuaauggca

SEQ ID NO: 173996 - RNA, 63 nt, hsa
auaaugaauuuuguuuguugaugugaaacauuaugccuuaaguaauguuaauucuuauuuaag

SEQ ID NO: 173997 - RNA, 63 nt, hsa
cuggugguugugccuuuuguaggcuguucccuuugccuuaaaccugaagaugucuccucaagc

SEQ ID NO: 173998 - RNA, 63 nt, hsa
ccucccaggucugggcugugcaguuccucccccugccuuaaaacaccccacuaucucuguaaa

SEQ ID NO: 173999 - RNA, 63 nt, hsa
uuuuaaacugcagaaauuggaguggauggguucugccuuaaauugggaggacuccaagccggg

SEQ ID NO: 174000 - RNA, 63 nt, hsa
auaaagguaacuuuaccuuucuuaaauauuuccugccuuaaagagagcauuuccaugacuuua

SEQ ID NO: 174001 - RNA, 63 nt, hsa
agaaacgcauguggaccagaagacuuucccugcugccuuaaaaccaauaaaagguuaacuuua

SEQ ID NO: 174002 - RNA, 63 nt, hsa
cagcugagcugcgcuggcucugggcagggagugugccuuaaugggaagcacacgggcuuugga

SEQ ID NO: 174003 - RNA, 63 nt, hsa
gauguuuuuaauggcauaacaaaggcaagacucugccuuaauuuuugaaaagcugcuaacuac

SEQ ID NO: 174004 - RNA, 63 nt, hsa
uaauuccucaggcuuugcgauuuaaggaggagcugccuuaaaaaaaaauaaaggccuuauuuu

SEQ ID NO: 174005 - RNA, 63 nt, hsa
acaaagacaagaaaaaucagggcauuuugugagugccuuaagaucaaacuaacaagaucugac

SEQ ID NO: 174006 - RNA, 63 nt, hsa
acaggggaggcagguccuuggcgagguagccccugccuuaauccacggggcuccuuucccucc

SEQ ID NO: 174007 - RNA, 63 nt, hsa
ggcugagaccacccuugccugcccccuucuuucugccuuaagaauguccuuuuaggcugggca

SEQ ID NO: 174008 - RNA, 63 nt, hsa
aauaaauacaaagcccauucuuccagagucuugugccuuaaauaaaacacaccucucugcugu

SEQ ID NO: 174009 - RNA, 63 nt, hsa
gauaaaaacccugaaauucccagaaguuacagaugccuuaaagacuuucuuuggaagaucauu

SEQ ID NO: 174010 - RNA, 63 nt, hsa
auaacaaaugacuuuuuuccuuagggggagguuugccuuaaaggcuuuuaauuuuguuuuguu

SEQ ID NO: 174011 - RNA, 63 nt, hsa
cggugccuugguuucagcugauuuggggggaaaugccuuaauuucacucuccucccuucucca

SEQ ID NO: 174012 - RNA, 63 nt, hsa
cuuggccauguucugagcggccagcuuggccuuugccuuaauaaaugugcuuuauuuucucuu

SEQ ID NO: 174013 - RNA, 63 nt, hsa
acccggggaguggugggcaucucgaugcuucuuugccuuaaugauggccacaucugggcugcu

SEQ ID NO: 174014 - RNA, 63 nt, hsa
ccccuugucgcugucggucccgucuaaccaugaugccuuaacauguggaguguaccguggggc

SEQ ID NO: 174015 - RNA, 63 nt, hsa
gcauauuucaacuguucuucauaaauguuuaugugccuuaaaagacuuuauguuaaaggauua

SEQ ID NO: 174016 - RNA, 63 nt, hsa
aaaguguuaccaguuuacaaaaauaagucuuuuugccuuaagucauuuuggaaauaaguaaua

SEQ ID NO: 174017 - RNA, 63 nt, hsa
ccgaggagcgagaggaauguccauuucuuaaacugccuuaauaacuagccuuuaaccuguggg

SEQ ID NO: 174018 - RNA, 63 nt, hsa
gcuguacauacccuccuuuccuucuaccuaucuugccuuaauuaacauucccugugaccuagu

SEQ ID NO: 174019 - RNA, 63 nt, hsa
gauaauaugauuauaaggaaaucaaauaaauguugccuuaacuucaguuaauauuuuccuguc

SEQ ID NO: 174020 - RNA, 63 nt, hsa
gcauagaaauugaagaauuuguaaaaauagaauugccuuaaaggauuugaaguaagaacauaa

SEQ ID NO: 174021 - RNA, 63 nt, hsa
uccggaauccuguccucagcuucuuaauauaacugccuuaaaacuuuaaucccacuugccccu

SEQ ID NO: 174022 - RNA, 63 nt, hsa
ggugggcgccccgaccacgacuuggcuuccuugugccuuaaaaaaccugccuuccugcagcca

SEQ ID NO: 174023 - RNA, 63 nt, hsa
cgccccacuucuagcugcuucuccucuuguuucugccuuaauaauucccacggccacaggcaa

SEQ ID NO: 174024 - RNA, 63 nt, hsa
ggacucgcugccaggggcugccacacuccugaaugccuuaacauuucuuccauggccccacac

SEQ ID NO: 174025 - RNA, 63 nt, hsa
agggccccggccugggacucagcauuucugauaugccuuaagaauucauucuguuuuguacaa

SEQ ID NO: 174026 - RNA, 63 nt, hsa
auuuuguaaaauuauccugcacaucaagcugcaugccuuaaagcggaaacucuaggacugugu

SEQ ID NO: 174027 - RNA, 63 nt, hsa
uaguugggucuauuagcucagauugagagguguugccuuaaaacugaguugggugacuuggua

SEQ ID NO: 174028 - RNA, 63 nt, hsa
auaaguaguaucugcaguguguucauccguugcugccuuaacaagucacccacacguaguggc

SEQ ID NO: 174029 - RNA, 63 nt, hsa
acaaaacauacacuuugucagagaagaaaaaaaugccuuaacuauaaaaagcggagaaaugga

SEQ ID NO: 174030 - RNA, 63 nt, hsa
uaagccuuguugaaaugcucugguauucaguauugccuuaauaaacuucacccacaacugcau

SEQ ID NO: 174031 - RNA, 63 nt, hsa
uggaaggugagccuuuuccuggccaagggcagcugccuuaaccucugagagucugcgcuuggc

SEQ ID NO: 174032 - RNA, 63 nt, hsa
auuuuuaguuuuuuuguuuguuuguuuuuaaucugccuuaaugagcucaggccacuaucacaa

SEQ ID NO: 174033 - RNA, 63 nt, hsa
cggggucccugccgcagcccccuccccuucugaugccuuaaaagcugggccccaggcccugcu

SEQ ID NO: 174034 - RNA, 63 nt, hsa
cauccccuuccuagcuguaugaccuugauugugugccuuaaccgcucugugacacagucuacc

SEQ ID NO: 174035 - RNA, 63 nt, hsa
gagccgcagcugcaaacucugacacaaaagacgugccuuaaggaacccgccgcgugcccaggu

SEQ ID NO: 174036 - RNA, 63 nt, hsa
uauguauauguguguguguauaaaauauauauuugccuuaaauggaaauauaaacaaaauuua

SEQ ID NO: 174037 - RNA, 63 nt, hsa
uccugaaccacaaaccauagcauaagugaucugugccuuaacgacauguuccugcugcagaua

SEQ ID NO: 174038 - RNA, 63 nt, hsa
ugggucuuccugaauuaauuuaucuauuccaaaugccuuaacgagacucuguuucugggaguc

SEQ ID NO: 174039 - RNA, 63 nt, hsa
cugugugccccgcaccccccaugcuucuuuugcugccuuaagcccccuaugcccuggagguga

SEQ ID NO: 174040 - RNA, 63 nt, hsa
ggggacggggcggggcuugaccugcgggugcuuugccuuaaaaagaaauaaaagaugugaacu

SEQ ID NO: 174041 - RNA, 63 nt, hsa
cagcucccgccccucgccccccaccuccacaggugccuuaaagggcccucguccacccaaggu

SEQ ID NO: 174042 - RNA, 63 nt, hsa
aauaaccuuucaucacuuccuuugugcgcuuccugccuuaagugacaaguagcaacauggcuu

SEQ ID NO: 174043 - RNA, 63 nt, hsa
ccuagguuuccucuccagccaacggggcgucgcugccuuaaugggaggagcacucggaagggu

SEQ ID NO: 174044 - RNA, 63 nt, hsa
gaccaaaagucucagcacacuuaccuccgauuaugccuuaaagaguugauugugaagaaccag

SEQ ID NO: 174045 - RNA, 63 nt, hsa
aaugugaaaucagagaauguuguaauaaguaaaugccuuaagaguauuuaaaauaugcuucca

SEQ ID NO: 174046 - RNA, 63 nt, hsa
cacaugaacucacaaaggagaggcccucauucuugccuuaaaacugccccuaaagccaagccu

SEQ ID NO: 174047 - RNA, 63 nt, hsa
acugccuaaagucacagcacagauacugcccagugccuuaagaggagacaugaucucuaccag

SEQ ID NO: 174048 - RNA, 63 nt, hsa
uauguuagagagguagcgagcugcucugcuauaugccuuaagccaauauuuacucaucagguc

SEQ ID NO: 174049 - RNA, 63 nt, hsa
ucacuguuuagauuugccauagaguacacugccugccuuaagugaggaaaucaaagugcuauu

SEQ ID NO: 174050 - RNA, 63 nt, hsa
aauacucgugugacucuucuuagaguuaccaucugccuuaaauuuccucuguuuuucacauuc

SEQ ID NO: 174051 - RNA, 63 nt, hsa
ggggaguggaggggcauagccuuucccuaauucugccuuaaauaaaacugcauugcugauuca

SEQ ID NO: 174052 - RNA, 63 nt, hsa
agaccccccauuuauuuguaugaaggcuucaguugccuuaauaaagugcucugugggguccga

SEQ ID NO: 174053 - RNA, 63 nt, hsa
cuguuacaaaacgagauaagcaaguguuagaauugccuuaaggccacacuggcaucucccuga

SEQ ID NO: 174054 - RNA, 63 nt, hsa
ggcuucuguuguauuugaaguaucaucugguuuugccuuaacucuuuaaauuguauauauuua

SEQ ID NO: 174055 - RNA, 63 nt, hsa
uacacaagaaauauuuguuuuacucagcaggugugccuuaaccucccuauucagaaagcucca

SEQ ID NO: 174056 - RNA, 63 nt, hsa
guauuuaacaggugccucguguugagauuacgcugccuuaauguaacacagucuggcaguugc

SEQ ID NO: 174057 - RNA, 63 nt, hsa
acuguaaccucaaggaaaccauaaagcuuggagugccuuaauuuuuaaccaguuuccaauaaa

SEQ ID NO: 174058 - RNA, 63 nt, hsa
aaaauguuacugaaagucacuuuuaugagcaucugccuuaauaaacagacauugauucccuua

SEQ ID NO: 174059 - RNA, 63 nt, hsa
ugggauucuuuuuucuccugugguggauaaaucugccuuaaaaaucaauguaacuugggggcu

SEQ ID NO: 174060 - RNA, 63 nt, hsa
gagcuggcacugaaccaggcugcaagauuugacugccuuaaaaacacaaggcccucuaggccu

SEQ ID NO: 174061 - RNA, 63 nt, hsa
ccgguguuggcucuagacuggucucaucuccauugccuuaaugccagguggcccaggaguacc

SEQ ID NO: 174062 - RNA, 61 nt, hsa
uucuuccuuccccagcuccacuaaauucccuccugccuuaacugaggcucgacuccuucgu

SEQ ID NO: 174063 - RNA, 63 nt, hsa
uuccuaccuagcuccuuguuggugagcuucuugugccuuaauccugugacccagccccuuaca

SEQ ID NO: 174064 - RNA, 63 nt, hsa
aaaccuggaauuguggggcaaucuauuaauagcugccuuaaagucaguaacuuacccuuaggg

SEQ ID NO: 174065 - RNA, 63 nt, hsa
guguuugaaaaagaagggggggagaauuccaggugccuuaauauaaaguuugaagcuucaucc

SEQ ID NO: 174066 - RNA, 63 nt, hsa
caguucuugagguauauuauuuuaaucauuccaugccuuaauaugcuugcaauacaagaauau

SEQ ID NO: 174067 - RNA, 63 nt, hsa
acuaauauucugcaaaugucucuuggaacacacugccuuaaacagauauuucuauagcuguca

SEQ ID NO: 174068 - RNA, 63 nt, hsa
uuggauuuuuuuucccucaggucugaguagcauugccuuaaaucuuauccaguuagaacauug

SEQ ID NO: 174069 - RNA, 63 nt, hsa
agcuuucagugacccauuuuccugucuagacucugccuuaagcuaguggcaacugcuggggcc

SEQ ID NO: 174070 - RNA, 63 nt, hsa
aggcccggcuguggcuccaccuccagcucuccgugccuuaagggaaaagcgggacagcuccca

SEQ ID NO: 174071 - RNA, 63 nt, hsa
ucagaugagaauuagcaucaggaaagccugaaaugccuuaauugugaacugauaugcaggaaa

SEQ ID NO: 174072 - RNA, 63 nt, hsa
uggguuauuauuuugcaguuuuguuuuuuauuuugccuuaaguaaugauagaagauauauaug

SEQ ID NO: 174073 - RNA, 63 nt, hsa
ccaauuuucauuauucuugagaaaugucagcuuugccuuaaugaguauuugcuuuaaauuucu

SEQ ID NO: 174074 - RNA, 63 nt, hsa
acacugcagggaggagugguacuuaagcuccccugccuuaaccugggaccaaccugaccuaac

SEQ ID NO: 174075 - RNA, 63 nt, hsa
uugugaaaauuuugaauuagcuuucauaugaagugccuuaaguagacucuucauuuacuuuuc

SEQ ID NO: 174076 - RNA, 63 nt, hsa
auaguuaaucauuuaaccaaagaagauguguagugccuuaacaagcaauccucugucaaaauc

SEQ ID NO: 174077 - RNA, 63 nt, hsa
gcaccuuccagggcuccguccacuaguuuccccugccuuaaugugacaugaggcccauucuuc

SEQ ID NO: 174078 - RNA, 63 nt, hsa
ucagaugagcauuagcaucaggaaagccugaaaugccuuaauugugaacugauacgcaggaaa

SEQ ID NO: 174079 - RNA, 64 nt, hsa
cccaccuaccaccagaggccugcagccucccacaugccuuaaggggaccguggcccccaccagg

SEQ ID NO: 174080 - RNA, 64 nt, hsa
gcagagguggcagggauggcuccgaagccagaaaugccuuaaacugcaacgucccgucccuucc

SEQ ID NO: 174081 - RNA, 64 nt, hsa
uggacagagucucucauggaugccggcacaaaacugccuuaaaauauucauaguuaauacaggu

SEQ ID NO: 174082 - RNA, 64 nt, hsa
ccaucuuugcuacuuuccuagagaacccggcuguugccuuaaaugugugagagggacuuggcca

SEQ ID NO: 174083 - RNA, 64 nt, hsa
aagaaucacaaaagaagugaaaagggccgguuccugccuuaacugaugacauuccaccauugug

SEQ ID NO: 174084 - RNA, 64 nt, hsa
ucacuuaccuuauuuaaaauaaaucaauaaagcuugccuuaaauuauuuuuauaugacuguugg

SEQ ID NO: 174085 - RNA, 64 nt, hsa
ugguuauuauggaugauaguuauagcccuuauaaugccuuaacuaaggaagaaaagauguuauu

SEQ ID NO: 174086 - RNA, 64 nt, hsa
aggcuucaccauacuguaagcauuuuagguagauugccuuaaagguuaugggagggcaugaggg

SEQ ID NO: 174087 - RNA, 64 nt, hsa
uuuucuucugguguauuuugcacagacaagcaucugccuuaaaauauauacacuuguacaaaaa

SEQ ID NO: 174088 - RNA, 64 nt, hsa
uuuuuuuuuuuccuuucaacuuaguugacauacgugccuuaaaaaggaaaacuaguguugcuau

SEQ ID NO: 174089 - RNA, 64 nt, hsa
ucugacaaauaaauaugucauccugaauuaauaaugccuuaauaaaaguacauccuccugcuaa

SEQ ID NO: 174090 - RNA, 64 nt, hsa
cacuggaaguuuuucaugauaacuuauuuuaagaugccuuaaaaaucuuaaagucacaaaagga

SEQ ID NO: 174091 - RNA, 64 nt, hsa
uuuucucucauuucccauggaaggacuucggaaaugccuuaaguuccccucuuuauccugccca

SEQ ID NO: 174092 - RNA, 64 nt, hsa
uaauuuuggagguuggggugcaaucuuuagaauaugccuuaaaaggccgggcgcgguggcucac

SEQ ID NO: 174093 - RNA, 64 nt, hsa
ugauaugaauaugccuuauaugcugauaugaauaugccuuaaaauaaaguguuccccaccccug

SEQ ID NO: 174094 - RNA, 64 nt, hsa
cuuccuuuucccugcuuccaggaaacuccacaucugccuuaaaaccaaagagggcuuccucuag

SEQ ID NO: 174095 - RNA, 64 nt, hsa
gugcccugccccucuggccacugcugcagacaccugccuuaacacacacaccucuaggacucca

SEQ ID NO: 174096 - RNA, 64 nt, hsa
ccuuaacacacacaccucuaggacuccacaguuuugccuuaaaggaccuucccaagucucccuu

SEQ ID NO: 174097 - RNA, 64 nt, hsa
gaaacauuccuuucaccaucauuuagaaaugguuugccuuaauggagacaauagcagauccugu

SEQ ID NO: 174098 - RNA, 64 nt, hsa
gugaguucuaaaaggcaugcccacaucucuuucgugccuuaaggauagugagaugcacacuuau

SEQ ID NO: 174099 - RNA, 64 nt, hsa
gaguucccugcugaagccccuagcacacacugcaugccuuaacaagugugugcaagccccucag

SEQ ID NO: 174100 - RNA, 64 nt, hsa
uucaaaaacagagcccauucuuaagaucacuuggugccuuaaagacacgcauuccaaaguggaa

SEQ ID NO: 174101 - RNA, 64 nt, hsa
gaagaauguggauacucuuaggcgugaauguaaaugccuuaauauugaagguccugguuagaag

SEQ ID NO: 174102 - RNA, 64 nt, hsa
uggaccuuuuauaugugccuucacuuuagcuguuugccuuaaucucuacagccuugcucuccgg

SEQ ID NO: 174103 - RNA, 64 nt, hsa
gaggcuguguguccaaggauggugcugaaaucacugccuuaaggucucugcugugcagaaugag

SEQ ID NO: 174104 - RNA, 64 nt, hsa
uauuuaaauuggaucuugaaagaugaauaaggccugccuuaaguucugcuaaaggccauguugu

SEQ ID NO: 174105 - RNA, 64 nt, hsa
cagcccccgcccagcucaucagucugaauggaguugccuuaaauuggcaggugguaccguacuc

SEQ ID NO: 174106 - RNA, 64 nt, hsa
ucucugauuuugugcuacuccuuuguaaagucacugccuuaagggggcugauggcgccaccugu

SEQ ID NO: 174107 - RNA, 64 nt, hsa
uucuugaugauccucaaggaaauacaaccuagggugccuuaaaaauaacaacaacaaaaaaccu

SEQ ID NO: 174108 - RNA, 64 nt, hsa
gaaccaagucauuacaugucaaauucaauuuuucugccuuaagaaugaauguccuucauaaaau

SEQ ID NO: 174109 - RNA, 64 nt, hsa
aagucccuugugcuggccagauggcguggcugguugccuuaauaugucccaggaccccugacag

SEQ ID NO: 174110 - RNA, 64 nt, hsa
uuuuuuuucuuucauuuuucucucauuccauuucugccuuaacuuuaguuuguucacagggagg

SEQ ID NO: 174111 - RNA, 64 nt, hsa
aaaagguucaagcaccuuuuccaaauuuaaaucuugccuuaaauucucucuaccacacugccuu

SEQ ID NO: 174112 - RNA, 64 nt, hsa
ccagcacuauggugcucucuguaaugccucuuacugccuuaagucuuuccucuguugcugacca

SEQ ID NO: 174113 - RNA, 64 nt, hsa
caauuaccagccccaccuguuucagcucaagagaugccuuaagauaauuaugugaggccacuug

SEQ ID NO: 174114 - RNA, 64 nt, hsa
ggcuaaaagggcuguacaguuauuucccccucccugccuuaaaacuugggagaggagcacucag

SEQ ID NO: 174115 - RNA, 64 nt, hsa
uuaaaauauguguauauuuuaucagauuugguuuugccuuaaauauuauccccaauugcuucag

SEQ ID NO: 174116 - RNA, 64 nt, hsa
aaaagggcacucauuuggauugccuuacuucucuugccuuaaauauaucccauauauuuaauau

SEQ ID NO: 174117 - RNA, 64 nt, hsa
agacuguucuacaguuucuuugacuccuggcauuugccuuaaggaccuauagcaagcuguuucu

SEQ ID NO: 174118 - RNA, 64 nt, hsa
uagcuuuuaauagugucauaaagauuauaauaugugccuuaaguuuuagucuuuagaacucuag

SEQ ID NO: 174119 - RNA, 64 nt, hsa
cggacucccacuccccgcucccuuccagccaagcugccuuaacucgccccucggggcuccccca

SEQ ID NO: 174120 - RNA, 64 nt, hsa
ucaggaauacauauucacugcuuagaggugaccuugccuuaauauauuugugaaguuaaaauuu

SEQ ID NO: 174121 - RNA, 64 nt, hsa
agaauuuauaacagguuagcuaaaauugggagcaugccuuaaaacuuaaagauuguaugcauau

SEQ ID NO: 174122 - RNA, 64 nt, hsa
cccacuccacuuuccuccacagaugccucuucugugccuuaagcagagucaggagaccccaagg

SEQ ID NO: 174123 - RNA, 64 nt, hsa
auuucauaaagcuggcucuuuauguugcuuuacaugccuuaauauauguuuuauggagauuaua

SEQ ID NO: 174124 - RNA, 64 nt, hsa
uuuucuugcaauuuaaugccaaaaguuugccaugugccuuaaacauauuacuauauauuuuccc

SEQ ID NO: 174125 - RNA, 64 nt, hsa
gucagauauuugagaauaggggauuuuuuugaugugccuuaaauuauaccaaagauuacuaauu

SEQ ID NO: 174126 - RNA, 64 nt, hsa
guuuguaccaaaacaguccuucaacuuugcacugugccuuaaguaauuacuaacaaaagguacu

SEQ ID NO: 174127 - RNA, 64 nt, hsa
ccccaguuuuuguggcucaaggcuggaauauuuaugccuuaauauaucuauggcagacauuuaa

SEQ ID NO: 174128 - RNA, 64 nt, hsa
caugucaaaaaaaaaaaaaaaaaaaaaaaaguccugccuuaacuaacuccucugcgcuuguuca

SEQ ID NO: 174129 - RNA, 64 nt, hsa
uauaaauguacuacauuugcaugccuuuuggguuugccuuaauucuuaccucauuugcauccua

SEQ ID NO: 174130 - RNA, 64 nt, hsa
cauguuugagucucuuaacugauggaugcccacuugccuuaaagcagcauacuuauuuuuuguu

SEQ ID NO: 174131 - RNA, 64 nt, hsa
uacaguauuacagcuuugcauuuggggguuuuacugccuuaacuuucaaugcuuguuaugggaa

SEQ ID NO: 174132 - RNA, 64 nt, hsa
acugcucaucugacuguuuuguacaugugacaauugccuuaaaaccuagcacaguccucagaaa

SEQ ID NO: 174133 - RNA, 64 nt, hsa
ucccgcagaccugccuccagagcaaggagaauucugccuuaaucuguugggcuccagucuccgg

SEQ ID NO: 174134 - RNA, 64 nt, hsa
acagccaagguggacguaccucuccaggagccuuugccuuaauguaucucugccuggacaacuu

SEQ ID NO: 174135 - RNA, 64 nt, hsa
gcucgggagacuuuucugugcuccuuucuacacaugccuuaaaccuuccuuccuguggggugcc

SEQ ID NO: 174136 - RNA, 64 nt, hsa
cuuaguguuuuaaaacaccucugcuuucugauguugccuuaauauucugcuauugcagcaauua

SEQ ID NO: 174137 - RNA, 64 nt, hsa
uggugguuugcuuucuuuaccauaagcaaucccuugccuuaacucaucacccuuuuucacuaug

SEQ ID NO: 174138 - RNA, 64 nt, hsa
aaaguaaugcuuuuccugagcuggaucccaguguugccuuaacagggugucugucgugccgcag

SEQ ID NO: 174139 - RNA, 64 nt, hsa
agaaggcuaugacucccaagaggcagugaaccauugccuuaaauuaauagcagccucucaaguc

SEQ ID NO: 174140 - RNA, 64 nt, hsa
gcuauauggcaccuaauuauuuuuucuuuuaaaaugccuuaaguugcagucucauuuugauaau

SEQ ID NO: 174141 - RNA, 64 nt, hsa
cucagaaccuguuccaucuguaugccauuguucaugccuuaagaaaugcaaagauguacaauaa

SEQ ID NO: 174142 - RNA, 64 nt, hsa
aaguuaauaauuuuuaaauuuuuuucuaauuuuaugccuuaaaauagguuucugauuacauaaa

SEQ ID NO: 174143 - RNA, 64 nt, hsa
ugauaacuaaacuucauuucaguuuacuuuguuaugccuuaauauucugugucuuuugcaauua

SEQ ID NO: 174144 - RNA, 64 nt, hsa
ucccugcaucauccaagcaaugaccucagacuucugccuuaaccagccccggggcuuggcuccc

SEQ ID NO: 174145 - RNA, 64 nt, hsa
gggccccagcagcccuauggugaccgccacacugugccuuaaugucugccgggggcccaggcug

SEQ ID NO: 174146 - RNA, 64 nt, hsa
gcuuaugccacuuccuuguucaaaauaaaguaacugccuuaaucuuauacucauggcuuggagu

SEQ ID NO: 174147 - RNA, 64 nt, hsa
guuugaccuauguauggaacuuacuuuuacuuuuugccuuaaauuuuuaaugaaaugcaaauuu

SEQ ID NO: 174148 - RNA, 64 nt, hsa
auagagagaaauuaacuuuuccaaaugaaugucuugccuuaaacccucuauuuccuaaaauauu

SEQ ID NO: 174149 - RNA, 64 nt, hsa
augcuucaugauaggcaacuuuacccauuuugaaugccuuaauuuaauuuuuuucaaagucuca

SEQ ID NO: 174150 - RNA, 64 nt, hsa
ccaaaauaaggcacagcuuuaauucauuauugaaugccuuaaaugucccagguauugagaauaa

SEQ ID NO: 174151 - RNA, 64 nt, hsa
ugauguacauguugagauauuuggacaaugaaaaugccuuaaaaggaaugcauauggauaaagu

SEQ ID NO: 174152 - RNA, 64 nt, hsa
uuugaauaaagcuucgcuucuagguggcacuguuugccuuaauacccugacaguucaucuuccu

SEQ ID NO: 174153 - RNA, 64 nt, hsa
aagauccacaaaagaagugaaaauagccaguuccugccuuaacugaugacauuccaccauugug

SEQ ID NO: 174154 - RNA, 64 nt, hsa
ccaacagcaccggauccacagaauguuucuucucugccuuaaagagcuauucacuaauaacaua

SEQ ID NO: 174155 - RNA, 64 nt, hsa
aucccauuagagguacuuuuuuuugauggcaugcugccuuaaaagagccauuuauuuuuagaga

SEQ ID NO: 174156 - RNA, 64 nt, hsa
ugaagugucuuauccuuuucuaugaauuccaauuugccuuaacucuuuugaugcuguagcuguu

SEQ ID NO: 174157 - RNA, 64 nt, hsa
uuuauaauuuauaguaauuuuuugaucuuuuuuuugccuuaagaguugaauaugcugcuuuaga

SEQ ID NO: 174158 - RNA, 64 nt, hsa
agagagguuucugguauucacagaaagcuagauaugccuuaaaacauacucugccgaucuaauu

SEQ ID NO: 174159 - RNA, 64 nt, hsa
caguuugcaacaugucuguaccaagaugguacuuugccuuaaccguuuauaugcacuuucaugg

SEQ ID NO: 174160 - RNA, 64 nt, hsa
caucacagaagaugcaacaucuuuucugaaagauugccuuaagagagcuccaguccuacucuug

SEQ ID NO: 174161 - RNA, 64 nt, hsa
aaaucccuuaaucuaugugcaccguugggaccaaugccuuaauuaaagaauuuaaaaaaguugu

SEQ ID NO: 174162 - RNA, 64 nt, hsa
uuuguggcuggguuuucugaagucugaggaacaaugccuuaagaaaaaacaaacagcaggaauc

SEQ ID NO: 174163 - RNA, 64 nt, hsa
aagucucacaagaccuauaggaaaguuuaccaucugccuuaaauauuaaaauauccaucuguua

SEQ ID NO: 174164 - RNA, 64 nt, hsa
cuuccacaggcuacaagcccugggaccaucuuucugccuuaagggcaggagcccacuucugugg

SEQ ID NO: 174165 - RNA, 64 nt, hsa
aaauauguagguaagguuuaucuugaaucuuaauugccuuaauuuuaaggacgucaaaggcucu

SEQ ID NO: 174166 - RNA, 64 nt, hsa
aaucccuucuacuucacuccucaggggagugaagugccuuaagaaacaaagcccuguccuaauu

SEQ ID NO: 174167 - RNA, 64 nt, hsa
uuuauuuggaaaaguagucauuaaaugaacccacugccuuaaaugucuugaauguugcagucaa

SEQ ID NO: 174168 - RNA, 64 nt, hsa
acaauguccuaacugaaagaugaucauuuguaguugccuuaaaauaaugaauacauuuccaaaa

SEQ ID NO: 174169 - RNA, 64 nt, hsa
gcaagugaagaguuugccuguacucuuaucugggugccuuaaggagagagauuguguucuuccu

SEQ ID NO: 174170 - RNA, 64 nt, hsa
aggccuguggucagcagcuacugaugguuuuuucugccuuaaaccguguguguguccaucauca

SEQ ID NO: 174171 - RNA, 64 nt, hsa
uuuccauuuuauaaauguauugauucauugguacugccuuaaagauacaguaccccucuagcuu

SEQ ID NO: 174172 - RNA, 64 nt, hsa
caaguggcauaaagcauauccauucagaaugaagugccuuaaauauagcaguagucuuuuuugg

SEQ ID NO: 174173 - RNA, 64 nt, hsa
caaguccaauaagacacucaaauaugaguacaaaugccuuaaaauggaauugaaaaacucuuua

SEQ ID NO: 174174 - RNA, 64 nt, hsa
acagcucaacaacuagaaaaauaaacuguuuaccugccuuaauuauuuaucuuuaguuccuuau

SEQ ID NO: 174175 - RNA, 64 nt, hsa
gggcuuggagggaaauacauuuuaggaggaguuuugccuuaauuuuuuaaguacugcaccaaaa

SEQ ID NO: 174176 - RNA, 64 nt, hsa
guucuacagaugaaucuguaagccaguuacaguuugccuuaacucauagacaucaaucagagag

SEQ ID NO: 174177 - RNA, 64 nt, hsa
ccacagguuucuuuaaagcuguguuaacauaucuugccuuaaaauguguguguguguuuuugcu

SEQ ID NO: 174178 - RNA, 64 nt, hsa
uuuuggguggaugaguuuuauuuucuuuuaaagcugccuuaauuccauuuuuauuuugcauuuu

SEQ ID NO: 174179 - RNA, 64 nt, hsa
ucuuaacuucuccccauuucccccaucuuuugguugccuuaaaagaaaucucuagcucagauaa

SEQ ID NO: 174180 - RNA, 64 nt, hsa
auuaagcuuuagaauaaugcgcaauuucauguuaugccuuaaguccaaaaagguaaacuuugaa

SEQ ID NO: 174181 - RNA, 64 nt, hsa
aagaagaaaaguauuuaaaagaaauaccagugagugccuuaaaguuggagaaguaacugcccau

SEQ ID NO: 174182 - RNA, 64 nt, hsa
gaggaguuacagaugcagccacagauugaucaucugccuuaacgugaucggagaugcuuuguaa

SEQ ID NO: 174183 - RNA, 64 nt, hsa
uaauuuacuacauauauugauuuuuaaauaaaguugccuuaaauaaguguauguaagcaguagu

SEQ ID NO: 174184 - RNA, 64 nt, hsa
uuugucuauacauauauauauauauauauggcuuugccuuaauauacccccuuuuuuguuugug

SEQ ID NO: 174185 - RNA, 64 nt, hsa
guagaaugccauuccagaggacaagccacaaaaaugccuuaauuugagcucguauuuaccccug

SEQ ID NO: 174186 - RNA, 64 nt, hsa
gugugacauuuggagagggggccugggacuuccaugccuuaaaccuaccucccacacucccaag

SEQ ID NO: 174187 - RNA, 64 nt, hsa
auccgagcccugugcauggacuuggugagacuguugccuuaaugacauccugcaccguguauaa

SEQ ID NO: 174188 - RNA, 64 nt, hsa
gaggucagggagugcuggcucacaguacagcaugugccuuaaugcuucauaugaggaggauguc

SEQ ID NO: 174189 - RNA, 64 nt, hsa
uuuaauuuuggaggggguggggaaauaguucuggugccuuaacgcauggcuggaauuuauagag

SEQ ID NO: 174190 - RNA, 64 nt, hsa
ugcauuaauauaccauccauguguuuuuaccauuugccuuaauauugaauauacuguuuaccuc

SEQ ID NO: 174191 - RNA, 64 nt, hsa
guauagcaggaaauacgaagaguuacacaguguaugccuuaaaaggcuguuucuuaaagguguu

SEQ ID NO: 174192 - RNA, 64 nt, hsa
ugaaaacaaaaaaaauguuaagaaauggguuucuugccuuaaccagucucucaagugaugagac

SEQ ID NO: 174193 - RNA, 64 nt, hsa
uacuuaaauuuaguggucagaaauguauuugaagugccuuaaagaugaucaugguucagaauau

SEQ ID NO: 174194 - RNA, 64 nt, hsa
gcuaauagaaaaacagguaagaauaaagcaauguugccuuaauuucaaaagcugcuauuuuaga

SEQ ID NO: 174195 - RNA, 64 nt, hsa
aagguagauccccaauauuuuggaauaccaaaauugccuuaaaaauucccuucuguuucuuaca

SEQ ID NO: 174196 - RNA, 64 nt, hsa
cugacuaacuuaaaaaaauagauuguaauugaugugccuuaauuugcauaaaucauaaauguau

SEQ ID NO: 174197 - RNA, 64 nt, hsa
guuguagaacuuucuuuuuaaggugaauaagucaugccuuaacauccaaauaagaguucaucuu

SEQ ID NO: 174198 - RNA, 64 nt, hsa
uuugucuauuucuuaauuuuaaaauaugcugauaugccuuaaacuguaguuguagauccuuguc

SEQ ID NO: 174199 - RNA, 64 nt, hsa
uaguuaugaguaaaucugcaaaaggcaaugaaaaugccuuaaauuuuaucaauaacagaauuau

SEQ ID NO: 174200 - RNA, 64 nt, hsa
agcugaguaauucuaaucucuucuguguuuuccuugccuuaaccacaaauuguggugcuuuuug

SEQ ID NO: 174201 - RNA, 64 nt, hsa
cacaauguauguccucagugguaccuauuauugaugccuuaaauguauugauaaggugacuagu

SEQ ID NO: 174202 - RNA, 64 nt, hsa
uuucauuuguugguacauauuacacaaaacauugugccuuaaaaugagucauacaucuuuuaaa

SEQ ID NO: 174203 - RNA, 64 nt, hsa
uuaccacauauuauuuuuauauuaauucaacauuugccuuaaguguguuguuaaaugaaaguac

SEQ ID NO: 174204 - RNA, 64 nt, hsa
uguuuuuauauuaaaucauaaggaaggaacuacuugccuuaaauguuaauaucaaaagaguuuu

SEQ ID NO: 174205 - RNA, 64 nt, hsa
auuauuaguucacuucccugcugccaugaaacuuugccuuaagaaggugcuggauuccaagguu

SEQ ID NO: 174206 - RNA, 64 nt, hsa
uuuuuuuaaaucuguauguucagaauaauuucacugccuuaauguguucuggagagcgugcuca

SEQ ID NO: 174207 - RNA, 64 nt, hsa
ucauagacguaguuuucgcauccuugaauuaaacugccuuaacuccuuuugugguauaagcaaa

SEQ ID NO: 174208 - RNA, 64 nt, hsa
aaaggcuuuuugguuaagaccucacuuuuaaaacugccuuaaguauaaauaguaccuuuggaau

SEQ ID NO: 174209 - RNA, 64 nt, hsa
aaguauaacaggugccuucacuuuugagacuuagugccuuaaaauauguauucuauaaugauuu

SEQ ID NO: 174210 - RNA, 64 nt, hsa
caaauguuuuaaaguuuaaugccuagcagagaacugccuuaaaaaaaaaaaaaaaaaguucaug

SEQ ID NO: 174211 - RNA, 64 nt, hsa
accggaagugacugcccgcugcccagaagaacuuugccuuaaguuucccuguguuguuccacac

SEQ ID NO: 174212 - RNA, 64 nt, hsa
uuaagaaacguuuauuguaacaguaauuaaaugcugccuuaauugaagggguuuggguggauuu

SEQ ID NO: 174213 - RNA, 64 nt, hsa
uugauuguagaggguccaccacagaauuaugggaugccuuaagugcuguuacuagguugcucac

SEQ ID NO: 174214 - RNA, 64 nt, hsa
aaauguuuuauuucuguuaguaugaacaauagacugccuuaacaaaguuuuuuuuuaaacaaaa

SEQ ID NO: 174215 - RNA, 64 nt, hsa
gucaaaucacugcagucaugaaauacugaacaauugccuuaagucuuugcuugacucacuggga

SEQ ID NO: 174216 - RNA, 64 nt, hsa
uuuauuuuauggagcuuugcccuugaugcacugaugccuuaaaaauuaacaaggucauucagaa

SEQ ID NO: 174217 - RNA, 64 nt, hsa
aaugccucaccagcagaagaacagaauaucaggaugccuuaaauuuauaguaguagacuguaaa

SEQ ID NO: 174218 - RNA, 64 nt, hsa
accaucucuguucaaagagggggaaaugugccuaugccuuaagucaaugcacucagcaaggaga

SEQ ID NO: 174219 - RNA, 64 nt, hsa
cacuuuucuugacuugccuguuuuggccauuagcugccuuaaacguuaacagcacauuugaaug

SEQ ID NO: 174220 - RNA, 64 nt, hsa
ggaggaaccacgcugccaccaaagcagccggaagugccuuaacuuguggaaccaacacuaaucg

SEQ ID NO: 174221 - RNA, 64 nt, hsa
aguuuccaaagcuuuacuacucuuagaggacacaugccuuaaaaaaggaggggaggaaccacgc

SEQ ID NO: 174222 - RNA, 64 nt, hsa
gcaucugggggccaaacacauguuccgucuugauugccuuaagaguuacuagcgaggucagugu

SEQ ID NO: 174223 - RNA, 64 nt, hsa
gucuauauuucuaucuuuaacagcacuucaguccugccuuaaguuauaguuauguauagauacc

SEQ ID NO: 174224 - RNA, 64 nt, hsa
ugccuauguagcaggcacuuagaguaaauggacuugccuuaauuuauaaaggagggaagaggua

SEQ ID NO: 174225 - RNA, 64 nt, hsa
aaaacauagcugcaggucuuuggucccagggcugugccuuaacuuuaaccaauauuuucuucug

SEQ ID NO: 174226 - RNA, 64 nt, hsa
cugccucagacugaaaagcuaguccuaacgucuuugccuuaauucuguucauuuuuucaagucc

SEQ ID NO: 174227 - RNA, 64 nt, hsa
uccgcccugcaaguuaaccccccauugcaaugguugccuuaagguguuugcuaguuguguacau

SEQ ID NO: 174228 - RNA, 64 nt, hsa
gccuauuuucugacguuucuuaaugcaaacucuuugccuuaaaugguagaauauuuagaaauuu

SEQ ID NO: 174229 - RNA, 64 nt, hsa
gaauugaguauuguggguccccuaauucugugggugccuuaagugagaauuucuaaaugauuuu

SEQ ID NO: 174230 - RNA, 64 nt, hsa
aaaauguauauugaaugcuuuccuuuuuuauaccugccuuaaauaauuuggcaaucagaauuaa

SEQ ID NO: 174231 - RNA, 64 nt, hsa
auacagacaucaguuccaugguguuaauuugaaaugccuuaauggcaggcaaaaaccagucauu

SEQ ID NO: 174232 - RNA, 64 nt, hsa
gcuguuguauuaccaaagcaggguccauguuugcugccuuaacccugucuccucucuguuacuc

SEQ ID NO: 174233 - RNA, 64 nt, hsa
uuucaucaaaagugacugccuuaauaagaaugguugccuuaaagaaagucgaauuaauagcuuu

SEQ ID NO: 174234 - RNA, 51 nt, hsa; identical to SEQ ID NO: 173793

SEQ ID NO: 174235 - RNA, 64 nt, hsa
ucacccacuuaguuucuuuuucauuccugcucccugccuuaacuccuccucccacugccccuga

SEQ ID NO: 174236 - RNA, 64 nt, hsa
uuggcacauggguggacacggaucugcugggcucugccuuaaacacacauugcagcuucaacuu

SEQ ID NO: 174237 - RNA, 64 nt, hsa
uggcccugcauuucuggguagggcuggcaaugguugccuuaacccuggcuccuggcccgagccu

SEQ ID NO: 174238 - RNA, 64 nt, hsa
cauuucacuuggcuagaaauuacacugugcucaaugccuuaauaaaucccugaaagaaauaaaa

SEQ ID NO: 174239 - RNA, 64 nt, hsa
gaggaagaugaauuuuuaaaaucuccaucaaacgugccuuaaagcuaaagcauuuugacaggag

SEQ ID NO: 174240 - RNA, 64 nt, hsa
cugcgcgggaggccacagcccgugccgauuccagugccuuaacuacuuaccggaucccuccaua

SEQ ID NO: 174241 - RNA, 64 nt, hsa
acacacauucugccuuggauuccuagauuacaucugccuuaaaaaaacacggaagcacaguugg

SEQ ID NO: 174242 - RNA, 64 nt, hsa
acuuuacugagauuucugaguauacuuuucauauugccuuaauguagcaguaauguguuuaugc

SEQ ID NO: 174243 - RNA, 64 nt, hsa
acaaauccuuuggccugagaacuaauauguuaauugccuuaaauaaauuaauagaaaucuaguc

SEQ ID NO: 174244 - RNA, 64 nt, hsa
cuugacaguauauuugaaacuguaaauauguuugugccuuaaaaggagagaagaaaguguagau

SEQ ID NO: 174245 - RNA, 64 nt, hsa
uauaaguauuugccuaaaaccauaaaauaggaauugccuuaaggaucuaguaguuuauaaugcc

SEQ ID NO: 174246 - RNA, 64 nt, hsa
ccugucuuugcuuucuuuuuuuuuuucuuuuugaugccuuaauguagauaucuuuaucauucug

SEQ ID NO: 174247 - RNA, 59 nt, hsa; identical to SEQ ID NO: 173806

SEQ ID NO: 174248 - RNA, 64 nt, hsa
guuuggcaaacagaauguucauacugauguguugugccuuaaagacaagacagcauuugugugu

SEQ ID NO: 174249 - RNA, 64 nt, hsa
ggggagacagaaacugugguugauagccagucacugccuuaagaacauuugaugcaagauggcc

SEQ ID NO: 174250 - RNA, 64 nt, hsa
agaccgcugcugcugcugccgcuacugcugcugcugccuuaaguaggaagagagggaaggacac

SEQ ID NO: 174251 - RNA, 64 nt, hsa
uuucauaauugcuuucuagcaaucagcuuuuauuugccuuaauauaagcuuuuaagcaguuauc

SEQ ID NO: 174252 - RNA, 64 nt, hsa
augucccuuuuuaagccuuaccugagaggaacaaugccuuaaaauaaaaaagcauuaaugagau

SEQ ID NO: 174253 - RNA, 64 nt, hsa
acaugacauauugugguuaauuuuaaaacuacugugccuuaacguguuucuuaaacuuuuguag

SEQ ID NO: 174254 - RNA, 64 nt, hsa
ggcagaagauaacagcagcaucucgaccagccucugccuuaaaggaaaucuuuauuaaucacgu

SEQ ID NO: 174255 - RNA, 64 nt, hsa
gugcccgucucugagacagucucuguguggaauuugccuuaaacugaaguaaauuugguucuuu

SEQ ID NO: 174256 - RNA, 64 nt, hsa
uuguucaucucuuaggcuuccauuuggaugggccugccuuaacauuguuugaaaugcagcguga

SEQ ID NO: 174257 - RNA, 64 nt, hsa
gggauuggggagcccaggaggcagccuucccuuuugccuuaagucacccaucuuccaguaagca

SEQ ID NO: 174258 - RNA, 64 nt, hsa
cuuagugcuggaguaaaaggucaaguccaacaccugccuuaaauuuaaaucaugugauuuauag

SEQ ID NO: 174259 - RNA, 64 nt, hsa
caucucuauaugguacauuugccucacuuaugguugccuuaaaggcaagagggaaggucaccau

SEQ ID NO: 174260 - RNA, 64 nt, hsa
uuuguacaauguuguuaugguagagaaacacacaugccuuaaaauuuaaaaagcagggcccaaa

SEQ ID NO: 174261 - RNA, 64 nt, hsa
gaaguuagugcaucaacgggauacaguuccauauugccuuaaaccuccuuguuuuagacacacu

SEQ ID NO: 174262 - RNA, 64 nt, hsa
uugcacauuuguacauauacuuaauguuuucaagugccuuaauuguuuaaaaucucuggcuuca

SEQ ID NO: 174263 - RNA, 64 nt, hsa
uuuuuaaucugacaagcaguaacuucauaugguuugccuuaauauauauuuguuuuagucauga

SEQ ID NO: 174264 - RNA, 64 nt, hsa
uauuuuuauaaaguacuguuuaguuggaaaaaguugccuuaauguuugaaaugugugaaauuuu

SEQ ID NO: 174265 - RNA, 64 nt, hsa
aacuacacugcaccauguuaguaauaaacagaucugccuuaaagaaaagaaaauuuuagaaaga

SEQ ID NO: 174266 - RNA, 64 nt, hsa
gugguguaaacuuguacauggaauuuuuugaauaugccuuaauuuagaaacugaaaaauaucug

SEQ ID NO: 174267 - RNA, 64 nt, hsa
uacauaugguuuauuuugaaacuucaaguauuauugccuuaaugucucuuaacccuguuacacg

SEQ ID NO: 174268 - RNA, 64 nt, hsa
gaggcauucuagaaaauaugaauuaguuuccaaaugccuuaauuuuaaacuuuggccugaacag

SEQ ID NO: 174269 - RNA, 64 nt, hsa
guuggcagcuuauuccaguugaucucuucacaucugccuuaaaagugcuauguagagauacauu

SEQ ID NO: 174270 - RNA, 64 nt, hsa
gucucccugaggacugagggugaacuucgcucuuugccuuaaaccucuuuauuucauugcagua

SEQ ID NO: 174271 - RNA, 64 nt, hsa
gcgugaggcuccccagccacagcccccucuuacuugccuuaaaacuggagagaggaaucuagua

SEQ ID NO: 174272 - RNA, 64 nt, hsa
cuugaccaaauaaguuuccugagggcuggaauuaugccuuaacuauaucuauaguauuuaacag

SEQ ID NO: 174273 - RNA, 64 nt, hsa
uauacuuccucaccacugacuauuuuaucaaauuugccuuaaaauaaugaaaaagaaaaguaua

SEQ ID NO: 174274 - RNA, 64 nt, hsa
uuuacaaaugaaauuuaaaguauucuuaaagcuuugccuuaaauacugcuugcauacugauuua

SEQ ID NO: 174275 - RNA, 64 nt, hsa
ugagcaguucuaauaaugcagaauaaauacauguugccuuaaaggguuaucuaguauccuucau

SEQ ID NO: 174276 - RNA, 64 nt, hsa
gauaggguuaaaauagaccuuucuugccuauccuugccuuaaccuaucugccugagguuggccu

SEQ ID NO: 174277 - RNA, 64 nt, hsa
ccuguccugcugguaacugcuacgggguaagauuugccuuaacaguacuauuuucucgccacca

SEQ ID NO: 174278 - RNA, 64 nt, hsa
agggugcugagauaagcaauuagcucuagccuucugccuuaagaaugcacucuacuggggauuu

SEQ ID NO: 174279 - RNA, 64 nt, hsa
augggaauaaaaauuugugcaagucagagaagggugccuuaaaaauguuguggccaagccacau

SEQ ID NO: 174280 - RNA, 64 nt, hsa
uagcucguacauguggguucuuauccugauccugugccuuaaaguaggaagguguuuccaaguu

SEQ ID NO: 174281 - RNA, 64 nt, hsa
uuguuugauucgccuuccuuuuuugacauauguaugccuuaauucuuaaaucugagggaccaug

SEQ ID NO: 174282 - RNA, 64 nt, hsa
ugaggagcccuccuggagcucaggaggccgaggcugccuuaagcugugaucaugccacugcauu

SEQ ID NO: 174283 - RNA, 64 nt, hsa
gaacaaaagcucagguuuguccuggucaugcacaugccuuaagccaguuccgucuucccuagac

SEQ ID NO: 174284 - RNA, 64 nt, hsa
gcugcagugagcuaugauugcaccacuguacuccugccuuaaaaaaaaaaaaaaaaucccaaua

SEQ ID NO: 174285 - RNA, 64 nt, hsa
uuuaaaggauaguaauuauucuuguuuauaacagugccuuaagguaugauguauuucugaugga

SEQ ID NO: 174286 - RNA, 64 nt, hsa
aacaccuccaguuaucaggaauacauuuuuuuacugccuuaaccuguagugcguagaauaugca

SEQ ID NO: 174287 - RNA, 64 nt, hsa
aaaacugauuucaugcagguccugaauuuuacuuugccuuaagaagugcccuccccacaaugca

SEQ ID NO: 174288 - RNA, 64 nt, hsa
ugaucccccguuacuuccuagcauuuucuccucuugccuuaaaaguucccuguaugugaaacgg

SEQ ID NO: 174289 - RNA, 64 nt, hsa
agacuagagccuucuugagguuuauuuucuagguugccuuaauauuugaacauaauagcuauuc

SEQ ID NO: 174290 - RNA, 64 nt, hsa
ccauaggaagagaucugccagacgcgaacucaggugccuuaaaaaguauuccaaguuuacucca

SEQ ID NO: 174291 - RNA, 64 nt, hsa
uugaauccaaaucuuuuucauagguaaugacagaugccuuaaugugaagcuuauuuauaauagc

SEQ ID NO: 174292 - RNA, 64 nt, hsa
auaccaguuucaaacuuggugacuugauccacuaugccuuaaugguuuccuccauuugagaaaa

SEQ ID NO: 174293 - RNA, 64 nt, hsa
cccaggaggccgugugaggaucccgcaauaaagaugccuuaagucucccgguucuggggacgca

SEQ ID NO: 174294 - RNA, 64 nt, hsa
acuauguacugccuuagugcugaugccuguguacugccuuaaauguaccuauggcaauuuagcu

SEQ ID NO: 174295 - RNA, 64 nt, hsa
gaacuccauaccaucggccgggugugguggcucaugccuuaaucccagcacuuugggaggucaa

SEQ ID NO: 174296 - RNA, 64 nt, hsa
auuucuucccuucucuaucuguugccccugauuuugccuuaaguucuugccugagugaucuccc

SEQ ID NO: 174297 - RNA, 64 nt, hsa
gauugcagcauuucacuuggcuacuucauacccaugccuuaaagaggggcaguuucucaaaagc

SEQ ID NO: 174298 - RNA, 64 nt, hsa
cauagccuaagugcuauaucgaucgucccggaugugccuuaagaaccgugaccucaucagucgc

SEQ ID NO: 174299 - RNA, 64 nt, hsa
aaaaaaaaagauacaaagucugcauuugauauaaugccuuaauuacugggucuacaauuaaugu

SEQ ID NO: 174300 - RNA, 64 nt, hsa
uagguuaggaaaaauuccacacaaccaaacagucugccuuaaaagugacccacauuuuuccaua

SEQ ID NO: 174301 - RNA, 64 nt, hsa
gggucccucgcauucuuuuacuguaaacaaacaaugccuuaaauugugucuuguuuucuguucc

SEQ ID NO: 174302 - RNA, 64 nt, hsa
uguagccauagaugugauuauguccacaccgggcugccuuaaucuguccugcuuggagagugac

SEQ ID NO: 174303 - RNA, 64 nt, hsa
uuuucaucaaugucuuuguaaagcacaaauuaucugccuuaaaggggcucugggucggggaauc

SEQ ID NO: 174304 - RNA, 64 nt, hsa
cucuaugacaauauauuuuaacugacuuucuagaugccuuaauauuugcaugauaagcuaguuu

SEQ ID NO: 174305 - RNA, 64 nt, hsa
cucuuucuguccgcagauccugacuuuuccaaagugccuuaaaagaaaucagacaaaugcccug

SEQ ID NO: 174306 - RNA, 64 nt, hsa
cuugcccuccugccacccuuccccuuguagauacugccuuaacacucccuccucucucagcugu

SEQ ID NO: 174307 - RNA, 64 nt, hsa
gacguuguagaaauguacaaaugcauuuccaaacugccuuaaacguuguauuuuuauagacaug

SEQ ID NO: 174308 - RNA, 64 nt, hsa
auuuugcaccacuggucauagcaucuaucuccuuugccuuaauuuacugaaauacaucauuuua

SEQ ID NO: 174309 - RNA, 64 nt, hsa
uggugagcagccacugugcaguucaacguaagugugccuuaauugcacagagguacugccccca

SEQ ID NO: 174310 - RNA, 64 nt, hsa
cugugaggcucaaaugagccaaagguuauaaacuugccuuaaaacuauaguccuauacaaaaau

SEQ ID NO: 174311 - RNA, 64 nt, hsa
uugcucuucugucuauaaauuuugaaugauacugugccuuaauugguuuucauaguuuaagugu

SEQ ID NO: 174312 - RNA, 64 nt, hsa
aagcagaacaaauguguuuuucuauauaguuccuugccuuaauaaauauguaauauaaauuuaa

SEQ ID NO: 174313 - RNA, 64 nt, hsa
ugcaauaauuuguacaaugguuuauucccaaguaugccuuaagcagaacaaauguguuuuucua

SEQ ID NO: 174314 - RNA, 64 nt, hsa
ccuaaccuaccaaacaucauagcuuagccuagccugccuuaaacaugcucagaacacuuacauu

SEQ ID NO: 174315 - RNA, 64 nt, hsa
auaauagauccaguguuuuucagauuccuuucacugccuuaaucuuugcaacaggguggaaguu

SEQ ID NO: 174316 - RNA, 64 nt, hsa
ggagccacugagggauguuuuccccccuugcuugugccuuaaaggcagagaagcgaggcggaug

SEQ ID NO: 174317 - RNA, 64 nt, hsa
aggccagcaccucccuccuccaucgcucgcugugugccuuaaacuccaucucaugucccucccc

SEQ ID NO: 174318 - RNA, 64 nt, hsa
cccggcccgggcugcguacacccuugcccugcuuugccuuaaagccucggggucugcccggccc

SEQ ID NO: 174319 - RNA, 64 nt, hsa
ccgagcuaagucugugugcagcauuaguacccgcugccuuaaaacucaaguuuacauuauucau

SEQ ID NO: 174320 - RNA, 64 nt, hsa
uucuuauaauuuaucuuuauuuaaaagcuuagccugccuuaaaacuagagaucaacuuucucag

SEQ ID NO: 174321 - RNA, 64 nt, hsa
caauggaagagcccagaugggugaagauugauuuugccuuaacucaagagaauuccuguucucc

SEQ ID NO: 174322 - RNA, 64 nt, hsa
uguucuacuuaaaaugugaauuguacuucugagcugccuuaaugcaaggucauuuauauuuguu

SEQ ID NO: 174323 - RNA, 64 nt, hsa
uaauaugaacauguacagcgugcauagggacucuugccuuaaggaguguaaacuugaucugcau

SEQ ID NO: 174324 - RNA, 57 nt, hsa; identical to SEQ ID NO: 173883

SEQ ID NO: 174325 - RNA, 64 nt, hsa
uaucuucccuaauuucuuuguauauauuuuguuaugccuuaaaggccaccugcuauacaguugu

SEQ ID NO: 174326 - RNA, 64 nt, hsa
aggggcuuugguuccaaaacuuggacaaaccugaugccuuaaggaaaagguuaagaugagaggg

SEQ ID NO: 174327 - RNA, 64 nt, hsa
auggauauuaugcuuugaagucaugagugggaguugccuuaaauguuaaaaugaaaacuuugug

SEQ ID NO: 174328 - RNA, 64 nt, hsa
ugcacgguuuggguauucuuaaugaccaggcaaaugccuuaaguaaacaaacaagaaaugucuu

SEQ ID NO: 174329 - RNA, 64 nt, hsa
gugcugugugugugcaugugugugucugcauucaugccuuaacucggguuacugcacaacuuua

SEQ ID NO: 174330 - RNA, 64 nt, hsa
ccuugagcccucuaugguguggcaaagccuucauugccuuaacuggagccccaucagcuccagc

SEQ ID NO: 174331 - RNA, 64 nt, hsa
caggguaaugugcuugguuugcacauguuguuauugccuuaauucuaauuuuauuuuguucucu

SEQ ID NO: 174332 - RNA, 64 nt, hsa
gucagugacagggcuucuuguaauuugugguaugugccuuaaaccugaaugucuguagccaaaa

SEQ ID NO: 174333 - RNA, 64 nt, hsa
agcgagguauaaaaguacgcaguuuucauguccuugccuuaaagagcucucuagucuaacgguc

SEQ ID NO: 174334 - RNA, 59 nt, hsa; identical to SEQ ID NO: 173893

SEQ ID NO: 174335 - RNA, 64 nt, hsa
ccaagauaaaugguaccagcguccucuuaaaagaugccuuaauccauuccuugaggacagaccu

SEQ ID NO: 174336 - RNA, 64 nt, hsa
uauuacuacucauuucaguguuuaguacagaaauugccuuaaaaauugcuauuaauugaaauau

SEQ ID NO: 174337 - RNA, 64 nt, hsa
uuaauuaaaauguuugccacauuaacuuuucugaugccuuaaaagugaacuucuuuaaagaacc

SEQ ID NO: 174338 - RNA, 64 nt, hsa
cccuccccugggccgcugaggccccgcgcaccugugccuuaaucuucccuccccugugcugccc

SEQ ID NO: 174339 - RNA, 64 nt, hsa
acaccagucauacuggcucagggcccaccgcuaaugccuuaaugaaaucauuuuaacauuauau

SEQ ID NO: 174340 - RNA, 64 nt, hsa
cuuuugguugaaauugaacauacucuagugaaugugccuuaaaaaucaagacacuaguucagag

SEQ ID NO: 174341 - RNA, 64 nt, hsa
gguaguuguucauuucagccucuggauggcuggcugccuuaaacacaaucaauuucaaagcucc

SEQ ID NO: 174342 - RNA, 64 nt, hsa
ugugcaauucuggaacauauuaauuaaaauaauaugccuuaacauauagugaauuucuaauucu

SEQ ID NO: 174343 - RNA, 64 nt, hsa
ccacuuccgaaaaguuuacauucacuuggaaggcugccuuaaaguauaucucuuaucuaugacc

SEQ ID NO: 174344 - RNA, 64 nt, hsa
guauuauugacuauagccaacuacagauggcauaugccuuaaagaugcauuuuucuauguauuu

SEQ ID NO: 174345 - RNA, 64 nt, hsa
uuggaaaaauugucccgucugucacuuguuuuguugccuuaauaagcaucugaauguuugguug

SEQ ID NO: 174346 - RNA, 64 nt, hsa
ccuucagcuucuuacguuuucugagcauccauugugccuuaacauuuucugcuuguccuuuggg

SEQ ID NO: 174347 - RNA, 64 nt, hsa
acugaacuccggccugggugacagaaggaggcucugccuuaaaaaaaaaaaaaaaaaaaaccuc

SEQ ID NO: 174348 - RNA, 64 nt, hsa
aacacuugccaaaacauuaagagaacuuugauucugccuuaagaggguauaaaacuaaaccauu

SEQ ID NO: 174349 - RNA, 64 nt, hsa
caguugugccuuggugccuuguccgccucagcugugccuuaaggacuaauucuggcaccccuuu

SEQ ID NO: 174350 - RNA, 64 nt, hsa
ugucuuaauauaucuuaggcuucaauuauuugggugccuuaaaaacucaaugagaaucauggua

SEQ ID NO: 174351 - RNA, 64 nt, hsa
guucguccagcccaugugcaaagucaacaguauuugccuuaagauuucauauauauauauuuuu

SEQ ID NO: 174352 - RNA, 64 nt, hsa
gggugcugguucacucugcccagcccugaaugugugccuuaaaggcccccuacaaggggcccca

SEQ ID NO: 174353 - RNA, 64 nt, hsa
aacugcuuugcaaugacauuuauuuauuaauucaugccuuaaaaaaauaggaagggaagcuuuu

SEQ ID NO: 174354 - RNA, 64 nt, hsa
ggaaccccuuuaucccaggaaguccucuuccuugugccuuaacauacaggacaaauaggcucua

SEQ ID NO: 174355 - RNA, 64 nt, hsa
ccaaggucaccaaacaacuugguugugaaccaacugccuuaaccuucugggggagggggauuag

SEQ ID NO: 174356 - RNA, 64 nt, hsa
cugaggggccagcuugccaggcuuaagccaaaucugccuuaaauuggggguggggagggguaag

SEQ ID NO: 174357 - RNA, 64 nt, hsa
guaucuuaaaacgugugcccuuuuauauuauuuaugccuuaaauguuuucuuccccauuccuuc

SEQ ID NO: 174358 - RNA, 64 nt, hsa
gucuagcugggugaaacccuuauuuucccagagaugccuuaaccuuuguugguuuuggcuuuag

SEQ ID NO: 174359 - RNA, 64 nt, hsa
cccagcuguauuauuuugaucuuuuggaugcaggugccuuaaugaagcucucaaaauauuuuag

SEQ ID NO: 174360 - RNA, 64 nt, hsa
aauuggaugaaauuagcugcugagauugaguuucugccuuaaaaucugaaacaaaaaaagggac

SEQ ID NO: 174361 - RNA, 64 nt, hsa
ucccuuuccuaaucuggcuuuuacauuuauuuugugccuuaaagauuaacuacaaagauaaaca

SEQ ID NO: 174362 - RNA, 64 nt, hsa
ugggcuauuuggacucaggugggcccucugaacuugccuuaaacacucaccuucuagucuuggc

SEQ ID NO: 174363 - RNA, 64 nt, hsa
uccccugaagccuaacacaguuccuaauguguuuugccuuaaccucuuuucucuucccacauug

SEQ ID NO: 174364 - RNA, 64 nt, hsa
uuccauuucuuuuuucccaaacccucaaacagagugccuuaaaaaauuguuuuaucaggauaau

SEQ ID NO: 174365 - RNA, 64 nt, hsa
gaaagaaggaacauuuccuauggugcugucucacugccuuaaaacagauuucuaugacaguuua

SEQ ID NO: 174366 - RNA, 64 nt, hsa
aauaagccaaagccauguggaauuuuuguuuagaugccuuaacugugccacaccccacaacccc

SEQ ID NO: 174367 - RNA, 64 nt, hsa
cugucuugagggaaggaagaggucuguucuguauugccuuaaguugauugagguuuguaggaga

SEQ ID NO: 174368 - RNA, 64 nt, hsa
aaguuuuauuuuugcaaacuaaauacacaaagcaugccuuaaacccagugaagcaacugaguac

SEQ ID NO: 174369 - RNA, 64 nt, hsa
uaauguaaagaacuuaaauuauguuuuaaacacaugccuuaaauuuguuuaauuaaauuuaacu

SEQ ID NO: 174370 - RNA, 64 nt, hsa
uagcaauugacagagaauaacucagaauauugucugccuuaaagcaguaccccccuaccacaca

SEQ ID NO: 174371 - RNA, 64 nt, hsa
guaacaggaccccaaggaccugccuccccggaagugccuuaaccuagagggucggggaggaggu

SEQ ID NO: 174372 - RNA, 64 nt, hsa
uuacuacauuucuuccacuccccuuuccccuaccugccuuaaccaaggcucauacuguccuguc

SEQ ID NO: 174373 - RNA, 64 nt, hsa
guccuccuccaucuuucuacagagauuacuuugcugccuuaaugacauuccccucccaccucuc

SEQ ID NO: 174374 - RNA, 64 nt, hsa
ggccucccaaaaaggagccccaccucagcaucacugccuuaaucguggccucccuggggugggu

SEQ ID NO: 174375 - RNA, 64 nt, hsa
cgaaucuguuucagagcucuccuaccuugcucacugccuuaaucagaccgauuuccugcccacc

SEQ ID NO: 174376 - RNA, 64 nt, hsa
ugacuuucuuuggcuaauuuuacuuugcaugauaugccuuaauaugccuucauaaauaaccauu

SEQ ID NO: 174377 - RNA, 64 nt, hsa
gcuacuuggcagcuaguaaguuuaaagcaggaccugccuuaacugcuccuggccacuuggaagu

SEQ ID NO: 174378 - RNA, 64 nt, hsa
ccuucagcugcuaagauccaagaaaacgccucacugccuuaaccuuaacuguucuuccuggcgc

SEQ ID NO: 174379 - RNA, 64 nt, hsa
ucuauuuugaaucaccuuuaauuacaugucagaaugccuuaacuacccuaacuugacaaaacag

SEQ ID NO: 174380 - RNA, 64 nt, hsa
ugugauggaauaacaagggucagauuuccucuccugccuuaaacaacuggaagcuauacaauac

SEQ ID NO: 174381 - RNA, 64 nt, hsa
cuagcaacuuagauaagugaaaguuuuucuaacaugccuuaaaaauauuaugguuugauccaaa

SEQ ID NO: 174382 - RNA, 64 nt, hsa
gcaauuuuccaccucgcaguaguuaguauuuacuugccuuaaacuaacuuugaagcaaguaaug

SEQ ID NO: 174383 - RNA, 64 nt, hsa
aguuuuaaucucuaacaguggacaaaguuaccagugccuuaaacucuguuacacuuuuuggaag

SEQ ID NO: 174384 - RNA, 64 nt, hsa
guaaaaauaaccuuaggaacuguagccauuucauugccuuaauuuuaagaggaaaauacaaaaa

SEQ ID NO: 174385 - RNA, 64 nt, hsa
ggauucacagaagcacuacuccagagcagaaugaugccuuaaucuuaaguguccauuugugcag

SEQ ID NO: 174386 - RNA, 64 nt, hsa
uaaaauuauauacugaaaacaccaaaaauuuagaugccuuaauaguauauacgugaaauacuca

SEQ ID NO: 174387 - RNA, 64 nt, hsa
uaaauuucacuggauuguauaaauuuuuaucuauugccuuaaacauuuacaugauucucaauau

SEQ ID NO: 174388 - RNA, 64 nt, hsa
uccuugcugcuagagugggaggagaaagaugucuugccuuaaaaguuuacuguuucuucuguuc

SEQ ID NO: 174389 - RNA, 64 nt, hsa
ccaaaaaccugagggggagaaaauacuuugcuuuugccuuaacacaucaucuggucacguuaga

SEQ ID NO: 174390 - RNA, 64 nt, hsa
accauaucuccagggauguuguugauccccacacugccuuaagguauauuauagaaacaguuuu

SEQ ID NO: 174391 - RNA, 64 nt, hsa
uccccccuccgccuccaggaagaaagaauguuacugccuuaauaaaaaaugaaaagagaaugau

SEQ ID NO: 174392 - RNA, 64 nt, hsa
aauuaauaucuucaggaauauuuugggauaggguugccuuaaaacauuuuacuuggcuuauuca

SEQ ID NO: 174393 - RNA, 64 nt, hsa
accauuucuuuuuuaagaucugauaugcuaucauugccuuaauaauggaacaaaauagaagcau

SEQ ID NO: 174394 - RNA, 64 nt, hsa
aggccaccaguuaaaugccgucuaucagguuuugugccuuaagagacuacagagucaaagcuca

SEQ ID NO: 174395 - RNA, 56 nt, hsa; identical to SEQ ID NO: 173954

SEQ ID NO: 174396 - RNA, 64 nt, hsa
aaaaaaggauuaccuuuccuuguaaagaggaugcugccuuaagaauugcauguuguaaaaaauc

SEQ ID NO: 174397 - RNA, 64 nt, hsa
uagaugaauacuaaaugguugucugggucaauacugccuuaaugagaacauuuacacauucuca

SEQ ID NO: 174398 - RNA, 64 nt, hsa
ugguuauaaaaauguuaauucagaauuaguuuaaugccuuaauuaaacuaauuaauagcuuugg

SEQ ID NO: 174399 - RNA, 64 nt, hsa
cuccauggcucuaaaauuuggaauuaacuucucuugccuuaagagcugcuuguacauaugugga

SEQ ID NO: 174400 - RNA, 64 nt, hsa
uugggaaaaaauccuaaaaggugacuuaauuugaugccuuaaauucacaagugaggaagcuaag

SEQ ID NO: 174401 - RNA, 64 nt, hsa
gauuucugaagaaaagcaaaugcauuaguauguuugccuuaaacuuguagacuaaaccaaguau

SEQ ID NO: 174402 - RNA, 64 nt, hsa
caggguggggcccacuccaugaagacagcagucaugccuuaagaagcagagcuaccuuacgugc

SEQ ID NO: 174403 - RNA, 64 nt, hsa
guguguguguuuuuaauauucacacugagacaugugccuuaaacagacuuuuuaguccaaaauu

SEQ ID NO: 174404 - RNA, 64 nt, hsa
ugaugccacauagucuugcauaaaaaaggguucuugccuuaaaagugaaaccuucauggauagu

SEQ ID NO: 174405 - RNA, 64 nt, hsa
gcagcugauucugagacaggccccugcagagggaugccuuaaagcugucccuggcuggaggagc

SEQ ID NO: 174406 - RNA, 64 nt, hsa
gggcuguuccgucugauagauggaaggguaacauugccuuaaaacagaaauaugcaggcguugg

SEQ ID NO: 174407 - RNA, 64 nt, hsa
ccgacacuuugucgacacugaaauaucgauuaagugccuuaaaaccucuuuagacauagcuaug

SEQ ID NO: 174408 - RNA, 64 nt, hsa
uauuagacauacuguuuuuauaauguuuuacuucugccuuaagauuuagguuuuuuaaauguau

SEQ ID NO: 174409 - RNA, 64 nt, hsa
ugugaacagaaguccuuaagcagaggaauuggugugccuuaaagauacaaucugggauaguuug

SEQ ID NO: 174410 - RNA, 64 nt, hsa
aauuuuccauuauucuggacaugaauuucuaaaaugccuuaauagguuuauguaguugaguaaa

SEQ ID NO: 174411 - RNA, 64 nt, hsa
uaacaguaugguacugcuucugugacaaauaucgugccuuaacaauguggcuguccuuuuccac

SEQ ID NO: 174412 - RNA, 64 nt, hsa
uauaguuaauccguaaagguuuccaguuaauucaugccuuaaaaggcacugcaauuuuauuuuu

SEQ ID NO: 174413 - RNA, 64 nt, hsa
gagagacuaaggauucuucucuuuuauagcuauuugccuuaagaacuuacuuuagauucuuauu

SEQ ID NO: 174414 - RNA, 64 nt, hsa
uuuauuauguagaaugaaugaggguacugucaccugccuuaauguagguaggcccagagucuua

SEQ ID NO: 174415 - RNA, 64 nt, hsa
acaggguauuaaucccuuugucaccuaccauugaugccuuaaguuuucugagucucaauuaaaa

SEQ ID NO: 174416 - RNA, 64 nt, hsa
uguuuuguggggucugagguuuacgagauuuggcugccuuaagaauacaaaaacagaaaugcag

SEQ ID NO: 174417 - RNA, 64 nt, hsa
gggauggucugcucaaguggcccacacuggucauugccuuaagccaccuccccaggacuuacgg

SEQ ID NO: 174418 - RNA, 64 nt, hsa
agggguggaauauaucaggaauuuauaauaaaauugccuuaaucucuacaacaguaucuuaauu

SEQ ID NO: 174419 - RNA, 60 nt, hsa; identical to SEQ ID NO: 173978

SEQ ID NO: 174420 - RNA, 64 nt, hsa
aacacucuguaguaaccauuacagaaaauacuucugccuuaaaaaauaugauaugccagagaug

SEQ ID NO: 174421 - RNA, 64 nt, hsa
auuauaccagaaaguuaaauucucagaucaaaugugccuuaauaaauuuguuuucauuuagauu

SEQ ID NO: 174422 - RNA, 64 nt, hsa
cuugaucaauucccuugaauagggaaguaacauuugccuuaaauuuuuucgaccucgucuuucu

SEQ ID NO: 174423 - RNA, 64 nt, hsa
ggggugugaauagccguaacuugccugcaccugcugccuuaacaguggaguuggccaggcgcag

SEQ ID NO: 174424 - RNA, 64 nt, hsa
aaacuuugagccaugcuaggagguaacuagucuaugccuuaacuccugaccuuuccugcauuag

SEQ ID NO: 174425 - RNA, 64 nt, hsa
caucaucuuuucuaaauucaucuccauuaaaacuugccuuaagcuaccagauugcuuuugccac

SEQ ID NO: 174426 - RNA, 64 nt, hsa
gcuaaguucagaagguacuuuguuuuuccucccuugccuuaaguccuugguauuuauaaucaau

SEQ ID NO: 174427 - RNA, 64 nt, hsa
aacuuagaauuucauuauguuuuagaaucaucacugccuuaauauucaagcaucuauuuaaguc

SEQ ID NO: 174428 - RNA, 64 nt, hsa
ucuugaacguacucauaaauaugacuuauuguauugccuuaaguuuucacucauugucuuuuga

SEQ ID NO: 174429 - RNA, 56 nt, hsa; identical to SEQ ID NO: 173988

SEQ ID NO: 174430 - RNA, 64 nt, hsa
guccggcucagacugaauaagaagagauaaaauuugccuuaaaacuuaccuggcaguggcuuug

SEQ ID NO: 174431 - RNA, 64 nt, hsa
ugccagaaagccaacagcuccccucguggggccuugccuuaaacuugccugguuuguacauuuu

SEQ ID NO: 174432 - RNA, 64 nt, hsa
caaaaugucaaaauaaugagaacugacacaacuuugccuuaaagaguacuagacuggaccuucu

SEQ ID NO: 174433 - RNA, 64 nt, hsa
acugcacuccagccugggcaaccaagcgagacucugccuuaaaaaaaaaaaaaagaaaaugugg

SEQ ID NO: 174434 - RNA, 64 nt, hsa
uuaacagaaacauuugaaauagaauuugcaugucugccuuaauuaacuuaaagacugauuuuaa

SEQ ID NO: 174435 - RNA, 64 nt, hsa
uuuuuuuuuuuacucccccucuaaacacugcugcugccuuaauuuuagaaagcagcuuacuagu

SEQ ID NO: 174436 - RNA, 64 nt, hsa
cacauaacuguggucaucucuguaguuuacuaacugccuuaaaauugcaugguucuuaauggca

SEQ ID NO: 174437 - RNA, 64 nt, hsa
uauaaugaauuuuguuuguugaugugaaacauuaugccuuaaguaauguuaauucuuauuuaag

SEQ ID NO: 174438 - RNA, 64 nt, hsa
gcuggugguugugccuuuuguaggcuguucccuuugccuuaaaccugaagaugucuccucaagc

SEQ ID NO: 174439 - RNA, 64 nt, hsa
cccucccaggucugggcugugcaguuccucccccugccuuaaaacaccccacuaucucuguaaa

SEQ ID NO: 174440 - RNA, 64 nt, hsa
guuuuaaacugcagaaauuggaguggauggguucugccuuaaauugggaggacuccaagccggg

SEQ ID NO: 174441 - RNA, 64 nt, hsa
aauaaagguaacuuuaccuuucuuaaauauuuccugccuuaaagagagcauuuccaugacuuua

SEQ ID NO: 174442 - RNA, 64 nt, hsa
aagaaacgcauguggaccagaagacuuucccugcugccuuaaaaccaauaaaagguuaacuuua

SEQ ID NO: 174443 - RNA, 64 nt, hsa
gcagcugagcugcgcuggcucugggcagggagugugccuuaaugggaagcacacgggcuuugga

SEQ ID NO: 174444 - RNA, 64 nt, hsa
ggauguuuuuaauggcauaacaaaggcaagacucugccuuaauuuuugaaaagcugcuaacuac

SEQ ID NO: 174445 - RNA, 64 nt, hsa
uuaauuccucaggcuuugcgauuuaaggaggagcugccuuaaaaaaaaauaaaggccuuauuuu

SEQ ID NO: 174446 - RNA, 64 nt, hsa
cacaaagacaagaaaaaucagggcauuuugugagugccuuaagaucaaacuaacaagaucugac

SEQ ID NO: 174447 - RNA, 64 nt, hsa
cacaggggaggcagguccuuggcgagguagccccugccuuaauccacggggcuccuuucccucc

SEQ ID NO: 174448 - RNA, 64 nt, hsa
gggcugagaccacccuugccugcccccuucuuucugccuuaagaauguccuuuuaggcugggca

SEQ ID NO: 174449 - RNA, 64 nt, hsa
aaauaaauacaaagcccauucuuccagagucuugugccuuaaauaaaacacaccucucugcugu

SEQ ID NO: 174450 - RNA, 64 nt, hsa
agauaaaaacccugaaauucccagaaguuacagaugccuuaaagacuuucuuuggaagaucauu

SEQ ID NO: 174451 - RNA, 64 nt, hsa
uauaacaaaugacuuuuuuccuuagggggagguuugccuuaaaggcuuuuaauuuuguuuuguu

SEQ ID NO: 174452 - RNA, 64 nt, hsa
ucggugccuugguuucagcugauuuggggggaaaugccuuaauuucacucuccucccuucucca

SEQ ID NO: 174453 - RNA, 64 nt, hsa
ccuuggccauguucugagcggccagcuuggccuuugccuuaauaaaugugcuuuauuuucucuu

SEQ ID NO: 174454 - RNA, 64 nt, hsa
uacccggggaguggugggcaucucgaugcuucuuugccuuaaugauggccacaucugggcugcu

SEQ ID NO: 174455 - RNA, 64 nt, hsa
cccccuugucgcugucggucccgucuaaccaugaugccuuaacauguggaguguaccguggggc

SEQ ID NO: 174456 - RNA, 64 nt, hsa
agcauauuucaacuguucuucauaaauguuuaugugccuuaaaagacuuuauguuaaaggauua

SEQ ID NO: 174457 - RNA, 64 nt, hsa
caaaguguuaccaguuuacaaaaauaagucuuuuugccuuaagucauuuuggaaauaaguaaua

SEQ ID NO: 174458 - RNA, 64 nt, hsa
uccgaggagcgagaggaauguccauuucuuaaacugccuuaauaacuagccuuuaaccuguggg

SEQ ID NO: 174459 - RNA, 64 nt, hsa
ugcuguacauacccuccuuuccuucuaccuaucuugccuuaauuaacauucccugugaccuagu

SEQ ID NO: 174460 - RNA, 64 nt, hsa
agauaauaugauuauaaggaaaucaaauaaauguugccuuaacuucaguuaauauuuuccuguc

SEQ ID NO: 174461 - RNA, 64 nt, hsa
ggcauagaaauugaagaauuuguaaaaauagaauugccuuaaaggauuugaaguaagaacauaa

SEQ ID NO: 174462 - RNA, 64 nt, hsa
uuccggaauccuguccucagcuucuuaauauaacugccuuaaaacuuuaaucccacuugccccu

SEQ ID NO: 174463 - RNA, 64 nt, hsa
aggugggcgccccgaccacgacuuggcuuccuugugccuuaaaaaaccugccuuccugcagcca

SEQ ID NO: 174464 - RNA, 64 nt, hsa
ccgccccacuucuagcugcuucuccucuuguuucugccuuaauaauucccacggccacaggcaa

SEQ ID NO: 174465 - RNA, 64 nt, hsa
gggacucgcugccaggggcugccacacuccugaaugccuuaacauuucuuccauggccccacac

SEQ ID NO: 174466 - RNA, 64 nt, hsa
cagggccccggccugggacucagcauuucugauaugccuuaagaauucauucuguuuuguacaa

SEQ ID NO: 174467 - RNA, 64 nt, hsa
cauuuuguaaaauuauccugcacaucaagcugcaugccuuaaagcggaaacucuaggacugugu

SEQ ID NO: 174468 - RNA, 64 nt, hsa
uuaguugggucuauuagcucagauugagagguguugccuuaaaacugaguugggugacuuggua

SEQ ID NO: 174469 - RNA, 64 nt, hsa
cauaaguaguaucugcaguguguucauccguugcugccuuaacaagucacccacacguaguggc

SEQ ID NO: 174470 - RNA, 64 nt, hsa
aacaaaacauacacuuugucagagaagaaaaaaaugccuuaacuauaaaaagcggagaaaugga

SEQ ID NO: 174471 - RNA, 64 nt, hsa
guaagccuuguugaaaugcucugguauucaguauugccuuaauaaacuucacccacaacugcau

SEQ ID NO: 174472 - RNA, 64 nt, hsa
cuggaaggugagccuuuuccuggccaagggcagcugccuuaaccucugagagucugcgcuuggc

SEQ ID NO: 174473 - RNA, 64 nt, hsa
cauuuuuaguuuuuuuguuuguuuguuuuuaaucugccuuaaugagcucaggccacuaucacaa

SEQ ID NO: 174474 - RNA, 64 nt, hsa
ccggggucccugccgcagcccccuccccuucugaugccuuaaaagcugggccccaggcccugcu

SEQ ID NO: 174475 - RNA, 64 nt, hsa
ucauccccuuccuagcuguaugaccuugauugugugccuuaaccgcucugugacacagucuacc

SEQ ID NO: 174476 - RNA, 64 nt, hsa
ggagccgcagcugcaaacucugacacaaaagacgugccuuaaggaacccgccgcgugcccaggu

SEQ ID NO: 174477 - RNA, 64 nt, hsa
auauguauauguguguguguauaaaauauauauuugccuuaaauggaaauauaaacaaaauuua

SEQ ID NO: 174478 - RNA, 64 nt, hsa
uuccugaaccacaaaccauagcauaagugaucugugccuuaacgacauguuccugcugcagaua

SEQ ID NO: 174479 - RNA, 64 nt, hsa
gugggucuuccugaauuaauuuaucuauuccaaaugccuuaacgagacucuguuucugggaguc

SEQ ID NO: 174480 - RNA, 64 nt, hsa
ccugugugccccgcaccccccaugcuucuuuugcugccuuaagcccccuaugcccuggagguga

SEQ ID NO: 174481 - RNA, 64 nt, hsa
gggggacggggcggggcuugaccugcgggugcuuugccuuaaaaagaaauaaaagaugugaacu

SEQ ID NO: 174482 - RNA, 64 nt, hsa
ccagcucccgccccucgccccccaccuccacaggugccuuaaagggcccucguccacccaaggu

SEQ ID NO: 174483 - RNA, 64 nt, hsa
uaauaaccuuucaucacuuccuuugugcgcuuccugccuuaagugacaaguagcaacauggcuu

SEQ ID NO: 174484 - RNA, 64 nt, hsa
cccuagguuuccucuccagccaacggggcgucgcugccuuaaugggaggagcacucggaagggu

SEQ ID NO: 174485 - RNA, 64 nt, hsa
ggaccaaaagucucagcacacuuaccuccgauuaugccuuaaagaguugauugugaagaaccag

SEQ ID NO: 174486 - RNA, 64 nt, hsa
uaaugugaaaucagagaauguuguaauaaguaaaugccuuaagaguauuuaaaauaugcuucca

SEQ ID NO: 174487 - RNA, 64 nt, hsa
ccacaugaacucacaaaggagaggcccucauucuugccuuaaaacugccccuaaagccaagccu

SEQ ID NO: 174488 - RNA, 64 nt, hsa
aacugccuaaagucacagcacagauacugcccagugccuuaagaggagacaugaucucuaccag

SEQ ID NO: 174489 - RNA, 64 nt, hsa
uuauguuagagagguagcgagcugcucugcuauaugccuuaagccaauauuuacucaucagguc

SEQ ID NO: 174490 - RNA, 64 nt, hsa
aucacuguuuagauuugccauagaguacacugccugccuuaagugaggaaaucaaagugcuauu

SEQ ID NO: 174491 - RNA, 64 nt, hsa
uaauacucgugugacucuucuuagaguuaccaucugccuuaaauuuccucuguuuuucacauuc

SEQ ID NO: 174492 - RNA, 64 nt, hsa
gggggaguggaggggcauagccuuucccuaauucugccuuaaauaaaacugcauugcugauuca

SEQ ID NO: 174493 - RNA, 64 nt, hsa
cagaccccccauuuauuuguaugaaggcuucaguugccuuaauaaagugcucugugggguccga

SEQ ID NO: 174494 - RNA, 64 nt, hsa
ucuguuacaaaacgagauaagcaaguguuagaauugccuuaaggccacacuggcaucucccuga

SEQ ID NO: 174495 - RNA, 64 nt, hsa
aggcuucuguuguauuugaaguaucaucugguuuugccuuaacucuuuaaauuguauauauuua

SEQ ID NO: 174496 - RNA, 64 nt, hsa
cuacacaagaaauauuuguuuuacucagcaggugugccuuaaccucccuauucagaaagcucca

SEQ ID NO: 174497 - RNA, 64 nt, hsa
gguauuuaacaggugccucguguugagauuacgcugccuuaauguaacacagucuggcaguugc

SEQ ID NO: 174498 - RNA, 64 nt, hsa
aacuguaaccucaaggaaaccauaaagcuuggagugccuuaauuuuuaaccaguuuccaauaaa

SEQ ID NO: 174499 - RNA, 64 nt, hsa
gaaaauguuacugaaagucacuuuuaugagcaucugccuuaauaaacagacauugauucccuua

SEQ ID NO: 174500 - RNA, 64 nt, hsa
uugggauucuuuuuucuccugugguggauaaaucugccuuaaaaaucaauguaacuugggggcu

SEQ ID NO: 174501 - RNA, 64 nt, hsa
ggagcuggcacugaaccaggcugcaagauuugacugccuuaaaaacacaaggcccucuaggccu

SEQ ID NO: 174502 - RNA, 64 nt, hsa
accgguguuggcucuagacuggucucaucuccauugccuuaaugccagguggcccaggaguacc

SEQ ID NO: 174503 - RNA, 62 nt, hsa
uuucuuccuuccccagcuccacuaaauucccuccugccuuaacugaggcucgacuccuucgu

SEQ ID NO: 174504 - RNA, 64 nt, hsa
cuuccuaccuagcuccuuguuggugagcuucuugugccuuaauccugugacccagccccuuaca

SEQ ID NO: 174505 - RNA, 64 nt, hsa
gaaaccuggaauuguggggcaaucuauuaauagcugccuuaaagucaguaacuuacccuuaggg

SEQ ID NO: 174506 - RNA, 64 nt, hsa
gguguuugaaaaagaagggggggagaauuccaggugccuuaauauaaaguuugaagcuucaucc

SEQ ID NO: 174507 - RNA, 64 nt, hsa
ucaguucuugagguauauuauuuuaaucauuccaugccuuaauaugcuugcaauacaagaauau

SEQ ID NO: 174508 - RNA, 64 nt, hsa
aacuaauauucugcaaaugucucuuggaacacacugccuuaaacagauauuucuauagcuguca

SEQ ID NO: 174509 - RNA, 64 nt, hsa
uuuggauuuuuuuucccucaggucugaguagcauugccuuaaaucuuauccaguuagaacauug

SEQ ID NO: 174510 - RNA, 64 nt, hsa
gagcuuucagugacccauuuuccugucuagacucugccuuaagcuaguggcaacugcuggggcc

SEQ ID NO: 174511 - RNA, 64 nt, hsa
uaggcccggcuguggcuccaccuccagcucuccgugccuuaagggaaaagcgggacagcuccca

SEQ ID NO: 174512 - RNA, 64 nt, hsa
cucagaugagaauuagcaucaggaaagccugaaaugccuuaauugugaacugauaugcaggaaa

SEQ ID NO: 174513 - RNA, 64 nt, hsa
uuggguuauuauuuugcaguuuuguuuuuuauuuugccuuaaguaaugauagaagauauauaug

SEQ ID NO: 174514 - RNA, 64 nt, hsa
uccaauuuucauuauucuugagaaaugucagcuuugccuuaaugaguauuugcuuuaaauuucu

SEQ ID NO: 174515 - RNA, 64 nt, hsa
cacacugcagggaggagugguacuuaagcuccccugccuuaaccugggaccaaccugaccuaac

SEQ ID NO: 174516 - RNA, 64 nt, hsa
uuugugaaaauuuugaauuagcuuucauaugaagugccuuaaguagacucuucauuuacuuuuc

SEQ ID NO: 174517 - RNA, 64 nt, hsa
aauaguuaaucauuuaaccaaagaagauguguagugccuuaacaagcaauccucugucaaaauc

SEQ ID NO: 174518 - RNA, 64 nt, hsa
ugcaccuuccagggcuccguccacuaguuuccccugccuuaaugugacaugaggcccauucuuc

SEQ ID NO: 174519 - RNA, 64 nt, hsa
cucagaugagcauuagcaucaggaaagccugaaaugccuuaauugugaacugauacgcaggaaa

SEQ ID NO: 174520 - RNA, 63 nt, hsa
cugccuaacacaaaucugugauaacaacaggcugugccuuauuuugauaauuuucugauuccc

SEQ ID NO: 174521 - RNA, 63 nt, hsa
cagacuuggguuuucucuuuggugguuucuaaagugccuuaucugcaaacaacuucuuuucuc

SEQ ID NO: 174522 - RNA, 63 nt, hsa
cccccaggggacccugcccacuuccuggacuucgugccuuacugagucucuaagacuuuuucu

SEQ ID NO: 174523 - RNA, 63 nt, hsa
uuuuuuuuuuuccuuucaacuuaguugacauacgugccuuaaaaaggaaaacuaguguugcua

SEQ ID NO: 174524 - RNA, 63 nt, hsa
uuccuucccuuucuuccuccuucccuuauuguagugccuuauaugauaauguagugguuaaua

SEQ ID NO: 174525 - RNA, 63 nt, hsa
cuuugccauuccuaccuugcauuuuuccugucagugccuuagccaaggcaaggagauaaggau

SEQ ID NO: 174526 - RNA, 63 nt, hsa
uuucaucuuccaacucaaacucuuaaaacccaagugccuuagcaaauucuguuuuucuaggcc

SEQ ID NO: 174527 - RNA, 63 nt, hsa
uucauugcacuuucccaccucuauaccuugccugugccuuaguguccucuuuuuuccaguuca

SEQ ID NO: 174528 - RNA, 63 nt, hsa
cucuacuguccucauugacuuguuugaaccuuagugccuuacccuguccucuucccaguucuc

SEQ ID NO: 174529 - RNA, 63 nt, hsa
gugaguucuaaaaggcaugcccacaucucuuucgugccuuaaggauagugagaugcacacuua

SEQ ID NO: 174530 - RNA, 63 nt, hsa
uucaaaaacagagcccauucuuaagaucacuuggugccuuaaagacacgcauuccaaagugga

SEQ ID NO: 174531 - RNA, 63 nt, hsa
gugugcagaaguuagaagggucuggcgggggcagugccuuacacaugcuugauucccacgcua

SEQ ID NO: 174532 - RNA, 63 nt, hsa
cuuuuagagagguguuauacagggcgauuuuuggugccuuacuuuuaucuuaauuuuugccaa

SEQ ID NO: 174533 - RNA, 63 nt, hsa
uaugcagccuuuuaccuaagaaauuuucugucagugccuuaucuuaugaagaaacagaaccuc

SEQ ID NO: 174534 - RNA, 63 nt, hsa
agcaaggccuucucuccagacuaucguaaccuggugccuuaccaaguugugcuuuucuguuuu

SEQ ID NO: 174535 - RNA, 63 nt, hsa
gucacugccuuaagggggcugauggcgccaccugugccuuacauccagguucaggcaucacua

SEQ ID NO: 174536 - RNA, 55 nt, hsa
agaaagaauuccugucuuaaacuaagugccuuacuguuguuuaagcauuuuuuua

SEQ ID NO: 174537 - RNA, 63 nt, hsa
uucuugaugauccucaaggaaauacaaccuagggugccuuaaaaauaacaacaacaaaaaacc

SEQ ID NO: 174538 - RNA, 63 nt, hsa
gauugccauggacaccaguugcgaagggaaauagugccuuacuauauguggguugagcuaugc

SEQ ID NO: 174539 - RNA, 63 nt, hsa
ucagccuccucccuccaugccucucuggucagugugccuuaggguggccucucacucccacca

SEQ ID NO: 174540 - RNA, 63 nt, hsa
cugcgcuggaagcauaucccgugaaaaguguuagugccuuaggugaaagcaacauguaucccu

SEQ ID NO: 174541 - RNA, 63 nt, hsa
ggcagggagccaggaggcaccugaggccuaucugugccuuagucacuucagcuaugagccaaa

SEQ ID NO: 174542 - RNA, 63 nt, hsa
caccacuccccaccccagcuguaguuaauuucagugccuuacaaauccuaagcucagagaaag

SEQ ID NO: 174543 - RNA, 63 nt, hsa
uaaaugucuauuuugaaauucccuaugcuaagggugccuuagaaucauugugucucuuuuauc

SEQ ID NO: 174544 - RNA, 63 nt, hsa
uagcuuuuaauagugucauaaagauuauaauaugugccuuaaguuuuagucuuuagaacucua

SEQ ID NO: 174545 - RNA, 63 nt, hsa
cauucuaaagagacugauagaauuaaaaacaaagugccuuaucuugcacuggaguucaagugc

SEQ ID NO: 174546 - RNA, 63 nt, hsa
caaaagaccacuuuuaccacucaggcucuauuugugccuuagcuugguuaugaguaaaaauua

SEQ ID NO: 174547 - RNA, 63 nt, hsa
gccuuugacucccugaccuccagagccaggguugugccuuauugucccaucugugggccucau

SEQ ID NO: 174548 - RNA, 63 nt, hsa
caaucugaugucaaauagcacuaagaaguuauugugccuuaugaaaaauaaugaucucugucu

SEQ ID NO: 174549 - RNA, 63 nt, hsa
cccacuccacuuuccuccacagaugccucuucugugccuuaagcagagucaggagaccccaag

SEQ ID NO: 174550 - RNA, 63 nt, hsa
uuuucuugcaauuuaaugccaaaaguuugccaugugccuuaaacauauuacuauauauuuucc

SEQ ID NO: 174551 - RNA, 63 nt, hsa
gucagauauuugagaauaggggauuuuuuugaugugccuuaaauuauaccaaagauuacuaau

SEQ ID NO: 174552 - RNA, 58 nt, hsa
acuguaucgaacagaaaugaagacaagagugccuuauuuccuuuccaaguauuucaca

SEQ ID NO: 174553 - RNA, 63 nt, hsa
guuuguaccaaaacaguccuucaacuuugcacugugccuuaaguaauuacuaacaaaagguac

SEQ ID NO: 174554 - RNA, 63 nt, hsa
ccuugaauauguaaaugggauuaauuuuguccugugccuuauguggaaaggaacuucuuuggu

SEQ ID NO: 174555 - RNA, 63 nt, hsa
auacgugcauguuuuccguacuuucagaauagagugccuuagcuaggccagaggcucguauug

SEQ ID NO: 174556 - RNA, 63 nt, hsa
uuuacauuucuuuauacaaauaaugugcuuucagugccuuaguuacagcucccuuucuguuuc

SEQ ID NO: 174557 - RNA, 63 nt, hsa
agguacagucaggggaaaauagaucuaggcagagugccuuagucagggaccacgggcgcugaa

SEQ ID NO: 174558 - RNA, 63 nt, hsa
augugggugugaaaaugccuacaaaggguuuuagugccuuagaaguccuaagaagcccaaucu

SEQ ID NO: 174559 - RNA, 63 nt, hsa
ugcacaguaucagaggagccuguuaaccucucugugccuuaguuucuuagcccaugaaagaga

SEQ ID NO: 174560 - RNA, 63 nt, hsa
guuuuuucuucaguuaacaaaaucauaaauauggugccuuauaacaugaaaggaaaauuaguu

SEQ ID NO: 174561 - RNA, 63 nt, hsa
ucauugcuuauguaguauuuuucuuuuggaaaugugccuuauguuaaacacuauguacuuuua

SEQ ID NO: 174562 - RNA, 63 nt, hsa
gggccccagcagcccuauggugaccgccacacugugccuuaaugucugccgggggcccaggcu

SEQ ID NO: 174563 - RNA, 63 nt, hsa
agggagaaggagccgugcgccagggcagggcccgugccuuagacuucucccgacccccagagc

SEQ ID NO: 174564 - RNA, 63 nt, hsa
ccaaggggccuucugcccgcccccgcccuagcugugccuuagucaguguguacuugugugugu

SEQ ID NO: 174565 - RNA, 63 nt, hsa
cauaauucauauuucaggugguauuugcauucagugccuuacugguauucucagaacauuuua

SEQ ID NO: 174566 - RNA, 63 nt, hsa
uaguaaaagccaggagaaauguuuaauccaauggugccuuacuuugugauuuaaaagaaauca

SEQ ID NO: 174567 - RNA, 63 nt, hsa
aauuuaguaguuacauccuauuuccaaacaugagugccuuauuuaaaagggcauucuuaggac

SEQ ID NO: 174568 - RNA, 63 nt, hsa
gccauuucucuguguaauacaggcuuuagauuagugccuuauauugguuuugguuuggggcac

SEQ ID NO: 174569 - RNA, 63 nt, hsa
cguggaggcugcuggaccuggucagagacugaugugccuuagcggcaaugguuagagcuuuuc

SEQ ID NO: 174570 - RNA, 63 nt, hsa
aaucccuucuacuucacuccucaggggagugaagugccuuaagaaacaaagcccuguccuaau

SEQ ID NO: 174571 - RNA, 63 nt, hsa
gcaagugaagaguuugccuguacucuuaucugggugccuuaaggagagagauuguguucuucc

SEQ ID NO: 174572 - RNA, 63 nt, hsa
caaguggcauaaagcauauccauucagaaugaagugccuuaaauauagcaguagucuuuuuug

SEQ ID NO: 174573 - RNA, 63 nt, hsa
ugaaggguugaagagugacaagcauugguaacagugccuuagaacugugucaguuagucugau

SEQ ID NO: 174574 - RNA, 63 nt, hsa
acacugucuuuaauacccccagcccaggagcucgugccuuacaugcugggcccacauucugcc

SEQ ID NO: 174575 - RNA, 63 nt, hsa
aagaagaaaaguauuuaaaagaaauaccagugagugccuuaaaguuggagaaguaacugccca

SEQ ID NO: 174576 - RNA, 63 nt, hsa
gaggucagggagugcuggcucacaguacagcaugugccuuaaugcuucauaugaggaggaugu

SEQ ID NO: 174577 - RNA, 63 nt, hsa
gucuuggucuccccuguggaaacccuucucccugugccuuagagcagguguguacaucucuca

SEQ ID NO: 174578 - RNA, 63 nt, hsa
uuuaauuuuggaggggguggggaaauaguucuggugccuuaacgcauggcuggaauuuauaga

SEQ ID NO: 174579 - RNA, 63 nt, hsa
gcaaccucugccuucuggauucaagugauucuugugccuuagccucccaaguagcugggauua

SEQ ID NO: 174580 - RNA, 63 nt, hsa
ggucggcacuuugccacuguguggcaguuacccgugccuuagucuucuccacucugcacccua

SEQ ID NO: 174581 - RNA, 63 nt, hsa
uccagcaguccacuaucugccagaggagcaagggugccuuagaccgaagccaggggaagaagc

SEQ ID NO: 174582 - RNA, 63 nt, hsa
guuacugcaagcuaccuuaauuucccaagaguggugccuuacucuguuuuuucugauaugguc

SEQ ID NO: 174583 - RNA, 63 nt, hsa
gccaacagaagcacauuugucuuccagaacaccgugccuuagaaaugcuuuagaaucugaacu

SEQ ID NO: 174584 - RNA, 63 nt, hsa
uucuguuuuaugguugugcuaaauucauagcaggugccuuauucuuugcuuuuagucaaacca

SEQ ID NO: 174585 - RNA, 63 nt, hsa
aauauaaauguauguuggugugugaaaugcucugugccuuagaagcgugacaguucagcucuc

SEQ ID NO: 174586 - RNA, 63 nt, hsa
uacuuaaauuuaguggucagaaauguauuugaagugccuuaaagaugaucaugguucagaaua

SEQ ID NO: 174587 - RNA, 63 nt, hsa
cugacuaacuuaaaaaaauagauuguaauugaugugccuuaauuugcauaaaucauaaaugua

SEQ ID NO: 174588 - RNA, 63 nt, hsa
cuuucacuggauaauguguguagauuuuuacaugugccuuauuugacaaugcuuaugucuugu

SEQ ID NO: 174589 - RNA, 63 nt, hsa
ggaaaaaauggagugauguuguaaucuaaacaagugccuuauguuuauugcuaagaacuggug

SEQ ID NO: 174590 - RNA, 63 nt, hsa
uuucauuuguugguacauauuacacaaaacauugugccuuaaaaugagucauacaucuuuuaa

SEQ ID NO: 174591 - RNA, 63 nt, hsa
acugaucucucgugauugauaagaaccuuuugagugccuuacacaaugguuuucuuguguguu

SEQ ID NO: 174592 - RNA, 63 nt, hsa
guauaggaguucaccuucuuaggacuagagacugugccuuauagcuguuaauucauuuccccc

SEQ ID NO: 174593 - RNA, 63 nt, hsa
aucacagaauccuuccaagugcucuaucacagugugccuuaugggaaguuucugacuggaaaa

SEQ ID NO: 174594 - RNA, 63 nt, hsa
aggucuccaagagaaaauagaaaggcugcuuuagugccuuacgcuuacuaaauuuaaaucuuu

SEQ ID NO: 174595 - RNA, 63 nt, hsa
aaguauaacaggugccuucacuuuugagacuuagugccuuaaaauauguauucuauaaugauu

SEQ ID NO: 174596 - RNA, 63 nt, hsa
cuucccuuucccuaaaucaaaucaauauuaauugugccuuauuucacuuaacauagacuugaa

SEQ ID NO: 174597 - RNA, 63 nt, hsa
aauaacauggaacuuacacaaaaggcuuuucaugugccuuacuuuuuuaaaaaggaguuuauu

SEQ ID NO: 174598 - RNA, 63 nt, hsa
acaguuuaggaugcaauuacgaguguaaacugugugccuuauuuacacuuuauugucucccgc

SEQ ID NO: 174599 - RNA, 63 nt, hsa
auuguuaaugguucuuacagaguaucuuuaaaagugccuuaggggaacccugucccuccuaac

SEQ ID NO: 174600 - RNA, 63 nt, hsa
ggaggaaccacgcugccaccaaagcagccggaagugccuuaacuuguggaaccaacacuaauc

SEQ ID NO: 174601 - RNA, 63 nt, hsa
aaaacauagcugcaggucuuuggucccagggcugugccuuaacuuuaaccaauauuuucuucu

SEQ ID NO: 174602 - RNA, 63 nt, hsa
gaauugaguauuguggguccccuaauucugugggugccuuaagugagaauuucuaaaugauuu

SEQ ID NO: 174603 - RNA, 63 nt, hsa
ucugugaauagccuguuuuccacauguaaauuugugccuuacaccuugaguuguguacacuug

SEQ ID NO: 174604 - RNA, 63 nt, hsa
gaggaagaugaauuuuuaaaaucuccaucaaacgugccuuaaagcuaaagcauuuugacagga

SEQ ID NO: 174605 - RNA, 63 nt, hsa
cugcgcgggaggccacagcccgugccgauuccagugccuuaacuacuuaccggaucccuccau

SEQ ID NO: 174606 - RNA, 63 nt, hsa
gggacgaugagacuuugaaacuaucucaugccagugccuuauuacccaggaagauuuuaaagg

SEQ ID NO: 174607 - RNA, 63 nt, hsa
guuguaucuagaucuuugcucuguguuucaguugugccuuacccucuguaagauacugauucu

SEQ ID NO: 174608 - RNA, 63 nt, hsa
cacaggguuccugagcucacugaaaagacuauugugccuuaggaaaagcauuugcuguguuuc

SEQ ID NO: 174609 - RNA, 63 nt, hsa
cuugacaguauauuugaaacuguaaauauguuugugccuuaaaaggagagaagaaaguguaga

SEQ ID NO: 174610 - RNA, 63 nt, hsa
guuuucuuccuuuuugugagauuuguggguuuugugccuuauaaauggaaauguaugaacaca

SEQ ID NO: 174611 - RNA, 63 nt, hsa
guggaguguggggaagcugcugucucccaggaagugccuuacucaucccgcaaccagucagcg

SEQ ID NO: 174612 - RNA, 63 nt, hsa
uaaaguauuuguuuuuauuuguaccauccacuugugccuuacuguauccugugucauguccaa

SEQ ID NO: 174613 - RNA, 63 nt, hsa
guuuggcaaacagaauguucauacugauguguugugccuuaaagacaagacagcauuugugug

SEQ ID NO: 174614 - RNA, 63 nt, hsa
ggcaaacaaggaaaggaaaggaaagaagaaaaggugccuuaguccuuuguugcacuuccauuu

SEQ ID NO: 174615 - RNA, 63 nt, hsa
ugggcacuguacuuggaucuucccggcgugugugugccuuacacaggggugaacuguucacug

SEQ ID NO: 174616 - RNA, 63 nt, hsa
accccugcggaggagcgcucccgucucccacaggugccuuaccgcguucccucccgcugcuuu

SEQ ID NO: 174617 - RNA, 63 nt, hsa
acaugacauauugugguuaauuuuaaaacuacugugccuuaacguguuucuuaaacuuuugua

SEQ ID NO: 174618 - RNA, 63 nt, hsa
cacuucccgugcagacucagaugccaacucaaagugccuuagcccagguuccugggcuucugc

SEQ ID NO: 174619 - RNA, 63 nt, hsa
ucacacauagccccccaucagcuguuuuacuccgugccuuacuggauuuggccuguccucaag

SEQ ID NO: 174620 - RNA, 63 nt, hsa
uugcacauuuguacauauacuuaauguuuucaagugccuuaauuguuuaaaaucucuggcuuc

SEQ ID NO: 174621 - RNA, 63 nt, hsa
aagcaucuuaugucauugagaauauaaagaacagugccuuagaagacagugaaagguaagcuc

SEQ ID NO: 174622 - RNA, 63 nt, hsa
ucagcccagcaggccaggcagacacaccccgcugugccuuaggaaggugugagaccggcuucc

SEQ ID NO: 174623 - RNA, 63 nt, hsa
auuuaguuguuucuagacuauaaauguugcuaugugccuuauguugaaaaaauuuaaaaguaa

SEQ ID NO: 174624 - RNA, 63 nt, hsa
uaagauaauucauacuggagaaaacucccagaagugccuuauugcacaggaaagcauuuauac

SEQ ID NO: 174625 - RNA, 63 nt, hsa
gggcauuuccucuauucuguuacgucauuaacagugccuuacugugcaaggcaccaaaggaca

SEQ ID NO: 174626 - RNA, 63 nt, hsa
gcuucccaaacaguaacucacuccaggccaagugugccuuagcacgagugaccacaguuuaau

SEQ ID NO: 174627 - RNA, 63 nt, hsa
augggaauaaaaauuugugcaagucagagaagggugccuuaaaaauguuguggccaagccaca

SEQ ID NO: 174628 - RNA, 63 nt, hsa
uagcucguacauguggguucuuauccugauccugugccuuaaaguaggaagguguuuccaagu

SEQ ID NO: 174629 - RNA, 63 nt, hsa
cagaaguccuuuaucugugcucucugcccgccagugccuuacaauuugcaaacguguauagcc

SEQ ID NO: 174630 - RNA, 63 nt, hsa
ccaguaaggaucuugcccucccugcaacaccgagugccuuagacagcugcugccugagaacug

SEQ ID NO: 174631 - RNA, 63 nt, hsa
cugaucagagauuuacaacuguucauuauaguggugccuuaggcaaucuuuccaaaguaaauu

SEQ ID NO: 174632 - RNA, 63 nt, hsa
uuuaaaggauaguaauuauucuuguuuauaacagugccuuaagguaugauguauuucugaugg

SEQ ID NO: 174633 - RNA, 63 nt, hsa
uggaaauacuuuggcuuuuucauauaccuaguggugccuuaucauaauagcacuguuacauga

SEQ ID NO: 174634 - RNA, 63 nt, hsa
gggcauuuguccccuccaugcuauaauccaguggugccuuacauggugugugugugugugugu

SEQ ID NO: 174635 - RNA, 63 nt, hsa
ccauaggaagagaucugccagacgcgaacucaggugccuuaaaaaguauuccaaguuuacucc

SEQ ID NO: 174636 - RNA, 63 nt, hsa
uggccagaaucauuauccuugaaauuucugguagugccuuagcuugguuaaaaaaaaaaaaaa

SEQ ID NO: 174637 - RNA, 63 nt, hsa
gcaugaggcagcacgugcacaaauucaugugccgugccuuaucugaguuuucgguauaaauau

SEQ ID NO: 174638 - RNA, 63 nt, hsa
cuggaaauuaaaaaaaaaaaacuagacuccauugugccuuacuaaauaugggaaugucuaacu

SEQ ID NO: 174639 - RNA, 63 nt, hsa
uacuuugguccucuauguauuuaaauguuugaagugccuuagacucuugccauauuuucaaaa

SEQ ID NO: 174640 - RNA, 63 nt, hsa
gauguuacuuuuaguuuuaaaaugaaaucuuaggugccuuagggguuuuuuuuuuuuuuaagu

SEQ ID NO: 174641 - RNA, 63 nt, hsa
cauagccuaagugcuauaucgaucgucccggaugugccuuaagaaccgugaccucaucagucg

SEQ ID NO: 174642 - RNA, 63 nt, hsa
auggaaccuggacacccucagcucuccugcuuugugccuuaucuacaggagcaucgcccauug

SEQ ID NO: 174643 - RNA, 63 nt, hsa
ggcuagagcuucuguauuuucaaagacugccacgugccuuaggaauacuguuuuaucuccaua

SEQ ID NO: 174644 - RNA, 63 nt, hsa
ucuggauguccagcaccugagcguggaugcaccgugccuuaucaaagccagcaccacuuugcc

SEQ ID NO: 174645 - RNA, 63 nt, hsa
ucuccauuacucucccugcccuucucuguuggggugccuuauccugagccaccuccucucccc

SEQ ID NO: 174646 - RNA, 63 nt, hsa
ccuggcucugcccuucuuacugcaaaccaugcugugccuuagggcccuucucauagcuguucc

SEQ ID NO: 174647 - RNA, 63 nt, hsa
cucuuucuguccgcagauccugacuuuuccaaagugccuuaaaagaaaucagacaaaugcccu

SEQ ID NO: 174648 - RNA, 63 nt, hsa
uggugagcagccacugugcaguucaacguaagugugccuuaauugcacagagguacugccccc

SEQ ID NO: 174649 - RNA, 63 nt, hsa
ccacagccccagcccugcccccgucacacugcugugccuuagucauguuguucccuuugcucg

SEQ ID NO: 174650 - RNA, 63 nt, hsa
uugcucuucugucuauaaauuuugaaugauacugugccuuaauugguuuucauaguuuaagug

SEQ ID NO: 174651 - RNA, 63 nt, hsa
gaauuacuguguauuuacuuaauuucuuauuaugugccuuauuaugugcuuaagauacaauag

SEQ ID NO: 174652 - RNA, 63 nt, hsa
augaaauuuggggcccaaaauuucacacuucaugugccuuacugaugagaguacuaacuggaa

SEQ ID NO: 174653 - RNA, 63 nt, hsa
ccuuacaccacaaccagcuucuccaggucauaugugccuuaccuccagagagucuuuuuuuuu

SEQ ID NO: 174654 - RNA, 63 nt, hsa
ggauuccucaaguaccauuugcuaggcugugaggugccuuagggcaggucucuugugcccugu

SEQ ID NO: 174655 - RNA, 63 nt, hsa
ggagccacugagggauguuuuccccccuugcuugugccuuaaaggcagagaagcgaggcggau

SEQ ID NO: 174656 - RNA, 63 nt, hsa
aggccagcaccucccuccuccaucgcucgcugugugccuuaaacuccaucucaugucccuccc

SEQ ID NO: 174657 - RNA, 63 nt, hsa
acagugguagauuuaugauucacauccgaaagugugccuuaguuaucaauuuaacauuucucu

SEQ ID NO: 174658 - RNA, 63 nt, hsa
aggguaauucauugacuuguuuuaguauuuugugugccuuagauuuccguuuuaagacaugua

SEQ ID NO: 174659 - RNA, 63 nt, hsa
ugcuuuggggggugugcugacaacuuagcucaggugccuuacaucuuuucuaaucacaguguu

SEQ ID NO: 174660 - RNA, 63 nt, hsa
uuugcauuuuguaccucaauauuucuacgucaugugccuuaguaaaaaaaaauaauaaauaaa

SEQ ID NO: 174661 - RNA, 63 nt, hsa
ccuuuccagccagugucucugacgucgggguuagugccuuagaggguacuggggucuggucuu

SEQ ID NO: 174662 - RNA, 63 nt, hsa
acagccuaguguuaacauucuugguaucuuuuugugccuuaucuaaaacauuucucgaucacu

SEQ ID NO: 174663 - RNA, 63 nt, hsa
agggugguaauauuggcauucugauuaaauacugugccuuaggagacuggaaguuuaaaaaug

SEQ ID NO: 174664 - RNA, 63 nt, hsa
gucagugacagggcuucuuguaauuugugguaugugccuuaaaccugaaugucuguagccaaa

SEQ ID NO: 174665 - RNA, 63 nt, hsa
cccuccccugggccgcugaggccccgcgcaccugugccuuaaucuucccuccccugugcugcc

SEQ ID NO: 174666 - RNA, 63 nt, hsa
acccccuacacuucaguugagggaaaagcucaagugccuuaggcccguggaccacagucuugg

SEQ ID NO: 174667 - RNA, 63 nt, hsa
ggacuucugccacagugacaauggaauuguguugugccuuacuucagagguggucucuucuuu

SEQ ID NO: 174668 - RNA, 63 nt, hsa
cuuuugguugaaauugaacauacucuagugaaugugccuuaaaaaucaagacacuaguucaga

SEQ ID NO: 174669 - RNA, 63 nt, hsa
ccuucagcuucuuacguuuucugagcauccauugugccuuaacauuuucugcuuguccuuugg

SEQ ID NO: 174670 - RNA, 63 nt, hsa
aauuuggagaccagcuaugccugcccucugugggugccuuagcauugcgggaggguggugcuu

SEQ ID NO: 174671 - RNA, 63 nt, hsa
caguugugccuuggugccuuguccgccucagcugugccuuaaggacuaauucuggcaccccuu

SEQ ID NO: 174672 - RNA, 63 nt, hsa
ugucuuaauauaucuuaggcuucaauuauuugggugccuuaaaaacucaaugagaaucauggu

SEQ ID NO: 174673 - RNA, 63 nt, hsa
gggugcugguucacucugcccagcccugaaugugugccuuaaaggcccccuacaaggggcccc

SEQ ID NO: 174674 - RNA, 63 nt, hsa
ggaaccccuuuaucccaggaaguccucuuccuugugccuuaacauacaggacaaauaggcucu

SEQ ID NO: 174675 - RNA, 63 nt, hsa
gguuugcacagcccuuguguguggggcuagaaugugccuuaguccugaauccuagcccuuacc

SEQ ID NO: 174676 - RNA, 63 nt, hsa
aagccugaagagcuuauuacuuauuugugcgaagugccuuaugcuaugagaccauucagaaua

SEQ ID NO: 174677 - RNA, 63 nt, hsa
ggcgauggaguguggcugggcugaccgcaaaaggugccuuacacacugcccccacccucagcc

SEQ ID NO: 174678 - RNA, 63 nt, hsa
cccagcuguauuauuuugaucuuuuggaugcaggugccuuaaugaagcucucaaaauauuuua

SEQ ID NO: 174679 - RNA, 63 nt, hsa
uuuuuuuccugucuugggagauagaauaaugaugugccuuacaauggauuguguuuuagauuc

SEQ ID NO: 174680 - RNA, 63 nt, hsa
ucccuuuccuaaucuggcuuuuacauuuauuuugugccuuaaagauuaacuacaaagauaaac

SEQ ID NO: 174681 - RNA, 63 nt, hsa
cugcuuucguaucuccucaggcaaaaguggagggugccuuaugggcccuccucauagguuguc

SEQ ID NO: 174682 - RNA, 63 nt, hsa
gaugcacacuauucuguaacagaaagcccuauugugccuuaccugugugcuuuugugggcacc

SEQ ID NO: 174683 - RNA, 63 nt, hsa
uuccauuucuuuuuucccaaacccucaaacagagugccuuaaaaaauuguuuuaucaggauaa

SEQ ID NO: 174684 - RNA, 63 nt, hsa
aaauaggaggguggcaagaacaguucuauccuggugccuuacgaauaaaaaacuggauucugg

SEQ ID NO: 174685 - RNA, 63 nt, hsa
agccacugaacaucccuucucugcuccacaggagugccuuagacagccugacucuccacaaac

SEQ ID NO: 174686 - RNA, 63 nt, hsa
uggcugucaggcgacuacaagacugagggucuugugccuuauagaucuuuguaucccccaugg

SEQ ID NO: 174687 - RNA, 63 nt, hsa
aaagcaccugccgaccucguccucccccugccagugccuuaccuccugcccaggagagccagc

SEQ ID NO: 174688 - RNA, 63 nt, hsa
guaacaggaccccaaggaccugccuccccggaagugccuuaaccuagagggucggggaggagg

SEQ ID NO: 174689 - RNA, 63 nt, hsa
ugaagaugggagauuccuaaguggaggagaacugugccuuacugaccuaaauauccacucagu

SEQ ID NO: 174690 - RNA, 63 nt, hsa
uugcuaaggggggagggugaggauuaaguacucgugccuuauauuugugugccaauuaaugcc

SEQ ID NO: 174691 - RNA, 63 nt, hsa
uuaaagggauguaagcacuuuuauuuuaauaaagugccuuauaacaaguucuuugcaugcuuu

SEQ ID NO: 174692 - RNA, 63 nt, hsa
ucuucuuucccucuauccaaaggagcuugguaagugccuuacugcagcgugucuccuggcacg

SEQ ID NO: 174693 - RNA, 63 nt, hsa
aguuuuaaucucuaacaguggacaaaguuaccagugccuuaaacucuguuacacuuuuuggaa

SEQ ID NO: 174694 - RNA, 63 nt, hsa
gguuucaguguuguauauauaaauaugcaagaugugccuuacaaugaaguuguuggaagcuau

SEQ ID NO: 174695 - RNA, 63 nt, hsa
guuccugccuaauuuuuauaucuucuaagcaaagugccuuaggauagcuugggaugagaugug

SEQ ID NO: 174696 - RNA, 63 nt, hsa
ugauucuguuuuaaguccauaccuuguaaauaagugccuuacgugagugugucaucaaucaga

SEQ ID NO: 174697 - RNA, 63 nt, hsa
aggccaccaguuaaaugccgucuaucagguuuugugccuuaagagacuacagagucaaagcuc

SEQ ID NO: 174698 - RNA, 63 nt, hsa
guguaccucacuguccaauaugaaaaccguaaagugccuuauaggaauuugcguaacuaacac

SEQ ID NO: 174699 - RNA, 63 nt, hsa
ggccccuauggcgccccugcugggccacugauugugccuuauaaccugccuuugccuggggga

SEQ ID NO: 174700 - RNA, 63 nt, hsa
uauuuuagucucugugaagccuuuacucucuaggugccuuauaauguuucagggcucaacuuu

SEQ ID NO: 174701 - RNA, 63 nt, hsa
cuggcgguacccacccagcccaagggagucacagugccuuagaaguggcagaggugaggguca

SEQ ID NO: 174702 - RNA, 63 nt, hsa
ggcaaccaauuauauacucaauaugguuuuacugugccuuacacaaagagaaacucuauacag

SEQ ID NO: 174703 - RNA, 63 nt, hsa
guguguguguuuuuaauauucacacugagacaugugccuuaaacagacuuuuuaguccaaaau

SEQ ID NO: 174704 - RNA, 63 nt, hsa
ccgacacuuugucgacacugaaauaucgauuaagugccuuaaaaccucuuuagacauagcuau

SEQ ID NO: 174705 - RNA, 63 nt, hsa
uuuggaggagggguaugaaguaucuuugacauggugccuuaggaaugacuuggguuuaacaag

SEQ ID NO: 174706 - RNA, 63 nt, hsa
uggcuguauagcaaaguguuuuaauccacgguugugccuuauuguuccauuaaaauuguaucu

SEQ ID NO: 174707 - RNA, 63 nt, hsa
ugugaacagaaguccuuaagcagaggaauuggugugccuuaaagauacaaucugggauaguuu

SEQ ID NO: 174708 - RNA, 63 nt, hsa
augaugacucaaguguagacugaaguugagguagugccuuaugccauuaugucauauguugaa

SEQ ID NO: 174709 - RNA, 63 nt, hsa
ccacaugugaguuuaccugaaucugugcauuuugugccuuauucaugagaaugauagaaguac

SEQ ID NO: 174710 - RNA, 63 nt, hsa
uaacaguaugguacugcuucugugacaaauaucgugccuuaacaauguggcuguccuuuucca

SEQ ID NO: 174711 - RNA, 63 nt, hsa
ucauuguuuuuaaaacuguuuuauaucuuaagagugccuuauuaaaguauagauguaugucuu

SEQ ID NO: 174712 - RNA, 63 nt, hsa
cugagaguuaggagaaauauuucagagccaaaagugccuuauacaaccuuagccuauuauagu

SEQ ID NO: 174713 - RNA, 63 nt, hsa
ggugaugcuaaaguaaugguggauaagcugcuggugccuuagugugaaucaagguagugccac

SEQ ID NO: 174714 - RNA, 63 nt, hsa
uucugggccuggugugggggcuaccucaacuaugugccuuaugguaacuuguucuguaccucc

SEQ ID NO: 174715 - RNA, 63 nt, hsa
ucucgccugccuucugagcugcacuuuccgugggugccuuaugugguggugguugugcccagc

SEQ ID NO: 174716 - RNA, 63 nt, hsa
guguucuuaauuccuagcaucugcuaucaaacugugccuuauuaaaaccaaauuguggcuauu

SEQ ID NO: 174717 - RNA, 63 nt, hsa
acccgugucuaugacgcaaagaucaccagccaugugccuuaguguccuucuuaacagacucaa

SEQ ID NO: 174718 - RNA, 63 nt, hsa
auuauaccagaaaguuaaauucucagaucaaaugugccuuaauaaauuuguuuucauuuagau

SEQ ID NO: 174719 - RNA, 63 nt, hsa
gucaugagaguggagcccucaugaaugggaucagugccuuaugaaaggcccuagagagauacc

SEQ ID NO: 174720 - RNA, 63 nt, hsa
cugcagggaggcccuucccaagguguggugacugugccuuacuguacaugcucggaggccugg

SEQ ID NO: 174721 - RNA, 63 nt, hsa
acacuugggggaccaaucauguccuucaccacugugccuuagaaucgccccuggacagaguuc

SEQ ID NO: 174722 - RNA, 63 nt, hsa
cacuugguacccauggccaccuccccauuuucugugccuuaucucacuguuucagcugagucc

SEQ ID NO: 174723 - RNA, 63 nt, hsa
guuucaaaugauuggaucuuugaaagcuucagcgugccuuaguuucuaggaucagaauuaguu

SEQ ID NO: 174724 - RNA, 63 nt, hsa
aacugagcccucguggccaccugugucacccuugugccuuagccucaugggcugccuaggagc

SEQ ID NO: 174725 - RNA, 63 nt, hsa
ccucucggcggccucaccuggccucacugcuucgugccuuagcucgggggucgggggagaacc

SEQ ID NO: 174726 - RNA, 63 nt, hsa
gagugagaggcuguggggcagcggcucuguccugugccuuaccagcccuggggaggggggcau

SEQ ID NO: 174727 - RNA, 63 nt, hsa
cugcuagucuguaagcuccuuaagaguaggguugugccuuauucaacugcauacauagcuccu

SEQ ID NO: 174728 - RNA, 63 nt, hsa
ccuuauucaacugcauacauagcuccuagcacagugccuuauucgguaggcaucuaagcacau

SEQ ID NO: 174729 - RNA, 63 nt, hsa
guacaggacauagcucucuccugcuaccagucugugccuuagaggucuguuaggccugccaaa

SEQ ID NO: 174730 - RNA, 63 nt, hsa
acugggggcaccuuaagauuuugcaccuguaaagugccuuacaggguaacugugcugaaugcu

SEQ ID NO: 174731 - RNA, 63 nt, hsa
gcagcugagcugcgcuggcucugggcagggagugugccuuaaugggaagcacacgggcuuugg

SEQ ID NO: 174732 - RNA, 63 nt, hsa
ccagaagagcccuuaugaccccugggccgcgcugugccuuagugucuacuugcaggacccuuc

SEQ ID NO: 174733 - RNA, 63 nt, hsa
cacaaagacaagaaaaaucagggcauuuugugagugccuuaagaucaaacuaacaagaucuga

SEQ ID NO: 174734 - RNA, 63 nt, hsa
aaauaaauacaaagcccauucuuccagagucuugugccuuaaauaaaacacaccucucugcug

SEQ ID NO: 174735 - RNA, 63 nt, hsa
cccugccuucagcuggugcuugcugcgauuccugugccuuauguaacugcccuuccuucccuu

SEQ ID NO: 174736 - RNA, 63 nt, hsa
gguugguaguuaagcaaacugacauuacggaaagugccuuagacacuacaguacuaagacaau

SEQ ID NO: 174737 - RNA, 63 nt, hsa
uuugaggaugcuuaaugauuccagccucucacugugccuuaugcauuaaaauuucuuuguuac

SEQ ID NO: 174738 - RNA, 63 nt, hsa
ucccacagaacaacgggaacguuacugacucuggugccuuaucucgaagggaccagaagugcu

SEQ ID NO: 174739 - RNA, 63 nt, hsa
uuccgguccugagagcuugcaucgguuucuucagugccuuacagggaaauagccugggguguc

SEQ ID NO: 174740 - RNA, 63 nt, hsa
ucugcuguuucagaggcuagguuguuucugugggugccuuaucagggcugggauacuucugau

SEQ ID NO: 174741 - RNA, 63 nt, hsa
cacccuucacugaguucucuggauuuguucucagugccuuagcaacgaaaaccugugcuugug

SEQ ID NO: 174742 - RNA, 63 nt, hsa
agcauauuucaacuguucuucauaaauguuuaugugccuuaaaagacuuuauguuaaaggauu

SEQ ID NO: 174743 - RNA, 63 nt, hsa
cccuucuggcaccccugggguucaauacuggaagugccuuauuuaaccagaccaucagggcau

SEQ ID NO: 174744 - RNA, 63 nt, hsa
guuuauucauugaaacacgguugaccugaacucgugccuuaggaauuaaugcccccuuaugga

SEQ ID NO: 174745 - RNA, 63 nt, hsa
cauccuccuccagccuccuccagcccccaggcagugccuuaccuguggugcccagaaaagugc

SEQ ID NO: 174746 - RNA, 63 nt, hsa
aggugggcgccccgaccacgacuuggcuuccuugugccuuaaaaaaccugccuuccugcagcc

SEQ ID NO: 174747 - RNA, 63 nt, hsa
guggccuuuuaugagaggggacccgucaaaucugugccuuauggagggguccggcagcggcca

SEQ ID NO: 174748 - RNA, 63 nt, hsa
cugcccagucuggccugcgcucccgccgcccuggugccuuagcccccggcacaggauggggca

SEQ ID NO: 174749 - RNA, 63 nt, hsa
cagugcgcccucccucccucccaucuggggguagugccuuaugcuggguguuggagcagagug

SEQ ID NO: 174750 - RNA, 63 nt, hsa
gggugugacuuggccccucuggcuugucuuucugugccuuacuccuccuccugcgucucccgu

SEQ ID NO: 174751 - RNA, 63 nt, hsa
aaacuccucaccaggagagccaaagacaggguugugccuuaccccaggagccaccccuguacc

SEQ ID NO: 174752 - RNA, 63 nt, hsa
ucggacuggggccuccccaccucccucucggcugugccuuacggagccccgauccaggccucc

SEQ ID NO: 174753 - RNA, 63 nt, hsa
ucaggucagcugcuuggggcucccaggcugggugugccuuagccacaggcagggcugucaaua

SEQ ID NO: 174754 - RNA, 63 nt, hsa
acacccccagcuggcccuccacccccaccucaagugccuuauucucacagcaagccccuuagu

SEQ ID NO: 174755 - RNA, 63 nt, hsa
cccauugccaaagcaugccugcccacccucgcugugccuuagucaguguguacgugugugugu

SEQ ID NO: 174756 - RNA, 63 nt, hsa
ccaagagggggaugucagccucacccacaccgugugccuuacuccugucuagagaccccaccu

SEQ ID NO: 174757 - RNA, 63 nt, hsa
agccucggauuuccuggccccucuacuguaaaugugccuuagccuaagccucccauccugugu

SEQ ID NO: 174758 - RNA, 63 nt, hsa
ucauccccuuccuagcuguaugaccuugauugugugccuuaaccgcucugugacacagucuac

SEQ ID NO: 174759 - RNA, 63 nt, hsa
ggagccgcagcugcaaacucugacacaaaagacgugccuuaaggaacccgccgcgugcccagg

SEQ ID NO: 174760 - RNA, 63 nt, hsa
uuccugaaccacaaaccauagcauaagugaucugugccuuaacgacauguuccugcugcagau

SEQ ID NO: 174761 - RNA, 63 nt, hsa
gccuuccgggccgggcggaaggggacgcgggcugugccuuacuuaagucggggguggcaaggg

SEQ ID NO: 174762 - RNA, 63 nt, hsa
uacuagacugugagcuccucgagggcagggaccgugccuuaugucugugugugaucaguuucu

SEQ ID NO: 174763 - RNA, 63 nt, hsa
ccagcucccgccccucgccccccaccuccacaggugccuuaaagggcccucguccacccaagg

SEQ ID NO: 174764 - RNA, 63 nt, hsa
agacaguccuuccgugaggccuggggggcaucugugccuuauuuauacuuauuuauuucagga

SEQ ID NO: 174765 - RNA, 63 nt, hsa
uucccgucagaagaaucagcaggacagaucguagugccuuauuccauuguccuccccuggcca

SEQ ID NO: 174766 - RNA, 63 nt, hsa
aacugccuaaagucacagcacagauacugcccagugccuuaagaggagacaugaucucuacca

SEQ ID NO: 174767 - RNA, 63 nt, hsa
aaagaccuacuugacgucauguggacagugcacgugccuuacgcuacaucuuguuuucuagga

SEQ ID NO: 174768 - RNA, 63 nt, hsa
cuugcucaugggauguugcaaagaacacaaagugugccuuagacauucucaagucaucagcgu

SEQ ID NO: 174769 - RNA, 63 nt, hsa
augucagauggcguggucugcagggggagcucugugccuuaguggcucuuggcaggacacuga

SEQ ID NO: 174770 - RNA, 63 nt, hsa
gcccacagcaggcuguaccaggcugcccugcuugugccuuagugggaagcccagugaggcauu

SEQ ID NO: 174771 - RNA, 63 nt, hsa
ucuguguccgggccggccugcugcagccaccuggugccuuaguccuugggcugggggaggggg

SEQ ID NO: 174772 - RNA, 63 nt, hsa
guaaaacccuuuuuaggcaagggcccaaggacagugccuuaguuuggauccucuagaaacuaa

SEQ ID NO: 174773 - RNA, 63 nt, hsa
cuacacaagaaauauuuguuuuacucagcaggugugccuuaaccucccuauucagaaagcucc

SEQ ID NO: 174774 - RNA, 63 nt, hsa
aaacguaucuuuccuuuaugugacgcgucucuagugccuuacugaagaagcagugacacuccc

SEQ ID NO: 174775 - RNA, 63 nt, hsa
caaggauugucuaauuucaauugugcaagacaugugccuuauaauuauuuuuagcuuaaaauu

SEQ ID NO: 174776 - RNA, 63 nt, hsa
cauaaucuuacucugugaaauagaggaauucgugugccuuagauuuagaaguguguucuuuaa

SEQ ID NO: 174777 - RNA, 63 nt, hsa
acucuaccauaucuuagcucagagcacagaggagugccuuauccccacacuugacugggcugu

SEQ ID NO: 174778 - RNA, 63 nt, hsa
aacuguaaccucaaggaaaccauaaagcuuggagugccuuaauuuuuaaccaguuuccaauaa

SEQ ID NO: 174779 - RNA, 63 nt, hsa
gggccgcucuccagcucaccacagugucuccacgugccuuaccccuucuccuucaggccaagu

SEQ ID NO: 174780 - RNA, 63 nt, hsa
aacuuuuccaggugguguuaauaagccauucaagugccuuacacagcuuugaagaaacuagga

SEQ ID NO: 174781 - RNA, 63 nt, hsa
cuuugaauaaagugaacagaggcucauuuguuugugccuuacuuuacugaaugaauaggguuu

SEQ ID NO: 174782 - RNA, 63 nt, hsa
gccagccaugagcgccuuccugcagaacacacagugccuuaugccacagccgaagaauccgug

SEQ ID NO: 174783 - RNA, 63 nt, hsa
cucccacccuacccccuuuuuuauauaauaaaagugccuuagcauguguugcagcugucacca

SEQ ID NO: 174784 - RNA, 63 nt, hsa
cccagaguccucacaccugaaugaauuauacaugugccuuaccaggugaguggucuuucgaag

SEQ ID NO: 174785 - RNA, 63 nt, hsa
cuuccuaccuagcuccuuguuggugagcuucuugugccuuaauccugugacccagccccuuac

SEQ ID NO: 174786 - RNA, 63 nt, hsa
aagggaaacaguugaaacuguuuaaaaauagaugugccuuauuuauugcaggcuuucuuuccc

SEQ ID NO: 174787 - RNA, 63 nt, hsa
aguauuucuuuguuauacauuuaaagauuuaaagugccuuaucaaauaauauucaugaagagu

SEQ ID NO: 174788 - RNA, 63 nt, hsa
gguguuugaaaaagaagggggggagaauuccaggugccuuaauauaaaguuugaagcuucauc

SEQ ID NO: 174789 - RNA, 63 nt, hsa
ucuaaucauguuuucgucacaugcugaguaaaagugccuuacaauguaaaaauuguacaguac

SEQ ID NO: 174790 - RNA, 63 nt, hsa
ucucucuuguggaauugcauucaaaccagaacagugccuuagaauggaugugcccaacugcuc

SEQ ID NO: 174791 - RNA, 63 nt, hsa
uaggcccggcuguggcuccaccuccagcucuccgugccuuaagggaaaagcgggacagcuccc

SEQ ID NO: 174792 - RNA, 63 nt, hsa
guccagugcccgcccuguggggccaaggcggccgugccuuacuacucugugucuucugccucc

SEQ ID NO: 174793 - RNA, 63 nt, hsa
uuugugaaaauuuugaauuagcuuucauaugaagugccuuaaguagacucuucauuuacuuuu

SEQ ID NO: 174794 - RNA, 63 nt, hsa
aauaguuaaucauuuaaccaaagaagauguguagugccuuaacaagcaauccucugucaaaau

SEQ ID NO: 174795 - RNA, 63 nt, hsa
uaaggcaccaugaccaccuggugugaccucucugugccuuacugaggcaccuuucuagagauu

SEQ ID NO: 174796 - RNA, 64 nt, hsa
gccaaguacugcgcaugcaagagacccuuuauuggccuuacagugggccauucauuucuauagg

SEQ ID NO: 174797 - RNA, 64 nt, hsa
ucacacgggguuuccccacucuuucugauauauugccuuacagaccuaccucaaacacacuguu

SEQ ID NO: 174798 - RNA, 64 nt, hsa
aaccaaaguggagcuggugcuucuugggagccucgccuuacaacuaauuccugccuuucgucca

SEQ ID NO: 174799 - RNA, 64 nt, hsa
ccucugugagucucaucaucagcugagcgaugaugccuuacagguugcauagcacuggaacuuu

SEQ ID NO: 174800 - RNA, 64 nt, hsa
aaguuuuucucacuaaaauauggggcaauuguuagccuuacauguuguguagacuuacuuuaag

SEQ ID NO: 174801 - RNA, 64 nt, hsa
acuaacaaacacacaacugguguguaaaaggcaggccuuacauuagaagccaagccaauccuuu

SEQ ID NO: 174802 - RNA, 64 nt, hsa
ugugcagaaguuagaagggucuggcgggggcagugccuuacacaugcuugauucccacgcuacc

SEQ ID NO: 174803 - RNA, 64 nt, hsa
aaaugcaucccuuccuuucuuuccugcuuccuuugccuuacaauugaagcagcccgugguacca

SEQ ID NO: 174804 - RNA, 64 nt, hsa
ucacugccuuaagggggcugauggcgccaccugugccuuacauccagguucaggcaucacuagc

SEQ ID NO: 174805 - RNA, 64 nt, hsa
uagacucuucuccaugucagcugcagcgccacccgccuuacaccugcccggccgucugucucuu

SEQ ID NO: 174806 - RNA, 64 nt, hsa
accacuccccaccccagcuguaguuaauuucagugccuuacaaauccuaagcucagagaaaguu

SEQ ID NO: 174807 - RNA, 64 nt, hsa
uuaauaaguaauuccuucucuuuuuucagagaaggccuuacagaaaauuguugugcuuagaauu

SEQ ID NO: 174808 - RNA, 64 nt, hsa
uugguccuucuaucacuaaaacucaucucauucagccuuacagcauaacuaauuauuuguuuuc

SEQ ID NO: 174809 - RNA, 64 nt, hsa
aggguaagauuccaacuuguccaaaagcuuucuggccuuacauauuuuauuauaaaaauucuca

SEQ ID NO: 174810 - RNA, 64 nt, hsa
auaaugaaagaaaucauacauaaaaauguagccugccuuacauauaagcuaauguagaaaaguu

SEQ ID NO: 174811 - RNA, 64 nt, hsa
ggaaauaaggcuaacagagguugaccuaaaauuagccuuacaaaggagaaaggaccacauugcu

SEQ ID NO: 174812 - RNA, 64 nt, hsa
uucacuuccuccagaagccuccuuacauuaaaaagccuuacaguuauccugcaagggacaggaa

SEQ ID NO: 174813 - RNA, 64 nt, hsa
guggcuccccacacccugccauaggggcaguccugccuuacacauagaagcauucaugccugcu

SEQ ID NO: 174814 - RNA, 64 nt, hsa
agcaaauagcgauucucuucauguaucuccuaaugccuuacacuacuugguuucugauuugcuc

SEQ ID NO: 174815 - RNA, 64 nt, hsa
aagcucagccccucacaguggccucaagugugaugccuuacaaaagcaccacucagaugggcag

SEQ ID NO: 174816 - RNA, 64 nt, hsa
uucaaggaguaugucauauaucacaaaagaaauugccuuacacugguucauguuugcaguuacu

SEQ ID NO: 174817 - RNA, 64 nt, hsa
uuacgagaaagggacuuguccuaacugguuugaggccuuacaguuuuguaucuacauuuuuccc

SEQ ID NO: 174818 - RNA, 64 nt, hsa
guuucagucuacaguccauccaaaggaccaaccugccuuacacaucucaaggaauucagcuguu

SEQ ID NO: 174819 - RNA, 64 nt, hsa
uuuauuuuugagagugggguaagcaccccuaccugccuuacagagcagcccagguacccaggcc

SEQ ID NO: 174820 - RNA, 64 nt, hsa
cagagagcuuucccaccaacuuuguaccuugauugccuuacaaaguuauuuguuuacaaacagc

SEQ ID NO: 174821 - RNA, 64 nt, hsa
cagcauaaacucuaugguuaauucuuaaaauaaugccuuacagucuccauuaacucccuugccc

SEQ ID NO: 174822 - RNA, 64 nt, hsa
guaggccuuauguugauugggaugcuccccuacagccuuacagguagaauagaaggugaguucu

SEQ ID NO: 174823 - RNA, 64 nt, hsa
auccacaacuggggaccugcucagugcccccccugccuuacagcuacaugacagugcuguuuua

SEQ ID NO: 174824 - RNA, 64 nt, hsa
cauguuuaggcaacuagucagaaaaccagcuauggccuuacagaaagggaaaaauuaacccauu

SEQ ID NO: 174825 - RNA, 64 nt, hsa
cacugucuuuaauacccccagcccaggagcucgugccuuacaugcugggcccacauucugcccc

SEQ ID NO: 174826 - RNA, 64 nt, hsa
uauguauucuuuugugccuggcuucuuucucucagccuuacauuugugagauuccucuguauug

SEQ ID NO: 174827 - RNA, 64 nt, hsa
acuauggggugggguggguguaggggcuuacaaagccuuacacagggcgagggguuggugggag

SEQ ID NO: 174828 - RNA, 64 nt, hsa
gcauuucguuugguuagucagcauucuuugaacugccuuacauguugucaccuuuauagaagca

SEQ ID NO: 174829 - RNA, 64 nt, hsa
uuuccaggcaggccuggccauagggcaagagcaggccuuacagcagugccacggugacccaaga

SEQ ID NO: 174830 - RNA, 64 nt, hsa
uuagcaagguaauggauuuugcuuuaaaaugucugccuuacaaauucauaacaacaagauuugu

SEQ ID NO: 174831 - RNA, 64 nt, hsa
aacacagucuacucuuucugcuuacaaagacaaagccuuacaaacucacuaugaagguaaaggg

SEQ ID NO: 174832 - RNA, 64 nt, hsa
cccaaauuccuaccuaaggggucuagggagucgcgccuuacaaaucauaaauucucaucagaug

SEQ ID NO: 174833 - RNA, 64 nt, hsa
cagcacagggccugggggguggcuaacgagagaggccuuacagugccggcaugccuccucuucc

SEQ ID NO: 174834 - RNA, 64 nt, hsa
gagaagggauagggaaauccucucugcucauugggccuuacaugaugggugacacuuggagugg

SEQ ID NO: 174835 - RNA, 64 nt, hsa
cuccaaaaaaaaacuuugcuuguauauuauuuuugccuuacaguggaucauucuaguaggaaag

SEQ ID NO: 174836 - RNA, 64 nt, hsa
ucucucuaccucucagcacuaaugauggucaaaugccuuacaucuuuucugauaucucuaaaau

SEQ ID NO: 174837 - RNA, 64 nt, hsa
aguguauuuuuucuuucuauguaauuuuagauucgccuuacaauguaaaucuucacauuggaga

SEQ ID NO: 174838 - RNA, 64 nt, hsa
cugaucucucgugauugauaagaaccuuuugagugccuuacacaaugguuuucuuguguguuua

SEQ ID NO: 174839 - RNA, 64 nt, hsa
guugguguccagguuuguggcacuguuccaagaggccuuacacacacacacaaauauauaauuu

SEQ ID NO: 174840 - RNA, 64 nt, hsa
agcuagaaaauuuuauguaugaaaaacgauaauagccuuacacugaguacaaauaauacuuuaa

SEQ ID NO: 174841 - RNA, 64 nt, hsa
cuucucauaggaaugcuagaggaaagagaacacugccuuacagucaccucauguugcagaccau

SEQ ID NO: 174842 - RNA, 64 nt, hsa
gaaaucuaaggcaaaaccaagugcucuguccuuugccuuacauuuccauauuuaaaacuagaaa

SEQ ID NO: 174843 - RNA, 64 nt, hsa
guuuuugugucaucccuacuuugaacugcuguuagccuuacauucucacuauaguccauaaugc

SEQ ID NO: 174844 - RNA, 64 nt, hsa
uuuuagccauauaucauaaaccaacacaguaauugccuuacaugacuugaaagauauaaacaga

SEQ ID NO: 174845 - RNA, 64 nt, hsa
cugugaauagccuguuuuccacauguaaauuugugccuuacaccuugaguuguguacacuugua

SEQ ID NO: 174846 - RNA, 64 nt, hsa
aguuaauaauuagcuuauucaaugauugcaugaugccuuacaguuuucaauaacuuuuuuucuu

SEQ ID NO: 174847 - RNA, 64 nt, hsa
acccacacuggugguuauuacagcaugguucccagccuuacagugucuaagugcuucucuugug

SEQ ID NO: 174848 - RNA, 64 nt, hsa
gagcauacccaugguggaauccaaacagaucccugccuuacaauuggaacauuuccagaacuua

SEQ ID NO: 174849 - RNA, 64 nt, hsa
uuaauaaggauuuggaucucacaagacaccuuaggccuuacacaaguuguucagauucuuugcc

SEQ ID NO: 174850 - RNA, 64 nt, hsa
uggggaggggggugagaagacaagaugaagaaaagccuuacauuucaguuucuucaucgguugg

SEQ ID NO: 174851 - RNA, 64 nt, hsa
cuucaaacuuccugguuucaugauaucuugagacgccuuacaaaugauggaggauuccaaagag

SEQ ID NO: 174852 - RNA, 64 nt, hsa
cugacauucacgugucagccacuuuggcacggaagccuuacaguguggggaaccaaaacuucgu

SEQ ID NO: 174853 - RNA, 64 nt, hsa
ugaaggauuuaguagauucuguuagauuagggaggccuuacagacugacuuuacuuaaagagga

SEQ ID NO: 174854 - RNA, 64 nt, hsa
gaagcacaugucuuuaaugucuucagacaaaaaagccuuacauuaauuuaauguuugcacucug

SEQ ID NO: 174855 - RNA, 63 nt, hsa
ugcagagucuguuaaaguagauguugcacaccagccuuacagcugggagccuuugccauggua

SEQ ID NO: 174856 - RNA, 64 nt, hsa
gggcacuguacuuggaucuucccggcgugugugugccuuacacaggggugaacuguucacugug

SEQ ID NO: 174857 - RNA, 64 nt, hsa
acagcugucagcccuccucauuccuaaauaacuugccuuacauaucagcccucccacuucugaa

SEQ ID NO: 174858 - RNA, 64 nt, hsa
ccacccccaccguccagccauccaaccucacuucgccuuacaggucuccauuuugugguaaaaa

SEQ ID NO: 174859 - RNA, 64 nt, hsa
aacacuaacagaauaauucuuuauaaauagguaagccuuacacuuguuaaagaaauuuaccucu

SEQ ID NO: 174860 - RNA, 64 nt, hsa
uguguuuggagucagauuucaaugugaaacccaugccuuacauuuacacagcacuuuguaguuu

SEQ ID NO: 174861 - RNA, 64 nt, hsa
aauguaucaagucuuaauuguauuuuaaauugaagccuuacauuuuuaaaacagauuuuguauu

SEQ ID NO: 174862 - RNA, 64 nt, hsa
aaauagcugagaguuucuaaaccaacucucugcugccuuacaaguauuaaauauuuuacuucuu

SEQ ID NO: 174863 - RNA, 64 nt, hsa
uaggaguggaauuuuccauuuucuaauauacuaagccuuacagcuaucuuagaugcgaucugac

SEQ ID NO: 174864 - RNA, 64 nt, hsa
caaaaggggaccaucaacauuguagacacuggaggccuuacagagugcuagccucuuccuucag

SEQ ID NO: 174865 - RNA, 64 nt, hsa
aaaauaauaccuucauuaucaaacugguuaccaugccuuacauaauggaguuaguauuugugag

SEQ ID NO: 174866 - RNA, 64 nt, hsa
uggagaaauagaaccacaaacacagaucacaggggccuuacaaaguuuaugucugaacaaauaa

SEQ ID NO: 174867 - RNA, 64 nt, hsa
agaaguccuuuaucugugcucucugcccgccagugccuuacaauuugcaaacguguauagccuc

SEQ ID NO: 174868 - RNA, 64 nt, hsa
ccugcuggggcaccauucuuaguauacagagguggccuuacacacaucuugcauggauggcagc

SEQ ID NO: 174869 - RNA, 64 nt, hsa
cuuuucaguuacaagacccaucucccuagucucagccuuacaacaccacgggacuaaggaagag

SEQ ID NO: 174870 - RNA, 64 nt, hsa
cuuguuuccacaugucugucucauucuucacugggccuuacagguuaguuuuaauuaacucuau

SEQ ID NO: 174871 - RNA, 64 nt, hsa
auuaacucucuguuccaucauagaauguggccaggccuuacaauggagagccagaguuaaaacu

SEQ ID NO: 174872 - RNA, 64 nt, hsa
ccgauagaacacgcccgcccucacugcuguucuugccuuacagccaccaugggaaagcugcaac

SEQ ID NO: 174873 - RNA, 64 nt, hsa
gagggggugccugcuguggcacagagcugggaaggccuuacagaagaggugacauuucagcugg

SEQ ID NO: 174874 - RNA, 64 nt, hsa
guuauagucugcuuauuuaauuaccacuuugcaagccuuacaagagagcacaaguuggccuaca

SEQ ID NO: 174875 - RNA, 64 nt, hsa
ggcauuuguccccuccaugcuauaauccaguggugccuuacauggugugugugugugugugugc

SEQ ID NO: 174876 - RNA, 64 nt, hsa
uuuauauuuaugugucuguauucuaccccuuuuugccuuacaagugauauuugcagguauuaua

SEQ ID NO: 174877 - RNA, 64 nt, hsa
agguauugccugaaaaacaagugaugucugugcagccuuacacucugucuuuacagaagcaaau

SEQ ID NO: 174878 - RNA, 64 nt, hsa
uguguuuuuauauuucaaggguuuaacccuuugagccuuacaucucauucacugucuuucucca

SEQ ID NO: 174879 - RNA, 64 nt, hsa
acaggguucagcagguuccccaaaaggcugcccagccuuacagcagaugcugaaggcagagcag

SEQ ID NO: 174880 - RNA, 64 nt, hsa
ggcuaccucuugcguucccccuagagauguccaggccuuacauuuaaucggcuuucucugcggu

SEQ ID NO: 174881 - RNA, 64 nt, hsa
aguaguugucaccagggccucauuuuguaguugagccuuacaaugcuuaguaguucaucuucuu

SEQ ID NO: 174882 - RNA, 64 nt, hsa
cacugguuugcugacuuacugaggauuaauuguugccuuacaauguuacugaaauaaacuguuu

SEQ ID NO: 174883 - RNA, 64 nt, hsa
ccuugcacucugggaguggggcaggguaaggugggccuuacagacaggcugagguuuggguggu

SEQ ID NO: 174884 - RNA, 64 nt, hsa
ugaugguuggguguuuuuccuuuaaauucucucagccuuacacucacagaagccaacuuuccac

SEQ ID NO: 174885 - RNA, 64 nt, hsa
gcuuuggcacucccagcuuugugacuuugggugagccuuacagccccugaguccuacacccaga

SEQ ID NO: 174886 - RNA, 64 nt, hsa
cuggcugacuaaauuuggggacagauucagucuugccuuacacaaaggggaucauaaaguuaga

SEQ ID NO: 174887 - RNA, 64 nt, hsa
gcuuuggggggugugcugacaacuuagcucaggugccuuacaucuuuucuaaucacaguguugc

SEQ ID NO: 174888 - RNA, 64 nt, hsa
guggaaauggacaaguuuaggcacucugcuuuuugccuuacacuaaugcuuagaaagcugucuu

SEQ ID NO: 174889 - RNA, 64 nt, hsa
ugaauuuuaacauugguuauuuauuuguguaauggccuuacauguggauauuaacaguguaaac

SEQ ID NO: 174890 - RNA, 64 nt, hsa
uccuuuacaucaugagagaucaaaaauccauuuugccuuacauaugcuaagaagcguggcauuc

SEQ ID NO: 174891 - RNA, 64 nt, hsa
uaagcuagaaugggcugugugauaggaaacaaaugccuuacagaugugccuagguguucuguuu

SEQ ID NO: 174892 - RNA, 64 nt, hsa
ucggcauauuuccucugggcuucuucuaguuucugccuuacaagcaaugcuguucuguaaauuu

SEQ ID NO: 174893 - RNA, 64 nt, hsa
uaacccacuaaguaaccucuacaggcauuuaacugccuuacagacagaauauacauauguuaau

SEQ ID NO: 174894 - RNA, 64 nt, hsa
uccuuucuggccucuggcuagucaguuuuucauagccuuacaguaucuggcuuuguacugagaa

SEQ ID NO: 174895 - RNA, 64 nt, hsa
caguuggaggccaggguaccacaugucacaggcggccuuacaugugugccgugaaaagguucaa

SEQ ID NO: 174896 - RNA, 64 nt, hsa
gcggccucgcuguuaccagaagacguuuuucucugccuuacacuucucacugccucucuggaca

SEQ ID NO: 174897 - RNA, 64 nt, hsa
gaaaaaagauguaaaaaccauucuuaguuugugggccuuacaaaucaggccacuggcccauugc

SEQ ID NO: 174898 - RNA, 63 nt, hsa
aagagaagaauggacucugaggacugagaaggggccuuacagaacccuaaagggagggaaggu

SEQ ID NO: 174899 - RNA, 64 nt, hsa
gagggaggcugcagggggggaggugggcagaggggccuuacagcagcagaggcuggaagagaag

SEQ ID NO: 174900 - RNA, 64 nt, hsa
ucauucaacugccuccaucuguggggcagcugcugccuuacagcccuuccuacugcugagcauc

SEQ ID NO: 174901 - RNA, 64 nt, hsa
ugaggucuugaguuuuuauaauguucuucugaaagccuuacauuuauaacaucauaguguguaa

SEQ ID NO: 174902 - RNA, 64 nt, hsa
aggaggggaagggaggaaugggccaccauauuuggccuuacaggaauuaaggagacuuccugua

SEQ ID NO: 174903 - RNA, 64 nt, hsa
gcgauggaguguggcugggcugaccgcaaaaggugccuuacacacugcccccacccucagccgu

SEQ ID NO: 174904 - RNA, 64 nt, hsa
uuuuuuccugucuugggagauagaauaaugaugugccuuacaauggauuguguuuuagauucac

SEQ ID NO: 174905 - RNA, 64 nt, hsa
uggaguacaauuucuuuuaauccagauuacaccugccuuacaaagcacccccuccuuguucccc

SEQ ID NO: 174906 - RNA, 64 nt, hsa
ugcagucgcugcaaccuacccucucucugccucagccuuacacccaagcaguaggucugugcuc

SEQ ID NO: 174907 - RNA, 64 nt, hsa
cuuucuuuguguguuccugauggaauucaccauagccuuacagcuuuucucagaagguaacuug

SEQ ID NO: 174908 - RNA, 64 nt, hsa
uauaguuacuuaaucaaagauuuuuuucaaaccugccuuacauauaggcccacuuuaaaagcac

SEQ ID NO: 174909 - RNA, 64 nt, hsa
caaccucuugggcccaagugauacucccaccucugccuuacaaaauacagggauuacuggugug

SEQ ID NO: 174910 - RNA, 64 nt, hsa
ggcccacaaaaauaacuauuauuuuagccuuagagccuuacacuuguuucaugaagagaaagga

SEQ ID NO: 174911 - RNA, 64 nt, hsa
gcccuugagguccagcuguggggcccaaaugacagccuuacaaggguucuaccagagaggaaaa

SEQ ID NO: 174912 - RNA, 64 nt, hsa
aaaugccaagggggagagagacacaauauccgcagccuuacaccuuaacuagcugcugcauuau

SEQ ID NO: 174913 - RNA, 64 nt, hsa
uuguuuuguuugguuuuacauuuuaguuacugaagccuuacaagguuauguagagagauaccau

SEQ ID NO: 174914 - RNA, 64 nt, hsa
aacggacgaagagccugccguguguuaaucauuugccuuacaagauguaccagacgguuuccag

SEQ ID NO: 174915 - RNA, 64 nt, hsa
ugguuucuucauucuuuacugcacucagauuuaagccuuacaaagggaaagccucuggccguca

SEQ ID NO: 174916 - RNA, 64 nt, hsa
uuagccagaguuagguugucuccaggccaugauggccuuacacugaaaaugucacauucuauuu

SEQ ID NO: 174917 - RNA, 64 nt, hsa
aggggagugauuuaagcaauggugucuggaguaagccuuacaauuuuaauagacuuuuucuuau

SEQ ID NO: 174918 - RNA, 64 nt, hsa
guauuaucuuugaaugaaauuccugggcugaucugccuuacauaaucacauaagguccuuugcu

SEQ ID NO: 174919 - RNA, 64 nt, hsa
guuucaguguuguauauauaaauaugcaagaugugccuuacaaugaaguuguuggaagcuauuu

SEQ ID NO: 174920 - RNA, 64 nt, hsa
gugaaucaaucaguauguuuuuagauuguauuuugccuuacagaaagccuuuauuguaagacuc

SEQ ID NO: 174921 - RNA, 64 nt, hsa
gacggaacacagcuauuucccuaugcaagguacagccuuacaaagauuucugcagugauuugug

SEQ ID NO: 174922 - RNA, 64 nt, hsa
cgaugccauugauucugccagcggcuccuaaaccgccuuacagcugaguuagaagaugaggaga

SEQ ID NO: 174923 - RNA, 64 nt, hsa
gcucucuuggguccguccccuuuucccagguacugccuuacaaagcuguggccaggaaguggcc

SEQ ID NO: 174924 - RNA, 64 nt, hsa
caauggcaugacggugaccuguugacguaacuaagccuuacagcaaggcaugugccgcacgugc

SEQ ID NO: 174925 - RNA, 64 nt, hsa
cccaucagagaggagcauuucaaucugcuuuccugccuuacaucaaggugggcaagggauuaua

SEQ ID NO: 174926 - RNA, 64 nt, hsa
gcaaccaauuauauacucaauaugguuuuacugugccuuacacaaagagaaacucuauacagaa

SEQ ID NO: 174927 - RNA, 64 nt, hsa
ugccaagcaccccuuuuaucccauccccgagcaggccuuacagaccacacugcaggaagucaaa

SEQ ID NO: 174928 - RNA, 64 nt, hsa
aaauacaaagggaaaacaaaaagcuacaaaaguagccuuacaaaaaaaaaaaaauuguuuagug

SEQ ID NO: 174929 - RNA, 64 nt, hsa
agagagcucaucucauuuuuacuuuugaacguuggccuuacaaucaaauguaaguuauauauau

SEQ ID NO: 174930 - RNA, 64 nt, hsa
cauaucagacgccuugguucuguuuguacacuuagccuuacauuucaggaggaggcuuuucauu

SEQ ID NO: 174931 - RNA, 64 nt, hsa
acacugugcagacccagucccacacuguggccaggccuuacaucuggcuggaaagcagagccuc

SEQ ID NO: 174932 - RNA, 64 nt, hsa
auugcuaccugauuuguugaagauuuuuccucuugccuuacacauggagguuccaggaaaccuc

SEQ ID NO: 174933 - RNA, 64 nt, hsa
ccccucucuucuccuugucccaccacauggacaugccuuacacuggcguccucuccugaguccc

SEQ ID NO: 174934 - RNA, 64 nt, hsa
acguuauccaauugcaggucaacuuauaguuguagccuuacaacuuacaggcaucagaaaauaa

SEQ ID NO: 174935 - RNA, 64 nt, hsa
ccacuuccagcuuuugaucuuggggccagaggccgccuuacacacaccccagguguccaugggg

SEQ ID NO: 174936 - RNA, 64 nt, hsa
ccuuucucuuuuuccagccaguuuccauucacuugccuuacagccugcccuggccgucacuccc

SEQ ID NO: 174937 - RNA, 64 nt, hsa
ccacauccuuagagccaucaccuggcacgcaggcgccuuacauucuacgguagaacguggggua

SEQ ID NO: 174938 - RNA, 64 nt, hsa
uuaagaauguggcauaaccuuuaacuauuuucaagccuuacacaauagcagagaauauaaacug

SEQ ID NO: 174939 - RNA, 64 nt, hsa
uccgucucuucccgucccugaugacaaagaucuugccuuacagacuuuacaggcuuggcuuuga

SEQ ID NO: 174940 - RNA, 64 nt, hsa
gugcuuuccuucagacggugcagggccugggccagccuuacaggucaguagacuagacucgacu

SEQ ID NO: 174941 - RNA, 64 nt, hsa
ucucuaaaggacugguuaaaucaauucugauacagccuuacaauacaauaguaugcagcuaaaa

SEQ ID NO: 174942 - RNA, 64 nt, hsa
cugggggcaccuuaagauuuugcaccuguaaagugccuuacaggguaacugugcugaaugcuuu

SEQ ID NO: 174943 - RNA, 64 nt, hsa
aaacaucuggugccaagaucuacauuucaacccugccuuacacccagagcguccagaucugcca

SEQ ID NO: 174944 - RNA, 64 nt, hsa
uccgguccugagagcuugcaucgguuucuucagugccuuacagggaaauagccuggggugucug

SEQ ID NO: 174945 - RNA, 64 nt, hsa
gcagccggagggcuuucccacacucaagagaggggccuuacagucccucugacaccccuccccc

SEQ ID NO: 174946 - RNA, 64 nt, hsa
gcucugcucaggccccuucagcuacugccacuucgccuuacaucccugcugacugcccagagac

SEQ ID NO: 174947 - RNA, 64 nt, hsa
aauauucaguuccaaaacaagauaucuucuguccgccuuacauauagcagugacacuuguugcc

SEQ ID NO: 174948 - RNA, 64 nt, hsa
gaagacagagcuaauggauaaauaucauaacauggccuuacaugucugcugucaucagcccugu

SEQ ID NO: 174949 - RNA, 64 nt, hsa
cuuagaaauguacauaauguuuauauacacuuaugccuuacauuaaaguccaauaugagaaaua

SEQ ID NO: 174950 - RNA, 64 nt, hsa
auuucauguuuccaauguaccugauuuuucaugagccuuacagacacacagagacacauacaca

SEQ ID NO: 174951 - RNA, 64 nt, hsa
uuuucaucuucuaguuugucuauuuuaauaaauggccuuacauuaaaaaauuguaaagaaaugu

SEQ ID NO: 174952 - RNA, 64 nt, hsa
gaacguuuccugggcugucacguacacuccugcugccuuacacagugcauuuuagaaucuucca

SEQ ID NO: 174953 - RNA, 64 nt, hsa
gggcgugucgccgccucuggcaucgccuccgguugccuuacaccacgccuucaccugcagucgc

SEQ ID NO: 174954 - RNA, 64 nt, hsa
ugucacuagcggaggucacuuuggagaagggugggccuuacauccagugugggugguguccuca

SEQ ID NO: 174955 - RNA, 64 nt, hsa
guugaaacugggaaccuguuggcuaaccauuggggccuuacacuguuuuucaaaugguugcaac

SEQ ID NO: 174956 - RNA, 64 nt, hsa
caaagaauuauauuaaagauucacccaguuuagagccuuacacuguaccugagaauaaucgagg

SEQ ID NO: 174957 - RNA, 64 nt, hsa
ggaggacuugggggcagagcagcacaaagaaacagccuuacacugggcacauggaggagacguc

SEQ ID NO: 174958 - RNA, 64 nt, hsa
cugauuucauuuuggaauucauuugccauccacagccuuacacuaggcacacacuuuagagucu

SEQ ID NO: 174959 - RNA, 64 nt, hsa
accggacuucuguucaagcuuuuuaaagugcugagccuuacaaaccccugaaggaaagugaccc

SEQ ID NO: 174960 - RNA, 64 nt, hsa
aauauuauuucuuuggacucaagcugaaauacaagccuuacauugccuuaugcuuuauuucuuu

SEQ ID NO: 174961 - RNA, 64 nt, hsa
uggaaaaagaaguuacuguucaacuuaccaaaaugccuuacacauuccuuacaaauaaaccaac

SEQ ID NO: 174962 - RNA, 64 nt, hsa
aauuaugguuacuuuccuugugaugaaaaacuuggccuuacagggcucuaguuaugguuacuuu

SEQ ID NO: 174963 - RNA, 64 nt, hsa
cugguugguaaguguccuugucaugaaaacacuugccuuacaaggcucuaauuaugauuucccu

SEQ ID NO: 174964 - RNA, 64 nt, hsa
ccgaggaggagcucuaggccgacgcccaccgcaggccuuacagucuucucuggacgcucccuug

SEQ ID NO: 174965 - RNA, 64 nt, hsa
auguguaugucugguaaauagguauuauauuuuggccuuacaauaccguaacaauguuugucau

SEQ ID NO: 174966 - RNA, 64 nt, hsa
aaaaaaaaaaagugaaaacaccaaugugugaaaugccuuacaaugcccacuggagaggcggggc

SEQ ID NO: 174967 - RNA, 64 nt, hsa
uauauggaauacaaaagcuggggaagcagggccugccuuacagguguggcugacucugagccca

SEQ ID NO: 174968 - RNA, 64 nt, hsa
acuuuuccaggugguguuaauaagccauucaagugccuuacacagcuuugaagaaacuaggacu

SEQ ID NO: 174969 - RNA, 64 nt, hsa
gcagauagcuucucucugggaaagguuggaugcugccuuacauccccuucuagcccuccuccca

SEQ ID NO: 174970 - RNA, 64 nt, hsa
uaauuaacugguuccaucaagacugugcacccaggccuuacaguccaaccuuuuucugugucug

SEQ ID NO: 174971 - RNA, 64 nt, hsa
agcguagaaucuguguagacgaagggggcaucuggccuuacaccucguuagggaagagaaacag

SEQ ID NO: 174972 - RNA, 58 nt, hsa
uuaagaacagcagccgcuaagacugcaagccuuacaccucaccaucucccucaugagu

SEQ ID NO: 174973 - RNA, 64 nt, hsa
cuaaucauguuuucgucacaugcugaguaaaagugccuuacaauguaaaaauuguacaguacuu

SEQ ID NO: 174974 - RNA, 64 nt, hsa
aguauaugaugaacaguguaugacucaaacagcugccuuacaauucacucauuccauguggaac

SEQ ID NO: 174975 - RNA, 64 nt, hsa
gucuguuuaacuucugcagugccuucacuacacugccuuacauaaaccaaaucacaauaaaguu

SEQ ID NO: 174976 - RNA, 64 nt, hsa
cccagaggagccuuucucaguguguuucuaaauggccuuacacuugguagaagaaauugaaggg

SEQ ID NO: 174977 - RNA, 64 nt, hsa
uuuuuauagacaaaguaaaaagacagauauuuaagaggcauaaccaaaaaagcaaaacuuguaa

SEQ ID NO: 174978 - RNA, 64 nt, hsa
aaacuccaaacuagaguacguaacauugaaaaaugaggcauaaaaaugcaauaaacuguuacag

SEQ ID NO: 174979 - RNA, 64 nt, hsa
aaaccaaaaacccaaacacccuauguaacuaucggaggcauauacgugguauaaaugacuguag

SEQ ID NO: 174980 - RNA, 64 nt, hsa
aauuagcugaauagaaagaauguggaaguggucugaggcauauagaguauaugccaagaacacu

SEQ ID NO: 174981 - RNA, 64 nt, hsa
gcacacgccuguaauaccagcuacucagguggcugaggcauaagaauugcuugagccugggagg

SEQ ID NO: 174982 - RNA, 64 nt, hsa
ccgcgugccuguaaucccagcuacuugggaggcugaggcauaagaauuguuugagcccgggaga

SEQ ID NO: 174983 - RNA, 64 nt, hsa
gcauauuuucuuuucuuacagucauugccagacagaggcauacaagucuguuugcugcauacac

SEQ ID NO: 174984 - RNA, 64 nt, hsa
uucauuucgucauguaauuguauauuuuuauuuggaggcauauuuucuuuucuuacagucauug

SEQ ID NO: 174985 - RNA, 64 nt, hsa
ugucauaaagccauuucuugguuuguuugggaaagaggcauaugggauuuauacagauucacuu

SEQ ID NO: 174986 - RNA, 55 nt, hsa
ccaagaaauugauugaguaaugaaugaggcauauucuccucccaccuuguaccuc

SEQ ID NO: 174987 - RNA, 64 nt, hsa
uugggaccuuuucugccccugccccuuagcuacugaggcauagggagaggaaguuaauuucaga

SEQ ID NO: 174988 - RNA, 64 nt, hsa
ugaggugugucccuagggcuucaguccuggggcagaggcauaaacagaaccagucacuauggag

SEQ ID NO: 174989 - RNA, 64 nt, hsa
acccuggacuucagucgccuggcccaaccccaugauuauggaacgucucuucaccuuaacccaa

SEQ ID NO: 174990 - RNA, 64 nt, hsa
gggcggugguuauuauaaggaauuggcucacgugauuauggaggcgguuaaaucccaagaucug

SEQ ID NO: 174991 - RNA, 64 nt, hsa
uaguuuaagaagaagucaauaugcuuauuuaaauauuauggauggugggcagaucacuugaggu

SEQ ID NO: 174992 - RNA, 64 nt, hsa
auaaauaaauaaauaaauaaauaaauaaauaaauauuauggauggugaagggaaugguauagaa

SEQ ID NO: 174993 - RNA, 64 nt, hsa
uuucuucaaaucucccacaaguauauacuuuuaaauuauggaguauuuuaagucuacaaaaagg

SEQ ID NO: 174994 - RNA, 64 nt, hsa
guuuuuaauuuuaacaucagaacugaaauaaaaaauuauggauacguguuuugaauugcaaacu

SEQ ID NO: 174995 - RNA, 64 nt, hsa
gaauguaucucagcuugguucuucuugugugcucauuauggaucucucugucuuaggaauugcc

SEQ ID NO: 174996 - RNA, 64 nt, hsa
gaaauguaauuucuaaauacuccaggugugugguauuauggaaagcaaauugccaacuaauggc

SEQ ID NO: 174997 - RNA, 64 nt, hsa
ccauagagagcaaaacuaugaucaaauaguggguauuauggaggagguugugauggugguaagc

SEQ ID NO: 174998 - RNA, 64 nt, hsa
uaauguuucaguucucuaauuaccaauuaguuaaauuauggaaauuggggaaagugguaaaaug

SEQ ID NO: 174999 - RNA, 64 nt, hsa
cagagaaaucuuacagaaaacaggggugggaaucucuuccgauagagucgcuauuucugguuaa

SEQ ID NO: 175000 - RNA, 64 nt, hsa
guuuugcagagaaggcaguguuccucuauucccuucuuccgaauuaaaaauacccccucagagc

SEQ ID NO: 175001 - RNA, 64 nt, hsa
gaaauugugugugcaagaaaacuaggcaauguacucuuccgauguuugugucacacaacacuga

SEQ ID NO: 175002 - RNA, 64 nt, hsa
uucugcacccucugcuuguucccucauauucuguucuuccgacuccugcuaacacacaugcaac

SEQ ID NO: 175003 - RNA, 64 nt, hsa
cucugucggcccugcuuccugccaggacguggccucuuccgauccuuuucucucagacacugga

SEQ ID NO: 175004 - RNA, 64 nt, hsa
gaccaggucuuggagcugagccucucaccuguacucuuccgaaaaauccucuuccucugaggcu

SEQ ID NO: 175005 - RNA, 64 nt, hsa
aucggggaaccacauguugacugugagcaaagugucuuccgauuagcagccucagggaugcccu

SEQ ID NO: 175006 - RNA, 64 nt, hsa
aguuucaugccucugugccuucgcucaugcuguuucuuccgacuggaaugccuuccccugcucc

SEQ ID NO: 175007 - RNA, 64 nt, hsa
uuuggaguuaugcugcguaugaaaggaugagucuucuuccgagaaauaaagcuuguuuguucuc

SEQ ID NO: 175008 - RNA, 64 nt, hsa
uucagcugaagaugccccuccccaggccuuggacucuuccgaagggaugugaggcacugugggg

SEQ ID NO: 175009 - RNA, 64 nt, hsa
aguccugucucccacuucccacucguuccccuccucuuccgagcugcuuugugggcuccaggcc

SEQ ID NO: 175010 - RNA, 64 nt, hsa
agugacacagaggacuccuugcauuuuuugcugcucuuccgagggcugcuggaacccaggagug

SEQ ID NO: 175011 - RNA, 64 nt, hsa
gaacugugcccaagggacucugauuauccaagcaucuuccgaagaguguuguggucaccuuaaa

SEQ ID NO: 175012 - RNA, 64 nt, hsa
guuggacagaggcugggggcagugccagccugauucuuccgaccuaccugccauuuguucccgc

SEQ ID NO: 175013 - RNA, 64 nt, hsa
gaucaugccucaggcaaaggcguggguccaucguucuuccgagaggguuuguguggcgacuaca

SEQ ID NO: 175014 - RNA, 64 nt, hsa
caacuguauacugguguuuaauagagaaugauugucuuccgaguuuuuugguuccuuuuuuaac

SEQ ID NO: 175015 - RNA, 64 nt, hsa
agggugcuucggcgggaggugggggaacaaggggucuuccgagcagcccccagcccuccccucc

SEQ ID NO: 175016 - RNA, 64 nt, hsa
cacaaaggauugucccuaauccuuggcccuggggucuuccgagugagcugguuuaauacucuga

SEQ ID NO: 175017 - RNA, 64 nt, hsa
gauaggacuagcaccauuuuaagucccugucaccucuuccgacucuuucugagugccuucugug

SEQ ID NO: 175018 - RNA, 64 nt, hsa
agagcauucugaguguuuacaggcggaccuguucucuuccgacaagcaauuugaaucuuaacuu

SEQ ID NO: 175019 - RNA, 64 nt, hsa
uccugccucuuugcauauucagcauaacagcuugucuuccgaaaaaggcauuaagggcuagaga

SEQ ID NO: 175020 - RNA, 64 nt, hsa
cuggguuucagugucgucuugccaagucgcuuuaucuuccgaggccaccguuuaacaggagucc

SEQ ID NO: 175021 - RNA, 64 nt, hsa
ugguuugucgugcugggacagucaugggacugcaucuuccgacuuguccacagcagaugaggac

SEQ ID NO: 175022 - RNA, 64 nt, hsa
uaugaaauccuugacuggaccugguggcuacgaaucuuccgauggaugaaucucccacuccagc

SEQ ID NO: 175023 - RNA, 64 nt, hsa
ugcugcauacuuugacaaggaaaaucuauauuugucuuccgaucaacauuuaugaccuaaguca

SEQ ID NO: 175024 - RNA, 64 nt, hsa
aagggaggcgccuggcuguaucccccgcaggcccucuuccgagagccuuccuccucgggcagug

SEQ ID NO: 175025 - RNA, 64 nt, hsa
ccugucugccccucacucugcccuggaaucaacaucuuccgaguccuucuugggggaaauagca

SEQ ID NO: 175026 - RNA, 64 nt, hsa
gcaaauguggcucuagcacuugcaaauuguuuuuucuuccgaauaguucagcagggacaaguua

SEQ ID NO: 175027 - RNA, 64 nt, hsa
gaugaugauugcgcagggagggguacguggcaccucuuccgaauggguuuucuauuugaacaug

SEQ ID NO: 175028 - RNA, 64 nt, hsa
cauggaggaaaagccuucgaaagugucgcucaagucuuccgaccgccaaggcucggacgaggag

SEQ ID NO: 175029 - RNA, 64 nt, hsa
ccaccugguugggguagagcaaaaggauggucacucuuccgaggucucccugaaaugaauguau

SEQ ID NO: 175030 - RNA, 64 nt, hsa
gccugguuaaauaaggcaggguuuauaugcacuuucuuccgaucuguaccugagagguuugugg

SEQ ID NO: 175031 - RNA, 64 nt, hsa
aauccacagugucccauuuuccgacuaggagacaucuuccgagaaacaggcgauaauuuuucag

SEQ ID NO: 175032 - RNA, 64 nt, hsa
aaauuacaauuaaggaaaugagaauaugauccccucuuccgaguugcccacaaacuugcuucuu

SEQ ID NO: 175033 - RNA, 64 nt, hsa
guucuacguaauggagggaagaauuucccagccaucuuccgaagaauacaagaucccguccucc

SEQ ID NO: 175034 - RNA, 64 nt, hsa
agugaagaacugccaagaguuggugaagguugucucuuccgagggccuucugaagacagggcuc

SEQ ID NO: 175035 - RNA, 64 nt, hsa
augcaugauuaagacaauaaaguauuuuuucuagucuuccgagaaacuuuucugaucaguuugc

SEQ ID NO: 175036 - RNA, 64 nt, hsa
ugauaacaacccaaggcaaugauauggcaugucaucuuccgagcccuucuuucuacuuugucaa

SEQ ID NO: 175037 - RNA, 64 nt, hsa
ugauauccucucaaaugcugcuuguuggcuccagucuuccgacaaacuaacaggaacaaaauga

SEQ ID NO: 175038 - RNA, 64 nt, hsa
ugggccuggcacacgccuguauucccacaccaggucuuccgaucaguggugucugugaagggug

SEQ ID NO: 175039 - RNA, 64 nt, hsa
agaagcugcccagaaacugcugccuggcuuuuuuucuuccgagcuugucuuaucucaaaccccu

SEQ ID NO: 175040 - RNA, 64 nt, hsa
ccucuuauucggcccaaggacuugaagcccggcaucuuccgaccugcccugcccccaccccugc

SEQ ID NO: 175041 - RNA, 64 nt, hsa
accugaaguuacacugccagcaguuccccaggccucuuccgagaggcacaugguucuagccugg

SEQ ID NO: 175042 - RNA, 64 nt, hsa
ggcgcccugccgaggcccgauggcuccaucaucuucuuccgagaugaccgcuacuggcgccucg

SEQ ID NO: 175043 - RNA, 64 nt, hsa
cuggccucccacagacucaaaugcucagaccagcucuuccgaaaaccaggccuuaucuccaaga

SEQ ID NO: 175044 - RNA, 64 nt, hsa
ccaaaggccaaccuugggcugggucuauguacguucuuccgaagcacugaugaucaaaauugaa

SEQ ID NO: 175045 - RNA, 64 nt, hsa
ugaaaacaaugauuuuaauauaucucuuucuuuuucuuccgacauuagaaacaaaacaaaaaga

SEQ ID NO: 175046 - RNA, 64 nt, hsa
aagcucaguauucaugauggugggggauggagugucuuccgagguucuugggggaaaaaaaauu

SEQ ID NO: 175047 - RNA, 64 nt, hsa
ugcaaaucauuggagaauccauaaugaagagagaucuuccgaguguaauaaauguggcaaauuu

SEQ ID NO: 175048 - RNA, 64 nt, hsa
cucucucuuccucaaugcacucugcuucuuccguucuuccgaaacauucagcugacuguaucca

SEQ ID NO: 175049 - RNA, 64 nt, hsa
cggggccucaguccacagccaccaggagguggacucuuccgaccuccagugagcuuggaagagg

SEQ ID NO: 175050 - RNA, 64 nt, hsa
uccguuaaacagagaaagagcugcuuggcauucuucuuccgacugguacugaacauauauacuu

SEQ ID NO: 175051 - RNA, 64 nt, hsa
cggaaaugcaagugccgaagguucccgacgugcaucuuccgaaggcaccagaggugaagcugcc

SEQ ID NO: 175052 - RNA, 64 nt, hsa
cuuuagcugguaugcaagauuugcuaagcaauaaucuuccgaccuuccucccagggcugaugug

SEQ ID NO: 175053 - RNA, 64 nt, hsa
gguggacaagcugucuggauggcaggucuaaugcucuuccgaauaaagugcugaacugugagga

SEQ ID NO: 175054 - RNA, 64 nt, hsa
auaagacuauagauaagugguagagguaaucaauucuuccgaaguguuuccuucgugaauaacu

SEQ ID NO: 175055 - RNA, 64 nt, hsa
uguaucacugccuguggaaaucuauccucaucagucauugcauuuuucccugccuauaccugug

SEQ ID NO: 175056 - RNA, 64 nt, hsa
cuguaacaauucaggguuuucccuuguuuuccucucauugcauguuucccuccaauauugguuc

SEQ ID NO: 175057 - RNA, 64 nt, hsa
guggaucugcagugcuucacuggaaauaauuuauucauugcagauacuuuuuagguggcauuuu

SEQ ID NO: 175058 - RNA, 64 nt, hsa
ccagcgcaugcaggacuggucucuaaugcuguggucauugcacagaagggaaaggucucaagga

SEQ ID NO: 175059 - RNA, 64 nt, hsa
caguguaaaccuuuuuaaugcaaauuuauuuuuuucauugcauauuuugcagauuuuauccaca

SEQ ID NO: 175060 - RNA, 64 nt, hsa
ucauuuuuuacugucagaaaagauaccccuuuugucauugcaacuauuuuuuaaauccagaaau

SEQ ID NO: 175061 - RNA, 64 nt, hsa
uguauugauuagccuguauguagcagggcucccuucauugcaucugaggacuuguuuucuuuuu

SEQ ID NO: 175062 - RNA, 64 nt, hsa
gcagcaagucaauuguauuagcagaauauuguccucauugcauguguaguuugagcacagaucc

SEQ ID NO: 175063 - RNA, 64 nt, hsa
ggcaccugauacuucuguugcccuugugcuccagucauugcacaaggcagaaaacagcucuggc

SEQ ID NO: 175064 - RNA, 64 nt, hsa
gaguuugaggcugcagugagccaucaucauggcaucauugcauuccagccugggcaacagagca

SEQ ID NO: 175065 - RNA, 64 nt, hsa
gcgcaaaggucucgaugccuuuugguaacauccgucauugcagaagaaaguuuacacgacguca

SEQ ID NO: 175066 - RNA, 64 nt, hsa
cgcuugugagcgaggcccuccccucugcaccagcucauugcaaagcgaacauccucuccuuucc

SEQ ID NO: 175067 - RNA, 64 nt, hsa
agcagaaggcuuuuuuaacucauccguuugccaaucauugcaaacaacugaaauguggauguga

SEQ ID NO: 175068 - RNA, 64 nt, hsa
ugaacugucaugauacgcuuaagguggaaaguguucauugcacaauauauuuuuacugcuuucu

SEQ ID NO: 175069 - RNA, 64 nt, hsa
ccccuguauauguggaucucgccuacaucccgaaucauugcaguggcaagacugcugaccuuga

SEQ ID NO: 175070 - RNA, 64 nt, hsa
cggagccaccuccaacucuaacaauaaaccaaguucauugcagauaguguagugcugcuuaggc

SEQ ID NO: 175071 - RNA, 64 nt, hsa
ucaauucagaaaauggacugaagucugaauaaggucauugcauuuaaaaagcauauaacuguac

SEQ ID NO: 175072 - RNA, 64 nt, hsa
auuuuuucauaaucuauauuuaaacaaaauuacaucauugcaucaucuuuucuaaauucaucuc

SEQ ID NO: 175073 - RNA, 64 nt, hsa
ggucggaacacuuuaggagugcagggguucugcuucauugcauuuucagaauuaaccugaaagu

SEQ ID NO: 175074 - RNA, 64 nt, hsa
ccaauauuacaacagcauuguuuucaguuauuuuucauugcagauacgaagagaaaauuuucua

SEQ ID NO: 175075 - RNA, 64 nt, hsa
aggcuccuucacuuucucuccaugggauagggguuggggguacucccuagagcugcuaggcuug

SEQ ID NO: 175076 - RNA, 64 nt, hsa
cagcaugacccaagcaaggggccugaggccucaguggggguagggcaaggagguaccucacagg

SEQ ID NO: 175077 - RNA, 64 nt, hsa
auuacagauuaaaaagcacccuuucuuuguacaguggggguaaaagucacagcugcuuaguaca

SEQ ID NO: 175078 - RNA, 64 nt, hsa
auccaugcccaaggcaacaucuuacuaguuccuguggggguacaggacaccuagauuuagcuaa

SEQ ID NO: 175079 - RNA, 64 nt, hsa
guucaguucuguuacacagugcauugcccuuuguuggggguaugcauguaugaacacacaugcu

SEQ ID NO: 175080 - RNA, 64 nt, hsa
ccacuguaggaaaaugauugacuaugcccaucccuggggguaauuuuggcauguauaccuguaa

SEQ ID NO: 175081 - RNA, 64 nt, hsa
ugugcuauguguguuaagccugcaugcauggguguggggguaugugcccucuguguacguaucu

SEQ ID NO: 175082 - RNA, 64 nt, hsa
aaagugaauccagggaacacaggcaaauuauuuguggggguaggaaucucaagaauugcgaaag

SEQ ID NO: 175083 - RNA, 64 nt, hsa
gcagggccaggcuuuggcauaucuguucuaaaucuggggguaaagcaagaaccugaacauuuug

SEQ ID NO: 175084 - RNA, 64 nt, hsa
cuuaacaccucauagaacacacuuugggaaacaguggggguaggaaaacucggccucaaguugc

SEQ ID NO: 175085 - RNA, 64 nt, hsa
uuuugaagcucaggugucucacgucugggcugcaccaggcgaagagagaaauuaaagauuugag

SEQ ID NO: 175086 - RNA, 64 nt, hsa
gagggccgagggucacccgucggccgccgccaccccaggcgaggccggaggaaggaucaucuga

SEQ ID NO: 175087 - RNA, 64 nt, hsa
uagauuagcucuggaccagccuguuggacccgcucuggaccaacccuguuuccugaguuuggga

SEQ ID NO: 175088 - RNA, 64 nt, hsa
ugaaucaaagacauggaauuaccuuagauuagcucuggaccagccuguuggacccgcucuggac

SEQ ID NO: 175089 - RNA, 64 nt, hsa
ucccccgccuuuaguucuccacuggggaggaauccuggaccaagcacaaaaacuuaacaaaagu

SEQ ID NO: 175090 - RNA, 64 nt, hsa
cuccaggagacuuucaugcagccuaaaguacagccuggaccaccccugguguguagcuaguaag

SEQ ID NO: 175091 - RNA, 64 nt, hsa
ugagccccuucccugaggcugucuccugggaaugcuggaccagggggauuacuucccccaccca

SEQ ID NO: 175092 - RNA, 64 nt, hsa
agagagggcaggugcccaccccacaggcccuuuccuggaccauggagccaggugaaaccugucu

SEQ ID NO: 175093 - RNA, 64 nt, hsa
agaauuaaacuggaccaucucucuccauaucaaucuggaccaucucuccucugcuaaauuugca

SEQ ID NO: 175094 - RNA, 64 nt, hsa
ggucuaccaguuacuauggaguaaaagaauuaaacuggaccaucucucuccauaucaaucugga

SEQ ID NO: 175095 - RNA, 64 nt, hsa
uuuaugcaguagaugcuuucuuccuccugcaguucuggaccauguggagcuacauggagaaauu

SEQ ID NO: 175096 - RNA, 64 nt, hsa
ucuuccauccaggagugugcuacugaggggcuggcuggaccaaccugcuggcucaggcauguga

SEQ ID NO: 175097 - RNA, 64 nt, hsa
uucucagccuacauucauuugcaagcuucaaucucuggaccaucugguguucacagguguuaga

SEQ ID NO: 175098 - RNA, 64 nt, hsa
agugguggggcuugguuauccucuuguuuugugacuggaccacugcccaggugcuugaugauga

SEQ ID NO: 175099 - RNA, 64 nt, hsa
cuaugcugaccucacucuugagcagcgcuuucagcuggaccacucaggccuggacagccucauc

SEQ ID NO: 175100 - RNA, 64 nt, hsa
acacaaggugggcagggaggcaccauucaggaaccuggaccaaagcugacgaggcugggccaag

SEQ ID NO: 175101 - RNA, 64 nt, hsa
gcccuucauuagccaaauugaaaaaagaaauucccuggaccagaugcugaaagagaaaagaggg

SEQ ID NO: 175102 - RNA, 64 nt, hsa
ccuccaucucucagggagacaaagaaccuccuuccuggaccaaggaggugcugccaaguuuucu

SEQ ID NO: 175103 - RNA, 64 nt, hsa
guaaggauuuggaauaaggauuugguccuguuuucuggaccaaauccuuacucuggcucugcuu

SEQ ID NO: 175104 - RNA, 64 nt, hsa
cggggagagcgggcgggggagcucgcgccgaggacuggaccaucuguacagaccagcgggagug

SEQ ID NO: 175105 - RNA, 64 nt, hsa
gagugcgcgcgcccgccucgcacagggccggggccuggaccaaaccacaugaacuggacugaga

SEQ ID NO: 175106 - RNA, 64 nt, hsa
agcuuugaggaauguggaaaaucauaauugccgucuggaccauugauugauugugaccaguagc

SEQ ID NO: 175107 - RNA, 64 nt, hsa
cauggagguguccugcuaagcagaugcuccuccccuggaccauugcaaguccauccuucaaaug

SEQ ID NO: 175108 - RNA, 64 nt, hsa; identical to SEQ ID NO: 21144

SEQ ID NO: 175109 - RNA, 64 nt, hsa; identical to SEQ ID NO: 21145

SEQ ID NO: 175110 - RNA, 64 nt, hsa; identical to SEQ ID NO: 21146

SEQ ID NO: 175111 - RNA, 64 nt, hsa; identical to SEQ ID NO: 21147

SEQ ID NO: 175112 - RNA, 64 nt, hsa; identical to SEQ ID NO: 21148

SEQ ID NO: 175113 - RNA, 64 nt, hsa; identical to SEQ ID NO: 21149

SEQ ID NO: 175114 - RNA, 64 nt, hsa
uguggaguuagguggaagccagauuuuaaaaguugccaaccaggagauuuaacagguacaguua

SEQ ID NO: 175115 - RNA, 64 nt, hsa
cagagagagagagagagagagagagugucuucaugccaaccacagccuguuucugcugaguuuc

SEQ ID NO: 175116 - RNA, 64 nt, hsa
cuugcccucuaccuccugauaggcuugaggguuugccaaccacacuguggcuacagguggaggg

SEQ ID NO: 175117 - RNA, 64 nt, hsa
gcaaggagagcccuggggucagugacacugucaggccaaccaugcacuccacaaaggggagcau

SEQ ID NO: 175118 - RNA, 64 nt, hsa
gaggaucagagcccauugcacaagaagagccgcugccaaccauccuuguccuccgauugcaaaa

SEQ ID NO: 175119 - RNA, 64 nt, hsa
ugguugaccucucagcaagugcuauccaggcugggccaaccagacccacaauuaacugagccuc

SEQ ID NO: 175120 - RNA, 64 nt, hsa
caaagugaaaauaagauacacaauaaucauugcucugugugauuacagauaggauuauccaucu

SEQ ID NO: 175121 - RNA, 64 nt, hsa
aaauauuuuuuuaaacauauuugccuacauaauacugugugaauauuuucauuagauuaauuca

SEQ ID NO: 175122 - RNA, 64 nt, hsa
uguaaauauuuauguaaacugcauuagaaauuagcugugugaaauaccagugugguuuguguuu

SEQ ID NO: 175123 - RNA, 64 nt, hsa
cuguauguuagggugcucuggaagagaggaaugccugugugagcaagcauuuauguuuauuuau

SEQ ID NO: 175124 - RNA, 64 nt, hsa
ccggcaccccuugcuuccucccucuguugucugccugugugacacacaucaauggcaauaacuu

SEQ ID NO: 175125 - RNA, 64 nt, hsa
uaucugcuacccugaaucaccuguccuggucuugcugugugaugggaacaugcuuguaaacugc

SEQ ID NO: 175126 - RNA, 64 nt, hsa
guaguguguuggggguggggguccugggcacuggcugugugaagggaucuggcagggcaccaca

SEQ ID NO: 175127 - RNA, 64 nt, hsa
cccuuauagccucaggcugcaguguccuucccagcugugugagaaaaugaaagccgacguccac

SEQ ID NO: 175128 - RNA, 64 nt, hsa
cacucugauuggcagccugcuuugccaaagagaacugugugagguuuuggugguuaguaagaga

SEQ ID NO: 175129 - RNA, 64 nt, hsa
cagagacugcacacccccuugccuguauccucaucugugugacggcaggaagcucugcccagag

SEQ ID NO: 175130 - RNA, 64 nt, hsa
uuucccaaauaaacucuaaacauuaaucaaucaucugugugaaaauggguuggugcuucuaacc

SEQ ID NO: 175131 - RNA, 64 nt, hsa
gaaggauggcaccuaaaccaccagugcccaaagucugugugaugaacuuucucuucauacuuuu

SEQ ID NO: 175132 - RNA, 64 nt, hsa
ucuguucuucuacuucacucuuccuguugaaaaacugugugauuuuuuuuuuuuuuuaaguaaa

SEQ ID NO: 175133 - RNA, 64 nt, hsa
uucgcuggccccgcuguccgcaggggcuuccuaccugugugagaggucguagcgggagacagca

SEQ ID NO: 175134 - RNA, 64 nt, hsa
guacacaugcaugcauacacacccauacaaacaucugugugagggcaguucuggagaugagcag

SEQ ID NO: 175135 - RNA, 64 nt, hsa
guuguaauugucaauuuguuguuauaggucuuaccugugugaaagaaagaaaaagaaagaaaga

SEQ ID NO: 175136 - RNA, 64 nt, hsa
ugugugcuguagugaccagcggcuccuaacgugucugugugaugaccaguuguccuccaaaaac

SEQ ID NO: 175137 - RNA, 64 nt, hsa
caccuaugucugccguggcuccucggguggugcccugugugacaaagcccaacagcaaggguga

SEQ ID NO: 175138 - RNA, 64 nt, hsa
cggcuuuguucucccagcuaaggccguggagcugcugugugacugugucaggccuggacaagga

SEQ ID NO: 175139 - RNA, 64 nt, hsa
caaggugacucuuguacuuggcaagggaaguccacugugugauugucuguauucuuaauauaau

SEQ ID NO: 175140 - RNA, 64 nt, hsa
augcgcagcguaugacuguuggugauaaguguaucugugugagugugugcaacuacuuguguga

SEQ ID NO: 175141 - RNA, 64 nt, hsa
cuuuaccaaaagggucaauggaccuuucuuugcacugugugacuuaaucaacuauaaaagcuua

SEQ ID NO: 175142 - RNA, 64 nt, hsa
cagguaugaaugagccagccaugcuuccuccugccugugugacgcugggcgagucucuuccccu

SEQ ID NO: 175143 - RNA, 64 nt, hsa
gagccacggguccuggguccuagaccaggacuuccugugugacccuggacaaguacuaccuucc

SEQ ID NO: 175144 - RNA, 64 nt, hsa
uauuucucauuugauauaauuuuucucuguuucacugugugaaaaaaagaagauauuucccaua

SEQ ID NO: 175145 - RNA, 64 nt, hsa
uucuguaauguccccuucuuucuaggcucuguugcugugugaauccauuagauuuacaguaucg

SEQ ID NO: 175146 - RNA, 64 nt, hsa
agucaugguuuggaagcaccauacagggagacagcugugugaauacaggcuguauggacacuug

SEQ ID NO: 175147 - RNA, 64 nt, hsa
uguaauaauaaucaugaccacaaaccauaaaggacugugugauguaucaguaagagggugcuca

SEQ ID NO: 175148 - RNA, 64 nt, hsa
auaccuguuuuccacugcuaaaacugaagcaccacugugugagcaacaggaagggagagcgcac

SEQ ID NO: 175149 - RNA, 64 nt, hsa
ggguaaggaaacaaguuacagaaauuaccgcguucugugugaagggacugagggugugguguca

SEQ ID NO: 175150 - RNA, 64 nt, hsa
gaggagcaucauuccuuccuuacccccuuucuagcugugugauguagaccaaagucguugcccc

SEQ ID NO: 175151 - RNA, 64 nt, hsa
gaaccagucggaacuggguuccaguccagcugugcugugugagccugugcaagugacaugaccu

SEQ ID NO: 175152 - RNA, 64 nt, hsa
aaacccucacggcuaagggcucugggaguugugucugugugaccugagagugauccaucuccug

SEQ ID NO: 175153 - RNA, 64 nt, hsa
ugucugugugaccugagagugauccaucuccugccugugugagguagcagugggcacuuuucau

SEQ ID NO: 175154 - RNA, 64 nt, hsa
ugucaaucauuuaagauuaaugggcaugcaauuaagucuccauuuaagauuaaugggcaugcaa

SEQ ID NO: 175155 - RNA, 64 nt, hsa
aagucuccauuuaagauuaaugggcaugcaaugaagucuccagcagacaaucagauguuguugg

SEQ ID NO: 175156 - RNA, 64 nt, hsa
gcccagggucgugcacucucugggauaccaguucagucuccacauuucugguuuucugucccca

SEQ ID NO: 175157 - RNA, 64 nt, hsa
ucuuggccccauccauggacucuugccucggugcagucuccacucuugacccccaccuccuacu

SEQ ID NO: 175158 - RNA, 64 nt, hsa
ugguucucuagggacuugaaggcgccaacagaguagucuccauggugggccugucccagcccug

SEQ ID NO: 175159 - RNA, 64 nt, hsa
uggcggcugggcuggugcagggagugugcugguuagucuccagacccucacagcagccacgccc

SEQ ID NO: 175160 - RNA, 64 nt, hsa
cauccagcaugagcagaugucggggagacugggaagucuccagcguuacugcucuccuucccuu

SEQ ID NO: 175161 - RNA, 64 nt, hsa
guuucuagaaaaggcagacacugguugggaccaaagucuccauggcacaugacugaagacuggu

SEQ ID NO: 175162 - RNA, 64 nt, hsa; identical to SEQ ID NO: 172974

SEQ ID NO: 175163 - RNA, 64 nt, hsa; identical to SEQ ID NO: 172975

SEQ ID NO: 175164 - RNA, 64 nt, hsa; identical to SEQ ID NO: 172976

SEQ ID NO: 175165 - RNA, 64 nt, hsa; identical to SEQ ID NO: 172977

SEQ ID NO: 175166 - RNA, 64 nt, hsa; identical to SEQ ID NO: 172978

SEQ ID NO: 175167 - RNA, 64 nt, hsa; identical to SEQ ID NO: 172979

SEQ ID NO: 175168 - RNA, 64 nt, hsa; identical to SEQ ID NO: 172980

SEQ ID NO: 175169 - RNA, 64 nt, hsa; identical to SEQ ID NO: 172981

SEQ ID NO: 175170 - RNA, 64 nt, hsa; identical to SEQ ID NO: 172982

SEQ ID NO: 175171 - RNA, 64 nt, hsa; identical to SEQ ID NO: 172983

SEQ ID NO: 175172 - RNA, 64 nt, hsa; identical to SEQ ID NO: 172984

SEQ ID NO: 175173 - RNA, 64 nt, hsa; identical to SEQ ID NO: 172985

SEQ ID NO: 175174 - RNA, 64 nt, hsa; identical to SEQ ID NO: 172986

SEQ ID NO: 175175 - RNA, 64 nt, hsa; identical to SEQ ID NO: 172987

SEQ ID NO: 175176 - RNA, 64 nt, hsa; identical to SEQ ID NO: 172988

SEQ ID NO: 175177 - RNA, 54 nt, hsa; identical to SEQ ID NO: 172989

SEQ ID NO: 175178 - RNA, 64 nt, hsa; identical to SEQ ID NO: 172990

SEQ ID NO: 175179 - RNA, 64 nt, hsa; identical to SEQ ID NO: 172991

SEQ ID NO: 175180 - RNA, 64 nt, hsa; identical to SEQ ID NO: 172992

SEQ ID NO: 175181 - RNA, 64 nt, hsa; identical to SEQ ID NO: 172993

SEQ ID NO: 175182 - RNA, 64 nt, hsa; identical to SEQ ID NO: 172994

SEQ ID NO: 175183 - RNA, 64 nt, hsa; identical to SEQ ID NO: 172995

SEQ ID NO: 175184 - RNA, 64 nt, hsa; identical to SEQ ID NO: 172996

SEQ ID NO: 175185 - RNA, 64 nt, hsa; identical to SEQ ID NO: 172997

SEQ ID NO: 175186 - RNA, 64 nt, hsa; identical to SEQ ID NO: 172998

SEQ ID NO: 175187 - RNA, 64 nt, hsa; identical to SEQ ID NO: 172999

SEQ ID NO: 175188 - RNA, 64 nt, hsa; identical to SEQ ID NO: 173000

SEQ ID NO: 175189 - RNA, 64 nt, hsa; identical to SEQ ID NO: 173001

SEQ ID NO: 175190 - RNA, 64 nt, hsa; identical to SEQ ID NO: 173002

SEQ ID NO: 175191 - RNA, 64 nt, hsa; identical to SEQ ID NO: 173003

SEQ ID NO: 175192 - RNA, 64 nt, hsa; identical to SEQ ID NO: 173004

SEQ ID NO: 175193 - RNA, 61 nt, hsa; identical to SEQ ID NO: 173005

SEQ ID NO: 175194 - RNA, 64 nt, hsa; identical to SEQ ID NO: 173006

SEQ ID NO: 175195 - RNA, 64 nt, hsa; identical to SEQ ID NO: 173007

SEQ ID NO: 175196 - RNA, 64 nt, hsa; identical to SEQ ID NO: 173008

SEQ ID NO: 175197 - RNA, 64 nt, hsa; identical to SEQ ID NO: 173009

SEQ ID NO: 175198 - RNA, 64 nt, hsa
acaugcuggccgaagauuucauccagaagucaacauccugcaauuauguugaaaagaguaguac

SEQ ID NO: 175199 - RNA, 64 nt, hsa
uuuucaggugcucaaaaugcaaaacacaaaacaaauccugcauuuagauacaccucaacuaaau

SEQ ID NO: 175200 - RNA, 64 nt, hsa
cagcaauaggguggcacagaagcucaucucagucauccugcaggcacaugagggggugcccucc

SEQ ID NO: 175201 - RNA, 64 nt, hsa
caucuccuucaccccuauggugcucagcccugagauccugcacaagguggaguguacuggcuac

SEQ ID NO: 175202 - RNA, 64 nt, hsa
ccugcagcgggaggaggaggagcaccuccgccagauccugcagaaguacuccuauugccgccag

SEQ ID NO: 175203 - RNA, 64 nt, hsa
cuucagcaugccugaacuacauaacuuccuacguauccugcagcgggaggaggaggagcaccuc

SEQ ID NO: 175204 - RNA, 64 nt, hsa
ggcuuccagcuccuaaaacaccuggacauuccccauccugcaccggcacuguguuuguucagag

SEQ ID NO: 175205 - RNA, 64 nt, hsa
cggcccgggugguccaugccugcggggugucuguauccugcaggaggacgccccuacagaccca

SEQ ID NO: 175206 - RNA, 64 nt, hsa
gcagcuccccuccuggaauagaaucuuucuuuccauccugcauggcugagagccaggcuuccuu

SEQ ID NO: 175207 - RNA, 64 nt, hsa
gcaggaggaaagucacugaugcccagauguuugcauccugcacagcuauagguccuuaaauaaa

SEQ ID NO: 175208 - RNA, 64 nt, hsa
ccauaugcccagugccagcuagggcccaccgcccauccugcacacggggccgcugggcaggugc

SEQ ID NO: 175209 - RNA, 64 nt, hsa
gcuuaaacaccauuuauaccacagguccagaugaauccugcagggccaaggucugggggugcug

SEQ ID NO: 175210 - RNA, 64 nt, hsa
aucgaguggguggagaccagagaagccgcucaacauccugcaaugcaugggacaggcccugccu

SEQ ID NO: 175211 - RNA, 64 nt, hsa
cugccccagcgcggcuuccucugaagaugcagugauccugcaucuuuuugucucgcggagcccc

SEQ ID NO: 175212 - RNA, 64 nt, hsa
gacaaccagaggcugaaagaugaaaauggugcccucaucagagucaucagcaaacuguccaagu

SEQ ID NO: 175213 - RNA, 64 nt, hsa
gggugccaagagaaacagcaggauguugaauugaucaucagaugcccucuggaaugguuagcau

SEQ ID NO: 175214 - RNA, 64 nt, hsa
aaacgaacuccgaugugcgcccauuguaaccaggucaucagaggaccauucuuaguggcacugg

SEQ ID NO: 175215 - RNA, 64 nt, hsa
cuuauaaaguuaucuuacauuaaggaugucauuuucaucagaccuucuuucuacauauuauuca

SEQ ID NO: 175216 - RNA, 64 nt, hsa
gauauucuauugauuuaaugugaccuguuuggucucaucagaagucuuaccauugggcauuuga

SEQ ID NO: 175217 - RNA, 64 nt, hsa
caauaaagccaucuccuugugggccuuaccaucuucaucagauuuagacccuuaaaaaacaagu

SEQ ID NO: 175218 - RNA, 64 nt, hsa
ucaaaugagcaaaacuaaggaugaaauguaauauucaucagaacaaggaucacugagaaaaaau

SEQ ID NO: 175219 - RNA, 64 nt, hsa
uauauauaaacucuauauccuaauuuacuaauacucaucagaugucagccuuugcucuccauuu

SEQ ID NO: 175220 - RNA, 64 nt, hsa
uuaaaauuuaaaguauaauuaguuuuuauaauuuucaucagauuuuuguuauauuuuuuggaag

SEQ ID NO: 175221 - RNA, 64 nt, hsa
ccgauuugcaugugugaaagccuuaaaccaaaacucaucagagaauacaugcuugagagugauu

SEQ ID NO: 175222 - RNA, 64 nt, hsa
uuaaauauaaugaauaugagaaaacucuuaguucucaucagauacuaaguuuuaagaauaaacu

SEQ ID NO: 175223 - RNA, 64 nt, hsa
ccaggagaauuaucucagaacagaagucaucagaucaucagagcccccagauggcuacagacca

SEQ ID NO: 175224 - RNA, 64 nt, hsa
cuaucuggccaggagaauuaucucagaacagaagucaucagaucaucagagcccccagauggcu

SEQ ID NO: 175225 - RNA, 64 nt, hsa
ucuaaaucauuuuuaagggaaugaaacaggaaugucaucagagauuuuuuaguacaggcccaag

SEQ ID NO: 175226 - RNA, 64 nt, hsa
uaccuaaaagcccuuucuuccucuagucgccagcucaucagaaaaacauacuuugaaaagaugc

SEQ ID NO: 175227 - RNA, 64 nt, hsa
uuuguugacugucagguuaggugucccuuagucgucaucagaagcugaagccuuccuuuccaca

SEQ ID NO: 175228 - RNA, 64 nt, hsa
gucaucagaagcugaagccuuccuuuccacacccucaucagauucaucuccacugauaaccggu

SEQ ID NO: 175229 - RNA, 64 nt, hsa
ugauaguuucuaaaacauuuagagcaauaaauauucaucagagguaccaaguaagccggcagaa

SEQ ID NO: 175230 - RNA, 64 nt, hsa
uucauaaaaccucaagagcauuuuuaagcccuuuucaucagacccagugaaaacuaaggauaga

SEQ ID NO: 175231 - RNA, 64 nt, hsa
gcuauauguuuauguauauaaucuuauucuguagucaucagaauguuaauguaagguacauuug

SEQ ID NO: 175232 - RNA, 64 nt, hsa
uuacgagcagaauaaggguaacugcauguaacaaucaucagauaguacucuuuccccugccguc

SEQ ID NO: 175233 - RNA, 64 nt, hsa
ccauuucccaaacacuccgcuccauggucuccagucaucagagcaacucuaccugguauuauca

SEQ ID NO: 175234 - RNA, 64 nt, hsa
gugcuggccaggugacuccuaguucuuggccacaucaucagaaagucaaaggucucacuccagg

SEQ ID NO: 175235 - RNA, 64 nt, hsa
ccaaacaaauucuuuuccacagcuuaagaguaccucaucagaauacagugguucaaguuaaaaa

SEQ ID NO: 175236 - RNA, 64 nt, hsa
aucuuacaaccgacugaagggguguugcaccuaaucaucagaggugcaguugggugcuuaaccu

SEQ ID NO: 175237 - RNA, 64 nt, hsa
cacaagcugagccuccacguucagcagauacuguccaaggcagggguacggcugaccaggaaug

SEQ ID NO: 175238 - RNA, 64 nt, hsa
uggcucacaccuguaaucccagcacuuugggaggccaaggcaggcaaucaccugaggucaggag

SEQ ID NO: 175239 - RNA, 64 nt, hsa
cuccaggauccagauccauggggacauuaauaguccaaggcauucccucccccaccacuauuca

SEQ ID NO: 175240 - RNA, 64 nt, hsa
acccugcaguuugagaucugaugcuuccugagggccaaggcauugcuguaagaaaaggucuaga

SEQ ID NO: 175241 - RNA, 64 nt, hsa
auggcguaaugggccugcccaaugcuuugggaggccaaggcagguagaucgcuugagcccagga

SEQ ID NO: 175242 - RNA, 64 nt, hsa
gaggagagugguuguugccaacuaagcccucgaaccaaggcagccuccagagccagccugggac

SEQ ID NO: 175243 - RNA, 64 nt, hsa
ugacucaugccuguaaucccaguacucugggaagccaaggcaggcagaucacuugaggucagga

SEQ ID NO: 175244 - RNA, 64 nt, hsa
ccuuguuacugcuacuacacuuugcuccucuggcccaaggcaugaggagagaggcugugucaga

SEQ ID NO: 175245 - RNA, 64 nt, hsa
agaacaggcagcuguugagcucggggugucuuccccaaggcauguggcucagcagcaagaaagg

SEQ ID NO: 175246 - RNA, 64 nt, hsa
uggaagaacuuguuugcuugaaaguaucucagacccaaggcaccucaggucucuuugcugugcc

SEQ ID NO: 175247 - RNA, 64 nt, hsa
agcucuggcuuucguguuuuugguuuucuccuucccaaggcagcuggauugaaaaaacaaaaca

SEQ ID NO: 175248 - RNA, 64 nt, hsa
uuuuccugaggucaucuguaaaauagucucauugccaaggcauccccagugccagcuggugaau

SEQ ID NO: 175249 - RNA, 64 nt, hsa
caggcguucaaggcuacagagagccaugauuaaaccaaggcacuccagccugggugacagagug

SEQ ID NO: 175250 - RNA, 64 nt, hsa
ugguucauaucuguaauccuaacacuuugacaggccaaggcaggggaauugcuugaguucagaa

SEQ ID NO: 175251 - RNA, 64 nt, hsa
gaaaugguugcugagaaacuugucuguucaugucccaaggcauaacuucccaacauuuaagaaa

SEQ ID NO: 175252 - RNA, 64 nt, hsa
cuugaggcacagcagccacugcucguuguaaaugccaaggcauuuggcuuugggacgugacaac

SEQ ID NO: 175253 - RNA, 64 nt, hsa
aagguacauggaugugcuuuggucaaggaauaggccaaggcagagauccaugccugcaugacuc

SEQ ID NO: 175254 - RNA, 64 nt, hsa
cacagcuguguguggaagccacgggcucaagcagccaaggcagggcggacagugugagagagcu

SEQ ID NO: 175255 - RNA, 64 nt, hsa
accauggcaacccuugcauuccacccugaguuugccaaggcacacaaaaauagggaacauuuuc

SEQ ID NO: 175256 - RNA, 64 nt, hsa
ccuggcuuccuuccuccacccaguggagacccccccaaggcaugaggggaaagccauuaagugg

SEQ ID NO: 175257 - RNA, 64 nt, hsa
gugcuuugaguuggacgggaaugggacucugcagccaaggcaggauaagaaaaucuugcaaucc

SEQ ID NO: 175258 - RNA, 64 nt, hsa
ggcugcuguguggaugcuuuuccuggagcacuuuccaaggcaucccccagccccaagccugcgc

SEQ ID NO: 175259 - RNA, 64 nt, hsa
agguucauaaacuacaauauuuggauuuuuuuccccaaggcacaaaauguauaauggagaccaa

SEQ ID NO: 175260 - RNA, 64 nt, hsa
uagcucacgccuguaaucccagcacuuugggaagccaaggcaggaggauuaccugaggccagga

SEQ ID NO: 175261 - RNA, 64 nt, hsa
guggcucaugcauguaauucuagcacuuuggaggccaaggcaggaggacugcuugagcccagga

SEQ ID NO: 175262 - RNA, 64 nt, hsa
uagcuuaugccuguaaucucagcacuuugggaggccaaggcaggcagaucaugaggucaagaga

SEQ ID NO: 175263 - RNA, 64 nt, hsa
gugaggcgugcuagaccugagcaguucuacccucccaaggcaccaguacucuaccauggggcau

SEQ ID NO: 175264 - RNA, 64 nt, hsa
acucuguacuucucuaucugcacacacaaaaugcccaaggcacucacuggggaggaagcaagga

SEQ ID NO: 175265 - RNA, 64 nt, hsa
uaguucaaugccucacgagauuugccaggggcauccaaggcaaacaaucccaaucuuucuauau

SEQ ID NO: 175266 - RNA, 64 nt, hsa
guagcucaugccuguaacccuggcacuuaaggggccaaggcaggaggaucacuugaggccagug

SEQ ID NO: 175267 - RNA, 64 nt, hsa
gugguagaauuuguaugcucuuagagcccaacagccaaggcagggucaagaagauaaguaauaa

SEQ ID NO: 175268 - RNA, 64 nt, hsa
gcugggauuacgggcgugagccaccgugcucggcccaaggcaggagaaucucuugaagccagga

SEQ ID NO: 175269 - RNA, 64 nt, hsa
uggcucacgccuguaaucucagcacuuugggaggccaaggcaggugggucaccuggggucagga

SEQ ID NO: 175270 - RNA, 64 nt, hsa
agaggauaacuugaaacuaggaguucaagaccagccaaggcaacauagugaggccccaucuuua

SEQ ID NO: 175271 - RNA, 64 nt, hsa
uggaucacgccuguaaucccagcacauugggaggccaaggcacauaggucacuugaggucaaga

SEQ ID NO: 175272 - RNA, 64 nt, hsa
ucaagcgauuccucugccucagcacuuugggaggccaaggcaggcagauaacaaagucaggaga

SEQ ID NO: 175273 - RNA, 64 nt, hsa
agauccagacaugccccucccccgcagacacaccccaaggcagcccaacccccaccccuucccc

SEQ ID NO: 175274 - RNA, 64 nt, hsa
aguagaggaagggaccacccaagaaaacuaaaaaccaaggcaccuuaccagucugucuggggac

SEQ ID NO: 175275 - RNA, 64 nt, hsa
gcagcaagcacaauaccauuaaaaagccucaagcccaaggcagaagaccuaucugcauuugagc

SEQ ID NO: 175276 - RNA, 64 nt, hsa
cuuugucuaaugugggauuccugacucccuucguccaaggcaccggugugugugugucuugcac

SEQ ID NO: 175277 - RNA, 64 nt, hsa
gggcaaaccugagauuucuccguggaccugacagccaaggcagggcacugucuccugaggccag

SEQ ID NO: 175278 - RNA, 64 nt, hsa
cccaccucuggucugguuaagagucucacuagggccaaggcaggcugcagaacuuucccucuuc

SEQ ID NO: 175279 - RNA, 64 nt, hsa
uccaucaccauucaccccaggggacagccucgaccgagacaaggaggcccuuaaaugacagccu

SEQ ID NO: 175280 - RNA, 64 nt, hsa
aagaugcaagaggggaaaccuguccccgacucaucgagacaacaugcccaguuaucagggaguc

SEQ ID NO: 175281 - RNA, 64 nt, hsa
uuaacacagcuaauuuuuuucucugaaaaaucaucgagacaaaagagccacagaguacaaguuu

SEQ ID NO: 175282 - RNA, 64 nt, hsa
caugugcuggccaccugcugagccccaaguggaacgagacaagcagcccuuagcccuuccccuc

SEQ ID NO: 175283 - RNA, 64 nt, hsa
gccgaggugggaagaucccuugagcccaggaguucgagacaagccuggguaacacggggagacc

SEQ ID NO: 175284 - RNA, 64 nt, hsa
auagagaaaggagagucuuuucaacaaauggcaccgagacaaugauaugcaagugcaaaagaau

SEQ ID NO: 175285 - RNA, 64 nt, hsa
aagccauaucaguuagacugcaauacuuuaaacacgagacaaaacaauccauauguuuagggaa

SEQ ID NO: 175286 - RNA, 64 nt, hsa
cacccuaggaaacauuuccaagauccugugauggcgagacaaaugauccuuaaagaaggugugg

SEQ ID NO: 175287 - RNA, 64 nt, hsa
gagauuucaguucagcgguugaggagaauugcggcgagacaagcauggaaaaucagugacaucu

SEQ ID NO: 175288 - RNA, 64 nt, hsa
gcaggcaaaguccucugcaggccuggaaacccuccgagacaauuacuugcaugggguaacccag

SEQ ID NO: 175289 - RNA, 64 nt, hsa
ggaccugacccacacugaauguagucuuucaguacgagacaaaguuucuuaaaucccgaagaaa

SEQ ID NO: 175290 - RNA, 64 nt, hsa
uaaauaaaauucuuuugaugaaacucuccgguuacgagacaaagacuguaacugaacaggagcu

SEQ ID NO: 175291 - RNA, 64 nt, hsa
caugcagaugugcauguuaaagagauaaagugaucgagacaaggacugacuggguauagaagga

SEQ ID NO: 175292 - RNA, 64 nt, hsa
augagcagccguggcgcucgacugcacaggagcccgagacaauacaccuccgagcugaauauga

SEQ ID NO: 175293 - RNA, 64 nt, hsa
acucauauccuuuaaacuaaauuuugccaaagcccgagacaacauuaaggagaaauuguaccuu

SEQ ID NO: 175294 - RNA, 64 nt, hsa
ucauaauggucuuuuuuauuuuguuugauucauucgagacaacauguguguaugugugugugug

SEQ ID NO: 175295 - RNA, 64 nt, hsa
gccaaggcagguggaucaccugaggucaggaguucgagacaagcguggccaauauggcaaagcc

SEQ ID NO: 175296 - RNA, 64 nt, hsa
acauuguucaacucccuucucggggugggacagacgagacaacagcacacaggcagccagccgu

SEQ ID NO: 175297 - RNA, 64 nt, hsa
uguauucccaagguuugcugggcucugggauccacgagacaaccagagagggauaucucaugaa

SEQ ID NO: 175298 - RNA, 64 nt, hsa
caggggucuccugccugugccauccacuggggcucgagacaauuucccacucaccugugaggcc

SEQ ID NO: 175299 - RNA, 64 nt, hsa
ggcuuacuugaucauuugauggaaucuaggcuaacgagacaaaggaagucugaaggcuuugaau

SEQ ID NO: 175300 - RNA, 64 nt, hsa
cucaggggagagugaaggccugcaggagggcaggcgagacaaggaggguguccagggcuaggga

SEQ ID NO: 175301 - RNA, 64 nt, hsa
guaaaauggaccaaucagcaggauguggguggggcgagacaagagaauaaaagcaggcugccug

SEQ ID NO: 175302 - RNA, 64 nt, hsa
ugccuaccuuaccacggugaccaccuggaccauccgagacaaguuugcccggcucucccagaug

SEQ ID NO: 175303 - RNA, 64 nt, hsa
acugcuaugcucaaggaccuggaaacccaugcuucgagacaacgugacuuuaaugggagggugg

SEQ ID NO: 175304 - RNA, 64 nt, hsa
cugagaccagacucgagcaccccuguccuguaagcgagacaaaauggcguguguuauuuugggg

SEQ ID NO: 175305 - RNA, 64 nt, hsa
uuuggugcucagacaauauuuaaggacauuucagcgagacaaagugcauguuuuuaucgaguac

SEQ ID NO: 175306 - RNA, 64 nt, hsa
ugguaggagagagacaggacagacccgcuuuucccgagacaaggaccccccaugucacggcagc

SEQ ID NO: 175307 - RNA, 64 nt, hsa
ccgugagcgggagcgcagagagcggagccgggagcgagacaaggagcgagaacggcgacgcucc

SEQ ID NO: 175308 - RNA, 64 nt, hsa
gcacguuaacucuaugccggauagcagcugugcacgagacaaucuugcaacacccgggcauguu

SEQ ID NO: 175309 - RNA, 64 nt, hsa
gugguggaggcaauuaugaggguagcauuucuuucgagacaaaacacccgucugggaaggcccc

SEQ ID NO: 175310 - RNA, 64 nt, hsa
ggaaauagcgggguugcaggcagacauugagcugcgagacaaugggaauaaccuucguguccac

SEQ ID NO: 175311 - RNA, 64 nt, hsa
ccucucaccaagcaguccuccaugugagcaaccccgagacaaaaaugcuaagugggaucaagag

SEQ ID NO: 175312 - RNA, 64 nt, hsa
gacugucauaagcuagcacccgugguaagcgggacgagacaagcucccgaagcccgccagcuuc

SEQ ID NO: 175313 - RNA, 64 nt, hsa
auauaucuauaguuuguaaaaagaacaaaacaaccgagacaaacccuugaugcuccuugcucgg

SEQ ID NO: 175314 - RNA, 64 nt, hsa
gaauguguugaugugcacagcuaaugauucaaugcgagacaagauuggcgucuguguuguggag

SEQ ID NO: 175315 - RNA, 64 nt, hsa
guaaacaaaaaugagagcuugagucagaggaagccgagacaauauccuuccucgacaacgugcg

SEQ ID NO: 175316 - RNA, 64 nt, hsa
agguuccccauguacauacaugcacauacucaaacaugcguacacacacacacauuuacacacg

SEQ ID NO: 175317 - RNA, 64 nt, hsa
aaauuuugugguuccuucccuuuccucccccucccaugcguaagacguucuguguaaccuccau

SEQ ID NO: 175318 - RNA, 64 nt, hsa
cugaugcugagugucuuuuccugugcuuacgggccaugcguauuucuuuggagaaaggucuauc

SEQ ID NO: 175319 - RNA, 64 nt, hsa
cuuugcuauacaaaaguguuuuccacuaauuuugcaugcguauuuauaagaaaaaugugaauuu

SEQ ID NO: 175320 - RNA, 64 nt, hsa
aacccuggaagaggcggccuaaggagauuccacacaugcguaucucuguugcuucuauuggccu

SEQ ID NO: 175321 - RNA, 64 nt, hsa
ccagggauugauuaguccuccacugcccugggugcaugcguacacaauucccuggccaagccug

SEQ ID NO: 175322 - RNA, 64 nt, hsa
uacguuugauaaaacuuacuggaacuaguacuaccaugcguauucccuguccaaagcaucacug

SEQ ID NO: 175323 - RNA, 54 nt, hsa
guauagguuuaaagcccuaaaugccaugcguaucuuuaagaaauuuuaucuuuu

SEQ ID NO: 175324 - RNA, 64 nt, hsa
gcauucugcggacccggucacgggcuugguuagucaugcguacaugugugccuuggggugcucu

SEQ ID NO: 175325 - RNA, 64 nt, hsa
uuggcauuugaauaaagcccugggaccaccucaacaugcguagccucuugucuuaaauguacuc

SEQ ID NO: 175326 - RNA, 64 nt, hsa
gagggagagggcagacucaggugggaagaugugccaugcguaaggcaucaacguguaucugugg

SEQ ID NO: 175327 - RNA, 64 nt, hsa
auaacacagcuacuccucacugcaaaaacauauccaugcguagaaucaacaacuccagucaugg

SEQ ID NO: 175328 - RNA, 64 nt, hsa
agccuucauaggcggucaugugugcaugugagcacaugcguauaugugcgucucucuuucuccc

SEQ ID NO: 175329 - RNA, 64 nt, hsa
ugcagugccagacucugagccaagccacuggggccaugcguaugacuggugcagggaggcaagg

SEQ ID NO: 175330 - RNA, 64 nt, hsa
cauuaagaaauaagaauucccaggguuacucacccaugcguaagcuacccaaguuuaauuuggu

SEQ ID NO: 175331 - RNA, 64 nt, hsa
acauuaaacaccaaauauaagccucgcugucccacaugcguauuggggacaagaugaaaccugc

SEQ ID NO: 175332 - RNA, 64 nt, hsa
ucagccauaugcuaguuuuuuuuucucuugccaacaugcguaaaaagggaagccaauuacaagu

SEQ ID NO: 175333 - RNA, 64 nt, hsa
uguauguauaugcaugcauguguauaaagaugcacaugcguacauauacauaacauacacacaa

SEQ ID NO: 175334 - RNA, 64 nt, hsa
cggcggcgcuuuaguuugagcgcauggcaagucacaugcguaaacgacacucucuggaagcccu

SEQ ID NO: 175335 - RNA, 64 nt, hsa
aauaugggccccuuauagagcugcaaaacacacacaugcguauagacauacauacauguacacc

SEQ ID NO: 175336 - RNA, 64 nt, hsa
uuuuuuauuauaucaguugacauguaacuaguaccaugcguacuuaaauagaugguaauuuucu

SEQ ID NO: 175337 - RNA, 64 nt, hsa
gggaagcguguugcaauccaugagugaugucugccaugcguacaggcauggagagugaggcgcc

SEQ ID NO: 175338 - RNA, 64 nt, hsa
aggccgccguuauauuugcagaagcuuugagaaccaugcguauagccuccugcauucuccccuc

SEQ ID NO: 175339 - RNA, 64 nt, hsa
aucuccaugcggucccuggaaguacccauugaaacaugcguauuuguguauagcagaacucuga

SEQ ID NO: 175340 - RNA, 64 nt, hsa
aggaacagacaucccuuucuaacugcacugccuacaugcguauuaagguccauucugccugugu

SEQ ID NO: 175341 - RNA, 64 nt, hsa
cuuaaugagcuuggaaucaagagauaguuuauuacaugcguaagaagcacauucuaacgcuacu

SEQ ID NO: 175342 - RNA, 64 nt, hsa
ccggcgggcuuugggaaugagggguucccuugaacaugcguaggcuggaaccccgucugagagg

SEQ ID NO: 175343 - RNA, 64 nt, hsa
gccugccugcagcaggcagcuucuacuccugccucaugcguacgucccacaaaugcaggugucc

SEQ ID NO: 175344 - RNA, 64 nt, hsa
uugugaaaaauagcaacuauucauuuguucacaacaugcguauuuauagaguaguuagguacca

SEQ ID NO: 175345 - RNA, 64 nt, hsa
cauccucgaaagugaaauguccuuuucuuugugccaugcguaaggugagucaaaccaaaccuca

SEQ ID NO: 175346 - RNA, 64 nt, hsa
gaaauccugucucuacuaaaaauacaaaauuagccaugcguaguggugcaugccuguaauccca

SEQ ID NO: 175347 - RNA, 64 nt, hsa
uuagaagguuucaggugggugaaaccuccuauuccaugcguaaggugccucgcugaagggagcu

SEQ ID NO: 175348 - RNA, 64 nt, hsa; identical to SEQ ID NO: 118878

SEQ ID NO: 175349 - RNA, 64 nt, hsa; identical to SEQ ID NO: 118879

SEQ ID NO: 175350 - RNA, 64 nt, hsa; identical to SEQ ID NO: 118880

SEQ ID NO: 175351 - RNA, 64 nt, hsa; identical to SEQ ID NO: 118881

SEQ ID NO: 175352 - RNA, 64 nt, hsa; identical to SEQ ID NO: 118882

SEQ ID NO: 175353 - RNA, 64 nt, hsa; identical to SEQ ID NO: 118883

SEQ ID NO: 175354 - RNA, 64 nt, hsa; identical to SEQ ID NO: 118884

SEQ ID NO: 175355 - RNA, 64 nt, hsa; identical to SEQ ID NO: 118885

SEQ ID NO: 175356 - RNA, 64 nt, hsa; identical to SEQ ID NO: 118886

SEQ ID NO: 175357 - RNA, 64 nt, hsa; identical to SEQ ID NO: 118887

SEQ ID NO: 175358 - RNA, 64 nt, hsa; identical to SEQ ID NO: 118888

SEQ ID NO: 175359 - RNA, 64 nt, hsa; identical to SEQ ID NO: 118889

SEQ ID NO: 175360 - RNA, 64 nt, hsa; identical to SEQ ID NO: 118890

SEQ ID NO: 175361 - RNA, 56 nt, hsa; identical to SEQ ID NO: 118891

SEQ ID NO: 175362 - RNA, 64 nt, hsa
ugugaggccucaucuugaaccagaccuuaacgaccaaacccagaccaugccaaaguccagucug

SEQ ID NO: 175363 - RNA, 64 nt, hsa
caggcugucaggaaacguguuuuauguuaagucacaaacccacuugacuucuggguacuggaau

SEQ ID NO: 175364 - RNA, 64 nt, hsa
cgaaccuuggagagggaaugcugauugucuugaccaaacccacagccugucucuucucuuguuu

SEQ ID NO: 175365 - RNA, 64 nt, hsa
cuugggcaauuugugcuaaaacuaggugaguugccaaacccaaggcaucuuaccaacagcuggu

SEQ ID NO: 175366 - RNA, 64 nt, hsa
accaguuaaggugaauauguauuguaucacaaaacaaacccaauauccagaugaauauccgaga

SEQ ID NO: 175367 - RNA, 64 nt, hsa
gcacuggcucauccgcccuacuucccaucccacacaaacccaauuguaaauaacauaugacuuc

SEQ ID NO: 175368 - RNA, 64 nt, hsa
guucagauucugccuguuuucaagauggcagucccaaacccaacaacuguuggccacacugaaa

SEQ ID NO: 175369 - RNA, 64 nt, hsa
cggagggugucuccccaagccaggcacaccugcacaaacccagagccgacccucagcugccuuc

SEQ ID NO: 175370 - RNA, 64 nt, hsa
accauuaggggccuugccaaggucuaccuuagagcaaacccaguaccucagacaggaaagucgg

SEQ ID NO: 175371 - RNA, 64 nt, hsa
uccaagagaaaugauccuauccaaagcugauucacaaacccacgcucaccugacagccgaggga

SEQ ID NO: 175372 - RNA, 64 nt, hsa
ccugaagggaagcccauucuaaacuccuuuccugcaaacccauuuccagcuccuaguagcuuuc

SEQ ID NO: 175373 - RNA, 64 nt, hsa
gaacccauccaauggauugugcaaauccccuccccaaacccacccauaccagcuagaaucacuu

SEQ ID NO: 175374 - RNA, 64 nt, hsa
ggggugcacccaccuguuuucugaaacacacgagcaaacccagagguggauguuaugaacagcu

SEQ ID NO: 175375 - RNA, 64 nt, hsa
uagaccaccagaggaggaugugugggauuguaggcaaacccaccuguggcaucacugaaaauaa

SEQ ID NO: 175376 - RNA, 64 nt, hsa
auccccaacccauccucauccccaacuacagccccaaacccagccccagacuaauccacagcca

SEQ ID NO: 175377 - RNA, 64 nt, hsa
auccccaacucauccucauccccaacugcagccccaaacccaacccagggccauccccaaaccc

SEQ ID NO: 175378 - RNA, 64 nt, hsa
aacugcagccccaaacccaacccagggccauccccaaacccauccccaagccaaacucaacacc

SEQ ID NO: 175379 - RNA, 64 nt, hsa
cguccugcgggacagccagcguaugcuaauguugcaaacccaugauaauguauguggaauaucc

SEQ ID NO: 175380 - RNA, 54 nt, hsa
cgccaggccuguccucuuaggacucaaacccagacccuggacugauuuuccagu

SEQ ID NO: 175381 - RNA, 64 nt, hsa
gucaucaucacauucagggcuauuuuuucccccacaaacccaagggcaggggccacucuuagcu

SEQ ID NO: 175382 - RNA, 64 nt, hsa
gugugaagcaaggagcuuagauaagacacccccucaaacccauucccucuccaggagaccuacc

SEQ ID NO: 175383 - RNA, 64 nt, hsa
augcugauggauaaccuauaugauuuauaguuuguacaugcauucauacaggcagcgauggucu

SEQ ID NO: 175384 - RNA, 64 nt, hsa
cacuaaucugggaagggaagggcuacugcagcuuuacaugcaauuuauuaaaaugauuguaaaa

SEQ ID NO: 175385 - RNA, 64 nt, hsa
cuuacuucguguccgacucuucugagcaccuacuuacaugcauuacugcaugcacuucuuacaa

SEQ ID NO: 175386 - RNA, 64 nt, hsa
uauauccagauggcauguguuuacuuuauguuacuacaugcacuuggcugcauaaaugugguac

SEQ ID NO: 175387 - RNA, 64 nt, hsa
uuauucauucagucgucaugaguugagugcuuacuacaugcaaggcacucugcuaguuauauuc

SEQ ID NO: 175388 - RNA, 64 nt, hsa
uuaagugcuuuguguugaugccaugcuuaucaaauacaugcacaagcuaaacauaauuugaaug

SEQ ID NO: 175389 - RNA, 64 nt, hsa
ugcuuguuuugaaaacucgagaugaugagggugguacaugcaguguguucucucuuuauuggcu

SEQ ID NO: 175390 - RNA, 64 nt, hsa
aaucaaaacgaugguuugaaaaggaaaccuaugauacaugcaggagaagcaaaacccaagugau

SEQ ID NO: 175391 - RNA, 64 nt, hsa
auuuuguuauucuguuaaaaaccacacacacucguacaugcagacaccuccaaugagauauagu

SEQ ID NO: 175392 - RNA, 64 nt, hsa
auaguuugaagcuaauaccaucaggcucagaguuuacaugcauuuuuacuuaggaagugguaaa

SEQ ID NO: 175393 - RNA, 64 nt, hsa
gcuuuaauccacuguguuaggucaaaacuucaaauacaugcauuuuucaauauaggguauauuu

SEQ ID NO: 175394 - RNA, 64 nt, hsa
aucuauucauauuuuacauauauauauauauauauacaugcacacacaccgauacauuuaccuu

SEQ ID NO: 175395 - RNA, 64 nt, hsa
accauuaaagccacuuaaauguuaaauaagaauauacaugcacaucagcucaaugucuuugagu

SEQ ID NO: 175396 - RNA, 64 nt, hsa
uguagguaggcccagagucuuacauuuaagaucuuacaugcaguuauaaaaccgccacagucuu

SEQ ID NO: 175397 - RNA, 64 nt, hsa
ggcaauuccgcauuuaauucaugguauucaggauuacaugcauguuugguuaaacccaugagau

SEQ ID NO: 175398 - RNA, 64 nt, hsa
ugugguugauauuucgaaagcugcuuuaaaaaaauacaugcaucucagcguuuuuuuguuuuua

SEQ ID NO: 175399 - RNA, 64 nt, hsa
caaaauuauauggaacauuuucuguguguacauguacaugcauuuuucuagggagagaguccgu

SEQ ID NO: 175400 - RNA, 64 nt, hsa
aaauacuuuuccuuaauuuuaauccacaguauguuacaugcauucuaccacuacauuuuggugc

SEQ ID NO: 175401 - RNA, 64 nt, hsa
acagauaaaccuagauaaagagauagagagugaguacaugcacacucaugugcaaacccacuca

SEQ ID NO: 175402 - RNA, 64 nt, hsa
ccauguggacuuaggaagguggccuuccugcuguuacaugcagccacuuaggacaaaucugcaa

SEQ ID NO: 175403 - RNA, 64 nt, hsa; identical to SEQ ID NO: 166002

SEQ ID NO: 175404 - RNA, 64 nt, hsa; identical to SEQ ID NO: 166003

SEQ ID NO: 175405 - RNA, 64 nt, hsa; identical to SEQ ID NO: 166004

SEQ ID NO: 175406 - RNA, 64 nt, hsa; identical to SEQ ID NO: 166005

SEQ ID NO: 175407 - RNA, 64 nt, hsa; identical to SEQ ID NO: 166006

SEQ ID NO: 175408 - RNA, 64 nt, hsa; identical to SEQ ID NO: 166007

SEQ ID NO: 175409 - RNA, 64 nt, hsa; identical to SEQ ID NO: 166008

SEQ ID NO: 175410 - RNA, 64 nt, hsa; identical to SEQ ID NO: 166009

SEQ ID NO: 175411 - RNA, 64 nt, hsa; identical to SEQ ID NO: 166010

SEQ ID NO: 175412 - RNA, 60 nt, hsa; identical to SEQ ID NO: 166011

SEQ ID NO: 175413 - RNA, 64 nt, hsa; identical to SEQ ID NO: 166012

SEQ ID NO: 175414 - RNA, 64 nt, hsa; identical to SEQ ID NO: 166013

SEQ ID NO: 175415 - RNA, 64 nt, hsa; identical to SEQ ID NO: 166014

SEQ ID NO: 175416 - RNA, 64 nt, hsa; identical to SEQ ID NO: 166015

SEQ ID NO: 175417 - RNA, 64 nt, hsa; identical to SEQ ID NO: 166016

SEQ ID NO: 175418 - RNA, 64 nt, hsa; identical to SEQ ID NO: 166017

SEQ ID NO: 175419 - RNA, 64 nt, hsa; identical to SEQ ID NO: 166018

SEQ ID NO: 175420 - RNA, 64 nt, hsa; identical to SEQ ID NO: 166019

SEQ ID NO: 175421 - RNA, 64 nt, hsa; identical to SEQ ID NO: 166020

SEQ ID NO: 175422 - RNA, 64 nt, hsa; identical to SEQ ID NO: 166021

SEQ ID NO: 175423 - RNA, 64 nt, hsa; identical to SEQ ID NO: 166022

SEQ ID NO: 175424 - RNA, 64 nt, hsa; identical to SEQ ID NO: 166023

SEQ ID NO: 175425 - RNA, 64 nt, hsa; identical to SEQ ID NO: 166024

SEQ ID NO: 175426 - RNA, 64 nt, hsa; identical to SEQ ID NO: 166025

SEQ ID NO: 175427 - RNA, 64 nt, hsa; identical to SEQ ID NO: 166026

SEQ ID NO: 175428 - RNA, 64 nt, hsa; identical to SEQ ID NO: 166027

SEQ ID NO: 175429 - RNA, 64 nt, hsa; identical to SEQ ID NO: 166028

SEQ ID NO: 175430 - RNA, 64 nt, hsa; identical to SEQ ID NO: 166029

SEQ ID NO: 175431 - RNA, 64 nt, hsa; identical to SEQ ID NO: 166030

SEQ ID NO: 175432 - RNA, 64 nt, hsa; identical to SEQ ID NO: 166031

SEQ ID NO: 175433 - RNA, 64 nt, hsa; identical to SEQ ID NO: 166032

SEQ ID NO: 175434 - RNA, 64 nt, hsa; identical to SEQ ID NO: 166033

SEQ ID NO: 175435 - RNA, 64 nt, hsa; identical to SEQ ID NO: 166034

SEQ ID NO: 175436 - RNA, 64 nt, hsa; identical to SEQ ID NO: 166035

SEQ ID NO: 175437 - RNA, 64 nt, hsa; identical to SEQ ID NO: 166036

SEQ ID NO: 175438 - RNA, 64 nt, hsa; identical to SEQ ID NO: 166037

SEQ ID NO: 175439 - RNA, 64 nt, hsa; identical to SEQ ID NO: 166038

SEQ ID NO: 175440 - RNA, 64 nt, hsa; identical to SEQ ID NO: 166039

SEQ ID NO: 175441 - RNA, 64 nt, hsa; identical to SEQ ID NO: 166040

SEQ ID NO: 175442 - RNA, 64 nt, hsa; identical to SEQ ID NO: 166041

SEQ ID NO: 175443 - RNA, 64 nt, hsa; identical to SEQ ID NO: 166042

SEQ ID NO: 175444 - RNA, 64 nt, hsa; identical to SEQ ID NO: 166043

SEQ ID NO: 175445 - RNA, 64 nt, hsa; identical to SEQ ID NO: 166044

SEQ ID NO: 175446 - RNA, 64 nt, hsa; identical to SEQ ID NO: 166045

SEQ ID NO: 175447 - RNA, 64 nt, hsa; identical to SEQ ID NO: 166046

SEQ ID NO: 175448 - RNA, 51 nt, hsa; identical to SEQ ID NO: 166047

SEQ ID NO: 175449 - RNA, 64 nt, hsa; identical to SEQ ID NO: 166048

SEQ ID NO: 175450 - RNA, 64 nt, hsa; identical to SEQ ID NO: 166049

SEQ ID NO: 175451 - RNA, 64 nt, hsa; identical to SEQ ID NO: 166050

SEQ ID NO: 175452 - RNA, 64 nt, hsa; identical to SEQ ID NO: 166051

SEQ ID NO: 175453 - RNA, 64 nt, hsa; identical to SEQ ID NO: 166052

SEQ ID NO: 175454 - RNA, 64 nt, hsa; identical to SEQ ID NO: 166053

SEQ ID NO: 175455 - RNA, 64 nt, hsa; identical to SEQ ID NO: 166054

SEQ ID NO: 175456 - RNA, 64 nt, hsa; identical to SEQ ID NO: 166055

SEQ ID NO: 175457 - RNA, 64 nt, hsa; identical to SEQ ID NO: 166056

SEQ ID NO: 175458 - RNA, 64 nt, hsa; identical to SEQ ID NO: 166057

SEQ ID NO: 175459 - RNA, 64 nt, hsa; identical to SEQ ID NO: 166058

SEQ ID NO: 175460 - RNA, 64 nt, hsa; identical to SEQ ID NO: 166059

SEQ ID NO: 175461 - RNA, 64 nt, hsa; identical to SEQ ID NO: 166060

SEQ ID NO: 175462 - RNA, 64 nt, hsa; identical to SEQ ID NO: 166061

SEQ ID NO: 175463 - RNA, 64 nt, hsa; identical to SEQ ID NO: 166062

SEQ ID NO: 175464 - RNA, 64 nt, hsa; identical to SEQ ID NO: 166063

SEQ ID NO: 175465 - RNA, 64 nt, hsa; identical to SEQ ID NO: 166064

SEQ ID NO: 175466 - RNA, 64 nt, hsa; identical to SEQ ID NO: 166065

SEQ ID NO: 175467 - RNA, 64 nt, hsa; identical to SEQ ID NO: 166066

SEQ ID NO: 175468 - RNA, 64 nt, hsa; identical to SEQ ID NO: 166067

SEQ ID NO: 175469 - RNA, 64 nt, hsa; identical to SEQ ID NO: 166068

SEQ ID NO: 175470 - RNA, 64 nt, hsa; identical to SEQ ID NO: 166069

SEQ ID NO: 175471 - RNA, 64 nt, hsa; identical to SEQ ID NO: 166070

SEQ ID NO: 175472 - RNA, 64 nt, hsa; identical to SEQ ID NO: 166071

SEQ ID NO: 175473 - RNA, 64 nt, hsa; identical to SEQ ID NO: 166072

SEQ ID NO: 175474 - RNA, 64 nt, hsa; identical to SEQ ID NO: 166073

SEQ ID NO: 175475 - RNA, 64 nt, hsa; identical to SEQ ID NO: 166074

SEQ ID NO: 175476 - RNA, 64 nt, hsa; identical to SEQ ID NO: 166075

SEQ ID NO: 175477 - RNA, 64 nt, hsa; identical to SEQ ID NO: 166076

SEQ ID NO: 175478 - RNA, 64 nt, hsa; identical to SEQ ID NO: 166077

SEQ ID NO: 175479 - RNA, 64 nt, hsa
ggucagauggugguggugagaggccuuggggcuggggaaggagaguggacuuuggcucacucug

SEQ ID NO: 175480 - RNA, 64 nt, hsa
gauagauggauggauggauggacggauggggugggggaaggaaggaaaggagggagaaaggagg

SEQ ID NO: 175481 - RNA, 64 nt, hsa
cauugccuucacaccacuggguuugccagaaacagggaaggagggcguuaagggaaaaaaaaaa

SEQ ID NO: 175482 - RNA, 64 nt, hsa
cagacaucgcccuggcccugcuggcccggguaucgggaaggaggagcgagggaaugacggaggu

SEQ ID NO: 175483 - RNA, 64 nt, hsa
gggaggaggguucacaguguuuuugugggggcgggggaaggaagaggcagccccgcccccgcca

SEQ ID NO: 175484 - RNA, 64 nt, hsa
gauauuuuaaagauuucugagcuagcaggcaugugggaaggaaggcucugucuucaacucuuug

SEQ ID NO: 175485 - RNA, 64 nt, hsa
cuccuccucaaaaacugauucagaaacugacuuggggaaggaauuuaauacuuugaagucauga

SEQ ID NO: 175486 - RNA, 64 nt, hsa
gcacuguuagcauuuaacuucuuguuaggauucagggaaggaacaguuggccaagaauuuuuuu

SEQ ID NO: 175487 - RNA, 64 nt, hsa
cugguuuggacaaaaacccucaguagagacaagcgggaaggauaauuagcugaaagcuaugaug

SEQ ID NO: 175488 - RNA, 64 nt, hsa
gaugagaucaauacuacugauccaucuguagccugggaaggagacaggacauuccuguacuaag

SEQ ID NO: 175489 - RNA, 64 nt, hsa
cuagaaauagaaggcccagugguggaauauuagagggaaggaaacugacaacgugugaaaguua

SEQ ID NO: 175490 - RNA, 64 nt, hsa
guuacaaaucacaguauaagauuuaagugccugggggaaggauacaauuuuuagaaauuacaua

SEQ ID NO: 175491 - RNA, 64 nt, hsa
gugaggaaaaggugguaaauaggaaaccaugaaugggaaggauggcaauaaguagcaacuauac

SEQ ID NO: 175492 - RNA, 64 nt, hsa
acucuccagcagaaugucugcuugugucuagauggggaaggagcagguucaucggguacuggga

SEQ ID NO: 175493 - RNA, 64 nt, hsa
ucucaucaaccagggaagaggaacugagaucacagggaaggagauuggaggugauaccagcaca

SEQ ID NO: 175494 - RNA, 64 nt, hsa
agcaggaaagauggaguuaccaguuacugaaauagggaaggaugggcuggguaaguauggaauu

SEQ ID NO: 175495 - RNA, 64 nt, hsa
cguuugggaaacaagacuuuuccugcaauagccugggaaggaauaaaaggauagaguguuuggg

SEQ ID NO: 175496 - RNA, 64 nt, hsa
aggauggccucugcuaagcucaaggcgugaggaugggaaggagggagguauucguaaggauggg

SEQ ID NO: 175497 - RNA, 64 nt, hsa
ugaggaugggaaggagggagguauucguaaggaugggaaggagggagguauucgugcagcauau

SEQ ID NO: 175498 - RNA, 64 nt, hsa
ccaacggcaauggcaugagaacucuuguuucuuggggaaggagaggagggaaaaggaccagggu

SEQ ID NO: 175499 - RNA, 64 nt, hsa
cagugggcugcaguugcccaaccacaggaagaaagggaaggagguagagggaagaaacagaagc

SEQ ID NO: 175500 - RNA, 64 nt, hsa
uucacauggggacaggggauggagcaugaggcaagggaaggaaaagcagagcuuauuuuucacc

SEQ ID NO: 175501 - RNA, 64 nt, hsa
cugcccaucgcggcugcgggucaagcaucuucaagggaaggacggacuggaggccucaccgugg

SEQ ID NO: 175502 - RNA, 64 nt, hsa
acaucaaacaaccuugugauuauaaaacgauccugggaaggagccccuaacuagggcaagucag

SEQ ID NO: 175503 - RNA, 64 nt, hsa
uuuuucaaauuggugucauaauauuguguaaaaagggaaggaaaaaaaaaaccacccccagcuu

SEQ ID NO: 175504 - RNA, 64 nt, hsa
guuuccugccuauggugagaucagauguggccaagggaaggagcucugguuccagagaauuugc

SEQ ID NO: 175505 - RNA, 64 nt, hsa
acgaggacacucgcuugccgggccugggccuccugggaaggagggagcugcucagaaugccgca

SEQ ID NO: 175506 - RNA, 64 nt, hsa
gccccacccagaccugaaugcuucugagagcaaagggaaggacugacgagagauguauauuuaa

SEQ ID NO: 175507 - RNA, 64 nt, hsa
gugaguaucccugccaccaagagagcaaugggcagggaaggaaggggucugccgaccccagcuc

SEQ ID NO: 175508 - RNA, 64 nt, hsa
uguacuuguggaaagguguguuugcguagccuuagggaaggaaggcaauugcuccuuaacagca

SEQ ID NO: 175509 - RNA, 64 nt, hsa
uuugaggugucaaauacaaauaaaucugggcuuagggaaggagagaccuuauuccaaagcacga

SEQ ID NO: 175510 - RNA, 64 nt, hsa
ggggucugcgguggcuccugucuucccugcagcagggaaggagggccguguggugcuuugcuag

SEQ ID NO: 175511 - RNA, 64 nt, hsa
ggacacagccuuauuacugcuggggugggauaaggggaaggagaagagggagaauggagcagga

SEQ ID NO: 175512 - RNA, 64 nt, hsa
uguccccagagggaggagcaggcaggagagagaggggaaggagguaugaaucccaguccccagg

SEQ ID NO: 175513 - RNA, 64 nt, hsa
aacuaauaaauggacuacaguagcucacguuacagggaaggaggguaggcagggaggcucugug

SEQ ID NO: 175514 - RNA, 64 nt, hsa
uuaggauugaaguggcuggaaagagugaugccuggggaaggagauggaguuaugaggguacugu

SEQ ID NO: 175515 - RNA, 64 nt, hsa
gugacucauguuucccuguuucaaagggauccuggggaaggaggggaacaugcuugcaguaucu

SEQ ID NO: 175516 - RNA, 64 nt, hsa
gcccagcauguauguaugcacacauugugugugugggaaggacaaagccacucucacaagaaag

SEQ ID NO: 175517 - RNA, 64 nt, hsa
uuuuagaaaaggaaaacgugaacaaacuuagaaagggaaggaaaucccaucagugaauccugaa

SEQ ID NO: 175518 - RNA, 64 nt, hsa
gguguguaggugguaaaaccuguucuccauaggagggaaggagcagucacugggagagguuacc

SEQ ID NO: 175519 - RNA, 64 nt, hsa
aggcuggagcuccaugcacguaguccagaugccugggaaggaacaucucccuuccagcaucugc

SEQ ID NO: 175520 - RNA, 64 nt, hsa
uacaguucugaccuuuuuuguccaguuucuuugggggaaggaagacaaagaagguaggaacgga

SEQ ID NO: 175521 - RNA, 64 nt, hsa
ggaggauuucaguuaggucucccauuuggcugaugggaaggaggcccaguguugcagggaggca

SEQ ID NO: 175522 - RNA, 64 nt, hsa
aggcaggggauuguaguagcagcugaccugaguggggaaggaaggaggauuucaguuaggucuc

SEQ ID NO: 175523 - RNA, 64 nt, hsa
ucggauggggcgcgccugcgcccucagaacgugugggaaggagggggcguggacaggacacggg

SEQ ID NO: 175524 - RNA, 64 nt, hsa
ccgccagccuugcucagcuguggguugcccugcugggaaggagggaaucacguccaccuggguc

SEQ ID NO: 175525 - RNA, 64 nt, hsa
gugugggugccaguccuccucaggagaaggggaagggaaggaggccacuuugagagggcugaag

SEQ ID NO: 175526 - RNA, 64 nt, hsa
uuacuagaaucauuucauuauuucugcuuccugggggaaggaugcagaaggagucugaugcuca

SEQ ID NO: 175527 - RNA, 64 nt, hsa
cuuaucugaucuuccucaaacuucagauagguuagggaaggacaaaggcccccagccaugaagg

SEQ ID NO: 175528 - RNA, 64 nt, hsa
ccucucaaccaucccacuaaguuauagccaagaagggaaggagacacggggauuugggguucuc

SEQ ID NO: 175529 - RNA, 64 nt, hsa
gaaucagcagguucucugcccucccuagggguuggggaaggacccaccccggucagcacagugc

SEQ ID NO: 175530 - RNA, 64 nt, hsa
gggaaagugcuauuuccuauuuucaccaaaauuggggaaggagugccacuuuccagcuccacuu

SEQ ID NO: 175531 - RNA, 64 nt, hsa
caaaucagugacccaagggagggggggauuuaaagggaaggagugggcaaaacacauaaaauga

SEQ ID NO: 175532 - RNA, 64 nt, hsa
gccacgggauggggugggggagccccaugggccugggaaggagggugcuguggagggggcugca

SEQ ID NO: 175533 - RNA, 64 nt, hsa
aggacaaagguagcaagaggauuuccuggcgggugggaaggaauggcuggggcggccaguuuug

SEQ ID NO: 175534 - RNA, 64 nt, hsa
ggaagaaaauggccagggggaaggaaaggugagugggaaggagcagaaagcugggaaaggggau

SEQ ID NO: 175535 - RNA, 64 nt, hsa
guuuuagacucugaugaggaagaaaauggccagggggaaggaaaggugagugggaaggagcaga

SEQ ID NO: 175536 - RNA, 64 nt, hsa
uccccuaagccagcacugcugcucccuggagcccgggaaggaggcugccuggcuggaggcccga

SEQ ID NO: 175537 - RNA, 64 nt, hsa
cgcgcuggggucugggcugugcucccucacuaaagggaaggaaaggaagcugggcguccucugg

SEQ ID NO: 175538 - RNA, 64 nt, hsa
acguucauuucauuuuauggagggucccagaaaagggaaggaggagccccaggucauacagggc

SEQ ID NO: 175539 - RNA, 53 nt, hsa
agaggggcaacgcccauuagaaggggaaggacugccuacguucauuucauuuu

SEQ ID NO: 175540 - RNA, 64 nt, hsa
cagggcccucccagcccauugcugccaagguggagggaaggauaaagccacuucuggcuucagc

SEQ ID NO: 175541 - RNA, 64 nt, hsa
ggauaaagccacuucuggcuucagcccccaccaggggaaggaaggagggcacauuaacucccuc

SEQ ID NO: 175542 - RNA, 64 nt, hsa
gcucugccuugcaucacccucagccuaagggagugggaaggaaaugggguguuuucuugcugac

SEQ ID NO: 175543 - RNA, 64 nt, hsa
cccugaaccacugugugcccauuuccuagggaaggggaaggagaauaaacagaauauuuauuac

SEQ ID NO: 175544 - RNA, 64 nt, hsa
ggccuguggggagccgagggcgucagagagacccgggaaggaaggcucucgggugggggagcca

SEQ ID NO: 175545 - RNA, 64 nt, hsa
aggggugguagucagaggagggaggaggaauaaggggaaggaagagagagggagcaggcggagc

SEQ ID NO: 175546 - RNA, 64 nt, hsa
ggcaggaaggaauggggggccccagccccaggccgggaaggagccagcggccgacaaagcagaa

SEQ ID NO: 175547 - RNA, 64 nt, hsa
gcaaggccaacagggcaggggaggggaagaccuggggaaggaagaaugaggacagucccgucgu

SEQ ID NO: 175548 - RNA, 64 nt, hsa
uggauggcugggcuauggguccugcccuugagcagggaaggaacuuacugucuaauauaggaaa

SEQ ID NO: 175549 - RNA, 64 nt, hsa
uuuucaggacagagugcacaguuuccucuccugugggaaggagaguugacucuugaggaccccc

SEQ ID NO: 175550 - RNA, 64 nt, hsa
ggauguuaaauuaacucacuaugguuuuucaccugggaaggaaacaaauuacguacuagagggc

SEQ ID NO: 175551 - RNA, 64 nt, hsa
gagggcauugacugguuaaaaacuuguguaucccgggaaggaccugcgguacaggagucagcca

SEQ ID NO: 175552 - RNA, 64 nt, hsa
gacaccuucugugcucauguuuggaaagcugaaagggaaggacagcugugcccuccugggagcu

SEQ ID NO: 175553 - RNA, 64 nt, hsa
ggucccaugaccagcauuaugaaaaugcgagagugggaaggacacagugugagacuuccacuag

SEQ ID NO: 175554 - RNA, 64 nt, hsa
gaaagucacucgacauuggucucuuguguugauagggaaggaaaucaggcauuccuauuucuuu

SEQ ID NO: 175555 - RNA, 64 nt, hsa
agcgugggaugcuguagcccccgggguugggcaagggaaggaugguggcccuccagaggucaug

SEQ ID NO: 175556 - RNA, 64 nt, hsa
caggugaggucugaggacagcaggccuucccuaggggaaggagcugggagugccaaggccccag

SEQ ID NO: 175557 - RNA, 64 nt, hsa
ugaacuugcucugaacugcacccaggaggugacugggaaggagaaaaccagcaaaggaagcucu

SEQ ID NO: 175558 - RNA, 64 nt, hsa
caggggugagguucuuggccucagcuccucccuggggaaggaacuagucuuucuccaagaagaa

SEQ ID NO: 175559 - RNA, 64 nt, hsa
guggagaaacgcccuccagucugagagcaggggagggaaggaggcagcagaguuggggcagcug

SEQ ID NO: 175560 - RNA, 64 nt, hsa
cucuuggggaggcagagaagccaccuucaggccugggaaggaagacacugggaggaggagaggc

SEQ ID NO: 175561 - RNA, 64 nt, hsa
uuacucuuuuagucaggauuucggucuuuucugcgggaaggaauuaagcuauguauuaggucca

SEQ ID NO: 175562 - RNA, 64 nt, hsa
ugucacguggcucccccuagccgcacacuagugugggaaggaaaauauugagcuaggcacauua

SEQ ID NO: 175563 - RNA, 64 nt, hsa
guccaccuaugucuuuguaucuacauucuugacggggaaggaacuuccucugggaaccuuuggg

SEQ ID NO: 175564 - RNA, 64 nt, hsa
gagccaaaauguuucccgguguuugcugguuucagggaaggaguuugauauagcagauuaacca

SEQ ID NO: 175565 - RNA, 64 nt, hsa
uacgcaaacugcgccugcuccugaaaagcucucugggaaggaaugggccuggcuuuccguuccu

SEQ ID NO: 175566 - RNA, 64 nt, hsa
ggcucauuagcuggcuacaugcuucgcaggaagugggaaggacucacaucauaaaaaggaccau

SEQ ID NO: 175567 - RNA, 61 nt, hsa
agccagaauaauuuuagaucugaucagguaguagcuaaaauuagaaaaaaacaaaauagau

SEQ ID NO: 175568 - RNA, 61 nt, hsa
ugaaaugucagugucaaaauauuauagauuauagcuaaaauccagauuaauacucauuugg

SEQ ID NO: 175569 - RNA, 61 nt, hsa
ucuuacauucagaaauguggcaaaaaaggcauagcuaaaggcuaaacauauggcuuuagua

SEQ ID NO: 175570 - RNA, 61 nt, hsa
auuucuguuauuuuuaagcuuuuauuucuuguagcuaaaaauaaaacaucauaaaucuggu

SEQ ID NO: 175571 - RNA, 61 nt, hsa
aauaucauuugaccuaagugaauguugauacuagcuaaagauuggguaaauugguugaauu

SEQ ID NO: 175572 - RNA, 61 nt, hsa
ugguugaauuauuguauugaagcuugagcuguagcuaaaaguaauuuagguuuccccuaag

SEQ ID NO: 175573 - RNA, 64 nt, hsa
ccauccccuguguauuuaaguuguuccauucuuuggccauuauaacuuuuuucugcaaauauuc

SEQ ID NO: 175574 - RNA, 64 nt, hsa
cuuuuuucugcaaauauucuggugacuuaucuuuggccauuauaaacuguugauaauagaucau

SEQ ID NO: 175575 - RNA, 64 nt, hsa; identical to SEQ ID NO: 70868

SEQ ID NO: 175576 - RNA, 64 nt, hsa; identical to SEQ ID NO: 70869

SEQ ID NO: 175577 - RNA, 64 nt, hsa; identical to SEQ ID NO: 70870

SEQ ID NO: 175578 - RNA, 64 nt, hsa; identical to SEQ ID NO: 70871

SEQ ID NO: 175579 - RNA, 64 nt, hsa; identical to SEQ ID NO: 70872

SEQ ID NO: 175580 - RNA, 62 nt, hsa; identical to SEQ ID NO: 70873

SEQ ID NO: 175581 - RNA, 64 nt, hsa; identical to SEQ ID NO: 70874

SEQ ID NO: 175582 - RNA, 64 nt, hsa; identical to SEQ ID NO: 70875

SEQ ID NO: 175583 - RNA, 64 nt, hsa; identical to SEQ ID NO: 70876

SEQ ID NO: 175584 - RNA, 64 nt, hsa; identical to SEQ ID NO: 70877

SEQ ID NO: 175585 - RNA, 64 nt, hsa; identical to SEQ ID NO: 70878

SEQ ID NO: 175586 - RNA, 64 nt, hsa; identical to SEQ ID NO: 70879

SEQ ID NO: 175587 - RNA, 64 nt, hsa; identical to SEQ ID NO: 172966

SEQ ID NO: 175588 - RNA, 64 nt, hsa; identical to SEQ ID NO: 172967

SEQ ID NO: 175589 - RNA, 64 nt, hsa; identical to SEQ ID NO: 172968

SEQ ID NO: 175590 - RNA, 64 nt, hsa; identical to SEQ ID NO: 172969

SEQ ID NO: 175591 - RNA, 64 nt, hsa; identical to SEQ ID NO: 172970

SEQ ID NO: 175592 - RNA, 64 nt, hsa; identical to SEQ ID NO: 172971

SEQ ID NO: 175593 - RNA, 64 nt, hsa; identical to SEQ ID NO: 172972

SEQ ID NO: 175594 - RNA, 64 nt, hsa; identical to SEQ ID NO: 172973

SEQ ID NO: 175595 - RNA, 64 nt, hsa
aauauuuuuuuaagaaaaaaagcaaaaacaauguauugcugauaaucaguuuggaccaguuucu

SEQ ID NO: 175596 - RNA, 64 nt, hsa
uagauguuacuauaccuaccauuuauucagcuggauugcugaacacaguucuggauucauagaa

SEQ ID NO: 175597 - RNA, 64 nt, hsa
uagaauugcuauucucgauacauacaaagacguaauugcugacccacaaucaguaacauccaua

SEQ ID NO: 175598 - RNA, 64 nt, hsa
gaaagaaaaaaaaaacgcccaacucuugaaguccauugcugaaaacugcagccagggguugaaa

SEQ ID NO: 175599 - RNA, 64 nt, hsa
guuacccaauuagggaaauaaauuuguuaauaaaauugcugaggucaccagugauuauuggugu

SEQ ID NO: 175600 - RNA, 64 nt, hsa
acacuggagggggcagcccaaguuagaggccagcauugcugacauucuggaauauuugcaucua

SEQ ID NO: 175601 - RNA, 64 nt, hsa
cuguguuaguucaaagaaucucuucuugccucccauugcugauuuucuguauugauggacucau

SEQ ID NO: 175602 - RNA, 64 nt, hsa
ugcauuggaagagagaaaggaaacacacucuuucauugcugaauucuaaauaaugaugcccuga

SEQ ID NO: 175603 - RNA, 64 nt, hsa
ugcuggagaucaucuuuaagggcaaaggaguuggauugcugaauuacaaugaaacaugucuuau

SEQ ID NO: 175604 - RNA, 64 nt, hsa
ccacuucugugucuuucuaauggaaaugaguagaauugcugaaagucucuauguuaaaaccuau

SEQ ID NO: 175605 - RNA, 64 nt, hsa
ucuugucugcacagaaagucccaguacaacuuccauugcugagaaaauccucagaggacuuucc

SEQ ID NO: 175606 - RNA, 64 nt, hsa
aacugaaucugagguuuuauaaaucccucaaacgauugcugagagccugauuguggaaagaagu

SEQ ID NO: 175607 - RNA, 64 nt, hsa
uuauauaaaaauaaguagaaaacauaaaauugaaauugcugaugagaagccuugucucgugaau

SEQ ID NO: 175608 - RNA, 64 nt, hsa
uauagcaugacuguugaccuuaagauccauucucauugcugauaaugcugcagcccugcugguu

SEQ ID NO: 175609 - RNA, 64 nt, hsa
gguuuucuaaaauuaaaauguccaaauuaggcauauugcugagcucaaauugaugugaaaugcc

SEQ ID NO: 175610 - RNA, 64 nt, hsa
gcuuaauuuagauccuuucugcaaagugcacugaauugcugaaaguugacuugagucuuguccu

SEQ ID NO: 175611 - RNA, 64 nt, hsa
aaaauauugaccagcuaccccuuuauggaaaaagauugcugacuccugauaaagaauauaaagu

SEQ ID NO: 175612 - RNA, 64 nt, hsa
uugguuguaauuuaacaagucaaauaaaauaaucauugcugagcacaaucacauguugaaacaa

SEQ ID NO: 175613 - RNA, 64 nt, hsa
ucccucuucugccaguacucccccuguaccacccauugcugauggcacacccauccuuaagcua

SEQ ID NO: 175614 - RNA, 64 nt, hsa
ggggggaggggagggaagucuugugaaaccgcugauugcugacuuuugugugaagaaucguguu

SEQ ID NO: 175615 - RNA, 64 nt, hsa
gcgagacucagucucaaaaagaaaaaagaaauuuauugcugaucacaaggacagacaguuuuuu

SEQ ID NO: 175616 - RNA, 64 nt, hsa
uuaauaagaaaugggguaaauagaaaagaaauuuauugcugauuggccaggugcggugguucgu

SEQ ID NO: 175617 - RNA, 64 nt, hsa
uauacuuguauguaaugauugccaagguaacagaauugcugacaucugucuaaaaaguuuugac

SEQ ID NO: 175618 - RNA, 64 nt, hsa
uauuugauaugauuuuaaagucagaauaguacagauugcugaguauuauacuuuaggcuagauu

SEQ ID NO: 175619 - RNA, 64 nt, hsa
cacuuugggccaaaagcucuaauggaacauuuuuaguggugauuuggggaaggaaaguuaauga

SEQ ID NO: 175620 - RNA, 64 nt, hsa
ugggguagugcccaagccuggucguguugccaggaguggugacaagaaaugcagcuuacaucaa

SEQ ID NO: 175621 - RNA, 64 nt, hsa
uuuggguuccuaagaugcacaagcguuuuacaccaguggugauuaacucaacuaaaacccacug

SEQ ID NO: 175622 - RNA, 64 nt, hsa
guuaaacagggcuggcaucagguagagggagcagaguggugaccugauagcuccugucaucgug

SEQ ID NO: 175623 - RNA, 64 nt, hsa
uccucucucauaaacauuuggugaccuuuuaccaaguggugaguuaguuagguuuuuuaaaaua

SEQ ID NO: 175624 - RNA, 64 nt, hsa
uucuguuuaauguucauucuccuuccaagaacaaaguggugauuuuugguuagggugaucgccc

SEQ ID NO: 175625 - RNA, 64 nt, hsa
agccacaaucagaaaaaggacaaggacaugagacaguggugauggccaucagacagagacuuca

SEQ ID NO: 175626 - RNA, 64 nt, hsa
agucgggcacagagguagcagacagaugugaagcaguggugaaggccauguagcaaguggggaa

SEQ ID NO: 175627 - RNA, 64 nt, hsa
ccaggccaacucuagcuccuuucucaagcuacaaaguggugaacaugguucucaacuccuuaau

SEQ ID NO: 175628 - RNA, 64 nt, hsa
ugaacaagcagaccaacaacacugaggaagauagaguggugacuuagaauuaacucgugcuaag

SEQ ID NO: 175629 - RNA, 64 nt, hsa
ggacacauccccuuagaggaccugaguuugggagaguggugaguggaagggaggagcagcaaga

SEQ ID NO: 175630 - RNA, 64 nt, hsa
uuuguggaccaauacuaagaauaacaagaagcccaguggugaggaaagugcguucucccagcac

SEQ ID NO: 175631 - RNA, 64 nt, hsa
ugauguuaaacugauggaaauucuuuuucgccuuaguggugauuguuuaaacucucacagucuu

SEQ ID NO: 175632 - RNA, 64 nt, hsa
uauauauuuucaaaagauagcuuaugucuaaaacaguggugaugaguaaggccaguugagcauu

SEQ ID NO: 175633 - RNA, 64 nt, hsa
gauggaaagacuuaaagaugaauuugagaaaaauugaaagaaauuagauuaucagguucuguua

SEQ ID NO: 175634 - RNA, 64 nt, hsa
uuacaagucuuucacagaaguuuggugguaauauugaaagaacuagcauugggcagaauguguc

SEQ ID NO: 175635 - RNA, 64 nt, hsa
gguaauaaacaugaaaacugguuuguagcaguuuugaaagaauagaaugcauucaaauguaagg

SEQ ID NO: 175636 - RNA, 64 nt, hsa
auucagaaagacaggagaauuaggagagagugagugaaagaagccaagggucaagaaugcagaa

SEQ ID NO: 175637 - RNA, 64 nt, hsa
uuuguacagaaaugaaaauaaaauaugaaaauaaugaaagaaaugaaaagauagcuuuuaauug

SEQ ID NO: 175638 - RNA, 64 nt, hsa
cuaagugguucauauuucuaaugaggaagauuaaugaaagaacauuguuauauucugcguggua

SEQ ID NO: 175639 - RNA, 64 nt, hsa
uuacacuggcucguggacagaacaauuugaaaagugaaagaauuauuuugguaaaagauuuugc

SEQ ID NO: 175640 - RNA, 64 nt, hsa
aauggaacgguugaaugaaauuuuacucuuucugugaaagaaaauccacagaguuguugccucc

SEQ ID NO: 175641 - RNA, 64 nt, hsa
ucauaacuguuaauucucagccaucuuugaagcuugaaagaagagucuuugguauuuuguaaac

SEQ ID NO: 175642 - RNA, 64 nt, hsa
cauuuuaaaacuuuuuuuuaacuaauaauagcuuugaaagaagaggcuuaauuuggggguggua

SEQ ID NO: 175643 - RNA, 64 nt, hsa
uacucacugcugcaaauacuguauauucaggacuugaaagaaauggugaaugccuaugguggau

SEQ ID NO: 175644 - RNA, 64 nt, hsa
uguuuuggauauaguauaagcagugucuguguuuugaaagaauagaacacaguuuguagugcca

SEQ ID NO: 175645 - RNA, 64 nt, hsa
uuuaauguucuaaguagugauaauauuacuagaaugaaagaauaaaaagaaauuguucuuuuaa

SEQ ID NO: 175646 - RNA, 64 nt, hsa
gauauaauaaaaugagacuggaggcauucugaaaugaaagaaacuccuuuauauauccaaccac

SEQ ID NO: 175647 - RNA, 64 nt, hsa
gaagcuagucuccugucuagacuaaaaauauccuugaaagaauaguagcaaacaguaugcagua

SEQ ID NO: 175648 - RNA, 64 nt, hsa
uggggcuguauuaucagcacagcaaauuaaagaaugaaagaaguacuucuuuuuacauuucagc

SEQ ID NO: 175649 - RNA, 64 nt, hsa
cuauugcucuagaauguauuacuuuguucucccaugaaagaauucaguuuguuaguaccuauau

SEQ ID NO: 175650 - RNA, 64 nt, hsa
cagcaaaacuuccccaugaacagcuaauguguagugaaagaaugagcuagcaaaugaguuuuag

SEQ ID NO: 175651 - RNA, 64 nt, hsa
cuguccaggagaacagaagggaaaaaaagauacuugaaagaaacugaaggaaauuuaaacaaag

SEQ ID NO: 175652 - RNA, 64 nt, hsa
aagaaacugaaggaaauuuaaacaaagaaacacuugaaagaaacuggaaagaaaaauaauuuuu

SEQ ID NO: 175653 - RNA, 64 nt, hsa
gugacuuccuuggaaaucaaauguaaaguuuaauugaaagaauguaaagcaaccaaaaagaaaa

SEQ ID NO: 175654 - RNA, 64 nt, hsa
ucacuggugguuuuccgcauucuuuguacacccaugaaagaaaacuuuuaugcaaggucuugca

SEQ ID NO: 175655 - RNA, 64 nt, hsa
gaccaugguuaagcaaccauauagaaagcuuuguugaaagaaaguauggcaucuuguaccacug

SEQ ID NO: 175656 - RNA, 64 nt, hsa
uauuaucuauuacucuugagagcuggcuguccuuugaaagaaagaaguaauguucuuugaaaga

SEQ ID NO: 175657 - RNA, 64 nt, hsa
uggcuguccuuugaaagaaagaaguaauguucuuugaaagaaagaaaaaucucuugcuguguca

SEQ ID NO: 175658 - RNA, 64 nt, hsa
uuugaccaugauaauucaguuuauauucaccacaugaaagaaaaauggguaacagaagaacccu

SEQ ID NO: 175659 - RNA, 64 nt, hsa
cuuaaaacagguuaauuuggauuguaacguucagugaaagaaauuucaacccuucauagccagc

SEQ ID NO: 175660 - RNA, 64 nt, hsa
ugaaagcuagguauuuaucaacugcagauguuauugaaagaaaauaaaauucagucucaagagu

SEQ ID NO: 175661 - RNA, 64 nt, hsa
uugggguuuaaagaaauggucugcauaaccugaaugaaagaagcaaaugacuauucucugaaga

SEQ ID NO: 175662 - RNA, 64 nt, hsa
gugauuuauuaauuuuaaaacauucagaacuuguugaaagaaaaauuauaucugaaucaagauu

SEQ ID NO: 175663 - RNA, 64 nt, hsa
aguucgaaagaagaagcaagcgcuggccuggccuugaaagaaccgaagucuuucccauucacuu

SEQ ID NO: 175664 - RNA, 64 nt, hsa
ugauuuuaauggccacaucuaaucucauuucacaugaaagaagaaguauauuuuagaaauuugu

SEQ ID NO: 175665 - RNA, 64 nt, hsa
cuauggauaacaauucuucauuuaccuaguauuaugaaagaaugaaggaguucaaacaaaugug

SEQ ID NO: 175666 - RNA, 64 nt, hsa
gaaacguguucuuacaaaugaaccuucggaucuaugaaagaaaauauaguagggggacuaagga

SEQ ID NO: 175667 - RNA, 64 nt, hsa
aacuaaaagcaacuuuuuauguuauugaaaauauugaaagaacugauauuaaugauaaucauuu

SEQ ID NO: 175668 - RNA, 64 nt, hsa
uaaaaauugagugaggguuauuauuuguauuugaugaaagaaaauccaaauaaagcccaccuag

SEQ ID NO: 175669 - RNA, 64 nt, hsa
ggacuguugaaacuacugcggaaguuuuucuaucugaaagaaggugcugggcauucaaaugugu

SEQ ID NO: 175670 - RNA, 64 nt, hsa
gacacagaggugccagugauggacuggaucagcuugaaagaagcacaaagacuccgugaucaca

SEQ ID NO: 175671 - RNA, 64 nt, hsa
aaucugagacauccugacucucgagcugggaagaugaaagaaacucuauuauauauuuggccua

SEQ ID NO: 175672 - RNA, 64 nt, hsa
gaguccugggauuuguacuucaugaagacuuuugugaaagaauagguguccuuaugaacaacgu

SEQ ID NO: 175673 - RNA, 64 nt, hsa
cugcugacuucaacguucacuuuaugcaccaaagugaaagaauucaguguauccguuauuuuaa

SEQ ID NO: 175674 - RNA, 64 nt, hsa
aacaaaguaaucuacuguaaaguacucugccccuugaaagaaguauuaaaaagagugaggaugg

SEQ ID NO: 175675 - RNA, 64 nt, hsa
gugaguggaugaagguggguauuggggguggcugugaaagaaaauaauggagaaucacuuuucu

SEQ ID NO: 175676 - RNA, 64 nt, hsa
cagcauuuuaucauuccauggaaggagaaucuuuugaaagaaagcauugccuccuaccagaacu

SEQ ID NO: 175677 - RNA, 64 nt, hsa
aucugggaaaccaacauugcgagaguagcuauuuugaaagaauaauucuccagaaguuaacauc

SEQ ID NO: 175678 - RNA, 64 nt, hsa
aguuauaaaaggugaaucuauugaaagaagaacaugaaagaaauaaacaggaguucagcggagc

SEQ ID NO: 175679 - RNA, 64 nt, hsa
auaaacgauuuuaaguuauaaaaggugaaucuauugaaagaagaacaugaaagaaauaaacagg

SEQ ID NO: 175680 - RNA, 64 nt, hsa
auugauugcacuugauuaagcuuuugucuguaggugaaagaacaaguuuaggucgaggacuggc

SEQ ID NO: 175681 - RNA, 64 nt, hsa
caguggcagagaauccaaacucaacaagugcuccugaaagaaacgcuagaagccuaagaacugu

SEQ ID NO: 175682 - RNA, 64 nt, hsa
uugaaaggggaaagauuggagguaagagagaaaaugaaagaacaccucuggguccuucugucca

SEQ ID NO: 175683 - RNA, 64 nt, hsa
uuucuucaccuucaauaugagaauucagcgaacuugaaagaaaaaucaucugugaguuccuuca

SEQ ID NO: 175684 - RNA, 64 nt, hsa
ugauugccuacuuucacauuuauuuaaauuuuugugaaagaaaauacaguuuuaaaggcuauag

SEQ ID NO: 175685 - RNA, 64 nt, hsa
uaauagacauauuuaguagguuaaacuacuccuuugaaagaauaaguuuugguucaaagucaau

SEQ ID NO: 175686 - RNA, 64 nt, hsa
gcacaaagauuauauaugacaaucaguauugcaaugaaagaaaaacuaaaaacagaaaugauau

SEQ ID NO: 175687 - RNA, 64 nt, hsa
gagguuuuucacuccaccaaaucuuacaaaucauugaaagaaauauauucuaacaguacgcacu

SEQ ID NO: 175688 - RNA, 64 nt, hsa
uuaugucuagauaagacuucagacguccugggauugaaagaaugugugugaagggguagaauuu

SEQ ID NO: 175689 - RNA, 64 nt, hsa
ccaaguagcagucagguucuuggugugaugggacugaaagaauuccagucagccagagccuugg

SEQ ID NO: 175690 - RNA, 64 nt, hsa
acuuacauugaaccugguggcauaaugaguauuuugaaagaagaaauuucuucacucucauuuu

SEQ ID NO: 175691 - RNA, 64 nt, hsa
guuucaaaucuugcaucuuccuuuuuuagauuuuugaaagaaaacccuuugguuucauuguguu

SEQ ID NO: 175692 - RNA, 64 nt, hsa
aacaaauaaauagcaugcaacaaaaugucuuuauugaaagaaguggaaguuaucuuaaugccac

SEQ ID NO: 175693 - RNA, 64 nt, hsa
gcuuaugaugccggaauucuguaaacaauaaagaugaaagaaaaaaugaaaacuuuauacaaaa

SEQ ID NO: 175694 - RNA, 64 nt, hsa
uuuagcuauauuaggaaacugcuucuaccuagauugaaagaaauuugacucauaaacuuccaag

SEQ ID NO: 175695 - RNA, 64 nt, hsa
accaauauaccacuuccuaaauauccaucuuuggugaaagaaaauagugugguaagaguaccca

SEQ ID NO: 175696 - RNA, 64 nt, hsa
gagguaaacuaccugauuuuuuuuuguuguuacaugaaagaaugagugacaaaucuuuaaagua

SEQ ID NO: 175697 - RNA, 64 nt, hsa
auauguuguguauaaauguacacuuuuuuagacaugaaagaauugccuuaguugaacaguucuc

SEQ ID NO: 175698 - RNA, 64 nt, hsa
uucaaaaaauuaauauguguacaauuaaaaugaaugaaagaaaaaccauuauuguacagaggua

SEQ ID NO: 175699 - RNA, 64 nt, hsa
cucuugcagugugcucuacugaauauucugacucugaaagaagacagucccuugacuugaagua

SEQ ID NO: 175700 - RNA, 64 nt, hsa
ucaaagagagaaggucggguacuucaagaagaaaugaaagaagggacagacauguucaucauca

SEQ ID NO: 175701 - RNA, 64 nt, hsa
uauggaccuuucucaggacagcuaauugccaccaugaaagaagcaugucgcuaugcacugcaag

SEQ ID NO: 175702 - RNA, 64 nt, hsa
ccugaaagaugggcaaaagacgggaagcaagaugugaaagaagagcagccuaggcagaggcucc

SEQ ID NO: 175703 - RNA, 64 nt, hsa
uccgcggcaggaggagccggugcucuggaagaccugaaagaagcccagguggccacagggcuaa

SEQ ID NO: 175704 - RNA, 64 nt, hsa
agcaugaaauucugucagugccuuuuuuaauacaugaaagaauucuagagagaagccauauaca

SEQ ID NO: 175705 - RNA, 64 nt, hsa
aagcuuucaaucauuuuaguuccuuucaaauacaugaaagaacucaucauggagaaaaccaaac

SEQ ID NO: 175706 - RNA, 64 nt, hsa
gagccuuuagucauuuuaguuccacuugaagccaugaaagaacacacaaaagagaaagcucuug

SEQ ID NO: 175707 - RNA, 64 nt, hsa
aaaagaauucagugauauuucucccauuugcuugugaaagaagagaaauguggcuuuguuccac

SEQ ID NO: 175708 - RNA, 64 nt, hsa
aagcauuugcucuuuccucaugccuaaguaugcaugaaagaauucacacuggggagaaauacua

SEQ ID NO: 175709 - RNA, 64 nt, hsa
aaacauacauuacucuugcagguuuccagauacaugaaagaacccacacuggagagaaaccuua

SEQ ID NO: 175710 - RNA, 64 nt, hsa
aaaccuacauaucuucuguagguuuucaagcacaugaaagaacucacacuggagaaaaacccua

SEQ ID NO: 175711 - RNA, 64 nt, hsa
aagccuucacucauucccguuuccuucaaggacaugaaagaacucauaccgcaaagaagcuaug

SEQ ID NO: 175712 - RNA, 64 nt, hsa
aagcauucucuuggcucacuugccuucuacaacaugaaagaauucacacucgagagaaaccuua

SEQ ID NO: 175713 - RNA, 64 nt, hsa
aaggcuuugauuguuccaguacacugcaaagucaugaaagaacucacacuggagagaagaaacu

SEQ ID NO: 175714 - RNA, 64 nt, hsa
aagccuuucauuuuuacaguucuuaucuaagacaugaaagaacacguacuggggagaaacugua

SEQ ID NO: 175715 - RNA, 64 nt, hsa
aagcauuuuucuggcccaguuuauuucguaugcaugaaagaacucacucuggagagaaacuaua

SEQ ID NO: 175716 - RNA, 64 nt, hsa
acccaccaccuucccaggucaccugccuggucccugaaagaaagcauuugugugggcaauccca

SEQ ID NO: 175717 - RNA, 64 nt, hsa
cuggaaaauaugcuacagaaugaaaguuuguaauugaaagaaaaagaauguauucaucugcuuc

SEQ ID NO: 175718 - RNA, 64 nt, hsa
ugaaguuuuuaauugcuauuguuuuauauaggauugaaagaaaauuaacuccuuuauuaaaaac

SEQ ID NO: 175719 - RNA, 64 nt, hsa
uuuauauuccuguuucuaaaucagcucuucagugugaaagaaaacacguuucuguaacagagag

SEQ ID NO: 175720 - RNA, 64 nt, hsa
ucauggauucccaagaugugagcuuuuuacauaaugaaagaacccagcaauucugucucuuaau

SEQ ID NO: 175721 - RNA, 64 nt, hsa
acagaauuaccucugcuuaguaucucauuauaacugaaagaagguuuaucauuacaaauaccuu

SEQ ID NO: 175722 - RNA, 64 nt, hsa
ccacaaauaugagugggaaauaaaucagcacauuugaaagaaaguguuaaaacugaaggccuca

SEQ ID NO: 175723 - RNA, 64 nt, hsa
uuuugcaauucagggaagauuugggcauauuaaaugaaagaauaucuaauugggggagguguga

SEQ ID NO: 175724 - RNA, 64 nt, hsa
uguuggacgagaaaacaauaacgauaaaagacagugaaagaaaauaacgauaaaagacagugaa

SEQ ID NO: 175725 - RNA, 64 nt, hsa
aaagacagugaaagaaaauaacgauaaaagacagugaaagaaaauaacaauaaaagacaaggaa

SEQ ID NO: 175726 - RNA, 64 nt, hsa
aagguaucaguccagucuuaaagauauuucauugugaaagaagaaacuaaacuaucaggccucu

SEQ ID NO: 175727 - RNA, 64 nt, hsa
caucuaauuugguaguuuccacaaucguauuugaugaaagaaacuucaguccccauuauuaccu

SEQ ID NO: 175728 - RNA, 64 nt, hsa
uuguagauuuaaaaacaagugccguacguuaagagaagagcagaucaugcuauugugacauuug

SEQ ID NO: 175729 - RNA, 64 nt, hsa
aaccuaaaaugcugcugccccaaagcacaagagggaagagcaccgccggggccacaggacgucu

SEQ ID NO: 175730 - RNA, 64 nt, hsa
cuggcaauggugauaauggauuaauuccucaaaggaagagcagaacaccugaaaaucagcaauu

SEQ ID NO: 175731 - RNA, 64 nt, hsa
cuggcaauggugaugauggauuaauuccuccaaggaagagcagaacaccugaaagccagcaauu

SEQ ID NO: 175732 - RNA, 64 nt, hsa
ggagacaaggaaacgggcacagcgaaauccuggugaagagcaaagcagaagaaaugacagcaga

SEQ ID NO: 175733 - RNA, 64 nt, hsa
aaaagaaaaaagauagaaaaaagaaaaaguuucagaagagcagaaguaaacacaaaaaacauaa

SEQ ID NO: 175734 - RNA, 64 nt, hsa
gaagaugaacugugagggcuccuauaaggggcaggaagagcaaagcuguccuaggccaaccaga

SEQ ID NO: 175735 - RNA, 64 nt, hsa
gcccugguuacagacagcuucgagaaccagaggagaagagcauagggucauggagcaggugggc

SEQ ID NO: 175736 - RNA, 64 nt, hsa
cuagugaccagcacugaccaccaucccaagcugggaagagcaauuggugaagaguguguguacu

SEQ ID NO: 175737 - RNA, 64 nt, hsa
ucagugccugugugaagauggugucggcugaaaagaagagcaauggcgucaaguacuaaaugau

SEQ ID NO: 175738 - RNA, 64 nt, hsa
guucugugcacauacuuuucaauacuccccgacggaagagcaaggguggauuuaauuuuuuaac

SEQ ID NO: 175739 - RNA, 50 nt, hsa
agcuccuugaccagggaugagaagagcagucuacuaaaaugugccuauag

SEQ ID NO: 175740 - RNA, 64 nt, hsa
aauacccaucgggaagagacuuuuuuuccauggugaagagcaauaaacucuggauguuugugcg

SEQ ID NO: 175741 - RNA, 64 nt, hsa
gugggggaaagguggcuggaccucuguuggcugagaagagcaucccuucagcuuccccuccccg

SEQ ID NO: 175742 - RNA, 64 nt, hsa
cuauugugaguucucagagcaugaacuguccucagaagagcagggcuaggacuugucccagcau

SEQ ID NO: 175743 - RNA, 64 nt, hsa
ccuucucugaaugacucaggguacccuauagggggaagagcaagucaaaugagcauagugggga

SEQ ID NO: 175744 - RNA, 64 nt, hsa
caucucugacauaaccacaggcugcuguuuucaagaagagcaaucuguuuggauaagaaaaacc

SEQ ID NO: 175745 - RNA, 64 nt, hsa
gaggucuuuuuucauuuaauacuggaaaaauauugaagagcauccauguucacuuauggcuggu

SEQ ID NO: 175746 - RNA, 64 nt, hsa
uagaaugaggccuugugaugugagcguucaauuugaagagcaguuccuaacuucauagaaacua

SEQ ID NO: 175747 - RNA, 64 nt, hsa
cuuuugguugcagugcagagacgccaugucucccgaagagcauugccaucacuggcccuccuag

SEQ ID NO: 175748 - RNA, 64 nt, hsa
ccucuguccccaggccuggcuccccgagggcucagaagagcagcuucggugugcagaucauccg

SEQ ID NO: 175749 - RNA, 64 nt, hsa
gagaacgggcgucaggggugcacaguccacagcugaagagcaagguuucguggcagcacggccc

SEQ ID NO: 175750 - RNA, 64 nt, hsa
acaagugugccuacugcgucaugggcuucacgcagaagagcaacaugaagcugcacaugaagcg

SEQ ID NO: 175751 - RNA, 64 nt, hsa
caccuuuaagaauguuucugaaguuacguuuugugaagagcaaagcacuuggaaucuccguuuu

SEQ ID NO: 175752 - RNA, 64 nt, hsa
gaaauacagagaacgccacaaagauacuccuugagaagagcaacuccaagacacauaauuguca

SEQ ID NO: 175753 - RNA, 64 nt, hsa
ugcuuaacgaaauaaaagaggaugcaaagaaauggaagagcauuccaugcucauggguaggaag

SEQ ID NO: 175754 - RNA, 64 nt, hsa
accauuuugauuuuuaaaguaugcuguagcauuucuuaauaacaucguugugauguucuuaagg

SEQ ID NO: 175755 - RNA, 64 nt, hsa
uguaauuuuaugcaaguugacuauauaucuuguacuuaauaaauuauaggcucauuuuguucuc

SEQ ID NO: 175756 - RNA, 64 nt, hsa
aggagggggagaucuacaauuugaauauguguuacuuaauaaggcuaggcuggccaucaguugc

SEQ ID NO: 175757 - RNA, 64 nt, hsa
cuaaauuuuccuucuagaugguccuugagcaaaacuuaauaauuacuguuuuuuauuuccacug

SEQ ID NO: 175758 - RNA, 64 nt, hsa
gaccucccuaccaagugaugaaaguguugaaaaacuuaauaacaaaugcuuguugggcaagaau

SEQ ID NO: 175759 - RNA, 64 nt, hsa
aacccuauuguaguaaaaaagucuucuuuacuaucuuaauaaaacagauauugugagauucaca

SEQ ID NO: 175760 - RNA, 64 nt, hsa
accuuaaaaccaaaaugaaacacaaaaauuaauccuuaauaaugauagcaagugaucuuucuuu

SEQ ID NO: 175761 - RNA, 64 nt, hsa
uuuuuuaaaaaagcaccuuuuuuuguuguuuccccuuaauaaaagagguuucuaauuuauguuu

SEQ ID NO: 175762 - RNA, 64 nt, hsa
accgcuaauauaaguaaaguuuguaaaauucauacuuaauaaacaauuuaggacagucaugucu

SEQ ID NO: 175763 - RNA, 64 nt, hsa
ucaguguauaaaacauacugugugguauaacaggcuuaauaaauucuuuaaaaggagagaacug

SEQ ID NO: 175764 - RNA, 64 nt, hsa
ugacucaguaaguuggcaagguccugacuuuagucuuaauaaaacauugaauuguaguaaaggu

SEQ ID NO: 175765 - RNA, 64 nt, hsa
aaggagagcuuugcagauaacaaaauagccuauccuuaauaaauccuccacucucuggaaggag

SEQ ID NO: 175766 - RNA, 64 nt, hsa
agaauguggcaaagcauuuaauugguccucaaugcuuaauaaauauaauucaugcuggagagaa

SEQ ID NO: 175767 - RNA, 64 nt, hsa
ucuccucacauuuuacuaacuagcaauguucauacuuaauaaaaacauuauaaauguaauuucu

SEQ ID NO: 175768 - RNA, 64 nt, hsa
acacuuaguauuucccccacagagugccuagaaucuuaauaaugaauaaaauaaaaagcagcaa

SEQ ID NO: 175769 - RNA, 64 nt, hsa
gggcauuuaauucugacuuuauccccacgucagccuuaauaaagucuucuuuaccuucucuaug

SEQ ID NO: 175770 - RNA, 64 nt, hsa
uuguuacuucagcuacugauucaaagccaauacucuuaauaaaguguugcaauacucugacguu

SEQ ID NO: 175771 - RNA, 64 nt, hsa
uauuauucaugacagcuuuguacuguggaaugugcuuaauaaaaaacaaaaaaguuugacuuuu

SEQ ID NO: 175772 - RNA, 64 nt, hsa
acacugguuaacuuuuuccagaucucaugucuggcuuaauaagagauauuuguauuaucauauc

SEQ ID NO: 175773 - RNA, 64 nt, hsa
uuucuuagccuccauaaucacaugagccaaucuccuuaauaaaugccugcucauagaucuguau

SEQ ID NO: 175774 - RNA, 64 nt, hsa
acauuuuggacagcacaugaagucugccaauguacuuaauaaaacaugacuuuguuuauuuaaa

SEQ ID NO: 175775 - RNA, 64 nt, hsa
gagcugaagcacacggccauguuggagagcaaaacuuaauaauaauucuuuuuuaaaaucugcu

SEQ ID NO: 175776 - RNA, 64 nt, hsa
guugaccuguguuuguaauuucacuuucaucuugcuuaauaaauaucugcuggauucuuucauu

SEQ ID NO: 175777 - RNA, 64 nt, hsa
cuccacaagagcugaggguuucauaacuuuauggcuuaauaaauguaugacacugaaaagauuu

SEQ ID NO: 175778 - RNA, 64 nt, hsa
cauucuagaaauuugaaguauguaaccugaaauccuuaauaaaauuuggauuuaauuuuauaaa

SEQ ID NO: 175779 - RNA, 64 nt, hsa
gauugucauuagaggaaggucuagauuuccugcucuuaauaaaauuacauugaauugauuuuua

SEQ ID NO: 175780 - RNA, 64 nt, hsa
cugcucacauuuuacucaacacagagaguuccugcuuaauaaaagcauuauaagugcaauuacu

SEQ ID NO: 175781 - RNA, 64 nt, hsa
auauacgaguauaaaugaaauucauuucuaaauucuuaauaaauauuuucucaugccaggugug

SEQ ID NO: 175782 - RNA, 64 nt, hsa
aaagaaaaaaaaugggcgaagagaggguggaaaauaaaaggauucuuuuuucuuccuuucuguu

SEQ ID NO: 175783 - RNA, 64 nt, hsa
agaaguagaaaggaagaaaaacucaaagaauucuuaaaaggauucauagcaacauaaugugucc

SEQ ID NO: 175784 - RNA, 64 nt, hsa
uuuuuauuuuguauauguagaauauuauaauuuuuaaaaggacuauugaugauagaagaauagg

SEQ ID NO: 175785 - RNA, 64 nt, hsa
ucuucccccaaagaguugaaaucuuaaaucuauuuaaaaggauauaaaagcuuuggauauguau

SEQ ID NO: 175786 - RNA, 64 nt, hsa
ucguucauguauauaagcuauuucuugauccauuuaaaaggaauuguacauuguguagaaaaaa

SEQ ID NO: 175787 - RNA, 64 nt, hsa
guuuuccugcuuugguuaccuuuccuuuccccuuuaaaaggaauuagcuauagaacugcuuugu

SEQ ID NO: 175788 - RNA, 64 nt, hsa
uauaggcuuuugacaaaaguuggcacaaaaaguauaaaaggaggccuauucuuuucaguugacc

SEQ ID NO: 175789 - RNA, 64 nt, hsa
auauucccacuuuauaaagaauuugagguuaagauaaaaggacucauuuaagcucacaugguca

SEQ ID NO: 175790 - RNA, 64 nt, hsa
auggucauagcucauuacucuaccaccaagaaccuaaaaggaauuagaauacagcagaauuggc

SEQ ID NO: 175791 - RNA, 64 nt, hsa
agaucauuuggaagacuuuagacucuauuaauuuuaaaaggaauauuuauuagccauaugcaga

SEQ ID NO: 175792 - RNA, 64 nt, hsa
agggccucugcucuccugggagacaaagcaauaauaaaaggaaguguuuguaaucccagcacuu

SEQ ID NO: 175793 - RNA, 64 nt, hsa
aauaaacaaauaaauuuuaaaaauaaauaaauaauaaaaggaaguguuagacaauguaaugcca

SEQ ID NO: 175794 - RNA, 64 nt, hsa
aaaauaagagaaguaaucccagauaauaaauuccuaaaaggaaacuguauaagcaauugcccuu

SEQ ID NO: 175795 - RNA, 64 nt, hsa
uuauuaaaaaauaagugauacaaauauuuauaaauaaaaggagagagguuugaguucuggguau

SEQ ID NO: 175796 - RNA, 64 nt, hsa
cauauuuuucuuaccaaaggagucuucagcccuauaaaaggauuccucuauaguguauuucucu

SEQ ID NO: 175797 - RNA, 64 nt, hsa
auggggcauucaaguugugagcucagaauuacuuuaaaaggagguaacagccagccauuacacc

SEQ ID NO: 175798 - RNA, 64 nt, hsa
ccugggcuggggguggggugggagaggucuuuuuuaaaaggaaguuacuguuauagagggucua

SEQ ID NO: 175799 - RNA, 64 nt, hsa
aggagguuuaggucaagaagaagauggauugguguaaaaggaugggucugguuugcagagcuug

SEQ ID NO: 175800 - RNA, 64 nt, hsa
uucuaacuccuuauugaagcuaaggggugcuuacuaaaaggaggcagccauauaggccuuuuaa

SEQ ID NO: 175801 - RNA, 64 nt, hsa
cugucaccaugcagccgcugauaguucucugaacuaaaaggacuaauuguacuuugaggccaau

SEQ ID NO: 175802 - RNA, 64 nt, hsa
ucuuauuugucuaaauugccccuuuuucuguuccuaaaaggaaggauaagagagaacauuccag

SEQ ID NO: 175803 - RNA, 64 nt, hsa
uagacccuauaguguuaagagguauuuuaaacacuaaaaggacaaagcucuucccaauccuuau

SEQ ID NO: 175804 - RNA, 64 nt, hsa
uccuuuugcauuaaaaggacuuuacacaccuguguaaaaggaugugggagaggagggucugaag

SEQ ID NO: 175805 - RNA, 64 nt, hsa
ucugucccuggagacucuggaaauccuuuugcauuaaaaggacuuuacacaccuguguaaaagg

SEQ ID NO: 175806 - RNA, 64 nt, hsa
cuuuugagaaaacaaugauguaaauuccuuaugauaaaaggaugauucuauauauucuuuaaug

SEQ ID NO: 175807 - RNA, 64 nt, hsa
aucuuugauauaaagcacugccauauuuauauuuuaaaaggaaauuagacauuuuauauguagc

SEQ ID NO: 175808 - RNA, 64 nt, hsa
augcacagggcuugagcuuucugucauuugacuuuaaaaggaaguuucauucauauuuauccuc

SEQ ID NO: 175809 - RNA, 64 nt, hsa
cagguguuuucucuuggacauacuaaaaaauaccuaaaaggaagcuuagaugggcugugacaca

SEQ ID NO: 175810 - RNA, 64 nt, hsa
gaaaaaguuugggaagcucuuuagcaauaucagcuaaaaggauaugaaaucacaggugauagca

SEQ ID NO: 175811 - RNA, 64 nt, hsa
uugaaagggaaacucagaguacuaggacguuuauuaaaaggaaaaaaaugucuugcaaugugcu

SEQ ID NO: 175812 - RNA, 64 nt, hsa
ugugauuggcaagacauguauuuaaacaauaaacuaaaaggaaauaaucuccacguacuaccau

SEQ ID NO: 175813 - RNA, 64 nt, hsa
auuuuucuucaaaggcuuguuaaaccaaucauguuaaaaggaaauucuugguuuugguuuguug

SEQ ID NO: 175814 - RNA, 64 nt, hsa
gugguaacuugaaggcagcacagaggugagggauuaaaaggaaaggcagauuuugaaaucugac

SEQ ID NO: 175815 - RNA, 64 nt, hsa
ucuccaucccauguaccacaacuaucuugcugcuuaaaaggagacuuaguaaaguucucuugua

SEQ ID NO: 175816 - RNA, 64 nt, hsa
aagccaaaggauuuaagaguuuuguuguuguuaauaaaaggaauacuccuuuuccuuuuggauc

SEQ ID NO: 175817 - RNA, 64 nt, hsa
aaaguuaguguaucaguaagaaacagaccuaguuuaaaaggaauaaucaacaauuuuauaaagg

SEQ ID NO: 175818 - RNA, 64 nt, hsa
gcagagaggagagucuuacggagggcugggagcuuaaaaggaaaacaauguccuuacuuguaaa

SEQ ID NO: 175819 - RNA, 64 nt, hsa
cuguuuaugauaccaaaaaaauuacaguuuuguuuaaaaggaaauguugauguuuucaacucca

SEQ ID NO: 175820 - RNA, 64 nt, hsa
gaagaugaagauuauaacuguuuauuuaccuaauuaaaaggaaaggcagugccaaauaugagag

SEQ ID NO: 175821 - RNA, 64 nt, hsa
agcuuuuaauuagucaaacuaaauuaaggcucauuaaaaggaaaggaacuacugggaaauuaug

SEQ ID NO: 175822 - RNA, 64 nt, hsa
uuacuguuauaugagaaacauuuuaguaauuuaauaaaaggauaauguuuauuuaaaaaaccug

SEQ ID NO: 175823 - RNA, 64 nt, hsa
acuuuacagauaauggagcagaagccaacauuaguaaaaggaaucccaacuucuucccauagaa

SEQ ID NO: 175824 - RNA, 64 nt, hsa
agggagcugaggccauucccuguaggaguaaagauaaaaggauaggaaaagauucaaagcucua

SEQ ID NO: 175825 - RNA, 64 nt, hsa
caaaucuuccucuggagcuuugcagccaaggugcuaaaaggaauagguaggagaccucuucuau

SEQ ID NO: 175826 - RNA, 64 nt, hsa
uagcaagaaaaaaacagucaacuacagaaacucuuaaaaggaauaaaaacccaaaguuccuuau

SEQ ID NO: 175827 - RNA, 64 nt, hsa
ggugaucacguuucguguucauacucaacguuaauaaaaggagagaguuuguagugaaauggca

SEQ ID NO: 175828 - RNA, 64 nt, hsa
uaccuauaagauuguugggaguuaauggugucaauaaaaggauugauggucccucuaaugaaac

SEQ ID NO: 175829 - RNA, 64 nt, hsa
ccccagccugacagugcuagucucuguuuaaugguaaaaggagacuuugccauaauuuucagau

SEQ ID NO: 175830 - RNA, 64 nt, hsa
auaccacagacacaguuaaagcaaaaggaaacaauaaaaggaaugucugcaugcuauuuuaauc

SEQ ID NO: 175831 - RNA, 64 nt, hsa
cugucuguuucauuggacugucccauuugcugguuaaaaggauuggggcccaaauccucuggcc

SEQ ID NO: 175832 - RNA, 64 nt, hsa
agugguaccuugaaaauccaaaagccaucucaaguaaaaggaauaaaugugucaugcuuuuuaa

SEQ ID NO: 175833 - RNA, 64 nt, hsa
gauuugcuaugcagacagggaagggaauuucacuuaaaaggaaggucauuuggagaugugaaga

SEQ ID NO: 175834 - RNA, 64 nt, hsa
uguuuaagacaagugaauucuauagugguugccauaaaaggaaguucuagguauuuauaguaga

SEQ ID NO: 175835 - RNA, 64 nt, hsa
uguguugcucacaaguggccagaacuccuauuccuaaaaggauuuugagauggaggaacacaua

SEQ ID NO: 175836 - RNA, 64 nt, hsa
ggcgcuccuucucuccuuccaucacuacaguaaguaaaaggaccauagaggggaaccaggaauc

SEQ ID NO: 175837 - RNA, 64 nt, hsa
uaacaugguaagccuuagcagcaaacauucuuccuaaaaggaagacuucauuuucucaagaaau

SEQ ID NO: 175838 - RNA, 64 nt, hsa
ggacuagaacuguauuuuuaagguuguuuuccccuaaaaggaccuuuaguaagcaaauuuauua

SEQ ID NO: 175839 - RNA, 64 nt, hsa
aauaguuugacagcucauuuugaagauuacauuauaaaaggaauauaccuggugggugcauagu

SEQ ID NO: 175840 - RNA, 64 nt, hsa
uuauaauuggagauccugaacaccaaaguaagccuaaaaggaaucuuugaggaaaaaagccuuc

SEQ ID NO: 175841 - RNA, 64 nt, hsa
caaauggaucacagaccugaaucuguuguguugguaaaaggaaucaacaccuuuacauugcuca

SEQ ID NO: 175842 - RNA, 62 nt, hsa
gugcugcucugcucugcccacccuggguucugcauuccuaugggugacccaauuauucagac

SEQ ID NO: 175843 - RNA, 62 nt, hsa
auauuuuugucuucuuccuuuccccucuuugccauuccuaccuugcauuuuuccugucagug

SEQ ID NO: 175844 - RNA, 62 nt, hsa
cuguuagucauuauguuggguaauagccguggcauuccuacagaacagagugaggacaggcu

SEQ ID NO: 175845 - RNA, 62 nt, hsa
ucacggguaaggaggauuaggaaugaguauuccauuccuaggugucaucagaugaccuugac

SEQ ID NO: 175846 - RNA, 62 nt, hsa
agaguaucacagccaggaugacccuugggucccauuccuaagacaugguuacuuuauuuucc

SEQ ID NO: 175847 - RNA, 62 nt, hsa
gguggggcacccuuuucucgccgcaagaagcccauuccuauggaagucuagcaaagcaauac

SEQ ID NO: 175848 - RNA, 62 nt, hsa
ccccauuccuacaauuucuauguggcccaagucauuccuaaucuuggucucuauagcagugu

SEQ ID NO: 175849 - RNA, 62 nt, hsa
agugggucugguggugcuggucuuuuccuccccauuccuacaauuucuauguggcccaaguc

SEQ ID NO: 175850 - RNA, 64 nt, hsa
cuuuauucugauuaugugaaaccauauucuauugcuaggggaagccaagaaccauucucuauac

SEQ ID NO: 175851 - RNA, 64 nt, hsa
auguguauauaugguaacaaagcauagcaguucucuaggggagaggccuggcauugcacauggu

SEQ ID NO: 175852 - RNA, 64 nt, hsa
uuuggcccuugguguuucuggagccuccagggaucuaggggagccugggcugcgugcaugucga

SEQ ID NO: 175853 - RNA, 64 nt, hsa
auuaauuacccuccguuucccacauccccacucucuaggggauuagcuugugcgugucaaaaga

SEQ ID NO: 175854 - RNA, 64 nt, hsa
uaugauagaaucucaucuaaucuugacaucucuccuaggggaagaauaucacaggcuaauagcg

SEQ ID NO: 175855 - RNA, 64 nt, hsa
uccugcuggcuagaccagccuauucagcgcuuugcuaggggauugggugguccacgcacucgcu

SEQ ID NO: 175856 - RNA, 64 nt, hsa
uguaauaucuccuguuguuucuaugauauaggagcuaggggaaggggguuguuugccuucuuca

SEQ ID NO: 175857 - RNA, 64 nt, hsa
ucuucuguccugucuuauacugcaacugugucuccuaggggacagauggccuucuuugucaucu

SEQ ID NO: 175858 - RNA, 64 nt, hsa
gugagggcuccuauaccuuguccuuccugcuugccuaggggaagaggagaagaggguaaggggg

SEQ ID NO: 175859 - RNA, 64 nt, hsa
accucacguucggacugccuucaucaagacaacucuaggggaccauuuugccuggggcuccuag

SEQ ID NO: 175860 - RNA, 64 nt, hsa
gagaaguguuguuagaaacauauaggaauaaugccuaggggaaagggagaagugagagggacaa

SEQ ID NO: 175861 - RNA, 64 nt, hsa
guguaagaggcagccaagucagcucugccaacugcuaggggaguugggaaagagugggugugug

SEQ ID NO: 175862 - RNA, 64 nt, hsa
ucucauugaauuauaaaagccagcaggcuucaaacuaggggacaaagcaaaaagugaugauagu

SEQ ID NO: 175863 - RNA, 64 nt, hsa
auuaauacaaugaugcuauuugcaauuccugcuccuaggggaggggagauaagaaacccucacu

SEQ ID NO: 175864 - RNA, 64 nt, hsa
cccuagaucugaguuuucagagugcuucugaaguacaguuuaaaaacacuuuuuaaaaagugga

SEQ ID NO: 175865 - RNA, 64 nt, hsa
ccuguuuugauacuucuaaguuaaaauauauguuacaguuuaucugguacuucauuuuucuuaa

SEQ ID NO: 175866 - RNA, 64 nt, hsa
gaaguuuaaaugcuuguuuggaaaacuuuauuuaacaguuuagaaggcuugauagaaagagugc

SEQ ID NO: 175867 - RNA, 64 nt, hsa
aagacauguauagaaaguauggaaaagaaaacagacaguuuaguucagaauggaaacgaacguu

SEQ ID NO: 175868 - RNA, 64 nt, hsa
cccaaaguaccaguuuuccagaaaaccacauuuuacaguuuaugaugauuaauagcagcagcau

SEQ ID NO: 175869 - RNA, 64 nt, hsa
ucuuuugcaagccuuugauuuuuuuuuuuuuguuacaguuuaguaauuuauauucaccagucac

SEQ ID NO: 175870 - RNA, 64 nt, hsa
auguuugaccagaauuauaugacaagaacuggugacaguuuagugccucugcccauuguccaug

SEQ ID NO: 175871 - RNA, 64 nt, hsa
aaacucuaaaugcauggcaacuguuaaugucauaacaguuuaguuauuuuguucuguucuguca

SEQ ID NO: 175872 - RNA, 64 nt, hsa
agaacguugcaaauuuguuaaaaugccaaaaaggacaguuuaauuuuguacagauuaugcuuac

SEQ ID NO: 175873 - RNA, 64 nt, hsa
aaaaaagaaaaaaagaauguaaaauuuuaaaaauacaguuuaacagcuguaaaaguuuuacuau

SEQ ID NO: 175874 - RNA, 64 nt, hsa
gaagagacuuucauucuuuaaauauuauugacuuacaguuuaaaaauaaauaaauaaaagcaua

SEQ ID NO: 175875 - RNA, 64 nt, hsa
uuggaacaaugccaggauccaaacugauuaaguuacaguuuaagcacccuucaguauuaauaua

SEQ ID NO: 175876 - RNA, 64 nt, hsa
gggaguugauuuauuaaguacaguauaccucucaacaguuuauaaauaauauguugaauuaugu

SEQ ID NO: 175877 - RNA, 64 nt, hsa
acuccaggccaagugugccuuagcacgagugaccacaguuuaauagaccacacacaucguuuaa

SEQ ID NO: 175878 - RNA, 64 nt, hsa
cuuuguuaaaaauaucugccaguuauuaaaaagcacaguuuaaauggggugggguuaaaguuca

SEQ ID NO: 175879 - RNA, 64 nt, hsa
gugguaggaaguaucauguaaucacaguuuaaugacaguuuauguauauauauaauucaguauu

SEQ ID NO: 175880 - RNA, 64 nt, hsa
ucuaauaagcugugguaggaaguaucauguaaucacaguuuaaugacaguuuauguauauauau

SEQ ID NO: 175881 - RNA, 55 nt, hsa
caggacuuccagagucaugacaugaacaguuuaauugaacccauccacucugggc

SEQ ID NO: 175882 - RNA, 64 nt, hsa
gaagaagaacaagaauuccacaugagaaguaaaaacaguuuacaguacucagcaaaagaacaug

SEQ ID NO: 175883 - RNA, 64 nt, hsa
aaauagaaauagauauuuuuaaauaaaaccauucacaguuuacuuugucuugauaccuugguuu

SEQ ID NO: 175884 - RNA, 64 nt, hsa
aaugcuaugacuuugaaauucacagaaagaaauaacaguuuagauuaggucuucagguauucag

SEQ ID NO: 175885 - RNA, 64 nt, hsa
guuaaacaaacuaggugcuuguaaauaauuuauuacaguuuacucuaucgcauuucuguaacau

SEQ ID NO: 175886 - RNA, 64 nt, hsa
uuuuaaauaucauguaauguuaaaacguuuucuaacaguuuacuguugcuuaucuccaagauau

SEQ ID NO: 175887 - RNA, 64 nt, hsa
uucaugaauucacagauaaguacuuaaagaacagacaguuuacuuggccuaaaaauauuuugau

SEQ ID NO: 175888 - RNA, 64 nt, hsa
ucuugccuagaugucgaugacugcaaguaauaauacaguuuauaaugaaacuaucuacaauucu

SEQ ID NO: 175889 - RNA, 64 nt, hsa
uuaguauugauagcuuacauauggccaaaggaauacaguuuauagcaaaacauggguaugcugu

SEQ ID NO: 175890 - RNA, 64 nt, hsa
aauuuuaaauuaauuuugaaucacuaauauuuucacaguuuauuaauauauuuaauuucuauuu

SEQ ID NO: 175891 - RNA, 64 nt, hsa
ggcucugcuauaugguacaacuaaugcuagaccuacaguuuauguauacaguugauuuugaugu

SEQ ID NO: 175892 - RNA, 64 nt, hsa
uugucuuuguguuucauaauuaguuuuuauaaaaacaguuuacauuaaacaucuuggaauucaa

SEQ ID NO: 175893 - RNA, 64 nt, hsa
ucauguugcucugguuugugauaauaaaggcuuuacaguuuaagccacauuuaaucuuggggcu

SEQ ID NO: 175894 - RNA, 64 nt, hsa
aaaauuacugagucauauucuguauggauauaccacaguuuauccauuuaucuuaauugauguc

SEQ ID NO: 175895 - RNA, 64 nt, hsa
aaggugucuaguccagcucccauggaggguggggaagaagaagaagaacuucuagguccuaaac

SEQ ID NO: 175896 - RNA, 64 nt, hsa
gugucuaguccagcucccauggaggguggggaagaagaagaagaacuucuagguccuaaacuag

SEQ ID NO: 175897 - RNA, 64 nt, hsa
ucuaguccagcucccauggaggguggggaagaagaagaagaacuucuagguccuaaacuagaag

SEQ ID NO: 175898 - RNA, 64 nt, hsa
gaagaagaacuucuagguccuaaacuagaagaggaagaagaagaggaaguaguugaaaaugaug

SEQ ID NO: 175899 - RNA, 64 nt, hsa
cagagaacugucucguacuagaauucaaggaggaaagaagaagaaauaaaagaagcugcuccau

SEQ ID NO: 175900 - RNA, 64 nt, hsa
agaacugucucguacuagaauucaaggaggaaagaagaagaaauaaaagaagcugcuccauuuu

SEQ ID NO: 175901 - RNA, 64 nt, hsa
ugccuuuguuuuuacuagugucugcuguugcaaaaagaagaaaacauucuuugccugaguuuua

SEQ ID NO: 175902 - RNA, 64 nt, hsa
ggaagaaaagaaggggaagaagaucaaagaagaaaagaagaaggggaagaaaagaaggggaaga

SEQ ID NO: 175903 - RNA, 64 nt, hsa
ggggaaggggaagaaaagaaggggaagaagaucaaagaagaaaagaagaaggggaagaaaagaa

SEQ ID NO: 175904 - RNA, 64 nt, hsa
cagagcaugcagugauggaagaagcaggaaaagcaagaagaaaagacagcagcaucaagaggag

SEQ ID NO: 175905 - RNA, 64 nt, hsa
agaacaugcugagcagaacaucagaaaaagcaagaagaagaaaaggcgacaucaagaaggaaag

SEQ ID NO: 175906 - RNA, 64 nt, hsa
cccagaacaugcugagcagaacaucagaaaaagcaagaagaagaaaaggcgacaucaagaagga

SEQ ID NO: 175907 - RNA, 64 nt, hsa
caaagaggagaaugaagauccagaaaggaaaauaaagaagaagggcuucggcgccaugcugagg

SEQ ID NO: 175908 - RNA, 64 nt, hsa
gaagaagggcuucggcgccaugcugagauuuggaaagaagaaagaggauaaggguggaaaggcu

SEQ ID NO: 175909 - RNA, 64 nt, hsa
gaacucagcccuguugcaaugcuuagggcccuuaaagaagaaaaucuccccagaaggcauccau

SEQ ID NO: 175910 - RNA, 64 nt, hsa
ucuauuuuuucuauaaguuuuauugcaagagguaaagaagaaaacuauauauauauaucuuauu

SEQ ID NO: 175911 - RNA, 64 nt, hsa
aaauauguaagcuaaacauauaacuauauguuuuaagaagaaaacaucuacgaaagguaaaaag

SEQ ID NO: 175912 - RNA, 64 nt, hsa
uagguucuaucucuguagaaugucuccaagauugaagaagaaacugagcaguugaaaaaugcua

SEQ ID NO: 175913 - RNA, 64 nt, hsa
ucuagcuuguauccccacaucaugagaaagagggaagaagaagaagggaugaugugugguagag

SEQ ID NO: 175914 - RNA, 64 nt, hsa
agcuuguauccccacaucaugagaaagagggaagaagaagaagggaugaugugugguagagaag

SEQ ID NO: 175915 - RNA, 64 nt, hsa
aaaggaaaaagaaaccacaaauuggggaaaaaaaaagaagaaaaaccuguuuccgugugcaaaa

SEQ ID NO: 175916 - RNA, 64 nt, hsa
ugacugugcuuguucguaacagaugcaaacaagaaagaagaacugggaagucuuugucccuagg

SEQ ID NO: 175917 - RNA, 64 nt, hsa
cuuaaaguggucauauuauuauuaauuuugccaaaagaagaagaauuuauugaauauuuauacu

SEQ ID NO: 175918 - RNA, 64 nt, hsa
aaaguggucauauuauuauuaauuuugccaaaagaagaagaauuuauugaauauuuauacuaua

SEQ ID NO: 175919 - RNA, 64 nt, hsa
ucaguauggcuugcugcuuuuauuuuuauuuuugaagaagaauagccuuuuucucugcacuauu

SEQ ID NO: 175920 - RNA, 64 nt, hsa
uaaauugcucuauuuuaacuuauuuauguccuaaaagaagaauguaauuuguuuacaaaccugu

SEQ ID NO: 175921 - RNA, 64 nt, hsa
cuacauacgcauguauauauuacagcuuaucuguaagaagaaaaugcauuuuaaacacaacucu

SEQ ID NO: 175922 - RNA, 64 nt, hsa
ugcauguaacuuuuaugauaguuauuccaaauucaagaagaagcaguauuaacaucaauugauc

SEQ ID NO: 175923 - RNA, 64 nt, hsa
uuaaguuucacagacaucauagauccuuuucuuaaagaagaaaaacauguauaaaauaguuuua

SEQ ID NO: 175924 - RNA, 64 nt, hsa
uaaugagaggaggcagagagagggaggcagauggaagaagaaaaacaguuaaauaagacauacc

SEQ ID NO: 175925 - RNA, 64 nt, hsa
uguuggucaaaaucugcaaacucuaaaagaagaaaagaagaaaaaaccaagcuuaggguauuuu

SEQ ID NO: 175926 - RNA, 64 nt, hsa
accaugucuguuggucaaaaucugcaaacucuaaaagaagaaaagaagaaaaaaccaagcuuag

SEQ ID NO: 175927 - RNA, 64 nt, hsa
ucauuuuuagauuuuguugaguccuguaaagaagaagaagaaaaaaguuucaguugugguagaa

SEQ ID NO: 175928 - RNA, 64 nt, hsa
aguucauuuuuagauuuuguugaguccuguaaagaagaagaagaaaaaaguuucaguuguggua

SEQ ID NO: 175929 - RNA, 64 nt, hsa
cauaguucauuuuuagauuuuguugaguccuguaaagaagaagaagaaaaaaguuucaguugug

SEQ ID NO: 175930 - RNA, 64 nt, hsa
cagcgaugggucuccaggcaaguccccguccaaaaagaagaagaaguuccguaccccguccuuu

SEQ ID NO: 175931 - RNA, 64 nt, hsa
cgaugggucuccaggcaaguccccguccaaaaagaagaagaaguuccguaccccguccuuucug

SEQ ID NO: 175932 - RNA, 64 nt, hsa
gaaguuccguaccccguccuuucugaagaagagcaagaagaagagugacuccugaaagcccugc

SEQ ID NO: 175933 - RNA, 64 nt, hsa
aucucaaaaaaaaaaaaaaaaaaaaaaaaaaaaaaagaagaagaaacccugagccauuaaugug

SEQ ID NO: 175934 - RNA, 64 nt, hsa
ucaaaaaaaaaaaaaaaaaaaaaaaaaaaaaaagaagaagaaacccugagccauuaaugugucu

SEQ ID NO: 175935 - RNA, 64 nt, hsa
uuuucaugcuuauuuuauucuuugucacagaugaaagaagaauaggacuaauuggggcuaagau

SEQ ID NO: 175936 - RNA, 64 nt, hsa
agaagcuuuugaaaacagacugaagggucgucggaagaagaacaggaaaagagaugaaguggca

SEQ ID NO: 175937 - RNA, 64 nt, hsa
cagauaaaagaagcagaagccaaagcugcucuugaagaagaaaaacgaagacaacagguaacca

SEQ ID NO: 175938 - RNA, 64 nt, hsa
ggcugagaaaaagcaaaagaaaagcaaaaaaaagaagaagaaacagcagaaagcagucucaggu

SEQ ID NO: 175939 - RNA, 64 nt, hsa
ucaggcugagaaaaagcaaaagaaaagcaaaaaaaagaagaagaaacagcagaaagcagucuca

SEQ ID NO: 175940 - RNA, 64 nt, hsa
uucccaaaauguugaaauaugauguuaaaaaaauaagaagaaugcuuaaucagauagauauucc

SEQ ID NO: 175941 - RNA, 64 nt, hsa
cuaaaucuuuuauaggauuuauuuaaaauagcaaaagaagaaguuucaucauuuuuuacuuccu

SEQ ID NO: 175942 - RNA, 64 nt, hsa
agcauugggauaucuccugaaaagguuuaugaaaaagaagaaucucaucucagugaagaauacu

SEQ ID NO: 175943 - RNA, 64 nt, hsa
gcuccaggaucuuugacugaaaaaaaaaaagaagaagaagaaggagagcaagaaggaaagauuu

SEQ ID NO: 175944 - RNA, 64 nt, hsa
uaugcuccaggaucuuugacugaaaaaaaaaaagaagaagaagaaggagagcaagaaggaaaga

SEQ ID NO: 175945 - RNA, 64 nt, hsa
ccauaugcuccaggaucuuugacugaaaaaaaaaaagaagaagaagaaggagagcaagaaggaa

SEQ ID NO: 175946 - RNA, 64 nt, hsa
gugccaaacagaguauguccgaugguaucuggguaagaagaaagcaaaagcaagggaccuucau

SEQ ID NO: 175947 - RNA, 64 nt, hsa
cucauucuuuagagaugcuaaaauucuucgcauaaagaagaagaaauuaaggaacauaaaucuu

SEQ ID NO: 175948 - RNA, 64 nt, hsa
auucuuuagagaugcuaaaauucuucgcauaaagaagaagaaauuaaggaacauaaaucuuaau

SEQ ID NO: 175949 - RNA, 64 nt, hsa
gugauaagcaaggaggguguaaguuuaggggacaaagaagaaagaaugaauaauacgagcagac

SEQ ID NO: 175950 - RNA, 64 nt, hsa
uuuaaugaaaaaaaaaaacaaaaaaaacggauccaagaagaaaagagaauuuauuuccuucucc

SEQ ID NO: 175951 - RNA, 64 nt, hsa
guacuguguuguaccuuuauuucuguauuucuaaaagaagaaaguucuuuccuagcaggguuug

SEQ ID NO: 175952 - RNA, 64 nt, hsa
uuccauccccaaggcaaacaaggaaaggaaaggaaagaagaaaaggugccuuaguccuuuguug

SEQ ID NO: 175953 - RNA, 64 nt, hsa
aaugcugaaucacaggaaugguguugaggcuaccaagaagaaauccaugcagccacuuuggguu

SEQ ID NO: 175954 - RNA, 62 nt, hsa
accccuucggccagucuuaaacgggugucagcaagaagaaaaauuaacaaaagacagaaggc

SEQ ID NO: 175955 - RNA, 64 nt, hsa
agaucucuuucuaaagacaggagagauuauuuacaagaagaacucaccaggguuuaguuugcau

SEQ ID NO: 175956 - RNA, 64 nt, hsa
uaaccguaaagguuuauuuuucuguuaccucaacaagaagaauuugaagacuucaaaauauuga

SEQ ID NO: 175957 - RNA, 64 nt, hsa
uuucucuuuuaauauuuuaugauugccaucaaagaagaagaaaaagaaggaacagacaaagguu

SEQ ID NO: 175958 - RNA, 64 nt, hsa
cauuuucucuuuuaauauuuuaugauugccaucaaagaagaagaaaaagaaggaacagacaaag

SEQ ID NO: 175959 - RNA, 64 nt, hsa
uacucauccugauaaucucuuaagagcgcccgagaagaagaaugaaacgccuguauauccuggu

SEQ ID NO: 175960 - RNA, 64 nt, hsa
cccucaccuguggaauuuggugucagcuaaaaggaagaagaaauggaaacuuaaauucuagccg

SEQ ID NO: 175961 - RNA, 64 nt, hsa
agacccuaugaaaaaauuaguugagaaagaagagaagaagaaaaucaaccagcaggaaaguaca

SEQ ID NO: 175962 - RNA, 64 nt, hsa
ugugcuccagccugggcgacagaagucuugucucaagaagaaaacgaacugggaaaauuucuuc

SEQ ID NO: 175963 - RNA, 64 nt, hsa
uuccuauaaaaguagcauuuuugguaaaguuucaaagaagaagaaacagagauggaagaguaaa

SEQ ID NO: 175964 - RNA, 64 nt, hsa
cuauaaaaguagcauuuuugguaaaguuucaaagaagaagaaacagagauggaagaguaaagau

SEQ ID NO: 175965 - RNA, 64 nt, hsa
gaagagagacaaagaucacuacagaccaaaacagaagaagaagaaaaaaaagaaaaagaaaucu

SEQ ID NO: 175966 - RNA, 64 nt, hsa
gagagacaaagaucacuacagaccaaaacagaagaagaagaaaaaaaagaaaaagaaaucuaag

SEQ ID NO: 175967 - RNA, 64 nt, hsa
gggagcucagaugaugaugauguuaguaguuuggaagaagaacaagaauuccacaugagaagua

SEQ ID NO: 175968 - RNA, 64 nt, hsa
aaacauaaaaggaggagacauacaaugggggaagaagaagaaguccccuguaagaugucacugu

SEQ ID NO: 175969 - RNA, 64 nt, hsa
gauaaacauaaaaggaggagacauacaaugggggaagaagaagaaguccccuguaagaugucac

SEQ ID NO: 175970 - RNA, 64 nt, hsa
ccauuagacugaauuuaacuacuaagaauaaauaaagaagaaaauaaccuuaaucucuuguauu

SEQ ID NO: 175971 - RNA, 64 nt, hsa
uguaauauacaguuuuuguaaccauaugauugaaaagaagaaagucuaugcuuaggccagucag

SEQ ID NO: 175972 - RNA, 64 nt, hsa
acaaaacaaaacaaacaaaugaaaaacguuuaaaaagaagaagaagaaaaaaaacaagaacaag

SEQ ID NO: 175973 - RNA, 64 nt, hsa
aaacaaaacaaacaaaugaaaaacguuuaaaaagaagaagaagaaaaaaaacaagaacaagcag

SEQ ID NO: 175974 - RNA, 64 nt, hsa
caaaacaaacaaaugaaaaacguuuaaaaagaagaagaagaaaaaaaacaagaacaagcagcaa

SEQ ID NO: 175975 - RNA, 64 nt, hsa
aagaaagaaagcuucagaccgcuaguaaggcucaaagaagaagaaaaacaccaaaaccacaagg

SEQ ID NO: 175976 - RNA, 64 nt, hsa
aaagaaagcuucagaccgcuaguaaggcucaaagaagaagaaaaacaccaaaaccacaagggaa

SEQ ID NO: 175977 - RNA, 64 nt, hsa
ccuuuuguuuccaggaaaauauugaucaccaugaaagaagaauaguuuuuuguccccagagaca

SEQ ID NO: 175978 - RNA, 64 nt, hsa
ugcucuuuaaucaaacucugguggcccacugacuaagaagaaaguuuauuuucgugugagaugc

SEQ ID NO: 175979 - RNA, 64 nt, hsa
cuuauuugggagaaauaggggcacgugagauaagaagaagaauaauuuugauguugguaugcuu

SEQ ID NO: 175980 - RNA, 64 nt, hsa
ucacuuauuugggagaaauaggggcacgugagauaagaagaagaauaauuuugauguugguaug

SEQ ID NO: 175981 - RNA, 64 nt, hsa
aucucaaaaauaaaauaaaaaaagaaagaaagaaaagaagaagaaaagagaagaaggagaagga

SEQ ID NO: 175982 - RNA, 64 nt, hsa
ucaaaaauaaaauaaaaaaagaaagaaagaaaagaagaagaaaagagaagaaggagaaggagau

SEQ ID NO: 175983 - RNA, 64 nt, hsa
gaaggagaugaaggaggaggaggaggagaaggagaagaagaagaagaagaagaccacaaaagac

SEQ ID NO: 175984 - RNA, 64 nt, hsa
ggagaugaaggaggaggaggaggagaaggagaagaagaagaagaagaagaccacaaaagacaug

SEQ ID NO: 175985 - RNA, 64 nt, hsa
gaugaaggaggaggaggaggagaaggagaagaagaagaagaagaagaccacaaaagacaugacu

SEQ ID NO: 175986 - RNA, 64 nt, hsa
gaaggaggaggaggaggagaaggagaagaagaagaagaagaagaccacaaaagacaugacuauc

SEQ ID NO: 175987 - RNA, 64 nt, hsa
auaagagacuuuuugacucuauauccuugcaguuaagaagaaagcacuuuuuuguaauguuugu

SEQ ID NO: 175988 - RNA, 64 nt, hsa
accaugaggggaacaagaaacuacuucuaacgggaagaagaaacacuacggucgauuaaaaaaa

SEQ ID NO: 175989 - RNA, 64 nt, hsa
gcauaaccacaugacuuggaaugcuuaaaucagcaagaagaauaaugguggggucuuuauacuc

SEQ ID NO: 175990 - RNA, 64 nt, hsa
aaaguguuuguaauauauucaugaggcuggaaguaagaagaauuaaaaauuuguccuaauuaca

SEQ ID NO: 175991 - RNA, 64 nt, hsa
uuaacaggcaaugcuucucagaccacaaagcagaaagaagaagaaaagcuccugacuaaaucag

SEQ ID NO: 175992 - RNA, 64 nt, hsa
acaggcaaugcuucucagaccacaaagcagaaagaagaagaaaagcuccugacuaaaucagggc

SEQ ID NO: 175993 - RNA, 64 nt, hsa
agaggauccugaacggaaaaggaagaagaaagagaagaagaaaaagaagguagaguagaggccu

SEQ ID NO: 175994 - RNA, 64 nt, hsa
aaagaaaaaagaagaggauccugaacggaaaaggaagaagaaagagaagaagaaaaagaaggua

SEQ ID NO: 175995 - RNA, 64 nt, hsa
uccuacagaaacaccaucugauucagaucacaagaagaagaaaaagaaaaaagaagaggauccu

SEQ ID NO: 175996 - RNA, 64 nt, hsa
gucuccuacagaaacaccaucugauucagaucacaagaagaagaaaaagaaaaaagaagaggau

SEQ ID NO: 175997 - RNA, 64 nt, hsa
uccguauggagcucuggacuccuaaauuccccugaagaagaaaccaauguacuguggucucuug

SEQ ID NO: 175998 - RNA, 62 nt, hsa
uaguuucugaguuuuaccaaauaaaguagaauauaagaagaaagguacauuuguuuuugcuu

SEQ ID NO: 175999 - RNA, 64 nt, hsa
agcccuuuugucucugcaaacugccuucuucggaaagaagaaggugggaggaugugaauuguua

SEQ ID NO: 176000 - RNA, 64 nt, hsa
cguugggagggggagaaaaggaaaagaaaaaaaaaagaagaagaagaagaaaagagaagaagaa

SEQ ID NO: 176001 - RNA, 64 nt, hsa
ugggagggggagaaaaggaaaagaaaaaaaaaagaagaagaagaagaaaagagaagaagaaaaa

SEQ ID NO: 176002 - RNA, 64 nt, hsa
gagggggagaaaaggaaaagaaaaaaaaaagaagaagaagaagaaaagagaagaagaaaaaaac

SEQ ID NO: 176003 - RNA, 64 nt, hsa
ggggagaaaaggaaaagaaaaaaaaaagaagaagaagaagaaaagagaagaagaaaaaaacgaa

SEQ ID NO: 176004 - RNA, 64 nt, hsa
aaagaaaaaaaaaagaagaagaagaagaaaagagaagaagaaaaaaacgaaaacagucaaccaa

SEQ ID NO: 176005 - RNA, 64 nt, hsa
guuaauguauuaaugauguuauuaaauacuguucaagaagaacaaaguuuaugcagcuacuguc

SEQ ID NO: 176006 - RNA, 64 nt, hsa
uaggaagcggacccgcuccagaaguccccacgagaagaagaagaagaggcggucccggucgcgg

SEQ ID NO: 176007 - RNA, 64 nt, hsa
gaaacucuugccuuucagaaguccccacgagaagaagaagaagaggcggucccggucgcggacc

SEQ ID NO: 176008 - RNA, 64 nt, hsa
agguaagacucugucucaaaaaaaaacaaaaaagaagaagaaaaguacuucuacagccaugucc

SEQ ID NO: 176009 - RNA, 64 nt, hsa
aacagguaagacucugucucaaaaaaaaacaaaaaagaagaagaaaaguacuucuacagccaug

SEQ ID NO: 176010 - RNA, 64 nt, hsa
cucagugaucaaagucuucaaauaguuaaaccaaaagaagaauagggcugcuuuguguggccau

SEQ ID NO: 176011 - RNA, 64 nt, hsa
cauggaaaaacaacuuagaggauuuagcagcuaaaagaagaaugagucagcuggugaugugcuu

SEQ ID NO: 176012 - RNA, 64 nt, hsa
ugaaaguguaaugugcgauggcuauguagacauaaagaagaaacuuguaaauaucuuuuuucuu

SEQ ID NO: 176013 - RNA, 64 nt, hsa
gaauuuucuggccuuucauggcaaugaaaauuuuaagaagaaagauuuaaaguauuuuaauuuu

SEQ ID NO: 176014 - RNA, 64 nt, hsa
uaagcacagcaguaaacuauggggaaaaaaaaagaagaagaaaaagaaacucagggaucacugg

SEQ ID NO: 176015 - RNA, 64 nt, hsa
accuaagcacagcaguaaacuauggggaaaaaaaaagaagaagaaaaagaaacucagggaucac

SEQ ID NO: 176016 - RNA, 64 nt, hsa
cuccccucacugauggacaaggaggucugugccaaagaagaauccaauaagcacauauugagca

SEQ ID NO: 176017 - RNA, 64 nt, hsa
ccucaguaaguaucuggaggaagaaaacaggugaaagaagaaguaaaaaccauuuaguauuagu

SEQ ID NO: 176018 - RNA, 64 nt, hsa
cagcuuuuaacuucauuuaaaaagacuuuugucuaagaagaauauuauuauuauauguucuuuc

SEQ ID NO: 176019 - RNA, 64 nt, hsa
gcaaauuacaggcaagacaacaaagccgcuucugaagaagaaaggaccgaagcugcugcguaag

SEQ ID NO: 176020 - RNA, 64 nt, hsa
guccucagcaugcccuauggccuaugugcgaagcaagaagaauugacugauuuacaggacuucu

SEQ ID NO: 176021 - RNA, 64 nt, hsa
cacggaaacauagaaacauacacaaggccagaaaaagaagaaggagcucaacuaaaaguggcau

SEQ ID NO: 176022 - RNA, 64 nt, hsa
cuggggucugggcacucugccucugggagagaggaagaagaaaggggccccauuuuuuaaaaaa

SEQ ID NO: 176023 - RNA, 64 nt, hsa
ugugugcgugcccugguguggggcuacuucucccaagaagaaggggugccuuuccuaauuugca

SEQ ID NO: 176024 - RNA, 64 nt, hsa
guuauuuuuuuaaaggaaacaaacagacaacaaaaagaagaaaaaaaaaaagaaccuccuugga

SEQ ID NO: 176025 - RNA, 64 nt, hsa
uaaaaauaaaaaaaauaaaaaaggaaaaaaaaaaaagaagaaacaagacaugccaccuuucccc

SEQ ID NO: 176026 - RNA, 64 nt, hsa
ggacauuaaaauauugaaguguuuuuaaaaauuaaagaagaagaaaaguaaaagagcuuaccac

SEQ ID NO: 176027 - RNA, 64 nt, hsa
cauuaaaauauugaaguguuuuuaaaaauuaaagaagaagaaaaguaaaagagcuuaccacugg

SEQ ID NO: 176028 - RNA, 64 nt, hsa
agacucaaagaacagguucuuugggcaacagacaaagaagaaucaaguucugugcugucccgug

SEQ ID NO: 176029 - RNA, 64 nt, hsa
uuaguaacuauuaugaaauacaaugguguuccaaaagaagaaagcacuaaaaacucaacuagca

SEQ ID NO: 176030 - RNA, 59 nt, hsa
ccuuggacaucaguaucuagagggacaagaagaagaagguggccaagacccagggauaa

SEQ ID NO: 176031 - RNA, 56 nt, hsa
ccuuggacaucaguaucuagagggacaagaagaagaagguggccaagacccaggga

SEQ ID NO: 176032 - RNA, 64 nt, hsa
aggugcccagcaucacguaaaacaucgauaugcuaagaagaacaaaaagagcccaaucucugau

SEQ ID NO: 176033 - RNA, 64 nt, hsa
aagacauuuaguacauuaauugcugucaaagaugaagaagaaggcacaucuugacacaguaccu

SEQ ID NO: 176034 - RNA, 64 nt, hsa
uuguccuuucauguaacuuuuuuauuuuaagaggaagaagaagaaaggggcacacacacacaau

SEQ ID NO: 176035 - RNA, 64 nt, hsa
uccuuucauguaacuuuuuuauuuuaagaggaagaagaagaaaggggcacacacacacaauacc

SEQ ID NO: 176036 - RNA, 64 nt, hsa
gaaaaaaaaaaaaaagagagagagagagaagaagaagaagaagagacacaaaucucuaccuccc

SEQ ID NO: 176037 - RNA, 64 nt, hsa
uuggaaaaaaaaaaaaaagagagagagagagaagaagaagaagaagagacacaaaucucuaccu

SEQ ID NO: 176038 - RNA, 64 nt, hsa
ugauuggaaaaaaaaaaaaaagagagagagagagaagaagaagaagaagagacacaaaucucua

SEQ ID NO: 176039 - RNA, 64 nt, hsa
cuuauagagaaaaugaguauauaagacaauauacaagaagaaauaucagugaguuuuaaaucag

SEQ ID NO: 176040 - RNA, 64 nt, hsa
aagaaaaggguaggcacuaaagggagaacacagaaagaagaauuucuaaaauauuggauuuacu

SEQ ID NO: 176041 - RNA, 64 nt, hsa
acacacucaggaggaaaagaaaaaacaaaggcagaagaagaagaagaagaaauaaaaacccacc

SEQ ID NO: 176042 - RNA, 64 nt, hsa
cacucaggaggaaaagaaaaaacaaaggcagaagaagaagaagaagaaauaaaaacccacccaa

SEQ ID NO: 176043 - RNA, 64 nt, hsa
ucaggaggaaaagaaaaaacaaaggcagaagaagaagaagaagaaauaaaaacccacccaagca

SEQ ID NO: 176044 - RNA, 64 nt, hsa
ggaggaaaagaaaaaacaaaggcagaagaagaagaagaagaaauaaaaacccacccaagcaaga

SEQ ID NO: 176045 - RNA, 64 nt, hsa
cacgcuggcauaucaggaagauguccuuccugggaagaagaagcuccagccaguucugcugcaa

SEQ ID NO: 176046 - RNA, 64 nt, hsa
acagugacaccucaggaagauguccuuccuggggaagaagaagcaccagccacaggggcaggug

SEQ ID NO: 176047 - RNA, 64 nt, hsa
uccccagaacauccagagucuguccccugugaagaagaagaagauggugccuggggcucugggg

SEQ ID NO: 176048 - RNA, 64 nt, hsa
cucuccccagaacauccagagucuguccccugugaagaagaagaagauggugccuggggcucug

SEQ ID NO: 176049 - RNA, 64 nt, hsa
uuuuauaaacaaaauuacagacugucugaaauugaagaagaaugaacuaauaauagcauucaua

SEQ ID NO: 176050 - RNA, 64 nt, hsa
ugugauggauuggacguugugacucuugccuuuuaagaagaaaaaaaagauaggacaaaguauu

SEQ ID NO: 176051 - RNA, 64 nt, hsa
uucccuccucuuuuuguaggcagaacaguaucaaaagaagaaucggaagaugcuugugauuuua

SEQ ID NO: 176052 - RNA, 64 nt, hsa
cuuuuccauuguuuuugcuucucuuaaaaaguuuaagaagaauaugaccucauuaaaugugcug

SEQ ID NO: 176053 - RNA, 64 nt, hsa
agauauaaaccagaaauucuauaacugaucauagaagaagaauccaguaauugaacaaauccua

SEQ ID NO: 176054 - RNA, 64 nt, hsa
uuucccccuuggugguuuuucagacaccugcagcaagaagaaauacugacugacuaggcauuau

SEQ ID NO: 176055 - RNA, 64 nt, hsa
aaagagucauauuuuccaaguuauauuuucuaagaagaagaauagaucauaaaucugacaagga

SEQ ID NO: 176056 - RNA, 64 nt, hsa
gugaaagagucauauuuuccaaguuauauuuucuaagaagaagaauagaucauaaaucugacaa

SEQ ID NO: 176057 - RNA, 64 nt, hsa
ugcugaaauugaaaaagaaaaagaagaaaacgaaaagaagaaacaaaagaaagcaucaugauga

SEQ ID NO: 176058 - RNA, 64 nt, hsa
auugagaaguauguugcugaaauugaaaaagaaaaagaagaaaacgaaaagaagaaacaaaaga

SEQ ID NO: 176059 - RNA, 64 nt, hsa
accagaaaauggcaaugauaggagacugacauagaagaagaaugcuucccuaggaaaaaggucg

SEQ ID NO: 176060 - RNA, 64 nt, hsa
cuaggaaaaaggucgcuggcuuuggugcaagaggaagaagaauguuccacuggaagccugagca

SEQ ID NO: 176061 - RNA, 64 nt, hsa
agaccccaucucaaaaaaaaaaaaaaaaaaaaaaaagaagaagaauacagucauguaucucuug

SEQ ID NO: 176062 - RNA, 64 nt, hsa
ccccaucucaaaaaaaaaaaaaaaaaaaaaaaagaagaagaauacagucauguaucucuuggug

SEQ ID NO: 176063 - RNA, 64 nt, hsa
auauuuuucaaauccuugaaucuuuuuuggguugaagaagaagaaagcauagcuuuagaauaga

SEQ ID NO: 176064 - RNA, 64 nt, hsa
uuuuucaaauccuugaaucuuuuuuggguugaagaagaagaaagcauagcuuuagaauagagau

SEQ ID NO: 176065 - RNA, 64 nt, hsa
gcugggguggagugggaagggagcauugcagccuaagaagaaggccagagagggaaaaggcagg

SEQ ID NO: 176066 - RNA, 64 nt, hsa
cugccuggaggcuccucuaggcccugugagcacaaagaagaaagcugauuuuugucuuuuaauc

SEQ ID NO: 176067 - RNA, 64 nt, hsa
uuuuuuuuuuauuugaccaaaaaaaaaaaggcccaagaagaagaaaaugaaaaauuugaagauu

SEQ ID NO: 176068 - RNA, 64 nt, hsa
uuuuuuuauuugaccaaaaaaaaaaaggcccaagaagaagaaaaugaaaaauuugaagauuuga

SEQ ID NO: 176069 - RNA, 64 nt, hsa
uaacuuaaacggaugggauucacuuaacaaaagcaagaagaaaagcacacgaacaggugucuua

SEQ ID NO: 176070 - RNA, 64 nt, hsa
aauacucuaagagaauaggacauggauauguuacaagaagaaguguauuggggcaagucuuguu

SEQ ID NO: 176071 - RNA, 64 nt, hsa
uuagugcuucuuaccugguaacuugagacuuuaaaagaagaaacaaagaggggaagauauggga

SEQ ID NO: 176072 - RNA, 64 nt, hsa
gaaagcuauuuaaaaaaacuugaaauuuaauugaaagaagaaacaacaacaaaaaagccuaaac

SEQ ID NO: 176073 - RNA, 64 nt, hsa
aaaaagaaaaaaagccaugauguacccuccgagaaagaagaacguaagcacaggaaagagaaaa

SEQ ID NO: 176074 - RNA, 64 nt, hsa
aagaguugcuuccuauuucaggacccugccaaaaaagaagaaagcuugccuuugguggggcuau

SEQ ID NO: 176075 - RNA, 64 nt, hsa
uguggauuuaucugaucaccaaauaauaaauauuaagaagaaugggggaaaaaggauagaauau

SEQ ID NO: 176076 - RNA, 64 nt, hsa
aaaacugguuuuaaaaucaguggaaaagggcagguugaaucaaggugaaucaaucugaaauuga

SEQ ID NO: 176077 - RNA, 64 nt, hsa
uacauggguaaauaauuugucauuaaacuuguguuugaaucaugaauucccuuguuucaaaaga

SEQ ID NO: 176078 - RNA, 64 nt, hsa
gccauuauuuuguauuuuaaauacauaaauaggauugaaucaacuagaaaugaaucuauauguu

SEQ ID NO: 176079 - RNA, 64 nt, hsa
aucaaguaguaccaguuuuaagguuuuaauucauuugaaucacuuaugaauugaugauauacag

SEQ ID NO: 176080 - RNA, 64 nt, hsa
gaaacuuaucauaaggaaaaauagaaaggaaaacuugaaucaauacucauugauuaaaauggaa

SEQ ID NO: 176081 - RNA, 64 nt, hsa
uuuggauacuaaaugacagccuuguuucuccccuuugaaucagcagacaccauggauuauauuc

SEQ ID NO: 176082 - RNA, 64 nt, hsa
uaucaggugauacugcugcaguaaucauagcuguuugaaucaggaauaaucccaaucacauuuu

SEQ ID NO: 176083 - RNA, 64 nt, hsa
gagaaaggagauugguaaggaagugugauacauauugaaucaggugucaagguaccauuugugc

SEQ ID NO: 176084 - RNA, 64 nt, hsa
ggccagaauuuaaaccuauacucacuuucccaaauugaaucacugcucacacugcugaugauuu

SEQ ID NO: 176085 - RNA, 64 nt, hsa
cucaccaagcugcuguggccaucaaccucuguauuugaaucagccuacaggccucacacacaau

SEQ ID NO: 176086 - RNA, 64 nt, hsa
agguuauguggugacuauuugaaucaaaaauguauugaaucaucaaauaaaagaauguggcuau

SEQ ID NO: 176087 - RNA, 64 nt, hsa
gcuuaauaucgugccuagguuauguggugacuauuugaaucaaaaauguauugaaucaucaaau

SEQ ID NO: 176088 - RNA, 64 nt, hsa
aauaaggaaaugggggugaaauauuuuuuuauuguugaaucauuuugugaaugucccccucaaa

SEQ ID NO: 176089 - RNA, 62 nt, hsa
cauccugccccucucguugaaggaacacuugguugaaucaaguugauguggguuccgaacug

SEQ ID NO: 176090 - RNA, 64 nt, hsa
gauggauagaaauauauuuuugcuaguucuaggcuugaaucaugggcuccuuggcuuuccuagc

SEQ ID NO: 176091 - RNA, 64 nt, hsa
gaaauuuuuugcucaccgccauguuuaaaugggguugaaucauagcgagccauuugcucuugcc

SEQ ID NO: 176092 - RNA, 64 nt, hsa
uauuuucacucuugauaagcuuauaaaaucaugauugaaucagcuuuaaagcaucauaccauca

SEQ ID NO: 176093 - RNA, 64 nt, hsa
uuaauuugcuugucaucacaaugaaguauguuuuuugaaucaucaauucuuucucauucuccau

SEQ ID NO: 176094 - RNA, 64 nt, hsa
uauugauaagccauacaugagacugcagauuauauugaaucauauuaaauguacagaaauaaaa

SEQ ID NO: 176095 - RNA, 63 nt, hsa
uaaacuucauguucaaguagaaguucucuaccauugaaucagugaacuagaaagaucugauuu

SEQ ID NO: 176096 - RNA, 64 nt, hsa
agaugaaaugcacucuucucgaugaggccucgauuugaaucaauggggugggccacaggaaaug

SEQ ID NO: 176097 - RNA, 64 nt, hsa
uggaccuuucuucccuucccuuggagguaucccuuugaaucaggccucucucuucucaucaguc

SEQ ID NO: 176098 - RNA, 64 nt, hsa
aaagcagauggccuauuugaggaagagggugucugcccuucacaaacaccucucucuccccugc

SEQ ID NO: 176099 - RNA, 64 nt, hsa
cccugcacuagcugucccaagcuuacauacagaggcccuucaggagggccuccugugccgcagg

SEQ ID NO: 176100 - RNA, 64 nt, hsa
uuuacuacccuggagggacagcucugcccuugaggcccuucagaaauuugugcugauuuggucc

SEQ ID NO: 176101 - RNA, 64 nt, hsa
ugacugcaguguagggaauaggucaccaggaggagcccuucauccuggcaggccggauugugga

SEQ ID NO: 176102 - RNA, 64 nt, hsa
ggccuuucccaucuggagagaagcuuccagaccagcccuucacacaccacagccaggaggggcc

SEQ ID NO: 176103 - RNA, 64 nt, hsa
ggccguuccugccuggagagaagcuuccagaccagcccuucacaccacagccaggagaggccuu

SEQ ID NO: 176104 - RNA, 64 nt, hsa
ugcgagacucagcuuaucugaucaaggugaacuugcccuucaauagacuugcccuuguuacugc

SEQ ID NO: 176105 - RNA, 64 nt, hsa
ucuagaagucagucaugacucuucauucuauuucgcccuucacaaagaguuagcugccagcucu

SEQ ID NO: 176106 - RNA, 64 nt, hsa
guggccaagccuggcccuuaaacaacugcagaaagcccuucaacuucagaaggccucacucaag

SEQ ID NO: 176107 - RNA, 64 nt, hsa
ccuggguucagccucucccacaauaagaguucuugcccuucauacccucuaccuggauggaugg

SEQ ID NO: 176108 - RNA, 64 nt, hsa
cucugugucaucucagucauuugacuuagaaagugcccuucaaaaggacccuguucacugcugc

SEQ ID NO: 176109 - RNA, 64 nt, hsa
uuuuccauguuaagaaggugagguccauguuggugcccuucagaguagagaaccauguaaacau

SEQ ID NO: 176110 - RNA, 64 nt, hsa
auuucacaaagucagagcgauaggaaagcacccugcccuucaucuucauguucucccaaaugga

SEQ ID NO: 176111 - RNA, 64 nt, hsa
ugcagauuucguuuccgucaacuuaaacauuguugcccuucaacaaggcucuugaauuaauaaa

SEQ ID NO: 176112 - RNA, 64 nt, hsa
accuuaaaaaccuauacaacaauaagaggagugcgcccuucagcagcauguauacaaaaauugc

SEQ ID NO: 176113 - RNA, 64 nt, hsa
ccaauaggaggagcacuucgagucgaguguaagggcccuucacaaaagcagaaggaacacuggc

SEQ ID NO: 176114 - RNA, 64 nt, hsa
guacagaggcaaggaggaugccggcaaggccuucgccagcuagaagcgggacugaggcugccuc

SEQ ID NO: 176115 - RNA, 64 nt, hsa
caaguagcugggauuacaggcaccuaccaccagggccagcuaauuuuuguauguuuaguagaaa

SEQ ID NO: 176116 - RNA, 64 nt, hsa
gggcagggcuccacugaagccacccccaccccucgccagcuagcuccauagggaagccuguguc

SEQ ID NO: 176117 - RNA, 64 nt, hsa
ggaugggggugggggggcgguucucgaggugugugccagcuacacguguguucuguaugggucc

SEQ ID NO: 176118 - RNA, 64 nt, hsa
ccccagcuugcccuggccugugccugccucaggugccagcuagaugucucgcuccaccuggguc

SEQ ID NO: 176119 - RNA, 64 nt, hsa
aauaccccagacccaacaaaccuccagccagaaagccagcuauuuugcauuugaaggaauugac

SEQ ID NO: 176120 - RNA, 64 nt, hsa
uauucugugaaacuaaucauaagcugccuaggcagccagcuacaggcuugagcuuuaaauucau

SEQ ID NO: 176121 - RNA, 64 nt, hsa
cuguggagaugaacauucuauccuugaugagcaugccagcuaugugguagggccagcccaccau

SEQ ID NO: 176122 - RNA, 64 nt, hsa
ggaucaucuaagaaauguagcugaaacccaaggagccagcuagaaagaagcuuuugauuagaug

SEQ ID NO: 176123 - RNA, 64 nt, hsa
auuuccuguguuuguccuggguucuggggcaucagccagcuaccccuugugggcaaaggcaggg

SEQ ID NO: 176124 - RNA, 64 nt, hsa
aaagcagaaaguacugcauaguauaugagauauagccagcuagcuaaaguucagauuuuguuag

SEQ ID NO: 176125 - RNA, 64 nt, hsa
aagggagacaaguggggcugcacucgguccagaggccagcuaggagggaaaccgcagcuuccug

SEQ ID NO: 176126 - RNA, 64 nt, hsa
acauuggagauuagugacucaccugcaguugggagccagcuacaacccaaaucauuuuaaaauu

SEQ ID NO: 176127 - RNA, 64 nt, hsa
uuuauuuuuuaaauuguuguaaaaauuauuauaggccagcuacaucuaguaguagguuuggggu

SEQ ID NO: 176128 - RNA, 64 nt, hsa
acugcauugaagcugagcgcaaagcuaacauccugccagcuaccucugugaacugaggggagcc

SEQ ID NO: 176129 - RNA, 64 nt, hsa
cucaguuacaccucccagugcccuucugaaaagugccagcuauuucauuaggcaaugcuggaag

SEQ ID NO: 176130 - RNA, 64 nt, hsa
cuccuggaccuaaaggguaugagcuggagcuaaggccagcuagagcuuccacugucagcccuca

SEQ ID NO: 176131 - RNA, 64 nt, hsa
cuguauuuuauagucagccuuuugaccaccuggugccagcuauauaaggaauaaaguugauuca

SEQ ID NO: 176132 - RNA, 64 nt, hsa
gcaaagcguugagucaucagguauuuagagccuagccagcuacccaguauccaugcugccauau

SEQ ID NO: 176133 - RNA, 64 nt, hsa
ggcacuguccagcccuggauagggggggcagugggccagcuaccguaagcaaaggcuguuuuuu

SEQ ID NO: 176134 - RNA, 64 nt, hsa
acagagauucagccaaagucaagaaacacuggaugccagcuagauuaucuguucugugcuuugg

SEQ ID NO: 176135 - RNA, 64 nt, hsa
cagaggauuauguaaccccugcaguggaaacugagccagcuaacuuaaaaagcugccuuaguuu

SEQ ID NO: 176136 - RNA, 64 nt, hsa
cuaagacuggagcuagacacaaugaaacaucagagccagcuaagagaaaagaaauauuuggagg

SEQ ID NO: 176137 - RNA, 64 nt, hsa
ggaaggggcggcugcucagacagauuuagggcccgccagcuaggcuacacccaucaugcgccgc

SEQ ID NO: 176138 - RNA, 64 nt, hsa
aagaaguacuucuuuuuacauuucagcuccagcagccagcuauuuaaaaaauauuuuuaaauau

SEQ ID NO: 176139 - RNA, 64 nt, hsa
gauagaagacuguacaauuugagccggguguuaggccagcuauuuuccuuuuccugugcuuucu

SEQ ID NO: 176140 - RNA, 64 nt, hsa
caugucaggcuguuguggguaucccccuggcagggccagcuaggccugugguucccugcuccga

SEQ ID NO: 176141 - RNA, 64 nt, hsa
gcuguccuauugagcaaauaacuuuuuuucaauugccagcuacugcuuuuauucaucaaaauaa

SEQ ID NO: 176142 - RNA, 64 nt, hsa
aaagcaauaacguugugaugcccacaggccuggagccagcuagcgaccuugugccgcccagcug

SEQ ID NO: 176143 - RNA, 64 nt, hsa
gguaaaacuuuuuauauuuuauacauuaacuucagccagcuauugauauaaauaaaacauuuuc

SEQ ID NO: 176144 - RNA, 64 nt, hsa
uuuugagaauucaagauggcacugacacgggaaggccagcuacagguggacuccuggaauuuga

SEQ ID NO: 176145 - RNA, 64 nt, hsa
uguagguuaagggcauggacugcuugaguucagugccagcuaugccacuuaccagcugugggac

SEQ ID NO: 176146 - RNA, 64 nt, hsa
uuaccauaucacuguaaagaagaggggaaacccagccagcuacuuuuuuucaucacuuuuuauu

SEQ ID NO: 176147 - RNA, 64 nt, hsa
cagagcuuuggccauuaccaccugaccucuugcugccagcuaauaagaagugccaaguggacag

SEQ ID NO: 176148 - RNA, 64 nt, hsa
caguagagacauugcuguuccugcccaucccagugccagcuacuccuuccuggaagccuuccug

SEQ ID NO: 176149 - RNA, 64 nt, hsa
ccgaguagcuggggcuacaggugugugccacccugccagcuaauuuuuuauauuuuuuuguaga

SEQ ID NO: 176150 - RNA, 64 nt, hsa
gaacuuacagaauuguugaaauuuucuacuaacagccagcuaaaauuugguauauguuagcucu

SEQ ID NO: 176151 - RNA, 64 nt, hsa
ugccguuuucuugcucaaagggaacagugaauuagccagcuagaaucuuccuggucccuuuuug

SEQ ID NO: 176152 - RNA, 64 nt, hsa
aauuacagcaugaugaauuuugcauggguggccagccagcuagcccauaacugauagaugcauu

SEQ ID NO: 176153 - RNA, 64 nt, hsa
aaagggauaccauguagaauugugcaauagucuagccagcuagccuuaacaucuaagaaauuuu

SEQ ID NO: 176154 - RNA, 64 nt, hsa
ccaaguagcugggauuacagacucaugccaccacgccagcuaauuuuuguauuuuuaguagaga

SEQ ID NO: 176155 - RNA, 64 nt, hsa
aauauauugauagccaagucauggugccuaaaaugccagcuauugccaagaagaaaauaguuga

SEQ ID NO: 176156 - RNA, 64 nt, hsa
ccuaaacuaauuauaaggaugaucagagacuuuugccagcuacacuaaaagaaaauggccuucu

SEQ ID NO: 176157 - RNA, 57 nt, hsa
ggucagcaggguucauuuaaaauggaugccagcuaauuuuccacagagcaaugcuau

SEQ ID NO: 176158 - RNA, 64 nt, hsa
aaaugagccgggugcaauggcaggcaccuauaaugccagcuacucgggaggcugaggcaggaga

SEQ ID NO: 176159 - RNA, 64 nt, hsa
guacuugcuuuguguccugguuacuauguauguugccagcuaguggaaauaaccuaccaauugu

SEQ ID NO: 176160 - RNA, 64 nt, hsa
guuuauuuuguaaaaaagaaaugaaaaucugcuggccagcuauguccucuaggaaaugacagac

SEQ ID NO: 176161 - RNA, 64 nt, hsa
gucccaugugcuaacuaucuuauauauaaugagagccagcuacguaaaaguagcugagaggccu

SEQ ID NO: 176162 - RNA, 64 nt, hsa
gcauaaaggccuuuuuuggcuuuagacacuggcugccagcuauuuuuacuagaacacagaaagc

SEQ ID NO: 176163 - RNA, 64 nt, hsa
acaccaucucuaggaaaauuuaauucugucccuggccagcuauuguucuuccacuucguuuucu

SEQ ID NO: 176164 - RNA, 64 nt, hsa
aaauuagccggacgugguggcacaugccuguaaugccagcuacucgggaggcugaggcaggaga

SEQ ID NO: 176165 - RNA, 64 nt, hsa
guguauuuuuucaaaagaaguacuguauucggaugccagcuaauaaauugucacacaauggaaa

SEQ ID NO: 176166 - RNA, 64 nt, hsa
aaauuagccgggcgugguggcgggugccuguauugccagcuacucggaaggcugaggcaggaga

SEQ ID NO: 176167 - RNA, 64 nt, hsa
agguuugggacacuucuguuuagaauugaaagcugccagcuaacaguaauucuuccauaguuga

SEQ ID NO: 176168 - RNA, 64 nt, hsa
uuacugaggugguaaauuaacuuuuuucuguucagccagcuaccccucaaggaaucauagcucu

SEQ ID NO: 176169 - RNA, 64 nt, hsa
ccccaaguggcagcaacuggccaaaggagaugcagccagcuaagacuguccacacuuuggcaga

SEQ ID NO: 176170 - RNA, 64 nt, hsa
aacaauguuugggggaaaaaaaagaaaaaaucaugccagcuaaucaugucaaguucacugccug

SEQ ID NO: 176171 - RNA, 64 nt, hsa
ccucucucccggagguugggugggccggcuucaugccagcuacuuccuccuccccacuuguccg

SEQ ID NO: 176172 - RNA, 64 nt, hsa
uucauuaucugguuuuauuaagcagaugaaugcagccagcuauaugaagcacuuugcagugaau

SEQ ID NO: 176173 - RNA, 64 nt, hsa
uguuccuucucucgaacaaaacagcaaagggaaugccagcuaacuucuuugauuagaagguaau

SEQ ID NO: 176174 - RNA, 64 nt, hsa
ccuuugaaagccaagauauuauuuaaguuguaaagccagcuaauaaaaugccuuaguuugagca

SEQ ID NO: 176175 - RNA, 64 nt, hsa
cacaggagguguaccaccaagagugaacccuaaugccagcuauagauuuggggugauuaucguu

SEQ ID NO: 176176 - RNA, 64 nt, hsa
uuaaaaaaaauacagauuaccaauuucaagugcugccagcuaaaauaacuguuuuaacggguau

SEQ ID NO: 176177 - RNA, 64 nt, hsa
gaaaggacagggugcuagugaguacugacagcaugccagcuaccgaagucacccagccauuccc

SEQ ID NO: 176178 - RNA, 64 nt, hsa
cguggcugauugaggguuuggaacugguggcuaugccagcuauuccaucucaaaacagccuuga

SEQ ID NO: 176179 - RNA, 64 nt, hsa
aaauuagcugggcaugguggugcgugccuguagugccagcuacucaggaggccgaggcaggaga

SEQ ID NO: 176180 - RNA, 64 nt, hsa
uggucuuuuaccucugaucuuguccccaaccuaagccagcuagcugcgugcucccacucccucu

SEQ ID NO: 176181 - RNA, 64 nt, hsa
uuggaaaaggcuuccccugugaugaaaaugaugugccagcuaaaauugugugccauuuaaaaac

SEQ ID NO: 176182 - RNA, 64 nt, hsa
ggguaguccagaagaagcuguuucagggccuguugccagcuaugccuuugagaaccucgggauc

SEQ ID NO: 176183 - RNA, 64 nt, hsa
ccgaucuuucccaaagguguugauuuacaaagaggccagcuaauagcagaaaucaugacccuga

SEQ ID NO: 176184 - RNA, 64 nt, hsa
uaaggaaaacuacggcugcuggguugggauuucugccagcuagcugguacuggcuucuuguuuc

SEQ ID NO: 176185 - RNA, 64 nt, hsa
aauacccucccagcaacaaaaccuaaucaguaaggccagcuagacccaauggcucaugccugua

SEQ ID NO: 176186 - RNA, 64 nt, hsa
ucaaagacaggaccaacuucagauucccaaagaagccagcuacagagccucuggaacacuaugg

SEQ ID NO: 176187 - RNA, 64 nt, hsa
uccaagcaauucgugcagugggaugagcuacuuugccagcuagaggccgccacgcaagugaagc

SEQ ID NO: 176188 - RNA, 64 nt, hsa
ccccagaaccaaaagggggccuuucugcuucuuagccagcuaccucuucgaguuuuucaaauug

SEQ ID NO: 176189 - RNA, 64 nt, hsa
gcuucuccuaggaucccaguggcguuuaucaguggccagcuaccugccaggcccgggcuggggc

SEQ ID NO: 176190 - RNA, 64 nt, hsa
gaccucagugcaaggcuggugaacccugcagcgggccagcuauggugggaagccuggcauuugg

SEQ ID NO: 176191 - RNA, 64 nt, hsa
uuuacuucucucaaagcuagaagccaagaaaauggccagcuagaaccaagauuuaaggggcugu

SEQ ID NO: 176192 - RNA, 64 nt, hsa
guucuucccucacuccauccccgcuaccguccuggccagcuaccgucagagagaaccagagcuc

SEQ ID NO: 176193 - RNA, 64 nt, hsa
cugugccagcccagugaaugcgugccccagcccagccagcuacccagccccucucugugugcag

SEQ ID NO: 176194 - RNA, 53 nt, hsa
agcucagguauguauuuuagccagccagcuagcuagcaacccauugccaccac

SEQ ID NO: 176195 - RNA, 64 nt, hsa
uuuugaguuuuagaauuagucauucuuuagagcagccagcuaguggcauuucuaggaaaacugu

SEQ ID NO: 176196 - RNA, 64 nt, hsa
ggaaggaaagugauucugugaaaaggacagugaagccagcuauuuuacccccaggcuggauuuu

SEQ ID NO: 176197 - RNA, 64 nt, hsa
agauaccuggcauuuugggaagugaccaaagauggccagcuagagauucagcaucuccaggauc

SEQ ID NO: 176198 - RNA, 64 nt, hsa
cagcuuccuuccugaccaagucugccaaccaauggccagcuaugcgccucauccucauugcuuc

SEQ ID NO: 176199 - RNA, 64 nt, hsa
aaaaauggggccuuagcuucuggcuuuuaauuuugccagcuaaggacauaaaacaaaaauaaac

SEQ ID NO: 176200 - RNA, 64 nt, hsa
cugggucccacccuccgagccauggugccccccugccagcuauugacacagcugcgaagugccc

SEQ ID NO: 176201 - RNA, 64 nt, hsa
cuuccucuuugaucuuuaaccccaagaagcaacagccagcuaaugcuuuauuaaaauuacccuc

SEQ ID NO: 176202 - RNA, 64 nt, hsa
gccguguuugugacccccuccugcccagcaaccugccagcuacaggagcccccugcgucccaga

SEQ ID NO: 176203 - RNA, 64 nt, hsa
uuuucucccucaaaaaaauagguuaaguuucagugccagcuagaaaauacugcuuucugccauc

SEQ ID NO: 176204 - RNA, 64 nt, hsa
uucccaaugaagugaagauguuggaaagacagaggccagcuauuuaggaccauacgcaccugug

SEQ ID NO: 176205 - RNA, 64 nt, hsa
cuagaguggauccuggcacugauuccaacucuuugccagcuaaucuuaacauuuagcagaaagc

SEQ ID NO: 176206 - RNA, 64 nt, hsa
gcaagugcucagggaaauggccuucccgccggaggccagcuaucugccugacaggcugugacuc

SEQ ID NO: 176207 - RNA, 64 nt, hsa
ccuguuccugcaaaucaucaacgugccuggacucgccagcuaaaagccugggccuuccccagcc

SEQ ID NO: 176208 - RNA, 64 nt, hsa
cucaggauuggaagagauuuuaaaggccacauaggccagcuaguguucauguguucuuuauaaa

SEQ ID NO: 176209 - RNA, 64 nt, hsa
ugcuuuugaauuuuauuuuuaggaaaauucugaagccagcuaucacagguuuguuagcuaauaa

SEQ ID NO: 176210 - RNA, 64 nt, hsa
aaucuauaacucagaaauggucagauggucaggagccagcuaugcagcaguauaccaucuguuu

SEQ ID NO: 176211 - RNA, 64 nt, hsa
agcucagaggcuggggcuaaagcaugaggacuaugccagcuauagaacuuggacucauaauucg

SEQ ID NO: 176212 - RNA, 64 nt, hsa
cucuuuggccagguaaacauuguauuguaucagcgccagcuacagauugaaaaaaaaaaacaaa

SEQ ID NO: 176213 - RNA, 64 nt, hsa
caaagacaacacuuacccaggauguuuccccaaggccagcuacaagccccucugcccccaugcc

SEQ ID NO: 176214 - RNA, 64 nt, hsa
guuuuuaaaaacuugcuucaugcccuacagaggugccagcuauuucuguugauacuauguauaa

SEQ ID NO: 176215 - RNA, 64 nt, hsa
auuuguucuaccuagcauuuuaacuaguuuuucugccagcuauguugaaugcacaaauucuguc

SEQ ID NO: 176216 - RNA, 64 nt, hsa
auguagcacauuuugcuuucccauuuauuguuuggccagcuaugccaauguggugcuauuguuu

SEQ ID NO: 176217 - RNA, 64 nt, hsa
uguccuguuccugccacauggagcuugacuucaugccagcuauaaucuccccugccuuccuuua

SEQ ID NO: 176218 - RNA, 64 nt, hsa
caaagggaugcacaggcggcucgcaugccccagggccagcuaagaguuccaaagaucucagauu

SEQ ID NO: 176219 - RNA, 64 nt, hsa
cuggaacauaauucuuuuguguagcucacuauuagccagcuaaguucaucuuuuuaauaccaua

SEQ ID NO: 176220 - RNA, 64 nt, hsa
cuaagacuggaacuagacguaaugaaacaucagagccagcuaagagaaaagaaauauuuggagg

SEQ ID NO: 176221 - RNA, 64 nt, hsa
ugcuggcaucgugucuuuccugugcucugaagaugccagcuacaucacuggggaaacaguggug

SEQ ID NO: 176222 - RNA, 64 nt, hsa
ucuggcucuuguccaucugucuguguuucuuuuugccagcuauugacuaaucuuugcugaagcu

SEQ ID NO: 176223 - RNA, 64 nt, hsa
agccugcaggcaccagccgggccauaugcccagugccagcuagggcccaccgcccauccugcac

SEQ ID NO: 176224 - RNA, 64 nt, hsa; identical to SEQ ID NO: 176220

SEQ ID NO: 176225 - RNA, 64 nt, hsa
acuguauauaacaucuaauauauauauauuauaggccagcuacaagggguuuaaauauuuagga

SEQ ID NO: 176226 - RNA, 64 nt, hsa
cacgucaucuggauuuuggauuucccuccaugcagccagcuauaguuggcuuuccaaaacaaca

SEQ ID NO: 176227 - RNA, 64 nt, hsa
agagccccaaagcaggaagaagcuccggauggaggccagcuaagccacucggggcaggccagca

SEQ ID NO: 176228 - RNA, 64 nt, hsa
caauaccuuuuuucuuagcuggcaugccauaaaggccagcuaugugauauuagaggaagaaagg

SEQ ID NO: 176229 - RNA, 64 nt, hsa
gccugaacuuccuuuuggagcaccgcauggucuugccagcuaccaggagccacuuaagagauua

SEQ ID NO: 176230 - RNA, 64 nt, hsa
ugugucuccaagacagcuuaugaauaucuaaaaggccagcuaccugccuaggagccacuauaua

SEQ ID NO: 176231 - RNA, 64 nt, hsa
cugggccuuuccuuuaugaaccuccauccucccagccagcuacaguagggccuccucaccccgu

SEQ ID NO: 176232 - RNA, 64 nt, hsa
cgaguagcugggacuauaggcaugcgccaccauggccagcuaauuuuuguauuuuuaguagaga

SEQ ID NO: 176233 - RNA, 64 nt, hsa
accagcugcacggaccagguucccgcaaaacauugccagcuagugaggcauaauuugcucaaag

SEQ ID NO: 176234 - RNA, 64 nt, hsa
ggcaccccaugggacucaguggcucacauuuccugccagcuacaccacaggcagaugggagucg

SEQ ID NO: 176235 - RNA, 64 nt, hsa
agugggauacagaagaagccaggacaguggcuuugccagcuaagugacuuuuagaguaacagau

SEQ ID NO: 176236 - RNA, 64 nt, hsa
augcuugcaguccuacaggcuucccgacccacaggccagcuacggauuuugcacuuuugcucca

SEQ ID NO: 176237 - RNA, 64 nt, hsa
guccggcagcuucugcccccugcagaaccggagagccagcuaagggguggggcugcggggguuc

SEQ ID NO: 176238 - RNA, 64 nt, hsa
cuugcuugcccuccaaauguccuuucucagaggggccagcuaacccgugcagaaccagcacuaa

SEQ ID NO: 176239 - RNA, 51 nt, hsa
agcagaaaaaggcgcaguagagccagcuacuggagucauuccguuuccacu

SEQ ID NO: 176240 - RNA, 64 nt, hsa
ucgcuguaccuuugccacaugguacuguaugcuugccagcuagaaggagggucagggauuuuuu

SEQ ID NO: 176241 - RNA, 64 nt, hsa
ucccuagacuccaggagccauaucccagaccuuugccagcuacagugaugggauuugcauuuua

SEQ ID NO: 176242 - RNA, 64 nt, hsa
acuuagccaggcaugaugggggucugccuguaaugccagcuacuccagaggcugaggcaagaga

SEQ ID NO: 176243 - RNA, 64 nt, hsa
uguguaugguaaggaauucuuuucagcuuuuggugccagcuacagaguugagcuggccauguuu

SEQ ID NO: 176244 - RNA, 64 nt, hsa
gagcugugaguccacgucucaugugcacgccccggccagcuaagccucgggccgucagcaauac

SEQ ID NO: 176245 - RNA, 64 nt, hsa
gccaucguucugcacggggcuuucugcaugugacgccagcuaagcauaguaagaaguccagccu

SEQ ID NO: 176246 - RNA, 64 nt, hsa
acuccauacuggggugggcuggaggaggccacaggccagcuauuguaaaagcuuuuuauuuuag

SEQ ID NO: 176247 - RNA, 64 nt, hsa
cagcaugcuuuuugaagauuaacucgacaauauggccagcuaaugaaauuaaaaaggauucuuc

SEQ ID NO: 176248 - RNA, 64 nt, hsa
cagguagcugggacuacaagcgugugcccccacagccagcuaauuuuuguauuuuuaguagaga

SEQ ID NO: 176249 - RNA, 64 nt, hsa
aaaccacggccagcugcuugucuuuguauggcuugccagcuaacaauagugguuccaucuuuaa

SEQ ID NO: 176250 - RNA, 64 nt, hsa
uggaauuacugccuuuauaagaagaagccaaagagccagcuagcucuuucaaccacaugagguu

SEQ ID NO: 176251 - RNA, 64 nt, hsa
aauuagccaggagugguggcgggcgccugugguggccagcuacucaggaggcugaggcaggaga

SEQ ID NO: 176252 - RNA, 64 nt, hsa
ccucagccagggagggcuuccuggaggagaaggagccagcuagacauggauaggagugcguuuu

SEQ ID NO: 176253 - RNA, 64 nt, hsa
gagacccagucacacgucucugcuuuaagccuuagccagcuagugacgaguacaacgagauaac

SEQ ID NO: 176254 - RNA, 64 nt, hsa
gcucuaauagggucaucucuggcagcccacuugggccagcuacgugggagggaggaauuacaca

SEQ ID NO: 176255 - RNA, 64 nt, hsa
cucucacuuuucccucuccccuuugaauaaagucgccagcuagagcacgugacgaguguggcug

SEQ ID NO: 176256 - RNA, 64 nt, hsa
aaucccugucucuacgugaacuugggauuccaaagccagcuaacagcaugaucuuuucucacuu

SEQ ID NO: 176257 - RNA, 64 nt, hsa
ggagggagagaaaggagcugaaagucuagguuuggccagcuagguagacugacuugugagguau

SEQ ID NO: 176258 - RNA, 64 nt, hsa
aaauuagcugggcaugguggugugugccuguaaugccagcuacucaggaggcugaggcaugaga

SEQ ID NO: 176259 - RNA, 64 nt, hsa
ugcucugauuaggacagcgaccucggauagcacagccagcuacuccacccugccugccugggcc

SEQ ID NO: 176260 - RNA, 64 nt, hsa
ccaauuugauucaaaaauauuuuuaacauugugagccagcuagacccccagugcaccaccccau

SEQ ID NO: 176261 - RNA, 64 nt, hsa
cucaacagccgcuugaagccaagaacucuucaaugccagcuacugccaccuaaaaaucaucugg

SEQ ID NO: 176262 - RNA, 64 nt, hsa
gaacucuagucccaaagggguggccagagccaaagccagcuacuguccuguccucugcuuccug

SEQ ID NO: 176263 - RNA, 64 nt, hsa
cauguccugcuggaagugccuaguugccugcaaagccagcuaaggcuuauuauuucaaaagaag

SEQ ID NO: 176264 - RNA, 64 nt, hsa
uuuuuuuuuuuuaaacauccacaguuaagguugggccagcuaccuuuggggcugacccccucca

SEQ ID NO: 176265 - RNA, 64 nt, hsa
ucugcugacauuuuggauuaaccuuauguagguugccagcuaaugaauuguaauugauuucaau

SEQ ID NO: 176266 - RNA, 64 nt, hsa
acuaguaggcaagccugggcauuucugcauuugugccagcuaacacuacaaaauagacuuaauu

SEQ ID NO: 176267 - RNA, 64 nt, hsa
cugggccccuaaucccaggccccgagauaggaaagccagcuagucucuucucuucugugaucuc

SEQ ID NO: 176268 - RNA, 64 nt, hsa
acaaagacgauaucuuuauggucguauaucaauagccagcuagacgaguuuucuaaucccuucu

SEQ ID NO: 176269 - RNA, 64 nt, hsa
ucucuacugucacauuuuguuucuuaaaagcaaagccagcuaacaccuucauucaucccuaguu

SEQ ID NO: 176270 - RNA, 53 nt, hsa
aagaacuaccgaguguguagacggccagcuacuccccuaucuccgagagcagc

SEQ ID NO: 176271 - RNA, 64 nt, hsa
caaguugagacaaccaaaaaugucuccagauauugccagcuaccccuugagggaugguaccucu

SEQ ID NO: 176272 - RNA, 64 nt, hsa
gagcgacccugagcucuucagccagauccugagggccagcuaugaguuugacucuccuuucugg

SEQ ID NO: 176273 - RNA, 64 nt, hsa; identical to SEQ ID NO: 78937

SEQ ID NO: 176274 - RNA, 64 nt, hsa; identical to SEQ ID NO: 78938

SEQ ID NO: 176275 - RNA, 64 nt, hsa; identical to SEQ ID NO: 78939

SEQ ID NO: 176276 - RNA, 64 nt, hsa; identical to SEQ ID NO: 78940

SEQ ID NO: 176277 - RNA, 64 nt, hsa; identical to SEQ ID NO: 78941

SEQ ID NO: 176278 - RNA, 64 nt, hsa; identical to SEQ ID NO: 78942

SEQ ID NO: 176279 - RNA, 64 nt, hsa; identical to SEQ ID NO: 78943

SEQ ID NO: 176280 - RNA, 64 nt, hsa; identical to SEQ ID NO: 78944

SEQ ID NO: 176281 - RNA, 64 nt, hsa; identical to SEQ ID NO: 78945

SEQ ID NO: 176282 - RNA, 64 nt, hsa; identical to SEQ ID NO: 78946

SEQ ID NO: 176283 - RNA, 64 nt, hsa; identical to SEQ ID NO: 78947

SEQ ID NO: 176284 - RNA, 64 nt, hsa; identical to SEQ ID NO: 78948

SEQ ID NO: 176285 - RNA, 64 nt, hsa; identical to SEQ ID NO: 78949

SEQ ID NO: 176286 - RNA, 64 nt, hsa; identical to SEQ ID NO: 78950

SEQ ID NO: 176287 - RNA, 64 nt, hsa; identical to SEQ ID NO: 78951

SEQ ID NO: 176288 - RNA, 64 nt, hsa; identical to SEQ ID NO: 78952

SEQ ID NO: 176289 - RNA, 64 nt, hsa; identical to SEQ ID NO: 78953

SEQ ID NO: 176290 - RNA, 64 nt, hsa; identical to SEQ ID NO: 78954

SEQ ID NO: 176291 - RNA, 64 nt, hsa; identical to SEQ ID NO: 78955

SEQ ID NO: 176292 - RNA, 64 nt, hsa; identical to SEQ ID NO: 78956

SEQ ID NO: 176293 - RNA, 64 nt, hsa; identical to SEQ ID NO: 78957

SEQ ID NO: 176294 - RNA, 64 nt, hsa; identical to SEQ ID NO: 78958

SEQ ID NO: 176295 - RNA, 64 nt, hsa; identical to SEQ ID NO: 78959

SEQ ID NO: 176296 - RNA, 64 nt, hsa; identical to SEQ ID NO: 78960

SEQ ID NO: 176297 - RNA, 64 nt, hsa; identical to SEQ ID NO: 78961

SEQ ID NO: 176298 - RNA, 64 nt, hsa; identical to SEQ ID NO: 78962

SEQ ID NO: 176299 - RNA, 64 nt, hsa; identical to SEQ ID NO: 78963

SEQ ID NO: 176300 - RNA, 64 nt, hsa; identical to SEQ ID NO: 78964

SEQ ID NO: 176301 - RNA, 64 nt, hsa; identical to SEQ ID NO: 78965

SEQ ID NO: 176302 - RNA, 64 nt, hsa; identical to SEQ ID NO: 78966

SEQ ID NO: 176303 - RNA, 64 nt, hsa; identical to SEQ ID NO: 78967

SEQ ID NO: 176304 - RNA, 64 nt, hsa; identical to SEQ ID NO: 78968

SEQ ID NO: 176305 - RNA, 64 nt, hsa; identical to SEQ ID NO: 78969

SEQ ID NO: 176306 - RNA, 64 nt, hsa; identical to SEQ ID NO: 78970

SEQ ID NO: 176307 - RNA, 64 nt, hsa; identical to SEQ ID NO: 78971

SEQ ID NO: 176308 - RNA, 64 nt, hsa; identical to SEQ ID NO: 78972

SEQ ID NO: 176309 - RNA, 64 nt, hsa; identical to SEQ ID NO: 78973

SEQ ID NO: 176310 - RNA, 64 nt, hsa; identical to SEQ ID NO: 78974

SEQ ID NO: 176311 - RNA, 64 nt, hsa; identical to SEQ ID NO: 78975

SEQ ID NO: 176312 - RNA, 64 nt, hsa; identical to SEQ ID NO: 78976

SEQ ID NO: 176313 - RNA, 64 nt, hsa; identical to SEQ ID NO: 78977

SEQ ID NO: 176314 - RNA, 64 nt, hsa; identical to SEQ ID NO: 78978

SEQ ID NO: 176315 - RNA, 64 nt, hsa; identical to SEQ ID NO: 78979

SEQ ID NO: 176316 - RNA, 64 nt, hsa; identical to SEQ ID NO: 78980

SEQ ID NO: 176317 - RNA, 64 nt, hsa; identical to SEQ ID NO: 78981

SEQ ID NO: 176318 - RNA, 64 nt, hsa; identical to SEQ ID NO: 78982

SEQ ID NO: 176319 - RNA, 64 nt, hsa; identical to SEQ ID NO: 78983

SEQ ID NO: 176320 - RNA, 64 nt, hsa; identical to SEQ ID NO: 78984

SEQ ID NO: 176321 - RNA, 64 nt, hsa; identical to SEQ ID NO: 78985

SEQ ID NO: 176322 - RNA, 64 nt, hsa; identical to SEQ ID NO: 78986

SEQ ID NO: 176323 - RNA, 64 nt, hsa; identical to SEQ ID NO: 78987

SEQ ID NO: 176324 - RNA, 64 nt, hsa; identical to SEQ ID NO: 78988

SEQ ID NO: 176325 - RNA, 64 nt, hsa; identical to SEQ ID NO: 78989

SEQ ID NO: 176326 - RNA, 64 nt, hsa; identical to SEQ ID NO: 78990

SEQ ID NO: 176327 - RNA, 64 nt, hsa; identical to SEQ ID NO: 78991

SEQ ID NO: 176328 - RNA, 64 nt, hsa; identical to SEQ ID NO: 78992

SEQ ID NO: 176329 - RNA, 64 nt, hsa; identical to SEQ ID NO: 78993

SEQ ID NO: 176330 - RNA, 64 nt, hsa; identical to SEQ ID NO: 78994

SEQ ID NO: 176331 - RNA, 64 nt, hsa; identical to SEQ ID NO: 78995

SEQ ID NO: 176332 - RNA, 64 nt, hsa; identical to SEQ ID NO: 78996

SEQ ID NO: 176333 - RNA, 64 nt, hsa; identical to SEQ ID NO: 78997

SEQ ID NO: 176334 - RNA, 64 nt, hsa; identical to SEQ ID NO: 78998

SEQ ID NO: 176335 - RNA, 64 nt, hsa; identical to SEQ ID NO: 78999

SEQ ID NO: 176336 - RNA, 64 nt, hsa; identical to SEQ ID NO: 79000

SEQ ID NO: 176337 - RNA, 64 nt, hsa; identical to SEQ ID NO: 79001

SEQ ID NO: 176338 - RNA, 64 nt, hsa; identical to SEQ ID NO: 79002

SEQ ID NO: 176339 - RNA, 64 nt, hsa; identical to SEQ ID NO: 79003

SEQ ID NO: 176340 - RNA, 64 nt, hsa; identical to SEQ ID NO: 79004

SEQ ID NO: 176341 - RNA, 64 nt, hsa; identical to SEQ ID NO: 79005

SEQ ID NO: 176342 - RNA, 64 nt, hsa; identical to SEQ ID NO: 79006

SEQ ID NO: 176343 - RNA, 64 nt, hsa; identical to SEQ ID NO: 79007

SEQ ID NO: 176344 - RNA, 64 nt, hsa; identical to SEQ ID NO: 79008

SEQ ID NO: 176345 - RNA, 64 nt, hsa; identical to SEQ ID NO: 79009

SEQ ID NO: 176346 - RNA, 64 nt, hsa; identical to SEQ ID NO: 79010

SEQ ID NO: 176347 - RNA, 64 nt, hsa; identical to SEQ ID NO: 79011

SEQ ID NO: 176348 - RNA, 64 nt, hsa; identical to SEQ ID NO: 79012

SEQ ID NO: 176349 - RNA, 64 nt, hsa; identical to SEQ ID NO: 79013

SEQ ID NO: 176350 - RNA, 64 nt, hsa; identical to SEQ ID NO: 79014

SEQ ID NO: 176351 - RNA, 64 nt, hsa; identical to SEQ ID NO: 79015

SEQ ID NO: 176352 - RNA, 64 nt, hsa; identical to SEQ ID NO: 79016

SEQ ID NO: 176353 - RNA, 64 nt, hsa; identical to SEQ ID NO: 79017

SEQ ID NO: 176354 - RNA, 64 nt, hsa; identical to SEQ ID NO: 79018

SEQ ID NO: 176355 - RNA, 64 nt, hsa; identical to SEQ ID NO: 79019

SEQ ID NO: 176356 - RNA, 64 nt, hsa; identical to SEQ ID NO: 79020

SEQ ID NO: 176357 - RNA, 64 nt, hsa; identical to SEQ ID NO: 79021

SEQ ID NO: 176358 - RNA, 64 nt, hsa; identical to SEQ ID NO: 79022

SEQ ID NO: 176359 - RNA, 64 nt, hsa; identical to SEQ ID NO: 79023

SEQ ID NO: 176360 - RNA, 64 nt, hsa; identical to SEQ ID NO: 79024

SEQ ID NO: 176361 - RNA, 64 nt, hsa; identical to SEQ ID NO: 79025

SEQ ID NO: 176362 - RNA, 64 nt, hsa; identical to SEQ ID NO: 79026

SEQ ID NO: 176363 - RNA, 64 nt, hsa; identical to SEQ ID NO: 79027

SEQ ID NO: 176364 - RNA, 64 nt, hsa; identical to SEQ ID NO: 79028

SEQ ID NO: 176365 - RNA, 64 nt, hsa; identical to SEQ ID NO: 79029

SEQ ID NO: 176366 - RNA, 64 nt, hsa; identical to SEQ ID NO: 79030

SEQ ID NO: 176367 - RNA, 64 nt, hsa; identical to SEQ ID NO: 79031

SEQ ID NO: 176368 - RNA, 64 nt, hsa; identical to SEQ ID NO: 79032

SEQ ID NO: 176369 - RNA, 64 nt, hsa; identical to SEQ ID NO: 79033

SEQ ID NO: 176370 - RNA, 64 nt, hsa; identical to SEQ ID NO: 79034

SEQ ID NO: 176371 - RNA, 64 nt, hsa; identical to SEQ ID NO: 79035

SEQ ID NO: 176372 - RNA, 64 nt, hsa; identical to SEQ ID NO: 79036

SEQ ID NO: 176373 - RNA, 64 nt, hsa; identical to SEQ ID NO: 79037

SEQ ID NO: 176374 - RNA, 64 nt, hsa; identical to SEQ ID NO: 79038

SEQ ID NO: 176375 - RNA, 64 nt, hsa; identical to SEQ ID NO: 79039

SEQ ID NO: 176376 - RNA, 64 nt, hsa; identical to SEQ ID NO: 79040

SEQ ID NO: 176377 - RNA, 64 nt, hsa; identical to SEQ ID NO: 79041

SEQ ID NO: 176378 - RNA, 64 nt, hsa; identical to SEQ ID NO: 79042

SEQ ID NO: 176379 - RNA, 64 nt, hsa; identical to SEQ ID NO: 79043

SEQ ID NO: 176380 - RNA, 64 nt, hsa; identical to SEQ ID NO: 79044

SEQ ID NO: 176381 - RNA, 64 nt, hsa; identical to SEQ ID NO: 79045

SEQ ID NO: 176382 - RNA, 64 nt, hsa; identical to SEQ ID NO: 79046

SEQ ID NO: 176383 - RNA, 64 nt, hsa; identical to SEQ ID NO: 79047

SEQ ID NO: 176384 - RNA, 64 nt, hsa; identical to SEQ ID NO: 79048

SEQ ID NO: 176385 - RNA, 64 nt, hsa; identical to SEQ ID NO: 79049

SEQ ID NO: 176386 - RNA, 64 nt, hsa; identical to SEQ ID NO: 79050

SEQ ID NO: 176387 - RNA, 64 nt, hsa; identical to SEQ ID NO: 172495

SEQ ID NO: 176388 - RNA, 64 nt, hsa; identical to SEQ ID NO: 172496

SEQ ID NO: 176389 - RNA, 64 nt, hsa; identical to SEQ ID NO: 78937

SEQ ID NO: 176390 - RNA, 64 nt, hsa; identical to SEQ ID NO: 78938

SEQ ID NO: 176391 - RNA, 64 nt, hsa; identical to SEQ ID NO: 78939

SEQ ID NO: 176392 - RNA, 64 nt, hsa; identical to SEQ ID NO: 78940

SEQ ID NO: 176393 - RNA, 64 nt, hsa; identical to SEQ ID NO: 78941

SEQ ID NO: 176394 - RNA, 64 nt, hsa; identical to SEQ ID NO: 78942

SEQ ID NO: 176395 - RNA, 64 nt, hsa; identical to SEQ ID NO: 78943

SEQ ID NO: 176396 - RNA, 64 nt, hsa; identical to SEQ ID NO: 78944

SEQ ID NO: 176397 - RNA, 64 nt, hsa; identical to SEQ ID NO: 78945

SEQ ID NO: 176398 - RNA, 64 nt, hsa; identical to SEQ ID NO: 78946

SEQ ID NO: 176399 - RNA, 64 nt, hsa; identical to SEQ ID NO: 78947

SEQ ID NO: 176400 - RNA, 64 nt, hsa; identical to SEQ ID NO: 78948

SEQ ID NO: 176401 - RNA, 64 nt, hsa; identical to SEQ ID NO: 78949

SEQ ID NO: 176402 - RNA, 64 nt, hsa; identical to SEQ ID NO: 78950

SEQ ID NO: 176403 - RNA, 64 nt, hsa; identical to SEQ ID NO: 78951

SEQ ID NO: 176404 - RNA, 64 nt, hsa; identical to SEQ ID NO: 78952

SEQ ID NO: 176405 - RNA, 64 nt, hsa; identical to SEQ ID NO: 78953

SEQ ID NO: 176406 - RNA, 64 nt, hsa; identical to SEQ ID NO: 78954

SEQ ID NO: 176407 - RNA, 64 nt, hsa; identical to SEQ ID NO: 78955

SEQ ID NO: 176408 - RNA, 64 nt, hsa; identical to SEQ ID NO: 78956

SEQ ID NO: 176409 - RNA, 64 nt, hsa; identical to SEQ ID NO: 78957

SEQ ID NO: 176410 - RNA, 64 nt, hsa; identical to SEQ ID NO: 78958

SEQ ID NO: 176411 - RNA, 64 nt, hsa; identical to SEQ ID NO: 78959

SEQ ID NO: 176412 - RNA, 64 nt, hsa; identical to SEQ ID NO: 78960

SEQ ID NO: 176413 - RNA, 64 nt, hsa; identical to SEQ ID NO: 78961

SEQ ID NO: 176414 - RNA, 64 nt, hsa; identical to SEQ ID NO: 78962

SEQ ID NO: 176415 - RNA, 64 nt, hsa; identical to SEQ ID NO: 78963

SEQ ID NO: 176416 - RNA, 64 nt, hsa; identical to SEQ ID NO: 78964

SEQ ID NO: 176417 - RNA, 64 nt, hsa; identical to SEQ ID NO: 78965

SEQ ID NO: 176418 - RNA, 64 nt, hsa; identical to SEQ ID NO: 78966

SEQ ID NO: 176419 - RNA, 64 nt, hsa; identical to SEQ ID NO: 78967

SEQ ID NO: 176420 - RNA, 64 nt, hsa; identical to SEQ ID NO: 78968

SEQ ID NO: 176421 - RNA, 64 nt, hsa; identical to SEQ ID NO: 78969

SEQ ID NO: 176422 - RNA, 64 nt, hsa; identical to SEQ ID NO: 78970

SEQ ID NO: 176423 - RNA, 64 nt, hsa; identical to SEQ ID NO: 78971

SEQ ID NO: 176424 - RNA, 64 nt, hsa; identical to SEQ ID NO: 78972

SEQ ID NO: 176425 - RNA, 64 nt, hsa; identical to SEQ ID NO: 78973

SEQ ID NO: 176426 - RNA, 64 nt, hsa; identical to SEQ ID NO: 78974

SEQ ID NO: 176427 - RNA, 64 nt, hsa; identical to SEQ ID NO: 78975

SEQ ID NO: 176428 - RNA, 64 nt, hsa; identical to SEQ ID NO: 78976

SEQ ID NO: 176429 - RNA, 64 nt, hsa; identical to SEQ ID NO: 78977

SEQ ID NO: 176430 - RNA, 64 nt, hsa; identical to SEQ ID NO: 78978

SEQ ID NO: 176431 - RNA, 64 nt, hsa; identical to SEQ ID NO: 78979

SEQ ID NO: 176432 - RNA, 64 nt, hsa; identical to SEQ ID NO: 78980

SEQ ID NO: 176433 - RNA, 64 nt, hsa; identical to SEQ ID NO: 78981

SEQ ID NO: 176434 - RNA, 64 nt, hsa; identical to SEQ ID NO: 78982

SEQ ID NO: 176435 - RNA, 64 nt, hsa; identical to SEQ ID NO: 78983

SEQ ID NO: 176436 - RNA, 64 nt, hsa; identical to SEQ ID NO: 78984

SEQ ID NO: 176437 - RNA, 64 nt, hsa; identical to SEQ ID NO: 78985

SEQ ID NO: 176438 - RNA, 64 nt, hsa; identical to SEQ ID NO: 78986

SEQ ID NO: 176439 - RNA, 64 nt, hsa; identical to SEQ ID NO: 78987

SEQ ID NO: 176440 - RNA, 64 nt, hsa; identical to SEQ ID NO: 78988

SEQ ID NO: 176441 - RNA, 64 nt, hsa; identical to SEQ ID NO: 78989

SEQ ID NO: 176442 - RNA, 64 nt, hsa; identical to SEQ ID NO: 78990

SEQ ID NO: 176443 - RNA, 64 nt, hsa; identical to SEQ ID NO: 78991

SEQ ID NO: 176444 - RNA, 64 nt, hsa; identical to SEQ ID NO: 78992

SEQ ID NO: 176445 - RNA, 64 nt, hsa; identical to SEQ ID NO: 78993

SEQ ID NO: 176446 - RNA, 64 nt, hsa; identical to SEQ ID NO: 78994

SEQ ID NO: 176447 - RNA, 64 nt, hsa; identical to SEQ ID NO: 78995

SEQ ID NO: 176448 - RNA, 64 nt, hsa; identical to SEQ ID NO: 78996

SEQ ID NO: 176449 - RNA, 64 nt, hsa; identical to SEQ ID NO: 78997

SEQ ID NO: 176450 - RNA, 64 nt, hsa; identical to SEQ ID NO: 78998

SEQ ID NO: 176451 - RNA, 64 nt, hsa; identical to SEQ ID NO: 78999

SEQ ID NO: 176452 - RNA, 64 nt, hsa; identical to SEQ ID NO: 79000

SEQ ID NO: 176453 - RNA, 64 nt, hsa; identical to SEQ ID NO: 79001

SEQ ID NO: 176454 - RNA, 64 nt, hsa; identical to SEQ ID NO: 79002

SEQ ID NO: 176455 - RNA, 64 nt, hsa; identical to SEQ ID NO: 79003

SEQ ID NO: 176456 - RNA, 64 nt, hsa; identical to SEQ ID NO: 79004

SEQ ID NO: 176457 - RNA, 64 nt, hsa; identical to SEQ ID NO: 79005

SEQ ID NO: 176458 - RNA, 64 nt, hsa; identical to SEQ ID NO: 79006

SEQ ID NO: 176459 - RNA, 64 nt, hsa; identical to SEQ ID NO: 79007

SEQ ID NO: 176460 - RNA, 64 nt, hsa; identical to SEQ ID NO: 79008

SEQ ID NO: 176461 - RNA, 64 nt, hsa; identical to SEQ ID NO: 79009

SEQ ID NO: 176462 - RNA, 64 nt, hsa; identical to SEQ ID NO: 79010

SEQ ID NO: 176463 - RNA, 64 nt, hsa; identical to SEQ ID NO: 79011

SEQ ID NO: 176464 - RNA, 64 nt, hsa; identical to SEQ ID NO: 79012

SEQ ID NO: 176465 - RNA, 64 nt, hsa; identical to SEQ ID NO: 79013

SEQ ID NO: 176466 - RNA, 64 nt, hsa; identical to SEQ ID NO: 79014

SEQ ID NO: 176467 - RNA, 64 nt, hsa; identical to SEQ ID NO: 79015

SEQ ID NO: 176468 - RNA, 64 nt, hsa; identical to SEQ ID NO: 79016

SEQ ID NO: 176469 - RNA, 64 nt, hsa; identical to SEQ ID NO: 79017

SEQ ID NO: 176470 - RNA, 64 nt, hsa; identical to SEQ ID NO: 79018

SEQ ID NO: 176471 - RNA, 64 nt, hsa; identical to SEQ ID NO: 79019

SEQ ID NO: 176472 - RNA, 64 nt, hsa; identical to SEQ ID NO: 79020

SEQ ID NO: 176473 - RNA, 64 nt, hsa; identical to SEQ ID NO: 79021

SEQ ID NO: 176474 - RNA, 64 nt, hsa; identical to SEQ ID NO: 79022

SEQ ID NO: 176475 - RNA, 64 nt, hsa; identical to SEQ ID NO: 79023

SEQ ID NO: 176476 - RNA, 64 nt, hsa; identical to SEQ ID NO: 79024

SEQ ID NO: 176477 - RNA, 64 nt, hsa; identical to SEQ ID NO: 79025

SEQ ID NO: 176478 - RNA, 64 nt, hsa; identical to SEQ ID NO: 79026

SEQ ID NO: 176479 - RNA, 64 nt, hsa; identical to SEQ ID NO: 79027

SEQ ID NO: 176480 - RNA, 64 nt, hsa; identical to SEQ ID NO: 79028

SEQ ID NO: 176481 - RNA, 64 nt, hsa; identical to SEQ ID NO: 79029

SEQ ID NO: 176482 - RNA, 64 nt, hsa; identical to SEQ ID NO: 79030

SEQ ID NO: 176483 - RNA, 64 nt, hsa; identical to SEQ ID NO: 79031

SEQ ID NO: 176484 - RNA, 64 nt, hsa; identical to SEQ ID NO: 79032

SEQ ID NO: 176485 - RNA, 64 nt, hsa; identical to SEQ ID NO: 79033

SEQ ID NO: 176486 - RNA, 64 nt, hsa; identical to SEQ ID NO: 79034

SEQ ID NO: 176487 - RNA, 64 nt, hsa; identical to SEQ ID NO: 79035

SEQ ID NO: 176488 - RNA, 64 nt, hsa; identical to SEQ ID NO: 79036

SEQ ID NO: 176489 - RNA, 64 nt, hsa; identical to SEQ ID NO: 79037

SEQ ID NO: 176490 - RNA, 64 nt, hsa; identical to SEQ ID NO: 79038

SEQ ID NO: 176491 - RNA, 64 nt, hsa; identical to SEQ ID NO: 79039

SEQ ID NO: 176492 - RNA, 64 nt, hsa; identical to SEQ ID NO: 79040

SEQ ID NO: 176493 - RNA, 64 nt, hsa; identical to SEQ ID NO: 79041

SEQ ID NO: 176494 - RNA, 64 nt, hsa; identical to SEQ ID NO: 79042

SEQ ID NO: 176495 - RNA, 64 nt, hsa; identical to SEQ ID NO: 79043

SEQ ID NO: 176496 - RNA, 64 nt, hsa; identical to SEQ ID NO: 79044

SEQ ID NO: 176497 - RNA, 64 nt, hsa; identical to SEQ ID NO: 79045

SEQ ID NO: 176498 - RNA, 64 nt, hsa; identical to SEQ ID NO: 79046

SEQ ID NO: 176499 - RNA, 64 nt, hsa; identical to SEQ ID NO: 79047

SEQ ID NO: 176500 - RNA, 64 nt, hsa; identical to SEQ ID NO: 79048

SEQ ID NO: 176501 - RNA, 64 nt, hsa; identical to SEQ ID NO: 79049

SEQ ID NO: 176502 - RNA, 64 nt, hsa; identical to SEQ ID NO: 79050

SEQ ID NO: 176503 - RNA, 64 nt, hsa; identical to SEQ ID NO: 172495

SEQ ID NO: 176504 - RNA, 64 nt, hsa; identical to SEQ ID NO: 172496

SEQ ID NO: 176505 - RNA, 64 nt, hsa; identical to SEQ ID NO: 78937

SEQ ID NO: 176506 - RNA, 64 nt, hsa; identical to SEQ ID NO: 78938

SEQ ID NO: 176507 - RNA, 64 nt, hsa; identical to SEQ ID NO: 78939

SEQ ID NO: 176508 - RNA, 64 nt, hsa; identical to SEQ ID NO: 78940

SEQ ID NO: 176509 - RNA, 64 nt, hsa; identical to SEQ ID NO: 78941

SEQ ID NO: 176510 - RNA, 64 nt, hsa; identical to SEQ ID NO: 78942

SEQ ID NO: 176511 - RNA, 64 nt, hsa; identical to SEQ ID NO: 78943

SEQ ID NO: 176512 - RNA, 64 nt, hsa; identical to SEQ ID NO: 78944

SEQ ID NO: 176513 - RNA, 64 nt, hsa; identical to SEQ ID NO: 78945

SEQ ID NO: 176514 - RNA, 64 nt, hsa; identical to SEQ ID NO: 78946

SEQ ID NO: 176515 - RNA, 64 nt, hsa; identical to SEQ ID NO: 78947

SEQ ID NO: 176516 - RNA, 64 nt, hsa; identical to SEQ ID NO: 78948

SEQ ID NO: 176517 - RNA, 64 nt, hsa; identical to SEQ ID NO: 78949

SEQ ID NO: 176518 - RNA, 64 nt, hsa; identical to SEQ ID NO: 78950

SEQ ID NO: 176519 - RNA, 64 nt, hsa; identical to SEQ ID NO: 78951

SEQ ID NO: 176520 - RNA, 64 nt, hsa; identical to SEQ ID NO: 78952

SEQ ID NO: 176521 - RNA, 64 nt, hsa; identical to SEQ ID NO: 78953

SEQ ID NO: 176522 - RNA, 64 nt, hsa; identical to SEQ ID NO: 78954

SEQ ID NO: 176523 - RNA, 64 nt, hsa; identical to SEQ ID NO: 78955

SEQ ID NO: 176524 - RNA, 64 nt, hsa; identical to SEQ ID NO: 78956

SEQ ID NO: 176525 - RNA, 64 nt, hsa; identical to SEQ ID NO: 78957

SEQ ID NO: 176526 - RNA, 64 nt, hsa; identical to SEQ ID NO: 78958

SEQ ID NO: 176527 - RNA, 64 nt, hsa; identical to SEQ ID NO: 78959

SEQ ID NO: 176528 - RNA, 64 nt, hsa; identical to SEQ ID NO: 78960

SEQ ID NO: 176529 - RNA, 64 nt, hsa; identical to SEQ ID NO: 78961

SEQ ID NO: 176530 - RNA, 64 nt, hsa; identical to SEQ ID NO: 78962

SEQ ID NO: 176531 - RNA, 64 nt, hsa; identical to SEQ ID NO: 78963

SEQ ID NO: 176532 - RNA, 64 nt, hsa; identical to SEQ ID NO: 78964

SEQ ID NO: 176533 - RNA, 64 nt, hsa; identical to SEQ ID NO: 78965

SEQ ID NO: 176534 - RNA, 64 nt, hsa; identical to SEQ ID NO: 78966

SEQ ID NO: 176535 - RNA, 64 nt, hsa; identical to SEQ ID NO: 78967

SEQ ID NO: 176536 - RNA, 64 nt, hsa; identical to SEQ ID NO: 78968

SEQ ID NO: 176537 - RNA, 64 nt, hsa; identical to SEQ ID NO: 78969

SEQ ID NO: 176538 - RNA, 64 nt, hsa; identical to SEQ ID NO: 78970

SEQ ID NO: 176539 - RNA, 64 nt, hsa; identical to SEQ ID NO: 78971

SEQ ID NO: 176540 - RNA, 64 nt, hsa; identical to SEQ ID NO: 78972

SEQ ID NO: 176541 - RNA, 64 nt, hsa; identical to SEQ ID NO: 78973

SEQ ID NO: 176542 - RNA, 64 nt, hsa; identical to SEQ ID NO: 78974

SEQ ID NO: 176543 - RNA, 64 nt, hsa; identical to SEQ ID NO: 78975

SEQ ID NO: 176544 - RNA, 64 nt, hsa; identical to SEQ ID NO: 78976

SEQ ID NO: 176545 - RNA, 64 nt, hsa; identical to SEQ ID NO: 78977

SEQ ID NO: 176546 - RNA, 64 nt, hsa; identical to SEQ ID NO: 78978

SEQ ID NO: 176547 - RNA, 64 nt, hsa; identical to SEQ ID NO: 78979

SEQ ID NO: 176548 - RNA, 64 nt, hsa; identical to SEQ ID NO: 78980

SEQ ID NO: 176549 - RNA, 64 nt, hsa; identical to SEQ ID NO: 78981

SEQ ID NO: 176550 - RNA, 64 nt, hsa; identical to SEQ ID NO: 78982

SEQ ID NO: 176551 - RNA, 64 nt, hsa; identical to SEQ ID NO: 78983

SEQ ID NO: 176552 - RNA, 64 nt, hsa; identical to SEQ ID NO: 78984

SEQ ID NO: 176553 - RNA, 64 nt, hsa; identical to SEQ ID NO: 78985

SEQ ID NO: 176554 - RNA, 64 nt, hsa; identical to SEQ ID NO: 78986

SEQ ID NO: 176555 - RNA, 64 nt, hsa; identical to SEQ ID NO: 78987

SEQ ID NO: 176556 - RNA, 64 nt, hsa; identical to SEQ ID NO: 78988

SEQ ID NO: 176557 - RNA, 64 nt, hsa; identical to SEQ ID NO: 78989

SEQ ID NO: 176558 - RNA, 64 nt, hsa; identical to SEQ ID NO: 78990

SEQ ID NO: 176559 - RNA, 64 nt, hsa; identical to SEQ ID NO: 78991

SEQ ID NO: 176560 - RNA, 64 nt, hsa; identical to SEQ ID NO: 78992

SEQ ID NO: 176561 - RNA, 64 nt, hsa; identical to SEQ ID NO: 78993

SEQ ID NO: 176562 - RNA, 64 nt, hsa; identical to SEQ ID NO: 78994

SEQ ID NO: 176563 - RNA, 64 nt, hsa; identical to SEQ ID NO: 78995

SEQ ID NO: 176564 - RNA, 64 nt, hsa; identical to SEQ ID NO: 78996

SEQ ID NO: 176565 - RNA, 64 nt, hsa; identical to SEQ ID NO: 78997

SEQ ID NO: 176566 - RNA, 64 nt, hsa; identical to SEQ ID NO: 78998

SEQ ID NO: 176567 - RNA, 64 nt, hsa; identical to SEQ ID NO: 78999

SEQ ID NO: 176568 - RNA, 64 nt, hsa; identical to SEQ ID NO: 79000

SEQ ID NO: 176569 - RNA, 64 nt, hsa; identical to SEQ ID NO: 79001

SEQ ID NO: 176570 - RNA, 64 nt, hsa; identical to SEQ ID NO: 79002

SEQ ID NO: 176571 - RNA, 64 nt, hsa; identical to SEQ ID NO: 79003

SEQ ID NO: 176572 - RNA, 64 nt, hsa; identical to SEQ ID NO: 79004

SEQ ID NO: 176573 - RNA, 64 nt, hsa; identical to SEQ ID NO: 79005

SEQ ID NO: 176574 - RNA, 64 nt, hsa; identical to SEQ ID NO: 79006

SEQ ID NO: 176575 - RNA, 64 nt, hsa; identical to SEQ ID NO: 79007

SEQ ID NO: 176576 - RNA, 64 nt, hsa; identical to SEQ ID NO: 79008

SEQ ID NO: 176577 - RNA, 64 nt, hsa; identical to SEQ ID NO: 79009

SEQ ID NO: 176578 - RNA, 64 nt, hsa; identical to SEQ ID NO: 79010

SEQ ID NO: 176579 - RNA, 64 nt, hsa; identical to SEQ ID NO: 79011

SEQ ID NO: 176580 - RNA, 64 nt, hsa; identical to SEQ ID NO: 79012

SEQ ID NO: 176581 - RNA, 64 nt, hsa; identical to SEQ ID NO: 79013

SEQ ID NO: 176582 - RNA, 64 nt, hsa; identical to SEQ ID NO: 79014

SEQ ID NO: 176583 - RNA, 64 nt, hsa; identical to SEQ ID NO: 79015

SEQ ID NO: 176584 - RNA, 64 nt, hsa; identical to SEQ ID NO: 79016

SEQ ID NO: 176585 - RNA, 64 nt, hsa; identical to SEQ ID NO: 79017

SEQ ID NO: 176586 - RNA, 64 nt, hsa; identical to SEQ ID NO: 79018

SEQ ID NO: 176587 - RNA, 64 nt, hsa; identical to SEQ ID NO: 79019

SEQ ID NO: 176588 - RNA, 64 nt, hsa; identical to SEQ ID NO: 79020

SEQ ID NO: 176589 - RNA, 64 nt, hsa; identical to SEQ ID NO: 79021

SEQ ID NO: 176590 - RNA, 64 nt, hsa; identical to SEQ ID NO: 79022

SEQ ID NO: 176591 - RNA, 64 nt, hsa; identical to SEQ ID NO: 79023

SEQ ID NO: 176592 - RNA, 64 nt, hsa; identical to SEQ ID NO: 79024

SEQ ID NO: 176593 - RNA, 64 nt, hsa; identical to SEQ ID NO: 79025

SEQ ID NO: 176594 - RNA, 64 nt, hsa; identical to SEQ ID NO: 79026

SEQ ID NO: 176595 - RNA, 64 nt, hsa; identical to SEQ ID NO: 79027

SEQ ID NO: 176596 - RNA, 64 nt, hsa; identical to SEQ ID NO: 79028

SEQ ID NO: 176597 - RNA, 64 nt, hsa; identical to SEQ ID NO: 79029

SEQ ID NO: 176598 - RNA, 64 nt, hsa; identical to SEQ ID NO: 79030

SEQ ID NO: 176599 - RNA, 64 nt, hsa; identical to SEQ ID NO: 79031

SEQ ID NO: 176600 - RNA, 64 nt, hsa; identical to SEQ ID NO: 79032

SEQ ID NO: 176601 - RNA, 64 nt, hsa; identical to SEQ ID NO: 79033

SEQ ID NO: 176602 - RNA, 64 nt, hsa; identical to SEQ ID NO: 79034

SEQ ID NO: 176603 - RNA, 64 nt, hsa; identical to SEQ ID NO: 79035

SEQ ID NO: 176604 - RNA, 64 nt, hsa; identical to SEQ ID NO: 79036

SEQ ID NO: 176605 - RNA, 64 nt, hsa; identical to SEQ ID NO: 79037

SEQ ID NO: 176606 - RNA, 64 nt, hsa; identical to SEQ ID NO: 79038

SEQ ID NO: 176607 - RNA, 64 nt, hsa; identical to SEQ ID NO: 79039

SEQ ID NO: 176608 - RNA, 64 nt, hsa; identical to SEQ ID NO: 79040

SEQ ID NO: 176609 - RNA, 64 nt, hsa; identical to SEQ ID NO: 79041

SEQ ID NO: 176610 - RNA, 64 nt, hsa; identical to SEQ ID NO: 79042

SEQ ID NO: 176611 - RNA, 64 nt, hsa; identical to SEQ ID NO: 79043

SEQ ID NO: 176612 - RNA, 64 nt, hsa; identical to SEQ ID NO: 79044

SEQ ID NO: 176613 - RNA, 64 nt, hsa; identical to SEQ ID NO: 79045

SEQ ID NO: 176614 - RNA, 64 nt, hsa; identical to SEQ ID NO: 79046

SEQ ID NO: 176615 - RNA, 64 nt, hsa; identical to SEQ ID NO: 79047

SEQ ID NO: 176616 - RNA, 64 nt, hsa; identical to SEQ ID NO: 79048

SEQ ID NO: 176617 - RNA, 64 nt, hsa; identical to SEQ ID NO: 79049

SEQ ID NO: 176618 - RNA, 64 nt, hsa; identical to SEQ ID NO: 79050

SEQ ID NO: 176619 - RNA, 64 nt, hsa; identical to SEQ ID NO: 172495

SEQ ID NO: 176620 - RNA, 64 nt, hsa; identical to SEQ ID NO: 172496

SEQ ID NO: 176621 - RNA, 64 nt, hsa; identical to SEQ ID NO: 78937

SEQ ID NO: 176622 - RNA, 64 nt, hsa; identical to SEQ ID NO: 78938

SEQ ID NO: 176623 - RNA, 64 nt, hsa; identical to SEQ ID NO: 78939

SEQ ID NO: 176624 - RNA, 64 nt, hsa; identical to SEQ ID NO: 78940

SEQ ID NO: 176625 - RNA, 64 nt, hsa; identical to SEQ ID NO: 78941

SEQ ID NO: 176626 - RNA, 64 nt, hsa; identical to SEQ ID NO: 78942

SEQ ID NO: 176627 - RNA, 64 nt, hsa; identical to SEQ ID NO: 78943

SEQ ID NO: 176628 - RNA, 64 nt, hsa; identical to SEQ ID NO: 78944

SEQ ID NO: 176629 - RNA, 64 nt, hsa; identical to SEQ ID NO: 78945

SEQ ID NO: 176630 - RNA, 64 nt, hsa; identical to SEQ ID NO: 78946

SEQ ID NO: 176631 - RNA, 64 nt, hsa; identical to SEQ ID NO: 78947

SEQ ID NO: 176632 - RNA, 64 nt, hsa; identical to SEQ ID NO: 78948

SEQ ID NO: 176633 - RNA, 64 nt, hsa; identical to SEQ ID NO: 78949

SEQ ID NO: 176634 - RNA, 64 nt, hsa; identical to SEQ ID NO: 78950

SEQ ID NO: 176635 - RNA, 64 nt, hsa; identical to SEQ ID NO: 78951

SEQ ID NO: 176636 - RNA, 64 nt, hsa; identical to SEQ ID NO: 78952

SEQ ID NO: 176637 - RNA, 64 nt, hsa; identical to SEQ ID NO: 78953

SEQ ID NO: 176638 - RNA, 64 nt, hsa; identical to SEQ ID NO: 78954

SEQ ID NO: 176639 - RNA, 64 nt, hsa; identical to SEQ ID NO: 78955

SEQ ID NO: 176640 - RNA, 64 nt, hsa; identical to SEQ ID NO: 78956

SEQ ID NO: 176641 - RNA, 64 nt, hsa; identical to SEQ ID NO: 78957

SEQ ID NO: 176642 - RNA, 64 nt, hsa; identical to SEQ ID NO: 78958

SEQ ID NO: 176643 - RNA, 64 nt, hsa; identical to SEQ ID NO: 78959

SEQ ID NO: 176644 - RNA, 64 nt, hsa; identical to SEQ ID NO: 78960

SEQ ID NO: 176645 - RNA, 64 nt, hsa; identical to SEQ ID NO: 78961

SEQ ID NO: 176646 - RNA, 64 nt, hsa; identical to SEQ ID NO: 78962

SEQ ID NO: 176647 - RNA, 64 nt, hsa; identical to SEQ ID NO: 78963

SEQ ID NO: 176648 - RNA, 64 nt, hsa; identical to SEQ ID NO: 78964

SEQ ID NO: 176649 - RNA, 64 nt, hsa; identical to SEQ ID NO: 78965

SEQ ID NO: 176650 - RNA, 64 nt, hsa; identical to SEQ ID NO: 78966

SEQ ID NO: 176651 - RNA, 64 nt, hsa; identical to SEQ ID NO: 78967

SEQ ID NO: 176652 - RNA, 64 nt, hsa; identical to SEQ ID NO: 78968

SEQ ID NO: 176653 - RNA, 64 nt, hsa; identical to SEQ ID NO: 78969

SEQ ID NO: 176654 - RNA, 64 nt, hsa; identical to SEQ ID NO: 78970

SEQ ID NO: 176655 - RNA, 64 nt, hsa; identical to SEQ ID NO: 78971

SEQ ID NO: 176656 - RNA, 64 nt, hsa; identical to SEQ ID NO: 78972

SEQ ID NO: 176657 - RNA, 64 nt, hsa; identical to SEQ ID NO: 78973

SEQ ID NO: 176658 - RNA, 64 nt, hsa; identical to SEQ ID NO: 78974

SEQ ID NO: 176659 - RNA, 64 nt, hsa; identical to SEQ ID NO: 78975

SEQ ID NO: 176660 - RNA, 64 nt, hsa; identical to SEQ ID NO: 78976

SEQ ID NO: 176661 - RNA, 64 nt, hsa; identical to SEQ ID NO: 78977

SEQ ID NO: 176662 - RNA, 64 nt, hsa; identical to SEQ ID NO: 78978

SEQ ID NO: 176663 - RNA, 64 nt, hsa; identical to SEQ ID NO: 78979

SEQ ID NO: 176664 - RNA, 64 nt, hsa; identical to SEQ ID NO: 78980

SEQ ID NO: 176665 - RNA, 64 nt, hsa; identical to SEQ ID NO: 78981

SEQ ID NO: 176666 - RNA, 64 nt, hsa; identical to SEQ ID NO: 78982

SEQ ID NO: 176667 - RNA, 64 nt, hsa; identical to SEQ ID NO: 78983

SEQ ID NO: 176668 - RNA, 64 nt, hsa; identical to SEQ ID NO: 78984

SEQ ID NO: 176669 - RNA, 64 nt, hsa; identical to SEQ ID NO: 78985

SEQ ID NO: 176670 - RNA, 64 nt, hsa; identical to SEQ ID NO: 78986

SEQ ID NO: 176671 - RNA, 64 nt, hsa; identical to SEQ ID NO: 78987

SEQ ID NO: 176672 - RNA, 64 nt, hsa; identical to SEQ ID NO: 78988

SEQ ID NO: 176673 - RNA, 64 nt, hsa; identical to SEQ ID NO: 78989

SEQ ID NO: 176674 - RNA, 64 nt, hsa; identical to SEQ ID NO: 78990

SEQ ID NO: 176675 - RNA, 64 nt, hsa; identical to SEQ ID NO: 78991

SEQ ID NO: 176676 - RNA, 64 nt, hsa; identical to SEQ ID NO: 78992

SEQ ID NO: 176677 - RNA, 64 nt, hsa; identical to SEQ ID NO: 78993

SEQ ID NO: 176678 - RNA, 64 nt, hsa; identical to SEQ ID NO: 78994

SEQ ID NO: 176679 - RNA, 64 nt, hsa; identical to SEQ ID NO: 78995

SEQ ID NO: 176680 - RNA, 64 nt, hsa; identical to SEQ ID NO: 78996

SEQ ID NO: 176681 - RNA, 64 nt, hsa; identical to SEQ ID NO: 78997

SEQ ID NO: 176682 - RNA, 64 nt, hsa; identical to SEQ ID NO: 78998

SEQ ID NO: 176683 - RNA, 64 nt, hsa; identical to SEQ ID NO: 78999

SEQ ID NO: 176684 - RNA, 64 nt, hsa; identical to SEQ ID NO: 79000

SEQ ID NO: 176685 - RNA, 64 nt, hsa; identical to SEQ ID NO: 79001

SEQ ID NO: 176686 - RNA, 64 nt, hsa; identical to SEQ ID NO: 79002

SEQ ID NO: 176687 - RNA, 64 nt, hsa; identical to SEQ ID NO: 79003

SEQ ID NO: 176688 - RNA, 64 nt, hsa; identical to SEQ ID NO: 79004

SEQ ID NO: 176689 - RNA, 64 nt, hsa; identical to SEQ ID NO: 79005

SEQ ID NO: 176690 - RNA, 64 nt, hsa; identical to SEQ ID NO: 79006

SEQ ID NO: 176691 - RNA, 64 nt, hsa; identical to SEQ ID NO: 79007

SEQ ID NO: 176692 - RNA, 64 nt, hsa; identical to SEQ ID NO: 79008

SEQ ID NO: 176693 - RNA, 64 nt, hsa; identical to SEQ ID NO: 79009

SEQ ID NO: 176694 - RNA, 64 nt, hsa; identical to SEQ ID NO: 79010

SEQ ID NO: 176695 - RNA, 64 nt, hsa; identical to SEQ ID NO: 79011

SEQ ID NO: 176696 - RNA, 64 nt, hsa; identical to SEQ ID NO: 79012

SEQ ID NO: 176697 - RNA, 64 nt, hsa; identical to SEQ ID NO: 79013

SEQ ID NO: 176698 - RNA, 64 nt, hsa; identical to SEQ ID NO: 79014

SEQ ID NO: 176699 - RNA, 64 nt, hsa; identical to SEQ ID NO: 79015

SEQ ID NO: 176700 - RNA, 64 nt, hsa; identical to SEQ ID NO: 79016

SEQ ID NO: 176701 - RNA, 64 nt, hsa; identical to SEQ ID NO: 79017

SEQ ID NO: 176702 - RNA, 64 nt, hsa; identical to SEQ ID NO: 79018

SEQ ID NO: 176703 - RNA, 64 nt, hsa; identical to SEQ ID NO: 79019

SEQ ID NO: 176704 - RNA, 64 nt, hsa; identical to SEQ ID NO: 79020

SEQ ID NO: 176705 - RNA, 64 nt, hsa; identical to SEQ ID NO: 79021

SEQ ID NO: 176706 - RNA, 64 nt, hsa; identical to SEQ ID NO: 79022

SEQ ID NO: 176707 - RNA, 64 nt, hsa; identical to SEQ ID NO: 79023

SEQ ID NO: 176708 - RNA, 64 nt, hsa; identical to SEQ ID NO: 79024

SEQ ID NO: 176709 - RNA, 64 nt, hsa; identical to SEQ ID NO: 79025

SEQ ID NO: 176710 - RNA, 64 nt, hsa; identical to SEQ ID NO: 79026

SEQ ID NO: 176711 - RNA, 64 nt, hsa; identical to SEQ ID NO: 79027

SEQ ID NO: 176712 - RNA, 64 nt, hsa; identical to SEQ ID NO: 79028

SEQ ID NO: 176713 - RNA, 64 nt, hsa; identical to SEQ ID NO: 79029

SEQ ID NO: 176714 - RNA, 64 nt, hsa; identical to SEQ ID NO: 79030

SEQ ID NO: 176715 - RNA, 64 nt, hsa; identical to SEQ ID NO: 79031

SEQ ID NO: 176716 - RNA, 64 nt, hsa; identical to SEQ ID NO: 79032

SEQ ID NO: 176717 - RNA, 64 nt, hsa; identical to SEQ ID NO: 79033

SEQ ID NO: 176718 - RNA, 64 nt, hsa; identical to SEQ ID NO: 79034

SEQ ID NO: 176719 - RNA, 64 nt, hsa; identical to SEQ ID NO: 79035

SEQ ID NO: 176720 - RNA, 64 nt, hsa; identical to SEQ ID NO: 79036

SEQ ID NO: 176721 - RNA, 64 nt, hsa; identical to SEQ ID NO: 79037

SEQ ID NO: 176722 - RNA, 64 nt, hsa; identical to SEQ ID NO: 79038

SEQ ID NO: 176723 - RNA, 64 nt, hsa; identical to SEQ ID NO: 79039

SEQ ID NO: 176724 - RNA, 64 nt, hsa; identical to SEQ ID NO: 79040

SEQ ID NO: 176725 - RNA, 64 nt, hsa; identical to SEQ ID NO: 79041

SEQ ID NO: 176726 - RNA, 64 nt, hsa; identical to SEQ ID NO: 79042

SEQ ID NO: 176727 - RNA, 64 nt, hsa; identical to SEQ ID NO: 79043

SEQ ID NO: 176728 - RNA, 64 nt, hsa; identical to SEQ ID NO: 79044

SEQ ID NO: 176729 - RNA, 64 nt, hsa; identical to SEQ ID NO: 79045

SEQ ID NO: 176730 - RNA, 64 nt, hsa; identical to SEQ ID NO: 79046

SEQ ID NO: 176731 - RNA, 64 nt, hsa; identical to SEQ ID NO: 79047

SEQ ID NO: 176732 - RNA, 64 nt, hsa; identical to SEQ ID NO: 79048

SEQ ID NO: 176733 - RNA, 64 nt, hsa; identical to SEQ ID NO: 79049

SEQ ID NO: 176734 - RNA, 64 nt, hsa; identical to SEQ ID NO: 79050

SEQ ID NO: 176735 - RNA, 64 nt, hsa; identical to SEQ ID NO: 172495

SEQ ID NO: 176736 - RNA, 64 nt, hsa; identical to SEQ ID NO: 172496

SEQ ID NO: 176737 - RNA, 64 nt, hsa; identical to SEQ ID NO: 78937

SEQ ID NO: 176738 - RNA, 64 nt, hsa; identical to SEQ ID NO: 78938

SEQ ID NO: 176739 - RNA, 64 nt, hsa; identical to SEQ ID NO: 78939

SEQ ID NO: 176740 - RNA, 64 nt, hsa; identical to SEQ ID NO: 78940

SEQ ID NO: 176741 - RNA, 64 nt, hsa; identical to SEQ ID NO: 78941

SEQ ID NO: 176742 - RNA, 64 nt, hsa; identical to SEQ ID NO: 78942

SEQ ID NO: 176743 - RNA, 64 nt, hsa; identical to SEQ ID NO: 78943

SEQ ID NO: 176744 - RNA, 64 nt, hsa; identical to SEQ ID NO: 78944

SEQ ID NO: 176745 - RNA, 64 nt, hsa; identical to SEQ ID NO: 78945

SEQ ID NO: 176746 - RNA, 64 nt, hsa; identical to SEQ ID NO: 78946

SEQ ID NO: 176747 - RNA, 64 nt, hsa; identical to SEQ ID NO: 78947

SEQ ID NO: 176748 - RNA, 64 nt, hsa; identical to SEQ ID NO: 78948

SEQ ID NO: 176749 - RNA, 64 nt, hsa; identical to SEQ ID NO: 78949

SEQ ID NO: 176750 - RNA, 64 nt, hsa; identical to SEQ ID NO: 78950

SEQ ID NO: 176751 - RNA, 64 nt, hsa; identical to SEQ ID NO: 78951

SEQ ID NO: 176752 - RNA, 64 nt, hsa; identical to SEQ ID NO: 78952

SEQ ID NO: 176753 - RNA, 64 nt, hsa; identical to SEQ ID NO: 78953

SEQ ID NO: 176754 - RNA, 64 nt, hsa; identical to SEQ ID NO: 78954

SEQ ID NO: 176755 - RNA, 64 nt, hsa; identical to SEQ ID NO: 78955

SEQ ID NO: 176756 - RNA, 64 nt, hsa; identical to SEQ ID NO: 78956

SEQ ID NO: 176757 - RNA, 64 nt, hsa; identical to SEQ ID NO: 78957

SEQ ID NO: 176758 - RNA, 64 nt, hsa; identical to SEQ ID NO: 78958

SEQ ID NO: 176759 - RNA, 64 nt, hsa; identical to SEQ ID NO: 78959

SEQ ID NO: 176760 - RNA, 64 nt, hsa; identical to SEQ ID NO: 78960

SEQ ID NO: 176761 - RNA, 64 nt, hsa; identical to SEQ ID NO: 78961

SEQ ID NO: 176762 - RNA, 64 nt, hsa; identical to SEQ ID NO: 78962

SEQ ID NO: 176763 - RNA, 64 nt, hsa; identical to SEQ ID NO: 78963

SEQ ID NO: 176764 - RNA, 64 nt, hsa; identical to SEQ ID NO: 78964

SEQ ID NO: 176765 - RNA, 64 nt, hsa; identical to SEQ ID NO: 78965

SEQ ID NO: 176766 - RNA, 64 nt, hsa; identical to SEQ ID NO: 78966

SEQ ID NO: 176767 - RNA, 64 nt, hsa; identical to SEQ ID NO: 78967

SEQ ID NO: 176768 - RNA, 64 nt, hsa; identical to SEQ ID NO: 78968

SEQ ID NO: 176769 - RNA, 64 nt, hsa; identical to SEQ ID NO: 78969

SEQ ID NO: 176770 - RNA, 64 nt, hsa; identical to SEQ ID NO: 78970

SEQ ID NO: 176771 - RNA, 64 nt, hsa; identical to SEQ ID NO: 78971

SEQ ID NO: 176772 - RNA, 64 nt, hsa; identical to SEQ ID NO: 78972

SEQ ID NO: 176773 - RNA, 64 nt, hsa; identical to SEQ ID NO: 78973

SEQ ID NO: 176774 - RNA, 64 nt, hsa; identical to SEQ ID NO: 78974

SEQ ID NO: 176775 - RNA, 64 nt, hsa; identical to SEQ ID NO: 78975

SEQ ID NO: 176776 - RNA, 64 nt, hsa; identical to SEQ ID NO: 78976

SEQ ID NO: 176777 - RNA, 64 nt, hsa; identical to SEQ ID NO: 78977

SEQ ID NO: 176778 - RNA, 64 nt, hsa; identical to SEQ ID NO: 78978

SEQ ID NO: 176779 - RNA, 64 nt, hsa; identical to SEQ ID NO: 78979

SEQ ID NO: 176780 - RNA, 64 nt, hsa; identical to SEQ ID NO: 78980

SEQ ID NO: 176781 - RNA, 64 nt, hsa; identical to SEQ ID NO: 78981

SEQ ID NO: 176782 - RNA, 64 nt, hsa; identical to SEQ ID NO: 78982

SEQ ID NO: 176783 - RNA, 64 nt, hsa; identical to SEQ ID NO: 78983

SEQ ID NO: 176784 - RNA, 64 nt, hsa; identical to SEQ ID NO: 78984

SEQ ID NO: 176785 - RNA, 64 nt, hsa; identical to SEQ ID NO: 78985

SEQ ID NO: 176786 - RNA, 64 nt, hsa; identical to SEQ ID NO: 78986

SEQ ID NO: 176787 - RNA, 64 nt, hsa; identical to SEQ ID NO: 78987

SEQ ID NO: 176788 - RNA, 64 nt, hsa; identical to SEQ ID NO: 78988

SEQ ID NO: 176789 - RNA, 64 nt, hsa; identical to SEQ ID NO: 78989

SEQ ID NO: 176790 - RNA, 64 nt, hsa; identical to SEQ ID NO: 78990

SEQ ID NO: 176791 - RNA, 64 nt, hsa; identical to SEQ ID NO: 78991

SEQ ID NO: 176792 - RNA, 64 nt, hsa; identical to SEQ ID NO: 78992

SEQ ID NO: 176793 - RNA, 64 nt, hsa; identical to SEQ ID NO: 78993

SEQ ID NO: 176794 - RNA, 64 nt, hsa; identical to SEQ ID NO: 78994

SEQ ID NO: 176795 - RNA, 64 nt, hsa; identical to SEQ ID NO: 78995

SEQ ID NO: 176796 - RNA, 64 nt, hsa; identical to SEQ ID NO: 78996

SEQ ID NO: 176797 - RNA, 64 nt, hsa; identical to SEQ ID NO: 78997

SEQ ID NO: 176798 - RNA, 64 nt, hsa; identical to SEQ ID NO: 78998

SEQ ID NO: 176799 - RNA, 64 nt, hsa; identical to SEQ ID NO: 78999

SEQ ID NO: 176800 - RNA, 64 nt, hsa; identical to SEQ ID NO: 79000

SEQ ID NO: 176801 - RNA, 64 nt, hsa; identical to SEQ ID NO: 79001

SEQ ID NO: 176802 - RNA, 64 nt, hsa; identical to SEQ ID NO: 79002

SEQ ID NO: 176803 - RNA, 64 nt, hsa; identical to SEQ ID NO: 79003

SEQ ID NO: 176804 - RNA, 64 nt, hsa; identical to SEQ ID NO: 79004

SEQ ID NO: 176805 - RNA, 64 nt, hsa; identical to SEQ ID NO: 79005

SEQ ID NO: 176806 - RNA, 64 nt, hsa; identical to SEQ ID NO: 79006

SEQ ID NO: 176807 - RNA, 64 nt, hsa; identical to SEQ ID NO: 79007

SEQ ID NO: 176808 - RNA, 64 nt, hsa; identical to SEQ ID NO: 79008

SEQ ID NO: 176809 - RNA, 64 nt, hsa; identical to SEQ ID NO: 79009

SEQ ID NO: 176810 - RNA, 64 nt, hsa; identical to SEQ ID NO: 79010

SEQ ID NO: 176811 - RNA, 64 nt, hsa; identical to SEQ ID NO: 79011

SEQ ID NO: 176812 - RNA, 64 nt, hsa; identical to SEQ ID NO: 79012

SEQ ID NO: 176813 - RNA, 64 nt, hsa; identical to SEQ ID NO: 79013

SEQ ID NO: 176814 - RNA, 64 nt, hsa; identical to SEQ ID NO: 79014

SEQ ID NO: 176815 - RNA, 64 nt, hsa; identical to SEQ ID NO: 79015

SEQ ID NO: 176816 - RNA, 64 nt, hsa; identical to SEQ ID NO: 79016

SEQ ID NO: 176817 - RNA, 64 nt, hsa; identical to SEQ ID NO: 79017

SEQ ID NO: 176818 - RNA, 64 nt, hsa; identical to SEQ ID NO: 79018

SEQ ID NO: 176819 - RNA, 64 nt, hsa; identical to SEQ ID NO: 79019

SEQ ID NO: 176820 - RNA, 64 nt, hsa; identical to SEQ ID NO: 79020

SEQ ID NO: 176821 - RNA, 64 nt, hsa; identical to SEQ ID NO: 79021

SEQ ID NO: 176822 - RNA, 64 nt, hsa; identical to SEQ ID NO: 79022

SEQ ID NO: 176823 - RNA, 64 nt, hsa; identical to SEQ ID NO: 79023

SEQ ID NO: 176824 - RNA, 64 nt, hsa; identical to SEQ ID NO: 79024

SEQ ID NO: 176825 - RNA, 64 nt, hsa; identical to SEQ ID NO: 79025

SEQ ID NO: 176826 - RNA, 64 nt, hsa; identical to SEQ ID NO: 79026

SEQ ID NO: 176827 - RNA, 64 nt, hsa; identical to SEQ ID NO: 79027

SEQ ID NO: 176828 - RNA, 64 nt, hsa; identical to SEQ ID NO: 79028

SEQ ID NO: 176829 - RNA, 64 nt, hsa; identical to SEQ ID NO: 79029

SEQ ID NO: 176830 - RNA, 64 nt, hsa; identical to SEQ ID NO: 79030

SEQ ID NO: 176831 - RNA, 64 nt, hsa; identical to SEQ ID NO: 79031

SEQ ID NO: 176832 - RNA, 64 nt, hsa; identical to SEQ ID NO: 79032

SEQ ID NO: 176833 - RNA, 64 nt, hsa; identical to SEQ ID NO: 79033

SEQ ID NO: 176834 - RNA, 64 nt, hsa; identical to SEQ ID NO: 79034

SEQ ID NO: 176835 - RNA, 64 nt, hsa; identical to SEQ ID NO: 79035

SEQ ID NO: 176836 - RNA, 64 nt, hsa; identical to SEQ ID NO: 79036

SEQ ID NO: 176837 - RNA, 64 nt, hsa; identical to SEQ ID NO: 79037

SEQ ID NO: 176838 - RNA, 64 nt, hsa; identical to SEQ ID NO: 79038

SEQ ID NO: 176839 - RNA, 64 nt, hsa; identical to SEQ ID NO: 79039

SEQ ID NO: 176840 - RNA, 64 nt, hsa; identical to SEQ ID NO: 79040

SEQ ID NO: 176841 - RNA, 64 nt, hsa; identical to SEQ ID NO: 79041

SEQ ID NO: 176842 - RNA, 64 nt, hsa; identical to SEQ ID NO: 79042

SEQ ID NO: 176843 - RNA, 64 nt, hsa; identical to SEQ ID NO: 79043

SEQ ID NO: 176844 - RNA, 64 nt, hsa; identical to SEQ ID NO: 79044

SEQ ID NO: 176845 - RNA, 64 nt, hsa; identical to SEQ ID NO: 79045

SEQ ID NO: 176846 - RNA, 64 nt, hsa; identical to SEQ ID NO: 79046

SEQ ID NO: 176847 - RNA, 64 nt, hsa; identical to SEQ ID NO: 79047

SEQ ID NO: 176848 - RNA, 64 nt, hsa; identical to SEQ ID NO: 79048

SEQ ID NO: 176849 - RNA, 64 nt, hsa; identical to SEQ ID NO: 79049

SEQ ID NO: 176850 - RNA, 64 nt, hsa; identical to SEQ ID NO: 79050

SEQ ID NO: 176851 - RNA, 64 nt, hsa; identical to SEQ ID NO: 172495

SEQ ID NO: 176852 - RNA, 64 nt, hsa; identical to SEQ ID NO: 172496

SEQ ID NO: 176853 - RNA, 64 nt, hsa; identical to SEQ ID NO: 78937

SEQ ID NO: 176854 - RNA, 64 nt, hsa; identical to SEQ ID NO: 78938

SEQ ID NO: 176855 - RNA, 64 nt, hsa; identical to SEQ ID NO: 78939

SEQ ID NO: 176856 - RNA, 64 nt, hsa; identical to SEQ ID NO: 78940

SEQ ID NO: 176857 - RNA, 64 nt, hsa; identical to SEQ ID NO: 78941

SEQ ID NO: 176858 - RNA, 64 nt, hsa; identical to SEQ ID NO: 78942

SEQ ID NO: 176859 - RNA, 64 nt, hsa; identical to SEQ ID NO: 78943

SEQ ID NO: 176860 - RNA, 64 nt, hsa; identical to SEQ ID NO: 78944

SEQ ID NO: 176861 - RNA, 64 nt, hsa; identical to SEQ ID NO: 78945

SEQ ID NO: 176862 - RNA, 64 nt, hsa; identical to SEQ ID NO: 78946

SEQ ID NO: 176863 - RNA, 64 nt, hsa; identical to SEQ ID NO: 78947

SEQ ID NO: 176864 - RNA, 64 nt, hsa; identical to SEQ ID NO: 78948

SEQ ID NO: 176865 - RNA, 64 nt, hsa; identical to SEQ ID NO: 78949

SEQ ID NO: 176866 - RNA, 64 nt, hsa; identical to SEQ ID NO: 78950

SEQ ID NO: 176867 - RNA, 64 nt, hsa; identical to SEQ ID NO: 78951

SEQ ID NO: 176868 - RNA, 64 nt, hsa; identical to SEQ ID NO: 78952

SEQ ID NO: 176869 - RNA, 64 nt, hsa; identical to SEQ ID NO: 78953

SEQ ID NO: 176870 - RNA, 64 nt, hsa; identical to SEQ ID NO: 78954

SEQ ID NO: 176871 - RNA, 64 nt, hsa; identical to SEQ ID NO: 78955

SEQ ID NO: 176872 - RNA, 64 nt, hsa; identical to SEQ ID NO: 78956

SEQ ID NO: 176873 - RNA, 64 nt, hsa; identical to SEQ ID NO: 78957

SEQ ID NO: 176874 - RNA, 64 nt, hsa; identical to SEQ ID NO: 78958

SEQ ID NO: 176875 - RNA, 64 nt, hsa; identical to SEQ ID NO: 78959

SEQ ID NO: 176876 - RNA, 64 nt, hsa; identical to SEQ ID NO: 78960

SEQ ID NO: 176877 - RNA, 64 nt, hsa; identical to SEQ ID NO: 78961

SEQ ID NO: 176878 - RNA, 64 nt, hsa; identical to SEQ ID NO: 78962

SEQ ID NO: 176879 - RNA, 64 nt, hsa; identical to SEQ ID NO: 78963

SEQ ID NO: 176880 - RNA, 64 nt, hsa; identical to SEQ ID NO: 78964

SEQ ID NO: 176881 - RNA, 64 nt, hsa; identical to SEQ ID NO: 78965

SEQ ID NO: 176882 - RNA, 64 nt, hsa; identical to SEQ ID NO: 78966

SEQ ID NO: 176883 - RNA, 64 nt, hsa; identical to SEQ ID NO: 78967

SEQ ID NO: 176884 - RNA, 64 nt, hsa; identical to SEQ ID NO: 78968

SEQ ID NO: 176885 - RNA, 64 nt, hsa; identical to SEQ ID NO: 78969

SEQ ID NO: 176886 - RNA, 64 nt, hsa; identical to SEQ ID NO: 78970

SEQ ID NO: 176887 - RNA, 64 nt, hsa; identical to SEQ ID NO: 78971

SEQ ID NO: 176888 - RNA, 64 nt, hsa; identical to SEQ ID NO: 78972

SEQ ID NO: 176889 - RNA, 64 nt, hsa; identical to SEQ ID NO: 78973

SEQ ID NO: 176890 - RNA, 64 nt, hsa; identical to SEQ ID NO: 78974

SEQ ID NO: 176891 - RNA, 64 nt, hsa; identical to SEQ ID NO: 78975

SEQ ID NO: 176892 - RNA, 64 nt, hsa; identical to SEQ ID NO: 78976

SEQ ID NO: 176893 - RNA, 64 nt, hsa; identical to SEQ ID NO: 78977

SEQ ID NO: 176894 - RNA, 64 nt, hsa; identical to SEQ ID NO: 78978

SEQ ID NO: 176895 - RNA, 64 nt, hsa; identical to SEQ ID NO: 78979

SEQ ID NO: 176896 - RNA, 64 nt, hsa; identical to SEQ ID NO: 78980

SEQ ID NO: 176897 - RNA, 64 nt, hsa; identical to SEQ ID NO: 78981

SEQ ID NO: 176898 - RNA, 64 nt, hsa; identical to SEQ ID NO: 78982

SEQ ID NO: 176899 - RNA, 64 nt, hsa; identical to SEQ ID NO: 78983

SEQ ID NO: 176900 - RNA, 64 nt, hsa; identical to SEQ ID NO: 78984

SEQ ID NO: 176901 - RNA, 64 nt, hsa; identical to SEQ ID NO: 78985

SEQ ID NO: 176902 - RNA, 64 nt, hsa; identical to SEQ ID NO: 78986

SEQ ID NO: 176903 - RNA, 64 nt, hsa; identical to SEQ ID NO: 78987

SEQ ID NO: 176904 - RNA, 64 nt, hsa; identical to SEQ ID NO: 78988

SEQ ID NO: 176905 - RNA, 64 nt, hsa; identical to SEQ ID NO: 78989

SEQ ID NO: 176906 - RNA, 64 nt, hsa; identical to SEQ ID NO: 78990

SEQ ID NO: 176907 - RNA, 64 nt, hsa; identical to SEQ ID NO: 78991

SEQ ID NO: 176908 - RNA, 64 nt, hsa; identical to SEQ ID NO: 78992

SEQ ID NO: 176909 - RNA, 64 nt, hsa; identical to SEQ ID NO: 78993

SEQ ID NO: 176910 - RNA, 64 nt, hsa; identical to SEQ ID NO: 78994

SEQ ID NO: 176911 - RNA, 64 nt, hsa; identical to SEQ ID NO: 78995

SEQ ID NO: 176912 - RNA, 64 nt, hsa; identical to SEQ ID NO: 78996

SEQ ID NO: 176913 - RNA, 64 nt, hsa; identical to SEQ ID NO: 78997

SEQ ID NO: 176914 - RNA, 64 nt, hsa; identical to SEQ ID NO: 78998

SEQ ID NO: 176915 - RNA, 64 nt, hsa; identical to SEQ ID NO: 78999

SEQ ID NO: 176916 - RNA, 64 nt, hsa; identical to SEQ ID NO: 79000

SEQ ID NO: 176917 - RNA, 64 nt, hsa; identical to SEQ ID NO: 79001

SEQ ID NO: 176918 - RNA, 64 nt, hsa; identical to SEQ ID NO: 79002

SEQ ID NO: 176919 - RNA, 64 nt, hsa; identical to SEQ ID NO: 79003

SEQ ID NO: 176920 - RNA, 64 nt, hsa; identical to SEQ ID NO: 79004

SEQ ID NO: 176921 - RNA, 64 nt, hsa; identical to SEQ ID NO: 79005

SEQ ID NO: 176922 - RNA, 64 nt, hsa; identical to SEQ ID NO: 79006

SEQ ID NO: 176923 - RNA, 64 nt, hsa; identical to SEQ ID NO: 79007

SEQ ID NO: 176924 - RNA, 64 nt, hsa; identical to SEQ ID NO: 79008

SEQ ID NO: 176925 - RNA, 64 nt, hsa; identical to SEQ ID NO: 79009

SEQ ID NO: 176926 - RNA, 64 nt, hsa; identical to SEQ ID NO: 79010

SEQ ID NO: 176927 - RNA, 64 nt, hsa; identical to SEQ ID NO: 79011

SEQ ID NO: 176928 - RNA, 64 nt, hsa; identical to SEQ ID NO: 79012

SEQ ID NO: 176929 - RNA, 64 nt, hsa; identical to SEQ ID NO: 79013

SEQ ID NO: 176930 - RNA, 64 nt, hsa; identical to SEQ ID NO: 79014

SEQ ID NO: 176931 - RNA, 64 nt, hsa; identical to SEQ ID NO: 79015

SEQ ID NO: 176932 - RNA, 64 nt, hsa; identical to SEQ ID NO: 79016

SEQ ID NO: 176933 - RNA, 64 nt, hsa; identical to SEQ ID NO: 79017

SEQ ID NO: 176934 - RNA, 64 nt, hsa; identical to SEQ ID NO: 79018

SEQ ID NO: 176935 - RNA, 64 nt, hsa; identical to SEQ ID NO: 79019

SEQ ID NO: 176936 - RNA, 64 nt, hsa; identical to SEQ ID NO: 79020

SEQ ID NO: 176937 - RNA, 64 nt, hsa; identical to SEQ ID NO: 79021

SEQ ID NO: 176938 - RNA, 64 nt, hsa; identical to SEQ ID NO: 79022

SEQ ID NO: 176939 - RNA, 64 nt, hsa; identical to SEQ ID NO: 79023

SEQ ID NO: 176940 - RNA, 64 nt, hsa; identical to SEQ ID NO: 79024

SEQ ID NO: 176941 - RNA, 64 nt, hsa; identical to SEQ ID NO: 79025

SEQ ID NO: 176942 - RNA, 64 nt, hsa; identical to SEQ ID NO: 79026

SEQ ID NO: 176943 - RNA, 64 nt, hsa; identical to SEQ ID NO: 79027

SEQ ID NO: 176944 - RNA, 64 nt, hsa; identical to SEQ ID NO: 79028

SEQ ID NO: 176945 - RNA, 64 nt, hsa; identical to SEQ ID NO: 79029

SEQ ID NO: 176946 - RNA, 64 nt, hsa; identical to SEQ ID NO: 79030

SEQ ID NO: 176947 - RNA, 64 nt, hsa; identical to SEQ ID NO: 79031

SEQ ID NO: 176948 - RNA, 64 nt, hsa; identical to SEQ ID NO: 79032

SEQ ID NO: 176949 - RNA, 64 nt, hsa; identical to SEQ ID NO: 79033

SEQ ID NO: 176950 - RNA, 64 nt, hsa; identical to SEQ ID NO: 79034

SEQ ID NO: 176951 - RNA, 64 nt, hsa; identical to SEQ ID NO: 79035

SEQ ID NO: 176952 - RNA, 64 nt, hsa; identical to SEQ ID NO: 79036

SEQ ID NO: 176953 - RNA, 64 nt, hsa; identical to SEQ ID NO: 79037

SEQ ID NO: 176954 - RNA, 64 nt, hsa; identical to SEQ ID NO: 79038

SEQ ID NO: 176955 - RNA, 64 nt, hsa; identical to SEQ ID NO: 79039

SEQ ID NO: 176956 - RNA, 64 nt, hsa; identical to SEQ ID NO: 79040

SEQ ID NO: 176957 - RNA, 64 nt, hsa; identical to SEQ ID NO: 79041

SEQ ID NO: 176958 - RNA, 64 nt, hsa; identical to SEQ ID NO: 79042

SEQ ID NO: 176959 - RNA, 64 nt, hsa; identical to SEQ ID NO: 79043

SEQ ID NO: 176960 - RNA, 64 nt, hsa; identical to SEQ ID NO: 79044

SEQ ID NO: 176961 - RNA, 64 nt, hsa; identical to SEQ ID NO: 79045

SEQ ID NO: 176962 - RNA, 64 nt, hsa; identical to SEQ ID NO: 79046

SEQ ID NO: 176963 - RNA, 64 nt, hsa; identical to SEQ ID NO: 79047

SEQ ID NO: 176964 - RNA, 64 nt, hsa; identical to SEQ ID NO: 79048

SEQ ID NO: 176965 - RNA, 64 nt, hsa; identical to SEQ ID NO: 79049

SEQ ID NO: 176966 - RNA, 64 nt, hsa; identical to SEQ ID NO: 79050

SEQ ID NO: 176967 - RNA, 64 nt, hsa; identical to SEQ ID NO: 172495

SEQ ID NO: 176968 - RNA, 64 nt, hsa; identical to SEQ ID NO: 172496

SEQ ID NO: 176969 - RNA, 64 nt, hsa; identical to SEQ ID NO: 78937

SEQ ID NO: 176970 - RNA, 64 nt, hsa; identical to SEQ ID NO: 78938

SEQ ID NO: 176971 - RNA, 64 nt, hsa; identical to SEQ ID NO: 78939

SEQ ID NO: 176972 - RNA, 64 nt, hsa; identical to SEQ ID NO: 78940

SEQ ID NO: 176973 - RNA, 64 nt, hsa; identical to SEQ ID NO: 78941

SEQ ID NO: 176974 - RNA, 64 nt, hsa; identical to SEQ ID NO: 78942

SEQ ID NO: 176975 - RNA, 64 nt, hsa; identical to SEQ ID NO: 78943

SEQ ID NO: 176976 - RNA, 64 nt, hsa; identical to SEQ ID NO: 78944

SEQ ID NO: 176977 - RNA, 64 nt, hsa; identical to SEQ ID NO: 78945

SEQ ID NO: 176978 - RNA, 64 nt, hsa; identical to SEQ ID NO: 78946

SEQ ID NO: 176979 - RNA, 64 nt, hsa; identical to SEQ ID NO: 78947

SEQ ID NO: 176980 - RNA, 64 nt, hsa; identical to SEQ ID NO: 78948

SEQ ID NO: 176981 - RNA, 64 nt, hsa; identical to SEQ ID NO: 78949

SEQ ID NO: 176982 - RNA, 64 nt, hsa; identical to SEQ ID NO: 78950

SEQ ID NO: 176983 - RNA, 64 nt, hsa; identical to SEQ ID NO: 78951

SEQ ID NO: 176984 - RNA, 64 nt, hsa; identical to SEQ ID NO: 78952

SEQ ID NO: 176985 - RNA, 64 nt, hsa; identical to SEQ ID NO: 78953

SEQ ID NO: 176986 - RNA, 64 nt, hsa; identical to SEQ ID NO: 78954

SEQ ID NO: 176987 - RNA, 64 nt, hsa; identical to SEQ ID NO: 78955

SEQ ID NO: 176988 - RNA, 64 nt, hsa; identical to SEQ ID NO: 78956

SEQ ID NO: 176989 - RNA, 64 nt, hsa; identical to SEQ ID NO: 78957

SEQ ID NO: 176990 - RNA, 64 nt, hsa; identical to SEQ ID NO: 78958

SEQ ID NO: 176991 - RNA, 64 nt, hsa; identical to SEQ ID NO: 78959

SEQ ID NO: 176992 - RNA, 64 nt, hsa; identical to SEQ ID NO: 78960

SEQ ID NO: 176993 - RNA, 64 nt, hsa; identical to SEQ ID NO: 78961

SEQ ID NO: 176994 - RNA, 64 nt, hsa; identical to SEQ ID NO: 78962

SEQ ID NO: 176995 - RNA, 64 nt, hsa; identical to SEQ ID NO: 78963

SEQ ID NO: 176996 - RNA, 64 nt, hsa; identical to SEQ ID NO: 78964

SEQ ID NO: 176997 - RNA, 64 nt, hsa; identical to SEQ ID NO: 78965

SEQ ID NO: 176998 - RNA, 64 nt, hsa; identical to SEQ ID NO: 78966

SEQ ID NO: 176999 - RNA, 64 nt, hsa; identical to SEQ ID NO: 78967

SEQ ID NO: 177000 - RNA, 64 nt, hsa; identical to SEQ ID NO: 78968

SEQ ID NO: 177001 - RNA, 64 nt, hsa; identical to SEQ ID NO: 78969

SEQ ID NO: 177002 - RNA, 64 nt, hsa; identical to SEQ ID NO: 78970

SEQ ID NO: 177003 - RNA, 64 nt, hsa; identical to SEQ ID NO: 78971

SEQ ID NO: 177004 - RNA, 64 nt, hsa; identical to SEQ ID NO: 78972

SEQ ID NO: 177005 - RNA, 64 nt, hsa; identical to SEQ ID NO: 78973

SEQ ID NO: 177006 - RNA, 64 nt, hsa; identical to SEQ ID NO: 78974

SEQ ID NO: 177007 - RNA, 64 nt, hsa; identical to SEQ ID NO: 78975

SEQ ID NO: 177008 - RNA, 64 nt, hsa; identical to SEQ ID NO: 78976

SEQ ID NO: 177009 - RNA, 64 nt, hsa; identical to SEQ ID NO: 78977

SEQ ID NO: 177010 - RNA, 64 nt, hsa; identical to SEQ ID NO: 78978

SEQ ID NO: 177011 - RNA, 64 nt, hsa; identical to SEQ ID NO: 78979

SEQ ID NO: 177012 - RNA, 64 nt, hsa; identical to SEQ ID NO: 78980

SEQ ID NO: 177013 - RNA, 64 nt, hsa; identical to SEQ ID NO: 78981

SEQ ID NO: 177014 - RNA, 64 nt, hsa; identical to SEQ ID NO: 78982

SEQ ID NO: 177015 - RNA, 64 nt, hsa; identical to SEQ ID NO: 78983

SEQ ID NO: 177016 - RNA, 64 nt, hsa; identical to SEQ ID NO: 78984

SEQ ID NO: 177017 - RNA, 64 nt, hsa; identical to SEQ ID NO: 78985

SEQ ID NO: 177018 - RNA, 64 nt, hsa; identical to SEQ ID NO: 78986

SEQ ID NO: 177019 - RNA, 64 nt, hsa; identical to SEQ ID NO: 78987

SEQ ID NO: 177020 - RNA, 64 nt, hsa; identical to SEQ ID NO: 78988

SEQ ID NO: 177021 - RNA, 64 nt, hsa; identical to SEQ ID NO: 78989

SEQ ID NO: 177022 - RNA, 64 nt, hsa; identical to SEQ ID NO: 78990

SEQ ID NO: 177023 - RNA, 64 nt, hsa; identical to SEQ ID NO: 78991

SEQ ID NO: 177024 - RNA, 64 nt, hsa; identical to SEQ ID NO: 78992

SEQ ID NO: 177025 - RNA, 64 nt, hsa; identical to SEQ ID NO: 78993

SEQ ID NO: 177026 - RNA, 64 nt, hsa; identical to SEQ ID NO: 78994

SEQ ID NO: 177027 - RNA, 64 nt, hsa; identical to SEQ ID NO: 78995

SEQ ID NO: 177028 - RNA, 64 nt, hsa; identical to SEQ ID NO: 78996

SEQ ID NO: 177029 - RNA, 64 nt, hsa; identical to SEQ ID NO: 78997

SEQ ID NO: 177030 - RNA, 64 nt, hsa; identical to SEQ ID NO: 78998

SEQ ID NO: 177031 - RNA, 64 nt, hsa; identical to SEQ ID NO: 78999

SEQ ID NO: 177032 - RNA, 64 nt, hsa; identical to SEQ ID NO: 79000

SEQ ID NO: 177033 - RNA, 64 nt, hsa; identical to SEQ ID NO: 79001

SEQ ID NO: 177034 - RNA, 64 nt, hsa; identical to SEQ ID NO: 79002

SEQ ID NO: 177035 - RNA, 64 nt, hsa; identical to SEQ ID NO: 79003

SEQ ID NO: 177036 - RNA, 64 nt, hsa; identical to SEQ ID NO: 79004

SEQ ID NO: 177037 - RNA, 64 nt, hsa; identical to SEQ ID NO: 79005

SEQ ID NO: 177038 - RNA, 64 nt, hsa; identical to SEQ ID NO: 79006

SEQ ID NO: 177039 - RNA, 64 nt, hsa; identical to SEQ ID NO: 79007

SEQ ID NO: 177040 - RNA, 64 nt, hsa; identical to SEQ ID NO: 79008

SEQ ID NO: 177041 - RNA, 64 nt, hsa; identical to SEQ ID NO: 79009

SEQ ID NO: 177042 - RNA, 64 nt, hsa; identical to SEQ ID NO: 79010

SEQ ID NO: 177043 - RNA, 64 nt, hsa; identical to SEQ ID NO: 79011

SEQ ID NO: 177044 - RNA, 64 nt, hsa; identical to SEQ ID NO: 79012

SEQ ID NO: 177045 - RNA, 64 nt, hsa; identical to SEQ ID NO: 79013

SEQ ID NO: 177046 - RNA, 64 nt, hsa; identical to SEQ ID NO: 79014

SEQ ID NO: 177047 - RNA, 64 nt, hsa; identical to SEQ ID NO: 79015

SEQ ID NO: 177048 - RNA, 64 nt, hsa; identical to SEQ ID NO: 79016

SEQ ID NO: 177049 - RNA, 64 nt, hsa; identical to SEQ ID NO: 79017

SEQ ID NO: 177050 - RNA, 64 nt, hsa; identical to SEQ ID NO: 79018

SEQ ID NO: 177051 - RNA, 64 nt, hsa; identical to SEQ ID NO: 79019

SEQ ID NO: 177052 - RNA, 64 nt, hsa; identical to SEQ ID NO: 79020

SEQ ID NO: 177053 - RNA, 64 nt, hsa; identical to SEQ ID NO: 79021

SEQ ID NO: 177054 - RNA, 64 nt, hsa; identical to SEQ ID NO: 79022

SEQ ID NO: 177055 - RNA, 64 nt, hsa; identical to SEQ ID NO: 79023

SEQ ID NO: 177056 - RNA, 64 nt, hsa; identical to SEQ ID NO: 79024

SEQ ID NO: 177057 - RNA, 64 nt, hsa; identical to SEQ ID NO: 79025

SEQ ID NO: 177058 - RNA, 64 nt, hsa; identical to SEQ ID NO: 79026

SEQ ID NO: 177059 - RNA, 64 nt, hsa; identical to SEQ ID NO: 79027

SEQ ID NO: 177060 - RNA, 64 nt, hsa; identical to SEQ ID NO: 79028

SEQ ID NO: 177061 - RNA, 64 nt, hsa; identical to SEQ ID NO: 79029

SEQ ID NO: 177062 - RNA, 64 nt, hsa; identical to SEQ ID NO: 79030

SEQ ID NO: 177063 - RNA, 64 nt, hsa; identical to SEQ ID NO: 79031

SEQ ID NO: 177064 - RNA, 64 nt, hsa; identical to SEQ ID NO: 79032

SEQ ID NO: 177065 - RNA, 64 nt, hsa; identical to SEQ ID NO: 79033

SEQ ID NO: 177066 - RNA, 64 nt, hsa; identical to SEQ ID NO: 79034

SEQ ID NO: 177067 - RNA, 64 nt, hsa; identical to SEQ ID NO: 79035

SEQ ID NO: 177068 - RNA, 64 nt, hsa; identical to SEQ ID NO: 79036

SEQ ID NO: 177069 - RNA, 64 nt, hsa; identical to SEQ ID NO: 79037

SEQ ID NO: 177070 - RNA, 64 nt, hsa; identical to SEQ ID NO: 79038

SEQ ID NO: 177071 - RNA, 64 nt, hsa; identical to SEQ ID NO: 79039

SEQ ID NO: 177072 - RNA, 64 nt, hsa; identical to SEQ ID NO: 79040

SEQ ID NO: 177073 - RNA, 64 nt, hsa; identical to SEQ ID NO: 79041

SEQ ID NO: 177074 - RNA, 64 nt, hsa; identical to SEQ ID NO: 79042

SEQ ID NO: 177075 - RNA, 64 nt, hsa; identical to SEQ ID NO: 79043

SEQ ID NO: 177076 - RNA, 64 nt, hsa; identical to SEQ ID NO: 79044

SEQ ID NO: 177077 - RNA, 64 nt, hsa; identical to SEQ ID NO: 79045

SEQ ID NO: 177078 - RNA, 64 nt, hsa; identical to SEQ ID NO: 79046

SEQ ID NO: 177079 - RNA, 64 nt, hsa; identical to SEQ ID NO: 79047

SEQ ID NO: 177080 - RNA, 64 nt, hsa; identical to SEQ ID NO: 79048

SEQ ID NO: 177081 - RNA, 64 nt, hsa; identical to SEQ ID NO: 79049

SEQ ID NO: 177082 - RNA, 64 nt, hsa; identical to SEQ ID NO: 79050

SEQ ID NO: 177083 - RNA, 64 nt, hsa; identical to SEQ ID NO: 172495

SEQ ID NO: 177084 - RNA, 64 nt, hsa; identical to SEQ ID NO: 172496

SEQ ID NO: 177085 - RNA, 64 nt, hsa; identical to SEQ ID NO: 78937

SEQ ID NO: 177086 - RNA, 64 nt, hsa; identical to SEQ ID NO: 78938

SEQ ID NO: 177087 - RNA, 64 nt, hsa; identical to SEQ ID NO: 78939

SEQ ID NO: 177088 - RNA, 64 nt, hsa; identical to SEQ ID NO: 78940

SEQ ID NO: 177089 - RNA, 64 nt, hsa; identical to SEQ ID NO: 78941

SEQ ID NO: 177090 - RNA, 64 nt, hsa; identical to SEQ ID NO: 78942

SEQ ID NO: 177091 - RNA, 64 nt, hsa; identical to SEQ ID NO: 78943

SEQ ID NO: 177092 - RNA, 64 nt, hsa; identical to SEQ ID NO: 78944

SEQ ID NO: 177093 - RNA, 64 nt, hsa; identical to SEQ ID NO: 78945

SEQ ID NO: 177094 - RNA, 64 nt, hsa; identical to SEQ ID NO: 78946

SEQ ID NO: 177095 - RNA, 64 nt, hsa; identical to SEQ ID NO: 78947

SEQ ID NO: 177096 - RNA, 64 nt, hsa; identical to SEQ ID NO: 78948

SEQ ID NO: 177097 - RNA, 64 nt, hsa; identical to SEQ ID NO: 78949

SEQ ID NO: 177098 - RNA, 64 nt, hsa; identical to SEQ ID NO: 78950

SEQ ID NO: 177099 - RNA, 64 nt, hsa; identical to SEQ ID NO: 78951

SEQ ID NO: 177100 - RNA, 64 nt, hsa; identical to SEQ ID NO: 78952

SEQ ID NO: 177101 - RNA, 64 nt, hsa; identical to SEQ ID NO: 78953

SEQ ID NO: 177102 - RNA, 64 nt, hsa; identical to SEQ ID NO: 78954

SEQ ID NO: 177103 - RNA, 64 nt, hsa; identical to SEQ ID NO: 78955

SEQ ID NO: 177104 - RNA, 64 nt, hsa; identical to SEQ ID NO: 78956

SEQ ID NO: 177105 - RNA, 64 nt, hsa; identical to SEQ ID NO: 78957

SEQ ID NO: 177106 - RNA, 64 nt, hsa; identical to SEQ ID NO: 78958

SEQ ID NO: 177107 - RNA, 64 nt, hsa; identical to SEQ ID NO: 78959

SEQ ID NO: 177108 - RNA, 64 nt, hsa; identical to SEQ ID NO: 78960

SEQ ID NO: 177109 - RNA, 64 nt, hsa; identical to SEQ ID NO: 78961

SEQ ID NO: 177110 - RNA, 64 nt, hsa; identical to SEQ ID NO: 78962

SEQ ID NO: 177111 - RNA, 64 nt, hsa; identical to SEQ ID NO: 78963

SEQ ID NO: 177112 - RNA, 64 nt, hsa; identical to SEQ ID NO: 78964

SEQ ID NO: 177113 - RNA, 64 nt, hsa; identical to SEQ ID NO: 78965

SEQ ID NO: 177114 - RNA, 64 nt, hsa; identical to SEQ ID NO: 78966

SEQ ID NO: 177115 - RNA, 64 nt, hsa; identical to SEQ ID NO: 78967

SEQ ID NO: 177116 - RNA, 64 nt, hsa; identical to SEQ ID NO: 78968

SEQ ID NO: 177117 - RNA, 64 nt, hsa; identical to SEQ ID NO: 78969

SEQ ID NO: 177118 - RNA, 64 nt, hsa; identical to SEQ ID NO: 78970

SEQ ID NO: 177119 - RNA, 64 nt, hsa; identical to SEQ ID NO: 78971

SEQ ID NO: 177120 - RNA, 64 nt, hsa; identical to SEQ ID NO: 78972

SEQ ID NO: 177121 - RNA, 64 nt, hsa; identical to SEQ ID NO: 78973

SEQ ID NO: 177122 - RNA, 64 nt, hsa; identical to SEQ ID NO: 78974

SEQ ID NO: 177123 - RNA, 64 nt, hsa; identical to SEQ ID NO: 78975

SEQ ID NO: 177124 - RNA, 64 nt, hsa; identical to SEQ ID NO: 78976

SEQ ID NO: 177125 - RNA, 64 nt, hsa; identical to SEQ ID NO: 78977

SEQ ID NO: 177126 - RNA, 64 nt, hsa; identical to SEQ ID NO: 78978

SEQ ID NO: 177127 - RNA, 64 nt, hsa; identical to SEQ ID NO: 78979

SEQ ID NO: 177128 - RNA, 64 nt, hsa; identical to SEQ ID NO: 78980

SEQ ID NO: 177129 - RNA, 64 nt, hsa; identical to SEQ ID NO: 78981

SEQ ID NO: 177130 - RNA, 64 nt, hsa; identical to SEQ ID NO: 78982

SEQ ID NO: 177131 - RNA, 64 nt, hsa; identical to SEQ ID NO: 78983

SEQ ID NO: 177132 - RNA, 64 nt, hsa; identical to SEQ ID NO: 78984

SEQ ID NO: 177133 - RNA, 64 nt, hsa; identical to SEQ ID NO: 78985

SEQ ID NO: 177134 - RNA, 64 nt, hsa; identical to SEQ ID NO: 78986

SEQ ID NO: 177135 - RNA, 64 nt, hsa; identical to SEQ ID NO: 78987

SEQ ID NO: 177136 - RNA, 64 nt, hsa; identical to SEQ ID NO: 78988

SEQ ID NO: 177137 - RNA, 64 nt, hsa; identical to SEQ ID NO: 78989

SEQ ID NO: 177138 - RNA, 64 nt, hsa; identical to SEQ ID NO: 78990

SEQ ID NO: 177139 - RNA, 64 nt, hsa; identical to SEQ ID NO: 78991

SEQ ID NO: 177140 - RNA, 64 nt, hsa; identical to SEQ ID NO: 78992

SEQ ID NO: 177141 - RNA, 64 nt, hsa; identical to SEQ ID NO: 78993

SEQ ID NO: 177142 - RNA, 64 nt, hsa; identical to SEQ ID NO: 78994

SEQ ID NO: 177143 - RNA, 64 nt, hsa; identical to SEQ ID NO: 78995

SEQ ID NO: 177144 - RNA, 64 nt, hsa; identical to SEQ ID NO: 78996

SEQ ID NO: 177145 - RNA, 64 nt, hsa; identical to SEQ ID NO: 78997

SEQ ID NO: 177146 - RNA, 64 nt, hsa; identical to SEQ ID NO: 78998

SEQ ID NO: 177147 - RNA, 64 nt, hsa; identical to SEQ ID NO: 78999

SEQ ID NO: 177148 - RNA, 64 nt, hsa; identical to SEQ ID NO: 79000

SEQ ID NO: 177149 - RNA, 64 nt, hsa; identical to SEQ ID NO: 79001

SEQ ID NO: 177150 - RNA, 64 nt, hsa; identical to SEQ ID NO: 79002

SEQ ID NO: 177151 - RNA, 64 nt, hsa; identical to SEQ ID NO: 79003

SEQ ID NO: 177152 - RNA, 64 nt, hsa; identical to SEQ ID NO: 79004

SEQ ID NO: 177153 - RNA, 64 nt, hsa; identical to SEQ ID NO: 79005

SEQ ID NO: 177154 - RNA, 64 nt, hsa; identical to SEQ ID NO: 79006

SEQ ID NO: 177155 - RNA, 64 nt, hsa; identical to SEQ ID NO: 79007

SEQ ID NO: 177156 - RNA, 64 nt, hsa; identical to SEQ ID NO: 79008

SEQ ID NO: 177157 - RNA, 64 nt, hsa; identical to SEQ ID NO: 79009

SEQ ID NO: 177158 - RNA, 64 nt, hsa; identical to SEQ ID NO: 79010

SEQ ID NO: 177159 - RNA, 64 nt, hsa; identical to SEQ ID NO: 79011

SEQ ID NO: 177160 - RNA, 64 nt, hsa; identical to SEQ ID NO: 79012

SEQ ID NO: 177161 - RNA, 64 nt, hsa; identical to SEQ ID NO: 79013

SEQ ID NO: 177162 - RNA, 64 nt, hsa; identical to SEQ ID NO: 79014

SEQ ID NO: 177163 - RNA, 64 nt, hsa; identical to SEQ ID NO: 79015

SEQ ID NO: 177164 - RNA, 64 nt, hsa; identical to SEQ ID NO: 79016

SEQ ID NO: 177165 - RNA, 64 nt, hsa; identical to SEQ ID NO: 79017

SEQ ID NO: 177166 - RNA, 64 nt, hsa; identical to SEQ ID NO: 79018

SEQ ID NO: 177167 - RNA, 64 nt, hsa; identical to SEQ ID NO: 79019

SEQ ID NO: 177168 - RNA, 64 nt, hsa; identical to SEQ ID NO: 79020

SEQ ID NO: 177169 - RNA, 64 nt, hsa; identical to SEQ ID NO: 79021

SEQ ID NO: 177170 - RNA, 64 nt, hsa; identical to SEQ ID NO: 79022

SEQ ID NO: 177171 - RNA, 64 nt, hsa; identical to SEQ ID NO: 79023

SEQ ID NO: 177172 - RNA, 64 nt, hsa; identical to SEQ ID NO: 79024

SEQ ID NO: 177173 - RNA, 64 nt, hsa; identical to SEQ ID NO: 79025

SEQ ID NO: 177174 - RNA, 64 nt, hsa; identical to SEQ ID NO: 79026

SEQ ID NO: 177175 - RNA, 64 nt, hsa; identical to SEQ ID NO: 79027

SEQ ID NO: 177176 - RNA, 64 nt, hsa; identical to SEQ ID NO: 79028

SEQ ID NO: 177177 - RNA, 64 nt, hsa; identical to SEQ ID NO: 79029

SEQ ID NO: 177178 - RNA, 64 nt, hsa; identical to SEQ ID NO: 79030

SEQ ID NO: 177179 - RNA, 64 nt, hsa; identical to SEQ ID NO: 79031

SEQ ID NO: 177180 - RNA, 64 nt, hsa; identical to SEQ ID NO: 79032

SEQ ID NO: 177181 - RNA, 64 nt, hsa; identical to SEQ ID NO: 79033

SEQ ID NO: 177182 - RNA, 64 nt, hsa; identical to SEQ ID NO: 79034

SEQ ID NO: 177183 - RNA, 64 nt, hsa; identical to SEQ ID NO: 79035

SEQ ID NO: 177184 - RNA, 64 nt, hsa; identical to SEQ ID NO: 79036

SEQ ID NO: 177185 - RNA, 64 nt, hsa; identical to SEQ ID NO: 79037

SEQ ID NO: 177186 - RNA, 64 nt, hsa; identical to SEQ ID NO: 79038

SEQ ID NO: 177187 - RNA, 64 nt, hsa; identical to SEQ ID NO: 79039

SEQ ID NO: 177188 - RNA, 64 nt, hsa; identical to SEQ ID NO: 79040

SEQ ID NO: 177189 - RNA, 64 nt, hsa; identical to SEQ ID NO: 79041

SEQ ID NO: 177190 - RNA, 64 nt, hsa; identical to SEQ ID NO: 79042

SEQ ID NO: 177191 - RNA, 64 nt, hsa; identical to SEQ ID NO: 79043

SEQ ID NO: 177192 - RNA, 64 nt, hsa; identical to SEQ ID NO: 79044

SEQ ID NO: 177193 - RNA, 64 nt, hsa; identical to SEQ ID NO: 79045

SEQ ID NO: 177194 - RNA, 64 nt, hsa; identical to SEQ ID NO: 79046

SEQ ID NO: 177195 - RNA, 64 nt, hsa; identical to SEQ ID NO: 79047

SEQ ID NO: 177196 - RNA, 64 nt, hsa; identical to SEQ ID NO: 79048

SEQ ID NO: 177197 - RNA, 64 nt, hsa; identical to SEQ ID NO: 79049

SEQ ID NO: 177198 - RNA, 64 nt, hsa; identical to SEQ ID NO: 79050

SEQ ID NO: 177199 - RNA, 64 nt, hsa; identical to SEQ ID NO: 172495

SEQ ID NO: 177200 - RNA, 64 nt, hsa; identical to SEQ ID NO: 172496

SEQ ID NO: 177201 - RNA, 64 nt, hsa; identical to SEQ ID NO: 78937

SEQ ID NO: 177202 - RNA, 64 nt, hsa; identical to SEQ ID NO: 78938

SEQ ID NO: 177203 - RNA, 64 nt, hsa; identical to SEQ ID NO: 78939

SEQ ID NO: 177204 - RNA, 64 nt, hsa; identical to SEQ ID NO: 78940

SEQ ID NO: 177205 - RNA, 64 nt, hsa; identical to SEQ ID NO: 78941

SEQ ID NO: 177206 - RNA, 64 nt, hsa; identical to SEQ ID NO: 78942

SEQ ID NO: 177207 - RNA, 64 nt, hsa; identical to SEQ ID NO: 78943

SEQ ID NO: 177208 - RNA, 64 nt, hsa; identical to SEQ ID NO: 78944

SEQ ID NO: 177209 - RNA, 64 nt, hsa; identical to SEQ ID NO: 78945

SEQ ID NO: 177210 - RNA, 64 nt, hsa; identical to SEQ ID NO: 78946

SEQ ID NO: 177211 - RNA, 64 nt, hsa; identical to SEQ ID NO: 78947

SEQ ID NO: 177212 - RNA, 64 nt, hsa; identical to SEQ ID NO: 78948

SEQ ID NO: 177213 - RNA, 64 nt, hsa; identical to SEQ ID NO: 78949

SEQ ID NO: 177214 - RNA, 64 nt, hsa; identical to SEQ ID NO: 78950

SEQ ID NO: 177215 - RNA, 64 nt, hsa; identical to SEQ ID NO: 78951

SEQ ID NO: 177216 - RNA, 64 nt, hsa; identical to SEQ ID NO: 78952

SEQ ID NO: 177217 - RNA, 64 nt, hsa; identical to SEQ ID NO: 78953

SEQ ID NO: 177218 - RNA, 64 nt, hsa; identical to SEQ ID NO: 78954

SEQ ID NO: 177219 - RNA, 64 nt, hsa; identical to SEQ ID NO: 78955

SEQ ID NO: 177220 - RNA, 64 nt, hsa; identical to SEQ ID NO: 78956

SEQ ID NO: 177221 - RNA, 64 nt, hsa; identical to SEQ ID NO: 78957

SEQ ID NO: 177222 - RNA, 64 nt, hsa; identical to SEQ ID NO: 78958

SEQ ID NO: 177223 - RNA, 64 nt, hsa; identical to SEQ ID NO: 78959

SEQ ID NO: 177224 - RNA, 64 nt, hsa; identical to SEQ ID NO: 78960

SEQ ID NO: 177225 - RNA, 64 nt, hsa; identical to SEQ ID NO: 78961

SEQ ID NO: 177226 - RNA, 64 nt, hsa; identical to SEQ ID NO: 78962

SEQ ID NO: 177227 - RNA, 64 nt, hsa; identical to SEQ ID NO: 78963

SEQ ID NO: 177228 - RNA, 64 nt, hsa; identical to SEQ ID NO: 78964

SEQ ID NO: 177229 - RNA, 64 nt, hsa; identical to SEQ ID NO: 78965

SEQ ID NO: 177230 - RNA, 64 nt, hsa; identical to SEQ ID NO: 78966

SEQ ID NO: 177231 - RNA, 64 nt, hsa; identical to SEQ ID NO: 78967

SEQ ID NO: 177232 - RNA, 64 nt, hsa; identical to SEQ ID NO: 78968

SEQ ID NO: 177233 - RNA, 64 nt, hsa; identical to SEQ ID NO: 78969

SEQ ID NO: 177234 - RNA, 64 nt, hsa; identical to SEQ ID NO: 78970

SEQ ID NO: 177235 - RNA, 64 nt, hsa; identical to SEQ ID NO: 78971

SEQ ID NO: 177236 - RNA, 64 nt, hsa; identical to SEQ ID NO: 78972

SEQ ID NO: 177237 - RNA, 64 nt, hsa; identical to SEQ ID NO: 78973

SEQ ID NO: 177238 - RNA, 64 nt, hsa; identical to SEQ ID NO: 78974

SEQ ID NO: 177239 - RNA, 64 nt, hsa; identical to SEQ ID NO: 78975

SEQ ID NO: 177240 - RNA, 64 nt, hsa; identical to SEQ ID NO: 78976

SEQ ID NO: 177241 - RNA, 64 nt, hsa; identical to SEQ ID NO: 78977

SEQ ID NO: 177242 - RNA, 64 nt, hsa; identical to SEQ ID NO: 78978

SEQ ID NO: 177243 - RNA, 64 nt, hsa; identical to SEQ ID NO: 78979

SEQ ID NO: 177244 - RNA, 64 nt, hsa; identical to SEQ ID NO: 78980

SEQ ID NO: 177245 - RNA, 64 nt, hsa; identical to SEQ ID NO: 78981

SEQ ID NO: 177246 - RNA, 64 nt, hsa; identical to SEQ ID NO: 78982

SEQ ID NO: 177247 - RNA, 64 nt, hsa; identical to SEQ ID NO: 78983

SEQ ID NO: 177248 - RNA, 64 nt, hsa; identical to SEQ ID NO: 78984

SEQ ID NO: 177249 - RNA, 64 nt, hsa; identical to SEQ ID NO: 78985

SEQ ID NO: 177250 - RNA, 64 nt, hsa; identical to SEQ ID NO: 78986

SEQ ID NO: 177251 - RNA, 64 nt, hsa; identical to SEQ ID NO: 78987

SEQ ID NO: 177252 - RNA, 64 nt, hsa; identical to SEQ ID NO: 78988

SEQ ID NO: 177253 - RNA, 64 nt, hsa; identical to SEQ ID NO: 78989

SEQ ID NO: 177254 - RNA, 64 nt, hsa; identical to SEQ ID NO: 78990

SEQ ID NO: 177255 - RNA, 64 nt, hsa; identical to SEQ ID NO: 78991

SEQ ID NO: 177256 - RNA, 64 nt, hsa; identical to SEQ ID NO: 78992

SEQ ID NO: 177257 - RNA, 64 nt, hsa; identical to SEQ ID NO: 78993

SEQ ID NO: 177258 - RNA, 64 nt, hsa; identical to SEQ ID NO: 78994

SEQ ID NO: 177259 - RNA, 64 nt, hsa; identical to SEQ ID NO: 78995

SEQ ID NO: 177260 - RNA, 64 nt, hsa; identical to SEQ ID NO: 78996

SEQ ID NO: 177261 - RNA, 64 nt, hsa; identical to SEQ ID NO: 78997

SEQ ID NO: 177262 - RNA, 64 nt, hsa; identical to SEQ ID NO: 78998

SEQ ID NO: 177263 - RNA, 64 nt, hsa; identical to SEQ ID NO: 78999

SEQ ID NO: 177264 - RNA, 64 nt, hsa; identical to SEQ ID NO: 79000

SEQ ID NO: 177265 - RNA, 64 nt, hsa; identical to SEQ ID NO: 79001

SEQ ID NO: 177266 - RNA, 64 nt, hsa; identical to SEQ ID NO: 79002

SEQ ID NO: 177267 - RNA, 64 nt, hsa; identical to SEQ ID NO: 79003

SEQ ID NO: 177268 - RNA, 64 nt, hsa; identical to SEQ ID NO: 79004

SEQ ID NO: 177269 - RNA, 64 nt, hsa; identical to SEQ ID NO: 79005

SEQ ID NO: 177270 - RNA, 64 nt, hsa; identical to SEQ ID NO: 79006

SEQ ID NO: 177271 - RNA, 64 nt, hsa; identical to SEQ ID NO: 79007

SEQ ID NO: 177272 - RNA, 64 nt, hsa; identical to SEQ ID NO: 79008

SEQ ID NO: 177273 - RNA, 64 nt, hsa; identical to SEQ ID NO: 79009

SEQ ID NO: 177274 - RNA, 64 nt, hsa; identical to SEQ ID NO: 79010

SEQ ID NO: 177275 - RNA, 64 nt, hsa; identical to SEQ ID NO: 79011

SEQ ID NO: 177276 - RNA, 64 nt, hsa; identical to SEQ ID NO: 79012

SEQ ID NO: 177277 - RNA, 64 nt, hsa; identical to SEQ ID NO: 79013

SEQ ID NO: 177278 - RNA, 64 nt, hsa; identical to SEQ ID NO: 79014

SEQ ID NO: 177279 - RNA, 64 nt, hsa; identical to SEQ ID NO: 79015

SEQ ID NO: 177280 - RNA, 64 nt, hsa; identical to SEQ ID NO: 79016

SEQ ID NO: 177281 - RNA, 64 nt, hsa; identical to SEQ ID NO: 79017

SEQ ID NO: 177282 - RNA, 64 nt, hsa; identical to SEQ ID NO: 79018

SEQ ID NO: 177283 - RNA, 64 nt, hsa; identical to SEQ ID NO: 79019

SEQ ID NO: 177284 - RNA, 64 nt, hsa; identical to SEQ ID NO: 79020

SEQ ID NO: 177285 - RNA, 64 nt, hsa; identical to SEQ ID NO: 79021

SEQ ID NO: 177286 - RNA, 64 nt, hsa; identical to SEQ ID NO: 79022

SEQ ID NO: 177287 - RNA, 64 nt, hsa; identical to SEQ ID NO: 79023

SEQ ID NO: 177288 - RNA, 64 nt, hsa; identical to SEQ ID NO: 79024

SEQ ID NO: 177289 - RNA, 64 nt, hsa; identical to SEQ ID NO: 79025

SEQ ID NO: 177290 - RNA, 64 nt, hsa; identical to SEQ ID NO: 79026

SEQ ID NO: 177291 - RNA, 64 nt, hsa; identical to SEQ ID NO: 79027

SEQ ID NO: 177292 - RNA, 64 nt, hsa; identical to SEQ ID NO: 79028

SEQ ID NO: 177293 - RNA, 64 nt, hsa; identical to SEQ ID NO: 79029

SEQ ID NO: 177294 - RNA, 64 nt, hsa; identical to SEQ ID NO: 79030

SEQ ID NO: 177295 - RNA, 64 nt, hsa; identical to SEQ ID NO: 79031

SEQ ID NO: 177296 - RNA, 64 nt, hsa; identical to SEQ ID NO: 79032

SEQ ID NO: 177297 - RNA, 64 nt, hsa; identical to SEQ ID NO: 79033

SEQ ID NO: 177298 - RNA, 64 nt, hsa; identical to SEQ ID NO: 79034

SEQ ID NO: 177299 - RNA, 64 nt, hsa; identical to SEQ ID NO: 79035

SEQ ID NO: 177300 - RNA, 64 nt, hsa; identical to SEQ ID NO: 79036

SEQ ID NO: 177301 - RNA, 64 nt, hsa; identical to SEQ ID NO: 79037

SEQ ID NO: 177302 - RNA, 64 nt, hsa; identical to SEQ ID NO: 79038

SEQ ID NO: 177303 - RNA, 64 nt, hsa; identical to SEQ ID NO: 79039

SEQ ID NO: 177304 - RNA, 64 nt, hsa; identical to SEQ ID NO: 79040

SEQ ID NO: 177305 - RNA, 64 nt, hsa; identical to SEQ ID NO: 79041

SEQ ID NO: 177306 - RNA, 64 nt, hsa; identical to SEQ ID NO: 79042

SEQ ID NO: 177307 - RNA, 64 nt, hsa; identical to SEQ ID NO: 79043

SEQ ID NO: 177308 - RNA, 64 nt, hsa; identical to SEQ ID NO: 79044

SEQ ID NO: 177309 - RNA, 64 nt, hsa; identical to SEQ ID NO: 79045

SEQ ID NO: 177310 - RNA, 64 nt, hsa; identical to SEQ ID NO: 79046

SEQ ID NO: 177311 - RNA, 64 nt, hsa; identical to SEQ ID NO: 79047

SEQ ID NO: 177312 - RNA, 64 nt, hsa; identical to SEQ ID NO: 79048

SEQ ID NO: 177313 - RNA, 64 nt, hsa; identical to SEQ ID NO: 79049

SEQ ID NO: 177314 - RNA, 64 nt, hsa; identical to SEQ ID NO: 79050

SEQ ID NO: 177315 - RNA, 64 nt, hsa; identical to SEQ ID NO: 172495

SEQ ID NO: 177316 - RNA, 64 nt, hsa; identical to SEQ ID NO: 172496

SEQ ID NO: 177317 - RNA, 64 nt, hsa; identical to SEQ ID NO: 78937

SEQ ID NO: 177318 - RNA, 64 nt, hsa; identical to SEQ ID NO: 78938

SEQ ID NO: 177319 - RNA, 64 nt, hsa; identical to SEQ ID NO: 78939

SEQ ID NO: 177320 - RNA, 64 nt, hsa; identical to SEQ ID NO: 78940

SEQ ID NO: 177321 - RNA, 64 nt, hsa; identical to SEQ ID NO: 78941

SEQ ID NO: 177322 - RNA, 64 nt, hsa; identical to SEQ ID NO: 78942

SEQ ID NO: 177323 - RNA, 64 nt, hsa; identical to SEQ ID NO: 78943

SEQ ID NO: 177324 - RNA, 64 nt, hsa; identical to SEQ ID NO: 78944

SEQ ID NO: 177325 - RNA, 64 nt, hsa; identical to SEQ ID NO: 78945

SEQ ID NO: 177326 - RNA, 64 nt, hsa; identical to SEQ ID NO: 78946

SEQ ID NO: 177327 - RNA, 64 nt, hsa; identical to SEQ ID NO: 78947

SEQ ID NO: 177328 - RNA, 64 nt, hsa; identical to SEQ ID NO: 78948

SEQ ID NO: 177329 - RNA, 64 nt, hsa; identical to SEQ ID NO: 78949

SEQ ID NO: 177330 - RNA, 64 nt, hsa; identical to SEQ ID NO: 78950

SEQ ID NO: 177331 - RNA, 64 nt, hsa; identical to SEQ ID NO: 78951

SEQ ID NO: 177332 - RNA, 64 nt, hsa; identical to SEQ ID NO: 78952

SEQ ID NO: 177333 - RNA, 64 nt, hsa; identical to SEQ ID NO: 78953

SEQ ID NO: 177334 - RNA, 64 nt, hsa; identical to SEQ ID NO: 78954

SEQ ID NO: 177335 - RNA, 64 nt, hsa; identical to SEQ ID NO: 78955

SEQ ID NO: 177336 - RNA, 64 nt, hsa; identical to SEQ ID NO: 78956

SEQ ID NO: 177337 - RNA, 64 nt, hsa; identical to SEQ ID NO: 78957

SEQ ID NO: 177338 - RNA, 64 nt, hsa; identical to SEQ ID NO: 78958

SEQ ID NO: 177339 - RNA, 64 nt, hsa; identical to SEQ ID NO: 78959

SEQ ID NO: 177340 - RNA, 64 nt, hsa; identical to SEQ ID NO: 78960

SEQ ID NO: 177341 - RNA, 64 nt, hsa; identical to SEQ ID NO: 78961

SEQ ID NO: 177342 - RNA, 64 nt, hsa; identical to SEQ ID NO: 78962

SEQ ID NO: 177343 - RNA, 64 nt, hsa; identical to SEQ ID NO: 78963

SEQ ID NO: 177344 - RNA, 64 nt, hsa; identical to SEQ ID NO: 78964

SEQ ID NO: 177345 - RNA, 64 nt, hsa; identical to SEQ ID NO: 78965

SEQ ID NO: 177346 - RNA, 64 nt, hsa; identical to SEQ ID NO: 78966

SEQ ID NO: 177347 - RNA, 64 nt, hsa; identical to SEQ ID NO: 78967

SEQ ID NO: 177348 - RNA, 64 nt, hsa; identical to SEQ ID NO: 78968

SEQ ID NO: 177349 - RNA, 64 nt, hsa; identical to SEQ ID NO: 78969

SEQ ID NO: 177350 - RNA, 64 nt, hsa; identical to SEQ ID NO: 78970

SEQ ID NO: 177351 - RNA, 64 nt, hsa; identical to SEQ ID NO: 78971

SEQ ID NO: 177352 - RNA, 64 nt, hsa; identical to SEQ ID NO: 78972

SEQ ID NO: 177353 - RNA, 64 nt, hsa; identical to SEQ ID NO: 78973

SEQ ID NO: 177354 - RNA, 64 nt, hsa; identical to SEQ ID NO: 78974

SEQ ID NO: 177355 - RNA, 64 nt, hsa; identical to SEQ ID NO: 78975

SEQ ID NO: 177356 - RNA, 64 nt, hsa; identical to SEQ ID NO: 78976

SEQ ID NO: 177357 - RNA, 64 nt, hsa; identical to SEQ ID NO: 78977

SEQ ID NO: 177358 - RNA, 64 nt, hsa; identical to SEQ ID NO: 78978

SEQ ID NO: 177359 - RNA, 64 nt, hsa; identical to SEQ ID NO: 78979

SEQ ID NO: 177360 - RNA, 64 nt, hsa; identical to SEQ ID NO: 78980

SEQ ID NO: 177361 - RNA, 64 nt, hsa; identical to SEQ ID NO: 78981

SEQ ID NO: 177362 - RNA, 64 nt, hsa; identical to SEQ ID NO: 78982

SEQ ID NO: 177363 - RNA, 64 nt, hsa; identical to SEQ ID NO: 78983

SEQ ID NO: 177364 - RNA, 64 nt, hsa; identical to SEQ ID NO: 78984

SEQ ID NO: 177365 - RNA, 64 nt, hsa; identical to SEQ ID NO: 78985

SEQ ID NO: 177366 - RNA, 64 nt, hsa; identical to SEQ ID NO: 78986

SEQ ID NO: 177367 - RNA, 64 nt, hsa; identical to SEQ ID NO: 78987

SEQ ID NO: 177368 - RNA, 64 nt, hsa; identical to SEQ ID NO: 78988

SEQ ID NO: 177369 - RNA, 64 nt, hsa; identical to SEQ ID NO: 78989

SEQ ID NO: 177370 - RNA, 64 nt, hsa; identical to SEQ ID NO: 78990

SEQ ID NO: 177371 - RNA, 64 nt, hsa; identical to SEQ ID NO: 78991

SEQ ID NO: 177372 - RNA, 64 nt, hsa; identical to SEQ ID NO: 78992

SEQ ID NO: 177373 - RNA, 64 nt, hsa; identical to SEQ ID NO: 78993

SEQ ID NO: 177374 - RNA, 64 nt, hsa; identical to SEQ ID NO: 78994

SEQ ID NO: 177375 - RNA, 64 nt, hsa; identical to SEQ ID NO: 78995

SEQ ID NO: 177376 - RNA, 64 nt, hsa; identical to SEQ ID NO: 78996

SEQ ID NO: 177377 - RNA, 64 nt, hsa; identical to SEQ ID NO: 78997

SEQ ID NO: 177378 - RNA, 64 nt, hsa; identical to SEQ ID NO: 78998

SEQ ID NO: 177379 - RNA, 64 nt, hsa; identical to SEQ ID NO: 78999

SEQ ID NO: 177380 - RNA, 64 nt, hsa; identical to SEQ ID NO: 79000

SEQ ID NO: 177381 - RNA, 64 nt, hsa; identical to SEQ ID NO: 79001

SEQ ID NO: 177382 - RNA, 64 nt, hsa; identical to SEQ ID NO: 79002

SEQ ID NO: 177383 - RNA, 64 nt, hsa; identical to SEQ ID NO: 79003

SEQ ID NO: 177384 - RNA, 64 nt, hsa; identical to SEQ ID NO: 79004

SEQ ID NO: 177385 - RNA, 64 nt, hsa; identical to SEQ ID NO: 79005

SEQ ID NO: 177386 - RNA, 64 nt, hsa; identical to SEQ ID NO: 79006

SEQ ID NO: 177387 - RNA, 64 nt, hsa; identical to SEQ ID NO: 79007

SEQ ID NO: 177388 - RNA, 64 nt, hsa; identical to SEQ ID NO: 79008

SEQ ID NO: 177389 - RNA, 64 nt, hsa; identical to SEQ ID NO: 79009

SEQ ID NO: 177390 - RNA, 64 nt, hsa; identical to SEQ ID NO: 79010

SEQ ID NO: 177391 - RNA, 64 nt, hsa; identical to SEQ ID NO: 79011

SEQ ID NO: 177392 - RNA, 64 nt, hsa; identical to SEQ ID NO: 79012

SEQ ID NO: 177393 - RNA, 64 nt, hsa; identical to SEQ ID NO: 79013

SEQ ID NO: 177394 - RNA, 64 nt, hsa; identical to SEQ ID NO: 79014

SEQ ID NO: 177395 - RNA, 64 nt, hsa; identical to SEQ ID NO: 79015

SEQ ID NO: 177396 - RNA, 64 nt, hsa; identical to SEQ ID NO: 79016

SEQ ID NO: 177397 - RNA, 64 nt, hsa; identical to SEQ ID NO: 79017

SEQ ID NO: 177398 - RNA, 64 nt, hsa; identical to SEQ ID NO: 79018

SEQ ID NO: 177399 - RNA, 64 nt, hsa; identical to SEQ ID NO: 79019

SEQ ID NO: 177400 - RNA, 64 nt, hsa; identical to SEQ ID NO: 79020

SEQ ID NO: 177401 - RNA, 64 nt, hsa; identical to SEQ ID NO: 79021

SEQ ID NO: 177402 - RNA, 64 nt, hsa; identical to SEQ ID NO: 79022

SEQ ID NO: 177403 - RNA, 64 nt, hsa; identical to SEQ ID NO: 79023

SEQ ID NO: 177404 - RNA, 64 nt, hsa; identical to SEQ ID NO: 79024

SEQ ID NO: 177405 - RNA, 64 nt, hsa; identical to SEQ ID NO: 79025

SEQ ID NO: 177406 - RNA, 64 nt, hsa; identical to SEQ ID NO: 79026

SEQ ID NO: 177407 - RNA, 64 nt, hsa; identical to SEQ ID NO: 79027

SEQ ID NO: 177408 - RNA, 64 nt, hsa; identical to SEQ ID NO: 79028

SEQ ID NO: 177409 - RNA, 64 nt, hsa; identical to SEQ ID NO: 79029

SEQ ID NO: 177410 - RNA, 64 nt, hsa; identical to SEQ ID NO: 79030

SEQ ID NO: 177411 - RNA, 64 nt, hsa; identical to SEQ ID NO: 79031

SEQ ID NO: 177412 - RNA, 64 nt, hsa; identical to SEQ ID NO: 79032

SEQ ID NO: 177413 - RNA, 64 nt, hsa; identical to SEQ ID NO: 79033

SEQ ID NO: 177414 - RNA, 64 nt, hsa; identical to SEQ ID NO: 79034

SEQ ID NO: 177415 - RNA, 64 nt, hsa; identical to SEQ ID NO: 79035

SEQ ID NO: 177416 - RNA, 64 nt, hsa; identical to SEQ ID NO: 79036

SEQ ID NO: 177417 - RNA, 64 nt, hsa; identical to SEQ ID NO: 79037

SEQ ID NO: 177418 - RNA, 64 nt, hsa; identical to SEQ ID NO: 79038

SEQ ID NO: 177419 - RNA, 64 nt, hsa; identical to SEQ ID NO: 79039

SEQ ID NO: 177420 - RNA, 64 nt, hsa; identical to SEQ ID NO: 79040

SEQ ID NO: 177421 - RNA, 64 nt, hsa; identical to SEQ ID NO: 79041

SEQ ID NO: 177422 - RNA, 64 nt, hsa; identical to SEQ ID NO: 79042

SEQ ID NO: 177423 - RNA, 64 nt, hsa; identical to SEQ ID NO: 79043

SEQ ID NO: 177424 - RNA, 64 nt, hsa; identical to SEQ ID NO: 79044

SEQ ID NO: 177425 - RNA, 64 nt, hsa; identical to SEQ ID NO: 79045

SEQ ID NO: 177426 - RNA, 64 nt, hsa; identical to SEQ ID NO: 79046

SEQ ID NO: 177427 - RNA, 64 nt, hsa; identical to SEQ ID NO: 79047

SEQ ID NO: 177428 - RNA, 64 nt, hsa; identical to SEQ ID NO: 79048

SEQ ID NO: 177429 - RNA, 64 nt, hsa; identical to SEQ ID NO: 79049

SEQ ID NO: 177430 - RNA, 64 nt, hsa; identical to SEQ ID NO: 79050

SEQ ID NO: 177431 - RNA, 64 nt, hsa; identical to SEQ ID NO: 172495

SEQ ID NO: 177432 - RNA, 64 nt, hsa; identical to SEQ ID NO: 172496

SEQ ID NO: 177433 - RNA, 64 nt, hsa; identical to SEQ ID NO: 78937

SEQ ID NO: 177434 - RNA, 64 nt, hsa; identical to SEQ ID NO: 78938

SEQ ID NO: 177435 - RNA, 64 nt, hsa; identical to SEQ ID NO: 78939

SEQ ID NO: 177436 - RNA, 64 nt, hsa; identical to SEQ ID NO: 78940

SEQ ID NO: 177437 - RNA, 64 nt, hsa; identical to SEQ ID NO: 78941

SEQ ID NO: 177438 - RNA, 64 nt, hsa; identical to SEQ ID NO: 78942

SEQ ID NO: 177439 - RNA, 64 nt, hsa; identical to SEQ ID NO: 78943

SEQ ID NO: 177440 - RNA, 64 nt, hsa; identical to SEQ ID NO: 78944

SEQ ID NO: 177441 - RNA, 64 nt, hsa; identical to SEQ ID NO: 78945

SEQ ID NO: 177442 - RNA, 64 nt, hsa; identical to SEQ ID NO: 78946

SEQ ID NO: 177443 - RNA, 64 nt, hsa; identical to SEQ ID NO: 78947

SEQ ID NO: 177444 - RNA, 64 nt, hsa; identical to SEQ ID NO: 78948

SEQ ID NO: 177445 - RNA, 64 nt, hsa; identical to SEQ ID NO: 78949

SEQ ID NO: 177446 - RNA, 64 nt, hsa; identical to SEQ ID NO: 78950

SEQ ID NO: 177447 - RNA, 64 nt, hsa; identical to SEQ ID NO: 78951

SEQ ID NO: 177448 - RNA, 64 nt, hsa; identical to SEQ ID NO: 78952

SEQ ID NO: 177449 - RNA, 64 nt, hsa; identical to SEQ ID NO: 78953

SEQ ID NO: 177450 - RNA, 64 nt, hsa; identical to SEQ ID NO: 78954

SEQ ID NO: 177451 - RNA, 64 nt, hsa; identical to SEQ ID NO: 78955

SEQ ID NO: 177452 - RNA, 64 nt, hsa; identical to SEQ ID NO: 78956

SEQ ID NO: 177453 - RNA, 64 nt, hsa; identical to SEQ ID NO: 78957

SEQ ID NO: 177454 - RNA, 64 nt, hsa; identical to SEQ ID NO: 78958

SEQ ID NO: 177455 - RNA, 64 nt, hsa; identical to SEQ ID NO: 78959

SEQ ID NO: 177456 - RNA, 64 nt, hsa; identical to SEQ ID NO: 78960

SEQ ID NO: 177457 - RNA, 64 nt, hsa; identical to SEQ ID NO: 78961

SEQ ID NO: 177458 - RNA, 64 nt, hsa; identical to SEQ ID NO: 78962

SEQ ID NO: 177459 - RNA, 64 nt, hsa; identical to SEQ ID NO: 78963

SEQ ID NO: 177460 - RNA, 64 nt, hsa; identical to SEQ ID NO: 78964

SEQ ID NO: 177461 - RNA, 64 nt, hsa; identical to SEQ ID NO: 78965

SEQ ID NO: 177462 - RNA, 64 nt, hsa; identical to SEQ ID NO: 78966

SEQ ID NO: 177463 - RNA, 64 nt, hsa; identical to SEQ ID NO: 78967

SEQ ID NO: 177464 - RNA, 64 nt, hsa; identical to SEQ ID NO: 78968

SEQ ID NO: 177465 - RNA, 64 nt, hsa; identical to SEQ ID NO: 78969

SEQ ID NO: 177466 - RNA, 64 nt, hsa; identical to SEQ ID NO: 78970

SEQ ID NO: 177467 - RNA, 64 nt, hsa; identical to SEQ ID NO: 78971

SEQ ID NO: 177468 - RNA, 64 nt, hsa; identical to SEQ ID NO: 78972

SEQ ID NO: 177469 - RNA, 64 nt, hsa; identical to SEQ ID NO: 78973

SEQ ID NO: 177470 - RNA, 64 nt, hsa; identical to SEQ ID NO: 78974

SEQ ID NO: 177471 - RNA, 64 nt, hsa; identical to SEQ ID NO: 78975

SEQ ID NO: 177472 - RNA, 64 nt, hsa; identical to SEQ ID NO: 78976

SEQ ID NO: 177473 - RNA, 64 nt, hsa; identical to SEQ ID NO: 78977

SEQ ID NO: 177474 - RNA, 64 nt, hsa; identical to SEQ ID NO: 78978

SEQ ID NO: 177475 - RNA, 64 nt, hsa; identical to SEQ ID NO: 78979

SEQ ID NO: 177476 - RNA, 64 nt, hsa; identical to SEQ ID NO: 78980

SEQ ID NO: 177477 - RNA, 64 nt, hsa; identical to SEQ ID NO: 78981

SEQ ID NO: 177478 - RNA, 64 nt, hsa; identical to SEQ ID NO: 78982

SEQ ID NO: 177479 - RNA, 64 nt, hsa; identical to SEQ ID NO: 78983

SEQ ID NO: 177480 - RNA, 64 nt, hsa; identical to SEQ ID NO: 78984

SEQ ID NO: 177481 - RNA, 64 nt, hsa; identical to SEQ ID NO: 78985

SEQ ID NO: 177482 - RNA, 64 nt, hsa; identical to SEQ ID NO: 78986

SEQ ID NO: 177483 - RNA, 64 nt, hsa; identical to SEQ ID NO: 78987

SEQ ID NO: 177484 - RNA, 64 nt, hsa; identical to SEQ ID NO: 78988

SEQ ID NO: 177485 - RNA, 64 nt, hsa; identical to SEQ ID NO: 78989

SEQ ID NO: 177486 - RNA, 64 nt, hsa; identical to SEQ ID NO: 78990

SEQ ID NO: 177487 - RNA, 64 nt, hsa; identical to SEQ ID NO: 78991

SEQ ID NO: 177488 - RNA, 64 nt, hsa; identical to SEQ ID NO: 78992

SEQ ID NO: 177489 - RNA, 64 nt, hsa; identical to SEQ ID NO: 78993

SEQ ID NO: 177490 - RNA, 64 nt, hsa; identical to SEQ ID NO: 78994

SEQ ID NO: 177491 - RNA, 64 nt, hsa; identical to SEQ ID NO: 78995

SEQ ID NO: 177492 - RNA, 64 nt, hsa; identical to SEQ ID NO: 78996

SEQ ID NO: 177493 - RNA, 64 nt, hsa; identical to SEQ ID NO: 78997

SEQ ID NO: 177494 - RNA, 64 nt, hsa; identical to SEQ ID NO: 78998

SEQ ID NO: 177495 - RNA, 64 nt, hsa; identical to SEQ ID NO: 78999

SEQ ID NO: 177496 - RNA, 64 nt, hsa; identical to SEQ ID NO: 79000

SEQ ID NO: 177497 - RNA, 64 nt, hsa; identical to SEQ ID NO: 79001

SEQ ID NO: 177498 - RNA, 64 nt, hsa; identical to SEQ ID NO: 79002

SEQ ID NO: 177499 - RNA, 64 nt, hsa; identical to SEQ ID NO: 79003

SEQ ID NO: 177500 - RNA, 64 nt, hsa; identical to SEQ ID NO: 79004

SEQ ID NO: 177501 - RNA, 64 nt, hsa; identical to SEQ ID NO: 79005

SEQ ID NO: 177502 - RNA, 64 nt, hsa; identical to SEQ ID NO: 79006

SEQ ID NO: 177503 - RNA, 64 nt, hsa; identical to SEQ ID NO: 79007

SEQ ID NO: 177504 - RNA, 64 nt, hsa; identical to SEQ ID NO: 79008

SEQ ID NO: 177505 - RNA, 64 nt, hsa; identical to SEQ ID NO: 79009

SEQ ID NO: 177506 - RNA, 64 nt, hsa; identical to SEQ ID NO: 79010

SEQ ID NO: 177507 - RNA, 64 nt, hsa; identical to SEQ ID NO: 79011

SEQ ID NO: 177508 - RNA, 64 nt, hsa; identical to SEQ ID NO: 79012

SEQ ID NO: 177509 - RNA, 64 nt, hsa; identical to SEQ ID NO: 79013

SEQ ID NO: 177510 - RNA, 64 nt, hsa; identical to SEQ ID NO: 79014

SEQ ID NO: 177511 - RNA, 64 nt, hsa; identical to SEQ ID NO: 79015

SEQ ID NO: 177512 - RNA, 64 nt, hsa; identical to SEQ ID NO: 79016

SEQ ID NO: 177513 - RNA, 64 nt, hsa; identical to SEQ ID NO: 79017

SEQ ID NO: 177514 - RNA, 64 nt, hsa; identical to SEQ ID NO: 79018

SEQ ID NO: 177515 - RNA, 64 nt, hsa; identical to SEQ ID NO: 79019

SEQ ID NO: 177516 - RNA, 64 nt, hsa; identical to SEQ ID NO: 79020

SEQ ID NO: 177517 - RNA, 64 nt, hsa; identical to SEQ ID NO: 79021

SEQ ID NO: 177518 - RNA, 64 nt, hsa; identical to SEQ ID NO: 79022

SEQ ID NO: 177519 - RNA, 64 nt, hsa; identical to SEQ ID NO: 79023

SEQ ID NO: 177520 - RNA, 64 nt, hsa; identical to SEQ ID NO: 79024

SEQ ID NO: 177521 - RNA, 64 nt, hsa; identical to SEQ ID NO: 79025

SEQ ID NO: 177522 - RNA, 64 nt, hsa; identical to SEQ ID NO: 79026

SEQ ID NO: 177523 - RNA, 64 nt, hsa; identical to SEQ ID NO: 79027

SEQ ID NO: 177524 - RNA, 64 nt, hsa; identical to SEQ ID NO: 79028

SEQ ID NO: 177525 - RNA, 64 nt, hsa; identical to SEQ ID NO: 79029

SEQ ID NO: 177526 - RNA, 64 nt, hsa; identical to SEQ ID NO: 79030

SEQ ID NO: 177527 - RNA, 64 nt, hsa; identical to SEQ ID NO: 79031

SEQ ID NO: 177528 - RNA, 64 nt, hsa; identical to SEQ ID NO: 79032

SEQ ID NO: 177529 - RNA, 64 nt, hsa; identical to SEQ ID NO: 79033

SEQ ID NO: 177530 - RNA, 64 nt, hsa; identical to SEQ ID NO: 79034

SEQ ID NO: 177531 - RNA, 64 nt, hsa; identical to SEQ ID NO: 79035

SEQ ID NO: 177532 - RNA, 64 nt, hsa; identical to SEQ ID NO: 79036

SEQ ID NO: 177533 - RNA, 64 nt, hsa; identical to SEQ ID NO: 79037

SEQ ID NO: 177534 - RNA, 64 nt, hsa; identical to SEQ ID NO: 79038

SEQ ID NO: 177535 - RNA, 64 nt, hsa; identical to SEQ ID NO: 79039

SEQ ID NO: 177536 - RNA, 64 nt, hsa; identical to SEQ ID NO: 79040

SEQ ID NO: 177537 - RNA, 64 nt, hsa; identical to SEQ ID NO: 79041

SEQ ID NO: 177538 - RNA, 64 nt, hsa; identical to SEQ ID NO: 79042

SEQ ID NO: 177539 - RNA, 64 nt, hsa; identical to SEQ ID NO: 79043

SEQ ID NO: 177540 - RNA, 64 nt, hsa; identical to SEQ ID NO: 79044

SEQ ID NO: 177541 - RNA, 64 nt, hsa; identical to SEQ ID NO: 79045

SEQ ID NO: 177542 - RNA, 64 nt, hsa; identical to SEQ ID NO: 79046

SEQ ID NO: 177543 - RNA, 64 nt, hsa; identical to SEQ ID NO: 79047

SEQ ID NO: 177544 - RNA, 64 nt, hsa; identical to SEQ ID NO: 79048

SEQ ID NO: 177545 - RNA, 64 nt, hsa; identical to SEQ ID NO: 79049

SEQ ID NO: 177546 - RNA, 64 nt, hsa; identical to SEQ ID NO: 79050

SEQ ID NO: 177547 - RNA, 64 nt, hsa; identical to SEQ ID NO: 172495

SEQ ID NO: 177548 - RNA, 64 nt, hsa; identical to SEQ ID NO: 172496

SEQ ID NO: 177549 - RNA, 64 nt, hsa; identical to SEQ ID NO: 78937

SEQ ID NO: 177550 - RNA, 64 nt, hsa; identical to SEQ ID NO: 78938

SEQ ID NO: 177551 - RNA, 64 nt, hsa; identical to SEQ ID NO: 78939

SEQ ID NO: 177552 - RNA, 64 nt, hsa; identical to SEQ ID NO: 78940

SEQ ID NO: 177553 - RNA, 64 nt, hsa; identical to SEQ ID NO: 78941

SEQ ID NO: 177554 - RNA, 64 nt, hsa; identical to SEQ ID NO: 78942

SEQ ID NO: 177555 - RNA, 64 nt, hsa; identical to SEQ ID NO: 78943

SEQ ID NO: 177556 - RNA, 64 nt, hsa; identical to SEQ ID NO: 78944

SEQ ID NO: 177557 - RNA, 64 nt, hsa; identical to SEQ ID NO: 78945

SEQ ID NO: 177558 - RNA, 64 nt, hsa; identical to SEQ ID NO: 78946

SEQ ID NO: 177559 - RNA, 64 nt, hsa; identical to SEQ ID NO: 78947

SEQ ID NO: 177560 - RNA, 64 nt, hsa; identical to SEQ ID NO: 78948

SEQ ID NO: 177561 - RNA, 64 nt, hsa; identical to SEQ ID NO: 78949

SEQ ID NO: 177562 - RNA, 64 nt, hsa; identical to SEQ ID NO: 78950

SEQ ID NO: 177563 - RNA, 64 nt, hsa; identical to SEQ ID NO: 78951

SEQ ID NO: 177564 - RNA, 64 nt, hsa; identical to SEQ ID NO: 78952

SEQ ID NO: 177565 - RNA, 64 nt, hsa; identical to SEQ ID NO: 78953

SEQ ID NO: 177566 - RNA, 64 nt, hsa; identical to SEQ ID NO: 78954

SEQ ID NO: 177567 - RNA, 64 nt, hsa; identical to SEQ ID NO: 78955

SEQ ID NO: 177568 - RNA, 64 nt, hsa; identical to SEQ ID NO: 78956

SEQ ID NO: 177569 - RNA, 64 nt, hsa; identical to SEQ ID NO: 78957

SEQ ID NO: 177570 - RNA, 64 nt, hsa; identical to SEQ ID NO: 78958

SEQ ID NO: 177571 - RNA, 64 nt, hsa; identical to SEQ ID NO: 78959

SEQ ID NO: 177572 - RNA, 64 nt, hsa; identical to SEQ ID NO: 78960

SEQ ID NO: 177573 - RNA, 64 nt, hsa; identical to SEQ ID NO: 78961

SEQ ID NO: 177574 - RNA, 64 nt, hsa; identical to SEQ ID NO: 78962

SEQ ID NO: 177575 - RNA, 64 nt, hsa; identical to SEQ ID NO: 78963

SEQ ID NO: 177576 - RNA, 64 nt, hsa; identical to SEQ ID NO: 78964

SEQ ID NO: 177577 - RNA, 64 nt, hsa; identical to SEQ ID NO: 78965

SEQ ID NO: 177578 - RNA, 64 nt, hsa; identical to SEQ ID NO: 78966

SEQ ID NO: 177579 - RNA, 64 nt, hsa; identical to SEQ ID NO: 78967

SEQ ID NO: 177580 - RNA, 64 nt, hsa; identical to SEQ ID NO: 78968

SEQ ID NO: 177581 - RNA, 64 nt, hsa; identical to SEQ ID NO: 78969

SEQ ID NO: 177582 - RNA, 64 nt, hsa; identical to SEQ ID NO: 78970

SEQ ID NO: 177583 - RNA, 64 nt, hsa; identical to SEQ ID NO: 78971

SEQ ID NO: 177584 - RNA, 64 nt, hsa; identical to SEQ ID NO: 78972

SEQ ID NO: 177585 - RNA, 64 nt, hsa; identical to SEQ ID NO: 78973

SEQ ID NO: 177586 - RNA, 64 nt, hsa; identical to SEQ ID NO: 78974

SEQ ID NO: 177587 - RNA, 64 nt, hsa; identical to SEQ ID NO: 78975

SEQ ID NO: 177588 - RNA, 64 nt, hsa; identical to SEQ ID NO: 78976

SEQ ID NO: 177589 - RNA, 64 nt, hsa; identical to SEQ ID NO: 78977

SEQ ID NO: 177590 - RNA, 64 nt, hsa; identical to SEQ ID NO: 78978

SEQ ID NO: 177591 - RNA, 64 nt, hsa; identical to SEQ ID NO: 78979

SEQ ID NO: 177592 - RNA, 64 nt, hsa; identical to SEQ ID NO: 78980

SEQ ID NO: 177593 - RNA, 64 nt, hsa; identical to SEQ ID NO: 78981

SEQ ID NO: 177594 - RNA, 64 nt, hsa; identical to SEQ ID NO: 78982

SEQ ID NO: 177595 - RNA, 64 nt, hsa; identical to SEQ ID NO: 78983

SEQ ID NO: 177596 - RNA, 64 nt, hsa; identical to SEQ ID NO: 78984

SEQ ID NO: 177597 - RNA, 64 nt, hsa; identical to SEQ ID NO: 78985

SEQ ID NO: 177598 - RNA, 64 nt, hsa; identical to SEQ ID NO: 78986

SEQ ID NO: 177599 - RNA, 64 nt, hsa; identical to SEQ ID NO: 78987

SEQ ID NO: 177600 - RNA, 64 nt, hsa; identical to SEQ ID NO: 78988

SEQ ID NO: 177601 - RNA, 64 nt, hsa; identical to SEQ ID NO: 78989

SEQ ID NO: 177602 - RNA, 64 nt, hsa; identical to SEQ ID NO: 78990

SEQ ID NO: 177603 - RNA, 64 nt, hsa; identical to SEQ ID NO: 78991

SEQ ID NO: 177604 - RNA, 64 nt, hsa; identical to SEQ ID NO: 78992

SEQ ID NO: 177605 - RNA, 64 nt, hsa; identical to SEQ ID NO: 78993

SEQ ID NO: 177606 - RNA, 64 nt, hsa; identical to SEQ ID NO: 78994

SEQ ID NO: 177607 - RNA, 64 nt, hsa; identical to SEQ ID NO: 78995

SEQ ID NO: 177608 - RNA, 64 nt, hsa; identical to SEQ ID NO: 78996

SEQ ID NO: 177609 - RNA, 64 nt, hsa; identical to SEQ ID NO: 78997

SEQ ID NO: 177610 - RNA, 64 nt, hsa; identical to SEQ ID NO: 78998

SEQ ID NO: 177611 - RNA, 64 nt, hsa; identical to SEQ ID NO: 78999

SEQ ID NO: 177612 - RNA, 64 nt, hsa; identical to SEQ ID NO: 79000

SEQ ID NO: 177613 - RNA, 64 nt, hsa; identical to SEQ ID NO: 79001

SEQ ID NO: 177614 - RNA, 64 nt, hsa; identical to SEQ ID NO: 79002

SEQ ID NO: 177615 - RNA, 64 nt, hsa; identical to SEQ ID NO: 79003

SEQ ID NO: 177616 - RNA, 64 nt, hsa; identical to SEQ ID NO: 79004

SEQ ID NO: 177617 - RNA, 64 nt, hsa; identical to SEQ ID NO: 79005

SEQ ID NO: 177618 - RNA, 64 nt, hsa; identical to SEQ ID NO: 79006

SEQ ID NO: 177619 - RNA, 64 nt, hsa; identical to SEQ ID NO: 79007

SEQ ID NO: 177620 - RNA, 64 nt, hsa; identical to SEQ ID NO: 79008

SEQ ID NO: 177621 - RNA, 64 nt, hsa; identical to SEQ ID NO: 79009

SEQ ID NO: 177622 - RNA, 64 nt, hsa; identical to SEQ ID NO: 79010

SEQ ID NO: 177623 - RNA, 64 nt, hsa; identical to SEQ ID NO: 79011

SEQ ID NO: 177624 - RNA, 64 nt, hsa; identical to SEQ ID NO: 79012

SEQ ID NO: 177625 - RNA, 64 nt, hsa; identical to SEQ ID NO: 79013

SEQ ID NO: 177626 - RNA, 64 nt, hsa; identical to SEQ ID NO: 79014

SEQ ID NO: 177627 - RNA, 64 nt, hsa; identical to SEQ ID NO: 79015

SEQ ID NO: 177628 - RNA, 64 nt, hsa; identical to SEQ ID NO: 79016

SEQ ID NO: 177629 - RNA, 64 nt, hsa; identical to SEQ ID NO: 79017

SEQ ID NO: 177630 - RNA, 64 nt, hsa; identical to SEQ ID NO: 79018

SEQ ID NO: 177631 - RNA, 64 nt, hsa; identical to SEQ ID NO: 79019

SEQ ID NO: 177632 - RNA, 64 nt, hsa; identical to SEQ ID NO: 79020

SEQ ID NO: 177633 - RNA, 64 nt, hsa; identical to SEQ ID NO: 79021

SEQ ID NO: 177634 - RNA, 64 nt, hsa; identical to SEQ ID NO: 79022

SEQ ID NO: 177635 - RNA, 64 nt, hsa; identical to SEQ ID NO: 79023

SEQ ID NO: 177636 - RNA, 64 nt, hsa; identical to SEQ ID NO: 79024

SEQ ID NO: 177637 - RNA, 64 nt, hsa; identical to SEQ ID NO: 79025

SEQ ID NO: 177638 - RNA, 64 nt, hsa; identical to SEQ ID NO: 79026

SEQ ID NO: 177639 - RNA, 64 nt, hsa; identical to SEQ ID NO: 79027

SEQ ID NO: 177640 - RNA, 64 nt, hsa; identical to SEQ ID NO: 79028

SEQ ID NO: 177641 - RNA, 64 nt, hsa; identical to SEQ ID NO: 79029

SEQ ID NO: 177642 - RNA, 64 nt, hsa; identical to SEQ ID NO: 79030

SEQ ID NO: 177643 - RNA, 64 nt, hsa; identical to SEQ ID NO: 79031

SEQ ID NO: 177644 - RNA, 64 nt, hsa; identical to SEQ ID NO: 79032

SEQ ID NO: 177645 - RNA, 64 nt, hsa; identical to SEQ ID NO: 79033

SEQ ID NO: 177646 - RNA, 64 nt, hsa; identical to SEQ ID NO: 79034

SEQ ID NO: 177647 - RNA, 64 nt, hsa; identical to SEQ ID NO: 79035

SEQ ID NO: 177648 - RNA, 64 nt, hsa; identical to SEQ ID NO: 79036

SEQ ID NO: 177649 - RNA, 64 nt, hsa; identical to SEQ ID NO: 79037

SEQ ID NO: 177650 - RNA, 64 nt, hsa; identical to SEQ ID NO: 79038

SEQ ID NO: 177651 - RNA, 64 nt, hsa; identical to SEQ ID NO: 79039

SEQ ID NO: 177652 - RNA, 64 nt, hsa; identical to SEQ ID NO: 79040

SEQ ID NO: 177653 - RNA, 64 nt, hsa; identical to SEQ ID NO: 79041

SEQ ID NO: 177654 - RNA, 64 nt, hsa; identical to SEQ ID NO: 79042

SEQ ID NO: 177655 - RNA, 64 nt, hsa; identical to SEQ ID NO: 79043

SEQ ID NO: 177656 - RNA, 64 nt, hsa; identical to SEQ ID NO: 79044

SEQ ID NO: 177657 - RNA, 64 nt, hsa; identical to SEQ ID NO: 79045

SEQ ID NO: 177658 - RNA, 64 nt, hsa; identical to SEQ ID NO: 79046

SEQ ID NO: 177659 - RNA, 64 nt, hsa; identical to SEQ ID NO: 79047

SEQ ID NO: 177660 - RNA, 64 nt, hsa; identical to SEQ ID NO: 79048

SEQ ID NO: 177661 - RNA, 64 nt, hsa; identical to SEQ ID NO: 79049

SEQ ID NO: 177662 - RNA, 64 nt, hsa; identical to SEQ ID NO: 79050

SEQ ID NO: 177663 - RNA, 64 nt, hsa; identical to SEQ ID NO: 172495

SEQ ID NO: 177664 - RNA, 64 nt, hsa; identical to SEQ ID NO: 172496

SEQ ID NO: 177665 - RNA, 64 nt, hsa; identical to SEQ ID NO: 78937

SEQ ID NO: 177666 - RNA, 64 nt, hsa; identical to SEQ ID NO: 78938

SEQ ID NO: 177667 - RNA, 64 nt, hsa; identical to SEQ ID NO: 78939

SEQ ID NO: 177668 - RNA, 64 nt, hsa; identical to SEQ ID NO: 78940

SEQ ID NO: 177669 - RNA, 64 nt, hsa; identical to SEQ ID NO: 78941

SEQ ID NO: 177670 - RNA, 64 nt, hsa; identical to SEQ ID NO: 78942

SEQ ID NO: 177671 - RNA, 64 nt, hsa; identical to SEQ ID NO: 78943

SEQ ID NO: 177672 - RNA, 64 nt, hsa; identical to SEQ ID NO: 78944

SEQ ID NO: 177673 - RNA, 64 nt, hsa; identical to SEQ ID NO: 78945

SEQ ID NO: 177674 - RNA, 64 nt, hsa; identical to SEQ ID NO: 78946

SEQ ID NO: 177675 - RNA, 64 nt, hsa; identical to SEQ ID NO: 78947

SEQ ID NO: 177676 - RNA, 64 nt, hsa; identical to SEQ ID NO: 78948

SEQ ID NO: 177677 - RNA, 64 nt, hsa; identical to SEQ ID NO: 78949

SEQ ID NO: 177678 - RNA, 64 nt, hsa; identical to SEQ ID NO: 78950

SEQ ID NO: 177679 - RNA, 64 nt, hsa; identical to SEQ ID NO: 78951

SEQ ID NO: 177680 - RNA, 64 nt, hsa; identical to SEQ ID NO: 78952

SEQ ID NO: 177681 - RNA, 64 nt, hsa; identical to SEQ ID NO: 78953

SEQ ID NO: 177682 - RNA, 64 nt, hsa; identical to SEQ ID NO: 78954

SEQ ID NO: 177683 - RNA, 64 nt, hsa; identical to SEQ ID NO: 78955

SEQ ID NO: 177684 - RNA, 64 nt, hsa; identical to SEQ ID NO: 78956

SEQ ID NO: 177685 - RNA, 64 nt, hsa; identical to SEQ ID NO: 78957

SEQ ID NO: 177686 - RNA, 64 nt, hsa; identical to SEQ ID NO: 78958

SEQ ID NO: 177687 - RNA, 64 nt, hsa; identical to SEQ ID NO: 78959

SEQ ID NO: 177688 - RNA, 64 nt, hsa; identical to SEQ ID NO: 78960

SEQ ID NO: 177689 - RNA, 64 nt, hsa; identical to SEQ ID NO: 78961

SEQ ID NO: 177690 - RNA, 64 nt, hsa; identical to SEQ ID NO: 78962

SEQ ID NO: 177691 - RNA, 64 nt, hsa; identical to SEQ ID NO: 78963

SEQ ID NO: 177692 - RNA, 64 nt, hsa; identical to SEQ ID NO: 78964

SEQ ID NO: 177693 - RNA, 64 nt, hsa; identical to SEQ ID NO: 78965

SEQ ID NO: 177694 - RNA, 64 nt, hsa; identical to SEQ ID NO: 78966

SEQ ID NO: 177695 - RNA, 64 nt, hsa; identical to SEQ ID NO: 78967

SEQ ID NO: 177696 - RNA, 64 nt, hsa; identical to SEQ ID NO: 78968

SEQ ID NO: 177697 - RNA, 64 nt, hsa; identical to SEQ ID NO: 78969

SEQ ID NO: 177698 - RNA, 64 nt, hsa; identical to SEQ ID NO: 78970

SEQ ID NO: 177699 - RNA, 64 nt, hsa; identical to SEQ ID NO: 78971

SEQ ID NO: 177700 - RNA, 64 nt, hsa; identical to SEQ ID NO: 78972

SEQ ID NO: 177701 - RNA, 64 nt, hsa; identical to SEQ ID NO: 78973

SEQ ID NO: 177702 - RNA, 64 nt, hsa; identical to SEQ ID NO: 78974

SEQ ID NO: 177703 - RNA, 64 nt, hsa; identical to SEQ ID NO: 78975

SEQ ID NO: 177704 - RNA, 64 nt, hsa; identical to SEQ ID NO: 78976

SEQ ID NO: 177705 - RNA, 64 nt, hsa; identical to SEQ ID NO: 78977

SEQ ID NO: 177706 - RNA, 64 nt, hsa; identical to SEQ ID NO: 78978

SEQ ID NO: 177707 - RNA, 64 nt, hsa; identical to SEQ ID NO: 78979

SEQ ID NO: 177708 - RNA, 64 nt, hsa; identical to SEQ ID NO: 78980

SEQ ID NO: 177709 - RNA, 64 nt, hsa; identical to SEQ ID NO: 78981

SEQ ID NO: 177710 - RNA, 64 nt, hsa; identical to SEQ ID NO: 78982

SEQ ID NO: 177711 - RNA, 64 nt, hsa; identical to SEQ ID NO: 78983

SEQ ID NO: 177712 - RNA, 64 nt, hsa; identical to SEQ ID NO: 78984

SEQ ID NO: 177713 - RNA, 64 nt, hsa; identical to SEQ ID NO: 78985

SEQ ID NO: 177714 - RNA, 64 nt, hsa; identical to SEQ ID NO: 78986

SEQ ID NO: 177715 - RNA, 64 nt, hsa; identical to SEQ ID NO: 78987

SEQ ID NO: 177716 - RNA, 64 nt, hsa; identical to SEQ ID NO: 78988

SEQ ID NO: 177717 - RNA, 64 nt, hsa; identical to SEQ ID NO: 78989

SEQ ID NO: 177718 - RNA, 64 nt, hsa; identical to SEQ ID NO: 78990

SEQ ID NO: 177719 - RNA, 64 nt, hsa; identical to SEQ ID NO: 78991

SEQ ID NO: 177720 - RNA, 64 nt, hsa; identical to SEQ ID NO: 78992

SEQ ID NO: 177721 - RNA, 64 nt, hsa; identical to SEQ ID NO: 78993

SEQ ID NO: 177722 - RNA, 64 nt, hsa; identical to SEQ ID NO: 78994

SEQ ID NO: 177723 - RNA, 64 nt, hsa; identical to SEQ ID NO: 78995

SEQ ID NO: 177724 - RNA, 64 nt, hsa; identical to SEQ ID NO: 78996

SEQ ID NO: 177725 - RNA, 64 nt, hsa; identical to SEQ ID NO: 78997

SEQ ID NO: 177726 - RNA, 64 nt, hsa; identical to SEQ ID NO: 78998

SEQ ID NO: 177727 - RNA, 64 nt, hsa; identical to SEQ ID NO: 78999

SEQ ID NO: 177728 - RNA, 64 nt, hsa; identical to SEQ ID NO: 79000

SEQ ID NO: 177729 - RNA, 64 nt, hsa; identical to SEQ ID NO: 79001

SEQ ID NO: 177730 - RNA, 64 nt, hsa; identical to SEQ ID NO: 79002

SEQ ID NO: 177731 - RNA, 64 nt, hsa; identical to SEQ ID NO: 79003

SEQ ID NO: 177732 - RNA, 64 nt, hsa; identical to SEQ ID NO: 79004

SEQ ID NO: 177733 - RNA, 64 nt, hsa; identical to SEQ ID NO: 79005

SEQ ID NO: 177734 - RNA, 64 nt, hsa; identical to SEQ ID NO: 79006

SEQ ID NO: 177735 - RNA, 64 nt, hsa; identical to SEQ ID NO: 79007

SEQ ID NO: 177736 - RNA, 64 nt, hsa; identical to SEQ ID NO: 79008

SEQ ID NO: 177737 - RNA, 64 nt, hsa; identical to SEQ ID NO: 79009

SEQ ID NO: 177738 - RNA, 64 nt, hsa; identical to SEQ ID NO: 79010

SEQ ID NO: 177739 - RNA, 64 nt, hsa; identical to SEQ ID NO: 79011

SEQ ID NO: 177740 - RNA, 64 nt, hsa; identical to SEQ ID NO: 79012

SEQ ID NO: 177741 - RNA, 64 nt, hsa; identical to SEQ ID NO: 79013

SEQ ID NO: 177742 - RNA, 64 nt, hsa; identical to SEQ ID NO: 79014

SEQ ID NO: 177743 - RNA, 64 nt, hsa; identical to SEQ ID NO: 79015

SEQ ID NO: 177744 - RNA, 64 nt, hsa; identical to SEQ ID NO: 79016

SEQ ID NO: 177745 - RNA, 64 nt, hsa; identical to SEQ ID NO: 79017

SEQ ID NO: 177746 - RNA, 64 nt, hsa; identical to SEQ ID NO: 79018

SEQ ID NO: 177747 - RNA, 64 nt, hsa; identical to SEQ ID NO: 79019

SEQ ID NO: 177748 - RNA, 64 nt, hsa; identical to SEQ ID NO: 79020

SEQ ID NO: 177749 - RNA, 64 nt, hsa; identical to SEQ ID NO: 79021

SEQ ID NO: 177750 - RNA, 64 nt, hsa; identical to SEQ ID NO: 79022

SEQ ID NO: 177751 - RNA, 64 nt, hsa; identical to SEQ ID NO: 79023

SEQ ID NO: 177752 - RNA, 64 nt, hsa; identical to SEQ ID NO: 79024

SEQ ID NO: 177753 - RNA, 64 nt, hsa; identical to SEQ ID NO: 79025

SEQ ID NO: 177754 - RNA, 64 nt, hsa; identical to SEQ ID NO: 79026

SEQ ID NO: 177755 - RNA, 64 nt, hsa; identical to SEQ ID NO: 79027

SEQ ID NO: 177756 - RNA, 64 nt, hsa; identical to SEQ ID NO: 79028

SEQ ID NO: 177757 - RNA, 64 nt, hsa; identical to SEQ ID NO: 79029

SEQ ID NO: 177758 - RNA, 64 nt, hsa; identical to SEQ ID NO: 79030

SEQ ID NO: 177759 - RNA, 64 nt, hsa; identical to SEQ ID NO: 79031

SEQ ID NO: 177760 - RNA, 64 nt, hsa; identical to SEQ ID NO: 79032

SEQ ID NO: 177761 - RNA, 64 nt, hsa; identical to SEQ ID NO: 79033

SEQ ID NO: 177762 - RNA, 64 nt, hsa; identical to SEQ ID NO: 79034

SEQ ID NO: 177763 - RNA, 64 nt, hsa; identical to SEQ ID NO: 79035

SEQ ID NO: 177764 - RNA, 64 nt, hsa; identical to SEQ ID NO: 79036

SEQ ID NO: 177765 - RNA, 64 nt, hsa; identical to SEQ ID NO: 79037

SEQ ID NO: 177766 - RNA, 64 nt, hsa; identical to SEQ ID NO: 79038

SEQ ID NO: 177767 - RNA, 64 nt, hsa; identical to SEQ ID NO: 79039

SEQ ID NO: 177768 - RNA, 64 nt, hsa; identical to SEQ ID NO: 79040

SEQ ID NO: 177769 - RNA, 64 nt, hsa; identical to SEQ ID NO: 79041

SEQ ID NO: 177770 - RNA, 64 nt, hsa; identical to SEQ ID NO: 79042

SEQ ID NO: 177771 - RNA, 64 nt, hsa; identical to SEQ ID NO: 79043

SEQ ID NO: 177772 - RNA, 64 nt, hsa; identical to SEQ ID NO: 79044

SEQ ID NO: 177773 - RNA, 64 nt, hsa; identical to SEQ ID NO: 79045

SEQ ID NO: 177774 - RNA, 64 nt, hsa; identical to SEQ ID NO: 79046

SEQ ID NO: 177775 - RNA, 64 nt, hsa; identical to SEQ ID NO: 79047

SEQ ID NO: 177776 - RNA, 64 nt, hsa; identical to SEQ ID NO: 79048

SEQ ID NO: 177777 - RNA, 64 nt, hsa; identical to SEQ ID NO: 79049

SEQ ID NO: 177778 - RNA, 64 nt, hsa; identical to SEQ ID NO: 79050

SEQ ID NO: 177779 - RNA, 64 nt, hsa; identical to SEQ ID NO: 172495

SEQ ID NO: 177780 - RNA, 64 nt, hsa; identical to SEQ ID NO: 172496

SEQ ID NO: 177781 - RNA, 64 nt, hsa; identical to SEQ ID NO: 78937

SEQ ID NO: 177782 - RNA, 64 nt, hsa; identical to SEQ ID NO: 78938

SEQ ID NO: 177783 - RNA, 64 nt, hsa; identical to SEQ ID NO: 78939

SEQ ID NO: 177784 - RNA, 64 nt, hsa; identical to SEQ ID NO: 78940

SEQ ID NO: 177785 - RNA, 64 nt, hsa; identical to SEQ ID NO: 78941

SEQ ID NO: 177786 - RNA, 64 nt, hsa; identical to SEQ ID NO: 78942

SEQ ID NO: 177787 - RNA, 64 nt, hsa; identical to SEQ ID NO: 78943

SEQ ID NO: 177788 - RNA, 64 nt, hsa; identical to SEQ ID NO: 78944

SEQ ID NO: 177789 - RNA, 64 nt, hsa; identical to SEQ ID NO: 78945

SEQ ID NO: 177790 - RNA, 64 nt, hsa; identical to SEQ ID NO: 78946

SEQ ID NO: 177791 - RNA, 64 nt, hsa; identical to SEQ ID NO: 78947

SEQ ID NO: 177792 - RNA, 64 nt, hsa; identical to SEQ ID NO: 78948

SEQ ID NO: 177793 - RNA, 64 nt, hsa; identical to SEQ ID NO: 78949

SEQ ID NO: 177794 - RNA, 64 nt, hsa; identical to SEQ ID NO: 78950

SEQ ID NO: 177795 - RNA, 64 nt, hsa; identical to SEQ ID NO: 78951

SEQ ID NO: 177796 - RNA, 64 nt, hsa; identical to SEQ ID NO: 78952

SEQ ID NO: 177797 - RNA, 64 nt, hsa; identical to SEQ ID NO: 78953

SEQ ID NO: 177798 - RNA, 64 nt, hsa; identical to SEQ ID NO: 78954

SEQ ID NO: 177799 - RNA, 64 nt, hsa; identical to SEQ ID NO: 78955

SEQ ID NO: 177800 - RNA, 64 nt, hsa; identical to SEQ ID NO: 78956

SEQ ID NO: 177801 - RNA, 64 nt, hsa; identical to SEQ ID NO: 78957

SEQ ID NO: 177802 - RNA, 64 nt, hsa; identical to SEQ ID NO: 78958

SEQ ID NO: 177803 - RNA, 64 nt, hsa; identical to SEQ ID NO: 78959

SEQ ID NO: 177804 - RNA, 64 nt, hsa; identical to SEQ ID NO: 78960

SEQ ID NO: 177805 - RNA, 64 nt, hsa; identical to SEQ ID NO: 78961

SEQ ID NO: 177806 - RNA, 64 nt, hsa; identical to SEQ ID NO: 78962

SEQ ID NO: 177807 - RNA, 64 nt, hsa; identical to SEQ ID NO: 78963

SEQ ID NO: 177808 - RNA, 64 nt, hsa; identical to SEQ ID NO: 78964

SEQ ID NO: 177809 - RNA, 64 nt, hsa; identical to SEQ ID NO: 78965

SEQ ID NO: 177810 - RNA, 64 nt, hsa; identical to SEQ ID NO: 78966

SEQ ID NO: 177811 - RNA, 64 nt, hsa; identical to SEQ ID NO: 78967

SEQ ID NO: 177812 - RNA, 64 nt, hsa; identical to SEQ ID NO: 78968

SEQ ID NO: 177813 - RNA, 64 nt, hsa; identical to SEQ ID NO: 78969

SEQ ID NO: 177814 - RNA, 64 nt, hsa; identical to SEQ ID NO: 78970

SEQ ID NO: 177815 - RNA, 64 nt, hsa; identical to SEQ ID NO: 78971

SEQ ID NO: 177816 - RNA, 64 nt, hsa; identical to SEQ ID NO: 78972

SEQ ID NO: 177817 - RNA, 64 nt, hsa; identical to SEQ ID NO: 78973

SEQ ID NO: 177818 - RNA, 64 nt, hsa; identical to SEQ ID NO: 78974

SEQ ID NO: 177819 - RNA, 64 nt, hsa; identical to SEQ ID NO: 78975

SEQ ID NO: 177820 - RNA, 64 nt, hsa; identical to SEQ ID NO: 78976

SEQ ID NO: 177821 - RNA, 64 nt, hsa; identical to SEQ ID NO: 78977

SEQ ID NO: 177822 - RNA, 64 nt, hsa; identical to SEQ ID NO: 78978

SEQ ID NO: 177823 - RNA, 64 nt, hsa; identical to SEQ ID NO: 78979

SEQ ID NO: 177824 - RNA, 64 nt, hsa; identical to SEQ ID NO: 78980

SEQ ID NO: 177825 - RNA, 64 nt, hsa; identical to SEQ ID NO: 78981

SEQ ID NO: 177826 - RNA, 64 nt, hsa; identical to SEQ ID NO: 78982

SEQ ID NO: 177827 - RNA, 64 nt, hsa; identical to SEQ ID NO: 78983

SEQ ID NO: 177828 - RNA, 64 nt, hsa; identical to SEQ ID NO: 78984

SEQ ID NO: 177829 - RNA, 64 nt, hsa; identical to SEQ ID NO: 78985

SEQ ID NO: 177830 - RNA, 64 nt, hsa; identical to SEQ ID NO: 78986

SEQ ID NO: 177831 - RNA, 64 nt, hsa; identical to SEQ ID NO: 78987

SEQ ID NO: 177832 - RNA, 64 nt, hsa; identical to SEQ ID NO: 78988

SEQ ID NO: 177833 - RNA, 64 nt, hsa; identical to SEQ ID NO: 78989

SEQ ID NO: 177834 - RNA, 64 nt, hsa; identical to SEQ ID NO: 78990

SEQ ID NO: 177835 - RNA, 64 nt, hsa; identical to SEQ ID NO: 78991

SEQ ID NO: 177836 - RNA, 64 nt, hsa; identical to SEQ ID NO: 78992

SEQ ID NO: 177837 - RNA, 64 nt, hsa; identical to SEQ ID NO: 78993

SEQ ID NO: 177838 - RNA, 64 nt, hsa; identical to SEQ ID NO: 78994

SEQ ID NO: 177839 - RNA, 64 nt, hsa; identical to SEQ ID NO: 78995

SEQ ID NO: 177840 - RNA, 64 nt, hsa; identical to SEQ ID NO: 78996

SEQ ID NO: 177841 - RNA, 64 nt, hsa; identical to SEQ ID NO: 78997

SEQ ID NO: 177842 - RNA, 64 nt, hsa; identical to SEQ ID NO: 78998

SEQ ID NO: 177843 - RNA, 64 nt, hsa; identical to SEQ ID NO: 78999

SEQ ID NO: 177844 - RNA, 64 nt, hsa; identical to SEQ ID NO: 79000

SEQ ID NO: 177845 - RNA, 64 nt, hsa; identical to SEQ ID NO: 79001

SEQ ID NO: 177846 - RNA, 64 nt, hsa; identical to SEQ ID NO: 79002

SEQ ID NO: 177847 - RNA, 64 nt, hsa; identical to SEQ ID NO: 79003

SEQ ID NO: 177848 - RNA, 64 nt, hsa; identical to SEQ ID NO: 79004

SEQ ID NO: 177849 - RNA, 64 nt, hsa; identical to SEQ ID NO: 79005

SEQ ID NO: 177850 - RNA, 64 nt, hsa; identical to SEQ ID NO: 79006

SEQ ID NO: 177851 - RNA, 64 nt, hsa; identical to SEQ ID NO: 79007

SEQ ID NO: 177852 - RNA, 64 nt, hsa; identical to SEQ ID NO: 79008

SEQ ID NO: 177853 - RNA, 64 nt, hsa; identical to SEQ ID NO: 79009

SEQ ID NO: 177854 - RNA, 64 nt, hsa; identical to SEQ ID NO: 79010

SEQ ID NO: 177855 - RNA, 64 nt, hsa; identical to SEQ ID NO: 79011

SEQ ID NO: 177856 - RNA, 64 nt, hsa; identical to SEQ ID NO: 79012

SEQ ID NO: 177857 - RNA, 64 nt, hsa; identical to SEQ ID NO: 79013

SEQ ID NO: 177858 - RNA, 64 nt, hsa; identical to SEQ ID NO: 79014

SEQ ID NO: 177859 - RNA, 64 nt, hsa; identical to SEQ ID NO: 79015

SEQ ID NO: 177860 - RNA, 64 nt, hsa; identical to SEQ ID NO: 79016

SEQ ID NO: 177861 - RNA, 64 nt, hsa; identical to SEQ ID NO: 79017

SEQ ID NO: 177862 - RNA, 64 nt, hsa; identical to SEQ ID NO: 79018

SEQ ID NO: 177863 - RNA, 64 nt, hsa; identical to SEQ ID NO: 79019

SEQ ID NO: 177864 - RNA, 64 nt, hsa; identical to SEQ ID NO: 79020

SEQ ID NO: 177865 - RNA, 64 nt, hsa; identical to SEQ ID NO: 79021

SEQ ID NO: 177866 - RNA, 64 nt, hsa; identical to SEQ ID NO: 79022

SEQ ID NO: 177867 - RNA, 64 nt, hsa; identical to SEQ ID NO: 79023

SEQ ID NO: 177868 - RNA, 64 nt, hsa; identical to SEQ ID NO: 79024

SEQ ID NO: 177869 - RNA, 64 nt, hsa; identical to SEQ ID NO: 79025

SEQ ID NO: 177870 - RNA, 64 nt, hsa; identical to SEQ ID NO: 79026

SEQ ID NO: 177871 - RNA, 64 nt, hsa; identical to SEQ ID NO: 79027

SEQ ID NO: 177872 - RNA, 64 nt, hsa; identical to SEQ ID NO: 79028

SEQ ID NO: 177873 - RNA, 64 nt, hsa; identical to SEQ ID NO: 79029

SEQ ID NO: 177874 - RNA, 64 nt, hsa; identical to SEQ ID NO: 79030

SEQ ID NO: 177875 - RNA, 64 nt, hsa; identical to SEQ ID NO: 79031

SEQ ID NO: 177876 - RNA, 64 nt, hsa; identical to SEQ ID NO: 79032

SEQ ID NO: 177877 - RNA, 64 nt, hsa; identical to SEQ ID NO: 79033

SEQ ID NO: 177878 - RNA, 64 nt, hsa; identical to SEQ ID NO: 79034

SEQ ID NO: 177879 - RNA, 64 nt, hsa; identical to SEQ ID NO: 79035

SEQ ID NO: 177880 - RNA, 64 nt, hsa; identical to SEQ ID NO: 79036

SEQ ID NO: 177881 - RNA, 64 nt, hsa; identical to SEQ ID NO: 79037

SEQ ID NO: 177882 - RNA, 64 nt, hsa; identical to SEQ ID NO: 79038

SEQ ID NO: 177883 - RNA, 64 nt, hsa; identical to SEQ ID NO: 79039

SEQ ID NO: 177884 - RNA, 64 nt, hsa; identical to SEQ ID NO: 79040

SEQ ID NO: 177885 - RNA, 64 nt, hsa; identical to SEQ ID NO: 79041

SEQ ID NO: 177886 - RNA, 64 nt, hsa; identical to SEQ ID NO: 79042

SEQ ID NO: 177887 - RNA, 64 nt, hsa; identical to SEQ ID NO: 79043

SEQ ID NO: 177888 - RNA, 64 nt, hsa; identical to SEQ ID NO: 79044

SEQ ID NO: 177889 - RNA, 64 nt, hsa; identical to SEQ ID NO: 79045

SEQ ID NO: 177890 - RNA, 64 nt, hsa; identical to SEQ ID NO: 79046

SEQ ID NO: 177891 - RNA, 64 nt, hsa; identical to SEQ ID NO: 79047

SEQ ID NO: 177892 - RNA, 64 nt, hsa; identical to SEQ ID NO: 79048

SEQ ID NO: 177893 - RNA, 64 nt, hsa; identical to SEQ ID NO: 79049

SEQ ID NO: 177894 - RNA, 64 nt, hsa; identical to SEQ ID NO: 79050

SEQ ID NO: 177895 - RNA, 64 nt, hsa; identical to SEQ ID NO: 172495

SEQ ID NO: 177896 - RNA, 64 nt, hsa; identical to SEQ ID NO: 172496

SEQ ID NO: 177897 - RNA, 64 nt, hsa; identical to SEQ ID NO: 78937

SEQ ID NO: 177898 - RNA, 64 nt, hsa; identical to SEQ ID NO: 78938

SEQ ID NO: 177899 - RNA, 64 nt, hsa; identical to SEQ ID NO: 78939

SEQ ID NO: 177900 - RNA, 64 nt, hsa; identical to SEQ ID NO: 78940

SEQ ID NO: 177901 - RNA, 64 nt, hsa; identical to SEQ ID NO: 78941

SEQ ID NO: 177902 - RNA, 64 nt, hsa; identical to SEQ ID NO: 78942

SEQ ID NO: 177903 - RNA, 64 nt, hsa; identical to SEQ ID NO: 78943

SEQ ID NO: 177904 - RNA, 64 nt, hsa; identical to SEQ ID NO: 78944

SEQ ID NO: 177905 - RNA, 64 nt, hsa; identical to SEQ ID NO: 78945

SEQ ID NO: 177906 - RNA, 64 nt, hsa; identical to SEQ ID NO: 78946

SEQ ID NO: 177907 - RNA, 64 nt, hsa; identical to SEQ ID NO: 78947

SEQ ID NO: 177908 - RNA, 64 nt, hsa; identical to SEQ ID NO: 78948

SEQ ID NO: 177909 - RNA, 64 nt, hsa; identical to SEQ ID NO: 78949

SEQ ID NO: 177910 - RNA, 64 nt, hsa; identical to SEQ ID NO: 78950

SEQ ID NO: 177911 - RNA, 64 nt, hsa; identical to SEQ ID NO: 78951

SEQ ID NO: 177912 - RNA, 64 nt, hsa; identical to SEQ ID NO: 78952

SEQ ID NO: 177913 - RNA, 64 nt, hsa; identical to SEQ ID NO: 78953

SEQ ID NO: 177914 - RNA, 64 nt, hsa; identical to SEQ ID NO: 78954

SEQ ID NO: 177915 - RNA, 64 nt, hsa; identical to SEQ ID NO: 78955

SEQ ID NO: 177916 - RNA, 64 nt, hsa; identical to SEQ ID NO: 78956

SEQ ID NO: 177917 - RNA, 64 nt, hsa; identical to SEQ ID NO: 78957

SEQ ID NO: 177918 - RNA, 64 nt, hsa; identical to SEQ ID NO: 78958

SEQ ID NO: 177919 - RNA, 64 nt, hsa; identical to SEQ ID NO: 78959

SEQ ID NO: 177920 - RNA, 64 nt, hsa; identical to SEQ ID NO: 78960

SEQ ID NO: 177921 - RNA, 64 nt, hsa; identical to SEQ ID NO: 78961

SEQ ID NO: 177922 - RNA, 64 nt, hsa; identical to SEQ ID NO: 78962

SEQ ID NO: 177923 - RNA, 64 nt, hsa; identical to SEQ ID NO: 78963

SEQ ID NO: 177924 - RNA, 64 nt, hsa; identical to SEQ ID NO: 78964

SEQ ID NO: 177925 - RNA, 64 nt, hsa; identical to SEQ ID NO: 78965

SEQ ID NO: 177926 - RNA, 64 nt, hsa; identical to SEQ ID NO: 78966

SEQ ID NO: 177927 - RNA, 64 nt, hsa; identical to SEQ ID NO: 78967

SEQ ID NO: 177928 - RNA, 64 nt, hsa; identical to SEQ ID NO: 78968

SEQ ID NO: 177929 - RNA, 64 nt, hsa; identical to SEQ ID NO: 78969

SEQ ID NO: 177930 - RNA, 64 nt, hsa; identical to SEQ ID NO: 78970

SEQ ID NO: 177931 - RNA, 64 nt, hsa; identical to SEQ ID NO: 78971

SEQ ID NO: 177932 - RNA, 64 nt, hsa; identical to SEQ ID NO: 78972

SEQ ID NO: 177933 - RNA, 64 nt, hsa; identical to SEQ ID NO: 78973

SEQ ID NO: 177934 - RNA, 64 nt, hsa; identical to SEQ ID NO: 78974

SEQ ID NO: 177935 - RNA, 64 nt, hsa; identical to SEQ ID NO: 78975

SEQ ID NO: 177936 - RNA, 64 nt, hsa; identical to SEQ ID NO: 78976

SEQ ID NO: 177937 - RNA, 64 nt, hsa; identical to SEQ ID NO: 78977

SEQ ID NO: 177938 - RNA, 64 nt, hsa; identical to SEQ ID NO: 78978

SEQ ID NO: 177939 - RNA, 64 nt, hsa; identical to SEQ ID NO: 78979

SEQ ID NO: 177940 - RNA, 64 nt, hsa; identical to SEQ ID NO: 78980

SEQ ID NO: 177941 - RNA, 64 nt, hsa; identical to SEQ ID NO: 78981

SEQ ID NO: 177942 - RNA, 64 nt, hsa; identical to SEQ ID NO: 78982

SEQ ID NO: 177943 - RNA, 64 nt, hsa; identical to SEQ ID NO: 78983

SEQ ID NO: 177944 - RNA, 64 nt, hsa; identical to SEQ ID NO: 78984

SEQ ID NO: 177945 - RNA, 64 nt, hsa; identical to SEQ ID NO: 78985

SEQ ID NO: 177946 - RNA, 64 nt, hsa; identical to SEQ ID NO: 78986

SEQ ID NO: 177947 - RNA, 64 nt, hsa; identical to SEQ ID NO: 78987

SEQ ID NO: 177948 - RNA, 64 nt, hsa; identical to SEQ ID NO: 78988

SEQ ID NO: 177949 - RNA, 64 nt, hsa; identical to SEQ ID NO: 78989

SEQ ID NO: 177950 - RNA, 64 nt, hsa; identical to SEQ ID NO: 78990

SEQ ID NO: 177951 - RNA, 64 nt, hsa; identical to SEQ ID NO: 78991

SEQ ID NO: 177952 - RNA, 64 nt, hsa; identical to SEQ ID NO: 78992

SEQ ID NO: 177953 - RNA, 64 nt, hsa; identical to SEQ ID NO: 78993

SEQ ID NO: 177954 - RNA, 64 nt, hsa; identical to SEQ ID NO: 78994

SEQ ID NO: 177955 - RNA, 64 nt, hsa; identical to SEQ ID NO: 78995

SEQ ID NO: 177956 - RNA, 64 nt, hsa; identical to SEQ ID NO: 78996

SEQ ID NO: 177957 - RNA, 64 nt, hsa; identical to SEQ ID NO: 78997

SEQ ID NO: 177958 - RNA, 64 nt, hsa; identical to SEQ ID NO: 78998

SEQ ID NO: 177959 - RNA, 64 nt, hsa; identical to SEQ ID NO: 78999

SEQ ID NO: 177960 - RNA, 64 nt, hsa; identical to SEQ ID NO: 79000

SEQ ID NO: 177961 - RNA, 64 nt, hsa; identical to SEQ ID NO: 79001

SEQ ID NO: 177962 - RNA, 64 nt, hsa; identical to SEQ ID NO: 79002

SEQ ID NO: 177963 - RNA, 64 nt, hsa; identical to SEQ ID NO: 79003

SEQ ID NO: 177964 - RNA, 64 nt, hsa; identical to SEQ ID NO: 79004

SEQ ID NO: 177965 - RNA, 64 nt, hsa; identical to SEQ ID NO: 79005

SEQ ID NO: 177966 - RNA, 64 nt, hsa; identical to SEQ ID NO: 79006

SEQ ID NO: 177967 - RNA, 64 nt, hsa; identical to SEQ ID NO: 79007

SEQ ID NO: 177968 - RNA, 64 nt, hsa; identical to SEQ ID NO: 79008

SEQ ID NO: 177969 - RNA, 64 nt, hsa; identical to SEQ ID NO: 79009

SEQ ID NO: 177970 - RNA, 64 nt, hsa; identical to SEQ ID NO: 79010

SEQ ID NO: 177971 - RNA, 64 nt, hsa; identical to SEQ ID NO: 79011

SEQ ID NO: 177972 - RNA, 64 nt, hsa; identical to SEQ ID NO: 79012

SEQ ID NO: 177973 - RNA, 64 nt, hsa; identical to SEQ ID NO: 79013

SEQ ID NO: 177974 - RNA, 64 nt, hsa; identical to SEQ ID NO: 79014

SEQ ID NO: 177975 - RNA, 64 nt, hsa; identical to SEQ ID NO: 79015

SEQ ID NO: 177976 - RNA, 64 nt, hsa; identical to SEQ ID NO: 79016

SEQ ID NO: 177977 - RNA, 64 nt, hsa; identical to SEQ ID NO: 79017

SEQ ID NO: 177978 - RNA, 64 nt, hsa; identical to SEQ ID NO: 79018

SEQ ID NO: 177979 - RNA, 64 nt, hsa; identical to SEQ ID NO: 79019

SEQ ID NO: 177980 - RNA, 64 nt, hsa; identical to SEQ ID NO: 79020

SEQ ID NO: 177981 - RNA, 64 nt, hsa; identical to SEQ ID NO: 79021

SEQ ID NO: 177982 - RNA, 64 nt, hsa; identical to SEQ ID NO: 79022

SEQ ID NO: 177983 - RNA, 64 nt, hsa; identical to SEQ ID NO: 79023

SEQ ID NO: 177984 - RNA, 64 nt, hsa; identical to SEQ ID NO: 79024

SEQ ID NO: 177985 - RNA, 64 nt, hsa; identical to SEQ ID NO: 79025

SEQ ID NO: 177986 - RNA, 64 nt, hsa; identical to SEQ ID NO: 79026

SEQ ID NO: 177987 - RNA, 64 nt, hsa; identical to SEQ ID NO: 79027

SEQ ID NO: 177988 - RNA, 64 nt, hsa; identical to SEQ ID NO: 79028

SEQ ID NO: 177989 - RNA, 64 nt, hsa; identical to SEQ ID NO: 79029

SEQ ID NO: 177990 - RNA, 64 nt, hsa; identical to SEQ ID NO: 79030

SEQ ID NO: 177991 - RNA, 64 nt, hsa; identical to SEQ ID NO: 79031

SEQ ID NO: 177992 - RNA, 64 nt, hsa; identical to SEQ ID NO: 79032

SEQ ID NO: 177993 - RNA, 64 nt, hsa; identical to SEQ ID NO: 79033

SEQ ID NO: 177994 - RNA, 64 nt, hsa; identical to SEQ ID NO: 79034

SEQ ID NO: 177995 - RNA, 64 nt, hsa; identical to SEQ ID NO: 79035

SEQ ID NO: 177996 - RNA, 64 nt, hsa; identical to SEQ ID NO: 79036

SEQ ID NO: 177997 - RNA, 64 nt, hsa; identical to SEQ ID NO: 79037

SEQ ID NO: 177998 - RNA, 64 nt, hsa; identical to SEQ ID NO: 79038

SEQ ID NO: 177999 - RNA, 64 nt, hsa; identical to SEQ ID NO: 79039

SEQ ID NO: 178000 - RNA, 64 nt, hsa; identical to SEQ ID NO: 79040

SEQ ID NO: 178001 - RNA, 64 nt, hsa; identical to SEQ ID NO: 79041

SEQ ID NO: 178002 - RNA, 64 nt, hsa; identical to SEQ ID NO: 79042

SEQ ID NO: 178003 - RNA, 64 nt, hsa; identical to SEQ ID NO: 79043

SEQ ID NO: 178004 - RNA, 64 nt, hsa; identical to SEQ ID NO: 79044

SEQ ID NO: 178005 - RNA, 64 nt, hsa; identical to SEQ ID NO: 79045

SEQ ID NO: 178006 - RNA, 64 nt, hsa; identical to SEQ ID NO: 79046

SEQ ID NO: 178007 - RNA, 64 nt, hsa; identical to SEQ ID NO: 79047

SEQ ID NO: 178008 - RNA, 64 nt, hsa; identical to SEQ ID NO: 79048

SEQ ID NO: 178009 - RNA, 64 nt, hsa; identical to SEQ ID NO: 79049

SEQ ID NO: 178010 - RNA, 64 nt, hsa; identical to SEQ ID NO: 79050

SEQ ID NO: 178011 - RNA, 64 nt, hsa; identical to SEQ ID NO: 172495

SEQ ID NO: 178012 - RNA, 64 nt, hsa; identical to SEQ ID NO: 172496

SEQ ID NO: 178013 - RNA, 63 nt, hsa; identical to SEQ ID NO: 57603

SEQ ID NO: 178014 - RNA, 64 nt, hsa; identical to SEQ ID NO: 57604

SEQ ID NO: 178015 - RNA, 64 nt, hsa; identical to SEQ ID NO: 57605

SEQ ID NO: 178016 - RNA, 64 nt, hsa; identical to SEQ ID NO: 57606

SEQ ID NO: 178017 - RNA, 64 nt, hsa; identical to SEQ ID NO: 57607

SEQ ID NO: 178018 - RNA, 64 nt, hsa; identical to SEQ ID NO: 57608

SEQ ID NO: 178019 - RNA, 64 nt, hsa; identical to SEQ ID NO: 57609

SEQ ID NO: 178020 - RNA, 64 nt, hsa; identical to SEQ ID NO: 57610

SEQ ID NO: 178021 - RNA, 64 nt, hsa; identical to SEQ ID NO: 57611

SEQ ID NO: 178022 - RNA, 64 nt, hsa; identical to SEQ ID NO: 57612

SEQ ID NO: 178023 - RNA, 64 nt, hsa; identical to SEQ ID NO: 57613

SEQ ID NO: 178024 - RNA, 64 nt, hsa; identical to SEQ ID NO: 57614

SEQ ID NO: 178025 - RNA, 64 nt, hsa
aucaaaacacugcagcaguuccuaaaugauucucacaagcaacccugagagagacagucuugug

SEQ ID NO: 178026 - RNA, 64 nt, hsa
aucaaucuguaaaagguaaaaaugaaaaacaaaaacaagcaaacaaacaaaaaacaauggaaaa

SEQ ID NO: 178027 - RNA, 64 nt, hsa
agggaguggcagaacugggccgccucucugguugacaagcaaaccacaugcuaaggcuuggagc

SEQ ID NO: 178028 - RNA, 64 nt, hsa
uaauaaaaugguaaauuuuuuucucaguuauugaacaagcaagcauuauccaguugaucuggca

SEQ ID NO: 178029 - RNA, 64 nt, hsa
ucuuaaagauacuccaagccacaugccacuaaccacaagcaagcuggcugcaagacuaaagagc

SEQ ID NO: 178030 - RNA, 64 nt, hsa
ccaucuuaagagaugccucauuuuagaaccaccaacaagcaagcucccaagggauggugcccug

SEQ ID NO: 178031 - RNA, 64 nt, hsa
ggccuauuccauucuggauuuugucaagcaguagacaagcaauuagacaagaacuuggaggcac

SEQ ID NO: 178032 - RNA, 64 nt, hsa
uuggccugaaauagaguccuuaagacaagcaaagacaagcaaggcaagcacgucuggaaacaga

SEQ ID NO: 178033 - RNA, 64 nt, hsa
ggaucaaguauuggccugaaauagaguccuuaagacaagcaaagacaagcaaggcaagcacguc

SEQ ID NO: 178034 - RNA, 64 nt, hsa
uucauaagugaaggagaaauaaaauacuuuacagacaagcaaaugcugagagauuuugucacca

SEQ ID NO: 178035 - RNA, 64 nt, hsa
uacaacuaucugaccuuugacaaaccugacaaaaacaagcaauggggaaaggauucccuauuua

SEQ ID NO: 178036 - RNA, 64 nt, hsa
aucuaugcuggacucacagccaaauuaauacugaacaagcaaaagcuggaagcauuccccuuga

SEQ ID NO: 178037 - RNA, 64 nt, hsa
uauaccuacaaccaugugauccucaacaaaacugacaagcaaugaaguaagaacuucauucaau

SEQ ID NO: 178038 - RNA, 64 nt, hsa
ucccuggaucuuccccccacuccucacaccucacaugucccaggagcugccuucauucaggcgg

SEQ ID NO: 178039 - RNA, 64 nt, hsa
agccaugcugguggccuucugaaucacugcauggaugucccaggaggcagcucuccccacacag

SEQ ID NO: 178040 - RNA, 64 nt, hsa
ucucucuucuagugucuaucuuuaucauaaccugaugucccaaacuugugacaaguucuuuugg

SEQ ID NO: 178041 - RNA, 64 nt, hsa
aacugggaaaucuuacaaggaguugaaaagauuaaugucccaaccugaugagauuacggccuug

SEQ ID NO: 178042 - RNA, 64 nt, hsa
uggcaggggacacaguuguccuugugucugaaccaugucccagcacgggaauucuagacauacg

SEQ ID NO: 178043 - RNA, 64 nt, hsa
accaucccaggaggccugugcacacaucccaggcaugucccagacacaucccacacguguccgu

SEQ ID NO: 178044 - RNA, 64 nt, hsa
gguggaaugagaugcuccuuggcacuauagccugaugucccacauugacccacugaccacacag

SEQ ID NO: 178045 - RNA, 64 nt, hsa
uaguaacagcaugcuacacugcucgagguacgguaugucccaucgcccugugcaccguagagac

SEQ ID NO: 178046 - RNA, 64 nt, hsa
uuuuuaagguacugaaaagaaaugaaguugauguaugucccaaguuuugaugaaacuguauuug

SEQ ID NO: 178047 - RNA, 64 nt, hsa
guccagauaccauuucuccuaguauuucuuuguuaugucccagaacugauguuuuuuuuuuaag

SEQ ID NO: 178048 - RNA, 62 nt, hsa
ucccggccgggcgcgguggcucacgccuguaaucccagcacuuugggaggccgaggcgggca

SEQ ID NO: 178049 - RNA, 62 nt, hsa
ugccagccaggcgugguggaucacgccuguaaucccagcacucugggaggccaaagcgggca

SEQ ID NO: 178050 - RNA, 62 nt, hsa
ggcaggccaggugcaguggcucaugccuguaaucccagcauuuugguaggccgaggagggca

SEQ ID NO: 178051 - RNA, 62 nt, hsa
acauggccaggcgcgguggcucacacccguaaucccagcacuuugcggggccgaggcagggg

SEQ ID NO: 178052 - RNA, 62 nt, hsa
gccaggccgagcguguuggcucacgcuuguaaucccagcacuuugggaggccgaggcgggug

SEQ ID NO: 178053 - RNA, 62 nt, hsa
gauuggccaggcgcaguggcucacgccuguaaucccagcacugggaggccgaggggggcgga

SEQ ID NO: 178054 - RNA, 62 nt, hsa
ggcaggcugggcgcgguggcucacgccuguaaucccagcacuuugggaggccaaggugggcg

SEQ ID NO: 178055 - RNA, 62 nt, hsa
cuaacagaggaaacaaaugguccagcagucguucccagcagaacagcggagccuggacugac

SEQ ID NO: 178056 - RNA, 62 nt, hsa
ugggggcccagcagagccugcucccacccuccucccagcagcagacacccacccucucacug

SEQ ID NO: 178057 - RNA, 62 nt, hsa
uuuaggcugggcaugguggcucacaccuguaaucccagcacuuugagaggccgaggugagac

SEQ ID NO: 178058 - RNA, 62 nt, hsa
cgaggcugggcgcaguggccucaugccuauaaucccagcacuuuggaaggcugaggcagaag

SEQ ID NO: 178059 - RNA, 62 nt, hsa
ccaguaguuaaaaaucaacucauugccuguaaucccagcacuuugggaggccgagacgggug

SEQ ID NO: 178060 - RNA, 62 nt, hsa
guuucaaucuucugcauauggcuagccaguaaucccagcaccauuuauuaaauggggacuuc

SEQ ID NO: 178061 - RNA, 62 nt, hsa
gaaaucugcccgggcacaccucaugccuguaaucccagcacucugggaggccaaggcagaug

SEQ ID NO: 178062 - RNA, 62 nt, hsa
uuucauccgggcgcaguggcucacaccuguaaucccagcacuuugggaggccgaggugggca

SEQ ID NO: 178063 - RNA, 62 nt, hsa
uuuaaaauuagccugguggcucacgccuguaaucccagcacuuugggaggccgagguggcca

SEQ ID NO: 178064 - RNA, 62 nt, hsa
auuaggccgggcaugguggcucacgccuguaaucccagcacuuugggaggcccaggugggcg

SEQ ID NO: 178065 - RNA, 62 nt, hsa
cucgggccaggcgcuguggcucacaccuauaaucccagcacuuuaggaggccgaggcaggcg

SEQ ID NO: 178066 - RNA, 50 nt, hsa
gcuguggcucacgccuauaaucccagcacuuugggaggccaaggcaggcg

SEQ ID NO: 178067 - RNA, 62 nt, hsa
augcucuggggaggcggcucuggcucuugccuucccagcaugcccuuuacuacaaagggcua

SEQ ID NO: 178068 - RNA, 62 nt, hsa
augcucuagagaggcggcucuggugccccuccucccagcaugcucuggggaggcggcucugg

SEQ ID NO: 178069 - RNA, 62 nt, hsa
acgcucuggggaggcggcucuggugcccauccucccagcaugcucuagagaggcggcucugg

SEQ ID NO: 178070 - RNA, 62 nt, hsa
augcucuagagaggcggcucuggugcccauccucccagcacgcucuggggaggcggcucugg

SEQ ID NO: 178071 - RNA, 62 nt, hsa
gugcaguccuuggagauguacugguguccgucucccagcaugcucuagagaggcggcucugg

SEQ ID NO: 178072 - RNA, 62 nt, hsa
gggaggaaggggaaagggcugggccucaccgcucccagcaacugaaaggacaacacuaucug

SEQ ID NO: 178073 - RNA, 62 nt, hsa
gcccacuccugcgcuuuucaucgccauuccauucccagcagcuuuggagaccuccaggauua

SEQ ID NO: 178074 - RNA, 62 nt, hsa
ccugagccagccgugguggcucacaccuguaaucccagcacuuugggaggcugaggcaggug

SEQ ID NO: 178075 - RNA, 62 nt, hsa
uuuuggccgggcaugguggcucaugccuguaaucccagcacuuggggaggccaaggcaggcg

SEQ ID NO: 178076 - RNA, 62 nt, hsa
acacacuugucugugcuaugauguaugcaggaucccagcauugauacccaaugacaaacuau

SEQ ID NO: 178077 - RNA, 62 nt, hsa
caaaccgugccuucuggcucugcgccccauauucccagcaucauagacauccaacagcacca

SEQ ID NO: 178078 - RNA, 62 nt, hsa
gaccuagccagcgcaguggcucaugccuguaaucccagcacuuugggaggcugaggcgggcg

SEQ ID NO: 178079 - RNA, 62 nt, hsa
cgugggcugggcaugguggcucaugccuguaaucccagcacucugggaggcugaggugggcg

SEQ ID NO: 178080 - RNA, 62 nt, hsa
ucagcaggaggcugccggaacaacagcggcuuucccagcaaccccaaauucuggcugcgggu

SEQ ID NO: 178081 - RNA, 62 nt, hsa
ucaggugacuggagcccgagggccugacagguucccagcagcugggccggccagccuugcac

SEQ ID NO: 178082 - RNA, 62 nt, hsa
cuuuggcugggcaugguggcucacgccuguaaucccagcacuuugggaggccauggcgggug

SEQ ID NO: 178083 - RNA, 62 nt, hsa
gacuggcugggugcgguggcucacgcuuguaaucccagcacuuugggaggcugaggcaggcg

SEQ ID NO: 178084 - RNA, 62 nt, hsa
ugaaauggaagucagaagugagugaccuguuuucccagcaacucacccucuuccaucuccaa

SEQ ID NO: 178085 - RNA, 62 nt, hsa
ucguggccgggcgcaguggcucacgccuguaaucccagcacuuugggaggccgaggugggug

SEQ ID NO: 178086 - RNA, 62 nt, hsa
uaagggcugggggugguggcucaugccuguaaucccagcacuuugggaggccgaggcgggcg

SEQ ID NO: 178087 - RNA, 62 nt, hsa
aauaggccaggcgcaguggcucacaccuguaaucccagcacguugggaggccaaggcgggca

SEQ ID NO: 178088 - RNA, 62 nt, hsa
auaaggccagguguggugacucacacuuguaaucccagcaauuugggaggcugagacaggag

SEQ ID NO: 178089 - RNA, 62 nt, hsa
aauaaauaaucgacucaaaaauaagucaugugucccagcauaaggcaucagguuguuagaug

SEQ ID NO: 178090 - RNA, 62 nt, hsa
agagggccgggcgcggugacucacgccuauaaucccagcacuuugggaggccgagaugggug

SEQ ID NO: 178091 - RNA, 62 nt, hsa
cuuuggccgggcacgguggcucacaccuauaaucccagcacuaugggaggcugaggcaagca

SEQ ID NO: 178092 - RNA, 62 nt, hsa
aaggggccgggugugguggcucacaccuguaaucccagcacuuugggaggccgaagugggug

SEQ ID NO: 178093 - RNA, 62 nt, hsa
uucuaggccggugcgguggcucaugccuguaaucccagcacuguaggcggccgaggugggug

SEQ ID NO: 178094 - RNA, 62 nt, hsa
uuugggccaggugcgguggcucaugccuguaaucccagcacuaugggaggccagggagggag

SEQ ID NO: 178095 - RNA, 62 nt, hsa
uugauuggauugacuuuuuugcauuaaauuuuucccagcaaaauaaaucauauggcgaguca

SEQ ID NO: 178096 - RNA, 62 nt, hsa
uccaggccaggugugguggcucaugccuguaaucccagcacuuugagaggccgaggugggca

SEQ ID NO: 178097 - RNA, 62 nt, hsa
uguaggcugagcgcgguggcucacgccuguaaucccagcacuuugggaggccaaggugggug

SEQ ID NO: 178098 - RNA, 62 nt, hsa
agagggccaggugugguggcucacgccugugaucccagcacuuugggaggccaagacgggcg

SEQ ID NO: 178099 - RNA, 62 nt, hsa
acauaugccggcgcaguggcucauguguguaaucccagcacucugggaggcugagacaggua

SEQ ID NO: 178100 - RNA, 62 nt, hsa
aauuagccgggcgcgguggcucacaccuguaaucccagcacuuugggagguggaggcgggug

SEQ ID NO: 178101 - RNA, 62 nt, hsa
ugcuucugggcccagcuaaggaagccaucuguucccagcagaggagagcugcugcgcugacc

SEQ ID NO: 178102 - RNA, 62 nt, hsa
gagcugcugcgcugaccugcagagguugguggucccagcacagagcugugcccaugggcuug

SEQ ID NO: 178103 - RNA, 62 nt, hsa
ugguggccgggcgcgguggcucaaaccuguaaucccagcacuuugggaggccgaggugggug

SEQ ID NO: 178104 - RNA, 62 nt, hsa
gauuggccaggugcaguggcucacaccuguaaucccagcacuuugggaggccaaagugggug

SEQ ID NO: 178105 - RNA, 62 nt, hsa
aauuagcuuggcgugguggugggcgccuguagucccagcagcuugggaggcugaggcuggag

SEQ ID NO: 178106 - RNA, 62 nt, hsa
uuuaguccaggcacaguggcucacgccuguaaucccagcacuuugggaggccgaggugggug

SEQ ID NO: 178107 - RNA, 62 nt, hsa
caucucaggccacucauuaccuucgcucaugaucccagcagccauuuuucuuaacaccuucu

SEQ ID NO: 178108 - RNA, 62 nt, hsa
aacuccugcacaaguuuuaacugaacaagaaaucccagcaaaaggcauuuuuuuuucuacuu

SEQ ID NO: 178109 - RNA, 62 nt, hsa
aagcggccgggcacgguggcucaugccuguaaucccagcacuuuggggggcugaggugggcg

SEQ ID NO: 178110 - RNA, 62 nt, hsa
cuauggucuugauacauccucaaacuuucccuucccagcacagaggaauauuggcuggcaug

SEQ ID NO: 178111 - RNA, 62 nt, hsa
auuuuuauagaaucauucauauggaacugaguucccagcaucaucuuauucugaauagcauu

SEQ ID NO: 178112 - RNA, 62 nt, hsa
uugugacuucucugauaaagcgucugaucuaaucccagcacuucuguaaccuucagcauuuc

SEQ ID NO: 178113 - RNA, 62 nt, hsa
agagucaaagggcuugcuugccccagcagaguucccagcagacagccauggcucuucccagc

SEQ ID NO: 178114 - RNA, 62 nt, hsa
cagcagaguucccagcagacagccauggcucuucccagcagccugugcaaauucugaugaug

SEQ ID NO: 178115 - RNA, 62 nt, hsa
uccaugaagaccacauccacacacgcaggaacucccagcaacacaagcuggaagcacauguu

SEQ ID NO: 178116 - RNA, 62 nt, hsa
guuuggccgggugcgguggcucacgccuguaaucccagcacuuugggaggccaagguggggg

SEQ ID NO: 178117 - RNA, 62 nt, hsa
auauggccgagcgugauggcucaccccuguaaucccagcacuuugugaggccaaggugggcg

SEQ ID NO: 178118 - RNA, 62 nt, hsa
acagggcugggcacgguggcucacgccuguaaucccagcacuuugggagguugcggguggau

SEQ ID NO: 178119 - RNA, 62 nt, hsa
aguuagcugggugugguggcucaugccuguaaucccagcacuuugggggccaaggagggugg

SEQ ID NO: 178120 - RNA, 62 nt, hsa
uaauagccaggcaugguggcucaugccuguaaucccagcacuuugggaggcugaggcgggcg

SEQ ID NO: 178121 - RNA, 62 nt, hsa; identical to SEQ ID NO: 178114

SEQ ID NO: 178122 - RNA, 62 nt, hsa; identical to SEQ ID NO: 178113

SEQ ID NO: 178123 - RNA, 62 nt, hsa
aagaggccagacauggugucucacacguuuaaucccagcacuuugggaggcaggggcgggug

SEQ ID NO: 178124 - RNA, 62 nt, hsa
ggguggccgggcacaguggcucacgccuguaaucccagcacuuugagaggcugaggugguag

SEQ ID NO: 178125 - RNA, 62 nt, hsa
gccuggcugggcgugguggcucacgccuguaaucccagcacuuugggaggccgaggcaggcg

SEQ ID NO: 178126 - RNA, 62 nt, hsa
ucuagcccaggagcgguggcucacacuuguaaucccagcacuuugggaugcuaaggcaggcg

SEQ ID NO: 178127 - RNA, 62 nt, hsa
ucuaggcggggcgugguggcucacacuuguaaucccagcacuuugggaggccaaggugggcg

SEQ ID NO: 178128 - RNA, 62 nt, hsa
aagcugggugggguggcucacacccgacguaaucccagcacguugggaggccgaggcaggug

SEQ ID NO: 178129 - RNA, 62 nt, hsa
uucaggccaggcacggugacucacgccuguaaucccagcacuuugggaggccgaggcgggug

SEQ ID NO: 178130 - RNA, 62 nt, hsa
ccgcccacauccuccuuccccaggaccugagcucccagcaucugcagacgacccccgcagcc

SEQ ID NO: 178131 - RNA, 62 nt, hsa
gaccaaaggccgcccccgccugcugggguuccucccagcaccccagcuugcuggcugcccuc

SEQ ID NO: 178132 - RNA, 62 nt, hsa
gguugcugcucuggccagggaggcagccccacucccagcaagcagaagugauccucgagggu

SEQ ID NO: 178133 - RNA, 62 nt, hsa
cugaaaacagaggggagggaggaaggaaggagucccagcaggagcacagcccugguuuccug

SEQ ID NO: 178134 - RNA, 62 nt, hsa
agaccuucagcaguugaggcuggggcuaguggucccagcagcccagcccccacccuccuggc

SEQ ID NO: 178135 - RNA, 62 nt, hsa
cuaccucccagggcaugcagucuggaagggggucccagcaguggagugccgggacccucaga

SEQ ID NO: 178136 - RNA, 62 nt, hsa
caaaaucauucauaguuccauucacugugcuaucccagcaucucaguccuuccuccaugcag

SEQ ID NO: 178137 - RNA, 62 nt, hsa
uuugggucggaugcaggggcucacaccgguaaucccagcacuuugagaggcugaggcgggaa

SEQ ID NO: 178138 - RNA, 62 nt, hsa
guauggcuggacgcgguggcucacgccuguaaucccagcacuuugggaggcugaggcgggug

SEQ ID NO: 178139 - RNA, 62 nt, hsa
uucaggccagucgugguggcucaugccuguaaucccagcacuuugcaaggccgaggagggug

SEQ ID NO: 178140 - RNA, 62 nt, hsa
ucacucuucaaacucccaaacacaugacuucuucccagcagcccuucccggccucuaaaguu

SEQ ID NO: 178141 - RNA, 62 nt, hsa
cccagcagcccuucccggccucuaaaguuuggucccagcagcccuucccagccucuaaaguu

SEQ ID NO: 178142 - RNA, 62 nt, hsa
gcacccagcaugugaccccacuccugaucaggucccagcaucuucccuucuuguucuguucc

SEQ ID NO: 178143 - RNA, 62 nt, hsa
agcaucuucccuucuuguucuguuccuuaaggucccagcaccuuaccccaggacuuggucuu

SEQ ID NO: 178144 - RNA, 62 nt, hsa
ucuguuaaaugagagaauagaguaugguugauucccagcauucagugguccugucaagcaac

SEQ ID NO: 178145 - RNA, 62 nt, hsa
ccuuggccuggcgcgguggcucacaccuguaaucccagcacuuuuggaggccaaggugggug

SEQ ID NO: 178146 - RNA, 62 nt, hsa
ccagggccggacacaguggcccaugccuguaaucccagcacuuuggggggccaaggcaggcu

SEQ ID NO: 178147 - RNA, 62 nt, hsa
gaaaucucagcaugagcugcuauagaauacccucccagcaacaaaaccuaaucaguaaggcc

SEQ ID NO: 178148 - RNA, 62 nt, hsa
uaggugccgucucuagucugugagggaggaacucccagcauccccauugcccacaaauggaa

SEQ ID NO: 178149 - RNA, 62 nt, hsa
gugguggcauuggccgagggucuucgggugcuucccagcacaagcugcccuugcuguccugu

SEQ ID NO: 178150 - RNA, 62 nt, hsa
ccugggugggggacacucagagugggagcacaucccagcagugcccauguagcaggagcaca

SEQ ID NO: 178151 - RNA, 62 nt, hsa
ccaccuccugcacugcacuucugccguccacaucccagcacacuggcgaccugacuagcagc

SEQ ID NO: 178152 - RNA, 62 nt, hsa
agucccuccacugugaacaagcuuuugcagcuucccagcacgaccauugaaaauaucucugu

SEQ ID NO: 178153 - RNA, 62 nt, hsa
gccaguagugccuucaucaguuaagggaggugucccagcacagaucauucucaaaagcgagc

SEQ ID NO: 178154 - RNA, 62 nt, hsa
cuucucuucugccaacuaacgugcucgcgcccucccagcacguggagagcuucaauugucag

SEQ ID NO: 178155 - RNA, 62 nt, hsa
cugagcucuccugcaggguggagggcauuguuucccagcacccaggcagugucuugcuggug

SEQ ID NO: 178156 - RNA, 62 nt, hsa
aggccaggaugugcagucuccacauaguggcuucccagcaacaacuuuugacuuagaugggg

SEQ ID NO: 178157 - RNA, 62 nt, hsa
uuaaggccgggugggguggcacaugccuguaaucccagcacuuugggaggccaaggcuggug

SEQ ID NO: 178158 - RNA, 62 nt, hsa
ugauggcugggugcaguggcucacgccuguaaucccagcacuuugggaggcuuaggcggcug

SEQ ID NO: 178159 - RNA, 62 nt, hsa
ggcagaguagccaggguguggcccugccaucuucccagcagggccacucccggcacuccaug

SEQ ID NO: 178160 - RNA, 62 nt, hsa
uuccuuuuugguacuuauuacugcuaaguauuucccagcacaugaaaccuuauuuuuuccca

SEQ ID NO: 178161 - RNA, 62 nt, hsa
auagggcugggcgcgguugcucacgccuguaaucccagcacuuuucagaggccaaggcgggc

SEQ ID NO: 178162 - RNA, 62 nt, hsa
uuuuggcauggugccauggcucacaucuguaaucccagcacuuuuggaggcugaggcgggug

SEQ ID NO: 178163 - RNA, 62 nt, hsa
cacagaaggagacccagacaucccgaggaaguucccagcagagcaaacugcuuuccagccug

SEQ ID NO: 178164 - RNA, 62 nt, hsa
gggugaggcucccaaccuggcaguccccagccucccagcaucugugagcgucuguuggacuu

SEQ ID NO: 178165 - RNA, 62 nt, hsa
accauaaugcagagugggcccccuacuccauuucccagcaaaaggcuccagcuggagggaug

SEQ ID NO: 178166 - RNA, 62 nt, hsa
uuaccugucaauaacaaugguggccaccugggucccagcacuuggcugguggagagauuuuu

SEQ ID NO: 178167 - RNA, 62 nt, hsa
gauaggccgggcaugguggcucaugccuguaaucccagcacuuugggaggccaggaguucga

SEQ ID NO: 178168 - RNA, 62 nt, hsa
gucaggcugggcgcaguggcucacgccuguaaucccagcacuuugggagggauaggugggcg

SEQ ID NO: 178169 - RNA, 62 nt, hsa
uggggaggaaccauaaacccagcccucacagcucccagcacagggccucccugagccagugg

SEQ ID NO: 178170 - RNA, 62 nt, hsa
ucugggccaggcaagauggcucacgccugugaucccagcauuuugggaggccgaggcgggug

SEQ ID NO: 178171 - RNA, 62 nt, hsa
uugcuuauguuuuuccuuuuuaucuucucucaucccagcauacugaguuauuuauuaauuag

SEQ ID NO: 178172 - RNA, 62 nt, hsa
gccccucagucaugcugccuucugcugcucccucccagcaggauucacccucucauucccgg

SEQ ID NO: 178173 - RNA, 62 nt, hsa
ucucuucuaauuuucaguauaaccaaaaauuaucccagcaugagcacgggcacgugcccuuc

SEQ ID NO: 178174 - RNA, 62 nt, hsa
auugggccaggcacgguggcucacgccuguaaucccagcacuuugggaggccaaggccagcg

SEQ ID NO: 178175 - RNA, 62 nt, hsa
auaugguuauauauaugggaugguuugguuggucccagcaaaguauaugaaaauuaaaguuc

SEQ ID NO: 178176 - RNA, 62 nt, hsa
cagcagucaggcacgguggcucaugccuguaaucccagcacuuugggaggcugaggcaggcg

SEQ ID NO: 178177 - RNA, 62 nt, hsa
uguuggccaggcaugguggcucaugccuguaaucccagcauuuugggaggccaaggcgggcg

SEQ ID NO: 178178 - RNA, 62 nt, hsa
uaaggccaggagcaguggcucacaccuuguaaucccagcacuuugggaggccaaggugggcg

SEQ ID NO: 178179 - RNA, 62 nt, hsa
auauggccaggcgggauggcucacgccuguaaucccagcacuuugggaggcugaggcgggca

SEQ ID NO: 178180 - RNA, 62 nt, hsa
aauuagccgggcgugguggcuuacgccuguaaucccagcacuuugggaggccaaggugggcg

SEQ ID NO: 178181 - RNA, 62 nt, hsa
aacuugccgggugcgguggcucaccccuguaaucccagcacuuugggaggccaaagcaggcg

SEQ ID NO: 178182 - RNA, 62 nt, hsa
aauuagccagggguggugguaugcaccugcagucccagcaacaugggaggcugaacaggaga

SEQ ID NO: 178183 - RNA, 62 nt, hsa
ugagaacuuggcucagggcuccugaggaccuuucccagcauuaccuucccuucccuugaaag

SEQ ID NO: 178184 - RNA, 62 nt, hsa
uaaaggccaggugcaguggcccaugccuguaaucccagcacuuugggaggugggacaauugc

SEQ ID NO: 178185 - RNA, 62 nt, hsa
cacaggccgggucugguggcucaugccuguaaucccagcacuuugagaggccugaggucggc

SEQ ID NO: 178186 - RNA, 62 nt, hsa
uugucaacacagaauucaagccucauuugcuaucccagcaucucuuaaaacuuuguagucuu

SEQ ID NO: 178187 - RNA, 62 nt, hsa
ggggggccaggugcaguggcucacgccuguaaucccagcaguuugggaggccaaggcaagug

SEQ ID NO: 178188 - RNA, 62 nt, hsa
ccuuaucagaaaccaagcuuaugaagaucuucucccagcagguccauagcaguaggcuuagg

SEQ ID NO: 178189 - RNA, 62 nt, hsa
uauuugggcuggguauggagguucacugguaaucccagcacuuugggaggcccaggcagaag

SEQ ID NO: 178190 - RNA, 62 nt, hsa
uuuuggcuaggcgugauggcucaggucuguaaucccagcacuuucgguggccggggugggug

SEQ ID NO: 178191 - RNA, 62 nt, hsa
ucugucgcccaggcuggggugcaguggcgcgaucccagcacugcagccucaaccuccugggc

SEQ ID NO: 178192 - RNA, 62 nt, hsa
ccucugcccugucccugcacaccuccacugccucccagcagaucuguggagacaaaacaagc

SEQ ID NO: 178193 - RNA, 62 nt, hsa
aucccagcaccccagccacaggcuguggcugcucccagcagaggcggggccggcagagaagg

SEQ ID NO: 178194 - RNA, 62 nt, hsa
uuguacguuucucuuugaugaccaggaagaaaucccagcaccccagccacaggcuguggcug

SEQ ID NO: 178195 - RNA, 62 nt, hsa
ucuaggcugggugugguggcucacgccuauaaucccagcacuuugggaggcugaggugggug

SEQ ID NO: 178196 - RNA, 62 nt, hsa
cacuggccaggcgagguggcucacaccuguaaucccagcacuuugggaggccaaggcgggug

SEQ ID NO: 178197 - RNA, 62 nt, hsa
gaaauagcaguucagagagaggaagcucucugucccagcaccgagacucacuccuaagucuu

SEQ ID NO: 178198 - RNA, 62 nt, hsa
aagauggaagccuaaagcccaagucgagcagcucccagcacugcugugcagaccuagagguc

SEQ ID NO: 178199 - RNA, 62 nt, hsa
aaagaauuccccaggagaaaauggaaacacuaucccagcaaucugaauuccuuacuugggga

SEQ ID NO: 178200 - RNA, 62 nt, hsa
auugggcugagugugguggcucaugccuguaaucccagcacuuugggaggcugagacaggcg

SEQ ID NO: 178201 - RNA, 62 nt, hsa
aauuaaccaugcguggugguacacgucugucaucccagcagcucuuaaggcugaggcacaag

SEQ ID NO: 178202 - RNA, 62 nt, hsa
aagaggccgggugcgguggcucaagccuguaaucccagcacuuugggaggccgaggcaggca

SEQ ID NO: 178203 - RNA, 62 nt, hsa
ugcuggccagguaugguggcucacgccuguaaucccagcacuuugggaggcuaaggugggcg

SEQ ID NO: 178204 - RNA, 62 nt, hsa
auuuggccaagccugauggcucgugccuguacucccagcacuuugggaggcugaggugggag

SEQ ID NO: 178205 - RNA, 62 nt, hsa
ccuuggccaggugcaguggcucacgccuguaaucccagcacuuugggaggcugaggcaggcg

SEQ ID NO: 178206 - RNA, 62 nt, hsa
agcaaagaagagaagugacuuuuccuggccucucccagcaugcccugggcugagaugagaug

SEQ ID NO: 178207 - RNA, 62 nt, hsa
agacgggccggcacgguggcucacgccuguaaucccagcacugagaggccgaucacuugagg

SEQ ID NO: 178208 - RNA, 62 nt, hsa
gaugggccaggugcgguggcucacaccuguaaucccagcauuuugggaggccaaggugggug

SEQ ID NO: 178209 - RNA, 62 nt, hsa
uagcagccaggugcaguggcucacgccuguaaucccagcacuuuaggaggccgaggcuggca

SEQ ID NO: 178210 - RNA, 62 nt, hsa
cagcuucaucaaaacagaagaaaaaggcuaagucccagcaauacaaaggacauaagaaaagu

SEQ ID NO: 178211 - RNA, 62 nt, hsa
gcuuucuggcugcucuucauugaccuguguguucccagcacacgaacagugccccuaacgga

SEQ ID NO: 178212 - RNA, 62 nt, hsa
gggagagaaucaagcuccuguggccaccugugucccagcagcagugaguggagcugcucagg

SEQ ID NO: 178213 - RNA, 62 nt, hsa
cuuagaaacagaauuccuaaggggauugacucucccagcauguucccagguccugcacccuu

SEQ ID NO: 178214 - RNA, 62 nt, hsa
uggcggccgggugcaguggcucacgccuguaaucccagcacuucgggaggccgaggcgggug

SEQ ID NO: 178215 - RNA, 62 nt, hsa
gugaggccgggcgcaguggcucacgccuguaaucccagcacuuugggaggccgaggcgggug

SEQ ID NO: 178216 - RNA, 62 nt, hsa
uuuggccagacacaggugccucacgccuguaaucccagcacuuugggaggcugagcuggauc

SEQ ID NO: 178217 - RNA, 62 nt, hsa
ccuuggcugggcaugguggcucacgccuguaaucccagcacuuugggaggccgaggucagga

SEQ ID NO: 178218 - RNA, 62 nt, hsa
uuagggccgagugcgguggcucacgccuauaaucccagcacuuugggaggccgaggcgggcg

SEQ ID NO: 178219 - RNA, 62 nt, hsa
uugucuggcaaacaggagaugcuggauuucaaucccagcagggccucacuaguugagguauu

SEQ ID NO: 178220 - RNA, 62 nt, hsa
cucuggcugggugugguggcucacaccuguaaucccagcacuuugggaggcugaggcaggag

SEQ ID NO: 178221 - RNA, 62 nt, hsa
gagaggccaggccugguggcucacgccuguaaucccagcacuuuaagaggccaaggcggaug

SEQ ID NO: 178222 - RNA, 62 nt, hsa
gagauagugggugugguggcucacaccugcaaucccagcacuuuggaaggccgaggugggca

SEQ ID NO: 178223 - RNA, 62 nt, hsa
aaugggccaggugaaguggcucacaccuguaaucccagcacuguggaaagacaggaguucga

SEQ ID NO: 178224 - RNA, 62 nt, hsa
ugcgggccaggcacaguggcucacaccuguaaucccagcacuaugggaggcccaggugagca

SEQ ID NO: 178225 - RNA, 62 nt, hsa
ugaauuguuuauuugcagugaugcuucauauuucccagcacuguucaugguaucuuauuucc

SEQ ID NO: 178226 - RNA, 62 nt, hsa
uauaggcugggugcgguggcucaugccuguaaucccagcacuuugggaggccaaggcaggug

SEQ ID NO: 178227 - RNA, 62 nt, hsa
auggagccgggugcaguugccaacacuuguaaucccagcaguuugcgaggccgaggcaggug

SEQ ID NO: 178228 - RNA, 62 nt, hsa
aggugagugggcaugguggcucaugccuguaaucccagcacuuuggaaggcugaggugggug

SEQ ID NO: 178229 - RNA, 62 nt, hsa
caggggccgggcacggugccucacaccuguaaucccagcacuuagguaggccaaggugggug

SEQ ID NO: 178230 - RNA, 62 nt, hsa
aauuagccaggcgugguggugggcaccuguagucccagcaacucgggaggcugaggcaggag

SEQ ID NO: 178231 - RNA, 62 nt, hsa
cuuuggccgggugcgggggcucacgccuguaaucccagcacuuugggaggcccaggugggcg

SEQ ID NO: 178232 - RNA, 62 nt, hsa
aaguggccaggugcgguggcucaugccuguaaucccagcacuuugggaggccauggcaggug

SEQ ID NO: 178233 - RNA, 62 nt, hsa
aauuuggccuggcacaggggucacaccuguaaucccagcacuuugggaggacaaggugggug

SEQ ID NO: 178234 - RNA, 62 nt, hsa
aauuagccaggcgcauuggcucaugucuguaaucccagcacuuugggaggucgggggggugg

SEQ ID NO: 178235 - RNA, 62 nt, hsa
gguuggccaggcacggugguucaugccuguaaucccagcacuaugggaggccgagacgggcg

SEQ ID NO: 178236 - RNA, 62 nt, hsa
aauagaccaggugcucuggcucaugccuguaaucccagcacuuugggaggccaaggugggca

SEQ ID NO: 178237 - RNA, 62 nt, hsa
cacaggacaggugugguggcucacaccuguaaucccagcacuuugggaggccgaggcaagag

SEQ ID NO: 178238 - RNA, 62 nt, hsa
auugggccaggcguggugucucacaccuguaaucccagcacuuugagaggccaagacaggua

SEQ ID NO: 178239 - RNA, 62 nt, hsa
ucuuugcugggcauggugacucacgccuguaaucccagcacuuuggaagggugaggugggug

SEQ ID NO: 178240 - RNA, 62 nt, hsa
ucucggcugggcgcgguggcgcaugccuguaaucccagcacuuugggaggccaaggugggug

SEQ ID NO: 178241 - RNA, 62 nt, hsa
aucagggcugggcacagcgguuccgccuguaaucccagcacuuugggagguccaggcaggug

SEQ ID NO: 178242 - RNA, 62 nt, hsa
uucuggccgggcgugguggcucaagccuguaaucccagcacuuugggaggccgaggugggcg

SEQ ID NO: 178243 - RNA, 62 nt, hsa
uuugggccaggcacagucgcucauacuuguaaucccagcacuuugggaggccgaggcgggug

SEQ ID NO: 178244 - RNA, 62 nt, hsa
aucaggcuaggcacaguggcucacacauggaaucccagcacuuugggaggccgaggugggag

SEQ ID NO: 178245 - RNA, 62 nt, hsa
uccccagcacugaguccccccuccuuugugugucccagcacccuuggccugaguaaacuugg

SEQ ID NO: 178246 - RNA, 62 nt, hsa
gagaggccgggcacgguggcucacgccuguaaucccagcacuuugggaggcugagacaggca

SEQ ID NO: 178247 - RNA, 62 nt, hsa
accuggccaggcaugguggcucacgccuguaaucccagcacuuugggaggccgaggcaggug

SEQ ID NO: 178248 - RNA, 62 nt, hsa
ucugagcuggaugcaguggcuuguuccuauagucccagcacuuugggaggcugaggugggug

SEQ ID NO: 178249 - RNA, 62 nt, hsa
ucuaggcuaggugcaguggcuuguuccuguagucccagcacucugggaaccuggguugggag

SEQ ID NO: 178250 - RNA, 62 nt, hsa
aguuuaccuggcagagugugucaugccugcaaucccagcacuuugggaggccaaggcaggca

SEQ ID NO: 178251 - RNA, 64 nt, hsa
ggaaucuccuccauuauuacccaggcuuugcuuuaaguugcacuuuaaaucacacuguccuauu

SEQ ID NO: 178252 - RNA, 64 nt, hsa
cacauagugguacugcauagucccacuauaagucaaguugcaguuuaagguggucucagccaau

SEQ ID NO: 178253 - RNA, 64 nt, hsa
aguauaaaaauguacuaacaaagacuaauucaagaaguugcaggauacacaauuuuuaaaaauc

SEQ ID NO: 178254 - RNA, 64 nt, hsa
uuauucauaagaaauugagaaaaggaacaaucagaaguugcaaaagaugguauagccgaauaua

SEQ ID NO: 178255 - RNA, 64 nt, hsa
aggguaagagagggcaagagugagcaagagauggaaguugcaaccucaagcucuuuuauaauga

SEQ ID NO: 178256 - RNA, 64 nt, hsa
cuguauaagaaugguguguuuggcuaauguuucuaaguugcacacaguuuauuaacaacugaac

SEQ ID NO: 178257 - RNA, 64 nt, hsa
aucgcaaccccucuccuuccaguauaaccagcugaaguugcagauguuagauauuuuucauaaa

SEQ ID NO: 178258 - RNA, 64 nt, hsa
accaagaauauccuuuaaaauuuaaaaggauggcaaguugcaucagaaagcuuuauuuugagau

SEQ ID NO: 178259 - RNA, 64 nt, hsa
caauuuuuauccaguacuuuauagauucaacucuaaguugcaagcgaagucaaaacugaugaaa

SEQ ID NO: 178260 - RNA, 64 nt, hsa
cccacaacaugugggaauuccagaagauaaauucaaguugcaauuucaguggggacauagccaa

SEQ ID NO: 178261 - RNA, 64 nt, hsa
ugcuuucuuugaguuuuaaauuauguauaaacauaaguugcauuuagaaaucaagcauaaauca

SEQ ID NO: 178262 - RNA, 64 nt, hsa
ccaccauguauucauccagaguucuuaaaguuuaaaguugcacaugauuguauaagcaugcuuu

SEQ ID NO: 178263 - RNA, 64 nt, hsa
cucacaauguaacugcuuuagucauauuaaccugaaguugcaguuuagacacauguuguugggg

SEQ ID NO: 178264 - RNA, 64 nt, hsa
uaaagacuauuuugaagauuugaauaaagugaugaaguugcauuacaccucacugcaaggauuc

SEQ ID NO: 178265 - RNA, 64 nt, hsa
ucagucacuauauucuguuuccuuuuuuuuuuucaaguugcauauuugguuuccccuuaugauu

SEQ ID NO: 178266 - RNA, 64 nt, hsa
uuugaccucauucuucauauaguagucuaggaaaaaguugcagguaauuuaaacugucuagugg

SEQ ID NO: 178267 - RNA, 64 nt, hsa
uaccucaguaaaaaccuucaggccacaaagcaaaaaguugcauagccacaacgaagaucuaguu

SEQ ID NO: 178268 - RNA, 64 nt, hsa
caacgaagaucuaguuggauauaguuuuugauuuaaguugcaguuauagccaauuuaggcuaau

SEQ ID NO: 178269 - RNA, 64 nt, hsa
ugaacauauauacuugccccucaggugagguuccaaguugcaacugaccuugaacugaaucacu

SEQ ID NO: 178270 - RNA, 64 nt, hsa
agaggucucuauuggauuucucaacaccugaagaaaguugcaguguuuuccucuuggacauugu

SEQ ID NO: 178271 - RNA, 64 nt, hsa
acuuuuuuuuuucugcaggucaguaaaaggauuuaaguugcacugacaaaaauaccaaaauaaa

SEQ ID NO: 178272 - RNA, 64 nt, hsa
aucagaaaacaacuuugucuuggggcacacuuggaaguugcauguuuucuuuccuucccuuauc

SEQ ID NO: 178273 - RNA, 64 nt, hsa; identical to SEQ ID NO: 161467

SEQ ID NO: 178274 - RNA, 64 nt, hsa; identical to SEQ ID NO: 161468

SEQ ID NO: 178275 - RNA, 64 nt, hsa; identical to SEQ ID NO: 161469

SEQ ID NO: 178276 - RNA, 64 nt, hsa; identical to SEQ ID NO: 161470

SEQ ID NO: 178277 - RNA, 64 nt, hsa; identical to SEQ ID NO: 161471

SEQ ID NO: 178278 - RNA, 64 nt, hsa; identical to SEQ ID NO: 161472

SEQ ID NO: 178279 - RNA, 64 nt, hsa; identical to SEQ ID NO: 161473

SEQ ID NO: 178280 - RNA, 64 nt, hsa; identical to SEQ ID NO: 161474

SEQ ID NO: 178281 - RNA, 64 nt, hsa; identical to SEQ ID NO: 161475

SEQ ID NO: 178282 - RNA, 64 nt, hsa; identical to SEQ ID NO: 161476

SEQ ID NO: 178283 - RNA, 64 nt, hsa; identical to SEQ ID NO: 161477

SEQ ID NO: 178284 - RNA, 64 nt, hsa; identical to SEQ ID NO: 161478

SEQ ID NO: 178285 - RNA, 64 nt, hsa; identical to SEQ ID NO: 161479

SEQ ID NO: 178286 - RNA, 64 nt, hsa; identical to SEQ ID NO: 161480

SEQ ID NO: 178287 - RNA, 64 nt, hsa; identical to SEQ ID NO: 161481

SEQ ID NO: 178288 - RNA, 64 nt, hsa; identical to SEQ ID NO: 161482

SEQ ID NO: 178289 - RNA, 64 nt, hsa; identical to SEQ ID NO: 161483

SEQ ID NO: 178290 - RNA, 64 nt, hsa; identical to SEQ ID NO: 161484

SEQ ID NO: 178291 - RNA, 64 nt, hsa; identical to SEQ ID NO: 161485

SEQ ID NO: 178292 - RNA, 64 nt, hsa; identical to SEQ ID NO: 161486

SEQ ID NO: 178293 - RNA, 64 nt, hsa; identical to SEQ ID NO: 161487

SEQ ID NO: 178294 - RNA, 64 nt, hsa; identical to SEQ ID NO: 161488

SEQ ID NO: 178295 - RNA, 64 nt, hsa; identical to SEQ ID NO: 161489

SEQ ID NO: 178296 - RNA, 64 nt, hsa; identical to SEQ ID NO: 161490

SEQ ID NO: 178297 - RNA, 64 nt, hsa; identical to SEQ ID NO: 161491

SEQ ID NO: 178298 - RNA, 64 nt, hsa; identical to SEQ ID NO: 161492

SEQ ID NO: 178299 - RNA, 64 nt, hsa; identical to SEQ ID NO: 161493

SEQ ID NO: 178300 - RNA, 64 nt, hsa; identical to SEQ ID NO: 161494

SEQ ID NO: 178301 - RNA, 64 nt, hsa; identical to SEQ ID NO: 161495

SEQ ID NO: 178302 - RNA, 64 nt, hsa; identical to SEQ ID NO: 161496

SEQ ID NO: 178303 - RNA, 64 nt, hsa; identical to SEQ ID NO: 161497

SEQ ID NO: 178304 - RNA, 64 nt, hsa
ggcagggcuacauccuggcucggugggaucugacgaccugaaaguccagcucccaaguuuuccu

SEQ ID NO: 178305 - RNA, 64 nt, hsa
guggaaucccuucauucugcagugagauugccgagaccugaagaggguaagugacuugcccaag

SEQ ID NO: 178306 - RNA, 64 nt, hsa
aaguggacagggaaggccucugacauuuauccaagaccugaaagaugggcaaaagacgggaagc

SEQ ID NO: 178307 - RNA, 64 nt, hsa
aggcuccgcggcaggaggagccggugcucuggaagaccugaaagaagcccagguggccacaggg

SEQ ID NO: 178308 - RNA, 64 nt, hsa
cggucagcaccagaagucaacugaguuaaggcaggaaaagaaauaagcccaaccaacuugccaa

SEQ ID NO: 178309 - RNA, 64 nt, hsa
acuuaaaugaauuuaaaaugagccaaaggacccugaaaagaagacauguugauuucccacuccu

SEQ ID NO: 178310 - RNA, 64 nt, hsa
gcauuucuuuuuaggcucugagacuaaaugagaggaaaagaaaagaaaaaaaaaaugauugucu

SEQ ID NO: 178311 - RNA, 64 nt, hsa
ucuuuuuaggcucugagacuaaaugagaggaaaagaaaagaaaaaaaaaaugauugucuaacca

SEQ ID NO: 178312 - RNA, 64 nt, hsa
ggugggaagagagccuggaaaagaaccaggccuggaaaagaaccagaaggaggcugggcagaac

SEQ ID NO: 178313 - RNA, 64 nt, hsa
uucugucauuguucaaaggugggaagagagccuggaaaagaaccaggccuggaaaagaaccaga

SEQ ID NO: 178314 - RNA, 64 nt, hsa
ccagcaguguuucugcaguggcugcagggagauggaaaagaagagcccugcuucccugccuccu

SEQ ID NO: 178315 - RNA, 64 nt, hsa
gcugaaaugucuccacgucucuuugugucuuguugaaaagaaacccaaaggaguguugugugga

SEQ ID NO: 178316 - RNA, 64 nt, hsa
cuaaaacacuucuacuagggccaaaaagagaaaagaaaagaaaauuucuacuaauuucagaccu

SEQ ID NO: 178317 - RNA, 64 nt, hsa
ggaagcuaaaacacuucuacuagggccaaaaagagaaaagaaaagaaaauuucuacuaauuuca

SEQ ID NO: 178318 - RNA, 64 nt, hsa
ggaagaagaucaaagaagaaaagaagaaggggaagaaaagaaggggaagaagaucaaaacccac

SEQ ID NO: 178319 - RNA, 64 nt, hsa
aggggaagaaaagaaggggaagaagaucaaagaagaaaagaagaaggggaagaaaagaagggga

SEQ ID NO: 178320 - RNA, 64 nt, hsa
uuauugcagaaauugaaaagaaggggaaggggaagaaaagaaggggaagaagaucaaagaagaa

SEQ ID NO: 178321 - RNA, 64 nt, hsa
acauguuggcuuuucucuugacgugggagaaauugaaaagaaggggaaggggaagaaaagaagg

SEQ ID NO: 178322 - RNA, 64 nt, hsa
aagagcaaaacuccagcucaaaaaaaaaaagaaagaaaagaaagcuggagcugguggcuuaggc

SEQ ID NO: 178323 - RNA, 64 nt, hsa
ugaagccaaaaggauuuaaaaccgcugcucuaaagaaaagaaaacuggaggcugggcgcagugg

SEQ ID NO: 178324 - RNA, 64 nt, hsa
uuucuauucaccauccuuuacuauuaagggaaaggaaaagaacacuagcuaaggaagggaaagg

SEQ ID NO: 178325 - RNA, 64 nt, hsa
aacuauuuuaaagcugacuuuguugccuuaucuugaaaagaaucuagauaggugcuuuuaacug

SEQ ID NO: 178326 - RNA, 64 nt, hsa
cucccugaaaaagagaaaaaaaaaaggaaaaaaagaaaagaaaagugaaaagaaaaacucuuau

SEQ ID NO: 178327 - RNA, 64 nt, hsa
gagaaaaaaaaaaggaaaaaaagaaaagaaaagugaaaagaaaaacucuuauuggccuaaguuc

SEQ ID NO: 178328 - RNA, 64 nt, hsa
auauagagaaaacugguaaagaacauuccaguaggaaaagaaaagaacaaucuuccauuucugg

SEQ ID NO: 178329 - RNA, 64 nt, hsa
gagaaaacugguaaagaacauuccaguaggaaaagaaaagaacaaucuuccauuucugggcuug

SEQ ID NO: 178330 - RNA, 64 nt, hsa
gugagaaaacuaaaacuacaugaguuucauguuagaaaagaauuuuuaaacaaucuucagaugg

SEQ ID NO: 178331 - RNA, 64 nt, hsa
aaauccccuugaugcuaccuuugaaauauaacuagaaaagaaugacuugccaccauauccacua

SEQ ID NO: 178332 - RNA, 64 nt, hsa
ucccucccgccuccagguccauccaucccguccggaaaagaaggacccagagggaagaaggaac

SEQ ID NO: 178333 - RNA, 64 nt, hsa
auguccgacauuauuuaauaaauaauuuuuaaaagaaaagaacgauaaaugaagccaacaugau

SEQ ID NO: 178334 - RNA, 64 nt, hsa
cccagcccucuugcaagaggagaggcacgguagggaaaagaacugcugggugggggccuguuuc

SEQ ID NO: 178335 - RNA, 64 nt, hsa
aguucuuugcagauuuggggcgaggggugauuuggaaaagaagaccuggguggaaagcgguuug

SEQ ID NO: 178336 - RNA, 64 nt, hsa
agaaagacggguguuuuauuuggucuaauacccugaaaagaagugaugacuuguugcuuuucaa

SEQ ID NO: 178337 - RNA, 64 nt, hsa
cgaguaaguagacaagaauaaagugguuugagaugaaaagaaccuaacauuauuuacaguagau

SEQ ID NO: 178338 - RNA, 64 nt, hsa
caggagcaagagaaagaagauaauuuaaccaugugaaaagaauuuuuuugugugugaauuauca

SEQ ID NO: 178339 - RNA, 64 nt, hsa
uuauuuaauaugcuuauaaccuaguuaaagaaaggaaaagaaaacaaaaaacgaaugaaaauaa

SEQ ID NO: 178340 - RNA, 64 nt, hsa
guggggggaugguaagagaaaagagagaaacacugaaaagaaggaaagaugguuaaacauuuuc

SEQ ID NO: 178341 - RNA, 64 nt, hsa
uuacuagaaaauaguucaguguaauauuaaguuagaaaagaaguugcugcccaguuaaaggggc

SEQ ID NO: 178342 - RNA, 64 nt, hsa
cuuaacggaaguuacaucaggcaaguaccaggaugaaaagaacuaugaaauaaaugaaggaagc

SEQ ID NO: 178343 - RNA, 64 nt, hsa
uuaguucacuauuauauaguggguuauauuaaaagaaaagaagaaaaauaucuaauuucucuug

SEQ ID NO: 178344 - RNA, 64 nt, hsa
uggucauauuugaaauguauaaguccauaaaauagaaaagaacaagugaauuguugcuauuuaa

SEQ ID NO: 178345 - RNA, 64 nt, hsa
ccuuugagguagaccaggauuucuaaucaaaagggaaaagaagauguugaagaauacaguuagg

SEQ ID NO: 178346 - RNA, 64 nt, hsa
gaccuucuagaauuauaagucacaaagaguucuggaaaagaacuguuuacugcuugauaggaau

SEQ ID NO: 178347 - RNA, 64 nt, hsa
gugacagagugagacucuguuucaaaaaagaaaagaaaagaaacaugguucaaauuauaucuaa

SEQ ID NO: 178348 - RNA, 64 nt, hsa
gccuggugacagagugagacucuguuucaaaaaagaaaagaaaagaaacaugguucaaauuaua

SEQ ID NO: 178349 - RNA, 64 nt, hsa
cagaggaaagccaagaacagccuuuauuggugaagaaaagaaugaaugauucuuuguaggcgcc

SEQ ID NO: 178350 - RNA, 64 nt, hsa
aaaaguuuuuuuuaaucugucuuucaaguuuacagaaaagaaagcaguaaaugcauugauguca

SEQ ID NO: 178351 - RNA, 64 nt, hsa
agcagaucacauguaaaucauuccuaaagcacaagaaaagaaugugccuugauguacauauauu

SEQ ID NO: 178352 - RNA, 64 nt, hsa
uacuauuucuucaaggcaaguaaauugaccaugagaaaagaacacaguuauuaaacacuguuga

SEQ ID NO: 178353 - RNA, 64 nt, hsa
uguagcuacuguuuuuaauguaaagguuaaacuugaaaagaaauucuuaaucacggugccaaaa

SEQ ID NO: 178354 - RNA, 64 nt, hsa
gucugcucugagccuuaaaacacagauugaagaagaaaagaaagaaaaaacuuaaauauuuauu

SEQ ID NO: 178355 - RNA, 64 nt, hsa
aagcgauucuucugccucagccucccaaaugucagaaaagaaagcauacaugcuuaugcaugaa

SEQ ID NO: 178356 - RNA, 64 nt, hsa
guuuuggaaggcuuuccacaaacuaaccuuggaugaaaagaaaaaauuccucuguaaguacugu

SEQ ID NO: 178357 - RNA, 64 nt, hsa
aaaaaaaaaaaaaaagagagagagagaauaaauagaaaagaauguggcugggaauugugaauca

SEQ ID NO: 178358 - RNA, 64 nt, hsa
ucagauuggccuguuauuugauuuccuccuuugggaaaagaauuauguagauaccacauggaga

SEQ ID NO: 178359 - RNA, 64 nt, hsa
gaaaagaaacuaucucggucacgugagcgccagcgaaaagaaacuguaucagucauccagagac

SEQ ID NO: 178360 - RNA, 64 nt, hsa
uuagggccuuccuuuuugccuugugagcgccaaggaaaagaaacuaucucggucacgugagcgc

SEQ ID NO: 178361 - RNA, 64 nt, hsa
acuuacuaccuaacacugagcgcuguuuuuaaaugaaaagaaugagauuuauaaccacuugagu

SEQ ID NO: 178362 - RNA, 64 nt, hsa
ccucaagccaguugauuuuuaauauauuugauuggaaaagaacucucugguauuauuaagacuc

SEQ ID NO: 178363 - RNA, 64 nt, hsa
gaauucccaaacuuuucuuuuuggcuuugucagggaaaagaaaaauaucuuuauaaagaaaucu

SEQ ID NO: 178364 - RNA, 64 nt, hsa
uuguuuguaaugucuaguggggcuucaucauccugaaaagaaggagacagggauuuuuuuaaag

SEQ ID NO: 178365 - RNA, 64 nt, hsa
auaacagaauacgacagacuggguaauuuaaaaagaaaagaaauuuauuuucuuccuaguucug

SEQ ID NO: 178366 - RNA, 64 nt, hsa
agaguuauuuguguaaguagaguauccggagaaggaaaagaacuuacgaccuuucuuuauaaca

SEQ ID NO: 178367 - RNA, 64 nt, hsa
ggcaacagauugaaaagaccuacagacuaagaaggaaaagaagaagagaugacaaaccauaacu

SEQ ID NO: 178368 - RNA, 64 nt, hsa
acucccugcccuucccccugcaaaaagaaaaaaagaaaagaaaaagaaaaaaaucccuuguucu

SEQ ID NO: 178369 - RNA, 64 nt, hsa
aauugauaaauauucuuauuauccuggaaugccagaaaagaacuauguccugcuugucuaguuu

SEQ ID NO: 178370 - RNA, 64 nt, hsa
guauuucucuucuuacgccagucagaaccaauccgaaaagaauguguguugacucagguuugga

SEQ ID NO: 178371 - RNA, 64 nt, hsa
ucuuccauccauuguuggcacccccuugcaaaaggaaaagaacagcaaaagucaggagcaguaa

SEQ ID NO: 178372 - RNA, 64 nt, hsa
agggaaaauaacaaccacccuuacugauaguugggaaaagaagauuggguuauuuugccauauc

SEQ ID NO: 178373 - RNA, 64 nt, hsa
ugaucaucucagccaacaugcaucaguacugcaagaaaagaagucaaucagcagaggagagcau

SEQ ID NO: 178374 - RNA, 64 nt, hsa
uuucuggaauuccuuguuagggaacuuuaaagaagaaaagaaaaacuugaauuguguugaauua

SEQ ID NO: 178375 - RNA, 64 nt, hsa
uuuguagcagucuguaacuuaacuauaguauaaugaaaagaaugaccuauaauauagguguuuu

SEQ ID NO: 178376 - RNA, 64 nt, hsa
aagaguaauccucuuucuugcugguguuucuaaagaaaagaaucagaaaucaaucuuucuacua

SEQ ID NO: 178377 - RNA, 64 nt, hsa
ucuggccccaucgggucacaggugauggcaaauagaaaagaagcaaauggaggaaauagucgga

SEQ ID NO: 178378 - RNA, 64 nt, hsa
ggcucucacuagaguuaccauucauauuugagaagaaaagaacauuuaauaaauguaugugugg

SEQ ID NO: 178379 - RNA, 64 nt, hsa
cuguaguugggccuaaauaaaugagcuguuggaagaaaagaaucacaguacuuuccagcaguca

SEQ ID NO: 178380 - RNA, 64 nt, hsa
ucggagaggccaagucuaaugaagagaaaaaaaggaaaagaaguugcaagacucgaauaaaauc

SEQ ID NO: 178381 - RNA, 64 nt, hsa
caaaugauaucuaaagaucuauuuugccuuaccagaaaagaaaaaaaaaacccuaaaaccaaaa

SEQ ID NO: 178382 - RNA, 64 nt, hsa
uuuagggagcagccacacauacaggaagcucuuagaaaagaacuuuuuuuuuuuuuugagacag

SEQ ID NO: 178383 - RNA, 64 nt, hsa
uaugacaaaugaaaagaauaacaaguugucaaaugaaaagaaugacauugaaacauuuguauug

SEQ ID NO: 178384 - RNA, 64 nt, hsa
uuaguuaugagaaaucuuugcuuauaugacaaaugaaaagaauaacaaguugucaaaugaaaag

SEQ ID NO: 178385 - RNA, 64 nt, hsa
cacgacuuaauguauguuguaagaaaagaaaaaagaaaagaaaaaaagggaaaaaagaaaagca

SEQ ID NO: 178386 - RNA, 64 nt, hsa
uaacaucugauucacgacuuaauguauguuguaagaaaagaaaaaagaaaagaaaaaaagggaa

SEQ ID NO: 178387 - RNA, 64 nt, hsa
aaagguaauauuagcaguuaaagaacacggaugagaaaagaauguguuacauagguugcaucac

SEQ ID NO: 178388 - RNA, 64 nt, hsa
aucuuggugccuucuguuaaaagucaguguaucagaaaagaaagcagccauguaagaggcuaac

SEQ ID NO: 178389 - RNA, 64 nt, hsa
cacucugaggugcaacuuaacagggagggccugagaaaagaaugggagggggcuauuaauuauu

SEQ ID NO: 178390 - RNA, 64 nt, hsa
ccaucaugauuaaugaaaacuaucuuuugaguuugaaaagaaauuaauuugcaguguuuggauu

SEQ ID NO: 178391 - RNA, 64 nt, hsa
gguggccaaacaacagucuucauuuuuuuuaauugaaaagaaguagugucuggaucaguaaaau

SEQ ID NO: 178392 - RNA, 64 nt, hsa
gcucugugagccugaugccucccuggcagcacaggaaaagaauuuuuuuuuuuaagcucaaaau

SEQ ID NO: 178393 - RNA, 64 nt, hsa
uaaaaugaugcuguuuucucugcuaaagguaaaagaaaagaaaaaaauaguuggaaaauaagac

SEQ ID NO: 178394 - RNA, 64 nt, hsa
cccagagcacaggcuccagcaauaugucugcauugaaaagaaccaaaaaaaugcaaacuaugau

SEQ ID NO: 178395 - RNA, 64 nt, hsa
gaauaaggucuaagagaauucgagcccuggcugugaaaagaaucucaacauagaagaaagaaga

SEQ ID NO: 178396 - RNA, 64 nt, hsa
cuuacccaaaauuauuaauuuuauuaggcuuuuggaaaagaaaaaaaacuuuuugauguuuuag

SEQ ID NO: 178397 - RNA, 64 nt, hsa
aacuucucaccauacgacaacagaucauauuccugaaaagaaauuuaaaucugaagcucuucua

SEQ ID NO: 178398 - RNA, 64 nt, hsa
uaugaagcauuuaagaauaaugacuuucaguugggaaaagaauuuucaauggccagggaaacag

SEQ ID NO: 178399 - RNA, 64 nt, hsa
cgaauguuaugaaugaagaguaaaauaauuacaggaaaagaaugcaugauuuuucauugucaca

SEQ ID NO: 178400 - RNA, 64 nt, hsa
uguacccuguugcucagagaaauuauucauaagagaaaagaauuccaauuaauuaaauaucaca

SEQ ID NO: 178401 - RNA, 64 nt, hsa
uagccuuuguggauuuggguuugugcuuuggguugaaaagaaguuuuuaguccuaggccaguag

SEQ ID NO: 178402 - RNA, 64 nt, hsa
auuugaggcuuuucuauauacuucucagagcacugaaaagaaaggaaggguuugcagaggagag

SEQ ID NO: 178403 - RNA, 64 nt, hsa
agagcaaaacuccgucucaaaaaagaaaagaaaagaaaagaaaucauagggccaaguucaaagg

SEQ ID NO: 178404 - RNA, 64 nt, hsa
caacaagagcaaaacuccgucucaaaaaagaaaagaaaagaaaagaaaucauagggccaaguuc

SEQ ID NO: 178405 - RNA, 64 nt, hsa
cugggcaacaagagcaaaacuccgucucaaaaaagaaaagaaaagaaaagaaaucauagggcca

SEQ ID NO: 178406 - RNA, 64 nt, hsa
gacaaaacagacuauguacauaaucuguauaugggaaaagaaagagcgaaauuaccuuacuuaa

SEQ ID NO: 178407 - RNA, 64 nt, hsa
auuaaggagaaauagaaaagaagaaauuuauaaugaaaagaagaugaauuucauuauguaaacg

SEQ ID NO: 178408 - RNA, 64 nt, hsa
uuuaaugcccuaacucucuuauuaaggagaaauagaaaagaagaaauuuauaaugaaaagaaga

SEQ ID NO: 178409 - RNA, 64 nt, hsa
uuugcccaguuuuuaauuacacugagauaauuuugaaaagaaauagaaauuaagcuacuauaua

SEQ ID NO: 178410 - RNA, 64 nt, hsa
uaaaaugugaauaaauaaauguucugauaaaauagaaaagaaaguaaauuacagugauuuccau

SEQ ID NO: 178411 - RNA, 64 nt, hsa
cuugggagacaucugucaaaccaggaauauucuugaaaagaacgugagcaggaaaaacugcugg

SEQ ID NO: 178412 - RNA, 64 nt, hsa
uuuuuaaauaacucagguguaugagaagaaauuagaaaagaaaauuaacuuauguggacuguaa

SEQ ID NO: 178413 - RNA, 64 nt, hsa
acuagacacaauaaaacaucagaaccagcuaagggaaaagaaauaucuggaguacauuaaaagu

SEQ ID NO: 178414 - RNA, 64 nt, hsa
aaagaaauaucuggaguacauuaaaagugugaaagaaaagaaugauaaucuucuaaaggcuaua

SEQ ID NO: 178415 - RNA, 64 nt, hsa
uuuaauugaacccauccacucugggcagguaagagaaaagaaaaagauaaggaaagaagagaga

SEQ ID NO: 178416 - RNA, 64 nt, hsa
gaaaaaaauagcucaagacacaguuaaucgagaagaaaagaaauauguacagaaccauaaagaa

SEQ ID NO: 178417 - RNA, 64 nt, hsa
uuuacaguacucagcaaaagaacauggaaugccugaaaagaauccagcugaagggaauacagua

SEQ ID NO: 178418 - RNA, 64 nt, hsa
aguauuuucgaagaggagcaacugaacacuggaggaaaagaaaaugacacuuucugcuuuacag

SEQ ID NO: 178419 - RNA, 64 nt, hsa
gaguacauuaaguaaaauaaaauggaccagaaaagaaaagaaaccauaaauaucgugucauauu

SEQ ID NO: 178420 - RNA, 64 nt, hsa
cuagugaguacauuaaguaaaauaaaauggaccagaaaagaaaagaaaccauaaauaucguguc

SEQ ID NO: 178421 - RNA, 64 nt, hsa
aauaguuucaaaugaguuuaaaaaaauaacaucugaaaagaaaugcuaauguaaucauuuaucu

SEQ ID NO: 178422 - RNA, 64 nt, hsa
guuuguaauauacaguuuuuguaaccauaugauugaaaagaagaaagucuaugcuuaggccagu

SEQ ID NO: 178423 - RNA, 64 nt, hsa
agacaacuacagcccucauuagccuuucuugugagaaaagaauaauucuaacuggucaguauuc

SEQ ID NO: 178424 - RNA, 64 nt, hsa
aagauugaagagggccaaacacugaugauuuguggaaaagaaauagaagucauggguguaaucu

SEQ ID NO: 178425 - RNA, 64 nt, hsa
uccuaauucuugcugaguugacuuucccuuguaggaaaagaaaaauauuucaaauagaaaccca

SEQ ID NO: 178426 - RNA, 64 nt, hsa
ugguggccugaagacaggggugacuugccuuugagaaaagaagggcugcaaugccaccagagaa

SEQ ID NO: 178427 - RNA, 64 nt, hsa
uaccaagacauuaaaguagcauggcugcccaggagaaaagaagacauucuaauuccagucauuu

SEQ ID NO: 178428 - RNA, 64 nt, hsa
gcaagaaggacagcaguaaaugaagaccauggaagaaaagaaggaaugccaaagaucgaggaaa

SEQ ID NO: 178429 - RNA, 64 nt, hsa
ugcuaaguguagauuauugagguuuguuagugaggaaaagaauaagaguucagaagccuuuguu

SEQ ID NO: 178430 - RNA, 64 nt, hsa
cuguucaucccuuccuauaaccucuagguaaaaagaaaagaaaaaaagaaauuucgagauauuu

SEQ ID NO: 178431 - RNA, 64 nt, hsa
ucaccaggcaaagcuaaggaaggauauacuaguugaaaagaauaacccacuccucuucugggca

SEQ ID NO: 178432 - RNA, 64 nt, hsa
acccucuuauuuuauaacuaaauaaauaaucacagaaaagaaugaucugaacaagaacagcuga

SEQ ID NO: 178433 - RNA, 64 nt, hsa
uuuuuucuuuuuuccuuuuuuuuuaaguggaggggaaaagaagagauaaacaaggaauauuuug

SEQ ID NO: 178434 - RNA, 64 nt, hsa
uaacacaaaacugccaacuuugcacaaguuuccagaaaagaaaauacaauuagucacucaacau

SEQ ID NO: 178435 - RNA, 64 nt, hsa
aacauggauggaaacugaccaccuacuuuguccagaaaagaagucuuaagauauuucaaggaau

SEQ ID NO: 178436 - RNA, 64 nt, hsa
gagcuugagcugagagacagacacaacaguaucugaaaagaauacauacucuuuccaugcauau

SEQ ID NO: 178437 - RNA, 64 nt, hsa
ccccccgcaaaaaaaaaaaagaaagaaagaaagagaaaagaaaagaaaagcaaccacagccagc

SEQ ID NO: 178438 - RNA, 64 nt, hsa
cgcaaaaaaaaaaaagaaagaaagaaagagaaaagaaaagaaaagcaaccacagccagccuuag

SEQ ID NO: 178439 - RNA, 64 nt, hsa
acaagaaaagaaaugaagugcauaagucuccugggaaaagaaccuuaaccccuucucgugccau

SEQ ID NO: 178440 - RNA, 64 nt, hsa
acagucacucacugccauucucacacuauaacaagaaaagaaaugaagugcauaagucuccugg

SEQ ID NO: 178441 - RNA, 64 nt, hsa
ugugauaaaagcaagugacaaagagaagagagaugaaaagaaacaaguccagaaaucauauuac

SEQ ID NO: 178442 - RNA, 64 nt, hsa
aaaauaugcaauggauguagaaaauaaaauucaagaaaagaacguugaaccaaauauuagcuuu

SEQ ID NO: 178443 - RNA, 64 nt, hsa
uuaauggcaugauuuuuuuuaugcaaaaagaaaagaaaagaaaaccacccacauuuuaauuuag

SEQ ID NO: 178444 - RNA, 64 nt, hsa
acacauuaauggcaugauuuuuuuuaugcaaaaagaaaagaaaagaaaaccacccacauuuuaa

SEQ ID NO: 178445 - RNA, 64 nt, hsa
gccaaugauguauacauguauuuuaguaaauccagaaaagaagacuaaggggacaggugaauac

SEQ ID NO: 178446 - RNA, 64 nt, hsa
uugucugccuugaauauugcuuccauguauuuuggaaaagaaaaugauuucauuuauaaaugaa

SEQ ID NO: 178447 - RNA, 64 nt, hsa
ccauaugaugacacacagugucuuucuccuguuugaaaagaaauugugucauauuggugugcug

SEQ ID NO: 178448 - RNA, 64 nt, hsa
cugcacaaagcaaccgccaaauuguuucagagcagaaaagaaaaagggagaaaaccucuuagca

SEQ ID NO: 178449 - RNA, 64 nt, hsa
aauggaaacuauuggaugaaaugaggaaaaacaggaaaagaauucacuuuuuaaaugaagaaau

SEQ ID NO: 178450 - RNA, 64 nt, hsa
uggcaagagcccaacucuacuaaaaauacaaaaagaaaagaaaacagccaagcuuggugguaug

SEQ ID NO: 178451 - RNA, 64 nt, hsa
aaaaaauguuuucuggggaaaggggacaaggaaggaaaagaaagaagagaaggggagaaacccu

SEQ ID NO: 178452 - RNA, 64 nt, hsa
uuuucuuuuuuuaacuggugaagagaaaaaggcugaaaagaaggaauauaccuuuuuuguucca

SEQ ID NO: 178453 - RNA, 64 nt, hsa
gaaggcuuaguagcucagucuuuaacaagggcuagaaaagaauguaaucugauauggaaggaua

SEQ ID NO: 178454 - RNA, 64 nt, hsa
gagacuaagccuagagagucaauguuagaacagugaaaagaauucugugugugugugugugugu

SEQ ID NO: 178455 - RNA, 64 nt, hsa
cagcaguuguuccagggagcuucuaccuggaaaagaaaagaaaugaauagacuaucuagaacuu

SEQ ID NO: 178456 - RNA, 64 nt, hsa
uauuccagcaguuguuccagggagcuucuaccuggaaaagaaaagaaaugaauagacuaucuag

SEQ ID NO: 178457 - RNA, 64 nt, hsa
uaccuauaagaauuaagggguaaagcacuaaacagaaaagaaaaaaaaaauagcaacucuggug

SEQ ID NO: 178458 - RNA, 64 nt, hsa
ccaaauuccacaauaagcaauauguggugauaaugaaaagaaugauucagucuugacggugaau

SEQ ID NO: 178459 - RNA, 64 nt, hsa
acacacauucacccuaaggauccaauggaauacugaaaagaaaucacuuccuugaaaauuuuau

SEQ ID NO: 178460 - RNA, 64 nt, hsa
uuaugaauacaaagauaagugaaaagagagaaaggaaaagaaaaaggagaaaaacaaagagauu

SEQ ID NO: 178461 - RNA, 64 nt, hsa
auugcuguugaucuuuuaucaauaauguucuauagaaaagaaaaaaaaaauauauauauauaua

SEQ ID NO: 178462 - RNA, 64 nt, hsa
uuuccuuguccugguugaagguaacguguuccuagaaaagaaaaugcugcauaggaaaacugag

SEQ ID NO: 178463 - RNA, 64 nt, hsa
cacccauuuagguaucacuaccaugaacuauagggaaaagaaaucaccuacucccugacacugu

SEQ ID NO: 178464 - RNA, 64 nt, hsa
guguuccaacuguuuaaaauugaucagagaccacgaaaagaaauuugugcuucaccgaagaaaa

SEQ ID NO: 178465 - RNA, 64 nt, hsa
auacaaaaaccaguuaauguuuuguagacccugggaaaagaauuuucagcaaaguacaaaaauu

SEQ ID NO: 178466 - RNA, 64 nt, hsa
caaaccacacauuaguacuuauguugcacaaugagaaaagaaauuaguuucaaauuuaccucag

SEQ ID NO: 178467 - RNA, 64 nt, hsa
gagacccccaucuuuacaaagaaaaaaaaaaggggaaaagaaaaucuuuuaaaucuuuggauuu

SEQ ID NO: 178468 - RNA, 64 nt, hsa
uagauuauguuccauugcuaaugaauuugacuuagaaaagaauugccuuauuuuuaagagauug

SEQ ID NO: 178469 - RNA, 64 nt, hsa
accaacugugaaagcuggcuuuaauuuuuaggaggaaaagaaaagccugcauguguucuuuauu

SEQ ID NO: 178470 - RNA, 64 nt, hsa
cuguuagcugauugugguaaacaauguuuaaugugaaaagaaauuaaaacuuucuucaucuguu

SEQ ID NO: 178471 - RNA, 64 nt, hsa
guuaauuacugggccaacuugagaggaaaaaauggaaaagaaacuaaaauguugggugaauucu

SEQ ID NO: 178472 - RNA, 64 nt, hsa
acaacaacccaaugaaauaacauuuugcauaucugaaaagaagcauugaauauaagccaaaagc

SEQ ID NO: 178473 - RNA, 64 nt, hsa
cugaaucuuuccuguugaagaaauccauguuauagaaaagaacuuugcagucagacauucguca

SEQ ID NO: 178474 - RNA, 64 nt, hsa
ugauuuuuauuuuuccuuugguauuugcuacagugaaaagaaguuuggaaaguagauacauaaa

SEQ ID NO: 178475 - RNA, 64 nt, hsa
auacauaaagacuugagaagggaauuguuuaagggaaaagaaaagaguaauaauuuuuuuuaaa

SEQ ID NO: 178476 - RNA, 64 nt, hsa
uuuaggcauuaccucagggaaaagccuugacagugaaaagaaacuacuuaaucgcuaauagcua

SEQ ID NO: 178477 - RNA, 64 nt, hsa
caagcugauauuuuaggugcucuaaagcaccuaagaaaagaacugcaaagucugagaaauagga

SEQ ID NO: 178478 - RNA, 64 nt, hsa
ccaaaauucugaagucuggaaguuuuuccuucaagaaaagaaacugcauaaaaaauuuaaaacu

SEQ ID NO: 178479 - RNA, 64 nt, hsa
augccaccuccucuguucuuggaacaacgcauaggaaaagaaucuccuuuggaaggugacacug

SEQ ID NO: 178480 - RNA, 64 nt, hsa
aguuuauuuuuuaaaauucuaaguagaguauauugaaaagaaaaagaagagccuuaacauauau

SEQ ID NO: 178481 - RNA, 64 nt, hsa
uaccaauacuguguuuuauuaauaaucuucauaagaaaagaaacacuggauacuuuuuuguugu

SEQ ID NO: 178482 - RNA, 64 nt, hsa
ccaaacuucuguuuuauaauauguaauuuuucaugaaaagaaagggcucagaaaaauuaggaug

SEQ ID NO: 178483 - RNA, 64 nt, hsa
guuccuuucaguaguugccaucuuggccaugcaagaaaagaaaagaaggcauuuacucuauguc

SEQ ID NO: 178484 - RNA, 64 nt, hsa
uuucaguaguugccaucuuggccaugcaagaaaagaaaagaaggcauuuacucuaugucggggg

SEQ ID NO: 178485 - RNA, 64 nt, hsa
ugaauuucgaaagaaauaauuggcaagauaaugagaaaagaaaaaagucaugguaggugaggug

SEQ ID NO: 178486 - RNA, 64 nt, hsa
uguagccaagcagaguuguagagggggauaaaaagaaaagaaauuggauguauuuacagcuguc

SEQ ID NO: 178487 - RNA, 64 nt, hsa
uuuuaauucuucccuuggauuaauauuuucuacugaaaagaaaugaaaucucaguuccacuaug

SEQ ID NO: 178488 - RNA, 64 nt, hsa
auugacuguuaauugauucaggguacccuuaaaagaaaagaaguuuucccauugugaaccuuaa

SEQ ID NO: 178489 - RNA, 64 nt, hsa
cgagaaaaggagaaaggagcucugaaucugauaggaaaagaaggcugccuaaggaggaguuuuu

SEQ ID NO: 178490 - RNA, 64 nt, hsa
cauucaaaacaaccauccugcucauaacaucuuugaaaagaaaaauauauaugugcaguauuuu

SEQ ID NO: 178491 - RNA, 64 nt, hsa
aaugcauugcuuugcuuacaguauugacucaagggaaaagaacugucaguaucuguagauuaau

SEQ ID NO: 178492 - RNA, 64 nt, hsa
aagcugauagucuugaauauuuuauuuuuuuaaugaaaagaaaaaacaagaaaguuauguuuca

SEQ ID NO: 178493 - RNA, 64 nt, hsa
auauaaaagagugauuuuccucaccugaguacaugaaaagaaaaugcugaaaucaauguauaaa

SEQ ID NO: 178494 - RNA, 64 nt, hsa
agacugaagacaaacaugggaggagaagugacuggaaaagaacuggugugggagagggauaccu

SEQ ID NO: 178495 - RNA, 64 nt, hsa
acacuuaaguagauuuuaagaauaaauguuucuggaaaagaacuauguuaugauuuuguagaaa

SEQ ID NO: 178496 - RNA, 64 nt, hsa
gugaacagugaggugguagcaagacuucuuuuuagaaaagaaagcauuuaccugccugucugua

SEQ ID NO: 178497 - RNA, 64 nt, hsa
ugccuucgcaaauucucaaaagaguaaaguuuaugaaaagaaaguggcaggcaaacacaacucu

SEQ ID NO: 178498 - RNA, 64 nt, hsa
ucccucaucccagaagaggcaucuccauaucccagaaaagaagauccuaucaugaauaaaagcu

SEQ ID NO: 178499 - RNA, 64 nt, hsa
uuguucuaagaugcauggaacuaaaauguggaaagaaaagaaugcgaaaagauccuguuuucag

SEQ ID NO: 178500 - RNA, 64 nt, hsa
ggagacugaagugugcagguucuucuauguuuuugaaaagaagguggggucuuggauaucaccu

SEQ ID NO: 178501 - RNA, 64 nt, hsa
aaugaagcaguguugucuauggaaguggggaguagaaaagaagauccccauugacagugaggag

SEQ ID NO: 178502 - RNA, 64 nt, hsa
cauugccgagaguccuguuauugagguagaaacagaaaagaaagacguucuugauuuuggugac

SEQ ID NO: 178503 - RNA, 64 nt, hsa
aguaaaacuauuugcaacugguuuucagaaaagagaaaagaaacaacaaaggaauugaaacagg

SEQ ID NO: 178504 - RNA, 64 nt, hsa
ccuguuagauuaaagcugcacccugugauuauuugaaaagaauuagcuugagaguaaugucacu

SEQ ID NO: 178505 - RNA, 64 nt, hsa
gugggucugaaauucauacaugaagucaggaaaagaaaagaaacuuaguucuaccuugauuaca

SEQ ID NO: 178506 - RNA, 64 nt, hsa
cugaggugggucugaaauucauacaugaagucaggaaaagaaaagaaacuuaguucuaccuuga

SEQ ID NO: 178507 - RNA, 64 nt, hsa
auucagcuaaaauaguacuucacaggaaauauaggaaaagaaacacuaguucaguuuuauucca

SEQ ID NO: 178508 - RNA, 64 nt, hsa
gcaacaagagcaaaacuccgucucaaaauaaaaagaaaagaaaagaauggacaguguuugcaga

SEQ ID NO: 178509 - RNA, 64 nt, hsa
aagagcaaaacuccgucucaaaauaaaaagaaaagaaaagaauggacaguguuugcagagaguu

SEQ ID NO: 178510 - RNA, 64 nt, hsa
auauggauauccaauuguuucacacaauuuuuuugaaaagaauauccuuggcagggcacgguag

SEQ ID NO: 178511 - RNA, 64 nt, hsa
caaaaaaaaaaaaaaaaaaaaggaaagaaagaaagaaaagaaaagaaaauccuuuuugcuuuaa

SEQ ID NO: 178512 - RNA, 64 nt, hsa
aaaaaaaaaaaaaaaaggaaagaaagaaagaaaagaaaagaaaauccuuuuugcuuuaacuugc

SEQ ID NO: 178513 - RNA, 64 nt, hsa
uuuuaggcagcaagaauuggagaacucacacugcgaaaagaaaaccuuggguggcagugauuug

SEQ ID NO: 178514 - RNA, 64 nt, hsa
acuccaucuuaaaaaaaaaaaaaaaaaaaagaaagaaaagaaaauggaguucugagagcuagga

SEQ ID NO: 178515 - RNA, 64 nt, hsa
agucuggcaacagagcaagacuccaucucaaaaagaaaagaaaagaagacucugaccuguacuc

SEQ ID NO: 178516 - RNA, 64 nt, hsa
ggcaacagagcaagacuccaucucaaaaagaaaagaaaagaagacucugaccuguacucuugaa

SEQ ID NO: 178517 - RNA, 64 nt, hsa
uuuccuagaaaauccuucagaccugaagacgcaggaaaagaaucuggcucucaggguggcuucu

SEQ ID NO: 178518 - RNA, 64 nt, hsa
ccugggcgacacagcgagacccugucucaagaaagaaaagaaaaagagacaaauuacccagaaa

SEQ ID NO: 178519 - RNA, 64 nt, hsa
gaaaagaaaaaaaaaagacaaaaaaaaaaaaaaagaaaagaaaaaaaaucucaucacuugaagc

SEQ ID NO: 178520 - RNA, 64 nt, hsa
ccuuccccauugcuguaaauauuucaacgaaauggaaaagaaaaaaaaaagacaaaaaaaaaaa

SEQ ID NO: 178521 - RNA, 64 nt, hsa
ggaaagugucuaugauauauagugaaaagugugggaaaagaauauagaaauaauauucacuucu

SEQ ID NO: 178522 - RNA, 64 nt, hsa
cccucuguuaauugugugucucaaauuuguucuggaaaagaaagggggaaagucuaugaacgac

SEQ ID NO: 178523 - RNA, 64 nt, hsa
agagcaacacucugucucaaaaaaaaaaagaaaagaaaagaaaaagccagaaaaaguuggugcc

SEQ ID NO: 178524 - RNA, 64 nt, hsa
gcagcagagcaacacucugucucaaaaaaaaaaagaaaagaaaagaaaaagccagaaaaaguug

SEQ ID NO: 178525 - RNA, 64 nt, hsa
gaaaguuaaaaauguauaguaacugauugagggggaaaagaaugaucuuuauuaaugacaaggg

SEQ ID NO: 178526 - RNA, 64 nt, hsa
accaacccaguucuguuugacuauguagcaucuugaaaagaaaaauuauaauaaagccccaaaa

SEQ ID NO: 178527 - RNA, 64 nt, hsa
uucucagucauccuggcagccaaaaaugugccaggaaaagaaagaauguggagcacgcguggcu

SEQ ID NO: 178528 - RNA, 64 nt, hsa
aguaauuuaccuguccaggaucaaaagaagccuagaaaagaagcaguaaucuaccucugccgau

SEQ ID NO: 178529 - RNA, 64 nt, hsa
ugaacaaaagcagguuuuuauauguaaacagugagaaaagaaaggcuaaacacuauguaaaugu

SEQ ID NO: 178530 - RNA, 64 nt, hsa
ggaggcacguaggaacaagcaaugagaagaccaggaaaagaaagagcugaaaauggagaaagcc

SEQ ID NO: 178531 - RNA, 64 nt, hsa
uauuucucaaaccggccaacacuuagggaaaauagaaaagaaccuacgugaccaucggggcagg

SEQ ID NO: 178532 - RNA, 64 nt, hsa
auuuagaaguaaaacacaaaacaaaaaagagagagaaaagaaaagaaaucacaauguauauaaa

SEQ ID NO: 178533 - RNA, 64 nt, hsa
gaaguaaaacacaaaacaaaaaagagagagaaaagaaaagaaaucacaauguauauaaaacagu

SEQ ID NO: 178534 - RNA, 64 nt, hsa
ggugaaaugucacuccauugacccaccgaaaaaagaaaagaaaucuguuucuaccaaacauuuc

SEQ ID NO: 178535 - RNA, 64 nt, hsa
cccaagugucaagaaccacaccagauuggagauagaaaagaauagcugaaauuaugucaguggu

SEQ ID NO: 178536 - RNA, 64 nt, hsa
uaggccuggaagagacuguugaugccacuuugaagaaaagaacacugagaacuagaggagggaa

SEQ ID NO: 178537 - RNA, 64 nt, hsa
uuaggaaagaagaccuguuuauacauugaaggaagaaaagaaggaagcaguugccuuccggagg

SEQ ID NO: 178538 - RNA, 64 nt, hsa
guccccagcacguccagggugggugcucccuugcccgacagaaccauccccacugugaggcugu

SEQ ID NO: 178539 - RNA, 64 nt, hsa
agaggccccaauggggcggugaccccagccucgcccgacagagcccggggcgcaggcgggcgcc

SEQ ID NO: 178540 - RNA, 64 nt, hsa
auccuucggaccucaccacgcgaaacuacgcccgccgacagaaacaucugcaaagauacagucu

SEQ ID NO: 178541 - RNA, 64 nt, hsa
acaaguggagggggugucuggaagcugagcaggcccgacagagagaugaagccaucagaaggac

SEQ ID NO: 178542 - RNA, 64 nt, hsa
acacggaaguucauacuugaaugcugaauuggccccgacagauuaaaugcguguuggggauugg

SEQ ID NO: 178543 - RNA, 64 nt, hsa
ccuggggccguguccaaggugccaaugaugcgggccgacagagcgggccgcacugucugucugu

SEQ ID NO: 178544 - RNA, 64 nt, hsa
guucagcggaaaugggaugugagaaugaugaaacccgacagaaguaucucagccugcagucagu

SEQ ID NO: 178545 - RNA, 64 nt, hsa
agggggccagcgggagcagggccugcaugagaccccgacagaaggugggggggggggggcucug

SEQ ID NO: 178546 - RNA, 64 nt, hsa
gggugagccuccacaugggugcugaagcaagaaaccgacagauguugaggagaauggugugacc

SEQ ID NO: 178547 - RNA, 64 nt, hsa
caaaagagggugcugccccuagccugggcccccaccgacagacugcagcugcguuacugugcug

SEQ ID NO: 178548 - RNA, 64 nt, hsa
cugcaguccugccaacguuggacacugaggacgcccgacagagcuugugcaccuaagcugcaga

SEQ ID NO: 178549 - RNA, 64 nt, hsa
aaaccucugcacccugaagguagccauacagaugccgacagauccacaaaggaacaauaaagcu

SEQ ID NO: 178550 - RNA, 64 nt, hsa
uguucuaagagaagaauugcuucuuuauacagcuccgacagaagcaggaguccgaguuaaaccu

SEQ ID NO: 178551 - RNA, 53 nt, hsa
ugcaacccaagcaggacugacgcccgacagacuccacccuaacagucucaagc

SEQ ID NO: 178552 - RNA, 64 nt, hsa
uagggcagccuggugagaggggccuagcucgcugccgacagaagucacugccuaccucaggguc

SEQ ID NO: 178553 - RNA, 64 nt, hsa
ccugcuagacugagugacugcaguuaggagggauccgacagagaagaccauuuccacucauucc

SEQ ID NO: 178554 - RNA, 64 nt, hsa
guuucagagcagagcuccuggccagagcguuugaccgacagacaauucacauccauaugccagg

SEQ ID NO: 178555 - RNA, 64 nt, hsa
ccucugcccugaucgucacaacccucaggaaccaccgacagaaagaaagaaacacaaaaacaug

SEQ ID NO: 178556 - RNA, 64 nt, hsa
gccaggcuuuucucaggagcuucaaugaguauggccgacagacauggacaaggagcuguguuca

SEQ ID NO: 178557 - RNA, 64 nt, hsa
aggaagcgugaaggccgagaagcaagaaagaaacccgacagagggaagaaaagagcuuucuucc

SEQ ID NO: 178558 - RNA, 64 nt, hsa
uggauguagauuuuguuuuuaucauugauuuguaccgacagaaauagacauuucaucauguaaa

SEQ ID NO: 178559 - RNA, 64 nt, hsa
gucaugagcuaugccgacagucagcagcugauccccgacagaaacgcagcagaugcagacggug

SEQ ID NO: 178560 - RNA, 64 nt, hsa
uccacccacagagaaaugccucugugcgagugcaccgacagaaaacugucagcucugcuuucua

SEQ ID NO: 178561 - RNA, 64 nt, hsa
gugaagcaccaagcucaaagcguggacaggugugccgacagaaggaaccagcguguauaugagg

SEQ ID NO: 178562 - RNA, 64 nt, hsa
gugccuuugucagcucuucuuucaaaagaccccaccgacagaccgcauuccacccccaacaucg

SEQ ID NO: 178563 - RNA, 64 nt, hsa
cccgccgcugacugcgccaggaugcacagaccgaccgacagaccucagugcccaccacgggcug

SEQ ID NO: 178564 - RNA, 64 nt, hsa
cccccacccccacacgcacuuuaugagggagaccccgacagaggacgcuugagccagaaucuca

SEQ ID NO: 178565 - RNA, 60 nt, hsa
cgggggccgaaccccaguagcggcuccuucccgacagagcugccucucgguggccagcag

SEQ ID NO: 178566 - RNA, 64 nt, hsa
agagcccuuaagucuguccuggcuguggcccaugccgacagauaucguggggcugacaggucca

SEQ ID NO: 178567 - RNA, 64 nt, hsa
ucugacccuggagcuugggguuggcaccucugccccgacagaauggggcugaaucagcuccagg

SEQ ID NO: 178568 - RNA, 64 nt, hsa
aggggauaaagaggaagcaauaaaaaaaaaacauccgacagagcagcucuggcuuugcagccug

SEQ ID NO: 178569 - RNA, 64 nt, hsa
uugcuggagguagaggagcuauguggagcaaaggccgacagaggggaaggaauggaccugugag

SEQ ID NO: 178570 - RNA, 64 nt, hsa
cauguaaucagagcauuagcugcagaaaaaccccccgacagagcccuggcggagaggcaggcgc

SEQ ID NO: 178571 - RNA, 64 nt, hsa
ucccaccccggggucagccggccgugugcgucccccgacagacacugugaacggaagacagcag

SEQ ID NO: 178572 - RNA, 64 nt, hsa
augagggcggagccacuccuuguaaauucagugcccgacagaugcucuggcacagaugcuuugu

SEQ ID NO: 178573 - RNA, 64 nt, hsa
uguaugagcccaauagccaaggguacaaguacuaccgacagaagcuggaggaguuccggaaagc

SEQ ID NO: 178574 - RNA, 64 nt, hsa
uguccaggaggagccuggccauggguccuugcccccgacagacagagcagcccccacccgggag

SEQ ID NO: 178575 - RNA, 64 nt, hsa
gcagcugggacccagaacugagccugggagggauccgacagaaaagcucagggcgggucuucuc

SEQ ID NO: 178576 - RNA, 64 nt, hsa
ccuccaccuccuuccccuucucccucaggcaaccccgacagacaguggcacuccugguccugcu

SEQ ID NO: 178577 - RNA, 64 nt, hsa
ucaccaacacggccucccugcagcugcccugccaccgacagaccccgauuaaacccacaccugg

SEQ ID NO: 178578 - RNA, 64 nt, hsa
ugcaguaccguguggaaaaugcuuugguguuuacccgacagaggcuuuauuugugcuguaucag

SEQ ID NO: 178579 - RNA, 64 nt, hsa
agauaaugccgggcaggccgggcacaguggcucacgccuguaauccaagcacuuggggaggccg

SEQ ID NO: 178580 - RNA, 64 nt, hsa
ccucuugaaagauucaaccgggugugguggcucacgccuguaaucccagcacauugggaggcca

SEQ ID NO: 178581 - RNA, 64 nt, hsa
uaauaaauguuuucaggccgggcacuguggcucacgccuguaaucccagcacuuugggagaccg

SEQ ID NO: 178582 - RNA, 64 nt, hsa
aaaauacaaaaaauuagccgggcgugguggcgggcgccuguagucccagcuacucgggaggcug

SEQ ID NO: 178583 - RNA, 64 nt, hsa
agaaaauagaaaauaggcuaggcacaguggcucacgccuguaaucucaacacuuugggaggcca

SEQ ID NO: 178584 - RNA, 64 nt, hsa
uaaagucugaagcucggccaggugcgguggcucacgccuguaaucccaaaacuuuggaaggcug

SEQ ID NO: 178585 - RNA, 64 nt, hsa
ggaaaaaggaaacuaggccaggcgugguggcucacgccuguaaucccaacacuuugggaggccg

SEQ ID NO: 178586 - RNA, 64 nt, hsa
aaaauacaaaaaauuggccgggcgcagcggcucacgccuguaaucccagcacuuucggaggcag

SEQ ID NO: 178587 - RNA, 64 nt, hsa
aaaaauacaaaaauuacccaggcauaguggcacacgccuguagucccaguuacuugggaggcug

SEQ ID NO: 178588 - RNA, 64 nt, hsa
ggauaagaugcucccggccgggcgcgguggcucacgccuguaaucccagcacuuugggaggccg

SEQ ID NO: 178589 - RNA, 64 nt, hsa
caaagucaucuugccagccaggcgugguggaucacgccuguaaucccagcacucugggaggcca

SEQ ID NO: 178590 - RNA, 64 nt, hsa
aauacaaaaaaaauuagccagccaugguggcgggcgccuguaaucccagcuacuugggaggcug

SEQ ID NO: 178591 - RNA, 64 nt, hsa
uaauuggcagugauuggccaggcgcaguggcucacgccuguaaucccagcacugggaggccgag

SEQ ID NO: 178592 - RNA, 64 nt, hsa
aaaaagcccauggcaggcugggcgcgguggcucacgccuguaaucccagcacuuugggaggcca

SEQ ID NO: 178593 - RNA, 64 nt, hsa
aaaacaaaaacaauuagcugggcaugguggccggcgccuguaaucccagcuacuagggaggcug

SEQ ID NO: 178594 - RNA, 64 nt, hsa
cacauacaggaaacaggcgggacacaguggcucacgccuguaaucccaccacuuuggaaagcug

SEQ ID NO: 178595 - RNA, 64 nt, hsa
aaaauacaaaaaauuaccugggccugguggcacacgccuguagucccagcuacuugggaggcug

SEQ ID NO: 178596 - RNA, 64 nt, hsa
aaaacauuauuuuuaaaauuagccugguggcucacgccuguaaucccagcacuuugggaggccg

SEQ ID NO: 178597 - RNA, 64 nt, hsa
agauuaacaaaauuaggccgggcaugguggcucacgccuguaaucccagcacuuugggaggccc

SEQ ID NO: 178598 - RNA, 64 nt, hsa
aaauacguaaaaauuagccaggcgugguggcacacgccuguaaacccagcuacuugggaggcug

SEQ ID NO: 178599 - RNA, 64 nt, hsa
ucuuagcaccccgcaggcugggcgcuguggcucacgccuguaaucccagcacuuugggagggca

SEQ ID NO: 178600 - RNA, 64 nt, hsa
aaaauacaaaaaauuauccaggcaugguggcguacgccuguagucccagcuacucaggaggcug

SEQ ID NO: 178601 - RNA, 64 nt, hsa
uaaaaauacagaauuagucaggcgugguggugggcgccuguaaucccagcuacucaggaggcug

SEQ ID NO: 178602 - RNA, 64 nt, hsa
aaauacaaaaaaauuagccaagcaugguggcaggcgccuguagucccagcuacuugggaggcug

SEQ ID NO: 178603 - RNA, 64 nt, hsa
aaaauuuugucugacagcugggcgugguugcucacgccuguaaucccagcacuuugggaggcug

SEQ ID NO: 178604 - RNA, 64 nt, hsa
uaauuucucauuuggagccgggcgcaguggcucacgccuguaaucccagcacuuugggaggcca

SEQ ID NO: 178605 - RNA, 64 nt, hsa
aaaaauacaaaaauuagccaggcgugguggcuggcgccuguaaucccagcuacucaggagguug

SEQ ID NO: 178606 - RNA, 64 nt, hsa
aaauacaaaaaaauuagccaggcaugguggcgggcgccuguagucccagcuacuuggaaggcug

SEQ ID NO: 178607 - RNA, 64 nt, hsa
aaaauuacuaaaauaggcugggcgcgguggcucacgccuguaaccucagcacuuugggaggccg

SEQ ID NO: 178608 - RNA, 64 nt, hsa
auuuaaaaacuagagggcuaggcuuaguggcucacgccuguaaucucagcacuuugggaggcug

SEQ ID NO: 178609 - RNA, 64 nt, hsa
auauaaaaugguguaggccgggcaugguggcucacgccuguaaucccaguacuuugggaggccg

SEQ ID NO: 178610 - RNA, 64 nt, hsa
uuucaugccugaaaagcuuuuuacagaaagaugccgccuguagccagugacagccgcaacccua

SEQ ID NO: 178611 - RNA, 64 nt, hsa
ugccagggggaggcucagguugguccccgagugccgccuguacucacaaaggcugccuuuccuc

SEQ ID NO: 178612 - RNA, 64 nt, hsa
aaaaaauugcuuguaggcugagcgcgguggcucacgccuguaaucccagcacuuugggaggcca

SEQ ID NO: 178613 - RNA, 64 nt, hsa
aaaaauacaaaaauuagccggacgcaguggcacgcgccuguaaucccagcuacucaagaggcug

SEQ ID NO: 178614 - RNA, 64 nt, hsa
cuugaaaguaauuuuggcuggucgcgguggcucacgccuguaaucccagcacuuugggaggccg

SEQ ID NO: 178615 - RNA, 64 nt, hsa
aaaauacaaaaaauuagccgggcguaguggcgggcgccuguagucccagcuacuugggaggcug

SEQ ID NO: 178616 - RNA, 64 nt, hsa
aaaauacaaaaaauuagcuuggcgugguggugggcgccuguagucccagcagcuugggaggcug

SEQ ID NO: 178617 - RNA, 64 nt, hsa
gaaagcauuguuuuaguccaggcacaguggcucacgccuguaaucccagcacuuugggaggccg

SEQ ID NO: 178618 - RNA, 64 nt, hsa
caaauuauguaacucggccggguacaauggcucacgccuguaauccuaacacuuugggaggccg

SEQ ID NO: 178619 - RNA, 64 nt, hsa
auuacaaaaaaaauuauccaggcgugguggugcacgccuguaaucccagcuacucaggaggcua

SEQ ID NO: 178620 - RNA, 64 nt, hsa
gaauaaguaauucuuggcugggcaugguggcucacgccuguaauuccagugcuuugggaggcca

SEQ ID NO: 178621 - RNA, 64 nt, hsa
cagaagaugaugagggagcucaguggaauuguaccgccuguacuuuuuugaaccauccagccuu

SEQ ID NO: 178622 - RNA, 64 nt, hsa
aaaugguuugggauaggcugggugccgugggucacgccuguaaucccagcacuuugggaggcug

SEQ ID NO: 178623 - RNA, 64 nt, hsa
aaaaauacagaaauuagcugggugugguugcacacgccuguaaucccagcuacucaggaggcug

SEQ ID NO: 178624 - RNA, 64 nt, hsa
cuagaaagcaacugaggccaggugcgguggcucacgccuguaaucccagcacuuugggaggccg

SEQ ID NO: 178625 - RNA, 64 nt, hsa
agggagcucaaucuuggccgggcgccguggcucacgccuguaaucgcagcacuuugggaggccg

SEQ ID NO: 178626 - RNA, 64 nt, hsa
aaaaaaaaaaaguuuggccgggugcgguggcucacgccuguaaucccagcacuuugggaggcca

SEQ ID NO: 178627 - RNA, 64 nt, hsa
aaaaacacaaaaguuagcugagcgugguggcgggcgccuguagucccagccacucgggaggcug

SEQ ID NO: 178628 - RNA, 64 nt, hsa
aaaauacaaaaaauuagccgggcgcgguggcgggcgccuguagucccagcuacuugggaggcug

SEQ ID NO: 178629 - RNA, 64 nt, hsa
aaaaugaauugaccuggccgggcgcgguggcucacgccuguaaucccagcacuuugggaggccg

SEQ ID NO: 178630 - RNA, 64 nt, hsa
uaaaaauacacaaauuagcuaggcaugguggacucgccuguaaucucacuacacaggaggcuga

SEQ ID NO: 178631 - RNA, 64 nt, hsa
aauuaugccuuuuuugaucaggcacaguggcucacgccuguaauccuagcaguuugggaggcug

SEQ ID NO: 178632 - RNA, 64 nt, hsa
aaauuugaagugccuggcugggcgugguggcucacgccuguaaucccagcacuuugggaggccg

SEQ ID NO: 178633 - RNA, 64 nt, hsa
aaaaauacaaaaauucacaggguguguuggcacacgccuguaauaccagcuacucagguggcug

SEQ ID NO: 178634 - RNA, 64 nt, hsa
uacaaaaauuagccgggcguggugguggagcgcacgccuguagucccagcuacucgggaggcug

SEQ ID NO: 178635 - RNA, 64 nt, hsa
aaaauagaagcagcuggccgggugcgguggcucacgccuguaaucccagcacuuugggaggccg

SEQ ID NO: 178636 - RNA, 64 nt, hsa
aaaaauacaaaauuuagcugagugugguggcaggcgccuguaauccagcuacucgggaggcuga

SEQ ID NO: 178637 - RNA, 64 nt, hsa
aaauacaaaaaaauuagccaggcgugguggcgggcgccuguagucccagcuacuugggaggcug

SEQ ID NO: 178638 - RNA, 64 nt, hsa
ccaggagucaagagaauuuaugugagguggcucccgccuguaaucucagcacuuugggaggcca

SEQ ID NO: 178639 - RNA, 64 nt, hsa
uaaaaaaaucuaugcagcugggugcaguggcucacgccuguaaucccagcauuuugggaggcug

SEQ ID NO: 178640 - RNA, 64 nt, hsa
aaaauacaaaaaauuagccaggcgugguggcaggcgccuguagucccagcuacucgggaggcug

SEQ ID NO: 178641 - RNA, 64 nt, hsa
uaagaugaaaaacauggccgggcgggguggcucacgccuguaauccuagcacuuugggaggcug

SEQ ID NO: 178642 - RNA, 64 nt, hsa
aaaagaaagugugauggcugggugcaguggcucacgccuguaaucccagcacuuugggaggcuu

SEQ ID NO: 178643 - RNA, 64 nt, hsa
uaaagaacauuucuuggcugggcgcugcggcuugcgccuguaaucucagcacuuugggaggcug

SEQ ID NO: 178644 - RNA, 64 nt, hsa
aaaaaaaaaaaauaaagccgggcgugguggcucacgccuguaaucccggcacuuugggaggcug

SEQ ID NO: 178645 - RNA, 64 nt, hsa
acuacaaaaaaaauuagccaggcgugguggcgggcgccuguaaucccagcuacucaggaggcug

SEQ ID NO: 178646 - RNA, 64 nt, hsa
agaaacagcuuugggggccgggcgugguggcucacgccuguaaucccagcacuuugggaggccg

SEQ ID NO: 178647 - RNA, 64 nt, hsa
aauacaaaaaaaauuagcugagcgugguggcgggcgccuguaaucccagcuacuugggaggcug

SEQ ID NO: 178648 - RNA, 64 nt, hsa
uuaagaaacuugaaaagcugggcacgguggcucacgccuguaaucccagcacuuugggaggcug

SEQ ID NO: 178649 - RNA, 64 nt, hsa
aaaauacaaaaaauuagccaggcgugguggcacgcgccuguagucccagcuacucgggaggcug

SEQ ID NO: 178650 - RNA, 64 nt, hsa
aagaaauauggauggggccggccacaguggcucacgccuguaaucccagaacucuggaaggcug

SEQ ID NO: 178651 - RNA, 64 nt, hsa
uaaaaauacaaaauuagccaggcgugguggcguacgccuguaaucccagcuacucaggaggcag

SEQ ID NO: 178652 - RNA, 64 nt, hsa
aaaaauggucaaaggggcugggcaugguggcucacgccuguaaucucagcacuuugggaggccg

SEQ ID NO: 178653 - RNA, 64 nt, hsa
aaaauaugaaacauuagccaggugugguggcacgcgccuguaaucccagcuacucgggaggcug

SEQ ID NO: 178654 - RNA, 64 nt, hsa
aaaaaugcaaaaauuagccgggcgugguggcgggcgccuguaaucccagcuacuugggaagcug

SEQ ID NO: 178655 - RNA, 64 nt, hsa
aaugcacguagcugaggccggaugcgguggcucacgccuguaaucccagcacuuugggaggccu

SEQ ID NO: 178656 - RNA, 64 nt, hsa
uaaaaauauagaauuagccaggcaugguagcgcacgccuguaaucccaucuucuugggaggcug

SEQ ID NO: 178657 - RNA, 64 nt, hsa
aaaauauaaaaaauuagcugggcaugguggcgcacgccuguaguuccagcuacucaggaggcug

SEQ ID NO: 178658 - RNA, 64 nt, hsa
aaauaagcacaugauggcugggcaccguggcucacgccuguaaucccagcacuuugggaggcug

SEQ ID NO: 178659 - RNA, 64 nt, hsa
aagcgaaguaaaagaggccgggugcgguggcucacgccuguaaucccaacacuuuaggagucca

SEQ ID NO: 178660 - RNA, 64 nt, hsa
auaacaauaauauauggccaggcgggauggcucacgccuguaaucccagcacuuugggaggcug

SEQ ID NO: 178661 - RNA, 64 nt, hsa
aaaaauacaaaaauuagccgggcgugguggcuuacgccuguaaucccagcacuuugggaggcca

SEQ ID NO: 178662 - RNA, 64 nt, hsa
aaaaauacaaaaauuagcugggcgugguggcaugcgccuguaaucccagcuacccaggaggcug

SEQ ID NO: 178663 - RNA, 64 nt, hsa
gaagaaaaaaaugcaggcugggcgcgguggcucacgccuguaauccuagcacuuugggaggccg

SEQ ID NO: 178664 - RNA, 64 nt, hsa
aaaaaaagaaaaauuagccagacgugguggcaugcgccuguaaucccagcuacucaggaagcug

SEQ ID NO: 178665 - RNA, 64 nt, hsa
aaauuagccugguaaggccgggugcaguggcucacgccuguaaucccagcacuuugggaggcug

SEQ ID NO: 178666 - RNA, 64 nt, hsa
ucaaagcuagaucucagcugggugcgauggcucacgccuguaaucccggcacuuugggaggcca

SEQ ID NO: 178667 - RNA, 64 nt, hsa
aaaaauacaaaaacuagccaggaaugguggcgcgcgccuguaaucccaguuacuuaggaggcug

SEQ ID NO: 178668 - RNA, 64 nt, hsa
ucuacuaaaaauacaaaaagccgggcguggugggcgccuguaaucccagcugcucaggaggcug

SEQ ID NO: 178669 - RNA, 64 nt, hsa
caaaacucagaacguggccgggcgugguggcucacgccuguaaucccagcacuuugggaggcug

SEQ ID NO: 178670 - RNA, 64 nt, hsa
aaauacaaaaaaauuagccaggcaugguggcaagcgccuguagucccagcuacucuggaggcug

SEQ ID NO: 178671 - RNA, 64 nt, hsa
aauuuaaaaauuagcggccgggcgcaguggcucacgccuguaaucccagcacuuugggaggccg

SEQ ID NO: 178672 - RNA, 64 nt, hsa
uagaaaccauuuauuggccggacgcgguggcucacgccuguaaucgcagcacuuugggaggccg

SEQ ID NO: 178673 - RNA, 64 nt, hsa
aaaauacaaaaaauuagccgggcgugguggcgggcgccuguagucccagcuacucuggaggcug

SEQ ID NO: 178674 - RNA, 64 nt, hsa
uguaagcuuacccagcccggcgcacagugacucacgccuguaaucccagcacuuugggagggcg

SEQ ID NO: 178675 - RNA, 64 nt, hsa
aaaaauacaaaaauuaacugggugugguggcgggcgccuguaaucccagcuacugagggggcug

SEQ ID NO: 178676 - RNA, 64 nt, hsa
ugagaaggaagucugggcugggcaugguggcucacgccuguaacccuagcacuuuaggaaaucg

SEQ ID NO: 178677 - RNA, 64 nt, hsa
aaaaauacaaaaauuagcugggcaugguggcacccgccuguaguccagcuacuugaggcugaga

SEQ ID NO: 178678 - RNA, 64 nt, hsa
aauacaaaaaaaauuagccgggcgugguggcgggcgccuguagucccagcuacucgggaggcug

SEQ ID NO: 178679 - RNA, 64 nt, hsa
aaaaucuuaauuguuggcugggcacaguggcucacgccuguaaucccagcacuuugggaggccg

SEQ ID NO: 178680 - RNA, 64 nt, hsa
aaaaaggcugaaggcagccgggcgcaguggcucacgccuguaaucccagcacuuugggaggcug

SEQ ID NO: 178681 - RNA, 64 nt, hsa
aaauacaaaaaaauuagcugggcgugguggcacgcgccuguagucccagcugcucaggaggcug

SEQ ID NO: 178682 - RNA, 64 nt, hsa
aaggaucuuggggagguggccgggugcaguggcucgccuguaaucccagcacuuugggaggccg

SEQ ID NO: 178683 - RNA, 64 nt, hsa
aaaaagaaaaaaaauagccgggcgugguggcaggcgccuguaaucccagcuacuggggaggcug

SEQ ID NO: 178684 - RNA, 64 nt, hsa
aaauacaaaaaaauuagucgggcgugguggcggacgccuguauucacagcuacucgggagguug

SEQ ID NO: 178685 - RNA, 64 nt, hsa
uaaagagguuuugcuggccagguaugguggcucacgccuguaaucccagcacuuugggaggcua

SEQ ID NO: 178686 - RNA, 64 nt, hsa
aaaaauacaaaaauuagccgggcgugguggcccacgccuguaaucccagcuacucgggaggcua

SEQ ID NO: 178687 - RNA, 64 nt, hsa
aaaauacaaaaaauuagccgggcgugguagcgggcgccuguagucccagcuacucgggaggcug

SEQ ID NO: 178688 - RNA, 64 nt, hsa
caaaaaccuuccccaggcuggacgugguggcucacgccuguaaucccagcacuuugggaggcca

SEQ ID NO: 178689 - RNA, 64 nt, hsa
aguccuucacuacauggccaggugcaguggcucacgccuguagucccagguacuugggagccug

SEQ ID NO: 178690 - RNA, 64 nt, hsa
cacaagcugguccuuggccaggugcaguggcucacgccuguaaucccagcacuuugggaggcug

SEQ ID NO: 178691 - RNA, 64 nt, hsa
aaaguacaaaaaauuagcugggugugguggugggcgccuguagucccagcuacucgggaggcug

SEQ ID NO: 178692 - RNA, 64 nt, hsa
uuaagaaacuuaagcagccgggcaugguggcucacgccuguaaucccagcacuuugggaggccg

SEQ ID NO: 178693 - RNA, 64 nt, hsa
aaaauacaaaaaauuagcugggcaugguugcaggcgccuguagucccagcuacuugggaggcug

SEQ ID NO: 178694 - RNA, 64 nt, hsa
uaagaaggagcucuuggccgggcgcgguggcucacgccuguaaucccagcacuuugggaggccg

SEQ ID NO: 178695 - RNA, 64 nt, hsa
aaacaugcacggugaggccgggcgcaguggcucacgccuguaaucccagcacuuugggaggccg

SEQ ID NO: 178696 - RNA, 64 nt, hsa
uaaaaaaugaauuuggccagacacaggugccucacgccuguaaucccagcacuuugggaggcug

SEQ ID NO: 178697 - RNA, 64 nt, hsa
cauaagauaaggagaggccaggccugguggcucacgccuguaaucccagcacuuuaagaggcca

SEQ ID NO: 178698 - RNA, 64 nt, hsa
aaaaauacaaaaauuagcugggcuugguggcuggcgccuguaaucccagcuacucaggagacug

SEQ ID NO: 178699 - RNA, 64 nt, hsa
aaaauaccaaaaagaggcugggcgugguggcucacgccuguaaucccagcacuuugggaggccg

SEQ ID NO: 178700 - RNA, 64 nt, hsa
aaaaauacaaaaauuagccgggugugguggcgugcgccuguagucccagcuacucgggaggcug

SEQ ID NO: 178701 - RNA, 64 nt, hsa
aaguacaaaaaaaauagccgggccugguggcgggcgccuguagucccagcuacuugguaggcug

SEQ ID NO: 178702 - RNA, 64 nt, hsa
acuugauugacagccggccaggcgcgguggcucacgccuguaaucccagcacuuugggaggacg

SEQ ID NO: 178703 - RNA, 64 nt, hsa
aucucuacaaaaauuagcugggcgugguggcgcgcgccuguaaucccagcuacucaggaggcug

SEQ ID NO: 178704 - RNA, 64 nt, hsa
uaaaacuuggcuguuggccgggcacgguggcucacgccuguaaucccagcacuuugggaggcug

SEQ ID NO: 178705 - RNA, 64 nt, hsa
aagaaauucucuacuggccgggcacaguggcucacgccuguaaugccagcacuuugggaggcca

SEQ ID NO: 178706 - RNA, 64 nt, hsa
aaaaauacaaaaauuagcugggugugguggugcacgccuguaaucccagcuacucgggaggcug

SEQ ID NO: 178707 - RNA, 64 nt, hsa
aaaccuuacaaaggacgccgggcgugguggcucacgccuguaaucccagcacuuugggaggccg

SEQ ID NO: 178708 - RNA, 64 nt, hsa
acuguuuuaaggaggggcugggcucgguggcucacgccuguaaucccagacuuugagaggccaa

SEQ ID NO: 178709 - RNA, 64 nt, hsa
cuacaaaaaauacaaaaauuagccgggugggacacgccuguaaucccagcuacucaagaggcug

SEQ ID NO: 178710 - RNA, 64 nt, hsa
aaaauacaaaaaauuagccgggcgugguggcgggcgccuguagucccagcuacucugaagacug

SEQ ID NO: 178711 - RNA, 64 nt, hsa
aaauuacaaaaaauuagcugggcgugguggugcacgccuguagucucagcuacucaggaggcug

SEQ ID NO: 178712 - RNA, 64 nt, hsa
uaaaaaaggaaaaauaggccgggcugguggcucacgccuguaaucccagcacuuuggcaggcug

SEQ ID NO: 178713 - RNA, 64 nt, hsa
aaaaauaaaaaauuagcgaggcguggugggcgggcgccuguaaucccagcuacuugggaggcug

SEQ ID NO: 178714 - RNA, 64 nt, hsa
uaaaaaaucagagugggccgggcgcgguggcucacgccuguaaucccagcacuuuggaggccaa

SEQ ID NO: 178715 - RNA, 64 nt, hsa
aaaauacaaaaaauuagccaggcgugguggcgggcgccuguagucccagcuacucuggaggcug

SEQ ID NO: 178716 - RNA, 64 nt, hsa
aaaaauacacaacuuagccagucuuguuggcgcacgccuguaaucucagcuacuagggaugcug

SEQ ID NO: 178717 - RNA, 64 nt, hsa
ugguaaauguuucccggcugggcgcgguggcucacgccuguaaucccagcacuuugggaggccg

SEQ ID NO: 178718 - RNA, 64 nt, hsa
aaugaaauaaaauggggcugggcucaguggcucacgccuguaaucccagcacuuugggaggcug

SEQ ID NO: 178719 - RNA, 64 nt, hsa
aaaaaacagaaaauuagccgggcgugguggcgggcgccuguagucccagcuacucgggaggcug

SEQ ID NO: 178720 - RNA, 64 nt, hsa
gaaauacaaaaaauuagcugggcgugguggugggcgccuguaaucccaguuacucgggaggcug

SEQ ID NO: 178721 - RNA, 64 nt, hsa
aauaacuugcaucuaggcugggcguggcggcucacgccuguaaucccagcacuuugggaggccg

SEQ ID NO: 178722 - RNA, 64 nt, hsa
cuuucuccacaggcaggcucauuucacuaagcuccuccuuuacuuucucucuccucuuugaugu

SEQ ID NO: 178723 - RNA, 64 nt, hsa
cgcuguaagauuugucaaggcugacuacucacuucuccuuuaaauucuuuccuaccuugguccu

SEQ ID NO: 178724 - RNA, 64 nt, hsa
cccugcguucuuaauauugggcuauggagagauccuccuuuacccucuugaaauuucuuagcca

SEQ ID NO: 178725 - RNA, 64 nt, hsa
cugccaacauugaaaaauaaaaacagcagcuuuucuccuuuaccaccaccucuaccccuuucca

SEQ ID NO: 178726 - RNA, 64 nt, hsa
acuggaauuccugccaacaucugucacccugcagcuccuuuacaguucaauccaaugauagaaa

SEQ ID NO: 178727 - RNA, 52 nt, hsa
cagaugaccuaucagugugacccuccuuuaugggaggaucaggaccaggugg

SEQ ID NO: 178728 - RNA, 64 nt, hsa
gagauaugcuucaaacagaaaaugcccaccccuccuccuuuacccagcauaaacucuaugguua

SEQ ID NO: 178729 - RNA, 64 nt, hsa
gaaaauauaaaagguaguucugucucuauccugucuccuuuauucugcuacugcucucauucug

SEQ ID NO: 178730 - RNA, 64 nt, hsa
cgaacccccuaaaugcaaaaaauacucuuuuuugcuccuuuacccccaccuggacccugggcua

SEQ ID NO: 178731 - RNA, 64 nt, hsa
aauccacuucuucaagcuccaacacaaaugcugccuccuuuaggaugccugcucugugcucucc

SEQ ID NO: 178732 - RNA, 64 nt, hsa
auauauauauauaauuuaaaggaaaaauaggugccuccuuuauaaacaguaauagcuacguuug

SEQ ID NO: 178733 - RNA, 64 nt, hsa
cacagugaucuucaacuuaacaaacacuuacguucuccuuuauaaaaugcauaguaaaccacua

SEQ ID NO: 178734 - RNA, 64 nt, hsa
uauuucaaaaugccuuuccuaugauugucauguccuccuuuaaggcuuuucccucaaauuuauu

SEQ ID NO: 178735 - RNA, 64 nt, hsa
aagcaaguuacuuaaacucuugaguuuuagcuuucuccuuuacaaugcaugaaugccuaucccc

SEQ ID NO: 178736 - RNA, 64 nt, hsa
caguuaaauaccuccucuaccuuuaccuaaguugcuccuuuauuuuuauuuuauuauuauuauu

SEQ ID NO: 178737 - RNA, 64 nt, hsa
ugggauuacaggcaugagccaccaugcccagcugcuccuuuauuuuaaucccuaaauauaaucc

SEQ ID NO: 178738 - RNA, 64 nt, hsa
uaacauuucggcauguaauaaaacaagggccuaucuccuuuaaaauuuaacauuccauguaacu

SEQ ID NO: 178739 - RNA, 64 nt, hsa
auauauauauaugcccccuugugguuaauuauugcuccuuuaauaauuuuuacuugaaaugauc

SEQ ID NO: 178740 - RNA, 64 nt, hsa
aagagugacauuaaacuuugaaaggacuucacugcuccuuuacgauauuccaaauaguuuuuua

SEQ ID NO: 178741 - RNA, 64 nt, hsa
ugguuuuaguaaaaugagacuucuucaggagucacuccuuuacuguggacccauugcuuagugg

SEQ ID NO: 178742 - RNA, 64 nt, hsa
augagaccagacaagaaaaggauuaaacggguggcuccuuuaauauuauuauuauuguuuuuga

SEQ ID NO: 178743 - RNA, 64 nt, hsa
uccaugucuuccuaaagagcagaacuuggaguuucuccuuuauguagagaagaaguaacuuagg

SEQ ID NO: 178744 - RNA, 64 nt, hsa; identical to SEQ ID NO: 119656

SEQ ID NO: 178745 - RNA, 64 nt, hsa; identical to SEQ ID NO: 119657

SEQ ID NO: 178746 - RNA, 64 nt, hsa; identical to SEQ ID NO: 119658

SEQ ID NO: 178747 - RNA, 64 nt, hsa; identical to SEQ ID NO: 119659

SEQ ID NO: 178748 - RNA, 64 nt, hsa; identical to SEQ ID NO: 119660

SEQ ID NO: 178749 - RNA, 64 nt, hsa; identical to SEQ ID NO: 119661

SEQ ID NO: 178750 - RNA, 64 nt, hsa; identical to SEQ ID NO: 119662

SEQ ID NO: 178751 - RNA, 64 nt, hsa; identical to SEQ ID NO: 119663

SEQ ID NO: 178752 - RNA, 64 nt, hsa; identical to SEQ ID NO: 119664

SEQ ID NO: 178753 - RNA, 64 nt, hsa; identical to SEQ ID NO: 119665

SEQ ID NO: 178754 - RNA, 64 nt, hsa; identical to SEQ ID NO: 119666

SEQ ID NO: 178755 - RNA, 64 nt, hsa; identical to SEQ ID NO: 119667

SEQ ID NO: 178756 - RNA, 64 nt, hsa; identical to SEQ ID NO: 119668

SEQ ID NO: 178757 - RNA, 64 nt, hsa; identical to SEQ ID NO: 119669

SEQ ID NO: 178758 - RNA, 64 nt, hsa; identical to SEQ ID NO: 119670

SEQ ID NO: 178759 - RNA, 64 nt, hsa; identical to SEQ ID NO: 119671

SEQ ID NO: 178760 - RNA, 64 nt, hsa; identical to SEQ ID NO: 119672

SEQ ID NO: 178761 - RNA, 64 nt, hsa; identical to SEQ ID NO: 119673

SEQ ID NO: 178762 - RNA, 64 nt, hsa; identical to SEQ ID NO: 119674

SEQ ID NO: 178763 - RNA, 64 nt, hsa; identical to SEQ ID NO: 119675

SEQ ID NO: 178764 - RNA, 64 nt, hsa; identical to SEQ ID NO: 119676

SEQ ID NO: 178765 - RNA, 64 nt, hsa; identical to SEQ ID NO: 119677

SEQ ID NO: 178766 - RNA, 64 nt, hsa; identical to SEQ ID NO: 119678

SEQ ID NO: 178767 - RNA, 64 nt, hsa; identical to SEQ ID NO: 119679

SEQ ID NO: 178768 - RNA, 64 nt, hsa
aagugcuggaauuauaggcgugaaccaccgcccccggcugcaguuggauuuuuaaauugcuuuu

SEQ ID NO: 178769 - RNA, 64 nt, hsa
gugacagggucugcggcaccgcgccuggccaggccggcugcaguuucucacuucccuguuccau

SEQ ID NO: 178770 - RNA, 64 nt, hsa
ccgcugucucccaggugcuugcugggacucggggcggcugcaccuggcugucaccugggugugc

SEQ ID NO: 178771 - RNA, 64 nt, hsa
gcuucagaggaguguugagugacaccugaggaugcggcugcacacacucagccaagggccgagu

SEQ ID NO: 178772 - RNA, 64 nt, hsa
guuauuuacaucaaaaagcuuuuagaaaaugguacgagguaaccaauucuugucauggugaaau

SEQ ID NO: 178773 - RNA, 64 nt, hsa
ugcucuaugagccuuuugccagccucagaauaggcgagguaaccuugaauuucagggcccugga

SEQ ID NO: 178774 - RNA, 64 nt, hsa
ucugacccucagggccucucggaauguaguugcucgagguaaccgcuagagggugcgcaccugg

SEQ ID NO: 178775 - RNA, 64 nt, hsa
ggcuggggaaggcccucggagcucguuuccagaucgagguaagagggacuuucuuaaaggccua

SEQ ID NO: 178776 - RNA, 64 nt, hsa
auuuugcugacagauaacuaaccgaugaugaggccgagguaaaagagacaucugcagugugaca

SEQ ID NO: 178777 - RNA, 64 nt, hsa
cuuacagguccccaacagcgauacugcuguuucucgagguaagagauucagccauccaauuggu

SEQ ID NO: 178778 - RNA, 64 nt, hsa
cucucucuuugucaugaaagccagcuccuuguggcgagguaaaguggaauuccaauaaagaaau

SEQ ID NO: 178779 - RNA, 64 nt, hsa
guuuccccagugucauucaauaugcucuaaacgacgagguaaugcugaggcuauugcugaauaa

SEQ ID NO: 178780 - RNA, 64 nt, hsa
uuacugguuugacuauaauucucuguuaucuuuacgagguaaaacugcaagcugacuagcaugu

SEQ ID NO: 178781 - RNA, 64 nt, hsa
caguuacaccacgauuccuuccucuucacuggcucgagguaaacccuuuucaaggaaaaacaac

SEQ ID NO: 178782 - RNA, 64 nt, hsa
aggcuccucuuguagaacugccucuuugaaauuucgagguaaucuacuuuggagacucugccug

SEQ ID NO: 178783 - RNA, 64 nt, hsa
gauggcuuuuuggcuaggacuguucgaaagcaggcgagguaaauggacaguggacagccgccuc

SEQ ID NO: 178784 - RNA, 64 nt, hsa
uuagggguuucugacauauauucuggauacuauccgagguaauuuugaaguuuaauauaaaugc

SEQ ID NO: 178785 - RNA, 64 nt, hsa
ugcugugggccaaagccaagcccaucugccaggacgagguaaugucagagcuccaucagcccgg

SEQ ID NO: 178786 - RNA, 64 nt, hsa
ccaaauuguggcuauugauuuuugcuaggguccccgagguaaguggggaaggaaccucccuccu

SEQ ID NO: 178787 - RNA, 64 nt, hsa
gcucucagugaccccgacugucuccugacuuagccgagguaaggucagugcagcagacagggcc

SEQ ID NO: 178788 - RNA, 64 nt, hsa
caaagacacgucugcauuugaauuucuagauuuucgagguaaggaguuuuuuuuaauugguugu

SEQ ID NO: 178789 - RNA, 64 nt, hsa
uucucugaaucuuuaaugaaaucauuugccagagcgagguaaucaucugcauuuggcuacugca

SEQ ID NO: 178790 - RNA, 64 nt, hsa
cugggcagggccugcaccagggaggaguggaggacgagguaacucagcagcaaugucaccuugu

SEQ ID NO: 178791 - RNA, 64 nt, hsa
gauauugucagucuuuagggguugggcuggaugccgagguaaaaguucuuuuugcucuaaaaga

SEQ ID NO: 178792 - RNA, 64 nt, hsa
accacuguugccauggugaccaaacucuggaguccgagguaacagaacaccugucccccuaggc

SEQ ID NO: 178793 - RNA, 64 nt, hsa
ucuugugaacucccaucaccuucaagaaagcuuccgagguaagaauuuuauggucaucugggac

SEQ ID NO: 178794 - RNA, 64 nt, hsa
gaugguucugcccacucugguuucucugaaaaaacgagguaauucccugagcccaacccugauc

SEQ ID NO: 178795 - RNA, 64 nt, hsa
caaagccccugggguaacaguccccaccgcuacccgagguaaaacaauaaaagcuaugugguug

SEQ ID NO: 178796 - RNA, 64 nt, hsa
aaaacgcagacauuuuuuaggggaauaaagagggcgagguaaaguuuauggaacucaguguuag

SEQ ID NO: 178797 - RNA, 64 nt, hsa; identical to SEQ ID NO: 131365

SEQ ID NO: 178798 - RNA, 64 nt, hsa; identical to SEQ ID NO: 131366

SEQ ID NO: 178799 - RNA, 64 nt, hsa; identical to SEQ ID NO: 131367

SEQ ID NO: 178800 - RNA, 64 nt, hsa; identical to SEQ ID NO: 131368

SEQ ID NO: 178801 - RNA, 64 nt, hsa; identical to SEQ ID NO: 131369

SEQ ID NO: 178802 - RNA, 64 nt, hsa; identical to SEQ ID NO: 131370

SEQ ID NO: 178803 - RNA, 64 nt, hsa; identical to SEQ ID NO: 131371

SEQ ID NO: 178804 - RNA, 64 nt, hsa; identical to SEQ ID NO: 131372

SEQ ID NO: 178805 - RNA, 64 nt, hsa; identical to SEQ ID NO: 131373

SEQ ID NO: 178806 - RNA, 64 nt, hsa; identical to SEQ ID NO: 131374

SEQ ID NO: 178807 - RNA, 64 nt, hsa; identical to SEQ ID NO: 131375

SEQ ID NO: 178808 - RNA, 64 nt, hsa; identical to SEQ ID NO: 131376

SEQ ID NO: 178809 - RNA, 64 nt, hsa; identical to SEQ ID NO: 131377

SEQ ID NO: 178810 - RNA, 64 nt, hsa; identical to SEQ ID NO: 131378

SEQ ID NO: 178811 - RNA, 64 nt, hsa; identical to SEQ ID NO: 131379

SEQ ID NO: 178812 - RNA, 64 nt, hsa; identical to SEQ ID NO: 131380

SEQ ID NO: 178813 - RNA, 64 nt, hsa; identical to SEQ ID NO: 131381

SEQ ID NO: 178814 - RNA, 64 nt, hsa; identical to SEQ ID NO: 131382

SEQ ID NO: 178815 - RNA, 64 nt, hsa
augugagauuugcugcuguugcaguauaaacacuagguauaauaggauuugaaauugcauuaca

SEQ ID NO: 178816 - RNA, 64 nt, hsa
uuugcaauuauuaguugauucacaguacagaacaagguauaaaggaaaaaacccugcuagguag

SEQ ID NO: 178817 - RNA, 64 nt, hsa
cuuuuaaauuauggaguauuuuaagucuacaaaaagguauaaauaauaauauaaugaauuccua

SEQ ID NO: 178818 - RNA, 64 nt, hsa
acauuuagauuuagaguuuuuuuuuucuuucacaagguauaauaaggaaaggauccuacaauau

SEQ ID NO: 178819 - RNA, 64 nt, hsa
uuaacuuucuuuuauaauccuuaaugugaggcuaagguauaaggagaaaggagauugguaagga

SEQ ID NO: 178820 - RNA, 64 nt, hsa
aaauauuaaaaacugaguauuguaguuauuugcuagguauaaaaggugacucagaguagagagu

SEQ ID NO: 178821 - RNA, 64 nt, hsa
uguagcuugauagugaaauaaggagcuugggcuaagguauaaaucaacacacugcuuccuuccu

SEQ ID NO: 178822 - RNA, 64 nt, hsa
acuaaacagcugucuuucaggguaucauuuuuaaagguauaaggaacaaacuuuaauguauuga

SEQ ID NO: 178823 - RNA, 64 nt, hsa
ggauaaaggcauugcuuaacuucuuauauaauuuagguauaaauucugugacaugcucuugagc

SEQ ID NO: 178824 - RNA, 64 nt, hsa
uaaaauuuagaaauuguucauuaaaucccauuugagguauaagucacucaggaaguuaaaauau

SEQ ID NO: 178825 - RNA, 64 nt, hsa
uccagaggacagcaggacacucucgcauacuuugccaaaugaggccugcucagaggaguaggag

SEQ ID NO: 178826 - RNA, 64 nt, hsa
gccaaugcccaaaauaaggaguuccaauuuggggccaaaugaggaaggacacagacucugcccu

SEQ ID NO: 178827 - RNA, 64 nt, hsa
acacacagaugugggguacacugaacuucaaagcccaaaugaauagaaacacauuuucuggcua

SEQ ID NO: 178828 - RNA, 64 nt, hsa
cucccuguuugacuucacacacacucauaacuuuccaaaugaaaccccacaguauagcgcauau

SEQ ID NO: 178829 - RNA, 64 nt, hsa
aaguaucacacucagacaccaccgcuuccuagagccaaaugagcaaucccaaacugcaagugcc

SEQ ID NO: 178830 - RNA, 64 nt, hsa
ucgggcagggagcggagauuccucauaggugaguccaaaugaccuccagccucucgaaggcauc

SEQ ID NO: 178831 - RNA, 64 nt, hsa
uaauaaucuguggacugugccauuuuacaguguaccaaaugagaaugagguugaaauguaugca

SEQ ID NO: 178832 - RNA, 64 nt, hsa
uauaauuuugccuuguauuaaauguuacaaaguuccaaaugaaucaguauuuuaaaaaauaaaa

SEQ ID NO: 178833 - RNA, 64 nt, hsa
ucuggaaguuuugucuugggcaguaugggcugggccaaaugaaaugauuuuuauaauucuaaac

SEQ ID NO: 178834 - RNA, 64 nt, hsa
aaaugaaaugauuuuuauaauucuaaacagguuaccaaaugaaaugucauggcuuuacuuuggu

SEQ ID NO: 178835 - RNA, 64 nt, hsa
ucuuuauguggaagaauagauuuuaaaguacaagccaaaugauuuucauugguggaacugacac

SEQ ID NO: 178836 - RNA, 64 nt, hsa
cccacauucaauaugaagcaccaccagauggcuaccaaaugauaagaacaacagcaacaaaagg

SEQ ID NO: 178837 - RNA, 64 nt, hsa
gaaacccaacaaaugccuuucauauauacgagaaccaaaugaagucagaauuugccauuauugc

SEQ ID NO: 178838 - RNA, 64 nt, hsa
uaugaauggugcagguugacucugauauucauucccaaaugacaguauggcagaguguuccaga

SEQ ID NO: 178839 - RNA, 64 nt, hsa; identical to SEQ ID NO: 166398

SEQ ID NO: 178840 - RNA, 64 nt, hsa; identical to SEQ ID NO: 166399

SEQ ID NO: 178841 - RNA, 64 nt, hsa; identical to SEQ ID NO: 166400

SEQ ID NO: 178842 - RNA, 64 nt, hsa; identical to SEQ ID NO: 166401

SEQ ID NO: 178843 - RNA, 64 nt, hsa; identical to SEQ ID NO: 166402

SEQ ID NO: 178844 - RNA, 64 nt, hsa; identical to SEQ ID NO: 166403

SEQ ID NO: 178845 - RNA, 64 nt, hsa; identical to SEQ ID NO: 166404

SEQ ID NO: 178846 - RNA, 64 nt, hsa; identical to SEQ ID NO: 166405

SEQ ID NO: 178847 - RNA, 64 nt, hsa; identical to SEQ ID NO: 166406

SEQ ID NO: 178848 - RNA, 64 nt, hsa; identical to SEQ ID NO: 166407

SEQ ID NO: 178849 - RNA, 64 nt, hsa; identical to SEQ ID NO: 166408

SEQ ID NO: 178850 - RNA, 64 nt, hsa; identical to SEQ ID NO: 166409

SEQ ID NO: 178851 - RNA, 64 nt, hsa; identical to SEQ ID NO: 166410

SEQ ID NO: 178852 - RNA, 64 nt, hsa; identical to SEQ ID NO: 166411

SEQ ID NO: 178853 - RNA, 64 nt, hsa; identical to SEQ ID NO: 166412

SEQ ID NO: 178854 - RNA, 64 nt, hsa; identical to SEQ ID NO: 166413

SEQ ID NO: 178855 - RNA, 64 nt, hsa; identical to SEQ ID NO: 166414

SEQ ID NO: 178856 - RNA, 64 nt, hsa; identical to SEQ ID NO: 166415

SEQ ID NO: 178857 - RNA, 64 nt, hsa; identical to SEQ ID NO: 166416

SEQ ID NO: 178858 - RNA, 64 nt, hsa; identical to SEQ ID NO: 166417

SEQ ID NO: 178859 - RNA, 64 nt, hsa; identical to SEQ ID NO: 166418

SEQ ID NO: 178860 - RNA, 64 nt, hsa; identical to SEQ ID NO: 166419

SEQ ID NO: 178861 - RNA, 64 nt, hsa; identical to SEQ ID NO: 166420

SEQ ID NO: 178862 - RNA, 64 nt, hsa; identical to SEQ ID NO: 166421

SEQ ID NO: 178863 - RNA, 64 nt, hsa; identical to SEQ ID NO: 166422

SEQ ID NO: 178864 - RNA, 64 nt, hsa; identical to SEQ ID NO: 166423

SEQ ID NO: 178865 - RNA, 64 nt, hsa; identical to SEQ ID NO: 166424

SEQ ID NO: 178866 - RNA, 64 nt, hsa; identical to SEQ ID NO: 166425

SEQ ID NO: 178867 - RNA, 64 nt, hsa; identical to SEQ ID NO: 166426

SEQ ID NO: 178868 - RNA, 64 nt, hsa; identical to SEQ ID NO: 166427

SEQ ID NO: 178869 - RNA, 64 nt, hsa; identical to SEQ ID NO: 166426

SEQ ID NO: 178870 - RNA, 64 nt, hsa; identical to SEQ ID NO: 166429

SEQ ID NO: 178871 - RNA, 64 nt, hsa
guuugaggacaaacuccaaggucccuuaaaaagugccuuuuagaggcugggcaugguggcucac

SEQ ID NO: 178872 - RNA, 64 nt, hsa
caagagggaaacuccgucucaaaaaaaaaaaagugccuuuuaggccggaugugguggcucaugc

SEQ ID NO: 178873 - RNA, 64 nt, hsa
cuugaguuucuuuucauguacauaaaaagcaauagccuuuuaguauagauagcccugagccaaa

SEQ ID NO: 178874 - RNA, 64 nt, hsa
caugucagacuuugagcugauccugaauaauaaagccuuuuaccuuaucugauguccuuuucug

SEQ ID NO: 178875 - RNA, 64 nt, hsa
ccuucuggcucccaagcacccagagcuuuccuccgccuuuuaguuuugguuccuccacuggaau

SEQ ID NO: 178876 - RNA, 64 nt, hsa
gcuguagaguccuuggcaaaucacaacauucugggccuuuuaacucaccagguugcuugugagg

SEQ ID NO: 178877 - RNA, 64 nt, hsa
auguuauuccacuacaaaaaccacaaguuaucuggccuuuuagaucuuuuuggaaucggaccug

SEQ ID NO: 178878 - RNA, 64 nt, hsa
cugggcaguuuugcuugaucuuuugugacuuugagccuuuuaaguaguuugaaugauaagacuu

SEQ ID NO: 178879 - RNA, 64 nt, hsa
gcucugugacaucuuugguuuauaggauuuuggagccuuuuaugaucuggaacuauuugagggg

SEQ ID NO: 178880 - RNA, 64 nt, hsa
cauauccucuuaucaccucagacucagacacaaggccuuuuacauggaaauuuuacaaauuacu

SEQ ID NO: 178881 - RNA, 64 nt, hsa
ggccucauacucuuuuuuccauuuucuacaagaagccuuuuaguauaugaaaauuauuacucuu

SEQ ID NO: 178882 - RNA, 64 nt, hsa
ccacugcaccuggccucauguuuuuuaaauaauugccuuuuauauuuacccuuuuugucaucac

SEQ ID NO: 178883 - RNA, 64 nt, hsa
aguuuuugucuuuucuguugucuucaaauuuuaugccuuuuauuuuuaauuuaaucccguucaa

SEQ ID NO: 178884 - RNA, 64 nt, hsa
uguagaugguuaauuuacagauaaaaucccaagagccuuuuaaacaacaagguaccuaaaauag

SEQ ID NO: 178885 - RNA, 64 nt, hsa
aguaccagaacuuagaaggaaagucacaaagcaugccuuuuaccagaauauugcuuugccuuuu

SEQ ID NO: 178886 - RNA, 64 nt, hsa
cugcauuggggacuucuagauagguuaaugaaaggccuuuuauucuguuacuggacaugaaaac

SEQ ID NO: 178887 - RNA, 64 nt, hsa
guggggauggugauuaaacaccucuuuuggguaugccuuuuaaaaaugcuuauagagaaaaaaa

SEQ ID NO: 178888 - RNA, 64 nt, hsa
uaaaguuaaccacaguggccuuuuaacaaauguugccuuuuauaauguuaucuuuaugaguuuc

SEQ ID NO: 178889 - RNA, 64 nt, hsa
uauugacuccagugacauaaaguuaaccacaguggccuuuuaacaaauguugccuuuuauaaug

SEQ ID NO: 178890 - RNA, 64 nt, hsa
ugagcccuguggggugacgcuucagggcagagcugccuuuuaauuuuuauucucagagcaucag

SEQ ID NO: 178891 - RNA, 64 nt, hsa
gugggcaaagcagaaaccugcggggagcggagacgccuuuuaucucuggaugccacagaccuga

SEQ ID NO: 178892 - RNA, 64 nt, hsa
agggucaagcccugagcagcuucacuuccccugcgccuuuuauguccccaccuugaggccuugc

SEQ ID NO: 178893 - RNA, 64 nt, hsa
uaauaggauaaguacucuguugccagauuaccaugccuuuuauacaaaaccaaauuaacuuacc

SEQ ID NO: 178894 - RNA, 64 nt, hsa
agcacuuggagugagcgaacauuuccugauaaaugccuuuuagagauagguucuugauauucag

SEQ ID NO: 178895 - RNA, 64 nt, hsa
uguagcaguauuuuuauuagaaaagaaucuauuggccuuuuacaggguauuaaucccuuuguca

SEQ ID NO: 178896 - RNA, 64 nt, hsa
ccccagcccugugggcccccaccuccaucgcccagccuuuuauuacacacucugagagugucuc

SEQ ID NO: 178897 - RNA, 64 nt, hsa
uauuguuauuauuaauuggcuuucuguauucuaugccuuuuauuuauaaagacacuaagaaaac

SEQ ID NO: 178898 - RNA, 64 nt, hsa
ucccuuccuuccuuucuuccauucauccuuccuugccuuuuauuuuuauuuuuuguaauaucac

SEQ ID NO: 178899 - RNA, 64 nt, hsa
aacaguuaaucccuaaggucuugacaaaacagaagaaaaacaagccuccucguccuagucuuuu

SEQ ID NO: 178900 - RNA, 64 nt, hsa
auaaaaugcaacacuuggcauuuuuauguuuuaagaaaaacaguauuuuauuuauaauaaaauc

SEQ ID NO: 178901 - RNA, 64 nt, hsa
uaagaucauuuuccugaaagccaaaccaaacaacgaaaaacaagaacaacuaauucagaaucaa

SEQ ID NO: 178902 - RNA, 64 nt, hsa
uauaauaggacuugccuauuuucauuuuuaagaagaaaaacaccacucauuuuauaaaauauag

SEQ ID NO: 178903 - RNA, 64 nt, hsa
acuugaaagauaacacaauuuuacaaauuuguuggaaaaacaugaauucauaaauucaggaagc

SEQ ID NO: 178904 - RNA, 64 nt, hsa
aacaagcgaaacugaaacaaacagaugcucagaugaaaaacagauguuauccucagcacaaauu

SEQ ID NO: 178905 - RNA, 64 nt, hsa
gaguauauguucagcaauguugaucucauaaaaggaaaaacaaaagauuuaaguauucuauaua

SEQ ID NO: 178906 - RNA, 64 nt, hsa
cuguuaacuaaaaaugcugagaccccuuuuuauagaaaaacaaaaagacaucaagucuucuuaa

SEQ ID NO: 178907 - RNA, 64 nt, hsa
ggaagaaaaaaggccuugaauugacaaauuaacagaaaaacagaacaaguuuauucuaucauuu

SEQ ID NO: 178908 - RNA, 64 nt, hsa
uaucauguacaguuuuauuuuauaacgugaggaggaaaaacagucuuuggauuaacccucuaua

SEQ ID NO: 178909 - RNA, 64 nt, hsa
ugccgccgccucccugcagggccccuguuccaaugaaaaacagaacacaaaagagcagagcacc

SEQ ID NO: 178910 - RNA, 64 nt, hsa
ggaaaaaaguaauuaugagguguagcagauugcagaaaaacaggauuagaaacacacuuaaaaa

SEQ ID NO: 178911 - RNA, 64 nt, hsa
aauacauacauguauggaaacauauucagauugggaaaaacaauggacauuaguuuuuaaaaag

SEQ ID NO: 178912 - RNA, 64 nt, hsa
aggaaugucccacaaaacauuuccauucccugaggaaaaacauuuucuuuccuacauguaucuc

SEQ ID NO: 178913 - RNA, 64 nt, hsa
uuuucccagaaaaucaguauuauuuuuuaaauaagaaaaacauuccuagaagaugauaauugug

SEQ ID NO: 178914 - RNA, 64 nt, hsa
cuuggucugacuuguaccaauucuagcacccacugaaaaacaaguugaguagagaguguagagu

SEQ ID NO: 178915 - RNA, 64 nt, hsa
uuuuuuuguuguucuauuuuguacagacaaguuggaaaaacaacagcgacaaaaaagucaagaa

SEQ ID NO: 178916 - RNA, 64 nt, hsa
uacagaaaaauauauauuuuaaguuuaaaaaacagaaaaacagacaaaacaauccccaucaggu

SEQ ID NO: 178917 - RNA, 64 nt, hsa
uuucacagacaucauagauccuuuucuuaaagaagaaaaacauguauaaaauaguuuuaguagu

SEQ ID NO: 178918 - RNA, 64 nt, hsa
agaggaggcagagagagggaggcagauggaagaagaaaaacaguuaaauaagacauacccaguc

SEQ ID NO: 178919 - RNA, 64 nt, hsa
aaaauguuuauuuaaaaaaaaaaaagaugacaaagaaaaacagagagagagaauauuggagaug

SEQ ID NO: 178920 - RNA, 64 nt, hsa
cccagggcguuaaauucacagauuuuuuuaacgagaaaaacacacagaagaagcuaccucaggu

SEQ ID NO: 178921 - RNA, 64 nt, hsa
auuuuuguaguuuugguauuuaaagcaaaaaaacgaaaaacaaaaaacaaaaacaaaccuuuug

SEQ ID NO: 178922 - RNA, 64 nt, hsa
uuugggggauuguuuuguuuuggugguuguuuuggaaaaacaguuuauaaacugauuuuuguag

SEQ ID NO: 178923 - RNA, 64 nt, hsa
aucuucaaaaaauauauuuuagucuguuauuuaagaaaaacauaacaucccaaaaucuuugaca

SEQ ID NO: 178924 - RNA, 64 nt, hsa
cugaggcugggggccagagaagcuuuuacgcauggaaaaacacuaaucaugccaagguguaugu

SEQ ID NO: 178925 - RNA, 58 nt, hsa
auuuauuauaucguacauaaguuaguaugaaaaacagacuaucaccuuuauugagaaa

SEQ ID NO: 178926 - RNA, 64 nt, hsa
aauacauuccuuggauaucugacaacguguuucugaaaaacagauuuucauaaguaauaauaaa

SEQ ID NO: 178927 - RNA, 64 nt, hsa
auaagguaccaaauaugaugcaauaaauuguuuugaaaaacaguugugugaauauuucaacuaa

SEQ ID NO: 178928 - RNA, 64 nt, hsa
auucauccuauuaauuucaaaugauacugugggggaaaaacaggguuagaaaaacaaguggaaa

SEQ ID NO: 178929 - RNA, 64 nt, hsa
uuucaaaugauacugugggggaaaaacaggguuagaaaaacaaguggaaaaaauggagugaugu

SEQ ID NO: 178930 - RNA, 64 nt, hsa
cauucccccaugcuuuucuguuuucaaaaaaauugaaaaacaaaucaacucuuauccccaacag

SEQ ID NO: 178931 - RNA, 64 nt, hsa
uguccggagucuuuggguuugauucaccugcugcgaaaaacauucaacaaauuguguacaagau

SEQ ID NO: 178932 - RNA, 64 nt, hsa
ucuugaaaacgguacauauuuuaguauuugugcagaaaaacaaguccuaaaguauuuguuuuua

SEQ ID NO: 178933 - RNA, 64 nt, hsa
augguaugugccauuuguaaaauaaaauagagcagaaaaacacaaaaagagaacacugguucag

SEQ ID NO: 178934 - RNA, 64 nt, hsa
uaaauuuagauuauguauuccuuuugaaacauaagaaaaacauuuaaaccuaugcugaaaauac

SEQ ID NO: 178935 - RNA, 64 nt, hsa
aaacauuuaaaccuaugcugaaaauacgauaaaagaaaaacaacuccaauaugcuaaaaguuaa

SEQ ID NO: 178936 - RNA, 64 nt, hsa
aaacuacuaaccagaggagucuaugccauuuuaagaaaaacaauuaaccugguuaaagagaaau

SEQ ID NO: 178937 - RNA, 64 nt, hsa
guuuauaauccugaugcauuucaguaauaauguagaaaaacauuauuuuaaaaaaguuccaaca

SEQ ID NO: 178938 - RNA, 64 nt, hsa
agagaguuuggacaucucacucaaaaguacaucagaaaaacaggaauccgugauuuuauaccag

SEQ ID NO: 178939 - RNA, 64 nt, hsa
cuaauuaaaaagcacucaggugauaauuauguaggaaaaacaaucuugccaaauaaugaauuca

SEQ ID NO: 178940 - RNA, 64 nt, hsa
ucaagccaugugcuuuagcauaaaagaauauuuagaaaaacaucccaagaaaaucacaucacua

SEQ ID NO: 178941 - RNA, 64 nt, hsa
guuaugguuuaauguuacaacaacuauuuuuuaagaaaaacaaguuuuagaaauuugguuucaa

SEQ ID NO: 178942 - RNA, 64 nt, hsa
uccacaaggucuuaauaaaaugauucuauagcuagaaaaacauuuaccuucccagugcuuugca

SEQ ID NO: 178943 - RNA, 64 nt, hsa
gaauucuuguccauuuuuguaaucaagauuuuaggaaaaacagaaguacaucuaucuuuaugaa

SEQ ID NO: 178944 - RNA, 64 nt, hsa
uaaacaucuucaaaugguacuaugaggaaaaaaagaaaaacauuuuucuaaauauucaacuaua

SEQ ID NO: 178945 - RNA, 60 nt, hsa
agugcacggagaagccuuaaacacacccccgaaaaacacaagaccgacccaaaaucuaga

SEQ ID NO: 178946 - RNA, 64 nt, hsa
uuuuugaaaggggacuccuuuacauuccaaaagggaaaaacaucacagcaauaguugcuauacg

SEQ ID NO: 178947 - RNA, 64 nt, hsa
uuuuaauaaaaauauucuguguaaaaaguacucagaaaaacaucuaaagcuguuggagaagagg

SEQ ID NO: 178948 - RNA, 64 nt, hsa
aacauuuuucuuugguucuuuuuuccuuuuuuaggaaaaacaaaacaacagacuucauccuuag

SEQ ID NO: 178949 - RNA, 64 nt, hsa
ccucaucuagcuaugaauucugggaagucaaugugaaaaacauugcugcauucaugcaagacug

SEQ ID NO: 178950 - RNA, 64 nt, hsa
ucugaaacuucuuaucaauuaccuaaaucucaacgaaaaacaauuuacugaagccgacuccccu

SEQ ID NO: 178951 - RNA, 64 nt, hsa
aagcuucagaccgcuaguaaggcucaaagaagaagaaaaacaccaaaaccacaagggaaaagaa

SEQ ID NO: 178952 - RNA, 64 nt, hsa
uggauaaguccuuuuuaagaaaaaaaaagaaaaugaaaaacaacacaaaaaaaauagaaaacuc

SEQ ID NO: 178953 - RNA, 64 nt, hsa
gcucuauugcaauucccuauuauauucugcaucagaaaaacaaacaaaacaaaaacaacuuuaa

SEQ ID NO: 178954 - RNA, 64 nt, hsa
agucaaccucagaaaguaacuaucuugaagguuugaaaaacaaccaaagaaagggagugaggac

SEQ ID NO: 178955 - RNA, 64 nt, hsa
uauccauaaaaaaaaauagaugucuuuuauaguggaaaaacacauggggaaaaaaaucaucuau

SEQ ID NO: 178956 - RNA, 64 nt, hsa
gaacuugcuacguuucaggugcuagggacuuaaugaaaaacaggacaaaacaauuccuuuuugu

SEQ ID NO: 178957 - RNA, 64 nt, hsa
ccaaugagcuauccauagcuaacuugcuugcucagaaaaacauaaguaacaaaguugagcuuuc

SEQ ID NO: 178958 - RNA, 64 nt, hsa
uuccuacugccuguguugcuacuuuaagagcugagaaaaacauuccaaugagcuauccauagcu

SEQ ID NO: 178959 - RNA, 64 nt, hsa
uuuaggaauuguccuuauagcauugcauacacaagaaaaacagagaaaagccugaucccuguca

SEQ ID NO: 178960 - RNA, 64 nt, hsa
uuuuuucuuugaagacuuucuaaauuaggaagcagaaaaacaaaucucuaggagauucugccaa

SEQ ID NO: 178961 - RNA, 64 nt, hsa
ucauucagauucuuuguucguagagcaguuauuugaaaaacaguuauggaacacaaaacauuuu

SEQ ID NO: 178962 - RNA, 64 nt, hsa
aucauaccauaaugugucauagcuauaggcacaagaaaaacaacaguuugagagaauauuauau

SEQ ID NO: 178963 - RNA, 64 nt, hsa
ggagcugucuggagcuccaccuuugcaaagaaaggaaaaacacaaauugcccccagauuggccc

SEQ ID NO: 178964 - RNA, 64 nt, hsa
aucagggaacagggcagcucuguuugaauggggugaaaaacagcaaaauuaauucuuagcaagc

SEQ ID NO: 178965 - RNA, 64 nt, hsa
ugcacaguccugccucuuagauuacagucagccagaaaaacauacuuauaaaucaucccuuuuc

SEQ ID NO: 178966 - RNA, 64 nt, hsa
ccaagaaccagcccauugcuacagcuagaguggagaaaaacagagugacucaaaagccaugggu

SEQ ID NO: 178967 - RNA, 64 nt, hsa
cccuacccagccugcugccucagcacagccaagggaaaaacaaaaaccccacaaaauaccccaa

SEQ ID NO: 178968 - RNA, 64 nt, hsa
gagcaagauagacaaaagccaaucagcuuaaaaagaaaaacaaggaaggggaaaagaaaacucu

SEQ ID NO: 178969 - RNA, 64 nt, hsa
accuggccccaugucucucagaauucuucagguggaaaaacaucugaaagccacguuccuuacu

SEQ ID NO: 178970 - RNA, 64 nt, hsa
aggcacgaacccaccugcugagagacccaaggaggaaaaacagacaaaaacagccucacagaag

SEQ ID NO: 178971 - RNA, 64 nt, hsa
auuuccacaucgugagucauuuuacuuuaaaagggaaaaacaaauuuguagcaacucugaagua

SEQ ID NO: 178972 - RNA, 64 nt, hsa
auaauggauuuuuaacagagaagucuuuguuuuugaaaaacaaaaaucaaaaacaguaacuauu

SEQ ID NO: 178973 - RNA, 64 nt, hsa
aauucuauauuuuacauucuuggaaagucuauaugaaaaacaaaaauaacaucuucaguuuuuc

SEQ ID NO: 178974 - RNA, 64 nt, hsa
cguuuaauacuauaaauaauauucuauucauuuugaaaaacacaaugauuccuucuuuucuagg

SEQ ID NO: 178975 - RNA, 64 nt, hsa
auaagugaaaagagagaaaggaaaagaaaaaggagaaaaacaaagagauuucuaccagugaaag

SEQ ID NO: 178976 - RNA, 64 nt, hsa
aggcagaauacuggcaagaaaugaggaagagagagaaaaacaauauaacuuucuugagugcaaa

SEQ ID NO: 178977 - RNA, 64 nt, hsa
aaaaaaaaaauuguuuagugaauacagaggaaaggaaaaacaaguauuaaaggcacaugaaacc

SEQ ID NO: 178978 - RNA, 64 nt, hsa
caaguauuacaggagaaggauugggaacagaauggaaaaacaguguaugaaagucauguuacag

SEQ ID NO: 178979 - RNA, 64 nt, hsa
uuuucacccuuuaaucuuaaguuuagccuuuuaagaaaaacaguaagcgaugacugcugaaagg

SEQ ID NO: 178980 - RNA, 64 nt, hsa
aucaaauauauauccagacgguucuucccuagaagaaaaacaagucuuuacaccugauaaaaua

SEQ ID NO: 178981 - RNA, 64 nt, hsa
ggucucgcauucaagggcaauuacauuuuaaaaagaaaaacagaaaaagguuaaucacaaaacc

SEQ ID NO: 178982 - RNA, 64 nt, hsa
cuuaaaaaaaaaaaaaaaaaaaaaaagaaaaaaagaaaaacaggaaaaaggacuuuuuuuuucc

SEQ ID NO: 178983 - RNA, 64 nt, hsa
aaagaaaaacaggaaaaaggacuuuuuuuuuccugaaaaacaaaaaccgaucugcauggacucc

SEQ ID NO: 178984 - RNA, 64 nt, hsa
ugauuauccucaauuuccauauguuacugaaucugaaaaacaucuuuaaaauucaaacaguucc

SEQ ID NO: 178985 - RNA, 64 nt, hsa
gucuacuuuaaaaaaauucaaaugaagagaaaaagaaaaacagcauucuagaaauggcauuucu

SEQ ID NO: 178986 - RNA, 64 nt, hsa
aaaaauuuauacuguacaaaaaccccacaagugugaaaaacauggcaaagccuuuaagaagccc

SEQ ID NO: 178987 - RNA, 64 nt, hsa
uauauugaaaaauugugcaaauauaauaaauuuggaaaaacaauuuuucaaaaacuacagcuua

SEQ ID NO: 178988 - RNA, 64 nt, hsa
agacucuucauucaguggcccacauuuuccuuaggaaaaacaugagcauccccagccacaacug

SEQ ID NO: 178989 - RNA, 64 nt, hsa
aaucugcauccuuuucaaaaccuaaaaacaaaaagaaaaacaaauaaaacaaaaccaacucaga

SEQ ID NO: 178990 - RNA, 64 nt, hsa
caaaauugaguuacuguauacaaagcuguucauagaaaaacaaauguuaccaagaaauacuuac

SEQ ID NO: 178991 - RNA, 64 nt, hsa
uauuauuuuuauuuggccccauuauuuuaaauaggaaaaacaguauguuuucaguccauuaaaa

SEQ ID NO: 178992 - RNA, 64 nt, hsa
uggcaauagagcugcuugguuggaggaagugaagcuggcuuaguaccagcagcugaucucuucc

SEQ ID NO: 178993 - RNA, 64 nt, hsa
augcuauuuccaagaucucuuacugcugcuucuccuggcuuacuggccagaaacuagcucacuc

SEQ ID NO: 178994 - RNA, 64 nt, hsa
agacuacccuuuagguugaaguuugaccuggcuccuggcuuaccagucuccuggaagcagagca

SEQ ID NO: 178995 - RNA, 64 nt, hsa
uuugaccucuagacacuaauuuuauccuuugaggcuggcuuaauuagggaugcugucauuaagg

SEQ ID NO: 178996 - RNA, 64 nt, hsa
cuugcaagcauauuggugcccuccaugaccaccucuggcuuaggacuuggcccuguuaugagcu

SEQ ID NO: 178997 - RNA, 64 nt, hsa
ugggacccaaaugggcacuuucuugucugagacucuggcuuauuccagguuggcugauguguug

SEQ ID NO: 178998 - RNA, 64 nt, hsa
gaagugaugagauuauaggcgugagccaccgcgccuggcuuauacuuucuuaauaaaaaggaga

SEQ ID NO: 178999 - RNA, 64 nt, hsa
uccaccagacugauuucuccgauguugcacuuggcuggcuuaugccucugagaucggugccacg

SEQ ID NO: 179000 - RNA, 64 nt, hsa
uagcugcagauugacaggcgaggcucagaaacuccuggcuuagauugaagugugugugaugggg

SEQ ID NO: 179001 - RNA, 64 nt, hsa
aggcacacaggaugcagccuucccccucccaggccuggcuuauuccaagaggcugagccaaugg

SEQ ID NO: 179002 - RNA, 64 nt, hsa
agauccugggggagccccuccccccccugaaucccuggcuuagcuaccuuccugccugugcacc

SEQ ID NO: 179003 - RNA, 64 nt, hsa
uuuuuuuccuccaguuuuuaacaagaucacauaacuggcuuauuuuuaacagcuuugucaaacu

SEQ ID NO: 179004 - RNA, 64 nt, hsa
cauuuuauugaguuaaaugaguucuuaauaaucucuggcuuacaaguccuuaauuuaucaaaua

SEQ ID NO: 179005 - RNA, 64 nt, hsa
augaaaaauaaaugaaguaucucuaggaaacagucuggcuuaacuauuuuugaaaauauaacug

SEQ ID NO: 179006 - RNA, 64 nt, hsa
gagcagugcugaaggaggagauccagguuuaaaucuggcuuauuaacucaagccaauuuuaagg

SEQ ID NO: 179007 - RNA, 64 nt, hsa
guccuguuucuugcuccuguucucagccuguuaucuggcuuauccaucaguuucugaaccaaca

SEQ ID NO: 179008 - RNA, 64 nt, hsa
cuauuucuuuuucaccguuuuuaccuuuuguccucuggcuuauugccucagaguugcaagaugg

SEQ ID NO: 179009 - RNA, 64 nt, hsa; identical to SEQ ID NO: 89670

SEQ ID NO: 179010 - RNA, 64 nt, hsa; identical to SEQ ID NO: 89671

SEQ ID NO: 179011 - RNA, 64 nt, hsa; identical to SEQ ID NO: 89672

SEQ ID NO: 179012 - RNA, 64 nt, hsa; identical to SEQ ID NO: 89673

SEQ ID NO: 179013 - RNA, 64 nt, hsa; identical to SEQ ID NO: 89674

SEQ ID NO: 179014 - RNA, 64 nt, hsa; identical to SEQ ID NO: 89675

SEQ ID NO: 179015 - RNA, 64 nt, hsa; identical to SEQ ID NO: 89676

SEQ ID NO: 179016 - RNA, 64 nt, hsa; identical to SEQ ID NO: 89677

SEQ ID NO: 179017 - RNA, 64 nt, hsa; identical to SEQ ID NO: 89678

SEQ ID NO: 179018 - RNA, 64 nt, hsa; identical to SEQ ID NO: 89679

SEQ ID NO: 179019 - RNA, 64 nt, hsa; identical to SEQ ID NO: 89680

SEQ ID NO: 179020 - RNA, 64 nt, hsa; identical to SEQ ID NO: 89681

SEQ ID NO: 179021 - RNA, 64 nt, hsa; identical to SEQ ID NO: 125939

SEQ ID NO: 179022 - RNA, 64 nt, hsa; identical to SEQ ID NO: 125940

SEQ ID NO: 179023 - RNA, 64 nt, hsa; identical to SEQ ID NO: 125941

SEQ ID NO: 179024 - RNA, 64 nt, hsa; identical to SEQ ID NO: 125942

SEQ ID NO: 179025 - RNA, 64 nt, hsa; identical to SEQ ID NO: 125943

SEQ ID NO: 179026 - RNA, 64 nt, hsa; identical to SEQ ID NO: 125944

SEQ ID NO: 179027 - RNA, 64 nt, hsa; identical to SEQ ID NO: 125945

SEQ ID NO: 179028 - RNA, 64 nt, hsa; identical to SEQ ID NO: 125946

SEQ ID NO: 179029 - RNA, 64 nt, hsa; identical to SEQ ID NO: 125947

SEQ ID NO: 179030 - RNA, 64 nt, hsa; identical to SEQ ID NO: 125948

SEQ ID NO: 179031 - RNA, 64 nt, hsa; identical to SEQ ID NO: 125949

SEQ ID NO: 179032 - RNA, 64 nt, hsa; identical to SEQ ID NO: 125950

SEQ ID NO: 179033 - RNA, 64 nt, hsa; identical to SEQ ID NO: 125951

SEQ ID NO: 179034 - RNA, 64 nt, hsa; identical to SEQ ID NO: 125952

SEQ ID NO: 179035 - RNA, 64 nt, hsa; identical to SEQ ID NO: 53591

SEQ ID NO: 179036 - RNA, 64 nt, hsa; identical to SEQ ID NO: 53592

SEQ ID NO: 179037 - RNA, 64 nt, hsa; identical to SEQ ID NO: 53593

SEQ ID NO: 179038 - RNA, 64 nt, hsa; identical to SEQ ID NO: 53594

SEQ ID NO: 179039 - RNA, 64 nt, hsa; identical to SEQ ID NO: 53595

SEQ ID NO: 179040 - RNA, 64 nt, hsa; identical to SEQ ID NO: 53596

SEQ ID NO: 179041 - RNA, 64 nt, hsa; identical to SEQ ID NO: 53597

SEQ ID NO: 179042 - RNA, 64 nt, hsa; identical to SEQ ID NO: 53598

SEQ ID NO: 179043 - RNA, 64 nt, hsa; identical to SEQ ID NO: 53599

SEQ ID NO: 179044 - RNA, 64 nt, hsa; identical to SEQ ID NO: 53600

SEQ ID NO: 179045 - RNA, 64 nt, hsa; identical to SEQ ID NO: 53601

SEQ ID NO: 179046 - RNA, 64 nt, hsa; identical to SEQ ID NO: 53602

SEQ ID NO: 179047 - RNA, 64 nt, hsa; identical to SEQ ID NO: 53603

SEQ ID NO: 179048 - RNA, 64 nt, hsa; identical to SEQ ID NO: 53604

SEQ ID NO: 179049 - RNA, 64 nt, hsa; identical to SEQ ID NO: 53605

SEQ ID NO: 179050 - RNA, 64 nt, hsa; identical to SEQ ID NO: 53606

SEQ ID NO: 179051 - RNA, 64 nt, hsa; identical to SEQ ID NO: 53607

SEQ ID NO: 179052 - RNA, 64 nt, hsa; identical to SEQ ID NO: 53608

SEQ ID NO: 179053 - RNA, 64 nt, hsa; identical to SEQ ID NO: 53609

SEQ ID NO: 179054 - RNA, 64 nt, hsa; identical to SEQ ID NO: 53610

SEQ ID NO: 179055 - RNA, 64 nt, hsa; identical to SEQ ID NO: 53611

SEQ ID NO: 179056 - RNA, 64 nt, hsa; identical to SEQ ID NO: 53612

SEQ ID NO: 179057 - RNA, 64 nt, hsa; identical to SEQ ID NO: 53613

SEQ ID NO: 179058 - RNA, 64 nt, hsa; identical to SEQ ID NO: 53614

SEQ ID NO: 179059 - RNA, 64 nt, hsa; identical to SEQ ID NO: 53615

SEQ ID NO: 179060 - RNA, 64 nt, hsa; identical to SEQ ID NO: 53616

SEQ ID NO: 179061 - RNA, 64 nt, hsa; identical to SEQ ID NO: 53617

SEQ ID NO: 179062 - RNA, 64 nt, hsa; identical to SEQ ID NO: 53618

SEQ ID NO: 179063 - RNA, 64 nt, hsa; identical to SEQ ID NO: 53619

SEQ ID NO: 179064 - RNA, 64 nt, hsa; identical to SEQ ID NO: 53620

SEQ ID NO: 179065 - RNA, 64 nt, hsa; identical to SEQ ID NO: 53621

SEQ ID NO: 179066 - RNA, 64 nt, hsa; identical to SEQ ID NO: 53622

SEQ ID NO: 179067 - RNA, 64 nt, hsa; identical to SEQ ID NO: 53623

SEQ ID NO: 179068 - RNA, 64 nt, hsa; identical to SEQ ID NO: 53624

SEQ ID NO: 179069 - RNA, 64 nt, hsa; identical to SEQ ID NO: 53625

SEQ ID NO: 179070 - RNA, 64 nt, hsa; identical to SEQ ID NO: 81987

SEQ ID NO: 179071 - RNA, 64 nt, hsa; identical to SEQ ID NO: 81988

SEQ ID NO: 179072 - RNA, 64 nt, hsa; identical to SEQ ID NO: 81989

SEQ ID NO: 179073 - RNA, 64 nt, hsa; identical to SEQ ID NO: 81990

SEQ ID NO: 179074 - RNA, 64 nt, hsa; identical to SEQ ID NO: 81991

SEQ ID NO: 179075 - RNA, 64 nt, hsa; identical to SEQ ID NO: 81992

SEQ ID NO: 179076 - RNA, 64 nt, hsa; identical to SEQ ID NO: 81993

SEQ ID NO: 179077 - RNA, 64 nt, hsa; identical to SEQ ID NO: 81994

SEQ ID NO: 179078 - RNA, 64 nt, hsa; identical to SEQ ID NO: 81995

SEQ ID NO: 179079 - RNA, 64 nt, hsa; identical to SEQ ID NO: 81996

SEQ ID NO: 179080 - RNA, 64 nt, hsa; identical to SEQ ID NO: 81997

SEQ ID NO: 179081 - RNA, 64 nt, hsa; identical to SEQ ID NO: 81998

SEQ ID NO: 179082 - RNA, 64 nt, hsa; identical to SEQ ID NO: 81999

SEQ ID NO: 179083 - RNA, 64 nt, hsa; identical to SEQ ID NO: 82000

SEQ ID NO: 179084 - RNA, 64 nt, hsa; identical to SEQ ID NO: 82001

SEQ ID NO: 179085 - RNA, 64 nt, hsa; identical to SEQ ID NO: 82002

SEQ ID NO: 179086 - RNA, 64 nt, hsa; identical to SEQ ID NO: 82003

SEQ ID NO: 179087 - RNA, 64 nt, hsa; identical to SEQ ID NO: 82004

SEQ ID NO: 179088 - RNA, 64 nt, hsa; identical to SEQ ID NO: 82005

SEQ ID NO: 179089 - RNA, 64 nt, hsa; identical to SEQ ID NO: 82006

SEQ ID NO: 179090 - RNA, 64 nt, hsa; identical to SEQ ID NO: 82007

SEQ ID NO: 179091 - RNA, 64 nt, hsa; identical to SEQ ID NO: 82008

SEQ ID NO: 179092 - RNA, 58 nt, hsa; identical to SEQ ID NO: 82009

SEQ ID NO: 179093 - RNA, 64 nt, hsa; identical to SEQ ID NO: 82010

SEQ ID NO: 179094 - RNA, 64 nt, hsa; identical to SEQ ID NO: 82011

SEQ ID NO: 179095 - RNA, 64 nt, hsa; identical to SEQ ID NO: 82012

SEQ ID NO: 179096 - RNA, 64 nt, hsa; identical to SEQ ID NO: 82013

SEQ ID NO: 179097 - RNA, 64 nt, hsa; identical to SEQ ID NO: 82014

SEQ ID NO: 179098 - RNA, 64 nt, hsa; identical to SEQ ID NO: 82015

SEQ ID NO: 179099 - RNA, 64 nt, hsa; identical to SEQ ID NO: 82016

SEQ ID NO: 179100 - RNA, 64 nt, hsa
ucacuguaaucuccagcuccugggcucaagugauccucuagacucagccucuagaauagcuggg

SEQ ID NO: 179101 - RNA, 64 nt, hsa
cagcuccugggcucaagugauccucuagacucagccucuagaauagcugggacuacaggcacau

SEQ ID NO: 179102 - RNA, 64 nt, hsa
acuuaugaaauccuauugguggauaucguagucuccucuagauauuuugccauaauacaugcca

SEQ ID NO: 179103 - RNA, 64 nt, hsa
auggcucaaaacagaauuuaucuuguuaauaauuccucuagauagaauaauguagaaacauuuu

SEQ ID NO: 179104 - RNA, 64 nt, hsa; identical to SEQ ID NO: 109572

SEQ ID NO: 179105 - RNA, 64 nt, hsa; identical to SEQ ID NO: 109573

SEQ ID NO: 179106 - RNA, 64 nt, hsa; identical to SEQ ID NO: 109574

SEQ ID NO: 179107 - RNA, 64 nt, hsa; identical to SEQ ID NO: 109575

SEQ ID NO: 179108 - RNA, 64 nt, hsa; identical to SEQ ID NO: 109576

SEQ ID NO: 179109 - RNA, 64 nt, hsa; identical to SEQ ID NO: 109577

SEQ ID NO: 179110 - RNA, 64 nt, hsa; identical to SEQ ID NO: 109578

SEQ ID NO: 179111 - RNA, 64 nt, hsa; identical to SEQ ID NO: 109579

SEQ ID NO: 179112 - RNA, 64 nt, hsa; identical to SEQ ID NO: 109580

SEQ ID NO: 179113 - RNA, 64 nt, hsa; identical to SEQ ID NO: 109581

SEQ ID NO: 179114 - RNA, 64 nt, hsa; identical to SEQ ID NO: 109582

SEQ ID NO: 179115 - RNA, 64 nt, hsa; identical to SEQ ID NO: 109583

SEQ ID NO: 179116 - RNA, 64 nt, hsa; identical to SEQ ID NO: 109584

SEQ ID NO: 179117 - RNA, 64 nt, hsa; identical to SEQ ID NO: 109585

SEQ ID NO: 179118 - RNA, 64 nt, hsa
auuuauuacuaaaauguuuuuccuacagucuacaugaauacaaaccucaauagcuaagcuugac

SEQ ID NO: 179119 - RNA, 64 nt, hsa
uuggggagcggggauaguuaauauuccaguacacugaauacaugaggaauuuaaccacauacau

SEQ ID NO: 179120 - RNA, 64 nt, hsa
uuaccuuugauuguugaaaaaagucacuaagaugugaauacagaauagacauugagagguuaua

SEQ ID NO: 179121 - RNA, 64 nt, hsa
aagcuuugaagcaugcgcaagcaacaugaacaacugaauacagaaaguaacugaaagcagcaca

SEQ ID NO: 179122 - RNA, 64 nt, hsa
uagaccagcuuaaugucuucaggauguaaaacucugaauacacggcgucucuuuuucauacauu

SEQ ID NO: 179123 - RNA, 64 nt, hsa
auugaccaguacuugauaaucucucuguauaugaugaauacauuuuuacacacuaacauuagca

SEQ ID NO: 179124 - RNA, 64 nt, hsa
ugacaggcagaggguguuccugacagagggaagaugaauacacuugaccccaacauuucugccc

SEQ ID NO: 179125 - RNA, 64 nt, hsa
aagugauacccccacagguaagcccucagcauccugaauacaucauccgcagccugggaaccuu

SEQ ID NO: 179126 - RNA, 64 nt, hsa
uuaacaguuuguccuuaggaugcaaaugaaaaugugaauacauaccuuguuguacuguugguaa

SEQ ID NO: 179127 - RNA, 64 nt, hsa
agcuauuuagccuuugauggaaucauaaauacagugaauacaauccuuugcauuguuaaggagg

SEQ ID NO: 179128 - RNA, 64 nt, hsa
uuuaaggaucacauuuagacaucucaugggcugaugaauacagcugguaucuuuguggagcuuu

SEQ ID NO: 179129 - RNA, 64 nt, hsa
aucuuugcacucuugugcuaguaugucuauagugugaauacauucauaaauuucuugaucaaag

SEQ ID NO: 179130 - RNA, 64 nt, hsa
uugugggaaagcauucauaucugccaagauccuuugaauacaugcaagaacacacaauggagag

SEQ ID NO: 179131 - RNA, 64 nt, hsa
guaugggaaagcguucagaccugacaagauucuuugaauacagauaaugaauguaaacaauuaa

SEQ ID NO: 179132 - RNA, 64 nt, hsa
uugugggaaagcauucauaucugccaagaucguuugaauacaugcaaaacacacacuggagaga

SEQ ID NO: 179133 - RNA, 64 nt, hsa
guaugggaaagccuucagaucggcuaggauucuuugaauacaaauaaugaauguaaacaauuaa

SEQ ID NO: 179134 - RNA, 64 nt, hsa
uacacaaaagaguucauacuggacagaagcugugugaauacaaacauuguucuaaagcccuuaa

SEQ ID NO: 179135 - RNA, 64 nt, hsa
acauucugaagccuucgguuguuccagcuccuucugaauacacaaaagaguucauacuggacag

SEQ ID NO: 179136 - RNA, 64 nt, hsa
cauaugucugaaaaguauacagagauaaauucugugaauacaaagacuaagaaaagucuucugu

SEQ ID NO: 179137 - RNA, 64 nt, hsa
gaggugaaauaauuugcccuagagaucaauuugaugaauacaguaaauaagguagugccuuuag

SEQ ID NO: 179138 - RNA, 64 nt, hsa
aacacaugagcagucacuuuggagagaagcccugugaauacagugaauguaaggaucccuucag

SEQ ID NO: 179139 - RNA, 64 nt, hsa
aggguccauacaugagagaacccuauugcugcaaugaauacagcaaggccuuuacccacuguua

SEQ ID NO: 179140 - RNA, 64 nt, hsa
agugccaggguuucugugaugauucugagaaugcugaauacaaauauaccuuauauucuuuaag

SEQ ID NO: 179141 - RNA, 64 nt, hsa
gugggugugaagugaauuucuauauguccaggagugaauacaacagaaagaguuggaucuuauu

SEQ ID NO: 179142 - RNA, 64 nt, hsa
uaauguacguaugcaaaguucaacucaauagguuauugaucaccaugaaguauugaucauuuuc

SEQ ID NO: 179143 - RNA, 64 nt, hsa
guucaacucaauagguuauugaucaccaugaaguauugaucauuuucuaucucaaaaguguaag

SEQ ID NO: 179144 - RNA, 64 nt, hsa
uaaaacuuggcaguuuuaucugcuucaaaaugccauugaucauuauuccuguauuuucucugaa

SEQ ID NO: 179145 - RNA, 64 nt, hsa
cacccagcugccuuuguuucugcauuaaaccaauauugaucacacauaugacacaggcuagucc

SEQ ID NO: 179146 - RNA, 64 nt, hsa
gaauguaaagguucagaaaaggucuguuuucucagauuaacaaauaugauggauuccauggcug

SEQ ID NO: 179147 - RNA, 64 nt, hsa
auugacuauuaaaucugguuaaauaguucaccuggauuaacaguauuguuggacaguccuaaaa

SEQ ID NO: 179148 - RNA, 64 nt, hsa
agcagacugcacaugagcagagugacauggugguggcacuuauggugguggcuugagagccuug

SEQ ID NO: 179149 - RNA, 64 nt, hsa
ucaagagguuugugcuagcccgaugccuccaccgggcacuuagaaggcaagaggacaggaucuc

SEQ ID NO: 179150 - RNA, 64 nt, hsa
guucugcugccuuuguuucuccccugcuguuguaggcacuuacagcugcguuguuaugaaagga

SEQ ID NO: 179151 - RNA, 64 nt, hsa
ccucuccgcgguggagcaaacuguggacuugccuggcacuuaaaccuugguagaucuggguuua

SEQ ID NO: 179152 - RNA, 64 nt, hsa
ggcuccugggggugcuccugccgccuuccuucacggcacuuacaaccggcgggacccccaggga

SEQ ID NO: 179153 - RNA, 64 nt, hsa
cccccgucccccgacccgcacccuccuuccucagggcacuuacuaagggaggggucucccucuc

SEQ ID NO: 179154 - RNA, 64 nt, hsa
cacgugccuguagucccagcuacuugggaggcugaggcaggagaaucacuugaccccagguggu

SEQ ID NO: 179155 - RNA, 64 nt, hsa
cgcauaacuauaaucccagcuacuugggaggcugaggcaggagaaucgcuugaacccgggaggc

SEQ ID NO: 179156 - RNA, 64 nt, hsa
ugggcuccuguagucccagcuacuugggaggcugaggcaggagaaucgcuugaaccugggaggc

SEQ ID NO: 179157 - RNA, 64 nt, hsa
cacaugccuguaauuccagcugcuugggagccugaggcaggagaacugcuugaacccaggaggc

SEQ ID NO: 179158 - RNA, 64 nt, hsa
uaaagcacgccuuuaaauaagcaaaaacuuuaaaaggcaggaaagagaauucuuaggcaaauuc

SEQ ID NO: 179159 - RNA, 64 nt, hsa
gcgcaggaggacaggcaccaccggaugccacaccaggcaggaggagguguggacagugauggua

SEQ ID NO: 179160 - RNA, 64 nt, hsa
gggaaacaccagcuuuuggggugauagcacuuucaggcaggagcuaugguuccuuccucaggag

SEQ ID NO: 179161 - RNA, 64 nt, hsa
cucaugccuguaaucccgacacuuugggaggccaaggcaggaggauggcuugaagccaguaguu

SEQ ID NO: 179162 - RNA, 64 nt, hsa
ugcacaccuguaguccuagcuacuugggaggcugaggcaggaggaucccuugaguccaggaggu

SEQ ID NO: 179163 - RNA, 64 nt, hsa
cacacgccuguagucccaguuacuugggaggcugaggcaggagaauugcuugaaccugggaggu

SEQ ID NO: 179164 - RNA, 64 nt, hsa
caccugccuguaaucccagcuacuugggaggcugaggcaggagaaucgcuugaacccgggaggc

SEQ ID NO: 179165 - RNA, 64 nt, hsa
ccaggcaugguggcccacgcacuucgggaggucgaggcaggaggaucacuugaguccagaaguu

SEQ ID NO: 179166 - RNA, 64 nt, hsa
gcugcuugaggcaacucaucuuagguuggcaaaaaggcaggauggccgggcgcgguggcucacg

SEQ ID NO: 179167 - RNA, 64 nt, hsa
agaacaaacucagaucucaucaggguagcagcagaggcaggaccagaaggcaaucaagagcuuc

SEQ ID NO: 179168 - RNA, 64 nt, hsa
cacacgccuguaaucucagcuacucaggaggcugaggcaggagaauugcuugaaccugugagga

SEQ ID NO: 179169 - RNA, 64 nt, hsa
caggagccuguagucccagcuacucgggaggcugaggcaggagaauugcuugaaccggggaggc

SEQ ID NO: 179170 - RNA, 64 nt, hsa
cgggcgccuguaaucccagcuacuugggaggcugaggcaggagaauggcaugaaccugggaggc

SEQ ID NO: 179171 - RNA, 64 nt, hsa
ugggcaccuguagucccagcuacucagggggcugaggcaggagaauggcgugaauccgggaggc

SEQ ID NO: 179172 - RNA, 64 nt, hsa
ugggugccuguaaucccagcuacucgagaggccaaggcaggagaauugcuagaaccugggggug

SEQ ID NO: 179173 - RNA, 64 nt, hsa
uauuauuugagacagagucucacucuuaucacccaggcaggagugcaguggugcgaucaaggcc

SEQ ID NO: 179174 - RNA, 64 nt, hsa
cacacgccuguagucccagcuacuugggaggcugaggcaggagaauugcuugagcccaagaggu

SEQ ID NO: 179175 - RNA, 64 nt, hsa
uggguaccuauaaucccagcuacuugggaggcugaggcaggagaaucgcuugaaccugggaggu

SEQ ID NO: 179176 - RNA, 64 nt, hsa
ugagggagcgguaugcucuacccuuguguauuuaaggcaggacagagaaauugaggaugccccu

SEQ ID NO: 179177 - RNA, 64 nt, hsa
caugugccuauagucccagcuacucaggaggcugaggcaggagaauugcuugaaccugggaggc

SEQ ID NO: 179178 - RNA, 64 nt, hsa
cguacgccuguagucccagcuacucaggaggcugaggcaggagaauugcuugaacccaggagga

SEQ ID NO: 179179 - RNA, 64 nt, hsa
ugggcgccuguaaucccagcuacucaggaggcugaggcaggagaaucgcuugaacccgggaggc

SEQ ID NO: 179180 - RNA, 64 nt, hsa
ugugugccugcaguccuagcuacuugggugguugaggcaggaggauuguuugagcgagggaagu

SEQ ID NO: 179181 - RNA, 64 nt, hsa
ccaaggggcagauggccagaugcacugcccaguaaggcaggaagccaaagaggcagugcccagc

SEQ ID NO: 179182 - RNA, 64 nt, hsa
ccuggcagauugggguauccacccagucauguaaaggcaggagaccugcucugggccugacuca

SEQ ID NO: 179183 - RNA, 64 nt, hsa
cuccucuggaacugggauuaaacagauacccaagaggcaggaaaaacgcgagugucugaagacc

SEQ ID NO: 179184 - RNA, 64 nt, hsa
cacgcaccaguaaucccagcuacuugggaggcugaggcaggagaaucacuugaacccgggaggc

SEQ ID NO: 179185 - RNA, 64 nt, hsa
ugcaugccuguaauccaagauacucaggaggcugaggcaggagaaucgcuugaaccugggaggc

SEQ ID NO: 179186 - RNA, 64 nt, hsa
ggacuccuuggguccuggcagugcaugugccagcaggcaggacaaacucuguguaccugugccc

SEQ ID NO: 179187 - RNA, 64 nt, hsa
gagagaccucguggcagcaugugaucuggaaggcaggcaggacgggggcguuggggagccaaag

SEQ ID NO: 179188 - RNA, 64 nt, hsa
auauagaaauaggggaggagcucaggucugcgccaggcaggaagaaggcaggcuucuggcuucc

SEQ ID NO: 179189 - RNA, 64 nt, hsa
ccugugaagggacacagagaacaggcaggaggaaaggcaggagccaguccgugcaggcacacuc

SEQ ID NO: 179190 - RNA, 64 nt, hsa
acggggugucauccugugaagggacacagagaacaggcaggaggaaaggcaggagccaguccgu

SEQ ID NO: 179191 - RNA, 64 nt, hsa
ugaacaaggugauaucuucauagugggcuauuacaggcaggaaaauguuuuaacugguuuacaa

SEQ ID NO: 179192 - RNA, 64 nt, hsa
aaaauccaucaauacuugugucauucccuguaaaaggcaggagacaugugauuaugaucaggaa

SEQ ID NO: 179193 - RNA, 64 nt, hsa
cacacaccuguagucccagauacuugggaggccaaggcaggaggauugcuugagaccuagcaau

SEQ ID NO: 179194 - RNA, 64 nt, hsa
cacaugccaguaaccccagcuacuagggaggcugaggcaggagaaucacuugaacccgggaggc

SEQ ID NO: 179195 - RNA, 64 nt, hsa
cgcacaccuguaaucccagcuacuugggaggcugaggcaggagaauugcuugaaccugggaggu

SEQ ID NO: 179196 - RNA, 64 nt, hsa
auucuuuuucuuaaaagagagaggugacgaaggaaggcaggaaugaagaagcacugcguggccu

SEQ ID NO: 179197 - RNA, 64 nt, hsa
cauaugccuguaaucccaacuacucagaaggccgaggcaggagaauuacuugaacgcaggagaa

SEQ ID NO: 179198 - RNA, 64 nt, hsa
cucacaccugcaaucccagcaccuuaggaggccgaggcaggaggauccuugaggucaggaguuc

SEQ ID NO: 179199 - RNA, 64 nt, hsa
uucaugccuauaaucccagugcuuuacaaggcugaggcaggaggcucucuugagaauaggaguu

SEQ ID NO: 179200 - RNA, 64 nt, hsa
cucugguccaaguuguaugugcacugaacuaaucaggcaggaaaaaagcccagccacugucuca

SEQ ID NO: 179201 - RNA, 64 nt, hsa
agaagcaccugcuccggcauccagcgcugccuggaggcaggaaggagaggcagggcaggacacg

SEQ ID NO: 179202 - RNA, 64 nt, hsa
gggagaaucagggcucgggaagccacgccugggaaggcaggacacaggacacagcagcuuucuu

SEQ ID NO: 179203 - RNA, 64 nt, hsa
gugugugccuauagucccacuacuuguggggcuaaggcaggaggaucacuugagccccggaggu

SEQ ID NO: 179204 - RNA, 64 nt, hsa
cucacaccuguaauccuugcauuuuggaaggcugaggcaggaggaucacuuuaggccuggugug

SEQ ID NO: 179205 - RNA, 64 nt, hsa
acaagcagaggcccccucgaugggagggaguggcaggcaggagaagguggcgcugccaggugcc

SEQ ID NO: 179206 - RNA, 64 nt, hsa
ugugugccuguaauuccagcuacucgggaggcugaggcaggaagaaucacuugaacccaggagg

SEQ ID NO: 179207 - RNA, 64 nt, hsa
uacauaccugcgguuccagcuacucaagaggcugaggcaggaggacugcuugagcccaggaguu

SEQ ID NO: 179208 - RNA, 64 nt, hsa
ggacuaaaaccauuuuuuuugcacccaaaaaaaaaggcaggaaaaugaucaucagaaacuaaau

SEQ ID NO: 179209 - RNA, 64 nt, hsa
ugggcacccguaaucccagcuacucaggaggcugaggcaggagaauugcuugaacccaggaagc

SEQ ID NO: 179210 - RNA, 64 nt, hsa
caguugccuguaauccuagcuacucaggaggcugaggcaggagaaucgcuugaaccugggaggu

SEQ ID NO: 179211 - RNA, 64 nt, hsa
cuggcugggcacaguggcucacuuugggaggcugaggcaggaaggcugcuggaaacugagaguu

SEQ ID NO: 179212 - RNA, 64 nt, hsa
uauuuaaacagugguucuagugugggaccaagagaggcaggagcugggucuuggggcagcuuua

SEQ ID NO: 179213 - RNA, 64 nt, hsa
ggcgugccuguagucccauguacuugggaggcugaggcaggaaaauucuugaacccaggagacg

SEQ ID NO: 179214 - RNA, 64 nt, hsa
cccaagcuaccuccucacccugcaucuuggagggaggcaggaaauuucuuuugaaauaaagugc

SEQ ID NO: 179215 - RNA, 64 nt, hsa
cgggcaccuguaaucccaguuacuugggaagcugaggcaggagaaucccuugaaccugggaggc

SEQ ID NO: 179216 - RNA, 64 nt, hsa
uguguaccuguagucccagcuacccaggaagcuaaggcaggagaaucgcuugaauccaggaggc

SEQ ID NO: 179217 - RNA, 64 nt, hsa
caggcaccuauaaugccagcuacucgggaggcugaggcaggagaaucgcuugaacccgggaggc

SEQ ID NO: 179218 - RNA, 64 nt, hsa
cccuaaggcugagggaaagaauccuaacaaggaaaggcaggaaugaggguuucagaauucacug

SEQ ID NO: 179219 - RNA, 64 nt, hsa
uccaugccuauaaucccggcuacucgggaggcugaggcaggagaaucaccugaacccgggaggc

SEQ ID NO: 179220 - RNA, 64 nt, hsa
cgcaugccuguagucccaacuacuagggaggcugaggcaggagaaucacuugaacccaggaggu

SEQ ID NO: 179221 - RNA, 64 nt, hsa
ugcaugccuguaaucccagcuacuagggaggcugaggcaggagaauugcuugaaccugggagac

SEQ ID NO: 179222 - RNA, 64 nt, hsa
caugugccuguagucuuagcuacuugagaggcugaggcaggagaaucgcuugaaccugggaggc

SEQ ID NO: 179223 - RNA, 64 nt, hsa
uaguucccuaccaauaauuugaagccuuugcuuuaggcaggaggcauguggcuaugaauaggga

SEQ ID NO: 179224 - RNA, 64 nt, hsa
uuaucugugccuagacccaaacugaaagugucucaggcaggaaguuccaagggauguauguuua

SEQ ID NO: 179225 - RNA, 64 nt, hsa
guggauuaggcucuggcuucugugauggugcaagaggcaggauggucuccagacaccuucuugc

SEQ ID NO: 179226 - RNA, 64 nt, hsa
ggugggcucagugaccccuuggaauggcugagggaggcaggagagccuggaaagauucgaagug

SEQ ID NO: 179227 - RNA, 64 nt, hsa
cagagccaggggugaagggagaagcucuuggagcaggcaggaugcccaccgcugcuucagcugc

SEQ ID NO: 179228 - RNA, 64 nt, hsa
ugucaguaccugagcuaguuuaccucaguuccgcaggcaggacagccgguccgggaacccugag

SEQ ID NO: 179229 - RNA, 64 nt, hsa
cuuaugccuguaauugcagcacuuuuagaggcugaggcaggagaauugguugaacccaggaggc

SEQ ID NO: 179230 - RNA, 64 nt, hsa
ugcaugccuguaaucccagcuacucgggaggcugaggcaggagaauugcuugaacucgggaggu

SEQ ID NO: 179231 - RNA, 64 nt, hsa
uccccuuuucccacugaagguuuuagaagcuaggaggcaggaaaaugugacccagaugggggug

SEQ ID NO: 179232 - RNA, 64 nt, hsa
uccuggcccuggccuuucacuccaguucugggugaggcaggagcugggagggguggggaggggg

SEQ ID NO: 179233 - RNA, 64 nt, hsa
uguacccuaggcacguggcuccagcaagagccccaggcaggacaaagggagcaggcagcagcug

SEQ ID NO: 179234 - RNA, 64 nt, hsa
cgcaugccuauaaucccagguacucaggaggcugaggcaggagaaucacuugaaccugggaggc

SEQ ID NO: 179235 - RNA, 64 nt, hsa
cgugcaugugcagucccagcuacucaggaggcugaggcaggaggaucacagugaccuauaauga

SEQ ID NO: 179236 - RNA, 57 nt, hsa
cuguaaucccagcauuuuaggaggccaaggcaggaggaucacuuggagccaggaguu

SEQ ID NO: 179237 - RNA, 64 nt, hsa
ugcacaccuguaaucccagcuacucuggaggcugaggcaggagaaucacuugaacccuggaggc

SEQ ID NO: 179238 - RNA, 64 nt, hsa
ccagcaccuagacaagaucuuggcuuucccacagaggcaggaguccuaccucgggccaacacuc

SEQ ID NO: 179239 - RNA, 64 nt, hsa
ggacacugcagaggaagauaaugaagagaucucuaggcaggaaauccacagcuccuccugcacc

SEQ ID NO: 179240 - RNA, 64 nt, hsa
ggcuugggggugaugcaggcacagcagauggccgaggcaggacacugcagaggaagauaaugaa

SEQ ID NO: 179241 - RNA, 64 nt, hsa
cgcacgccuguagucccagcuacucgggaggcugaggcaggagaauugcuugaacccaggaggc

SEQ ID NO: 179242 - RNA, 57 nt, hsa
ggccucaggcgaugacauagccgcagcaggcaggaggcguccucuucagcguagcuc

SEQ ID NO: 179243 - RNA, 64 nt, hsa
gccugggauugagcuaaccugaaacaaagguagcaggcaggaccuaaugaccagagguuaaauc

SEQ ID NO: 179244 - RNA, 64 nt, hsa
caacauuggugucccuguccccagagggaggagcaggcaggagagagaggggaaggagguauga

SEQ ID NO: 179245 - RNA, 64 nt, hsa
cacaugccuauaaucccagcuacuugggaggcuaaggcaggagaaucgcuugaacccgggaggc

SEQ ID NO: 179246 - RNA, 64 nt, hsa
caugccuauaaaauuccagcacuuugggaggccaaggcaggaggaucacuugagccuaugaguu

SEQ ID NO: 179247 - RNA, 64 nt, hsa
gcaggcgccuguaauccagcuacucgggaggcugaggcaggagaaucacuugaacccaggaggu

SEQ ID NO: 179248 - RNA, 64 nt, hsa
cgggcgccuguagucccagcuacuugggaggcugaggcaggagaauggcgggaaccugggaggc

SEQ ID NO: 179249 - RNA, 64 nt, hsa
ccugugcggugucacagauugcaggguucugacaaggcaggacagucaagaguggggacacuuu

SEQ ID NO: 179250 - RNA, 64 nt, hsa
cucacaccugaaaucccagcacuuugggaggccgaggcaggaagaucauugagcucaggaguuu

SEQ ID NO: 179251 - RNA, 64 nt, hsa
ugugcgccuguaaucccagcuacucgggaggcugaggcaggacgauuacuugagcuugggaaau

SEQ ID NO: 179252 - RNA, 64 nt, hsa
cgcauaccuguagucccagcuacuugggaggcugaggcaggagaaucacuugaacucgggaggc

SEQ ID NO: 179253 - RNA, 64 nt, hsa
ugcgugccuguagucucagcuacucaggaggcugaggcaggagaaucgccugaacccgggcggc

SEQ ID NO: 179254 - RNA, 64 nt, hsa
ccaaacaaccuugccagccuuggcugucaaaaggaggcaggagcaguucucaacacaccaagcc

SEQ ID NO: 179255 - RNA, 64 nt, hsa
ccaaauagcaucuuuacagaggaagugggaucagaggcaggaaguguggaaaguugcuaagaag

SEQ ID NO: 179256 - RNA, 64 nt, hsa
ugggcgccuguaaucccagcuacucagaaggcugaggcaggagaaucacuugaaccuaggaggc

SEQ ID NO: 179257 - RNA, 64 nt, hsa
ugcauaccuauaguccuggcuauuugggaggcugaggcaggaggauugcuuuagcccuggaggu

SEQ ID NO: 179258 - RNA, 64 nt, hsa
ugcaugccuguaaucccagcuacucgggaggcugaggcaggagaaucgcuugaacccaggaggc

SEQ ID NO: 179259 - RNA, 64 nt, hsa
ggaagcaacagagaaguggggaauccagucugcuaggcaggaaagaugccucuaaguucuuguc

SEQ ID NO: 179260 - RNA, 64 nt, hsa
ucugaagggcaguccuccuucucuagguuacaugaggcaggaauaagaagucagacagagacag

SEQ ID NO: 179261 - RNA, 64 nt, hsa
caugugccuguauucccagcuacucaugaggcugaggcaggagaauggcgugaacccgggaggu

SEQ ID NO: 179262 - RNA, 64 nt, hsa
cucaugccuguaaucccagcacuuugggaagcugaggcaggaggauccccugaggucaggaguu

SEQ ID NO: 179263 - RNA, 64 nt, hsa
ggggcucccaucuucuuacacagagaggcagcugaggcaggacaguggggcuaacuguagacca

SEQ ID NO: 179264 - RNA, 64 nt, hsa
cacgugccuguaaucccagcuacucgggaggcugaggcaggagaaucgcuugaaccugggaggu

SEQ ID NO: 179265 - RNA, 64 nt, hsa
caugcgcuuguagucucagcuacuccggaggcugaggcaggagaauugcuugaaccuggaaggc

SEQ ID NO: 179266 - RNA, 64 nt, hsa
ugggugucuguaaucccagcuauucgggaggcugaggcaggagaaucgcuugaacccaggaggu

SEQ ID NO: 179267 - RNA, 64 nt, hsa
ccugggcauguagucccagcuacucgggaggcugaggcaggagaaucgcuugaaccugggaggc

SEQ ID NO: 179268 - RNA, 64 nt, hsa
ccucccaccuccccacacccauugagucauucacaggcaggagggagacugaucauuccucugg

SEQ ID NO: 179269 - RNA, 64 nt, hsa
cucauucugacugugaacuaagcaagcuuugaggaggcaggagauuccgugggucccugugaca

SEQ ID NO: 179270 - RNA, 64 nt, hsa
gggacuugcaugugcaaguuggguggaugcugggaggcaggaggcucaugcuccugucugccug

SEQ ID NO: 179271 - RNA, 64 nt, hsa
gcucaugcauguaauucuagcacuuuggaggccaaggcaggaggacugcuugagcccaggaguu

SEQ ID NO: 179272 - RNA, 64 nt, hsa
gcacgcaccucuacucccagcuacuaggaggcugaggcaggagaaucguuugaacccaggaggu

SEQ ID NO: 179273 - RNA, 64 nt, hsa
uguucacaccuguagucccggccacucggggcugaggcaggaggaucacuggaaccugggaggu

SEQ ID NO: 179274 - RNA, 64 nt, hsa
cucaccccuauaaucccaggacuuugggaggccaaggcaggaggaucacuugaguccagaaauu

SEQ ID NO: 179275 - RNA, 64 nt, hsa
ucaugccuguaaucccaacacuuuugggagguccaggcaggaggaucacuugggcccaggaggu

SEQ ID NO: 179276 - RNA, 64 nt, hsa
cacgcgccuguaaucccagcuacccaggaggcugaggcaggagaaucgcuugaaccggggaggu

SEQ ID NO: 179277 - RNA, 64 nt, hsa
cgggcgccuguaaucccagcuacuugggaggcugaggcaggagaauuacuugaaccugggaggc

SEQ ID NO: 179278 - RNA, 64 nt, hsa
agcucugcagggccccgcagaugaggaaauccguaggcaggagcgguugagugauuuuccuaag

SEQ ID NO: 179279 - RNA, 64 nt, hsa
cucacaucuguaauaccagcgcuuugggaggcugaggcaggaggauugcuugaggccaggaguu

SEQ ID NO: 179280 - RNA, 64 nt, hsa
ugggcaccuguagucccagcuacucgggaggcugaggcaggagaauugcuugaaccuaggaggc

SEQ ID NO: 179281 - RNA, 64 nt, hsa
gggcagaggaaguacuuagggagguuggugucagaggcaggagugggggaucagggaaggugga

SEQ ID NO: 179282 - RNA, 64 nt, hsa
caugaggaccguuccuaggaugggacagugggucaggcaggacaaggagaaagcagggcagaau

SEQ ID NO: 179283 - RNA, 64 nt, hsa
cgugugccuguaaucccagcuauuugggaggcugaggcaggagaaucgcuugagcccgggaagc

SEQ ID NO: 179284 - RNA, 64 nt, hsa
gagaaagggcucccaccugccagucccuggggggaggcaggaggcacaugugaggguccccaga

SEQ ID NO: 179285 - RNA, 64 nt, hsa
gacguagcguagacaacagcagucauaaauaauuaggcaggaacuuaacccaaaucuaguucuu

SEQ ID NO: 179286 - RNA, 64 nt, hsa
cccguaaaccauguagaaagcucccagcacugaaaggcaggaguguuagcaucucgcuuuaucc

SEQ ID NO: 179287 - RNA, 64 nt, hsa
ugguggcguacgccuguaaucccagcuacucaggaggcaggagaaucgcuugagccugggaggc

SEQ ID NO: 179288 - RNA, 64 nt, hsa
uuucuuuguucuagccccucuguucauucuucacaggcaggaaccucaugcucugaggaagucu

SEQ ID NO: 179289 - RNA, 64 nt, hsa
ggaggaagaagugguggagccucagggccagggcaggcaggagcaggcacugaugcuagagggu

SEQ ID NO: 179290 - RNA, 64 nt, hsa
cacgcaccugcagucccagcuacuugggaggcugaggcaggagaaucacucgaacccaggaggc

SEQ ID NO: 179291 - RNA, 64 nt, hsa
cguaaagauggauuucuaaacccacuggguggcaaggcaggaccuuccuaauccuugcaacaac

SEQ ID NO: 179292 - RNA, 64 nt, hsa
caggcaccuguaaucccagcuacuugggaggcugaggcaggagaaaucgccugaacccagaagg

SEQ ID NO: 179293 - RNA, 64 nt, hsa
ugcaugccuguaaucccagcuacuggggaggcugaggcaggagaaucgcuugaaccugggaggc

SEQ ID NO: 179294 - RNA, 64 nt, hsa
cgggcgccuguagucccagcuacuuggaaggcugaggcaggagaauggcgugaacccgggaggc

SEQ ID NO: 179295 - RNA, 64 nt, hsa
ccacccaaagugguagaauuacagaggaaggcugaggcaggaggauugcuuaaacgcaggaguc

SEQ ID NO: 179296 - RNA, 64 nt, hsa
cgcacgccuguaaucccaucuucuugggaggcugaggcaggagaaucgcuagaaacugggaggu

SEQ ID NO: 179297 - RNA, 64 nt, hsa
cgcacgccuguaguuccagcuacucaggaggcugaggcaggagaaucgcuugaacccgggaggu

SEQ ID NO: 179298 - RNA, 64 nt, hsa
ccuuugugcuggaaccugggcuccuccagcugccaggcaggagucgguaggacugugccugugc

SEQ ID NO: 179299 - RNA, 64 nt, hsa
ugacugaagccgcuuagugcuguggccucacugcaggcaggagccccgccccuccugccggggg

SEQ ID NO: 179300 - RNA, 64 nt, hsa
caugugccuguagucccagcuacuugggaggcugaggcaggagaaucgcuugagcccaagaggu

SEQ ID NO: 179301 - RNA, 64 nt, hsa
gaaauaaagagaaaagggaaccuuggagcugggaaggcaggaaaccggcuagaugaccaucaca

SEQ ID NO: 179302 - RNA, 64 nt, hsa
uggcaagugccuuuaaucccaccucaggaggcugaggcaggagaaucgcuugaaccugggaggc

SEQ ID NO: 179303 - RNA, 64 nt, hsa
cggaugccuguaaucccagcuacuugggaggcugaggcaggagaaucgcuugaaccugggaggc

SEQ ID NO: 179304 - RNA, 64 nt, hsa
ugggucuuuaggguaggacaggcugugguaugagaggcaggagucuccacaaggcuucaugugg

SEQ ID NO: 179305 - RNA, 64 nt, hsa
cgggugccuguaaucucagcuacuugagaggcugaggcaggagaaucgcuugaacuugggagca

SEQ ID NO: 179306 - RNA, 64 nt, hsa
cgcaugcuuguaaucccagcuacucaggaggcagaggcaggagaaucacuugaacccgggaggu

SEQ ID NO: 179307 - RNA, 64 nt, hsa
cuauuugagaugcacuuuuguacucaggaggccaaggcaggaggauugcuugagcccaggaguu

SEQ ID NO: 179308 - RNA, 64 nt, hsa
agggcuggcgagggugggggcgggcaagggaugcaggcaggacagccaugagguggggcugcag

SEQ ID NO: 179309 - RNA, 64 nt, hsa
ugaaagcaaacagugcugcucuuuauuccagacaaggcaggaaagucugaguugggagugacag

SEQ ID NO: 179310 - RNA, 64 nt, hsa
cugcagccuaguggaaggugcugagggggcccugaggcaggaccgcccuccugaccccugguag

SEQ ID NO: 179311 - RNA, 64 nt, hsa
ccauucagaccccauuaagaagguuggcuuggccaggcaggaugggcuguguccggcccugcag

SEQ ID NO: 179312 - RNA, 64 nt, hsa
guaaggggccagagccuuggaggacacuaagaggaggcaggaggagcaacucaaauccccaaga

SEQ ID NO: 179313 - RNA, 64 nt, hsa
uucaaaagucuggcccacugugcaguggagcagaaggcaggaccaugaggccuccugccaugua

SEQ ID NO: 179314 - RNA, 64 nt, hsa
uugcuaaguggccggaaaacaagccugagggaggaggcaggaguuggaguuaccuuaggccccu

SEQ ID NO: 179315 - RNA, 64 nt, hsa
gugggugccuguaauccagcuacuugggagacugaggcaggagaauugcuugaacccaggaggc

SEQ ID NO: 179316 - RNA, 64 nt, hsa
uaguccccuguagucccagcuacucgggaggcugaggcaggagaaucguuugaaccugggaggu

SEQ ID NO: 179317 - RNA, 64 nt, hsa
cggacgccuguauucacagcuacucgggagguugaggcaggagaauggggugaacccgggagga

SEQ ID NO: 179318 - RNA, 64 nt, hsa
ugggcaccuguaaucccagcuacuugggaggcugaggcaggagaaucucuugaacccaggaggc

SEQ ID NO: 179319 - RNA, 64 nt, hsa
cccacgccuguaaucccagcuacucgggaggcuaaggcaggaaaauuguuugaacccaggaggu

SEQ ID NO: 179320 - RNA, 64 nt, hsa
cgggcgccuguagucccagcuacucgggaggcugaggcaggagaauggcgugaacccgggaggc

SEQ ID NO: 179321 - RNA, 64 nt, hsa
cucacgccuguagucccagguacuugggagccugaggcaggaggauugcuugagcucaggaguu

SEQ ID NO: 179322 - RNA, 64 nt, hsa
cuguucugaugucagugccuguacauaccuccaaaggcaggacuugccugauaaauauuuuucc

SEQ ID NO: 179323 - RNA, 64 nt, hsa
caggcaugguggcacacaccuguaaucguagcugaggcaggagaaucgccugaacccaggaggc

SEQ ID NO: 179324 - RNA, 64 nt, hsa
caggcgccugaaaucccagcuacucaagaggcugaggcaggagaaucgcuugaaccugggaggc

SEQ ID NO: 179325 - RNA, 64 nt, hsa
cuucaagggcccuccccagcuacucgggaggcugaggcaggagaaucgcuugaacucaggaggu

SEQ ID NO: 179326 - RNA, 64 nt, hsa
caggcgccuguagucccagcuacuugggaggcugaggcaggagaauggccugaacccgggaggc

SEQ ID NO: 179327 - RNA, 64 nt, hsa
cgggcaccuguagucccagcuacucgggaggcugaggcaggagaauggugugaacccgggaagc

SEQ ID NO: 179328 - RNA, 64 nt, hsa
cacgugccugugaucccagcuacuugggaggcugaggcaggaggaucgccugagcccaggaggu

SEQ ID NO: 179329 - RNA, 64 nt, hsa
gggacaucgaacuaagaccugaacuaugagaaauaggcaggaagaaguuguaccugacucauuu

SEQ ID NO: 179330 - RNA, 64 nt, hsa
gccugggcgauagacucuuccucagcagccuggcaggcaggaaacagacauaggaccccagccc

SEQ ID NO: 179331 - RNA, 64 nt, hsa
gggcgccugugguggccagcuacucaggaggcugaggcaggagaauggcgugaacccgggaggc

SEQ ID NO: 179332 - RNA, 64 nt, hsa
cucacgcuugcaaucccagugcuuugggagacugaggcaggaggaucacuuaaggccaggaguu

SEQ ID NO: 179333 - RNA, 64 nt, hsa
cacaugccuguaauccgagugcuuugggaggcugaggcaggaggaucacucgagcucaagaauu

SEQ ID NO: 179334 - RNA, 64 nt, hsa
ccaguauucccagcuacucuggaggcugaggcggaggcaggauugcuugauaugagggagauug

SEQ ID NO: 179335 - RNA, 64 nt, hsa
ugggugccuguaauccuagcuacuugggaggcugaggcaggagaauugcuugaacuugggaggu

SEQ ID NO: 179336 - RNA, 64 nt, hsa
ggugcgcuuguaaucccagcuacucgggaggcugaggcaggagaauugcuugaacccaugaggu

SEQ ID NO: 179337 - RNA, 64 nt, hsa
ugcaugccuguagucucagcuacuugggaggcugaggcaggagaauugcuugaauccaagaggc

SEQ ID NO: 179338 - RNA, 64 nt, hsa
caggugccuguaaucccagcuacuugggaggcugaggcaggagagugcuugaacccaggaggcg

SEQ ID NO: 179339 - RNA, 64 nt, hsa
uuugggucuggaguucuggcuacuugaggaccaaaggcaggaaggauccugccuugauuuuacu

SEQ ID NO: 179340 - RNA, 64 nt, hsa
augcagaaagaaacaggcuggggccuggauucugaggcaggaaggaauuugggucuggaguucu

SEQ ID NO: 179341 - RNA, 64 nt, hsa
cgugugccuauggucccagcuacucaggaggcugaggcaggagaauugcuucaauccaggaggu

SEQ ID NO: 179342 - RNA, 64 nt, hsa
cucacaccugucauccuagcacuuugggaggcagaggcaggaggaucgcuugagcucaggaguu

SEQ ID NO: 179343 - RNA, 64 nt, hsa
caggugccuguagucccagcuacucgggaggcugaggcaggagaauggcgugaaccugggaggc

SEQ ID NO: 179344 - RNA, 64 nt, hsa
ugugcaucuguagucucagcaacuuaggagccugaggcaggagaaugguuugaacacagggaug

SEQ ID NO: 179345 - RNA, 64 nt, hsa
gucacacuuguaaucccacuacuuugggaggccaaggcaggaagauugcuugagcucaggaguu

SEQ ID NO: 179346 - RNA, 64 nt, hsa
aaagcuucgauggagagcagggaagggggacccaaggcaggagguacaccagcuggacaaauug

SEQ ID NO: 179347 - RNA, 64 nt, hsa
cagaguggcacuacugcccggccaguccaggcucaggcaggaaucggacgcuggggcccgggcu

SEQ ID NO: 179348 - RNA, 64 nt, hsa
aucagcaacugcagugugaggacagcgucucgggaggcaggacccuagggagacccgggugugc

SEQ ID NO: 179349 - RNA, 64 nt, hsa
ccugaugcaggagggugcgauagcggacguggccaggcaggaggggccggguucaggagcugag

SEQ ID NO: 179350 - RNA, 64 nt, hsa
ugcacaccuguaguccuagcuucuugggaggcugaggcaggauugcuugagcccaggaguuuga

SEQ ID NO: 179351 - RNA, 64 nt, hsa
uugagagagacugagacaggagucuuccggagucaggcaggaaggagaagcacagcaauauaca

SEQ ID NO: 179352 - RNA, 64 nt, hsa
ucaaagggucagugcgucagugccuuuucuucugaggcaggaaacaggugccaucuuggccacc

SEQ ID NO: 179353 - RNA, 64 nt, hsa
ugcugaaguugacuugaaaacacacuugacccucaggcaggagggcacugaccacaccccacac

SEQ ID NO: 179354 - RNA, 64 nt, hsa
cgcgcgccuguugucuuagcuacucaggaggcugaggcaggagaaucgcuugaaaacaggaggu

SEQ ID NO: 179355 - RNA, 64 nt, hsa
uugcuacuggggauuacccauggauauccuuaauaggcaggaagucugggaauucugguggccu

SEQ ID NO: 179356 - RNA, 64 nt, hsa
gaagaccuggcuuccgcgagagccuuguuccuggaggcaggagcgccccgccauccuggguacc

SEQ ID NO: 179357 - RNA, 64 nt, hsa
cacaugccuguaaucccagcuacucgggaggcugaggcaggagaauugcuugaaccugggaggc

SEQ ID NO: 179358 - RNA, 64 nt, hsa
ggaaacuucagaguacaaauugguggaugguggaaggcaggacacguaucucugucugacggaa

SEQ ID NO: 179359 - RNA, 64 nt, hsa
ugcagcuggcccugaguacagggaaguggaacauaggcaggauuuuggauuaauagagaaauuu

SEQ ID NO: 179360 - RNA, 64 nt, hsa
cgggcgccuguagucccagcuacucugaagacugaggcaggagaauggcgugaacccaggaggc

SEQ ID NO: 179361 - RNA, 64 nt, hsa
ugcacgccuguagucucagcuacucaggaggcugaggcaggagaaucgcuugaacccgggaggc

SEQ ID NO: 179362 - RNA, 64 nt, hsa
agggguuaaugcagauggcagugcagcaaggagaaggcaggaacauuggagccugcaauaaggg

SEQ ID NO: 179363 - RNA, 64 nt, hsa
cgggcgccuguaguuccagcuaacugggcggcugaggcaggagaauggcgugaaccugggaggu

SEQ ID NO: 179364 - RNA, 64 nt, hsa
ugcaugccuguaaucccagcuauucggaaggcugaggcaggagaaucacuugaacccaggaggc

SEQ ID NO: 179365 - RNA, 64 nt, hsa
aaucuagugugcagggcauucaccucagccccccaggcaggagccaagcacagcaggagcuucc

SEQ ID NO: 179366 - RNA, 64 nt, hsa
cacaugacuguaaucccagcuacucaggaggcugaggcaggaggaucacuugaaccugggaggc

SEQ ID NO: 179367 - RNA, 64 nt, hsa
cacaugccaguaauuccaucuacucgggaggcugaggcaggagaaucgucuaagcccgggaggu

SEQ ID NO: 179368 - RNA, 64 nt, hsa
caggcaccuguagucccagauacucgggaggcuaaggcaggagaaucgcuugacgggaagcgga

SEQ ID NO: 179369 - RNA, 64 nt, hsa
cgggggccuguaauccuagcuacuuggggugcugaggcaggagaaucaacugaacccgggaggc

SEQ ID NO: 179370 - RNA, 64 nt, hsa
gcucauggccaaaugugcgcacucuacauaaaggaggcaggaguuccuauaggcuauuuaaugu

SEQ ID NO: 179371 - RNA, 64 nt, hsa
uuucauuuacaucaaaguuaucucacaaaagagaaggcaggaaacguuuugugagugccuauuc

SEQ ID NO: 179372 - RNA, 64 nt, hsa
cgggcaccuguaauccuggcuacucgggaggcugaggcaggagaaucgcuugaacccgggaggc

SEQ ID NO: 179373 - RNA, 64 nt, hsa
ugcacuccuguaacccugggacuuugggaagcugaggcaggaagauugagccuaggaguucgag

SEQ ID NO: 179374 - RNA, 64 nt, hsa
cccagggacaccuggagcccccaggagcugggagaggcaggaaggauccuccccuagagccucc

SEQ ID NO: 179375 - RNA, 64 nt, hsa
cccagggaugccuggaguccccaggagcugggagaggcaggaaggacccuccccuagagucucu

SEQ ID NO: 179376 - RNA, 64 nt, hsa; identical to SEQ ID NO: 124726

SEQ ID NO: 179377 - RNA, 64 nt, hsa; identical to SEQ ID NO: 124727

SEQ ID NO: 179378 - RNA, 64 nt, hsa; identical to SEQ ID NO: 124728

SEQ ID NO: 179379 - RNA, 64 nt, hsa; identical to SEQ ID NO: 124729

SEQ ID NO: 179380 - RNA, 64 nt, hsa; identical to SEQ ID NO: 124730

SEQ ID NO: 179381 - RNA, 64 nt, hsa; identical to SEQ ID NO: 124731

SEQ ID NO: 179382 - RNA, 64 nt, hsa; identical to SEQ ID NO: 124732

SEQ ID NO: 179383 - RNA, 64 nt, hsa; identical to SEQ ID NO: 124733

SEQ ID NO: 179384 - RNA, 64 nt, hsa; identical to SEQ ID NO: 124734

SEQ ID NO: 179385 - RNA, 64 nt, hsa; identical to SEQ ID NO: 124735

SEQ ID NO: 179386 - RNA, 64 nt, hsa; identical to SEQ ID NO: 124736

SEQ ID NO: 179387 - RNA, 64 nt, hsa; identical to SEQ ID NO: 124737

SEQ ID NO: 179388 - RNA, 64 nt, hsa; identical to SEQ ID NO: 124738

SEQ ID NO: 179389 - RNA, 64 nt, hsa; identical to SEQ ID NO: 124739

SEQ ID NO: 179390 - RNA, 64 nt, hsa; identical to SEQ ID NO: 124740

SEQ ID NO: 179391 - RNA, 64 nt, hsa; identical to SEQ ID NO: 124741

SEQ ID NO: 179392 - RNA, 64 nt, hsa; identical to SEQ ID NO: 124742

SEQ ID NO: 179393 - RNA, 64 nt, hsa; identical to SEQ ID NO: 124743

SEQ ID NO: 179394 - RNA, 64 nt, hsa; identical to SEQ ID NO: 124744

SEQ ID NO: 179395 - RNA, 64 nt, hsa; identical to SEQ ID NO: 124745

SEQ ID NO: 179396 - RNA, 64 nt, hsa; identical to SEQ ID NO: 124746

SEQ ID NO: 179397 - RNA, 64 nt, hsa; identical to SEQ ID NO: 124747

SEQ ID NO: 179398 - RNA, 64 nt, hsa; identical to SEQ ID NO: 124748

SEQ ID NO: 179399 - RNA, 64 nt, hsa; identical to SEQ ID NO: 124749

SEQ ID NO: 179400 - RNA, 64 nt, hsa; identical to SEQ ID NO: 124750

SEQ ID NO: 179401 - RNA, 64 nt, hsa; identical to SEQ ID NO: 124751

SEQ ID NO: 179402 - RNA, 60 nt, hsa; identical to SEQ ID NO: 124752

SEQ ID NO: 179403 - RNA, 64 nt, hsa; identical to SEQ ID NO: 124753

SEQ ID NO: 179404 - RNA, 64 nt, hsa; identical to SEQ ID NO: 124754

SEQ ID NO: 179405 - RNA, 64 nt, hsa; identical to SEQ ID NO: 124755

SEQ ID NO: 179406 - RNA, 64 nt, hsa; identical to SEQ ID NO: 124756

SEQ ID NO: 179407 - RNA, 64 nt, hsa; identical to SEQ ID NO: 124757

SEQ ID NO: 179408 - RNA, 64 nt, hsa; identical to SEQ ID NO: 124758

SEQ ID NO: 179409 - RNA, 64 nt, hsa; identical to SEQ ID NO: 124759

SEQ ID NO: 179410 - RNA, 64 nt, hsa; identical to SEQ ID NO: 124760

SEQ ID NO: 179411 - RNA, 64 nt, hsa; identical to SEQ ID NO: 124761

SEQ ID NO: 179412 - RNA, 64 nt, hsa; identical to SEQ ID NO: 124762

SEQ ID NO: 179413 - RNA, 64 nt, hsa; identical to SEQ ID NO: 124763

SEQ ID NO: 179414 - RNA, 64 nt, hsa; identical to SEQ ID NO: 124764

SEQ ID NO: 179415 - RNA, 64 nt, hsa; identical to SEQ ID NO: 124765

SEQ ID NO: 179416 - RNA, 64 nt, hsa; identical to SEQ ID NO: 124766

SEQ ID NO: 179417 - RNA, 64 nt, hsa; identical to SEQ ID NO: 124767

SEQ ID NO: 179418 - RNA, 64 nt, hsa; identical to SEQ ID NO: 124768

SEQ ID NO: 179419 - RNA, 64 nt, hsa; identical to SEQ ID NO: 124769

SEQ ID NO: 179420 - RNA, 64 nt, hsa; identical to SEQ ID NO: 124770

SEQ ID NO: 179421 - RNA, 64 nt, hsa; identical to SEQ ID NO: 124771

SEQ ID NO: 179422 - RNA, 64 nt, hsa; identical to SEQ ID NO: 124772

SEQ ID NO: 179423 - RNA, 64 nt, hsa; identical to SEQ ID NO: 124773

SEQ ID NO: 179424 - RNA, 64 nt, hsa; identical to SEQ ID NO: 124774

SEQ ID NO: 179425 - RNA, 64 nt, hsa; identical to SEQ ID NO: 124775

SEQ ID NO: 179426 - RNA, 64 nt, hsa; identical to SEQ ID NO: 124776

SEQ ID NO: 179427 - RNA, 64 nt, hsa; identical to SEQ ID NO: 124777

SEQ ID NO: 179428 - RNA, 64 nt, hsa; identical to SEQ ID NO: 124778

SEQ ID NO: 179429 - RNA, 64 nt, hsa; identical to SEQ ID NO: 124779

SEQ ID NO: 179430 - RNA, 64 nt, hsa; identical to SEQ ID NO: 124780

SEQ ID NO: 179431 - RNA, 64 nt, hsa; identical to SEQ ID NO: 124781

SEQ ID NO: 179432 - RNA, 64 nt, hsa; identical to SEQ ID NO: 124782

SEQ ID NO: 179433 - RNA, 64 nt, hsa; identical to SEQ ID NO: 124783

SEQ ID NO: 179434 - RNA, 64 nt, hsa; identical to SEQ ID NO: 124784

SEQ ID NO: 179435 - RNA, 64 nt, hsa; identical to SEQ ID NO: 124785

SEQ ID NO: 179436 - RNA, 64 nt, hsa; identical to SEQ ID NO: 124786

SEQ ID NO: 179437 - RNA, 64 nt, hsa; identical to SEQ ID NO: 124787

SEQ ID NO: 179438 - RNA, 64 nt, hsa; identical to SEQ ID NO: 124788

SEQ ID NO: 179439 - RNA, 64 nt, hsa; identical to SEQ ID NO: 124789

SEQ ID NO: 179440 - RNA, 64 nt, hsa; identical to SEQ ID NO: 124790

SEQ ID NO: 179441 - RNA, 64 nt, hsa; identical to SEQ ID NO: 124791

SEQ ID NO: 179442 - RNA, 64 nt, hsa; identical to SEQ ID NO: 124792

SEQ ID NO: 179443 - RNA, 64 nt, hsa; identical to SEQ ID NO: 124793

SEQ ID NO: 179444 - RNA, 64 nt, hsa; identical to SEQ ID NO: 124794

SEQ ID NO: 179445 - RNA, 64 nt, hsa; identical to SEQ ID NO: 124795

SEQ ID NO: 179446 - RNA, 64 nt, hsa; identical to SEQ ID NO: 124796

SEQ ID NO: 179447 - RNA, 64 nt, hsa; identical to SEQ ID NO: 124797

SEQ ID NO: 179448 - RNA, 64 nt, hsa; identical to SEQ ID NO: 124798

SEQ ID NO: 179449 - RNA, 64 nt, hsa; identical to SEQ ID NO: 124799

SEQ ID NO: 179450 - RNA, 64 nt, hsa; identical to SEQ ID NO: 124800

SEQ ID NO: 179451 - RNA, 64 nt, hsa; identical to SEQ ID NO: 124801

SEQ ID NO: 179452 - RNA, 64 nt, hsa; identical to SEQ ID NO: 124802

SEQ ID NO: 179453 - RNA, 64 nt, hsa; identical to SEQ ID NO: 124803

SEQ ID NO: 179454 - RNA, 64 nt, hsa; identical to SEQ ID NO: 124804

SEQ ID NO: 179455 - RNA, 64 nt, hsa; identical to SEQ ID NO: 124805

SEQ ID NO: 179456 - RNA, 64 nt, hsa; identical to SEQ ID NO: 124806

SEQ ID NO: 179457 - RNA, 64 nt, hsa; identical to SEQ ID NO: 124807

SEQ ID NO: 179458 - RNA, 64 nt, hsa; identical to SEQ ID NO: 124808

SEQ ID NO: 179459 - RNA, 64 nt, hsa; identical to SEQ ID NO: 124809

SEQ ID NO: 179460 - RNA, 64 nt, hsa; identical to SEQ ID NO: 124810

SEQ ID NO: 179461 - RNA, 64 nt, hsa; identical to SEQ ID NO: 124811

SEQ ID NO: 179462 - RNA, 64 nt, hsa; identical to SEQ ID NO: 124812

SEQ ID NO: 179463 - RNA, 64 nt, hsa
ugcuaucaauuucuuauuaauuaaucuugaugauucuuauuaauuaaucacauuugcaggaaau

SEQ ID NO: 179464 - RNA, 64 nt, hsa
cugucugggccuguuacucauccugcuaucaauuucuuauuaauuaaucuugaugauucuuauu

SEQ ID NO: 179465 - RNA, 64 nt, hsa
gugaucuggaaaucuaccaccaaucccgaucggcucuuauuagcuccccgcuccacaagacacc

SEQ ID NO: 179466 - RNA, 64 nt, hsa
gugcuuuggaaauccaccaccaaucccgaucggcucuuauuagcuccccgcuccacaagacacc

SEQ ID NO: 179467 - RNA, 64 nt, hsa
gggaucuggaaauccacgaccaaucccgaucggcucuuauuagcuccccgcuccacaagacacc

SEQ ID NO: 179468 - RNA, 64 nt, hsa
aguuauccaugccaagucccauugucagaaauauucuuauuacucagucaaacacucuuugagc

SEQ ID NO: 179469 - RNA, 64 nt, hsa
uuucuuguagcuaaaaauaaaacaucauaaaucuucuuauuaaaucaaucuugaaauagaaaau

SEQ ID NO: 179470 - RNA, 64 nt, hsa
agucuuagauuuuaagaguaauacaacccaucuaucuuauuagucuugugccaauaagagaagu

SEQ ID NO: 179471 - RNA, 64 nt, hsa
cauuuguaauggauaacgugcauuaaaauggaguucuuauuauagaauaaccugguuaaacaga

SEQ ID NO: 179472 - RNA, 64 nt, hsa
cgcuugauggauagagcgccuucaguguacuguuucuuauuaacuuuacuuuuuuuaaaucaac

SEQ ID NO: 179473 - RNA, 64 nt, hsa
aauugacuuacugggaaacugaauaaaauaugccucuuauuaucauauugucuccugguuuuuu

SEQ ID NO: 179474 - RNA, 64 nt, hsa
uucucucacaagcuagcuuauuccaaauuauuugucuuauuaaucaccagaaaauggucauauc

SEQ ID NO: 179475 - RNA, 64 nt, hsa
aaaauuuugucaccuaaguguuugggaggcuuuuucuuauuaaagguugggauugguccuguca

SEQ ID NO: 179476 - RNA, 64 nt, hsa
gaagauggacuguugaaauuguauaggaccagugucuuauuaauaugauuaauauauuuagaag

SEQ ID NO: 179477 - RNA, 64 nt, hsa
auacacuaaaagcaugcaucuaaucuaauaguccucuuauuaugcuuuuaguuguaugagucuc

SEQ ID NO: 179478 - RNA, 64 nt, hsa
ucuccaauugcauggucucuguggaucucugacuucuuauuaccuccgauuggaacgcgccaca

SEQ ID NO: 179479 - RNA, 64 nt, hsa
ugccagaugggaugagaugggauguuaaaccacuucuuauuaccacguuguuggccuccauugc

SEQ ID NO: 179480 - RNA, 64 nt, hsa
auuguggcgcuuuuguagaucacugagaagcuuaucuuauuaaccaauauaccacuuccuaaau

SEQ ID NO: 179481 - RNA, 64 nt, hsa
ggucaaagaauggcuuucaguuaaaguuuugacuucuuauuauaaauaauauaaagaaugucuc

SEQ ID NO: 179482 - RNA, 64 nt, hsa
uuuagcauuaaaacucaccaucaaauagauguaaucuuauuaauuacacauuuuguauuuuaau

SEQ ID NO: 179483 - RNA, 64 nt, hsa
ucauagaauaacauguuauuuauugguauugacuucuuauuagacagagcucauaguauuuguu

SEQ ID NO: 179484 - RNA, 64 nt, hsa
acauguaaagacuacaguuaauucugacacuguaucuuauuaaaauaggaugauuugcauuuug

SEQ ID NO: 179485 - RNA, 64 nt, hsa
gauuucaggcaaagacuugcaggaagaugaugauaacggcgaugugaaucgucaaagguacggg

SEQ ID NO: 179486 - RNA, 64 nt, hsa
ccauuugucuucaguuucuaguuugcacauccagaacggcgaaggcuggguguguauuccacua

SEQ ID NO: 179487 - RNA, 64 nt, hsa
ggcgcagagcacacccgcugggccagcagcucccaacggcgaugcuacuacuaagaauccccag

SEQ ID NO: 179488 - RNA, 64 nt, hsa
gaacaccugaaaugcaugcucuauaaauaauaggaacggcgacauucuaguaaugauaguuuuu

SEQ ID NO: 179489 - RNA, 64 nt, hsa
ucaccgagcccaagaguucaagacaauccuggccaacggcgaaacucugucucuacaaaaaaua

SEQ ID NO: 179490 - RNA, 64 nt, hsa
gccgggcgcgcacacacggcagcuucuguuugaaaacggcgaccuucgggcccuuuucuccagc

SEQ ID NO: 179491 - RNA, 64 nt, hsa
cagucugugccuuagaggucuguuaggccugccaaacggcgaccagcuccccuggagcgagggc

SEQ ID NO: 179492 - RNA, 64 nt, hsa
agagagcggagccgggagcgagacaaggagcgagaacggcgacgcucccgcucccgggaccggc

SEQ ID NO: 179493 - RNA, 64 nt, hsa
cuuauagccucccaucgugcccacgauagcuggcaacggcgacacuuccaacuucgaaacuuac

SEQ ID NO: 179494 - RNA, 64 nt, hsa
aaagugcugggauuacaggugugagccaccacgcccggccgauuuggggcauuuuuauuuaaca

SEQ ID NO: 179495 - RNA, 64 nt, hsa
caggcaaugggcacagccuuccuccccagaggacccggccgaccucagcgccuccugcaggcua

SEQ ID NO: 179496 - RNA, 64 nt, hsa
gucccggaccccaccucuucccugccgcccgccaccggccgaccgaccgcggcugccccaguug

SEQ ID NO: 179497 - RNA, 64 nt, hsa
gagggaggcgggagucgggggaagacgcggcaggccggccgagggcaccccgaggaacauggca

SEQ ID NO: 179498 - RNA, 64 nt, hsa
agugacuucagucugcucagaacgaauguggaggccggccgaaacugaugcugcccacaguccc

SEQ ID NO: 179499 - RNA, 64 nt, hsa
gaaguacgcggagccagcgccgucggagaccgcgccggccgagcugaggacugcacgccgcugu

SEQ ID NO: 179500 - RNA, 64 nt, hsa
aaaguguugggauuacaggcuugagccaccgcacccggccgagaauauguguuguuauuuauga

SEQ ID NO: 179501 - RNA, 64 nt, hsa
aaggacggguuggggccgggcacauugggggucaccggccgauggagacaccaaccgacaggcc

SEQ ID NO: 179502 - RNA, 64 nt, hsa
cacaccggggagagcugcucggacaggcccccucccggccgaagcugucccuuaaugcuggucc

SEQ ID NO: 179503 - RNA, 64 nt, hsa
ccguacaaaccaaguugcccucuccgagcuaggcccggccgagagcgccuuagcucgagucgga

SEQ ID NO: 179504 - RNA, 64 nt, hsa
aaagugcugggauuacaggcgugagccacugcgcccggccgaaguguuugaaaucuuuaagcau

SEQ ID NO: 179505 - RNA, 64 nt, hsa
ugcggagcucugguuucagaugccagcagccuccccggccgaccuagugucucuuuucaagguc

SEQ ID NO: 179506 - RNA, 64 nt, hsa
caagcccugcaguguguccccgcucggggagggcccggccgagcgggcagggagagccaguccu

SEQ ID NO: 179507 - RNA, 64 nt, hsa
cugugucugcagccacagugccagcucccugcgcccggccgaccugcuugcccucauccuccug

SEQ ID NO: 179508 - RNA, 64 nt, hsa
gaggaaggccaggcucgggggagccuccuccagcccggccgacccggacucccggucaccugac

SEQ ID NO: 179509 - RNA, 64 nt, hsa
agacagggaugaggcaagugguucuuccuggggcccggccgauccucaggaugcagagaaguca

SEQ ID NO: 179510 - RNA, 64 nt, hsa
uacacacuugccucucgcuacagcguccuccucaccggccgaagaggagaaacucauugaaauc

SEQ ID NO: 179511 - RNA, 64 nt, hsa
uuacaccuggaauguuaggaucgugcggccgcggccggccgagcugccuggcgggguuggcccu

SEQ ID NO: 179512 - RNA, 64 nt, hsa
ucagcuccuucccccucgcaaugcacugaaaggcccggccgacugcugcucgccgauccguggg

SEQ ID NO: 179513 - RNA, 64 nt, hsa
aucccauccaugaacucgaugggccccuccugugccggccgagaggcacacacugccuucacga

SEQ ID NO: 179514 - RNA, 64 nt, hsa
gaccgucuggggcucaggcuggugugggaugcagccggccgaugagaaaauaaagccauauuga

SEQ ID NO: 179515 - RNA, 64 nt, hsa
ccgcggggccuccccacaagccccucccaaagcgccggccgacucgcugucucgcuggggacuc

SEQ ID NO: 179516 - RNA, 64 nt, hsa
ugucgacugccuuauacacccgcccccgcgcuggccggccgaccuagugccuuguucucacccc

SEQ ID NO: 179517 - RNA, 64 nt, hsa
ccucccuccgcugagugacacgggacaccagugcccggccgacgcgccuuugcaggagaaaugu

SEQ ID NO: 179518 - RNA, 64 nt, hsa
ugcugggauuacgggcuggagccaccgugcccggccggccgagcauaagaaguuuaaucaaagu

SEQ ID NO: 179519 - RNA, 64 nt, hsa
aaagugcugggauuacaggugugagccaccgcgcccggccgagaaugacaucuuaaagccacca

SEQ ID NO: 179520 - RNA, 64 nt, hsa
aaaucaaagcaaaccaauaccauugauaagaagaagauaaaaacaaaauauuuuggaguguuuu

SEQ ID NO: 179521 - RNA, 64 nt, hsa
uuguaaagugcuauaaauguauuuuguuaaguacagauaaaagcuauugugugaguauauugug

SEQ ID NO: 179522 - RNA, 64 nt, hsa
aauccaguguuacuaguaauuuccaugguaauacagauaaaauacauucuuuuaauucugggaa

SEQ ID NO: 179523 - RNA, 64 nt, hsa
uugcaugcaauuguguaggauugacaaggaacucagauaaaaauuuccagggugcacuuccaga

SEQ ID NO: 179524 - RNA, 64 nt, hsa
ucccaguccuaugguaaugacuuaggaggaaugcagauaaaaguaccuuguaagauaaauauaa

SEQ ID NO: 179525 - RNA, 64 nt, hsa
ucagggugaggugcuguguuucuuauuucauacgagauaaaacagagagaaguucucucuucuc

SEQ ID NO: 179526 - RNA, 64 nt, hsa
ucagaagaccaccugugcccuuuucucucguggaagauaaaaccuggacucagggagcaaccac

SEQ ID NO: 179527 - RNA, 64 nt, hsa
auuuuguuccuuuucaucauagaaaacauguuuaagauaaaauacaaacuuuaccuaccccaaa

SEQ ID NO: 179528 - RNA, 64 nt, hsa
gugagaaccacuaaguuggaguacugacucauagagauaaaauucuuugaaagaaauguacugu

SEQ ID NO: 179529 - RNA, 64 nt, hsa
uuuuauaguuuuccacaaccaagccacccuucacagauaaaauaugaugcuggcauggcaauca

SEQ ID NO: 179530 - RNA, 64 nt, hsa
aauuuuguggcucccuaaugcaauaauguacagaagauaaaaaaauuuauaauugaacaauuug

SEQ ID NO: 179531 - RNA, 64 nt, hsa
aaguagcuuugaauuuucucuguaagagaauaaaagauaaaauaauguauuuucuuuauuucac

SEQ ID NO: 179532 - RNA, 64 nt, hsa
gagaaagcuuucauauuuaaaaaaaagucuuuucagauaaaaucugcuugugucuugaauaaua

SEQ ID NO: 179533 - RNA, 64 nt, hsa
cagaaaacuauugucauucaacugaagaagaggaagauaaaagauugucuuguuuccaucacug

SEQ ID NO: 179534 - RNA, 64 nt, hsa
cgggacugaaaacguuagagacacacugcauugcagauaaaaugcaggcagcacaauauggccu

SEQ ID NO: 179535 - RNA, 64 nt, hsa
gugcgguucuaauucaugugcagugauauaguauagauaaaagaaugaguaaaagaaaauacaa

SEQ ID NO: 179536 - RNA, 64 nt, hsa
uuuguuaccaauacgcuuuaaucuugucuuggaaagauaaaaugaccugcauucuaaauuagaa

SEQ ID NO: 179537 - RNA, 64 nt, hsa
augaacauuggguucacaaggcauuggguaaguuagauaaaauagcauauacuuucucugcagg

SEQ ID NO: 179538 - RNA, 64 nt, hsa
aguuuggguacugugcugauuuuuagauauacagagauaaaaauagccccuuuccuugcaggua

SEQ ID NO: 179539 - RNA, 64 nt, hsa
ugaugaaaugagucacagagaaguuacaugacaaagauaaaaucacaggguuggaaagaacuuu

SEQ ID NO: 179540 - RNA, 64 nt, hsa
aaguguucuucuacaaaucuuacagaguguaaagagauaaaaagaaaugauuuuuuuucuuacc

SEQ ID NO: 179541 - RNA, 64 nt, hsa
augaacuaauucuuuacaaauguugacugaagauagauaaaacucuaauuaaaaauuuaaaagg

SEQ ID NO: 179542 - RNA, 64 nt, hsa
uaaaagaaaacaccgacagcuguaaaauguucuaagauaaaaaaacucgagcuacaaagaaaga

SEQ ID NO: 179543 - RNA, 64 nt, hsa
agacagggaggcugcagaagccauuucucuuuguagauaaaaagcauuaucuaugauuguugua

SEQ ID NO: 179544 - RNA, 64 nt, hsa
auauaggcugaaaucucuuaccaaagugcguuccagauaaaaaugagacuuagaagacagacug

SEQ ID NO: 179545 - RNA, 64 nt, hsa
agcuuuggcucuggcugcuuuuuagaauaaugcaagauaaaaaucacaccugagggcugaaaac

SEQ ID NO: 179546 - RNA, 64 nt, hsa
cccgaagacacuccuuccccaaguaauuguaggaagauaaaaaaacuguuaccagauaacaaac

SEQ ID NO: 179547 - RNA, 64 nt, hsa
auuuuuucuggaacugaauucuuaaacauaaaacagauaaaaugcaucuuguuacuacaaaugu

SEQ ID NO: 179548 - RNA, 64 nt, hsa
uaucacucuugaauuuuaucaucuauaaaaugagagauaaaaauaucucacugaauuguuacuu

SEQ ID NO: 179549 - RNA, 64 nt, hsa
uguaguuuuaaccagacuuucucuuaaaaacauuagauaaaauaaaagauucaccggauggauu

SEQ ID NO: 179550 - RNA, 64 nt, hsa
auucagaacauagcaaauaccuuugaaguauaaaagauaaaauucauuuuuagugaacccugua

SEQ ID NO: 179551 - RNA, 64 nt, hsa
gagaccuauuagauguaagugcuaguagaauauaagauaaaagaggcugagaauuaccauacaa

SEQ ID NO: 179552 - RNA, 64 nt, hsa
uguuucauuguucugucaauaauuguuaccaaagagauaaaaauaaaagcagaauguauaucau

SEQ ID NO: 179553 - RNA, 64 nt, hsa
gacuccaucucaaaaaaaaaaaaaaaaaaaaaaaagauaaaaagucagaaaucugaaaagugga

SEQ ID NO: 179554 - RNA, 64 nt, hsa
gggccugaugacauccaauacagaguucugguaaagauaaaauuugauacagguuuggugucau

SEQ ID NO: 179555 - RNA, 64 nt, hsa
agaagggagcugaggccauucccuguaggaguaaagauaaaaggauaggaaaagauucaaagcu

SEQ ID NO: 179556 - RNA, 64 nt, hsa
uaaaguugaggggagaggaaaucuuaagauuacaagauaaaaaacgaauccccuaaacaaaaag

SEQ ID NO: 179557 - RNA, 64 nt, hsa
ggucuuggcugaaaaaaaaaaaugcuuuuaaaaaagauaaaaugaaaaggagagcucucuuuuu

SEQ ID NO: 179558 - RNA, 64 nt, hsa
acccuguguggcucauucccacccaggaaacugaagauaaaagauuugggaaaacacaccaaga

SEQ ID NO: 179559 - RNA, 64 nt, hsa
aauaaucuauacauguucaaauuagguagcauaaagauaaaagugaaauuuaguaguauaggcc

SEQ ID NO: 179560 - RNA, 64 nt, hsa
gaauguuuaguguaguuaagacuaauuugacaacagauaaaacagucugucagcuauuacaaag

SEQ ID NO: 179561 - RNA, 64 nt, hsa
auacuuauccucugaacacauaaauaagugaauaagauaaaaauaucuuuaccuuauuaauauu

SEQ ID NO: 179562 - RNA, 64 nt, hsa
uuuuugugauuuaugcgauuaaacgaaaugauaaagauaaaaccauauuauuaaauaccuauau

SEQ ID NO: 179563 - RNA, 64 nt, hsa
auggaagaaguaaggaaaaggagagagcuagucuagauaaaaaaagagauaaagacuacagaag

SEQ ID NO: 179564 - RNA, 64 nt, hsa
aaaaugaugaaaagaguaguucaagaaguucuggagauaaaaaaaauacgagugauagaaguag

SEQ ID NO: 179565 - RNA, 64 nt, hsa
uuaacugcuggcaaaauguugauuuuuuaauauuagauaaaacgaguaaacgaaauuccccaga

SEQ ID NO: 179566 - RNA, 64 nt, hsa
cuugacugaugagcuuucagugaagaauccucuaagauaaaacuucuauuuaaagacuuuaacu

SEQ ID NO: 179567 - RNA, 64 nt, hsa
ggucugauauaugcugcucuugguucuauaaacuagauaaaagcagugcuuugugaaaugcagu

SEQ ID NO: 179568 - RNA, 64 nt, hsa
augaaaaugaugcauggccaaguucaguguuuacagauaaaacugcugugguucaagugcuucc

SEQ ID NO: 179569 - RNA, 64 nt, hsa
agaaaauuauuuauuguuacagauaaaacuugagagauaaaaagcuauaccauaauaaaaucua

SEQ ID NO: 179570 - RNA, 64 nt, hsa
ucagaauugcucaaagaaaauuauuuauuguuacagauaaaacuugagagauaaaaagcuauac

SEQ ID NO: 179571 - RNA, 64 nt, hsa
acuuaaaaucaagagccaaggaguagugaguuguagauaaaaaaagaaugucagcuuuggagac

SEQ ID NO: 179572 - RNA, 64 nt, hsa
ucucugagccuacaucuucuugucuguaaaauggagauaaaauggguuuaaugaggucuaccuu

SEQ ID NO: 179573 - RNA, 64 nt, hsa
agucguauuauucacuuguaaaaaugauuguaacagauaaaaaauguaucugcagcaacucugc

SEQ ID NO: 179574 - RNA, 64 nt, hsa
ucuacaugauuuucaaguuguaaugcagauggacagauaaaaaagauuuuacguuugucuuuug

SEQ ID NO: 179575 - RNA, 64 nt, hsa
aaucuuaggagauaaacacauucaaaaaggaaugagauaaaaagaauaaggcaauaaauguuga

SEQ ID NO: 179576 - RNA, 64 nt, hsa
acuuuuguauucacaggcaucccaucuccaucacagauaaaaucuuaggagauaaacacauuca

SEQ ID NO: 179577 - RNA, 64 nt, hsa
cauauaggugugcauuuuaauauuuuucuuuccaagauaaaauuuugaaacuuaaauuguguau

SEQ ID NO: 179578 - RNA, 64 nt, hsa
aguaagaaaaaaaaagacguauuuuugcuuacucagauaaaagacaaccuguaaaaauauaaua

SEQ ID NO: 179579 - RNA, 64 nt, hsa
agagugaaaaucuucucuucaaauaaucuuugauagauaaaaauggaagguaagauguuucuag

SEQ ID NO: 179580 - RNA, 64 nt, hsa
uaaaaagacaacagucaaguugauuuugauuagaagauaaaaguacauaaugaaaauccauggc

SEQ ID NO: 179581 - RNA, 64 nt, hsa; identical to SEQ ID NO: 128751

SEQ ID NO: 179582 - RNA, 64 nt, hsa; identical to SEQ ID NO: 128752

SEQ ID NO: 179583 - RNA, 64 nt, hsa; identical to SEQ ID NO: 128753

SEQ ID NO: 179584 - RNA, 64 nt, hsa; identical to SEQ ID NO: 128754

SEQ ID NO: 179585 - RNA, 64 nt, hsa; identical to SEQ ID NO: 128755

SEQ ID NO: 179586 - RNA, 64 nt, hsa; identical to SEQ ID NO: 128756

SEQ ID NO: 179587 - RNA, 64 nt, hsa; identical to SEQ ID NO: 128757

SEQ ID NO: 179588 - RNA, 64 nt, hsa; identical to SEQ ID NO: 128758

SEQ ID NO: 179589 - RNA, 64 nt, hsa; identical to SEQ ID NO: 128759

SEQ ID NO: 179590 - RNA, 64 nt, hsa; identical to SEQ ID NO: 128760

SEQ ID NO: 179591 - RNA, 64 nt, hsa; identical to SEQ ID NO: 128761

SEQ ID NO: 179592 - RNA, 64 nt, hsa; identical to SEQ ID NO: 128762

SEQ ID NO: 179593 - RNA, 64 nt, hsa; identical to SEQ ID NO: 128763

SEQ ID NO: 179594 - RNA, 64 nt, hsa; identical to SEQ ID NO: 128764

SEQ ID NO: 179595 - RNA, 64 nt, hsa; identical to SEQ ID NO: 128765

SEQ ID NO: 179596 - RNA, 64 nt, hsa; identical to SEQ ID NO: 128766

SEQ ID NO: 179597 - RNA, 64 nt, hsa; identical to SEQ ID NO: 128767

SEQ ID NO: 179598 - RNA, 64 nt, hsa; identical to SEQ ID NO: 128768

SEQ ID NO: 179599 - RNA, 64 nt, hsa; identical to SEQ ID NO: 128769

SEQ ID NO: 179600 - RNA, 64 nt, hsa; identical to SEQ ID NO: 128770

SEQ ID NO: 179601 - RNA, 64 nt, hsa; identical to SEQ ID NO: 128771

SEQ ID NO: 179602 - RNA, 64 nt, hsa; identical to SEQ ID NO: 128772

SEQ ID NO: 179603 - RNA, 64 nt, hsa; identical to SEQ ID NO: 128773

SEQ ID NO: 179604 - RNA, 64 nt, hsa; identical to SEQ ID NO: 128774

SEQ ID NO: 179605 - RNA, 64 nt, hsa; identical to SEQ ID NO: 128775

SEQ ID NO: 179606 - RNA, 64 nt, hsa; identical to SEQ ID NO: 128776

SEQ ID NO: 179607 - RNA, 64 nt, hsa; identical to SEQ ID NO: 128777

SEQ ID NO: 179608 - RNA, 64 nt, hsa; identical to SEQ ID NO: 128778

SEQ ID NO: 179609 - RNA, 64 nt, hsa; identical to SEQ ID NO: 128779

SEQ ID NO: 179610 - RNA, 64 nt, hsa; identical to SEQ ID NO: 128780

SEQ ID NO: 179611 - RNA, 64 nt, hsa; identical to SEQ ID NO: 128781

SEQ ID NO: 179612 - RNA, 64 nt, hsa; identical to SEQ ID NO: 128782

SEQ ID NO: 179613 - RNA, 64 nt, hsa; identical to SEQ ID NO: 128783

SEQ ID NO: 179614 - RNA, 64 nt, hsa; identical to SEQ ID NO: 128784

SEQ ID NO: 179615 - RNA, 64 nt, hsa; identical to SEQ ID NO: 128785

SEQ ID NO: 179616 - RNA, 64 nt, hsa; identical to SEQ ID NO: 128786

SEQ ID NO: 179617 - RNA, 64 nt, hsa; identical to SEQ ID NO: 128787

SEQ ID NO: 179618 - RNA, 64 nt, hsa; identical to SEQ ID NO: 128788

SEQ ID NO: 179619 - RNA, 64 nt, hsa; identical to SEQ ID NO: 128789

SEQ ID NO: 179620 - RNA, 64 nt, hsa
uuuuuuaguagcacuuucucuggaugacagaaggagcaaccacaugggcacccuuguucauacc

SEQ ID NO: 179621 - RNA, 64 nt, hsa
aauuuuacauccgaacaaaauuuuacauccgaaaagcaaccaacuucuucauggaacucagccc

SEQ ID NO: 179622 - RNA, 64 nt, hsa
aaaucaaauguaaaguuuaauugaaagaauguaaagcaaccaaaaagaaaaaaaaaaagaaaga

SEQ ID NO: 179623 - RNA, 64 nt, hsa
cuaaccuacggccacgggaacaggaccaugguuaagcaaccauauagaaagcuuuguugaaaga

SEQ ID NO: 179624 - RNA, 64 nt, hsa
gagucuccugagucgaggaaucuguauuauuaauagcaaccagggccgggugucguggcucacg

SEQ ID NO: 179625 - RNA, 64 nt, hsa
agugagacuccuucucaaaaguaaauaaauaaauagcaaccaguacuccaggugauuccagcau

SEQ ID NO: 179626 - RNA, 64 nt, hsa
ccugugauuuucuuuucuaaaugaaacuccauguagcaaccaggacgaaguugagaaggaaaac

SEQ ID NO: 179627 - RNA, 64 nt, hsa
gguaggcauuuggcauauuuuguggacucagucaagcaaccacagucuguuaaucauuucucua

SEQ ID NO: 179628 - RNA, 64 nt, hsa
aauuugugugugaaauauaacauugauugaauugcaguuacauuugguuaguaauauuucauua

SEQ ID NO: 179629 - RNA, 64 nt, hsa
gugguuagcaacuaugaaacagaaauaggacacucaguuacaaacauuaucuccuuuaguuuuu

SEQ ID NO: 179630 - RNA, 64 nt, hsa
auuuguguuuuuuguuguuauuguuuggguagagcaguuacaagaaacccuaaaacccuuggau

SEQ ID NO: 179631 - RNA, 64 nt, hsa
acagccccuugcuagauauuaccacagauaaugacaguuacaugguagaacugcccaugccaca

SEQ ID NO: 179632 - RNA, 64 nt, hsa
uagggguuaaagcagacagucacacugguuuggucaguuacaaaguaauuucuuugaucuggac

SEQ ID NO: 179633 - RNA, 64 nt, hsa
cuuggugugauugcacagaauuuguauguauuuucaguuacaagauuguaaguaaauugccuga

SEQ ID NO: 179634 - RNA, 64 nt, hsa
uucauuuaucuuaaagaaagacuaaacugguugucaguuacaucugacagaaaaaaaaaaaaaa

SEQ ID NO: 179635 - RNA, 64 nt, hsa
uucuggaagauguuuuaagaagcauuuuaaaugucaguuacaauaugagaaagauuuggaaaac

SEQ ID NO: 179636 - RNA, 64 nt, hsa
ucugagcucaucgugcuacugguauguguaugugcaguuacacaguuuucuguaucauagauuc

SEQ ID NO: 179637 - RNA, 64 nt, hsa
aggacugcucuccaaggaacuggaccuguccagacaguuacacuccaaggucauuggagagaac

SEQ ID NO: 179638 - RNA, 64 nt, hsa
ucucaaacuuacuugacaacaaaacccauucuuucaguuacaucuacuaagagcucguaguuca

SEQ ID NO: 179639 - RNA, 64 nt, hsa
ucaaauacaguaacugacacuccucgguaguugacaguuacauagucuacaauacuagcacuac

SEQ ID NO: 179640 - RNA, 64 nt, hsa
uuugcuugcaguagauuuucuuuaaaagaaugggcaguuacaugcauacuucaaaaguauuuuc

SEQ ID NO: 179641 - RNA, 64 nt, hsa
gaugcugauguucaguguaauuucuuugccuguucaguuacagaaaguggugcucaguuguaga

SEQ ID NO: 179642 - RNA, 64 nt, hsa
gugcuacaugugugccucucacagcaguuggccacaguuacagggagagaacaauaucacaguc

SEQ ID NO: 179643 - RNA, 64 nt, hsa
cagcacagguuggauagggguuaguguaggagaccaguuacagaauggccuggagucuucaacu

SEQ ID NO: 179644 - RNA, 64 nt, hsa
cccuagacaguucugugagaaagcagcaauugcacaguuacauacacagucaauuaaauuuuaa

SEQ ID NO: 179645 - RNA, 64 nt, hsa
uggcuacauguccgagugaguugcucuuccacagcaguuacauaaguuuuguauuauuuuuuuu

SEQ ID NO: 179646 - RNA, 62 nt, hsa
gcaggacuacccccuuaccauuuuaagaagguacuuuauacauuuauuuaauccuacuaaug

SEQ ID NO: 179647 - RNA, 62 nt, hsa
uaugaaugauuagagaaaauuugagucaguguacuuuauagugugaauccugugagcuaaua

SEQ ID NO: 179648 - RNA, 62 nt, hsa
cuggcugggcaguggaauuuugagcgaccuuuacuuuauacuuuucugugcuugacagauuu

SEQ ID NO: 179649 - RNA, 62 nt, hsa
ugcuugacagauuuucagccaugaccauguucacuuuauaaucaaaacaaaaauaaaggucc

SEQ ID NO: 179650 - RNA, 62 nt, hsa
auguauauaagacagguagugccugauuuacuacuuuauauaaaauaguaccuccuucaguu

SEQ ID NO: 179651 - RNA, 62 nt, hsa
uacacuacaguuuacuuuucagaauacuaaagacuuuauaacugcaugaacuuggauuuuuu

SEQ ID NO: 179652 - RNA, 62 nt, hsa
cuggagguugcauggacuguacgaccggcaugacuuuauauuguauacagauuuugcacgcc

SEQ ID NO: 179653 - RNA, 62 nt, hsa
ugggggcacuggcugggagucagcaagcgagcacuuuauaucccuuugagggaaacccugau

SEQ ID NO: 179654 - RNA, 62 nt, hsa
acuuuauauaaaugucuugauuacaguauagaacuuuauagaguccauaauacaaaguauca

SEQ ID NO: 179655 - RNA, 62 nt, hsa
uagcuuaugaggccaaauaaucccaaagugucacuuuauauaaaugucuugauuacaguaua

SEQ ID NO: 179656 - RNA, 62 nt, hsa
augcaauuugcaugugcacaugugcgcacauaacuuuauauguuaguucuuuuuuccaaacu

SEQ ID NO: 179657 - RNA, 62 nt, hsa
agugaauuaaagugaaucauggaagcagcauuacuuuauaugaauauuauuauuuaaguuaa

SEQ ID NO: 179658 - RNA, 62 nt, hsa
gcaaaggggcugaaaaacugaauaaggaaacaacuuuauaagagaaacaguggucuucaauc

SEQ ID NO: 179659 - RNA, 62 nt, hsa
uauucaccaauuucaggaaaaccaaccauagaacuuuauaauaggacaguuauaaccugacu

SEQ ID NO: 179660 - RNA, 62 nt, hsa
aauggugagauguauguuuggcucugcuuuuaacuuuauaaauccagugaccucucucucug

SEQ ID NO: 179661 - RNA, 62 nt, hsa
acagguccugauuucuagaacccgugacuguuacuuuauacagcaaaggaaacuuugcagau

SEQ ID NO: 179662 - RNA, 62 nt, hsa
auuauugcacauuauaaaauuguuuuucuaauacuuuauagggcccaacuucagaaaauacu

SEQ ID NO: 179663 - RNA, 62 nt, hsa
aagaugugcagagggcauaaaagcaaaucaacacuuuauaguuauucuucugaacuaagaca

SEQ ID NO: 179664 - RNA, 62 nt, hsa
auuacaguugcgagccacugugcguggccagaacuuuauaauaagagacuugaagcugggug

SEQ ID NO: 179665 - RNA, 62 nt, hsa
uaaaaucacauucaauuuucagaugaaggggaacuuuauaguuuuuuuuuuuuuuuuuuuuu

SEQ ID NO: 179666 - RNA, 62 nt, hsa
auagcugugguuauguuauuuuuuauuuaaaaacuuuauauuaaagucauuuguaauguuau

SEQ ID NO: 179667 - RNA, 62 nt, hsa
uuucaauucuuggauaaucaggcucuguuugcacuuuauauuuuagcagauacagucucuua

SEQ ID NO: 179668 - RNA, 62 nt, hsa
ucaauuuuuaaaccuuugcuguuaaaugcaauacuuuauaaagaaugaacaaaauuacugga

SEQ ID NO: 179669 - RNA, 62 nt, hsa
aacuggcagucguauguuaguuucacuugucuacuuuauaugucugaucaauuuggauacca

SEQ ID NO: 179670 - RNA, 62 nt, hsa
aaaacaaaagguuugaggaaaucaggcauaugacuuuauacuuaacaucagaucuuuucuau

SEQ ID NO: 179671 - RNA, 62 nt, hsa
ucuuuaugcuguuauuacaggagaagugacauacuuuauauauguuuauauuagcaaggucu

SEQ ID NO: 179672 - RNA, 62 nt, hsa
uauauuagcaaggucuguuuuuaauaccauauacuuuauauuucuauacauuuauauuucua

SEQ ID NO: 179673 - RNA, 62 nt, hsa
uacauguucuacccagcauuuuaacggcaagaacuuuauauuuauucucaagcagggcaugu

SEQ ID NO: 179674 - RNA, 62 nt, hsa
guaaaaacuguuaaauauuuaguaucacucuuacuuuauauucuacaaaggagagagaugua

SEQ ID NO: 179675 - RNA, 62 nt, hsa
gaguaacaaaaugucauuucugaaagaggcuuacuuuauaccaacuagugucagcauuuggg

SEQ ID NO: 179676 - RNA, 62 nt, hsa
agcaguuugcaauacuaaaauauuuuuuauagacuuuauauuuuuccuuuugauaaagggau

SEQ ID NO: 179677 - RNA, 62 nt, hsa
acuauauauaauuuucccaccacuaauaccacacuuuauauucaguucugugucuuacuuau

SEQ ID NO: 179678 - RNA, 62 nt, hsa
acaauagucagaaaacauuuuagaaauugaugacuuuauaaugcaaccaggaguauugaaaa

SEQ ID NO: 179679 - RNA, 62 nt, hsa
uggagagugucaaauacauacuuugaggauugacuuuauauaaggugcccuguagaacucug

SEQ ID NO: 179680 - RNA, 62 nt, hsa
caaaaucagccuucugucuguaacaaaaauguacuuuauagagauggaggaaaaggucuaau

SEQ ID NO: 179681 - RNA, 62 nt, hsa
uaauguguauaaucagagugccucuuauacauacuuuauagaauaaaggaacauuuugacag

SEQ ID NO: 179682 - RNA, 62 nt, hsa
uuucacucuacaaugcauauucuaaugaagcuacuuuauauaaauuggagagcuuauaaaau

SEQ ID NO: 179683 - RNA, 62 nt, hsa
aacaucuugaauuuaaccauauaugccagauuacuuuauaugcaucaacaagaucaccagug

SEQ ID NO: 179684 - RNA, 62 nt, hsa
uacaucccuacuaauauaauuuuaaaaugagaacuuuauauauauuacuuaaaauuaaaugg

SEQ ID NO: 179685 - RNA, 62 nt, hsa
ugggacauuuuaucuucuggcccaaagucagaacuuuauaaaaaucuugaguuuguucacua

SEQ ID NO: 179686 - RNA, 62 nt, hsa
uuuauauuuuauauugcuaaauagagaaccacacuuuauauaaaguaguuuuugcauuuguu

SEQ ID NO: 179687 - RNA, 62 nt, hsa
auacaaaaaauuuucaucuaaaguaauauuucacuuuauauuguaaagaagguagguauauu

SEQ ID NO: 179688 - RNA, 62 nt, hsa
aaauaacuaaauuucagaaaauuaagaagcugacuuuauauuuggugguuugaaguaucuug

SEQ ID NO: 179689 - RNA, 62 nt, hsa
uuguaguuuauuuugugauuuuuuggaaucguacuuuauauuuccaaauuuaaauuuaaaug

SEQ ID NO: 179690 - RNA, 62 nt, hsa
cgaacacuaguaccauugacucucguugaauaacuuuauauuuccauaauccugaauugugu

SEQ ID NO: 179691 - RNA, 62 nt, hsa
aagagguauuuucuaauuaugcacagauaucuacuuuauacaaauacuuuauauggcuauuu

SEQ ID NO: 179692 - RNA, 62 nt, hsa
uaauuaugcacagauaucuacuuuauacaaauacuuuauauggcuauuuuugagaaaacccu

SEQ ID NO: 179693 - RNA, 65 nt, hsa
aaagaaucccucuguucacuguggugggaaagaucacacuacaugccuguugauuggcucaguca

SEQ ID NO: 179694 - RNA, 65 nt, hsa
augcugaccagcagugaaggcugcacuaguuuucuacacuacaggaauuacuguugaugauuuuu

SEQ ID NO: 179695 - RNA, 65 nt, hsa
cuaguacauaaaucccgucaugcacuuuuuuucauacacuacaaggggauguguaauaaccaugc

SEQ ID NO: 179696 - RNA, 61 nt, hsa
ccuucacuucaguagauuagucucagaauggacacuacaaaugccagcucucaccagaugg

SEQ ID NO: 179697 - RNA, 50 nt, hsa
acuugccauggccgcuguaaacacuacauguugcuuuggcaacagcuaua

SEQ ID NO: 179698 - RNA, 65 nt, hsa
uaugcaaauggucauuucagauguaugguguuuuuacacuacaaagaagucccccauguggauau

SEQ ID NO: 179699 - RNA, 65 nt, hsa
gacucccucucaaaaaaaaaaguuacauuuacacuacacuacacuguagucuaauaaaguguaaa

SEQ ID NO: 179700 - RNA, 65 nt, hsa
agcgagacucccucucaaaaaaaaaaguuacauuuacacuacacuacacuguagucuaauaaagu

SEQ ID NO: 179701 - RNA, 64 nt, hsa; identical to SEQ ID NO: 118786

SEQ ID NO: 179702 - RNA, 64 nt, hsa; identical to SEQ ID NO: 118787

SEQ ID NO: 179703 - RNA, 64 nt, hsa; identical to SEQ ID NO: 118788

SEQ ID NO: 179704 - RNA, 64 nt, hsa; identical to SEQ ID NO: 118789

SEQ ID NO: 179705 - RNA, 64 nt, hsa; identical to SEQ ID NO: 118790

SEQ ID NO: 179706 - RNA, 53 nt, hsa; identical to SEQ ID NO: 118791

SEQ ID NO: 179707 - RNA, 64 nt, hsa; identical to SEQ ID NO: 97849

SEQ ID NO: 179708 - RNA, 64 nt, hsa; identical to SEQ ID NO: 97850

SEQ ID NO: 179709 - RNA, 64 nt, hsa; identical to SEQ ID NO: 97851

SEQ ID NO: 179710 - RNA, 64 nt, hsa; identical to SEQ ID NO: 97852

SEQ ID NO: 179711 - RNA, 64 nt, hsa; identical to SEQ ID NO: 97853

SEQ ID NO: 179712 - RNA, 64 nt, hsa; identical to SEQ ID NO: 97854

SEQ ID NO: 179713 - RNA, 64 nt, hsa; identical to SEQ ID NO: 97855

SEQ ID NO: 179714 - RNA, 64 nt, hsa; identical to SEQ ID NO: 97856

SEQ ID NO: 179715 - RNA, 64 nt, hsa; identical to SEQ ID NO: 97857

SEQ ID NO: 179716 - RNA, 64 nt, hsa; identical to SEQ ID NO: 97858

SEQ ID NO: 179717 - RNA, 64 nt, hsa; identical to SEQ ID NO: 97859

SEQ ID NO: 179718 - RNA, 64 nt, hsa; identical to SEQ ID NO: 97860

SEQ ID NO: 179719 - RNA, 64 nt, hsa; identical to SEQ ID NO: 97861

SEQ ID NO: 179720 - RNA, 64 nt, hsa; identical to SEQ ID NO: 97862

SEQ ID NO: 179721 - RNA, 64 nt, hsa; identical to SEQ ID NO: 97863

SEQ ID NO: 179722 - RNA, 64 nt, hsa; identical to SEQ ID NO: 97864

SEQ ID NO: 179723 - RNA, 64 nt, hsa; identical to SEQ ID NO: 97865

SEQ ID NO: 179724 - RNA, 64 nt, hsa; identical to SEQ ID NO: 97866

SEQ ID NO: 179725 - RNA, 64 nt, hsa; identical to SEQ ID NO: 97867

SEQ ID NO: 179726 - RNA, 64 nt, hsa; identical to SEQ ID NO: 97868

SEQ ID NO: 179727 - RNA, 64 nt, hsa; identical to SEQ ID NO: 97869

SEQ ID NO: 179728 - RNA, 64 nt, hsa; identical to SEQ ID NO: 97870

SEQ ID NO: 179729 - RNA, 64 nt, hsa; identical to SEQ ID NO: 97871

SEQ ID NO: 179730 - RNA, 64 nt, hsa; identical to SEQ ID NO: 97872

SEQ ID NO: 179731 - RNA, 64 nt, hsa; identical to SEQ ID NO: 97873

SEQ ID NO: 179732 - RNA, 64 nt, hsa; identical to SEQ ID NO: 97874

SEQ ID NO: 179733 - RNA, 64 nt, hsa; identical to SEQ ID NO: 97875

SEQ ID NO: 179734 - RNA, 64 nt, hsa; identical to SEQ ID NO: 97876

SEQ ID NO: 179735 - RNA, 64 nt, hsa; identical to SEQ ID NO: 97877

SEQ ID NO: 179736 - RNA, 64 nt, hsa; identical to SEQ ID NO: 97878

SEQ ID NO: 179737 - RNA, 64 nt, hsa; identical to SEQ ID NO: 97879

SEQ ID NO: 179738 - RNA, 64 nt, hsa; identical to SEQ ID NO: 97880

SEQ ID NO: 179739 - RNA, 64 nt, hsa; identical to SEQ ID NO: 97881

SEQ ID NO: 179740 - RNA, 64 nt, hsa; identical to SEQ ID NO: 97882

SEQ ID NO: 179741 - RNA, 64 nt, hsa; identical to SEQ ID NO: 97883

SEQ ID NO: 179742 - RNA, 64 nt, hsa; identical to SEQ ID NO: 97884

SEQ ID NO: 179743 - RNA, 64 nt, hsa; identical to SEQ ID NO: 97885

SEQ ID NO: 179744 - RNA, 64 nt, hsa; identical to SEQ ID NO: 97886

SEQ ID NO: 179745 - RNA, 64 nt, hsa; identical to SEQ ID NO: 97887

SEQ ID NO: 179746 - RNA, 64 nt, hsa; identical to SEQ ID NO: 97888

SEQ ID NO: 179747 - RNA, 64 nt, hsa; identical to SEQ ID NO: 97889

SEQ ID NO: 179748 - RNA, 64 nt, hsa; identical to SEQ ID NO: 97890

SEQ ID NO: 179749 - RNA, 64 nt, hsa; identical to SEQ ID NO: 97891

SEQ ID NO: 179750 - RNA, 64 nt, hsa; identical to SEQ ID NO: 97892

SEQ ID NO: 179751 - RNA, 64 nt, hsa; identical to SEQ ID NO: 97893

SEQ ID NO: 179752 - RNA, 64 nt, hsa; identical to SEQ ID NO: 97894

SEQ ID NO: 179753 - RNA, 64 nt, hsa; identical to SEQ ID NO: 97895

SEQ ID NO: 179754 - RNA, 64 nt, hsa; identical to SEQ ID NO: 97896

SEQ ID NO: 179755 - RNA, 64 nt, hsa; identical to SEQ ID NO: 97897

SEQ ID NO: 179756 - RNA, 64 nt, hsa; identical to SEQ ID NO: 97898

SEQ ID NO: 179757 - RNA, 64 nt, hsa; identical to SEQ ID NO: 97899

SEQ ID NO: 179758 - RNA, 64 nt, hsa; identical to SEQ ID NO: 97900

SEQ ID NO: 179759 - RNA, 64 nt, hsa; identical to SEQ ID NO: 97901

SEQ ID NO: 179760 - RNA, 64 nt, hsa; identical to SEQ ID NO: 97902

SEQ ID NO: 179761 - RNA, 64 nt, hsa; identical to SEQ ID NO: 97903

SEQ ID NO: 179762 - RNA, 64 nt, hsa; identical to SEQ ID NO: 97904

SEQ ID NO: 179763 - RNA, 64 nt, hsa; identical to SEQ ID NO: 97905

SEQ ID NO: 179764 - RNA, 64 nt, hsa; identical to SEQ ID NO: 97906

SEQ ID NO: 179765 - RNA, 64 nt, hsa; identical to SEQ ID NO: 97907

SEQ ID NO: 179766 - RNA, 64 nt, hsa; identical to SEQ ID NO: 97908

SEQ ID NO: 179767 - RNA, 64 nt, hsa; identical to SEQ ID NO: 97909

SEQ ID NO: 179768 - RNA, 64 nt, hsa; identical to SEQ ID NO: 97910

SEQ ID NO: 179769 - RNA, 64 nt, hsa; identical to SEQ ID NO: 97911

SEQ ID NO: 179770 - RNA, 64 nt, hsa; identical to SEQ ID NO: 97912

SEQ ID NO: 179771 - RNA, 64 nt, hsa; identical to SEQ ID NO: 97913

SEQ ID NO: 179772 - RNA, 64 nt, hsa; identical to SEQ ID NO: 97914

SEQ ID NO: 179773 - RNA, 64 nt, hsa; identical to SEQ ID NO: 97915

SEQ ID NO: 179774 - RNA, 64 nt, hsa; identical to SEQ ID NO: 97916

SEQ ID NO: 179775 - RNA, 64 nt, hsa; identical to SEQ ID NO: 97917

SEQ ID NO: 179776 - RNA, 64 nt, hsa; identical to SEQ ID NO: 97918

SEQ ID NO: 179777 - RNA, 64 nt, hsa; identical to SEQ ID NO: 97919

SEQ ID NO: 179778 - RNA, 64 nt, hsa; identical to SEQ ID NO: 97920

SEQ ID NO: 179779 - RNA, 64 nt, hsa; identical to SEQ ID NO: 97921

SEQ ID NO: 179780 - RNA, 64 nt, hsa; identical to SEQ ID NO: 97922

SEQ ID NO: 179781 - RNA, 64 nt, hsa; identical to SEQ ID NO: 97923

SEQ ID NO: 179782 - RNA, 64 nt, hsa; identical to SEQ ID NO: 97924

SEQ ID NO: 179783 - RNA, 64 nt, hsa; identical to SEQ ID NO: 97925

SEQ ID NO: 179784 - RNA, 64 nt, hsa; identical to SEQ ID NO: 97926

SEQ ID NO: 179785 - RNA, 64 nt, hsa; identical to SEQ ID NO: 97927

SEQ ID NO: 179786 - RNA, 64 nt, hsa; identical to SEQ ID NO: 97928

SEQ ID NO: 179787 - RNA, 64 nt, hsa; identical to SEQ ID NO: 97929

SEQ ID NO: 179788 - RNA, 64 nt, hsa; identical to SEQ ID NO: 97930

SEQ ID NO: 179789 - RNA, 64 nt, hsa; identical to SEQ ID NO: 97931

SEQ ID NO: 179790 - RNA, 64 nt, hsa; identical to SEQ ID NO: 97932

SEQ ID NO: 179791 - RNA, 64 nt, hsa; identical to SEQ ID NO: 97933

SEQ ID NO: 179792 - RNA, 64 nt, hsa; identical to SEQ ID NO: 97934

SEQ ID NO: 179793 - RNA, 64 nt, hsa; identical to SEQ ID NO: 97935

SEQ ID NO: 179794 - RNA, 64 nt, hsa; identical to SEQ ID NO: 97936

SEQ ID NO: 179795 - RNA, 64 nt, hsa; identical to SEQ ID NO: 97937

SEQ ID NO: 179796 - RNA, 64 nt, hsa; identical to SEQ ID NO: 97938

SEQ ID NO: 179797 - RNA, 64 nt, hsa; identical to SEQ ID NO: 97939

SEQ ID NO: 179798 - RNA, 64 nt, hsa; identical to SEQ ID NO: 97940

SEQ ID NO: 179799 - RNA, 64 nt, hsa; identical to SEQ ID NO: 97941

SEQ ID NO: 179800 - RNA, 64 nt, hsa; identical to SEQ ID NO: 97942

SEQ ID NO: 179801 - RNA, 64 nt, hsa; identical to SEQ ID NO: 97943

SEQ ID NO: 179802 - RNA, 64 nt, hsa; identical to SEQ ID NO: 97944

SEQ ID NO: 179803 - RNA, 64 nt, hsa; identical to SEQ ID NO: 97945

SEQ ID NO: 179804 - RNA, 64 nt, hsa; identical to SEQ ID NO: 97946

SEQ ID NO: 179805 - RNA, 64 nt, hsa; identical to SEQ ID NO: 97947

SEQ ID NO: 179806 - RNA, 64 nt, hsa; identical to SEQ ID NO: 97948

SEQ ID NO: 179807 - RNA, 64 nt, hsa; identical to SEQ ID NO: 97949

SEQ ID NO: 179808 - RNA, 64 nt, hsa; identical to SEQ ID NO: 97950

SEQ ID NO: 179809 - RNA, 64 nt, hsa; identical to SEQ ID NO: 97951

SEQ ID NO: 179810 - RNA, 64 nt, hsa; identical to SEQ ID NO: 97952

SEQ ID NO: 179811 - RNA, 64 nt, hsa; identical to SEQ ID NO: 97953

SEQ ID NO: 179812 - RNA, 64 nt, hsa; identical to SEQ ID NO: 97954

SEQ ID NO: 179813 - RNA, 64 nt, hsa; identical to SEQ ID NO: 97955

SEQ ID NO: 179814 - RNA, 64 nt, hsa; identical to SEQ ID NO: 97956

SEQ ID NO: 179815 - RNA, 64 nt, hsa
uccacagcccuagcugccagcaaugcuguccucacagaggcauagucgcccccagcuggguugu

SEQ ID NO: 179816 - RNA, 64 nt, hsa
gcaggaucaugccuucugugucuggaagaggcggcagaggcaacaguguuuaggauuuggguua

SEQ ID NO: 179817 - RNA, 64 nt, hsa
ugcgugagugugguggugugaccuucaggcugcacagaggcaaggacccagauguggcagcaug

SEQ ID NO: 179818 - RNA, 64 nt, hsa
gccauccgugcggccuuggccacaucccuauuaacagaggcagcuccacuucagacagggacaa

SEQ ID NO: 179819 - RNA, 64 nt, hsa
ucugucauuuucccuuccuaccccaacccugagccagaggcaucugacagcccuuucccagagg

SEQ ID NO: 179820 - RNA, 64 nt, hsa
gggcagagcugggcggcauccacagccagagaggcagaggcaagagcagagccaggcugugccc

SEQ ID NO: 179821 - RNA, 64 nt, hsa
ccacuuaaaggagaaaaauauuugggacuagcagcagaggcaguaagagaugugaaccuuggug

SEQ ID NO: 179822 - RNA, 64 nt, hsa
caacgagaugagaagacugugauccucauguacucagaggcacuucccuccuaagucaaagacc

SEQ ID NO: 179823 - RNA, 64 nt, hsa
cuuucccauucacuucucuagaaagcugccaagacagaggcagaaagaaauggaugauaguucu

SEQ ID NO: 179824 - RNA, 64 nt, hsa
gaauuuugaaguaacgaaugcaaauuccacucagcagaggcaauguuauuuauguacauaggga

SEQ ID NO: 179825 - RNA, 64 nt, hsa
cugcuaauaaaugucauccaagaggaacuaaaaccagaggcauuauuacugcauuguuugucac

SEQ ID NO: 179826 - RNA, 64 nt, hsa
cuacaaaccauuagaaaauaacucaaaaagauggcagaggcaaauccacagaaggggggcugcc

SEQ ID NO: 179827 - RNA, 64 nt, hsa
cacccaggagccccccaggcugccugccugcgugcagaggcaggagaggaccguggagcguuuc

SEQ ID NO: 179828 - RNA, 64 nt, hsa
ugcuggcuuucaagcgugguuuuuugcuaagagccagaggcaggucuucuggaguucucagggg

SEQ ID NO: 179829 - RNA, 64 nt, hsa
cgcacaggugggugauguccuuggcugcugccgucagaggcagcccccugcacagggaggggcu

SEQ ID NO: 179830 - RNA, 64 nt, hsa
gagcacccacccugguucuccaggccccucuguccagaggcagggccugaaccucgggcuccug

SEQ ID NO: 179831 - RNA, 64 nt, hsa
auugcucaggguggggggcugggaccauggcccgcagaggcacugccacagcugugagggccaa

SEQ ID NO: 179832 - RNA, 64 nt, hsa
aaccuuugcggguggggcguuacugccaaaacuccagaggcaaaguggaccuggcaaccacaag

SEQ ID NO: 179833 - RNA, 64 nt, hsa
cccuggaacauugggccugaguggagaugggagacagaggcaggccagaagguucucucugcac

SEQ ID NO: 179834 - RNA, 64 nt, hsa
ggccuguggcagcgccgcuggacccuaggaggcucagaggcaguggugugggagcccugucugc

SEQ ID NO: 179835 - RNA, 64 nt, hsa
guugaagaggcugacuuggcccacugcuaagcggcagaggcagggccagccauccugucgcaag

SEQ ID NO: 179836 - RNA, 64 nt, hsa
gcccccccugucgucugcucuucacccagcaccacagaggcaccugcugcacacacaagcaucu

SEQ ID NO: 179837 - RNA, 64 nt, hsa
uggggguuggaaggaugggggcucauuuaacccucagaggcagcgccuuugucugucuaucugg

SEQ ID NO: 179838 - RNA, 53 nt, hsa; identical to SEQ ID NO: 86549

SEQ ID NO: 179839 - RNA, 64 nt, hsa
ucucugcuggccuacagcuugucuguuucucaagcagaggcaggaagagcuagucuuagcauuu

SEQ ID NO: 179840 - RNA, 64 nt, hsa
ccaaagggggagucccucgucucuugugacucagcagaggcaguggccacguucagggaggggc

SEQ ID NO: 179841 - RNA, 64 nt, hsa
augccccccagcuacuguaugcccccgacccccgcagaggcagaaugaacccauagggagcuga

SEQ ID NO: 179842 - RNA, 64 nt, hsa
ggagggcagaggaaguacuuagggagguuggugucagaggcaggagugggggaucagggaaggu

SEQ ID NO: 179843 - RNA, 64 nt, hsa
acugaggggaacccugggacaggcacaggcugggcagaggcacagggcagugcaggggacucug

SEQ ID NO: 179844 - RNA, 64 nt, hsa
gcugaggccauggcaggacagcugcuguggggugcagaggcagaagaugaaggacaaaaggaag

SEQ ID NO: 179845 - RNA, 64 nt, hsa
cucaggaccagagaagggaaaugacuucuccaggcagaggcagaucugagucuagaacccaggc

SEQ ID NO: 179846 - RNA, 64 nt, hsa
gucagagaacagagaucacacacaccaaaccagacagaggcagggcagcauggagacagguaga

SEQ ID NO: 179847 - RNA, 64 nt, hsa
uggcuccggggggaguggggcccugcgcuagaggcagaggcaguucuuuguucaagcguuccuc

SEQ ID NO: 179848 - RNA, 64 nt, hsa
uucuuuguucaagcguuccucuggggaccggcagcagaggcaccguguucucucagcccuggau

SEQ ID NO: 179849 - RNA, 64 nt, hsa
uaagacaaaaaaaaaaaaaaaaaacaaacagaggcagaggcaggcaguagcaagaaagcagagc

SEQ ID NO: 179850 - RNA, 64 nt, hsa
aaaauguaagacaaaaaaaaaaaaaaaaaacaaacagaggcagaggcaggcaguagcaagaaag

SEQ ID NO: 179851 - RNA, 64 nt, hsa
guccacagcggcgacccaggccuccaagcuugcacagaggcaaggccagacuuuuccgucguuu

SEQ ID NO: 179852 - RNA, 64 nt, hsa
gcacagcggagccaugggggcugggaguccccaucagaggcagugaggugggccccggcccugg

SEQ ID NO: 179853 - RNA, 64 nt, hsa
ccuggcuccgcuguguggauggggagaucggggccagaggcagaacccuggugaggaagcucca

SEQ ID NO: 179854 - RNA, 64 nt, hsa
acucgcuucucugugacugauguuaggcugggcccagaggcacagccggggccugccuagcacu

SEQ ID NO: 179855 - RNA, 64 nt, hsa
gaugugucaaaggcuuuuggagugaccaaaagcacagaggcagcggguggggcgccuggguggu

SEQ ID NO: 179856 - RNA, 64 nt, hsa
ugguccccaaggucgcugccacccuugcccggggcagaggcagaagcccacauaugcugugacg

SEQ ID NO: 179857 - RNA, 64 nt, hsa
uggcucacaccugucauccuagcacuuugggaggcagaggcaggaggaucgcuugagcucagga

SEQ ID NO: 179858 - RNA, 64 nt, hsa
aucaggcaaggucuggagacauuuuugguuggggcagaggcaugcuccuggcaucgagugggug

SEQ ID NO: 179859 - RNA, 64 nt, hsa
auggcacugagaugcauccacucagcaggagugacagaggcagaaguuccuuuaaagcacaucu

SEQ ID NO: 179860 - RNA, 64 nt, hsa
aacccuuaaaguacaguguuauuuaagaaucuuccagaggcagucaacagacuuauacacuaag

SEQ ID NO: 179861 - RNA, 64 nt, hsa
gccugcagggguggagggcagucccucagaaucccagaggcagucccagccucagaacccagga

SEQ ID NO: 179862 - RNA, 64 nt, hsa
ggaaagacucuuaauuaagaggcucaggcaagcacagaggcagcccgugggucucugucucagu

SEQ ID NO: 179863 - RNA, 64 nt, hsa
gcugcuucuaagaggcuaaccuggaaacuaagcucagaggcaagguaauaaagcacuucagggc

SEQ ID NO: 179864 - RNA, 64 nt, hsa
agagaaggaucugcuccgccuuuggccacaggagcagaggcagaccugggaugccccaguuucu

SEQ ID NO: 179865 - RNA, 64 nt, hsa
aggucugggggacagacaaggaugauggaccccucagaggcaagacuaggaucagggacagauc

SEQ ID NO: 179866 - RNA, 64 nt, hsa
gcagcuaugcaaaucccuaccuacccagcugggccagaggcacgaggcagccaggcaggguggg

SEQ ID NO: 179867 - RNA, 64 nt, hsa
agacacagacacagagcaggaggacacguggagacagaggcagacuggagugaugcggccacaa

SEQ ID NO: 179868 - RNA, 64 nt, hsa
agacacagacacaaagcaggaggccacauaaagacagaggcagagacugaagugaugcugcccc

SEQ ID NO: 179869 - RNA, 64 nt, hsa
aagggucuccaggcuuuauuccucccaggcacugcagaggcaccggugaggaagggucuccagg

SEQ ID NO: 179870 - RNA, 64 nt, hsa; identical to SEQ ID NO: 155489

SEQ ID NO: 179871 - RNA, 64 nt, hsa; identical to SEQ ID NO: 155490

SEQ ID NO: 179872 - RNA, 64 nt, hsa; identical to SEQ ID NO: 155491

SEQ ID NO: 179873 - RNA, 64 nt, hsa; identical to SEQ ID NO: 155492

SEQ ID NO: 179874 - RNA, 64 nt, hsa; identical to SEQ ID NO: 155493

SEQ ID NO: 179875 - RNA, 64 nt, hsa; identical to SEQ ID NO: 155494

SEQ ID NO: 179876 - RNA, 64 nt, hsa; identical to SEQ ID NO: 155495

SEQ ID NO: 179877 - RNA, 64 nt, hsa; identical to SEQ ID NO: 155496

SEQ ID NO: 179878 - RNA, 64 nt, hsa; identical to SEQ ID NO: 155497

SEQ ID NO: 179879 - RNA, 64 nt, hsa; identical to SEQ ID NO: 155498

SEQ ID NO: 179880 - RNA, 64 nt, hsa; identical to SEQ ID NO: 155499

SEQ ID NO: 179881 - RNA, 64 nt, hsa; identical to SEQ ID NO: 155500

SEQ ID NO: 179882 - RNA, 64 nt, hsa; identical to SEQ ID NO: 155501

SEQ ID NO: 179883 - RNA, 64 nt, hsa; identical to SEQ ID NO: 155502

SEQ ID NO: 179884 - RNA, 64 nt, hsa; identical to SEQ ID NO: 155503

SEQ ID NO: 179885 - RNA, 64 nt, hsa; identical to SEQ ID NO: 155504

SEQ ID NO: 179886 - RNA, 64 nt, hsa; identical to SEQ ID NO: 155505

SEQ ID NO: 179887 - RNA, 64 nt, hsa; identical to SEQ ID NO: 155506

SEQ ID NO: 179888 - RNA, 64 nt, hsa; identical to SEQ ID NO: 155507

SEQ ID NO: 179889 - RNA, 64 nt, hsa; identical to SEQ ID NO: 155508

SEQ ID NO: 179890 - RNA, 64 nt, hsa; identical to SEQ ID NO: 155509

SEQ ID NO: 179891 - RNA, 64 nt, hsa; identical to SEQ ID NO: 155510

SEQ ID NO: 179892 - RNA, 64 nt, hsa; identical to SEQ ID NO: 155511

SEQ ID NO: 179893 - RNA, 64 nt, hsa; identical to SEQ ID NO: 155512

SEQ ID NO: 179894 - RNA, 64 nt, hsa; identical to SEQ ID NO: 155513

SEQ ID NO: 179895 - RNA, 61 nt, hsa; identical to SEQ ID NO: 155514

SEQ ID NO: 179896 - RNA, 64 nt, hsa; identical to SEQ ID NO: 155515

SEQ ID NO: 179897 - RNA, 64 nt, hsa; identical to SEQ ID NO: 155516

SEQ ID NO: 179898 - RNA, 64 nt, hsa; identical to SEQ ID NO: 155517

SEQ ID NO: 179899 - RNA, 64 nt, hsa; identical to SEQ ID NO: 155518

SEQ ID NO: 179900 - RNA, 64 nt, hsa; identical to SEQ ID NO: 155519

SEQ ID NO: 179901 - RNA, 64 nt, hsa; identical to SEQ ID NO: 155520

SEQ ID NO: 179902 - RNA, 64 nt, hsa; identical to SEQ ID NO: 155521

SEQ ID NO: 179903 - RNA, 64 nt, hsa; identical to SEQ ID NO: 73323

SEQ ID NO: 179904 - RNA, 64 nt, hsa; identical to SEQ ID NO: 73324

SEQ ID NO: 179905 - RNA, 64 nt, hsa; identical to SEQ ID NO: 73325

SEQ ID NO: 179906 - RNA, 64 nt, hsa; identical to SEQ ID NO: 73326

SEQ ID NO: 179907 - RNA, 64 nt, hsa; identical to SEQ ID NO: 73327

SEQ ID NO: 179908 - RNA, 64 nt, hsa; identical to SEQ ID NO: 73328

SEQ ID NO: 179909 - RNA, 64 nt, hsa; identical to SEQ ID NO: 73329

SEQ ID NO: 179910 - RNA, 64 nt, hsa; identical to SEQ ID NO: 73330

SEQ ID NO: 179911 - RNA, 64 nt, hsa; identical to SEQ ID NO: 73331

SEQ ID NO: 179912 - RNA, 64 nt, hsa; identical to SEQ ID NO: 73332

SEQ ID NO: 179913 - RNA, 64 nt, hsa; identical to SEQ ID NO: 73333

SEQ ID NO: 179914 - RNA, 64 nt, hsa; identical to SEQ ID NO: 73334

SEQ ID NO: 179915 - RNA, 64 nt, hsa; identical to SEQ ID NO: 73335

SEQ ID NO: 179916 - RNA, 64 nt, hsa; identical to SEQ ID NO: 73336

SEQ ID NO: 179917 - RNA, 64 nt, hsa; identical to SEQ ID NO: 73337

SEQ ID NO: 179918 - RNA, 64 nt, hsa; identical to SEQ ID NO: 73338

SEQ ID NO: 179919 - RNA, 64 nt, hsa; identical to SEQ ID NO: 73339

SEQ ID NO: 179920 - RNA, 64 nt, hsa; identical to SEQ ID NO: 73340

SEQ ID NO: 179921 - RNA, 64 nt, hsa; identical to SEQ ID NO: 73341

SEQ ID NO: 179922 - RNA, 64 nt, hsa; identical to SEQ ID NO: 73342

SEQ ID NO: 179923 - RNA, 64 nt, hsa; identical to SEQ ID NO: 73343

SEQ ID NO: 179924 - RNA, 64 nt, hsa; identical to SEQ ID NO: 73344

SEQ ID NO: 179925 - RNA, 64 nt, hsa
aauauagccgcugccauaguuuucuaacuugaacagccaugaauguuucaugucucccuuuuuu

SEQ ID NO: 179926 - RNA, 64 nt, hsa
ggauugcuugagccugggaagcugaggcugcaguagccaugacugcaccacugcauuccagccu

SEQ ID NO: 179927 - RNA, 64 nt, hsa
ccuccuacacuauugaccaggcccagaaggaaccagccaugagguucggcacccaggucuccgg

SEQ ID NO: 179928 - RNA, 64 nt, hsa
cugguccccaggccccuccaguucaucggaauucagccaugaaacugacucaucagugagcagg

SEQ ID NO: 179929 - RNA, 64 nt, hsa
gaccuucguuaagugauaauuguccuggccucucagccaugaccguuaugaggaaauauccccc

SEQ ID NO: 179930 - RNA, 64 nt, hsa
ugaggugggagccugggaggucaaggcugcagugagccaugaucaugccacugcacuccauccu

SEQ ID NO: 179931 - RNA, 64 nt, hsa
cuucacccucccugccuaagcagggugggggcagagccaugacauuuuugguuuaaaggagccu

SEQ ID NO: 179932 - RNA, 64 nt, hsa
ggucauauaguugggccauggggcaauuguuggcagccaugacugacggccccuugugcaagcu

SEQ ID NO: 179933 - RNA, 64 nt, hsa
ccuuuguuauguuguuaugacugcuuagaaauguagccaugauguuguucuaaagaugucuuaa

SEQ ID NO: 179934 - RNA, 64 nt, hsa
gucagugacagagaacacagagagggacaaacacagccaugaacccccuggcacuaguaccagc

SEQ ID NO: 179935 - RNA, 64 nt, hsa
cuuugagacuauucaucaagaaugaggauauaguagccaugacauagcuugagcuauagccuuu

SEQ ID NO: 179936 - RNA, 64 nt, hsa
uugaagagguucugauuuucuuguaaccugggaaagccaugaccuugugcccgauucuuucaga

SEQ ID NO: 179937 - RNA, 64 nt, hsa
gcagagcaauugaguauucuuuuuuaaauuauuaagccaugauuuacaaaaacauuacuuucug

SEQ ID NO: 179938 - RNA, 64 nt, hsa
gucaggaucauagaaaagaagacaaagcuugcucagccaugagauggccagguauccaguuuug

SEQ ID NO: 179939 - RNA, 64 nt, hsa
cagccguauuggccucccaaggugcugggauuacagccaugagccaccaugaccaacguguuuc

SEQ ID NO: 179940 - RNA, 64 nt, hsa
gauggcuugagccuaggaguucgaggcugcagggagccaugaucaugccauuguacuccagcau

SEQ ID NO: 179941 - RNA, 64 nt, hsa
uauuuuuuuccaguagcaacgauggguuacauggagccaugaaaccuccuucuggccucccuug

SEQ ID NO: 179942 - RNA, 64 nt, hsa
auaacacauuggcagacuuuuugcuggcucugggagccaugauuuuaaucacauucugcaaggu

SEQ ID NO: 179943 - RNA, 64 nt, hsa
gggugcuauaugcagacuuccaugguuuguguguagccaugaacacagcuugcuugcauuuagu

SEQ ID NO: 179944 - RNA, 64 nt, hsa
uguauuuauauuguauaucauacuuucaacuguagacaauuaugaugcuaauuuauuguuucuu

SEQ ID NO: 179945 - RNA, 64 nt, hsa
aacgguucuaucaugcauguguaauguggauggagacaauuauaagauuugacuauaacuauuu

SEQ ID NO: 179946 - RNA, 64 nt, hsa
uuugggacugauucucaguggagggcuuagaucauacaaaaaucuuuauuggguccguguguuc

SEQ ID NO: 179947 - RNA, 64 nt, hsa
gcuuuuaaacuggugucuuuggaaggaagguagauacaaaaagauugugguaaaaacugggguc

SEQ ID NO: 179948 - RNA, 64 nt, hsa
uuauuuguuuuugagauggagucucuacuaaaaauacaaaaaauuagccaggcauggugccgca

SEQ ID NO: 179949 - RNA, 64 nt, hsa
ggccaauauggugaaaccccaucucuacuaagaauacaaaaaauuagcugagcauggugguggg

SEQ ID NO: 179950 - RNA, 64 nt, hsa
gaccagccgggccaacauggugaaaccccaucucuacaaaaaauacaaaaauuagccuggcaua

SEQ ID NO: 179951 - RNA, 64 nt, hsa
ggccaacauggugaaaccccaucucuacaaaaaauacaaaaauuagccuggcauauggcgggua

SEQ ID NO: 179952 - RNA, 64 nt, hsa
ugagaugcgccugggcaacauagaaaccugugucuacaaaaaauuuaaaaauuagccaaguaug

SEQ ID NO: 179953 - RNA, 64 nt, hsa
ggcuaacacggugaaacuccaucucuacuaaaaauacaaaaaauuggccgggcgcagcggcuca

SEQ ID NO: 179954 - RNA, 64 nt, hsa
ggccaacauggugacaccccgucucuacuaaaaauacaaaaauuacccaggcauaguggcacac

SEQ ID NO: 179955 - RNA, 64 nt, hsa
ucugucucaaaaaaacaaaacaaacaaacaaaaauacaaaaaauuagccgggcgugguggcacc

SEQ ID NO: 179956 - RNA, 64 nt, hsa
gggcaacauggugaaacccccgucucuacuaaaauacaaaaaaauuagccaggcauaguggcgc

SEQ ID NO: 179957 - RNA, 64 nt, hsa
ggccaacauagugaaaccccuuguuuacucaaaauacaaaaauuggcugggugcggugguacau

SEQ ID NO: 179958 - RNA, 64 nt, hsa
cagccuggccaacaugacccaucuuuacuaaaaauacaaaaauuagccaggcgugguggugugc

SEQ ID NO: 179959 - RNA, 64 nt, hsa
aauuuguaaacccugucucucauauuuguaaaacuacaaaaauuagcuuggcaugguggugugc

SEQ ID NO: 179960 - RNA, 64 nt, hsa
ccacacccggcuaauuuuuuguguuuuuacaaaauacaaaaaaguagagacaggauuucacugu

SEQ ID NO: 179961 - RNA, 64 nt, hsa
uggugauaaguuccaaauauguuaagggcuuuaauacaaaaagcaaaaauugucaguguuugga

SEQ ID NO: 179962 - RNA, 64 nt, hsa
uggcuaacacagugaaacguguuuuuacuaaaaguacaaaaaacuagcugggcgugguggcagg

SEQ ID NO: 179963 - RNA, 64 nt, hsa
ggcuaacauggugaaacccugucucuacuaaaaauacaaaaaaaauuagccagccaugguggcg

SEQ ID NO: 179964 - RNA, 64 nt, hsa
gaacacggugaaaccccgucucuacuaaaaaaaauacaaaaaaauuagccaggcguggucgugg

SEQ ID NO: 179965 - RNA, 64 nt, hsa
gaccaacauggcgaaaccccaucucuacuaaaaauacaaaaauuagccuggcauggugguggga

SEQ ID NO: 179966 - RNA, 64 nt, hsa
uuuguucuuuuacagaauucuguagcaaagccaauacaaaaaucagcuaaagcugccacagaag

SEQ ID NO: 179967 - RNA, 64 nt, hsa
gggcaauguggcaaaaccgcguguuuacaaaaaauacaaaaauuagccaggcaugguggugcau

SEQ ID NO: 179968 - RNA, 64 nt, hsa
gacuagccugggcaauguggcaaaaccgcguguuuacaaaaaauacaaaaauuagccaggcaug

SEQ ID NO: 179969 - RNA, 64 nt, hsa
gggcaacguggcgaaacccugucucuacaaaaaauacaaaaauuagccgggcgugguccuagcu

SEQ ID NO: 179970 - RNA, 64 nt, hsa
uacuagccugggcaacguggcgaaacccugucucuacaaaaaauacaaaaauuagccgggcgug

SEQ ID NO: 179971 - RNA, 64 nt, hsa
gggcaacauggcaaaaacccaccucuacaaaaaguacaaaaauuagucgggcgugauggcaggc

SEQ ID NO: 179972 - RNA, 64 nt, hsa
gaccagccugggcaacauggcaaaaacccaccucuacaaaaaguacaaaaauuagucgggcgug

SEQ ID NO: 179973 - RNA, 64 nt, hsa
ggcuaacauggugaaacccuguaucugcuaaaaauacaaaaauuagccaggcgugguggcgggc

SEQ ID NO: 179974 - RNA, 64 nt, hsa
ugaccaacaugguaaaaccccaucucuacuaaaauacaaaaauuggcugggcgugguggcacuc

SEQ ID NO: 179975 - RNA, 64 nt, hsa
auggugaaaccccaucucuacaguuuuguaaaaauacaaaaaauuaccugggccugguggcaca

SEQ ID NO: 179976 - RNA, 64 nt, hsa
uuuaauuuuacuuaauuaagaaauggaauuuauauacaaaaauauuuuccauuuccguuauuau

SEQ ID NO: 179977 - RNA, 64 nt, hsa
ggccaacauggugaaaccuggccucuacuaaaaauacaaaaauuagccgggugugguggugggu

SEQ ID NO: 179978 - RNA, 64 nt, hsa
cuuuacugugucuguagcuaaagaaaaauuauuuuacaaaaauuacuucaugaaauauaguuug

SEQ ID NO: 179979 - RNA, 64 nt, hsa
uuaacaacuuuuuaaggaaauauuuuuguucuuauacaaaaacauguaaauauugcuuuauuac

SEQ ID NO: 179980 - RNA, 64 nt, hsa
uaaguaaauuaguaauguacuauagauauaacuguacaaaaauuguucaaccuaaaacaaucug

SEQ ID NO: 179981 - RNA, 64 nt, hsa
ggcuaacauggugaaaccccaucucuacuaaaaauacaaaaaauuagccgagcacgguggugca

SEQ ID NO: 179982 - RNA, 64 nt, hsa
uucaguaacacaucucaugaucugaagauuguguuacaaaaaauauuaucaggccaaaauuugu

SEQ ID NO: 179983 - RNA, 64 nt, hsa
gaugaggcaaugaugccaccacaguauucuaauuuacaaaaagaauuggaguucaauuaguggu

SEQ ID NO: 179984 - RNA, 64 nt, hsa
aauagcggauagagcuacagguguucaguaagacuacaaaaacauuuugccuauuucgcuaaca

SEQ ID NO: 179985 - RNA, 64 nt, hsa
uguuauuuuacaucccuauggcuauugccaaggcuacaaaaaaggaaagcuauauuuguaugca

SEQ ID NO: 179986 - RNA, 64 nt, hsa
gaccagccugggcaacauggugaaaccccaucucuacaaaaaauuuuuaaaaaguuggccaggc

SEQ ID NO: 179987 - RNA, 64 nt, hsa
ggccaacauggugaaacccugucuuuacuaaaaauacaaaaauuagccaggcaugguggcgugu

SEQ ID NO: 179988 - RNA, 64 nt, hsa
uaauaggguaguucuggagagaugguaugcagcauacaaaaauauauuaaaaauauaaacaaug

SEQ ID NO: 179989 - RNA, 64 nt, hsa
aaauaugcuaaauguuagcaagaugauuuuuaaguacaaaaaaguuuaagauugcaaggaagga

SEQ ID NO: 179990 - RNA, 64 nt, hsa
gaguucuagacuagccugggcgagacuucaucucuacaaaaaaagcaacaacgacaaaaaaaau

SEQ ID NO: 179991 - RNA, 64 nt, hsa
guccaaucugggcaacauggggaaaccccagcucuacaaaaaaaauuagccuggugugguggca

SEQ ID NO: 179992 - RNA, 64 nt, hsa
acacuagaaagcaaugacuaacauuuaauuuguuuacaaaaauguuuauugucuucaguacaaa

SEQ ID NO: 179993 - RNA, 64 nt, hsa
uuaauuuguuuacaaaaauguuuauugucuucaguacaaaaaguuaaaaccaugauuggauuca

SEQ ID NO: 179994 - RNA, 64 nt, hsa
gaaaacacaaaaguaacuuguuuaucucagucuguacaaaaacaguaaggaggcagaaagccaa

SEQ ID NO: 179995 - RNA, 64 nt, hsa
uaucaguguuggauuuaguuccaacuacuugauuuacaaaaauguacauuuagagguuaaaaga

SEQ ID NO: 179996 - RNA, 64 nt, hsa
ggccaacauggugaaacccuguugcuacuaaaaauacaaaaauuggcuggguguggugucacau

SEQ ID NO: 179997 - RNA, 64 nt, hsa
aauuaaagagacaaccaagggaacacauugagacuacaaaaauaugaauaaucucaauuauauu

SEQ ID NO: 179998 - RNA, 64 nt, hsa
auguaaauggaaauacaaaggauucuuacuaacauacaaaaauaaugcacaacagaaauaucua

SEQ ID NO: 179999 - RNA, 64 nt, hsa
ggccaacauggugaaacccugucucuacuaaaaauacaaaaauuagccagguguggagguacau

SEQ ID NO: 180000 - RNA, 64 nt, hsa
ggcuaacauggugaaaccccgucucuacuaaaaauacaaaaaauuagccaggcgugguggcacg

SEQ ID NO: 180001 - RNA, 64 nt, hsa
cgccaacaaggugaaaccccaccucuauuaaaaauacaaaaauuagccgggagugguggugcgu

SEQ ID NO: 180002 - RNA, 64 nt, hsa
ggccaauaugaugaaaccccaucucuacuaaaaauacaaaaauuaggccggguacaguggcuca

SEQ ID NO: 180003 - RNA, 64 nt, hsa
gaaugaguuaaaccauuuaaacacauuugaaacauacaaaaauagaaaugugaaagcauuuggu

SEQ ID NO: 180004 - RNA, 64 nt, hsa
ggccaacauagugaaaccccaucucuacugaaaauacaaaaauuagcugggugugguggcacgu

SEQ ID NO: 180005 - RNA, 64 nt, hsa
ugaccaacauggugaaaccccaucucuacuaaaauacaaaaauuauccgggcaugggggcacac

SEQ ID NO: 180006 - RNA, 64 nt, hsa
cugaaaaaauaaaguucaucccaacuuucaagucuacaaaaacauaauccaaaucuaauaacau

SEQ ID NO: 180007 - RNA, 64 nt, hsa
gaccagccuggccaacauggugaaaccccgucucuacaaaaauacaaaaauuagccaggcguga

SEQ ID NO: 180008 - RNA, 64 nt, hsa
uggccaacauggugaaaccccgucucuacaaaaauacaaaaauuagccaggcgugauggcaggu

SEQ ID NO: 180009 - RNA, 64 nt, hsa
gacuaacauggugaaaucccgucucuacuaaaaauacaaaaaaaaaaaaaaaaaaaagccaggc

SEQ ID NO: 180010 - RNA, 64 nt, hsa
ggccaacauggugaaauccugccucuacuaaaaauacaaaaaaaaaaaaaaauuagcugggcau

SEQ ID NO: 180011 - RNA, 64 nt, hsa
ucacagucugagcaacauggcaaaacccugugucuacaaaaaauaaaaaauuagcugggcauga

SEQ ID NO: 180012 - RNA, 64 nt, hsa
ggaagaaaagcaauuauuucauuucagauagaaauacaaaaaaaaaaaaaauacuuuucuuaga

SEQ ID NO: 180013 - RNA, 64 nt, hsa
gaccagccugggcaacauagugagacuccgucucuacaaaaaauaaauuuagcugggcauggug

SEQ ID NO: 180014 - RNA, 64 nt, hsa
ccuggauacaauuaaccauuuuauauuugccaccuacaaaaaaacacccaauaucuucucuugu

SEQ ID NO: 180015 - RNA, 64 nt, hsa
ggucaacauggugaaauccugucucuacuaaaaauacaaaaauuagcugggcaugguggcacau

SEQ ID NO: 180016 - RNA, 64 nt, hsa
guauauacuuuuaaauuauggaguauuuuaagucuacaaaaagguauaaauaauaauauaauga

SEQ ID NO: 180017 - RNA, 64 nt, hsa
caccagccugggcaacauagugagaccuugucucuacaaaaaauaaaauaaaauaaaaaccaaa

SEQ ID NO: 180018 - RNA, 64 nt, hsa
gggcaacauggcaagaccuugucucuacaaaaaguacaaaaauuagaugggugugguguuucgc

SEQ ID NO: 180019 - RNA, 64 nt, hsa
gaccagccugggcaacauggcaagaccuugucucuacaaaaaguacaaaaauuagaugggugug

SEQ ID NO: 180020 - RNA, 64 nt, hsa
guucucaagaauuauaagagaaaugaacucacaguacaaaaauuuuauaauuacuauacuugug

SEQ ID NO: 180021 - RNA, 64 nt, hsa
caaggggaacuugggaccagaaaccacuguuauguacaaaaaaauggcaaauucaauaaacuca

SEQ ID NO: 180022 - RNA, 64 nt, hsa
ggccaacauggcgaaaccccauuucuacuaaaaauacaaaaaaauuagcugggagugguggcau

SEQ ID NO: 180023 - RNA, 64 nt, hsa
ggucucugacgguggguccaggaccagaccucucuacaaaaaauugccccaacuacaguuugca

SEQ ID NO: 180024 - RNA, 64 nt, hsa
aaaaggggaauucucuuuuccuauauauguuccuuacaaaaaaaaaaaaaaaagaaaucaagca

SEQ ID NO: 180025 - RNA, 64 nt, hsa
uuaguuuaaaaugucacuuuuuugguuuuuauuauacaaaaaccaugaaguacuuuuuuuauuu

SEQ ID NO: 180026 - RNA, 64 nt, hsa
ugaaaguugccuuugagaagcuuguuauucauuauacaaaaaguauuugcccauuccuauucua

SEQ ID NO: 180027 - RNA, 64 nt, hsa
gaucagccuaggcaacauagggagacccuaucccuacaaaaaauuucugaaaaauuaccugggc

SEQ ID NO: 180028 - RNA, 64 nt, hsa
uuuguagcucuaugugcaucuauuuuuguagaaauacaaaaaguuugguuuagcauugaugggc

SEQ ID NO: 180029 - RNA, 64 nt, hsa
gaccagccugggcaacauagcaaaacccugucucuacaaaaaauacuuuccguacauuaguggu

SEQ ID NO: 180030 - RNA, 64 nt, hsa
gccuuguguaguuaaaaauuaaggggcuggucaauacaaaaacuuguacacaaauauuuauagc

SEQ ID NO: 180031 - RNA, 64 nt, hsa
gagcaauguggugaaaccccaucucuacuaaaaauacaaaaauuaucugggcuugguggcgggc

SEQ ID NO: 180032 - RNA, 64 nt, hsa
uggguguauaccuauguuaaugaaacaacagaaguacaaaaaagaauaucagauacaaaaauca

SEQ ID NO: 180033 - RNA, 64 nt, hsa
augaaacaacagaaguacaaaaaagaauaucagauacaaaaaucaaucgugaagaaaaucuguu

SEQ ID NO: 180034 - RNA, 64 nt, hsa
gaccaccuuggcgaacacggugaaaccccgucucuacaaaaaauacaaaaauuagccaggcgug

SEQ ID NO: 180035 - RNA, 64 nt, hsa
ggcgaacacggugaaaccccgucucuacaaaaaauacaaaaauuagccaggcgugguggcacgu

SEQ ID NO: 180036 - RNA, 64 nt, hsa
uaccgacccacguccugcugucucugugugguccuacaaaaacuguccauucccaccccuuugc

SEQ ID NO: 180037 - RNA, 64 nt, hsa
ggccaacauggugaaaccccaucucuacuaaaaauacaaaaauuagccggacgcaguggcacgc

SEQ ID NO: 180038 - RNA, 64 nt, hsa
ggccaacauggugaaacccugucucuacuaaaaauacaaaaaugagcugggcaugguggggcgu

SEQ ID NO: 180039 - RNA, 64 nt, hsa
ggagagguuuuuuuuuuuaauuuuucccccuuuauacaaaaaaaaaagaacauuuccaaaacua

SEQ ID NO: 180040 - RNA, 64 nt, hsa
ggccaacaugaugaaaccuugucuuuacuaaaaauacaaaaauuagcugggcaugguggcaggc

SEQ ID NO: 180041 - RNA, 64 nt, hsa
ggccagcaugguaaaacccugucuccacuaaaaauacaaaaauuagccaggcaugguggcgggc

SEQ ID NO: 180042 - RNA, 64 nt, hsa
ggccaacauggugaaacccugucucuacuaaaaauacaaaaauuagcugggugugguggugugu

SEQ ID NO: 180043 - RNA, 64 nt, hsa
aguauugagggggcaaaaauuaccaauuaugguauacaaaaauaagccuauaaauguguuucac

SEQ ID NO: 180044 - RNA, 64 nt, hsa
gggucacuuugaauugugcacauaagaaaaccaauacaaaaaacaauuuguauucaauauuguc

SEQ ID NO: 180045 - RNA, 64 nt, hsa
gaccaacauggugaaacccugucucuacuaaaaguacaaaaauuagccaggcgugguggcgcau

SEQ ID NO: 180046 - RNA, 64 nt, hsa
ugcauuuauuuauuaucagaaaugaaugcauuuuuacaaaaaccuuuuuguagacuguaguuua

SEQ ID NO: 180047 - RNA, 64 nt, hsa
aggaugaucucauuuggaaauccuuaauuucaucuacaaaaacuguuuucccaaauaggucaca

SEQ ID NO: 180048 - RNA, 64 nt, hsa
gggcaacauggcgaaaccccauuucuacuaaaaauacaaaaauuagcuggggcgaggggauagg

SEQ ID NO: 180049 - RNA, 64 nt, hsa
gaccagccugggcaacauggugaaacccugucgguacaaaaaaauacaaaaauuugccuguuua

SEQ ID NO: 180050 - RNA, 64 nt, hsa
ggcaacauggugaaacccugucgguacaaaaaaauacaaaaauuugccuguuuaugguggugug

SEQ ID NO: 180051 - RNA, 64 nt, hsa
ggccaacauggugaaacuucaucucuacuaaaaauacaaaaacuagccaggugugguucuccau

SEQ ID NO: 180052 - RNA, 64 nt, hsa
ggucuacauggugaaaccccaucucaacuaaaaauacaaaaaauacaaaaaauuagccgggcgc

SEQ ID NO: 180053 - RNA, 64 nt, hsa
ggugaaaccccaucucaacuaaaaauacaaaaaauacaaaaaauuagccgggcgcgguggcuca

SEQ ID NO: 180054 - RNA, 64 nt, hsa
ggccaacauggugaaacccugucucuauuaaaaauacaaaaauuagcugggcgugguggcgcau

SEQ ID NO: 180055 - RNA, 64 nt, hsa
gaccagccuggccaauauggugaaacccugucucuacaaaaaauacaaaaauuagcugggcaug

SEQ ID NO: 180056 - RNA, 64 nt, hsa
ggccaauauggugaaacccugucucuacaaaaaauacaaaaauuagcugggcaugguggugcgu

SEQ ID NO: 180057 - RNA, 64 nt, hsa
ugugugguaguauuuuguuggaagagaauguuuauacaaaaaaugaaauucuuccaacagcaga

SEQ ID NO: 180058 - RNA, 64 nt, hsa
ggcuaacacugugaaaccccgucucuacuaaaaauacaaaaaauuagcggggcaugguggcacg

SEQ ID NO: 180059 - RNA, 64 nt, hsa
aguucuuuaagcauuauuuuaaacacuauauugauacaaaaauaucuugcuuacucuaaacuuu

SEQ ID NO: 180060 - RNA, 64 nt, hsa
ggcuaacauggugaaacccugccucuacuaaaaauacaaaaaaaaacaaaauuagccgggcgug

SEQ ID NO: 180061 - RNA, 64 nt, hsa
gaccagccuggucaacaugucaaaacccuguaccuacaaaaaaauacaaaaguuaaccaagccu

SEQ ID NO: 180062 - RNA, 64 nt, hsa
gaccaacauggagaaaccccgucucuacuaaaaauacaaaaauauuagccgggcgugguggugc

SEQ ID NO: 180063 - RNA, 64 nt, hsa
guuuccacauguaacugguuauguucuguaaaguuacaaaaauagaaagguugaaucuguggcg

SEQ ID NO: 180064 - RNA, 64 nt, hsa
ggcccacauggugagaccccaacucuacuaaaaauacaaaaauuagcugggugugguggcaugu

SEQ ID NO: 180065 - RNA, 64 nt, hsa
gaugcacgcacauuuguuuuucacugauaguuuuuacaaaaagcuugguuuaaguuauggaguu

SEQ ID NO: 180066 - RNA, 64 nt, hsa
ggccaauguggugaaacccugucucuacuaaaaauacaaaaauuagccaggugugauggugggu

SEQ ID NO: 180067 - RNA, 64 nt, hsa
auuucccugagaaagggaauuaugaaauuuuuaauacaaaaaauaauccauuuaggugcugagu

SEQ ID NO: 180068 - RNA, 64 nt, hsa
gaccaauauggugaaaccccaucucuacuaaaauuacaaaaaaaauuauccaggcgugguggug

SEQ ID NO: 180069 - RNA, 64 nt, hsa
ggccaacauggugaaaccccaucucuacuaaaaauacaaaaaauuagcugggcaugcacuugua

SEQ ID NO: 180070 - RNA, 64 nt, hsa
uggcaugguggaauaaccaaaauguguaucauucuacaaaaaaauaggccuggacuauuuaagg

SEQ ID NO: 180071 - RNA, 64 nt, hsa
ggcuaacauagugagacccuguuucuacuaaaaauacaaaaauaagccaggugugguggugcau

SEQ ID NO: 180072 - RNA, 64 nt, hsa
ggccaacauggcaaaacuccgucucugcaaaaaauacaaaaaugagcccgguauguuggcauau

SEQ ID NO: 180073 - RNA, 64 nt, hsa
aaaacguuugugcaucugucacucucguguaguuuacaaaaaucgugucucuuauucaguaaga

SEQ ID NO: 180074 - RNA, 64 nt, hsa
cauuaguagcuguccuggcccacuuaaacaagguuacaaaaaaucagagucggaagcagccaaa

SEQ ID NO: 180075 - RNA, 64 nt, hsa
aauauaugaacauuagaaaaauagcaacuuguguuacaaaaauacaaacacauguuaggaaggu

SEQ ID NO: 180076 - RNA, 64 nt, hsa
uggccaacauggcgaaaccccucucuacuaaaaauacaaaaauuugccaggcgugguggcgggu

SEQ ID NO: 180077 - RNA, 64 nt, hsa
gacuagccugggcaacauagcgagacugcaucucuacaaaaaauuuaaaaauuauccaggugua

SEQ ID NO: 180078 - RNA, 64 nt, hsa
ccaacaugguuaaaccccgucucuacuaaaauaguacaaaaauuagccgggcgugguggugggc

SEQ ID NO: 180079 - RNA, 64 nt, hsa
uugaaagugaaaauuauguuccuagaacaaaauguacaaaaagaacaauauaauuuucacauga

SEQ ID NO: 180080 - RNA, 64 nt, hsa
ucaaauguuuuucuucuggaucugcuuuuuauuuuacaaaaauauuuuucauacaaaugguuaa

SEQ ID NO: 180081 - RNA, 64 nt, hsa
uggccaacauggugaaacccugucucuacaaaaauacaaaaauuagcugggugugguggcgggc

SEQ ID NO: 180082 - RNA, 64 nt, hsa
gaccagccuggccaacauggugaaacccugucucuacaaaaauacaaaaauuagcugggugugg

SEQ ID NO: 180083 - RNA, 64 nt, hsa
ggccaacauggugaaaccccgucucuacuaaaaauacaaaaauuagcugggcaugguggggcau

SEQ ID NO: 180084 - RNA, 64 nt, hsa
ggccaacauggcaaaaucccaucucuacuaaaaauacaaaaauucacaggguguguuggcacac

SEQ ID NO: 180085 - RNA, 64 nt, hsa
ugggcaacacggugaaaccccaucucuauuaaaauacaaaaaauuagcugggcaugguggugcg

SEQ ID NO: 180086 - RNA, 64 nt, hsa
aaagauugaaaauggacgccuuccuuaugccauauacaaaaauuaacucaagauggauuaaaga

SEQ ID NO: 180087 - RNA, 64 nt, hsa
gaccauccugggcaacauggcgaaacccuaucucuacaaaaaauacaaaaauuagccagacaug

SEQ ID NO: 180088 - RNA, 64 nt, hsa
gggcaacauggcgaaacccuaucucuacaaaaaauacaaaaauuagccagacaugguggcacau

SEQ ID NO: 180089 - RNA, 64 nt, hsa
accaacaucgugaaaugccgucuuuacaaaaaaauacaaaaauuaacuggaugugauggugugu

SEQ ID NO: 180090 - RNA, 64 nt, hsa
gaccagccugaccaacaucgugaaaugccgucuuuacaaaaaaauacaaaaauuaacuggaugu

SEQ ID NO: 180091 - RNA, 64 nt, hsa
aaggacucaaguguagaagaaaauauccccuucuuacaaaaagaaaugucaauuuauggaguuu

SEQ ID NO: 180092 - RNA, 64 nt, hsa
uauuuucuuuaccuccaaggaaagaacuacuagcuacaaaaaauauuuuggaauaagcauuguu

SEQ ID NO: 180093 - RNA, 64 nt, hsa
acuaugcauuaaaucuugaacuuuauaaaacauguacaaaaauuguacaagauaaguuccaccu

SEQ ID NO: 180094 - RNA, 64 nt, hsa
uaacuuaauauacuagauguuaagguuguuaauguacaaaaaaaaaacccuuauacucaccugc

SEQ ID NO: 180095 - RNA, 64 nt, hsa
uuuuggauaaagaauacuauuuccaaacucauauuacaaaaacaaaauaaaauaauaaaaaaag

SEQ ID NO: 180096 - RNA, 64 nt, hsa
aauuggcaaaacuauuauauguaagggaaauauauacaaaaagaaaauuaaucauagucaccug

SEQ ID NO: 180097 - RNA, 64 nt, hsa
aguacuaguuuugcuuuaaaaugcuauguaaauauacaaaaaaacuagaaagaaauauauauaa

SEQ ID NO: 180098 - RNA, 64 nt, hsa
ggcuaaugcguugaaacuccgucucuacuaaaaauacaaaaaauuagcugggcguggugguggg

SEQ ID NO: 180099 - RNA, 64 nt, hsa
uggccaacauggugaaacccuucucuacugaaaauacaaaaauuagccaggugugguggcgcau

SEQ ID NO: 180100 - RNA, 64 nt, hsa
ggcuaauauggugaaaccucgucucuacuaaaaauacaaaaauuagcugggcaugguggugcgu

SEQ ID NO: 180101 - RNA, 64 nt, hsa
acuaaagguaaagauguuuacagauuacuuuucuuacaaaaaaaaucuagaagacacuguguuu

SEQ ID NO: 180102 - RNA, 64 nt, hsa
aauaaacaaaucguaucaguguuugugaauaaaauacaaaaaugauuguuaaugauuggugcuc

SEQ ID NO: 180103 - RNA, 64 nt, hsa
cuuuuaaggacuugagauaacuaauuuguuuauauacaaaaauuaauguuacuguguuacuuaa

SEQ ID NO: 180104 - RNA, 64 nt, hsa
cugagauacccgauucuauauguaaaagcuaauauacaaaaaagcagauuaaauuacaugauaa

SEQ ID NO: 180105 - RNA, 64 nt, hsa
ggccaacauggggaaaccccgucucuacuaaaaauacaaaaauuagccgggcaugguggugggc

SEQ ID NO: 180106 - RNA, 64 nt, hsa
ggccaauguggugaaaccccaucucuacuaaaaauacaaaaauuagcugggcgugguggugcau

SEQ ID NO: 180107 - RNA, 64 nt, hsa
guugauaagacaaguuuagaauugguuuacuuaauacaaaaaaaaaaaaaagaauuucaaaaaa

SEQ ID NO: 180108 - RNA, 64 nt, hsa
accuguaguuucauuaccuuuuugaauaaugucauacaaaaaauguauuuguuuuuuugugcug

SEQ ID NO: 180109 - RNA, 64 nt, hsa
ggccaacacggugaaaccccgccucuacuaaaaauacaaaaaauagccgggugugguggugggc

SEQ ID NO: 180110 - RNA, 64 nt, hsa
acaaaacauagugaaaccccgucucuacuaaaaauacaaaaauuagcugggcgugguggugggu

SEQ ID NO: 180111 - RNA, 64 nt, hsa
ggucaacauggugaaacccccuaucuacuaaaaauacaaaaaauuagcugggcaugguggcaug

SEQ ID NO: 180112 - RNA, 64 nt, hsa
caggagaacuuacucaaguugguaaagaacauacuacaaaaaacccuacagcuaacauuauccu

SEQ ID NO: 180113 - RNA, 64 nt, hsa
ggccaacaugaugaaacccugucucuacuaaaaauacaaaaauuagccgggcaugguggugcac

SEQ ID NO: 180114 - RNA, 64 nt, hsa
gagaccagccugggcaacauggcacaauugucucuacaaaaaauacaaaaauuagccaggcaug

SEQ ID NO: 180115 - RNA, 64 nt, hsa
cugggcaacauggcacaauugucucuacaaaaaauacaaaaauuagccaggcaugguggcaugc

SEQ ID NO: 180116 - RNA, 64 nt, hsa
gaagaaugaaacuagacccccaucucuuagcauauacaaaaaucaaaauuaauuaaaaaguuaa

SEQ ID NO: 180117 - RNA, 64 nt, hsa
ggccgacauggugaaacucagucucuauugaaaauacaaaaauuagcucagugugguggcacac

SEQ ID NO: 180118 - RNA, 64 nt, hsa
ggccaacauggugaaaccuugucucuacuaaaacuacaaaaaaaauuagccaggcgugguggcg

SEQ ID NO: 180119 - RNA, 64 nt, hsa
gaguuuugagaccagccugggaaacaucugucucuacaaaaaaauacaaaaauuagcugggcau

SEQ ID NO: 180120 - RNA, 64 nt, hsa
accagccugggaaacaucugucucuacaaaaaaauacaaaaauuagcugggcauaguggugcau

SEQ ID NO: 180121 - RNA, 64 nt, hsa
cucugccucaaaaaaaaauuaaaauaaauuuaaauacaaaaaaaaauagccagguguggggugc

SEQ ID NO: 180122 - RNA, 64 nt, hsa
uggccaacguggugaaacgcugucucuacuaaaauacaaaaaaauagggcugggcgcgguugcu

SEQ ID NO: 180123 - RNA, 64 nt, hsa
acaggagaacuuacucaauuugauaaagaacuacuacaaaaaacccuacaucuagcaucauccu

SEQ ID NO: 180124 - RNA, 64 nt, hsa
auaaccuuccaagaccaggcgcgguggcuaaaaauacaaaaaguuagccgggcgugguggcaug

SEQ ID NO: 180125 - RNA, 64 nt, hsa
ggccaacaaggugaaacccugucucuacuaaaaauacaaaaaauuagccaggcaugguggugcg

SEQ ID NO: 180126 - RNA, 64 nt, hsa
caaagaauuguuaaauguucuuaaauguucucacuacaaaaaaagaaaaaagauaacuacguga

SEQ ID NO: 180127 - RNA, 64 nt, hsa
aggaguucgugaccagccugggcaacccugucucuacaaaaaauacaaaaauuaaccaggcaug

SEQ ID NO: 180128 - RNA, 64 nt, hsa
ugaccagccugggcaacccugucucuacaaaaaauacaaaaauuaaccaggcaugguggcaugc

SEQ ID NO: 180129 - RNA, 64 nt, hsa
ggccaacauggugaaacccugucucuacuaaaaauacaaaaauagcugggcaugguggcacgca

SEQ ID NO: 180130 - RNA, 64 nt, hsa
ggguaauauggcaagagcccaacucuacuaaaaauacaaaaagaaaagaaaacagccaagcuug

SEQ ID NO: 180131 - RNA, 64 nt, hsa
cugggcuaaaucuacuguuucaaaaaagugucuuuacaaaaaaacaaaaaagaaaagaaauuua

SEQ ID NO: 180132 - RNA, 64 nt, hsa
uacaagagacucaaaucuaaaacauuuacagaguuacaaaaaacaaacaaucaaaaaaaaagac

SEQ ID NO: 180133 - RNA, 64 nt, hsa
ggccaauauggugaaacccugucucuacuaaaaauacaaaaauuagccgggugugguggugggc

SEQ ID NO: 180134 - RNA, 64 nt, hsa
uauuuaucuucuuuuaguguagaaaauaauuuuuuacaaaaagucacuuuugggcugggcgcag

SEQ ID NO: 180135 - RNA, 64 nt, hsa
cuuaaaacguuuuuauugugcaacauuuaaggcauacaaaaacauauaaagaauaccaugauga

SEQ ID NO: 180136 - RNA, 64 nt, hsa
acuaugcacuaggcaugguaucaaguaccaggaguacaaaaauaaguaaaccuugauuucugcu

SEQ ID NO: 180137 - RNA, 64 nt, hsa
ggcuaacaaggcgaaauccugucuguacuaaaaauacaaaaaucagccagacaugguggcaugc

SEQ ID NO: 180138 - RNA, 64 nt, hsa
cgccaacauggugaaaccguaucucuaauaaaaauacaaaaauuagcugggcauggugcgggca

SEQ ID NO: 180139 - RNA, 64 nt, hsa
aaugggaucuguacaacugauuuuaaaaaaaugcuacaaaaagccccaaagcauauaaucucua

SEQ ID NO: 180140 - RNA, 64 nt, hsa
ggccaacauggugaaaccccaucucuacuaaaaauacaaaaauuagcugggcgugguggcacgu

SEQ ID NO: 180141 - RNA, 64 nt, hsa
gaccgacaugggcaacaugacaagaccccaucucuacaaaaaaauuaaaaaauuagccaggcau

SEQ ID NO: 180142 - RNA, 64 nt, hsa
agggauuugauacuuaggccuuugaauuuuagaauacaaaaagagaagcaagccagacauggug

SEQ ID NO: 180143 - RNA, 64 nt, hsa
gguuugagcacuggguucuuuuagccaaauuccauacaaaaagaauuuggauguuuuccagcau

SEQ ID NO: 180144 - RNA, 64 nt, hsa
uaccauuguuauagguaaaaucccauuacaaaaauacaaaaauauuuuuuguaacaguuauuuu

SEQ ID NO: 180145 - RNA, 64 nt, hsa
ugagcuuuuaccauuguuauagguaaaaucccauuacaaaaauacaaaaauauuuuuuguaaca

SEQ ID NO: 180146 - RNA, 64 nt, hsa
ggaauuaaacacaaagaacuugaaagcagucaguuacaaaaagguaguuguggucaaguaguuu

SEQ ID NO: 180147 - RNA, 64 nt, hsa
gcuaacagggugaaacccugucucuacuaaaaaauacaaaaaauuagccaggcguggugguggg

SEQ ID NO: 180148 - RNA, 64 nt, hsa
gcuucuuuuauauauagcaaacaauuugaaagaauacaaaaauaugugaaguucauuuaaaaaa

SEQ ID NO: 180149 - RNA, 64 nt, hsa
aaaaagaaaaaaaacacaaaaaauaaaaaaccccuacaaaaaaacuuuaaaaaaaauggcagca

SEQ ID NO: 180150 - RNA, 64 nt, hsa
gauuuuaccuuuguugaauuuguauaaacaauuguacaaaaaaaaccacucuugaacuuugagg

SEQ ID NO: 180151 - RNA, 64 nt, hsa
aaauacggggcgggcucugggaggggagagacuuuacaaaaaugagggcuuuuauuuuccauuu

SEQ ID NO: 180152 - RNA, 64 nt, hsa
gcuuggccaaggugauaaaacccgucucuacuaauacaaaaaaaauuagcuggguauguuggug

SEQ ID NO: 180153 - RNA, 64 nt, hsa
ggccaacauggcgaaaccccaucucuacuaaaaauacaaaaauuagccgggcgugguggcuuac

SEQ ID NO: 180154 - RNA, 64 nt, hsa
cuuaauuuugauuuaaaaacaaaaaaucguaaaauacaaaaaccaguuaauguuuuguagaccc

SEQ ID NO: 180155 - RNA, 64 nt, hsa
uuuguagacccugggaaaagaauuuucagcaaaguacaaaaauuuaaagcauuccuuuaauuuu

SEQ ID NO: 180156 - RNA, 64 nt, hsa
ggcauaccuuauauuuguaucauucuuuaaaguuuacaaaaaaaaaccuuauguuuuuauguaa

SEQ ID NO: 180157 - RNA, 64 nt, hsa
guuuaaaaauaggaccauguaugagacacuuuuuuacaaaaagugccguauauacauauguaac

SEQ ID NO: 180158 - RNA, 64 nt, hsa
gaccagccugggcaacauagcaaaaccccaucucuacaaaaauaaaaaauaugucugggcaugg

SEQ ID NO: 180159 - RNA, 64 nt, hsa
ggccaacauggugaaaccccgucucuacuaaaaauacaaaaauuagcugggcgugguggcaugc

SEQ ID NO: 180160 - RNA, 64 nt, hsa
aaagguuauuacgaauuuuguuguacaaaaucuguacaaaaaucuguuuuuacaucauaaugca

SEQ ID NO: 180161 - RNA, 64 nt, hsa
uguguauuaauguucuuuaaaaguuuaaguauucuacaaaaaaaaaaaaaguuuucuccauuga

SEQ ID NO: 180162 - RNA, 64 nt, hsa
ugaaugagacaguuuuuaaaaguugauuuauaaauacaaaaauacauucuccaaagauaguauu

SEQ ID NO: 180163 - RNA, 64 nt, hsa
ggccaacaugguaaaacgccgucucuacuaaaaauacaaaaacuuagcuggguguaacggcgga

SEQ ID NO: 180164 - RNA, 64 nt, hsa
gaccagccugggcaacauggcaaaaccccaucucuacaaaaaauacaaaaaguaggccgggcac

SEQ ID NO: 180165 - RNA, 64 nt, hsa
gggcaacauggcaaaaccccaucucuacaaaaaauacaaaaaguaggccgggcacggugguuca

SEQ ID NO: 180166 - RNA, 64 nt, hsa
ggccaacaugguggaacccaaucucuacuaaaaauacaaaaaaacuagccggauaugguggcgg

SEQ ID NO: 180167 - RNA, 64 nt, hsa
ggccaacauggugcaaccucgucuuuacuaaaaauacaaaaacaaaaauuagccagggguggug

SEQ ID NO: 180168 - RNA, 64 nt, hsa
auguauaauuaucuauuuguuuuggacuauauguuacaaaaauuuaaaacauaagauccucucu

SEQ ID NO: 180169 - RNA, 64 nt, hsa
gggcaacauggugaagccccaucucuacaaaaaauacaaaaaaauuagccggguaugauggugu

SEQ ID NO: 180170 - RNA, 64 nt, hsa
gaccagccugggcaacauggugaagccccaucucuacaaaaaauacaaaaaaauuagccgggua

SEQ ID NO: 180171 - RNA, 64 nt, hsa
aauguauuaaauuggaauuuuuuaauccuuuauauacaaaaaaaauacgaucacucagugugug

SEQ ID NO: 180172 - RNA, 64 nt, hsa
acaaagggaaaacaaaaagcuacaaaaguagccuuacaaaaaaaaaaaaauuguuuagugaaua

SEQ ID NO: 180173 - RNA, 64 nt, hsa
ggccaacauagugaaaccccgucucuauuaaaaauacaaaaauuagcuggguguggugguaugu

SEQ ID NO: 180174 - RNA, 64 nt, hsa
ggccaacauggcaaaaccccgucucuacuaaaaauacaaaaagccgggcguggugggcgccugu

SEQ ID NO: 180175 - RNA, 64 nt, hsa
ugaccagccuggucuuuuguagagacccugucucuacaaaaauauaaaaaucagccaggcgucg

SEQ ID NO: 180176 - RNA, 64 nt, hsa
aucuucugucccuuuaagaacugccaacaauuuguacaaaaaaugugguacguugguuccugcc

SEQ ID NO: 180177 - RNA, 64 nt, hsa
uuuuccuauuacaaaaaacucccacuuuuuuuguuacaaaaaguaauagaaaaugguaauaguu

SEQ ID NO: 180178 - RNA, 64 nt, hsa
aguuaguuaaaaaaaaacaaacauuuuuuccuauuacaaaaaacucccacuuuuuuuguuacaa

SEQ ID NO: 180179 - RNA, 64 nt, hsa
gggcaacauggcaaaacgcagucuguacaaaaaauacaaaaaauuagccagguguagggguagg

SEQ ID NO: 180180 - RNA, 64 nt, hsa
gaccagccugggcaacauggcaaaacgcagucuguacaaaaaauacaaaaaauuagccaggugu

SEQ ID NO: 180181 - RNA, 64 nt, hsa
ggccaacauggugaaaccccgucucuacaaaaaauacaaaaauuagcugggcaugguggcaugc

SEQ ID NO: 180182 - RNA, 64 nt, hsa
gaccagccuggccaacauggugaaaccccgucucuacaaaaaauacaaaaauuagcugggcaug

SEQ ID NO: 180183 - RNA, 64 nt, hsa
ucuaacauuuguauaaauagaauucagugcaaguuacaaaaauucuguugcaccacucuaguuu

SEQ ID NO: 180184 - RNA, 64 nt, hsa
ucagugauauaaagcauauuuuauucuauauuauuacaaaaacggaaauguauaaacaugucaa

SEQ ID NO: 180185 - RNA, 64 nt, hsa
gacuagccugggcaacauagcgagaccucgucucuacaaaaaaaaauuaaaaagggggcuuugg

SEQ ID NO: 180186 - RNA, 64 nt, hsa
uggccaacauggugaaaccccgucucuacuaaaauacaaaaaauuagcugggcaugguggcgca

SEQ ID NO: 180187 - RNA, 64 nt, hsa
gaccaacuuggugaaaucccaucucuacuaaaaauacaaaaauuagcugggugcaguggcgcau

SEQ ID NO: 180188 - RNA, 64 nt, hsa
aagacaauccuggccaacggcgaaacucugucucuacaaaaaauauacaggcguguuagcaugu

SEQ ID NO: 180189 - RNA, 64 nt, hsa
ggccagccugggcaacauggcaaaaccccauuucuacaaaaaauacaaaaauuagcugggcaug

SEQ ID NO: 180190 - RNA, 64 nt, hsa
gggcaacauggcaaaaccccauuucuacaaaaaauacaaaaauuagcugggcaugguggcaccc

SEQ ID NO: 180191 - RNA, 64 nt, hsa
uugaaaggcauugugggucugucuuuaaaguguuuacaaaaaaaaauuauauaaaaaaaaaguc

SEQ ID NO: 180192 - RNA, 64 nt, hsa
augcaagauagguuucuguauuuauauauuaaaauacaaaaaaaaacuuauaaaauguuuaaaa

SEQ ID NO: 180193 - RNA, 64 nt, hsa
ggcaaacauggugaaaccccgucucuauuaaaaauacaaaaauuagcugggcgugguggcgugc

SEQ ID NO: 180194 - RNA, 64 nt, hsa
aaggcaacauagugaggccccaucuuuacaaaaauacaaaaauuagcuggacguguagucccag

SEQ ID NO: 180195 - RNA, 64 nt, hsa
gaccagccaaggcaacauagugaggccccaucuuuacaaaaauacaaaaauuagcuggacgugu

SEQ ID NO: 180196 - RNA, 64 nt, hsa
ggccaguauggugaaacccugucucuccuaaaaauacaaaaauuagccgggcaugguggaaugu

SEQ ID NO: 180197 - RNA, 64 nt, hsa
cagccuggggaacacauccugucucuacaaaaaauacaaaaauuagccaggcaggguggugcau

SEQ ID NO: 180198 - RNA, 64 nt, hsa
ggucgagaccagccuggggaacacauccugucucuacaaaaaauacaaaaauuagccaggcagg

SEQ ID NO: 180199 - RNA, 64 nt, hsa
gucuaacacggugaaaccccaucucuacuaaaaauacaaaaaaauuagucggacaugguggcag

SEQ ID NO: 180200 - RNA, 64 nt, hsa
ggccaacauggugaaaccccaucucuacuaaaaauacaaaaauuagcuaggcgggguagugcau

SEQ ID NO: 180201 - RNA, 64 nt, hsa
aaccagccugggcaauauagugagaccguaucacuacaaaaaaguuuuuuuaguucaccgagca

SEQ ID NO: 180202 - RNA, 64 nt, hsa
ggcuaacacggugaaaccccgucucuacuaaaaauacaaaaaaauuagucgggcgugguggcgg

SEQ ID NO: 180203 - RNA, 64 nt, hsa
ggccaacauggugaaaccccaucuuuacuaaaaauacaaaaaacuagccaggcguggugguggg

SEQ ID NO: 180204 - RNA, 64 nt, hsa
gacuccgucucaaaaaaaaaaaaaaaaaaaaaaauacaaaaauuagccgggcgugguggcccac

SEQ ID NO: 180205 - RNA, 64 nt, hsa
ggccaacaugaugaaaccccaucucuacuaaaaauacaaaaaauuagccgggcgugguagcggg

SEQ ID NO: 180206 - RNA, 64 nt, hsa
uugaagggcccagauucuaccacacagcagcaguuacaaaaaccuuccccaggcuggacguggu

SEQ ID NO: 180207 - RNA, 64 nt, hsa
ugaguauucuuuuuuaaauuauuaagccaugauuuacaaaaacauuacuuucuguaauucacaa

SEQ ID NO: 180208 - RNA, 64 nt, hsa
gcagccugugaaucuccacaaaguguuaccaguuuacaaaaauaagucuuuuugccuuaaguca

SEQ ID NO: 180209 - RNA, 64 nt, hsa
gaccagccugggcagcauggugaaacccuguaucuacaaaaaauacaaaaauuagccaggcaug

SEQ ID NO: 180210 - RNA, 64 nt, hsa
gggcagcauggugaaacccuguaucuacaaaaaauacaaaaauuagccaggcaugguggugggu

SEQ ID NO: 180211 - RNA, 64 nt, hsa
gauuuaacuaacccaaaguccaggaggauguucuuacaaaaauagcuauaucaagggcuggcac

SEQ ID NO: 180212 - RNA, 64 nt, hsa
agugaaagggcuuaaaauuucuuggaaauaguuuuacaaaaauggauuuaaaaaauccuaccga

SEQ ID NO: 180213 - RNA, 64 nt, hsa
ggccaacauggugaaaccucaucucuacuaaaaauacaaaaauuagccaggcgugguggcaggu

SEQ ID NO: 180214 - RNA, 64 nt, hsa
ggugaacauggcgaaaccccgucucuaauaaaaauacaaaaauuagccgggcaugguggugcau

SEQ ID NO: 180215 - RNA, 64 nt, hsa
uggcuaacacgugaaaccccgucucuacuaaaaauacaaaaaauuagccgggcgugguggcggg

SEQ ID NO: 180216 - RNA, 64 nt, hsa
accaggccugagcaacaaagcgagaucccaucucuacaaaaaccaaaaaguuaaaaaucagcug

SEQ ID NO: 180217 - RNA, 64 nt, hsa
gagcaacaugguaaaaccccaucucuaccaaaaauacaaaaauuagcugggcuugguggcuggc

SEQ ID NO: 180218 - RNA, 64 nt, hsa
ggcuaacauggugaaauccuaucucuaccaaaaauacaaaaauuagccaggcgugguggugggc

SEQ ID NO: 180219 - RNA, 64 nt, hsa
ggccaacauggugaaacccugucucuacuaaaaauacaaaaauuaucugggugugguggcacgu

SEQ ID NO: 180220 - RNA, 64 nt, hsa
gagugagacuccgucucaaaaaaaauuuauacuguacaaaaaccccacaagugugaaaaacaug

SEQ ID NO: 180221 - RNA, 64 nt, hsa
aacuucaaaaaaguuucaggauacaaaaucuguguacaaaaauuaguugcauuucuauacacca

SEQ ID NO: 180222 - RNA, 64 nt, hsa
ggauauugaaacuggaccccuauccuucacgauauacaaaaaucaacucaagauggauuaaaga

SEQ ID NO: 180223 - RNA, 64 nt, hsa
ccuugaacgcccauuagugcuauguuauagaaccuacaaaaaagaaauggaacaaauguagugg

SEQ ID NO: 180224 - RNA, 64 nt, hsa
gcagaacucgcguuagaaacacagauauuuguuuuacaaaaagggagauuuuuccuuuguuaaa

SEQ ID NO: 180225 - RNA, 64 nt, hsa
aaccagccuggguaacauggcaaaauccugucuuuacaaaaaauacaaaaauuagccuagcaug

SEQ ID NO: 180226 - RNA, 64 nt, hsa
ggguaacauggcaaaauccugucuuuacaaaaaauacaaaaauuagccuagcaugguggcgcau

SEQ ID NO: 180227 - RNA, 64 nt, hsa
ggcuaauauggugaaacccugucucuacuaaaaauacaaaaaaauuagcuaggcaugguggcgg

SEQ ID NO: 180228 - RNA, 64 nt, hsa
uuaaaacuuucuaucaugaaaaaauuugaacauauacaaaaauacacagaaucuuauauugaac

SEQ ID NO: 180229 - RNA, 64 nt, hsa
ggccaacauggugaaaccucaucucuacuaaaaauacaaaaaauuagcaacagagcgcgauucc

SEQ ID NO: 180230 - RNA, 64 nt, hsa
auucaaaauauguuaaauuucugacaauuccuaauacaaaaaugacccgauuaaaagauucugu

SEQ ID NO: 180231 - RNA, 64 nt, hsa
ggagaaaaauuuuagcuuucuacuuuauaucauauacaaaaauaaaauccaacuaaagaccaga

SEQ ID NO: 180232 - RNA, 64 nt, hsa
auaaaucaagcaguaguaagauagugagcauucauacaaaaauccaagaagauacaggaauucu

SEQ ID NO: 180233 - RNA, 64 nt, hsa
ggccaacaugaugaaacccuaucucuacuaaaaauacaaaaauuagccgggcaugguggugcac

SEQ ID NO: 180234 - RNA, 64 nt, hsa
ggcuaacacggugaaaccccaucucuacuaaaaauacaaaaaccaaaaaaaauuagccaggcgc

SEQ ID NO: 180235 - RNA, 64 nt, hsa
ggcuaacacggugaaaccccgucucuacuaaaaauacaaaaaaauuagccgggugcgguggcgg

SEQ ID NO: 180236 - RNA, 64 nt, hsa
gggcaacauggugagaccccaucucuacaaaaaauacaaaaauuagcugagugugguggcacau

SEQ ID NO: 180237 - RNA, 64 nt, hsa
gaccagccugggcaacauggugagaccccaucucuacaaaaaauacaaaaauuagcugagugug

SEQ ID NO: 180238 - RNA, 64 nt, hsa
ggcuaacacggugaaaccccaucucuacuaaaaauacaaaaaauuagccaggcgugguuguggg

SEQ ID NO: 180239 - RNA, 64 nt, hsa
accagccugggcagaauggugaaaccaccuucucuacaaaaaauacauaaauuagcugggcauu

SEQ ID NO: 180240 - RNA, 64 nt, hsa
guggagaaaccccgucucuacuaaaaaaaaaaauuacaaaaaauuagccgggcaugguagcagg

SEQ ID NO: 180241 - RNA, 64 nt, hsa
ucuuuuuucaaucaucacaguaauuauugauuuguacaaaaaucacuugacgucauaaccuuaa

SEQ ID NO: 180242 - RNA, 64 nt, hsa
gaccagccuagccaacauggugaaaccccgucucuacaaaaaauacaaaaauuagccggguggg

SEQ ID NO: 180243 - RNA, 64 nt, hsa
agccaacauggugaaaccccgucucuacaaaaaauacaaaaauuagccgggugggacacgccug

SEQ ID NO: 180244 - RNA, 64 nt, hsa
gggcaacauggugaaacccaguuucuacaaaaaauacaaaaaauuagccggguuccaucaccug

SEQ ID NO: 180245 - RNA, 64 nt, hsa
gaccagccugggcaacauggugaaacccaguuucuacaaaaaauacaaaaaauuagccggguuc

SEQ ID NO: 180246 - RNA, 64 nt, hsa
auauauguaauuaaaauguuucuaguagcugcauuacaaaaaagaagccugggcacuguggcuc

SEQ ID NO: 180247 - RNA, 64 nt, hsa
cugcuuuuuugccucacaauuaugcugugaauuuuacaaaaauuuauuuucuuuuuugauaauu

SEQ ID NO: 180248 - RNA, 64 nt, hsa
gaauggaaacuuggaaauacucguuuuuauaaacuacaaaaacuuuuuguuguuuaucaggaaa

SEQ ID NO: 180249 - RNA, 64 nt, hsa
uuuaaagaaauauuuugaaucugccaaguacauuuacaaaaacacggaugcugguauuuuaaca

SEQ ID NO: 180250 - RNA, 64 nt, hsa
ggcuaacauggugaaacccugucucuacuaaaaauacaaaaaauuagccggguguggugguggg

SEQ ID NO: 180251 - RNA, 64 nt, hsa
cuggcuaacagugaaacccugucuccacuaaaaauacaaaaaauuagccgggcgugguggcggg

SEQ ID NO: 180252 - RNA, 64 nt, hsa
ggcuaauacagugaaaccccaugucugcuaaaauuacaaaaaauuagcugggcgugguggugca

SEQ ID NO: 180253 - RNA, 64 nt, hsa
gaccagccuggacaacauggugaaaccccaucucuacaaaaaauacaaaaauuagccaugcaug

SEQ ID NO: 180254 - RNA, 64 nt, hsa
ggacaacauggugaaaccccaucucuacaaaaaauacaaaaauuagccaugcaugguggcucau

SEQ ID NO: 180255 - RNA, 64 nt, hsa
gaccagccugggccacaugacaaagccccaucucuacaaaaaaauuacaaaaaaaaaaaaaaca

SEQ ID NO: 180256 - RNA, 64 nt, hsa
gccacaugacaaagccccaucucuacaaaaaaauuacaaaaaaaaaaaaaacaggugugguggc

SEQ ID NO: 180257 - RNA, 64 nt, hsa
ggccaacguggugaaacacugucucuacuaaaaauacaaaaaugagcugggugugaugauacau

SEQ ID NO: 180258 - RNA, 64 nt, hsa
ggcuaacacggugaaaccccgucuuuacuaaaaauacaaaaaaaauuagcugggcgugguggcg

SEQ ID NO: 180259 - RNA, 64 nt, hsa
accagccugggaaauauagugaaacuccugucccuacaaaaaauacaaaaauuagccgggugug

SEQ ID NO: 180260 - RNA, 64 nt, hsa
ggaaauauagugaaacuccugucccuacaaaaaauacaaaaauuagccgggugugguagugcau

SEQ ID NO: 180261 - RNA, 64 nt, hsa
ggcauuuuugcuucaauuuuauuuuuuuuaagaauacaaaaacagaaaucugcacuaauuuacc

SEQ ID NO: 180262 - RNA, 64 nt, hsa
aggaaaggccaaaaaaaagaggaaaagaaaaauguacaaaaagauuuucgaucuucucacucuu

SEQ ID NO: 180263 - RNA, 64 nt, hsa
gaccagccuggccaacauggugaaaccccaccucuacaaaaaauacaaaaauuagccgggcgug

SEQ ID NO: 180264 - RNA, 64 nt, hsa
ggccaacauggugaaaccccaccucuacaaaaaauacaaaaauuagccgggcgugguggcaggc

SEQ ID NO: 180265 - RNA, 64 nt, hsa
ggccaacauggcaaaacccccaucucuacuaaaauacaaaaauuaggugugguggcgggcaccu

SEQ ID NO: 180266 - RNA, 64 nt, hsa
cugggaaacguggugagaccucaucucuacaaaauacaaaaaaauuagccgggcaugguggcac

SEQ ID NO: 180267 - RNA, 64 nt, hsa
gaagucuuauaaaaauuuaaaaagacacauuucuuacaaaaaagaguugaaugagguaaaaugg

SEQ ID NO: 180268 - RNA, 64 nt, hsa
gguaauuugccaggaauucuucauaacaguaucuuacaaaaaacguguugcucucuucacagua

SEQ ID NO: 180269 - RNA, 64 nt, hsa
guaaguaagaaagaaggcaaauugauucaaauguuacaaaaaaacccuucuugguggauuagac

SEQ ID NO: 180270 - RNA, 64 nt, hsa
uaacaauggcagguuuuacacgucuaugcaauuguacaaaaaaguuauaagaaaacuacaugua

SEQ ID NO: 180271 - RNA, 64 nt, hsa
ggccaacauggugaaaccccaucucuacuaaaaauacaaaaauuagcugggcguaguggcgcgu

SEQ ID NO: 180272 - RNA, 64 nt, hsa
uggccaacauagcaaaaccucaucucuacuaaaauacaaaaauuagccgggcgugguggugcgu

SEQ ID NO: 180273 - RNA, 64 nt, hsa
uuuuuaauguucgguuaaaaaugugacagaugaguacaaaaaugcagacacuuaacaaaaagca

SEQ ID NO: 180274 - RNA, 64 nt, hsa
ggccaacauggcgaaaccccgucucuacuaaaaauacaaaaauuagccaggacugauggcaugu

SEQ ID NO: 180275 - RNA, 64 nt, hsa; identical to SEQ ID NO: 53771

SEQ ID NO: 180276 - RNA, 64 nt, hsa; identical to SEQ ID NO: 53772

SEQ ID NO: 180277 - RNA, 64 nt, hsa; identical to SEQ ID NO: 53773

SEQ ID NO: 180278 - RNA, 64 nt, hsa; identical to SEQ ID NO: 53774

SEQ ID NO: 180279 - RNA, 64 nt, hsa; identical to SEQ ID NO: 53775

SEQ ID NO: 180280 - RNA, 64 nt, hsa; identical to SEQ ID NO: 53776

SEQ ID NO: 180281 - RNA, 64 nt, hsa; identical to SEQ ID NO: 53777

SEQ ID NO: 180282 - RNA, 64 nt, hsa; identical to SEQ ID NO: 53778

SEQ ID NO: 180283 - RNA, 64 nt, hsa; identical to SEQ ID NO: 53779

SEQ ID NO: 180284 - RNA, 64 nt, hsa; identical to SEQ ID NO: 53780

SEQ ID NO: 180285 - RNA, 64 nt, hsa; identical to SEQ ID NO: 53781

SEQ ID NO: 180286 - RNA, 64 nt, hsa; identical to SEQ ID NO: 53782

SEQ ID NO: 180287 - RNA, 64 nt, hsa; identical to SEQ ID NO: 53783

SEQ ID NO: 180288 - RNA, 64 nt, hsa; identical to SEQ ID NO: 53784

SEQ ID NO: 180289 - RNA, 64 nt, hsa; identical to SEQ ID NO: 53785

SEQ ID NO: 180290 - RNA, 64 nt, hsa; identical to SEQ ID NO: 53786

SEQ ID NO: 180291 - RNA, 64 nt, hsa; identical to SEQ ID NO: 53787

SEQ ID NO: 180292 - RNA, 64 nt, hsa; identical to SEQ ID NO: 53788

SEQ ID NO: 180293 - RNA, 64 nt, hsa; identical to SEQ ID NO: 53789

SEQ ID NO: 180294 - RNA, 64 nt, hsa; identical to SEQ ID NO: 53790

SEQ ID NO: 180295 - RNA, 64 nt, hsa; identical to SEQ ID NO: 53791

SEQ ID NO: 180296 - RNA, 64 nt, hsa; identical to SEQ ID NO: 53792

SEQ ID NO: 180297 - RNA, 64 nt, hsa; identical to SEQ ID NO: 53793

SEQ ID NO: 180298 - RNA, 64 nt, hsa; identical to SEQ ID NO: 53794

SEQ ID NO: 180299 - RNA, 64 nt, hsa; identical to SEQ ID NO: 53795

SEQ ID NO: 180300 - RNA, 64 nt, hsa; identical to SEQ ID NO: 53796

SEQ ID NO: 180301 - RNA, 64 nt, hsa; identical to SEQ ID NO: 53797

SEQ ID NO: 180302 - RNA, 64 nt, hsa; identical to SEQ ID NO: 53798

SEQ ID NO: 180303 - RNA, 64 nt, hsa; identical to SEQ ID NO: 53799

SEQ ID NO: 180304 - RNA, 64 nt, hsa; identical to SEQ ID NO: 53800

SEQ ID NO: 180305 - RNA, 64 nt, hsa; identical to SEQ ID NO: 53801

SEQ ID NO: 180306 - RNA, 64 nt, hsa; identical to SEQ ID NO: 53802

SEQ ID NO: 180307 - RNA, 64 nt, hsa; identical to SEQ ID NO: 53803

SEQ ID NO: 180308 - RNA, 64 nt, hsa; identical to SEQ ID NO: 53804

SEQ ID NO: 180309 - RNA, 64 nt, hsa; identical to SEQ ID NO: 53805

SEQ ID NO: 180310 - RNA, 64 nt, hsa; identical to SEQ ID NO: 53806

SEQ ID NO: 180311 - RNA, 64 nt, hsa; identical to SEQ ID NO: 53807

SEQ ID NO: 180312 - RNA, 64 nt, hsa; identical to SEQ ID NO: 53808

SEQ ID NO: 180313 - RNA, 64 nt, hsa; identical to SEQ ID NO: 53809

SEQ ID NO: 180314 - RNA, 64 nt, hsa; identical to SEQ ID NO: 53810

SEQ ID NO: 180315 - RNA, 64 nt, hsa; identical to SEQ ID NO: 53811

SEQ ID NO: 180316 - RNA, 64 nt, hsa; identical to SEQ ID NO: 53812

SEQ ID NO: 180317 - RNA, 64 nt, hsa; identical to SEQ ID NO: 53813

SEQ ID NO: 180318 - RNA, 64 nt, hsa; identical to SEQ ID NO: 53814

SEQ ID NO: 180319 - RNA, 64 nt, hsa; identical to SEQ ID NO: 53815

SEQ ID NO: 180320 - RNA, 64 nt, hsa
ggcgucucuccaccagccagaucccccaaucccagauccgcauguucgacccagagcagcaccc

SEQ ID NO: 180321 - RNA, 64 nt, hsa
accugucugggaucaacuccuggaagaaacgccugauccgcaucaaggugcgcacaggugcuuc

SEQ ID NO: 180322 - RNA, 64 nt, hsa
ucugucucccccagccagacaccugcaucccuggcuccucuauuacucaggggcauucaugccu

SEQ ID NO: 180323 - RNA, 64 nt, hsa
ccuuuauuacugccuucuuuucaaaagcacaacucuccucuaacccuccccucccccuucccuu

SEQ ID NO: 180324 - RNA, 64 nt, hsa
gauaaagauaaucuuaaagcugaggcaaugcucccuccucuaucucucucuguguaauuuacca

SEQ ID NO: 180325 - RNA, 64 nt, hsa
gaauucugcagcuagggauugugacuccuaaauccuccucuaaaagaaggcacuugccauuaau

SEQ ID NO: 180326 - RNA, 64 nt, hsa
gggggcaucaucaaaaacuuuggaguccccucaccuccucuaagguugggcagggugacccuga

SEQ ID NO: 180327 - RNA, 64 nt, hsa
uucuaccucaggcagcucaagcagcgaccgcccccuccucuagcugugggggugagggucccau

SEQ ID NO: 180328 - RNA, 64 nt, hsa
cauauguauacugguuuauggaacuuuauuuacacuccucuaucaugcaaaaaaauuuugacuu

SEQ ID NO: 180329 - RNA, 64 nt, hsa
ugaaaagagcaaucagaauugugcuuuuucuccccuccucuauuccuuuuagggaauaauauuc

SEQ ID NO: 180330 - RNA, 64 nt, hsa
ggaagacaaaacuucccuuuuguuuuacuccucacuccucuauuuuuguuuuacucacuucuuu

SEQ ID NO: 180331 - RNA, 64 nt, hsa
uuacuccucacuccuguauauuuugguuuacuuacuccucuauuucagaaauugaaaaagaucc

SEQ ID NO: 180332 - RNA, 64 nt, hsa
ggaagaagcgggcucugagccacgcccuuucacccuccucuaccccgcccugggcuggugaagg

SEQ ID NO: 180333 - RNA, 64 nt, hsa
uuauuugccuccuagucauaauaguaaaacucuacuccucuacuccgaggagucccuaccaccc

SEQ ID NO: 180334 - RNA, 64 nt, hsa
ccaaaggaaucauggauuagacccaagggcugagcuccucuagggcaggaccugcacccugugu

SEQ ID NO: 180335 - RNA, 64 nt, hsa
ugauuagucugcauuuuacuaguucacuggaucccuccucuaggggccuggggacuuucacuga

SEQ ID NO: 180336 - RNA, 64 nt, hsa
ccaggccaagggucuacaauucuccaacgaauagcuccucuacccaagauucuauggagguugg

SEQ ID NO: 180337 - RNA, 64 nt, hsa
ugucuuccucaacgacuucuuccucgacaucuuccuccucuacugguaaccaaggcaaucaggc

SEQ ID NO: 180338 - RNA, 64 nt, hsa
ugcuuuccauugccuggaaagagagcuuuuuucccuccucuauucaguguuucaaacuuugguc

SEQ ID NO: 180339 - RNA, 64 nt, hsa
aauguccugaaauccacuugucauuccuuaauuucuccucuaugcaauuaaagagaaaggggaa

SEQ ID NO: 180340 - RNA, 50 nt, hsa; identical to SEQ ID NO: 172653

SEQ ID NO: 180341 - RNA, 64 nt, hsa; identical to SEQ ID NO: 172654

SEQ ID NO: 180342 - RNA, 64 nt, hsa; identical to SEQ ID NO: 172655

SEQ ID NO: 180343 - RNA, 64 nt, hsa; identical to SEQ ID NO: 172656

SEQ ID NO: 180344 - RNA, 64 nt, hsa; identical to SEQ ID NO: 172657

SEQ ID NO: 180345 - RNA, 64 nt, hsa; identical to SEQ ID NO: 172658

SEQ ID NO: 180346 - RNA, 64 nt, hsa; identical to SEQ ID NO: 172659

SEQ ID NO: 180347 - RNA, 64 nt, hsa; identical to SEQ ID NO: 172660

SEQ ID NO: 180348 - RNA, 64 nt, hsa; identical to SEQ ID NO: 172661

SEQ ID NO: 180349 - RNA, 64 nt, hsa; identical to SEQ ID NO: 172662

SEQ ID NO: 180350 - RNA, 64 nt, hsa; identical to SEQ ID NO: 172663

SEQ ID NO: 180351 - RNA, 64 nt, hsa; identical to SEQ ID NO: 172664

SEQ ID NO: 180352 - RNA, 64 nt, hsa; identical to SEQ ID NO: 172665

SEQ ID NO: 180353 - RNA, 64 nt, hsa; identical to SEQ ID NO: 172666

SEQ ID NO: 180354 - RNA, 64 nt, hsa; identical to SEQ ID NO: 172667

SEQ ID NO: 180355 - RNA, 64 nt, hsa; identical to SEQ ID NO: 172668

SEQ ID NO: 180356 - RNA, 64 nt, hsa; identical to SEQ ID NO: 172669

SEQ ID NO: 180357 - RNA, 64 nt, hsa; identical to SEQ ID NO: 172670

SEQ ID NO: 180358 - RNA, 64 nt, hsa; identical to SEQ ID NO: 172671

SEQ ID NO: 180359 - RNA, 64 nt, hsa; identical to SEQ ID NO: 172672

SEQ ID NO: 180360 - RNA, 64 nt, hsa; identical to SEQ ID NO: 172673

SEQ ID NO: 180361 - RNA, 64 nt, hsa; identical to SEQ ID NO: 172674

SEQ ID NO: 180362 - RNA, 64 nt, hsa; identical to SEQ ID NO: 172675

SEQ ID NO: 180363 - RNA, 64 nt, hsa; identical to SEQ ID NO: 172676

SEQ ID NO: 180364 - RNA, 64 nt, hsa; identical to SEQ ID NO: 172677

SEQ ID NO: 180365 - RNA, 64 nt, hsa; identical to SEQ ID NO: 172678

SEQ ID NO: 180366 - RNA, 64 nt, hsa; identical to SEQ ID NO: 172679

SEQ ID NO: 180367 - RNA, 64 nt, hsa; identical to SEQ ID NO: 172680

SEQ ID NO: 180368 - RNA, 64 nt, hsa; identical to SEQ ID NO: 117070

SEQ ID NO: 180369 - RNA, 64 nt, hsa; identical to SEQ ID NO: 117071

SEQ ID NO: 180370 - RNA, 64 nt, hsa; identical to SEQ ID NO: 117072

SEQ ID NO: 180371 - RNA, 64 nt, hsa; identical to SEQ ID NO: 117073

SEQ ID NO: 180372 - RNA, 64 nt, hsa; identical to SEQ ID NO: 117074

SEQ ID NO: 180373 - RNA, 64 nt, hsa; identical to SEQ ID NO: 117075

SEQ ID NO: 180374 - RNA, 64 nt, hsa; identical to SEQ ID NO: 117076

SEQ ID NO: 180375 - RNA, 64 nt, hsa; identical to SEQ ID NO: 117077

SEQ ID NO: 180376 - RNA, 64 nt, hsa; identical to SEQ ID NO: 117078

SEQ ID NO: 180377 - RNA, 64 nt, hsa; identical to SEQ ID NO: 117079

SEQ ID NO: 180378 - RNA, 64 nt, hsa; identical to SEQ ID NO: 117080

SEQ ID NO: 180379 - RNA, 64 nt, hsa; identical to SEQ ID NO: 117081

SEQ ID NO: 180380 - RNA, 64 nt, hsa; identical to SEQ ID NO: 117082

SEQ ID NO: 180381 - RNA, 64 nt, hsa; identical to SEQ ID NO: 117083

SEQ ID NO: 180382 - RNA, 64 nt, hsa; identical to SEQ ID NO: 117084

SEQ ID NO: 180383 - RNA, 64 nt, hsa; identical to SEQ ID NO: 117085

SEQ ID NO: 180384 - RNA, 64 nt, hsa; identical to SEQ ID NO: 117086

SEQ ID NO: 180385 - RNA, 64 nt, hsa; identical to SEQ ID NO: 117087

SEQ ID NO: 180386 - RNA, 64 nt, hsa; identical to SEQ ID NO: 117088

SEQ ID NO: 180387 - RNA, 64 nt, hsa; identical to SEQ ID NO: 117089

SEQ ID NO: 180388 - RNA, 64 nt, hsa; identical to SEQ ID NO: 117090

SEQ ID NO: 180389 - RNA, 64 nt, hsa; identical to SEQ ID NO: 117091

SEQ ID NO: 180390 - RNA, 64 nt, hsa; identical to SEQ ID NO: 117092

SEQ ID NO: 180391 - RNA, 64 nt, hsa; identical to SEQ ID NO: 117093

SEQ ID NO: 180392 - RNA, 64 nt, hsa; identical to SEQ ID NO: 117094

SEQ ID NO: 180393 - RNA, 64 nt, hsa; identical to SEQ ID NO: 117095

SEQ ID NO: 180394 - RNA, 64 nt, hsa; identical to SEQ ID NO: 117096

SEQ ID NO: 180395 - RNA, 64 nt, hsa; identical to SEQ ID NO: 117097

SEQ ID NO: 180396 - RNA, 64 nt, hsa; identical to SEQ ID NO: 117098

SEQ ID NO: 180397 - RNA, 64 nt, hsa; identical to SEQ ID NO: 117099

SEQ ID NO: 180398 - RNA, 64 nt, hsa; identical to SEQ ID NO: 117100

SEQ ID NO: 180399 - RNA, 64 nt, hsa; identical to SEQ ID NO: 117101

SEQ ID NO: 180400 - RNA, 64 nt, hsa; identical to SEQ ID NO: 117102

SEQ ID NO: 180401 - RNA, 64 nt, hsa; identical to SEQ ID NO: 117103

SEQ ID NO: 180402 - RNA, 64 nt, hsa; identical to SEQ ID NO: 117104

SEQ ID NO: 180403 - RNA, 64 nt, hsa; identical to SEQ ID NO: 117105

SEQ ID NO: 180404 - RNA, 64 nt, hsa; identical to SEQ ID NO: 117106

SEQ ID NO: 180405 - RNA, 64 nt, hsa; identical to SEQ ID NO: 117107

SEQ ID NO: 180406 - RNA, 64 nt, hsa; identical to SEQ ID NO: 117108

SEQ ID NO: 180407 - RNA, 64 nt, hsa; identical to SEQ ID NO: 117109

SEQ ID NO: 180408 - RNA, 64 nt, hsa; identical to SEQ ID NO: 117110

SEQ ID NO: 180409 - RNA, 64 nt, hsa; identical to SEQ ID NO: 117111

SEQ ID NO: 180410 - RNA, 64 nt, hsa; identical to SEQ ID NO: 117112

SEQ ID NO: 180411 - RNA, 64 nt, hsa; identical to SEQ ID NO: 117113

SEQ ID NO: 180412 - RNA, 64 nt, hsa; identical to SEQ ID NO: 117114

SEQ ID NO: 180413 - RNA, 64 nt, hsa; identical to SEQ ID NO: 117115

SEQ ID NO: 180414 - RNA, 64 nt, hsa; identical to SEQ ID NO: 117116

SEQ ID NO: 180415 - RNA, 64 nt, hsa; identical to SEQ ID NO: 117117

SEQ ID NO: 180416 - RNA, 64 nt, hsa; identical to SEQ ID NO: 117118

SEQ ID NO: 180417 - RNA, 64 nt, hsa; identical to SEQ ID NO: 117119

SEQ ID NO: 180418 - RNA, 64 nt, hsa; identical to SEQ ID NO: 117120

SEQ ID NO: 180419 - RNA, 64 nt, hsa; identical to SEQ ID NO: 117121

SEQ ID NO: 180420 - RNA, 64 nt, hsa; identical to SEQ ID NO: 117122

SEQ ID NO: 180421 - RNA, 64 nt, hsa; identical to SEQ ID NO: 117123

SEQ ID NO: 180422 - RNA, 64 nt, hsa; identical to SEQ ID NO: 117124

SEQ ID NO: 180423 - RNA, 64 nt, hsa; identical to SEQ ID NO: 117125

SEQ ID NO: 180424 - RNA, 64 nt, hsa; identical to SEQ ID NO: 117126

SEQ ID NO: 180425 - RNA, 64 nt, hsa; identical to SEQ ID NO: 117127

SEQ ID NO: 180426 - RNA, 64 nt, hsa; identical to SEQ ID NO: 117128

SEQ ID NO: 180427 - RNA, 64 nt, hsa; identical to SEQ ID NO: 117129

SEQ ID NO: 180428 - RNA, 64 nt, hsa; identical to SEQ ID NO: 117130

SEQ ID NO: 180429 - RNA, 64 nt, hsa; identical to SEQ ID NO: 117131

SEQ ID NO: 180430 - RNA, 64 nt, hsa; identical to SEQ ID NO: 117132

SEQ ID NO: 180431 - RNA, 64 nt, hsa; identical to SEQ ID NO: 117133

SEQ ID NO: 180432 - RNA, 64 nt, hsa; identical to SEQ ID NO: 117134

SEQ ID NO: 180433 - RNA, 64 nt, hsa; identical to SEQ ID NO: 117135

SEQ ID NO: 180434 - RNA, 64 nt, hsa; identical to SEQ ID NO: 117136

SEQ ID NO: 180435 - RNA, 64 nt, hsa; identical to SEQ ID NO: 117137

SEQ ID NO: 180436 - RNA, 64 nt, hsa; identical to SEQ ID NO: 117138

SEQ ID NO: 180437 - RNA, 64 nt, hsa; identical to SEQ ID NO: 117139

SEQ ID NO: 180438 - RNA, 64 nt, hsa; identical to SEQ ID NO: 117140

SEQ ID NO: 180439 - RNA, 64 nt, hsa; identical to SEQ ID NO: 117141

SEQ ID NO: 180440 - RNA, 64 nt, hsa; identical to SEQ ID NO: 117142

SEQ ID NO: 180441 - RNA, 64 nt, hsa; identical to SEQ ID NO: 117143

SEQ ID NO: 180442 - RNA, 64 nt, hsa; identical to SEQ ID NO: 117144

SEQ ID NO: 180443 - RNA, 64 nt, hsa; identical to SEQ ID NO: 117145

SEQ ID NO: 180444 - RNA, 64 nt, hsa; identical to SEQ ID NO: 117146

SEQ ID NO: 180445 - RNA, 64 nt, hsa; identical to SEQ ID NO: 117147

SEQ ID NO: 180446 - RNA, 64 nt, hsa; identical to SEQ ID NO: 117148

SEQ ID NO: 180447 - RNA, 64 nt, hsa; identical to SEQ ID NO: 117149

SEQ ID NO: 180448 - RNA, 64 nt, hsa; identical to SEQ ID NO: 117150

SEQ ID NO: 180449 - RNA, 64 nt, hsa; identical to SEQ ID NO: 117151

SEQ ID NO: 180450 - RNA, 64 nt, hsa; identical to SEQ ID NO: 117152

SEQ ID NO: 180451 - RNA, 64 nt, hsa; identical to SEQ ID NO: 117153

SEQ ID NO: 180452 - RNA, 64 nt, hsa; identical to SEQ ID NO: 117154

SEQ ID NO: 180453 - RNA, 64 nt, hsa; identical to SEQ ID NO: 117155

SEQ ID NO: 180454 - RNA, 64 nt, hsa; identical to SEQ ID NO: 117156

SEQ ID NO: 180455 - RNA, 64 nt, hsa; identical to SEQ ID NO: 117157

SEQ ID NO: 180456 - RNA, 64 nt, hsa; identical to SEQ ID NO: 117158

SEQ ID NO: 180457 - RNA, 64 nt, hsa; identical to SEQ ID NO: 117159

SEQ ID NO: 180458 - RNA, 64 nt, hsa; identical to SEQ ID NO: 117160

SEQ ID NO: 180459 - RNA, 64 nt, hsa; identical to SEQ ID NO: 117161

SEQ ID NO: 180460 - RNA, 64 nt, hsa; identical to SEQ ID NO: 117162

SEQ ID NO: 180461 - RNA, 64 nt, hsa; identical to SEQ ID NO: 117163

SEQ ID NO: 180462 - RNA, 64 nt, hsa; identical to SEQ ID NO: 117164

SEQ ID NO: 180463 - RNA, 64 nt, hsa; identical to SEQ ID NO: 117165

SEQ ID NO: 180464 - RNA, 64 nt, hsa; identical to SEQ ID NO: 117166

SEQ ID NO: 180465 - RNA, 64 nt, hsa; identical to SEQ ID NO: 117167

SEQ ID NO: 180466 - RNA, 64 nt, hsa; identical to SEQ ID NO: 117168

SEQ ID NO: 180467 - RNA, 64 nt, hsa; identical to SEQ ID NO: 117169

SEQ ID NO: 180468 - RNA, 64 nt, hsa; identical to SEQ ID NO: 117170

SEQ ID NO: 180469 - RNA, 64 nt, hsa; identical to SEQ ID NO: 117171

SEQ ID NO: 180470 - RNA, 64 nt, hsa; identical to SEQ ID NO: 117172

SEQ ID NO: 180471 - RNA, 64 nt, hsa; identical to SEQ ID NO: 117173

SEQ ID NO: 180472 - RNA, 64 nt, hsa; identical to SEQ ID NO: 117174

SEQ ID NO: 180473 - RNA, 64 nt, hsa; identical to SEQ ID NO: 117175

SEQ ID NO: 180474 - RNA, 64 nt, hsa; identical to SEQ ID NO: 117176

SEQ ID NO: 180475 - RNA, 64 nt, hsa; identical to SEQ ID NO: 117177

SEQ ID NO: 180476 - RNA, 64 nt, hsa; identical to SEQ ID NO: 117178

SEQ ID NO: 180477 - RNA, 64 nt, hsa; identical to SEQ ID NO: 117179

SEQ ID NO: 180478 - RNA, 64 nt, hsa; identical to SEQ ID NO: 117180

SEQ ID NO: 180479 - RNA, 64 nt, hsa; identical to SEQ ID NO: 117181

SEQ ID NO: 180480 - RNA, 64 nt, hsa; identical to SEQ ID NO: 117182

SEQ ID NO: 180481 - RNA, 64 nt, hsa; identical to SEQ ID NO: 117183

SEQ ID NO: 180482 - RNA, 64 nt, hsa; identical to SEQ ID NO: 117184

SEQ ID NO: 180483 - RNA, 64 nt, hsa; identical to SEQ ID NO: 117185

SEQ ID NO: 180484 - RNA, 64 nt, hsa
ccaguggucucucuggguggguacuauaaugaguuauugugacccacagcugugugggaccaca

SEQ ID NO: 180485 - RNA, 64 nt, hsa
uuuauuucuacugugcuuuauugcuacuguucuuuauugugaauguuguaacauuuuaaaaaug

SEQ ID NO: 180486 - RNA, 64 nt, hsa
caaaugacucucaucaucaacaaauuguauuccuuauugugaaauuaauacccucaggcuccau

SEQ ID NO: 180487 - RNA, 64 nt, hsa
gaagacaggaauguaaaacuacuagaucauaugguauugugauuuucuuuccccugcuaggaaa

SEQ ID NO: 180488 - RNA, 64 nt, hsa
uaaauuugaauauaaauugaaacauaaaaaugaguauugugaacuuucuaggaaauauucauua

SEQ ID NO: 180489 - RNA, 64 nt, hsa
aauuuucagaucacuuucaaauugcccaaggaaauauugugauccuaagaauauuaagauaauu

SEQ ID NO: 180490 - RNA, 64 nt, hsa
auuaauguuaauuuaaaucuguaaauaauugcuuuauugugaugugauacagaacaaaguguuc

SEQ ID NO: 180491 - RNA, 64 nt, hsa
uucaacuuuuuucagguaauagaagugaauaauuuauugugaaauaauucauuuuauaaaugua

SEQ ID NO: 180492 - RNA, 64 nt, hsa
acaaucuuauuccagaagacuguuuuuaguagcuuauugugaaguaagacaacuauaaugaaug

SEQ ID NO: 180493 - RNA, 64 nt, hsa
uaacauauuccaaaaccagacccaucuuguugccuauugugauaaaauaaaaagacggcuguau

SEQ ID NO: 180494 - RNA, 64 nt, hsa
uuguuaugaugaguaugcaccuaccauuuuccuuuauugugaucacuaaaaugaggccaagguu

SEQ ID NO: 180495 - RNA, 64 nt, hsa
gcacuacaauguuuaucuuuuucuuuuugaacaauauugugaaaaugauugcauucucauugag

SEQ ID NO: 180496 - RNA, 64 nt, hsa
aauagagaauuuuauuuauuuuuaugccagcuuauauugugagaacacauuuagucaguuuggg

SEQ ID NO: 180497 - RNA, 64 nt, hsa
ccuuaaaccauuauuauguguacauuauuguugcuauugugauaauagagaauuuuauuuauuu

SEQ ID NO: 180498 - RNA, 64 nt, hsa
ugcugccaucaacuuuguaagauugcauucuauuuauugugaauaauuugaguguuuccacagg

SEQ ID NO: 180499 - RNA, 64 nt, hsa
ucuauugaaacaacaagugccucagagauguauauauugugaauuacugcuuaauuacggaaag

SEQ ID NO: 180500 - RNA, 64 nt, hsa
uuuuaauauaagaacacugaauuuuggcuugaaauauugugacuaaauugcacaaucucuggcu

SEQ ID NO: 180501 - RNA, 64 nt, hsa
ugaaugugucucuguaaacauagcuguuauuuauuauugugauguugggaccuuuagcccauag

SEQ ID NO: 180502 - RNA, 64 nt, hsa
uguugcaugcaaacacuucucuuuauucugcauuuauugugauuuuuggaaacagguaucaacc

SEQ ID NO: 180503 - RNA, 64 nt, hsa
uuugaagcucucuaauuugugguacgauauugcuuauugugacuuuggcauguauuuuugcuag

SEQ ID NO: 180504 - RNA, 64 nt, hsa
uuuauuucuuuggguguaaagcguuuuugcuuaguauugugauauuguauauguuuugucccag

SEQ ID NO: 180505 - RNA, 64 nt, hsa
ggaauguacuuuuaacaauucccaguacuaucaguauugugaaauaauuccucugaaagauaag

SEQ ID NO: 180506 - RNA, 64 nt, hsa; identical to SEQ ID NO: 104428

SEQ ID NO: 180507 - RNA, 64 nt, hsa; identical to SEQ ID NO: 104429

SEQ ID NO: 180508 - RNA, 64 nt, hsa; identical to SEQ ID NO: 104430

SEQ ID NO: 180509 - RNA, 64 nt, hsa; identical to SEQ ID NO: 104431

SEQ ID NO: 180510 - RNA, 64 nt, hsa; identical to SEQ ID NO: 104432

SEQ ID NO: 180511 - RNA, 64 nt, hsa; identical to SEQ ID NO: 104433

SEQ ID NO: 180512 - RNA, 64 nt, hsa; identical to SEQ ID NO: 104434

SEQ ID NO: 180513 - RNA, 64 nt, hsa; identical to SEQ ID NO: 104435

SEQ ID NO: 180514 - RNA, 64 nt, hsa; identical to SEQ ID NO: 104436

SEQ ID NO: 180515 - RNA, 64 nt, hsa; identical to SEQ ID NO: 104437

SEQ ID NO: 180516 - RNA, 64 nt, hsa; identical to SEQ ID NO: 104438

SEQ ID NO: 180517 - RNA, 64 nt, hsa; identical to SEQ ID NO: 104439

SEQ ID NO: 180518 - RNA, 64 nt, hsa; identical to SEQ ID NO: 104440

SEQ ID NO: 180519 - RNA, 64 nt, hsa; identical to SEQ ID NO: 104441

SEQ ID NO: 180520 - RNA, 64 nt, hsa; identical to SEQ ID NO: 104442

SEQ ID NO: 180521 - RNA, 64 nt, hsa; identical to SEQ ID NO: 104443

SEQ ID NO: 180522 - RNA, 64 nt, hsa; identical to SEQ ID NO: 104444

SEQ ID NO: 180523 - RNA, 64 nt, hsa; identical to SEQ ID NO: 104445

SEQ ID NO: 180524 - RNA, 64 nt, hsa; identical to SEQ ID NO: 104446

SEQ ID NO: 180525 - RNA, 64 nt, hsa; identical to SEQ ID NO: 104447

SEQ ID NO: 180526 - RNA, 64 nt, hsa; identical to SEQ ID NO: 104448

SEQ ID NO: 180527 - RNA, 64 nt, hsa; identical to SEQ ID NO: 104449

SEQ ID NO: 180528 - RNA, 64 nt, hsa; identical to SEQ ID NO: 104450

SEQ ID NO: 180529 - RNA, 64 nt, hsa; identical to SEQ ID NO: 104451

SEQ ID NO: 180530 - RNA, 64 nt, hsa
uuauaagcuugaguuuucuuccuaccauaucacucucauauaucagugaugaaaugucagauuu

SEQ ID NO: 180531 - RNA, 64 nt, hsa
aaauauugaaaacugaggcaguuaaccaaaguagcucauauaaauaauaaaaccaaucugaguu

SEQ ID NO: 180532 - RNA, 64 nt, hsa; identical to SEQ ID NO: 74460

SEQ ID NO: 180533 - RNA, 64 nt, hsa; identical to SEQ ID NO: 74461

SEQ ID NO: 180534 - RNA, 64 nt, hsa; identical to SEQ ID NO: 74462

SEQ ID NO: 180535 - RNA, 64 nt, hsa; identical to SEQ ID NO: 74463

SEQ ID NO: 180536 - RNA, 64 nt, hsa; identical to SEQ ID NO: 74464

SEQ ID NO: 180537 - RNA, 64 nt, hsa; identical to SEQ ID NO: 74465

SEQ ID NO: 180538 - RNA, 64 nt, hsa; identical to SEQ ID NO: 74466

SEQ ID NO: 180539 - RNA, 64 nt, hsa; identical to SEQ ID NO: 74467

SEQ ID NO: 180540 - RNA, 64 nt, hsa; identical to SEQ ID NO: 74468

SEQ ID NO: 180541 - RNA, 64 nt, hsa; identical to SEQ ID NO: 74469

SEQ ID NO: 180542 - RNA, 64 nt, hsa; identical to SEQ ID NO: 74470

SEQ ID NO: 180543 - RNA, 64 nt, hsa; identical to SEQ ID NO: 74471

SEQ ID NO: 180544 - RNA, 64 nt, hsa; identical to SEQ ID NO: 74472

SEQ ID NO: 180545 - RNA, 64 nt, hsa; identical to SEQ ID NO: 74473

SEQ ID NO: 180546 - RNA, 64 nt, hsa; identical to SEQ ID NO: 74474

SEQ ID NO: 180547 - RNA, 64 nt, hsa; identical to SEQ ID NO: 74475

SEQ ID NO: 180548 - RNA, 64 nt, hsa; identical to SEQ ID NO: 74476

SEQ ID NO: 180549 - RNA, 64 nt, hsa; identical to SEQ ID NO: 74477

SEQ ID NO: 180550 - RNA, 64 nt, hsa; identical to SEQ ID NO: 74478

SEQ ID NO: 180551 - RNA, 64 nt, hsa; identical to SEQ ID NO: 74479

SEQ ID NO: 180552 - RNA, 64 nt, hsa; identical to SEQ ID NO: 74480

SEQ ID NO: 180553 - RNA, 64 nt, hsa; identical to SEQ ID NO: 74481

SEQ ID NO: 180554 - RNA, 64 nt, hsa; identical to SEQ ID NO: 74482

SEQ ID NO: 180555 - RNA, 64 nt, hsa; identical to SEQ ID NO: 74483

SEQ ID NO: 180556 - RNA, 64 nt, hsa; identical to SEQ ID NO: 74484

SEQ ID NO: 180557 - RNA, 64 nt, hsa; identical to SEQ ID NO: 74485

SEQ ID NO: 180558 - RNA, 64 nt, hsa; identical to SEQ ID NO: 74486

SEQ ID NO: 180559 - RNA, 64 nt, hsa; identical to SEQ ID NO: 74487

SEQ ID NO: 180560 - RNA, 64 nt, hsa; identical to SEQ ID NO: 74488

SEQ ID NO: 180561 - RNA, 64 nt, hsa; identical to SEQ ID NO: 74489

SEQ ID NO: 180562 - RNA, 64 nt, hsa; identical to SEQ ID NO: 74490

SEQ ID NO: 180563 - RNA, 64 nt, hsa; identical to SEQ ID NO: 74491

SEQ ID NO: 180564 - RNA, 64 nt, hsa; identical to SEQ ID NO: 74492

SEQ ID NO: 180565 - RNA, 64 nt, hsa; identical to SEQ ID NO: 74493

SEQ ID NO: 180566 - RNA, 64 nt, hsa; identical to SEQ ID NO: 74494

SEQ ID NO: 180567 - RNA, 64 nt, hsa; identical to SEQ ID NO: 74495

SEQ ID NO: 180568 - RNA, 64 nt, hsa; identical to SEQ ID NO: 74496

SEQ ID NO: 180569 - RNA, 64 nt, hsa; identical to SEQ ID NO: 74497

SEQ ID NO: 180570 - RNA, 64 nt, hsa; identical to SEQ ID NO: 74498

SEQ ID NO: 180571 - RNA, 64 nt, hsa; identical to SEQ ID NO: 74499

SEQ ID NO: 180572 - RNA, 61 nt, hsa; identical to SEQ ID NO: 74500

SEQ ID NO: 180573 - RNA, 64 nt, hsa; identical to SEQ ID NO: 74501

SEQ ID NO: 180574 - RNA, 64 nt, hsa; identical to SEQ ID NO: 74502

SEQ ID NO: 180575 - RNA, 64 nt, hsa; identical to SEQ ID NO: 74503

SEQ ID NO: 180576 - RNA, 64 nt, hsa; identical to SEQ ID NO: 74504

SEQ ID NO: 180577 - RNA, 64 nt, hsa; identical to SEQ ID NO: 74505

SEQ ID NO: 180578 - RNA, 64 nt, hsa; identical to SEQ ID NO: 74506

SEQ ID NO: 180579 - RNA, 64 nt, hsa; identical to SEQ ID NO: 74507

SEQ ID NO: 180580 - RNA, 64 nt, hsa; identical to SEQ ID NO: 74508

SEQ ID NO: 180581 - RNA, 64 nt, hsa; identical to SEQ ID NO: 74509

SEQ ID NO: 180582 - RNA, 64 nt, hsa; identical to SEQ ID NO: 74510

SEQ ID NO: 180583 - RNA, 64 nt, hsa; identical to SEQ ID NO: 74511

SEQ ID NO: 180584 - RNA, 64 nt, hsa
uuuuauugcauuacuucaaaauccuaauuuugucucuacugauaugucuuauuaacaucugaaa

SEQ ID NO: 180585 - RNA, 64 nt, hsa
gagaaaaaaaaguaguuuguaaacucauuugugaucuacugaaaagagguuauauuaaagcaaa

SEQ ID NO: 180586 - RNA, 64 nt, hsa
cuaucacuucccacaaugaggcugaguguuuguuucuacugaucaaugccccugcagguugcau

SEQ ID NO: 180587 - RNA, 64 nt, hsa
cauacuaacugguuuggaugccuggguugugacuucuacugaccgcuagauaaacgugugccug

SEQ ID NO: 180588 - RNA, 64 nt, hsa
acugacucugcuaugugauuuaucaggguuuucaucuacugacuucuuucucauuagguaggcu

SEQ ID NO: 180589 - RNA, 64 nt, hsa
gagucugacaacauauucaaaauauuuuucagccucuacugauaguggauaacaaauauauuug

SEQ ID NO: 180590 - RNA, 64 nt, hsa
cucugaaguaaacauauuuacaauccaaagcaauucuacugacagaaguguugccuucauaauc

SEQ ID NO: 180591 - RNA, 64 nt, hsa
agaacugaaccuuguaggaaauuccaagggccuuucuacugaaucuggugaugggguggggccg

SEQ ID NO: 180592 - RNA, 64 nt, hsa
aagaccagccuagccaacaugacgaaaccccaucucuacugaaaauagaaaaaaaaaauuagcc

SEQ ID NO: 180593 - RNA, 64 nt, hsa
aaacaaugauuguauggguacucaaaguauaauuucuacugaaugcauaucacuugugcacugu

SEQ ID NO: 180594 - RNA, 64 nt, hsa
gauuuuuuuuuaaaucaggaagcugguuacuggcucuacugagaguuggagcccugauguucug

SEQ ID NO: 180595 - RNA, 64 nt, hsa
aagaccauccuggcuaacauggugaaaccccgucucuacugaaaauacaaaaaauuagccgggu

SEQ ID NO: 180596 - RNA, 64 nt, hsa
aauuguguuggcuucaggccuuugguauucugucucuacugaauaaauacaaaugguuccagcc

SEQ ID NO: 180597 - RNA, 64 nt, hsa
ucucacuugaauucuggcauuauuuuuaguggccucuacugauaauaccuacccuagaguacau

SEQ ID NO: 180598 - RNA, 64 nt, hsa
aguaggcaagggaaucuguuuacucccucuucccucuacugaauaauuuucccucuacugaaua

SEQ ID NO: 180599 - RNA, 64 nt, hsa
uuacucccucuucccucuacugaauaauuuucccucuacugaauaauuuucccucuaagaauug

SEQ ID NO: 180600 - RNA, 64 nt, hsa; identical to SEQ ID NO: 104428

SEQ ID NO: 180601 - RNA, 64 nt, hsa; identical to SEQ ID NO: 104429

SEQ ID NO: 180602 - RNA, 64 nt, hsa; identical to SEQ ID NO: 104430

SEQ ID NO: 180603 - RNA, 64 nt, hsa; identical to SEQ ID NO: 104431

SEQ ID NO: 180604 - RNA, 64 nt, hsa; identical to SEQ ID NO: 104432

SEQ ID NO: 180605 - RNA, 64 nt, hsa; identical to SEQ ID NO: 104433

SEQ ID NO: 180606 - RNA, 64 nt, hsa; identical to SEQ ID NO: 104434

SEQ ID NO: 180607 - RNA, 64 nt, hsa; identical to SEQ ID NO: 104435

SEQ ID NO: 180608 - RNA, 64 nt, hsa; identical to SEQ ID NO: 104436

SEQ ID NO: 180609 - RNA, 64 nt, hsa; identical to SEQ ID NO: 104437

SEQ ID NO: 180610 - RNA, 64 nt, hsa; identical to SEQ ID NO: 104438

SEQ ID NO: 180611 - RNA, 64 nt, hsa; identical to SEQ ID NO: 104439

SEQ ID NO: 180612 - RNA, 64 nt, hsa; identical to SEQ ID NO: 104440

SEQ ID NO: 180613 - RNA, 64 nt, hsa; identical to SEQ ID NO: 104441

SEQ ID NO: 180614 - RNA, 64 nt, hsa; identical to SEQ ID NO: 104442

SEQ ID NO: 180615 - RNA, 64 nt, hsa; identical to SEQ ID NO: 104443

SEQ ID NO: 180616 - RNA, 64 nt, hsa; identical to SEQ ID NO: 104444

SEQ ID NO: 180617 - RNA, 64 nt, hsa; identical to SEQ ID NO: 104445

SEQ ID NO: 180618 - RNA, 64 nt, hsa; identical to SEQ ID NO: 104446

SEQ ID NO: 180619 - RNA, 64 nt, hsa; identical to SEQ ID NO: 104447

SEQ ID NO: 180620 - RNA, 64 nt, hsa; identical to SEQ ID NO: 104448

SEQ ID NO: 180621 - RNA, 64 nt, hsa; identical to SEQ ID NO: 104449

SEQ ID NO: 180622 - RNA, 64 nt, hsa; identical to SEQ ID NO: 104450

SEQ ID NO: 180623 - RNA, 64 nt, hsa; identical to SEQ ID NO: 104451

SEQ ID NO: 180624 - RNA, 64 nt, hsa
cuucuugcugcuuagugucuguacuagaggguaagggaaucaaaggagacauaaaccaaaauag

SEQ ID NO: 180625 - RNA, 64 nt, hsa
cagaucugaauuuaagaacauuuccuuuuucugugggaaucacaagaguuuauccacuaaaaaa

SEQ ID NO: 180626 - RNA, 64 nt, hsa
gucagacaccaagguuuaugccaccagguaacacgggaaucacagguacaugucgcuccgguca

SEQ ID NO: 180627 - RNA, 64 nt, hsa
aagagcuauuuaaugacacaccuuggauuaaaacgggaaucacaucuuaaagcuaaaaaugaac

SEQ ID NO: 180628 - RNA, 64 nt, hsa
ccaggacacauuauuguucugauagaugcucacagggaaucaagcuucucgcccacuccacggc

SEQ ID NO: 180629 - RNA, 64 nt, hsa
aggaucuccugggccuuggagcaccucacgcugggggaaucaaucccugagggacucagaaucu

SEQ ID NO: 180630 - RNA, 64 nt, hsa
aaacccagauuccuguguacagaugcuauuuagagggaaucagaaaaaugccaagccuuuucuc

SEQ ID NO: 180631 - RNA, 64 nt, hsa
gauuuuuaaaacuuuuuuggaguaggggguauaggggaaucauuuaauuuaaaucauuaagauu

SEQ ID NO: 180632 - RNA, 64 nt, hsa
gaauaugugcaguuuucaacauuuuggcacaugaaagccugacaaguuuuuaaaagggcagaag

SEQ ID NO: 180633 - RNA, 64 nt, hsa
aaaugacaacuuuaaaaaggcaauuauaaauaaaaagccugauuauuuuaggccaguuuaccaa

SEQ ID NO: 180634 - RNA, 64 nt, hsa
uuucucauuuaguaaaaguugucuaauugauaugaagccugacugauuuuuuuuuuccuuacag

SEQ ID NO: 180635 - RNA, 64 nt, hsa
aaaucaaagcugccccugagaagagacuuaauccaagccugauuguacuaguggcaucacuuag

SEQ ID NO: 180636 - RNA, 53 nt, hsa
acuaucugcaguaccagugagccaagccugaugggcagcacagacacagacac

SEQ ID NO: 180637 - RNA, 64 nt, hsa
agggggaaaauugccucugaauaaugaaugaugaaagccugacgccgugccccuccuggcccau

SEQ ID NO: 180638 - RNA, 64 nt, hsa
augauuuuaauaauucucacuuaacuaauuuuguaagccugagaucaauaagaaauguucagga

SEQ ID NO: 180639 - RNA, 64 nt, hsa
uuugaaauuuuuuuuuuguuuguuuguuuaaaucaagccugaggcuggugaacaguagcuacac

SEQ ID NO: 180640 - RNA, 64 nt, hsa
gcugggacauggugggcaucagggacuuugugcuaagccugaugaaaugugcuccuucaaucuc

SEQ ID NO: 180641 - RNA, 64 nt, hsa
ucagacuuuguuuuuugaaaucgauugggaucgaaagccugaaauaaauauucauacuuuccau

SEQ ID NO: 180642 - RNA, 64 nt, hsa
auuuccgaaaaguagucuucucugaggcugggccaagccugagggaaauggggcccuaggaggg

SEQ ID NO: 180643 - RNA, 64 nt, hsa
gccuggaggcuucagaggugaauuuaugcuugggaagccugaucccaaaccugaagggaaggga

SEQ ID NO: 180644 - RNA, 64 nt, hsa
uccuacuaauuuaaacuaagacaguuuaaaaaggaagccugaaaaagacucauacuacaaauaa

SEQ ID NO: 180645 - RNA, 64 nt, hsa
ugugguccuuggccgccuccugcuccugcucugcaagccugaaacuggcuugucuggagccagg

SEQ ID NO: 180646 - RNA, 64 nt, hsa; identical to SEQ ID NO: 138555

SEQ ID NO: 180647 - RNA, 64 nt, hsa; identical to SEQ ID NO: 138556

SEQ ID NO: 180648 - RNA, 64 nt, hsa; identical to SEQ ID NO: 138557

SEQ ID NO: 180649 - RNA, 64 nt, hsa; identical to SEQ ID NO: 138558

SEQ ID NO: 180650 - RNA, 64 nt, hsa; identical to SEQ ID NO: 138559

SEQ ID NO: 180651 - RNA, 64 nt, hsa; identical to SEQ ID NO: 138560

SEQ ID NO: 180652 - RNA, 64 nt, hsa; identical to SEQ ID NO: 138561

SEQ ID NO: 180653 - RNA, 64 nt, hsa; identical to SEQ ID NO: 138562

SEQ ID NO: 180654 - RNA, 64 nt, hsa; identical to SEQ ID NO: 138563

SEQ ID NO: 180655 - RNA, 64 nt, hsa; identical to SEQ ID NO: 138564

SEQ ID NO: 180656 - RNA, 64 nt, hsa; identical to SEQ ID NO: 138565

SEQ ID NO: 180657 - RNA, 64 nt, hsa; identical to SEQ ID NO: 138566

SEQ ID NO: 180658 - RNA, 64 nt, hsa; identical to SEQ ID NO: 138567

SEQ ID NO: 180659 - RNA, 64 nt, hsa; identical to SEQ ID NO: 138568

SEQ ID NO: 180660 - RNA, 64 nt, hsa; identical to SEQ ID NO: 138569

SEQ ID NO: 180661 - RNA, 64 nt, hsa; identical to SEQ ID NO: 138570

SEQ ID NO: 180662 - RNA, 64 nt, hsa; identical to SEQ ID NO: 138571

SEQ ID NO: 180663 - RNA, 64 nt, hsa; identical to SEQ ID NO: 138572

SEQ ID NO: 180664 - RNA, 55 nt, hsa; identical to SEQ ID NO: 138573

SEQ ID NO: 180665 - RNA, 64 nt, hsa; identical to SEQ ID NO: 138574

SEQ ID NO: 180666 - RNA, 64 nt, hsa; identical to SEQ ID NO: 138575

SEQ ID NO: 180667 - RNA, 64 nt, hsa; identical to SEQ ID NO: 138576

SEQ ID NO: 180668 - RNA, 64 nt, hsa; identical to SEQ ID NO: 138577

SEQ ID NO: 180669 - RNA, 64 nt, hsa; identical to SEQ ID NO: 138578

SEQ ID NO: 180670 - RNA, 64 nt, hsa; identical to SEQ ID NO: 138579

SEQ ID NO: 180671 - RNA, 64 nt, hsa; identical to SEQ ID NO: 138580

SEQ ID NO: 180672 - RNA, 64 nt, hsa; identical to SEQ ID NO: 138581

SEQ ID NO: 180673 - RNA, 64 nt, hsa; identical to SEQ ID NO: 138582

SEQ ID NO: 180674 - RNA, 64 nt, hsa; identical to SEQ ID NO: 138583

SEQ ID NO: 180675 - RNA, 64 nt, hsa; identical to SEQ ID NO: 138584

SEQ ID NO: 180676 - RNA, 64 nt, hsa
agcuuuggugggcagcagcagcucaugaauggcaagcugacagcuucuccugcuguuuccuucc

SEQ ID NO: 180677 - RNA, 64 nt, hsa
ugaguggguacggccagccacucagcccauuggcagcugacaacgcagacacgcucuacggagg

SEQ ID NO: 180678 - RNA, 64 nt, hsa
aucaaagucauaguagguaaaugcuuuaugggacagcugacaccuuuuagacccuaccagguau

SEQ ID NO: 180679 - RNA, 64 nt, hsa
aagaucaggcugaaacugcagucagauuuaugacagcugacaguuuuucagaggucgcacacag

SEQ ID NO: 180680 - RNA, 64 nt, hsa
cauggcaucaccuccaccauacuccaucaguuagagcugacacaaaccugccuggguuuaaggg

SEQ ID NO: 180681 - RNA, 64 nt, hsa
uugaggcuuagcuuugcucugccaacuucuucagagcugacacaggaugaaggcaaugccaucc

SEQ ID NO: 180682 - RNA, 64 nt, hsa
gguguucccagccccaccagagccccgugccgggagcugacagcuuucacgcuuaaggcacgug

SEQ ID NO: 180683 - RNA, 64 nt, hsa
ugcccacaucugcugguuuggggcuucaguggggagcugacagcugugagcacaccacuguccc

SEQ ID NO: 180684 - RNA, 64 nt, hsa
cguccaguuguggcagcucuccagaaguaauagcagcugacaacuuucugugccuuuuccuuuc

SEQ ID NO: 180685 - RNA, 64 nt, hsa
uucuuccugagugccaugggaugcuacaccuugaagcugacagucaucaacaggggagcuaaag

SEQ ID NO: 180686 - RNA, 64 nt, hsa
cacgugggcccaccccgggcagcagagaaggcccagcugacagggggugaggugugggucuggg

SEQ ID NO: 180687 - RNA, 64 nt, hsa
cgugugagccagaaaccagggcuucccuacccccagcugacacuggaccccaacauguaugcuc

SEQ ID NO: 180688 - RNA, 64 nt, hsa
cuguguaaauaugucuuuauaauaaacaguuaaaagcugacaguucgcccuuacucuuggaggu

SEQ ID NO: 180689 - RNA, 64 nt, hsa
gagguuguuuuugccaagaaucacagaauguuagagcugacaggacccuugaaggucacuuagc

SEQ ID NO: 180690 - RNA, 60 nt, hsa
auuaacauaaaauaccagaaacaaacuuuaucucccuauucuuacauuuagugcaaauug

SEQ ID NO: 180691 - RNA, 60 nt, hsa
gucuuuauauuuuaucuucauccuaaauuuucucccuaucaaaacagcaggaaauuuuua

SEQ ID NO: 180692 - RNA, 60 nt, hsa
cucucaaaacagcagaacaaugaaacauacucucccuacacuugcuuagccaagagauac

SEQ ID NO: 180693 - RNA, 60 nt, hsa
gagaggcaguagagucaggcugcaguggaaucucccuaggaugccaaaguggcauuaugu

SEQ ID NO: 180694 - RNA, 60 nt, hsa
aucauuauuuugauauccauuacccucaccucucccuaguucauaaauaggucuauagca

SEQ ID NO: 180695 - RNA, 60 nt, hsa
agccagggacacuguguggaguucgcacacucucccuaugucuccgggugcuccaguuuc

SEQ ID NO: 180696 - RNA, 60 nt, hsa
ccaacccuaccaugcuccaucauacucaggucucccuacuccugccuuagauuccucaau

SEQ ID NO: 180697 - RNA, 60 nt, hsa
ccucaacuauugacugcugcagacagcuuaucucccuaacccugaaaugcugugagcuug

SEQ ID NO: 180698 - RNA, 60 nt, hsa
caucugucucuugcuaccuaagccugugccucucccuaaagagcugccucccugcugccg

SEQ ID NO: 180699 - RNA, 60 nt, hsa
uugagagaggcugugaccaccccccauccuucucccuacacucccagccaaccuagugcc

SEQ ID NO: 180700 - RNA, 64 nt, hsa
cuacucuuuauuucauggagucguaucaacgcuaugaacgcaaggcugugauauggaaccagaa

SEQ ID NO: 180701 - RNA, 64 nt, hsa
gggauuacaggcaugagccagcaugccuggccugugaacgcagaauucuuauaagguguuuaga

SEQ ID NO: 180702 - RNA, 64 nt, hsa
aaccauacuucgacauuuccucugccacaaaaaaugaacgcauuuuaaguuaggagucaugaau

SEQ ID NO: 180703 - RNA, 64 nt, hsa
gggaaugagccucagggaggagugagcaccuaaaugaacgcaguaaaccuucauggaccaacag

SEQ ID NO: 180704 - RNA, 64 nt, hsa
cuugucacugggaaagaagccuguuucagcugccugaacgcaguuuggaugucuuugaggacag

SEQ ID NO: 180705 - RNA, 64 nt, hsa
aaucuaguuaccaccagcuuggcuagaauuuuauugaacgcaacuugcuaguuaugacagagag

SEQ ID NO: 180706 - RNA, 64 nt, hsa
gcccgcccgcccgcauagcacuugcagaccugccugaacgcacaugacauagcacuugccgauc

SEQ ID NO: 180707 - RNA, 64 nt, hsa
aggcucgaccacagaauaaugccagucaccacccugaacgcacaaucuccagugcaggaucuaa

SEQ ID NO: 180708 - RNA, 64 nt, hsa
gaguccugggucccuggccuccaaagcuggaaugugaacgcaugccacgguggucugacccuca

SEQ ID NO: 180709 - RNA, 64 nt, hsa
caacuacucagaaggccgaggcaggagaauuacuugaacgcaggagaaucacugcagcccagga

SEQ ID NO: 180710 - RNA, 64 nt, hsa
aagcacacaaauuggugacagaauuucaauuacgugaacgcauccucuuugcuaggucaaaaaa

SEQ ID NO: 180711 - RNA, 64 nt, hsa
uuauuguagagaaaaaaaaauauguguacacauaugaacgcacaacaugcacauucauccucac

SEQ ID NO: 180712 - RNA, 64 nt, hsa
ucuagggugugggcugaguucuucuguaaagagaugaacgcaaugccaauaaaauugaacaaga

SEQ ID NO: 180713 - RNA, 64 nt, hsa
aaaguguuucugggaggucaggagggcuggcagcugaacgcacuugcagcguccgagggccacc

SEQ ID NO: 180714 - RNA, 64 nt, hsa
acccucaaauuaaaacuagaacuauagauccacaugaacgcacgccugagauuuggccacucac

SEQ ID NO: 180715 - RNA, 64 nt, hsa
acuguguacgagagcgugguuguggugcuguaugugaacgcaugcaagcuugauucaccuucag

SEQ ID NO: 180716 - RNA, 64 nt, hsa
agaaccaggagcuucagauccuaagucaagugggugaacgcagugcccuugggagggccgaggc

SEQ ID NO: 180717 - RNA, 64 nt, hsa
gaaggcgggacagagcccaccugucuuugcuaccugaacgcaccacccucuggccuaggcuggc

SEQ ID NO: 180718 - RNA, 64 nt, hsa
uguuacugacugccuaaaaucacuuaaucucaggugaacgcaucacuugccaaacuguuggaau

SEQ ID NO: 180719 - RNA, 64 nt, hsa
uagaacagacugaauuaauaaaugagaagcgacaugaacgcagccuuaauucuucugagucuuu

SEQ ID NO: 180720 - RNA, 64 nt, hsa
cauucugaccaugagacgcggcuugcagugggggugaacgcacauaaaaagggaccacugacgu

SEQ ID NO: 180721 - RNA, 64 nt, hsa
uugccuuaaaggcaagagggaaggucaccaucagugaacgcaaugcaaucucaacaguguauug

SEQ ID NO: 180722 - RNA, 64 nt, hsa
uuugggaucguccugugcgagaucaucgggcgggugaacgcagacccugacuaccugccccgca

SEQ ID NO: 180723 - RNA, 64 nt, hsa
aaagaaagaacugucucuaccagggucaagagcaugaacgcaucaauagaaagaacucggggaa

SEQ ID NO: 180724 - RNA, 64 nt, hsa
ugugauaugcacguggccgacaugcugguuaaggugaacgcacuuaucaaggaucgggaagguu

SEQ ID NO: 180725 - RNA, 64 nt, hsa
gacacauuuguagucauuguaucacggauuacaaugaacgcagugcagagccccaaagcucagg

SEQ ID NO: 180726 - RNA, 64 nt, hsa
uuggugcuagauucugcaggaaaccccagcagugugaacgcaucccaacauagguuaagagcaa

SEQ ID NO: 180727 - RNA, 64 nt, hsa
ccaugugagaaagagagaguuucagcgucauccuugaacgcaggauccgggaccuucagaccca

SEQ ID NO: 180728 - RNA, 64 nt, hsa
uuaccaaaacuuaugcuaaauauacuuuccaguaugaacgcacaggagagucccaucagcaggc

SEQ ID NO: 180729 - RNA, 64 nt, hsa
gcccugcccucucuucucuggacccuuuuacaacugaacgcaucugggcuucgugguuuccugu

SEQ ID NO: 180730 - RNA, 64 nt, hsa
cauugguuuuuuucuacuugugugucugggggaaugaacgcacagaucuguuugacuuuguuau

SEQ ID NO: 180731 - RNA, 64 nt, hsa
aguccguuuauggaggcaauuccauauccuuucuugaacgcacauucagcuuaccccagagagc

SEQ ID NO: 180732 - RNA, 64 nt, hsa
uuugagaaaaacuaaaucaugcuccugaaccuucugaacgcauuuguuauugaaggaaagacac

SEQ ID NO: 180733 - RNA, 64 nt, hsa
ggggugcuaugacaugcaagugagaagcugggcaugaacgcacuuuauaaaagcaaaagcucug

SEQ ID NO: 180734 - RNA, 64 nt, hsa
uuaaagaaaucccuaaaaaaaaaaauuauccaauugaacgcacauagcucaaucacacuggaaa

SEQ ID NO: 180735 - RNA, 64 nt, hsa
uucauaagcuaauaccacuguagggauuuuguuuugaacgcauauugacagcacgcuuuacuua

SEQ ID NO: 180736 - RNA, 64 nt, hsa
ccgcgugaacugggaugcaaguugcuaaccgaugugaacgcaaaaugccuuguucauuauuccu

SEQ ID NO: 180737 - RNA, 64 nt, hsa
cugcagcuguguagucuuuggaagagguagccccugaacgcagagccuaagagaagcaagucgg

SEQ ID NO: 180738 - RNA, 64 nt, hsa
ugaacaacuugguaacaucccuagacuccacucaugaacgcagaauuauuaccugcuguuugcu

SEQ ID NO: 180739 - RNA, 64 nt, hsa
ggcccaucaacuguauugggccuuuuggauaugcugaacgcagaagaaaggguggaaaucaacc

SEQ ID NO: 180740 - RNA, 64 nt, hsa
uuugauagaacaguuuugaggaacauuucauucuugaacgcagcaucugacaugguucucagca

SEQ ID NO: 180741 - RNA, 64 nt, hsa
aaggcugacucugagaaccaagcccggaaguacaugaacgcaguacgaaagcggaaggggcuuu

SEQ ID NO: 180742 - RNA, 64 nt, hsa
gcaugcauaugcaugugcaugugugugagcuccuugaacgcacggagcaaaauaaaauuuucuu

SEQ ID NO: 180743 - RNA, 64 nt, hsa
gaccuggggccaaaaauaaagugagccagcgucaugaacgcaugcuauuuagggacacaccugg

SEQ ID NO: 180744 - RNA, 64 nt, hsa
gaguggaccugugcugugaguguguggaugcgugugaacgcaugugguaagguguguacucagg

SEQ ID NO: 180745 - RNA, 64 nt, hsa
uucugcccuucccagcaccuugugcccuugccagugaacgcaggguuugccauugcuaccaagc

SEQ ID NO: 180746 - RNA, 64 nt, hsa
ccagcuuggagaacaccucagaauucagaagauaugaacgcauugggaacaauucuauuuugga

SEQ ID NO: 180747 - RNA, 64 nt, hsa
cagcuacucaggaggcugaggugggaggaugacuugaacgcaggaggcugaggcugcagugagu

SEQ ID NO: 180748 - RNA, 64 nt, hsa
gacaaggcgggagguucgggggccuuccggcaggugaacgcagggcuggagaguauuuggugcc

SEQ ID NO: 180749 - RNA, 64 nt, hsa
agacccucagaacuugaccuggaaguccagacacugaacgcaggccucaaaacugcugcggccu

SEQ ID NO: 180750 - RNA, 64 nt, hsa
ggaaagcaugguggugcccugggccgucccugugugaacgcaggcaaaagcagcccaguccccc

SEQ ID NO: 180751 - RNA, 59 nt, hsa
agaggauccacaacaguugaagagccuuuugaacgcaguagcccgcucguaucuauggu

SEQ ID NO: 180752 - RNA, 64 nt, hsa
gccacaugugcuuuucugccgggaaucccuggggugaacgcauguuuuaugggcguuuccagga

SEQ ID NO: 180753 - RNA, 64 nt, hsa
augucgaggcuaccugcagauaugacaggugccuugaacgcagcccaucuucaugucaucaaag

SEQ ID NO: 180754 - RNA, 64 nt, hsa
gugcauucuugagcuuuuucugcuaagcacaaaaugaacgcaaagcuaaaugcauauuuuuaag

SEQ ID NO: 180755 - RNA, 64 nt, hsa
gccucgcucgagagaagcagaugagggaggaggcugaacgcacgagggaugaguuggagaggag

SEQ ID NO: 180756 - RNA, 64 nt, hsa
gcucuuuagaaaaagcagucuuugugcuuguggcugaacgcaucacccuggacucugcuagugu

SEQ ID NO: 180757 - RNA, 64 nt, hsa
aacuuccaaucuuacuuugucucuuggagauuguugaacgcagcuugucuaggaaggggauggg

SEQ ID NO: 180758 - RNA, 64 nt, hsa
augugaaaugauuugaugauuugggaaauaagauugaacgcaauuuacuuguuugaauuugcug

SEQ ID NO: 180759 - RNA, 64 nt, hsa; identical to SEQ ID NO: 138795

SEQ ID NO: 180760 - RNA, 64 nt, hsa; identical to SEQ ID NO: 138796

SEQ ID NO: 180761 - RNA, 64 nt, hsa; identical to SEQ ID NO: 138797

SEQ ID NO: 180762 - RNA, 64 nt, hsa; identical to SEQ ID NO: 138798

SEQ ID NO: 180763 - RNA, 64 nt, hsa; identical to SEQ ID NO: 138799

SEQ ID NO: 180764 - RNA, 64 nt, hsa; identical to SEQ ID NO: 138800

SEQ ID NO: 180765 - RNA, 64 nt, hsa; identical to SEQ ID NO: 138801

SEQ ID NO: 180766 - RNA, 64 nt, hsa; identical to SEQ ID NO: 138802

SEQ ID NO: 180767 - RNA, 64 nt, hsa; identical to SEQ ID NO: 138803

SEQ ID NO: 180768 - RNA, 64 nt, hsa; identical to SEQ ID NO: 138804

SEQ ID NO: 180769 - RNA, 64 nt, hsa; identical to SEQ ID NO: 138805

SEQ ID NO: 180770 - RNA, 64 nt, hsa; identical to SEQ ID NO: 138806

SEQ ID NO: 180771 - RNA, 64 nt, hsa; identical to SEQ ID NO: 138807

SEQ ID NO: 180772 - RNA, 64 nt, hsa; identical to SEQ ID NO: 138808

SEQ ID NO: 180773 - RNA, 64 nt, hsa
ccccagcaaggaucuucccacuuccugcucccuguguucccacccuccaguguuggcacaggcc

SEQ ID NO: 180774 - RNA, 64 nt, hsa
gcacauccuguuguguuuaagucaccagauauuuuguucccaucaguuuagcccagagauagac

SEQ ID NO: 180775 - RNA, 64 nt, hsa
uaacuccaggccuugcuuuuauuagugaguguccuguucccagugcccgguuauuuaugauuaa

SEQ ID NO: 180776 - RNA, 64 nt, hsa
uggauuuucaguaaccaacuuggaaagcuguauuuguucccaugauucagcaaacaaugaguac

SEQ ID NO: 180777 - RNA, 64 nt, hsa
caguucauagucaugauagugaguauucuuacacuguucccaguauuacagggaaugcuuagaa

SEQ ID NO: 180778 - RNA, 64 nt, hsa
guggagauuucuaaaauauucuaugugugauuucuguucccaacuagguucuaagugccaucaa

SEQ ID NO: 180779 - RNA, 64 nt, hsa
gacugagcaagcgcuucaggaggacugugcugguuguucccagaccaaagagagucacuuuuga

SEQ ID NO: 180780 - RNA, 64 nt, hsa
ccuaaagauuuuaccucccagcuuugguuguauguguucccaaguggugaggugagauuguggc

SEQ ID NO: 180781 - RNA, 64 nt, hsa
acaauuaugggauacucuagucuacuuauacuuguguucccaucugucugccauccucugaagg

SEQ ID NO: 180782 - RNA, 64 nt, hsa
caaucuaaguucugccacaaguacccguggugucuguucccacaacaauggcccuuucacaagc

SEQ ID NO: 180783 - RNA, 64 nt, hsa
auuagcagguuucuugcaaagacuuuccucucuuuguucccagggcagagaguuucugugaguc

SEQ ID NO: 180784 - RNA, 64 nt, hsa
uucagauggaacccccaaccaccuccacccuguuuguucccacaugugucucccaagccugcua

SEQ ID NO: 180785 - RNA, 64 nt, hsa
ccaaguggaaaaauacuuucccgccccccuccccuguucccacuuccucaucuggcacuaugca

SEQ ID NO: 180786 - RNA, 64 nt, hsa
cccucuccugcgagacccaggggcuuuucccuacuguucccacgcuuccucucucucgaggcca

SEQ ID NO: 180787 - RNA, 64 nt, hsa
aagacugaggcaggccaggggucugccaguaacauguucccauguacagacacgguccccacac

SEQ ID NO: 180788 - RNA, 64 nt, hsa
gucagugcuucugggcccagcuaaggaagccaucuguucccagcagaggagagcugcugcgcug

SEQ ID NO: 180789 - RNA, 64 nt, hsa
aggccccuggaggucaagcuuggccuuugccuccuguucccaucccccagcccuggcuccuagg

SEQ ID NO: 180790 - RNA, 64 nt, hsa
gaggugcagggccuucucugaccccugccugagcuguucccagggcuggagcagguguacccug

SEQ ID NO: 180791 - RNA, 64 nt, hsa
guuugcuaaggauaauggucuccaguucuaccgauguucccacaaaagacauaaucuucuuuuu

SEQ ID NO: 180792 - RNA, 64 nt, hsa
acuuauaagugaggacaugcaguauuugguuuucuguucccauguuugcuaaggauaauggucu

SEQ ID NO: 180793 - RNA, 64 nt, hsa
cuaggcaaguucucugaggcagaaggggguucccuguucccagagucugcagccaucagcaagg

SEQ ID NO: 180794 - RNA, 64 nt, hsa
uggccucgaccagcuuagagguuucucacaccucuguucccagggccccgcucagggcccagca

SEQ ID NO: 180795 - RNA, 64 nt, hsa
cucauugccuguuuauggccagauuuggggggccuguucccagcacauuuuccuguaagcacuc

SEQ ID NO: 180796 - RNA, 64 nt, hsa
auuguuaaaaagaugcuccuccaagguucucuucuguucccauggauccugcagagcaugucag

SEQ ID NO: 180797 - RNA, 64 nt, hsa
ugccuaguuagugugguuggcaaauuuaggagcuuguucccauugccaaauggauuuagaaauu

SEQ ID NO: 180798 - RNA, 64 nt, hsa
augaagaggacucauaaguaaauuccuaacauuuuguucccauuaccagaagcaaagcugcugc

SEQ ID NO: 180799 - RNA, 64 nt, hsa
guugcuauccucuugcuggggauagcaaccacugguuugcaaccacuggguugcuauccuuuug

SEQ ID NO: 180800 - RNA, 64 nt, hsa
uugggugcugacuucagggacaggaaaaagcaagguuugcaaagagugaaacuaguguauauuc

SEQ ID NO: 180801 - RNA, 64 nt, hsa
uuuaugagauauuccuguauccauaccccagcuuguuugcaauuuauaaaccuccccuucaaaa

SEQ ID NO: 180802 - RNA, 64 nt, hsa
gauuauaaaaaauguuuuccauuugaacuuuacaguuugcaaaagugcuuuuauacauuuucua

SEQ ID NO: 180803 - RNA, 64 nt, hsa
gcuacagccaaauggcaucucacuuuuuaaagacguuugcaauuauuaguugauucacaguaca

SEQ ID NO: 180804 - RNA, 64 nt, hsa
agacacuucccugcauuaacugcacaaacaauauguuugcaaacuuguuagaucaaccuccaac

SEQ ID NO: 180805 - RNA, 64 nt, hsa
ugggaggaaaacucaguaagaauuauauuagucuguuugcaaaguagaaaaagauucucaucac

SEQ ID NO: 180806 - RNA, 64 nt, hsa
aaacccaugccuuacauuuacacagcacuuuguaguuugcaaauugguguguuuucagcccccu

SEQ ID NO: 180807 - RNA, 64 nt, hsa
ugacauaaagugcccuuccaccuauuuuucuuugguuugcaacaccagccuguagacuuccagu

SEQ ID NO: 180808 - RNA, 64 nt, hsa
uuuaaaaucuuccuacacacaucuagacguucaaguuugcaaaucaguuuuuagcaagaaaaca

SEQ ID NO: 180809 - RNA, 64 nt, hsa
ggguaacaugacucuuguuggauuguuauuuuuuguuugcaauggggaauuuauaagaagcauc

SEQ ID NO: 180810 - RNA, 64 nt, hsa
aacaguauaugccaaucacugagacugcaucagaguuugcaauuuuguauguuucauugccaaa

SEQ ID NO: 180811 - RNA, 64 nt, hsa
cugaccaguacauuuuauaaccauccaggccuugguuugcaagcaacagaccuuaaacauacag

SEQ ID NO: 180812 - RNA, 64 nt, hsa
gguucaugaggucucuuaucaaaaauauuacucaguuugcaagacugcauuguaacuuuaacau

SEQ ID NO: 180813 - RNA, 64 nt, hsa
cuauagauauucauauaaaacaagugcacgugaaguuugcaaaaugcuuuaaggccuuccuuuc

SEQ ID NO: 180814 - RNA, 64 nt, hsa; identical to SEQ ID NO: 172311

SEQ ID NO: 180815 - RNA, 64 nt, hsa; identical to SEQ ID NO: 172312

SEQ ID NO: 180816 - RNA, 64 nt, hsa; identical to SEQ ID NO: 172313

SEQ ID NO: 180817 - RNA, 64 nt, hsa; identical to SEQ ID NO: 172314

SEQ ID NO: 180818 - RNA, 64 nt, hsa; identical to SEQ ID NO: 172315

SEQ ID NO: 180819 - RNA, 64 nt, hsa; identical to SEQ ID NO: 172316

SEQ ID NO: 180820 - RNA, 64 nt, hsa; identical to SEQ ID NO: 172317

SEQ ID NO: 180821 - RNA, 64 nt, hsa; identical to SEQ ID NO: 172318

SEQ ID NO: 180822 - RNA, 64 nt, hsa
aaugagaguuccuuugcuuuaaccauuccuggaugccugcaaaguaaggaauaaugcaguuuuu

SEQ ID NO: 180823 - RNA, 64 nt, hsa
auauaacuugaauaucugguacuaguuuuuucacgccugcaaucuuggagucuagguugccuug

SEQ ID NO: 180824 - RNA, 64 nt, hsa
cuuccccgaggcccacucggccuggccuuccucugccugcaagugagcagggaugggcugggga

SEQ ID NO: 180825 - RNA, 64 nt, hsa
auuuccucugggcaggacucucuggccuucuguggccugcaaugccaggccaugugccccucug

SEQ ID NO: 180826 - RNA, 64 nt, hsa
gaaggaccuugcacugccuaccgagcucccucaugccugcaauuuaaauaccgagguguguucu

SEQ ID NO: 180827 - RNA, 64 nt, hsa
ccagcauauggaugcccuccccuuggagggcccagccugcaaaccccaucugauaccacacaug

SEQ ID NO: 180828 - RNA, 64 nt, hsa
ugauacuauccaguuacugccgguuugaaaauaugccugcaaucugagccagugcuuuaauggc

SEQ ID NO: 180829 - RNA, 60 nt, hsa
gucgaagagcaucccaguaaugguuguccugccugcaauauuugaauuuuaaaucuaaau

SEQ ID NO: 180830 - RNA, 64 nt, hsa
aacacgccugcaaacgcugccugcccguaaacacgccugcaaacgcugccugcccacacagguu

SEQ ID NO: 180831 - RNA, 64 nt, hsa
aacacgccugcaaacgcugccugccgguaaacacgccugcaaacgcugccugcccguaaacacg

SEQ ID NO: 180832 - RNA, 64 nt, hsa
ggucucacauggugcuacgccugcauguaaacacgccugcaaacgcugccugccgguaaacacg

SEQ ID NO: 180833 - RNA, 64 nt, hsa
agccauuucuuguugugccccuuuccaagauacagccugcaagugguagcaagaagugauuaga

SEQ ID NO: 180834 - RNA, 64 nt, hsa
gcuucaguuuuacucugcugcaaaaugaaggcgggccugcaagccgacuacaccuacggaggcu

SEQ ID NO: 180835 - RNA, 64 nt, hsa
uuugcuuuuagugcuggcccucucuguggguguggccugcaaaggaaccaacagacccuaugcu

SEQ ID NO: 180836 - RNA, 64 nt, hsa
ggcuccagcccaaugccccagcuggccuuccccagccugcaaggagccuguagcauggcaaauc

SEQ ID NO: 180837 - RNA, 64 nt, hsa
gaaguggaccuugacuuccucuuccuucugauucugccugaauagcugagagguuccagcaaaa

SEQ ID NO: 180838 - RNA, 64 nt, hsa
cuuccuccccagcucacgcugcuguauucugugcugccugaacugaagaaauaaaauccagaau

SEQ ID NO: 180839 - RNA, 64 nt, hsa
acauaggaacaagggggaaagucucuuacugaagugccugaaacccaaagcuagagcuucuaga

SEQ ID NO: 180840 - RNA, 64 nt, hsa
ucauaagccaggaaaugaaacaaaggaaaacaggugccugaauuuccuggggaaacauggcuug

SEQ ID NO: 180841 - RNA, 64 nt, hsa
ggaaauacaucagaucugcaacacagaaaugcucugccugaaauuuccaccaugccuaggacuc

SEQ ID NO: 180842 - RNA, 64 nt, hsa
accauauucuguugacagccagcucacaguuucuugccugaagcuuggugcacccuccagugag

SEQ ID NO: 180843 - RNA, 64 nt, hsa
agaaaaccagguuucuucuccccauaccacguugugccugaagaacaagccuucccguccuugc

SEQ ID NO: 180844 - RNA, 64 nt, hsa
agagaaucaaagccuugucacauggauccucuggugccugaagaaaugagauuuuauuaucccu

SEQ ID NO: 180845 - RNA, 64 nt, hsa
cugaaugacagacaaucuuauguagcaaagauuaugccugaaaaggaaaauuauucagggcagc

SEQ ID NO: 180846 - RNA, 64 nt, hsa
gaaaaauuucuauucuuuuuuuugcauccaauugugccugaacuuuuaaaauauguaaaugcug

SEQ ID NO: 180847 - RNA, 64 nt, hsa
uagccaugguuucauucuuaucaguccaacccuuugccugaaacauugaaucuuguuaaaccac

SEQ ID NO: 180848 - RNA, 64 nt, hsa
gcccagccgucaccagacaacagaauaaucaaucugccugaaaaucccuccuccuuguccuaca

SEQ ID NO: 180849 - RNA, 64 nt, hsa
aggucuguauuucuauuugaugucacuuuccuuuugccugaaggacuuuuucugcuggugauaa

SEQ ID NO: 180850 - RNA, 64 nt, hsa
ugcuggugauaaacucuuucaguguuuguauauaugccugaaaaaguauuuugccuucauuuuu

SEQ ID NO: 180851 - RNA, 64 nt, hsa
ucauuuaauuuguucaucugagaauuuuuuuuuuugccugaaaacccauuaaaagaaaacgugc

SEQ ID NO: 180852 - RNA, 64 nt, hsa
augaauggacuuuaacaauuguuguuacaaacugugccugaaucuuauuauuuaaaucacuuca

SEQ ID NO: 180853 - RNA, 64 nt, hsa; identical to SEQ ID NO: 147168

SEQ ID NO: 180854 - RNA, 64 nt, hsa; identical to SEQ ID NO: 147169

SEQ ID NO: 180855 - RNA, 64 nt, hsa; identical to SEQ ID NO: 147170

SEQ ID NO: 180856 - RNA, 64 nt, hsa; identical to SEQ ID NO: 147171

SEQ ID NO: 180857 - RNA, 64 nt, hsa; identical to SEQ ID NO: 147172

SEQ ID NO: 180858 - RNA, 64 nt, hsa; identical to SEQ ID NO: 147173

SEQ ID NO: 180859 - RNA, 64 nt, hsa; identical to SEQ ID NO: 147174

SEQ ID NO: 180860 - RNA, 64 nt, hsa; identical to SEQ ID NO: 147175

SEQ ID NO: 180861 - RNA, 64 nt, hsa; identical to SEQ ID NO: 147176

SEQ ID NO: 180862 - RNA, 64 nt, hsa; identical to SEQ ID NO: 147177

SEQ ID NO: 180863 - RNA, 64 nt, hsa; identical to SEQ ID NO: 147178

SEQ ID NO: 180864 - RNA, 64 nt, hsa; identical to SEQ ID NO: 147179

SEQ ID NO: 180865 - RNA, 64 nt, hsa
cauaagucugauucuauuucuaugacuuugaauuuagaaucacuuaaagcuuuuauaaagaauc

SEQ ID NO: 180866 - RNA, 64 nt, hsa
uaugaaagcucuaaauuuaaaauaaauuuagagauagaaucaugguacauuauuguuucaguau

SEQ ID NO: 180867 - RNA, 64 nt, hsa
cuaguuaugcuccuuuauauuauaaguaagggaauagaaucaauaagacaguuucugcccaaag

SEQ ID NO: 180868 - RNA, 64 nt, hsa
auugguuuuguuuucaauuuuuauucacucuucauagaaucacaauuaccuuuauauaucauau

SEQ ID NO: 180869 - RNA, 64 nt, hsa
gaagaggcaauucauuaaacucucaaauuuucuauagaaucaagauagaaccuuuagauacucc

SEQ ID NO: 180870 - RNA, 64 nt, hsa
aaacucagucuuccaacugcaauaaaauacuggguagaaucaaaugggaaagggguuggguggg

SEQ ID NO: 180871 - RNA, 64 nt, hsa
cauuuacuauuuaaaugagacaaucauauuauuuuagaaucauuuauuuuaaaugagacaauca

SEQ ID NO: 180872 - RNA, 64 nt, hsa
uucuuuggugaggcaagaaggauauacauuauuuuagaaucauuuacuauuuaaaugagacaau

SEQ ID NO: 180873 - RNA, 64 nt, hsa
uccugguuucugaguaaaggcaggcuguuaucuuuagaaucaagcuaucacagggagauaggca

SEQ ID NO: 180874 - RNA, 64 nt, hsa
cuaaauucuugcugcccucauacuuuuuauguauuagaaucauauucguauugcccuuuuaaaa

SEQ ID NO: 180875 - RNA, 64 nt, hsa
auuuuguuuuuaaauuaugcaccuucugauaacccccaaauacagaaauguucuacaucucuga

SEQ ID NO: 180876 - RNA, 64 nt, hsa
uuaaaaucaaagugcagauugcuuguauguaaaacccaaauaaagguagaguaagugugauaua

SEQ ID NO: 180877 - RNA, 64 nt, hsa
uuagcacacaguuaaauuauauuuacauccuagacccaaauaaauaggauuguguguauauuug

SEQ ID NO: 180878 - RNA, 64 nt, hsa
acaguuguuucacaauuauuauguagauaugaugcccaaauaucauuuuuaguauaucuugucg

SEQ ID NO: 180879 - RNA, 64 nt, hsa
uccauggagucacaggcacacuaugacuucugcucccaaauacauaugaccauauguaaauacc

SEQ ID NO: 180880 - RNA, 64 nt, hsa
auuaaaaacacaugaaaugaauaacaaaacaagacccaaauagaguuuauuuuauucucagagu

SEQ ID NO: 180881 - RNA, 64 nt, hsa
uuccucucuuguccccuagucccuggauguuucucccaaauaaauuuguguguaaacuguuugg

SEQ ID NO: 180882 - RNA, 64 nt, hsa
ugucaauugggaacccccucaaccacuuccauuccccaaauaccugcgcugcuaccgaugccuc

SEQ ID NO: 180883 - RNA, 64 nt, hsa
gcucuaacuugaagccacauccuacagauggcagcccaaauagcacaugggcaauuggcaccau

SEQ ID NO: 180884 - RNA, 64 nt, hsa
acgaaaaacuuugccucugaugcucagccccacccccaaauagcacacaagcuuguuaacccca

SEQ ID NO: 180885 - RNA, 64 nt, hsa
uaagauguaguucauguuuuucuguagcacugggcccaaauauucuuuguaaagaaaaucgcug

SEQ ID NO: 180886 - RNA, 64 nt, hsa
ugcugggauuacaggcgugagccaccaugcccggcccaaauauuuuuuauucaggaugguauaa

SEQ ID NO: 180887 - RNA, 64 nt, hsa
guguccacuguuuaauuccagagaauuuuuaucacccaaauaagaaacaaagcaccaauuagca

SEQ ID NO: 180888 - RNA, 64 nt, hsa
uuuucauguaauguuaagaguuaaacuuaucuuucccaaauauaacuuuauuauuagcuuggga

SEQ ID NO: 180889 - RNA, 64 nt, hsa; identical to SEQ ID NO: 87044

SEQ ID NO: 180890 - RNA, 64 nt, hsa; identical to SEQ ID NO: 87045

SEQ ID NO: 180891 - RNA, 64 nt, hsa
gccagauggggccucuguuucggagacgggaccgggccgcuagaugggcauggggugggccucu

SEQ ID NO: 180892 - RNA, 64 nt, hsa
gaugucgaaaucuuuauuccugguuaggaaggugggccgcuacccuucuuucccuuuagaaaac

SEQ ID NO: 180893 - RNA, 64 nt, hsa
caaguggaaacuaggagcagggaguugcuuggguggccgcuaacaccaggcuacucuuauuuua

SEQ ID NO: 180894 - RNA, 64 nt, hsa
aauucacccgaagcgcuucugcaccaacucaccuggccgcuaaguugcugauggguaguaccug

SEQ ID NO: 180895 - RNA, 64 nt, hsa
aguucugggauuaaaugcgugagccaccaugcccggccgcuauugcucuuuuuaacuucauuug

SEQ ID NO: 180896 - RNA, 60 nt, hsa
agcucagccucugccugugacccgccgcccggccgcuagacugacuucgcgcagcggugg

SEQ ID NO: 180897 - RNA, 64 nt, hsa
gcuguugccaugucaucugacuguggccccaucuggccgcuagcacgcuuccugcucagagcag

SEQ ID NO: 180898 - RNA, 64 nt, hsa
aguccaguggaccacagagggcccaaucccucuuggccgcuaaggcuaagguaggagccagaga

SEQ ID NO: 180899 - RNA, 64 nt, hsa
gguggcuggcugcaagugugacgggggcaccuucggccgcuacugcgagggcuccgaggaugcc

SEQ ID NO: 180900 - RNA, 64 nt, hsa
uggccuaggacauuaggauuccuuccacggcuccggccgcuaggacccugccaggucccgcgca

SEQ ID NO: 180901 - RNA, 64 nt, hsa
ucccgugugucaccagugccacaaggucauccggggccgcuaccugguggcgcugggccacgcg

SEQ ID NO: 180902 - RNA, 64 nt, hsa
acgagcccugccuuggcuguggagaagcacuccaggccgcuagcagaugggacuggcauuccag

SEQ ID NO: 180903 - RNA, 64 nt, hsa
aaacuuuauucggaaccuuccuuugcuguucuggggccgcuauuguaaaagccugggcucccuc

SEQ ID NO: 180904 - RNA, 64 nt, hsa
uaccuguucagugucccgggcccguugaggaugaggccgcuagaggccugaggaugagcuggaa

SEQ ID NO: 180905 - RNA, 64 nt, hsa
accccuccugcgcugccccagagccugggaaggaggccgcuaugcaggguagcacugggaacag

SEQ ID NO: 180906 - RNA, 64 nt, hsa
gucagaugcaaucugugggccgccccucuccccuggccgcuaagcagccuccauugauuuccgc

SEQ ID NO: 180907 - RNA, 64 nt, hsa
auuggagagagcagugacugcgagagaugguggaggccgcuaagcaugguagaggcuagaggaa

SEQ ID NO: 180908 - RNA, 64 nt, hsa
gugcuuccacguuuucugcuucgagugcgugcggggccgcuaugaggcccgccagaggaagugc

SEQ ID NO: 180909 - RNA, 64 nt, hsa
uaggggugcagggucagugcugaggccugggcagggccgcuagccucccugagcuuucuggcuu

SEQ ID NO: 180910 - RNA, 64 nt, hsa
cucucccaggucucagcucuggguggggagcaguggccgcuaccgacagcgcaugucccgcucu

SEQ ID NO: 180911 - RNA, 64 nt, hsa
uguuuccaggcuuccugugugauccuggcccuccggccgcuagagagaggauugggaaacccca

SEQ ID NO: 180912 - RNA, 64 nt, hsa
cucugugccgcggagguccaggaggaaacggggcggccgcuaggccucaagucccgaccgugga

SEQ ID NO: 180913 - RNA, 64 nt, hsa
auccacuugucugugucugggaagggauggccaaggccgcuaggguccuuaccccucaggauca

SEQ ID NO: 180914 - RNA, 65 nt, hsa
aaaugacacugaguugggcaaaacccaggacaucuccuggcuaagccucugcuuccguacuaugg

SEQ ID NO: 180915 - RNA, 65 nt, hsa
gugggcagaucauaaggucgggagauuaagaccauccuggcuaacacggugaaaccccgucucua

SEQ ID NO: 180916 - RNA, 65 nt, hsa
acacuccuaagcaguauuauuuuaaaauccuuuacccuggcuaccuccccuacccggguuccccu

SEQ ID NO: 180917 - RNA, 65 nt, hsa
ggagaagugucagacacuagagagccccuucugguccuggcuagggcaaauuuuagacaacuauu

SEQ ID NO: 180918 - RNA, 65 nt, hsa
cugcugaggucgcuguggagcacccucgcuccucuccuggcuacuagcucuggcccugcaccuac

SEQ ID NO: 180919 - RNA, 65 nt, hsa
ugagagcucuuguuauucagagcuccaagacuagaccuggcuaacaaacauaggagacaaaguua

SEQ ID NO: 180920 - RNA, 65 nt, hsa
ucucaaguagcugggacuacaggugcaccaccacaccuggcuaauuuuuguauuuuuuguaaaga

SEQ ID NO: 180921 - RNA, 65 nt, hsa
cugaguagcugugauuacaggcaugcgccaccaugccuggcuaauuucauauuuuuuaguagaga

SEQ ID NO: 180922 - RNA, 65 nt, hsa
aucagaaugaacuguguaccugauuuguucucugaccuggcuagguagggagggggugguuaucg

SEQ ID NO: 180923 - RNA, 65 nt, hsa
gcuacaaagucccacgucccuguccucagugugacccuggcuagugguaaggcugccgacucaag

SEQ ID NO: 180924 - RNA, 65 nt, hsa
acucuaguagauuuugaauccugccucugccauuuccuggcuaugaggugucuugagaaauuuac

SEQ ID NO: 180925 - RNA, 65 nt, hsa
gccccaagcuucccucggagaagugagaggcucucccuggcuagauccucaucucaauagcaccu

SEQ ID NO: 180926 - RNA, 65 nt, hsa
caggcaaucaccugaggucaggaguucaagaccagccuggcuaacaugugaaacuaauaauaaua

SEQ ID NO: 180927 - RNA, 65 nt, hsa
ugucaguguucuaaguuucaggcauuuuuauuuuuccuggcuaaacguuggugaaaguuauaacc

SEQ ID NO: 180928 - RNA, 65 nt, hsa
aggagaagcacaugguugcccuuuuguccuugcucccuggcuagggaaagcugcuaguggucagc

SEQ ID NO: 180929 - RNA, 65 nt, hsa
uugucacaacccucuguuucucuuugacuaagugcccuggcuacaggaauuacacaguucucuuu

SEQ ID NO: 180930 - RNA, 65 nt, hsa
gaggcgggcggaucacgaggucagaucaagaacauccuggcuaacacggugaaacuccaucucua

SEQ ID NO: 180931 - RNA, 65 nt, hsa
cugaguagcugggacuacaggugugcaccaccacaccuggcuaauucuucuuaaaauuuuuuugu

SEQ ID NO: 180932 - RNA, 65 nt, hsa
guaaggauggacuggauauuaccaucauccaccauccuggcuaccagauggaaccuucucuucuu

SEQ ID NO: 180933 - RNA, 65 nt, hsa
cucccuuccugcuaauguguaaaauacauacuugcccuggcuaccucaccgggcuguuauugcug

SEQ ID NO: 180934 - RNA, 65 nt, hsa
uggcgugcuguugcaaaguuuucacgucauuguuuccuggcuaguucauuucauuaaguggcuac

SEQ ID NO: 180935 - RNA, 65 nt, hsa
ccccauagcugggacuaggggugcaugccagcauaccuggcuacguugacucuuaaaaucuaugu

SEQ ID NO: 180936 - RNA, 65 nt, hsa
guggacagaucacgaggucaggaguucgagaccauccuggcuaacacggugaaacccaaucucua

SEQ ID NO: 180937 - RNA, 65 nt, hsa
augagaacugccaggugacgcccucgcugcuccuaccuggcuacuaaacaucgacuucgguucac

SEQ ID NO: 180938 - RNA, 65 nt, hsa
acccagaggaaggaggcacugcugaauggcuauggccuggcuaagaaggugauuagucaguaggg

SEQ ID NO: 180939 - RNA, 65 nt, hsa
cacggguggcaggaauucagaggcuggccuugugcccuggcuaccugucuccauucuaaccugac

SEQ ID NO: 180940 - RNA, 65 nt, hsa
uuuugagauuuugagccauggaacuuacuuguucaccuggcuaagaacucauggccacuguggaa

SEQ ID NO: 180941 - RNA, 65 nt, hsa
ccgaguagcugggauuacaggcgugugucaccacgccuggcuaauuuuuuuguauuuuuaguaga

SEQ ID NO: 180942 - RNA, 65 nt, hsa
aguuuugaucauauuuucuauuaaaguggcuaacaccuggcuacucuuacuguacgaggcuuugu

SEQ ID NO: 180943 - RNA, 65 nt, hsa
ucugcaccguccaguugguggguaacagcuggaccccuggcuaccccgagacccaggaggcgcuc

SEQ ID NO: 180944 - RNA, 65 nt, hsa
gcggguggaucacgaggucaggagaucgagaccauccuggcuaacacagugaaacguguuuuuac

SEQ ID NO: 180945 - RNA, 65 nt, hsa
gggggcggaucgugaagucaggagaucgagaccauccuggcuaacauggugaaacccugucucua

SEQ ID NO: 180946 - RNA, 65 nt, hsa
cugaguaccugggauuacaggugccugccaccacgccuggcuaauuuuuguauuuuuaguagaga

SEQ ID NO: 180947 - RNA, 65 nt, hsa
gcaggcggcucacgaggucaggagaucgagacuauccuggcuaacacgguaaaacccugucucua

SEQ ID NO: 180948 - RNA, 65 nt, hsa
ucccaauaaaggaauggggacccagaggcugggucccuggcuaccuuguuaugagguuuuguuau

SEQ ID NO: 180949 - RNA, 65 nt, hsa
ccaaguagcugggauuacaggcacccgccaccacaccuggcuaauuuuuuuguauuuuuaguaga

SEQ ID NO: 180950 - RNA, 65 nt, hsa
ccgaguagcugggguuacaggcaugcaccaccaugccuggcuaauuuucuguauuuuuaguagag

SEQ ID NO: 180951 - RNA, 65 nt, hsa
ucgaguagcugggauuauaggcguccgccaccaugccuggcuaauuuuuuuguguguuuuuagua

SEQ ID NO: 180952 - RNA, 65 nt, hsa
aaagagagaccaagaucagagggguucauuauaccccuggcuagagaacccagcuacugacaugc

SEQ ID NO: 180953 - RNA, 65 nt, hsa
ccgaguagggaggaccacaggugugagccaccacaccuggcuaauuuuuacuuuuuuuuuuuuuu

SEQ ID NO: 180954 - RNA, 65 nt, hsa
uucuaggguaugggaaauccaaucagagaccaggcccuggcuaagacccaaacauaugcacauuc

SEQ ID NO: 180955 - RNA, 65 nt, hsa
ccagguagcugggauuacaggcaugugccacaacgccuggcuaauuuuguauuuuuaguagagac

SEQ ID NO: 180956 - RNA, 65 nt, hsa
gcggguggaucaugaggucaggagaucgagaccauccuggcuaacaaggugaaaccccgucucua

SEQ ID NO: 180957 - RNA, 65 nt, hsa
auccuaccaccuacugcuaccuuccuuagcuucacccuggcuagaaauaaucacgaggguugggu

SEQ ID NO: 180958 - RNA, 65 nt, hsa
ggacagaaaauuauaaauuauaaauaugacuuuauccuggcuauaaaauuauugaaccaaaauga

SEQ ID NO: 180959 - RNA, 65 nt, hsa
acggguggaucacgaggucaggagaucgagaccauccuggcuaacacggugaaaccccgucucua

SEQ ID NO: 180960 - RNA, 65 nt, hsa
ccgaguaccugggacuauaugugcgcaccaccacgccuggcuaauuuuuuguauuuuuaguagag

SEQ ID NO: 180961 - RNA, 65 nt, hsa
cagaugaucaccugaggucaggaguucuagaccagccuggcuaacauggugaaacccuguaucug

SEQ ID NO: 180962 - RNA, 65 nt, hsa
ccgaguagcuaggauuacagaugugcaucaccaugccuggcuaauuuuuguauuuuuuaguagag

SEQ ID NO: 180963 - RNA, 65 nt, hsa
uugcagugagccgagaucacgccacugcacuccagccuggcuacagggcgagacucugucucaaa

SEQ ID NO: 180964 - RNA, 65 nt, hsa
cuccugcacagccccguccucuuccuuucugcuagccuggcuaaaucugcucauuauuucagagg

SEQ ID NO: 180965 - RNA, 65 nt, hsa
guuauagcaaugcacagauacuacaauuccagaauccuggcuaugacccagaacacuguccagau

SEQ ID NO: 180966 - RNA, 65 nt, hsa
ggcauaucaacuugaggccaggaguuaaagagcagccuggcuaacauggugaaaccccaucucua

SEQ ID NO: 180967 - RNA, 65 nt, hsa
cugacuccccccaucccugccacgcuguggcccugccuggcuagucccugccugaauaaaguaau

SEQ ID NO: 180968 - RNA, 65 nt, hsa
cugaguagcugggauuacgggugcgugccaccaugccuggcuaauuuuuguguuuuuaguagaga

SEQ ID NO: 180969 - RNA, 65 nt, hsa
ugcuuacagccgggcuucuggagcaccagcugcagccuggcuacugcuuuuuacugcagaaugaa

SEQ ID NO: 180970 - RNA, 65 nt, hsa
cugacuuuuccuaaugcuuaccugaaggaacccauccuggcuagaaagggugaugguacuggacc

SEQ ID NO: 180971 - RNA, 65 nt, hsa
cuugaagccaauucaguaggugcauuggaaucaagccuggcuaccugcaugcuguuccuuuucuu

SEQ ID NO: 180972 - RNA, 65 nt, hsa
ccaaguagcugggacuacaggcgccugccagcacgccuggcuaauuuuuuguauuuuuaguagag

SEQ ID NO: 180973 - RNA, 65 nt, hsa
cugaggugggcggcucacgaggagaucaagaccauccuggcuaacacagugaaaccccgucucca

SEQ ID NO: 180974 - RNA, 65 nt, hsa
cccgaguagcugggacugcaggcaccgccaccacgccuggcuaauuuuuuguauuuuuaguagag

SEQ ID NO: 180975 - RNA, 65 nt, hsa
aaauaaaaguauauacaacuuuuaaaaagugcaacccuggcuaaauuccacuccuuugguuaaua

SEQ ID NO: 180976 - RNA, 65 nt, hsa
gcaggcggaucacgaggucaggagaucgagaccauccuggcuaacacggugaaaccccgucucua

SEQ ID NO: 180977 - RNA, 65 nt, hsa
aaccacaugccuuuaaaacuaaacuguaauaauuaccuggcuaauuucagcuaagccuucaucau

SEQ ID NO: 180978 - RNA, 65 nt, hsa
ccaacuagcugggauuacaggcacaagccaccaugccuggcuaaaauucuuuuguauuuuuacua

SEQ ID NO: 180979 - RNA, 65 nt, hsa
ccuaguagcugggacuacagguaugcaccaccaugccuggcuaauuuuuuguauuuuuuguagag

SEQ ID NO: 180980 - RNA, 65 nt, hsa
ccgaguagcugggacuacaggugugugccacuaugccuggcuaauuuuuguauuuuuuguagaga

SEQ ID NO: 180981 - RNA, 65 nt, hsa
gcgggcggaucacgaggucaggagaucgagaccauccuggcuaacacggugaaaccccaucucua

SEQ ID NO: 180982 - RNA, 65 nt, hsa
gaauguagcccucuccaaaucaaggaucuuuuggaccuggcuaauggaguguuugaaaacugaca

SEQ ID NO: 180983 - RNA, 65 nt, hsa
uguuuuagaaguagauacaggcacugcucugaaaaccuggcuagccaaggauauucucagaaugu

SEQ ID NO: 180984 - RNA, 65 nt, hsa
ccgaguagcugggacuacaggggcccgccaccacaccuggcuaauuuuuuaaaaauauuuuuagu

SEQ ID NO: 180985 - RNA, 65 nt, hsa
cugaguagcugggauuacaggcacgcaccaccauaccuggcuaauuuuuguauuuugaguagaga

SEQ ID NO: 180986 - RNA, 65 nt, hsa
ccuaguagcugggauuacaggcacacaccaccauaccuggcuaauuuuuguauuuuugguagaca

SEQ ID NO: 180987 - RNA, 65 nt, hsa
gugggcggaucacgaggucaggagauggagaccauccuggcuaacacggugaaaccccuuaucua

SEQ ID NO: 180988 - RNA, 65 nt, hsa
ccgaguagcugggacuacaggcgcccgccaccacgccuggcuaauuuuuuauauuuuuaguagag

SEQ ID NO: 180989 - RNA, 65 nt, hsa
ggcugcucauguuggggcucuuccucuacagccucccuggcuacauggucaaaaagcuccuuggg

SEQ ID NO: 180990 - RNA, 65 nt, hsa
uaccugggaauaaaauguacuuggggguggcugcuccuggcuaaugcuuauuagaaaauguccuc

SEQ ID NO: 180991 - RNA, 65 nt, hsa
gcaggcggaucaugagaucaggagaucgagaccauccuggcuaacacggugaaaccccgucucua

SEQ ID NO: 180992 - RNA, 65 nt, hsa
gugggcagaucaugaggucagaagaucgagaccauccuggcuaacacggugaaacccagccucua

SEQ ID NO: 180993 - RNA, 65 nt, hsa
ugaauaaaaccauagggagcuucuuccccccaaccccuggcuauuuuauauuaauggggagaggg

SEQ ID NO: 180994 - RNA, 65 nt, hsa
uggaugugacucaaaugaggggucccacagcuuuuccuggcuaccacuugcugugaccuuauaca

SEQ ID NO: 180995 - RNA, 65 nt, hsa
gcggacagaucacgaggucaggaguucgagaccauccuggcuaacacagugaaacccugucucuc

SEQ ID NO: 180996 - RNA, 65 nt, hsa
ucagguguuaaggaaggggaugccccugagguucuccuggcuagucaggguggcuucacccauca

SEQ ID NO: 180997 - RNA, 65 nt, hsa
cucugccuccugauccugucuugcagauaagguccccuggcuagguuugcguuuauagucagguu

SEQ ID NO: 180998 - RNA, 65 nt, hsa
acgcaggugugagaggagagaccucuucugcaccgccuggcuaccucacuccucugcugguagca

SEQ ID NO: 180999 - RNA, 65 nt, hsa
aacaucgacauuucugccuucuccugcauugcugcccuggcuauggucacaggucaguacugcag

SEQ ID NO: 181000 - RNA, 65 nt, hsa
gcaggcggaucacgaggucaggagauggagaccauccuggcuaacauggugaaaccccgucucua

SEQ ID NO: 181001 - RNA, 65 nt, hsa
cggugcgggcagggagaaugccugggggucccucaccuggcuagggagauaccgaagccuacugu

SEQ ID NO: 181002 - RNA, 65 nt, hsa
guucucaguuucuucaccaucacuccaucaaagucccuggcuauaagaucuggauuuuacccacu

SEQ ID NO: 181003 - RNA, 65 nt, hsa
ccaaguagcugggacuaugggugcacaccaccacgccuggcuaauuuuuguauuuuuaguggaga

SEQ ID NO: 181004 - RNA, 65 nt, hsa
ccguaaaccuagagcuucuggagcccucgggagggccuggcuacugugccucaacgguucggcuc

SEQ ID NO: 181005 - RNA, 65 nt, hsa
ccgaguagcugggauuacaggugagcaccacuguaccuggcuagcuacuucuuuguuagaggauu

SEQ ID NO: 181006 - RNA, 65 nt, hsa
cugaguagaugggacuguaggcaccugccacuaugccuggcuaauuuuuguguuuuuaguagaga

SEQ ID NO: 181007 - RNA, 65 nt, hsa
aaagagcugagguucuugguggugucucccauuccccuggcuaauuucagacagcuguggucaag

SEQ ID NO: 181008 - RNA, 65 nt, hsa
ccaaguagccaggacuauaggcaccugccaccaugccuggcuaauuuuuguauuuuuuuucuuuc

SEQ ID NO: 181009 - RNA, 65 nt, hsa
ccaaguagcuaggacuacaggagcacaccaccacaccuggcuaauuuuuguauuuuuuguggaga

SEQ ID NO: 181010 - RNA, 65 nt, hsa
ccaaguagcugggacuacaggugcccgccaccaugccuggcuaauauuuuuuauuuuuaguagag

SEQ ID NO: 181011 - RNA, 65 nt, hsa
ggagcucuuggcuucagccagcccccagccagaguccuggcuaggacagugaccugaucuccucc

SEQ ID NO: 181012 - RNA, 65 nt, hsa
cuccuugccucuccuggaaggugucuucucuauggccuggcuagagcugcaaaaaagggacacac

SEQ ID NO: 181013 - RNA, 65 nt, hsa
gagagcuccaccguauuagcuccauuagcuuggagccuggcuagcaacacucacugucaguuagg

SEQ ID NO: 181014 - RNA, 65 nt, hsa
ucugaguaacuggaacuacaggugugcacuccucgccuggcuaauuuuuuauuuuuuguacaggc

SEQ ID NO: 181015 - RNA, 65 nt, hsa
guggguggaucacgaggucaggagaucgagaccauccuggcuaacacagugaaaccccgucucua

SEQ ID NO: 181016 - RNA, 65 nt, hsa
ccgaguagcugggacuacaggcgcccgccaccaugccuggcuaauuuuuuauauuuuuaguagag

SEQ ID NO: 181017 - RNA, 65 nt, hsa
ccgaguagcugggauuacaggugccugccaccaugccuggcuaauuuuuguauuuuuaguagagg

SEQ ID NO: 181018 - RNA, 65 nt, hsa
cugaguagcuaggacuacagaugcucgccaccacaccuggcuaauuuuuuuuuuuugagacugag

SEQ ID NO: 181019 - RNA, 65 nt, hsa
cugaguagcugggauuacaggcgugugccaccaugccuggcuaacuuuuguauuuuuaguagaga

SEQ ID NO: 181020 - RNA, 65 nt, hsa
uuuacccugccccugccuugauuagacuccuagcaccuggcuaguuucuaacauguuuugugcag

SEQ ID NO: 181021 - RNA, 65 nt, hsa
uuccugggugcgccuccaccucccuucugauguuuccuggcuaugguggggugggaaccucaguu

SEQ ID NO: 181022 - RNA, 65 nt, hsa
uucaugugcugcuugaagagcuccuauuuuguacuccuggcuagaaugcuguggaacaaauacaa

SEQ ID NO: 181023 - RNA, 65 nt, hsa
auagcaauugaagaaccacugcugcaggugguagcccuggcuagacugaauuacacuagaaauca

SEQ ID NO: 181024 - RNA, 65 nt, hsa
ggcuguugguuuuaccgaccaaaugaaacauuccaccuggcuacacgaaaauuucuagaaaaaga

SEQ ID NO: 181025 - RNA, 65 nt, hsa
ccgaauggcugggacuacaggcacccaccaccacgccuggcuaacuaacuaacuaacuuuuugua

SEQ ID NO: 181026 - RNA, 65 nt, hsa
ccugacuagcugggauugcagccugcaccaccacaccuggcuaaauuuuuguuguugucguugag

SEQ ID NO: 181027 - RNA, 65 nt, hsa
auuccuaucccuuguguuuauccuaccacugccuuccuggcuaucuuaaacaaguucauacauuu

SEQ ID NO: 181028 - RNA, 65 nt, hsa
guguuauauauaauauguuaaaaacauuuugcuuuccuggcuaauuauuugauccuuuuaaauuc

SEQ ID NO: 181029 - RNA, 65 nt, hsa
ucccagguagcuaggauuacaggcgugccaccaugccuggcuaauguuucuauuuuuaguagaga

SEQ ID NO: 181030 - RNA, 65 nt, hsa
gugggcaaaucaugaggucaggagauugagaccuuccuggcuaacauggugaaaccccaucucua

SEQ ID NO: 181031 - RNA, 65 nt, hsa
gcaggcggaucacgaggucaggaggucgagaucauccuggcuaacacagugaaaccccaucucua

SEQ ID NO: 181032 - RNA, 65 nt, hsa
cugagacuuaagggaacugaaucacuuaaaugucaccuggcuaacugauggcagagccagagcuu

SEQ ID NO: 181033 - RNA, 65 nt, hsa
ccgaguagcugggauuacaggcacacacuaccacgccuggcuaauuuuuguauuuuuauuauaga

SEQ ID NO: 181034 - RNA, 65 nt, hsa
uauagaguguacgacuguauuaacacggaggccugccuggcuacuuuuuuaacauauuguuaagu

SEQ ID NO: 181035 - RNA, 65 nt, hsa
ccgaguagcugggauuccaggcgcccgccaccacgccuggcuaauuuuuuguauuuuuaguagag

SEQ ID NO: 181036 - RNA, 65 nt, hsa
cucugagacagcaguaucacaggccagauguuguuccuggcuagauguuuacauuuguaagaaau

SEQ ID NO: 181037 - RNA, 65 nt, hsa
cccaguagcugggacuacagacgugugccaccacgccuggcuaaaucuuuuuuguauuuuauuuu

SEQ ID NO: 181038 - RNA, 65 nt, hsa
ccucccaaguagcugggauuacaggcagcaccacaccuggcuaauuuucauauuuuuaguagaga

SEQ ID NO: 181039 - RNA, 65 nt, hsa
gagggaggaucacaaggucaggagaucgagaccauccuggcuaacacggugaaaccccaucucua

SEQ ID NO: 181040 - RNA, 65 nt, hsa
cugaguagcugggacuauaggccuguaccgucaugccuggcuaauuuuuguauuuuuguagagac

SEQ ID NO: 181041 - RNA, 65 nt, hsa
ccaaguagcugggauuacaggugccugccaccaugccuggcuaauuuuuuuguauuuuuaguaga

SEQ ID NO: 181042 - RNA, 65 nt, hsa
uccacguccacacaguggccggcccuguggucggaccuggcuacagcccugaccacagcaucuuc

SEQ ID NO: 181043 - RNA, 63 nt, hsa
uucagcaggcugaugaauaagaucuaagaguuaccuggcuacagaaagaagaugccagaugac

SEQ ID NO: 181044 - RNA, 65 nt, hsa
ccaaguagcugggacuacaggcacccgccacagugccuggcuaauuuuuuguauuuuuaguagag

SEQ ID NO: 181045 - RNA, 65 nt, hsa
aaggcauauacuuugucuuucugcagaaaauucuaccuggcuacaauuacuuugaacauuaaugu

SEQ ID NO: 181046 - RNA, 65 nt, hsa
ccagaccauugucucagagcaggugcuggcucuuuccuggcuacuccauguuggcuagccucugg

SEQ ID NO: 181047 - RNA, 65 nt, hsa
cguaagauaaacuggaaauauuugggcgucuuguaccuggcuacgcaccaccucaguguuguucc

SEQ ID NO: 181048 - RNA, 65 nt, hsa
gcugcaccugcuauuccuuugcuuaugccccuaccccuggcuauccuaauucccuguucuccugc

SEQ ID NO: 181049 - RNA, 65 nt, hsa
ccaagcagcugggacuacaggcauguacugcuaugccuggcuaauuuuuuuuuuccuguauuguu

SEQ ID NO: 181050 - RNA, 65 nt, hsa
guuccauuuccgucauggugaagcaaaugaauuggccuggcuaccacuguggucgcgugcuacag

SEQ ID NO: 181051 - RNA, 65 nt, hsa
augaauagcugggauuacaggugcccaccaccaugccuggcuaguuuuuguauuuuuaguagagg

SEQ ID NO: 181052 - RNA, 65 nt, hsa
cugaguagcugggauuacaggugugccccaccacgccuggcuaauuuuuguaguuuuaguagaga

SEQ ID NO: 181053 - RNA, 65 nt, hsa
gcggguggaucacgaggucaggagaucgagaccauccuggcuaacacggugaaacccgucucuac

SEQ ID NO: 181054 - RNA, 65 nt, hsa
aagggcggaucacgaggucaggagauggagaccauccuggcuaacacggugagaccccgucuccg

SEQ ID NO: 181055 - RNA, 65 nt, hsa
ccaucccugcccugcccacgugguauugcugggcuccuggcuagaugcaagcaagguggacaaga

SEQ ID NO: 181056 - RNA, 65 nt, hsa
cugaguagcugggauuacaagcacgugucaccacgccuggcuaauuuuuguauuuuuaguauaga

SEQ ID NO: 181057 - RNA, 65 nt, hsa
uuaagccucuggcccucagaggcuccucccuaucuccuggcuaguuaccacuaggcuaccagguc

SEQ ID NO: 181058 - RNA, 65 nt, hsa
ugcgaucuggggagccccaucucgauauuuccaauccuggcuacuuuucuuagagaaaauaaguc

SEQ ID NO: 181059 - RNA, 65 nt, hsa
ccaaguagcuuggacuauaggugcaugccaccaugccuggcuaaucuuuugcagcgaugagauuu

SEQ ID NO: 181060 - RNA, 65 nt, hsa
gcgggcggaucacgaggucaggagauugagaccauccuggcuacgacggugaaaccccgucucua

SEQ ID NO: 181061 - RNA, 65 nt, hsa
ggguggaucaccugaagucaggaguucgagaccauccuggcuaacacugugaaaccccgucucua

SEQ ID NO: 181062 - RNA, 65 nt, hsa
agacccaggaagggcagcuccagccagaggaccuuccuggcuaugcaggugcacagcucuuaggc

SEQ ID NO: 181063 - RNA, 65 nt, hsa
uguccagcugcuaagaucccuucaucugcacaagcccuggcuagauaugugugaauguguggcau

SEQ ID NO: 181064 - RNA, 65 nt, hsa
uuugcaguaauuuuucuuuuuaucauuuuguuuguccuggcuaaacuuggaguuugaguauagua

SEQ ID NO: 181065 - RNA, 65 nt, hsa
aguccagauccacagcuucucuugaagaaugaccaccuggcuacgccggcucuucgguggcaaca

SEQ ID NO: 181066 - RNA, 65 nt, hsa
gugggcggaucacgaggucaggagaucgagaccauccuggcuaacagggugaaaccccaucgcua

SEQ ID NO: 181067 - RNA, 65 nt, hsa
cugaguagcugggacuacagaugcacaccaccacaccuggcuaauuuuuguguuuuuuguagaga

SEQ ID NO: 181068 - RNA, 65 nt, hsa
ccaaguagcugggauuacaggugugcgccaguacgccuggcuaguuuuaguauuuuuuguuacag

SEQ ID NO: 181069 - RNA, 65 nt, hsa
cccaaguagcuggauuacaggcauacaccaccacgccuggcuauguuuuguauuuuucguagaga

SEQ ID NO: 181070 - RNA, 65 nt, hsa
cggaguagcugggacugcaggcgccugccaccacgccuggcuaauuuuuuguauuuuuaguggag

SEQ ID NO: 181071 - RNA, 65 nt, hsa
cuuggcuagaguuugaaaaacuaauugagccugugccuggcuagaaaacaagcguuuauuugaau

SEQ ID NO: 181072 - RNA, 65 nt, hsa
gcgggcggaucacaaggucaggagaucgagaccauccuggcuaacacggugaaaccccgucucua

SEQ ID NO: 181073 - RNA, 65 nt, hsa
gggggguaguuuacuuuguuguaaggacuugauaaccuggcuacagcguuuucuaugaaaucuac

SEQ ID NO: 181074 - RNA, 65 nt, hsa
guggguggaucacaagguugggagauugagaccauccuggcuaacacagugaaacccugucucua

SEQ ID NO: 181075 - RNA, 65 nt, hsa
ccaaguagcuaggauuacaagugccugccacuaugccuggcuaauuuuuguuuuucguagagaug

SEQ ID NO: 181076 - RNA, 65 nt, hsa
ccgaguaguugggauuagaggcauaguccagcacgccuggcuaauuuuguauuuuuaguagagac

SEQ ID NO: 181077 - RNA, 65 nt, hsa
ccauguagcugcaacuauaggugugugccacuacaccuggcuaauguuuuuaguuuuuuagagau

SEQ ID NO: 181078 - RNA, 65 nt, hsa
uuaaccguuucaggaccacguuuauagcuucaggaccuggcuacguaauuauacuuaaaauaucc

SEQ ID NO: 181079 - RNA, 65 nt, hsa
cugagcagcugggacuacaggcacacaccaccacaccuggcuaaguuuuguauuuuuuguagaga

SEQ ID NO: 181080 - RNA, 65 nt, hsa
gggaaagcccugcuuugcuccaggcuccaagaucuccuggcuaagucagcaagugagaaaaugug

SEQ ID NO: 181081 - RNA, 65 nt, hsa
agcugauuuuuuccaaagucuaaagacugagcucaccuggcuagauuguuguguguuuuguugaa

SEQ ID NO: 181082 - RNA, 65 nt, hsa
gcaggcagaucacgacaucaggagaucgagaccauccuggcuaacacggugaaaccccgucucua

SEQ ID NO: 181083 - RNA, 65 nt, hsa
gagggcggaucacaaggucaggagaucaagaccauccuggcuaacacggugaaaccccgucucua

SEQ ID NO: 181084 - RNA, 65 nt, hsa
uaauuugugcaguugggagauguucagccuuagucccuggcuaauugccuguucuuuuccagccu

SEQ ID NO: 181085 - RNA, 65 nt, hsa
gaguagcugggacuacaguuucgugugccaccaugccuggcuaauuuuuagaauuuuuuguaggg

SEQ ID NO: 181086 - RNA, 65 nt, hsa
agcaauaaccaccucccuggaggccagcugagaugccuggcuacuuggcaccagggacuuccuga

SEQ ID NO: 181087 - RNA, 65 nt, hsa
agagauaagaacuuguucuuccaaguuuccuuguuccuggcuacuauaggccugaagccugaagc

SEQ ID NO: 181088 - RNA, 65 nt, hsa
cuaaguaccugguacuacaggcgcgugccaccacaccuggcuaauuuuugcauuuuuuguagaga

SEQ ID NO: 181089 - RNA, 65 nt, hsa
ccaaagugcugggauuacaggcaugagccacugcaccuggcuauauuuacauuuaauagaaacau

SEQ ID NO: 181090 - RNA, 65 nt, hsa
cuuugaauuguauuuacauucacugucaguaaagaccuggcuacgcuuugagaaaucaggaucuc

SEQ ID NO: 181091 - RNA, 65 nt, hsa
aagauacuugaagccaaauguuugcaguauagguuccuggcuacuguuuaugcugugauuucacu

SEQ ID NO: 181092 - RNA, 65 nt, hsa
agaagaacaaauauggcuaauuguuaauaagguccccuggcuaugguuuuuguucuuauaacaga

SEQ ID NO: 181093 - RNA, 65 nt, hsa
uaaucaaauuucaauuuaaaccaaauuagucgaaaccuggcuaaguuuagccaguaggacuguua

SEQ ID NO: 181094 - RNA, 65 nt, hsa
aggcauaucauuugaggucaggaguuuaagaccagccuggcuaacauagugagacccuguuucua

SEQ ID NO: 181095 - RNA, 65 nt, hsa
ucugucacgcuugaaccccucugugcuguucccuuccuggcuaauagggagacccuucgcaggca

SEQ ID NO: 181096 - RNA, 65 nt, hsa
ccgaguagcugggauuagaggcgugugccaccaugccuggcuaauuuuuguaguauuaguagaga

SEQ ID NO: 181097 - RNA, 65 nt, hsa
ccaaguagcucggacuacaggcguccuccaccaugccuggcuaauauuuuguauuuuuuaguaga

SEQ ID NO: 181098 - RNA, 65 nt, hsa
gcaggcggaucacgaggucaagagauccagaccauccuggcuaacacggugaaaccccgucucua

SEQ ID NO: 181099 - RNA, 65 nt, hsa
ugcgugccaggcaacagugggcagacaaagggcucccuggcuacugggaagauacagaaccaucc

SEQ ID NO: 181100 - RNA, 65 nt, hsa
gcagguagaucaugaggucaggagaucaaaaccauccuggcuaacauggugaaaccccaucucua

SEQ ID NO: 181101 - RNA, 65 nt, hsa
uaaaccuaccccagcaacuguggccucucgacagcccuggcuaacuaacuuacauuuguggggaa

SEQ ID NO: 181102 - RNA, 65 nt, hsa
ccgaguagcugggauuacaggcaccugccacugcgccuggcuaauuuuucuauuuuuaguagaga

SEQ ID NO: 181103 - RNA, 65 nt, hsa
ccgaguagcuggaauuacaggcaccugccaccacgccuggcuaauuuuguauuuuuaguagagau

SEQ ID NO: 181104 - RNA, 65 nt, hsa
acugcccauauauucuaucuagauuaggagaggguccuggcuaggauuuuagugguaauuccuag

SEQ ID NO: 181105 - RNA, 65 nt, hsa
ccuuacccuuuuucauaggggaagagugucacacuccuggcuaucucagggggaauggggaaaag

SEQ ID NO: 181106 - RNA, 65 nt, hsa
cugaguagcugggaccacagguucacauaaccaugccuggcuaauuuauuuuuacuuuuauuuua

SEQ ID NO: 181107 - RNA, 65 nt, hsa
cugaguagcugggacuacaagugugcaccaccaugccuggcuaauuuuuugaauuuuuguaguga

SEQ ID NO: 181108 - RNA, 65 nt, hsa
cucccuaguagcugggauuacaggcaugugccacaccuggcuaauuuuugugguuuuaguagaga

SEQ ID NO: 181109 - RNA, 65 nt, hsa
ccaaguagcugggauuacaggcaugcaccaccacaccuggcuaguuuuuguauuuuuaguagaga

SEQ ID NO: 181110 - RNA, 65 nt, hsa
ccgagcagcugggacuacaggcgcccgccaccacgccuggcuaacuuuuuuguauuuuuaguaga

SEQ ID NO: 181111 - RNA, 65 nt, hsa
gcggguggaucacgaggucaggagaucgagaccauccuggcuaacaugguaaaaccccgucucua

SEQ ID NO: 181112 - RNA, 65 nt, hsa
uugaguagcuugguuuauaggcgcaugccaccaugccuggcuaauuuuguguuuuuaguagagac

SEQ ID NO: 181113 - RNA, 65 nt, hsa
auuauucuagccuaggugaaucccuaauugaaacaccuggcuaacacuuuagacacauaaauuaa

SEQ ID NO: 181114 - RNA, 65 nt, hsa
ugucucggcauaccccucuccucuucccaccuccuccuggcuauguucugcagccucccagagua

SEQ ID NO: 181115 - RNA, 54 nt, hsa
ggauugccaauaaaaaauagcuuuccuggcuaaaagacccagguaaaagaccca

SEQ ID NO: 181116 - RNA, 65 nt, hsa
cugaguagcugggauuacaggcacccgccaccacgccuggcuaauuuuuguauuuuuaguggaga

SEQ ID NO: 181117 - RNA, 65 nt, hsa
auaucuugcauggacuuuagcagcaauggcaaauaccuggcuaccugugcagaugaucgcaccau

SEQ ID NO: 181118 - RNA, 65 nt, hsa
cuccuguguaacugggauuacaggcucccaccacaccuggcuaguguuuuguauuuuuaguagau

SEQ ID NO: 181119 - RNA, 65 nt, hsa
ccgagcagcugggacuacaggcgugcgccaccaugccuggcuaauuuuuguauuaguagagauga

SEQ ID NO: 181120 - RNA, 65 nt, hsa; identical to SEQ ID NO: 180956

SEQ ID NO: 181121 - RNA, 65 nt, hsa
ccaaguaguugggauuacaggcaccugccaccaugccuggcuaauuuuuuguauuuuuaguagag

SEQ ID NO: 181122 - RNA, 65 nt, hsa
caccucucugcccuucccugcccgguuccuacucaccuggcuagggccagugcccauuuucagcc

SEQ ID NO: 181123 - RNA, 65 nt, hsa
gaagucagacuguggucaaguagguggucccuugcccuggcuacagaacauggaagccccuaggg

SEQ ID NO: 181124 - RNA, 65 nt, hsa
ccagguagcugggauuacaggcacccaccaccacgccuggcuaauuuuuguauuuuuaauagaga

SEQ ID NO: 181125 - RNA, 65 nt, hsa
ucccauagcugggacuacaggcgcccgccaacacgccuggcuaauuuuuuguauuuuuaguagag

SEQ ID NO: 181126 - RNA, 65 nt, hsa
gcgggcggaucaugaggucaggagaucgagaccauccuggcuaacacggugaaaacccaugucua

SEQ ID NO: 181127 - RNA, 65 nt, hsa
guuguuuguuuugagagagagucuugcucugucucccuggcuagggugugguggugugaucuugg

SEQ ID NO: 181128 - RNA, 65 nt, hsa
auaugugacugucaugagauccuacuuaguaugauccuggcuagaaugauaauuaaaaguauuua

SEQ ID NO: 181129 - RNA, 65 nt, hsa
aucucccucagucugcccccagcccccaaacuccuccuggcuagacuguaggaagggacuuuugu

SEQ ID NO: 181130 - RNA, 65 nt, hsa
ggucaagaggccaggccuggcacauuuuggaguguccuggcuaccagcucucaccuacacccacg

SEQ ID NO: 181131 - RNA, 65 nt, hsa
cagaguaaguaggaccacaggcaugcacaagcaugccuggcuaauuuuuaaauuuuuuuuuuuua

SEQ ID NO: 181132 - RNA, 65 nt, hsa
aaagaaaggguauuuuugagcaaauaaugugauuuccuggcuauuuuguugggggcuuaagauuu

SEQ ID NO: 181133 - RNA, 65 nt, hsa
cgaguagcugggacuacuggcaggugggcaccaugccuggcuacuuuuuuguauuuuuuguagag

SEQ ID NO: 181134 - RNA, 65 nt, hsa
gcagguggaucacgaggucaggagaucgagaccauccuggcuaacacggugaaacccugucucua

SEQ ID NO: 181135 - RNA, 65 nt, hsa
ccaaacaucagaccugucuuccaaggagaccaaguccuggcuacaucccagccugugguuacagu

SEQ ID NO: 181136 - RNA, 65 nt, hsa
ccaacuagcugggacuacaggugcgcgccaccgugccuggcuaacuuuucauuuuuuuuguaggg

SEQ ID NO: 181137 - RNA, 65 nt, hsa
cggaguagcugggauugcaggcacccgccaccacgccuggcuaauuuuuguauuuuuaguagaga

SEQ ID NO: 181138 - RNA, 65 nt, hsa
gcgggcggaucaugaggucaggagaucgagaccauccuggcuaacacggugaaaccccgucucua

SEQ ID NO: 181139 - RNA, 65 nt, hsa
gaauuagaauguuucugguauuucucauuuuuuucccuggcuaugauagaaucucaucuaaucuu

SEQ ID NO: 181140 - RNA, 65 nt, hsa
gcggguagaucacaaggucaggagaucaggaccauccuggcuaacauggugaaaccccgucucua

SEQ ID NO: 181141 - RNA, 65 nt, hsa
uucgguuccagacacugguuucuugcuuuguuuucccuggcuaacagucuagugcaaaagauuaa

SEQ ID NO: 181142 - RNA, 65 nt, hsa
uuauuguguuuaauuucuucuuuggcacucuaaagccuggcuaauuguucuagguuuaugaauuu

SEQ ID NO: 181143 - RNA, 65 nt, hsa
cugaguagcugggacuacaggcaccugccaccacgccuggcuaacuuuuuuuuauauuuugagua

SEQ ID NO: 181144 - RNA, 65 nt, hsa
gcgggcggaucacgaggucaggagaucgagaccauccuggcuaacauggugaaaccccgucucua

SEQ ID NO: 181145 - RNA, 65 nt, hsa
augagauucugcagacucuacuugaccuuuucuucccuggcuacagcaaaggacgaugaucugcc

SEQ ID NO: 181146 - RNA, 65 nt, hsa
acggguggaucacaaggucaggagaucgagaccauccuggcuaaugcguugaaacuccgucucua

SEQ ID NO: 181147 - RNA, 65 nt, hsa
gugaguggauuacaaggucaggaguuccagaccagccuggcuaauauggugaaaccucgucucua

SEQ ID NO: 181148 - RNA, 65 nt, hsa
cugaguagcugggauuauagguacaugccaucacaccuggcuaauuuuuguauuuuuaguagaga

SEQ ID NO: 181149 - RNA, 65 nt, hsa
aaaauuagccaggcaugguggugcauaccuauaguccuggcuauuugggaggcugaggcaggagg

SEQ ID NO: 181150 - RNA, 65 nt, hsa
cuugugggucugugucaccuccaucucagucuuggccuggcuaugaggggaggaggaaugggaga

SEQ ID NO: 181151 - RNA, 65 nt, hsa
caguauuugggagacuuugacuauuuauucagacuccuggcuauguauugcacauuggcaagugc

SEQ ID NO: 181152 - RNA, 65 nt, hsa
augggaugggcugggaucuucucugugaauccaccccuggcuacccccacccuggcuaccccaac

SEQ ID NO: 181153 - RNA, 65 nt, hsa
aucuucucugugaauccaccccuggcuacccccacccuggcuaccccaacggcaucccaaggcca

SEQ ID NO: 181154 - RNA, 65 nt, hsa
ccuaguagcugggacuacaggcacccacuaccacgccuggcuaauucuuuguauuuuuaguagag

SEQ ID NO: 181155 - RNA, 65 nt, hsa
ccgaguagcugggaguacaggugcacaccaccaugccuggcuaauuucuguauuuuuaguagaga

SEQ ID NO: 181156 - RNA, 65 nt, hsa
ugggcuccacugggccccuggccucgggagcggccccuggcuaugcacccccaccauuccuacac

SEQ ID NO: 181157 - RNA, 65 nt, hsa
cagcccagcagcccuucgugaauccugcacugccaccuggcuauagcuacacuggucuucccuac

SEQ ID NO: 181158 - RNA, 65 nt, hsa
gcgggcggaucacgaggucaggagaucgagaccgcccuggcuaacauggugaaacauggugaaac

SEQ ID NO: 181159 - RNA, 65 nt, hsa
ccggguagcugggacuacaggugugcaccacuaugccuggcuaauuuuguauuuuuaguagagau

SEQ ID NO: 181160 - RNA, 65 nt, hsa
cagggggauuacuucagcccaggaguuccagacugccuggcuaacauggcaauacccuaucucua

SEQ ID NO: 181161 - RNA, 65 nt, hsa
cugaguaucugggacuacagaugcgugccaccaagccuggcuaauuuugucucaugucuucuaaa

SEQ ID NO: 181162 - RNA, 65 nt, hsa
aaaauuagccgggcgugguagcgcauggcuguaauccuggcuacucaggaggccgaggcagaaga

SEQ ID NO: 181163 - RNA, 65 nt, hsa
cugaguagcugggacuacaggcgcccgccaucacgccuggcuaauuuuuuuuuuuuuuguauuuu

SEQ ID NO: 181164 - RNA, 65 nt, hsa
aagaaggagugguaacagucacagaucccuaccugccuggcuaagacccguggccgucaaggacu

SEQ ID NO: 181165 - RNA, 65 nt, hsa
gcgggcggaucacgaggucaggagaucgagaccguccuggcuaacaccgugaaaccccaucucua

SEQ ID NO: 181166 - RNA, 65 nt, hsa
aaaauuagccgggcaugguggugcacaucgguaguccuggcuacuagagagguugaggugggagg

SEQ ID NO: 181167 - RNA, 65 nt, hsa
ccgaguagcugggauuaccggcacccaccaccacgccuggcuaauuuuucaauuuucuuuuucag

SEQ ID NO: 181168 - RNA, 65 nt, hsa
ggcaguuuugccucaggugcugaacauuucucagcccuggcuaaaagggagcagcacagggagag

SEQ ID NO: 181169 - RNA, 65 nt, hsa
gugggcggaucacgaggucuggaguuugagaccauccuggcuaacacagugaaaucccgucucua

SEQ ID NO: 181170 - RNA, 65 nt, hsa
ucaagcagcgggaacuacaggugugcacuaccacaccuggcuauuuuuuuuuuuuuuuuuuuuuu

SEQ ID NO: 181171 - RNA, 65 nt, hsa
caaguagcugggauuacagggcaccugccaccacgccuggcuaauuuuuguauuuuaguggagac

SEQ ID NO: 181172 - RNA, 65 nt, hsa
ucugggcagcugcagcccugagccaggacauguggccuggcuagugcagcauggaguggauuuua

SEQ ID NO: 181173 - RNA, 65 nt, hsa
gcucacaaaagguuaauggauggggguuaccuagcccuggcuaauuccccuuccauucccaacuc

SEQ ID NO: 181174 - RNA, 65 nt, hsa
ccgaguagcuaggauuacaggugcaugccaccacaccuggcuaauuuuuguauuuuaguagagau

SEQ ID NO: 181175 - RNA, 65 nt, hsa
gcgaguggaucacgaggucaggagaucgagaccauccuggcuaacacggugaaaccccgucucua

SEQ ID NO: 181176 - RNA, 65 nt, hsa
gcgggaggaucaugaggucaggagaucgagaccauccuggcuaacguggugaaaccccgucucuu

SEQ ID NO: 181177 - RNA, 65 nt, hsa
ccaaguagcugggauuacuggcgcccgccaccaugccuggcuaauuuuuuuuauuuuuaguagag

SEQ ID NO: 181178 - RNA, 65 nt, hsa
ccaaguagcugggacuacaggcacgugccaccaugccuggcuaauuuuuguauuuuuuaaauaga

SEQ ID NO: 181179 - RNA, 65 nt, hsa
ccuaguagcugggauuacaggugcacaccaccacaccuggcuaauuuuuguauuuuuagcagaca

SEQ ID NO: 181180 - RNA, 65 nt, hsa
gcgggcggaucacgaggucaggagaucgagaccauccuggcuaacacggugaaaccccauuucca

SEQ ID NO: 181181 - RNA, 65 nt, hsa
ucccucuucauccgcagcaguguaucuauucuauaccuggcuaugggagagaccccuugcauggg

SEQ ID NO: 181182 - RNA, 65 nt, hsa
gcccaggcagcucuguaacaucuucuauagaugccccuggcuacccuguuguuuucaucuaccuc

SEQ ID NO: 181183 - RNA, 65 nt, hsa
auaaggaauuuucuauguuucaaaguguucuaaaaccuggcuaaaagaauguauuuuuguggaug

SEQ ID NO: 181184 - RNA, 65 nt, hsa
acuccaucaguagguuuagauuugagcuuuugagaccuggcuauggaaaagaaagacacuugaga

SEQ ID NO: 181185 - RNA, 65 nt, hsa
ccgaguagcugggacuacaggcacaagucaccaugccuggcuaauuuuguauuuuuaguagagaa

SEQ ID NO: 181186 - RNA, 65 nt, hsa
ugggcggauuucggguuuccggagaggcagagacgccuggcuacgacgauuuguuccacuuccuu

SEQ ID NO: 181187 - RNA, 65 nt, hsa
caggggagauuccagccagacacccgccccccggcccuggcuaagaaguugcuuccuguugccag

SEQ ID NO: 181188 - RNA, 65 nt, hsa
auucggccucugggccugugugucugugagcucaaccuggcuaaaggcagagucacucccaaaug

SEQ ID NO: 181189 - RNA, 65 nt, hsa
gcggguggaucacgaggucaggagaucgagaccauccuggcuaacauggugaaaccccgucucua

SEQ ID NO: 181190 - RNA, 65 nt, hsa
cugaguagcugggaucacaggugcacaccaccacgccuggcuaauuuuuuuauuuuuauuuuuag

SEQ ID NO: 181191 - RNA, 65 nt, hsa
ccaaagugcugggauuacaaguuugagccacugcaccuggcuaacuugcccuauuuuaaagucaa

SEQ ID NO: 181192 - RNA, 65 nt, hsa
ccgaguagcugggauuacaggcgaccgccaccacgccuggcuacuuuuuguauuuuuaguagaga

SEQ ID NO: 181193 - RNA, 65 nt, hsa
aggcggaucaccugaaaucaggaguucaagaucagccuggcuaacauggcgaaaccccgucucua

SEQ ID NO: 181194 - RNA, 65 nt, hsa
guaauccucuuccuccauuaugcaguacacggacaccuggcuacagaccaggacguggcuugugu

SEQ ID NO: 181195 - RNA, 65 nt, hsa
ccgaguagcugggaccacaggcaugcacaaccacgccuggcuaauuuuuguauuuuuuauaaaga

SEQ ID NO: 181196 - RNA, 65 nt, hsa
ccagguagcugguacuacaggcacggaccaccacgccuggcuaauuuuuguauuuuuucuaggga

SEQ ID NO: 181197 - RNA, 65 nt, hsa
ccgaguagcugggacuacaggugcacgccaccacgccuggcuaauuuuuuguauuuuaguagaga

SEQ ID NO: 181198 - RNA, 65 nt, hsa
gcggguggaucaagaggucaggagaucgagaccauccuggcuaagucggucucuaauaaaaauac

SEQ ID NO: 181199 - RNA, 65 nt, hsa
gcggguggaucaugaggucaggagaucgagaccauccuggcuaacacggugaaaccccgucucua

SEQ ID NO: 181200 - RNA, 65 nt, hsa
gcaggcagaucacggggucaggagaucaagaccauccuggcuaacauggugaaaccccgucucua

SEQ ID NO: 181201 - RNA, 65 nt, hsa
ccaaguagcugggauuacaggugcccaccaccaccccuggcuaaauuuguauuuucaguagagac

SEQ ID NO: 181202 - RNA, 65 nt, hsa
gcgggcggaucaccaggucaggagaucaagaccauccuggcuaacacggugaaaacccaucucua

SEQ ID NO: 181203 - RNA, 65 nt, hsa
ccuccuaccuccaaagcuucccacggccuuucuagccuggcuauguccuaauaauaucccacugg

SEQ ID NO: 181204 - RNA, 65 nt, hsa
ucaggccccagcucuacuuggucccugaaaaagcaccuggcuaagggcugggccuggccagcagg

SEQ ID NO: 181205 - RNA, 65 nt, hsa
auacugagcuuccucuucacucugcucucaggagaccuggcuaugaggcccucggggcagggaua

SEQ ID NO: 181206 - RNA, 65 nt, hsa
aagcuuaagguagaggugcaggauuagcaagcccaccuggcuaccaggccgacagcuacauccuc

SEQ ID NO: 181207 - RNA, 65 nt, hsa
auccuguugggaaagaauaaaauuagcuugagcaaccuggcuaagauagaggggcucugggagac

SEQ ID NO: 181208 - RNA, 65 nt, hsa
ccgaguagcugggacuacaggcacaugccaccaugccuggcuaauuuuuuguauuuuuaguacag

SEQ ID NO: 181209 - RNA, 65 nt, hsa
cuggguagcugggauuacaggugcccaccaacaugccuggcuaauuuuuguacuuuuaguagaga

SEQ ID NO: 181210 - RNA, 65 nt, hsa
gcgggcagaucacgaagucaggagaucgagaccauccuggcuaacacggugaaaccccgucucua

SEQ ID NO: 181211 - RNA, 65 nt, hsa
ccgaguagcugggacuacaggcgccuaucaccaugccuggcuaauuuuuuuugauuuuuaguaga

SEQ ID NO: 181212 - RNA, 65 nt, hsa
guaaggacuggaaacacuagaaucuugaagaaacgccuggcuagaggugaggguaagcuguuaau

SEQ ID NO: 181213 - RNA, 65 nt, hsa
ccgaguagcugggauuacaggugcaugccaccaugccuggcuaauuuuuguauuuuuaguagaga

SEQ ID NO: 181214 - RNA, 65 nt, hsa
ccgaauagcuggaauuacgggcaugcaccaccacaccuggcuaauuuuuguauuuuuaauagaga

SEQ ID NO: 181215 - RNA, 65 nt, hsa
ccugcacgcucugcggggagaaaaggaggggccugccuggcuagcccugaaccuuucacuuucca

SEQ ID NO: 181216 - RNA, 65 nt, hsa
aaaugagagaaugguacuuagggauggaaaacgggccuggcuagagcuucgggugugugugucug

SEQ ID NO: 181217 - RNA, 65 nt, hsa
gaggcgggcggaucacaaagucaggacgagaccauccuggcuaacacggugaaacccugucucua

SEQ ID NO: 181218 - RNA, 65 nt, hsa
ccagguaacugggacuacaggcaugcaccaccaugccuggcuaauuuuuguauuuuauguagaga

SEQ ID NO: 181219 - RNA, 65 nt, hsa
uccaguagcugggauuacaggugugcaccaccacgccuggcuaaauuuuguauuuuuaguacaga

SEQ ID NO: 181220 - RNA, 65 nt, hsa
cugggauggaggggaguguugggcaugugaucacgccuggcuaauaaggcuuuaguguauuuauu

SEQ ID NO: 181221 - RNA, 65 nt, hsa
gugggagaaucacaaggucaggagacugagaccauccuggcuaacaccaugaugggcuaacaccc

SEQ ID NO: 181222 - RNA, 65 nt, hsa
aaauaaaugaauugagaauuuaguccauagaggucccuggcuaccaaacacauucuccuuugaau

SEQ ID NO: 181223 - RNA, 65 nt, hsa
ccaaguaggugggacuccaggcaugcaccaccaugccuggcuaauuuuugcauuuuuaguagaga

SEQ ID NO: 181224 - RNA, 65 nt, hsa
ccaagcagcugggacuacagguaccugccaccacgccuggcuaauuuuguuuuuguauuuuuagu

SEQ ID NO: 181225 - RNA, 65 nt, hsa
caccagcagagacagaaacagcaauagccaggacuccuggcuaaaacgggggaagugagaggaaa

SEQ ID NO: 181226 - RNA, 65 nt, hsa
cuguguaacuguggcuauucugugucccuacacuaccuggcuacccccuuccauggccccagcuc

SEQ ID NO: 181227 - RNA, 65 nt, hsa
gcggguggaucacgaggucaggagauggagaccauccuggcuaacauggugaaaccccgucucua

SEQ ID NO: 181228 - RNA, 65 nt, hsa
ccaauuagcuuggccuacagucaucugccaccacaccuggcuaauuuuuuguacuuuuaguagag

SEQ ID NO: 181229 - RNA, 65 nt, hsa
ccgaguaguugggauuacaggcgccugccuccaugccuggcuaauuuuguauuuuuaguagagac

SEQ ID NO: 181230 - RNA, 65 nt, hsa
acacucaagcaauccugaggaauacugagggagggccuggcuacugucucucugcacucugcugc

SEQ ID NO: 181231 - RNA, 65 nt, hsa
ccgugcagcugggauugcaggugcgugccaccaugccuggcuaauuucugguauuuuguagagac

SEQ ID NO: 181232 - RNA, 65 nt, hsa
ucaaguagcugggauuacaagcaccagccaccaugccuggcuaauuuuguauuuuuaguagagac

SEQ ID NO: 181233 - RNA, 65 nt, hsa
guguuuuuaaggccagccacuugucccuguugaggccuggcuauggaacuaaauacaguguuggu

SEQ ID NO: 181234 - RNA, 65 nt, hsa
gccuugacgacaagaccaccaacguguccuuguacccuggcuacaacuucagguaacuccaaggc

SEQ ID NO: 181235 - RNA, 65 nt, hsa
aggcagaucaccugaggucgggaguuggagacccgccuggcuaacaaggcgaaauccugucugua

SEQ ID NO: 181236 - RNA, 65 nt, hsa
gccucgauacacgggacguugagcacaacguaucuccuggcuacaauuucaggugggcgugagcu

SEQ ID NO: 181237 - RNA, 65 nt, hsa
gcccacugcuaguuugacuuuuuauaauugaaccuccuggcuaugcccugagaucagcgcuauuu

SEQ ID NO: 181238 - RNA, 65 nt, hsa
gcaggcggaucacaaggucaggagauugagacccuccuggcuaacaccgugaaaccccgucucua

SEQ ID NO: 181239 - RNA, 65 nt, hsa
accugacaguauuagggagugaagggaggaggggcccuggcuauuugggaccuaagccuaggccc

SEQ ID NO: 181240 - RNA, 65 nt, hsa
caaugaaguuuucagaucaguggcaaucucaguccccuggcuaugacccugcuuuguucuuuccc

SEQ ID NO: 181241 - RNA, 65 nt, hsa
agccugcccaguaacugguacuacagaugugcacaccuggcuaagucuuuaauuuuuucguagag

SEQ ID NO: 181242 - RNA, 65 nt, hsa
gcagguggaucacgaggucaggagauccagaccauccuggcuaacauggugaaaccucgucucua

SEQ ID NO: 181243 - RNA, 65 nt, hsa
acaggcagaucacgaggucaggagaucgagaccauccuggcuaacacggugaaacccugucucua

SEQ ID NO: 181244 - RNA, 65 nt, hsa
ccgaguagcugggauuauaggcacccaccaccacaccuggcuaauuuuuguauuuuuaguggaga

SEQ ID NO: 181245 - RNA, 65 nt, hsa
agacucaagaaacugauccuggagaucgagaccauccuggcuaacauggugaaaccccgucucua

SEQ ID NO: 181246 - RNA, 65 nt, hsa
agucuauuuauauuuucuacaucuaauuuuagaagccuggcuacaauacugcacaaacuugguua

SEQ ID NO: 181247 - RNA, 65 nt, hsa
aagugguuuuucaucuuuccucccuccucccacagccuggcuauacagugcauccuugaacuguc

SEQ ID NO: 181248 - RNA, 65 nt, hsa
ccaccacccuggagucuagaccaacacacaaagauccuggcuaacccuggccuauuuagauuccu

SEQ ID NO: 181249 - RNA, 65 nt, hsa
cugaguagcugggauuacagguaugugccaccaugccuggcuaauuuuguauuuuuaguagagac

SEQ ID NO: 181250 - RNA, 65 nt, hsa
ccaaguagcugggacuacgggcacaugccacugcaccuggcuaauuuuuauauuuuugguagaga

SEQ ID NO: 181251 - RNA, 65 nt, hsa
uacucaguaaagguguuuccugcaccugcugucagccuggcuaugccgccaccggccccgcccau

SEQ ID NO: 181252 - RNA, 65 nt, hsa
gaggugcucaaccccagcucggguccucuagucugccuggcuaccaugcuucucacucuccugca

SEQ ID NO: 181253 - RNA, 65 nt, hsa
gugggcagaucacgaggucaggagaucaagaccauccuggcuaacauagugaaacccugucucua

SEQ ID NO: 181254 - RNA, 62 nt, hsa
cggggcagccccagcccugaggaccaccauucccuggcuacucucuccuuccucccccuuuu

SEQ ID NO: 181255 - RNA, 65 nt, hsa
cugaguagcugggaauauaggugcacaccaccaugccuggcuaauuuuuguauuuucaguagaag

SEQ ID NO: 181256 - RNA, 65 nt, hsa
ugccuucccacccagaaaccgugucagcaugguugccuggcuaccugcucaugaaggacuugauu

SEQ ID NO: 181257 - RNA, 65 nt, hsa
uuuauaaaguuugcuuuuaaucauacaauagcuuaccuggcuaaaacuuugcguauaaagggaaa

SEQ ID NO: 181258 - RNA, 65 nt, hsa
cugaguagcugggaguacaggcauguggcaccaugccuggcuaauuuuuguauuuuuaauagagu

SEQ ID NO: 181259 - RNA, 65 nt, hsa
acucaugagcagcagcaacaacugaauguccugguccuggcuagcagcagcaccguggugaugca

SEQ ID NO: 181260 - RNA, 65 nt, hsa
gcgggcggaucacaaggucaggagaucgagaccauccuggcuaacacagugaaaccccgucucua

SEQ ID NO: 181261 - RNA, 65 nt, hsa
ccaagaagcugagauuacagaugaccaccaccacuccuggcuaauuuuuuguauuuaguagagac

SEQ ID NO: 181262 - RNA, 65 nt, hsa
uggccaguggugccaggugccacccagggcuacugccuggcuaucuggccuggccucugggcugg

SEQ ID NO: 181263 - RNA, 65 nt, hsa
ccaaguagcugagacuacaggcacacaccaccacgccuggcuaauuuuuguauuuuuaguagaga

SEQ ID NO: 181264 - RNA, 65 nt, hsa
cugaguagcugggauuacaggugccugccaucacgccuggcuaauuuuuguauuuuuaguagaga

SEQ ID NO: 181265 - RNA, 65 nt, hsa
cucagcacugccaggccugcccugaaacuccagauccuggcuaagagggaaauagcuccuuggga

SEQ ID NO: 181266 - RNA, 65 nt, hsa
ccuggcaccccugccccaccuggcuccuuucuacuccuggcuaugucgucuuggcuccaccucug

SEQ ID NO: 181267 - RNA, 65 nt, hsa
gagggcggaucacgaggucaggagaucgagaccauccuggcuaacacagugaaaccccaucucua

SEQ ID NO: 181268 - RNA, 65 nt, hsa
gcaggcggaucacaaggucaggagaucaagacuauccuggcuaacacgguaaaacccugucucua

SEQ ID NO: 181269 - RNA, 65 nt, hsa
gcgggccgaucacgaggucaggagaucaaggccauccuggcuaacacggugaaacccugucucua

SEQ ID NO: 181270 - RNA, 65 nt, hsa
cccagauagcugggccacaggcgugugccaccacaccuggcuaacuuuuuuuuuuuuuuuuuuuu

SEQ ID NO: 181271 - RNA, 65 nt, hsa
cccaguagcugggacuacaggcgccugccaacaugccuggcuaauuuuuuuuuuuuguauuuuua

SEQ ID NO: 181272 - RNA, 65 nt, hsa
gcccuggacucaucuugggaagggccaugggagguccuggcuagaguucugcccaaccuugacca

SEQ ID NO: 181273 - RNA, 65 nt, hsa
cugaguagcugggauuacaggcgugcaccacaacgccuggcuaaguuuuuguauuuuuaguagag

SEQ ID NO: 181274 - RNA, 65 nt, hsa
cagaguagcuggaauuacaggcacacaccaccacgccuggcuaauuuuuguauuuuuaguagagc

SEQ ID NO: 181275 - RNA, 65 nt, hsa
cucagacagugcaucaccgggcacccagaggcuugccuggcuauuccuguucuggugugugugga

SEQ ID NO: 181276 - RNA, 65 nt, hsa
cuucucccuccagccaccugcugccacgggcaggcccuggcuauagcuuauacaguaucuccccu

SEQ ID NO: 181277 - RNA, 65 nt, hsa
agggccacugcuccauugcucugggggcugggaugccuggcuaagcaggggcugacaggguggca

SEQ ID NO: 181278 - RNA, 65 nt, hsa
ggcacaaagcuugugccuugacuggacccguagccccuggcuaggucgaaacagcccuccaccuc

SEQ ID NO: 181279 - RNA, 65 nt, hsa
ucucccuccuccugccauccuccccucccgcccuuccuggcuaccuccucugacaugcggucaga

SEQ ID NO: 181280 - RNA, 65 nt, hsa
ccaccuccucugucccccaugccacaaccugggcuccuggcuacagcagggcuccagggacucca

SEQ ID NO: 181281 - RNA, 65 nt, hsa
gcgggcggaucaugagguuaggagagcgagaccauccuggcuaacacggugaaaccccgucuuua

SEQ ID NO: 181282 - RNA, 65 nt, hsa
uuggugcuggcuaggcugagggggccaccacuuuuccuggcuagaagcuacuugaccuuugaugu

SEQ ID NO: 181283 - RNA, 65 nt, hsa
uguauuuuaaagaagaaaaaaaacaaaaaaaauucccuggcuauuccucuuuccucucugcugcu

SEQ ID NO: 181284 - RNA, 65 nt, hsa
ccaaagugcugggacuacaggugcaugcaaccacaccuggcuaauuuucuuuucuucuuucuuuc

SEQ ID NO: 181285 - RNA, 65 nt, hsa
uaauuccuaggacagcacgcccgcuuugcccuugaccuggcuagggagccaaggaaaugccaugg

SEQ ID NO: 181286 - RNA, 65 nt, hsa
uuaauuucucacuggggagagcagggguggcagauccuggcuagaucugccucuguuuugcuggu

SEQ ID NO: 181287 - RNA, 65 nt, hsa
ccuuccucccuucagucaguguccccaggguccagccuggcuagaguuagaaggcagaccuagcc

SEQ ID NO: 181288 - RNA, 65 nt, hsa
gcgggcggaucacgaggucaggagaucgagaccauccuggcuaacguggugaaaccccaucucua

SEQ ID NO: 181289 - RNA, 65 nt, hsa
ugggcuccgcugugcccgcccugggcugggcccuuccuggcuaggacuguggaggggagcugcug

SEQ ID NO: 181290 - RNA, 65 nt, hsa
ccccgaaccuuguaaucgugugcuggcguggcagcccuggcuaaguuaauccccaccgcuuucag

SEQ ID NO: 181291 - RNA, 65 nt, hsa
uuagaaguaaauauauucaagacaaacgagaaaauccuggcuacccaagucgaguauauacagga

SEQ ID NO: 181292 - RNA, 65 nt, hsa
ccgaguagcugggauuacaggcacgcaccaccacaccuggcuaauuuuuguacuuuuaguagaga

SEQ ID NO: 181293 - RNA, 65 nt, hsa
cacuuugggaggccgaggcgggcggaucagaccauccuggcuaacacggugaaaccccaccucua

SEQ ID NO: 181294 - RNA, 65 nt, hsa
guggccagaucccaaggucagaagaucgagaccauccuggcuaacauggugaaaccccaucucua

SEQ ID NO: 181295 - RNA, 65 nt, hsa
cgaaguagcugggacuauagguguguaccaucacaccuggcuaauuuuuguauuuuuuguagaca

SEQ ID NO: 181296 - RNA, 65 nt, hsa
cugagcagcugggacuacaggcgccugccaucaugccuggcuaauuuuuguauuuuuaguagaga

SEQ ID NO: 181297 - RNA, 65 nt, hsa
ccgaguagcugggauuacaggcacccgccaccguaccuggcuaauuuuuguauuuuuaguagaga

SEQ ID NO: 181298 - RNA, 65 nt, hsa
gcaggcagaucacgaggucaggagauccagaccauccuggcuaacacggugaaaccccgucucua

SEQ ID NO: 181299 - RNA, 65 nt, hsa
gugggcggaucacgagguagggagaucaagaccauccuggcuaacacggugaaaccccgucucua

SEQ ID NO: 181300 - RNA, 65 nt, hsa
gugggcagaucacgaggucaggagaucgagaccauccuggcuaacauggugaaaccccgucucug

SEQ ID NO: 181301 - RNA, 65 nt, hsa
gggguugcagggcaacaguacagucgcgcuuacgaccuggcuagaacacaaggucagaugauaaa

SEQ ID NO: 181302 - RNA, 65 nt, hsa
cugaguagcugggauuacaggcgucggccaccacaccuggcuaauuuuuguauuuuuaguagaga

SEQ ID NO: 181303 - RNA, 65 nt, hsa
cugaguagcugggacuacaggcuugcgccaccacaccuggcuaauuuuuguauuuuugguagaga

SEQ ID NO: 181304 - RNA, 65 nt, hsa
cgaggcggaucauaaggucaggagaucaagaccauccuggcuaacacggugaaaccccgucucua

SEQ ID NO: 181305 - RNA, 65 nt, hsa
ccaaguagcugggaccacaggugggcagcaccacaccuggcuaauuuuuuaaauuuuuuuuuaua

SEQ ID NO: 181306 - RNA, 65 nt, hsa
cugaguagcugggacuacaggcacaggccaccaaaccuggcuaauguuuaaauuuuauguagaga

SEQ ID NO: 181307 - RNA, 65 nt, hsa
gcuggcagaucacaaggucaggagaucgagaccauccuggcuaacacggugaaacccugucucca

SEQ ID NO: 181308 - RNA, 65 nt, hsa
aaggcccugcaucagcgggucaacaucgugccuauccuggcuaaggcagacacacugacaccucc

SEQ ID NO: 181309 - RNA, 65 nt, hsa
acuauuuucucuguaaaguuuucaaaguucuccauccuggcuaacacggugaaacaccgucucua

SEQ ID NO: 181310 - RNA, 65 nt, hsa
ccgaguagcugggauuacaggcuccugccaccacgccuggcuaggaaauuuuuuguuguuaauau

SEQ ID NO: 181311 - RNA, 65 nt, hsa
gugguugaggcagggccaucccgauccuugcucuaccuggcuagaguuucuucucaucagagcac

SEQ ID NO: 181312 - RNA, 65 nt, hsa
uaugcuguagcgugucuggaaacaaaguacacaaaccuggcuacggugaugaguuagcuucugcu

SEQ ID NO: 181313 - RNA, 65 nt, hsa
gcggguggaucaugagaucaggagaucgagaccauccuggcuaacacggcgaaaccccgucucua

SEQ ID NO: 181314 - RNA, 65 nt, hsa
ccgaguagcugggauugcaggcaugcaccaucacaccuggcuaauuuuguauuuucaguagagac

SEQ ID NO: 181315 - RNA, 65 nt, hsa
ggcccacgcuccaugccaguggcucacgcucugcuccuggcuaccccagagggaguugucacgcu

SEQ ID NO: 181316 - RNA, 65 nt, hsa
guagcugggauuacagacaggcaugugcuauuacaccuggcuaauuuuuaaaguuuuuuuuguaa

SEQ ID NO: 181317 - RNA, 65 nt, hsa
cugagcagcugggauuacaggugcaugccaccaugccuggcuaauuuugguauuuuuaguagaga

SEQ ID NO: 181318 - RNA, 65 nt, hsa
cugcguagcugggaccacagggguaugccaccacaccuggcuaauuuuuuauuuuccuuuuugua

SEQ ID NO: 181319 - RNA, 65 nt, hsa
ccgaguagcugggacuacaggugcccaccaccacgccuggcuaguuuuuuguauuuuuaguagag

SEQ ID NO: 181320 - RNA, 65 nt, hsa
cugaguagcugggauuacaggcacccaccaccacaccuggcuaauuuuuuguauuuuuaguaaag

SEQ ID NO: 181321 - RNA, 65 nt, hsa
ccccaccggugcauccgcccagugcguccaccugcccuggcuagcaugcugcugggccacacccc

SEQ ID NO: 181322 - RNA, 65 nt, hsa
auucuaugaagcccacccagaaaaaacuugcugguccuggcuauuuuugugucauuuauucaagu

SEQ ID NO: 181323 - RNA, 65 nt, hsa
gcggguggaucacgaggucaggagaucaagaccauccuggcuaacacggugaaaccccgucucua

SEQ ID NO: 181324 - RNA, 65 nt, hsa
ccauggccugcugggcuuggcucggcgcccccaccccuggcuaccuugugggaauaaacagacaa

SEQ ID NO: 181325 - RNA, 65 nt, hsa
ugaacaaggcuggcaguaaguggacaagcugcuccccuggcuaaggcccugcccugcccucagcc

SEQ ID NO: 181326 - RNA, 65 nt, hsa
gcggguggaucaugaggucaggagaucgagaccauccuggcuaacacagugaaacccugucucua

SEQ ID NO: 181327 - RNA, 65 nt, hsa
gcaggcggaucacgaggucaggagaucaagaccauccuggcuauggugaaaccccgucucuacua

SEQ ID NO: 181328 - RNA, 65 nt, hsa
gaacagacccaaauucaauggcaugaccaagaacaccuggcuaccauuuuguuuucuccugcccu

SEQ ID NO: 181329 - RNA, 65 nt, hsa
gcggguggaucaugaggucaggagaucgagaccauccuggcuaacacgugaaaccccgucucuac

SEQ ID NO: 181330 - RNA, 65 nt, hsa
uuuuaagggccaaagcuugaccccauuggccauugccuggcuaaugagaaccccugguucucaga

SEQ ID NO: 181331 - RNA, 65 nt, hsa
cuucuugcaagcaagggcaggccauuuccuccgguccuggcuaguaugaauaugagaagucacug

SEQ ID NO: 181332 - RNA, 65 nt, hsa
gggcagaucaucugaggccaggaguucaagaccagccuggcuaacauggugaaauccuaucucua

SEQ ID NO: 181333 - RNA, 65 nt, hsa
aaaauuagcugggugugguggugcaugccugugauccuggcuacuucagaggcugagguggaagg

SEQ ID NO: 181334 - RNA, 65 nt, hsa
uggaggagcugguaucacaggcgucccccaccacgccuggcuaaauuuuguauuuuuaggugguc

SEQ ID NO: 181335 - RNA, 65 nt, hsa
ccaaguagcugggauuacaggcauguacuaccaugccuggcuaauuuucuuguaguuuuaguagg

SEQ ID NO: 181336 - RNA, 65 nt, hsa
gcgggcagaucacgaggucaggagaucgagaccauccuggcuaacacggugaaaccccgucucua

SEQ ID NO: 181337 - RNA, 65 nt, hsa
ucccagugcugggauuauaggugugagccacugcgccuggcuaaguuauuauuauuuuuuugaga

SEQ ID NO: 181338 - RNA, 65 nt, hsa
gcaggcagauaacaaagucaggagauugagaccguccuggcuaacacggugaaaccucgucucua

SEQ ID NO: 181339 - RNA, 65 nt, hsa
cccaguagcugggauuacagacaugcaccaccacaccuggcuaauuuuuguauuuuuaguagaga

SEQ ID NO: 181340 - RNA, 65 nt, hsa
ucccuaguaauggauuacaggcgcccgccaccacgccuggcuaauuuuuguauuuuuaguagaga

SEQ ID NO: 181341 - RNA, 65 nt, hsa
ccaaguagcugggacuacaggcacccgccacuacgccuggcuaauuuuuuguauuuuuaguagag

SEQ ID NO: 181342 - RNA, 65 nt, hsa
ccgaguagcugggacuacaggugccugccaccacgccuggcuaauuuuuuuguauuuuuaguaga

SEQ ID NO: 181343 - RNA, 65 nt, hsa
guggguggaucacgaggucaggagauugagaccauccuggcuaauauggugaaacccugucucua

SEQ ID NO: 181344 - RNA, 65 nt, hsa
cuguaacguaccaacguaccaauuuccccuuuuccccuggcuaccaggaaacucggagacaaucu

SEQ ID NO: 181345 - RNA, 65 nt, hsa
cuagggcaguggucacuguggcacccaggugugggccuggcuagcugggggccuucaugugcccu

SEQ ID NO: 181346 - RNA, 65 nt, hsa
gcaggcggaucaugaggucaggagauggagaccauccuggcuaacacggugaaaccccgucucua

SEQ ID NO: 181347 - RNA, 65 nt, hsa
aggcggaucaccugaggucaggaguucgagaccagccuggcuaacauggcaaaaccccaucucua

SEQ ID NO: 181348 - RNA, 65 nt, hsa
ccaagaagcugggauuacaggcaugcgccaccacgccuggcuaauuuuguaauuuuaguagagau

SEQ ID NO: 181349 - RNA, 65 nt, hsa
ccaaagugcuaggauuacaggugugagccaccacgccuggcuaauuuuguauuuuuaguagagau

SEQ ID NO: 181350 - RNA, 65 nt, hsa; identical to SEQ ID NO: 181144

SEQ ID NO: 181351 - RNA, 65 nt, hsa
gguugcaacaggauggaauucagggacggacccagccuggcuaagggaaccauuucacugccgga

SEQ ID NO: 181352 - RNA, 65 nt, hsa
cccucauccaugcugugcuguguuauuuaauuuuuccuggcuaagaucaugucugaauuauguau

SEQ ID NO: 181353 - RNA, 65 nt, hsa
ccgaguagcugggaccacaaaugugagccaccaugccuggcuaauuuuuguacuuuuuguagaaa

SEQ ID NO: 181354 - RNA, 65 nt, hsa
acgggcggaucacgaggucaggagacugagaccauccuggcuaacacggugaaaccccaucucua

SEQ ID NO: 181355 - RNA, 65 nt, hsa
cugaguagaugggacuacaggcacaggccauuaugccuggcuaauuuuuguauuuuuaguagaga

SEQ ID NO: 181356 - RNA, 65 nt, hsa
gugggcaaauuacgaggucaggagauccagaccauccuggcuaacacggugaaaccccgucucua

SEQ ID NO: 181357 - RNA, 65 nt, hsa
gaguggaucaccuaaggucagaaguucaagagcacccuggcuaacauggugaaaccccaucucua

SEQ ID NO: 181358 - RNA, 65 nt, hsa
acgggcccaugacaaggucaggagaucgagaccguccuggcuaacacggugaaaccccaucucua

SEQ ID NO: 181359 - RNA, 65 nt, hsa
gggcagaucaccugagaucaaguauuugagaacagccuggcuaacauggcgaauccucguuuuga

SEQ ID NO: 181360 - RNA, 65 nt, hsa
gcaagagcaucacgaggucaggagaucgagaaaauccuggcuaacacggugaaaccccaucucua

SEQ ID NO: 181361 - RNA, 65 nt, hsa
gcgggcagaucgcgaggucaggagaucgagaccauccuggcuaacguggagaaaccccgucucua

SEQ ID NO: 181362 - RNA, 65 nt, hsa
caaaguagcuaggauuacaggugccugccaccaugccuggcuaauuuuuucuauuuuuaguagag

SEQ ID NO: 181363 - RNA, 65 nt, hsa
ccaagcagcugggaugacagacuugcgucacuacaccuggcuaauuuuaaaauuuuuuguaagga

SEQ ID NO: 181364 - RNA, 65 nt, hsa
gaugcaggaacuccuggacuccuuggugggcuggcccuggcuagcccuugggccucggagaugau

SEQ ID NO: 181365 - RNA, 65 nt, hsa
guguguuugccagcucaggagcugucuccucucuaccuggcuaguaagaggugggacaguaaugg

SEQ ID NO: 181366 - RNA, 65 nt, hsa
augacuuuuggcaucauucagagccagguuugaauccuggcuauaaaacucaagggacucuuucc

SEQ ID NO: 181367 - RNA, 65 nt, hsa
gcgcuugcaccacuuccgucccauccuugcggguaccuggcuaugcgggggugccuaaggagccu

SEQ ID NO: 181368 - RNA, 65 nt, hsa
cugaguagcugggauuacaggcgcacgccaccacgccuggcuaauuuuuguauuuuuaguacaga

SEQ ID NO: 181369 - RNA, 65 nt, hsa
aagggaaaugacgaccaagagaagaagcuuaaaguccuggcuaauuguguggucauuggaaaacu

SEQ ID NO: 181370 - RNA, 65 nt, hsa
gcugguggaucacaaggucaggagauugagaccauccuggcuaacacagugaaaccccgucucua

SEQ ID NO: 181371 - RNA, 65 nt, hsa
guuugaggagggagacagaugcuuggaccugggugccuggcuauggagauugaccaagcaagauc

SEQ ID NO: 181372 - RNA, 65 nt, hsa
ccaaguagugugaacuaaaggcaugugccaccacgccuggcuaauuuuuguauuuuuaguagaga

SEQ ID NO: 181373 - RNA, 65 nt, hsa
gcacgggcuggaggaggaggcauggcacaagugacccuggcuaaggagggagggagccucaaauc

SEQ ID NO: 181374 - RNA, 65 nt, hsa
cagaauagcugggauuacaggcguacaccaccaugccuggcuaauuuuuuuguauuuuuaguaga

SEQ ID NO: 181375 - RNA, 65 nt, hsa
agcccagccuuauccagcagcgccuuccagccuucccuggcuagcccaaauggcacuaaggaggc

SEQ ID NO: 181376 - RNA, 65 nt, hsa
ccgaguagcugggacuacaggugcacaccaccacaccuggcuaauuuuuuguauuuuuaguagag

SEQ ID NO: 181377 - RNA, 65 nt, hsa
gcgggcggaucaauaggucaggaaauccagaccguccuggcuaacauggugaaaccccgucucua

SEQ ID NO: 181378 - RNA, 65 nt, hsa
gcagguggaucacgaggucaggagaucgacaccauccuggcuaacacggugaaaccccgucucua

SEQ ID NO: 181379 - RNA, 65 nt, hsa
agaagaauuugugagcaacuucccgacaguaaggcccuggcuagaccucaggauggucccugccu

SEQ ID NO: 181380 - RNA, 65 nt, hsa
ccaaguagcugggauuacaggcaugagcuaccacgccuggcuaauuuuuuguauuuuuaguagag

SEQ ID NO: 181381 - RNA, 65 nt, hsa
ccuaguagcuggaauuacaggcaugagccaccacgccuggcuaauuuuuguauuuuuaguagaga

SEQ ID NO: 181382 - RNA, 65 nt, hsa
gcgagcagaucacgaggucaggagaccgagaccauccuggcuaacauggugaaacccugucucua

SEQ ID NO: 181383 - RNA, 65 nt, hsa
ccaaauagcugggacuacaggcacaggccaccacaccuggcuaauuuuuuuguauuuuuugugga

SEQ ID NO: 181384 - RNA, 65 nt, hsa
aggcgagguaccuaccacuuuuuuuuuuuucuuccccuggcuacuugaguagaaugcauuauacc

SEQ ID NO: 181385 - RNA, 65 nt, hsa
ccaaguagcugggauuacaggcacgcgccaccacaccuggcuaauucuauuuaguagaaauggag

SEQ ID NO: 181386 - RNA, 65 nt, hsa
gcgggcggaucaugaggucaggagaucgcgaccauccuggcuaacagugaaacccugucuccacu

SEQ ID NO: 181387 - RNA, 65 nt, hsa
gcagguagaucacaaggucaggaaauugagaccauccuggcuaauacagugaaaccccaugucug

SEQ ID NO: 181388 - RNA, 65 nt, hsa
caccccuaaguccccaccugggcuccugccccgccccuggcuagcagcgccuucuccaccggggc

SEQ ID NO: 181389 - RNA, 65 nt, hsa
caguuaggagggacagacagcucuuccuuucggagccuggcuagucuaggacaucaccuugcugu

SEQ ID NO: 181390 - RNA, 65 nt, hsa
ugucuacugugccucaggauaaggacccgccaugcccuggcuagacagugugugguuaguaggaa

SEQ ID NO: 181391 - RNA, 65 nt, hsa
augcucagggccaccugagacugucacugcucuccccuggcuacugggaggagucacugagagcu

SEQ ID NO: 181392 - RNA, 65 nt, hsa
cuaugaaccagccccacagccccaggccccugucaccuggcuaugcccacucaucccacccgucu

SEQ ID NO: 181393 - RNA, 65 nt, hsa
ccaaguagcugggauuacaggcaugcaccaccaugccuggcuaauuuuguauuuuuaguagagau

SEQ ID NO: 181394 - RNA, 65 nt, hsa
ccgaguagcugggacuacaggcgugugccaccaugccuggcuaauuuuuguauuuuuaguagaga

SEQ ID NO: 181395 - RNA, 65 nt, hsa
agcaaacuaaacaauaaaggacagcucucuucucuccuggcuaaagcugcucuccugguucagaa

SEQ ID NO: 181396 - RNA, 65 nt, hsa
gcgggcggaucacgaggucaggagaucgagaccauccuggcuaacacagugaaaccccgucucua

SEQ ID NO: 181397 - RNA, 65 nt, hsa
gcggguggaucacgaggucaggagaucgagaccauccuggcuaacacggugaaacccugucucua

SEQ ID NO: 181398 - RNA, 65 nt, hsa
aaaaugagcugggugugaugauacaugccuguaauccuggcuacuugggaggcugaggcaugaga

SEQ ID NO: 181399 - RNA, 65 nt, hsa
ggugggcggaucacgaggucaggagauugagaccuccuggcuaacacggugaaaccccgucuuua

SEQ ID NO: 181400 - RNA, 65 nt, hsa
ggggagacagagucuggguuccagggcugcugucuccuggcuaauaaucuccagccagcuggagg

SEQ ID NO: 181401 - RNA, 65 nt, hsa
ggggagacagagucuggguuccagggcugcuuucuccuggcuaauaauaaauauccagccagcug

SEQ ID NO: 181402 - RNA, 65 nt, hsa
cugaguagcugggacuacaggugcgugccaccaugccuggcuaauuuuuuguauuuuuaguacag

SEQ ID NO: 181403 - RNA, 65 nt, hsa
cagcaccugcuggggugggaaagggccccagcugaccuggcuaugggugccacuggagcuagaac

SEQ ID NO: 181404 - RNA, 65 nt, hsa
ccccugcaaaugggacagccccccaguucaugaggccuggcuauugcaauauuuacuaguagagg

SEQ ID NO: 181405 - RNA, 65 nt, hsa
ccuaguggcugggauuacaggcgccugcuaccaugccuggcuaauuuuuguauuuuuaguagaga

SEQ ID NO: 181406 - RNA, 65 nt, hsa
gugacauggccucuggguggggucuggccguuggcccuggcuaaugucucucagucauuccccug

SEQ ID NO: 181407 - RNA, 65 nt, hsa
aaacuuagcugggcaugguggugcaugccugugguccuggcuacuugggaggcugaggauggagg

SEQ ID NO: 181408 - RNA, 65 nt, hsa
cugaguagcugggaauacaggcaugcgccacuacaccuggcuaauuuuuguauuuuuaguugaga

SEQ ID NO: 181409 - RNA, 65 nt, hsa
gccugcuggggauuacucgaucaaaaccuuccuucccuggcuacuucccuuccucccggggccuu

SEQ ID NO: 181410 - RNA, 65 nt, hsa
uggcaacagucuuacugaagaacauucccagugccccuggcuaggggcagagggcacugccaggc

SEQ ID NO: 181411 - RNA, 65 nt, hsa
ucaauggcugaauaguuccuuaaaucagacaagcuccuggcuaucuucauaaccagcagugagua

SEQ ID NO: 181412 - RNA, 65 nt, hsa
gcagguggaucacgaggucaggagaucgagaccauccuggcuaacacggugaaaccccgucucua

SEQ ID NO: 181413 - RNA, 65 nt, hsa
aguugucucuuuaucaugguuuaccagguagagugccuggcuauuacuauauaaugaagcccacu

SEQ ID NO: 181414 - RNA, 65 nt, hsa
uacaaaaauuaggugugguggcgggcaccuguaauccuggcuacucgggaggcugaggcaggaga

SEQ ID NO: 181415 - RNA, 65 nt, hsa
gcgugugguggagugauugucugugaaugacaggcccuggcuauugauugauguugcaucaauuu

SEQ ID NO: 181416 - RNA, 65 nt, hsa
ccgaguagcugggauuacaggcaugcaccaccacaccuggcuaauuuuuguguuuuuaguagaga

SEQ ID NO: 181417 - RNA, 65 nt, hsa
ccgaguagcugagauuauaggcgugcaccaccacaccuggcuaauuuuuguauuuuuaguagaga

SEQ ID NO: 181418 - RNA, 65 nt, hsa
gcaguucuccaucuagucacaccaaaggcaaaaagccuggcuaccuccccccuagcacgugaguc

SEQ ID NO: 181419 - RNA, 65 nt, hsa
cugaguagcugggacuacaggcgccagccaccaugccuggcuaauuuuuguauuuuuaguagagg

SEQ ID NO: 181420 - RNA, 65 nt, hsa
gucuugcuaucauuguuccuacuucccuaggaagcccuggcuaccuuucgcauuaggaccagucu

SEQ ID NO: 181421 - RNA, 65 nt, hsa
uuuaggcgucuucggauaucuucucaccuauguucccuggcuaagaagucagagguagccaaugu

SEQ ID NO: 181422 - RNA, 65 nt, hsa
uuggggagggaagagccuugauguccagcacacagccuggcuauaaagacacgaagcgaccuacc

SEQ ID NO: 181423 - RNA, 65 nt, hsa
auugacagcaucuggauuaugaauacaccuggcacccuggcuaccagaauuucauaugggcagaa

SEQ ID NO: 181424 - RNA, 64 nt, hsa
uacucaguaaggcagugcaguacucaguaacacaauacaguacucaggcagugcaguacucagu

SEQ ID NO: 181425 - RNA, 64 nt, hsa
aguguaguacucaguaacagugaaguacucaguaauacaguacaguauucaguaaggcagugaa

SEQ ID NO: 181426 - RNA, 64 nt, hsa
uauucaguaaggcagugaaguacucaguaauacaauacaguacucaguuaggcagugcaguacu

SEQ ID NO: 181427 - RNA, 64 nt, hsa
ugcaguacucaguaacacagugcaguacucaguaauacaguacaguacucaguaaggcaguaug

SEQ ID NO: 181428 - RNA, 64 nt, hsa
ggguacaaaucuguacaacauguuacuguauugaauacaguaggcaauuguaacacaaugguaa

SEQ ID NO: 181429 - RNA, 64 nt, hsa
uccauccuugagagaguggguguaguuaucauuuauacaguaaucauugcauuuuaaaaucuuc

SEQ ID NO: 181430 - RNA, 64 nt, hsa
gcuguaaaauaaguagauagcugcuguuaauauaauacaguacauuuuggggggcauaugugug

SEQ ID NO: 181431 - RNA, 64 nt, hsa
acuggugugauaucuuguaugaaugaucauuuaaauacaguacauuacuguagaagcuaaauug

SEQ ID NO: 181432 - RNA, 64 nt, hsa
uuagauauaguuucuuaauaggauagauacccacauacaguauaauauaucccauucagguuuc

SEQ ID NO: 181433 - RNA, 64 nt, hsa
ucuggaaagaaagccugccaggaaauaaauucaaauacaguaugagcugcggggauauuuuugu

SEQ ID NO: 181434 - RNA, 64 nt, hsa
ggcaguaaccgauuuuaaugacuagcuuuuaaaaauacaguacaaagacuuuguaaaugugauu

SEQ ID NO: 181435 - RNA, 64 nt, hsa
guuuguguuucuguguuucauauucagugauuuaauacaguaucauggcugagguggauggggc

SEQ ID NO: 181436 - RNA, 64 nt, hsa
uauguagaaagauacauuaagggugaaaauagcaauacaguagauuugaauaccuugauguuuu

SEQ ID NO: 181437 - RNA, 64 nt, hsa
uuaaaugugcaaauacuguauucaagugaaaaaaauacaguauuuguagauaaccauagcuacu

SEQ ID NO: 181438 - RNA, 64 nt, hsa
caaauuaguaaaguuuuauggaagcugaaauguaauacaguagucuccccuuaucuguaagaga

SEQ ID NO: 181439 - RNA, 64 nt, hsa
aacuguugaauucacuuuugugccauuuuuguaaauacaguaguuuugcacaaccucucacaaa

SEQ ID NO: 181440 - RNA, 64 nt, hsa
auauauauaguuaugcauacauacacacacacacauacaguauauucuuuccucaaaaggguua

SEQ ID NO: 181441 - RNA, 64 nt, hsa
auagggaccuagaagcuuaacacuauuuaaguaaauacaguagaagcucacaaauagauuucuu

SEQ ID NO: 181442 - RNA, 64 nt, hsa
cacaaacacacauaagaauacacucuggagaaagaccuuauaaauguaagacaugugggaaagg

SEQ ID NO: 181443 - RNA, 64 nt, hsa
cacaaacacacguaagaaugcacucuguagaaagaccuuauaaauguaagauaugugggaaagg

SEQ ID NO: 181444 - RNA, 64 nt, hsa; identical to SEQ ID NO: 99247

SEQ ID NO: 181445 - RNA, 64 nt, hsa; identical to SEQ ID NO: 99248

SEQ ID NO: 181446 - RNA, 64 nt, hsa; identical to SEQ ID NO: 99249

SEQ ID NO: 181447 - RNA, 64 nt, hsa; identical to SEQ ID NO: 99250

SEQ ID NO: 181448 - RNA, 64 nt, hsa; identical to SEQ ID NO: 99251

SEQ ID NO: 181449 - RNA, 64 nt, hsa; identical to SEQ ID NO: 99252

SEQ ID NO: 181450 - RNA, 64 nt, hsa; identical to SEQ ID NO: 99253

SEQ ID NO: 181451 - RNA, 64 nt, hsa; identical to SEQ ID NO: 99254

SEQ ID NO: 181452 - RNA, 64 nt, hsa; identical to SEQ ID NO: 99255

SEQ ID NO: 181453 - RNA, 64 nt, hsa; identical to SEQ ID NO: 99256

SEQ ID NO: 181454 - RNA, 64 nt, hsa; identical to SEQ ID NO: 99257

SEQ ID NO: 181455 - RNA, 64 nt, hsa; identical to SEQ ID NO: 99258

SEQ ID NO: 181456 - RNA, 64 nt, hsa; identical to SEQ ID NO: 99259

SEQ ID NO: 181457 - RNA, 64 nt, hsa; identical to SEQ ID NO: 99260

SEQ ID NO: 181458 - RNA, 64 nt, hsa; identical to SEQ ID NO: 99261

SEQ ID NO: 181459 - RNA, 64 nt, hsa; identical to SEQ ID NO: 99262

SEQ ID NO: 181460 - RNA, 64 nt, hsa; identical to SEQ ID NO: 99263

SEQ ID NO: 181461 - RNA, 64 nt, hsa; identical to SEQ ID NO: 99264

SEQ ID NO: 181462 - RNA, 64 nt, hsa; identical to SEQ ID NO: 99265

SEQ ID NO: 181463 - RNA, 64 nt, hsa; identical to SEQ ID NO: 99266

SEQ ID NO: 181464 - RNA, 64 nt, hsa; identical to SEQ ID NO: 99267

SEQ ID NO: 181465 - RNA, 64 nt, hsa; identical to SEQ ID NO: 99268

SEQ ID NO: 181466 - RNA, 64 nt, hsa; identical to SEQ ID NO: 99269

SEQ ID NO: 181467 - RNA, 64 nt, hsa; identical to SEQ ID NO: 99270

SEQ ID NO: 181468 - RNA, 64 nt, hsa; identical to SEQ ID NO: 99271

SEQ ID NO: 181469 - RNA, 61 nt, hsa
agcccccuuccagucaugaaacuucauuuguuuuauccauaucccugaggacuguguagac

SEQ ID NO: 181470 - RNA, 61 nt, hsa
acugaaauugcauggaucaaguaagcauaguuuuauccagggagaaaaauaaaaggaagcc

SEQ ID NO: 181471 - RNA, 61 nt, hsa
aaaguaugagaaacacaguuuguccucuccuuuuauccaagcaggaagauucuauauccug

SEQ ID NO: 181472 - RNA, 61 nt, hsa
ucugcauuccaaacagcauccuaccuggguuuuuauccacaaagguagcggccacaugguu

SEQ ID NO: 181473 - RNA, 61 nt, hsa
aacuccauuccagucucugcauguaaucaguuuuauccacagaaacauuuucauuuuagga

SEQ ID NO: 181474 - RNA, 61 nt, hsa
ucuuacagacugcauguaguuggguauaauuuuuauccagucuaaaaauaucugucuuuua

SEQ ID NO: 181475 - RNA, 61 nt, hsa
augcguauggucucagccaagugacucgacguuuauccacuucuguucauuugaucguuuc

SEQ ID NO: 181476 - RNA, 61 nt, hsa
uggcuggaccaugaggcugucuccccacagcuuuauccaagccuccaaggucaggauggga

SEQ ID NO: 181477 - RNA, 61 nt, hsa
gggagcaaggagaaaaaugggaagaaccaguuuuauccaucuuaaaacgccaggcaccucu

SEQ ID NO: 181478 - RNA, 61 nt, hsa
ccaacauguauccaaauuaagcccccuuaccuuuauccagacccuuucacaaacaaguucu

SEQ ID NO: 181479 - RNA, 61 nt, hsa
cugcagucccaauuuaaaaaugcagaacugcuuuauccaagaaugcugaaaaauacuguuc

SEQ ID NO: 181480 - RNA, 61 nt, hsa
uucauuguuaaguagaauauguauguugcauuuuauccauaagaaauaaagagaaaaaaac

SEQ ID NO: 181481 - RNA, 61 nt, hsa
cauuaguacguguggcagaaguuuauuuauuuuuauccaguauagaauucaauuauaugau

SEQ ID NO: 181482 - RNA, 61 nt, hsa
uauagaauucaauuauaugauuauaucacaauuuauccauucugcuguugauggacuuuua

SEQ ID NO: 181483 - RNA, 61 nt, hsa
cuugcccauugccugucucucgccaauuccguuuauccaaaaagguacauguuuuuguauu

SEQ ID NO: 181484 - RNA, 61 nt, hsa
aauaaauaaauaaauaaguuaaaauuaauucuuuauccagagucgggugcuuuagaauuua

SEQ ID NO: 181485 - RNA, 61 nt, hsa
uuuaaauaauuuacucucuacuuuuauccauuuuauccauuuuaacucauguaauccucau

SEQ ID NO: 181486 - RNA, 61 nt, hsa
uugauaaaguuuaaauaauuuacucucuacuuuuauccauuuuauccauuuuaacucaugu

SEQ ID NO: 181487 - RNA, 61 nt, hsa
aaagucaguuauucauguuuucauuuaaaguuuuauccaauauucuaggaauuuucagcaa

SEQ ID NO: 181488 - RNA, 61 nt, hsa
caaagacacaguuguucauguuauuuaaaguuuuauccaguauucuaggaauuuucagcaa

SEQ ID NO: 181489 - RNA, 64 nt, hsa
uucaguaguuauugccaauauuguuguuggucaauggcuugaagauaaacuuucuaauaauuau

SEQ ID NO: 181490 - RNA, 64 nt, hsa
uuagauaaauacuuauacuuugcaaagucaaaaauggcuugauuuuuggaaacaauauagaggu

SEQ ID NO: 181491 - RNA, 64 nt, hsa
ugagugcaacuguggcuuagcuaauauugcaauguggcuugaauguagguagcauccuuugaug

SEQ ID NO: 181492 - RNA, 64 nt, hsa
ucacaaugaaauuauauuuucuuuguaaagaaaguggcuugaaaucuuuuuuguucaaagauua

SEQ ID NO: 181493 - RNA, 64 nt, hsa
ggacuggcaggcggggccucaagccugcagccacuggcuugauugggcccuggacguugagccc

SEQ ID NO: 181494 - RNA, 64 nt, hsa
aagggcuccacugcugacaagguuugagaacugcuggcuugaggugagaaccccuuuaaccucu

SEQ ID NO: 181495 - RNA, 64 nt, hsa
ggggugcuuccaagaggcaugagagugccuacucuggcuugagcacuucuauaugcaaggugaa

SEQ ID NO: 181496 - RNA, 64 nt, hsa
aauuggcucuuucuaaaucaugugacguuuugacuggcuugagauucagaugcauaauuuuuaa

SEQ ID NO: 181497 - RNA, 64 nt, hsa
agaaaccuuuuucuacuuacuaucauuuuuauuguggcuugagcucagucaaucuggugcagau

SEQ ID NO: 181498 - RNA, 64 nt, hsa
uuggcagaucuugacaggcuggaccugcaagauguggcuugaauuuuaaccauuuauuacauaa

SEQ ID NO: 181499 - RNA, 64 nt, hsa
ugugugaaaggaggguuuugccucuucuugagcauggcuugaguugguaaggaaagcuguaacu

SEQ ID NO: 181500 - RNA, 64 nt, hsa
ugcuaccccuaagaucgagcuuguuuucagugacuggcuugagucauaggaggaggagucuggu

SEQ ID NO: 181501 - RNA, 64 nt, hsa
ucauuucaugauguaaagaaacugaacagugaaguggcuugauugcuuaaacuauugacuuggu

SEQ ID NO: 181502 - RNA, 64 nt, hsa; identical to SEQ ID NO: 181501

SEQ ID NO: 181503 - RNA, 64 nt, hsa
auccugggcucagcugccccugucugaagggucuuggcuugauugcagaaggacaaccuccgca

SEQ ID NO: 181504 - RNA, 64 nt, hsa
ucuggacagaaagaugcccguuuggccaggcugguggcuugauggguguaccuggagagggggu

SEQ ID NO: 181505 - RNA, 64 nt, hsa
accuagaaguaaugauauacaguuuucuuccuaguggcuugaaaaucuggacuuccucaauuau

SEQ ID NO: 181506 - RNA, 64 nt, hsa
gagugccuggcuauuacuauauaaugaagcccacuggcuugacuuguaaguucaaccuaaacca

SEQ ID NO: 181507 - RNA, 64 nt, hsa; identical to SEQ ID NO: 48749

SEQ ID NO: 181508 - RNA, 64 nt, hsa; identical to SEQ ID NO: 48750

SEQ ID NO: 181509 - RNA, 64 nt, hsa; identical to SEQ ID NO: 48751

SEQ ID NO: 181510 - RNA, 64 nt, hsa; identical to SEQ ID NO: 48752

SEQ ID NO: 181511 - RNA, 64 nt, hsa; identical to SEQ ID NO: 48753

SEQ ID NO: 181512 - RNA, 64 nt, hsa; identical to SEQ ID NO: 48754

SEQ ID NO: 181513 - RNA, 64 nt, hsa; identical to SEQ ID NO: 48755

SEQ ID NO: 181514 - RNA, 64 nt, hsa; identical to SEQ ID NO: 48756

SEQ ID NO: 181515 - RNA, 64 nt, hsa; identical to SEQ ID NO: 48757

SEQ ID NO: 181516 - RNA, 64 nt, hsa; identical to SEQ ID NO: 48758

SEQ ID NO: 181517 - RNA, 64 nt, hsa
ggagacaagacuuggagacucagcgaugucaggccagggccauggccacacuggcccacacauu

SEQ ID NO: 181518 - RNA, 64 nt, hsa
gagaauuucuaugaagcccacucacuugccauuccagggccaaaggaccggagguuugcauauc

SEQ ID NO: 181519 - RNA, 64 nt, hsa
augcucauuccaugacucugccuaaccaugggcucagggccagguccucacagcagucacaggc

SEQ ID NO: 181520 - RNA, 64 nt, hsa
cagggaccacauccaccccagccccacugcccuccagggccaggauucaggccucugaggagcc

SEQ ID NO: 181521 - RNA, 64 nt, hsa
cugcuccgacucucagggcugccucccugagcuccagggccagaaugccuggaugccuggguag

SEQ ID NO: 181522 - RNA, 64 nt, hsa
gcgccaugucaggcuguuguggguaucccccuggcagggccagcuaggccugugguucccugcu

SEQ ID NO: 181523 - RNA, 64 nt, hsa
ccacagccagggcagccugcuggagccacagggccagggccaugcagauggaggccucugggag

SEQ ID NO: 181524 - RNA, 64 nt, hsa
ggcuacccacagccagggcagccugcuggagccacagggccagggccaugcagauggaggccuc

SEQ ID NO: 181525 - RNA, 64 nt, hsa
gaacaaaacaaaguaugcagagacagagcauuugcagggccaccuggaggcuggggugcugggg

SEQ ID NO: 181526 - RNA, 64 nt, hsa
cucuggcagggccugagcuggggcaggccucccucagggccaggggcgauggcaccccggggac

SEQ ID NO: 181527 - RNA, 64 nt, hsa
uagauccuggcucggaccacugcaagggccgaggcagggccagaccagagcauccuggguacag

SEQ ID NO: 181528 - RNA, 64 nt, hsa
guguccuuguccacucgcaccccucgccgcccaccagggccaugcucugugacuugggcugauc

SEQ ID NO: 181529 - RNA, 64 nt, hsa
aggcgcggccucccgaggaggggcccgguggcggcagggccaggcugguccgagcugaggacuc

SEQ ID NO: 181530 - RNA, 64 nt, hsa
ucgcccaggaaggccuaggcuaggacguuggccucagggccaggaaggacagacuggccgggca

SEQ ID NO: 181531 - RNA, 64 nt, hsa
cccucgucugggaauucgagagaggaggaggacccagggccaaaggaauccucaaacuucccuc

SEQ ID NO: 181532 - RNA, 64 nt, hsa
uagguccuggguggaggaagaagugguggagccucagggccagggcaggcaggagcaggcacug

SEQ ID NO: 181533 - RNA, 64 nt, hsa
gggguggcagguaccacaguguaggcagcagggucagggccaaagucuaugcguuccaucucca

SEQ ID NO: 181534 - RNA, 64 nt, hsa
ccaauuuggaagccauccagcugaugcuaacagccagggccagucccuccagcuggucccaugu

SEQ ID NO: 181535 - RNA, 64 nt, hsa
gagcacaaagacacgaagucaugggccuggggcccagggccaggguggggcccaggccacuggc

SEQ ID NO: 181536 - RNA, 64 nt, hsa
acgacugacucucucccagcugcucugggagucucagggccaagccuguaucucuucacucugc

SEQ ID NO: 181537 - RNA, 64 nt, hsa
acaccauuuauaccacagguccagaugaauccugcagggccaaggucugggggugcuggaggcc

SEQ ID NO: 181538 - RNA, 64 nt, hsa
uccaucccugagcucucggcuccuccuccgucuucagggccagggcguagcgucugcucucucg

SEQ ID NO: 181539 - RNA, 64 nt, hsa
uuuauuucccugacccugccuucugccaugaccccagggccacuagucucuuccccuguuuuua

SEQ ID NO: 181540 - RNA, 64 nt, hsa
uaauagucugaaggaagaggcugugagggcaguucagggccagggcccacagggcaucugcuga

SEQ ID NO: 181541 - RNA, 64 nt, hsa
agugaacauauuccuaggcccuuucugccugugucagggccaggaaguagaggcugggaacucu

SEQ ID NO: 181542 - RNA, 64 nt, hsa
uagauauccuuggcacauccguaccaucggucagcagggccacugaguagucauuuugcccauu

SEQ ID NO: 181543 - RNA, 64 nt, hsa
ccugacuuagccgagguaaggucagugcagcagacagggccagacugggguguggggggcugag

SEQ ID NO: 181544 - RNA, 64 nt, hsa
caagcaccuugaaugggaggggccucacagagggcagggccaggguccagcagggguggggggu

SEQ ID NO: 181545 - RNA, 64 nt, hsa
agggccaaggguccagagaagugauaacuuggcccagggccacacagcagagguagaggguccu

SEQ ID NO: 181546 - RNA, 64 nt, hsa
uaggccccugagagcuggacagagcagagaacuacagggccaaggguccagagaagugauaacu

SEQ ID NO: 181547 - RNA, 64 nt, hsa
gccaugccugcucccugucugugucccagccacgcagggccauccacugugacgucggccgacc

SEQ ID NO: 181548 - RNA, 64 nt, hsa
ucccccuccugcugugcuggaauuccacagggaccagggccaccgcaggggacugucucagaag

SEQ ID NO: 181549 - RNA, 53 nt, hsa
augcagagacucuguacugaggccagggccagggccaggggacucugugaguc

SEQ ID NO: 181550 - RNA, 59 nt, hsa
augcagagacucuguacugaggccagggccagggccaggggacucugugagucuggcuc

SEQ ID NO: 181551 - RNA, 64 nt, hsa
cgcugguaugggggcucggaccccucacuggggacagggccaguguuggagaauucugauuccu

SEQ ID NO: 181552 - RNA, 64 nt, hsa
agacgaggcugcauccugagccccugcaugcacccagggccacccggcagcacacucaucccgc

SEQ ID NO: 181553 - RNA, 64 nt, hsa
gaaauggcgaagccagccaccaggucgcuggugacagggccaggguuaugcaggaagguggugc

SEQ ID NO: 181554 - RNA, 64 nt, hsa
gugacaagggguccucgucugccccccaaugcuccagggccaguccuaaggagcugagggucug

SEQ ID NO: 181555 - RNA, 64 nt, hsa
gucccaguccucggccacccccagcucuggaucccagggccagcugcccucuggcucuggcugu

SEQ ID NO: 181556 - RNA, 64 nt, hsa
cucuggcuguggcucccgccuguccggcagggcccagggccagcgucgggcacagggcagcucc

SEQ ID NO: 181557 - RNA, 64 nt, hsa
cacgucuucgugcauucgccaacacgugcccucacagggccagcguccuccuucccugcgcaag

SEQ ID NO: 181558 - RNA, 64 nt, hsa
cuucagaggcuccuccugggacugggaaccgccgcagggccaggcggacggcgugagguuugug

SEQ ID NO: 181559 - RNA, 64 nt, hsa
aggcccgucugccagggcgccggccacaauccugcagggccaaggacuggacuccaggcaaguc

SEQ ID NO: 181560 - RNA, 64 nt, hsa
ccccaggggcgucgaccuggcccagcuggguccccagggccagcacauggaauaaaauagccag

SEQ ID NO: 181561 - RNA, 64 nt, hsa
ggguccccagggccagcacauggaauaaaauagccagggccacacucagcccagcucuguccug

SEQ ID NO: 181562 - RNA, 64 nt, hsa
guguuuaguggggaaagggacggggugcagacggcagggccaguauggggcccccucccucucc

SEQ ID NO: 181563 - RNA, 64 nt, hsa
gcagggggcuaggggaggacucagaggccaucugcagggccaagccacaggaagggcugagcug

SEQ ID NO: 181564 - RNA, 64 nt, hsa
ccagccccaguuucccauugcuccucucugcggccagggccagguggguucauauuuacagaua

SEQ ID NO: 181565 - RNA, 64 nt, hsa
agugaaggaacagaggcagggggugggccagccccagggccaggguccccuuggugaagccgug

SEQ ID NO: 181566 - RNA, 64 nt, hsa
gucccccaugcaacaggcccaguggcuuccccuucagggccacaacaggcuguagaaggggaug

SEQ ID NO: 181567 - RNA, 64 nt, hsa
gccagcgggcagggaaaugggccaaugcaugcuucagggccacacccagcaguuucccuguccu

SEQ ID NO: 181568 - RNA, 64 nt, hsa
aggagggagagggagucugagcaugagaugcaaccagggccagcgggcagggaaaugggccaau

SEQ ID NO: 181569 - RNA, 62 nt, hsa
ucaggacacaggucauggagguucuucccaagcuggcagaggccauuuguggaaaguggaga

SEQ ID NO: 181570 - RNA, 62 nt, hsa
accucauagccagcucuacacagaggucucuccuggcagaaagcaggcgaagggcaggagga

SEQ ID NO: 181571 - RNA, 62 nt, hsa
ccauuuacgauucucacugacuccccgucuuccuggcagacacaaauaaacccagugucagg

SEQ ID NO: 181572 - RNA, 62 nt, hsa
gagaccugggacucuguauuucuauaguucuccuggcagagccuuugagaauggggagaaac

SEQ ID NO: 181573 - RNA, 62 nt, hsa
cagggagaauggggagagggaccuccuugugucuggcagagaccuguggaccuggccucccc

SEQ ID NO: 181574 - RNA, 62 nt, hsa
ccgccccugggguuggcagccucaguuggccccuggcagaggaacaaggacacagacauucc

SEQ ID NO: 181575 - RNA, 62 nt, hsa
ccuuccuuaggacuuccagaguucaguuccuucuggcagagagguuuucuuucuccaugcca

SEQ ID NO: 181576 - RNA, 62 nt, hsa
acccuccucuagaauuuaguggcgggucugggcuggcagagguagggggcugcuuugggcuu

SEQ ID NO: 181577 - RNA, 62 nt, hsa
auuuucaaaagcaauucuucggugcuguguagcuggcagaaaguucuguccaguaaacgcag

SEQ ID NO: 181578 - RNA, 62 nt, hsa
uggaagaaauagcaggagagaggacccauuagcuggcagacccagggggaagaaaggagggc

SEQ ID NO: 181579 - RNA, 62 nt, hsa
uucagucccucuccccaaagacuagacgugaccuggcagauuagcaggauccucuuggccuu

SEQ ID NO: 181580 - RNA, 62 nt, hsa
aggcaaccuuguguucucugugcccucagggacuggcagagcaagaggccaucagaaggacg

SEQ ID NO: 181581 - RNA, 62 nt, hsa
gagcaugcccgagagccuggacagcccaaccucuggcagaccagggguuaccagccucacag

SEQ ID NO: 181582 - RNA, 62 nt, hsa
uauuuaauucaccagcaguaauccuuuaauaacuggcagagcacuuuauucuucuggugagc

SEQ ID NO: 181583 - RNA, 62 nt, hsa
ugccccauggugggcaggcagaugaugaaguacuggcagauuugcaggcugggaaggcuaga

SEQ ID NO: 181584 - RNA, 62 nt, hsa
ccacccuucucuccuuuccucauccuaagugccuggcagaugaaggaguuuucaggagcuuu

SEQ ID NO: 181585 - RNA, 62 nt, hsa
aguuggcgagggacacgaaggcugcggccgggcuggcagagggcccggccccuggggggagg

SEQ ID NO: 181586 - RNA, 62 nt, hsa
guuccacaagugccucuggagggcccugggcucuggcagaugguccuggugccccagacggg

SEQ ID NO: 181587 - RNA, 62 nt, hsa
gcucuccuugccucccaagggcucagaugcugcuggcagaguugucucgggagcggggugag

SEQ ID NO: 181588 - RNA, 62 nt, hsa
ugugcccucuugcccccaggaagggcagcuggcuggcagacaaggugaagaggcugaugcgg

SEQ ID NO: 181589 - RNA, 62 nt, hsa
gcccugugugggaccacacugucaucucgcugcuggcagaaaagccugaucccaggaggccc

SEQ ID NO: 181590 - RNA, 62 nt, hsa
ggcacagccuggcagggaccucguccccaagccuggcagaaugagagggguugaggucccga

SEQ ID NO: 181591 - RNA, 62 nt, hsa
cuauagcugcugcuuuuucuugguccuuggggcuggcagacccauagaccauggccuguuag

SEQ ID NO: 181592 - RNA, 62 nt, hsa
ucccaccagcuguuucagauagauccuuacagcuggcagaguaaaaguggucccgcuaccau

SEQ ID NO: 181593 - RNA, 62 nt, hsa
augaggagacagaauagagugauaggaagcgucuggcagauacuccuuuugccacugcugug

SEQ ID NO: 181594 - RNA, 62 nt, hsa
cugcccagacagccgcagugaggaugagcguccuggcagagacgcaguugucucugggcgcu

SEQ ID NO: 181595 - RNA, 62 nt, hsa
gccccagcauuguguugugaggcgcacuguuccuggcagauauugugcccccuggagcagug

SEQ ID NO: 181596 - RNA, 62 nt, hsa
ggaugaucagagaacuugggcauaggaacaaucuggcagaaguuuccagaaggaggucacuu

SEQ ID NO: 181597 - RNA, 62 nt, hsa
cccagggcaucgcuaaacccaaaugggggcugcuggcagaccccgagggugccuggccaguc

SEQ ID NO: 181598 - RNA, 62 nt, hsa
gacgcuggcuggcucgacuggcagagagagcgcuggcagaucugggagcuccugucgaccga

SEQ ID NO: 181599 - RNA, 62 nt, hsa
aguccgcgccugggggacgcuggcuggcucgacuggcagagagagcgcuggcagaucuggga

SEQ ID NO: 181600 - RNA, 56 nt, hsa; identical to SEQ ID NO: 44915

SEQ ID NO: 181601 - RNA, 64 nt, hsa; identical to SEQ ID NO: 44916

SEQ ID NO: 181602 - RNA, 64 nt, hsa; identical to SEQ ID NO: 44917

SEQ ID NO: 181603 - RNA, 64 nt, hsa; identical to SEQ ID NO: 44918

SEQ ID NO: 181604 - RNA, 64 nt, hsa; identical to SEQ ID NO: 44919

SEQ ID NO: 181605 - RNA, 64 nt, hsa; identical to SEQ ID NO: 44920

SEQ ID NO: 181606 - RNA, 64 nt, hsa; identical to SEQ ID NO: 44921

SEQ ID NO: 181607 - RNA, 64 nt, hsa; identical to SEQ ID NO: 44922

SEQ ID NO: 181608 - RNA, 64 nt, hsa; identical to SEQ ID NO: 44923

SEQ ID NO: 181609 - RNA, 64 nt, hsa; identical to SEQ ID NO: 44924

SEQ ID NO: 181610 - RNA, 64 nt, hsa; identical to SEQ ID NO: 44925

SEQ ID NO: 181611 - RNA, 64 nt, hsa; identical to SEQ ID NO: 44926

SEQ ID NO: 181612 - RNA, 64 nt, hsa; identical to SEQ ID NO: 44927

SEQ ID NO: 181613 - RNA, 64 nt, hsa; identical to SEQ ID NO: 44928

SEQ ID NO: 181614 - RNA, 64 nt, hsa; identical to SEQ ID NO: 44929

SEQ ID NO: 181615 - RNA, 64 nt, hsa; identical to SEQ ID NO: 44930

SEQ ID NO: 181616 - RNA, 64 nt, hsa; identical to SEQ ID NO: 44931

SEQ ID NO: 181617 - RNA, 64 nt, hsa; identical to SEQ ID NO: 44932

SEQ ID NO: 181618 - RNA, 64 nt, hsa; identical to SEQ ID NO: 44933

SEQ ID NO: 181619 - RNA, 64 nt, hsa; identical to SEQ ID NO: 45477

SEQ ID NO: 181620 - RNA, 64 nt, hsa; identical to SEQ ID NO: 45478

SEQ ID NO: 181621 - RNA, 64 nt, hsa; identical to SEQ ID NO: 45479

SEQ ID NO: 181622 - RNA, 64 nt, hsa; identical to SEQ ID NO: 45480

SEQ ID NO: 181623 - RNA, 64 nt, hsa; identical to SEQ ID NO: 45481

SEQ ID NO: 181624 - RNA, 64 nt, hsa; identical to SEQ ID NO: 45482

SEQ ID NO: 181625 - RNA, 64 nt, hsa; identical to SEQ ID NO: 45483

SEQ ID NO: 181626 - RNA, 64 nt, hsa; identical to SEQ ID NO: 45484

SEQ ID NO: 181627 - RNA, 64 nt, hsa; identical to SEQ ID NO: 45485

SEQ ID NO: 181628 - RNA, 64 nt, hsa; identical to SEQ ID NO: 45486

SEQ ID NO: 181629 - RNA, 64 nt, hsa; identical to SEQ ID NO: 45487

SEQ ID NO: 181630 - RNA, 56 nt, hsa; identical to SEQ ID NO: 45488

SEQ ID NO: 181631 - RNA, 64 nt, hsa; identical to SEQ ID NO: 45489

SEQ ID NO: 181632 - RNA, 64 nt, hsa; identical to SEQ ID NO: 45490

SEQ ID NO: 181633 - RNA, 64 nt, hsa; identical to SEQ ID NO: 45491

SEQ ID NO: 181634 - RNA, 64 nt, hsa; identical to SEQ ID NO: 45492

SEQ ID NO: 181635 - RNA, 64 nt, hsa; identical to SEQ ID NO: 45493

SEQ ID NO: 181636 - RNA, 64 nt, hsa; identical to SEQ ID NO: 45494

SEQ ID NO: 181637 - RNA, 64 nt, hsa; identical to SEQ ID NO: 45495

SEQ ID NO: 181638 - RNA, 64 nt, hsa; identical to SEQ ID NO: 45496

SEQ ID NO: 181639 - RNA, 64 nt, hsa; identical to SEQ ID NO: 45497

SEQ ID NO: 181640 - RNA, 64 nt, hsa; identical to SEQ ID NO: 45498

SEQ ID NO: 181641 - RNA, 64 nt, hsa; identical to SEQ ID NO: 45499

SEQ ID NO: 181642 - RNA, 64 nt, hsa; identical to SEQ ID NO: 45500

SEQ ID NO: 181643 - RNA, 64 nt, hsa; identical to SEQ ID NO: 45501

SEQ ID NO: 181644 - RNA, 64 nt, hsa; identical to SEQ ID NO: 45502

SEQ ID NO: 181645 - RNA, 64 nt, hsa; identical to SEQ ID NO: 45503

SEQ ID NO: 181646 - RNA, 64 nt, hsa; identical to SEQ ID NO: 45504

SEQ ID NO: 181647 - RNA, 64 nt, hsa; identical to SEQ ID NO: 45505

SEQ ID NO: 181648 - RNA, 64 nt, hsa; identical to SEQ ID NO: 45506

SEQ ID NO: 181649 - RNA, 64 nt, hsa; identical to SEQ ID NO: 45507

SEQ ID NO: 181650 - RNA, 64 nt, hsa; identical to SEQ ID NO: 45508

SEQ ID NO: 181651 - RNA, 64 nt, hsa; identical to SEQ ID NO: 45509

SEQ ID NO: 181652 - RNA, 64 nt, hsa; identical to SEQ ID NO: 45510

SEQ ID NO: 181653 - RNA, 64 nt, hsa; identical to SEQ ID NO: 45511

SEQ ID NO: 181654 - RNA, 64 nt, hsa; identical to SEQ ID NO: 45512

SEQ ID NO: 181655 - RNA, 64 nt, hsa; identical to SEQ ID NO: 45513

SEQ ID NO: 181656 - RNA, 64 nt, hsa; identical to SEQ ID NO: 45514

SEQ ID NO: 181657 - RNA, 64 nt, hsa; identical to SEQ ID NO: 45515

SEQ ID NO: 181658 - RNA, 64 nt, hsa; identical to SEQ ID NO: 45516

SEQ ID NO: 181659 - RNA, 64 nt, hsa; identical to SEQ ID NO: 45517

SEQ ID NO: 181660 - RNA, 64 nt, hsa; identical to SEQ ID NO: 45518

SEQ ID NO: 181661 - RNA, 64 nt, hsa; identical to SEQ ID NO: 45519

SEQ ID NO: 181662 - RNA, 64 nt, hsa; identical to SEQ ID NO: 45520

SEQ ID NO: 181663 - RNA, 64 nt, hsa; identical to SEQ ID NO: 45521

SEQ ID NO: 181664 - RNA, 64 nt, hsa; identical to SEQ ID NO: 45522

SEQ ID NO: 181665 - RNA, 64 nt, hsa; identical to SEQ ID NO: 45523

SEQ ID NO: 181666 - RNA, 64 nt, hsa; identical to SEQ ID NO: 45524

SEQ ID NO: 181667 - RNA, 64 nt, hsa; identical to SEQ ID NO: 45525

SEQ ID NO: 181668 - RNA, 64 nt, hsa; identical to SEQ ID NO: 45526

SEQ ID NO: 181669 - RNA, 64 nt, hsa; identical to SEQ ID NO: 45527

SEQ ID NO: 181670 - RNA, 64 nt, hsa; identical to SEQ ID NO: 45528

SEQ ID NO: 181671 - RNA, 64 nt, hsa; identical to SEQ ID NO: 45529

SEQ ID NO: 181672 - RNA, 64 nt, hsa; identical to SEQ ID NO: 45530

SEQ ID NO: 181673 - RNA, 64 nt, hsa; identical to SEQ ID NO: 45531

SEQ ID NO: 181674 - RNA, 64 nt, hsa; identical to SEQ ID NO: 45532

SEQ ID NO: 181675 - RNA, 64 nt, hsa; identical to SEQ ID NO: 45533

SEQ ID NO: 181676 - RNA, 64 nt, hsa; identical to SEQ ID NO: 45534

SEQ ID NO: 181677 - RNA, 64 nt, hsa; identical to SEQ ID NO: 45535

SEQ ID NO: 181678 - RNA, 64 nt, hsa; identical to SEQ ID NO: 45536

SEQ ID NO: 181679 - RNA, 64 nt, hsa; identical to SEQ ID NO: 45537

SEQ ID NO: 181680 - RNA, 64 nt, hsa; identical to SEQ ID NO: 45538

SEQ ID NO: 181681 - RNA, 64 nt, hsa; identical to SEQ ID NO: 45539

SEQ ID NO: 181682 - RNA, 64 nt, hsa; identical to SEQ ID NO: 45540

SEQ ID NO: 181683 - RNA, 64 nt, hsa; identical to SEQ ID NO: 45541

SEQ ID NO: 181684 - RNA, 64 nt, hsa; identical to SEQ ID NO: 45542

SEQ ID NO: 181685 - RNA, 64 nt, hsa; identical to SEQ ID NO: 45543

SEQ ID NO: 181686 - RNA, 64 nt, hsa; identical to SEQ ID NO: 45544

SEQ ID NO: 181687 - RNA, 64 nt, hsa; identical to SEQ ID NO: 45545

SEQ ID NO: 181688 - RNA, 64 nt, hsa; identical to SEQ ID NO: 45546

SEQ ID NO: 181689 - RNA, 64 nt, hsa; identical to SEQ ID NO: 45547

SEQ ID NO: 181690 - RNA, 64 nt, hsa; identical to SEQ ID NO: 45548

SEQ ID NO: 181691 - RNA, 64 nt, hsa; identical to SEQ ID NO: 45549

SEQ ID NO: 181692 - RNA, 64 nt, hsa; identical to SEQ ID NO: 45550

SEQ ID NO: 181693 - RNA, 64 nt, hsa; identical to SEQ ID NO: 45551

SEQ ID NO: 181694 - RNA, 64 nt, hsa; identical to SEQ ID NO: 45552

SEQ ID NO: 181695 - RNA, 64 nt, hsa; identical to SEQ ID NO: 45553

SEQ ID NO: 181696 - RNA, 64 nt, hsa; identical to SEQ ID NO: 45554

SEQ ID NO: 181697 - RNA, 64 nt, hsa; identical to SEQ ID NO: 45555

SEQ ID NO: 181698 - RNA, 64 nt, hsa; identical to SEQ ID NO: 45556

SEQ ID NO: 181699 - RNA, 64 nt, hsa; identical to SEQ ID NO: 45557

SEQ ID NO: 181700 - RNA, 64 nt, hsa; identical to SEQ ID NO: 45558

SEQ ID NO: 181701 - RNA, 64 nt, hsa; identical to SEQ ID NO: 45559

SEQ ID NO: 181702 - RNA, 64 nt, hsa; identical to SEQ ID NO: 45560

SEQ ID NO: 181703 - RNA, 64 nt, hsa; identical to SEQ ID NO: 45561

SEQ ID NO: 181704 - RNA, 64 nt, hsa; identical to SEQ ID NO: 45562

SEQ ID NO: 181705 - RNA, 64 nt, hsa; identical to SEQ ID NO: 45563

SEQ ID NO: 181706 - RNA, 64 nt, hsa; identical to SEQ ID NO: 45564

SEQ ID NO: 181707 - RNA, 64 nt, hsa; identical to SEQ ID NO: 45565

SEQ ID NO: 181708 - RNA, 64 nt, hsa; identical to SEQ ID NO: 45566

SEQ ID NO: 181709 - RNA, 64 nt, hsa; identical to SEQ ID NO: 45567

SEQ ID NO: 181710 - RNA, 64 nt, hsa; identical to SEQ ID NO: 45568

SEQ ID NO: 181711 - RNA, 64 nt, hsa; identical to SEQ ID NO: 45569

SEQ ID NO: 181712 - RNA, 64 nt, hsa; identical to SEQ ID NO: 45570

SEQ ID NO: 181713 - RNA, 64 nt, hsa; identical to SEQ ID NO: 45571

SEQ ID NO: 181714 - RNA, 64 nt, hsa; identical to SEQ ID NO: 45572

SEQ ID NO: 181715 - RNA, 64 nt, hsa; identical to SEQ ID NO: 45573

SEQ ID NO: 181716 - RNA, 64 nt, hsa; identical to SEQ ID NO: 45574

SEQ ID NO: 181717 - RNA, 64 nt, hsa; identical to SEQ ID NO: 45575

SEQ ID NO: 181718 - RNA, 64 nt, hsa; identical to SEQ ID NO: 45576

SEQ ID NO: 181719 - RNA, 64 nt, hsa; identical to SEQ ID NO: 45577

SEQ ID NO: 181720 - RNA, 64 nt, hsa; identical to SEQ ID NO: 45578

SEQ ID NO: 181721 - RNA, 64 nt, hsa; identical to SEQ ID NO: 45579

SEQ ID NO: 181722 - RNA, 64 nt, hsa; identical to SEQ ID NO: 45580

SEQ ID NO: 181723 - RNA, 64 nt, hsa; identical to SEQ ID NO: 45581

SEQ ID NO: 181724 - RNA, 64 nt, hsa; identical to SEQ ID NO: 45582

SEQ ID NO: 181725 - RNA, 64 nt, hsa; identical to SEQ ID NO: 45583

SEQ ID NO: 181726 - RNA, 64 nt, hsa; identical to SEQ ID NO: 45584

SEQ ID NO: 181727 - RNA, 64 nt, hsa; identical to SEQ ID NO: 45585

SEQ ID NO: 181728 - RNA, 64 nt, hsa; identical to SEQ ID NO: 45586

SEQ ID NO: 181729 - RNA, 64 nt, hsa; identical to SEQ ID NO: 45587

SEQ ID NO: 181730 - RNA, 64 nt, hsa; identical to SEQ ID NO: 45588

SEQ ID NO: 181731 - RNA, 64 nt, hsa; identical to SEQ ID NO: 45589

SEQ ID NO: 181732 - RNA, 64 nt, hsa; identical to SEQ ID NO: 45590

SEQ ID NO: 181733 - RNA, 64 nt, hsa; identical to SEQ ID NO: 45591

SEQ ID NO: 181734 - RNA, 64 nt, hsa; identical to SEQ ID NO: 45592

SEQ ID NO: 181735 - RNA, 64 nt, hsa; identical to SEQ ID NO: 45593

SEQ ID NO: 181736 - RNA, 64 nt, hsa; identical to SEQ ID NO: 45594

SEQ ID NO: 181737 - RNA, 64 nt, hsa; identical to SEQ ID NO: 45595

SEQ ID NO: 181738 - RNA, 64 nt, hsa; identical to SEQ ID NO: 45596

SEQ ID NO: 181739 - RNA, 64 nt, hsa; identical to SEQ ID NO: 45597

SEQ ID NO: 181740 - RNA, 64 nt, hsa; identical to SEQ ID NO: 45598

SEQ ID NO: 181741 - RNA, 64 nt, hsa; identical to SEQ ID NO: 45599

SEQ ID NO: 181742 - RNA, 64 nt, hsa; identical to SEQ ID NO: 45600

SEQ ID NO: 181743 - RNA, 64 nt, hsa; identical to SEQ ID NO: 45601

SEQ ID NO: 181744 - RNA, 64 nt, hsa; identical to SEQ ID NO: 45602

SEQ ID NO: 181745 - RNA, 64 nt, hsa; identical to SEQ ID NO: 45603

SEQ ID NO: 181746 - RNA, 64 nt, hsa; identical to SEQ ID NO: 45604

SEQ ID NO: 181747 - RNA, 64 nt, hsa; identical to SEQ ID NO: 45605

SEQ ID NO: 181748 - RNA, 64 nt, hsa; identical to SEQ ID NO: 45606

SEQ ID NO: 181749 - RNA, 64 nt, hsa; identical to SEQ ID NO: 45607

SEQ ID NO: 181750 - RNA, 64 nt, hsa; identical to SEQ ID NO: 45608

SEQ ID NO: 181751 - RNA, 64 nt, hsa; identical to SEQ ID NO: 45609

SEQ ID NO: 181752 - RNA, 64 nt, hsa; identical to SEQ ID NO: 45610

SEQ ID NO: 181753 - RNA, 64 nt, hsa; identical to SEQ ID NO: 45611

SEQ ID NO: 181754 - RNA, 64 nt, hsa; identical to SEQ ID NO: 45612

SEQ ID NO: 181755 - RNA, 64 nt, hsa; identical to SEQ ID NO: 45613

SEQ ID NO: 181756 - RNA, 64 nt, hsa; identical to SEQ ID NO: 45614

SEQ ID NO: 181757 - RNA, 64 nt, hsa; identical to SEQ ID NO: 45615

SEQ ID NO: 181758 - RNA, 64 nt, hsa; identical to SEQ ID NO: 45616

SEQ ID NO: 181759 - RNA, 64 nt, hsa; identical to SEQ ID NO: 45617

SEQ ID NO: 181760 - RNA, 64 nt, hsa; identical to SEQ ID NO: 45618

SEQ ID NO: 181761 - RNA, 64 nt, hsa; identical to SEQ ID NO: 45619

SEQ ID NO: 181762 - RNA, 64 nt, hsa; identical to SEQ ID NO: 45620

SEQ ID NO: 181763 - RNA, 64 nt, hsa; identical to SEQ ID NO: 45621

SEQ ID NO: 181764 - RNA, 64 nt, hsa; identical to SEQ ID NO: 45622

SEQ ID NO: 181765 - RNA, 64 nt, hsa; identical to SEQ ID NO: 45623

SEQ ID NO: 181766 - RNA, 64 nt, hsa; identical to SEQ ID NO: 45624

SEQ ID NO: 181767 - RNA, 64 nt, hsa; identical to SEQ ID NO: 45625

SEQ ID NO: 181768 - RNA, 64 nt, hsa; identical to SEQ ID NO: 45626

SEQ ID NO: 181769 - RNA, 64 nt, hsa; identical to SEQ ID NO: 45627

SEQ ID NO: 181770 - RNA, 64 nt, hsa; identical to SEQ ID NO: 45628

SEQ ID NO: 181771 - RNA, 64 nt, hsa; identical to SEQ ID NO: 45629

SEQ ID NO: 181772 - RNA, 64 nt, hsa; identical to SEQ ID NO: 45630

SEQ ID NO: 181773 - RNA, 64 nt, hsa; identical to SEQ ID NO: 45631

SEQ ID NO: 181774 - RNA, 64 nt, hsa; identical to SEQ ID NO: 45632

SEQ ID NO: 181775 - RNA, 64 nt, hsa; identical to SEQ ID NO: 45633

SEQ ID NO: 181776 - RNA, 64 nt, hsa; identical to SEQ ID NO: 45634

SEQ ID NO: 181777 - RNA, 64 nt, hsa; identical to SEQ ID NO: 45635

SEQ ID NO: 181778 - RNA, 64 nt, hsa; identical to SEQ ID NO: 45636

SEQ ID NO: 181779 - RNA, 64 nt, hsa; identical to SEQ ID NO: 45637

SEQ ID NO: 181780 - RNA, 64 nt, hsa; identical to SEQ ID NO: 45638

SEQ ID NO: 181781 - RNA, 64 nt, hsa; identical to SEQ ID NO: 45639

SEQ ID NO: 181782 - RNA, 64 nt, hsa; identical to SEQ ID NO: 45640

SEQ ID NO: 181783 - RNA, 64 nt, hsa; identical to SEQ ID NO: 45641

SEQ ID NO: 181784 - RNA, 64 nt, hsa; identical to SEQ ID NO: 45642

SEQ ID NO: 181785 - RNA, 64 nt, hsa; identical to SEQ ID NO: 45643

SEQ ID NO: 181786 - RNA, 64 nt, hsa; identical to SEQ ID NO: 45644

SEQ ID NO: 181787 - RNA, 64 nt, hsa; identical to SEQ ID NO: 45645

SEQ ID NO: 181788 - RNA, 64 nt, hsa; identical to SEQ ID NO: 45646

SEQ ID NO: 181789 - RNA, 64 nt, hsa; identical to SEQ ID NO: 45647

SEQ ID NO: 181790 - RNA, 64 nt, hsa; identical to SEQ ID NO: 45648

SEQ ID NO: 181791 - RNA, 64 nt, hsa; identical to SEQ ID NO: 45649

SEQ ID NO: 181792 - RNA, 64 nt, hsa; identical to SEQ ID NO: 45650

SEQ ID NO: 181793 - RNA, 64 nt, hsa; identical to SEQ ID NO: 45651

SEQ ID NO: 181794 - RNA, 64 nt, hsa; identical to SEQ ID NO: 45652

SEQ ID NO: 181795 - RNA, 64 nt, hsa; identical to SEQ ID NO: 45653

SEQ ID NO: 181796 - RNA, 64 nt, hsa; identical to SEQ ID NO: 45654

SEQ ID NO: 181797 - RNA, 64 nt, hsa; identical to SEQ ID NO: 45655

SEQ ID NO: 181798 - RNA, 64 nt, hsa; identical to SEQ ID NO: 48032

SEQ ID NO: 181799 - RNA, 64 nt, hsa; identical to SEQ ID NO: 48033

SEQ ID NO: 181800 - RNA, 64 nt, hsa; identical to SEQ ID NO: 48034

SEQ ID NO: 181801 - RNA, 64 nt, hsa; identical to SEQ ID NO: 48035

SEQ ID NO: 181802 - RNA, 64 nt, hsa; identical to SEQ ID NO: 48036

SEQ ID NO: 181803 - RNA, 64 nt, hsa; identical to SEQ ID NO: 48037

SEQ ID NO: 181804 - RNA, 64 nt, hsa; identical to SEQ ID NO: 48038

SEQ ID NO: 181805 - RNA, 64 nt, hsa; identical to SEQ ID NO: 48039

SEQ ID NO: 181806 - RNA, 64 nt, hsa; identical to SEQ ID NO: 48040

SEQ ID NO: 181807 - RNA, 64 nt, hsa; identical to SEQ ID NO: 48041

SEQ ID NO: 181808 - RNA, 64 nt, hsa; identical to SEQ ID NO: 48042

SEQ ID NO: 181809 - RNA, 64 nt, hsa; identical to SEQ ID NO: 48043

SEQ ID NO: 181810 - RNA, 64 nt, hsa; identical to SEQ ID NO: 48044

SEQ ID NO: 181811 - RNA, 64 nt, hsa; identical to SEQ ID NO: 48045

SEQ ID NO: 181812 - RNA, 64 nt, hsa; identical to SEQ ID NO: 48046

SEQ ID NO: 181813 - RNA, 64 nt, hsa; identical to SEQ ID NO: 48047

SEQ ID NO: 181814 - RNA, 64 nt, hsa
aauguuaacuacauauugucuggaaaccugucauuguauucagauaauuagaugauuauauauu

SEQ ID NO: 181815 - RNA, 64 nt, hsa
aauuagaugauuauauauuguuguuacuuuuucuuguauucaugaaaacuguuuuuacuaaguu

SEQ ID NO: 181816 - RNA, 64 nt, hsa
ccccucuucugagcuguguauucauguagagggauguauucagccuuuuuagugaacauuuuuu

SEQ ID NO: 181817 - RNA, 64 nt, hsa
gccuccccaccuccauuuccccucuucugagcuguguauucauguagagggauguauucagccu

SEQ ID NO: 181818 - RNA, 64 nt, hsa
auuaugugcaaaauaauucuggcuaacuguaaaauguauucaauuuuaggauuuuuuuuuuuug

SEQ ID NO: 181819 - RNA, 64 nt, hsa
uauuucauuguaaacguuauugugccaaauguacuguauucaaaaggaugugaauguguauugu

SEQ ID NO: 181820 - RNA, 64 nt, hsa
uaaaauauggaaagcagagcaguacauauucaaauguauucagaaagucaaaagauuaccuauc

SEQ ID NO: 181821 - RNA, 64 nt, hsa
uuugaaacucugaugcuauauauacaugguauaauguauucagacuuugauuacuacuuauuua

SEQ ID NO: 181822 - RNA, 64 nt, hsa
gguaauuaucauuuuagaagacucuaccagacuguguauucauugaagucagaugugguaacug

SEQ ID NO: 181823 - RNA, 64 nt, hsa
ucauccaaucuaaccacaucaauauugucauuccuguauucacccguccagaccuuguucacac

SEQ ID NO: 181824 - RNA, 64 nt, hsa
acuaaaaguauguuuauacugugaauuaauauaauguauucacauuauucuuuaauaaucuguu

SEQ ID NO: 181825 - RNA, 64 nt, hsa
uaguugucaugccuauguuuagaccauaucuuaauguauucacaaagaauuaucaacuuugaug

SEQ ID NO: 181826 - RNA, 64 nt, hsa
ggggcaggugaaauacuucuaccccauggguaaauguauucacauauuaccaagagaagaagca

SEQ ID NO: 181827 - RNA, 64 nt, hsa
acagaaaacuuguccacgugcuuuuguaugcccauguauucauguuuguuuguagauguuuguc

SEQ ID NO: 181828 - RNA, 64 nt, hsa
uauuucuucuccaugaauggccuuaacauuauuuuguauucacguguacuguuuaacugagggu

SEQ ID NO: 181829 - RNA, 64 nt, hsa
caguugacauaagauuuaguccuaauaaggacucuguauucacuugauuauucugacccuuccu

SEQ ID NO: 181830 - RNA, 64 nt, hsa
acugacuuagccuaaacaaccuggugcaucgaaauguauucaccuuucuuuuguaaagagacca

SEQ ID NO: 181831 - RNA, 64 nt, hsa
ccuuagacugaaaaacuguugguucauccagaaguguauucauauuaccagaaaaugaguuugu

SEQ ID NO: 181832 - RNA, 64 nt, hsa
auuauugugaaauguacaguagauuauuguuaauuguauucacccuaauaaucuaugaaacacu

SEQ ID NO: 181833 - RNA, 64 nt, hsa
acuaggucuuacuucuucuaucuaacagaauauuuguauucauaauggcuuuuuaucuaccuuc

SEQ ID NO: 181834 - RNA, 64 nt, hsa
caaaaugcauguaguaaagacaucuuaugaaaacuguauucauggaauuugauuuagcaugcuc

SEQ ID NO: 181835 - RNA, 64 nt, hsa
ccguuauuucccucaguguagauugcucuuaaaauguauucaguuauuuaguggcccccacagg

SEQ ID NO: 181836 - RNA, 64 nt, hsa
auugugguuuuagaaucuucuguggcugacuucuuguauucaacucugguuuauuaucuuaauc

SEQ ID NO: 181837 - RNA, 64 nt, hsa
aaguacacuguucacguuuagccugccccacuuuuguauucaaaauuaaugaaacugaagguuu

SEQ ID NO: 181838 - RNA, 64 nt, hsa
aaaguuuuuauugaauguaugaaaauuaucaaauuguauucaucauuauuaacauguccugggg

SEQ ID NO: 181839 - RNA, 64 nt, hsa
augucucccucaauggaacuccugguaaauacuguguauucaaguaaucaugugccaaagccag

SEQ ID NO: 181840 - RNA, 64 nt, hsa
guaaucuccagugaacuuuuaagugguuaaaacuuguauucaugugaaccuuugcacauuuuuu

SEQ ID NO: 181841 - RNA, 64 nt, hsa
aaauuccauguguuugcugagguguaaagguaaauguauucaccccucauccaggcaguuugau

SEQ ID NO: 181842 - RNA, 64 nt, hsa
uucuaguagcuagcagagagccuggcacauaguauguauucaaaacaaguguguuaauuaauaa

SEQ ID NO: 181843 - RNA, 64 nt, hsa
ugcagaauaaaagggugaggacaucagaucacucuguauucaaagcuuacuagacgaacaaucu

SEQ ID NO: 181844 - RNA, 64 nt, hsa
aguauguauaauuuugugaucuuuauuuucccuuuguauucauuuuaagcaucuaaauaaauug

SEQ ID NO: 181845 - RNA, 64 nt, hsa
uauaguagacuuugggaaaagcgauuuuuuuucauguauucauucugaauaguugaaauguaua

SEQ ID NO: 181846 - RNA, 64 nt, hsa
uauuauguguaccuuggagucauccucuuggucuuguauucauauugugggacagugggaauag

SEQ ID NO: 181847 - RNA, 64 nt, hsa
uaguaaugagaaauuuuauaaauguguauuucuguguauucacauacauauauauauacacaca

SEQ ID NO: 181848 - RNA, 64 nt, hsa
aaguucucuauuuauauuucauuuaucacucuucuguauucacucagcaaccaugcccuuaguc

SEQ ID NO: 181849 - RNA, 64 nt, hsa
caaacauuacucuuuggacaguuuggacaguaucuguauucagauuuuacaacauggaguaaag

SEQ ID NO: 181850 - RNA, 64 nt, hsa
uccaagaaaugugccuacugaaaucaaauuaauuuguauucaauguguacuucaagacugcuaa

SEQ ID NO: 181851 - RNA, 64 nt, hsa
ccuucauucacucauuuguguauucauucauuuauguauucaucagacacauaccgaacacccu

SEQ ID NO: 181852 - RNA, 64 nt, hsa
caguuaccugaaacugccuucauucacucauuuguguauucauucauuuauguauucaucagac

SEQ ID NO: 181853 - RNA, 64 nt, hsa
auaauuuaagccuaugagaagauagacuguuucguagggauauauucacaugugugugcacacu

SEQ ID NO: 181854 - RNA, 64 nt, hsa
auuucuccaauugggacuccccagcaggaauacuuagggauaaggaagaaugcuagcaucucug

SEQ ID NO: 181855 - RNA, 64 nt, hsa
ggcaguauguuuaaguccagacuuggcacauggcuagggauacugcucacuagcuguggagguc

SEQ ID NO: 181856 - RNA, 64 nt, hsa
uucaccaguuucuguuccuugugggaugcugcucuagggauacucagggggcuccugcucuccu

SEQ ID NO: 181857 - RNA, 64 nt, hsa
aaauguaguauaguacuugaaacagucacuaucauagggauaauuggugcauccuguguaaaug

SEQ ID NO: 181858 - RNA, 64 nt, hsa
auggaagcugagcuugacaccuggugcuuuuaaguagggauaaagucauccucucacugcaagc

SEQ ID NO: 181859 - RNA, 64 nt, hsa
uuuuccugcuaacccaaaauguuauuuguaaucaaauguguagugauuacacuugaauugugua

SEQ ID NO: 181860 - RNA, 64 nt, hsa
auuuuccagcauaaaaauccaccugugucugcugaauguguauguaugugcucacuguggcuuu

SEQ ID NO: 181861 - RNA, 64 nt, hsa
uaacuggauuacauagauuuuuaucuuuuguuaaaauguguauaccccguggaccaacauaaua

SEQ ID NO: 181862 - RNA, 64 nt, hsa
aguauucuucuuccugaauacugaaacuauuuacaauguguaucaaaacuaccugugagcaugg

SEQ ID NO: 181863 - RNA, 64 nt, hsa
auggauaaauauugguugggaugacuuggugucuaauguguagugcuacacaccuaacuuaugg

SEQ ID NO: 181864 - RNA, 64 nt, hsa
uugccaauuugcacauuaaaugacucuucccucaaauguguacuaugggguaaaagggguaggg

SEQ ID NO: 181865 - RNA, 64 nt, hsa
uuguuacauuauauuuuuacauauauucccauguaauguguacagucuuugcaguuccaccaag

SEQ ID NO: 181866 - RNA, 64 nt, hsa
gcucauccaaggauuaaaucuggucagcagguggaauguguauaaaaugcuacuuaacaaagua

SEQ ID NO: 181867 - RNA, 64 nt, hsa
uuggaaggauuauauaagaugaacaguugugauaaauguguagauuagagggaugugaaugggc

SEQ ID NO: 181868 - RNA, 64 nt, hsa
caguagagaggaacuguuuggaacuuagauuuccaauguguauauucuaauggagaaagcaaga

SEQ ID NO: 181869 - RNA, 64 nt, hsa
uugcuguugagcugggcuacuguauacaguguacaauguguauuucuucaaccauauauuuuaa

SEQ ID NO: 181870 - RNA, 64 nt, hsa
augguuucccauuugguuuuauauguguuaaauaaauguguaaaguaaccaccaaauguuauua

SEQ ID NO: 181871 - RNA, 64 nt, hsa
aaaauccuuguuauaucuauuucuguauuggaguaauguguagauuaguggauuguuagggauu

SEQ ID NO: 181872 - RNA, 64 nt, hsa
augucugguggguuauguuuugcuucaauucagcaauguguauaaaaguuccuacacugauuuu

SEQ ID NO: 181873 - RNA, 64 nt, hsa
uauugcucuuugugaauuugugcuuaagucaaugaauguguaguaucuccuucugacaagcauu

SEQ ID NO: 181874 - RNA, 64 nt, hsa
gcaaauaaaucccuaggauguaaucaggacuucaaauguguaauuaaauuuuuuuaaaaaaaau

SEQ ID NO: 181875 - RNA, 64 nt, hsa
gcaucuucauuuugcuagcuuugcagaaucuuaaaauguguacucguuauuucuaaugauguaa

SEQ ID NO: 181876 - RNA, 64 nt, hsa
acauggcauuucaggguauaagauguagcauuucaauguguaagauauauguacuaaacauaug

SEQ ID NO: 181877 - RNA, 64 nt, hsa
uuguaccaucauuuuauuauaauccucaagagaaaauguguaauucaaaagauuaauguguauu

SEQ ID NO: 181878 - RNA, 64 nt, hsa
aauccucaagagaaaauguguaauucaaaagauuaauguguauuaaaacacauuauguaucuua

SEQ ID NO: 181879 - RNA, 64 nt, hsa
uuaagugauagcucacuuguaaagugacuaccuuaauguguauagagaccccagucuacuauua

SEQ ID NO: 181880 - RNA, 64 nt, hsa
uguacacuguagcacgguguuauugacuggaguuaauguguaaguuauuaacauuucuaugaaa

SEQ ID NO: 181881 - RNA, 64 nt, hsa
guuuaucuacaaagaugcgaaucagucaaggggaaauguguaugcaauguguguguauaugaug

SEQ ID NO: 181882 - RNA, 64 nt, hsa
gcaacaagaggauaauuccgaccuaccucugaaaaauguguagauuaaaugaguuuuuaaagca

SEQ ID NO: 181883 - RNA, 64 nt, hsa
gucaaguuuaaagcagggcacauuguugcagcaaaauguguauuugacaaauuauacuugcaau

SEQ ID NO: 181884 - RNA, 64 nt, hsa
gccgaccaagaucccucccugcaagacagaugggaauguguauaauaacuagguauuugagaag

SEQ ID NO: 181885 - RNA, 64 nt, hsa
guuaaauguacaagauacaugaaauauuaaagaaaauguguaacuuuuuguguaaauacaucuu

SEQ ID NO: 181886 - RNA, 64 nt, hsa
uuaaauuuagagagaaugccgcucuguuuaaagcaauguguaaagaugaguuuuuuuaagcaug

SEQ ID NO: 181887 - RNA, 64 nt, hsa
gaacugagauuuaaaucuaauaaacaaguuaauaaauguguauguuuuguuguggguuugguag

SEQ ID NO: 181888 - RNA, 64 nt, hsa
ucccuucaaacacaaagauugcugugaaaacgaaaauguguagacgcacucucaaaaacugcac

SEQ ID NO: 181889 - RNA, 64 nt, hsa
ccgccacaucagcaccauccgagagcuuauuaguaauguguagauucucaugucccagccagac

SEQ ID NO: 181890 - RNA, 64 nt, hsa
cuggcaaguuuggccagacugacuucaaaaaauuaauguguauccagggacauuuuaaaaaccu

SEQ ID NO: 181891 - RNA, 64 nt, hsa
ggcaacagcgagacuccaucucaaaaaaaaaggaaauguguaucaagaacaugauuauccagcg

SEQ ID NO: 181892 - RNA, 64 nt, hsa
uuguacuaccuaaaagucccagugcaugucucugaauguguaagcuauauaaaugcuauuuaua

SEQ ID NO: 181893 - RNA, 64 nt, hsa
aagagaauggugguuucagagaucucucuucccaaauguguaaauauucuauaccagauaaguu

SEQ ID NO: 181894 - RNA, 64 nt, hsa
gagaagauaagguuuauggcagguaauuuuuuguaauguguauuaaacgaaguucaaagauuag

SEQ ID NO: 181895 - RNA, 64 nt, hsa
agaucauuuuuauccuaggugauuuuuaaaugaaaauguguaaucuaaaauauaccagcgaauu

SEQ ID NO: 181896 - RNA, 64 nt, hsa
gcuuacugugugcuaggcauuuucuuaauauuucaauguguauuuaauccucacaacaacccaa

SEQ ID NO: 181897 - RNA, 64 nt, hsa
aacuuacauucaagggacauagagggaaaauguuaauguguauuucauuguuucuuguggaauu

SEQ ID NO: 181898 - RNA, 64 nt, hsa
ccaauuuacuguauuaguccguuuucacgcugcugauaaagacauacccgagacugggaagaaa

SEQ ID NO: 181899 - RNA, 64 nt, hsa
ucaagcaucuguauuagucuguauuaaugcugcugauaaagacguacccgagacugggaagaaa

SEQ ID NO: 181900 - RNA, 64 nt, hsa
uuucugagaccacagaaucagguuuuccguaguagauaaagacucucuggugcuucaaauucug

SEQ ID NO: 181901 - RNA, 64 nt, hsa
cuguucuaaaaauguuuaaaagaaacucaauacagauaaagauaaauaugugacuauuauuggg

SEQ ID NO: 181902 - RNA, 64 nt, hsa
auaucugguuguauuagucuguuuucacgcugcugauaaagacauaccugagaccaggaagaaa

SEQ ID NO: 181903 - RNA, 64 nt, hsa
gcaguuuacuguauuagucuguuuucacacugcugauaaagacauuccucaagauugugaagaa

SEQ ID NO: 181904 - RNA, 64 nt, hsa
uaauuugaggacugggcugucuuggggcucagaagauaaagaacuauuugagcagaugugugug

SEQ ID NO: 181905 - RNA, 64 nt, hsa
acagugaggcauaucauguguuuuuauuaaaaaugauaaagauguguuucuucucaucuaaagg

SEQ ID NO: 181906 - RNA, 64 nt, hsa
agaaacaaugugaaauaauguggaaauuaauacugauaaagacuaucaguaucugauacaaaag

SEQ ID NO: 181907 - RNA, 64 nt, hsa
agauuaucuaaagccaucucuauguuucuguucagauaaagauuaaugaguucuguguuuauau

SEQ ID NO: 181908 - RNA, 64 nt, hsa
acagcucuugucagaaagcccugaguucccccuggauaaagaguuaauuuuaauccuucccuau

SEQ ID NO: 181909 - RNA, 64 nt, hsa
gaaguagcuaguagcaaugugccuugauugauuagauaaagauuucuaguaggcagcaaaagac

SEQ ID NO: 181910 - RNA, 64 nt, hsa
cuaagaauaguggggcccagccgaugugguaggugauaaagaggcaucuuuucuagagacacau

SEQ ID NO: 181911 - RNA, 64 nt, hsa
ccccacuucccugcagaaucaaucugagggaggggauaaagaggaagcaauaaaaaaaaaacau

SEQ ID NO: 181912 - RNA, 64 nt, hsa
cuacuaguucuuccagcccucauugagguaacaagauaaagacaaauccacuucuuuggccaaa

SEQ ID NO: 181913 - RNA, 64 nt, hsa
aguacuggaaguccuaagcuuagugaucaggcaagauaaagauaugaaaggcauauauaaauag

SEQ ID NO: 181914 - RNA, 64 nt, hsa
ggaaucaacguaaaugcccaucagcaguagaccagauaaagaaaauuugguacauauacaccau

SEQ ID NO: 181915 - RNA, 64 nt, hsa
gggaggcugaggcagggggaucacgaggucaagagauaaagaccauccuggccaacauggugaa

SEQ ID NO: 181916 - RNA, 64 nt, hsa
aauucauacugguuagaaagccuugaguguaagggauaaagauaagccuuuauguggaguucac

SEQ ID NO: 181917 - RNA, 64 nt, hsa
uaauaccuucuuagccauuaauguaauuccucuggauaaagauaauauauucaaaaaauauugg

SEQ ID NO: 181918 - RNA, 64 nt, hsa
uuguaugggaaccaagguuacuuucuuguucuuggauaaagaaaauuucuacaauuacaguucc

SEQ ID NO: 181919 - RNA, 64 nt, hsa
aggaaguaauuauuuacaacgauuuucccaaauuuuguacaaucuguccuggaaagcaaacccc

SEQ ID NO: 181920 - RNA, 64 nt, hsa
auagguagaauaaaaaauuccuuucauaucguuauuguacaaaaaguaaagaguauccuaaaga

SEQ ID NO: 181921 - RNA, 64 nt, hsa
ccuuuuuuuucugaaggcuuguuuuuaguccucauuguacaaaauauaaaauaaucauauugcu

SEQ ID NO: 181922 - RNA, 64 nt, hsa
uaauuaauugccaguuuuuacaugugauagucaguuguacaaagaaaaugcacuuaaaccuguu

SEQ ID NO: 181923 - RNA, 64 nt, hsa
aggaucugcaaacaaugaagaauuauguaauauauuguacaaauguaagcaaaggcucugaaau

SEQ ID NO: 181924 - RNA, 64 nt, hsa
auuuauuuaugaaaaaauaugaaccuauuuucauuuguacaagguaauuguuuuuuaaagcaag

SEQ ID NO: 181925 - RNA, 64 nt, hsa
acuaaagguaagacugguuguuacuuuuguuuuguuguacaauuaguacuuuauagucacaugu

SEQ ID NO: 181926 - RNA, 64 nt, hsa
uuguaaugaaguuccugugaacaucauuaugguuuuguacaaauaggaaccucugaugucauuc

SEQ ID NO: 181927 - RNA, 64 nt, hsa
ccgaacgcugcuccaugcacaggaaaagggcauuuuguacaauggggacuucccgggaacgcuu

SEQ ID NO: 181928 - RNA, 64 nt, hsa
uccaaaccuaccuuauagagcacaauauuaaguguuguacaauuacugugagaacugugaauau

SEQ ID NO: 181929 - RNA, 64 nt, hsa
auaagcuuagcacuugaguuguacaacagaacacuuguacaaaauagauuuuaaggcuaacuuc

SEQ ID NO: 181930 - RNA, 64 nt, hsa
aaacagaaaugcugagauaagcuuagcacuugaguuguacaacagaacacuuguacaaaauaga

SEQ ID NO: 181931 - RNA, 64 nt, hsa
guugaaagcuuuuuaggaaauuuugacaguauuuuuguacaaaacauuuuuuugaaaaaauacu

SEQ ID NO: 181932 - RNA, 64 nt, hsa
guuugagaacuuggaaacaaaguaaacuauaaacuuguacaaauugguuuuaaaaaaaauugcu

SEQ ID NO: 181933 - RNA, 64 nt, hsa
auaaaacauggccuuaacaaaguuguuuguguuauuguacaauuugaaaauuaugucgggacau

SEQ ID NO: 181934 - RNA, 64 nt, hsa
augauugcuuuauguuuauauuuaacuuguauuuuuguacaaacaagauuguguaagauauauu

SEQ ID NO: 181935 - RNA, 64 nt, hsa
uguguacacagcuuuuacaaaucaauaaagaugauuguacaagaguauuuucagacuaauugga

SEQ ID NO: 181936 - RNA, 64 nt, hsa
cuguaugauuagaaguuuuuacguccuuccuuuuuuguacaaaucuguauuguauuaauuucug

SEQ ID NO: 181937 - RNA, 64 nt, hsa
acagcuuguaauguuguauacacauuuauucuguuuguacaaagguuuuccauucuauggagag

SEQ ID NO: 181938 - RNA, 64 nt, hsa
gaggaacauggcagccucuagcucauacuugucguuguacaauugagaucaagugaauuggccc

SEQ ID NO: 181939 - RNA, 64 nt, hsa
ccucuuuuuuccugggaauauuuuguacaauauuuuguacaaagacaggcaugaggagugccua

SEQ ID NO: 181940 - RNA, 64 nt, hsa
gcccuucuuuucccucuuuuuuccugggaauauuuuguacaauauuuuguacaaagacaggcau

SEQ ID NO: 181941 - RNA, 64 nt, hsa
ugcgauuuuaccuuuguugaauuuguauaaacaauuguacaaaaaaaaccacucuugaacuuug

SEQ ID NO: 181942 - RNA, 64 nt, hsa
guuuuguuacaucuuacauuaugcagaacuauuuuuguacaaauuguuuaaaaguuauuuaugc

SEQ ID NO: 181943 - RNA, 64 nt, hsa
uacuaaccaaagcuuguauuuggaaauuuacuuuuuguacaaauugaauuauauaaugcuuaaa

SEQ ID NO: 181944 - RNA, 64 nt, hsa
auauccccuccuucuaaauaguaaaaagcucugauuguacaagaauuaccugugcuagucaagu

SEQ ID NO: 181945 - RNA, 64 nt, hsa
cuguggguaaaauaugcaaacgaaaagaaauauauuguacaaauucuauauaauaagguacgcc

SEQ ID NO: 181946 - RNA, 64 nt, hsa
cgcuguaaagaaauccuguuccagagcauaccuguuguacaaacagacacuguuccuaacgaga

SEQ ID NO: 181947 - RNA, 64 nt, hsa
ucuauucuucuauacugcagauuuuucucaccuauuguacaaagaaauugcgauguauauuuuc

SEQ ID NO: 181948 - RNA, 64 nt, hsa
uccugcacucuacccaccuauugcuggacuucuguuguacaaguuggcaaacacuggcuggaac

SEQ ID NO: 181949 - RNA, 64 nt, hsa
uauuagcuauuagauuuuucucaaaauaugaguuuuguacaauggaaugaaaaagugacuucau

SEQ ID NO: 181950 - RNA, 64 nt, hsa
auuggauacguaauaccuuagugcugucauaauguuguacaagaucaugaucagcuucucccuu

SEQ ID NO: 181951 - RNA, 64 nt, hsa
cuguauuuauuaaugcauauauuuccccugcuuguuguacaaguaaguuacucuuuuccuuuaa

SEQ ID NO: 181952 - RNA, 64 nt, hsa
aacugguccuguaauuguugcuagacuuuauguguuguacaacuaaacauugcuguuugaacag

SEQ ID NO: 181953 - RNA, 64 nt, hsa; identical to SEQ ID NO: 122412

SEQ ID NO: 181954 - RNA, 64 nt, hsa; identical to SEQ ID NO: 122413

SEQ ID NO: 181955 - RNA, 64 nt, hsa; identical to SEQ ID NO: 122453

SEQ ID NO: 181956 - RNA, 64 nt, hsa; identical to SEQ ID NO: 122454

SEQ ID NO: 181957 - RNA, 64 nt, hsa; identical to SEQ ID NO: 122460

SEQ ID NO: 181958 - RNA, 64 nt, hsa; identical to SEQ ID NO: 122461

SEQ ID NO: 181959 - RNA, 64 nt, hsa; identical to SEQ ID NO: 122467

SEQ ID NO: 181960 - RNA, 64 nt, hsa; identical to SEQ ID NO: 122468

SEQ ID NO: 181961 - RNA, 64 nt, hsa; identical to SEQ ID NO: 122481

SEQ ID NO: 181962 - RNA, 64 nt, hsa; identical to SEQ ID NO: 122482

SEQ ID NO: 181963 - RNA, 64 nt, hsa; identical to SEQ ID NO: 122498

SEQ ID NO: 181964 - RNA, 64 nt, hsa; identical to SEQ ID NO: 122499

SEQ ID NO: 181965 - RNA, 64 nt, hsa; identical to SEQ ID NO: 122513

SEQ ID NO: 181966 - RNA, 64 nt, hsa; identical to SEQ ID NO: 122514

SEQ ID NO: 181967 - RNA, 64 nt, hsa; identical to SEQ ID NO: 122517

SEQ ID NO: 181968 - RNA, 64 nt, hsa; identical to SEQ ID NO: 122518

SEQ ID NO: 181969 - RNA, 64 nt, hsa; identical to SEQ ID NO: 122606

SEQ ID NO: 181970 - RNA, 64 nt, hsa; identical to SEQ ID NO: 122607

SEQ ID NO: 181971 - RNA, 64 nt, hsa; identical to SEQ ID NO: 122654

SEQ ID NO: 181972 - RNA, 64 nt, hsa; identical to SEQ ID NO: 122655

SEQ ID NO: 181973 - RNA, 64 nt, hsa; identical to SEQ ID NO: 122669

SEQ ID NO: 181974 - RNA, 64 nt, hsa; identical to SEQ ID NO: 122670

SEQ ID NO: 181975 - RNA, 64 nt, hsa; identical to SEQ ID NO: 122677

SEQ ID NO: 181976 - RNA, 64 nt, hsa; identical to SEQ ID NO: 122678

SEQ ID NO: 181977 - RNA, 64 nt, hsa; identical to SEQ ID NO: 122684

SEQ ID NO: 181978 - RNA, 64 nt, hsa; identical to SEQ ID NO: 122685

SEQ ID NO: 181979 - RNA, 64 nt, hsa; identical to SEQ ID NO: 122691

SEQ ID NO: 181980 - RNA, 64 nt, hsa; identical to SEQ ID NO: 122692

SEQ ID NO: 181981 - RNA, 64 nt, hsa; identical to SEQ ID NO: 122693

SEQ ID NO: 181982 - RNA, 64 nt, hsa; identical to SEQ ID NO: 122709

SEQ ID NO: 181983 - RNA, 64 nt, hsa; identical to SEQ ID NO: 122710

SEQ ID NO: 181984 - RNA, 64 nt, hsa; identical to SEQ ID NO: 122711

SEQ ID NO: 181985 - RNA, 64 nt, hsa; identical to SEQ ID NO: 122718

SEQ ID NO: 181986 - RNA, 64 nt, hsa; identical to SEQ ID NO: 122719

SEQ ID NO: 181987 - RNA, 64 nt, hsa; identical to SEQ ID NO: 122734

SEQ ID NO: 181988 - RNA, 64 nt, hsa; identical to SEQ ID NO: 122735

SEQ ID NO: 181989 - RNA, 64 nt, hsa; identical to SEQ ID NO: 122742

SEQ ID NO: 181990 - RNA, 64 nt, hsa; identical to SEQ ID NO: 122743

SEQ ID NO: 181991 - RNA, 64 nt, hsa; identical to SEQ ID NO: 122744

SEQ ID NO: 181992 - RNA, 64 nt, hsa; identical to SEQ ID NO: 122746

SEQ ID NO: 181993 - RNA, 64 nt, hsa; identical to SEQ ID NO: 122747

SEQ ID NO: 181994 - RNA, 64 nt, hsa; identical to SEQ ID NO: 122749

SEQ ID NO: 181995 - RNA, 64 nt, hsa; identical to SEQ ID NO: 122750

SEQ ID NO: 181996 - RNA, 64 nt, hsa; identical to SEQ ID NO: 122801

SEQ ID NO: 181997 - RNA, 64 nt, hsa; identical to SEQ ID NO: 122802

SEQ ID NO: 181998 - RNA, 64 nt, hsa; identical to SEQ ID NO: 122837

SEQ ID NO: 181999 - RNA, 64 nt, hsa; identical to SEQ ID NO: 122838

SEQ ID NO: 182000 - RNA, 64 nt, hsa; identical to SEQ ID NO: 122842

SEQ ID NO: 182001 - RNA, 64 nt, hsa; identical to SEQ ID NO: 122843

SEQ ID NO: 182002 - RNA, 64 nt, hsa; identical to SEQ ID NO: 122853

SEQ ID NO: 182003 - RNA, 64 nt, hsa; identical to SEQ ID NO: 122854

SEQ ID NO: 182004 - RNA, 64 nt, hsa; identical to SEQ ID NO: 122861

SEQ ID NO: 182005 - RNA, 64 nt, hsa; identical to SEQ ID NO: 122862

SEQ ID NO: 182006 - RNA, 64 nt, hsa; identical to SEQ ID NO: 122909

SEQ ID NO: 182007 - RNA, 64 nt, hsa; identical to SEQ ID NO: 122910

SEQ ID NO: 182008 - RNA, 64 nt, hsa; identical to SEQ ID NO: 122911

SEQ ID NO: 182009 - RNA, 64 nt, hsa; identical to SEQ ID NO: 122931

SEQ ID NO: 182010 - RNA, 64 nt, hsa; identical to SEQ ID NO: 122932

SEQ ID NO: 182011 - RNA, 64 nt, hsa; identical to SEQ ID NO: 122949

SEQ ID NO: 182012 - RNA, 64 nt, hsa; identical to SEQ ID NO: 122950

SEQ ID NO: 182013 - RNA, 64 nt, hsa; identical to SEQ ID NO: 122967

SEQ ID NO: 182014 - RNA, 64 nt, hsa; identical to SEQ ID NO: 122968

SEQ ID NO: 182015 - RNA, 64 nt, hsa; identical to SEQ ID NO: 122972

SEQ ID NO: 182016 - RNA, 64 nt, hsa; identical to SEQ ID NO: 122973

SEQ ID NO: 182017 - RNA, 64 nt, hsa; identical to SEQ ID NO: 122977

SEQ ID NO: 182018 - RNA, 64 nt, hsa; identical to SEQ ID NO: 122978

SEQ ID NO: 182019 - RNA, 64 nt, hsa
ugagagacaacauagcaauaucugguauguugcaagcuuucaagauagccugaacuuaaaaagu

SEQ ID NO: 182020 - RNA, 64 nt, hsa
gaaauauaggugugaacaguguguaccaguuuaaagcuuucacuucauuuguguuuuuuaauua

SEQ ID NO: 182021 - RNA, 64 nt, hsa
aaccuauuucgcucccagaaaaaaaagaucaaagagcuuucagaaacuuugagaacuuggcuau

SEQ ID NO: 182022 - RNA, 64 nt, hsa
augaagcuacuucuacaugaaaauugcaaucuaaagcuuucauaccaaaugucacaggagcugu

SEQ ID NO: 182023 - RNA, 64 nt, hsa
caucagaacaccaacagauucauguucucgucuuagcuuucaucuauucuggucucaauggcuu

SEQ ID NO: 182024 - RNA, 64 nt, hsa
aagaacagaaucuguccuucacuguaagagcuacagcuuucaaaugagcucacuggaaauucau

SEQ ID NO: 182025 - RNA, 64 nt, hsa
aauuguuuuaaccauuuccuuuucuaaacucucuagcuuucaacuuuacuuaaacauugugugg

SEQ ID NO: 182026 - RNA, 64 nt, hsa
uuaguguguucuucugccucuucccccuugauucagcuuucagagguacuauggcaguuuugcc

SEQ ID NO: 182027 - RNA, 64 nt, hsa
gauaugguugauuuauauuggguuuaaacuguggagcuuucauguuuacuguaauuuagucuua

SEQ ID NO: 182028 - RNA, 64 nt, hsa
cauuggugauguuuuuuaaaaaaaucuugcuuucagcuuucaggaguuaauauucuuuguuuua

SEQ ID NO: 182029 - RNA, 64 nt, hsa
acagugcucauuccuaacaguggauuuacuuguaagcuuucagaucaacacaaauagcugcagc

SEQ ID NO: 182030 - RNA, 64 nt, hsa
aaaacaauaaaaagaaaacccuuacauuuaaaagagcuuucagguacagaaguauugauacaac

SEQ ID NO: 182031 - RNA, 64 nt, hsa
ucuuaacuaggaaacuaaaagcuuucacucuuaaagcuuucauuuucuguuuauucaguuuuuu

SEQ ID NO: 182032 - RNA, 64 nt, hsa
cauucucaagaaaagucuuaacuaggaaacuaaaagcuuucacucuuaaagcuuucauuuucug

SEQ ID NO: 182033 - RNA, 64 nt, hsa
gugccugaaucuuauuauuuaaaucacuucaguuagcuuucaguguauguuuaauaauauacau

SEQ ID NO: 182034 - RNA, 64 nt, hsa
ucucaaaagcuaauauugauucuucuguuccaucagcuuucauuguuaaguagaauauguaugu

SEQ ID NO: 182035 - RNA, 64 nt, hsa
cugauagagucauuaauugcagagaaguucuggaagcuuucaaccuccuggugcuccaggucag

SEQ ID NO: 182036 - RNA, 64 nt, hsa
agcugacaagucccagaagcagucccugacccccagcuuucagagcccagccaccagcuugggg

SEQ ID NO: 182037 - RNA, 64 nt, hsa
ggcuuuuuuguuuguuuguuuguuuguuuguuuaagcuuucaggugcuucauuagcuuucaguu

SEQ ID NO: 182038 - RNA, 64 nt, hsa
uuguuuguuuguuuaagcuuucaggugcuucauuagcuuucaguuccuuugguagugugggcau

SEQ ID NO: 182039 - RNA, 64 nt, hsa
caggcuuauuuuuuuuacugauuuuuuauucuccagcuuucagugccaaagaggccaugcugag

SEQ ID NO: 182040 - RNA, 63 nt, hsa
gccuguucccaguucccugaggccucugggucaagcuuucaucagccccagcccccacacucc

SEQ ID NO: 182041 - RNA, 64 nt, hsa
uaaccauagccccaucuauaauacagaggaacggcuguuccaaggcuguuugcuggguguccca

SEQ ID NO: 182042 - RNA, 53 nt, hsa
ccaucaguggacagaaauaacgccuguuccacuuguacugccccauccuugaa

SEQ ID NO: 182043 - RNA, 64 nt, hsa
ccacauuuuccuguuuucuucugagcccuccaaacuguuccagccucugccuguuacccaguuc

SEQ ID NO: 182044 - RNA, 64 nt, hsa
uaccaacagggguacagguauugauuaaagacggcuguuccaaaugggagaaauuggccaaaau

SEQ ID NO: 182045 - RNA, 64 nt, hsa
agaucaccggggccgccgcgggccgucugcacuucuguuccagguuuuucuggcauuuucuguu

SEQ ID NO: 182046 - RNA, 64 nt, hsa
ucugcacuucuguuccagguuuuucuggcauuuucuguuccagguuucuuccacccacgagcac

SEQ ID NO: 182047 - RNA, 64 nt, hsa
uaccccaaacagaaggcacauggaucuggggcgacuguuccagguccucccaaccucugaagug

SEQ ID NO: 182048 - RNA, 64 nt, hsa
aacugaggcgcacacccaugcagccccugauguucuguuccaccguaguugauucucaguagag

SEQ ID NO: 182049 - RNA, 64 nt, hsa
gcagaaaccgcaccccgagagaaaaucccauccucuguuccaaggccccugucugcucuaugcu

SEQ ID NO: 182050 - RNA, 64 nt, hsa
aagagacuuacccaggcucacacagcagcucagccuguuccaggcgcuggucagugcguguucu

SEQ ID NO: 182051 - RNA, 64 nt, hsa
ggaggggggaaauacaguucugcucugguuguuucuguuccaaaugauuccauccaccuuuccc

SEQ ID NO: 182052 - RNA, 64 nt, hsa
uuuuacuuuuguuuauuuuuaugguaacugcuuucuguuccaaauucaguuucauaaaaggaga

SEQ ID NO: 182053 - RNA, 64 nt, hsa
uaucaucuucaggucuuuuguauguaaaauguuucuguuccaguuguagaccuugaugauugug

SEQ ID NO: 182054 - RNA, 64 nt, hsa
cuuccaucugaagccccacucuuaaaaaguugcacuguuccaguaguuauaauccacuugcccu

SEQ ID NO: 182055 - RNA, 64 nt, hsa
cuucccccagggccuguccuguaccgagcucugucuguuccagccuucauccuuccuggcuguu

SEQ ID NO: 182056 - RNA, 64 nt, hsa
cagggauucucugcuggugcuggugcaaggacuucuguuccaaaggcugggaaaaacuaagcug

SEQ ID NO: 182057 - RNA, 64 nt, hsa
gaggcucccucuuaacacggcacuuagacacgugcuguuccaccuucccucaugcuguuccacc

SEQ ID NO: 182058 - RNA, 64 nt, hsa
cacuuagacacgugcuguuccaccuucccucaugcuguuccaccuccccucagacuagcuuuca

SEQ ID NO: 182059 - RNA, 64 nt, hsa
gaggcucucucuuaacacggcacuuagacacgugcuguuccaccuucccucgugcuguuccacc

SEQ ID NO: 182060 - RNA, 64 nt, hsa
cacuuagacacgugcuguuccaccuucccucgugcuguuccaccuuuccucagacuauuuuuca

SEQ ID NO: 182061 - RNA, 64 nt, hsa
gaggcucccucuuaacacggcacuuacacacuugcuguuccaccuucccucaugcuguuccacc

SEQ ID NO: 182062 - RNA, 64 nt, hsa
cacuuacacacuugcuguuccaccuucccucaugcuguuccaccuccccucagacuaucuuuca

SEQ ID NO: 182063 - RNA, 64 nt, hsa
gccauacugagccugagguauuucauaucuccugcuguuccaucccagcuugaauuggugccac

SEQ ID NO: 182064 - RNA, 64 nt, hsa
auggccucaggucauuuugccuuccuacaugugccuguuccagauggcagggcuccuuacugca

SEQ ID NO: 182065 - RNA, 64 nt, hsa
gagacuccgucucuuaaaauauuugcccaaacauugaaccuaaauuugaccaugccccuagaaa

SEQ ID NO: 182066 - RNA, 64 nt, hsa
cuguaaauaacuugcaaggaugaaagauggaggaugaaccuauagauuuaaagagacuuaagag

SEQ ID NO: 182067 - RNA, 64 nt, hsa
cauuaagcucuguugucaugaacaacuggaauguaaaccacaguauuuuggagugcagaacauu

SEQ ID NO: 182068 - RNA, 64 nt, hsa
agguguuguaaagagcugcuaguagguucgcuuuaaaccacaugagcuuaaccaagaauauguu

SEQ ID NO: 182069 - RNA, 64 nt, hsa
aaagcaauuuaaucaauugcaaagcaauuauauaaaaccacaaagaauguacugaaccuacuaa

SEQ ID NO: 182070 - RNA, 64 nt, hsa
caaagugguuuuuuaaaauuacauaacuaaaaauaaaccacacuguggauacaucuuauaaaac

SEQ ID NO: 182071 - RNA, 64 nt, hsa
aaagaauauuccauuuuccuuuccuugugguugaaaaccacagucaguggagagauguuuggaa

SEQ ID NO: 182072 - RNA, 64 nt, hsa
gguugaaaaccacagucaguggagagauguuuggaaaccacagucaguggagccugggugguac

SEQ ID NO: 182073 - RNA, 64 nt, hsa
gcaguauauguucuaagaccccuaguagauucgcaaaccacagauaguaccaaacuccauucau

SEQ ID NO: 182074 - RNA, 64 nt, hsa
uaccaagcucucccuuaucaagugaauaucaucaaaaccacagcauccuugaucagagaagggg

SEQ ID NO: 182075 - RNA, 64 nt, hsa
augacagcccacuugucaaauauguaauucaccgaaaccacaccaaguccugcuacuguagagu

SEQ ID NO: 182076 - RNA, 64 nt, hsa
ccucugaaauguggcuagguguagaaugauguugaaaccacaggcuaaaauguagaucuggaag

SEQ ID NO: 182077 - RNA, 64 nt, hsa
acugcagaaguggcuccuuuucauaaacuccccuaaaccacacacaggagagagcgacgggccu

SEQ ID NO: 182078 - RNA, 64 nt, hsa
aaaauaaauaagaauaacucagaaacucaaaaggaaaccacaaauucagcuaauaauagcauuu

SEQ ID NO: 182079 - RNA, 64 nt, hsa
guugccaggcaggcaccugggcuuucuggaauccaaaccacagucuuaggggcuugguaguuug

SEQ ID NO: 182080 - RNA, 64 nt, hsa
ucugguugugauuuauauuuuaaagcuuggugcuaaaccacaauauguauagcauauggagugc

SEQ ID NO: 182081 - RNA, 64 nt, hsa
cauugaaucucuuaugccaguuuucauaaaacccaaaccacauaugaaaaaauccauuaagggu

SEQ ID NO: 182082 - RNA, 64 nt, hsa
accaguuguugagggguauacuagaagcagaaugaaaccacauuuuuugguuugauaauaugca

SEQ ID NO: 182083 - RNA, 64 nt, hsa
guccauuccaggaccuucauuugcauaagguaucaaaccacaucagccucugauuggccauggg

SEQ ID NO: 182084 - RNA, 64 nt, hsa
guucauuccaggacauucauuugcauaaggagucaaaccacaccagucuuggauuggcugugag

SEQ ID NO: 182085 - RNA, 64 nt, hsa
uggacagauccugucauuguuuaagcugagcaaaaaaccacacaaaaguuguguaagagaugag

SEQ ID NO: 182086 - RNA, 64 nt, hsa
gaagagggaacuuucuggaguuuuugagaaugccaaaccacauuuuuaucacacuucuuuggaa

SEQ ID NO: 182087 - RNA, 64 nt, hsa
gaaauaaggaaauaggggaaaaaaagagcacuauaaaccacauguuuucauuucuagugcuucg

SEQ ID NO: 182088 - RNA, 64 nt, hsa
ugugugaucacaagacuaaagauaauuaaaaagaaaaccacagaucaugacuuuuugacugugc

SEQ ID NO: 182089 - RNA, 64 nt, hsa
cauuauuacaaaacaaaaugaacacuugaccaaaaaaccacauuaauuuaaauggagccuuuca

SEQ ID NO: 182090 - RNA, 64 nt, hsa
uuaauacuaauggaauguuucaaagguuuuauucaaaccacaaauuauagaauccacccaagaa

SEQ ID NO: 182091 - RNA, 64 nt, hsa
uguagaaaagugcuugucaguuguugaauaaaaaaaaccacauuugauagagauucaaaagacu

SEQ ID NO: 182092 - RNA, 64 nt, hsa
uugcuucccucccaucagucugguugacaggaagaaaccacaccaucaacaccaacaaguuucu

SEQ ID NO: 182093 - RNA, 64 nt, hsa
cauuguuuaaaaccaucacuuuuuugucuuugggaaaccacaggaacaauuucucuggagacaa

SEQ ID NO: 182094 - RNA, 64 nt, hsa
uagaaauacacguaugguuaauguucaguccaacaaaccacacacaguaaauguuuauuaauag

SEQ ID NO: 182095 - RNA, 64 nt, hsa
auugucauuugggcuuucuguugaaugaaucaacaaaccacaauacuuccugggaccuuuugua

SEQ ID NO: 182096 - RNA, 64 nt, hsa
ccgaaggcauuuuccacuaguuuuuggacuauguaaaccacauuguacuuuuuuuuacuuuggc

SEQ ID NO: 182097 - RNA, 64 nt, hsa
aagcacaacauuaugauuuaauaugcuuuuguugaaaccacagcuuuugugcccauuguuuuaa

SEQ ID NO: 182098 - RNA, 64 nt, hsa
cagauguuguuuucagguuaauggacacgcaaagaaaccacagcacauacuucuuuucuuucau

SEQ ID NO: 182099 - RNA, 64 nt, hsa
gcuggggaagugaacuacccagggcagccccuuuguggcccaggauaaucaacacuguucucuc

SEQ ID NO: 182100 - RNA, 64 nt, hsa
ugcagacgugagaugaacacuggagugggcagagguggcccaggaccauggcacccuuagagug

SEQ ID NO: 182101 - RNA, 64 nt, hsa
gaggagggggccucucauggcccuucccuggccuguggcccagccuggcuggccugcagguguc

SEQ ID NO: 182102 - RNA, 64 nt, hsa
gcuggacuguggaccccgaugggccagaguccuuguggcccacagcauagcacuggggacagag

SEQ ID NO: 182103 - RNA, 64 nt, hsa
augaagaagcugaagcccagaguggggaaggggaguggcccaaggucacacagcuaguuugagu

SEQ ID NO: 182104 - RNA, 64 nt, hsa
gcgccauggugugucagugucuguguguugauggguggcccaugagugacccccgccaggggag

SEQ ID NO: 182105 - RNA, 64 nt, hsa
gugaccagacaguccugagacccagaaggcccagguggcccaagugcucuugguggcccagcuu

SEQ ID NO: 182106 - RNA, 64 nt, hsa
gacccagaaggcccagguggcccaagugcucuugguggcccagcuuggccagcacacacuuucc

SEQ ID NO: 182107 - RNA, 64 nt, hsa
cccugcagugcaagcugcugcuccagagcguaccguggcccagacugauccucgaggccuccug

SEQ ID NO: 182108 - RNA, 64 nt, hsa
cccugcggugcaagcugcugcuccagagcauaccguggcccaggugguauccccaaggccucgu

SEQ ID NO: 182109 - RNA, 64 nt, hsa
cggccccaagcugccuuccucgauguggcccaaaguggcccaaagcgucccaaaguaggccucg

SEQ ID NO: 182110 - RNA, 64 nt, hsa
cggcgccucccggccccaagcugccuuccucgauguggcccaaaguggcccaaagcgucccaaa

SEQ ID NO: 182111 - RNA, 64 nt, hsa
uccuucccccugugcugacagcauugcuguggggguggcccacugcccuccccuggcccucaug

SEQ ID NO: 182112 - RNA, 64 nt, hsa
uuggaggcaacagacggugguccucuugguaaguguggcccacacccagccugguggacaugga

SEQ ID NO: 182113 - RNA, 64 nt, hsa
agucgggugacucauuuuucuguguagagacucgguggcccaggcaggaggugaaagcagccau

SEQ ID NO: 182114 - RNA, 64 nt, hsa
ugacugggucuucaaugacaggcuuggacuagcuguggcccagacaucggcccugcccagaauu

SEQ ID NO: 182115 - RNA, 59 nt, hsa
agaccuaccgcagcuccuagcccguugcgguggcccaucccgcauacccaucuucucgg

SEQ ID NO: 182116 - RNA, 64 nt, hsa
agcuggguuaucaugguuggcuuagguaccucagguggcccaggagguccccccuccauaagga

SEQ ID NO: 182117 - RNA, 64 nt, hsa
uuuacauguggcccaacacaauucuucuuccaacguggcccagagaagccaaaagauuggauac

SEQ ID NO: 182118 - RNA, 64 nt, hsa
caucggcuaucguuagugcuaguggauuuuacauguggcccaacacaauucuucuuccaacgug

SEQ ID NO: 182119 - RNA, 64 nt, hsa
uuuauguguggcccaagauaauucuucuuccaauguggcccagggaagccaaaagaugggacac

SEQ ID NO: 182120 - RNA, 64 nt, hsa
uuuucucgucagcuaucguuaguguauuuuauguguggcccaagauaauucuucuuccaaugug

SEQ ID NO: 182121 - RNA, 64 nt, hsa
gcauaagggaugaaaacuuggccgagacuaauguguggcccacagcuuuggcuggaaucauuuu

SEQ ID NO: 182122 - RNA, 64 nt, hsa
gcagguugugagcuggaaaagaaaguucuagacuguggcccagaauagggcuggggcagcuccc

SEQ ID NO: 182123 - RNA, 64 nt, hsa
augaccccagccagaugagcgaguggggcucagcguggcccauggugccugucacucagcauuc

SEQ ID NO: 182124 - RNA, 64 nt, hsa
cuuguaaccugaacuucugugugguggcaguacuguggcccaccaguguaaucucccuggauua

SEQ ID NO: 182125 - RNA, 64 nt, hsa
uuuggagaacagggaaagccuggaggcuucccagguggcccagcgugguguccugucagcuucc

SEQ ID NO: 182126 - RNA, 64 nt, hsa
auuuuguaaauguauaaacucaccucugguaacaguggcccagacgcugcuuugugcuaaaagc

SEQ ID NO: 182127 - RNA, 64 nt, hsa
uuuccagaccagcauccaguggccaucaggucuuguggcccaaaggcuaugcuugccuccggcu

SEQ ID NO: 182128 - RNA, 64 nt, hsa
cugacccgggacucacucuucauucagaagacugguggcccacgugccaggaccaccccaccuc

SEQ ID NO: 182129 - RNA, 64 nt, hsa
auguuggcucagagcuauagcuucucugugggggguggcccaagggaaggcuccucuggggccc

SEQ ID NO: 182130 - RNA, 64 nt, hsa
ccugugguuguuaguggggccugaggucaucggcguggcccaaggcuggcaggucaaccucgcg

SEQ ID NO: 182131 - RNA, 64 nt, hsa
ccaaagugccggugagacccauggcuguguugguguggcccauggcuguuggugggacccgugg

SEQ ID NO: 182132 - RNA, 64 nt, hsa
uugggcucaggcugggugcucugccaugggcugaguggcccagauauucuucuguccaucuuug

SEQ ID NO: 182133 - RNA, 64 nt, hsa
acuuuaguuacuugaugagcuggcuguggccaggguggcccaccugcccuucccuguuccuuuc

SEQ ID NO: 182134 - RNA, 64 nt, hsa
gaugcuggaugugcugcaggagcuccgaggcacuguggcccagcaggugagccugcuguucugc

SEQ ID NO: 182135 - RNA, 64 nt, hsa
ccacccccagguaugucucuguauggcagcaaauguggcccauggccugcagcaaaacguccua

SEQ ID NO: 182136 - RNA, 64 nt, hsa
acacggcugaccucauacaucaagccaauaccguguggcccaagacccccaccauaaaucacau

SEQ ID NO: 182137 - RNA, 64 nt, hsa
ccauaaaucacaucauuagcaugaaccacccagaguggcccaagacucccagaucagcuaccag

SEQ ID NO: 182138 - RNA, 64 nt, hsa
cggcaucgccaggcacuggcugggguggggaaagguggcccaguggagccgguggccaggaagg

SEQ ID NO: 182139 - RNA, 64 nt, hsa
gcaggcgggcgagugcgugagugcacgccagcgcguggcccauguaugaggagugaaggggccc

SEQ ID NO: 182140 - RNA, 64 nt, hsa
ccugggcgucaucugguccugguaagaggagugcguggcccaccaggccccccugucacccaug

SEQ ID NO: 182141 - RNA, 64 nt, hsa
gcacagaggccuccuguggccugccagucaucgaguggcccaacaggggcuccaugccagccga

SEQ ID NO: 182142 - RNA, 64 nt, hsa
aaggcagccacacgccccuccuggaagggugugugcgugugagugugugcgagugugugggcug

SEQ ID NO: 182143 - RNA, 64 nt, hsa
uagccugccucuucucuacucuagggaaaaaccagcgugugacuacucccccaggugguuaugg

SEQ ID NO: 182144 - RNA, 64 nt, hsa
uaagauagaacacaaaacuugaaagaaguuuuaugcgugugacaguguauggggcugcaguugg

SEQ ID NO: 182145 - RNA, 64 nt, hsa
ugugacgcggcacauacaccccagccgcacagaugcgugugacccagaggcgagacgcagcuuu

SEQ ID NO: 182146 - RNA, 64 nt, hsa
uggaauuaagggagcugagccagucaugguuguggcgugugagucaggagaccuagguuucagc

SEQ ID NO: 182147 - RNA, 64 nt, hsa
gaggaaaagcuuucuuaaaaauggacauguaugugcgugugaguguguguguagauuuauaguu

SEQ ID NO: 182148 - RNA, 64 nt, hsa
aggagaguagcuucuuugugugugugauguuugugcgugugaugaauuuagcaaauuaaguuau

SEQ ID NO: 182149 - RNA, 64 nt, hsa
ggucccaugacggcggggcccaggcagccuccgggcgugugaagaacaccuccucccgaaaaau

SEQ ID NO: 182150 - RNA, 64 nt, hsa
gugcagagaugcugcauauccuuuuuaugggauugcgugugaauuugaaccaugagacauuccu

SEQ ID NO: 182151 - RNA, 64 nt, hsa
uggagucuuaacacuuccagcaaacucaaucucagcgugugaccaauggcuucauuuugaagaa

SEQ ID NO: 182152 - RNA, 64 nt, hsa
gucuauuaaaacugugaauguauguagcaauccugcgugugaaggcaaauaaacucuuuaacag

SEQ ID NO: 182153 - RNA, 64 nt, hsa
aguacucuauaaauuuuuguguauguguguaugugcgugugauuaccagagaacuacuaaaaaa

SEQ ID NO: 182154 - RNA, 64 nt, hsa
gcagggcugaggcuccaugugcaucugugagcaugcgugugacaggugcagagacgggggacug

SEQ ID NO: 182155 - RNA, 64 nt, hsa
cccccugcugggucaggagccaacacaggacccugcgugugagcgugccugacaucucacgcac

SEQ ID NO: 182156 - RNA, 64 nt, hsa
acugcagcuugaaggagccaaccauggauuugaggcgugugaaggaauauuucuccuggcucua

SEQ ID NO: 182157 - RNA, 64 nt, hsa
cucaccuccccgcccugggcagcaggugugggcagcgugugaggcugccgggugguggugacug

SEQ ID NO: 182158 - RNA, 64 nt, hsa
cuuauuguaaaugaauagaauauuucuucccuaagcgugugaaaauaggggauggaugaguggg

SEQ ID NO: 182159 - RNA, 64 nt, hsa
gggccaggcccagcccaucuguguguguguaugugcgugugaugcuaccucuccucccgucccu

SEQ ID NO: 182160 - RNA, 64 nt, hsa
ccagcccugugcccccgcugaaccuggcuggaccgcgugugaaaggcagaacuaacgugcggaa

SEQ ID NO: 182161 - RNA, 64 nt, hsa
guucacaucacucugcagacagcaaugugacucagcgugugacuuguagcagcaguacgagggc

SEQ ID NO: 182162 - RNA, 57 nt, hsa
cggcugccaaaaagaaguaggaagcuggcgugugaaaaccgcaacaaagccccaaag

SEQ ID NO: 182163 - RNA, 64 nt, hsa
uucaauaaacguggcugcuggccagaggacgugagcgugugacgggcgccuuggcgccaccugu

SEQ ID NO: 182164 - RNA, 64 nt, hsa
gugcuagggguuaggcuuuugagcuugaacgccugcgugugaacagaugaaaaauccuucagua

SEQ ID NO: 182165 - RNA, 64 nt, hsa
cuggaucaccuaacagucagaggucaguaucucagcgugugaauuauagaggaaauacagagag

SEQ ID NO: 182166 - RNA, 64 nt, hsa
uccuugguaaacccaaaggcuuauucuguugccugcgugugaauguuugguagagcuauaucau

SEQ ID NO: 182167 - RNA, 64 nt, hsa
agguuaauuaagaauguugguuauuuucacgggagcgugugauauuuaacauuaauauuuuauu

SEQ ID NO: 182168 - RNA, 62 nt, hsa
uuuaugacuuggaucuauagcaaccuugcguggcgugugaacuggucugcugaccucagaca

SEQ ID NO: 182169 - RNA, 64 nt, hsa
aggcaggugcagggaagugcagagcuuguggaaagcgugugagugagggagacaggaacggcuc

SEQ ID NO: 182170 - RNA, 64 nt, hsa
auuaauuuugguugguguugggggaggcgcgagugcgugugagaagaaccgacccaccccgcgc

SEQ ID NO: 182171 - RNA, 64 nt, hsa
caccuacugagggaaaggaaaagccccuggaaaugcgugugaccugugaagugguguauuguca

SEQ ID NO: 182172 - RNA, 64 nt, hsa
guuaacgcacuuggaguaauuuuuaugaaauacugcgugugauaagcaaacgggagaaauuuau

SEQ ID NO: 182173 - RNA, 64 nt, hsa
ucauuagguagcucuggcugggcuuugucagccagcgugugagaaaggagaaccaaaaccaaua

SEQ ID NO: 182174 - RNA, 64 nt, hsa
gacuuuccacuccaagcacaggaggagguagcuagcgugugaggguuggcacuaggcccacggc

SEQ ID NO: 182175 - RNA, 64 nt, hsa
agagugaggaagaagcagaaugauucauuuugcugcgugugaaaucaugguuccugcaugcugu

SEQ ID NO: 182176 - RNA, 64 nt, hsa
ggugucguugugugcgguccucuuguuuggcugugcgugugaacacgugugugaguucaccaug

SEQ ID NO: 182177 - RNA, 64 nt, hsa
uucuguucgugccccaggcgguguauggcgugcugcgugugauggaggggcuggaugcguucga

SEQ ID NO: 182178 - RNA, 64 nt, hsa
uucccuugcccagcucuguugaaugcugcugugcgcgugugagggccgcucugcacacagggcc

SEQ ID NO: 182179 - RNA, 64 nt, hsa
uuguuuuucuaaauguucaaauauuucauuuugugcgugugaaagggaaaacacuuugacggau

SEQ ID NO: 182180 - RNA, 64 nt, hsa
guuacagaaagagguucuggugggagagaaaggugcgugugagacaggagaauugucuuaagca

SEQ ID NO: 182181 - RNA, 64 nt, hsa
acaaaaucguguguccguggaaccaguccuagccgcgugugacagucuugcauucuguuugucu

SEQ ID NO: 182182 - RNA, 64 nt, hsa
ucucuugcccugucucucaaauaaacccaaugcugcgugugaggccuuuuuuauuuuucuuuuc

SEQ ID NO: 182183 - RNA, 64 nt, hsa
auccugggagguggcccuucccaagcccaucagggcgugugagcagacugaaggggccgcugca

SEQ ID NO: 182184 - RNA, 64 nt, hsa
cucccucuccaccuccccgcccccgagagcuacagcgugugauggaaucagugaccggccaggu

SEQ ID NO: 182185 - RNA, 64 nt, hsa
uuggagggagggcugacccagauucccuuccggugcgugugaagccacggaaggcuugguccca

SEQ ID NO: 182186 - RNA, 64 nt, hsa
cugugagccucuggcccuuuccuggaccggcugggcgugugaugcgaucagcccugucuccucc

SEQ ID NO: 182187 - RNA, 64 nt, hsa
agauccccacagcucucggccgcggacccgggccgcgugugagcgcacuuugcaccuccuaucc

SEQ ID NO: 182188 - RNA, 64 nt, hsa
uuccauaccaagugcuuugcucuagggaagcagugcgugugaaacagcguaacggagggugaag

SEQ ID NO: 182189 - RNA, 64 nt, hsa
ucaucaaggcggcagcauaauuugaagggcaauugcgugugaaaauugaugugacuugauuuac

SEQ ID NO: 182190 - RNA, 64 nt, hsa
cguugugccugguucgugccaugcccuuacacgugcgugugagugugugugugugucuguaggu

SEQ ID NO: 182191 - RNA, 64 nt, hsa
cauagcugccuaugcccccgcagaacuggcugcugcgugugaacugaacagacggagaagaugu

SEQ ID NO: 182192 - RNA, 64 nt, hsa
cacgucucuccccagugggcuccuaagggggcaggcgugugaguggacgccauccgaagacagc

SEQ ID NO: 182193 - RNA, 64 nt, hsa
ucagucucgugcacgucugucuugcgugcacggugcgugugacgcugggcucuguggcucugug

SEQ ID NO: 182194 - RNA, 64 nt, hsa
cugccaggcugucagcgccucaaggguagggucugcgugugauuugucucugagcccccugugc

SEQ ID NO: 182195 - RNA, 64 nt, hsa
caaugggcagugcccaccccgcccacuggcaucugcgugugagggcuaggccgcccugccacac

SEQ ID NO: 182196 - RNA, 64 nt, hsa
auacucaggaccccaagauacagaaggaaaucaugcgugugaucggaacucagguuuacacaaa

SEQ ID NO: 182197 - RNA, 64 nt, hsa
ccacccuuccugccuccugccccacucaggguuggcgugugaugagccauucauguguuccaaa

SEQ ID NO: 182198 - RNA, 64 nt, hsa
aaaaguuugcuuuggugagugagaaaaggcuggggcgugugauccauccccucacguuucagaa

SEQ ID NO: 182199 - RNA, 64 nt, hsa
cucuguaaacaaggcccuucugaccggacucagugcgugugauggugagugcaaugaggaaggg

SEQ ID NO: 182200 - RNA, 64 nt, hsa
cccauguuuggagcauuuguagccuuauucucuugcgugugaaucucuuacccugaaaaaaagc

SEQ ID NO: 182201 - RNA, 64 nt, hsa
ugcucgagacguguggacaccccagcgugcgugugcgugugaugugugugaugcaccagagcac

SEQ ID NO: 182202 - RNA, 64 nt, hsa
cggagcugccagucgucuugaacgugcaugggcggcgugugacaucuccagggaggccguccga

SEQ ID NO: 182203 - RNA, 64 nt, hsa
agaggccaaaucgucuaaggacguugcugaacaagcgugugaaaucauuucagaucaaggauaa

SEQ ID NO: 182204 - RNA, 64 nt, hsa
agcaggauugcuuucauuguauggagcaugaccagcgugugacucauucugacauuucagaucc

SEQ ID NO: 182205 - RNA, 64 nt, hsa
uggggaggagcaggagccugagccuugggaacaugcgugugaccuccacagcuaccucuucuau

SEQ ID NO: 182206 - RNA, 64 nt, hsa
uggggaggagcaggagccugagccuugggaacaugcgugugaccucuacagcuaccucuucuau

SEQ ID NO: 182207 - RNA, 64 nt, hsa
ugggagaguggaccugugcugugaguguguggaugcgugugaacgcaugugguaagguguguac

SEQ ID NO: 182208 - RNA, 64 nt, hsa
cugcccacauuccugccacccgacaucaaagcuggcgugugaccuuuccagccaugcgauauuc

SEQ ID NO: 182209 - RNA, 64 nt, hsa
uugugguagagaggugaagguaugagaauuaauagcgugugaacaaaguaaagaacaggauucc

SEQ ID NO: 182210 - RNA, 64 nt, hsa
ggccucaaggggacucugcuccacguggggccaggcgugugacugacgcuguccgacgaaggcg

SEQ ID NO: 182211 - RNA, 64 nt, hsa
gugccaugugcguggcacgcauaugagugugugugcgugugaacggcuuuggguccugcugguu

SEQ ID NO: 182212 - RNA, 64 nt, hsa
acacuaagaggugaacauguaugagugugugcacgcgugugagugugcaugugugugugugcaa

SEQ ID NO: 182213 - RNA, 64 nt, hsa
ucucccuccuccaagccccuguacauaaccuggagcgugugaccuucagagcuuuucacuuuau

SEQ ID NO: 182214 - RNA, 64 nt, hsa
gggcggugggaggcccgccucaggucagggcccagcgugugauguaggggccggggcaggccag

SEQ ID NO: 182215 - RNA, 64 nt, hsa
ccucgggcuggacaccgaaaccucccuucuuaaagcgugugagguugggugauagccguuccuu

SEQ ID NO: 182216 - RNA, 64 nt, hsa
cccuuuggucuggguuguguggcuuuugggggaugcgugugagggggcuauguguuuuuuaauu

SEQ ID NO: 182217 - RNA, 64 nt, hsa
cgugugaauucucacauuagacuuuaauucgagcgcgugugaacugaacgcugaucaguauuuu

SEQ ID NO: 182218 - RNA, 64 nt, hsa
cuaaaaggugggacugaggauguguauagagugagcgugugauuguagacagaggggugaagaa

SEQ ID NO: 182219 - RNA, 64 nt, hsa
gcucuugaagcacuuucuuuucaugucggaggcugcgugugagccggugguggcggcagcuguc

SEQ ID NO: 182220 - RNA, 64 nt, hsa
gacguacaacagguucugcggagaccaagagaaggcgugugagcaacccacccacuggaagauc

SEQ ID NO: 182221 - RNA, 64 nt, hsa
aguucauucucucacccccuuauguugguguuuggcgugugacagcaguucuacagagcucugu

SEQ ID NO: 182222 - RNA, 64 nt, hsa
cgucggagccuguuccuggcgagaucauugcugugcgugugaaggaagagcaucuagacguggc

SEQ ID NO: 182223 - RNA, 64 nt, hsa
ucauuuauuccuugcuggacaaacucuggaagcagcgugugaaacagcgggggaagggaagagc

SEQ ID NO: 182224 - RNA, 64 nt, hsa
ccguguucauaugucagggcacaugugauguggugcgugugaaucugugggcgcccaaggccag

SEQ ID NO: 182225 - RNA, 64 nt, hsa
cauggugcugagguuacauguguguguguacagugcgugugauucccauguccaaagugcuguc

SEQ ID NO: 182226 - RNA, 64 nt, hsa
gauccacccaccucaggaagugcugggauuacaggcgugugagccaccacgcccggccaugaaa

SEQ ID NO: 182227 - RNA, 64 nt, hsa; identical to SEQ ID NO: 56439

SEQ ID NO: 182228 - RNA, 64 nt, hsa; identical to SEQ ID NO: 56440

SEQ ID NO: 182229 - RNA, 64 nt, hsa; identical to SEQ ID NO: 56441

SEQ ID NO: 182230 - RNA, 64 nt, hsa; identical to SEQ ID NO: 56442

SEQ ID NO: 182231 - RNA, 64 nt, hsa; identical to SEQ ID NO: 56443

SEQ ID NO: 182232 - RNA, 64 nt, hsa; identical to SEQ ID NO: 56444

SEQ ID NO: 182233 - RNA, 64 nt, hsa; identical to SEQ ID NO: 56445

SEQ ID NO: 182234 - RNA, 64 nt, hsa; identical to SEQ ID NO: 56446

SEQ ID NO: 182235 - RNA, 64 nt, hsa; identical to SEQ ID NO: 56447

SEQ ID NO: 182236 - RNA, 64 nt, hsa; identical to SEQ ID NO: 56448

SEQ ID NO: 182237 - RNA, 64 nt, hsa; identical to SEQ ID NO: 56449

SEQ ID NO: 182238 - RNA, 64 nt, hsa; identical to SEQ ID NO: 56450

SEQ ID NO: 182239 - RNA, 64 nt, hsa; identical to SEQ ID NO: 56451

SEQ ID NO: 182240 - RNA, 64 nt, hsa; identical to SEQ ID NO: 56452

SEQ ID NO: 182241 - RNA, 64 nt, hsa; identical to SEQ ID NO: 56453

SEQ ID NO: 182242 - RNA, 64 nt, hsa; identical to SEQ ID NO: 56454

SEQ ID NO: 182243 - RNA, 64 nt, hsa; identical to SEQ ID NO: 56455

SEQ ID NO: 182244 - RNA, 64 nt, hsa; identical to SEQ ID NO: 56456

SEQ ID NO: 182245 - RNA, 64 nt, hsa; identical to SEQ ID NO: 56457

SEQ ID NO: 182246 - RNA, 64 nt, hsa; identical to SEQ ID NO: 56458

SEQ ID NO: 182247 - RNA, 64 nt, hsa; identical to SEQ ID NO: 56459

SEQ ID NO: 182248 - RNA, 64 nt, hsa; identical to SEQ ID NO: 56460

SEQ ID NO: 182249 - RNA, 64 nt, hsa; identical to SEQ ID NO: 56461

SEQ ID NO: 182250 - RNA, 64 nt, hsa; identical to SEQ ID NO: 56462

SEQ ID NO: 182251 - RNA, 64 nt, hsa; identical to SEQ ID NO: 56463

SEQ ID NO: 182252 - RNA, 64 nt, hsa; identical to SEQ ID NO: 56464

SEQ ID NO: 182253 - RNA, 64 nt, hsa; identical to SEQ ID NO: 56465

SEQ ID NO: 182254 - RNA, 64 nt, hsa; identical to SEQ ID NO: 56466

SEQ ID NO: 182255 - RNA, 64 nt, hsa; identical to SEQ ID NO: 56467

SEQ ID NO: 182256 - RNA, 50 nt, hsa; identical to SEQ ID NO: 56468

SEQ ID NO: 182257 - RNA, 64 nt, hsa; identical to SEQ ID NO: 56469

SEQ ID NO: 182258 - RNA, 64 nt, hsa; identical to SEQ ID NO: 56470

SEQ ID NO: 182259 - RNA, 64 nt, hsa; identical to SEQ ID NO: 56471

SEQ ID NO: 182260 - RNA, 64 nt, hsa; identical to SEQ ID NO: 56472

SEQ ID NO: 182261 - RNA, 64 nt, hsa; identical to SEQ ID NO: 56473

SEQ ID NO: 182262 - RNA, 64 nt, hsa; identical to SEQ ID NO: 56474

SEQ ID NO: 182263 - RNA, 64 nt, hsa; identical to SEQ ID NO: 56475

SEQ ID NO: 182264 - RNA, 64 nt, hsa; identical to SEQ ID NO: 56476

SEQ ID NO: 182265 - RNA, 64 nt, hsa; identical to SEQ ID NO: 56477

SEQ ID NO: 182266 - RNA, 64 nt, hsa; identical to SEQ ID NO: 56478

SEQ ID NO: 182267 - RNA, 64 nt, hsa; identical to SEQ ID NO: 56479

SEQ ID NO: 182268 - RNA, 64 nt, hsa; identical to SEQ ID NO: 56480

SEQ ID NO: 182269 - RNA, 64 nt, hsa; identical to SEQ ID NO: 56481

SEQ ID NO: 182270 - RNA, 64 nt, hsa; identical to SEQ ID NO: 56482

SEQ ID NO: 182271 - RNA, 64 nt, hsa; identical to SEQ ID NO: 56483

SEQ ID NO: 182272 - RNA, 64 nt, hsa; identical to SEQ ID NO: 56484

SEQ ID NO: 182273 - RNA, 64 nt, hsa; identical to SEQ ID NO: 56485

SEQ ID NO: 182274 - RNA, 64 nt, hsa; identical to SEQ ID NO: 56486

SEQ ID NO: 182275 - RNA, 64 nt, hsa; identical to SEQ ID NO: 56487

SEQ ID NO: 182276 - RNA, 64 nt, hsa; identical to SEQ ID NO: 56488

SEQ ID NO: 182277 - RNA, 64 nt, hsa; identical to SEQ ID NO: 56489

SEQ ID NO: 182278 - RNA, 64 nt, hsa; identical to SEQ ID NO: 56490

SEQ ID NO: 182279 - RNA, 64 nt, hsa; identical to SEQ ID NO: 56491

SEQ ID NO: 182280 - RNA, 64 nt, hsa; identical to SEQ ID NO: 56492

SEQ ID NO: 182281 - RNA, 64 nt, hsa; identical to SEQ ID NO: 56493

SEQ ID NO: 182282 - RNA, 64 nt, hsa; identical to SEQ ID NO: 56494

SEQ ID NO: 182283 - RNA, 64 nt, hsa; identical to SEQ ID NO: 56495

SEQ ID NO: 182284 - RNA, 64 nt, hsa; identical to SEQ ID NO: 56496

SEQ ID NO: 182285 - RNA, 64 nt, hsa; identical to SEQ ID NO: 56497

SEQ ID NO: 182286 - RNA, 64 nt, hsa; identical to SEQ ID NO: 56498

SEQ ID NO: 182287 - RNA, 64 nt, hsa; identical to SEQ ID NO: 56499

SEQ ID NO: 182288 - RNA, 64 nt, hsa; identical to SEQ ID NO: 56500

SEQ ID NO: 182289 - RNA, 64 nt, hsa; identical to SEQ ID NO: 56501

SEQ ID NO: 182290 - RNA, 64 nt, hsa; identical to SEQ ID NO: 56502

SEQ ID NO: 182291 - RNA, 64 nt, hsa; identical to SEQ ID NO: 56503

SEQ ID NO: 182292 - RNA, 64 nt, hsa; identical to SEQ ID NO: 56504

SEQ ID NO: 182293 - RNA, 64 nt, hsa; identical to SEQ ID NO: 56505

SEQ ID NO: 182294 - RNA, 64 nt, hsa; identical to SEQ ID NO: 56506

SEQ ID NO: 182295 - RNA, 64 nt, hsa; identical to SEQ ID NO: 56507

SEQ ID NO: 182296 - RNA, 64 nt, hsa; identical to SEQ ID NO: 56508

SEQ ID NO: 182297 - RNA, 64 nt, hsa; identical to SEQ ID NO: 56509

SEQ ID NO: 182298 - RNA, 64 nt, hsa; identical to SEQ ID NO: 56510

SEQ ID NO: 182299 - RNA, 64 nt, hsa; identical to SEQ ID NO: 56511

SEQ ID NO: 182300 - RNA, 64 nt, hsa; identical to SEQ ID NO: 56512

SEQ ID NO: 182301 - RNA, 64 nt, hsa; identical to SEQ ID NO: 56513

SEQ ID NO: 182302 - RNA, 64 nt, hsa; identical to SEQ ID NO: 56514

SEQ ID NO: 182303 - RNA, 64 nt, hsa; identical to SEQ ID NO: 56515

SEQ ID NO: 182304 - RNA, 64 nt, hsa; identical to SEQ ID NO: 56516

SEQ ID NO: 182305 - RNA, 64 nt, hsa; identical to SEQ ID NO: 56517

SEQ ID NO: 182306 - RNA, 64 nt, hsa; identical to SEQ ID NO: 56518

SEQ ID NO: 182307 - RNA, 64 nt, hsa; identical to SEQ ID NO: 56519

SEQ ID NO: 182308 - RNA, 64 nt, hsa; identical to SEQ ID NO: 56520

SEQ ID NO: 182309 - RNA, 64 nt, hsa; identical to SEQ ID NO: 56521

SEQ ID NO: 182310 - RNA, 64 nt, hsa; identical to SEQ ID NO: 56522

SEQ ID NO: 182311 - RNA, 64 nt, hsa; identical to SEQ ID NO: 56523

SEQ ID NO: 182312 - RNA, 64 nt, hsa; identical to SEQ ID NO: 56524

SEQ ID NO: 182313 - RNA, 64 nt, hsa; identical to SEQ ID NO: 56525

SEQ ID NO: 182314 - RNA, 64 nt, hsa; identical to SEQ ID NO: 56526

SEQ ID NO: 182315 - RNA, 64 nt, hsa; identical to SEQ ID NO: 56527

SEQ ID NO: 182316 - RNA, 64 nt, hsa; identical to SEQ ID NO: 56528

SEQ ID NO: 182317 - RNA, 64 nt, hsa; identical to SEQ ID NO: 56529

SEQ ID NO: 182318 - RNA, 64 nt, hsa; identical to SEQ ID NO: 56530

SEQ ID NO: 182319 - RNA, 64 nt, hsa; identical to SEQ ID NO: 56531

SEQ ID NO: 182320 - RNA, 64 nt, hsa; identical to SEQ ID NO: 56532

SEQ ID NO: 182321 - RNA, 64 nt, hsa; identical to SEQ ID NO: 56533

SEQ ID NO: 182322 - RNA, 64 nt, hsa; identical to SEQ ID NO: 56534

SEQ ID NO: 182323 - RNA, 59 nt, hsa; identical to SEQ ID NO: 56535

SEQ ID NO: 182324 - RNA, 64 nt, hsa; identical to SEQ ID NO: 56536

SEQ ID NO: 182325 - RNA, 64 nt, hsa; identical to SEQ ID NO: 56537

SEQ ID NO: 182326 - RNA, 64 nt, hsa; identical to SEQ ID NO: 56538

SEQ ID NO: 182327 - RNA, 64 nt, hsa; identical to SEQ ID NO: 56539

SEQ ID NO: 182328 - RNA, 64 nt, hsa; identical to SEQ ID NO: 56540

SEQ ID NO: 182329 - RNA, 64 nt, hsa; identical to SEQ ID NO: 56541

SEQ ID NO: 182330 - RNA, 64 nt, hsa; identical to SEQ ID NO: 56542

SEQ ID NO: 182331 - RNA, 64 nt, hsa; identical to SEQ ID NO: 56543

SEQ ID NO: 182332 - RNA, 64 nt, hsa; identical to SEQ ID NO: 56544

SEQ ID NO: 182333 - RNA, 64 nt, hsa; identical to SEQ ID NO: 56545

SEQ ID NO: 182334 - RNA, 64 nt, hsa; identical to SEQ ID NO: 56546

SEQ ID NO: 182335 - RNA, 64 nt, hsa; identical to SEQ ID NO: 56547

SEQ ID NO: 182336 - RNA, 64 nt, hsa; identical to SEQ ID NO: 56548

SEQ ID NO: 182337 - RNA, 64 nt, hsa; identical to SEQ ID NO: 56549

SEQ ID NO: 182338 - RNA, 64 nt, hsa; identical to SEQ ID NO: 56550

SEQ ID NO: 182339 - RNA, 64 nt, hsa; identical to SEQ ID NO: 56551

SEQ ID NO: 182340 - RNA, 64 nt, hsa; identical to SEQ ID NO: 56552

SEQ ID NO: 182341 - RNA, 64 nt, hsa; identical to SEQ ID NO: 56553

SEQ ID NO: 182342 - RNA, 64 nt, hsa; identical to SEQ ID NO: 56554

SEQ ID NO: 182343 - RNA, 64 nt, hsa; identical to SEQ ID NO: 56555

SEQ ID NO: 182344 - RNA, 64 nt, hsa; identical to SEQ ID NO: 56556

SEQ ID NO: 182345 - RNA, 62 nt, hsa; identical to SEQ ID NO: 56557

SEQ ID NO: 182346 - RNA, 58 nt, hsa; identical to SEQ ID NO: 56558

SEQ ID NO: 182347 - RNA, 64 nt, hsa; identical to SEQ ID NO: 56559

SEQ ID NO: 182348 - RNA, 64 nt, hsa; identical to SEQ ID NO: 56560

SEQ ID NO: 182349 - RNA, 64 nt, hsa; identical to SEQ ID NO: 56561

SEQ ID NO: 182350 - RNA, 64 nt, hsa; identical to SEQ ID NO: 56562

SEQ ID NO: 182351 - RNA, 64 nt, hsa; identical to SEQ ID NO: 56563

SEQ ID NO: 182352 - RNA, 64 nt, hsa; identical to SEQ ID NO: 56564

SEQ ID NO: 182353 - RNA, 64 nt, hsa; identical to SEQ ID NO: 56565

SEQ ID NO: 182354 - RNA, 64 nt, hsa; identical to SEQ ID NO: 56566

SEQ ID NO: 182355 - RNA, 64 nt, hsa; identical to SEQ ID NO: 56567

SEQ ID NO: 182356 - RNA, 64 nt, hsa; identical to SEQ ID NO: 56568

SEQ ID NO: 182357 - RNA, 64 nt, hsa; identical to SEQ ID NO: 56569

SEQ ID NO: 182358 - RNA, 64 nt, hsa; identical to SEQ ID NO: 56570

SEQ ID NO: 182359 - RNA, 64 nt, hsa; identical to SEQ ID NO: 56571

SEQ ID NO: 182360 - RNA, 64 nt, hsa; identical to SEQ ID NO: 56572

SEQ ID NO: 182361 - RNA, 64 nt, hsa; identical to SEQ ID NO: 56573

SEQ ID NO: 182362 - RNA, 64 nt, hsa; identical to SEQ ID NO: 56574

SEQ ID NO: 182363 - RNA, 64 nt, hsa; identical to SEQ ID NO: 56575

SEQ ID NO: 182364 - RNA, 64 nt, hsa; identical to SEQ ID NO: 56576

SEQ ID NO: 182365 - RNA, 64 nt, hsa; identical to SEQ ID NO: 56577

SEQ ID NO: 182366 - RNA, 64 nt, hsa; identical to SEQ ID NO: 56578

SEQ ID NO: 182367 - RNA, 64 nt, hsa; identical to SEQ ID NO: 56579

SEQ ID NO: 182368 - RNA, 64 nt, hsa; identical to SEQ ID NO: 56580

SEQ ID NO: 182369 - RNA, 64 nt, hsa; identical to SEQ ID NO: 56581

SEQ ID NO: 182370 - RNA, 64 nt, hsa; identical to SEQ ID NO: 56582

SEQ ID NO: 182371 - RNA, 64 nt, hsa
ugggguuuucugugcccaugacuugggggcugcacccccacagcacccccacaauguaggaaaa

SEQ ID NO: 182372 - RNA, 64 nt, hsa
gugcccaugacuugggggcugcacccccacagcacccccacaauguaggaaaagaccucaggga

SEQ ID NO: 182373 - RNA, 64 nt, hsa
ugggccuccucaccaacggcagugccaaaaucagcccccacaucaaggugguguucucugugcu

SEQ ID NO: 182374 - RNA, 64 nt, hsa
uuucacuguucuucagagcuuucuggcucucuuucccccacaaaauucgacauauuuaaaaauc

SEQ ID NO: 182375 - RNA, 64 nt, hsa
ucuccccaccaccaccucuguggccuccaugguacccccacagggcuggccuccccuagagggu

SEQ ID NO: 182376 - RNA, 64 nt, hsa
ccugagaaaagacugagccaggaacuacaagcuccccccacauuccucccagccuggaccuaau

SEQ ID NO: 182377 - RNA, 64 nt, hsa
cagcagccccucagggcuucccaaggauguccagcccccacacccacacguuaacauaaugagu

SEQ ID NO: 182378 - RNA, 64 nt, hsa
aaggacucgccuugcaaccgacaggccauucccacccccacacacaaccuccccuguuuucaca

SEQ ID NO: 182379 - RNA, 64 nt, hsa
ucucuuuuuuccuuccagccuggauguucggggacccccacaucaccaccuuggauggugucag

SEQ ID NO: 182380 - RNA, 64 nt, hsa
gaggcggccccacgugggcugugcuacauacaggcccccacagcccggugagcgacagggccca

SEQ ID NO: 182381 - RNA, 64 nt, hsa
caggagcguguacuaccccaggaugcaugcagggcccccacaggagcguguacuaccccaggac

SEQ ID NO: 182382 - RNA, 64 nt, hsa
caggagcguguacuaccccaggacgcaugcagggcccccacaggagcguguacuaccccaggau

SEQ ID NO: 182383 - RNA, 64 nt, hsa
gcguguccuauccccggaccggacgcaugcagggcccccacaggagcguguacuaccccaggac

SEQ ID NO: 182384 - RNA, 64 nt, hsa
cuggagcguguacuaccccaggacgcaugcagggcccccacaggagcguguccuauccccggac

SEQ ID NO: 182385 - RNA, 64 nt, hsa
caggagcguguacuaccccagaacgcaugcagggcccccacaggagcguguacuaccccaggac

SEQ ID NO: 182386 - RNA, 64 nt, hsa
caggagcauguccuaucccuggacgcaugcagggcccccacaggagcguguacuaccccagaac

SEQ ID NO: 182387 - RNA, 64 nt, hsa
caggagcguguccuauccccggacgcaugcagggcccccacaggagcauguccuaucccuggac

SEQ ID NO: 182388 - RNA, 64 nt, hsa
gaggagcguguccuauccccggacgcaugcagggcccccacaggagcguguccuauccccggac

SEQ ID NO: 182389 - RNA, 64 nt, hsa
gaccugugucaaaacuuacauccacauuccuacacccccacaacccaucacuucugguguuaac

SEQ ID NO: 182390 - RNA, 64 nt, hsa
augagccaaaagcacauaccuaccccaucccccacccccacacacacacacacacacacaugca

SEQ ID NO: 182391 - RNA, 64 nt, hsa
gcggggacucaccuucauucucuuccuucacuuucccccacacccuacaacaggucggacccac

SEQ ID NO: 182392 - RNA, 64 nt, hsa
guaauccuguggccaacaccaaugccccaaccuucccccacagcuaucuucacucucugccuuc

SEQ ID NO: 182393 - RNA, 64 nt, hsa
acucugagccaucuucuuccuccaucucuuucaacccccacaggggcugccugcucuucacagc

SEQ ID NO: 182394 - RNA, 64 nt, hsa
cuccuccaggcccccggacgcucagcccccacagcccccacagccuggcgccagggcucacagc

SEQ ID NO: 182395 - RNA, 64 nt, hsa
acggcugcccuccuccaggcccccggacgcucagcccccacagcccccacagccuggcgccagg

SEQ ID NO: 182396 - RNA, 64 nt, hsa
cacagugcugucugaucugugcuuuccagcucaccccccacacucacuccugagaccccuggcc

SEQ ID NO: 182397 - RNA, 64 nt, hsa
cuuccccaugggaagacgaggcccucgggcccagcccccacagugcugucugaucugugcuuuc

SEQ ID NO: 182398 - RNA, 64 nt, hsa
gcagugccucugccagucacugucaucguugugucccccacaacuguccucuugcuagcucggc

SEQ ID NO: 182399 - RNA, 64 nt, hsa
cugccagugggggauguuucuggaggcagcuggucccccacaccgcguccugcugagccugccc

SEQ ID NO: 182400 - RNA, 64 nt, hsa
gggcguggguggggaaggggcucugggaccagaccccccacacuacugcgucuuuguuucuauc

SEQ ID NO: 182401 - RNA, 64 nt, hsa
cagauaaguggcucuuacccagcucucagugacucccccacaaaacagcaacagccuccaccgc

SEQ ID NO: 182402 - RNA, 64 nt, hsa
gagaccuccgguccgagacccugccuggguucaccccccacaacccagacccagaaccgcucuc

SEQ ID NO: 182403 - RNA, 64 nt, hsa
ggaauauuuuccagagucucuaaacucucaucuucccccacagauacacauccaagcucacaaa

SEQ ID NO: 182404 - RNA, 64 nt, hsa
agcuaccaagacugucccuagacaaagguggagucccccacacugcccaagaccaaaucccuca

SEQ ID NO: 182405 - RNA, 64 nt, hsa
ccccuucaggugcacuauaauggggcuggaggggcccccacaucucucagccccacuaaugcag

SEQ ID NO: 182406 - RNA, 64 nt, hsa
cacacccugcccugaggggcuguccaggccuucucccccacacccucaggccgagauccgugag

SEQ ID NO: 182407 - RNA, 64 nt, hsa
gagccccacagaggcagguccuggaaccaccccacccccacaccuggacgcucgcucugguggg

SEQ ID NO: 182408 - RNA, 64 nt, hsa
cagguuuggaggagccccgaguggcccaggaguccccccacacacagaugcauaggccugccuu

SEQ ID NO: 182409 - RNA, 64 nt, hsa
ccacgagccaccacugccucccgcugcugcccaccccccacaaaaaggaaaaaaugaaugaggu

SEQ ID NO: 182410 - RNA, 64 nt, hsa
gucccccacuccugccugcuucccggugagcugccccccacacgugcagcccgggcugccucca

SEQ ID NO: 182411 - RNA, 64 nt, hsa
uaccgaauccugacugcaaggcccaccugccccucccccacagagccuccagagcuagcugagg

SEQ ID NO: 182412 - RNA, 64 nt, hsa
gacauucccagaacuaccgccagguggcgccaggcccccacagucuguggccguggucuuagcc

SEQ ID NO: 182413 - RNA, 64 nt, hsa
acugggccccguuucuaggaaguaccagccccaucccccacaguccagcuccggggaaggggcu

SEQ ID NO: 182414 - RNA, 64 nt, hsa
cagcagaagccucuuucuccucucugcccccugccccccacaccacaccuguaggggaccuguc

SEQ ID NO: 182415 - RNA, 64 nt, hsa
gguggggaagggagggucucuugauuccuaaccgcccccacauacugcuccaccgcugaacuuc

SEQ ID NO: 182416 - RNA, 64 nt, hsa
cuggggcaggggcugugcacagacggaccccccacccccacacgcacuuuaugagggagacccc

SEQ ID NO: 182417 - RNA, 64 nt, hsa
aaggucaguuuucccccagagcccgggucccugucccccacagggcaggcggggucccuggagc

SEQ ID NO: 182418 - RNA, 64 nt, hsa
uuccuucuagggagcacccucccaccccccaccccccccacacacaccaucuuuccaucccagg

SEQ ID NO: 182419 - RNA, 64 nt, hsa
ccacagggauccccaggaugcccacuucccuccacccccacaccccagccgugucccuaacccc

SEQ ID NO: 182420 - RNA, 64 nt, hsa
uguacagucucgcccuuggaagacugagcugggacccccacagccauccgcuggcuuggccagc

SEQ ID NO: 182421 - RNA, 64 nt, hsa
caacagggccccgggagggaacccugcccccaaccccccacagcaaggcuguacagucucgccc

SEQ ID NO: 182422 - RNA, 64 nt, hsa
caggccuauucgcugcacuuccugccaaacuuugcccccacaagccuggucaucagccaggcag

SEQ ID NO: 182423 - RNA, 64 nt, hsa
cagggaaacagggccagcacagaggggccuuccucccccacagagcccccaugacauagucugc

SEQ ID NO: 182424 - RNA, 64 nt, hsa
aguguccucugauccuguccggugccucccccaacccccacacccaugcagaacucccagguca

SEQ ID NO: 182425 - RNA, 64 nt, hsa
agagaaggggaggaggacuccagcugggcucggucccccacagucagggacccccauaaaggac

SEQ ID NO: 182426 - RNA, 64 nt, hsa
cuugcucacagcugauugggcaccugaccacacgcccccacaggcucugaccagcagccuauga

SEQ ID NO: 182427 - RNA, 64 nt, hsa
cuuuaaugcuggggcccaaguaagggcacagauccccccacaaaguggaugccugcugcaucuu

SEQ ID NO: 182428 - RNA, 64 nt, hsa
caggguaucggggugcgaggucugucugcaccggcccccacaucuaaccaggcccugauguagg

SEQ ID NO: 182429 - RNA, 64 nt, hsa
caucugggagugggugaacagcaccccgccgcuucccccacacgcuugcucggcgcucugacuu

SEQ ID NO: 182430 - RNA, 64 nt, hsa; identical to SEQ ID NO: 86201

SEQ ID NO: 182431 - RNA, 64 nt, hsa; identical to SEQ ID NO: 86202

SEQ ID NO: 182432 - RNA, 64 nt, hsa; identical to SEQ ID NO: 86203

SEQ ID NO: 182433 - RNA, 64 nt, hsa; identical to SEQ ID NO: 86204

SEQ ID NO: 182434 - RNA, 64 nt, hsa; identical to SEQ ID NO: 86205

SEQ ID NO: 182435 - RNA, 64 nt, hsa; identical to SEQ ID NO: 86206

SEQ ID NO: 182436 - RNA, 64 nt, hsa; identical to SEQ ID NO: 86207

SEQ ID NO: 182437 - RNA, 64 nt, hsa; identical to SEQ ID NO: 86208

SEQ ID NO: 182438 - RNA, 64 nt, hsa; identical to SEQ ID NO: 86209

SEQ ID NO: 182439 - RNA, 64 nt, hsa; identical to SEQ ID NO: 86210

SEQ ID NO: 182440 - RNA, 64 nt, hsa; identical to SEQ ID NO: 86211

SEQ ID NO: 182441 - RNA, 64 nt, hsa; identical to SEQ ID NO: 86212

SEQ ID NO: 182442 - RNA, 64 nt, hsa; identical to SEQ ID NO: 86213

SEQ ID NO: 182443 - RNA, 64 nt, hsa; identical to SEQ ID NO: 86214

SEQ ID NO: 182444 - RNA, 64 nt, hsa; identical to SEQ ID NO: 86215

SEQ ID NO: 182445 - RNA, 64 nt, hsa; identical to SEQ ID NO: 86216

SEQ ID NO: 182446 - RNA, 64 nt, hsa; identical to SEQ ID NO: 86217

SEQ ID NO: 182447 - RNA, 64 nt, hsa; identical to SEQ ID NO: 86218

SEQ ID NO: 182448 - RNA, 64 nt, hsa; identical to SEQ ID NO: 86219

SEQ ID NO: 182449 - RNA, 64 nt, hsa; identical to SEQ ID NO: 86220

SEQ ID NO: 182450 - RNA, 64 nt, hsa; identical to SEQ ID NO: 86221

SEQ ID NO: 182451 - RNA, 64 nt, hsa; identical to SEQ ID NO: 86222

SEQ ID NO: 182452 - RNA, 64 nt, hsa; identical to SEQ ID NO: 86223

SEQ ID NO: 182453 - RNA, 64 nt, hsa; identical to SEQ ID NO: 86224

SEQ ID NO: 182454 - RNA, 64 nt, hsa; identical to SEQ ID NO: 86225

SEQ ID NO: 182455 - RNA, 64 nt, hsa; identical to SEQ ID NO: 86226

SEQ ID NO: 182456 - RNA, 64 nt, hsa; identical to SEQ ID NO: 86227

SEQ ID NO: 182457 - RNA, 64 nt, hsa; identical to SEQ ID NO: 86228

SEQ ID NO: 182458 - RNA, 64 nt, hsa; identical to SEQ ID NO: 86229

SEQ ID NO: 182459 - RNA, 64 nt, hsa; identical to SEQ ID NO: 86230

SEQ ID NO: 182460 - RNA, 64 nt, hsa; identical to SEQ ID NO: 86231

SEQ ID NO: 182461 - RNA, 64 nt, hsa; identical to SEQ ID NO: 86232

SEQ ID NO: 182462 - RNA, 64 nt, hsa; identical to SEQ ID NO: 86233

SEQ ID NO: 182463 - RNA, 64 nt, hsa; identical to SEQ ID NO: 86234

SEQ ID NO: 182464 - RNA, 64 nt, hsa; identical to SEQ ID NO: 86235

SEQ ID NO: 182465 - RNA, 64 nt, hsa; identical to SEQ ID NO: 86236

SEQ ID NO: 182466 - RNA, 64 nt, hsa; identical to SEQ ID NO: 86237

SEQ ID NO: 182467 - RNA, 64 nt, hsa; identical to SEQ ID NO: 86238

SEQ ID NO: 182468 - RNA, 64 nt, hsa; identical to SEQ ID NO: 86239

SEQ ID NO: 182469 - RNA, 64 nt, hsa; identical to SEQ ID NO: 86240

SEQ ID NO: 182470 - RNA, 64 nt, hsa; identical to SEQ ID NO: 86241

SEQ ID NO: 182471 - RNA, 64 nt, hsa; identical to SEQ ID NO: 86242

SEQ ID NO: 182472 - RNA, 64 nt, hsa; identical to SEQ ID NO: 86243

SEQ ID NO: 182473 - RNA, 64 nt, hsa; identical to SEQ ID NO: 86244

SEQ ID NO: 182474 - RNA, 64 nt, hsa; identical to SEQ ID NO: 86245

SEQ ID NO: 182475 - RNA, 64 nt, hsa; identical to SEQ ID NO: 86246

SEQ ID NO: 182476 - RNA, 64 nt, hsa; identical to SEQ ID NO: 86247

SEQ ID NO: 182477 - RNA, 64 nt, hsa; identical to SEQ ID NO: 86248

SEQ ID NO: 182478 - RNA, 64 nt, hsa; identical to SEQ ID NO: 86249

SEQ ID NO: 182479 - RNA, 64 nt, hsa; identical to SEQ ID NO: 86250

SEQ ID NO: 182480 - RNA, 64 nt, hsa; identical to SEQ ID NO: 86251

SEQ ID NO: 182481 - RNA, 64 nt, hsa; identical to SEQ ID NO: 86252

SEQ ID NO: 182482 - RNA, 64 nt, hsa; identical to SEQ ID NO: 86253

SEQ ID NO: 182483 - RNA, 64 nt, hsa; identical to SEQ ID NO: 86254

SEQ ID NO: 182484 - RNA, 64 nt, hsa; identical to SEQ ID NO: 86255

SEQ ID NO: 182485 - RNA, 64 nt, hsa; identical to SEQ ID NO: 86256

SEQ ID NO: 182486 - RNA, 55 nt, hsa; identical to SEQ ID NO: 86257

SEQ ID NO: 182487 - RNA, 64 nt, hsa; identical to SEQ ID NO: 86258

SEQ ID NO: 182488 - RNA, 64 nt, hsa; identical to SEQ ID NO: 86259

SEQ ID NO: 182489 - RNA, 64 nt, hsa; identical to SEQ ID NO: 86260

SEQ ID NO: 182490 - RNA, 64 nt, hsa; identical to SEQ ID NO: 86261

SEQ ID NO: 182491 - RNA, 64 nt, hsa; identical to SEQ ID NO: 86262

SEQ ID NO: 182492 - RNA, 64 nt, hsa; identical to SEQ ID NO: 86263

SEQ ID NO: 182493 - RNA, 64 nt, hsa; identical to SEQ ID NO: 86264

SEQ ID NO: 182494 - RNA, 64 nt, hsa; identical to SEQ ID NO: 86265

SEQ ID NO: 182495 - RNA, 64 nt, hsa; identical to SEQ ID NO: 86266

SEQ ID NO: 182496 - RNA, 64 nt, hsa; identical to SEQ ID NO: 86267

SEQ ID NO: 182497 - RNA, 64 nt, hsa; identical to SEQ ID NO: 86268

SEQ ID NO: 182498 - RNA, 64 nt, hsa; identical to SEQ ID NO: 86269

SEQ ID NO: 182499 - RNA, 64 nt, hsa; identical to SEQ ID NO: 86270

SEQ ID NO: 182500 - RNA, 64 nt, hsa; identical to SEQ ID NO: 86271

SEQ ID NO: 182501 - RNA, 64 nt, hsa; identical to SEQ ID NO: 86272

SEQ ID NO: 182502 - RNA, 64 nt, hsa; identical to SEQ ID NO: 86273

SEQ ID NO: 182503 - RNA, 64 nt, hsa; identical to SEQ ID NO: 86274

SEQ ID NO: 182504 - RNA, 64 nt, hsa; identical to SEQ ID NO: 86275

SEQ ID NO: 182505 - RNA, 64 nt, hsa; identical to SEQ ID NO: 86276

SEQ ID NO: 182506 - RNA, 64 nt, hsa; identical to SEQ ID NO: 86277

SEQ ID NO: 182507 - RNA, 64 nt, hsa; identical to SEQ ID NO: 86278

SEQ ID NO: 182508 - RNA, 64 nt, hsa
uggaugggggccgagugagguaaccagguggcaucuaccccauguuuuauaaggaauuuuguac

SEQ ID NO: 182509 - RNA, 64 nt, hsa
ccuucgauuuccucaaagacaacaacuaccugcccuaccccauccaccaagugcgccacauggc

SEQ ID NO: 182510 - RNA, 64 nt, hsa
uccuaccccaucuauucucuguuggcuccaagagcuaccccagagaccuuaaacagaaacagua

SEQ ID NO: 182511 - RNA, 64 nt, hsa
aaaauccaaagggauagggccaggaucccuauuccuaccccaucuauucucuguuggcuccaag

SEQ ID NO: 182512 - RNA, 64 nt, hsa
auuugugcuggguaaaagaggagagcugugcuuucuaccccaaaguuguugguaauggagccgg

SEQ ID NO: 182513 - RNA, 64 nt, hsa
agaaaacauguuuaagauaaaauacaaacuuuaccuaccccaaauucauaaaguacauuuagug

SEQ ID NO: 182514 - RNA, 64 nt, hsa
aggggcccuccccagugccguggcugcucuggggcuaccccaggugaacagagguggugagaug

SEQ ID NO: 182515 - RNA, 64 nt, hsa
gaucucugggcugauuucugguuggggucugcuccuaccccaccccauuuaacaaugugaagug

SEQ ID NO: 182516 - RNA, 64 nt, hsa
caggaugcaugcagggcccccacaggagcguguacuaccccaggacgcaugcagggcccccaug

SEQ ID NO: 182517 - RNA, 64 nt, hsa
caggacgcaugcagggcccccacaggagcguguacuaccccaggaugcaugcagggcccccaca

SEQ ID NO: 182518 - RNA, 64 nt, hsa
ccggacgcaugcagggcccccacaggagcguguacuaccccaggacgcaugcagggcccccaca

SEQ ID NO: 182519 - RNA, 64 nt, hsa
caggacgcaugcagggcccccacuggagcguguacuaccccaggacgcaugcagggcccccaca

SEQ ID NO: 182520 - RNA, 64 nt, hsa
cagaacgcaugcagggcccccacaggagcguguacuaccccaggacgcaugcagggcccccacu

SEQ ID NO: 182521 - RNA, 64 nt, hsa
cuggacgcaugcagggcccccacaggagcguguacuaccccagaacgcaugcagggcccccaca

SEQ ID NO: 182522 - RNA, 64 nt, hsa
guguauacacacacacacacacacacacacaccccuaccccacacugacugucuaccgacaaag

SEQ ID NO: 182523 - RNA, 64 nt, hsa
cucuaaugagagggcauggccugagucagaagagcuaccccaggugaaacuggaagugcaugag

SEQ ID NO: 182524 - RNA, 64 nt, hsa
cugcguggaggaagcccacccagcaagcucucuccuaccccagguaaaaggugcuccuuugccu

SEQ ID NO: 182525 - RNA, 64 nt, hsa
accugcuugcccucauccuccugguucaggaccucuaccccagcgagagcacagcagaggacga

SEQ ID NO: 182526 - RNA, 64 nt, hsa
aacuggaugcacugucguccccggacuauagacacuaccccaucaggugggaauaccacucccu

SEQ ID NO: 182527 - RNA, 64 nt, hsa
agugggacgagcuagcccgaacugacuucagcagcuaccccaaaccaaucaaggguuuguuuac

SEQ ID NO: 182528 - RNA, 64 nt, hsa
ugccccucccugcucugggagcauugcuagccuucuaccccaucccuggauccacaggggcuau

SEQ ID NO: 182529 - RNA, 64 nt, hsa
gccacggugacuguccuggacagcaaggagcaugcuaccccagugagcacuucuuuuugaggga

SEQ ID NO: 182530 - RNA, 64 nt, hsa
cucugaaaagacugggggauaugaaaucuucccccuaccccacuuaaugcguuggauaugauuu

SEQ ID NO: 182531 - RNA, 64 nt, hsa
cucagaggaggaaucguggaaaacaagagcaaaacuaccccacaccccuauuucaugucugaaa

SEQ ID NO: 182532 - RNA, 64 nt, hsa
ccgggggccuguggcuaaguaaaccauaccuaaccuaccccagugugggugugggccucugaau

SEQ ID NO: 182533 - RNA, 64 nt, hsa
ucccucaucucuaacugcccccacggggccagggcuaccccagaacuuuuaacucuuccaggac

SEQ ID NO: 182534 - RNA, 64 nt, hsa
aggaauggccuuucuacaaagcaaggcccacagacuaccccacucaagaacagcagguaugugg

SEQ ID NO: 182535 - RNA, 64 nt, hsa
augcucccauaccccuguaggaaguuacuagagucuaccccaucgccagucgucuucugccaca

SEQ ID NO: 182536 - RNA, 64 nt, hsa
ucaguggaaaauccagcacaccaagcaccagucuucuucugaggcaaaagaaaaguguugucau

SEQ ID NO: 182537 - RNA, 64 nt, hsa
caucauuuuuauuggaagaguauuaacuggugccucuucugaaacacaccaacccauauuccuc

SEQ ID NO: 182538 - RNA, 64 nt, hsa
cagugucuucucagaaaccaccaaccuugaagugucuucugagaaaccaccaggcuugaaggua

SEQ ID NO: 182539 - RNA, 64 nt, hsa
agaaaacaaggauggagaaaaaucuaggacagugucuucugagaaaccaccaggcuugaaggua

SEQ ID NO: 182540 - RNA, 64 nt, hsa
aggaaguuccaaacuuucccacauuuuccuguuuucuucugagcccuccaaacuguuccagccu

SEQ ID NO: 182541 - RNA, 64 nt, hsa
aacguuugccugggcauugaggcauuuccauacaucuucugaaaacuaggcggagguuuccaaa

SEQ ID NO: 182542 - RNA, 64 nt, hsa
ccuugggcaacuccuuucccuaugagaagcuggcucuucugaguccagggccaacgccaacugg

SEQ ID NO: 182543 - RNA, 64 nt, hsa
guuugauguacucugggagaguaauucuaucuccucuucugauaguuggggaaacugaggccuu

SEQ ID NO: 182544 - RNA, 64 nt, hsa
cccaaaguuuaaaaauaugcucauucaacuugaaucuucugaggacuuuuugugaaaauggugg

SEQ ID NO: 182545 - RNA, 64 nt, hsa
cuguuuuagagcauagaagaagcggcaccugccaucuucugaaaacuccaaagggaaauuucag

SEQ ID NO: 182546 - RNA, 64 nt, hsa
agauugaaaugaagagaaauagccagcaggugauucuucugaauccuuuagugugaugguuucc

SEQ ID NO: 182547 - RNA, 64 nt, hsa
agucaugaaccacaaaucacugugauuaaaauuuucuucugaucguaauccacgaaugcauuca

SEQ ID NO: 182548 - RNA, 64 nt, hsa
accagauccauauaaggugaaugugaaaugggagucuucugagggugauuuguacuuuccaugu

SEQ ID NO: 182549 - RNA, 64 nt, hsa
uuaugagaaaacuccgaagaggugugagcaggauucuucugaaugacugucuggaugguucauu

SEQ ID NO: 182550 - RNA, 64 nt, hsa
ugaacugugccgacuccacaaaacgauuauguacucuucugagauagaagaugcuguucuucug

SEQ ID NO: 182551 - RNA, 64 nt, hsa
cgauuauguacucuucugagauagaagaugcuguucuucugagagauacguuacucucuccuug

SEQ ID NO: 182552 - RNA, 64 nt, hsa
ugccaugccggaaugugggccuaguguugccagaucuucugauuuuucgaaagaaacuagaaug

SEQ ID NO: 182553 - RNA, 64 nt, hsa
gaaagaaacuagaaugcuggauucuuaagugauaucuucugauuuuuuaaaugauagcaccuaa

SEQ ID NO: 182554 - RNA, 64 nt, hsa
ugaccgcugagccaggcuggguuuggguuucuucucuucugauucugcugcucacugucauagc

SEQ ID NO: 182555 - RNA, 64 nt, hsa
cgaagccccagugcucugccuggaaaccugguucucuucugacaucuaagaagacugcagcaag

SEQ ID NO: 182556 - RNA, 64 nt, hsa
gugcuaaugugaauuuuaaaugaccugcaucaagucuucugaucucagauaacucaguacagau

SEQ ID NO: 182557 - RNA, 64 nt, hsa
agggcauaaaagcaaaucaacacuuuauaguuauucuucugaacuaagacaugucaauauucuu

SEQ ID NO: 182558 - RNA, 64 nt, hsa
aaccgacaaaguuacgaggccauccugcuauuuaucuucugaguucccagcaaugacucaggca

SEQ ID NO: 182559 - RNA, 64 nt, hsa
cuuucuccuuuccuucuccaaaggcuuggaguuuucuucugagguuuuucugccagugucuugu

SEQ ID NO: 182560 - RNA, 64 nt, hsa
aguggcccaugucacaaacccuaucucaggaauuucuucugaauguucaauuuuuuucauugaa

SEQ ID NO: 182561 - RNA, 64 nt, hsa
agaucacuuucucaguuuucauaaguauuaugucucuucugagcuauuucaucuauuuuuggca

SEQ ID NO: 182562 - RNA, 64 nt, hsa
aagauugaaguauuuugcuggaauaaguucaaauucuucugaacucaaacugaggaauuucacc

SEQ ID NO: 182563 - RNA, 64 nt, hsa
uugaguuuuauguauuucuuuauuuuaaucaggaucuucugauaguggaaauuuuuaguacaua

SEQ ID NO: 182564 - RNA, 64 nt, hsa
ggagacacguguggcgggcagugggacccauagaucuucugaaaugaaacaaauaaucacauug

SEQ ID NO: 182565 - RNA, 64 nt, hsa
ugaucauccaagaaauacuuuuuauugcugggagucuucugaaccucaccaaacugaggccaga

SEQ ID NO: 182566 - RNA, 64 nt, hsa
gugcucccccucccuaagcuccagggucccugaaucuucugaaaucucaaaugaguggaggccu

SEQ ID NO: 182567 - RNA, 64 nt, hsa
aggaaguuccaaacuuucccacauuuuccugucuucuucugagcccuucaaacuguuccaaccu

SEQ ID NO: 182568 - RNA, 64 nt, hsa
uagguuuucccuguaguucuuccuuuauagcuuuucuucugauaaccaugacuucaggagcuuu

SEQ ID NO: 182569 - RNA, 64 nt, hsa
cuuagugaauuuugucuccugcuuggaaagucucucuucugaaccuggagccugaauacauuuu

SEQ ID NO: 182570 - RNA, 64 nt, hsa
uuggcagcaacucuccugggccacguaucaacaaucuucugacagcaggagcagugauaguugg

SEQ ID NO: 182571 - RNA, 64 nt, hsa
uaaggauuuuagaugauaaggcuacaauucagaaucuucugaaccaucuauguaaugaaugggg

SEQ ID NO: 182572 - RNA, 64 nt, hsa
cccugcuuacauugaaaagucuuuuucccuuagcucuucugacuggauuuuucuacaaaaacua

SEQ ID NO: 182573 - RNA, 64 nt, hsa
gggaggugaaacgguacgauggucucaacaccuuucuucugaacuguaauacauaucacaaaaa

SEQ ID NO: 182574 - RNA, 64 nt, hsa
accacacaggaaaagcagcgaaaccugcacccucucuucugagucacgccuguggcucaucggc

SEQ ID NO: 182575 - RNA, 64 nt, hsa
uccaucucucuccaucgggccucgggacccuuucucuucugaaucugcuucccugcaguuuaga

SEQ ID NO: 182576 - RNA, 64 nt, hsa
ugggguaagacuucgagagagccugauccuggggucuucugagacuccaccaggagccggagag

SEQ ID NO: 182577 - RNA, 64 nt, hsa
uguuguauaucuuaagcauuuggaauuuuuuuuaucuucugaaaucauauaaaaagaaugucau

SEQ ID NO: 182578 - RNA, 64 nt, hsa
ugcauggugucucggugcauggggaaaggcaaggucuucugagcucaucuuaacuggugaggca

SEQ ID NO: 182579 - RNA, 64 nt, hsa
caaauaggacucaaaguuggauauuugggauuuuucuucugacaguauaauuuauugaguuacu

SEQ ID NO: 182580 - RNA, 64 nt, hsa
augaaaaucuacuuguuuaggcuuuuauuuauacucuucugauuuauauuuuuuauuauaauua

SEQ ID NO: 182581 - RNA, 64 nt, hsa
uguacuauuaaacucuuuucugaguucucucuucucuucugagccacccuucauugaucagaaa

SEQ ID NO: 182582 - RNA, 64 nt, hsa
cacuuaggguaggaacuucgguaucaucuuggacucuucugaguccauuaucuuucacauacag

SEQ ID NO: 182583 - RNA, 64 nt, hsa; identical to SEQ ID NO: 182579

SEQ ID NO: 182584 - RNA, 64 nt, hsa
augaaaaucuacuuguuuagacuuuuauuuauacucuucugauuuauauuuuuuauuauaauua

SEQ ID NO: 182585 - RNA, 64 nt, hsa
agaccaacagauuuucccaacccaagacuauuguaacacauaaagacagcaagaauucuuauuu

SEQ ID NO: 182586 - RNA, 64 nt, hsa
acauaaaccuaaaagcauuugaacaugacacccgaacacauacauauauguucacuuauuugug

SEQ ID NO: 182587 - RNA, 64 nt, hsa
caguguucaguauuauugaaauaugggcaucugcaacacauacccccuauuauuucuaccucuu

SEQ ID NO: 182588 - RNA, 64 nt, hsa
uucagaucugaaguagacgauaggaauguggaagaacacauacauagugcuuaagaaauacauu

SEQ ID NO: 182589 - RNA, 64 nt, hsa
cagauuucuggugguuucugcccugcagaugucuaacacauaagccaggacauucugcugugag

SEQ ID NO: 182590 - RNA, 64 nt, hsa
ugcaaugaaaaaaauggauacauuaggagcuucaaacacauauaauuucucaagaaauuuccag

SEQ ID NO: 182591 - RNA, 64 nt, hsa
aaagccacugcuuuuaacaucccauuguacauuuaacacauaaaugguguuaacaucccauugu

SEQ ID NO: 182592 - RNA, 64 nt, hsa
cacauaaaugguguuaacaucccauuguacauuuaacacauaaauggccauugucuuugucuca

SEQ ID NO: 182593 - RNA, 64 nt, hsa
aucuguuguuuguuuccuauaagaugcuuugcugaacacauagcaaaauucaugugacggauga

SEQ ID NO: 182594 - RNA, 64 nt, hsa
ucacacaagccaaccaugucaugccagaguacaaaacacauaguucuuuccccgccccgaaugu

SEQ ID NO: 182595 - RNA, 64 nt, hsa
cagccaguagauugucugucagugaccuucuguaguaauaaaguuuuugccacuguaaauaaaa

SEQ ID NO: 182596 - RNA, 64 nt, hsa
uguuaacuuuuuauauuaaugacuauugaaagugguaauaaaaauuuauauuauaggcuucaau

SEQ ID NO: 182597 - RNA, 64 nt, hsa
uaacaguugugagcuuuaguuuaauguaauauuuguaauaaaaacguuuggccaggcaccaugg

SEQ ID NO: 182598 - RNA, 64 nt, hsa
caacuucauuccuugccugcuuugauaaauuuuaguaauaaauucccaaaacuaucauguugau

SEQ ID NO: 182599 - RNA, 64 nt, hsa
uguuauuacugaggaaagggaggagaggacaaguguaauaaaucaaaauugaccucaaaagaaa

SEQ ID NO: 182600 - RNA, 64 nt, hsa
cuaagauuuccuuuggcaauaucauauucuaaaaguaauaaauuccaauacaaguuacauacau

SEQ ID NO: 182601 - RNA, 64 nt, hsa
aggaaaacaauagaacucauaaaacuuagaaaugguaauaaaucuuggcuccugucucuagccc

SEQ ID NO: 182602 - RNA, 64 nt, hsa
cuuuuuucuagaauccucauuacagcuaacgcugguaauaaagguaggaaaacaauagaacuca

SEQ ID NO: 182603 - RNA, 64 nt, hsa
gguguuauuccaagggaauauugccaaugcuacaguaauaaaugaaugucacuucuggauauag

SEQ ID NO: 182604 - RNA, 64 nt, hsa
gcaaaguagaucaugcauagagugugauguauguguaauaaauauguuucacacaaacaaggcc

SEQ ID NO: 182605 - RNA, 64 nt, hsa
aauuaggcuugucagguuaguaauaaacugaacaguaauaaaacuguggaaguaauuggaucug

SEQ ID NO: 182606 - RNA, 64 nt, hsa
agugaaauguuacccaauuaggcuugucagguuaguaauaaacugaacaguaauaaaacugugg

SEQ ID NO: 182607 - RNA, 64 nt, hsa
cuaaccuucuaacaacuaucuuucaaaaguaaauguaauaaaaaugcacaacauaaaauguuua

SEQ ID NO: 182608 - RNA, 64 nt, hsa
gacauucauuugugugcccuggaauuuccaacuaguaauaaacaacuacuguugauguaguuuu

SEQ ID NO: 182609 - RNA, 64 nt, hsa
guugaguuuguccauugcuagggagagacuuccaguaauaaaauuuacuauucuagaugcuucu

SEQ ID NO: 182610 - RNA, 64 nt, hsa
auaaucuugguuauaagggaguuaaaacaaugcuguaauaaauaaagugcuucaugugaucaaa

SEQ ID NO: 182611 - RNA, 64 nt, hsa
gcucagauuuuacucaacauuagagaguuaguacguaauaaaagcauuauaaaugcaauuuuug

SEQ ID NO: 182612 - RNA, 64 nt, hsa
uaguaguauaucauuuuacuauuuguacuuuuauguaauaaaaugcaauguguuuaaaaauuuu

SEQ ID NO: 182613 - RNA, 64 nt, hsa
cagggaauuuguauuggagaaaaacccugcaaauguaauaaauauggaaaaacauuuuuucaaa

SEQ ID NO: 182614 - RNA, 64 nt, hsa
aaauuaauuaucauuuuguugauugugcuuuuauguaauaaaaugcaguacuuuaaaacauuua

SEQ ID NO: 182615 - RNA, 64 nt, hsa
caauuuuuauuuucuaugauuucuagaaacaaauguaauaaauauuuuuaaaaucuccuuucua

SEQ ID NO: 182616 - RNA, 64 nt, hsa
uuaguucagacucauauauggauuucaaaucuuuguaauaaaaauuauuuguauuuuuaaguuu

SEQ ID NO: 182617 - RNA, 64 nt, hsa
cugauugcauuuccucucauuaacaauuggguguguaauaaaaagcauuguacuucaucuuaaa

SEQ ID NO: 182618 - RNA, 64 nt, hsa
gagacagggacucuuuuuggaucucuauugacaaguaauaaaagucuggcccucauaacuuguu

SEQ ID NO: 182619 - RNA, 64 nt, hsa
aaggauggcauaaaauaaucauuuuugaaccuguguaauaaagcuugaaagcagggaaaagaau

SEQ ID NO: 182620 - RNA, 64 nt, hsa
gcauuauugggugccuuuguuuguaaaccaaaaaguaauaaaugaaucccuauauuuccauuau

SEQ ID NO: 182621 - RNA, 64 nt, hsa
uucccugggaaaaccuucagcugcuuuauuuuuaguaauaaauuucucuugucaauucuguuua

SEQ ID NO: 182622 - RNA, 64 nt, hsa
uugaggacaacacaaaugggauugguacuuuauaguaauaaaucugaccagcagagggagggau

SEQ ID NO: 182623 - RNA, 64 nt, hsa
aaucuguauaaaugugaaauuuuuauuuguauuaguaauaaaacauuaguaguuuaaacaauuu

SEQ ID NO: 182624 - RNA, 64 nt, hsa
uguuuuauuguaaucauaaauacugcuguauaagguaauaaaacucugcaccuaauccccauaa

SEQ ID NO: 182625 - RNA, 64 nt, hsa
cugcauuuaagcaguaccaagacugaaaaaaaagguaauaaaugaaauguuuugaaauauacuu

SEQ ID NO: 182626 - RNA, 64 nt, hsa
cuggauucuaaguaguugccaucuugaauccuuuguaauaaagccauacuuuugugugugugug

SEQ ID NO: 182627 - RNA, 64 nt, hsa
augcguaaaguaauauuuacagauguggggagauguaauaaaacaauauuaacuugguuucuug

SEQ ID NO: 182628 - RNA, 64 nt, hsa
gcaucugcucuuuuuuuuuuuuacggauauuuuaguaauaaauaugcuggauaaauauuagucc

SEQ ID NO: 182629 - RNA, 64 nt, hsa
agugagucccgguuuguuucauuuuaaugggaggguaauaaagaugaaagaccaacauuuuaac

SEQ ID NO: 182630 - RNA, 64 nt, hsa
ugcacaggaaaugacugguaauggaaaaaauguuguaauaaaauaaucuaaucaaagaauauua

SEQ ID NO: 182631 - RNA, 64 nt, hsa
caccaguacuaaaaaaacuguugucaaagaggauguaauaaauuguaguaauaaauaugaccac

SEQ ID NO: 182632 - RNA, 64 nt, hsa
aaaacuguugucaaagaggauguaauaaauuguaguaauaaauaugaccacaagccauaaauga

SEQ ID NO: 182633 - RNA, 64 nt, hsa
aggaaaugacagaugugacuuuggaaccaaacuuguaauaaaaggaauuccaaauggacaagca

SEQ ID NO: 182634 - RNA, 64 nt, hsa
guuugucauguauugacuuuaauauuguauuuugguaauaaauuuuuuguuaaaaaaaacuugg

SEQ ID NO: 182635 - RNA, 64 nt, hsa
aauuaguacguuauuuuacuauuuguacuuuuauguaauaaaaugcaguacauuuuuaaauuuu

SEQ ID NO: 182636 - RNA, 64 nt, hsa
cagggaauucagauuggagaaaaacccugcaaauguaauaaauuugaaaaaaaaguuuuccaaa

SEQ ID NO: 182637 - RNA, 64 nt, hsa
ucucaaggaauuugcauucuagaaaguagaagauguaauaaauguacugugggacauguuaaua

SEQ ID NO: 182638 - RNA, 64 nt, hsa
auggaagaauucaaauauaaauaaaaaauugugaguaauaaaaugaacucacaguuucaacaau

SEQ ID NO: 182639 - RNA, 64 nt, hsa
gguggcaucuucaccugaauucuucaaugccaggguaauaaaccaaaauaguccuaaucaguau

SEQ ID NO: 182640 - RNA, 64 nt, hsa
uuaaaaaggucaucuuagauuuaucuuaguaaauguaauaaauuauuuuuuagaucuugaaauu

SEQ ID NO: 182641 - RNA, 64 nt, hsa
gaugauggauuuuauuucacucacacuccaguuuguaauaaaaugccaaauucugucagcuauc

SEQ ID NO: 182642 - RNA, 64 nt, hsa
cuuucuaagaugcugcgaucccguucugcugcccguaauaaaaaugcucucagacacugguuag

SEQ ID NO: 182643 - RNA, 64 nt, hsa
uuaagguguuuucaaugugauuuuaguauuuacaguaauaaauaaaauuuauacaaaguuucag

SEQ ID NO: 182644 - RNA, 64 nt, hsa
auuucaaaggaaauaaaucaguguccguuugccaguaauaaauuuaauauucuguuuuauacua

SEQ ID NO: 182645 - RNA, 64 nt, hsa; identical to SEQ ID NO: 45886

SEQ ID NO: 182646 - RNA, 64 nt, hsa; identical to SEQ ID NO: 45887

SEQ ID NO: 182647 - RNA, 64 nt, hsa; identical to SEQ ID NO: 45888

SEQ ID NO: 182648 - RNA, 64 nt, hsa; identical to SEQ ID NO: 45889

SEQ ID NO: 182649 - RNA, 64 nt, hsa; identical to SEQ ID NO: 45890

SEQ ID NO: 182650 - RNA, 64 nt, hsa; identical to SEQ ID NO: 45891

SEQ ID NO: 182651 - RNA, 64 nt, hsa; identical to SEQ ID NO: 45892

SEQ ID NO: 182652 - RNA, 64 nt, hsa; identical to SEQ ID NO: 45893

SEQ ID NO: 182653 - RNA, 64 nt, hsa; identical to SEQ ID NO: 45894

SEQ ID NO: 182654 - RNA, 64 nt, hsa; identical to SEQ ID NO: 45895

SEQ ID NO: 182655 - RNA, 64 nt, hsa; identical to SEQ ID NO: 45896

SEQ ID NO: 182656 - RNA, 64 nt, hsa; identical to SEQ ID NO: 45897

SEQ ID NO: 182657 - RNA, 64 nt, hsa; identical to SEQ ID NO: 45898

SEQ ID NO: 182658 - RNA, 64 nt, hsa; identical to SEQ ID NO: 45899

SEQ ID NO: 182659 - RNA, 64 nt, hsa; identical to SEQ ID NO: 45900

SEQ ID NO: 182660 - RNA, 64 nt, hsa; identical to SEQ ID NO: 45901

SEQ ID NO: 182661 - RNA, 64 nt, hsa; identical to SEQ ID NO: 45902

SEQ ID NO: 182662 - RNA, 64 nt, hsa; identical to SEQ ID NO: 45903

SEQ ID NO: 182663 - RNA, 64 nt, hsa; identical to SEQ ID NO: 45904

SEQ ID NO: 182664 - RNA, 64 nt, hsa; identical to SEQ ID NO: 45905

SEQ ID NO: 182665 - RNA, 64 nt, hsa; identical to SEQ ID NO: 45906

SEQ ID NO: 182666 - RNA, 64 nt, hsa; identical to SEQ ID NO: 45907

SEQ ID NO: 182667 - RNA, 64 nt, hsa; identical to SEQ ID NO: 45908

SEQ ID NO: 182668 - RNA, 64 nt, hsa; identical to SEQ ID NO: 45909

SEQ ID NO: 182669 - RNA, 64 nt, hsa; identical to SEQ ID NO: 45910

SEQ ID NO: 182670 - RNA, 64 nt, hsa; identical to SEQ ID NO: 45911

SEQ ID NO: 182671 - RNA, 64 nt, hsa; identical to SEQ ID NO: 45912

SEQ ID NO: 182672 - RNA, 64 nt, hsa; identical to SEQ ID NO: 45913

SEQ ID NO: 182673 - RNA, 64 nt, hsa; identical to SEQ ID NO: 45914

SEQ ID NO: 182674 - RNA, 64 nt, hsa; identical to SEQ ID NO: 45915

SEQ ID NO: 182675 - RNA, 64 nt, hsa; identical to SEQ ID NO: 45916

SEQ ID NO: 182676 - RNA, 64 nt, hsa; identical to SEQ ID NO: 45917

SEQ ID NO: 182677 - RNA, 64 nt, hsa; identical to SEQ ID NO: 45918

SEQ ID NO: 182678 - RNA, 64 nt, hsa; identical to SEQ ID NO: 45919

SEQ ID NO: 182679 - RNA, 64 nt, hsa; identical to SEQ ID NO: 45920

SEQ ID NO: 182680 - RNA, 64 nt, hsa; identical to SEQ ID NO: 45921

SEQ ID NO: 182681 - RNA, 64 nt, hsa; identical to SEQ ID NO: 45922

SEQ ID NO: 182682 - RNA, 64 nt, hsa; identical to SEQ ID NO: 45923

SEQ ID NO: 182683 - RNA, 64 nt, hsa; identical to SEQ ID NO: 45924

SEQ ID NO: 182684 - RNA, 64 nt, hsa; identical to SEQ ID NO: 45925

SEQ ID NO: 182685 - RNA, 64 nt, hsa; identical to SEQ ID NO: 45926

SEQ ID NO: 182686 - RNA, 64 nt, hsa; identical to SEQ ID NO: 45927

SEQ ID NO: 182687 - RNA, 64 nt, hsa; identical to SEQ ID NO: 45928

SEQ ID NO: 182688 - RNA, 64 nt, hsa; identical to SEQ ID NO: 45929

SEQ ID NO: 182689 - RNA, 64 nt, hsa; identical to SEQ ID NO: 45930

SEQ ID NO: 182690 - RNA, 64 nt, hsa; identical to SEQ ID NO: 45931

SEQ ID NO: 182691 - RNA, 64 nt, hsa; identical to SEQ ID NO: 45932

SEQ ID NO: 182692 - RNA, 64 nt, hsa; identical to SEQ ID NO: 45933

SEQ ID NO: 182693 - RNA, 64 nt, hsa; identical to SEQ ID NO: 45934

SEQ ID NO: 182694 - RNA, 64 nt, hsa; identical to SEQ ID NO: 45935

SEQ ID NO: 182695 - RNA, 64 nt, hsa; identical to SEQ ID NO: 45936

SEQ ID NO: 182696 - RNA, 64 nt, hsa; identical to SEQ ID NO: 45937

SEQ ID NO: 182697 - RNA, 64 nt, hsa; identical to SEQ ID NO: 45938

SEQ ID NO: 182698 - RNA, 64 nt, hsa; identical to SEQ ID NO: 45939

SEQ ID NO: 182699 - RNA, 64 nt, hsa; identical to SEQ ID NO: 45940

SEQ ID NO: 182700 - RNA, 64 nt, hsa; identical to SEQ ID NO: 45941

SEQ ID NO: 182701 - RNA, 64 nt, hsa; identical to SEQ ID NO: 45942

SEQ ID NO: 182702 - RNA, 64 nt, hsa; identical to SEQ ID NO: 45943

SEQ ID NO: 182703 - RNA, 64 nt, hsa; identical to SEQ ID NO: 45944

SEQ ID NO: 182704 - RNA, 64 nt, hsa; identical to SEQ ID NO: 45945

SEQ ID NO: 182705 - RNA, 64 nt, hsa; identical to SEQ ID NO: 45946

SEQ ID NO: 182706 - RNA, 64 nt, hsa; identical to SEQ ID NO: 45947

SEQ ID NO: 182707 - RNA, 64 nt, hsa; identical to SEQ ID NO: 45948

SEQ ID NO: 182708 - RNA, 64 nt, hsa; identical to SEQ ID NO: 45949

SEQ ID NO: 182709 - RNA, 64 nt, hsa; identical to SEQ ID NO: 45950

SEQ ID NO: 182710 - RNA, 64 nt, hsa; identical to SEQ ID NO: 45951

SEQ ID NO: 182711 - RNA, 64 nt, hsa; identical to SEQ ID NO: 45952

SEQ ID NO: 182712 - RNA, 64 nt, hsa; identical to SEQ ID NO: 45953

SEQ ID NO: 182713 - RNA, 64 nt, hsa; identical to SEQ ID NO: 45954

SEQ ID NO: 182714 - RNA, 64 nt, hsa; identical to SEQ ID NO: 45955

SEQ ID NO: 182715 - RNA, 64 nt, hsa; identical to SEQ ID NO: 45956

SEQ ID NO: 182716 - RNA, 64 nt, hsa; identical to SEQ ID NO: 45957

SEQ ID NO: 182717 - RNA, 64 nt, hsa; identical to SEQ ID NO: 45958

SEQ ID NO: 182718 - RNA, 64 nt, hsa; identical to SEQ ID NO: 45959

SEQ ID NO: 182719 - RNA, 64 nt, hsa; identical to SEQ ID NO: 45960

SEQ ID NO: 182720 - RNA, 64 nt, hsa; identical to SEQ ID NO: 45961

SEQ ID NO: 182721 - RNA, 64 nt, hsa; identical to SEQ ID NO: 45962

SEQ ID NO: 182722 - RNA, 64 nt, hsa; identical to SEQ ID NO: 45963

SEQ ID NO: 182723 - RNA, 64 nt, hsa; identical to SEQ ID NO: 45964

SEQ ID NO: 182724 - RNA, 64 nt, hsa; identical to SEQ ID NO: 45965

SEQ ID NO: 182725 - RNA, 64 nt, hsa; identical to SEQ ID NO: 45966

SEQ ID NO: 182726 - RNA, 64 nt, hsa; identical to SEQ ID NO: 45967

SEQ ID NO: 182727 - RNA, 64 nt, hsa; identical to SEQ ID NO: 45968

SEQ ID NO: 182728 - RNA, 64 nt, hsa; identical to SEQ ID NO: 45969

SEQ ID NO: 182729 - RNA, 64 nt, hsa; identical to SEQ ID NO: 45970

SEQ ID NO: 182730 - RNA, 64 nt, hsa; identical to SEQ ID NO: 45971

SEQ ID NO: 182731 - RNA, 64 nt, hsa; identical to SEQ ID NO: 45972

SEQ ID NO: 182732 - RNA, 64 nt, hsa; identical to SEQ ID NO: 45973

SEQ ID NO: 182733 - RNA, 64 nt, hsa; identical to SEQ ID NO: 45974

SEQ ID NO: 182734 - RNA, 64 nt, hsa; identical to SEQ ID NO: 45975

SEQ ID NO: 182735 - RNA, 64 nt, hsa; identical to SEQ ID NO: 45976

SEQ ID NO: 182736 - RNA, 64 nt, hsa; identical to SEQ ID NO: 45977

SEQ ID NO: 182737 - RNA, 64 nt, hsa; identical to SEQ ID NO: 45978

SEQ ID NO: 182738 - RNA, 64 nt, hsa; identical to SEQ ID NO: 45979

SEQ ID NO: 182739 - RNA, 64 nt, hsa; identical to SEQ ID NO: 45980

SEQ ID NO: 182740 - RNA, 64 nt, hsa; identical to SEQ ID NO: 45981

SEQ ID NO: 182741 - RNA, 64 nt, hsa; identical to SEQ ID NO: 45982

SEQ ID NO: 182742 - RNA, 64 nt, hsa; identical to SEQ ID NO: 45983

SEQ ID NO: 182743 - RNA, 64 nt, hsa; identical to SEQ ID NO: 45984

SEQ ID NO: 182744 - RNA, 64 nt, hsa; identical to SEQ ID NO: 45985

SEQ ID NO: 182745 - RNA, 64 nt, hsa; identical to SEQ ID NO: 45986

SEQ ID NO: 182746 - RNA, 64 nt, hsa; identical to SEQ ID NO: 45987

SEQ ID NO: 182747 - RNA, 64 nt, hsa; identical to SEQ ID NO: 45988

SEQ ID NO: 182748 - RNA, 64 nt, hsa; identical to SEQ ID NO: 45989

SEQ ID NO: 182749 - RNA, 64 nt, hsa; identical to SEQ ID NO: 45984

SEQ ID NO: 182750 - RNA, 64 nt, hsa; identical to SEQ ID NO: 45983

SEQ ID NO: 182751 - RNA, 64 nt, hsa; identical to SEQ ID NO: 45992

SEQ ID NO: 182752 - RNA, 64 nt, hsa; identical to SEQ ID NO: 45993

SEQ ID NO: 182753 - RNA, 64 nt, hsa; identical to SEQ ID NO: 45994

SEQ ID NO: 182754 - RNA, 64 nt, hsa; identical to SEQ ID NO: 45995

SEQ ID NO: 182755 - RNA, 64 nt, hsa; identical to SEQ ID NO: 45996

SEQ ID NO: 182756 - RNA, 64 nt, hsa; identical to SEQ ID NO: 45997

SEQ ID NO: 182757 - RNA, 64 nt, hsa; identical to SEQ ID NO: 45998

SEQ ID NO: 182758 - RNA, 64 nt, hsa; identical to SEQ ID NO: 45999

SEQ ID NO: 182759 - RNA, 64 nt, hsa; identical to SEQ ID NO: 46000

SEQ ID NO: 182760 - RNA, 64 nt, hsa; identical to SEQ ID NO: 46001

SEQ ID NO: 182761 - RNA, 64 nt, hsa; identical to SEQ ID NO: 46002

SEQ ID NO: 182762 - RNA, 64 nt, hsa; identical to SEQ ID NO: 46003

SEQ ID NO: 182763 - RNA, 64 nt, hsa; identical to SEQ ID NO: 46004

SEQ ID NO: 182764 - RNA, 64 nt, hsa; identical to SEQ ID NO: 46005

SEQ ID NO: 182765 - RNA, 62 nt, hsa; identical to SEQ ID NO: 46006

SEQ ID NO: 182766 - RNA, 64 nt, hsa; identical to SEQ ID NO: 46007

SEQ ID NO: 182767 - RNA, 64 nt, hsa; identical to SEQ ID NO: 46008

SEQ ID NO: 182768 - RNA, 64 nt, hsa; identical to SEQ ID NO: 46009

SEQ ID NO: 182769 - RNA, 64 nt, hsa; identical to SEQ ID NO: 46010

SEQ ID NO: 182770 - RNA, 64 nt, hsa; identical to SEQ ID NO: 46011

SEQ ID NO: 182771 - RNA, 64 nt, hsa; identical to SEQ ID NO: 46012

SEQ ID NO: 182772 - RNA, 64 nt, hsa
uugaaggguuauuuuuaauguauuuugguaauacauuuauuauuauauuuacauguacaguguu

SEQ ID NO: 182773 - RNA, 64 nt, hsa
gcuuuacucccaaccauugaguuauuuauaauguauuuauuaggggaggguaccuugagucuau

SEQ ID NO: 182774 - RNA, 64 nt, hsa
ggggaauccugucagguguuugguuauauugacuauuuauuaauaguauuagaacucauucccu

SEQ ID NO: 182775 - RNA, 64 nt, hsa
aaaguauauuguuuuagaguacucaaauuguauuauuuauuaauuuuuuuguuugcaaaaucuu

SEQ ID NO: 182776 - RNA, 64 nt, hsa
uuuuuaaggggaugaauggugggauuugguuuacauuuauuauuauuugagacagagucucacu

SEQ ID NO: 182777 - RNA, 64 nt, hsa
acacucugcaaguagaacuauuuuuauauaaagcauuuauuaaacacuuuucaugcuuaaagcu

SEQ ID NO: 182778 - RNA, 64 nt, hsa
ccuauuuuuguccuuuuucagucuuuugguaagcauuuauuaaguaccugcuguaugucaaggc

SEQ ID NO: 182779 - RNA, 64 nt, hsa
guauacuguagauuuuuaacaaagcgaguucuauauuuauuauguuuagugugguuugaaauua

SEQ ID NO: 182780 - RNA, 64 nt, hsa
gguugggguugggagugguuaguacauuuauuacauuuauuaagaaacguaaugacauaaaagg

SEQ ID NO: 182781 - RNA, 64 nt, hsa
uacacuggggguugggguugggagugguuaguacauuuauuacauuuauuaagaaacguaauga

SEQ ID NO: 182782 - RNA, 64 nt, hsa
uagaaagaagcccaauauuauaauuuuuuucaauauuuauuauuuucaccuguuuuuaagcugu

SEQ ID NO: 182783 - RNA, 64 nt, hsa
cuugagaaaccuuauuguaccucucuuauagaauauuuauuaccucugauaccucaacccccau

SEQ ID NO: 182784 - RNA, 64 nt, hsa
uuggacagagguugcugaacuuuaaaaaaaauuaauuuauuauuauaaugaccuaauuuauuaa

SEQ ID NO: 182785 - RNA, 64 nt, hsa
uuaaaaaaaauuaauuuauuauuauaaugaccuaauuuauuaaucugaagauuaaccauuuuuu

SEQ ID NO: 182786 - RNA, 64 nt, hsa
gguguucuagcuguuugcaucaaaggaaaaaaagauuuauuaucaaggggcaauauuuuuaucu

SEQ ID NO: 182787 - RNA, 64 nt, hsa
ggaauuucauuugagcaauuucuauaggauauguauuuauuauugauuguuauuuaauuuuuuu

SEQ ID NO: 182788 - RNA, 64 nt, hsa
gguacagagugauugucacauaagguacuugaagauuuauuaguuuaauucuauuuuuacagua

SEQ ID NO: 182789 - RNA, 64 nt, hsa
cagcuagaggcagcuuuuuaaauaaugcaaguguauuuauuagcauuaaaauuaacaucucagu

SEQ ID NO: 182790 - RNA, 64 nt, hsa
augcugacauauauguauauuaaaauaauugccuauuuauuaaucuacaaauagacaacguugg

SEQ ID NO: 182791 - RNA, 64 nt, hsa
ugauucauguuaaauguguuuguauacacaugucauuuauuauuauuacuuuaagauagguauu

SEQ ID NO: 182792 - RNA, 64 nt, hsa
uaaauuccaauaauaaaccaaauguauuuagaguauuuauuaguaaaugcaaggugauguuagu

SEQ ID NO: 182793 - RNA, 64 nt, hsa
uuuuauaaagguagugaaaaaaugaaaauuugcuauuuauuaaaaaacauuaaauuucauucca

SEQ ID NO: 182794 - RNA, 64 nt, hsa
aaagauuuauguaauagguauauauuuaguggccauuuauuaucaaugguaacacaauggagua

SEQ ID NO: 182795 - RNA, 64 nt, hsa
aaaauuuuccaagguuagauuccaauaaauaucuauuuauuauuaaauauuaaaauaucuauuu

SEQ ID NO: 182796 - RNA, 64 nt, hsa
aaauaucuauuuauuauuaaauauuaaaauaucuauuuauuauuaaaaccauuuauaaggcuuu

SEQ ID NO: 182797 - RNA, 64 nt, hsa
acuugaaauuuuaucuuuuacuaugggagucacuauuuauuauugcuuaugugcccuguucaaa

SEQ ID NO: 182798 - RNA, 64 nt, hsa
gguuugacagaggggaacagaagaaaauaauaugauuuauuagcacaacgugguacuauuugcc

SEQ ID NO: 182799 - RNA, 64 nt, hsa
cauuccauccuguuggugcagagaaauuuuggugauuuauuagaagacuuuuaaggagggugga

SEQ ID NO: 182800 - RNA, 64 nt, hsa
uugacccuucguugacuaucaguacuguugauacauuuauuagaauguaugucucagaagaugg

SEQ ID NO: 182801 - RNA, 64 nt, hsa
ucaguaauaaacgugccaucucuaucucuuaaacauuuauuacaacaauuguuuuaaaauagaa

SEQ ID NO: 182802 - RNA, 64 nt, hsa
uauaaauguaauaaggaauaucuugcucuuuaaaauuuauuaggauuuuuaugaguaauuuuua

SEQ ID NO: 182803 - RNA, 64 nt, hsa
aguuuuagacauggcaaaauagaaaucaucuguaauuuauuagcuaacaauguaaaaccaucuu

SEQ ID NO: 182804 - RNA, 64 nt, hsa
uaaugcacuucagagaaauuaaaaaucacagaguauuuauuaccaaugcugcagguacauuaau

SEQ ID NO: 182805 - RNA, 64 nt, hsa
ugauaagccauuuuuaucuguauacauuucaccaauuuauuaacagguugaauauuuguuucuu

SEQ ID NO: 182806 - RNA, 64 nt, hsa
aaccauuucuaaguagauuuuuugacauuaauguauuuauuaaacaaaaacugagaauuccuua

SEQ ID NO: 182807 - RNA, 64 nt, hsa
auuccuguugaaguucuuuugaaguccuaucucuauuuauuauauuugaaaguugucagccacc

SEQ ID NO: 182808 - RNA, 64 nt, hsa
cuuuucuuauauggaaaaucacugaugucauaucauuuauuauccucacagcagcuggcauuca

SEQ ID NO: 182809 - RNA, 64 nt, hsa
uuuuuacucugaugugcaauacauuuguuauuaaauuuauuauuuaagaugguagcacuagucu

SEQ ID NO: 182810 - RNA, 64 nt, hsa
aaauaauuauggggaaauacauguuuguuauuaaauuuauuauuaaagauaguagcacuagucu

SEQ ID NO: 182811 - RNA, 64 nt, hsa
auuaaaauuaucuuugaaacaccucuugaagcuaauuuauuagaaaaaauauuucaguuggaag

SEQ ID NO: 182812 - RNA, 64 nt, hsa
cuauaguuacuuuuuucacuuuuguuauauauguauuuauuagagcauuugaauauugguaccu

SEQ ID NO: 182813 - RNA, 64 nt, hsa
augacuguauuugaauauuuuguaaugcacugcuauuuauuauauauaucaacaguaguucaag

SEQ ID NO: 182814 - RNA, 64 nt, hsa
gcuacagaaguuuugugcauuaaucuuaauucauauuuauuaauuucaagggaauauugaaagg

SEQ ID NO: 182815 - RNA, 64 nt, hsa
guucucccagagcgcagucaccuauguuucuuuuauuuauuaaacuagguuuguauuguacaug

SEQ ID NO: 182816 - RNA, 64 nt, hsa
acaaaaguguuagguucccaugauuucucauuucauuuauuaauaguuaaugcugaauuuuuuu

SEQ ID NO: 182817 - RNA, 64 nt, hsa
uaaacuuuuuauuuauuacagcccaaagagcaguauuuauuaucaaaaugucuuuuuuuuuaug

SEQ ID NO: 182818 - RNA, 64 nt, hsa
cuggaaaagugcauuccuuguuaauaaacuuuuuauuuauuacagcccaaagagcaguauuuau

SEQ ID NO: 182819 - RNA, 64 nt, hsa
ugggaagggaagggcuacugcagcuuuacaugcaauuuauuaaaaugauuguaaaauagcuugu

SEQ ID NO: 182820 - RNA, 64 nt, hsa
aucacuuuucagugaugggagaguagauggugaaauuuauuaguuaauauaucccagaaauuag

SEQ ID NO: 182821 - RNA, 64 nt, hsa
cuuauccuuuuugcucuuuagaaauuucccuuuaauuuauuacauucauugcuuacuguaaaga

SEQ ID NO: 182822 - RNA, 64 nt, hsa
uuaggcugucucacuugugugaaucuucugacacauuuauuauagcuuugucccauuucuuauc

SEQ ID NO: 182823 - RNA, 64 nt, hsa
auggcauuugagauugaaacuaagaaauguuuuaauuuauuaccuuuacaacauuuauuuacau

SEQ ID NO: 182824 - RNA, 64 nt, hsa
acauuuauuuacauuacauacauacauuuacaacauuuauuaauuuauauuaaaauagcaugaa

SEQ ID NO: 182825 - RNA, 64 nt, hsa
ccagcucccucuauuuauguuugcacuugugauuauuuauuauuuauuuauuauuuauuuauuu

SEQ ID NO: 182826 - RNA, 64 nt, hsa
uauuuauguuugcacuugugauuauuuauuauuuauuuauuauuuauuuauuuacagaugaaug

SEQ ID NO: 182827 - RNA, 64 nt, hsa
auuucaacuaugaagauuuacauuucacuuucuaauuuauuaaacaucugugugccuuuuuauc

SEQ ID NO: 182828 - RNA, 64 nt, hsa
aaaaaguauauuuaaugccuuuacaauaccuuuaauuuauuaggaucucagaaucauuguuuac

SEQ ID NO: 182829 - RNA, 64 nt, hsa
uaucuaucuauauuuaauaaauauauacauuuuaauuuauuauguguacucacauacuauagaa

SEQ ID NO: 182830 - RNA, 64 nt, hsa
gugcaauugguucuaccaaggcccuuccuugagcauuuauuauuuaaguuugaacgauguaaaa

SEQ ID NO: 182831 - RNA, 64 nt, hsa
uuuuauuucuuagguuuuuagaguucaggauuucauuuauuaauuucuucuugcuuuuuuggug

SEQ ID NO: 182832 - RNA, 64 nt, hsa
ucgugaauuacauuaaguuauuuggcaauuuauaauuuauuacuacuuuaaaucaaauguagca

SEQ ID NO: 182833 - RNA, 64 nt, hsa
uuuauuuuuuauauauucuugauaacuaugauauauuuauuaauaaccaguguuucuggaugag

SEQ ID NO: 182834 - RNA, 64 nt, hsa
ugcaggcuguggugccguuuuccuuguaacaaggauuuauuagugaauuaucccaaguacucca

SEQ ID NO: 182835 - RNA, 64 nt, hsa
ggaaguaauguuaccuauccuugauaccaugaccauuuauuagauguuuugcuauauaaauuac

SEQ ID NO: 182836 - RNA, 64 nt, hsa
gucaagaaaaaaaaacccuuguauaaauuauuuuauuuauuauuguaauuagaucuucacaaag

SEQ ID NO: 182837 - RNA, 64 nt, hsa
ucaacuaauauaucuaugucuauaucaucuaucaauuuauuaagcaggucuaucuuuaauuugu

SEQ ID NO: 182838 - RNA, 64 nt, hsa
cccaaaaugcauuuagaaaacagucuuuggugauauuuauuauaugauuaucagguuguuagau

SEQ ID NO: 182839 - RNA, 64 nt, hsa
accauauuuuacacauguauuuauaaucuguaguauuuauuacauuucugcuuuuuucuaguca

SEQ ID NO: 182840 - RNA, 64 nt, hsa
uacaguuggaguucaauguaacauuuuaaaugcaauuuauuauuucagaaauuucccaugaaac

SEQ ID NO: 182841 - RNA, 64 nt, hsa
uggcggcugcacaugacaucaaauuguuuccugaauuuauuaaggaguguaaauaaagccuugu

SEQ ID NO: 182842 - RNA, 64 nt, hsa
uuugcagcguauuucacuuuuucuguuauuuucaauuuauuacaacuugacagcuccaagcucu

SEQ ID NO: 182843 - RNA, 64 nt, hsa
auuuauuaaauguauuuuccauacugaguuuaaaauuuauuaauuuguaccuuaagcauuuccc

SEQ ID NO: 182844 - RNA, 64 nt, hsa
cuuggaucuccucagaucuuugguuuuugcuuuaauuuauuaaauguauuuuccauacugaguu

SEQ ID NO: 182845 - RNA, 64 nt, hsa
uuuaauuuaaaagaaaucucuuaccaaccuacauauuuauuacuauaauuugcuaugacuucag

SEQ ID NO: 182846 - RNA, 64 nt, hsa
uauauguaaaauaaaugugacauuuuuauaauuuauuuauuacuaaucaaagaguuuuuuaucu

SEQ ID NO: 182847 - RNA, 64 nt, hsa
uauucacugcuaauuuaaaaaagggaguaccaggauuuauuaaguaaagcauuuuggaaauggg

SEQ ID NO: 182848 - RNA, 64 nt, hsa
acuuauguauuuaaauuuuauuaugaaaaauuacauuuauuaaaaaaguguguuccaaaggcau

SEQ ID NO: 182849 - RNA, 64 nt, hsa
auaaauuccaucuaucaguaguauaggucucaauauuuauuaugagaccaguggucuggaaaca

SEQ ID NO: 182850 - RNA, 64 nt, hsa
guauaugauuauggccuacaauguuguauuuguuauuuauuaaauugugauuguuuuauuauug

SEQ ID NO: 182851 - RNA, 64 nt, hsa
agacaccagacugaaguaaacagcugugcauccaauuuauuauaguuuuguaaguaacaauaug

SEQ ID NO: 182852 - RNA, 64 nt, hsa
gaauauaaaaacuugcaguucuaugauagauugcauuuauuaaaaauguuucauuguaucacau

SEQ ID NO: 182853 - RNA, 64 nt, hsa
uaucucuuuuuccaggccuccagguugcacauuuauuuauuauguucaauacuuugguucuuag

SEQ ID NO: 182854 - RNA, 64 nt, hsa
ugauuaugaaaaauguaucugugugugauuugcuauuuauuaaauuuuaaguacuuugcugaau

SEQ ID NO: 182855 - RNA, 64 nt, hsa
uaagggagauuguauacaaguuggagcaauauccauuuauuauuuuguaacuuuacaguuaaac

SEQ ID NO: 182856 - RNA, 64 nt, hsa
ugauuuauuuuucucuguuacaucucuauuuuuuauuuauuacaaugauuuucucccuucuuuu

SEQ ID NO: 182857 - RNA, 64 nt, hsa
uccuuuguuauuauauauuuacuacacauguugaauuuauuauuguuuauuuccaaggcaugua

SEQ ID NO: 182858 - RNA, 64 nt, hsa
aauuacaaauauacaaaguuauuuaucuuagcacauuuauuaugugugacugcaucugauuuau

SEQ ID NO: 182859 - RNA, 64 nt, hsa
ggaguguuguuguuucuaaacauauauuuaugucauuuauuaaguacaguucacuuaaauaaca

SEQ ID NO: 182860 - RNA, 64 nt, hsa
aaaaaacuguuguagaaauucuuaauuuggaucuauuuauuagucagaguuucagcuuucuuca

SEQ ID NO: 182861 - RNA, 64 nt, hsa
uauucaacacacugccuuauuacauaacugaucuauuuauuaucgcauacagauauucuaaguc

SEQ ID NO: 182862 - RNA, 64 nt, hsa
aggccacugucuccuuuuauauauuauuauaauuauuuauuaugaagaccagugaauuacgaua

SEQ ID NO: 182863 - RNA, 64 nt, hsa
aagcuaagcaauggaaaugcuauacguuuuugacauuuauuaaaugguaccaauaaaguauuuu

SEQ ID NO: 182864 - RNA, 64 nt, hsa
ugauaauaaaacaauucguacuccccaaugguggauuuauuacuauuaaagaaaccagggaaaa

SEQ ID NO: 182865 - RNA, 64 nt, hsa
accuccuaauaucauuuugugacuguaaacaauuauuuauuagcaaacaauugaucccagaagg

SEQ ID NO: 182866 - RNA, 64 nt, hsa
uugggaucuuacuaaaugcauuuuaccugcuacuauuuauuaaaaauggaagcugucuugaauu

SEQ ID NO: 182867 - RNA, 64 nt, hsa
aaauggaugugaauauauguggaaaacuaaauccauuuauuauaaaugccuuaucuuuacccuu

SEQ ID NO: 182868 - RNA, 64 nt, hsa
cacacagaaguuggcugcgucaaguagaggcgacauuuauuaagugaaaaucauggaguuggga

SEQ ID NO: 182869 - RNA, 64 nt, hsa
agagauauauacaccacaaagaaucuaauaagaaauuuauuauggagauauagcccuuaaaaug

SEQ ID NO: 182870 - RNA, 64 nt, hsa
guuuacuaacacacuuaauguuuauauaccuaauauuuauuaugccauaucugaauuuauuaaa

SEQ ID NO: 182871 - RNA, 64 nt, hsa
uuuauauaccuaauauuuauuaugccauaucugaauuuauuaaaaacaacacagaaaucuccug

SEQ ID NO: 182872 - RNA, 64 nt, hsa
uaacacauuuucagaauaauuauugcauaguagaauuuauuacuccagaacagaaagaccuuac

SEQ ID NO: 182873 - RNA, 64 nt, hsa
uucuuuaaaguuggacaggaagguggcauuucuuauuuauuaacauuuuuaacuuuaaacauau

SEQ ID NO: 182874 - RNA, 64 nt, hsa
cugaaagcucugacacguagagcucuuuuguaagauuuauuauucacucaagaguucggaaacc

SEQ ID NO: 182875 - RNA, 64 nt, hsa
gcagauauuggaaaaauauuuugugaaaagcuguauuuauuauaaauacuagggccaugacaua

SEQ ID NO: 182876 - RNA, 64 nt, hsa
ugcuucuaaaacauauuucauguaaacauuguacauuuauuauuguaauauauacuauuaugca

SEQ ID NO: 182877 - RNA, 64 nt, hsa
uccuguuaaaaaaaggaaaaaauucuaauuaaaaauuuauuaguuuuuuuuuaugugucuuggc

SEQ ID NO: 182878 - RNA, 64 nt, hsa
auagaaaauguaauacaauuuauuuaguacauacauuuauuauuuuaaugagaaugccucagga

SEQ ID NO: 182879 - RNA, 64 nt, hsa
agaauuaggguaagaacaguaauugaagccaauuauuuauuacaaauguauuuugcuuugggua

SEQ ID NO: 182880 - RNA, 64 nt, hsa
augauaaccuagcuagauuucuagcauuugcuguauuuauuaaaauuauuauuuuuuugguaaa

SEQ ID NO: 182881 - RNA, 64 nt, hsa
cucuguaugacuccuguaugcauuguauauugcaauuuauuacugucagagauuuguagacagu

SEQ ID NO: 182882 - RNA, 64 nt, hsa
uacagcuauauggaccuuauaaaauugauuucuuauuuauuauuagacauuacuacuaaaaggu

SEQ ID NO: 182883 - RNA, 64 nt, hsa
auucagggacauuuuuccauuuccaaaaaauaaaauuuauuaugcuuuauaaccucuucuguau

SEQ ID NO: 182884 - RNA, 64 nt, hsa
gguacaguauuacaaagauaauuuguuuaacuugauuuauuaaauucuaguuaugugcccuaua

SEQ ID NO: 182885 - RNA, 64 nt, hsa
guugauuacuaaaacuauacuuuguuucccauuuauuuauuacccuuuugcauguauuugugug

SEQ ID NO: 182886 - RNA, 64 nt, hsa
aacauacuaaauuuuuuuuauuuuauugcuuauaauuuauuaagaauguuuacaccuguauaag

SEQ ID NO: 182887 - RNA, 64 nt, hsa
acucuucagugacuccugcugguaccugcccucuauuuauuagccaacuguuucccugcugaau

SEQ ID NO: 182888 - RNA, 64 nt, hsa
cuuggaggagagagaccccgcacccggcucguguauuuauuaccgucacacucuucagugacuc

SEQ ID NO: 182889 - RNA, 64 nt, hsa
uaugcauuaggugaugggacuuuuaaagguuugaauuuauuaggacacgaacuaaaaauaaaag

SEQ ID NO: 182890 - RNA, 64 nt, hsa
gaauuacaagaaguaaaacaagugcaacuaaaucauuuauuaguuguuuuuugaaagcaguuuu

SEQ ID NO: 182891 - RNA, 64 nt, hsa
ccuguuuucuacuugagucuaacauauggucccaauuuauuaauacuucuguuaaauuugaugu

SEQ ID NO: 182892 - RNA, 64 nt, hsa
uuaagcuauaaauguguuaacauguauauauaccauuuauuauguucuacuuuagugauauacc

SEQ ID NO: 182893 - RNA, 64 nt, hsa
guauuuaaagucuuaacauuuauuuaauaauuauauuuauuaaaccauuuuucaauaagguaua

SEQ ID NO: 182894 - RNA, 64 nt, hsa
aauucaaagguauuucauuuaggugaaaagucuuauuuauuaaagugguuugaauaaaguagau

SEQ ID NO: 182895 - RNA, 64 nt, hsa
aaggauucagaauuuugcagucacagaagaguguauuuauuauguagaaugaaugaggguacug

SEQ ID NO: 182896 - RNA, 64 nt, hsa
ccaaagaguuguuauaaugcauaauuuguauuaaauuuauuacuauuucuuaugccuuuuaaaa

SEQ ID NO: 182897 - RNA, 64 nt, hsa
guaaacuacaauauauuuagugcuacucgcagcuauuuauuauuuuguagaccugccuuaugca

SEQ ID NO: 182898 - RNA, 64 nt, hsa
ucguacauacaauuuggaaucaaaugucauaagaauuuauuauauaaauuuaucaagaauaaaa

SEQ ID NO: 182899 - RNA, 64 nt, hsa
cuacugccaauguuuaaauugcccuuauguuuauauuuauuaugucaagccaauucguacauac

SEQ ID NO: 182900 - RNA, 64 nt, hsa
acuguuguggcacaaguucucuuguccaaauaaaauuuauuaauaagaucuauagagagagaua

SEQ ID NO: 182901 - RNA, 64 nt, hsa
cugauuuuuucaugcuggucaugaccugaaggaaauuuauuagacguauaauguaugucuggug

SEQ ID NO: 182902 - RNA, 64 nt, hsa
uccaaagauacuaaaaaaauguccuccaguuuguauuuauuaauucugucaugugcaaaugguu

SEQ ID NO: 182903 - RNA, 64 nt, hsa
aguaacuucaaauguguauuaugauaauuucccuauuuauuagaagaguuggauaaauuuucau

SEQ ID NO: 182904 - RNA, 64 nt, hsa
cuuuuauuucuuaauuaucuucagauuucucuguauuuauuauguguauccccagcuauguaug

SEQ ID NO: 182905 - RNA, 64 nt, hsa
gcuaaaagaaaauguauucucugcuuuguauugaauuuauuacuguacauucuguggcuuauag

SEQ ID NO: 182906 - RNA, 64 nt, hsa
caucagaacuauuuugcacaugauuuuuaaagguauuuauuagaaaucaaagaacacucaaaau

SEQ ID NO: 182907 - RNA, 64 nt, hsa
uauauugauagagguucauguuuaaauuauacauauuuauuagcaucauauugucauuuguuuu

SEQ ID NO: 182908 - RNA, 64 nt, hsa
uucagauaccuuaaaaguuacuuuauuuaaaagcauuuauuaaucuuagucugaaaucaaaaua

SEQ ID NO: 182909 - RNA, 64 nt, hsa
ugcacccauaauuuucuaguaauagccacgaccaauuuauuaacagucagggccuauccuugcc

SEQ ID NO: 182910 - RNA, 64 nt, hsa
uuauguuaacguuugcuauuuauuuaacauuuuuauuuauuaauuuuauacuauuucaacuaga

SEQ ID NO: 182911 - RNA, 64 nt, hsa
uuucaggcacggauaacagcaaauggaauucuguauuuauuauuauuuaaguguagcgcagaug

SEQ ID NO: 182912 - RNA, 64 nt, hsa
guguuguucuuggcaauaaauuuugaaaaguaauauuuauuaaauuuuuuuguaugaaaacaug

SEQ ID NO: 182913 - RNA, 64 nt, hsa
auaauucuuuuuuauuaaucacuguguauauuugauuuauuaacuuaauaaucaagagccuuaa

SEQ ID NO: 182914 - RNA, 64 nt, hsa
guauucaauuugauucuaugacugaaguacuggaauuuauuauguggcuaaagugcucuauuua

SEQ ID NO: 182915 - RNA, 64 nt, hsa
aguacuggaauuuauuauguggcuaaagugcucuauuuauuaagaacuauauuuaauaccacca

SEQ ID NO: 182916 - RNA, 64 nt, hsa
cuuucgguuguaaauuuaauuguacauaugguugauuuauuauuuuuaaaaauacagacuaacu

SEQ ID NO: 182917 - RNA, 64 nt, hsa
uuucucucuuaccuucuggaagagggaauguuucauuuauuacuguuugauuuucuuguaucug

SEQ ID NO: 182918 - RNA, 64 nt, hsa
aagcaucagacugguaucaauauuagacaauguuauuuauuagcccuaauuguguuugguuuca

SEQ ID NO: 182919 - RNA, 64 nt, hsa
uaagggauauguuacaguaccccaccuguaaguuauuuauuagcccuaauuguguuugauuuca

SEQ ID NO: 182920 - RNA, 64 nt, hsa
cucuugacaaaauaaaguauuuuuauucauuuguauuuauuaaaugaaaaaacaaucccauggu

SEQ ID NO: 182921 - RNA, 64 nt, hsa
ucuaggguuuuuguacauuuuggaugcacugggaauuuauuagcacaaaaucauucuuugcaac

SEQ ID NO: 182922 - RNA, 64 nt, hsa
gagaguuuaccaagagagaugucuccgggcccuuauuuauuauuuaaacauuuuuuuaaaaagc

SEQ ID NO: 182923 - RNA, 64 nt, hsa
aagcgugcugugcgucugaccuggcaugauuucuauuuauuaugauauccuauuuauauuaacu

SEQ ID NO: 182924 - RNA, 64 nt, hsa
uuauccacuacagguuuuaugagacuuccuauuaauuuauuaaauuuauuaaauguuggcuaau

SEQ ID NO: 182925 - RNA, 64 nt, hsa
acagguuuuaugagacuuccuauuaauuuauuaaauuuauuaaauguuggcuaauaugucacau

SEQ ID NO: 182926 - RNA, 64 nt, hsa
guauaggauuuuuaaaaaugacaacauucacaaaauuuauuacuuuuuaaaaaauaacaugccu

SEQ ID NO: 182927 - RNA, 64 nt, hsa
acauuuauuaggaaucuaaaucaugucuuugaacauuuauuagguucacucaguagguguuaca

SEQ ID NO: 182928 - RNA, 64 nt, hsa
auuauaugaacuguuuuauaucauguucauauacauuuauuaggaaucuaaaucaugucuuuga

SEQ ID NO: 182929 - RNA, 64 nt, hsa
ggauaacaaagaaccuaacauuuauuaagcacguauuuauuaacugcucaguguuucauauuca

SEQ ID NO: 182930 - RNA, 64 nt, hsa
gugaugaacuggcagggauaacaaagaaccuaacauuuauuaagcacguauuuauuaacugcuc

SEQ ID NO: 182931 - RNA, 64 nt, hsa; identical to SEQ ID NO: 143348

SEQ ID NO: 182932 - RNA, 64 nt, hsa; identical to SEQ ID NO: 143349

SEQ ID NO: 182933 - RNA, 64 nt, hsa; identical to SEQ ID NO: 143350

SEQ ID NO: 182934 - RNA, 64 nt, hsa; identical to SEQ ID NO: 143351

SEQ ID NO: 182935 - RNA, 64 nt, hsa; identical to SEQ ID NO: 143352

SEQ ID NO: 182936 - RNA, 64 nt, hsa; identical to SEQ ID NO: 143353

SEQ ID NO: 182937 - RNA, 64 nt, hsa; identical to SEQ ID NO: 143354

SEQ ID NO: 182938 - RNA, 64 nt, hsa; identical to SEQ ID NO: 143355

SEQ ID NO: 182939 - RNA, 64 nt, hsa; identical to SEQ ID NO: 143356

SEQ ID NO: 182940 - RNA, 64 nt, hsa; identical to SEQ ID NO: 143357

SEQ ID NO: 182941 - RNA, 64 nt, hsa; identical to SEQ ID NO: 143358

SEQ ID NO: 182942 - RNA, 64 nt, hsa; identical to SEQ ID NO: 143359

SEQ ID NO: 182943 - RNA, 64 nt, hsa; identical to SEQ ID NO: 143360

SEQ ID NO: 182944 - RNA, 64 nt, hsa; identical to SEQ ID NO: 143361

SEQ ID NO: 182945 - RNA, 64 nt, hsa; identical to SEQ ID NO: 143362

SEQ ID NO: 182946 - RNA, 64 nt, hsa; identical to SEQ ID NO: 143363

SEQ ID NO: 182947 - RNA, 64 nt, hsa; identical to SEQ ID NO: 143364

SEQ ID NO: 182948 - RNA, 64 nt, hsa; identical to SEQ ID NO: 143365

SEQ ID NO: 182949 - RNA, 64 nt, hsa
uacggggaggagggggggaucaucaggaagcccagaacacuaacaagcgguucucccaucuacc

SEQ ID NO: 182950 - RNA, 64 nt, hsa
aaaggaauagcaaucauuaaaaucuugggccagagaacacuauuuuuacauaacaguuucuuaa

SEQ ID NO: 182951 - RNA, 64 nt, hsa
uggugacuguuuggggccugguauuuuaauagaugaacacuacuuuuuuaauuuuuuauuuuuu

SEQ ID NO: 182952 - RNA, 64 nt, hsa
auuuuuuauuuuuuuaacccuacccuuaacccaugaacacuauuuuuaauuaaaguaucugaug

SEQ ID NO: 182953 - RNA, 64 nt, hsa
uuugcccaguuguguuuuaaaaacaauuccucaugaacacuaagauuaauugugucuguaucuc

SEQ ID NO: 182954 - RNA, 64 nt, hsa
aagucaucuaccuuugauauuagccauagaacuugaacacuaacuauauccuaugcauaguaug

SEQ ID NO: 182955 - RNA, 64 nt, hsa; identical to SEQ ID NO: 124053

SEQ ID NO: 182956 - RNA, 64 nt, hsa; identical to SEQ ID NO: 124054

SEQ ID NO: 182957 - RNA, 64 nt, hsa; identical to SEQ ID NO: 124055

SEQ ID NO: 182958 - RNA, 64 nt, hsa; identical to SEQ ID NO: 124056

SEQ ID NO: 182959 - RNA, 64 nt, hsa; identical to SEQ ID NO: 124057

SEQ ID NO: 182960 - RNA, 64 nt, hsa; identical to SEQ ID NO: 124058

SEQ ID NO: 182961 - RNA, 64 nt, hsa; identical to SEQ ID NO: 124059

SEQ ID NO: 182962 - RNA, 64 nt, hsa; identical to SEQ ID NO: 124060

SEQ ID NO: 182963 - RNA, 64 nt, hsa; identical to SEQ ID NO: 124061

SEQ ID NO: 182964 - RNA, 64 nt, hsa; identical to SEQ ID NO: 124062

SEQ ID NO: 182965 - RNA, 64 nt, hsa; identical to SEQ ID NO: 124063

SEQ ID NO: 182966 - RNA, 64 nt, hsa; identical to SEQ ID NO: 124064

SEQ ID NO: 182967 - RNA, 64 nt, hsa; identical to SEQ ID NO: 124065

SEQ ID NO: 182968 - RNA, 64 nt, hsa; identical to SEQ ID NO: 124066

SEQ ID NO: 182969 - RNA, 64 nt, hsa; identical to SEQ ID NO: 124067

SEQ ID NO: 182970 - RNA, 64 nt, hsa; identical to SEQ ID NO: 124068

SEQ ID NO: 182971 - RNA, 64 nt, hsa; identical to SEQ ID NO: 124069

SEQ ID NO: 182972 - RNA, 64 nt, hsa; identical to SEQ ID NO: 124070

SEQ ID NO: 182973 - RNA, 64 nt, hsa; identical to SEQ ID NO: 124071

SEQ ID NO: 182974 - RNA, 64 nt, hsa; identical to SEQ ID NO: 124072

SEQ ID NO: 182975 - RNA, 64 nt, hsa; identical to SEQ ID NO: 124073

SEQ ID NO: 182976 - RNA, 64 nt, hsa; identical to SEQ ID NO: 124074

SEQ ID NO: 182977 - RNA, 64 nt, hsa; identical to SEQ ID NO: 124075

SEQ ID NO: 182978 - RNA, 64 nt, hsa; identical to SEQ ID NO: 124076

SEQ ID NO: 182979 - RNA, 64 nt, hsa; identical to SEQ ID NO: 124077

SEQ ID NO: 182980 - RNA, 64 nt, hsa; identical to SEQ ID NO: 124078

SEQ ID NO: 182981 - RNA, 64 nt, hsa; identical to SEQ ID NO: 124079

SEQ ID NO: 182982 - RNA, 64 nt, hsa; identical to SEQ ID NO: 124080

SEQ ID NO: 182983 - RNA, 64 nt, hsa; identical to SEQ ID NO: 124081

SEQ ID NO: 182984 - RNA, 64 nt, hsa; identical to SEQ ID NO: 124082

SEQ ID NO: 182985 - RNA, 64 nt, hsa; identical to SEQ ID NO: 124083

SEQ ID NO: 182986 - RNA, 64 nt, hsa
gaccuucuguaguaauaaaguuuuugccacuguaaauaaaaacaguauccguagcuaucaggau

SEQ ID NO: 182987 - RNA, 64 nt, hsa
uuaacuuuuuauauuaaugacuauugaaagugguaauaaaaauuuauauuauaggcuucaaugu

SEQ ID NO: 182988 - RNA, 64 nt, hsa
cuggcagccaauaaaaucaucauaagcccuuuguaauaaaaagcuaguuuccugagugaacaag

SEQ ID NO: 182989 - RNA, 64 nt, hsa
uucuguaugcuucuauuccaaaucauucauuaccaauaaaaacgaaauaccacccuuuccauuu

SEQ ID NO: 182990 - RNA, 64 nt, hsa
acacaauuucuaacugccuguuuuuguauaauuuaauaaaaaccuuuuaaacauuacugcuuuu

SEQ ID NO: 182991 - RNA, 64 nt, hsa
cugacauuugggugaugucuucacauggaaauauaauaaaaauaaaaaucuaguuuaauacugc

SEQ ID NO: 182992 - RNA, 64 nt, hsa
uuugggugaugucuucacauggaaauauaauaaaaauaaaaaucuaguuuaauacugcauuauu

SEQ ID NO: 182993 - RNA, 64 nt, hsa
uuaggaaggucaaaaaaaaggaaaaaagaaaaauaauaaaaaauaauaaaaauccuuaggauaa

SEQ ID NO: 182994 - RNA, 64 nt, hsa
caaaaaaaaggaaaaaagaaaaauaauaaaaaauaauaaaaauccuuaggauaacuugaggcca

SEQ ID NO: 182995 - RNA, 64 nt, hsa
ugucaaaaauucccaacacuagaaaaucauguagaauaaaaauuuuaaaucucacuucacuuag

SEQ ID NO: 182996 - RNA, 64 nt, hsa
aucauuccuauauuguuauugauuuuuuucacuuaauaaaaauucaccuuauuccuuaucauug

SEQ ID NO: 182997 - RNA, 64 nt, hsa
uuuuugcauauaaaccaaaaaauaacuuguuaucaauaaaaacuugcauccaacaugaauuucc

SEQ ID NO: 182998 - RNA, 64 nt, hsa
auuguaacaauccaaacaauaccucacgauauaaaauaaaaaugaaaguauccuccucauuuuc

SEQ ID NO: 182999 - RNA, 64 nt, hsa
cacuucucuccucaacuguaauucuauuuuuaauaauaaaaauggcauacuguagggucuucag

SEQ ID NO: 183000 - RNA, 64 nt, hsa
gagauaauacacaggugauaaacaguuucgagaaaauaaaaauuggcuagaaucucaaguuaug

SEQ ID NO: 183001 - RNA, 64 nt, hsa
uuagaaaacccuuacacuuuggcuaugaacaaauaauaaaaauuauucuuuaaaguaaugucuu

SEQ ID NO: 183002 - RNA, 64 nt, hsa
gggcaggggaagggggauauagaggucacaaggaaauaaaaaucaucuuucaucuuuaauuuua

SEQ ID NO: 183003 - RNA, 64 nt, hsa
uuggcagguuaaauuaaaccagaagaggugacuuaauaaaaaagggaaugacauuuaggguaua

SEQ ID NO: 183004 - RNA, 64 nt, hsa
auuguuugcgcuagaauagaaaugauuucuuuucaauaaaaagaaagaaggacucuaccauguc

SEQ ID NO: 183005 - RNA, 64 nt, hsa
aaaucuagaaaccauuaguuugagaucucucaaaaauaaaaauaaaaauugcuuucagagagua

SEQ ID NO: 183006 - RNA, 64 nt, hsa
agaaaccauuaguuugagaucucucaaaaauaaaaauaaaaauugcuuucagagaguagcccau

SEQ ID NO: 183007 - RNA, 64 nt, hsa
uucucacgugaaauauaaaaagcaagucuugcccaauaaaaacgcuacauuguguguauuuuuu

SEQ ID NO: 183008 - RNA, 64 nt, hsa
cuggccaacauggugaaacccugucucuacugaaaauaaaaaaaacuagcugggcaugguggca

SEQ ID NO: 183009 - RNA, 64 nt, hsa
ugauucauuuuagaucucuggggaagaaaaaggaaauaaaaaccaucucaauaauuaagguaaa

SEQ ID NO: 183010 - RNA, 64 nt, hsa
acuuaugguccaaaaaagugacccaauggcaacaaauaaaaauugaaaugcaguuguucuccuu

SEQ ID NO: 183011 - RNA, 64 nt, hsa
gccuaggagacaaaacgagacuucauuuaaaaaaaauaaaaauaaaaauaaaaauaaagucauc

SEQ ID NO: 183012 - RNA, 64 nt, hsa
gagacaaaacgagacuucauuuaaaaaaaauaaaaauaaaaauaaaaauaaagucaucuugcca

SEQ ID NO: 183013 - RNA, 64 nt, hsa
aaacgagacuucauuuaaaaaaaauaaaaauaaaaauaaaaauaaagucaucuugccacccacc

SEQ ID NO: 183014 - RNA, 64 nt, hsa
caagaucuguaauguuauuuccacuuauaaaggaaauaaaaaaugaaaaacauuauuuggauau

SEQ ID NO: 183015 - RNA, 64 nt, hsa
aaaaaugaaaaacauuauuuggauaucaaaagcaaauaaaaacccaauucagucucuucuaagc

SEQ ID NO: 183016 - RNA, 64 nt, hsa
aaguuggagcaauugucuguguuugaaaagaugaaauaaaaauaauaaucaagggcaaagcuuu

SEQ ID NO: 183017 - RNA, 64 nt, hsa
acaguucucuuguauuuauuuaucaauuaaaucaaauaaaaaugauuaugucaaugcguuuuca

SEQ ID NO: 183018 - RNA, 64 nt, hsa
guuauuaggaaacagaaggcaaaaagauugucaaaauaaaaacaauaauucaaguaacaaugcc

SEQ ID NO: 183019 - RNA, 64 nt, hsa
cuguuuuugacaauuuuuuuaucaagaaagagcaaauaaaaagcagugguaaugauccaaagua

SEQ ID NO: 183020 - RNA, 64 nt, hsa
gugguacggucuaaaagcagucuuguuuccuggaaauaaaaaguugggauauuaacuuguuuuu

SEQ ID NO: 183021 - RNA, 64 nt, hsa
uucccacugucuuuaaguugaaacuguuaagcugaauaaaaacuuaagcugcaaauugauaacu

SEQ ID NO: 183022 - RNA, 64 nt, hsa
uuucugcuugcuguaaauuaagcaaacaugcuauaauaaaaacaaaaugaaggaaauaaugauu

SEQ ID NO: 183023 - RNA, 64 nt, hsa
caaaagugacuugacauguccaauuucauuucagaauaaaaagcuagcaucuuuaaaaaucuca

SEQ ID NO: 183024 - RNA, 64 nt, hsa
uccacuuagagcaauaaccacuuuuuaaauguaaaauaaaaagacaaaugaaaaggcacauccu

SEQ ID NO: 183025 - RNA, 64 nt, hsa
ggaggcugcacuacaaacccaaauucugcaaaaaaauaaaaauaagccacaaaacuaaaaggcc

SEQ ID NO: 183026 - RNA, 64 nt, hsa
agccuuggcaccuguuggagacuaugaccaagccaauaaaaagggcauuuaaaucagcccuguu

SEQ ID NO: 183027 - RNA, 64 nt, hsa
cuaucacacucuguuaaaaacacauagaaucaucaauaaaaacucaauauaacuuucuuugggu

SEQ ID NO: 183028 - RNA, 64 nt, hsa
uucauaaaaucuaugaauacuguacaaugcugauaauaaaaacuuuuuauaccugugucagacu

SEQ ID NO: 183029 - RNA, 64 nt, hsa
guaagucaauuaauaaaaagagccaucuggaggaaauaaaaaaaaaaggaagacucuaugaaga

SEQ ID NO: 183030 - RNA, 64 nt, hsa
cagcaaacugaccugccccuauuguaagucaauuaauaaaaagagccaucuggaggaaauaaaa

SEQ ID NO: 183031 - RNA, 64 nt, hsa
guuuuuuuuccguaacauugucugcugcaauuuaaauaaaaauuacgacauuuuaagauauuuc

SEQ ID NO: 183032 - RNA, 64 nt, hsa
ucacaugagcuuuaguuuguuuucugguuuaaaaaauaaaaagguuucucuuaacaguauuucc

SEQ ID NO: 183033 - RNA, 64 nt, hsa
aaauauugggauaaagugaaaguuccauuuccuaaauaaaaacuaauaaaauauaguacuuucc

SEQ ID NO: 183034 - RNA, 64 nt, hsa
aaaguguucuagcucgaguggaagaacucauugaaauaaaaacaaagucuaccucugaagaaaa

SEQ ID NO: 183035 - RNA, 64 nt, hsa
cauuaaacugaaucagaaauccauuuucuggcugaauaaaaaguuuggcuugccuguguaaugc

SEQ ID NO: 183036 - RNA, 64 nt, hsa
uguguguagauuuauaguuuuugguaguggcaggaauaaaaaaaauccauccuacaucuucccu

SEQ ID NO: 183037 - RNA, 64 nt, hsa
ucaaagugguaacccaaauucauaaagcaauaauaauaaaaaccuauauaguauguucucuccu

SEQ ID NO: 183038 - RNA, 64 nt, hsa
ccucaccuccaauauaaacacauuaaaagaguacaauaaaaauguuuaaaaucauguacuaaua

SEQ ID NO: 183039 - RNA, 64 nt, hsa
gaaggaaacauauguucuccccuacauuaguaaaaauaaaaauggaauuuuuuacccauacaaa

SEQ ID NO: 183040 - RNA, 64 nt, hsa
guuuuauccacaacuuuucaaguauugaaaguagaauaaaaacauggguucuuagucuuuagcu

SEQ ID NO: 183041 - RNA, 64 nt, hsa
ccuggacaacauagugagaccuugucuccacaaaaauaaaaaagaaacuauccaggaguggugg

SEQ ID NO: 183042 - RNA, 64 nt, hsa
ggugacagagcaagacucugucucaaaaaauaaaaauaaaaauaaauuugguucuaauagaacu

SEQ ID NO: 183043 - RNA, 64 nt, hsa
agccugggugacagagcaagacucugucucaaaaaauaaaaauaaaaauaaauuugguucuaau

SEQ ID NO: 183044 - RNA, 64 nt, hsa
ugauaacuauuauuugugcaacauuacucuuugaaauaaaaauuggcauguagccaauguuucc

SEQ ID NO: 183045 - RNA, 64 nt, hsa
aauauuguauuuccuuacuguuuuaucuauuguaaauaaaaagcauuuuaaaaaguauugacac

SEQ ID NO: 183046 - RNA, 64 nt, hsa
gcuauuguuauaguagcugcccuauaguuacaaaaauaaaaacuauaaaaacccauccccuauc

SEQ ID NO: 183047 - RNA, 64 nt, hsa
uucuuaacuaaaauuacuuuuuacuuuaagcuugaauaaaaaucuucauugguaacuguaugua

SEQ ID NO: 183048 - RNA, 64 nt, hsa
uuagucuuaaggguaacagagugaauaccuuccaaauaaaaagcuaaauauuccuccuugucau

SEQ ID NO: 183049 - RNA, 64 nt, hsa
uccauaacagacuuugacucuaugaccuaugaagaauaaaaagauaaucugaagguguuugagu

SEQ ID NO: 183050 - RNA, 64 nt, hsa
gaaagauuucuuagguuuugaaagaauacauuaaaauaaaaaacuugccccuacuagguaagaa

SEQ ID NO: 183051 - RNA, 64 nt, hsa
ucucuuccaaucaugacuuuggaacucccugaauaauaaaaaugagaguugagauaaauagggg

SEQ ID NO: 183052 - RNA, 64 nt, hsa
ggagcaucuguauuuuuauguuaaaagcccacaaaauaaaaauaaaaaguaacugagaugaauu

SEQ ID NO: 183053 - RNA, 64 nt, hsa
ucuguauuuuuauguuaaaagcccacaaaauaaaaauaaaaaguaacugagaugaauuuaccuu

SEQ ID NO: 183054 - RNA, 64 nt, hsa
auaaaugaggcaaauccgaagaaaaggaaaaucgaauaaaaaauagucccacaaaauaccuuuu

SEQ ID NO: 183055 - RNA, 64 nt, hsa
uuuaaauuuuuuuuguuuguugaaugacaaaggcaauaaaaauaaauuugacuuuagcuuuuuu

SEQ ID NO: 183056 - RNA, 64 nt, hsa
agcgagaccuugucucuaaaaauaauaguaauaaaauaaaaauaacguuuuaugacuauuuauu

SEQ ID NO: 183057 - RNA, 64 nt, hsa
ugaaucuguuuugagaauccucuccauuuucccaaauaaaaaccuaucacaacagugacuauau

SEQ ID NO: 183058 - RNA, 64 nt, hsa
agcaaaaucuuguaguuuuuaaucuuaaacacugaauaaaaaaacuuuccccuaaauuggaaug

SEQ ID NO: 183059 - RNA, 64 nt, hsa
aggaccuagaguaccuauaggacaaaaaguauagaauaaaaauaugccuuuagucauuugguuu

SEQ ID NO: 183060 - RNA, 64 nt, hsa
gaccccuuaccccaacuuuaugaguaaugcuuggaauaaaaacucuuaaggcaacucacugauu

SEQ ID NO: 183061 - RNA, 64 nt, hsa
auuugaaauacuaccauauuugugauuuauugagaauaaaaauccauuuugaaauguaaaauuu

SEQ ID NO: 183062 - RNA, 64 nt, hsa
uguuaugaaauaaaaaaaagauggguuuuguaaaaauaaaaaaaaaauauuuuuagcagaacag

SEQ ID NO: 183063 - RNA, 64 nt, hsa
ggaaguacagacguacuuuaaauuuuuguuaugaaauaaaaaaaagauggguuuuguaaaaaua

SEQ ID NO: 183064 - RNA, 64 nt, hsa
ccagaggucauggaacagaaagccuuauaaaccaaauaaaaauucucaaaauacauugguuuau

SEQ ID NO: 183065 - RNA, 64 nt, hsa
ugagcuuaggauagagagugggcucauuggccuaaauaaaaagagaagaccagaagucuuugag

SEQ ID NO: 183066 - RNA, 64 nt, hsa
cacuaacacuaaccauaguugaugagcuuaaaaaaauaaaaauagaaaauugcaaaaaaaaaaa

SEQ ID NO: 183067 - RNA, 64 nt, hsa
cauacuugcauuacauagguacuucaagcaacacaauaaaaaguaaaugauaaagugaacuugc

SEQ ID NO: 183068 - RNA, 64 nt, hsa
agaauauucaauuuuccaucuaugaaaauuucacaauaaaaaucauaguuuacuuuguauuaua

SEQ ID NO: 183069 - RNA, 64 nt, hsa
ccuaggggguuuuguuugguuuuuaauugugaggaauaaaaaaucuucugcccacacuggcauu

SEQ ID NO: 183070 - RNA, 64 nt, hsa
ucucugagagaaaaggguguuuuaaauuuaaaaaaauaaaaacaaaaaaguuugauugagacaa

SEQ ID NO: 183071 - RNA, 64 nt, hsa
agagcaagacuccaucucaguaaauaaauaaauaaauaaaaagcgcugcaguagcuguggccuc

SEQ ID NO: 183072 - RNA, 64 nt, hsa
ugaaucuguuuugagaauccucuccauuuucccaaauaaaaaccuaucccaacagugacuauau

SEQ ID NO: 183073 - RNA, 64 nt, hsa
agagcgagaccuugucucuaaaaauaauaauaguaauaaaaauaacguuuuaugacuauuuauu

SEQ ID NO: 183074 - RNA, 64 nt, hsa
aucaccacagauaaagauuuuguuuugcccugcaaauaaaaagacaauuccuuauugucugaau

SEQ ID NO: 183075 - RNA, 64 nt, hsa
uaaaaucuugucuagcacaguuaaagucauuaaaaauaaaaaugacagcuuuagcacaauuuua

SEQ ID NO: 183076 - RNA, 64 nt, hsa
ccaacauuguuuagaauuucaagcagauggugauaauaaaaagcagaccaacuuuuaguuagcu

SEQ ID NO: 183077 - RNA, 64 nt, hsa
cuuuugucuuuuaaaauaaucccagaacaccaaaaauaaaaacaaacaauaacauguuuaucuu

SEQ ID NO: 183078 - RNA, 64 nt, hsa
uagcaagggguaaauuauguacuguugucuuucuaauaaaaaagcucaauuuuaauuuuucauc

SEQ ID NO: 183079 - RNA, 64 nt, hsa
agagaagaaagacuguaugugacaauuaccugggaauaaaaauaucuccacuuuuuuauugaau

SEQ ID NO: 183080 - RNA, 64 nt, hsa
auaucucuaauuuacuuugaaauucaaaggugaaaauaaaaaaugauggccuaaguaaaauuua

SEQ ID NO: 183081 - RNA, 64 nt, hsa
gagaaagaaacugcauguuuguuguugaugaugaaauaaaaaugcuagcgacagucuuucuuac

SEQ ID NO: 183082 - RNA, 64 nt, hsa
uucauuucacuuuaaagucuuuccgucucccuaaaauaaaaaccagaaucauaauuuucaagag

SEQ ID NO: 183083 - RNA, 64 nt, hsa
uauguauuauuuucuauagcucuucuauuuaaaaaauaaaaaaauacaguaaaguuuaaaaaau

SEQ ID NO: 183084 - RNA, 64 nt, hsa
agagaaguauccaauuaugugacaaccuuuguguaauaaaaauuuguuuaaaguuaauaauugu

SEQ ID NO: 183085 - RNA, 64 nt, hsa
uccaugccuacagauaauuuauuuuguauuuuugaauaaaaaacauuuguacauuccugauacu

SEQ ID NO: 183086 - RNA, 64 nt, hsa
auuaucacacaaagagaccaauaaaaauaaaaaaaauaaaaaaaaaaaaagacgaacuauugga

SEQ ID NO: 183087 - RNA, 64 nt, hsa
guguaggucauuaucacacaaagagaccaauaaaaauaaaaaaaauaaaaaaaaaaaaagacga

SEQ ID NO: 183088 - RNA, 64 nt, hsa
guccauguguaggucauuaucacacaaagagaccaauaaaaauaaaaaaaauaaaaaaaaaaaa

SEQ ID NO: 183089 - RNA, 64 nt, hsa
cacagagucagaagcugccaccuuagagaacugaaauaaaaauagaaguucuuacgcuuuuuug

SEQ ID NO: 183090 - RNA, 64 nt, hsa
gguacagaugcuuucgacaauuuaaagaaagcuaaauaaaaauguagacauggcuggcgcagug

SEQ ID NO: 183091 - RNA, 64 nt, hsa
agcacuuggaaaaugcacuuguccuguuuuguaaaauaaaaagguauuaaauguguauuucugc

SEQ ID NO: 183092 - RNA, 64 nt, hsa
auuuaaaguaaucuauaguaauuucuuuuuauauaauaaaaauauauuuguaaagucgacagac

SEQ ID NO: 183093 - RNA, 64 nt, hsa
gaaaggaauucaaaagaauuuagauuaaaaguuaaauaaaaaguaggcacaguagugcugaauu

SEQ ID NO: 183094 - RNA, 64 nt, hsa
uuauuaacacuuguauuuuauuauugagcauaucaauaaaaauauuaaaaaauaacagauuguu

SEQ ID NO: 183095 - RNA, 64 nt, hsa
ggaggcaggacaacacugagacugggauauguccaauaaaaacuaugacuuuuccccuugcaga

SEQ ID NO: 183096 - RNA, 64 nt, hsa
aagaacaccagagaucagaaauucaaaaacucagaauaaaaaugaaaaagcuacaagcauauau

SEQ ID NO: 183097 - RNA, 64 nt, hsa
cucaacugugucugauguuucuucucauguaagaaauaaaaaauaaaaauaaaauaaaauauau

SEQ ID NO: 183098 - RNA, 64 nt, hsa
gugucugauguuucuucucauguaagaaauaaaaaauaaaaauaaaauaaaauauauugguaug

SEQ ID NO: 183099 - RNA, 64 nt, hsa
aauaaaauauauugguauguaacuacaggaaaaaaauaaaaaauauauaguggacaguaaccuu

SEQ ID NO: 183100 - RNA, 64 nt, hsa
aaaaaagauguuauacaaccaucaaaguggcaaaaauaaaaaaaaucaaguauuggcaaagaug

SEQ ID NO: 183101 - RNA, 64 nt, hsa
auagaaugagugaaucaccugugguauauuuauaaauaaaaauauuaaauagaagguaaaacaa

SEQ ID NO: 183102 - RNA, 64 nt, hsa
cauaaggucucacacuuuucuuauaaugcaauagaauaaaaaugacaacaaaguaaaaggguau

SEQ ID NO: 183103 - RNA, 64 nt, hsa
caaaucuaauaacauaguuguaaaugagagcaacaauaaaaaguagacaugggcugggugcagu

SEQ ID NO: 183104 - RNA, 64 nt, hsa
agccuggguaacacggggagacccgucuuuaguaaauaaaaauaaauuuauuaauaaaacuaaa

SEQ ID NO: 183105 - RNA, 64 nt, hsa
aaaauaaauuuauuaauaaaacuaaaaauuuaauaauaaaaaguggacauuguuuuuuaaaaug

SEQ ID NO: 183106 - RNA, 64 nt, hsa
augguaaugaaaauggaaugcagcuacugcagcuaauaaaaaauuuuagauagcaauuguuaca

SEQ ID NO: 183107 - RNA, 64 nt, hsa
uuuuccucccuuucucauguuuuuauaaauagguaauaaaaaauguuuugccugccaauugaau

SEQ ID NO: 183108 - RNA, 64 nt, hsa
aacugggaaacagcuuguguacuaaaguaaugagaauaaaaauguuggcccaaaauuacuuuua

SEQ ID NO: 183109 - RNA, 64 nt, hsa
ucuguuuacuauaguguagcuacuggcuucauuuaauaaaaauaaaugauuuugaaauuaaaua

SEQ ID NO: 183110 - RNA, 64 nt, hsa
uuauucuuaauucugaauuuugacauuuucacacaauaaaaauaauuuauaucaauauucuguu

SEQ ID NO: 183111 - RNA, 64 nt, hsa
cauaauaagagguguaaaaacuaucacaggaagaaauaaaaacagauuuuugaaggugagauga

SEQ ID NO: 183112 - RNA, 64 nt, hsa
uggacaacagagcaagacucugucucaaaaaaaaaauaaaaaauaaaaaauaaaaaauaaaaga

SEQ ID NO: 183113 - RNA, 64 nt, hsa
cagagcaagacucugucucaaaaaaaaaauaaaaaauaaaaaauaaaaaauaaaagaaacauaa

SEQ ID NO: 183114 - RNA, 64 nt, hsa
agacucugucucaaaaaaaaaauaaaaaauaaaaaauaaaaaauaaaagaaacauaagauaagu

SEQ ID NO: 183115 - RNA, 64 nt, hsa
cugagcaacauggcaaaacccugugucuacaaaaaauaaaaaauuagcugggcaugacggccag

SEQ ID NO: 183116 - RNA, 64 nt, hsa
acaaaagucaagauuuuauuaccaaacuuauagaaauaaaaauuauuagaaagaaauacuauga

SEQ ID NO: 183117 - RNA, 64 nt, hsa
gugacagugaugacugaagaaauauuuagcuauaaauaaaaauuuauacagcauguauaauuua

SEQ ID NO: 183118 - RNA, 64 nt, hsa
uuuauacagcauguauaauuuauuuuguauuaacaauaaaaauuccuaagacugagggaaauau

SEQ ID NO: 183119 - RNA, 64 nt, hsa
auauuucuuaggaaguauaggcuacuggacuuagaauaaaaaguccccaaacccaaacaaaugg

SEQ ID NO: 183120 - RNA, 64 nt, hsa
ugugccuauacauucauuugcuuuguacuauaaaaauaaaaaugauuucuuaaguuaaugacau

SEQ ID NO: 183121 - RNA, 64 nt, hsa
guaauuuuauaaaauccaccuccuccaaaaaagcaauaaaaaaaaaacaaacuauaauaagcuu

SEQ ID NO: 183122 - RNA, 64 nt, hsa
guccuauuuucauuuaaacacuuuauuuuugaguaauaaaaauauguaccacaauaaauuauug

SEQ ID NO: 183123 - RNA, 64 nt, hsa
auugauuaauuaacugggccuuuauacuuaacuaaauaaaaaacuaagcagauaugaguuaaau

SEQ ID NO: 183124 - RNA, 64 nt, hsa
aguugccauuguggaagaaauuauuugguacauuaauaaaaaaaguugguaaaacaugguuuua

SEQ ID NO: 183125 - RNA, 64 nt, hsa
ccuauuuugggguauaaacaugguguuuuucagaaauaaaaauuauuucauuaaccuuuacuau

SEQ ID NO: 183126 - RNA, 64 nt, hsa
accauguaccagaauuuuacuaggcacaaccaugaauaaaaauacaauucucuugcaccauuaa

SEQ ID NO: 183127 - RNA, 64 nt, hsa
ccaaacaggaaagaacuaugucugaaauauaaaaaauaaaaauaaaaaaacaacuaugaauaug

SEQ ID NO: 183128 - RNA, 64 nt, hsa
aggaaagaacuaugucugaaauauaaaaaauaaaaauaaaaaaacaacuaugaauaugcacaag

SEQ ID NO: 183129 - RNA, 64 nt, hsa
uuuuucuaguuuuuaauuuuaacaucagaacugaaauaaaaaauuauggauacguguuuugaau

SEQ ID NO: 183130 - RNA, 64 nt, hsa
uagugagaccuugucucuacaaaaaauaaaauaaaauaaaaaccaaauuagccagacauggugg

SEQ ID NO: 183131 - RNA, 64 nt, hsa
uugagaauguacuaaaaaccaaugaacuuuaaaaaauaaaaauaaacaaaaaaaauucaacaga

SEQ ID NO: 183132 - RNA, 64 nt, hsa
ugagauuccaguuuacaaucacuaggauggcuacaauaaaaagauggacaagaacgagugucgg

SEQ ID NO: 183133 - RNA, 64 nt, hsa
uaaaaauauguuccacuaccagccuuacuuguuuaauaaaaaucagugcaaagagaguuuuucu

SEQ ID NO: 183134 - RNA, 64 nt, hsa
uucucuaauaagggacuuauauguuuaugcauuaaauaaaaauauguuccacuaccagccuuac

SEQ ID NO: 183135 - RNA, 64 nt, hsa
acaguugugagcuuuaguuuaauguaauauuuguaauaaaaacguuuggccaggcaccauggcu

SEQ ID NO: 183136 - RNA, 64 nt, hsa
guaauaaauucccaaaacuaucauguugauuaaaaauaaaaaguaaccguaaccucacacauua

SEQ ID NO: 183137 - RNA, 64 nt, hsa
uaguacugugccgcuucccccuccccccacacaaaauaaaaacaguaucugccuucuggcucau

SEQ ID NO: 183138 - RNA, 64 nt, hsa
auacuuaguaaucgaaaaccauauccuguaauuuaauaaaaaaaacuaaggacgaaaaaacccu

SEQ ID NO: 183139 - RNA, 64 nt, hsa
guggagucuucuuuagugccaguccuugugguugaauaaaaaggaugguccgcuuucuauugag

SEQ ID NO: 183140 - RNA, 64 nt, hsa
aaacccacgcgaaugggcacuuguacccgaucauaauaaaaauggauaauaaugugaaggaaga

SEQ ID NO: 183141 - RNA, 64 nt, hsa
aaaauaauaauaauaauaauaaaguaaaaauaaaaauaaaaaaguaaucagaagcuaaaguaaa

SEQ ID NO: 183142 - RNA, 64 nt, hsa
aucucaaaaauaauaauaauaauaauaaaguaaaaauaaaaauaaaaaaguaaucagaagcuaa

SEQ ID NO: 183143 - RNA, 64 nt, hsa
gcacaguuugaugaagggcuagagagcuguuugcaauaaaaagucagguuuuuuuccugauuug

SEQ ID NO: 183144 - RNA, 64 nt, hsa
aauuucucuaauacugaccuuucuauucucuauuaauaaaaaauuaauacauacaauuauucaa

SEQ ID NO: 183145 - RNA, 64 nt, hsa
auguuauguauauuuuaccacaauaaaugcaaaaaauaaaaagucuguguucuaaacaauucuc

SEQ ID NO: 183146 - RNA, 64 nt, hsa
acccccauuuuaauuacuaugucuagguuuuuuaaauaaaaaucuuuucuuuuuaacauguuuc

SEQ ID NO: 183147 - RNA, 64 nt, hsa
augucuagauguaagugauuccacuuaaagccaaaauaaaaauuccuaaagcaguucuuaaagg

SEQ ID NO: 183148 - RNA, 64 nt, hsa
auuuuggacauacauaagaaacaucauuauaauuaauaaaaaguagguaauagcauauaaaugg

SEQ ID NO: 183149 - RNA, 64 nt, hsa
agaaaaaaaaaucuuuucaaaauuuacuuugucaaauaaaaauuuguuuuucagagauuuacca

SEQ ID NO: 183150 - RNA, 64 nt, hsa
aauauuuuguggcaaugaagaaaacacuacggaaaauaaaaaauaagauaaagccuuaugagcu

SEQ ID NO: 183151 - RNA, 64 nt, hsa
aucuguagaagacauuuugggaaacacugucuuaaauaaaaacucaauguuuaguuguuuuuuu

SEQ ID NO: 183152 - RNA, 64 nt, hsa
guauaaaacugucuuuuaagaauuauccuuucaaaauaaaaauguuauuguuucacuaguuuau

SEQ ID NO: 183153 - RNA, 64 nt, hsa
aaacuuugagaaauuauuucugaguugaccaauaaauaaaaauaccacuuucuuuaaaaaagcc

SEQ ID NO: 183154 - RNA, 64 nt, hsa
cuuccuacuuaggcaguucagagagaacaauucuaauaaaaacacuccucuccuauuaacaaaa

SEQ ID NO: 183155 - RNA, 64 nt, hsa
uuuaucaucuaauggcuguaaacuguaguacuagaauaaaaaaaauggaaaaucagcuuuuccu

SEQ ID NO: 183156 - RNA, 64 nt, hsa
uucuccucuaucuuagagggguauucuucuugaaaauaaaaaauauugaaaugcuguauuuuua

SEQ ID NO: 183157 - RNA, 64 nt, hsa
caucaucuguuuguaaucauuaucucacuuuguaaauaaaaacacaccuuaaaacaugaacaag

SEQ ID NO: 183158 - RNA, 64 nt, hsa
uguggcgaaacuccaucucuacaaaaaaugcaaaaauaaaaaauauaguacucaaguauucuug

SEQ ID NO: 183159 - RNA, 64 nt, hsa
aacuagaauuuguaaugcaaauggagcucagucuaauaaaaaagagguuuugguauuaaaaguu

SEQ ID NO: 183160 - RNA, 64 nt, hsa
uuauuaauguguaauacugagcacuuuacuucuuaauaaaaacuugauauaguagcagauguga

SEQ ID NO: 183161 - RNA, 64 nt, hsa
acguguuucugaaaaacagauuuucauaaguaauaauaaaaauaauaauaaaaaaguuuuggua

SEQ ID NO: 183162 - RNA, 64 nt, hsa
aaaacagauuuucauaaguaauaauaaaaauaauaauaaaaaaguuuugguaugguaagccuuu

SEQ ID NO: 183163 - RNA, 64 nt, hsa
cauucuaguaacuggccacuggaaaauaaauaaaaauaaaaacuaggguuuuaaaaguaucuuc

SEQ ID NO: 183164 - RNA, 64 nt, hsa
uaaaaacauucuaguaacuggccacuggaaaauaaauaaaaauaaaaacuaggguuuuaaaagu

SEQ ID NO: 183165 - RNA, 64 nt, hsa
caaaccacagagaaaauauuuauaacaugcaaaaaauaaaaacauucuaguaacuggccacugg

SEQ ID NO: 183166 - RNA, 64 nt, hsa
ucugaauuuugaguaucuucuguuguagaauaauaauaaaaagacuauuaagagcaauaaauua

SEQ ID NO: 183167 - RNA, 64 nt, hsa
uuuuuggcuucuuauuucuaaguagauagaaagcaauaaaaauacuaugaaaugaaagaacuug

SEQ ID NO: 183168 - RNA, 64 nt, hsa
uguuguucuugaugacauugcuucugcuaaauuuaauaaaaacuucagaaaaaccuccauuuug

SEQ ID NO: 183169 - RNA, 64 nt, hsa
uuuccaagaguguaccauuaacuugauuguugauaauaaaaacaaaaagcaagucuagcaauug

SEQ ID NO: 183170 - RNA, 64 nt, hsa
ugacuuguuuagaaaaaaaagacaaaaaaguaaaaauaaaaacaaaaaaguuggaaggcagaaa

SEQ ID NO: 183171 - RNA, 64 nt, hsa
auggcguacaaaucuuauuauuucuaaaaauaagaauaaaaagguaaaacuacauuuagacuuc

SEQ ID NO: 183172 - RNA, 64 nt, hsa
ggauguuuugaaagugagcauucauuuaaggauaaauaaaaaauaaaguaguaauaaagaauaa

SEQ ID NO: 183173 - RNA, 64 nt, hsa
ucuuuauguuuuaugaaaguguugcagucccuaaaauaaaaauauugaggaacauugcuuguau

SEQ ID NO: 183174 - RNA, 64 nt, hsa
gccugggugacagagugagacugucucaaaauaaaauaaaaauaacauauuggugaagaugcgg

SEQ ID NO: 183175 - RNA, 64 nt, hsa
aaaauuucacuaaauuuagagaaaugcacaugguaauaaaaaguauaaauuauaaaugcaauua

SEQ ID NO: 183176 - RNA, 64 nt, hsa
ucaaaccaacaaacucucuuaagguucaauauguaauaaaaaacauaacacaaauaauuauucu

SEQ ID NO: 183177 - RNA, 64 nt, hsa
guugacuuuguauauauauaaagaaaucuauuacaauaaaaauauaacauaaucuauucaucua

SEQ ID NO: 183178 - RNA, 64 nt, hsa
uguuuuaaauaaaaauaaagaaaagauuucccacaauaaaaagauuuuuacuggaaaaaaauca

SEQ ID NO: 183179 - RNA, 64 nt, hsa
aauacccacaaaacuuaaaauauaaaauguuuuaaauaaaaauaaagaaaagauuucccacaau

SEQ ID NO: 183180 - RNA, 64 nt, hsa
auguugaaaccaacugaacugccaacaaaauaaaaauaaaaagucuucacuauguagcauaccu

SEQ ID NO: 183181 - RNA, 64 nt, hsa
caauaaauguugaaaccaacugaacugccaacaaaauaaaaauaaaaagucuucacuauguagc

SEQ ID NO: 183182 - RNA, 64 nt, hsa
cagcauuuguauuuugcaucauuaaauaaaaagaaauaaaaauacuucuguauucuucagauaa

SEQ ID NO: 183183 - RNA, 64 nt, hsa
uauaucaagccagcauuuguauuuugcaucauuaaauaaaaagaaauaaaaauacuucuguauu

SEQ ID NO: 183184 - RNA, 64 nt, hsa
uugugaaguggaaauguucuaaagguggugaggcaauaaaaaucauaguacucuuuguagcaaa

SEQ ID NO: 183185 - RNA, 64 nt, hsa
gucagguaguugcaauugaauuaaauuaggaauaaauaaaaauggauacuggugcagucauuau

SEQ ID NO: 183186 - RNA, 64 nt, hsa
uuuauagaucuuuuaguuucaacucagcuuuuacaauaaaaaggauuuguauugcauugaguuu

SEQ ID NO: 183187 - RNA, 64 nt, hsa
uaacaucagauauuguucaacuagacuaggauuuaauaaaaauugugaaagcuuacuggccuaa

SEQ ID NO: 183188 - RNA, 64 nt, hsa
uuaauuuugugauauuccuuauuucauuucuacuaauaaaaauagacauguuuuguuugcauuu

SEQ ID NO: 183189 - RNA, 64 nt, hsa
cauagauucaaacaaucuuuuauucaaagauugaaauaaaaaguaucgggugccaacugugauu

SEQ ID NO: 183190 - RNA, 64 nt, hsa
aaacuauggguuauuuuuauuaaauguauuuuaaaauaaaaauuuaauucugguuuuucugauu

SEQ ID NO: 183191 - RNA, 64 nt, hsa
aaauguagaauugaaaaugcauuagggaaaacuuaauaaaaauuauuaccaguuauuuggaaga

SEQ ID NO: 183192 - RNA, 64 nt, hsa
gcucaagauacuuauugaaaacauccucaauugcaauaaaaacauuauaacaugaaaaagagug

SEQ ID NO: 183193 - RNA, 64 nt, hsa
gucuucgagauguagaaauaaggaauauucugaaaauaaaaauuauacaguaguaaagauaauu

SEQ ID NO: 183194 - RNA, 64 nt, hsa
caggagugcccugcauuguuuucuuuuaauuagaaauaaaaaguauuagucuaaaugugguucu

SEQ ID NO: 183195 - RNA, 64 nt, hsa
ucacagaaaugauauucugcaagaauuucuuuuaaauaaaaaguuugggggugcaauauaagaa

SEQ ID NO: 183196 - RNA, 64 nt, hsa
uugagacagacugaauauaucuaaaauuuccagcaauaaaaaaaaaagcauuuaacuugcacca

SEQ ID NO: 183197 - RNA, 64 nt, hsa
cuacgccaagcucugaagggcacacuacacuauuaauaaaaauggaaucauuaaauacucucuu

SEQ ID NO: 183198 - RNA, 64 nt, hsa
aauuauccuucuguucuuagaucuguaucuucauaauaaaaaauuuugcccaaguccuguuucc

SEQ ID NO: 183199 - RNA, 64 nt, hsa
gagccuacuucuagcuguauuuuuuguaugcuuaaauaaaaauaaaaauucauaaccaaagaga

SEQ ID NO: 183200 - RNA, 64 nt, hsa
acuucuagcuguauuuuuuguaugcuuaaauaaaaauaaaaauucauaaccaaagagaauccca

SEQ ID NO: 183201 - RNA, 64 nt, hsa
auguaacuuaaaucuagacaccaucaaagcauaaaauaaaaauaaaaagcguugcugaaucugg

SEQ ID NO: 183202 - RNA, 64 nt, hsa
cuuaaaucuagacaccaucaaagcauaaaauaaaaauaaaaagcguugcugaaucugggucgaa

SEQ ID NO: 183203 - RNA, 64 nt, hsa
auuauacuuuguacuuuugcccaaacguguaaauaauaaaaaaguuuuggcuuuuuucuuuaga

SEQ ID NO: 183204 - RNA, 64 nt, hsa
cuuuuccguuccuuuuauuuaagucuuuuuauuuaauaaaaaaguuagcuauuucacuuaacgc

SEQ ID NO: 183205 - RNA, 64 nt, hsa
cuucgugucauugugauauuugacaacucuaaaaaauaaaaaaaaaaaacuuagagcacaauaa

SEQ ID NO: 183206 - RNA, 64 nt, hsa
cauuugaugagcaaaaucuacuucuaguguuaggaauaaaaaaaaaagaccaguaacuuuguuu

SEQ ID NO: 183207 - RNA, 64 nt, hsa
cccacagagugccuagaaucuuaauaaugaauaaaauaaaaagcagcaauaugucauuaacaaa

SEQ ID NO: 183208 - RNA, 64 nt, hsa
ccccugagaucuagcugaugcuuagauccuuugaaauaaaaauuaugucuuuauaacucugauc

SEQ ID NO: 183209 - RNA, 64 nt, hsa
aaaauauuuauuauauugguaaaaauucugguuaaauaaaaaauuagagaucacucuuggcuga

SEQ ID NO: 183210 - RNA, 64 nt, hsa
auuuaauauuugacugauuucaauaacugugaaaaauaaaaaagguguuguauugcuugugaga

SEQ ID NO: 183211 - RNA, 64 nt, hsa
aaaaguuuacauuaauuauucaguguugugaguaaauaaaaaugugugcucuuuacuguuuuuc

SEQ ID NO: 183212 - RNA, 64 nt, hsa
ucagccugugcuguaguuaauguuaaguugcugaaauaaaaagugagcaaguaauagauuuucu

SEQ ID NO: 183213 - RNA, 64 nt, hsa
guuuuguuucuuagggaaaacagucugagaaaugaauaaaaagcaugaaguacgugugugugug

SEQ ID NO: 183214 - RNA, 64 nt, hsa
aggaauauauuuaauuauauucauauauuuaacaaauaaaaauauguugaauuuucguauuguu

SEQ ID NO: 183215 - RNA, 64 nt, hsa
gguuagcaaggcaagauccccaacucuacaaaaaaauaaaaauuaaaaaaaaauuauuaggcug

SEQ ID NO: 183216 - RNA, 64 nt, hsa
augucuuaauuuugaguuugaaaauguuaagugcaauaaaaacauacuaguacagauuuuguuu

SEQ ID NO: 183217 - RNA, 64 nt, hsa
acauaucaaaaaaaaccuguuuauugaaacaggaaauaaaaaagggaucuuuuacauuauagaa

SEQ ID NO: 183218 - RNA, 64 nt, hsa
cagaaagcauccaucaugaaugcaagauacuuucaauaaaaaguaaguuauauaguagguaguu

SEQ ID NO: 183219 - RNA, 64 nt, hsa
ugccuuugcuuuguucauaauuucagcagggcagaauaaaaaccaugggaggcaaagaaaggaa

SEQ ID NO: 183220 - RNA, 64 nt, hsa
cguaagcaggaagaccucuuaauggcauagcaccaauaaaaaaaugacuccuaguuguguuugg

SEQ ID NO: 183221 - RNA, 64 nt, hsa
gcaagagggcaaggcauuuuuuaacacuuuuuaaaauaaaaauuuauaccacaacuuuaggcua

SEQ ID NO: 183222 - RNA, 64 nt, hsa
ugcccuucuccgguuguguguacaguauguguggaauaaaaaagggaaacuguuuucacaagcu

SEQ ID NO: 183223 - RNA, 64 nt, hsa
guuuacuuuucagguuuguacuacaagguuuaauaauaaaaacaaaguuuuuuggacauuuguc

SEQ ID NO: 183224 - RNA, 64 nt, hsa
gggaagaaauacauuuccuaauguauuuauagaaaauaaaaauauuuuuaugugccuuuuuauu

SEQ ID NO: 183225 - RNA, 64 nt, hsa
auuaugaucuugacaggugcacuuuacuggggagaauaaaaaggaccauacgguaaagcuggua

SEQ ID NO: 183226 - RNA, 64 nt, hsa
aauuauugcuuuaauuagagcagcacauugcuaaaauaaaaaauacaccuuaauuuuuaagaaa

SEQ ID NO: 183227 - RNA, 64 nt, hsa
uuuaauucuuaaauauugaggccccauugugaguaauaaaaaauacgacauaaguagaagacua

SEQ ID NO: 183228 - RNA, 64 nt, hsa
agccuuaagucaaucucagaagguagcauaaacaaauaaaaauuaacuguauggcaugaucagu

SEQ ID NO: 183229 - RNA, 64 nt, hsa
ggaauuguauuauuguguguauauauaauuuguaaauaaaaaguauggagaugauacgguguua

SEQ ID NO: 183230 - RNA, 64 nt, hsa
gcuuuacuaaaagaacauaagucaagggaggaugaauaaaaacagcaaaaccaaauaaagugga

SEQ ID NO: 183231 - RNA, 64 nt, hsa
aaguuaaaagguuguacucauuguauuuacaaagaauaaaaauauauugaauuuaaaugaacuc

SEQ ID NO: 183232 - RNA, 64 nt, hsa
ccaauggguaagcccaugauguagccacuaguacaauaaaaaucugaaguaaaaugaggcauaa

SEQ ID NO: 183233 - RNA, 64 nt, hsa
ggccuaaguagccauuggcaugucuagaugaacaaauaaaaauaaagauaauuucuuuaaaaua

SEQ ID NO: 183234 - RNA, 64 nt, hsa
uagagaagacaguauuggcaaucaugacaccuguaauaaaaacuugaauccaaagucaaaacuu

SEQ ID NO: 183235 - RNA, 64 nt, hsa
aagaaccacuugaaaucggaucauuuuauuuaaaaauaaaaaauguuaaugccaguuggccuac

SEQ ID NO: 183236 - RNA, 64 nt, hsa
accuuuggggaaaauuuguauguaaauguacagaaauaaaaacguugccccauuaacagauuuc

SEQ ID NO: 183237 - RNA, 64 nt, hsa
cuggucaugaucucugaucuccaccucaaaugacaauaaaaaacugguccaacgaagacacugc

SEQ ID NO: 183238 - RNA, 64 nt, hsa
ugucuugagcaccagaaaauaaaauccauauauuaauaaaaaccuaucuugaaaaacuagugga

SEQ ID NO: 183239 - RNA, 64 nt, hsa
ugcuauaaguauguacauacaguuucacuucaaaaauaaaaaaaaaaucccuaaaaacucucua

SEQ ID NO: 183240 - RNA, 64 nt, hsa
aauguguauuuagaauauuuguauaacuguguaaaauaaaaaaggaauuauguggucagugcau

SEQ ID NO: 183241 - RNA, 64 nt, hsa
uuacaaaccugugggccuguugcaauacuuuaaaaauaaaaaauuuuauuccauuugcuuguuu

SEQ ID NO: 183242 - RNA, 64 nt, hsa
uuuucugucuugugaaugcacuugauaauuuaaaaauaaaaauaucuguuucucugcaguuuca

SEQ ID NO: 183243 - RNA, 64 nt, hsa
ugcccagauguauacccagugugaaauaucuucuaauaaaaauauauuuggcucuuaucccugc

SEQ ID NO: 183244 - RNA, 64 nt, hsa
aaaaaaaaacaaaaaaaaaaaaacaaaagaaaaaaauaaaaauacgguggcaauauuauguaac

SEQ ID NO: 183245 - RNA, 64 nt, hsa
cauuauguguaacagauugauuuucucagcacaaaauaaaaagcaucuguauuaauguaaagau

SEQ ID NO: 183246 - RNA, 64 nt, hsa
acccacguagguacuacugaauccaacugccaacaauaaaaagacuuuuauuuaguagaggcua

SEQ ID NO: 183247 - RNA, 64 nt, hsa
uguugcauguauauauuaaguagccgauacucuaaauaaaaauaccacuguuacagauaaaugg

SEQ ID NO: 183248 - RNA, 64 nt, hsa
uuauggaaaaugucaaccuuuguaagaaaaccaaaauaaaaauugaaaaauaaaaaccauaaac

SEQ ID NO: 183249 - RNA, 64 nt, hsa
aaccuuuguaagaaaaccaaaauaaaaauugaaaaauaaaaaccauaaacauuugcaccacuug

SEQ ID NO: 183250 - RNA, 64 nt, hsa
gauaacagagcgagacccugucucaaaaaaauaaaauaaaaaauaaaaacacccuugccugcgc

SEQ ID NO: 183251 - RNA, 64 nt, hsa
gagcgagacccugucucaaaaaaauaaaauaaaaaauaaaaacacccuugccugcgcuccauuc

SEQ ID NO: 183252 - RNA, 64 nt, hsa
gcaacaauuuaugaauugaauuaucuugguugaaaauaaaaagaucacuuucucaguuuucaua

SEQ ID NO: 183253 - RNA, 64 nt, hsa
cuuugcccagaaagaagaugggggaggaggcaguaauaaaaagauugaaguauuuugcuggaau

SEQ ID NO: 183254 - RNA, 64 nt, hsa
ucaugcauguccuguaaagguuacaagccugcacaauaaaaauguuuaacgguuaaacagucag

SEQ ID NO: 183255 - RNA, 64 nt, hsa
uaacaaucagaggaacuauaagaacaccuuuagaaauaaaaauacugggaucaaacuggccugc

SEQ ID NO: 183256 - RNA, 64 nt, hsa
gacagucuagagacucuggagcuggauaacuaaaaauaaaaauauaugccaaagauuuucuugg

SEQ ID NO: 183257 - RNA, 64 nt, hsa
aaugaaagcaucaacagauaauuuuaaauugauaaauaaaaagcacaguuucaaaugguaucac

SEQ ID NO: 183258 - RNA, 64 nt, hsa
aaagccaguauuguuaaaauaccauuuuauacaaaauaaaaagcugcucucacugucagcucuc

SEQ ID NO: 183259 - RNA, 64 nt, hsa
caauugaaauguaaaugucuguguaaaacuacaaaauaaaaacucuuagacuuuagggagaaaa

SEQ ID NO: 183260 - RNA, 64 nt, hsa
acccuauauaaaaaucauuggcacaguuacacuuaauaaaaaaaauuaaacagaagagcacccu

SEQ ID NO: 183261 - RNA, 64 nt, hsa
auuuguuacguaaaguuaaaaugauuuuugucugaauaaaaaaaaagcauugcaaaugcuuuag

SEQ ID NO: 183262 - RNA, 64 nt, hsa
auuaucuuuucauaucugcaagauuuuuuucaucaauaaaaauuauccuugaaacaagugagcu

SEQ ID NO: 183263 - RNA, 64 nt, hsa
aaaagaaaaucguaaaaacagaaaaugucauaggaauaaaaaaauuaucuuuucauaucugcaa

SEQ ID NO: 183264 - RNA, 64 nt, hsa
cccuuggaauugucucuaaaugcaucaagcauacaauaaaaaaaacugaaauuaacauccagug

SEQ ID NO: 183265 - RNA, 64 nt, hsa
uguuagauggaaaaugcuauuggcagggaauaauaauaaaaaaaaaagaaaaucauucuguuuc

SEQ ID NO: 183266 - RNA, 64 nt, hsa
uaaaauaugaaauuuuguaagauguuuucaccuaaauaaaaauugaaagcaaguggauuacaca

SEQ ID NO: 183267 - RNA, 64 nt, hsa
uacaucaaguucauuugcagaaacaaauaacugaaauaaaaaacauguuaauccuuguaucaua

SEQ ID NO: 183268 - RNA, 64 nt, hsa
uauaacacagucuuuaauuuucacucacuguggaaauaaaaacuaagguaacuucucagaaaga

SEQ ID NO: 183269 - RNA, 64 nt, hsa
auucaccuaagaauagaaucucagcauuguguuaaauaaaaaugaaagcuuuagaaggcaugag

SEQ ID NO: 183270 - RNA, 64 nt, hsa
uuuagcuuucauaagaaaucccauggcaaaggguaauaaaaaggaccuaaucuuaaaaauacaa

SEQ ID NO: 183271 - RNA, 64 nt, hsa
aaacauaggcuaauauagauuaaauugaauauugaauaaaaaauauauuuauuuauccacaucu

SEQ ID NO: 183272 - RNA, 64 nt, hsa
cacaccagaguucuauuuaccucaucuugguaucaauaaaaacuuauguggaagguaaauauau

SEQ ID NO: 183273 - RNA, 64 nt, hsa
aguauucuauaguaagcuuuauauuaagcaaaucaauaaaaaccucuuuacaaaaguauuauug

SEQ ID NO: 183274 - RNA, 64 nt, hsa
uuaacauuucucaauaauuucaaccacaaucauuaauaaaaauaggaauuauuuugauggcucu

SEQ ID NO: 183275 - RNA, 64 nt, hsa
uagucuaucuuuguauaucuuugaacuuuucaagaauaaaaaagcuuaaaaaguauacauggcc

SEQ ID NO: 183276 - RNA, 64 nt, hsa
aauggcaaauuguauguuauaccuauuuuacuacaauaaaaaguauaaaaaagagaagauauuu

SEQ ID NO: 183277 - RNA, 64 nt, hsa
ugcuuaaaucagaguaaaaugucagcuuuacaauaauaaaaaaaggacuuugguuuaaaguagc

SEQ ID NO: 183278 - RNA, 64 nt, hsa
aguucagacucauauauggauuucaaaucuuuguaauaaaaauuauuuguauuuuuaaguuuuu

SEQ ID NO: 183279 - RNA, 64 nt, hsa
uugcuuauuuuuucuguuuuuggaaauaauuuguaauaaaaaucauggcaacauaauucacuuu

SEQ ID NO: 183280 - RNA, 64 nt, hsa
auuuguaccuauaaagcauaaggcauuaaaugacaauaaaaauuccaaauggacuauuuguucc

SEQ ID NO: 183281 - RNA, 64 nt, hsa
auauucuccugcuccaguauaacagcuugcaggcaauaaaaaucuauuugcucauaacuacuuc

SEQ ID NO: 183282 - RNA, 64 nt, hsa
uccuuguaauuacauucauuguuuguuuuggccaaauaaaaaugcuuguauuucuuuaaaaagu

SEQ ID NO: 183283 - RNA, 64 nt, hsa
gccacccuagaucagcugaaacucuaagcacaaaaauaaaaacuuaucacuguauaccacugga

SEQ ID NO: 183284 - RNA, 64 nt, hsa
uuuucagaacuuguuuacucauuuauaauaugggaauaaaaauuugugcaagucagagaagggu

SEQ ID NO: 183285 - RNA, 64 nt, hsa
agccugggcaacggugagacccugccucaaaaaaaauaaaaauaaaaauaaaacacuuuaauua

SEQ ID NO: 183286 - RNA, 64 nt, hsa
ggcaacggugagacccugccucaaaaaaaauaaaaauaaaaauaaaacacuuuaauuagaaucu

SEQ ID NO: 183287 - RNA, 64 nt, hsa
aaaaggcaaggcacaacaaaaaaauauccugggcaauaaaaaaaauauuuuaaaccagcuuugg

SEQ ID NO: 183288 - RNA, 64 nt, hsa
acuagcaaucuauaaagugcaccaggucaacuugaauaaaaacacuaugacagacagguuugcc

SEQ ID NO: 183289 - RNA, 64 nt, hsa
gcauggggguuaagcugauguuaaaacaguuugcaauaaaaaaaaaugaaucagcuuaagucau

SEQ ID NO: 183290 - RNA, 64 nt, hsa
caccauuugguccucuuuaaucuuugaggguuucaauaaaaauuguucacucauaucuguguuc

SEQ ID NO: 183291 - RNA, 64 nt, hsa
uauuucaaagcucuuuuccuaacugguuaaguaaaauaaaaaauugagcuuucuagaauauuug

SEQ ID NO: 183292 - RNA, 64 nt, hsa
aaaaagagagaguaacuacagaagaacuuuaaaaaauaaaaaauaagcuuaccuuggauucuug

SEQ ID NO: 183293 - RNA, 64 nt, hsa
uuuuguuuuucacaaagcucuuauuaugaagcaaaauaaaaauucuaguuucuuguaugauuuu

SEQ ID NO: 183294 - RNA, 64 nt, hsa
uguaggagugaagacaggaucccgugcuuaaaaaaauaaaaaauaaaaaaauaaaaaaaaaaua

SEQ ID NO: 183295 - RNA, 64 nt, hsa
gugaagacaggaucccgugcuuaaaaaaauaaaaaauaaaaaaauaaaaaaaaaauaagacuuu

SEQ ID NO: 183296 - RNA, 64 nt, hsa
aggaucccgugcuuaaaaaaauaaaaaauaaaaaaauaaaaaaaaaauaagacuuuaacugcag

SEQ ID NO: 183297 - RNA, 64 nt, hsa
ugcuucucgggaaagcaaagaagcugcuuuaaaaaauaaaaaggggacuaaaaauuuguuuugu

SEQ ID NO: 183298 - RNA, 64 nt, hsa
ugcucaacaagcucagaaauuaaauauuuuuaauaauaaaaaucuguucugguuauaaaccuug

SEQ ID NO: 183299 - RNA, 64 nt, hsa
uaaaaccccauuuuccuaaagaacaaaguaguaaaauaaaaaaaaauuuaaaaaauuaaaaaau

SEQ ID NO: 183300 - RNA, 64 nt, hsa
guaguaaaauaaaaaaaaauuuaaaaaauuaaaaaauaaaaaaaagaggucacuaaaagaccaa

SEQ ID NO: 183301 - RNA, 64 nt, hsa
gucaauuauuuucaaaugucuaaauuccuuuggaaauaaaaauaucaguuuuacuuugaaauug

SEQ ID NO: 183302 - RNA, 64 nt, hsa
auaugcacagucuauuuuuuguauaguauuggaaaauaaaaaugcuauaauuuggguauggguu

SEQ ID NO: 183303 - RNA, 64 nt, hsa
ggguuggugauaacucuugaggauguaaugcauuaauaaaaaucaacucaucauuuucuacuug

SEQ ID NO: 183304 - RNA, 64 nt, hsa
aaagcagaauuuguuugauaccuaacaagauuucaauaaaaauccaaacuuuguauguacguuu

SEQ ID NO: 183305 - RNA, 64 nt, hsa
acaucuuaacuguauaugaacauuucacgaggacaauaaaaauaagacauugaaggaccaauuu

SEQ ID NO: 183306 - RNA, 64 nt, hsa
ggaaacguaauuuggauuauaaaauucuugcuuuaauaaaaauuccuuaaacagugcacggauu

SEQ ID NO: 183307 - RNA, 64 nt, hsa
auuauggaaaaaaaacauugcaaaauauaaaauaaauaaaaaaaggaaaggaaacuuugaaccu

SEQ ID NO: 183308 - RNA, 64 nt, hsa
uaauauccucuuagggaacauaagaaaaauguauaauaaaaauguggugcuuaauuaaccauga

SEQ ID NO: 183309 - RNA, 64 nt, hsa
uuuuauaugaaagauguacaauucaguguuuaaaaauaaaaauauuuauuguguacucuguucg

SEQ ID NO: 183310 - RNA, 64 nt, hsa
ugacagagcaagacuccaucucaaaaaaaaaauaaauaaaaaaaaaugcagcugcaggagugag

SEQ ID NO: 183311 - RNA, 64 nt, hsa
ccuggcucacaggaagugcucagauauguuaaguaauaaaaaguuaauguggugggugcagugg

SEQ ID NO: 183312 - RNA, 64 nt, hsa
gacuguuucagugugagucagaaugugaaaaaggaauaaaaaauacuguugggcucaaacuaaa

SEQ ID NO: 183313 - RNA, 64 nt, hsa
aaaagcacauguauugacaacaguuuuauaauuuaauaaaaaggaauacauugcaauccguaau

SEQ ID NO: 183314 - RNA, 64 nt, hsa
aagauuuacaucuuucuuacuaaggaaaagaguuaauaaaaauuguucuuuauuuuacaggcag

SEQ ID NO: 183315 - RNA, 64 nt, hsa
ucgauugaauuggaccuuuucaguuguucagaaaaauaaaaauaauuucucauauuaaauacag

SEQ ID NO: 183316 - RNA, 64 nt, hsa
uaaucaggcuauacauaaguauuguauuuauuugaauaaaaauaaaaagagcaacccauaaucc

SEQ ID NO: 183317 - RNA, 64 nt, hsa
ggcuauacauaaguauuguauuuauuugaauaaaaauaaaaagagcaacccauaauccuagucc

SEQ ID NO: 183318 - RNA, 64 nt, hsa
ucuuguuuauuaacucuccuuuauucuauauggaaauaaaaaggaggcagucauguuagcaaau

SEQ ID NO: 183319 - RNA, 64 nt, hsa
uuuuugucgugucuauaaaggaagaacaaaacaaaauaaaaacagagcccuagagaaaugcugu

SEQ ID NO: 183320 - RNA, 64 nt, hsa
uuguguuuuuuucuggaacuacuucaagugagaaaauaaaaaaaaauggugacaaagcuguaca

SEQ ID NO: 183321 - RNA, 64 nt, hsa
auagagauaauagaagacaaagagauuaaaaggaaauaaaaaugcaugauuaaaaacuaagaau

SEQ ID NO: 183322 - RNA, 64 nt, hsa
aaaaggaaauaaaaaugcaugauuaaaaacuaagaauaaaaaaccuauuuuuauguuuccuaaa

SEQ ID NO: 183323 - RNA, 64 nt, hsa
uuucuaccauuacugaacauuaggacaaacacaaaauaaaaaacaaaacacagacaacggugcu

SEQ ID NO: 183324 - RNA, 64 nt, hsa
ucugaccauuucuuguucuguuuccaaugaaaucaauaaaaaaaaagaaguacuuuaaaugggg

SEQ ID NO: 183325 - RNA, 64 nt, hsa
uagcaaucaaucauaauuaguaaacagguguaccaauaaaaagaauuuacaugauagguuaaca

SEQ ID NO: 183326 - RNA, 64 nt, hsa
auaaauaacaaguuauaguaccaucucccccgccaauaaaaaagagaagaaaaaagagaaaccc

SEQ ID NO: 183327 - RNA, 64 nt, hsa
acauauucugcaucccucacugaauucaguaauaaauaaaaauguguacaugugauuaaaagaa

SEQ ID NO: 183328 - RNA, 64 nt, hsa
uaguauguaaauuauauuucaacaaagcuguuuuaauaaaaaaaggaaaaauguguuuacuaua

SEQ ID NO: 183329 - RNA, 64 nt, hsa
uguaauauuuagcuguaaacugaauauaaagcuuaauaaaaacaaccuugcaugauucuuguua

SEQ ID NO: 183330 - RNA, 64 nt, hsa
gccuucugaaaugugacccccaaguccuauccuaaauaaaaaaagacaaauucggauguaugau

SEQ ID NO: 183331 - RNA, 64 nt, hsa
cccuaaucugcauaaaugaauuagaacugauuuuaauaaaaauauucuguguaaaaaguacuca

SEQ ID NO: 183332 - RNA, 64 nt, hsa
agccugggcaacauagcgagacuccaucucuauaaauaaaaaaaaaggaaaugcauuaaauaga

SEQ ID NO: 183333 - RNA, 64 nt, hsa
uccguaagacccaauaguuacuguacaucccauaaauaaaaaauacuuuaguuugcuaaccaac

SEQ ID NO: 183334 - RNA, 64 nt, hsa
aucuguauuaaaaauaaaauuaauaaaaguaaaaaauaaaaauagaaacacaacucuacuagua

SEQ ID NO: 183335 - RNA, 64 nt, hsa
cuuuuugacagcuuuuugagaccucuuaagaaaaaauaaaaaguaaaaaaugaaaggaaucuuu

SEQ ID NO: 183336 - RNA, 64 nt, hsa
gguuucugcuguauuaaugacaauuauucaugaaaauaaaaaaugaaauauuuuguauacuacu

SEQ ID NO: 183337 - RNA, 64 nt, hsa
gaacccuuccugagcuuuaugguccuaaaagcaaaauaaaaacuauucgaaugaaaagacaaga

SEQ ID NO: 183338 - RNA, 64 nt, hsa
aucaacuuugaagacacaaaaguuaauuggaagaaauaaaaacugugaacgaagaauaccuuuc

SEQ ID NO: 183339 - RNA, 64 nt, hsa
accuagaucauaaauuaaucaaaaugcacuuuuuaauaaaaacugauacuuaaaauaaauggcu

SEQ ID NO: 183340 - RNA, 64 nt, hsa
gauauuuguauuguaaaacaauaauggugaaggaaauaaaaaggcuuuuaaaauuuuguuuguu

SEQ ID NO: 183341 - RNA, 64 nt, hsa
ucugaaaucuuucuaccuguugcaccgauauucaaauaaaaaugauagacacagaaagguuugg

SEQ ID NO: 183342 - RNA, 64 nt, hsa
caguuguuuucuuuuuuuaaauugaguuaugacaaauaaaaaauugcauauauuuaagguguac

SEQ ID NO: 183343 - RNA, 64 nt, hsa
uuacuaguuucauucuaaucaagaugucaaauugaauaaaaaucacagcaaucucugauucugu

SEQ ID NO: 183344 - RNA, 64 nt, hsa
uuugugaauuguguauaaauuuauucuaacauuuaauaaaaauguauuuuaaccuauuugggaa

SEQ ID NO: 183345 - RNA, 64 nt, hsa
guugauaccuugcaauaguauugcuucugaaaguaauaaaaaauuuuaggagaauuugagaagu

SEQ ID NO: 183346 - RNA, 64 nt, hsa
gauuauacugaguaguagaaagaagcuaauuugaaauaaaaauuauuuguauaauuaagaaagc

SEQ ID NO: 183347 - RNA, 64 nt, hsa
cuguagguauuugucuuaagauuuuuggcuguuuaauaaaaauguaacuuuaacgguuucuuau

SEQ ID NO: 183348 - RNA, 64 nt, hsa
guacacauaagugugugugucucaggaaguaggaaauaaaaauggaagcuauuaugaccucaaa

SEQ ID NO: 183349 - RNA, 64 nt, hsa
gauguaaacuugauuauuuuauugcuaauuuaaaaauaaaaaugacuuuguauugauugugaaa

SEQ ID NO: 183350 - RNA, 64 nt, hsa
cuugacuuuaacaucagcauuauaaaaagugucaaauaaaaaauuaccaucauuaucauuaaaa

SEQ ID NO: 183351 - RNA, 64 nt, hsa
acuacuuugucgguugcucugaggguuaaaugaaaauaaaaagaaaaugugaaacagcaccaca

SEQ ID NO: 183352 - RNA, 64 nt, hsa
ccggccuacaagaacaaaacuccaucucaaaauaaauaaaaaaauaaauaaaaauaaaaauaga

SEQ ID NO: 183353 - RNA, 64 nt, hsa
aacaaaacuccaucucaaaauaaauaaaaaaauaaauaaaaauaaaaauagacuauauauaguc

SEQ ID NO: 183354 - RNA, 64 nt, hsa
acuccaucucaaaauaaauaaaaaaauaaauaaaaauaaaaauagacuauauauagucuuugaa

SEQ ID NO: 183355 - RNA, 64 nt, hsa
gaauucauuuauuuuaaauaaaugaauaaaauaaaauaaaaaagaauauucagucguuggcaca

SEQ ID NO: 183356 - RNA, 64 nt, hsa
aauuuccuuaggagugcagagggcucauugggaaaauaaaaauaauaaaaauaaauaaaacuuc

SEQ ID NO: 183357 - RNA, 64 nt, hsa
aggagugcagagggcucauugggaaaauaaaaauaauaaaaauaaauaaaacuuccuaaaagaa

SEQ ID NO: 183358 - RNA, 64 nt, hsa
agcaagacuccgucucacaaaaaugaauaaauaaaauaaaaauaaaaauguuacuuuuuaaaaa

SEQ ID NO: 183359 - RNA, 64 nt, hsa
acuccgucucacaaaaaugaauaaauaaaauaaaaauaaaaauguuacuuuuuaaaaaguaacu

SEQ ID NO: 183360 - RNA, 64 nt, hsa
aaauuuugucaauuucauguaauuuacccuuugcaauaaaaaugauucauuaaauauauaacua

SEQ ID NO: 183361 - RNA, 64 nt, hsa
uguaacaagccugcacauguaccccagaaucuaaaauaaaaauaaaaagaaaaacaaagaaugu

SEQ ID NO: 183362 - RNA, 64 nt, hsa
aagccugcacauguaccccagaaucuaaaauaaaaauaaaaagaaaaacaaagaauguacucua

SEQ ID NO: 183363 - RNA, 64 nt, hsa
gccaucagagcaaauuuggggguuucucaaauaaaauaaaaauaaaaacaaauacuguguuuca

SEQ ID NO: 183364 - RNA, 64 nt, hsa
agagcaaauuuggggguuucucaaauaaaauaaaaauaaaaacaaauacuguguuucagaagcg

SEQ ID NO: 183365 - RNA, 64 nt, hsa
agaggcaagaggcuggauuuugaauuuucuuuuuaauaaaaaggcaccuauaaaacaggucaau

SEQ ID NO: 183366 - RNA, 64 nt, hsa
gagacccccggaacaagccuaaaaauuguuucaaaauaaaaaccaagaagaugucuucacauau

SEQ ID NO: 183367 - RNA, 64 nt, hsa
aaacaacaacaaaaacaaaaaaagaagaaaacuaaauaaaaauaaaaauaaaaauaagauccac

SEQ ID NO: 183368 - RNA, 64 nt, hsa
caacaaaaacaaaaaaagaagaaaacuaaauaaaaauaaaaauaaaaauaagauccacuucucu

SEQ ID NO: 183369 - RNA, 63 nt, hsa
aaacaaaaaaagaagaaaacuaaauaaaaauaaaaauaaaaauaagauccacuucucucugcc

SEQ ID NO: 183370 - RNA, 64 nt, hsa
aguaaccuuauauuuaaaagaugauuuugcaaaaaauaaaaaauaaaaaauaugccuucuggag

SEQ ID NO: 183371 - RNA, 64 nt, hsa
uuauauuuaaaagaugauuuugcaaaaaauaaaaaauaaaaaauaugccuucuggagugauguc

SEQ ID NO: 183372 - RNA, 64 nt, hsa
auuguaaauagucuuuguuguacauugucaguguaauaaaaacagaaucuuuguauaucaaaau

SEQ ID NO: 183373 - RNA, 64 nt, hsa
guugaacucugguuaaacaagauaauauguuauuaauaaaaauagaagaagaaagaauaaagcu

SEQ ID NO: 183374 - RNA, 64 nt, hsa
ugugacacuuuggagcaaaaaccuugcagugguaaauaaaaaauuuccaacagggucagcugcc

SEQ ID NO: 183375 - RNA, 64 nt, hsa
gaauuuuaaauuauccagagaugucaaacugccaaauaaaaauauuucaguagucuuugcauca

SEQ ID NO: 183376 - RNA, 64 nt, hsa
ugcuaccacagagauuguacuauacaaauaaaaaaauaaaaacccaaccucaagcugucacccu

SEQ ID NO: 183377 - RNA, 64 nt, hsa
uauauuucugcuaccacagagauuguacuauacaaauaaaaaaauaaaaacccaaccucaagcu

SEQ ID NO: 183378 - RNA, 64 nt, hsa
aaaucuauucacuuuaacuuauaauaguuuaugaaauaaaaacaugagucacagcuuuuguucu

SEQ ID NO: 183379 - RNA, 64 nt, hsa
gucuuaacuugaccugggauaacuacuuuaaagaaauaaaaaauuccagucaauuauuccucaa

SEQ ID NO: 183380 - RNA, 64 nt, hsa
cuucuauucaaaaucuuuuuuuuauuuuuaagggaauaaaaauuuuaaaaauuaagagauauac

SEQ ID NO: 183381 - RNA, 64 nt, hsa
aaucaugugagaacucaggaagagguagagcagaaauaaaaaggaagaaaauguagauuagaaa

SEQ ID NO: 183382 - RNA, 64 nt, hsa
agagugagacuccaucucaaaaacugaaaauaaaaauaaaaauauguauucuccuaacugaaau

SEQ ID NO: 183383 - RNA, 64 nt, hsa
ggugacagagugagacuccaucucaaaaacugaaaauaaaaauaaaaauauguauucuccuaac

SEQ ID NO: 183384 - RNA, 64 nt, hsa
acacacacacacacacaaacauauaaccuaugccaauaaaaaugucucagcaacaguggaauuc

SEQ ID NO: 183385 - RNA, 64 nt, hsa
cuggaacagugucuggugcacauaauaggugcucaauaaaaauguguucaauggaugaauuucu

SEQ ID NO: 183386 - RNA, 64 nt, hsa
cauucccaggaaaauacgaaaaucccaugagauaaauaaaaauauaggugaugggcagaucuuu

SEQ ID NO: 183387 - RNA, 64 nt, hsa
aaaaauauaggugaugggcagaucuuuucuuuaaaauaaaaaagcaaaaacucuugugguaccu

SEQ ID NO: 183388 - RNA, 64 nt, hsa
uaaaauccugcuauaggagaaaaaaagagaaaaaaauaaaaaucaaaaaaaaaaaaaagaaaga

SEQ ID NO: 183389 - RNA, 64 nt, hsa
ccaaguacuuuguauuguauacgugagucauaauaauaaaaagaagaagaaaaauaauagaagc

SEQ ID NO: 183390 - RNA, 64 nt, hsa
cuaagcugagaaguagauuguuacccaguaaugaaauaaaaaauaaaaauaaaaggauuuuuuu

SEQ ID NO: 183391 - RNA, 64 nt, hsa
gagaaguagauuguuacccaguaaugaaauaaaaaauaaaaauaaaaggauuuuuuucucuauu

SEQ ID NO: 183392 - RNA, 64 nt, hsa
ggcagcuaaauuuuucaguuccaugugccucccaaauaaaaaacagaaaauaaguaguuuuugu

SEQ ID NO: 183393 - RNA, 64 nt, hsa
aagaauccugacuuuuuuauauuuggaaacaucaaauaaaaauggaaaaaaugaucauggcuuu

SEQ ID NO: 183394 - RNA, 64 nt, hsa
uaucaugcuauacaggugcaacucaauccccguuaauaaaaaccaauguagguauaggcauucu

SEQ ID NO: 183395 - RNA, 64 nt, hsa
uuuacugcuguuacuauuugauuagaauguauuaaauaaaaaaaaccugauuucuacaaguugc

SEQ ID NO: 183396 - RNA, 64 nt, hsa
ugguggugaggaggaagaacaaauaauagaagaaaauaaaaaugagauagaagaaaaguaagaa

SEQ ID NO: 183397 - RNA, 64 nt, hsa
uuuguuuauaccagucuuaaagauccagguucugaauaaaaaaauuaauugauacaauugaugu

SEQ ID NO: 183398 - RNA, 64 nt, hsa
acuuauugugaaaguugugcuguuuucuaaguaaaauaaaaaauaaaaaauuagcaauuuauga

SEQ ID NO: 183399 - RNA, 64 nt, hsa
gugaaaguugugcuguuuucuaaguaaaauaaaaaauaaaaaauuagcaauuuaugauagccag

SEQ ID NO: 183400 - RNA, 64 nt, hsa
ccuuugagccuauacuauacuguguauguguggaaauaaaaauguauuguacuuuuggagaauu

SEQ ID NO: 183401 - RNA, 64 nt, hsa
acaguugugcaagauaugaaugguuucacacucaaauaaaaaauauugaaacgaccugcuuucu

SEQ ID NO: 183402 - RNA, 64 nt, hsa
uuucgacacuggacuggaagaacaagucuauaaaaauaaaaauggacaauuaacaguggugagu

SEQ ID NO: 183403 - RNA, 64 nt, hsa
guuggagaacgaaugaauacaaauuuuauuguaaaauaaaaauguauauaaagcauaugagcac

SEQ ID NO: 183404 - RNA, 64 nt, hsa
acugucaugcucaugcaugaauagaauuuagucaaauaaaaaauuuuggucauuugguacugac

SEQ ID NO: 183405 - RNA, 64 nt, hsa
uauggaugaaaguauucaucacaauauuauuuauaauaaaaaauugcaaauguuauaaaugaac

SEQ ID NO: 183406 - RNA, 64 nt, hsa
aaaugugaacacugaauuuauuuuaaaaaauaauaauaaaaauuuaaaaaaauuaaaaauaaaa

SEQ ID NO: 183407 - RNA, 64 nt, hsa
uaaaaaauaauaauaaaaauuuaaaaaaauuaaaaauaaaaaaaaccacagaaaacaacuuuac

SEQ ID NO: 183408 - RNA, 64 nt, hsa
uguaguacuacuuaaaagcaugucggaauauaagaauaaaaaggauuaugggaggggaacauua

SEQ ID NO: 183409 - RNA, 64 nt, hsa
aaaauguaaccccuuuuuccuuucuucuguuuaaaauaaaaauaaaauuuaucucagcuucugu

SEQ ID NO: 183410 - RNA, 64 nt, hsa
gauuuucuauuguuacucugguucuuuguuuuaaaauaaaaauucugaauguacacgacauuau

SEQ ID NO: 183411 - RNA, 64 nt, hsa
guucucacuguucccucugcuccuggagccuuugaauaaaaaugcacguagcugaggccggaug

SEQ ID NO: 183412 - RNA, 64 nt, hsa
aauauuuauuuuuuuaagcguaauuuugccaaauaauaaaaacagaaggaaauugagauuagag

SEQ ID NO: 183413 - RNA, 64 nt, hsa
gucugauccauauuuaauaaugcuuuaaaauaaaaauaaaaacaauccuuuugauaaauuuaaa

SEQ ID NO: 183414 - RNA, 64 nt, hsa
uuucaagucugauccauauuuaauaaugcuuuaaaauaaaaauaaaaacaauccuuuugauaaa

SEQ ID NO: 183415 - RNA, 64 nt, hsa
gauuuguuaguaacaaucuugaagagcuaauuuuaauaaaaauaagaaaaauuaauacuaucau

SEQ ID NO: 183416 - RNA, 64 nt, hsa
gaacuuagugauuaaaaucuugccccagcacaguaauaaaaaucaagauuuguuaguaacaauc

SEQ ID NO: 183417 - RNA, 64 nt, hsa
gggaauaaagugcuaaaguguaaaaaaaaauaaaaauaaaaauaaauaaauaaauaaaauuaaa

SEQ ID NO: 183418 - RNA, 64 nt, hsa
acuucagggaauaaagugcuaaaguguaaaaaaaaauaaaaauaaaaauaaauaaauaaauaaa

SEQ ID NO: 183419 - RNA, 64 nt, hsa
ggugacagagcgagaccaugucucaaaaaauaaaaauaaaaaaaaauuguuuucauuaccucag

SEQ ID NO: 183420 - RNA, 64 nt, hsa
agccugggugacagagcgagaccaugucucaaaaaauaaaaauaaaaaaaaauuguuuucauua

SEQ ID NO: 183421 - RNA, 64 nt, hsa
agugcagcuguagaaaagugcuugucaguuguugaauaaaaaaaaccacauuugauagagauuc

SEQ ID NO: 183422 - RNA, 64 nt, hsa
ugacaagaguauuugguagggaaagcagguuuaaaauaaaaagacaacccacccccugcccuuu

SEQ ID NO: 183423 - RNA, 64 nt, hsa
auuuuuaggaaaauauuaagcuuuauaaaauagcaauaaaaaauaauucauuuaagaagagaug

SEQ ID NO: 183424 - RNA, 64 nt, hsa
cugaacuaaaacugauggguucccuaucaaaacaaauaaaaauauaccuuuuucagguuucaau

SEQ ID NO: 183425 - RNA, 64 nt, hsa
ucuuuauauuugauuguguuuuuuggauuuucuaaauaaaaauauugaaugcuuucuaacaaaa

SEQ ID NO: 183426 - RNA, 64 nt, hsa
auuaacacuaaagaaaacaauuacauucuuauacaauaaaaaggacacauuuguguauguuuaa

SEQ ID NO: 183427 - RNA, 64 nt, hsa
uaguaaagcuuuucuuuuuuaauuuccaggaaaaaauaaaaagaguaugagucuucuguaauuc

SEQ ID NO: 183428 - RNA, 64 nt, hsa
uaaagccaaauuuccaguuuaaguaauugccuacaauaaaaagaaauuuugccugccauuuuca

SEQ ID NO: 183429 - RNA, 64 nt, hsa
guuagaccucaucucuacaaaaauaaaaaauaaaaauaaaaaaaacuuagcuaggcauguugcc

SEQ ID NO: 183430 - RNA, 64 nt, hsa
aacauaguuagaccucaucucuacaaaaauaaaaaauaaaaauaaaaaaaacuuagcuaggcau

SEQ ID NO: 183431 - RNA, 64 nt, hsa
gccuggaaacauaguuagaccucaucucuacaaaaauaaaaaauaaaaauaaaaaaaacuuagc

SEQ ID NO: 183432 - RNA, 64 nt, hsa
gacuauuauuaucuuuguaauaaauuaaccuagcaauaaaaaauauucuguuucuuucguuaga

SEQ ID NO: 183433 - RNA, 64 nt, hsa
ggucuaguuucgguaacuguuccagacaucaagcaauaaaaaaaugaauaccacaaaagauguu

SEQ ID NO: 183434 - RNA, 64 nt, hsa
uaauauaaaauaaaaacuuaaaaaaaauuuaaaaaauaaaaaaaguuuuaaaaacugaucaagu

SEQ ID NO: 183435 - RNA, 64 nt, hsa
uaagggaaaaacuuuuacuuuguagauaauauaaaauaaaaacuuaaaaaaaauuuaaaaaaua

SEQ ID NO: 183436 - RNA, 64 nt, hsa
auuauucacacuuucaaacuguguauuuucuuacaauaaaaaaugaugaaaaaaaaaaaggcuu

SEQ ID NO: 183437 - RNA, 64 nt, hsa
uuuuauuuuauuuuuuugguauuuauucaucaggaauaaaaaaaacaaaguuuuauuaaagauu

SEQ ID NO: 183438 - RNA, 64 nt, hsa
agacaccaucucaaaaaauacauauaauaauauaaauaaaaauaucuuuuuugaaaauaauuua

SEQ ID NO: 183439 - RNA, 64 nt, hsa
auuuaccaguugaagauguucgcuuucagaauauaauaaaaauagucaaaaacuuuguguuucu

SEQ ID NO: 183440 - RNA, 64 nt, hsa
gcagugaacuuaaagcaaagaccucuuaguaaaaaauaaaaaaaaauaaaaaauaaaaauaaaa

SEQ ID NO: 183441 - RNA, 64 nt, hsa
uaaagcaaagaccucuuaguaaaaaauaaaaaaaaauaaaaaauaaaaauaaaaaaaguuaaau

SEQ ID NO: 183442 - RNA, 64 nt, hsa
aagaccucuuaguaaaaaauaaaaaaaaauaaaaaauaaaaauaaaaaaaguuaaauuuauuua

SEQ ID NO: 183443 - RNA, 64 nt, hsa
ucuuaguaaaaaauaaaaaaaaauaaaaaauaaaaauaaaaaaaguuaaauuuauuuauagaaa

SEQ ID NO: 183444 - RNA, 64 nt, hsa
gagaaacuaugggaaaaaaaauugcaaaaucuaaaauaaaaaaugcaaaaucuaaaauaaaaaa

SEQ ID NO: 183445 - RNA, 64 nt, hsa
uugcaaaaucuaaaauaaaaaaugcaaaaucuaaaauaaaaaauggaaaggaaacuuugaaccu

SEQ ID NO: 183446 - RNA, 64 nt, hsa
ggaaacaugguuuggauuauaaaauucuugcuuuaauaaaaauuucuuaaacagugaaaaaaag

SEQ ID NO: 183447 - RNA, 64 nt, hsa
cuuccggagucuuugaagcugaaaauauaaaacaaauaaaaaauaaaaaaauaaaaacccacaa

SEQ ID NO: 183448 - RNA, 64 nt, hsa
agucuuugaagcugaaaauauaaaacaaauaaaaaauaaaaaaauaaaaacccacaaaaauguu

SEQ ID NO: 183449 - RNA, 64 nt, hsa
aagcugaaaauauaaaacaaauaaaaaauaaaaaaauaaaaacccacaaaaauguugaaccaaa

SEQ ID NO: 183450 - RNA, 64 nt, hsa
ccuaauaucauaguuguacaauaugaaaaaaaagaauaaaaaguagcaguaaaauuauauacug

SEQ ID NO: 183451 - RNA, 64 nt, hsa
gcaaccuguacuuacagauucuuccuguaaacuaaauaaaaaaaaaaugauagugcauuuuggu

SEQ ID NO: 183452 - RNA, 64 nt, hsa
cacugcuaccuucuuugauuguauuaaugauuauaauaaaaaguuacaggucacuuuaaaagca

SEQ ID NO: 183453 - RNA, 64 nt, hsa
uuugcugaaaauuccuagaaaacugcuugaugacaauaaaaaguaaauaaaagcacugcuaccu

SEQ ID NO: 183454 - RNA, 64 nt, hsa
ucuuaauaacucccaauguaaaaaguuuuguuuuaauaaaaaauuuaauuauuauuucuugcca

SEQ ID NO: 183455 - RNA, 64 nt, hsa
aagagaacaacauaaagcaaacaacauaaagcacaauaaaaaugcaaauaaauauuucauuuuu

SEQ ID NO: 183456 - RNA, 64 nt, hsa
aacauuuuguucuaaaacuguccuucacaaauugaauaaaaaacucucacacucaguguguccc

SEQ ID NO: 183457 - RNA, 64 nt, hsa
uauuguaaugaauuuuuacuuuuuugauuuuuguaauaaaaauuggugcagauaaaaugucaaa

SEQ ID NO: 183458 - RNA, 64 nt, hsa
caaucuggcaacagagcgagaccuugucuuuaaaaauaaaaauaaaaacaucuuuacaacauuc

SEQ ID NO: 183459 - RNA, 64 nt, hsa
ggcaacagagcgagaccuugucuuuaaaaauaaaaauaaaaacaucuuuacaacauuccuguuu

SEQ ID NO: 183460 - RNA, 64 nt, hsa
uuuagucaucagagauacuuuccuaaaaaggaaaaauaaaaaacaaaauggugccacuuugggu

SEQ ID NO: 183461 - RNA, 64 nt, hsa
uuuugagaugucauacuguacacuguauuguaaaaauaaaaaguaaaauuauauuucaaauuuu

SEQ ID NO: 183462 - RNA, 64 nt, hsa
acauacauuguaucuuuguuuuaugguaauaaguaauaaaaauguagacuucauauuuuguaca

SEQ ID NO: 183463 - RNA, 64 nt, hsa
acuucauauuuuguacaaaauguccuauguacagaauaaaaaaguucauagaaacagcaaauau

SEQ ID NO: 183464 - RNA, 64 nt, hsa
uauauugguucgaaaucccagggaaaaaaauaaaaauaaaaaauuaaaggauuguugauaaccc

SEQ ID NO: 183465 - RNA, 64 nt, hsa
uaggaguauauugguucgaaaucccagggaaaaaaauaaaaauaaaaaauuaaaggauuguuga

SEQ ID NO: 183466 - RNA, 64 nt, hsa
gccagaccuugucucaaaaaauaaaaaauaaaaaaauaaaaacaaaauaaggaauccuuuuaaa

SEQ ID NO: 183467 - RNA, 64 nt, hsa
gagagagagccagaccuugucucaaaaaauaaaaaauaaaaaaauaaaaacaaaauaaggaauc

SEQ ID NO: 183468 - RNA, 64 nt, hsa
ccugagagagagagagccagaccuugucucaaaaaauaaaaaauaaaaaaauaaaaacaaaaua

SEQ ID NO: 183469 - RNA, 64 nt, hsa
aaguuaaggcuucccccuuuacuauaagacuauaaauaaaaacuuauuuuauccuucuuggugg

SEQ ID NO: 183470 - RNA, 64 nt, hsa
uagucucaguucguguuugauuccauuccauggaaauaaaaaguauguuguacauacugccgaa

SEQ ID NO: 183471 - RNA, 64 nt, hsa
uggaggccagcuaagccacucggggcaggccagcaauaaaaacugucugucuccaucgucucau

SEQ ID NO: 183472 - RNA, 64 nt, hsa
uucuuuuugauuauuuuuuguuuucauuuaccagaauaaaaacuaagaauuaaaaguuugauua

SEQ ID NO: 183473 - RNA, 64 nt, hsa
guuuuacuuaauuuauauugaacugucaaugacaaauaaaaauucuuuuugauuauuuuuuguu

SEQ ID NO: 183474 - RNA, 64 nt, hsa
uuugccugaguguauuuuacuauuugggcucugaaauaaaaauuaugaaauauggugaggucac

SEQ ID NO: 183475 - RNA, 64 nt, hsa
guguugagauuuacguggaacccuaaagcaguaaaauaaaaaaccugguugcagcacauucaca

SEQ ID NO: 183476 - RNA, 64 nt, hsa
ucaaaggaucuuuuguccauuccauuaauaacugaauaaaaaauaaauaaaauggauagaaaaa

SEQ ID NO: 183477 - RNA, 64 nt, hsa
ugguuauuuccuugaagcuuuauguggaccuauaaauaaaaauccaaucuccugcuaauaggua

SEQ ID NO: 183478 - RNA, 64 nt, hsa
uucucaguuucuuagaauccuagguaaauaaaacaauaaaaagaaaacccuuacauuuaaaaga

SEQ ID NO: 183479 - RNA, 64 nt, hsa
ggauuuaauguaccuuuuuguuagugaauuuggaaauaaaaagaaaaaaaaaacaaaaacaaac

SEQ ID NO: 183480 - RNA, 64 nt, hsa
uuacuuuuucauuccuuccuuuuuuuuguccugaaauaaaaaguggcaugcaguuuuuuuuuua

SEQ ID NO: 183481 - RNA, 64 nt, hsa
gaucaaaaauauuagaaaaaauaaaaauaauacaaauaaaaauacaguauaacaguuauuuaaa

SEQ ID NO: 183482 - RNA, 64 nt, hsa
auuaaaccaauugcagaucaaaaauauuagaaaaaauaaaaauaauacaaauaaaaauacagua

SEQ ID NO: 183483 - RNA, 64 nt, hsa
guauguggggaagacauuguugucuuuuugugaaaauaaaaauccacaccuggaaguguaugug

SEQ ID NO: 183484 - RNA, 64 nt, hsa
cucuucaaggcgagaugauccuuacuggagcgagaauaaaaaguugucucuagauacagaugca

SEQ ID NO: 183485 - RNA, 64 nt, hsa
uugccaauuauuuuguuauauuuccaaaaaacuaaauaaaaaucauuuuuauuuuuuaguuugu

SEQ ID NO: 183486 - RNA, 64 nt, hsa
acuauccauguagucaaaucuaggggaaaaagcaaauaaaaauaguaaaauuuggccgggcaca

SEQ ID NO: 183487 - RNA, 64 nt, hsa
ucaauaauuauggauuuuuaugaaaacuugaaauaauaaaaagagaaaaaaacuauuuccuaua

SEQ ID NO: 183488 - RNA, 64 nt, hsa
ccgacgaaccgacacgcggcagagucaauaauucaauaaaaaaguuacgaacuuucucuguaac

SEQ ID NO: 183489 - RNA, 64 nt, hsa
gaaaagauuuguauacaaauguuuucuaugauuuaauaaaaauauauggcacaccuuuuguuua

SEQ ID NO: 183490 - RNA, 64 nt, hsa
uuaacuaucuuuuaaauucgugguugauguaaguaauaaaaaacauucuuaaaguugaggguua

SEQ ID NO: 183491 - RNA, 64 nt, hsa
ucauuuuagcaacucuaaaaaaaaaaaaaauacaaauaaaaaggaaaaaaaauuacauuuuuua

SEQ ID NO: 183492 - RNA, 64 nt, hsa
uuuugugguugaucuagacagaugcuagauaaugaauaaaaacugguuuagggccauauccaga

SEQ ID NO: 183493 - RNA, 64 nt, hsa
gacuuuuauauuaugggagggaaaaaauaacauuaauaaaaaggugauaaaaaagcacuguuuc

SEQ ID NO: 183494 - RNA, 64 nt, hsa
ucuauuuuuuucuuuuuuuccaaaaaaagaaaguaauaaaaacuuaaauucuuuguaccaguua

SEQ ID NO: 183495 - RNA, 64 nt, hsa
gguauccgucacgggucuuccuguuuuguauuuaaauaaaaacaacagcagcaggcugucccug

SEQ ID NO: 183496 - RNA, 64 nt, hsa
cgcauggagauucucuagcuguuagguagaccuaaauaaaaaguucucaauagauuccucuuuu

SEQ ID NO: 183497 - RNA, 64 nt, hsa
cuggaguagugauaaacaccuuaaucauaaaaugaauaaaaacaaaaaaaccauggggcuuguc

SEQ ID NO: 183498 - RNA, 64 nt, hsa
ugggcaacacagcgagacuccgucucaaggaaaaaauaaaaauaaaaagcgggcacgggcccgu

SEQ ID NO: 183499 - RNA, 64 nt, hsa
acacagcgagacuccgucucaaggaaaaaauaaaaauaaaaagcgggcacgggcccgugacauc

SEQ ID NO: 183500 - RNA, 64 nt, hsa
aagaaaacaaaauauaagggaaaaauaugagaaaaauaaaaauaaaaagagaauaauaggccag

SEQ ID NO: 183501 - RNA, 64 nt, hsa
acaaaauauaagggaaaaauaugagaaaaauaaaaauaaaaagagaauaauaggccaggcacug

SEQ ID NO: 183502 - RNA, 64 nt, hsa
gccuauguccguucaucccugagaggucugaaagaauaaaaauaaauucuaaaaaaagccucug

SEQ ID NO: 183503 - RNA, 64 nt, hsa
gcacucuggugcgggaagaagcagaagcaaaaaaaauaaaaauaaaaaaauaaauaaaaauaaa

SEQ ID NO: 183504 - RNA, 64 nt, hsa
uggugcgggaagaagcagaagcaaaaaaaauaaaaauaaaaaaauaaauaaaaauaaaaaaaau

SEQ ID NO: 183505 - RNA, 64 nt, hsa
aagcagaagcaaaaaaaauaaaaauaaaaaaauaaauaaaaauaaaaaaaauaaaaaaggaaaa

SEQ ID NO: 183506 - RNA, 64 nt, hsa
aagcaaaaaaaauaaaaauaaaaaaauaaauaaaaauaaaaaaaauaaaaaaggaaaaaaaaaa

SEQ ID NO: 183507 - RNA, 64 nt, hsa
aaauaaaaauaaaaaaauaaauaaaaauaaaaaaaauaaaaaaggaaaaaaaaaaaagaagaaa

SEQ ID NO: 183508 - RNA, 64 nt, hsa
uagcuauuuguuuuuauuguaaaacaauaauaauaauaaaaagcaaacucuauugguguguugu

SEQ ID NO: 183509 - RNA, 64 nt, hsa
ugggagaguaaaccuugaagggcuuuauuaaagaaauaaaaaagaacuuuuguaucuuuuaucc

SEQ ID NO: 183510 - RNA, 64 nt, hsa
gaucacuguucuuuuuuuauuuuauugucauuucaauaaaaaauauuugaaagagaaugacucu

SEQ ID NO: 183511 - RNA, 64 nt, hsa
aaaaauacugauaaauucggaucaaauuugggggaauaaaaaauauuagagcaaaggaguuugc

SEQ ID NO: 183512 - RNA, 64 nt, hsa
uaaagcauugaauugauagaaaaauuugcucuguaauaaaaaucuacuuucacauacuuuuuau

SEQ ID NO: 183513 - RNA, 64 nt, hsa
augucauaagaauuuauuauauaaauuuaucaagaauaaaaaugccucuccagccuuaaguauu

SEQ ID NO: 183514 - RNA, 64 nt, hsa
cugaccggugcuuauccucuaagcccugauccacaauaaaaauggacccaacucagcucugacu

SEQ ID NO: 183515 - RNA, 64 nt, hsa
uagaaaccagcccuuuuuccccccacuuuugagaaauaaaaaagccuuagguaaauaagucauu

SEQ ID NO: 183516 - RNA, 64 nt, hsa
uaaaagggaaauuugaacaacaaaaaccaaaaaaaauaaaaauaaaaaacuucaaaaguugaca

SEQ ID NO: 183517 - RNA, 64 nt, hsa
ggaaauuugaacaacaaaaaccaaaaaaaauaaaaauaaaaaacuucaaaaguugacaagaagg

SEQ ID NO: 183518 - RNA, 64 nt, hsa
uggacaacacagugagaccucaucucuaucaaaaaauaaaaauuagcuagaugugguggcauga

SEQ ID NO: 183519 - RNA, 64 nt, hsa
uugggcaacagagcaagacccugucuccgaaacaaauaaaaaauacuguaauaaaaguacuuau

SEQ ID NO: 183520 - RNA, 64 nt, hsa
ugaaaaaggaaaaucagcaauucagcaaaaaauaaauaaaaaauaaaaauguaaauaugauagu

SEQ ID NO: 183521 - RNA, 64 nt, hsa
ggaaaaucagcaauucagcaaaaaauaaauaaaaaauaaaaauguaaauaugauaguaauaaaa

SEQ ID NO: 183522 - RNA, 64 nt, hsa
agaacccugaaauuuauauaggugagacaauagaaauaaaaagaucuucagccaggccuuucug

SEQ ID NO: 183523 - RNA, 64 nt, hsa
guuuuaaaaaaauaauuaaaaaacaguuggcguuaauaaaaaugucaaugugaaacugaugucc

SEQ ID NO: 183524 - RNA, 64 nt, hsa
caaaauagugagagacccuguaucugaaaguaauaauaaaaauaaaaaauauaaaugaggucuc

SEQ ID NO: 183525 - RNA, 64 nt, hsa
agugagagacccuguaucugaaaguaauaauaaaaauaaaaaauauaaaugaggucucguugau

SEQ ID NO: 183526 - RNA, 64 nt, hsa
gccugggcaacaaagcaagacucugucucaaaaaaauaaaaauaaaaaaaaaaucuuaguucca

SEQ ID NO: 183527 - RNA, 64 nt, hsa
gcaacaaagcaagacucugucucaaaaaaauaaaaauaaaaaaaaaaucuuaguuccauggaau

SEQ ID NO: 183528 - RNA, 64 nt, hsa
gcaagaaagggagaccuaagggugaacaguggccaauaaaaacccuagagaacaaacauccauu

SEQ ID NO: 183529 - RNA, 64 nt, hsa
uuuuggguugguuguucugucuuuuuuuuaauuaaauaaaaacauuuuuaaaauguucucuucu

SEQ ID NO: 183530 - RNA, 64 nt, hsa
aacggggaaugaaggcaggaaggaggcuggaauaaauaaaaauaaaaauagacaaguaagacag

SEQ ID NO: 183531 - RNA, 64 nt, hsa
gaaugaaggcaggaaggaggcuggaauaaauaaaaauaaaaauagacaaguaagacagcauaaa

SEQ ID NO: 183532 - RNA, 64 nt, hsa
aaguauaauaaaaagcaaugaucuuuguuaaaaaaauaaaaaguacuaacauuacagacaugua

SEQ ID NO: 183533 - RNA, 64 nt, hsa
uacuuuuguuacuagauugaauuugauaaaguauaauaaaaagcaaugaucuuuguuaaaaaaa

SEQ ID NO: 183534 - RNA, 64 nt, hsa
gaauguagauaccuuguccagccauaggaaucaaaauaaaaaacuaaaaaaguucagugugugu

SEQ ID NO: 183535 - RNA, 64 nt, hsa
uuuauuuuuagcauacuguuaaauaucacaucacaauaaaaaucaaauuggcauuaaaaguaua

SEQ ID NO: 183536 - RNA, 64 nt, hsa
uugaaguuuugguaaaaauucuuuuuucuuuuuuaauaaaaaauuagguuauuacuuuuuuuau

SEQ ID NO: 183537 - RNA, 64 nt, hsa
ucuuugguugucccuauuaacaaaaaaguauuuuaauaaaaaauugaaaugagugagucauauu

SEQ ID NO: 183538 - RNA, 64 nt, hsa
gaugcuccaugaggaaaaucccuguccacauuggaauaaaaaagacauuuuuguuacaaaguuu

SEQ ID NO: 183539 - RNA, 64 nt, hsa
auguacauauugacaaauauucauuuauucaacaaauaaaaaguauguacaaaacaugauacag

SEQ ID NO: 183540 - RNA, 64 nt, hsa
guaaaugaagcuugcuuggaaggggaaaacuuuaaauaaaaacuuuauguacuaauucaacugu

SEQ ID NO: 183541 - RNA, 64 nt, hsa
guuagaugauaugucugacccaaauuuaauccauaauaaaaaaaaaugggagauuguuuucagg

SEQ ID NO: 183542 - RNA, 64 nt, hsa
ccugggcgacagagcaagacucugucucaaaaaaaauaaaaaauaaucagggcacaguggcuca

SEQ ID NO: 183543 - RNA, 64 nt, hsa
accagccuggugaacauggcgaaaccccgucucuaauaaaaauacaaaaauuagccgggcaugg

SEQ ID NO: 183544 - RNA, 64 nt, hsa
cagccugggcaacaagagcaaaacuccgucucaaaauaaaaagaaaagaaaagaauggacagug

SEQ ID NO: 183545 - RNA, 64 nt, hsa
gggggacagagcacgacccugucuccaaaaauaaaauaaaaauaaaaauaaauauuggcggggg

SEQ ID NO: 183546 - RNA, 64 nt, hsa
cagagcacgacccugucuccaaaaauaaaauaaaaauaaaaauaaauauuggcgggggaacccu

SEQ ID NO: 183547 - RNA, 64 nt, hsa
acguggcuuaguccaucagcaucuuauucuggguaauaaaaaauaaaaauaaacggauaccugu

SEQ ID NO: 183548 - RNA, 64 nt, hsa
uuaguccaucagcaucuuauucuggguaauaaaaaauaaaaauaaacggauaccuguuuuccac

SEQ ID NO: 183549 - RNA, 64 nt, hsa
auauuuaugaacuauauuucucauugcacucuguaauaaaaagcaguuaguuguuacuuaccua

SEQ ID NO: 183550 - RNA, 64 nt, hsa
auggauauuuguauuuuuuauacuuuuguguaauaauaaaaauacugcuguaaauauucuuguu

SEQ ID NO: 183551 - RNA, 64 nt, hsa
cugggcgacagagugagacucccucucaaaagaaaauaaaaauaaaaauaaacuggccaggugc

SEQ ID NO: 183552 - RNA, 64 nt, hsa
gacagagugagacucccucucaaaagaaaauaaaaauaaaaauaaacuggccaggugcgguggc

SEQ ID NO: 183553 - RNA, 64 nt, hsa
cugggcaagagagagagacuuugucucuauuaaaaauaaaaaugauuggccgagcaugguggug

SEQ ID NO: 183554 - RNA, 64 nt, hsa
ugggaccacaggcugcaccauaagacccacucacaauaaaaaaauaaaaggccgagccgggcau

SEQ ID NO: 183555 - RNA, 64 nt, hsa
aaaggccgagccgggcaugguugcucacucccguaauaaaaaaauaaaagaacaggcugagccg

SEQ ID NO: 183556 - RNA, 64 nt, hsa
cuaggcaacauaguaagaccucaucucuacuaaaaauaaaaaaaaacagccagguguguuaguc

SEQ ID NO: 183557 - RNA, 64 nt, hsa
caaucaaguugcugcagccuaugcacuggcccagaauaaaaaacguggugauucugcuaaagcu

SEQ ID NO: 183558 - RNA, 64 nt, hsa
ugacagaaugagacucugugucaaaaaaauaaaaaauaaaaaaucuaagggcucaggaaccagu

SEQ ID NO: 183559 - RNA, 64 nt, hsa
gccugggugacagaaugagacucugugucaaaaaaauaaaaaauaaaaaaucuaagggcucagg

SEQ ID NO: 183560 - RNA, 64 nt, hsa
ugaauuauguaugaaaauuauucuauguuuuuauaauaaaaauaauauaucagacaucgacaug

SEQ ID NO: 183561 - RNA, 64 nt, hsa
cuuuucuucuauggggucuauaaauguaucuuauaauaaaaaggaaggacaggaggaagacagg

SEQ ID NO: 183562 - RNA, 64 nt, hsa
agcuacagugacagauuuuagagcaaaaauuaguaauaaaaauaagaaauaaaauuacaggagc

SEQ ID NO: 183563 - RNA, 64 nt, hsa
acguacuaccuaaaaggaugucuaaauguuuguuaauaaaaauaagaaauagcuacagugacag

SEQ ID NO: 183564 - RNA, 64 nt, hsa
cugaaaugaucaaauaacuacaaaugaucuguugaauaaaaauaguugagcugauauauguuaa

SEQ ID NO: 183565 - RNA, 64 nt, hsa
uuuuaugugcuuucaucacaaauccaaaggaaagaauaaaaauuucuuaacacaacccagcggu

SEQ ID NO: 183566 - RNA, 64 nt, hsa
cccuaauguucuuccuuuuacauccuggaacaacaauaaaaacauuuuuuuaaacuugucuacu

SEQ ID NO: 183567 - RNA, 64 nt, hsa
uuuuuuuuuuuuuuuuuacugcauguuacauugaaauaaaaacaaaguaaaaugagcaauugcc

SEQ ID NO: 183568 - RNA, 64 nt, hsa
auagauuuuaaugggaaaauuauaauucagauuaaauaaaaaacaauucccuuuucccuguugu

SEQ ID NO: 183569 - RNA, 64 nt, hsa
ucccacugcugggccucuaucuccaugacaacaaaauaaaaacagagguugcuugacucauuac

SEQ ID NO: 183570 - RNA, 64 nt, hsa
ugagcacuaacuauuggcagaaacugcauuugcaaauaaaaauaaauguuugccuuuuccccau

SEQ ID NO: 183571 - RNA, 64 nt, hsa
guaaaauauuaaagcauuaauauaaauaugugagaauaaaaacaaucuaaauccagaaaauggc

SEQ ID NO: 183572 - RNA, 64 nt, hsa
auccccucaaaaaaauaaaaauaaaaaaaauaaaaauaaaaaaacauuuuuuucaagcagggag

SEQ ID NO: 183573 - RNA, 64 nt, hsa
ugugcaauccccucaaaaaaauaaaaauaaaaaaaauaaaaauaaaaaaacauuuuuuucaagc

SEQ ID NO: 183574 - RNA, 64 nt, hsa
gaaauaaacugugcaauccccucaaaaaaauaaaaauaaaaaaaauaaaaauaaaaaaacauuu

SEQ ID NO: 183575 - RNA, 64 nt, hsa
uguuuggaaauaaacugugcaauccccucaaaaaaauaaaaauaaaaaaaauaaaaauaaaaaa

SEQ ID NO: 183576 - RNA, 64 nt, hsa
auuguuuccagcuuuaucaaagacauguuugaaaaauaaaaagcauccaagugagagcugguga

SEQ ID NO: 183577 - RNA, 64 nt, hsa
ugucaaauacagacaaaggauuugagauguucucaauaaaaagaaaauguuucacuacucuggu

SEQ ID NO: 183578 - RNA, 64 nt, hsa
aaacccaagaagggcacuaaacucagauugacuaaauaaaaaguacaaagggcacauauacgug

SEQ ID NO: 183579 - RNA, 64 nt, hsa
aacuguuaaacaacucuuuaaaggauaauuauccaauaaaaaaaaaccuagugcugauucacag

SEQ ID NO: 183580 - RNA, 64 nt, hsa
auuuaugcccuuauaucccaaaaaugucuuagaaaauaaaaauucugggccuuacuuguuuuuu

SEQ ID NO: 183581 - RNA, 64 nt, hsa
aaucaauggauauccuucaguagugaaugcagaaaauaaaaauacacagguaauuuaguaucuu

SEQ ID NO: 183582 - RNA, 64 nt, hsa
cuuaugaaauagagaguguccuaaauaucacugaaauaaaaaguaggaaaaagaagcuugaauu

SEQ ID NO: 183583 - RNA, 64 nt, hsa
uguaauaaauuauuuuuuagaucuugaaauuuauaauaaaaauacuuuaccuacccugaucacc

SEQ ID NO: 183584 - RNA, 64 nt, hsa
guuuuauauuguuuugacugccuuuuuuuguagaaauaaaaauugaccuuagaauuuaucguca

SEQ ID NO: 183585 - RNA, 64 nt, hsa
uucuaagaugcugcgaucccguucugcugcccguaauaaaaaugcucucagacacugguuaguc

SEQ ID NO: 183586 - RNA, 64 nt, hsa
gaacaguaauucauuuaauugcaaagcauuuugaaauaaaaaaaaucaaacuuaaaacuguguu

SEQ ID NO: 183587 - RNA, 64 nt, hsa
ugccccucaaccuaucccguuccuucugccuacaaauaaaaagugcaggcuggaaugaucucag

SEQ ID NO: 183588 - RNA, 64 nt, hsa
aaagcuggaaaauuacuuaaaacaggaaagugucaauaaaaaaacuugagcaacaccaacauau

SEQ ID NO: 183589 - RNA, 64 nt, hsa
gagcugcugaauuugugccccuggauuggaagcaaauaaaaaaaaaaaacaacacauaaacuaa

SEQ ID NO: 183590 - RNA, 64 nt, hsa
ccuaauuauguaaaaagaauauaauaccuguggaaauaaaaaugaauuccaaguguauacuugc

SEQ ID NO: 183591 - RNA, 64 nt, hsa
ccaccaaaaccuauggaaauuuaaaaaaaacaaaaauaaaaagcaaaacaaaaaucccaaaaug

SEQ ID NO: 183592 - RNA, 64 nt, hsa
uggucauuuaaagucaauauuuauuuauguauguaauaaaaaaaguuggauuuuuguguauguc

SEQ ID NO: 183593 - RNA, 64 nt, hsa
gguguuauuggaagaaaaaugcuauuaaugggcuaauaaaaaacauguguuucucuuauggauu

SEQ ID NO: 183594 - RNA, 64 nt, hsa
uuguaguugacaugaagucaucuauguggaaaaaaauaaaaauaaaagugauuucacggaugug

SEQ ID NO: 183595 - RNA, 64 nt, hsa
guuucacuggaaagugucaauagaguugccuaagaauaaaaauugaaaugguguuaaucugaaa

SEQ ID NO: 183596 - RNA, 64 nt, hsa
cucuauacuuuuguauauguuugaaauuuuccauaauaaaaauugaaaaaaguauucuucagag

SEQ ID NO: 183597 - RNA, 64 nt, hsa
uauugauuguguccccaguuguuacauaauuugaaauaaaaauauaacuucuugauuuauuguu

SEQ ID NO: 183598 - RNA, 64 nt, hsa
gauauuucguguucuuucacugcaaaauaaaaagaauaaaaauuucagagugucucauguuuaa

SEQ ID NO: 183599 - RNA, 64 nt, hsa
uuuugaaaagauauuucguguucuuucacugcaaaauaaaaagaauaaaaauuucagagugucu

SEQ ID NO: 183600 - RNA, 64 nt, hsa
auuaauauaaaguaaaauucaccauuuuaauuauaauaaaaauaaaguauauaauucaaugguu

SEQ ID NO: 183601 - RNA, 64 nt, hsa
uaugugaauacacaaauuuuacuggauuuaucuuaauaaaaagacucugacgaugauuguguuu

SEQ ID NO: 183602 - RNA, 64 nt, hsa
aaaauguauaaaaagaauuaguguaugcuuccugaauaaaaaggagccaaaguugaucagaaug

SEQ ID NO: 183603 - RNA, 64 nt, hsa
aucugcaacaauauguaaaguugauauugacuacaauaaaaauccagucuuaauuccagauuua

SEQ ID NO: 183604 - RNA, 64 nt, hsa
cucggcgcccaccacccccucaagccccagcagcccucaacaggcccagggagggaagugugag

SEQ ID NO: 183605 - RNA, 64 nt, hsa
gauauggugcagagaagcuggacuucugugggccccucaacagccaagugugaccccacugcca

SEQ ID NO: 183606 - RNA, 64 nt, hsa
aguugacuccagaggacaugaaagccauugauggccucaacagaaaucuccgauaugauaaguu

SEQ ID NO: 183607 - RNA, 64 nt, hsa
aucaaggagacaaacacaagcugcuggaacucauccucaacaagccagggcucagguacaagcc

SEQ ID NO: 183608 - RNA, 64 nt, hsa
uucugcccauagacggggaugacucagcacuaccccucaacagagaugacuuugaugacucugc

SEQ ID NO: 183609 - RNA, 64 nt, hsa
cacuaccccuuaacagggaugacuccgcacugccccucaacagggaugacucagcagagaugac

SEQ ID NO: 183610 - RNA, 64 nt, hsa
agggaugacucagcagggaugacucagcaccgccccucaacaggcaugacucugcagagaugac

SEQ ID NO: 183611 - RNA, 64 nt, hsa
aacagggaugacucagggauggcuuaguacugccccucaacagggaugacucagcagggaugac

SEQ ID NO: 183612 - RNA, 64 nt, hsa; identical to SEQ ID NO: 183610

SEQ ID NO: 183613 - RNA, 64 nt, hsa
uacugccccucagcagggaugacucagcacugccccucaacagggaugacucagcagggaugac

SEQ ID NO: 183614 - RNA, 64 nt, hsa
uacugccccucagcagggaugacucagcaccgccccucaacagggaugacucagcacugccccu

SEQ ID NO: 183615 - RNA, 64 nt, hsa
caccgccccucaacagggaugacucagcacugccccucaacagggaugacucagcagggaugac

SEQ ID NO: 183616 - RNA, 64 nt, hsa
agggaugacucagcagggaugacucagcaccaccccucaacagggaugacucagcagggaugac

SEQ ID NO: 183617 - RNA, 64 nt, hsa
agggaugacucagcagggaugacucagcacugccccucaacagggaugacugcagggaugacuc

SEQ ID NO: 183618 - RNA, 64 nt, hsa; identical to SEQ ID NO: 183610

SEQ ID NO: 183619 - RNA, 64 nt, hsa
agggauggcucagcagggaugacucagcauugccccucaacagggaugacucagcagacucagc

SEQ ID NO: 183620 - RNA, 64 nt, hsa
ucagcagacucagcagggaugacucagcacugccccucaacagacaugacucagcagggaugac

SEQ ID NO: 183621 - RNA, 64 nt, hsa
aguuaaucagaauaaagcggaagcaccaugaugaccucaacaguggaggcccagccaggccucc

SEQ ID NO: 183622 - RNA, 64 nt, hsa
ggcggaucaccugaggucaggaguucgagaccagccucaacauggagaaaccccgucucuauua

SEQ ID NO: 183623 - RNA, 64 nt, hsa
uuaauaaaauucaacaucccuucauuuuaaaaacccucaacaaauuacacauugagggaacaua

SEQ ID NO: 183624 - RNA, 64 nt, hsa
cagaaauaaaggcauauaccuacaaccaugugauccucaacaaaacugacaagcaaugaaguaa

SEQ ID NO: 183625 - RNA, 64 nt, hsa; identical to SEQ ID NO: 173401

SEQ ID NO: 183626 - RNA, 64 nt, hsa; identical to SEQ ID NO: 173402

SEQ ID NO: 183627 - RNA, 64 nt, hsa; identical to SEQ ID NO: 173403

SEQ ID NO: 183628 - RNA, 64 nt, hsa; identical to SEQ ID NO: 173404

SEQ ID NO: 183629 - RNA, 64 nt, hsa
augccccuguuccuuuguugcgggugguuuugguaaggcagagcccucugcugagaauguagua

SEQ ID NO: 183630 - RNA, 64 nt, hsa
gcuuccagaccuguggaacgaagaggauggggaaaaggcagagggcacugagugucccuuuaaa

SEQ ID NO: 183631 - RNA, 64 nt, hsa
cuauuucuuuuuccugaaauucgugauugcaacaaaggcagagggggcggggcgggggagggga

SEQ ID NO: 183632 - RNA, 64 nt, hsa
gcagagggcacccgggcgguaguccgggacgcgcaaggcagagcccugacgcuccggguccccg

SEQ ID NO: 183633 - RNA, 64 nt, hsa
ccacaugcaagucucccugaggguucugccccuaaaggcagacugccucaugcccgcuagcugu

SEQ ID NO: 183634 - RNA, 64 nt, hsa
ucaugcaccuauagucccagcugcucaggaggcuaaggcagaaagaccauucaagcccaggagu

SEQ ID NO: 183635 - RNA, 64 nt, hsa
agugcugaucgugucucagcaucaggaaaggagaaaggcagagggagagcgcugagaagacugu

SEQ ID NO: 183636 - RNA, 64 nt, hsa
gugcccccgcugaaccuggcuggaccgcgugugaaaggcagaacuaacgugcggaaacauuuga

SEQ ID NO: 183637 - RNA, 64 nt, hsa
agacuuccucugguuuccucaggaggaaaugggcaaggcagaguaagcaggggagacagguuua

SEQ ID NO: 183638 - RNA, 64 nt, hsa
agcaggccauucuggaugccauggccgaggagacaaggcagaagcaacuucuggccgacgagaa

SEQ ID NO: 183639 - RNA, 64 nt, hsa
gauauagacaguacuuuaacuuguguuuccagauaaggcagauuuuggucaucuuucugugaaa

SEQ ID NO: 183640 - RNA, 64 nt, hsa
aauggaucacucuugauuuaauuagaggcuaauaaaggcagaauguuuauugugaauauguaau

SEQ ID NO: 183641 - RNA, 64 nt, hsa
uguuuggaaaauagcgaauuaaccuaagacacagaaggcagacugggugaggagaccuagcaug

SEQ ID NO: 183642 - RNA, 64 nt, hsa
ucaagguuguugauggggaacuugccacuaagagaaggcagagaggucccuaguggguauauuu

SEQ ID NO: 183643 - RNA, 64 nt, hsa
gacagcuuaauaaaugccagggaaucugaccuggaaggcagaugggagggggcuggucuggcug

SEQ ID NO: 183644 - RNA, 64 nt, hsa
uacuuauauacagucuuucaagagagauacaaacaaggcagaaacauuuaaacuaguauuaaag

SEQ ID NO: 183645 - RNA, 64 nt, hsa
cuggggcucugggguagaugagagaagccugaaaaaggcagaguuugaaagcucccauuuaaaa

SEQ ID NO: 183646 - RNA, 64 nt, hsa
gacaggaagcugcuggguggggguggggggagaaaaggcagauaauuaaaccaucucaucgucu

SEQ ID NO: 183647 - RNA, 64 nt, hsa
caaggaugaaagacaaagaaggaaaagaguaucaaaggcagaaaggagaucauuuaguuggguc

SEQ ID NO: 183648 - RNA, 64 nt, hsa
acaaagacagggaauagugggaucaaagcuaggaaaggcagaaacacaaccacucaccaguccu

SEQ ID NO: 183649 - RNA, 64 nt, hsa
uuuaucuaaaucacuggaaaggcuggaggagcagaaggcagaggccaccacuggacuauugguu

SEQ ID NO: 183650 - RNA, 64 nt, hsa
ggugguaaaagaggguugcauuucuugcagccagaaggcagagaaagugaagaccaaguccaga

SEQ ID NO: 183651 - RNA, 64 nt, hsa
cgagggcuagggcuagagcagacccggguaaguaaaggcagacccagggcuccucuagccucau

SEQ ID NO: 183652 - RNA, 64 nt, hsa
gggcccugagagggaaggagagguuucucacaccaaggcagaugcuccucuggugggagggugc

SEQ ID NO: 183653 - RNA, 64 nt, hsa
caaaaaaaaaaaaagaaaaaagaaagaaagaaaaaaggcagaagcccuggauucaaauccgcca

SEQ ID NO: 183654 - RNA, 64 nt, hsa
ggaggcugaggcaggagaaaucgccugaacccagaaggcagagguugcagugagccaagaucac

SEQ ID NO: 183655 - RNA, 64 nt, hsa
ugcuggaacuggagccaaggggaggcugccuaugaaggcagaagauguggaugaauucaggcac

SEQ ID NO: 183656 - RNA, 64 nt, hsa
ugaccagauaucuuguuggcauaaauguuaugaaaaggcagaauacuggcaagaaaugaggaag

SEQ ID NO: 183657 - RNA, 64 nt, hsa
ucucuccaagugcaucuagccuggccuggagggcaaggcagaugcauucuccuggcugcuggga

SEQ ID NO: 183658 - RNA, 64 nt, hsa
cagagaauacugaccucaccuugggaugucaccaaaggcagagcagaugggacugucaaaguug

SEQ ID NO: 183659 - RNA, 64 nt, hsa
uuuaaaucucuggucacuuuaagacccuaaauaaaaggcagacagcuccacucaaaaacuaagg

SEQ ID NO: 183660 - RNA, 64 nt, hsa
cacuaacagugcucaugugccuuccagacgguucaaggcagaggccacugugcucaguguaguc

SEQ ID NO: 183661 - RNA, 64 nt, hsa
auaacuggggucaucgggaaaggcaaagaaacugaaggcagaguccuaacguugcaucuuauuc

SEQ ID NO: 183662 - RNA, 64 nt, hsa
uugucuuuccugaaugacuuucuaacugugcagaaaggcagaaaagucaucauauguauauguc

SEQ ID NO: 183663 - RNA, 64 nt, hsa
gucacaaagcaccuauguguagaagcuaggguucaaggcagaucugugauuccagaagcuguuc

SEQ ID NO: 183664 - RNA, 64 nt, hsa
cuuagauucauugucuauggguacauuuuauaaaaaggcagauucuaguucagugucauaagga

SEQ ID NO: 183665 - RNA, 64 nt, hsa
accuaaguuuggacucucggggccaaagguggcuaaggcagaggcugagggggcugggcgagcu

SEQ ID NO: 183666 - RNA, 64 nt, hsa
gcccagggcuccggaggugcagcuaaaggccaccaaggcagaacaggcagaagggauggaauuu

SEQ ID NO: 183667 - RNA, 64 nt, hsa
gccucaguucuuccuuccacagggauuuucaggaaaggcagaagcucguggaggaugggcaucu

SEQ ID NO: 183668 - RNA, 64 nt, hsa
uggggagggucagcugccugcaugacuuuucuggaaggcagagccucgaaaauaggcagaccgu

SEQ ID NO: 183669 - RNA, 64 nt, hsa
cagcagagaaugccaugcggccuguguaagaauuaaggcagauuuauaugcacugaugaggaaa

SEQ ID NO: 183670 - RNA, 64 nt, hsa
uuaaaggaguaugaggugggugacccaggacagagaacgcuacuggauccugggagguucagca

SEQ ID NO: 183671 - RNA, 64 nt, hsa
cuuguggugaggggugugggaagaccaaaggaaggaacgcuaacaauuucucauacuuagaaac

SEQ ID NO: 183672 - RNA, 64 nt, hsa
uuccuaaaugguauuuucaaguguaauauugugagaacgcuacugcaguaguugauguugugug

SEQ ID NO: 183673 - RNA, 64 nt, hsa
uuagaagcaaagauuucaguagaauuuuaguccugaacgcuacggggaaaaugcauuuucuuca

SEQ ID NO: 183674 - RNA, 64 nt, hsa
uaaugcugcaaacuuaauguucuuaugcaaaauggaacgcuaaugaaacacagcuuacaaucgc

SEQ ID NO: 183675 - RNA, 64 nt, hsa
acuuuauauaaaaggaugacucaaaggauaaaaugaacgcuauuugaggacucugguugaagga

SEQ ID NO: 183676 - RNA, 64 nt, hsa
gggugggggccggggcuggcccugggacccccaggaacgcuaagacacaggcuccaguaggggc

SEQ ID NO: 183677 - RNA, 64 nt, hsa
acaguuagcuccucagaaaggugaaugugagcaagaacgcuacaguucgagguaugacauucua

SEQ ID NO: 183678 - RNA, 64 nt, hsa
uagauuuaacccuaagguaagaugcugggguauagaacgcuaagaauuuucccccaaggacucu

SEQ ID NO: 183679 - RNA, 64 nt, hsa
uugaauauuauuccucaaaaaauugcacauaguagaacgcuaucugggaagcuauuuuuuucag

SEQ ID NO: 183680 - RNA, 64 nt, hsa
uguacucacagagaacuaauugacuaaacaacuugaacgcuagugguuuguccuuagacaaucu

SEQ ID NO: 183681 - RNA, 64 nt, hsa
acaauaaaacuguugucagcuuuuguuuuacagagaacgcuagauauuaagaauuuugaaaugg

SEQ ID NO: 183682 - RNA, 64 nt, hsa
aaacccccaaaugccccaaaauccaaaccuuccugaacgcuaugacaccaugaguggaaaauuc

SEQ ID NO: 183683 - RNA, 64 nt, hsa
gggauuacaggcuugagcuaccgcgcccggccgugaacgcuauuuucuaagcagccagcaguga

SEQ ID NO: 183684 - RNA, 64 nt, hsa
ugugguguucgcuaucucuugugucaaaucuggugaacgcuacgcuuacauauauugucuuugu

SEQ ID NO: 183685 - RNA, 64 nt, hsa
ugaugccacacauucucucucaauuucagcuucggaacgcuaugaaaauaauacaugauuaaag

SEQ ID NO: 183686 - RNA, 64 nt, hsa
cgacagggugucuuaugcaaaggcugacuugccugaacgcuaagaacaugacuucugucugagc

SEQ ID NO: 183687 - RNA, 64 nt, hsa
uuacggucagccuuauuccccuucaccucccagugaacgcuaagaaguuucagacaagcagaga

SEQ ID NO: 183688 - RNA, 64 nt, hsa
uuuacuugauuucuuuccacaauaaacugacagagaacgcuacuaaugauuuuuuuuuuuuuuu

SEQ ID NO: 183689 - RNA, 64 nt, hsa
guuuauuuuaccauugacugcugcccucaaucuagaacgcuacacaagaaauauuuguuuuacu

SEQ ID NO: 183690 - RNA, 64 nt, hsa
aacaugaacugaacgguuaaaagcacagucuauggaacgcuaauggagucagccccuaaagcug

SEQ ID NO: 183691 - RNA, 64 nt, hsa
gaaccaccuuuuccagccagaguucccaaagcuggaacgcuagcugccugcucuuccuuaagau

SEQ ID NO: 183692 - RNA, 64 nt, hsa
uuggggcugguuugguuuuugacaccugaaaugcgaacgcuaugugcuaaauuugucaccguau

SEQ ID NO: 183693 - RNA, 64 nt, hsa
uuggaacucagagagguggcuauugcauugcgcagaacgcuacagagcccaugcucuucccaga

SEQ ID NO: 183694 - RNA, 64 nt, hsa
ccuucgaccccagcgggcuaccugaaccaaggcgucucuuuaaguggggcgcccgaagucauuu

SEQ ID NO: 183695 - RNA, 64 nt, hsa
uaaugguugcuaagaagaauaaguccuucuguuuucucuuuaacauuuaaaauaucucaaugca

SEQ ID NO: 183696 - RNA, 64 nt, hsa
ccauuuuguuuuuucauuguacauagacacauugucucuuuaaaaugcugcugaaauuguagag

SEQ ID NO: 183697 - RNA, 64 nt, hsa
cauguugcagaaaaagguuauacguaccacggauucucuuuaauauuguacaguuaaacuguau

SEQ ID NO: 183698 - RNA, 64 nt, hsa
auccauaguuaggcccacugugccucuccuuuuuucucuuuauuuucaugcuuuuuaucagugu

SEQ ID NO: 183699 - RNA, 64 nt, hsa
uuaaguuuuuugaaccuguuuccccaacaugaagucucuuuaugguuagagaagaccaaaaaac

SEQ ID NO: 183700 - RNA, 64 nt, hsa
cagccugcggcggggggaggggggccucuuuagcucucuuuaucuuucucucucacucauguau

SEQ ID NO: 183701 - RNA, 64 nt, hsa
caccuuauucucuacuuuaaacaaaucauaacuuucucuuuaagccucugcuauaaauucuccu

SEQ ID NO: 183702 - RNA, 64 nt, hsa
gguuuucuucuguuugacauuuguguucauuuuuucucuuuauguauuacauuuuaaccuauau

SEQ ID NO: 183703 - RNA, 64 nt, hsa
uaccaaaaaaagagaguuauuacaaauaaauaugucucuuuauuuuuaaaaaugaaaucuuaau

SEQ ID NO: 183704 - RNA, 64 nt, hsa
guccuccugcuugggcaucauugggccaguuccuucucuuuaaaucagauuuguaauggcuccc

SEQ ID NO: 183705 - RNA, 64 nt, hsa
ggguucgcucuuggaucucauccauccauuguguucucuuuaaugcugccugccuuuugaggca

SEQ ID NO: 183706 - RNA, 64 nt, hsa
auaauucuagugggaauauaaugugacaggaacuucucuuuauauacgcuaccaauuuaugagc

SEQ ID NO: 183707 - RNA, 64 nt, hsa
uccucuuuucugcaauacccaacgaaacaccuuuucucuuuauuauucagaaauguccuaacau

SEQ ID NO: 183708 - RNA, 64 nt, hsa
cucugccuuaaacacacauugcagcuucaacuuuucucuuuaguguucuguuugaaacuaauac

SEQ ID NO: 183709 - RNA, 64 nt, hsa
gaucuaaauccacuccuuccacaguaccggauucucucuuuaacccuccccuucguguuucccc

SEQ ID NO: 183710 - RNA, 64 nt, hsa
auggucugucacuccuaucauuaccuugcacccaucucuuuagauggccucagcaccucacucg

SEQ ID NO: 183711 - RNA, 64 nt, hsa
cacauugaaauguauacagauguacuagcuaaagucucuuuaugugucaguauuaagaguaaua

SEQ ID NO: 183712 - RNA, 64 nt, hsa
acuucaagaugaucauucuggcccagcccuuuuaucucuuuaucuccaauggugugcguuuuaa

SEQ ID NO: 183713 - RNA, 64 nt, hsa
ggcuggcugccucugccucuacuaacuuccuuugucucuuuauccuccugcuuaggccgugucu

SEQ ID NO: 183714 - RNA, 64 nt, hsa
gggcaagggugggagguuuuuagaagaguauauaucucuuuaaaaaaaaacagaaagaaaaaua

SEQ ID NO: 183715 - RNA, 64 nt, hsa
gcauuggggucuucagagucgauauauagguagaucucuuuagucuuuuccaccuuucacaucc

SEQ ID NO: 183716 - RNA, 64 nt, hsa
guucuucuacuggcugugaugaagugccagaaugucucuuuagaacaagaguuagauucccccu

SEQ ID NO: 183717 - RNA, 64 nt, hsa
uauggauguguguauauguacagugaaaauguugucucuuuacaaccaauugauaaccaaucac

SEQ ID NO: 183718 - RNA, 64 nt, hsa
cccaggaacauucuuagcucggacucuugaagaaucucuuuagauuuuguuggcaaaagccuua

SEQ ID NO: 183719 - RNA, 64 nt, hsa
acaggagaucaucuguccauuuuagaaccauuaaucucuuuauccauugcugaacgacugugac

SEQ ID NO: 183720 - RNA, 64 nt, hsa
uuaguuauauaaauuuuauuguuuuagguuaguaucucuuuacuaaauugucagucuauaagau

SEQ ID NO: 183721 - RNA, 64 nt, hsa
aaaguuuuaauguuuuaacuuggggaaaaauacaucucuuuaauguuuagcaugcuugucaacc

SEQ ID NO: 183722 - RNA, 64 nt, hsa
cuucugaaagaauuuucuauuuuuaaaaaauguaucucuuuagccuuuucugcuggagauuaua

SEQ ID NO: 183723 - RNA, 64 nt, hsa
uagcauacaauuuauguuaguagacaucuuuaaaucucuuuaaugagugaauccaugcaagccc

SEQ ID NO: 183724 - RNA, 64 nt, hsa
aauuuguacugaaguguugaccaaguucauuuuuucucuuuacuuuuuccuuuuccuucuuaag

SEQ ID NO: 183725 - RNA, 64 nt, hsa
aaugcaccugacagaaaaaaaagaaaaaugaauuucucuuuacuucucuccaccuucuccaucu

SEQ ID NO: 183726 - RNA, 64 nt, hsa
gacauuccauuguagaaaaauggggccucuggugucucuuuaccaggggcagugccucucugcg

SEQ ID NO: 183727 - RNA, 64 nt, hsa
gccccuggcuucuuccucccuuucccgcuucugcucucuuuauggacuggucagaggguaggug

SEQ ID NO: 183728 - RNA, 64 nt, hsa
gccuugguuggguauuugauuuauccagaaugcuucucuuuagggaacaaggauguuuuuaaug

SEQ ID NO: 183729 - RNA, 64 nt, hsa
uacuuuguuuuuauucuguuaaugcauucuuucuucucuuuacuuccuuucuuaccaguacacu

SEQ ID NO: 183730 - RNA, 64 nt, hsa
acaggcauuagccaccaugccuggccuauucuggucucuuuaacucucuccucuuuauuucucu

SEQ ID NO: 183731 - RNA, 64 nt, hsa
ucaggacucaguccugggcucucuucuauucuggucucuuuauuuuuuuauuuuuguauuuuuu

SEQ ID NO: 183732 - RNA, 64 nt, hsa
aauuaagcugaugacuuugcagugacucaaguugucucuuuaucaugguuuaccagguagagug

SEQ ID NO: 183733 - RNA, 64 nt, hsa
ggccuuauucucauaauuaaaaucuaauucauuuucucuuuaguguuaguagacuccaacaaca

SEQ ID NO: 183734 - RNA, 64 nt, hsa
uaagacaacaccacaggccgcaugcucuaaucggucucuuuauauacucaggcagcauauauua

SEQ ID NO: 183735 - RNA, 64 nt, hsa
caaaugucauacauuccacauugugugguagccaucucuuuagacucauguguuuuggggaaag

SEQ ID NO: 183736 - RNA, 64 nt, hsa
gugauucuugacggugacucuuguauguaauccuguggcuuaacuacuucucccuccuugucca

SEQ ID NO: 183737 - RNA, 64 nt, hsa
ucucuguuugugauaucacuuuaauuuuucuuggguggcuuagagacuaagggaggagacaucu

SEQ ID NO: 183738 - RNA, 64 nt, hsa
uuauuagaaaacaaacugcuugacccaggaacaaguggcuuagcuuaaguaaacuuggcuuugc

SEQ ID NO: 183739 - RNA, 64 nt, hsa
cagaucccugauccuuccagcuggucugcuaugaguggcuuaucccgcaugagcaggagcgugc

SEQ ID NO: 183740 - RNA, 64 nt, hsa
caugauugaaaggaagcagucuuggccaggcacgguggcuuacaccuguaacccuggcauuuug

SEQ ID NO: 183741 - RNA, 64 nt, hsa
agaguaauuguauaguuauugagaccuauaguguguggcuuagaugaaagggagaguaaauuuu

SEQ ID NO: 183742 - RNA, 64 nt, hsa
uggcaaauuuaugcuauuccuggaaaaauacauuguggcuuagcaaauaagcaaguucccacgu

SEQ ID NO: 183743 - RNA, 64 nt, hsa
uuuuauauuggugaaaucaauaugucuugguauaguggcuuaaauaaaacaauuuuagccuuuc

SEQ ID NO: 183744 - RNA, 64 nt, hsa
gcuguuguaaaagagaccucuggggccgagugugguggcuuaugccuguaaucccugcacuuug

SEQ ID NO: 183745 - RNA, 64 nt, hsa
cauucuuuaugaaagaauuuuggggccgggcgcgguggcuuaugccuguaaucccagcacuuug

SEQ ID NO: 183746 - RNA, 64 nt, hsa
ccgcauuuugugcuugaauuacgugccccacacuguggcuuaggauacuuauugggguauaaug

SEQ ID NO: 183747 - RNA, 64 nt, hsa
guucagggugccuuucuccuaccaggagaguacuguggcuuagaggaaagaaauggucuaucaa

SEQ ID NO: 183748 - RNA, 64 nt, hsa
guuugagcugcuauaauaaagcaccauagacuugguggcuuauaaacaacagaaauuuauuccu

SEQ ID NO: 183749 - RNA, 64 nt, hsa
ccugagggcaacaggguuugcugcacuucuuuuaguggcuuaaggauuuuguucuguaggggag

SEQ ID NO: 183750 - RNA, 64 nt, hsa
aaacuuucugggccuccauccuaggaccugggcagacccacauggccugggcucugaaugccca

SEQ ID NO: 183751 - RNA, 64 nt, hsa
cagggaggccaguucugcagggugucagcuccaggacccacagggccagaaccagcugggagaa

SEQ ID NO: 183752 - RNA, 64 nt, hsa
ggacaagaaguugucaaagaauucccaacgccaggacccacaucccuuugguauugauuucaca

SEQ ID NO: 183753 - RNA, 64 nt, hsa
aauuccacacaaccaaacagucugccuuaaaagugacccacauuuuuccauagcuccucacuuu

SEQ ID NO: 183754 - RNA, 64 nt, hsa
ucauacggcuagcgaguggcgggccugggguucagacccacagcugccucaagcaaacagggua

SEQ ID NO: 183755 - RNA, 64 nt, hsa
uccaccugggaggcauuugggguugcaggaccgagacccacauccucucacucacuucuccacc

SEQ ID NO: 183756 - RNA, 64 nt, hsa
gcggggaugcucccacgccacgugcacacacacagacccacauguggguggggggcacccucac

SEQ ID NO: 183757 - RNA, 64 nt, hsa
ugggucagggggcuccgggucacggggucaaaaugacccacacgcugcagugacaagaagggca

SEQ ID NO: 183758 - RNA, 64 nt, hsa
ugagcaugggcaggggcuuucuccuuggaugugggacccacagcagcuuccugaggcugggggu

SEQ ID NO: 183759 - RNA, 64 nt, hsa
ccuggagguagggggcugucuuggucacugcugagacccacaggucuaagaggagaggcagagc

SEQ ID NO: 183760 - RNA, 64 nt, hsa
ccagcacugggaggccgaggggggcggaucgugaagucaggagaucgagaccauccuggcuaac

SEQ ID NO: 183761 - RNA, 64 nt, hsa
aacggauacugccucauugcacuccccaaaagagagucaggagagcagcaggagaggcgcacag

SEQ ID NO: 183762 - RNA, 64 nt, hsa
uacuucagauggccacuuuaguccuuucagcuguagucaggauuauuuaacuuaccuguauauc

SEQ ID NO: 183763 - RNA, 64 nt, hsa
ucagagaggaagcaucccuugugcaagaucacauagucaggaggugacacagggcuaagacuug

SEQ ID NO: 183764 - RNA, 64 nt, hsa
uuucagaaaugagugagaggccuuccugcagagcagucaggagaaaugguggagccuggggccc

SEQ ID NO: 183765 - RNA, 64 nt, hsa
ucucaugauuuuuggcucuagcuaggaauaguuuagucaggacucagaaaauuugagcuuaguu

SEQ ID NO: 183766 - RNA, 64 nt, hsa
aagcaguggcaagggacggagaggucccaacaggagucaggaagagguuugauuauaaccaaga

SEQ ID NO: 183767 - RNA, 64 nt, hsa
uaauuccuguuuucauggguccuguagauguuugagucaggaagguaaggcggggagugacuga

SEQ ID NO: 183768 - RNA, 64 nt, hsa
uugaucuaagucaagagaagaagaggagcuggcuagucaggaacuuauucauuaaccaccaaac

SEQ ID NO: 183769 - RNA, 64 nt, hsa
uugucuucuaaugaaauaaagauugaagagguugagucaggacugagcuggugaagaaaucuug

SEQ ID NO: 183770 - RNA, 64 nt, hsa
gaaggucugaggugggucugaaauucauacaugaagucaggaaaagaaaagaaacuuaguucua

SEQ ID NO: 183771 - RNA, 64 nt, hsa
gaacaaauucugacuugcagaaaugcagacauacagucaggaaagaacaaacuucaauuaaaug

SEQ ID NO: 183772 - RNA, 64 nt, hsa
cucgggccccuccguucugucucccucgacuccaagucaggaauaccgugggcuuccugcccuc

SEQ ID NO: 183773 - RNA, 64 nt, hsa
uuuacugcugaggcuucauucaguccugccccuuagucaggaaugcaguuuauucuacuccaag

SEQ ID NO: 183774 - RNA, 64 nt, hsa
ugucuaaccauugggaagguagaggcuggcagggaagacaaaucugcuacaaguccaugggaag

SEQ ID NO: 183775 - RNA, 64 nt, hsa
uuccaacugaucuauccauauuccuuaaguacuaaagacaaaauagagggcuucuuuuucucuc

SEQ ID NO: 183776 - RNA, 64 nt, hsa
augugucucuacagcuaccuuaccacugagccguaagacaaauguauaggaagaagcaaagucu

SEQ ID NO: 183777 - RNA, 64 nt, hsa
caccccugccuuuuuuuuuuuuuuuuuaaagaaaaagacaaaagaaaguggaagugguauuccc

SEQ ID NO: 183778 - RNA, 64 nt, hsa
gagcuagugauuucaaaagguuucacaauuccccaagacaaaagugauuuucguucauuauaau

SEQ ID NO: 183779 - RNA, 64 nt, hsa
gcacaaaaugaaugaauaaauaaauaaaugaauaaagacaaaagccaagguguaugcucucaag

SEQ ID NO: 183780 - RNA, 64 nt, hsa
uuauuacaucuuucacauuggcuauuuaaagacaaagacaaauucuguuucuugagaagagaau

SEQ ID NO: 183781 - RNA, 64 nt, hsa
uguauuuuauuacaucuuucacauuggcuauuuaaagacaaagacaaauucuguuucuugagaa

SEQ ID NO: 183782 - RNA, 64 nt, hsa
guauaugcaagugguauguguguaauuauggcuaaagacaaaccauuauucagugaauuacuaa

SEQ ID NO: 183783 - RNA, 64 nt, hsa
uugacugccaaacuuuuuccauuuguuauguuccaagacaaagaugaacccauacaugaucagc

SEQ ID NO: 183784 - RNA, 64 nt, hsa
cacuguggcgcugaaucagauuuaauaaugaguuaagacaaagccccuaccuaugggcuagugu

SEQ ID NO: 183785 - RNA, 64 nt, hsa
gauucuucugaauccuuuagugugaugguuucccaagacaaacauuuguccuaauagcuuucuc

SEQ ID NO: 183786 - RNA, 64 nt, hsa
aacccagaaagguuuaaaaaacauaaggaaaaaaaagacaaauuaaaggaggggcuaggggaga

SEQ ID NO: 183787 - RNA, 64 nt, hsa
gccucaaccaacuuagugacuuguuuagaaaaaaaagacaaaaaaguaaaaauaaaaacaaaaa

SEQ ID NO: 183788 - RNA, 64 nt, hsa
ucaucucauccuaauuaaggugacuauuuucaaaaagacaaaaaauaugacagccguggugguu

SEQ ID NO: 183789 - RNA, 64 nt, hsa
uuacuucauuaauacuucacaauacuauuugcauaagacaaaauaccacagcaaaaaaaaaaau

SEQ ID NO: 183790 - RNA, 64 nt, hsa
gaaccuagcauaacuuugugugacgagacugcacaagacaaagcucaggcaaguggcucaguag

SEQ ID NO: 183791 - RNA, 64 nt, hsa
gaagauuaacaauauuaaaauaugaaacauuuuuaagacaaaggcauuacuucucaguauuacc

SEQ ID NO: 183792 - RNA, 64 nt, hsa
uuuaguuuuaccuguaauuaauaagaacugauacaagacaaaaacaguuccuucagauucuacg

SEQ ID NO: 183793 - RNA, 64 nt, hsa
aaauaauggccaguuguuuaggaaggccuuuaggaagacaaauaaauaacaaacaaacagccac

SEQ ID NO: 183794 - RNA, 64 nt, hsa
uggaaagugugcauuggacaucuggaagccagaaaagacaaagaaauauccagaaaggaacaaa

SEQ ID NO: 183795 - RNA, 64 nt, hsa
agaugacaguucucuuugucuauauucagcaucuaagacaaauauuuaaacauuuuaaagaacc

SEQ ID NO: 183796 - RNA, 64 nt, hsa
ugauuuaaauguaaaccaaaagauggaagacaaaaagacaaacacacccacacgcagucuuugc

SEQ ID NO: 183797 - RNA, 64 nt, hsa
uuuugagaugauuuaaauguaaaccaaaagauggaagacaaaaagacaaacacacccacacgca

SEQ ID NO: 183798 - RNA, 64 nt, hsa
uuuuuaagggauguugcaaagggauuacuagagaaagacaaaaugugaccaaaaaaaagcauga

SEQ ID NO: 183799 - RNA, 64 nt, hsa
acagaagcaaaggagagcuuggggguggggagaaaagacaaaugugcucuauguccuaguaacu

SEQ ID NO: 183800 - RNA, 64 nt, hsa
uacaguugaaaacagauucucauaucaaguagcuaagacaaaaguuuuuuucaagaauugaaau

SEQ ID NO: 183801 - RNA, 64 nt, hsa
gggaauuugcccuuuuaauaauuuccaguccccuaagacaaaguaacccucaacguuuuaucuu

SEQ ID NO: 183802 - RNA, 64 nt, hsa
guggguucgggaggucucuaugagcaaggaauacaagacaaaacuuccucaaugcauugacuau

SEQ ID NO: 183803 - RNA, 64 nt, hsa
accuauaguagucuguguuuaaagugaauuuuuaaagacaaagcauucuaaaugaacucaauau

SEQ ID NO: 183804 - RNA, 64 nt, hsa
agagcgaaauuaccuuacuuaaggauaauaggacaagacaaauuacagauugucucagagaaaa

SEQ ID NO: 183805 - RNA, 64 nt, hsa
gggggacacuagaaugaaaaccaguguuaggguaaagacaaaacagacuauguacauaaucugu

SEQ ID NO: 183806 - RNA, 64 nt, hsa
ucauagaugcauacaaaugagcucacuuauuacaaagacaaacguuuaauuugcuaaauauuuu

SEQ ID NO: 183807 - RNA, 64 nt, hsa
uuugcgguaaggugagcugcacggaaggaauaagaagacaaauggcgcccacuaguggggaauc

SEQ ID NO: 183808 - RNA, 64 nt, hsa
auagucgaauguucuuuucuuuaccuuuacaauuaagacaaaauguuuaauaagaauagcaaaa

SEQ ID NO: 183809 - RNA, 64 nt, hsa
auacaaagaggaaaggggaaaaaugacucagaacaagacaaaagcucugacuguuuaaaguuau

SEQ ID NO: 183810 - RNA, 64 nt, hsa
uggaaagccuggaguccccaaaccaaggauguggaagacaaauccuguccagccggguggcacc

SEQ ID NO: 183811 - RNA, 64 nt, hsa
ucugaacuccccugugaaugcaguucuuggcacaaagacaaaagcugcagugaaaauuuuggac

SEQ ID NO: 183812 - RNA, 64 nt, hsa
aaaugugacccccaaguccuauccuaaauaaaaaaagacaaauucggauguaugaucucucuag

SEQ ID NO: 183813 - RNA, 64 nt, hsa
caucuccuuacagucacuaauauaguagauuuuaaagacaaaauuuuucuuuucuugauuuuuu

SEQ ID NO: 183814 - RNA, 64 nt, hsa
gguucacuaauaaauucugaguaaauuaguggugaagacaaaauauaacuuguuuuagugagcc

SEQ ID NO: 183815 - RNA, 64 nt, hsa
agugagccacugaggaaagaauaugcuuauuacaaagacaaaauguggugcagaaacuaucuug

SEQ ID NO: 183816 - RNA, 64 nt, hsa
cagcaccaacauguaaccggcauguuuccagcagaagacaaaaagacaaacaugaaagucuaga

SEQ ID NO: 183817 - RNA, 64 nt, hsa
acauguaaccggcauguuuccagcagaagacaaaaagacaaacaugaaagucuagaaauaaaac

SEQ ID NO: 183818 - RNA, 64 nt, hsa
ucuuuucucaaaagauugcuguaagaaaaaauguaagacaaaaaaaaaaaaaaaaaacaaacag

SEQ ID NO: 183819 - RNA, 64 nt, hsa
aucaguagaaaccaagauuuuaaaaugaagugucaagacaaaggcaaaaccugagcaguuccua

SEQ ID NO: 183820 - RNA, 64 nt, hsa
uagaaauaaauguuaccuaauuauuacagccuuaaagacaaaaauccuuguugaaguuuuuuua

SEQ ID NO: 183821 - RNA, 64 nt, hsa
gagcaaagaugguaaaaagaagaaaaagaagucaaagacaaaguguguaauuauguaaauacaa

SEQ ID NO: 183822 - RNA, 64 nt, hsa
uauauaacuuaauguuaagugucuugaggcauaaaagacaaaauguggcuuauuuuaggaucug

SEQ ID NO: 183823 - RNA, 64 nt, hsa
cuuuuugucuagguuuucuuucugcucuuuauugaagacaaacacucaccaaaaagaaaaauaa

SEQ ID NO: 183824 - RNA, 64 nt, hsa
ccaccacuccuggagucccaaugacuucucuggaaagacaaagagguuaucacaaaaauuccuc

SEQ ID NO: 183825 - RNA, 64 nt, hsa
aagaaacaaaaaacaaacaaacaaacaaaaauagaagacaaaagaaagacauaugaaaggaauu

SEQ ID NO: 183826 - RNA, 64 nt, hsa
gccaggccccgggaguggggaccaagauguacauaagacaaagcuacugccuucuagagacaac

SEQ ID NO: 183827 - RNA, 64 nt, hsa
ugccuucuagagacaaccggcagugaccucacugaagacaaaaacugcccuagccagguacuga

SEQ ID NO: 183828 - RNA, 64 nt, hsa
accccuauuuuccucuuaauaauacguuugggugaagacaaauuaguguuuaguaauugcauca

SEQ ID NO: 183829 - RNA, 64 nt, hsa
auuuggauuuacuuuuacagaauauugaaaagauaagacaaauuauaaauaaguucuaaaacau

SEQ ID NO: 183830 - RNA, 52 nt, hsa
guaugaacugcauguuuuaaagaagacaaaugcaaaccaaagcaacuuagua

SEQ ID NO: 183831 - RNA, 64 nt, hsa
gccagugcgagacugaacuugugcagccuuagccaagacaaagcaguguuuuucagcagacggc

SEQ ID NO: 183832 - RNA, 64 nt, hsa
gauucauugucccuuucuugaaaguuucuuuuuuaagacaaauacauuauuucugcauugauca

SEQ ID NO: 183833 - RNA, 64 nt, hsa
agaaucagcacucaggucuuuuucuucagaaaugaagacaaaauuuaaaauaugaaaugaugca

SEQ ID NO: 183834 - RNA, 64 nt, hsa
aagaacaccccugccgacucccagcccggccaaaaagacaaaacacauagacgcacacacucag

SEQ ID NO: 183835 - RNA, 64 nt, hsa
agaagaagaagaaauaaaaacccacccaagcaagaagacaaaagguaaagacgcaacguuucca

SEQ ID NO: 183836 - RNA, 64 nt, hsa
uguaaaaaaaaaaaaaaaaaaaaagacaaaacaaaagacaaaaaaaaaaaaaaaacccaacaag

SEQ ID NO: 183837 - RNA, 64 nt, hsa
gugauaaaaaacuguaaaaaaaaaaaaaaaaaaaaagacaaaacaaaagacaaaaaaaaaaaaa

SEQ ID NO: 183838 - RNA, 64 nt, hsa
ggauucuugaacuugaaaaaaaaaaacacaaaaaaagacaaaaaaaaaaaaagaaaauauuuug

SEQ ID NO: 183839 - RNA, 64 nt, hsa; identical to SEQ ID NO: 98813

SEQ ID NO: 183840 - RNA, 64 nt, hsa; identical to SEQ ID NO: 98814

SEQ ID NO: 183841 - RNA, 64 nt, hsa; identical to SEQ ID NO: 98815

SEQ ID NO: 183842 - RNA, 64 nt, hsa; identical to SEQ ID NO: 98816

SEQ ID NO: 183843 - RNA, 64 nt, hsa; identical to SEQ ID NO: 98817

SEQ ID NO: 183844 - RNA, 64 nt, hsa; identical to SEQ ID NO: 98818

SEQ ID NO: 183845 - RNA, 64 nt, hsa; identical to SEQ ID NO: 98819

SEQ ID NO: 183846 - RNA, 64 nt, hsa; identical to SEQ ID NO: 98820

SEQ ID NO: 183847 - RNA, 64 nt, hsa; identical to SEQ ID NO: 98821

SEQ ID NO: 183848 - RNA, 64 nt, hsa; identical to SEQ ID NO: 98822

SEQ ID NO: 183849 - RNA, 64 nt, hsa; identical to SEQ ID NO: 98823

SEQ ID NO: 183850 - RNA, 64 nt, hsa; identical to SEQ ID NO: 98824

SEQ ID NO: 183851 - RNA, 64 nt, hsa; identical to SEQ ID NO: 98825

SEQ ID NO: 183852 - RNA, 64 nt, hsa; identical to SEQ ID NO: 98826

SEQ ID NO: 183853 - RNA, 64 nt, hsa; identical to SEQ ID NO: 98827

SEQ ID NO: 183854 - RNA, 64 nt, hsa; identical to SEQ ID NO: 98828

SEQ ID NO: 183855 - RNA, 64 nt, hsa; identical to SEQ ID NO: 98829

SEQ ID NO: 183856 - RNA, 64 nt, hsa; identical to SEQ ID NO: 98830

SEQ ID NO: 183857 - RNA, 64 nt, hsa; identical to SEQ ID NO: 98831

SEQ ID NO: 183858 - RNA, 64 nt, hsa; identical to SEQ ID NO: 98832

SEQ ID NO: 183859 - RNA, 64 nt, hsa; identical to SEQ ID NO: 98833

SEQ ID NO: 183860 - RNA, 64 nt, hsa; identical to SEQ ID NO: 98834

SEQ ID NO: 183861 - RNA, 64 nt, hsa; identical to SEQ ID NO: 98835

SEQ ID NO: 183862 - RNA, 64 nt, hsa; identical to SEQ ID NO: 98836

SEQ ID NO: 183863 - RNA, 64 nt, hsa; identical to SEQ ID NO: 98837

SEQ ID NO: 183864 - RNA, 64 nt, hsa; identical to SEQ ID NO: 98838

SEQ ID NO: 183865 - RNA, 64 nt, hsa; identical to SEQ ID NO: 98839

SEQ ID NO: 183866 - RNA, 64 nt, hsa; identical to SEQ ID NO: 98840

SEQ ID NO: 183867 - RNA, 64 nt, hsa; identical to SEQ ID NO: 98841

SEQ ID NO: 183868 - RNA, 64 nt, hsa; identical to SEQ ID NO: 98842

SEQ ID NO: 183869 - RNA, 64 nt, hsa; identical to SEQ ID NO: 98843

SEQ ID NO: 183870 - RNA, 64 nt, hsa; identical to SEQ ID NO: 98844

SEQ ID NO: 183871 - RNA, 64 nt, hsa; identical to SEQ ID NO: 98845

SEQ ID NO: 183872 - RNA, 64 nt, hsa; identical to SEQ ID NO: 98846

SEQ ID NO: 183873 - RNA, 64 nt, hsa; identical to SEQ ID NO: 98847

SEQ ID NO: 183874 - RNA, 64 nt, hsa; identical to SEQ ID NO: 98848

SEQ ID NO: 183875 - RNA, 64 nt, hsa; identical to SEQ ID NO: 98849

SEQ ID NO: 183876 - RNA, 64 nt, hsa; identical to SEQ ID NO: 98850

SEQ ID NO: 183877 - RNA, 64 nt, hsa; identical to SEQ ID NO: 98851

SEQ ID NO: 183878 - RNA, 64 nt, hsa; identical to SEQ ID NO: 98852

SEQ ID NO: 183879 - RNA, 64 nt, hsa; identical to SEQ ID NO: 98853

SEQ ID NO: 183880 - RNA, 64 nt, hsa; identical to SEQ ID NO: 98854

SEQ ID NO: 183881 - RNA, 64 nt, hsa; identical to SEQ ID NO: 98855

SEQ ID NO: 183882 - RNA, 64 nt, hsa; identical to SEQ ID NO: 98856

SEQ ID NO: 183883 - RNA, 64 nt, hsa; identical to SEQ ID NO: 98857

SEQ ID NO: 183884 - RNA, 64 nt, hsa; identical to SEQ ID NO: 98858

SEQ ID NO: 183885 - RNA, 64 nt, hsa; identical to SEQ ID NO: 98859

SEQ ID NO: 183886 - RNA, 64 nt, hsa; identical to SEQ ID NO: 98860

SEQ ID NO: 183887 - RNA, 64 nt, hsa; identical to SEQ ID NO: 98861

SEQ ID NO: 183888 - RNA, 64 nt, hsa; identical to SEQ ID NO: 98862

SEQ ID NO: 183889 - RNA, 64 nt, hsa; identical to SEQ ID NO: 98863

SEQ ID NO: 183890 - RNA, 64 nt, hsa; identical to SEQ ID NO: 98864

SEQ ID NO: 183891 - RNA, 64 nt, hsa; identical to SEQ ID NO: 98865

SEQ ID NO: 183892 - RNA, 64 nt, hsa; identical to SEQ ID NO: 98866

SEQ ID NO: 183893 - RNA, 64 nt, hsa; identical to SEQ ID NO: 98867

SEQ ID NO: 183894 - RNA, 64 nt, hsa; identical to SEQ ID NO: 98868

SEQ ID NO: 183895 - RNA, 64 nt, hsa; identical to SEQ ID NO: 98869

SEQ ID NO: 183896 - RNA, 64 nt, hsa; identical to SEQ ID NO: 98870

SEQ ID NO: 183897 - RNA, 64 nt, hsa; identical to SEQ ID NO: 98871

SEQ ID NO: 183898 - RNA, 64 nt, hsa; identical to SEQ ID NO: 98872

SEQ ID NO: 183899 - RNA, 64 nt, hsa; identical to SEQ ID NO: 98873

SEQ ID NO: 183900 - RNA, 64 nt, hsa; identical to SEQ ID NO: 98874

SEQ ID NO: 183901 - RNA, 64 nt, hsa; identical to SEQ ID NO: 98875

SEQ ID NO: 183902 - RNA, 64 nt, hsa; identical to SEQ ID NO: 98876

SEQ ID NO: 183903 - RNA, 64 nt, hsa; identical to SEQ ID NO: 98877

SEQ ID NO: 183904 - RNA, 64 nt, hsa; identical to SEQ ID NO: 98878

SEQ ID NO: 183905 - RNA, 64 nt, hsa; identical to SEQ ID NO: 98879

SEQ ID NO: 183906 - RNA, 64 nt, hsa; identical to SEQ ID NO: 98880

SEQ ID NO: 183907 - RNA, 64 nt, hsa; identical to SEQ ID NO: 98881

SEQ ID NO: 183908 - RNA, 64 nt, hsa; identical to SEQ ID NO: 98882

SEQ ID NO: 183909 - RNA, 64 nt, hsa; identical to SEQ ID NO: 98883

SEQ ID NO: 183910 - RNA, 64 nt, hsa; identical to SEQ ID NO: 98884

SEQ ID NO: 183911 - RNA, 64 nt, hsa; identical to SEQ ID NO: 98885

SEQ ID NO: 183912 - RNA, 64 nt, hsa; identical to SEQ ID NO: 98886

SEQ ID NO: 183913 - RNA, 64 nt, hsa; identical to SEQ ID NO: 98887

SEQ ID NO: 183914 - RNA, 64 nt, hsa; identical to SEQ ID NO: 98888

SEQ ID NO: 183915 - RNA, 64 nt, hsa; identical to SEQ ID NO: 98889

SEQ ID NO: 183916 - RNA, 64 nt, hsa; identical to SEQ ID NO: 98890

SEQ ID NO: 183917 - RNA, 64 nt, hsa; identical to SEQ ID NO: 98891

SEQ ID NO: 183918 - RNA, 64 nt, hsa; identical to SEQ ID NO: 98892

SEQ ID NO: 183919 - RNA, 64 nt, hsa; identical to SEQ ID NO: 98893

SEQ ID NO: 183920 - RNA, 64 nt, hsa; identical to SEQ ID NO: 98894

SEQ ID NO: 183921 - RNA, 64 nt, hsa; identical to SEQ ID NO: 98895

SEQ ID NO: 183922 - RNA, 64 nt, hsa; identical to SEQ ID NO: 98896

SEQ ID NO: 183923 - RNA, 64 nt, hsa; identical to SEQ ID NO: 98897

SEQ ID NO: 183924 - RNA, 64 nt, hsa; identical to SEQ ID NO: 98898

SEQ ID NO: 183925 - RNA, 64 nt, hsa; identical to SEQ ID NO: 98899

SEQ ID NO: 183926 - RNA, 64 nt, hsa; identical to SEQ ID NO: 98900

SEQ ID NO: 183927 - RNA, 64 nt, hsa; identical to SEQ ID NO: 98901

SEQ ID NO: 183928 - RNA, 64 nt, hsa; identical to SEQ ID NO: 98902

SEQ ID NO: 183929 - RNA, 64 nt, hsa; identical to SEQ ID NO: 98903

SEQ ID NO: 183930 - RNA, 64 nt, hsa; identical to SEQ ID NO: 98904

SEQ ID NO: 183931 - RNA, 64 nt, hsa; identical to SEQ ID NO: 98905

SEQ ID NO: 183932 - RNA, 64 nt, hsa; identical to SEQ ID NO: 98906

SEQ ID NO: 183933 - RNA, 64 nt, hsa; identical to SEQ ID NO: 98907

SEQ ID NO: 183934 - RNA, 64 nt, hsa; identical to SEQ ID NO: 98908

SEQ ID NO: 183935 - RNA, 64 nt, hsa; identical to SEQ ID NO: 98909

SEQ ID NO: 183936 - RNA, 64 nt, hsa; identical to SEQ ID NO: 98910

SEQ ID NO: 183937 - RNA, 64 nt, hsa; identical to SEQ ID NO: 98911

SEQ ID NO: 183938 - RNA, 64 nt, hsa; identical to SEQ ID NO: 98912

SEQ ID NO: 183939 - RNA, 64 nt, hsa
gugccauagucacauggccuaugcacauauggacucugcacaugaaucccacccacaugugaca

SEQ ID NO: 183940 - RNA, 64 nt, hsa
ugugucuguacacguguccuguaguugcguggacucugcacaugucuuguacauguguagccug

SEQ ID NO: 183941 - RNA, 64 nt, hsa
ucugugccugacacuuuaccuguaguauuucuagucugcacaauaacaccaaaauguaggauuu

SEQ ID NO: 183942 - RNA, 64 nt, hsa
ugcagaaaccagcugucugcugaugaacggcccaucugcacagcggcagcaaggauuaccccaa

SEQ ID NO: 183943 - RNA, 64 nt, hsa
uuuuauuacuauuuaaacaagugauuaaauuuagucugcacagugagcaaggguucacaugcau

SEQ ID NO: 183944 - RNA, 64 nt, hsa
ucauauauaugguaauaauuucccucuuuuguagucugcacaagauccauaaaagauuguauuu

SEQ ID NO: 183945 - RNA, 64 nt, hsa
gccagaaaucacuuuuauauugucacaugggcccucugcacagaguccgauggcuccucccggg

SEQ ID NO: 183946 - RNA, 64 nt, hsa
caccucugccuucuuccucuguugccaugugaucucugcacacgcuagcucuccuucgccuucu

SEQ ID NO: 183947 - RNA, 64 nt, hsa
uuccgaagugaaccauuccaccagaaccuuugauucugcacaagauuuccuugcucugggaaca

SEQ ID NO: 183948 - RNA, 64 nt, hsa
ucugcuguuacucagccccugagucugacucaucucugcacaaccucucugugccaugaagaua

SEQ ID NO: 183949 - RNA, 64 nt, hsa
uuuuacauugugaaugcugugggaaggcaauuucucugcacacaagaggcuacguuuuggaagu

SEQ ID NO: 183950 - RNA, 64 nt, hsa
gcggagaauucuuagcauacauucagacguuuuuucugcacaauaauaaguccaucugucacuu

SEQ ID NO: 183951 - RNA, 64 nt, hsa
aaaguugaugccaucaaaccuugacaccgggugcucugcacacccacgcggauguugcaccuca

SEQ ID NO: 183952 - RNA, 64 nt, hsa
aacaaacuccuaguccuuuagaaauaacagauucucugcacaaaaccacccauucauucauuua

SEQ ID NO: 183953 - RNA, 64 nt, hsa
cucaagaaaggccugaaugacaauguccaggaugucugcacaacugagcagcucgcucacuccc

SEQ ID NO: 183954 - RNA, 64 nt, hsa
ugggaagaggcaaggagcuucugaagaaacugccucugcacacacaucacuggcugugaccccu

SEQ ID NO: 183955 - RNA, 64 nt, hsa
cucacugacaaauagaccuuucagccugugagccucugcacaaagcagaggcugugggcuguca

SEQ ID NO: 183956 - RNA, 64 nt, hsa
uuuuuuuuuuugucauugucugaccaaaauuccuucugcacaugaggccaguauaggcaacguc

SEQ ID NO: 183957 - RNA, 64 nt, hsa
auagcaccuuuuguauaaacaaugugauauugcuucugcacauccaaaaauucugggucuuuuc

SEQ ID NO: 183958 - RNA, 64 nt, hsa
ugaaucugaugcucugcugaauaauuucauuaccucugcacaugccugucaaauaugaaauugg

SEQ ID NO: 183959 - RNA, 64 nt, hsa
gccucuccacuucaugauuuucagcuaacuugcuucugcacagacccccuuucccuauaagggc

SEQ ID NO: 183960 - RNA, 64 nt, hsa
ugggugcuauggcauccugggcaggugcuuccuuucugcacaaggguugggugaccaugauguc

SEQ ID NO: 183961 - RNA, 64 nt, hsa
uucgucugcacagcugugaggcgaugcuguuccaucugcacaugaaggacccccauacagccug

SEQ ID NO: 183962 - RNA, 64 nt, hsa
cgcauuguucguggcaguagaccacaucuguucgucugcacagcugugaggcgaugcuguucca

SEQ ID NO: 183963 - RNA, 64 nt, hsa
gugcaucucuggccuaccgcaguggccccggcugucugcacauuuuuuguagacacauuagagu

SEQ ID NO: 183964 - RNA, 64 nt, hsa
gucuuguucaaguucagacgaagcuacucuggcaucugcacauuuccguguuacagcagcugcc

SEQ ID NO: 183965 - RNA, 64 nt, hsa
aaauccucagcaaaauacuaguaaaccaaauccaucugcacaucaaaaagcuaauccaacauua

SEQ ID NO: 183966 - RNA, 64 nt, hsa
auugacaagugggaccuaauuaaacuaaauaacuucugcacagcaaaagaagcuauuugcagac

SEQ ID NO: 183967 - RNA, 64 nt, hsa
ccauaggugugacaauccgagcaguggagucauucagcgggagcacugcgcgcuauccccucac

SEQ ID NO: 183968 - RNA, 64 nt, hsa
agccccguggagcuggacugaggaggaggcugcacagcgggagagcagcugguccagaccagcc

SEQ ID NO: 183969 - RNA, 64 nt, hsa
caaccuaugguauaaugguugacuggguuucucuguauaguacuggcaugguacggagauguuu

SEQ ID NO: 183970 - RNA, 64 nt, hsa
uuuuauuuucuuuuguaaauguuuagguuuuuuuguauaguaaagugauaauuucuggaauuag

SEQ ID NO: 183971 - RNA, 64 nt, hsa
agauggugauauuuuccuuacaagauggguaccaguauaguaauaucuguauacuaacuagggc

SEQ ID NO: 183972 - RNA, 64 nt, hsa
ggcuuuaagauuuaaaaguuucacacaaccauaaguauaguauuucaugccaguaaaauuuuuu

SEQ ID NO: 183973 - RNA, 64 nt, hsa
uccgagccuccggagaauuaacucuauuacguuuguauaguaaguuuguaaacugcuuggcaaa

SEQ ID NO: 183974 - RNA, 64 nt, hsa
ucugccauggugaggugagcgugaucucuuuucaguauaguaguuaacauuuucuaguauuuuu

SEQ ID NO: 183975 - RNA, 64 nt, hsa
guguguuuccuguaguuugauccgaaggaaaagaguauaguagccugagaaucaggagauggga

SEQ ID NO: 183976 - RNA, 64 nt, hsa
auaggucagaagacgauggaacuguccuggguuaguauaguaaucuuacaguaggauccuuagg

SEQ ID NO: 183977 - RNA, 64 nt, hsa
uuguguuggguucuuuuuuuuuuuuaaaugaaaaguauaguauguggcacuuuuuaaagaacaa

SEQ ID NO: 183978 - RNA, 64 nt, hsa
cauuuuguuuguccuggcuaaacuuggaguuugaguauaguaaauuaugauccuuaaauauuug

SEQ ID NO: 183979 - RNA, 64 nt, hsa
gggugugaggugcaguuguccaggagacgauuuuguauaguauuuuucuuguacauuacuucca

SEQ ID NO: 183980 - RNA, 64 nt, hsa
cucccaaucuuuuuuguuaguccggccgucaauuguauaguaccaauuucguaaauucucucaa

SEQ ID NO: 183981 - RNA, 64 nt, hsa
guauaguuauuguguagcacauaugguuugcacuguauaguagcuuuuaaagaaaauagucaca

SEQ ID NO: 183982 - RNA, 64 nt, hsa
cuguauguuaaaugaagauggcaauuuuuuucuuguauaguacuuguauuuucuuucgcugaug

SEQ ID NO: 183983 - RNA, 64 nt, hsa
agacauuugacccuuagcuccaguuuucuucugauguuuccaucuuccagaaucccucaaaaaa

SEQ ID NO: 183984 - RNA, 64 nt, hsa
gugguguaacuuaguucuugaugaucccacuuccuguuuccaucugcuugggauauaccagagu

SEQ ID NO: 183985 - RNA, 64 nt, hsa
aguuucuuguguuuuuuuuuuuccccacaaaguguguuuccacuuggagcaccauuuugaccca

SEQ ID NO: 183986 - RNA, 64 nt, hsa
aauaacauggcacacagaacaauggaaaaaaguuuguuuccauuggaaaauuauaucauuuugg

SEQ ID NO: 183987 - RNA, 64 nt, hsa
auuucucugugaccaaaauuaagcaugaaaaaaauguuuccauugccauauuugauucacuagu

SEQ ID NO: 183988 - RNA, 64 nt, hsa
ccucuuugucauacugcacauauaaaacgucuuuuguuuccaacaagaggauuuucuuuuucau

SEQ ID NO: 183989 - RNA, 64 nt, hsa
uuuucuacaagguccacuauuucugaguuuaauguguuuccaacacuuaaggagacucuaauga

SEQ ID NO: 183990 - RNA, 64 nt, hsa
cgaugccacggauugcaggccaaauuucagaucguguuuccaaacacccuugcugugcccuuua

SEQ ID NO: 183991 - RNA, 64 nt, hsa
aagcugaaucuuguaaaauuauaacuucauuaaauguuuccacaaguauuucugagauacaaua

SEQ ID NO: 183992 - RNA, 64 nt, hsa
acaaauauuuugcauuuuuaggagguuuuuagaauguuuccauugcuuuuauauagugugcuug

SEQ ID NO: 183993 - RNA, 64 nt, hsa
cuuuggcaagcuggauuucucagagccagcauguuguuuccauaacuacuuugauauuuuaacu

SEQ ID NO: 183994 - RNA, 64 nt, hsa
augcccugaaaagaguaacaaaguaugcuuugccuguuuccacuuaccaggaaauuccuucaga

SEQ ID NO: 183995 - RNA, 64 nt, hsa
aagaggaaaggguugugcaaggagagcaggaggcuguuuccaaaaaccaguguaguaggauagg

SEQ ID NO: 183996 - RNA, 64 nt, hsa
augcuuauagccacaacaucuauuuuaccaauauuguuuccauuacacuaccuuggauuuugca

SEQ ID NO: 183997 - RNA, 64 nt, hsa
ucaggaugggcaugugaagugacugaccuuaagauguuuccauucuccugugaauuuuaacuug

SEQ ID NO: 183998 - RNA, 64 nt, hsa
acugagaagccagugaucugcaagcauuugcucuuguuuccacaucaccucugggauauuucag

SEQ ID NO: 183999 - RNA, 64 nt, hsa
uguuuccacaucaccucugggauauuucagcuguuguuuccaaauggcaaaucaucaacuaaaa

SEQ ID NO: 184000 - RNA, 64 nt, hsa
aaucuaaucuguugugcuuuuguuggacuuggcauguuuccaugaacugcacuauuauaaacua

SEQ ID NO: 184001 - RNA, 64 nt, hsa
agagguauuuauuuuuucacuuguaaaaaaauaauguuuccacguaaagaacucuguuauaucc

SEQ ID NO: 184002 - RNA, 64 nt, hsa
cugcuuauccuucuuuccuuacccuuuguccuuuuguuuccauuaguuuucuuucgucuuguau

SEQ ID NO: 184003 - RNA, 64 nt, hsa
ucuuugacacauucggaaccguucacccaugacauguuuccauggcucacccuuggcauccauc

SEQ ID NO: 184004 - RNA, 64 nt, hsa
uuuuuccucugaaguaaguugcauguuugaggcauguuuccaaauauuaucaaaauauccugaa

SEQ ID NO: 184005 - RNA, 64 nt, hsa
aacugugugccaagugugacuuuguacaguuuuauguuuccacucuccuguauguguagccacu

SEQ ID NO: 184006 - RNA, 64 nt, hsa
gauucauaagggauauagacaguacuuuaacuuguguuuccagauaaggcagauuuuggucauc

SEQ ID NO: 184007 - RNA, 64 nt, hsa
guucuuuguaauuuuaauuccaugaaagucuuaauguuuccaacaugaaaauucucuuacuuaa

SEQ ID NO: 184008 - RNA, 64 nt, hsa
acccuuucauugcagcgaucugcacacguguggguguuuccauaggacauugucaggcacggau

SEQ ID NO: 184009 - RNA, 64 nt, hsa
gcccugcccguugacuaacuaugcucugugguuuuguuuccagagaacucagauugcacagagc

SEQ ID NO: 184010 - RNA, 64 nt, hsa
aaccauaugggcaguguacaaaauaugaaacaacuguuuccacacuugcaccugaucaagagca

SEQ ID NO: 184011 - RNA, 64 nt, hsa
uuguuuugcagagaaauguuuuucauuucccguguguuuccauuuccuucugaaauucugauuu

SEQ ID NO: 184012 - RNA, 64 nt, hsa
auauuaaauggaagguuugcuguuuugaucuaguuguuuccaguggagcaguuuuaugaaauau

SEQ ID NO: 184013 - RNA, 64 nt, hsa
agaaaacuaggaauugaguauuuuguguacgguauguuuccauccucccuccccuuccuccucc

SEQ ID NO: 184014 - RNA, 64 nt, hsa
ucucacugucccccguuugccuccacgagccugcuguuuccaggaaauuacauaacguucaguu

SEQ ID NO: 184015 - RNA, 64 nt, hsa
auguaacuguuucccuuugauucuccaguauuccuguuuccauccaguuccuuacucuccucuu

SEQ ID NO: 184016 - RNA, 64 nt, hsa
agaguccuuuuugccccucccugccaccuccccguguuuccaagucagcuuuccugcaagaaga

SEQ ID NO: 184017 - RNA, 64 nt, hsa
gcaauggugaaaagagauuaggaaccccccagccuguuuccauucucugcccagcagucucuua

SEQ ID NO: 184018 - RNA, 64 nt, hsa
ucaauaagccagcaaaccaggacucugccccuucuguuuccauaggaaucauguuggauaguca

SEQ ID NO: 184019 - RNA, 64 nt, hsa
ccccucacuaucucuagagugagaaucuggcuccuguuuccaugggucaaagccgguugcagag

SEQ ID NO: 184020 - RNA, 64 nt, hsa
cauucuguccuaaugguuagaacaaaucuuuaucuguuuccacccacccugggauccuuuuuac

SEQ ID NO: 184021 - RNA, 64 nt, hsa
uuuugcauuuuuauaacuugguuauacuauauucuguuuccaaguaaccuuuuaacuaaaagau

SEQ ID NO: 184022 - RNA, 64 nt, hsa
cggcgccgugcucccgcugcucacccaaagaaguuguuuccauuuuaaaccggucuuuuggggc

SEQ ID NO: 184023 - RNA, 64 nt, hsa
cccguugacguuuauuuuacguaaaauaaacuguuguuuccaaugcaaucaacucuguauuaua

SEQ ID NO: 184024 - RNA, 64 nt, hsa
augaaaaugcucuaguguugugaugcacugcugauguuuccaauucagguacaaguauguuuua

SEQ ID NO: 184025 - RNA, 64 nt, hsa
auuagaaauaaucaugucucagaugaguaaugucuguuuccaggguucagaaaaggcaaacuca

SEQ ID NO: 184026 - RNA, 64 nt, hsa
aggcagguaaaccaaucaaaaacagaguuuucuguguuuccaugauaguguugaagccuaauga

SEQ ID NO: 184027 - RNA, 64 nt, hsa
agaaugacagucuuauauuuaaggcaccagucauuguuuccauuuuuuuuuuaauucuucccuu

SEQ ID NO: 184028 - RNA, 64 nt, hsa
uuuucaugguuuuuguuuguuuuguuuuuguuuuuguuuccauuguuaccguugcuauggcccu

SEQ ID NO: 184029 - RNA, 64 nt, hsa
uagagagacuguguuucaacucucuuuucauugcuguuuccagaagaguggagagugugguuuc

SEQ ID NO: 184030 - RNA, 64 nt, hsa
ugacaugugaugauuuucagaaaguuguuguuuuuguuuccauagccuguuuaaguagguugua

SEQ ID NO: 184031 - RNA, 64 nt, hsa
guuaaugccaaaaagugguuaauauuaauaagacuguuuccacaccauaggcaauaauuucuua

SEQ ID NO: 184032 - RNA, 64 nt, hsa
guuguuuuuaucaucaugugcaauauuacugauuuguuuccaugcugauuguguggaaccagua

SEQ ID NO: 184033 - RNA, 64 nt, hsa
acuuuuuauuaugaccauuagaaacuauuuugaauguuuccaacuggcucaauuggcugggaaa

SEQ ID NO: 184034 - RNA, 64 nt, hsa; identical to SEQ ID NO: 45025

SEQ ID NO: 184035 - RNA, 64 nt, hsa; identical to SEQ ID NO: 45026

SEQ ID NO: 184036 - RNA, 64 nt, hsa; identical to SEQ ID NO: 45027

SEQ ID NO: 184037 - RNA, 64 nt, hsa; identical to SEQ ID NO: 45028

SEQ ID NO: 184038 - RNA, 64 nt, hsa; identical to SEQ ID NO: 45029

SEQ ID NO: 184039 - RNA, 64 nt, hsa; identical to SEQ ID NO: 45030

SEQ ID NO: 184040 - RNA, 64 nt, hsa; identical to SEQ ID NO: 45031

SEQ ID NO: 184041 - RNA, 64 nt, hsa; identical to SEQ ID NO: 45032

SEQ ID NO: 184042 - RNA, 64 nt, hsa; identical to SEQ ID NO: 45033

SEQ ID NO: 184043 - RNA, 64 nt, hsa; identical to SEQ ID NO: 45034

SEQ ID NO: 184044 - RNA, 64 nt, hsa; identical to SEQ ID NO: 45035

SEQ ID NO: 184045 - RNA, 64 nt, hsa; identical to SEQ ID NO: 45036

SEQ ID NO: 184046 - RNA, 64 nt, hsa; identical to SEQ ID NO: 45037

SEQ ID NO: 184047 - RNA, 64 nt, hsa; identical to SEQ ID NO: 45038

SEQ ID NO: 184048 - RNA, 64 nt, hsa; identical to SEQ ID NO: 45039

SEQ ID NO: 184049 - RNA, 64 nt, hsa; identical to SEQ ID NO: 45040

SEQ ID NO: 184050 - RNA, 64 nt, hsa; identical to SEQ ID NO: 45041

SEQ ID NO: 184051 - RNA, 64 nt, hsa; identical to SEQ ID NO: 45042

SEQ ID NO: 184052 - RNA, 64 nt, hsa; identical to SEQ ID NO: 45043

SEQ ID NO: 184053 - RNA, 64 nt, hsa; identical to SEQ ID NO: 45044

SEQ ID NO: 184054 - RNA, 64 nt, hsa; identical to SEQ ID NO: 45045

SEQ ID NO: 184055 - RNA, 64 nt, hsa; identical to SEQ ID NO: 45046

SEQ ID NO: 184056 - RNA, 64 nt, hsa; identical to SEQ ID NO: 45047

SEQ ID NO: 184057 - RNA, 64 nt, hsa; identical to SEQ ID NO: 45048

SEQ ID NO: 184058 - RNA, 64 nt, hsa; identical to SEQ ID NO: 45049

SEQ ID NO: 184059 - RNA, 64 nt, hsa; identical to SEQ ID NO: 45050

SEQ ID NO: 184060 - RNA, 64 nt, hsa; identical to SEQ ID NO: 45051

SEQ ID NO: 184061 - RNA, 64 nt, hsa; identical to SEQ ID NO: 45052

SEQ ID NO: 184062 - RNA, 64 nt, hsa; identical to SEQ ID NO: 45053

SEQ ID NO: 184063 - RNA, 64 nt, hsa; identical to SEQ ID NO: 45054

SEQ ID NO: 184064 - RNA, 64 nt, hsa; identical to SEQ ID NO: 45055

SEQ ID NO: 184065 - RNA, 64 nt, hsa; identical to SEQ ID NO: 45056

SEQ ID NO: 184066 - RNA, 64 nt, hsa; identical to SEQ ID NO: 45057

SEQ ID NO: 184067 - RNA, 64 nt, hsa; identical to SEQ ID NO: 45058

SEQ ID NO: 184068 - RNA, 64 nt, hsa; identical to SEQ ID NO: 45059

SEQ ID NO: 184069 - RNA, 64 nt, hsa; identical to SEQ ID NO: 45060

SEQ ID NO: 184070 - RNA, 64 nt, hsa; identical to SEQ ID NO: 45061

SEQ ID NO: 184071 - RNA, 64 nt, hsa; identical to SEQ ID NO: 45062

SEQ ID NO: 184072 - RNA, 64 nt, hsa; identical to SEQ ID NO: 45063

SEQ ID NO: 184073 - RNA, 64 nt, hsa; identical to SEQ ID NO: 45064

SEQ ID NO: 184074 - RNA, 64 nt, hsa; identical to SEQ ID NO: 45065

SEQ ID NO: 184075 - RNA, 64 nt, hsa; identical to SEQ ID NO: 45066

SEQ ID NO: 184076 - RNA, 64 nt, hsa
uauuaaucucacuuagcgaaagugacggaugagcaguaaguaaguaaguguggggauuuaaacu

SEQ ID NO: 184077 - RNA, 64 nt, hsa
aaucucacuuagcgaaagugacggaugagcaguaaguaaguaaguguggggauuuaaacuugag

SEQ ID NO: 184078 - RNA, 64 nt, hsa
uguguaguucuuugagauaguugcuuaugcauauaguaaguauuacauucuuagaguagagcag

SEQ ID NO: 184079 - RNA, 64 nt, hsa
uuuauuaguagcuugaaagagcuuaaucauaugcaguaaguauuuuuauuaccaauaaauuuaa

SEQ ID NO: 184080 - RNA, 64 nt, hsa
gacccaaacaaguucuuugggccaggcauggccuaguaaguacaccaugccucgaaaauaaguc

SEQ ID NO: 184081 - RNA, 64 nt, hsa
ucagagaaguuaagaaacuugcucaacaucauauaguaaguagcagaguugggauuggaauuca

SEQ ID NO: 184082 - RNA, 64 nt, hsa
ugacccuaaacuugcaggcaagguuagcugcuuuaguaaguagaauuuuguggucuuuuuguuu

SEQ ID NO: 184083 - RNA, 64 nt, hsa
cuggggaaaagagcaaguagccugucuuccuuuaaguaaguagccuguaauggauguacuacuu

SEQ ID NO: 184084 - RNA, 64 nt, hsa
cugcccuuaacccuugccucuauuaccuaagcuuaguaaguaguuuucuuaauauuguccaaug

SEQ ID NO: 184085 - RNA, 64 nt, hsa
uuguugcuuggcaacaguacugguuggguugaccaguaaguagaaaaaggcuaaaggcuaugcg

SEQ ID NO: 184086 - RNA, 64 nt, hsa
guauaguuuuguuaucuaagcaauuuuuguuuuaaguaaguaaguguacuagaaugcgaagccg

SEQ ID NO: 184087 - RNA, 64 nt, hsa
aaaugaucauauguuugcucccuggucuuuuuuaaguaaguaaguaaguaucuuaguagauuuu

SEQ ID NO: 184088 - RNA, 64 nt, hsa
gaucauauguuugcucccuggucuuuuuuaaguaaguaaguaaguaucuuaguagauuuuuccu

SEQ ID NO: 184089 - RNA, 64 nt, hsa
auauguuugcucccuggucuuuuuuaaguaaguaaguaaguaucuuaguagauuuuuccuuuga

SEQ ID NO: 184090 - RNA, 64 nt, hsa
caagggguuacuuuacauccuacuaagaaguuuaaguaaguaaguuucauucuaaaaucagagg

SEQ ID NO: 184091 - RNA, 64 nt, hsa
cauuucucugcgaguaguuccacacagguuuguaaguaaguaagaaagaaggcaaauugauuca

SEQ ID NO: 184092 - RNA, 64 nt, hsa; identical to SEQ ID NO: 94711

SEQ ID NO: 184093 - RNA, 64 nt, hsa; identical to SEQ ID NO: 94712

SEQ ID NO: 184094 - RNA, 64 nt, hsa
ccucacgcugcuaggaaauggcucccugaucuaucaggugcaagugguagggacaagcagugag

SEQ ID NO: 184095 - RNA, 64 nt, hsa
caccaaggguagccccagaggggagcuccgagggcaggugcacauagccaaccaaugugagguu

SEQ ID NO: 184096 - RNA, 64 nt, hsa
cccaaccuguuccggucuccccaucagggaccuccaggugcauggauuggugcugccccucaug

SEQ ID NO: 184097 - RNA, 64 nt, hsa
aagacccaaccaggcgcugggcugacucugaccgcaggugcacucucaccccacuguaggcuga

SEQ ID NO: 184098 - RNA, 64 nt, hsa
ggugggcaaagccuaguagagaaccagugcaccucaggugcacuuacauaugguggggcugagg

SEQ ID NO: 184099 - RNA, 64 nt, hsa
gcuguaaaauacccuaaucacauuaugaucuugacaggugcacuuuacuggggagaauaaaaag

SEQ ID NO: 184100 - RNA, 64 nt, hsa
acuucccagggucuugggaugggagaguggggaucaggugcaguuggcucuuaacccucaaggg

SEQ ID NO: 184101 - RNA, 64 nt, hsa
uugaagaaacuuagacuucacccaccagcuggcacaggugcacagauucauaaauucccacacg

SEQ ID NO: 184102 - RNA, 64 nt, hsa
gguaacuuaugguauaaaaguuaugaaaaaaggccaggugcaguggcucacgccuguaauccca

SEQ ID NO: 184103 - RNA, 64 nt, hsa
uagcaagcauagaccccugucuaacggggguagacaggugcagaugaggugaagaucacuguca

SEQ ID NO: 184104 - RNA, 64 nt, hsa
gaagcgggaugcuauuaaaaacuacauggggaaacaggugcaaacccuggagauggauuguaag

SEQ ID NO: 184105 - RNA, 64 nt, hsa
gggggacagugggcuguuguggcugggucuggggcaggugcauuugagccagggcuggcucugu

SEQ ID NO: 184106 - RNA, 64 nt, hsa
cuguuccaucaccugcggugugccucaggaucaccaggugcaggcccccacccucggagaugcu

SEQ ID NO: 184107 - RNA, 64 nt, hsa
cccucuccauuccccaggcuccacccgugcugcucaggugcaaauggacuugagagcaucuaug

SEQ ID NO: 184108 - RNA, 64 nt, hsa
cuggggagaaagaggggccugaugagacuccacucaggugcacacaucaccaggugcaucugca

SEQ ID NO: 184109 - RNA, 64 nt, hsa
gccugaugagacuccacucaggugcacacaucaccaggugcaucugcaggcaccgggcuggcug

SEQ ID NO: 184110 - RNA, 64 nt, hsa
aaggucuugcuuagaaaguccuucacuacauggccaggugcaguggcucacgccuguaguccca

SEQ ID NO: 184111 - RNA, 64 nt, hsa
ccagguucccuagacucacaagcugguccuuggccaggugcaguggcucacgccuguaauccca

SEQ ID NO: 184112 - RNA, 64 nt, hsa
aacccugccucagcuaaccaaguagcugggacuacaggugcaugcuaccaugcccaguccauuu

SEQ ID NO: 184113 - RNA, 64 nt, hsa
uauguugcccaggcuagagugcaguggcuauucacaggugcaguuauagcacacuacagccucc

SEQ ID NO: 184114 - RNA, 64 nt, hsa
gcacucucuaacguccacuagcuuacugaguuaucaggugcaggucagacucuuggcuacagug

SEQ ID NO: 184115 - RNA, 64 nt, hsa
gcaggacccuaagaugaagcugagcuuuugaugccaggugcaaucuacuggaaauguagcacuu

SEQ ID NO: 184116 - RNA, 64 nt, hsa
uuucccaccucagccucccgaguagcugggacuacaggugcacaccaccacaccuggcuaauuu

SEQ ID NO: 184117 - RNA, 64 nt, hsa
aauuagacuaacaaagcuccagacagcaagagcccaggugcacugcucacacccccaccugcau

SEQ ID NO: 184118 - RNA, 64 nt, hsa
ggugcagccguggcccauggcagccuguagaauccaggugcacagagagcccugccaccgucuu

SEQ ID NO: 184119 - RNA, 64 nt, hsa
gugguguguucggcccagaggccccuggccugagcaggugcagaguuuuacagacacccgguca

SEQ ID NO: 184120 - RNA, 64 nt, hsa
gccaagcaggaacuccaggugcagggcgggccuccaggugcagggcgggccagaagcccccuca

SEQ ID NO: 184121 - RNA, 64 nt, hsa
cugggucugcccacccguggccaagcaggaacuccaggugcagggcgggccuccaggugcaggg

SEQ ID NO: 184122 - RNA, 64 nt, hsa; identical to SEQ ID NO: 39347

SEQ ID NO: 184123 - RNA, 64 nt, hsa; identical to SEQ ID NO: 39348

SEQ ID NO: 184124 - RNA, 64 nt, hsa; identical to SEQ ID NO: 39349

SEQ ID NO: 184125 - RNA, 64 nt, hsa; identical to SEQ ID NO: 39350

SEQ ID NO: 184126 - RNA, 64 nt, hsa; identical to SEQ ID NO: 39351

SEQ ID NO: 184127 - RNA, 64 nt, hsa; identical to SEQ ID NO: 39352

SEQ ID NO: 184128 - RNA, 64 nt, hsa; identical to SEQ ID NO: 39353

SEQ ID NO: 184129 - RNA, 64 nt, hsa; identical to SEQ ID NO: 39354

SEQ ID NO: 184130 - RNA, 64 nt, hsa; identical to SEQ ID NO: 39355

SEQ ID NO: 184131 - RNA, 64 nt, hsa; identical to SEQ ID NO: 39356

SEQ ID NO: 184132 - RNA, 64 nt, hsa; identical to SEQ ID NO: 39357

SEQ ID NO: 184133 - RNA, 64 nt, hsa; identical to SEQ ID NO: 39358

SEQ ID NO: 184134 - RNA, 64 nt, hsa; identical to SEQ ID NO: 39359

SEQ ID NO: 184135 - RNA, 64 nt, hsa; identical to SEQ ID NO: 39360

SEQ ID NO: 184136 - RNA, 64 nt, hsa; identical to SEQ ID NO: 39361

SEQ ID NO: 184137 - RNA, 64 nt, hsa; identical to SEQ ID NO: 39362

SEQ ID NO: 184138 - RNA, 64 nt, hsa; identical to SEQ ID NO: 39363

SEQ ID NO: 184139 - RNA, 64 nt, hsa; identical to SEQ ID NO: 39364

SEQ ID NO: 184140 - RNA, 64 nt, hsa; identical to SEQ ID NO: 39365

SEQ ID NO: 184141 - RNA, 64 nt, hsa; identical to SEQ ID NO: 39366

SEQ ID NO: 184142 - RNA, 64 nt, hsa; identical to SEQ ID NO: 39367

SEQ ID NO: 184143 - RNA, 64 nt, hsa; identical to SEQ ID NO: 39368

SEQ ID NO: 184144 - RNA, 64 nt, hsa; identical to SEQ ID NO: 39369

SEQ ID NO: 184145 - RNA, 64 nt, hsa; identical to SEQ ID NO: 39370

SEQ ID NO: 184146 - RNA, 64 nt, hsa; identical to SEQ ID NO: 39371

SEQ ID NO: 184147 - RNA, 64 nt, hsa; identical to SEQ ID NO: 39372

SEQ ID NO: 184148 - RNA, 64 nt, hsa; identical to SEQ ID NO: 39373

SEQ ID NO: 184149 - RNA, 64 nt, hsa; identical to SEQ ID NO: 39374

SEQ ID NO: 184150 - RNA, 64 nt, hsa; identical to SEQ ID NO: 39375

SEQ ID NO: 184151 - RNA, 64 nt, hsa; identical to SEQ ID NO: 39376

SEQ ID NO: 184152 - RNA, 64 nt, hsa; identical to SEQ ID NO: 39377

SEQ ID NO: 184153 - RNA, 64 nt, hsa; identical to SEQ ID NO: 39378

SEQ ID NO: 184154 - RNA, 64 nt, hsa; identical to SEQ ID NO: 39379

SEQ ID NO: 184155 - RNA, 64 nt, hsa; identical to SEQ ID NO: 39380

SEQ ID NO: 184156 - RNA, 64 nt, hsa; identical to SEQ ID NO: 39381

SEQ ID NO: 184157 - RNA, 64 nt, hsa; identical to SEQ ID NO: 39382

SEQ ID NO: 184158 - RNA, 64 nt, hsa; identical to SEQ ID NO: 39383

SEQ ID NO: 184159 - RNA, 64 nt, hsa; identical to SEQ ID NO: 39384

SEQ ID NO: 184160 - RNA, 64 nt, hsa; identical to SEQ ID NO: 39385

SEQ ID NO: 184161 - RNA, 64 nt, hsa; identical to SEQ ID NO: 39386

SEQ ID NO: 184162 - RNA, 64 nt, hsa; identical to SEQ ID NO: 39387

SEQ ID NO: 184163 - RNA, 64 nt, hsa; identical to SEQ ID NO: 39388

SEQ ID NO: 184164 - RNA, 64 nt, hsa; identical to SEQ ID NO: 39389

SEQ ID NO: 184165 - RNA, 64 nt, hsa; identical to SEQ ID NO: 39390

SEQ ID NO: 184166 - RNA, 64 nt, hsa; identical to SEQ ID NO: 39391

SEQ ID NO: 184167 - RNA, 64 nt, hsa; identical to SEQ ID NO: 39392

SEQ ID NO: 184168 - RNA, 64 nt, hsa; identical to SEQ ID NO: 39393

SEQ ID NO: 184169 - RNA, 64 nt, hsa; identical to SEQ ID NO: 39394

SEQ ID NO: 184170 - RNA, 64 nt, hsa; identical to SEQ ID NO: 39395

SEQ ID NO: 184171 - RNA, 64 nt, hsa; identical to SEQ ID NO: 39396

SEQ ID NO: 184172 - RNA, 64 nt, hsa; identical to SEQ ID NO: 39397

SEQ ID NO: 184173 - RNA, 64 nt, hsa; identical to SEQ ID NO: 39398

SEQ ID NO: 184174 - RNA, 64 nt, hsa; identical to SEQ ID NO: 39399

SEQ ID NO: 184175 - RNA, 64 nt, hsa; identical to SEQ ID NO: 39400

SEQ ID NO: 184176 - RNA, 64 nt, hsa; identical to SEQ ID NO: 39401

SEQ ID NO: 184177 - RNA, 64 nt, hsa; identical to SEQ ID NO: 39402

SEQ ID NO: 184178 - RNA, 64 nt, hsa; identical to SEQ ID NO: 39403

SEQ ID NO: 184179 - RNA, 64 nt, hsa; identical to SEQ ID NO: 39404

SEQ ID NO: 184180 - RNA, 64 nt, hsa; identical to SEQ ID NO: 39405

SEQ ID NO: 184181 - RNA, 64 nt, hsa; identical to SEQ ID NO: 39406

SEQ ID NO: 184182 - RNA, 64 nt, hsa; identical to SEQ ID NO: 39407

SEQ ID NO: 184183 - RNA, 64 nt, hsa; identical to SEQ ID NO: 39408

SEQ ID NO: 184184 - RNA, 64 nt, hsa; identical to SEQ ID NO: 39409

SEQ ID NO: 184185 - RNA, 64 nt, hsa; identical to SEQ ID NO: 39410

SEQ ID NO: 184186 - RNA, 64 nt, hsa; identical to SEQ ID NO: 39411

SEQ ID NO: 184187 - RNA, 64 nt, hsa; identical to SEQ ID NO: 39412

SEQ ID NO: 184188 - RNA, 64 nt, hsa; identical to SEQ ID NO: 39413

SEQ ID NO: 184189 - RNA, 64 nt, hsa; identical to SEQ ID NO: 39414

SEQ ID NO: 184190 - RNA, 64 nt, hsa; identical to SEQ ID NO: 39415

SEQ ID NO: 184191 - RNA, 64 nt, hsa; identical to SEQ ID NO: 39416

SEQ ID NO: 184192 - RNA, 64 nt, hsa; identical to SEQ ID NO: 39417

SEQ ID NO: 184193 - RNA, 64 nt, hsa; identical to SEQ ID NO: 39418

SEQ ID NO: 184194 - RNA, 64 nt, hsa; identical to SEQ ID NO: 39419

SEQ ID NO: 184195 - RNA, 64 nt, hsa; identical to SEQ ID NO: 39420

SEQ ID NO: 184196 - RNA, 64 nt, hsa; identical to SEQ ID NO: 39421

SEQ ID NO: 184197 - RNA, 64 nt, hsa; identical to SEQ ID NO: 39422

SEQ ID NO: 184198 - RNA, 64 nt, hsa; identical to SEQ ID NO: 39423

SEQ ID NO: 184199 - RNA, 64 nt, hsa; identical to SEQ ID NO: 39424

SEQ ID NO: 184200 - RNA, 64 nt, hsa; identical to SEQ ID NO: 39425

SEQ ID NO: 184201 - RNA, 64 nt, hsa; identical to SEQ ID NO: 39426

SEQ ID NO: 184202 - RNA, 64 nt, hsa; identical to SEQ ID NO: 39427

SEQ ID NO: 184203 - RNA, 64 nt, hsa; identical to SEQ ID NO: 39428

SEQ ID NO: 184204 - RNA, 64 nt, hsa; identical to SEQ ID NO: 39429

SEQ ID NO: 184205 - RNA, 64 nt, hsa; identical to SEQ ID NO: 39430

SEQ ID NO: 184206 - RNA, 64 nt, hsa; identical to SEQ ID NO: 39431

SEQ ID NO: 184207 - RNA, 64 nt, hsa; identical to SEQ ID NO: 39432

SEQ ID NO: 184208 - RNA, 64 nt, hsa; identical to SEQ ID NO: 39433

SEQ ID NO: 184209 - RNA, 64 nt, hsa; identical to SEQ ID NO: 39434

SEQ ID NO: 184210 - RNA, 64 nt, hsa; identical to SEQ ID NO: 39435

SEQ ID NO: 184211 - RNA, 64 nt, hsa; identical to SEQ ID NO: 39436

SEQ ID NO: 184212 - RNA, 64 nt, hsa; identical to SEQ ID NO: 39437

SEQ ID NO: 184213 - RNA, 64 nt, hsa; identical to SEQ ID NO: 39438

SEQ ID NO: 184214 - RNA, 64 nt, hsa; identical to SEQ ID NO: 39439

SEQ ID NO: 184215 - RNA, 64 nt, hsa; identical to SEQ ID NO: 39440

SEQ ID NO: 184216 - RNA, 64 nt, hsa; identical to SEQ ID NO: 39441

SEQ ID NO: 184217 - RNA, 64 nt, hsa; identical to SEQ ID NO: 39442

SEQ ID NO: 184218 - RNA, 64 nt, hsa; identical to SEQ ID NO: 39443

SEQ ID NO: 184219 - RNA, 64 nt, hsa; identical to SEQ ID NO: 39444

SEQ ID NO: 184220 - RNA, 64 nt, hsa; identical to SEQ ID NO: 39445

SEQ ID NO: 184221 - RNA, 64 nt, hsa; identical to SEQ ID NO: 39446

SEQ ID NO: 184222 - RNA, 64 nt, hsa; identical to SEQ ID NO: 39447

SEQ ID NO: 184223 - RNA, 64 nt, hsa; identical to SEQ ID NO: 39448

SEQ ID NO: 184224 - RNA, 64 nt, hsa; identical to SEQ ID NO: 39449

SEQ ID NO: 184225 - RNA, 64 nt, hsa; identical to SEQ ID NO: 39450

SEQ ID NO: 184226 - RNA, 64 nt, hsa; identical to SEQ ID NO: 39451

SEQ ID NO: 184227 - RNA, 64 nt, hsa; identical to SEQ ID NO: 39452

SEQ ID NO: 184228 - RNA, 64 nt, hsa; identical to SEQ ID NO: 39453

SEQ ID NO: 184229 - RNA, 64 nt, hsa; identical to SEQ ID NO: 39454

SEQ ID NO: 184230 - RNA, 64 nt, hsa; identical to SEQ ID NO: 39455

SEQ ID NO: 184231 - RNA, 64 nt, hsa; identical to SEQ ID NO: 39456

SEQ ID NO: 184232 - RNA, 64 nt, hsa; identical to SEQ ID NO: 39457

SEQ ID NO: 184233 - RNA, 64 nt, hsa; identical to SEQ ID NO: 39458

SEQ ID NO: 184234 - RNA, 64 nt, hsa; identical to SEQ ID NO: 39459

SEQ ID NO: 184235 - RNA, 64 nt, hsa; identical to SEQ ID NO: 39460

SEQ ID NO: 184236 - RNA, 64 nt, hsa; identical to SEQ ID NO: 39461

SEQ ID NO: 184237 - RNA, 64 nt, hsa; identical to SEQ ID NO: 39462

SEQ ID NO: 184238 - RNA, 64 nt, hsa; identical to SEQ ID NO: 39463

SEQ ID NO: 184239 - RNA, 64 nt, hsa; identical to SEQ ID NO: 39464

SEQ ID NO: 184240 - RNA, 64 nt, hsa; identical to SEQ ID NO: 39465

SEQ ID NO: 184241 - RNA, 64 nt, hsa; identical to SEQ ID NO: 39466

SEQ ID NO: 184242 - RNA, 64 nt, hsa; identical to SEQ ID NO: 39467

SEQ ID NO: 184243 - RNA, 64 nt, hsa; identical to SEQ ID NO: 39468

SEQ ID NO: 184244 - RNA, 64 nt, hsa; identical to SEQ ID NO: 39469

SEQ ID NO: 184245 - RNA, 64 nt, hsa; identical to SEQ ID NO: 39470

SEQ ID NO: 184246 - RNA, 64 nt, hsa; identical to SEQ ID NO: 39471

SEQ ID NO: 184247 - RNA, 64 nt, hsa; identical to SEQ ID NO: 39472

SEQ ID NO: 184248 - RNA, 64 nt, hsa; identical to SEQ ID NO: 39473

SEQ ID NO: 184249 - RNA, 64 nt, hsa; identical to SEQ ID NO: 39474

SEQ ID NO: 184250 - RNA, 64 nt, hsa; identical to SEQ ID NO: 39475

SEQ ID NO: 184251 - RNA, 64 nt, hsa; identical to SEQ ID NO: 39476

SEQ ID NO: 184252 - RNA, 64 nt, hsa; identical to SEQ ID NO: 39477

SEQ ID NO: 184253 - RNA, 64 nt, hsa; identical to SEQ ID NO: 39478

SEQ ID NO: 184254 - RNA, 64 nt, hsa; identical to SEQ ID NO: 39479

SEQ ID NO: 184255 - RNA, 64 nt, hsa; identical to SEQ ID NO: 39480

SEQ ID NO: 184256 - RNA, 64 nt, hsa; identical to SEQ ID NO: 39481

SEQ ID NO: 184257 - RNA, 64 nt, hsa; identical to SEQ ID NO: 39482

SEQ ID NO: 184258 - RNA, 64 nt, hsa; identical to SEQ ID NO: 39483

SEQ ID NO: 184259 - RNA, 64 nt, hsa; identical to SEQ ID NO: 39484

SEQ ID NO: 184260 - RNA, 64 nt, hsa; identical to SEQ ID NO: 39485

SEQ ID NO: 184261 - RNA, 64 nt, hsa; identical to SEQ ID NO: 39486

SEQ ID NO: 184262 - RNA, 64 nt, hsa; identical to SEQ ID NO: 39487

SEQ ID NO: 184263 - RNA, 64 nt, hsa; identical to SEQ ID NO: 39488

SEQ ID NO: 184264 - RNA, 64 nt, hsa; identical to SEQ ID NO: 39489

SEQ ID NO: 184265 - RNA, 64 nt, hsa; identical to SEQ ID NO: 39490

SEQ ID NO: 184266 - RNA, 64 nt, hsa; identical to SEQ ID NO: 39491

SEQ ID NO: 184267 - RNA, 64 nt, hsa; identical to SEQ ID NO: 39492

SEQ ID NO: 184268 - RNA, 64 nt, hsa; identical to SEQ ID NO: 39493

SEQ ID NO: 184269 - RNA, 64 nt, hsa; identical to SEQ ID NO: 39494

SEQ ID NO: 184270 - RNA, 64 nt, hsa; identical to SEQ ID NO: 39495

SEQ ID NO: 184271 - RNA, 64 nt, hsa; identical to SEQ ID NO: 39496

SEQ ID NO: 184272 - RNA, 64 nt, hsa; identical to SEQ ID NO: 39497

SEQ ID NO: 184273 - RNA, 64 nt, hsa; identical to SEQ ID NO: 39498

SEQ ID NO: 184274 - RNA, 64 nt, hsa; identical to SEQ ID NO: 39499

SEQ ID NO: 184275 - RNA, 64 nt, hsa; identical to SEQ ID NO: 39500

SEQ ID NO: 184276 - RNA, 64 nt, hsa; identical to SEQ ID NO: 39501

SEQ ID NO: 184277 - RNA, 64 nt, hsa; identical to SEQ ID NO: 39502

SEQ ID NO: 184278 - RNA, 64 nt, hsa; identical to SEQ ID NO: 39503

SEQ ID NO: 184279 - RNA, 64 nt, hsa; identical to SEQ ID NO: 39504

SEQ ID NO: 184280 - RNA, 64 nt, hsa; identical to SEQ ID NO: 39505

SEQ ID NO: 184281 - RNA, 64 nt, hsa; identical to SEQ ID NO: 39506

SEQ ID NO: 184282 - RNA, 64 nt, hsa; identical to SEQ ID NO: 39507

SEQ ID NO: 184283 - RNA, 64 nt, hsa; identical to SEQ ID NO: 39508

SEQ ID NO: 184284 - RNA, 64 nt, hsa; identical to SEQ ID NO: 39509

SEQ ID NO: 184285 - RNA, 64 nt, hsa; identical to SEQ ID NO: 39510

SEQ ID NO: 184286 - RNA, 64 nt, hsa; identical to SEQ ID NO: 39511

SEQ ID NO: 184287 - RNA, 64 nt, hsa; identical to SEQ ID NO: 39512

SEQ ID NO: 184288 - RNA, 64 nt, hsa; identical to SEQ ID NO: 39513

SEQ ID NO: 184289 - RNA, 64 nt, hsa; identical to SEQ ID NO: 39514

SEQ ID NO: 184290 - RNA, 64 nt, hsa; identical to SEQ ID NO: 39515

SEQ ID NO: 184291 - RNA, 64 nt, hsa; identical to SEQ ID NO: 39516

SEQ ID NO: 184292 - RNA, 64 nt, hsa; identical to SEQ ID NO: 39517

SEQ ID NO: 184293 - RNA, 64 nt, hsa; identical to SEQ ID NO: 39518

SEQ ID NO: 184294 - RNA, 64 nt, hsa; identical to SEQ ID NO: 39519

SEQ ID NO: 184295 - RNA, 64 nt, hsa; identical to SEQ ID NO: 39520

SEQ ID NO: 184296 - RNA, 64 nt, hsa; identical to SEQ ID NO: 39521

SEQ ID NO: 184297 - RNA, 64 nt, hsa; identical to SEQ ID NO: 39522

SEQ ID NO: 184298 - RNA, 64 nt, hsa; identical to SEQ ID NO: 39523

SEQ ID NO: 184299 - RNA, 64 nt, hsa; identical to SEQ ID NO: 39524

SEQ ID NO: 184300 - RNA, 64 nt, hsa; identical to SEQ ID NO: 39525

SEQ ID NO: 184301 - RNA, 64 nt, hsa; identical to SEQ ID NO: 39526

SEQ ID NO: 184302 - RNA, 64 nt, hsa; identical to SEQ ID NO: 39527

SEQ ID NO: 184303 - RNA, 64 nt, hsa; identical to SEQ ID NO: 39528

SEQ ID NO: 184304 - RNA, 64 nt, hsa; identical to SEQ ID NO: 39529

SEQ ID NO: 184305 - RNA, 64 nt, hsa; identical to SEQ ID NO: 39530

SEQ ID NO: 184306 - RNA, 64 nt, hsa; identical to SEQ ID NO: 39531

SEQ ID NO: 184307 - RNA, 64 nt, hsa; identical to SEQ ID NO: 39532

SEQ ID NO: 184308 - RNA, 64 nt, hsa; identical to SEQ ID NO: 39533

SEQ ID NO: 184309 - RNA, 64 nt, hsa; identical to SEQ ID NO: 39534

SEQ ID NO: 184310 - RNA, 64 nt, hsa; identical to SEQ ID NO: 39535

SEQ ID NO: 184311 - RNA, 64 nt, hsa; identical to SEQ ID NO: 39536

SEQ ID NO: 184312 - RNA, 64 nt, hsa; identical to SEQ ID NO: 39537

SEQ ID NO: 184313 - RNA, 64 nt, hsa; identical to SEQ ID NO: 39538

SEQ ID NO: 184314 - RNA, 64 nt, hsa; identical to SEQ ID NO: 39539

SEQ ID NO: 184315 - RNA, 64 nt, hsa; identical to SEQ ID NO: 39540

SEQ ID NO: 184316 - RNA, 64 nt, hsa; identical to SEQ ID NO: 39541

SEQ ID NO: 184317 - RNA, 64 nt, hsa; identical to SEQ ID NO: 39542

SEQ ID NO: 184318 - RNA, 64 nt, hsa; identical to SEQ ID NO: 39543

SEQ ID NO: 184319 - RNA, 64 nt, hsa; identical to SEQ ID NO: 39544

SEQ ID NO: 184320 - RNA, 64 nt, hsa; identical to SEQ ID NO: 39545

SEQ ID NO: 184321 - RNA, 64 nt, hsa; identical to SEQ ID NO: 39546

SEQ ID NO: 184322 - RNA, 64 nt, hsa; identical to SEQ ID NO: 39547

SEQ ID NO: 184323 - RNA, 64 nt, hsa; identical to SEQ ID NO: 39548

SEQ ID NO: 184324 - RNA, 64 nt, hsa; identical to SEQ ID NO: 39549

SEQ ID NO: 184325 - RNA, 64 nt, hsa; identical to SEQ ID NO: 39550

SEQ ID NO: 184326 - RNA, 64 nt, hsa; identical to SEQ ID NO: 39551

SEQ ID NO: 184327 - RNA, 64 nt, hsa; identical to SEQ ID NO: 39552

SEQ ID NO: 184328 - RNA, 64 nt, hsa; identical to SEQ ID NO: 39553

SEQ ID NO: 184329 - RNA, 64 nt, hsa; identical to SEQ ID NO: 39554

SEQ ID NO: 184330 - RNA, 64 nt, hsa; identical to SEQ ID NO: 39555

SEQ ID NO: 184331 - RNA, 64 nt, hsa; identical to SEQ ID NO: 39556

SEQ ID NO: 184332 - RNA, 64 nt, hsa; identical to SEQ ID NO: 39557

SEQ ID NO: 184333 - RNA, 64 nt, hsa; identical to SEQ ID NO: 39558

SEQ ID NO: 184334 - RNA, 64 nt, hsa; identical to SEQ ID NO: 39559

SEQ ID NO: 184335 - RNA, 64 nt, hsa; identical to SEQ ID NO: 39560

SEQ ID NO: 184336 - RNA, 64 nt, hsa; identical to SEQ ID NO: 39561

SEQ ID NO: 184337 - RNA, 64 nt, hsa; identical to SEQ ID NO: 39562

SEQ ID NO: 184338 - RNA, 64 nt, hsa; identical to SEQ ID NO: 39563

SEQ ID NO: 184339 - RNA, 64 nt, hsa; identical to SEQ ID NO: 39564

SEQ ID NO: 184340 - RNA, 64 nt, hsa; identical to SEQ ID NO: 39565

SEQ ID NO: 184341 - RNA, 64 nt, hsa; identical to SEQ ID NO: 39566

SEQ ID NO: 184342 - RNA, 64 nt, hsa; identical to SEQ ID NO: 39567

SEQ ID NO: 184343 - RNA, 64 nt, hsa; identical to SEQ ID NO: 39568

SEQ ID NO: 184344 - RNA, 64 nt, hsa; identical to SEQ ID NO: 39569

SEQ ID NO: 184345 - RNA, 64 nt, hsa; identical to SEQ ID NO: 39570

SEQ ID NO: 184346 - RNA, 64 nt, hsa; identical to SEQ ID NO: 39571

SEQ ID NO: 184347 - RNA, 64 nt, hsa; identical to SEQ ID NO: 39572

SEQ ID NO: 184348 - RNA, 64 nt, hsa; identical to SEQ ID NO: 39573

SEQ ID NO: 184349 - RNA, 64 nt, hsa; identical to SEQ ID NO: 39574

SEQ ID NO: 184350 - RNA, 64 nt, hsa; identical to SEQ ID NO: 39575

SEQ ID NO: 184351 - RNA, 64 nt, hsa; identical to SEQ ID NO: 39576

SEQ ID NO: 184352 - RNA, 64 nt, hsa; identical to SEQ ID NO: 39577

SEQ ID NO: 184353 - RNA, 64 nt, hsa; identical to SEQ ID NO: 39578

SEQ ID NO: 184354 - RNA, 64 nt, hsa; identical to SEQ ID NO: 39579

SEQ ID NO: 184355 - RNA, 64 nt, hsa; identical to SEQ ID NO: 39580

SEQ ID NO: 184356 - RNA, 64 nt, hsa; identical to SEQ ID NO: 39581

SEQ ID NO: 184357 - RNA, 64 nt, hsa; identical to SEQ ID NO: 39582

SEQ ID NO: 184358 - RNA, 64 nt, hsa; identical to SEQ ID NO: 39583

SEQ ID NO: 184359 - RNA, 64 nt, hsa; identical to SEQ ID NO: 39584

SEQ ID NO: 184360 - RNA, 64 nt, hsa; identical to SEQ ID NO: 39585

SEQ ID NO: 184361 - RNA, 64 nt, hsa; identical to SEQ ID NO: 39586

SEQ ID NO: 184362 - RNA, 64 nt, hsa; identical to SEQ ID NO: 39587

SEQ ID NO: 184363 - RNA, 64 nt, hsa; identical to SEQ ID NO: 39588

SEQ ID NO: 184364 - RNA, 64 nt, hsa; identical to SEQ ID NO: 39589

SEQ ID NO: 184365 - RNA, 64 nt, hsa; identical to SEQ ID NO: 39590

SEQ ID NO: 184366 - RNA, 64 nt, hsa; identical to SEQ ID NO: 39591

SEQ ID NO: 184367 - RNA, 64 nt, hsa; identical to SEQ ID NO: 39592

SEQ ID NO: 184368 - RNA, 64 nt, hsa; identical to SEQ ID NO: 39593

SEQ ID NO: 184369 - RNA, 64 nt, hsa; identical to SEQ ID NO: 39594

SEQ ID NO: 184370 - RNA, 64 nt, hsa; identical to SEQ ID NO: 39595

SEQ ID NO: 184371 - RNA, 64 nt, hsa; identical to SEQ ID NO: 39596

SEQ ID NO: 184372 - RNA, 64 nt, hsa; identical to SEQ ID NO: 39597

SEQ ID NO: 184373 - RNA, 64 nt, hsa; identical to SEQ ID NO: 39598

SEQ ID NO: 184374 - RNA, 64 nt, hsa; identical to SEQ ID NO: 39599

SEQ ID NO: 184375 - RNA, 64 nt, hsa; identical to SEQ ID NO: 39600

SEQ ID NO: 184376 - RNA, 64 nt, hsa; identical to SEQ ID NO: 39601

SEQ ID NO: 184377 - RNA, 64 nt, hsa; identical to SEQ ID NO: 39602

SEQ ID NO: 184378 - RNA, 64 nt, hsa; identical to SEQ ID NO: 39603

SEQ ID NO: 184379 - RNA, 64 nt, hsa; identical to SEQ ID NO: 39604

SEQ ID NO: 184380 - RNA, 64 nt, hsa; identical to SEQ ID NO: 39605

SEQ ID NO: 184381 - RNA, 64 nt, hsa; identical to SEQ ID NO: 39606

SEQ ID NO: 184382 - RNA, 64 nt, hsa; identical to SEQ ID NO: 39607

SEQ ID NO: 184383 - RNA, 64 nt, hsa; identical to SEQ ID NO: 39608

SEQ ID NO: 184384 - RNA, 64 nt, hsa; identical to SEQ ID NO: 39609

SEQ ID NO: 184385 - RNA, 64 nt, hsa; identical to SEQ ID NO: 39610

SEQ ID NO: 184386 - RNA, 64 nt, hsa; identical to SEQ ID NO: 39611

SEQ ID NO: 184387 - RNA, 64 nt, hsa; identical to SEQ ID NO: 39612

SEQ ID NO: 184388 - RNA, 64 nt, hsa; identical to SEQ ID NO: 39613

SEQ ID NO: 184389 - RNA, 64 nt, hsa; identical to SEQ ID NO: 39614

SEQ ID NO: 184390 - RNA, 64 nt, hsa; identical to SEQ ID NO: 39615

SEQ ID NO: 184391 - RNA, 64 nt, hsa; identical to SEQ ID NO: 39616

SEQ ID NO: 184392 - RNA, 64 nt, hsa; identical to SEQ ID NO: 39617

SEQ ID NO: 184393 - RNA, 64 nt, hsa; identical to SEQ ID NO: 39618

SEQ ID NO: 184394 - RNA, 64 nt, hsa; identical to SEQ ID NO: 39619

SEQ ID NO: 184395 - RNA, 64 nt, hsa; identical to SEQ ID NO: 39620

SEQ ID NO: 184396 - RNA, 64 nt, hsa; identical to SEQ ID NO: 39621

SEQ ID NO: 184397 - RNA, 64 nt, hsa; identical to SEQ ID NO: 39622

SEQ ID NO: 184398 - RNA, 64 nt, hsa; identical to SEQ ID NO: 39623

SEQ ID NO: 184399 - RNA, 64 nt, hsa; identical to SEQ ID NO: 39624

SEQ ID NO: 184400 - RNA, 64 nt, hsa; identical to SEQ ID NO: 39625

SEQ ID NO: 184401 - RNA, 64 nt, hsa; identical to SEQ ID NO: 39626

SEQ ID NO: 184402 - RNA, 64 nt, hsa; identical to SEQ ID NO: 39627

SEQ ID NO: 184403 - RNA, 64 nt, hsa; identical to SEQ ID NO: 39628

SEQ ID NO: 184404 - RNA, 64 nt, hsa; identical to SEQ ID NO: 39629

SEQ ID NO: 184405 - RNA, 64 nt, hsa; identical to SEQ ID NO: 39630

SEQ ID NO: 184406 - RNA, 64 nt, hsa; identical to SEQ ID NO: 39631

SEQ ID NO: 184407 - RNA, 64 nt, hsa; identical to SEQ ID NO: 39632

SEQ ID NO: 184408 - RNA, 64 nt, hsa; identical to SEQ ID NO: 39633

SEQ ID NO: 184409 - RNA, 64 nt, hsa; identical to SEQ ID NO: 39634

SEQ ID NO: 184410 - RNA, 64 nt, hsa; identical to SEQ ID NO: 39635

SEQ ID NO: 184411 - RNA, 64 nt, hsa; identical to SEQ ID NO: 39636

SEQ ID NO: 184412 - RNA, 64 nt, hsa; identical to SEQ ID NO: 39637

SEQ ID NO: 184413 - RNA, 64 nt, hsa; identical to SEQ ID NO: 39638

SEQ ID NO: 184414 - RNA, 64 nt, hsa; identical to SEQ ID NO: 39639

SEQ ID NO: 184415 - RNA, 64 nt, hsa; identical to SEQ ID NO: 39640

SEQ ID NO: 184416 - RNA, 64 nt, hsa; identical to SEQ ID NO: 39641

SEQ ID NO: 184417 - RNA, 64 nt, hsa; identical to SEQ ID NO: 39642

SEQ ID NO: 184418 - RNA, 64 nt, hsa; identical to SEQ ID NO: 39643

SEQ ID NO: 184419 - RNA, 64 nt, hsa; identical to SEQ ID NO: 39644

SEQ ID NO: 184420 - RNA, 64 nt, hsa; identical to SEQ ID NO: 39645

SEQ ID NO: 184421 - RNA, 64 nt, hsa; identical to SEQ ID NO: 39646

SEQ ID NO: 184422 - RNA, 64 nt, hsa; identical to SEQ ID NO: 39647

SEQ ID NO: 184423 - RNA, 64 nt, hsa; identical to SEQ ID NO: 39648

SEQ ID NO: 184424 - RNA, 64 nt, hsa; identical to SEQ ID NO: 39649

SEQ ID NO: 184425 - RNA, 64 nt, hsa; identical to SEQ ID NO: 39650

SEQ ID NO: 184426 - RNA, 64 nt, hsa; identical to SEQ ID NO: 39651

SEQ ID NO: 184427 - RNA, 64 nt, hsa; identical to SEQ ID NO: 39652

SEQ ID NO: 184428 - RNA, 64 nt, hsa; identical to SEQ ID NO: 39653

SEQ ID NO: 184429 - RNA, 64 nt, hsa; identical to SEQ ID NO: 39654

SEQ ID NO: 184430 - RNA, 64 nt, hsa; identical to SEQ ID NO: 39655

SEQ ID NO: 184431 - RNA, 64 nt, hsa; identical to SEQ ID NO: 39656

SEQ ID NO: 184432 - RNA, 64 nt, hsa; identical to SEQ ID NO: 39657

SEQ ID NO: 184433 - RNA, 64 nt, hsa; identical to SEQ ID NO: 39658

SEQ ID NO: 184434 - RNA, 64 nt, hsa; identical to SEQ ID NO: 39659

SEQ ID NO: 184435 - RNA, 64 nt, hsa; identical to SEQ ID NO: 39660

SEQ ID NO: 184436 - RNA, 64 nt, hsa; identical to SEQ ID NO: 39661

SEQ ID NO: 184437 - RNA, 64 nt, hsa; identical to SEQ ID NO: 39662

SEQ ID NO: 184438 - RNA, 64 nt, hsa; identical to SEQ ID NO: 39663

SEQ ID NO: 184439 - RNA, 64 nt, hsa; identical to SEQ ID NO: 39664

SEQ ID NO: 184440 - RNA, 64 nt, hsa; identical to SEQ ID NO: 39665

SEQ ID NO: 184441 - RNA, 64 nt, hsa; identical to SEQ ID NO: 39666

SEQ ID NO: 184442 - RNA, 64 nt, hsa; identical to SEQ ID NO: 39667

SEQ ID NO: 184443 - RNA, 64 nt, hsa; identical to SEQ ID NO: 39668

SEQ ID NO: 184444 - RNA, 64 nt, hsa; identical to SEQ ID NO: 39669

SEQ ID NO: 184445 - RNA, 64 nt, hsa; identical to SEQ ID NO: 39670

SEQ ID NO: 184446 - RNA, 64 nt, hsa; identical to SEQ ID NO: 39671

SEQ ID NO: 184447 - RNA, 64 nt, hsa; identical to SEQ ID NO: 39672

SEQ ID NO: 184448 - RNA, 64 nt, hsa; identical to SEQ ID NO: 39673

SEQ ID NO: 184449 - RNA, 64 nt, hsa; identical to SEQ ID NO: 39674

SEQ ID NO: 184450 - RNA, 64 nt, hsa; identical to SEQ ID NO: 39675

SEQ ID NO: 184451 - RNA, 64 nt, hsa; identical to SEQ ID NO: 39676

SEQ ID NO: 184452 - RNA, 64 nt, hsa; identical to SEQ ID NO: 39677

SEQ ID NO: 184453 - RNA, 64 nt, hsa; identical to SEQ ID NO: 39678

SEQ ID NO: 184454 - RNA, 64 nt, hsa; identical to SEQ ID NO: 39679

SEQ ID NO: 184455 - RNA, 64 nt, hsa; identical to SEQ ID NO: 39680

SEQ ID NO: 184456 - RNA, 64 nt, hsa; identical to SEQ ID NO: 39681

SEQ ID NO: 184457 - RNA, 64 nt, hsa; identical to SEQ ID NO: 39682

SEQ ID NO: 184458 - RNA, 64 nt, hsa; identical to SEQ ID NO: 39683

SEQ ID NO: 184459 - RNA, 64 nt, hsa; identical to SEQ ID NO: 39684

SEQ ID NO: 184460 - RNA, 64 nt, hsa; identical to SEQ ID NO: 39685

SEQ ID NO: 184461 - RNA, 64 nt, hsa; identical to SEQ ID NO: 39686

SEQ ID NO: 184462 - RNA, 64 nt, hsa; identical to SEQ ID NO: 39687

SEQ ID NO: 184463 - RNA, 64 nt, hsa; identical to SEQ ID NO: 39688

SEQ ID NO: 184464 - RNA, 64 nt, hsa; identical to SEQ ID NO: 39689

SEQ ID NO: 184465 - RNA, 64 nt, hsa; identical to SEQ ID NO: 39690

SEQ ID NO: 184466 - RNA, 64 nt, hsa; identical to SEQ ID NO: 39691

SEQ ID NO: 184467 - RNA, 64 nt, hsa; identical to SEQ ID NO: 39692

SEQ ID NO: 184468 - RNA, 64 nt, hsa; identical to SEQ ID NO: 39693

SEQ ID NO: 184469 - RNA, 64 nt, hsa; identical to SEQ ID NO: 39694

SEQ ID NO: 184470 - RNA, 64 nt, hsa; identical to SEQ ID NO: 39695

SEQ ID NO: 184471 - RNA, 64 nt, hsa; identical to SEQ ID NO: 39696

SEQ ID NO: 184472 - RNA, 64 nt, hsa; identical to SEQ ID NO: 39697

SEQ ID NO: 184473 - RNA, 64 nt, hsa; identical to SEQ ID NO: 39698

SEQ ID NO: 184474 - RNA, 64 nt, hsa; identical to SEQ ID NO: 39699

SEQ ID NO: 184475 - RNA, 64 nt, hsa; identical to SEQ ID NO: 39700

SEQ ID NO: 184476 - RNA, 64 nt, hsa; identical to SEQ ID NO: 39701

SEQ ID NO: 184477 - RNA, 64 nt, hsa; identical to SEQ ID NO: 39702

SEQ ID NO: 184478 - RNA, 64 nt, hsa; identical to SEQ ID NO: 39703

SEQ ID NO: 184479 - RNA, 64 nt, hsa; identical to SEQ ID NO: 39704

SEQ ID NO: 184480 - RNA, 64 nt, hsa; identical to SEQ ID NO: 39705

SEQ ID NO: 184481 - RNA, 64 nt, hsa; identical to SEQ ID NO: 39706

SEQ ID NO: 184482 - RNA, 64 nt, hsa; identical to SEQ ID NO: 39707

SEQ ID NO: 184483 - RNA, 64 nt, hsa; identical to SEQ ID NO: 39708

SEQ ID NO: 184484 - RNA, 64 nt, hsa; identical to SEQ ID NO: 39709

SEQ ID NO: 184485 - RNA, 64 nt, hsa; identical to SEQ ID NO: 39710

SEQ ID NO: 184486 - RNA, 64 nt, hsa; identical to SEQ ID NO: 39711

SEQ ID NO: 184487 - RNA, 64 nt, hsa; identical to SEQ ID NO: 39712

SEQ ID NO: 184488 - RNA, 64 nt, hsa; identical to SEQ ID NO: 39713

SEQ ID NO: 184489 - RNA, 64 nt, hsa; identical to SEQ ID NO: 39714

SEQ ID NO: 184490 - RNA, 64 nt, hsa; identical to SEQ ID NO: 39715

SEQ ID NO: 184491 - RNA, 64 nt, hsa; identical to SEQ ID NO: 39716

SEQ ID NO: 184492 - RNA, 64 nt, hsa; identical to SEQ ID NO: 39717

SEQ ID NO: 184493 - RNA, 64 nt, hsa; identical to SEQ ID NO: 39718

SEQ ID NO: 184494 - RNA, 64 nt, hsa; identical to SEQ ID NO: 39719

SEQ ID NO: 184495 - RNA, 64 nt, hsa; identical to SEQ ID NO: 39720

SEQ ID NO: 184496 - RNA, 64 nt, hsa; identical to SEQ ID NO: 39721

SEQ ID NO: 184497 - RNA, 64 nt, hsa; identical to SEQ ID NO: 39722

SEQ ID NO: 184498 - RNA, 64 nt, hsa; identical to SEQ ID NO: 39723

SEQ ID NO: 184499 - RNA, 64 nt, hsa; identical to SEQ ID NO: 39724

SEQ ID NO: 184500 - RNA, 64 nt, hsa; identical to SEQ ID NO: 39725

SEQ ID NO: 184501 - RNA, 64 nt, hsa; identical to SEQ ID NO: 39726

SEQ ID NO: 184502 - RNA, 64 nt, hsa; identical to SEQ ID NO: 39727

SEQ ID NO: 184503 - RNA, 64 nt, hsa; identical to SEQ ID NO: 39728

SEQ ID NO: 184504 - RNA, 64 nt, hsa; identical to SEQ ID NO: 39729

SEQ ID NO: 184505 - RNA, 64 nt, hsa; identical to SEQ ID NO: 39730

SEQ ID NO: 184506 - RNA, 64 nt, hsa; identical to SEQ ID NO: 39731

SEQ ID NO: 184507 - RNA, 64 nt, hsa; identical to SEQ ID NO: 39732

SEQ ID NO: 184508 - RNA, 64 nt, hsa; identical to SEQ ID NO: 39733

SEQ ID NO: 184509 - RNA, 64 nt, hsa; identical to SEQ ID NO: 39734

SEQ ID NO: 184510 - RNA, 64 nt, hsa; identical to SEQ ID NO: 39735

SEQ ID NO: 184511 - RNA, 64 nt, hsa; identical to SEQ ID NO: 39736

SEQ ID NO: 184512 - RNA, 64 nt, hsa; identical to SEQ ID NO: 39737

SEQ ID NO: 184513 - RNA, 64 nt, hsa; identical to SEQ ID NO: 39738

SEQ ID NO: 184514 - RNA, 64 nt, hsa; identical to SEQ ID NO: 39739

SEQ ID NO: 184515 - RNA, 64 nt, hsa; identical to SEQ ID NO: 39740

SEQ ID NO: 184516 - RNA, 64 nt, hsa; identical to SEQ ID NO: 39741

SEQ ID NO: 184517 - RNA, 64 nt, hsa; identical to SEQ ID NO: 39742

SEQ ID NO: 184518 - RNA, 64 nt, hsa; identical to SEQ ID NO: 39743

SEQ ID NO: 184519 - RNA, 64 nt, hsa; identical to SEQ ID NO: 39744

SEQ ID NO: 184520 - RNA, 64 nt, hsa; identical to SEQ ID NO: 39745

SEQ ID NO: 184521 - RNA, 64 nt, hsa; identical to SEQ ID NO: 39746

SEQ ID NO: 184522 - RNA, 64 nt, hsa; identical to SEQ ID NO: 39747

SEQ ID NO: 184523 - RNA, 64 nt, hsa; identical to SEQ ID NO: 39748

SEQ ID NO: 184524 - RNA, 64 nt, hsa; identical to SEQ ID NO: 39749

SEQ ID NO: 184525 - RNA, 64 nt, hsa; identical to SEQ ID NO: 39750

SEQ ID NO: 184526 - RNA, 64 nt, hsa; identical to SEQ ID NO: 39751

SEQ ID NO: 184527 - RNA, 64 nt, hsa; identical to SEQ ID NO: 39752

SEQ ID NO: 184528 - RNA, 64 nt, hsa; identical to SEQ ID NO: 39753

SEQ ID NO: 184529 - RNA, 64 nt, hsa; identical to SEQ ID NO: 39754

SEQ ID NO: 184530 - RNA, 64 nt, hsa; identical to SEQ ID NO: 39755

SEQ ID NO: 184531 - RNA, 64 nt, hsa; identical to SEQ ID NO: 39756

SEQ ID NO: 184532 - RNA, 64 nt, hsa; identical to SEQ ID NO: 39757

SEQ ID NO: 184533 - RNA, 64 nt, hsa; identical to SEQ ID NO: 39758

SEQ ID NO: 184534 - RNA, 64 nt, hsa; identical to SEQ ID NO: 39759

SEQ ID NO: 184535 - RNA, 64 nt, hsa; identical to SEQ ID NO: 39760

SEQ ID NO: 184536 - RNA, 64 nt, hsa; identical to SEQ ID NO: 39761

SEQ ID NO: 184537 - RNA, 64 nt, hsa; identical to SEQ ID NO: 39762

SEQ ID NO: 184538 - RNA, 64 nt, hsa; identical to SEQ ID NO: 39763

SEQ ID NO: 184539 - RNA, 64 nt, hsa; identical to SEQ ID NO: 39764

SEQ ID NO: 184540 - RNA, 64 nt, hsa; identical to SEQ ID NO: 39765

SEQ ID NO: 184541 - RNA, 64 nt, hsa; identical to SEQ ID NO: 39766

SEQ ID NO: 184542 - RNA, 64 nt, hsa; identical to SEQ ID NO: 39767

SEQ ID NO: 184543 - RNA, 64 nt, hsa; identical to SEQ ID NO: 39768

SEQ ID NO: 184544 - RNA, 64 nt, hsa; identical to SEQ ID NO: 39769

SEQ ID NO: 184545 - RNA, 64 nt, hsa; identical to SEQ ID NO: 39770

SEQ ID NO: 184546 - RNA, 64 nt, hsa; identical to SEQ ID NO: 39771

SEQ ID NO: 184547 - RNA, 64 nt, hsa; identical to SEQ ID NO: 39772

SEQ ID NO: 184548 - RNA, 64 nt, hsa; identical to SEQ ID NO: 39773

SEQ ID NO: 184549 - RNA, 64 nt, hsa; identical to SEQ ID NO: 39774

SEQ ID NO: 184550 - RNA, 64 nt, hsa; identical to SEQ ID NO: 39775

SEQ ID NO: 184551 - RNA, 64 nt, hsa; identical to SEQ ID NO: 39776

SEQ ID NO: 184552 - RNA, 64 nt, hsa; identical to SEQ ID NO: 39777

SEQ ID NO: 184553 - RNA, 64 nt, hsa; identical to SEQ ID NO: 39778

SEQ ID NO: 184554 - RNA, 64 nt, hsa; identical to SEQ ID NO: 39779

SEQ ID NO: 184555 - RNA, 64 nt, hsa; identical to SEQ ID NO: 39780

SEQ ID NO: 184556 - RNA, 64 nt, hsa; identical to SEQ ID NO: 39781

SEQ ID NO: 184557 - RNA, 64 nt, hsa; identical to SEQ ID NO: 39782

SEQ ID NO: 184558 - RNA, 64 nt, hsa; identical to SEQ ID NO: 39783

SEQ ID NO: 184559 - RNA, 64 nt, hsa; identical to SEQ ID NO: 39784

SEQ ID NO: 184560 - RNA, 64 nt, hsa; identical to SEQ ID NO: 39785

SEQ ID NO: 184561 - RNA, 64 nt, hsa; identical to SEQ ID NO: 39786

SEQ ID NO: 184562 - RNA, 64 nt, hsa; identical to SEQ ID NO: 39787

SEQ ID NO: 184563 - RNA, 64 nt, hsa; identical to SEQ ID NO: 39788

SEQ ID NO: 184564 - RNA, 64 nt, hsa; identical to SEQ ID NO: 39789

SEQ ID NO: 184565 - RNA, 64 nt, hsa; identical to SEQ ID NO: 39790

SEQ ID NO: 184566 - RNA, 64 nt, hsa; identical to SEQ ID NO: 39791

SEQ ID NO: 184567 - RNA, 64 nt, hsa; identical to SEQ ID NO: 39792

SEQ ID NO: 184568 - RNA, 64 nt, hsa; identical to SEQ ID NO: 39793

SEQ ID NO: 184569 - RNA, 64 nt, hsa; identical to SEQ ID NO: 39794

SEQ ID NO: 184570 - RNA, 64 nt, hsa; identical to SEQ ID NO: 39795

SEQ ID NO: 184571 - RNA, 64 nt, hsa; identical to SEQ ID NO: 39796

SEQ ID NO: 184572 - RNA, 64 nt, hsa; identical to SEQ ID NO: 39797

SEQ ID NO: 184573 - RNA, 64 nt, hsa; identical to SEQ ID NO: 39798

SEQ ID NO: 184574 - RNA, 64 nt, hsa; identical to SEQ ID NO: 39799

SEQ ID NO: 184575 - RNA, 64 nt, hsa; identical to SEQ ID NO: 39800

SEQ ID NO: 184576 - RNA, 64 nt, hsa; identical to SEQ ID NO: 39801

SEQ ID NO: 184577 - RNA, 64 nt, hsa; identical to SEQ ID NO: 39802

SEQ ID NO: 184578 - RNA, 64 nt, hsa; identical to SEQ ID NO: 39803

SEQ ID NO: 184579 - RNA, 64 nt, hsa; identical to SEQ ID NO: 39804

SEQ ID NO: 184580 - RNA, 64 nt, hsa; identical to SEQ ID NO: 39805

SEQ ID NO: 184581 - RNA, 64 nt, hsa; identical to SEQ ID NO: 39806

SEQ ID NO: 184582 - RNA, 64 nt, hsa; identical to SEQ ID NO: 39807

SEQ ID NO: 184583 - RNA, 64 nt, hsa; identical to SEQ ID NO: 39808

SEQ ID NO: 184584 - RNA, 64 nt, hsa; identical to SEQ ID NO: 39809

SEQ ID NO: 184585 - RNA, 64 nt, hsa; identical to SEQ ID NO: 39810

SEQ ID NO: 184586 - RNA, 64 nt, hsa; identical to SEQ ID NO: 39811

SEQ ID NO: 184587 - RNA, 64 nt, hsa; identical to SEQ ID NO: 39812

SEQ ID NO: 184588 - RNA, 64 nt, hsa; identical to SEQ ID NO: 39813

SEQ ID NO: 184589 - RNA, 64 nt, hsa; identical to SEQ ID NO: 39814

SEQ ID NO: 184590 - RNA, 64 nt, hsa; identical to SEQ ID NO: 39815

SEQ ID NO: 184591 - RNA, 64 nt, hsa; identical to SEQ ID NO: 39816

SEQ ID NO: 184592 - RNA, 64 nt, hsa; identical to SEQ ID NO: 39817

SEQ ID NO: 184593 - RNA, 64 nt, hsa; identical to SEQ ID NO: 39818

SEQ ID NO: 184594 - RNA, 64 nt, hsa; identical to SEQ ID NO: 39819

SEQ ID NO: 184595 - RNA, 64 nt, hsa; identical to SEQ ID NO: 39820

SEQ ID NO: 184596 - RNA, 64 nt, hsa; identical to SEQ ID NO: 39821

SEQ ID NO: 184597 - RNA, 64 nt, hsa; identical to SEQ ID NO: 39822

SEQ ID NO: 184598 - RNA, 64 nt, hsa; identical to SEQ ID NO: 39823

SEQ ID NO: 184599 - RNA, 64 nt, hsa; identical to SEQ ID NO: 39824

SEQ ID NO: 184600 - RNA, 64 nt, hsa; identical to SEQ ID NO: 39825

SEQ ID NO: 184601 - RNA, 64 nt, hsa; identical to SEQ ID NO: 39826

SEQ ID NO: 184602 - RNA, 64 nt, hsa; identical to SEQ ID NO: 39827

SEQ ID NO: 184603 - RNA, 64 nt, hsa; identical to SEQ ID NO: 39828

SEQ ID NO: 184604 - RNA, 64 nt, hsa; identical to SEQ ID NO: 39829

SEQ ID NO: 184605 - RNA, 64 nt, hsa; identical to SEQ ID NO: 39830

SEQ ID NO: 184606 - RNA, 64 nt, hsa; identical to SEQ ID NO: 39831

SEQ ID NO: 184607 - RNA, 64 nt, hsa; identical to SEQ ID NO: 39832

SEQ ID NO: 184608 - RNA, 64 nt, hsa; identical to SEQ ID NO: 39833

SEQ ID NO: 184609 - RNA, 64 nt, hsa; identical to SEQ ID NO: 39834

SEQ ID NO: 184610 - RNA, 64 nt, hsa; identical to SEQ ID NO: 39835

SEQ ID NO: 184611 - RNA, 64 nt, hsa; identical to SEQ ID NO: 39836

SEQ ID NO: 184612 - RNA, 64 nt, hsa; identical to SEQ ID NO: 39837

SEQ ID NO: 184613 - RNA, 64 nt, hsa; identical to SEQ ID NO: 39838

SEQ ID NO: 184614 - RNA, 64 nt, hsa; identical to SEQ ID NO: 39839

SEQ ID NO: 184615 - RNA, 64 nt, hsa; identical to SEQ ID NO: 39840

SEQ ID NO: 184616 - RNA, 64 nt, hsa; identical to SEQ ID NO: 39841

SEQ ID NO: 184617 - RNA, 64 nt, hsa; identical to SEQ ID NO: 39842

SEQ ID NO: 184618 - RNA, 64 nt, hsa; identical to SEQ ID NO: 39843

SEQ ID NO: 184619 - RNA, 64 nt, hsa; identical to SEQ ID NO: 39844

SEQ ID NO: 184620 - RNA, 64 nt, hsa; identical to SEQ ID NO: 39845

SEQ ID NO: 184621 - RNA, 64 nt, hsa; identical to SEQ ID NO: 39846

SEQ ID NO: 184622 - RNA, 64 nt, hsa; identical to SEQ ID NO: 39847

SEQ ID NO: 184623 - RNA, 64 nt, hsa; identical to SEQ ID NO: 39848

SEQ ID NO: 184624 - RNA, 64 nt, hsa; identical to SEQ ID NO: 39849

SEQ ID NO: 184625 - RNA, 64 nt, hsa; identical to SEQ ID NO: 39850

SEQ ID NO: 184626 - RNA, 64 nt, hsa; identical to SEQ ID NO: 39851

SEQ ID NO: 184627 - RNA, 64 nt, hsa; identical to SEQ ID NO: 39852

SEQ ID NO: 184628 - RNA, 64 nt, hsa; identical to SEQ ID NO: 39853

SEQ ID NO: 184629 - RNA, 64 nt, hsa; identical to SEQ ID NO: 39854

SEQ ID NO: 184630 - RNA, 64 nt, hsa; identical to SEQ ID NO: 39855

SEQ ID NO: 184631 - RNA, 64 nt, hsa; identical to SEQ ID NO: 39856

SEQ ID NO: 184632 - RNA, 64 nt, hsa; identical to SEQ ID NO: 39857

SEQ ID NO: 184633 - RNA, 64 nt, hsa; identical to SEQ ID NO: 39858

SEQ ID NO: 184634 - RNA, 64 nt, hsa; identical to SEQ ID NO: 39859

SEQ ID NO: 184635 - RNA, 64 nt, hsa; identical to SEQ ID NO: 39860

SEQ ID NO: 184636 - RNA, 64 nt, hsa; identical to SEQ ID NO: 39861

SEQ ID NO: 184637 - RNA, 64 nt, hsa; identical to SEQ ID NO: 39862

SEQ ID NO: 184638 - RNA, 64 nt, hsa; identical to SEQ ID NO: 39863

SEQ ID NO: 184639 - RNA, 64 nt, hsa; identical to SEQ ID NO: 39864

SEQ ID NO: 184640 - RNA, 64 nt, hsa; identical to SEQ ID NO: 39865

SEQ ID NO: 184641 - RNA, 64 nt, hsa; identical to SEQ ID NO: 39866

SEQ ID NO: 184642 - RNA, 64 nt, hsa; identical to SEQ ID NO: 39867

SEQ ID NO: 184643 - RNA, 64 nt, hsa; identical to SEQ ID NO: 39868

SEQ ID NO: 184644 - RNA, 64 nt, hsa; identical to SEQ ID NO: 39869

SEQ ID NO: 184645 - RNA, 64 nt, hsa; identical to SEQ ID NO: 39870

SEQ ID NO: 184646 - RNA, 64 nt, hsa; identical to SEQ ID NO: 39871

SEQ ID NO: 184647 - RNA, 64 nt, hsa; identical to SEQ ID NO: 39872

SEQ ID NO: 184648 - RNA, 64 nt, hsa; identical to SEQ ID NO: 39873

SEQ ID NO: 184649 - RNA, 64 nt, hsa; identical to SEQ ID NO: 39874

SEQ ID NO: 184650 - RNA, 64 nt, hsa; identical to SEQ ID NO: 39875

SEQ ID NO: 184651 - RNA, 64 nt, hsa; identical to SEQ ID NO: 39876

SEQ ID NO: 184652 - RNA, 64 nt, hsa; identical to SEQ ID NO: 39877

SEQ ID NO: 184653 - RNA, 64 nt, hsa; identical to SEQ ID NO: 39878

SEQ ID NO: 184654 - RNA, 64 nt, hsa; identical to SEQ ID NO: 39879

SEQ ID NO: 184655 - RNA, 64 nt, hsa; identical to SEQ ID NO: 39880

SEQ ID NO: 184656 - RNA, 64 nt, hsa; identical to SEQ ID NO: 39881

SEQ ID NO: 184657 - RNA, 64 nt, hsa; identical to SEQ ID NO: 39882

SEQ ID NO: 184658 - RNA, 64 nt, hsa; identical to SEQ ID NO: 39883

SEQ ID NO: 184659 - RNA, 64 nt, hsa; identical to SEQ ID NO: 39884

SEQ ID NO: 184660 - RNA, 64 nt, hsa; identical to SEQ ID NO: 39885

SEQ ID NO: 184661 - RNA, 64 nt, hsa; identical to SEQ ID NO: 39886

SEQ ID NO: 184662 - RNA, 64 nt, hsa; identical to SEQ ID NO: 39887

SEQ ID NO: 184663 - RNA, 64 nt, hsa; identical to SEQ ID NO: 39888

SEQ ID NO: 184664 - RNA, 64 nt, hsa; identical to SEQ ID NO: 39889

SEQ ID NO: 184665 - RNA, 64 nt, hsa; identical to SEQ ID NO: 39890

SEQ ID NO: 184666 - RNA, 64 nt, hsa; identical to SEQ ID NO: 39891

SEQ ID NO: 184667 - RNA, 64 nt, hsa; identical to SEQ ID NO: 39892

SEQ ID NO: 184668 - RNA, 64 nt, hsa; identical to SEQ ID NO: 39893

SEQ ID NO: 184669 - RNA, 64 nt, hsa; identical to SEQ ID NO: 39894

SEQ ID NO: 184670 - RNA, 64 nt, hsa; identical to SEQ ID NO: 39895

SEQ ID NO: 184671 - RNA, 64 nt, hsa; identical to SEQ ID NO: 39896

SEQ ID NO: 184672 - RNA, 64 nt, hsa; identical to SEQ ID NO: 39897

SEQ ID NO: 184673 - RNA, 64 nt, hsa; identical to SEQ ID NO: 39898

SEQ ID NO: 184674 - RNA, 64 nt, hsa; identical to SEQ ID NO: 39899

SEQ ID NO: 184675 - RNA, 64 nt, hsa; identical to SEQ ID NO: 39900

SEQ ID NO: 184676 - RNA, 64 nt, hsa; identical to SEQ ID NO: 39901

SEQ ID NO: 184677 - RNA, 64 nt, hsa; identical to SEQ ID NO: 39902

SEQ ID NO: 184678 - RNA, 64 nt, hsa; identical to SEQ ID NO: 39903

SEQ ID NO: 184679 - RNA, 64 nt, hsa; identical to SEQ ID NO: 39904

SEQ ID NO: 184680 - RNA, 64 nt, hsa; identical to SEQ ID NO: 39905

SEQ ID NO: 184681 - RNA, 64 nt, hsa; identical to SEQ ID NO: 39906

SEQ ID NO: 184682 - RNA, 64 nt, hsa; identical to SEQ ID NO: 39907

SEQ ID NO: 184683 - RNA, 64 nt, hsa; identical to SEQ ID NO: 39908

SEQ ID NO: 184684 - RNA, 64 nt, hsa; identical to SEQ ID NO: 39909

SEQ ID NO: 184685 - RNA, 64 nt, hsa; identical to SEQ ID NO: 39910

SEQ ID NO: 184686 - RNA, 64 nt, hsa; identical to SEQ ID NO: 39911

SEQ ID NO: 184687 - RNA, 64 nt, hsa; identical to SEQ ID NO: 39912

SEQ ID NO: 184688 - RNA, 64 nt, hsa; identical to SEQ ID NO: 39913

SEQ ID NO: 184689 - RNA, 64 nt, hsa; identical to SEQ ID NO: 39914

SEQ ID NO: 184690 - RNA, 64 nt, hsa; identical to SEQ ID NO: 39915

SEQ ID NO: 184691 - RNA, 64 nt, hsa; identical to SEQ ID NO: 39916

SEQ ID NO: 184692 - RNA, 64 nt, hsa; identical to SEQ ID NO: 39917

SEQ ID NO: 184693 - RNA, 64 nt, hsa; identical to SEQ ID NO: 39918

SEQ ID NO: 184694 - RNA, 64 nt, hsa; identical to SEQ ID NO: 39919

SEQ ID NO: 184695 - RNA, 64 nt, hsa; identical to SEQ ID NO: 39920

SEQ ID NO: 184696 - RNA, 64 nt, hsa; identical to SEQ ID NO: 39921

SEQ ID NO: 184697 - RNA, 64 nt, hsa; identical to SEQ ID NO: 39922

SEQ ID NO: 184698 - RNA, 64 nt, hsa; identical to SEQ ID NO: 39923

SEQ ID NO: 184699 - RNA, 64 nt, hsa; identical to SEQ ID NO: 39924

SEQ ID NO: 184700 - RNA, 64 nt, hsa; identical to SEQ ID NO: 39925

SEQ ID NO: 184701 - RNA, 64 nt, hsa; identical to SEQ ID NO: 39926

SEQ ID NO: 184702 - RNA, 64 nt, hsa; identical to SEQ ID NO: 39927

SEQ ID NO: 184703 - RNA, 64 nt, hsa; identical to SEQ ID NO: 39928

SEQ ID NO: 184704 - RNA, 64 nt, hsa; identical to SEQ ID NO: 39929

SEQ ID NO: 184705 - RNA, 64 nt, hsa; identical to SEQ ID NO: 39930

SEQ ID NO: 184706 - RNA, 64 nt, hsa; identical to SEQ ID NO: 39931

SEQ ID NO: 184707 - RNA, 64 nt, hsa; identical to SEQ ID NO: 39932

SEQ ID NO: 184708 - RNA, 64 nt, hsa; identical to SEQ ID NO: 39933

SEQ ID NO: 184709 - RNA, 64 nt, hsa; identical to SEQ ID NO: 39934

SEQ ID NO: 184710 - RNA, 64 nt, hsa; identical to SEQ ID NO: 39935

SEQ ID NO: 184711 - RNA, 64 nt, hsa; identical to SEQ ID NO: 39936

SEQ ID NO: 184712 - RNA, 64 nt, hsa; identical to SEQ ID NO: 39937

SEQ ID NO: 184713 - RNA, 64 nt, hsa; identical to SEQ ID NO: 39938

SEQ ID NO: 184714 - RNA, 64 nt, hsa; identical to SEQ ID NO: 39939

SEQ ID NO: 184715 - RNA, 64 nt, hsa; identical to SEQ ID NO: 39940

SEQ ID NO: 184716 - RNA, 64 nt, hsa; identical to SEQ ID NO: 39941

SEQ ID NO: 184717 - RNA, 64 nt, hsa; identical to SEQ ID NO: 39942

SEQ ID NO: 184718 - RNA, 64 nt, hsa; identical to SEQ ID NO: 39943

SEQ ID NO: 184719 - RNA, 64 nt, hsa; identical to SEQ ID NO: 39944

SEQ ID NO: 184720 - RNA, 64 nt, hsa; identical to SEQ ID NO: 39945

SEQ ID NO: 184721 - RNA, 64 nt, hsa; identical to SEQ ID NO: 39946

SEQ ID NO: 184722 - RNA, 64 nt, hsa; identical to SEQ ID NO: 39947

SEQ ID NO: 184723 - RNA, 64 nt, hsa; identical to SEQ ID NO: 39948

SEQ ID NO: 184724 - RNA, 64 nt, hsa; identical to SEQ ID NO: 39949

SEQ ID NO: 184725 - RNA, 64 nt, hsa; identical to SEQ ID NO: 39950

SEQ ID NO: 184726 - RNA, 64 nt, hsa; identical to SEQ ID NO: 39951

SEQ ID NO: 184727 - RNA, 64 nt, hsa; identical to SEQ ID NO: 39952

SEQ ID NO: 184728 - RNA, 64 nt, hsa; identical to SEQ ID NO: 39953

SEQ ID NO: 184729 - RNA, 64 nt, hsa; identical to SEQ ID NO: 39954

SEQ ID NO: 184730 - RNA, 64 nt, hsa; identical to SEQ ID NO: 39955

SEQ ID NO: 184731 - RNA, 64 nt, hsa; identical to SEQ ID NO: 39956

SEQ ID NO: 184732 - RNA, 64 nt, hsa; identical to SEQ ID NO: 39957

SEQ ID NO: 184733 - RNA, 64 nt, hsa; identical to SEQ ID NO: 39958

SEQ ID NO: 184734 - RNA, 64 nt, hsa; identical to SEQ ID NO: 39959

SEQ ID NO: 184735 - RNA, 64 nt, hsa; identical to SEQ ID NO: 39960

SEQ ID NO: 184736 - RNA, 64 nt, hsa; identical to SEQ ID NO: 39961

SEQ ID NO: 184737 - RNA, 64 nt, hsa; identical to SEQ ID NO: 39962

SEQ ID NO: 184738 - RNA, 64 nt, hsa; identical to SEQ ID NO: 39963

SEQ ID NO: 184739 - RNA, 64 nt, hsa; identical to SEQ ID NO: 39964

SEQ ID NO: 184740 - RNA, 64 nt, hsa; identical to SEQ ID NO: 39965

SEQ ID NO: 184741 - RNA, 64 nt, hsa; identical to SEQ ID NO: 39966

SEQ ID NO: 184742 - RNA, 64 nt, hsa; identical to SEQ ID NO: 39967

SEQ ID NO: 184743 - RNA, 64 nt, hsa; identical to SEQ ID NO: 39968

SEQ ID NO: 184744 - RNA, 64 nt, hsa; identical to SEQ ID NO: 39969

SEQ ID NO: 184745 - RNA, 64 nt, hsa; identical to SEQ ID NO: 39970

SEQ ID NO: 184746 - RNA, 64 nt, hsa; identical to SEQ ID NO: 39971

SEQ ID NO: 184747 - RNA, 64 nt, hsa; identical to SEQ ID NO: 39972

SEQ ID NO: 184748 - RNA, 64 nt, hsa; identical to SEQ ID NO: 39973

SEQ ID NO: 184749 - RNA, 64 nt, hsa; identical to SEQ ID NO: 39974

SEQ ID NO: 184750 - RNA, 64 nt, hsa; identical to SEQ ID NO: 39975

SEQ ID NO: 184751 - RNA, 64 nt, hsa; identical to SEQ ID NO: 39976

SEQ ID NO: 184752 - RNA, 64 nt, hsa; identical to SEQ ID NO: 39977

SEQ ID NO: 184753 - RNA, 64 nt, hsa; identical to SEQ ID NO: 39978

SEQ ID NO: 184754 - RNA, 64 nt, hsa; identical to SEQ ID NO: 39979

SEQ ID NO: 184755 - RNA, 64 nt, hsa; identical to SEQ ID NO: 39980

SEQ ID NO: 184756 - RNA, 64 nt, hsa; identical to SEQ ID NO: 39981

SEQ ID NO: 184757 - RNA, 64 nt, hsa; identical to SEQ ID NO: 39982

SEQ ID NO: 184758 - RNA, 64 nt, hsa; identical to SEQ ID NO: 39983

SEQ ID NO: 184759 - RNA, 64 nt, hsa; identical to SEQ ID NO: 39984

SEQ ID NO: 184760 - RNA, 64 nt, hsa; identical to SEQ ID NO: 39985

SEQ ID NO: 184761 - RNA, 64 nt, hsa; identical to SEQ ID NO: 39986

SEQ ID NO: 184762 - RNA, 64 nt, hsa; identical to SEQ ID NO: 39987

SEQ ID NO: 184763 - RNA, 64 nt, hsa; identical to SEQ ID NO: 39988

SEQ ID NO: 184764 - RNA, 64 nt, hsa; identical to SEQ ID NO: 39989

SEQ ID NO: 184765 - RNA, 64 nt, hsa; identical to SEQ ID NO: 39990

SEQ ID NO: 184766 - RNA, 64 nt, hsa; identical to SEQ ID NO: 39991

SEQ ID NO: 184767 - RNA, 64 nt, hsa; identical to SEQ ID NO: 39992

SEQ ID NO: 184768 - RNA, 64 nt, hsa; identical to SEQ ID NO: 39993

SEQ ID NO: 184769 - RNA, 64 nt, hsa; identical to SEQ ID NO: 39994

SEQ ID NO: 184770 - RNA, 64 nt, hsa; identical to SEQ ID NO: 39995

SEQ ID NO: 184771 - RNA, 64 nt, hsa; identical to SEQ ID NO: 39996

SEQ ID NO: 184772 - RNA, 64 nt, hsa; identical to SEQ ID NO: 39997

SEQ ID NO: 184773 - RNA, 64 nt, hsa; identical to SEQ ID NO: 39998

SEQ ID NO: 184774 - RNA, 64 nt, hsa; identical to SEQ ID NO: 39999

SEQ ID NO: 184775 - RNA, 64 nt, hsa; identical to SEQ ID NO: 40000

SEQ ID NO: 184776 - RNA, 64 nt, hsa; identical to SEQ ID NO: 40001

SEQ ID NO: 184777 - RNA, 64 nt, hsa; identical to SEQ ID NO: 40002

SEQ ID NO: 184778 - RNA, 64 nt, hsa; identical to SEQ ID NO: 40003

SEQ ID NO: 184779 - RNA, 64 nt, hsa; identical to SEQ ID NO: 40004

SEQ ID NO: 184780 - RNA, 64 nt, hsa; identical to SEQ ID NO: 40005

SEQ ID NO: 184781 - RNA, 64 nt, hsa; identical to SEQ ID NO: 40006

SEQ ID NO: 184782 - RNA, 64 nt, hsa; identical to SEQ ID NO: 40007

SEQ ID NO: 184783 - RNA, 64 nt, hsa; identical to SEQ ID NO: 40008

SEQ ID NO: 184784 - RNA, 64 nt, hsa; identical to SEQ ID NO: 40009

SEQ ID NO: 184785 - RNA, 64 nt, hsa; identical to SEQ ID NO: 40010

SEQ ID NO: 184786 - RNA, 64 nt, hsa; identical to SEQ ID NO: 40011

SEQ ID NO: 184787 - RNA, 64 nt, hsa; identical to SEQ ID NO: 40012

SEQ ID NO: 184788 - RNA, 64 nt, hsa; identical to SEQ ID NO: 40013

SEQ ID NO: 184789 - RNA, 64 nt, hsa; identical to SEQ ID NO: 40014

SEQ ID NO: 184790 - RNA, 64 nt, hsa; identical to SEQ ID NO: 40015

SEQ ID NO: 184791 - RNA, 64 nt, hsa; identical to SEQ ID NO: 40016

SEQ ID NO: 184792 - RNA, 64 nt, hsa; identical to SEQ ID NO: 40017

SEQ ID NO: 184793 - RNA, 64 nt, hsa; identical to SEQ ID NO: 40018

SEQ ID NO: 184794 - RNA, 64 nt, hsa; identical to SEQ ID NO: 40019

SEQ ID NO: 184795 - RNA, 64 nt, hsa; identical to SEQ ID NO: 40020

SEQ ID NO: 184796 - RNA, 64 nt, hsa; identical to SEQ ID NO: 40021

SEQ ID NO: 184797 - RNA, 64 nt, hsa; identical to SEQ ID NO: 40022

SEQ ID NO: 184798 - RNA, 64 nt, hsa; identical to SEQ ID NO: 40023

SEQ ID NO: 184799 - RNA, 64 nt, hsa; identical to SEQ ID NO: 40024

SEQ ID NO: 184800 - RNA, 64 nt, hsa; identical to SEQ ID NO: 40025

SEQ ID NO: 184801 - RNA, 64 nt, hsa; identical to SEQ ID NO: 40026

SEQ ID NO: 184802 - RNA, 64 nt, hsa; identical to SEQ ID NO: 40027

SEQ ID NO: 184803 - RNA, 64 nt, hsa; identical to SEQ ID NO: 40028

SEQ ID NO: 184804 - RNA, 64 nt, hsa; identical to SEQ ID NO: 40029

SEQ ID NO: 184805 - RNA, 64 nt, hsa; identical to SEQ ID NO: 40030

SEQ ID NO: 184806 - RNA, 64 nt, hsa; identical to SEQ ID NO: 40031

SEQ ID NO: 184807 - RNA, 64 nt, hsa; identical to SEQ ID NO: 40032

SEQ ID NO: 184808 - RNA, 64 nt, hsa; identical to SEQ ID NO: 40033

SEQ ID NO: 184809 - RNA, 64 nt, hsa; identical to SEQ ID NO: 40034

SEQ ID NO: 184810 - RNA, 64 nt, hsa; identical to SEQ ID NO: 40035

SEQ ID NO: 184811 - RNA, 64 nt, hsa; identical to SEQ ID NO: 40036

SEQ ID NO: 184812 - RNA, 64 nt, hsa; identical to SEQ ID NO: 40037

SEQ ID NO: 184813 - RNA, 64 nt, hsa; identical to SEQ ID NO: 40038

SEQ ID NO: 184814 - RNA, 64 nt, hsa; identical to SEQ ID NO: 40039

SEQ ID NO: 184815 - RNA, 64 nt, hsa; identical to SEQ ID NO: 40040

SEQ ID NO: 184816 - RNA, 64 nt, hsa; identical to SEQ ID NO: 40041

SEQ ID NO: 184817 - RNA, 64 nt, hsa; identical to SEQ ID NO: 40042

SEQ ID NO: 184818 - RNA, 64 nt, hsa; identical to SEQ ID NO: 40043

SEQ ID NO: 184819 - RNA, 64 nt, hsa; identical to SEQ ID NO: 40044

SEQ ID NO: 184820 - RNA, 64 nt, hsa; identical to SEQ ID NO: 40045

SEQ ID NO: 184821 - RNA, 64 nt, hsa; identical to SEQ ID NO: 40046

SEQ ID NO: 184822 - RNA, 64 nt, hsa; identical to SEQ ID NO: 40047

SEQ ID NO: 184823 - RNA, 64 nt, hsa; identical to SEQ ID NO: 40048

SEQ ID NO: 184824 - RNA, 64 nt, hsa; identical to SEQ ID NO: 40049

SEQ ID NO: 184825 - RNA, 64 nt, hsa; identical to SEQ ID NO: 40050

SEQ ID NO: 184826 - RNA, 64 nt, hsa; identical to SEQ ID NO: 40051

SEQ ID NO: 184827 - RNA, 64 nt, hsa; identical to SEQ ID NO: 40052

SEQ ID NO: 184828 - RNA, 64 nt, hsa; identical to SEQ ID NO: 40053

SEQ ID NO: 184829 - RNA, 64 nt, hsa; identical to SEQ ID NO: 40054

SEQ ID NO: 184830 - RNA, 64 nt, hsa; identical to SEQ ID NO: 40055

SEQ ID NO: 184831 - RNA, 64 nt, hsa; identical to SEQ ID NO: 40056

SEQ ID NO: 184832 - RNA, 64 nt, hsa; identical to SEQ ID NO: 40057

SEQ ID NO: 184833 - RNA, 64 nt, hsa; identical to SEQ ID NO: 40058

SEQ ID NO: 184834 - RNA, 64 nt, hsa; identical to SEQ ID NO: 40059

SEQ ID NO: 184835 - RNA, 64 nt, hsa; identical to SEQ ID NO: 40060

SEQ ID NO: 184836 - RNA, 64 nt, hsa; identical to SEQ ID NO: 40061

SEQ ID NO: 184837 - RNA, 64 nt, hsa; identical to SEQ ID NO: 40062

SEQ ID NO: 184838 - RNA, 64 nt, hsa; identical to SEQ ID NO: 40063

SEQ ID NO: 184839 - RNA, 64 nt, hsa; identical to SEQ ID NO: 40064

SEQ ID NO: 184840 - RNA, 64 nt, hsa; identical to SEQ ID NO: 40065

SEQ ID NO: 184841 - RNA, 64 nt, hsa; identical to SEQ ID NO: 40066

SEQ ID NO: 184842 - RNA, 64 nt, hsa; identical to SEQ ID NO: 40067

SEQ ID NO: 184843 - RNA, 64 nt, hsa; identical to SEQ ID NO: 40068

SEQ ID NO: 184844 - RNA, 64 nt, hsa; identical to SEQ ID NO: 40069

SEQ ID NO: 184845 - RNA, 64 nt, hsa; identical to SEQ ID NO: 40070

SEQ ID NO: 184846 - RNA, 64 nt, hsa; identical to SEQ ID NO: 40071

SEQ ID NO: 184847 - RNA, 64 nt, hsa; identical to SEQ ID NO: 40072

SEQ ID NO: 184848 - RNA, 64 nt, hsa; identical to SEQ ID NO: 40073

SEQ ID NO: 184849 - RNA, 64 nt, hsa; identical to SEQ ID NO: 40074

SEQ ID NO: 184850 - RNA, 64 nt, hsa; identical to SEQ ID NO: 40075

SEQ ID NO: 184851 - RNA, 64 nt, hsa; identical to SEQ ID NO: 40076

SEQ ID NO: 184852 - RNA, 64 nt, hsa; identical to SEQ ID NO: 40077

SEQ ID NO: 184853 - RNA, 64 nt, hsa; identical to SEQ ID NO: 40078

SEQ ID NO: 184854 - RNA, 64 nt, hsa; identical to SEQ ID NO: 40079

SEQ ID NO: 184855 - RNA, 64 nt, hsa; identical to SEQ ID NO: 40080

SEQ ID NO: 184856 - RNA, 64 nt, hsa; identical to SEQ ID NO: 40081

SEQ ID NO: 184857 - RNA, 64 nt, hsa; identical to SEQ ID NO: 40082

SEQ ID NO: 184858 - RNA, 64 nt, hsa; identical to SEQ ID NO: 40083

SEQ ID NO: 184859 - RNA, 64 nt, hsa; identical to SEQ ID NO: 40084

SEQ ID NO: 184860 - RNA, 64 nt, hsa; identical to SEQ ID NO: 40085

SEQ ID NO: 184861 - RNA, 64 nt, hsa; identical to SEQ ID NO: 40086

SEQ ID NO: 184862 - RNA, 64 nt, hsa; identical to SEQ ID NO: 40087

SEQ ID NO: 184863 - RNA, 64 nt, hsa; identical to SEQ ID NO: 40088

SEQ ID NO: 184864 - RNA, 64 nt, hsa; identical to SEQ ID NO: 40089

SEQ ID NO: 184865 - RNA, 64 nt, hsa; identical to SEQ ID NO: 40090

SEQ ID NO: 184866 - RNA, 64 nt, hsa; identical to SEQ ID NO: 40091

SEQ ID NO: 184867 - RNA, 64 nt, hsa; identical to SEQ ID NO: 40092

SEQ ID NO: 184868 - RNA, 64 nt, hsa; identical to SEQ ID NO: 40093

SEQ ID NO: 184869 - RNA, 64 nt, hsa; identical to SEQ ID NO: 40094

SEQ ID NO: 184870 - RNA, 64 nt, hsa; identical to SEQ ID NO: 40095

SEQ ID NO: 184871 - RNA, 64 nt, hsa; identical to SEQ ID NO: 40096

SEQ ID NO: 184872 - RNA, 64 nt, hsa; identical to SEQ ID NO: 40097

SEQ ID NO: 184873 - RNA, 64 nt, hsa; identical to SEQ ID NO: 40098

SEQ ID NO: 184874 - RNA, 64 nt, hsa; identical to SEQ ID NO: 40099

SEQ ID NO: 184875 - RNA, 64 nt, hsa; identical to SEQ ID NO: 40100

SEQ ID NO: 184876 - RNA, 64 nt, hsa; identical to SEQ ID NO: 40101

SEQ ID NO: 184877 - RNA, 64 nt, hsa; identical to SEQ ID NO: 40102

SEQ ID NO: 184878 - RNA, 64 nt, hsa; identical to SEQ ID NO: 40103

SEQ ID NO: 184879 - RNA, 64 nt, hsa; identical to SEQ ID NO: 40104

SEQ ID NO: 184880 - RNA, 64 nt, hsa; identical to SEQ ID NO: 40105

SEQ ID NO: 184881 - RNA, 64 nt, hsa; identical to SEQ ID NO: 40106

SEQ ID NO: 184882 - RNA, 64 nt, hsa; identical to SEQ ID NO: 40107

SEQ ID NO: 184883 - RNA, 64 nt, hsa; identical to SEQ ID NO: 40108

SEQ ID NO: 184884 - RNA, 64 nt, hsa; identical to SEQ ID NO: 40109

SEQ ID NO: 184885 - RNA, 64 nt, hsa; identical to SEQ ID NO: 40110

SEQ ID NO: 184886 - RNA, 64 nt, hsa; identical to SEQ ID NO: 40111

SEQ ID NO: 184887 - RNA, 64 nt, hsa; identical to SEQ ID NO: 40112

SEQ ID NO: 184888 - RNA, 64 nt, hsa; identical to SEQ ID NO: 40113

SEQ ID NO: 184889 - RNA, 64 nt, hsa; identical to SEQ ID NO: 40114

SEQ ID NO: 184890 - RNA, 64 nt, hsa; identical to SEQ ID NO: 40115

SEQ ID NO: 184891 - RNA, 64 nt, hsa; identical to SEQ ID NO: 40116

SEQ ID NO: 184892 - RNA, 64 nt, hsa; identical to SEQ ID NO: 40117

SEQ ID NO: 184893 - RNA, 64 nt, hsa; identical to SEQ ID NO: 40118

SEQ ID NO: 184894 - RNA, 64 nt, hsa; identical to SEQ ID NO: 40119

SEQ ID NO: 184895 - RNA, 64 nt, hsa; identical to SEQ ID NO: 40120

SEQ ID NO: 184896 - RNA, 64 nt, hsa; identical to SEQ ID NO: 40121

SEQ ID NO: 184897 - RNA, 64 nt, hsa; identical to SEQ ID NO: 40122

SEQ ID NO: 184898 - RNA, 64 nt, hsa; identical to SEQ ID NO: 40123

SEQ ID NO: 184899 - RNA, 64 nt, hsa; identical to SEQ ID NO: 40124

SEQ ID NO: 184900 - RNA, 64 nt, hsa; identical to SEQ ID NO: 40125

SEQ ID NO: 184901 - RNA, 64 nt, hsa; identical to SEQ ID NO: 40126

SEQ ID NO: 184902 - RNA, 64 nt, hsa; identical to SEQ ID NO: 40127

SEQ ID NO: 184903 - RNA, 64 nt, hsa; identical to SEQ ID NO: 40128

SEQ ID NO: 184904 - RNA, 64 nt, hsa; identical to SEQ ID NO: 40129

SEQ ID NO: 184905 - RNA, 64 nt, hsa; identical to SEQ ID NO: 40130

SEQ ID NO: 184906 - RNA, 64 nt, hsa; identical to SEQ ID NO: 40131

SEQ ID NO: 184907 - RNA, 64 nt, hsa; identical to SEQ ID NO: 40132

SEQ ID NO: 184908 - RNA, 64 nt, hsa; identical to SEQ ID NO: 40133

SEQ ID NO: 184909 - RNA, 64 nt, hsa; identical to SEQ ID NO: 40134

SEQ ID NO: 184910 - RNA, 64 nt, hsa; identical to SEQ ID NO: 40135

SEQ ID NO: 184911 - RNA, 64 nt, hsa; identical to SEQ ID NO: 40136

SEQ ID NO: 184912 - RNA, 64 nt, hsa; identical to SEQ ID NO: 40137

SEQ ID NO: 184913 - RNA, 64 nt, hsa; identical to SEQ ID NO: 40138

SEQ ID NO: 184914 - RNA, 64 nt, hsa; identical to SEQ ID NO: 40139

SEQ ID NO: 184915 - RNA, 64 nt, hsa; identical to SEQ ID NO: 40140

SEQ ID NO: 184916 - RNA, 64 nt, hsa; identical to SEQ ID NO: 40141

SEQ ID NO: 184917 - RNA, 64 nt, hsa; identical to SEQ ID NO: 40142

SEQ ID NO: 184918 - RNA, 64 nt, hsa; identical to SEQ ID NO: 40143

SEQ ID NO: 184919 - RNA, 64 nt, hsa; identical to SEQ ID NO: 40144

SEQ ID NO: 184920 - RNA, 64 nt, hsa; identical to SEQ ID NO: 40145

SEQ ID NO: 184921 - RNA, 64 nt, hsa; identical to SEQ ID NO: 40146

SEQ ID NO: 184922 - RNA, 64 nt, hsa; identical to SEQ ID NO: 40147

SEQ ID NO: 184923 - RNA, 64 nt, hsa; identical to SEQ ID NO: 40148

SEQ ID NO: 184924 - RNA, 64 nt, hsa; identical to SEQ ID NO: 40149

SEQ ID NO: 184925 - RNA, 64 nt, hsa; identical to SEQ ID NO: 40150

SEQ ID NO: 184926 - RNA, 64 nt, hsa; identical to SEQ ID NO: 40151

SEQ ID NO: 184927 - RNA, 64 nt, hsa; identical to SEQ ID NO: 40152

SEQ ID NO: 184928 - RNA, 64 nt, hsa; identical to SEQ ID NO: 40153

SEQ ID NO: 184929 - RNA, 64 nt, hsa; identical to SEQ ID NO: 40154

SEQ ID NO: 184930 - RNA, 64 nt, hsa; identical to SEQ ID NO: 40155

SEQ ID NO: 184931 - RNA, 64 nt, hsa; identical to SEQ ID NO: 40156

SEQ ID NO: 184932 - RNA, 64 nt, hsa; identical to SEQ ID NO: 40157

SEQ ID NO: 184933 - RNA, 64 nt, hsa; identical to SEQ ID NO: 40158

SEQ ID NO: 184934 - RNA, 64 nt, hsa; identical to SEQ ID NO: 40159

SEQ ID NO: 184935 - RNA, 64 nt, hsa; identical to SEQ ID NO: 40160

SEQ ID NO: 184936 - RNA, 64 nt, hsa; identical to SEQ ID NO: 40161

SEQ ID NO: 184937 - RNA, 64 nt, hsa; identical to SEQ ID NO: 40162

SEQ ID NO: 184938 - RNA, 64 nt, hsa; identical to SEQ ID NO: 40163

SEQ ID NO: 184939 - RNA, 64 nt, hsa; identical to SEQ ID NO: 40164

SEQ ID NO: 184940 - RNA, 64 nt, hsa; identical to SEQ ID NO: 40165

SEQ ID NO: 184941 - RNA, 64 nt, hsa; identical to SEQ ID NO: 40166

SEQ ID NO: 184942 - RNA, 64 nt, hsa; identical to SEQ ID NO: 40167

SEQ ID NO: 184943 - RNA, 64 nt, hsa; identical to SEQ ID NO: 40168

SEQ ID NO: 184944 - RNA, 64 nt, hsa; identical to SEQ ID NO: 40169

SEQ ID NO: 184945 - RNA, 64 nt, hsa; identical to SEQ ID NO: 40170

SEQ ID NO: 184946 - RNA, 64 nt, hsa; identical to SEQ ID NO: 40171

SEQ ID NO: 184947 - RNA, 64 nt, hsa; identical to SEQ ID NO: 40172

SEQ ID NO: 184948 - RNA, 64 nt, hsa; identical to SEQ ID NO: 40173

SEQ ID NO: 184949 - RNA, 64 nt, hsa; identical to SEQ ID NO: 40174

SEQ ID NO: 184950 - RNA, 64 nt, hsa; identical to SEQ ID NO: 40175

SEQ ID NO: 184951 - RNA, 64 nt, hsa; identical to SEQ ID NO: 40176

SEQ ID NO: 184952 - RNA, 64 nt, hsa; identical to SEQ ID NO: 40177

SEQ ID NO: 184953 - RNA, 64 nt, hsa; identical to SEQ ID NO: 40178

SEQ ID NO: 184954 - RNA, 64 nt, hsa; identical to SEQ ID NO: 40179

SEQ ID NO: 184955 - RNA, 64 nt, hsa; identical to SEQ ID NO: 40180

SEQ ID NO: 184956 - RNA, 64 nt, hsa; identical to SEQ ID NO: 40181

SEQ ID NO: 184957 - RNA, 64 nt, hsa; identical to SEQ ID NO: 40182

SEQ ID NO: 184958 - RNA, 64 nt, hsa; identical to SEQ ID NO: 40183

SEQ ID NO: 184959 - RNA, 64 nt, hsa; identical to SEQ ID NO: 40184

SEQ ID NO: 184960 - RNA, 64 nt, hsa; identical to SEQ ID NO: 40185

SEQ ID NO: 184961 - RNA, 64 nt, hsa; identical to SEQ ID NO: 40186

SEQ ID NO: 184962 - RNA, 64 nt, hsa; identical to SEQ ID NO: 40187

SEQ ID NO: 184963 - RNA, 64 nt, hsa; identical to SEQ ID NO: 40188

SEQ ID NO: 184964 - RNA, 64 nt, hsa; identical to SEQ ID NO: 40189

SEQ ID NO: 184965 - RNA, 64 nt, hsa; identical to SEQ ID NO: 40190

SEQ ID NO: 184966 - RNA, 64 nt, hsa; identical to SEQ ID NO: 40191

SEQ ID NO: 184967 - RNA, 64 nt, hsa; identical to SEQ ID NO: 40192

SEQ ID NO: 184968 - RNA, 64 nt, hsa; identical to SEQ ID NO: 40193

SEQ ID NO: 184969 - RNA, 64 nt, hsa; identical to SEQ ID NO: 40194

SEQ ID NO: 184970 - RNA, 64 nt, hsa; identical to SEQ ID NO: 40195

SEQ ID NO: 184971 - RNA, 64 nt, hsa; identical to SEQ ID NO: 40196

SEQ ID NO: 184972 - RNA, 64 nt, hsa; identical to SEQ ID NO: 40197

SEQ ID NO: 184973 - RNA, 64 nt, hsa; identical to SEQ ID NO: 40198

SEQ ID NO: 184974 - RNA, 64 nt, hsa; identical to SEQ ID NO: 40199

SEQ ID NO: 184975 - RNA, 64 nt, hsa; identical to SEQ ID NO: 40200

SEQ ID NO: 184976 - RNA, 64 nt, hsa; identical to SEQ ID NO: 40201

SEQ ID NO: 184977 - RNA, 64 nt, hsa; identical to SEQ ID NO: 40202

SEQ ID NO: 184978 - RNA, 64 nt, hsa; identical to SEQ ID NO: 40203

SEQ ID NO: 184979 - RNA, 64 nt, hsa; identical to SEQ ID NO: 40204

SEQ ID NO: 184980 - RNA, 64 nt, hsa; identical to SEQ ID NO: 40205

SEQ ID NO: 184981 - RNA, 64 nt, hsa; identical to SEQ ID NO: 40206

SEQ ID NO: 184982 - RNA, 64 nt, hsa; identical to SEQ ID NO: 40207

SEQ ID NO: 184983 - RNA, 64 nt, hsa; identical to SEQ ID NO: 40208

SEQ ID NO: 184984 - RNA, 64 nt, hsa; identical to SEQ ID NO: 40209

SEQ ID NO: 184985 - RNA, 64 nt, hsa; identical to SEQ ID NO: 40210

SEQ ID NO: 184986 - RNA, 64 nt, hsa; identical to SEQ ID NO: 40211

SEQ ID NO: 184987 - RNA, 64 nt, hsa; identical to SEQ ID NO: 40212

SEQ ID NO: 184988 - RNA, 64 nt, hsa; identical to SEQ ID NO: 40213

SEQ ID NO: 184989 - RNA, 64 nt, hsa; identical to SEQ ID NO: 40214

SEQ ID NO: 184990 - RNA, 64 nt, hsa; identical to SEQ ID NO: 40215

SEQ ID NO: 184991 - RNA, 64 nt, hsa; identical to SEQ ID NO: 40216

SEQ ID NO: 184992 - RNA, 64 nt, hsa; identical to SEQ ID NO: 40217

SEQ ID NO: 184993 - RNA, 64 nt, hsa; identical to SEQ ID NO: 40218

SEQ ID NO: 184994 - RNA, 64 nt, hsa; identical to SEQ ID NO: 40219

SEQ ID NO: 184995 - RNA, 64 nt, hsa; identical to SEQ ID NO: 40220

SEQ ID NO: 184996 - RNA, 64 nt, hsa; identical to SEQ ID NO: 40221

SEQ ID NO: 184997 - RNA, 64 nt, hsa; identical to SEQ ID NO: 40222

SEQ ID NO: 184998 - RNA, 64 nt, hsa; identical to SEQ ID NO: 40223

SEQ ID NO: 184999 - RNA, 64 nt, hsa; identical to SEQ ID NO: 40224

SEQ ID NO: 185000 - RNA, 64 nt, hsa; identical to SEQ ID NO: 40225

SEQ ID NO: 185001 - RNA, 64 nt, hsa; identical to SEQ ID NO: 40226

SEQ ID NO: 185002 - RNA, 64 nt, hsa; identical to SEQ ID NO: 40227

SEQ ID NO: 185003 - RNA, 64 nt, hsa; identical to SEQ ID NO: 40228

SEQ ID NO: 185004 - RNA, 64 nt, hsa; identical to SEQ ID NO: 40229

SEQ ID NO: 185005 - RNA, 64 nt, hsa; identical to SEQ ID NO: 40230

SEQ ID NO: 185006 - RNA, 64 nt, hsa; identical to SEQ ID NO: 40231

SEQ ID NO: 185007 - RNA, 64 nt, hsa; identical to SEQ ID NO: 40232

SEQ ID NO: 185008 - RNA, 64 nt, hsa; identical to SEQ ID NO: 40233

SEQ ID NO: 185009 - RNA, 64 nt, hsa; identical to SEQ ID NO: 40234

SEQ ID NO: 185010 - RNA, 64 nt, hsa; identical to SEQ ID NO: 40235

SEQ ID NO: 185011 - RNA, 64 nt, hsa; identical to SEQ ID NO: 40236

SEQ ID NO: 185012 - RNA, 64 nt, hsa; identical to SEQ ID NO: 40237

SEQ ID NO: 185013 - RNA, 64 nt, hsa; identical to SEQ ID NO: 40238

SEQ ID NO: 185014 - RNA, 64 nt, hsa; identical to SEQ ID NO: 40239

SEQ ID NO: 185015 - RNA, 64 nt, hsa; identical to SEQ ID NO: 40240

SEQ ID NO: 185016 - RNA, 64 nt, hsa; identical to SEQ ID NO: 40241

SEQ ID NO: 185017 - RNA, 64 nt, hsa; identical to SEQ ID NO: 40242

SEQ ID NO: 185018 - RNA, 64 nt, hsa; identical to SEQ ID NO: 40243

SEQ ID NO: 185019 - RNA, 64 nt, hsa; identical to SEQ ID NO: 40244

SEQ ID NO: 185020 - RNA, 64 nt, hsa; identical to SEQ ID NO: 40245

SEQ ID NO: 185021 - RNA, 64 nt, hsa; identical to SEQ ID NO: 40246

SEQ ID NO: 185022 - RNA, 64 nt, hsa; identical to SEQ ID NO: 40247

SEQ ID NO: 185023 - RNA, 64 nt, hsa; identical to SEQ ID NO: 40248

SEQ ID NO: 185024 - RNA, 64 nt, hsa; identical to SEQ ID NO: 40249

SEQ ID NO: 185025 - RNA, 64 nt, hsa; identical to SEQ ID NO: 40250

SEQ ID NO: 185026 - RNA, 64 nt, hsa; identical to SEQ ID NO: 40251

SEQ ID NO: 185027 - RNA, 64 nt, hsa; identical to SEQ ID NO: 40252

SEQ ID NO: 185028 - RNA, 64 nt, hsa; identical to SEQ ID NO: 40253

SEQ ID NO: 185029 - RNA, 64 nt, hsa; identical to SEQ ID NO: 40254

SEQ ID NO: 185030 - RNA, 64 nt, hsa; identical to SEQ ID NO: 40255

SEQ ID NO: 185031 - RNA, 64 nt, hsa; identical to SEQ ID NO: 40256

SEQ ID NO: 185032 - RNA, 64 nt, hsa; identical to SEQ ID NO: 40257

SEQ ID NO: 185033 - RNA, 64 nt, hsa; identical to SEQ ID NO: 40258

SEQ ID NO: 185034 - RNA, 64 nt, hsa; identical to SEQ ID NO: 40259

SEQ ID NO: 185035 - RNA, 64 nt, hsa; identical to SEQ ID NO: 40260

SEQ ID NO: 185036 - RNA, 64 nt, hsa; identical to SEQ ID NO: 40261

SEQ ID NO: 185037 - RNA, 64 nt, hsa; identical to SEQ ID NO: 40262

SEQ ID NO: 185038 - RNA, 64 nt, hsa; identical to SEQ ID NO: 40263

SEQ ID NO: 185039 - RNA, 64 nt, hsa; identical to SEQ ID NO: 40264

SEQ ID NO: 185040 - RNA, 64 nt, hsa; identical to SEQ ID NO: 40265

SEQ ID NO: 185041 - RNA, 64 nt, hsa; identical to SEQ ID NO: 40266

SEQ ID NO: 185042 - RNA, 64 nt, hsa; identical to SEQ ID NO: 40267

SEQ ID NO: 185043 - RNA, 64 nt, hsa; identical to SEQ ID NO: 40268

SEQ ID NO: 185044 - RNA, 64 nt, hsa; identical to SEQ ID NO: 40269

SEQ ID NO: 185045 - RNA, 64 nt, hsa; identical to SEQ ID NO: 40270

SEQ ID NO: 185046 - RNA, 64 nt, hsa; identical to SEQ ID NO: 40271

SEQ ID NO: 185047 - RNA, 64 nt, hsa; identical to SEQ ID NO: 40272

SEQ ID NO: 185048 - RNA, 64 nt, hsa; identical to SEQ ID NO: 40273

SEQ ID NO: 185049 - RNA, 64 nt, hsa; identical to SEQ ID NO: 40274

SEQ ID NO: 185050 - RNA, 64 nt, hsa; identical to SEQ ID NO: 40275

SEQ ID NO: 185051 - RNA, 64 nt, hsa; identical to SEQ ID NO: 40276

SEQ ID NO: 185052 - RNA, 64 nt, hsa; identical to SEQ ID NO: 40277

SEQ ID NO: 185053 - RNA, 64 nt, hsa; identical to SEQ ID NO: 40278

SEQ ID NO: 185054 - RNA, 64 nt, hsa; identical to SEQ ID NO: 40279

SEQ ID NO: 185055 - RNA, 64 nt, hsa; identical to SEQ ID NO: 40280

SEQ ID NO: 185056 - RNA, 64 nt, hsa; identical to SEQ ID NO: 40281

SEQ ID NO: 185057 - RNA, 64 nt, hsa; identical to SEQ ID NO: 40282

SEQ ID NO: 185058 - RNA, 64 nt, hsa; identical to SEQ ID NO: 40283

SEQ ID NO: 185059 - RNA, 64 nt, hsa; identical to SEQ ID NO: 40284

SEQ ID NO: 185060 - RNA, 64 nt, hsa; identical to SEQ ID NO: 40285

SEQ ID NO: 185061 - RNA, 64 nt, hsa; identical to SEQ ID NO: 40286

SEQ ID NO: 185062 - RNA, 64 nt, hsa; identical to SEQ ID NO: 40287

SEQ ID NO: 185063 - RNA, 64 nt, hsa; identical to SEQ ID NO: 40288

SEQ ID NO: 185064 - RNA, 64 nt, hsa; identical to SEQ ID NO: 40289

SEQ ID NO: 185065 - RNA, 64 nt, hsa; identical to SEQ ID NO: 40290

SEQ ID NO: 185066 - RNA, 64 nt, hsa; identical to SEQ ID NO: 40291

SEQ ID NO: 185067 - RNA, 64 nt, hsa; identical to SEQ ID NO: 40292

SEQ ID NO: 185068 - RNA, 64 nt, hsa; identical to SEQ ID NO: 40293

SEQ ID NO: 185069 - RNA, 64 nt, hsa; identical to SEQ ID NO: 40294

SEQ ID NO: 185070 - RNA, 64 nt, hsa; identical to SEQ ID NO: 40295

SEQ ID NO: 185071 - RNA, 64 nt, hsa; identical to SEQ ID NO: 40296

SEQ ID NO: 185072 - RNA, 64 nt, hsa; identical to SEQ ID NO: 40297

SEQ ID NO: 185073 - RNA, 64 nt, hsa; identical to SEQ ID NO: 40298

SEQ ID NO: 185074 - RNA, 64 nt, hsa; identical to SEQ ID NO: 40299

SEQ ID NO: 185075 - RNA, 64 nt, hsa; identical to SEQ ID NO: 40300

SEQ ID NO: 185076 - RNA, 64 nt, hsa; identical to SEQ ID NO: 40301

SEQ ID NO: 185077 - RNA, 64 nt, hsa; identical to SEQ ID NO: 40302

SEQ ID NO: 185078 - RNA, 64 nt, hsa; identical to SEQ ID NO: 40303

SEQ ID NO: 185079 - RNA, 64 nt, hsa; identical to SEQ ID NO: 40304

SEQ ID NO: 185080 - RNA, 64 nt, hsa; identical to SEQ ID NO: 40305

SEQ ID NO: 185081 - RNA, 64 nt, hsa; identical to SEQ ID NO: 40306

SEQ ID NO: 185082 - RNA, 64 nt, hsa; identical to SEQ ID NO: 40307

SEQ ID NO: 185083 - RNA, 64 nt, hsa; identical to SEQ ID NO: 40308

SEQ ID NO: 185084 - RNA, 64 nt, hsa; identical to SEQ ID NO: 40309

SEQ ID NO: 185085 - RNA, 64 nt, hsa; identical to SEQ ID NO: 40310

SEQ ID NO: 185086 - RNA, 64 nt, hsa; identical to SEQ ID NO: 40311

SEQ ID NO: 185087 - RNA, 64 nt, hsa; identical to SEQ ID NO: 40312

SEQ ID NO: 185088 - RNA, 64 nt, hsa; identical to SEQ ID NO: 40313

SEQ ID NO: 185089 - RNA, 64 nt, hsa; identical to SEQ ID NO: 40314

SEQ ID NO: 185090 - RNA, 64 nt, hsa; identical to SEQ ID NO: 40315

SEQ ID NO: 185091 - RNA, 64 nt, hsa; identical to SEQ ID NO: 40316

SEQ ID NO: 185092 - RNA, 64 nt, hsa; identical to SEQ ID NO: 40317

SEQ ID NO: 185093 - RNA, 64 nt, hsa; identical to SEQ ID NO: 40318

SEQ ID NO: 185094 - RNA, 64 nt, hsa; identical to SEQ ID NO: 40319

SEQ ID NO: 185095 - RNA, 64 nt, hsa; identical to SEQ ID NO: 40320

SEQ ID NO: 185096 - RNA, 64 nt, hsa; identical to SEQ ID NO: 40321

SEQ ID NO: 185097 - RNA, 64 nt, hsa; identical to SEQ ID NO: 40322

SEQ ID NO: 185098 - RNA, 64 nt, hsa; identical to SEQ ID NO: 40323

SEQ ID NO: 185099 - RNA, 64 nt, hsa; identical to SEQ ID NO: 40324

SEQ ID NO: 185100 - RNA, 64 nt, hsa; identical to SEQ ID NO: 40325

SEQ ID NO: 185101 - RNA, 64 nt, hsa; identical to SEQ ID NO: 40326

SEQ ID NO: 185102 - RNA, 64 nt, hsa; identical to SEQ ID NO: 40327

SEQ ID NO: 185103 - RNA, 64 nt, hsa; identical to SEQ ID NO: 40328

SEQ ID NO: 185104 - RNA, 64 nt, hsa; identical to SEQ ID NO: 40329

SEQ ID NO: 185105 - RNA, 64 nt, hsa; identical to SEQ ID NO: 40330

SEQ ID NO: 185106 - RNA, 64 nt, hsa; identical to SEQ ID NO: 40331

SEQ ID NO: 185107 - RNA, 64 nt, hsa; identical to SEQ ID NO: 40332

SEQ ID NO: 185108 - RNA, 64 nt, hsa; identical to SEQ ID NO: 40333

SEQ ID NO: 185109 - RNA, 64 nt, hsa; identical to SEQ ID NO: 40334

SEQ ID NO: 185110 - RNA, 64 nt, hsa; identical to SEQ ID NO: 40335

SEQ ID NO: 185111 - RNA, 64 nt, hsa; identical to SEQ ID NO: 40336

SEQ ID NO: 185112 - RNA, 64 nt, hsa; identical to SEQ ID NO: 40337

SEQ ID NO: 185113 - RNA, 64 nt, hsa; identical to SEQ ID NO: 40338

SEQ ID NO: 185114 - RNA, 64 nt, hsa; identical to SEQ ID NO: 40339

SEQ ID NO: 185115 - RNA, 64 nt, hsa; identical to SEQ ID NO: 40340

SEQ ID NO: 185116 - RNA, 64 nt, hsa; identical to SEQ ID NO: 40341

SEQ ID NO: 185117 - RNA, 64 nt, hsa; identical to SEQ ID NO: 40342

SEQ ID NO: 185118 - RNA, 64 nt, hsa; identical to SEQ ID NO: 40343

SEQ ID NO: 185119 - RNA, 64 nt, hsa; identical to SEQ ID NO: 40344

SEQ ID NO: 185120 - RNA, 64 nt, hsa; identical to SEQ ID NO: 40345

SEQ ID NO: 185121 - RNA, 64 nt, hsa; identical to SEQ ID NO: 40346

SEQ ID NO: 185122 - RNA, 64 nt, hsa; identical to SEQ ID NO: 40347

SEQ ID NO: 185123 - RNA, 64 nt, hsa; identical to SEQ ID NO: 40348

SEQ ID NO: 185124 - RNA, 64 nt, hsa; identical to SEQ ID NO: 40349

SEQ ID NO: 185125 - RNA, 64 nt, hsa; identical to SEQ ID NO: 40350

SEQ ID NO: 185126 - RNA, 64 nt, hsa; identical to SEQ ID NO: 40351

SEQ ID NO: 185127 - RNA, 64 nt, hsa; identical to SEQ ID NO: 40352

SEQ ID NO: 185128 - RNA, 64 nt, hsa; identical to SEQ ID NO: 40353

SEQ ID NO: 185129 - RNA, 64 nt, hsa; identical to SEQ ID NO: 40354

SEQ ID NO: 185130 - RNA, 64 nt, hsa; identical to SEQ ID NO: 40355

SEQ ID NO: 185131 - RNA, 64 nt, hsa; identical to SEQ ID NO: 40356

SEQ ID NO: 185132 - RNA, 64 nt, hsa; identical to SEQ ID NO: 40357

SEQ ID NO: 185133 - RNA, 64 nt, hsa; identical to SEQ ID NO: 40358

SEQ ID NO: 185134 - RNA, 64 nt, hsa; identical to SEQ ID NO: 40359

SEQ ID NO: 185135 - RNA, 64 nt, hsa; identical to SEQ ID NO: 40360

SEQ ID NO: 185136 - RNA, 64 nt, hsa; identical to SEQ ID NO: 40361

SEQ ID NO: 185137 - RNA, 64 nt, hsa; identical to SEQ ID NO: 40362

SEQ ID NO: 185138 - RNA, 64 nt, hsa; identical to SEQ ID NO: 40363

SEQ ID NO: 185139 - RNA, 64 nt, hsa; identical to SEQ ID NO: 40364

SEQ ID NO: 185140 - RNA, 64 nt, hsa; identical to SEQ ID NO: 40365

SEQ ID NO: 185141 - RNA, 64 nt, hsa; identical to SEQ ID NO: 40366

SEQ ID NO: 185142 - RNA, 64 nt, hsa; identical to SEQ ID NO: 40367

SEQ ID NO: 185143 - RNA, 64 nt, hsa; identical to SEQ ID NO: 40368

SEQ ID NO: 185144 - RNA, 64 nt, hsa; identical to SEQ ID NO: 40369

SEQ ID NO: 185145 - RNA, 64 nt, hsa; identical to SEQ ID NO: 40370

SEQ ID NO: 185146 - RNA, 64 nt, hsa; identical to SEQ ID NO: 40371

SEQ ID NO: 185147 - RNA, 64 nt, hsa; identical to SEQ ID NO: 40372

SEQ ID NO: 185148 - RNA, 64 nt, hsa; identical to SEQ ID NO: 40373

SEQ ID NO: 185149 - RNA, 64 nt, hsa; identical to SEQ ID NO: 40374

SEQ ID NO: 185150 - RNA, 64 nt, hsa; identical to SEQ ID NO: 40375

SEQ ID NO: 185151 - RNA, 64 nt, hsa; identical to SEQ ID NO: 40376

SEQ ID NO: 185152 - RNA, 64 nt, hsa; identical to SEQ ID NO: 40377

SEQ ID NO: 185153 - RNA, 64 nt, hsa; identical to SEQ ID NO: 40378

SEQ ID NO: 185154 - RNA, 64 nt, hsa; identical to SEQ ID NO: 40379

SEQ ID NO: 185155 - RNA, 64 nt, hsa; identical to SEQ ID NO: 40380

SEQ ID NO: 185156 - RNA, 64 nt, hsa; identical to SEQ ID NO: 40381

SEQ ID NO: 185157 - RNA, 64 nt, hsa; identical to SEQ ID NO: 40382

SEQ ID NO: 185158 - RNA, 64 nt, hsa; identical to SEQ ID NO: 40383

SEQ ID NO: 185159 - RNA, 64 nt, hsa; identical to SEQ ID NO: 40384

SEQ ID NO: 185160 - RNA, 64 nt, hsa; identical to SEQ ID NO: 40385

SEQ ID NO: 185161 - RNA, 64 nt, hsa; identical to SEQ ID NO: 40386

SEQ ID NO: 185162 - RNA, 64 nt, hsa; identical to SEQ ID NO: 40387

SEQ ID NO: 185163 - RNA, 64 nt, hsa; identical to SEQ ID NO: 40388

SEQ ID NO: 185164 - RNA, 64 nt, hsa; identical to SEQ ID NO: 40389

SEQ ID NO: 185165 - RNA, 64 nt, hsa; identical to SEQ ID NO: 40390

SEQ ID NO: 185166 - RNA, 64 nt, hsa; identical to SEQ ID NO: 40391

SEQ ID NO: 185167 - RNA, 64 nt, hsa; identical to SEQ ID NO: 40392

SEQ ID NO: 185168 - RNA, 64 nt, hsa; identical to SEQ ID NO: 40393

SEQ ID NO: 185169 - RNA, 64 nt, hsa; identical to SEQ ID NO: 40394

SEQ ID NO: 185170 - RNA, 64 nt, hsa; identical to SEQ ID NO: 40395

SEQ ID NO: 185171 - RNA, 64 nt, hsa; identical to SEQ ID NO: 40396

SEQ ID NO: 185172 - RNA, 64 nt, hsa; identical to SEQ ID NO: 40397

SEQ ID NO: 185173 - RNA, 64 nt, hsa; identical to SEQ ID NO: 40398

SEQ ID NO: 185174 - RNA, 64 nt, hsa; identical to SEQ ID NO: 40399

SEQ ID NO: 185175 - RNA, 64 nt, hsa; identical to SEQ ID NO: 40400

SEQ ID NO: 185176 - RNA, 64 nt, hsa; identical to SEQ ID NO: 40401

SEQ ID NO: 185177 - RNA, 64 nt, hsa; identical to SEQ ID NO: 40402

SEQ ID NO: 185178 - RNA, 64 nt, hsa; identical to SEQ ID NO: 40403

SEQ ID NO: 185179 - RNA, 64 nt, hsa; identical to SEQ ID NO: 40404

SEQ ID NO: 185180 - RNA, 64 nt, hsa; identical to SEQ ID NO: 40405

SEQ ID NO: 185181 - RNA, 64 nt, hsa; identical to SEQ ID NO: 40406

SEQ ID NO: 185182 - RNA, 64 nt, hsa; identical to SEQ ID NO: 40407

SEQ ID NO: 185183 - RNA, 64 nt, hsa; identical to SEQ ID NO: 40408

SEQ ID NO: 185184 - RNA, 64 nt, hsa; identical to SEQ ID NO: 40409

SEQ ID NO: 185185 - RNA, 64 nt, hsa; identical to SEQ ID NO: 40410

SEQ ID NO: 185186 - RNA, 64 nt, hsa; identical to SEQ ID NO: 40411

SEQ ID NO: 185187 - RNA, 64 nt, hsa; identical to SEQ ID NO: 40412

SEQ ID NO: 185188 - RNA, 64 nt, hsa; identical to SEQ ID NO: 40413

SEQ ID NO: 185189 - RNA, 64 nt, hsa; identical to SEQ ID NO: 40414

SEQ ID NO: 185190 - RNA, 64 nt, hsa; identical to SEQ ID NO: 40415

SEQ ID NO: 185191 - RNA, 64 nt, hsa; identical to SEQ ID NO: 40416

SEQ ID NO: 185192 - RNA, 64 nt, hsa; identical to SEQ ID NO: 40417

SEQ ID NO: 185193 - RNA, 64 nt, hsa; identical to SEQ ID NO: 40418

SEQ ID NO: 185194 - RNA, 64 nt, hsa; identical to SEQ ID NO: 40419

SEQ ID NO: 185195 - RNA, 64 nt, hsa; identical to SEQ ID NO: 40420

SEQ ID NO: 185196 - RNA, 64 nt, hsa; identical to SEQ ID NO: 40421

SEQ ID NO: 185197 - RNA, 64 nt, hsa; identical to SEQ ID NO: 40422

SEQ ID NO: 185198 - RNA, 64 nt, hsa; identical to SEQ ID NO: 40423

SEQ ID NO: 185199 - RNA, 64 nt, hsa; identical to SEQ ID NO: 40424

SEQ ID NO: 185200 - RNA, 64 nt, hsa; identical to SEQ ID NO: 40425

SEQ ID NO: 185201 - RNA, 64 nt, hsa; identical to SEQ ID NO: 40426

SEQ ID NO: 185202 - RNA, 64 nt, hsa; identical to SEQ ID NO: 40427

SEQ ID NO: 185203 - RNA, 64 nt, hsa; identical to SEQ ID NO: 40428

SEQ ID NO: 185204 - RNA, 64 nt, hsa; identical to SEQ ID NO: 40429

SEQ ID NO: 185205 - RNA, 64 nt, hsa; identical to SEQ ID NO: 40430

SEQ ID NO: 185206 - RNA, 64 nt, hsa; identical to SEQ ID NO: 40431

SEQ ID NO: 185207 - RNA, 64 nt, hsa; identical to SEQ ID NO: 40432

SEQ ID NO: 185208 - RNA, 64 nt, hsa; identical to SEQ ID NO: 40433

SEQ ID NO: 185209 - RNA, 64 nt, hsa; identical to SEQ ID NO: 40434

SEQ ID NO: 185210 - RNA, 64 nt, hsa; identical to SEQ ID NO: 40435

SEQ ID NO: 185211 - RNA, 64 nt, hsa; identical to SEQ ID NO: 40436

SEQ ID NO: 185212 - RNA, 64 nt, hsa; identical to SEQ ID NO: 40437

SEQ ID NO: 185213 - RNA, 64 nt, hsa; identical to SEQ ID NO: 40438

SEQ ID NO: 185214 - RNA, 64 nt, hsa; identical to SEQ ID NO: 40439

SEQ ID NO: 185215 - RNA, 64 nt, hsa; identical to SEQ ID NO: 40440

SEQ ID NO: 185216 - RNA, 64 nt, hsa; identical to SEQ ID NO: 40441

SEQ ID NO: 185217 - RNA, 64 nt, hsa; identical to SEQ ID NO: 40442

SEQ ID NO: 185218 - RNA, 64 nt, hsa; identical to SEQ ID NO: 40443

SEQ ID NO: 185219 - RNA, 64 nt, hsa; identical to SEQ ID NO: 40444

SEQ ID NO: 185220 - RNA, 64 nt, hsa; identical to SEQ ID NO: 40445

SEQ ID NO: 185221 - RNA, 64 nt, hsa; identical to SEQ ID NO: 40446

SEQ ID NO: 185222 - RNA, 64 nt, hsa; identical to SEQ ID NO: 40447

SEQ ID NO: 185223 - RNA, 64 nt, hsa; identical to SEQ ID NO: 40448

SEQ ID NO: 185224 - RNA, 64 nt, hsa; identical to SEQ ID NO: 40449

SEQ ID NO: 185225 - RNA, 64 nt, hsa; identical to SEQ ID NO: 40450

SEQ ID NO: 185226 - RNA, 64 nt, hsa; identical to SEQ ID NO: 40451

SEQ ID NO: 185227 - RNA, 64 nt, hsa; identical to SEQ ID NO: 40452

SEQ ID NO: 185228 - RNA, 64 nt, hsa; identical to SEQ ID NO: 40453

SEQ ID NO: 185229 - RNA, 64 nt, hsa; identical to SEQ ID NO: 40454

SEQ ID NO: 185230 - RNA, 64 nt, hsa; identical to SEQ ID NO: 40455

SEQ ID NO: 185231 - RNA, 64 nt, hsa; identical to SEQ ID NO: 40456

SEQ ID NO: 185232 - RNA, 64 nt, hsa; identical to SEQ ID NO: 40457

SEQ ID NO: 185233 - RNA, 64 nt, hsa; identical to SEQ ID NO: 40458

SEQ ID NO: 185234 - RNA, 64 nt, hsa; identical to SEQ ID NO: 40459

SEQ ID NO: 185235 - RNA, 64 nt, hsa; identical to SEQ ID NO: 40460

SEQ ID NO: 185236 - RNA, 64 nt, hsa; identical to SEQ ID NO: 40461

SEQ ID NO: 185237 - RNA, 64 nt, hsa; identical to SEQ ID NO: 40462

SEQ ID NO: 185238 - RNA, 64 nt, hsa; identical to SEQ ID NO: 40463

SEQ ID NO: 185239 - RNA, 64 nt, hsa; identical to SEQ ID NO: 40464

SEQ ID NO: 185240 - RNA, 64 nt, hsa; identical to SEQ ID NO: 40465

SEQ ID NO: 185241 - RNA, 64 nt, hsa; identical to SEQ ID NO: 40466

SEQ ID NO: 185242 - RNA, 64 nt, hsa; identical to SEQ ID NO: 40467

SEQ ID NO: 185243 - RNA, 64 nt, hsa; identical to SEQ ID NO: 40468

SEQ ID NO: 185244 - RNA, 64 nt, hsa; identical to SEQ ID NO: 40469

SEQ ID NO: 185245 - RNA, 64 nt, hsa; identical to SEQ ID NO: 40470

SEQ ID NO: 185246 - RNA, 64 nt, hsa; identical to SEQ ID NO: 40471

SEQ ID NO: 185247 - RNA, 64 nt, hsa; identical to SEQ ID NO: 40472

SEQ ID NO: 185248 - RNA, 64 nt, hsa; identical to SEQ ID NO: 40473

SEQ ID NO: 185249 - RNA, 64 nt, hsa; identical to SEQ ID NO: 40474

SEQ ID NO: 185250 - RNA, 64 nt, hsa; identical to SEQ ID NO: 40475

SEQ ID NO: 185251 - RNA, 64 nt, hsa; identical to SEQ ID NO: 40476

SEQ ID NO: 185252 - RNA, 64 nt, hsa; identical to SEQ ID NO: 40477

SEQ ID NO: 185253 - RNA, 64 nt, hsa; identical to SEQ ID NO: 40478

SEQ ID NO: 185254 - RNA, 64 nt, hsa; identical to SEQ ID NO: 40479

SEQ ID NO: 185255 - RNA, 64 nt, hsa; identical to SEQ ID NO: 40480

SEQ ID NO: 185256 - RNA, 64 nt, hsa; identical to SEQ ID NO: 40481

SEQ ID NO: 185257 - RNA, 64 nt, hsa; identical to SEQ ID NO: 40482

SEQ ID NO: 185258 - RNA, 64 nt, hsa; identical to SEQ ID NO: 40483

SEQ ID NO: 185259 - RNA, 64 nt, hsa; identical to SEQ ID NO: 40484

SEQ ID NO: 185260 - RNA, 64 nt, hsa; identical to SEQ ID NO: 40485

SEQ ID NO: 185261 - RNA, 64 nt, hsa; identical to SEQ ID NO: 40486

SEQ ID NO: 185262 - RNA, 64 nt, hsa; identical to SEQ ID NO: 40487

SEQ ID NO: 185263 - RNA, 64 nt, hsa; identical to SEQ ID NO: 40488

SEQ ID NO: 185264 - RNA, 64 nt, hsa; identical to SEQ ID NO: 40489

SEQ ID NO: 185265 - RNA, 64 nt, hsa; identical to SEQ ID NO: 40490

SEQ ID NO: 185266 - RNA, 64 nt, hsa; identical to SEQ ID NO: 40491

SEQ ID NO: 185267 - RNA, 64 nt, hsa; identical to SEQ ID NO: 40492

SEQ ID NO: 185268 - RNA, 64 nt, hsa; identical to SEQ ID NO: 40493

SEQ ID NO: 185269 - RNA, 64 nt, hsa; identical to SEQ ID NO: 40494

SEQ ID NO: 185270 - RNA, 64 nt, hsa; identical to SEQ ID NO: 40495

SEQ ID NO: 185271 - RNA, 64 nt, hsa; identical to SEQ ID NO: 40496

SEQ ID NO: 185272 - RNA, 64 nt, hsa; identical to SEQ ID NO: 40497

SEQ ID NO: 185273 - RNA, 64 nt, hsa; identical to SEQ ID NO: 40498

SEQ ID NO: 185274 - RNA, 64 nt, hsa; identical to SEQ ID NO: 40499

SEQ ID NO: 185275 - RNA, 64 nt, hsa; identical to SEQ ID NO: 40500

SEQ ID NO: 185276 - RNA, 64 nt, hsa; identical to SEQ ID NO: 40501

SEQ ID NO: 185277 - RNA, 64 nt, hsa; identical to SEQ ID NO: 40502

SEQ ID NO: 185278 - RNA, 64 nt, hsa; identical to SEQ ID NO: 40503

SEQ ID NO: 185279 - RNA, 64 nt, hsa; identical to SEQ ID NO: 40504

SEQ ID NO: 185280 - RNA, 64 nt, hsa; identical to SEQ ID NO: 40505

SEQ ID NO: 185281 - RNA, 64 nt, hsa; identical to SEQ ID NO: 40506

SEQ ID NO: 185282 - RNA, 64 nt, hsa; identical to SEQ ID NO: 40507

SEQ ID NO: 185283 - RNA, 64 nt, hsa; identical to SEQ ID NO: 40508

SEQ ID NO: 185284 - RNA, 64 nt, hsa; identical to SEQ ID NO: 40509

SEQ ID NO: 185285 - RNA, 64 nt, hsa; identical to SEQ ID NO: 40510

SEQ ID NO: 185286 - RNA, 64 nt, hsa; identical to SEQ ID NO: 40511

SEQ ID NO: 185287 - RNA, 64 nt, hsa; identical to SEQ ID NO: 40512

SEQ ID NO: 185288 - RNA, 64 nt, hsa; identical to SEQ ID NO: 40513

SEQ ID NO: 185289 - RNA, 64 nt, hsa; identical to SEQ ID NO: 40514

SEQ ID NO: 185290 - RNA, 64 nt, hsa; identical to SEQ ID NO: 40515

SEQ ID NO: 185291 - RNA, 64 nt, hsa; identical to SEQ ID NO: 40516

SEQ ID NO: 185292 - RNA, 64 nt, hsa; identical to SEQ ID NO: 40517

SEQ ID NO: 185293 - RNA, 64 nt, hsa; identical to SEQ ID NO: 40518

SEQ ID NO: 185294 - RNA, 64 nt, hsa; identical to SEQ ID NO: 40519

SEQ ID NO: 185295 - RNA, 64 nt, hsa; identical to SEQ ID NO: 40520

SEQ ID NO: 185296 - RNA, 64 nt, hsa; identical to SEQ ID NO: 40521

SEQ ID NO: 185297 - RNA, 64 nt, hsa; identical to SEQ ID NO: 40522

SEQ ID NO: 185298 - RNA, 64 nt, hsa; identical to SEQ ID NO: 40523

SEQ ID NO: 185299 - RNA, 64 nt, hsa; identical to SEQ ID NO: 40524

SEQ ID NO: 185300 - RNA, 64 nt, hsa; identical to SEQ ID NO: 40525

SEQ ID NO: 185301 - RNA, 64 nt, hsa; identical to SEQ ID NO: 40526

SEQ ID NO: 185302 - RNA, 64 nt, hsa; identical to SEQ ID NO: 40527

SEQ ID NO: 185303 - RNA, 64 nt, hsa; identical to SEQ ID NO: 40528

SEQ ID NO: 185304 - RNA, 64 nt, hsa; identical to SEQ ID NO: 40529

SEQ ID NO: 185305 - RNA, 64 nt, hsa; identical to SEQ ID NO: 40530

SEQ ID NO: 185306 - RNA, 64 nt, hsa; identical to SEQ ID NO: 40531

SEQ ID NO: 185307 - RNA, 64 nt, hsa; identical to SEQ ID NO: 40532

SEQ ID NO: 185308 - RNA, 64 nt, hsa; identical to SEQ ID NO: 40533

SEQ ID NO: 185309 - RNA, 64 nt, hsa; identical to SEQ ID NO: 40534

SEQ ID NO: 185310 - RNA, 64 nt, hsa; identical to SEQ ID NO: 40535

SEQ ID NO: 185311 - RNA, 64 nt, hsa; identical to SEQ ID NO: 40536

SEQ ID NO: 185312 - RNA, 64 nt, hsa; identical to SEQ ID NO: 40537

SEQ ID NO: 185313 - RNA, 64 nt, hsa; identical to SEQ ID NO: 40538

SEQ ID NO: 185314 - RNA, 64 nt, hsa; identical to SEQ ID NO: 40539

SEQ ID NO: 185315 - RNA, 64 nt, hsa; identical to SEQ ID NO: 40540

SEQ ID NO: 185316 - RNA, 64 nt, hsa; identical to SEQ ID NO: 40541

SEQ ID NO: 185317 - RNA, 64 nt, hsa; identical to SEQ ID NO: 40542

SEQ ID NO: 185318 - RNA, 64 nt, hsa; identical to SEQ ID NO: 40543

SEQ ID NO: 185319 - RNA, 64 nt, hsa; identical to SEQ ID NO: 40544

SEQ ID NO: 185320 - RNA, 64 nt, hsa; identical to SEQ ID NO: 40545

SEQ ID NO: 185321 - RNA, 64 nt, hsa; identical to SEQ ID NO: 40546

SEQ ID NO: 185322 - RNA, 64 nt, hsa; identical to SEQ ID NO: 40547

SEQ ID NO: 185323 - RNA, 64 nt, hsa; identical to SEQ ID NO: 40548

SEQ ID NO: 185324 - RNA, 64 nt, hsa; identical to SEQ ID NO: 40549

SEQ ID NO: 185325 - RNA, 64 nt, hsa; identical to SEQ ID NO: 40550

SEQ ID NO: 185326 - RNA, 64 nt, hsa; identical to SEQ ID NO: 40551

SEQ ID NO: 185327 - RNA, 64 nt, hsa; identical to SEQ ID NO: 40552

SEQ ID NO: 185328 - RNA, 64 nt, hsa; identical to SEQ ID NO: 40553

SEQ ID NO: 185329 - RNA, 64 nt, hsa; identical to SEQ ID NO: 40554

SEQ ID NO: 185330 - RNA, 64 nt, hsa; identical to SEQ ID NO: 40555

SEQ ID NO: 185331 - RNA, 64 nt, hsa; identical to SEQ ID NO: 40556

SEQ ID NO: 185332 - RNA, 64 nt, hsa; identical to SEQ ID NO: 40557

SEQ ID NO: 185333 - RNA, 64 nt, hsa; identical to SEQ ID NO: 40558

SEQ ID NO: 185334 - RNA, 64 nt, hsa; identical to SEQ ID NO: 40559

SEQ ID NO: 185335 - RNA, 64 nt, hsa; identical to SEQ ID NO: 40560

SEQ ID NO: 185336 - RNA, 64 nt, hsa; identical to SEQ ID NO: 40561

SEQ ID NO: 185337 - RNA, 64 nt, hsa; identical to SEQ ID NO: 40562

SEQ ID NO: 185338 - RNA, 64 nt, hsa; identical to SEQ ID NO: 40563

SEQ ID NO: 185339 - RNA, 64 nt, hsa; identical to SEQ ID NO: 40564

SEQ ID NO: 185340 - RNA, 64 nt, hsa; identical to SEQ ID NO: 40565

SEQ ID NO: 185341 - RNA, 64 nt, hsa; identical to SEQ ID NO: 40566

SEQ ID NO: 185342 - RNA, 64 nt, hsa; identical to SEQ ID NO: 40567

SEQ ID NO: 185343 - RNA, 64 nt, hsa; identical to SEQ ID NO: 40568

SEQ ID NO: 185344 - RNA, 64 nt, hsa; identical to SEQ ID NO: 40569

SEQ ID NO: 185345 - RNA, 64 nt, hsa; identical to SEQ ID NO: 40570

SEQ ID NO: 185346 - RNA, 64 nt, hsa; identical to SEQ ID NO: 40571

SEQ ID NO: 185347 - RNA, 64 nt, hsa; identical to SEQ ID NO: 40572

SEQ ID NO: 185348 - RNA, 64 nt, hsa; identical to SEQ ID NO: 40573

SEQ ID NO: 185349 - RNA, 64 nt, hsa; identical to SEQ ID NO: 40574

SEQ ID NO: 185350 - RNA, 64 nt, hsa; identical to SEQ ID NO: 40575

SEQ ID NO: 185351 - RNA, 64 nt, hsa; identical to SEQ ID NO: 40576

SEQ ID NO: 185352 - RNA, 64 nt, hsa; identical to SEQ ID NO: 40577

SEQ ID NO: 185353 - RNA, 64 nt, hsa; identical to SEQ ID NO: 40578

SEQ ID NO: 185354 - RNA, 64 nt, hsa; identical to SEQ ID NO: 40579

SEQ ID NO: 185355 - RNA, 64 nt, hsa; identical to SEQ ID NO: 40580

SEQ ID NO: 185356 - RNA, 64 nt, hsa; identical to SEQ ID NO: 40581

SEQ ID NO: 185357 - RNA, 64 nt, hsa; identical to SEQ ID NO: 40582

SEQ ID NO: 185358 - RNA, 64 nt, hsa; identical to SEQ ID NO: 40583

SEQ ID NO: 185359 - RNA, 64 nt, hsa; identical to SEQ ID NO: 40584

SEQ ID NO: 185360 - RNA, 64 nt, hsa; identical to SEQ ID NO: 40585

SEQ ID NO: 185361 - RNA, 64 nt, hsa; identical to SEQ ID NO: 40586

SEQ ID NO: 185362 - RNA, 64 nt, hsa; identical to SEQ ID NO: 40587

SEQ ID NO: 185363 - RNA, 64 nt, hsa; identical to SEQ ID NO: 40588

SEQ ID NO: 185364 - RNA, 64 nt, hsa; identical to SEQ ID NO: 40589

SEQ ID NO: 185365 - RNA, 64 nt, hsa; identical to SEQ ID NO: 40590

SEQ ID NO: 185366 - RNA, 64 nt, hsa; identical to SEQ ID NO: 40591

SEQ ID NO: 185367 - RNA, 64 nt, hsa; identical to SEQ ID NO: 40592

SEQ ID NO: 185368 - RNA, 64 nt, hsa; identical to SEQ ID NO: 40593

SEQ ID NO: 185369 - RNA, 64 nt, hsa; identical to SEQ ID NO: 40594

SEQ ID NO: 185370 - RNA, 64 nt, hsa; identical to SEQ ID NO: 40595

SEQ ID NO: 185371 - RNA, 64 nt, hsa; identical to SEQ ID NO: 40596

SEQ ID NO: 185372 - RNA, 64 nt, hsa; identical to SEQ ID NO: 40597

SEQ ID NO: 185373 - RNA, 64 nt, hsa; identical to SEQ ID NO: 40598

SEQ ID NO: 185374 - RNA, 64 nt, hsa; identical to SEQ ID NO: 40599

SEQ ID NO: 185375 - RNA, 64 nt, hsa; identical to SEQ ID NO: 40600

SEQ ID NO: 185376 - RNA, 64 nt, hsa; identical to SEQ ID NO: 40601

SEQ ID NO: 185377 - RNA, 64 nt, hsa; identical to SEQ ID NO: 40602

SEQ ID NO: 185378 - RNA, 64 nt, hsa; identical to SEQ ID NO: 40603

SEQ ID NO: 185379 - RNA, 64 nt, hsa; identical to SEQ ID NO: 40604

SEQ ID NO: 185380 - RNA, 64 nt, hsa; identical to SEQ ID NO: 40605

SEQ ID NO: 185381 - RNA, 64 nt, hsa; identical to SEQ ID NO: 40606

SEQ ID NO: 185382 - RNA, 64 nt, hsa; identical to SEQ ID NO: 40607

SEQ ID NO: 185383 - RNA, 64 nt, hsa; identical to SEQ ID NO: 40608

SEQ ID NO: 185384 - RNA, 64 nt, hsa; identical to SEQ ID NO: 40609

SEQ ID NO: 185385 - RNA, 64 nt, hsa; identical to SEQ ID NO: 40610

SEQ ID NO: 185386 - RNA, 64 nt, hsa; identical to SEQ ID NO: 40611

SEQ ID NO: 185387 - RNA, 64 nt, hsa; identical to SEQ ID NO: 40612

SEQ ID NO: 185388 - RNA, 64 nt, hsa; identical to SEQ ID NO: 40613

SEQ ID NO: 185389 - RNA, 64 nt, hsa; identical to SEQ ID NO: 40614

SEQ ID NO: 185390 - RNA, 64 nt, hsa; identical to SEQ ID NO: 40615

SEQ ID NO: 185391 - RNA, 64 nt, hsa; identical to SEQ ID NO: 40616

SEQ ID NO: 185392 - RNA, 64 nt, hsa; identical to SEQ ID NO: 40617

SEQ ID NO: 185393 - RNA, 64 nt, hsa; identical to SEQ ID NO: 40618

SEQ ID NO: 185394 - RNA, 64 nt, hsa; identical to SEQ ID NO: 40619

SEQ ID NO: 185395 - RNA, 64 nt, hsa; identical to SEQ ID NO: 40620

SEQ ID NO: 185396 - RNA, 64 nt, hsa; identical to SEQ ID NO: 40621

SEQ ID NO: 185397 - RNA, 64 nt, hsa; identical to SEQ ID NO: 40622

SEQ ID NO: 185398 - RNA, 64 nt, hsa; identical to SEQ ID NO: 40623

SEQ ID NO: 185399 - RNA, 64 nt, hsa; identical to SEQ ID NO: 40624

SEQ ID NO: 185400 - RNA, 64 nt, hsa; identical to SEQ ID NO: 40625

SEQ ID NO: 185401 - RNA, 64 nt, hsa; identical to SEQ ID NO: 40626

SEQ ID NO: 185402 - RNA, 64 nt, hsa; identical to SEQ ID NO: 40627

SEQ ID NO: 185403 - RNA, 64 nt, hsa; identical to SEQ ID NO: 40628

SEQ ID NO: 185404 - RNA, 64 nt, hsa; identical to SEQ ID NO: 40629

SEQ ID NO: 185405 - RNA, 64 nt, hsa; identical to SEQ ID NO: 40630

SEQ ID NO: 185406 - RNA, 64 nt, hsa; identical to SEQ ID NO: 40631

SEQ ID NO: 185407 - RNA, 64 nt, hsa; identical to SEQ ID NO: 40632

SEQ ID NO: 185408 - RNA, 64 nt, hsa; identical to SEQ ID NO: 40633

SEQ ID NO: 185409 - RNA, 64 nt, hsa; identical to SEQ ID NO: 40634

SEQ ID NO: 185410 - RNA, 64 nt, hsa; identical to SEQ ID NO: 40635

SEQ ID NO: 185411 - RNA, 64 nt, hsa; identical to SEQ ID NO: 40636

SEQ ID NO: 185412 - RNA, 64 nt, hsa; identical to SEQ ID NO: 40637

SEQ ID NO: 185413 - RNA, 64 nt, hsa; identical to SEQ ID NO: 40638

SEQ ID NO: 185414 - RNA, 64 nt, hsa; identical to SEQ ID NO: 40639

SEQ ID NO: 185415 - RNA, 64 nt, hsa; identical to SEQ ID NO: 40640

SEQ ID NO: 185416 - RNA, 64 nt, hsa; identical to SEQ ID NO: 40641

SEQ ID NO: 185417 - RNA, 64 nt, hsa; identical to SEQ ID NO: 40642

SEQ ID NO: 185418 - RNA, 64 nt, hsa; identical to SEQ ID NO: 40643

SEQ ID NO: 185419 - RNA, 64 nt, hsa; identical to SEQ ID NO: 40644

SEQ ID NO: 185420 - RNA, 64 nt, hsa; identical to SEQ ID NO: 40645

SEQ ID NO: 185421 - RNA, 64 nt, hsa; identical to SEQ ID NO: 40646

SEQ ID NO: 185422 - RNA, 64 nt, hsa; identical to SEQ ID NO: 40647

SEQ ID NO: 185423 - RNA, 64 nt, hsa; identical to SEQ ID NO: 40648

SEQ ID NO: 185424 - RNA, 64 nt, hsa; identical to SEQ ID NO: 40649

SEQ ID NO: 185425 - RNA, 64 nt, hsa; identical to SEQ ID NO: 40650

SEQ ID NO: 185426 - RNA, 64 nt, hsa; identical to SEQ ID NO: 40651

SEQ ID NO: 185427 - RNA, 64 nt, hsa; identical to SEQ ID NO: 40652

SEQ ID NO: 185428 - RNA, 64 nt, hsa; identical to SEQ ID NO: 40653

SEQ ID NO: 185429 - RNA, 64 nt, hsa; identical to SEQ ID NO: 40654

SEQ ID NO: 185430 - RNA, 64 nt, hsa; identical to SEQ ID NO: 40655

SEQ ID NO: 185431 - RNA, 64 nt, hsa; identical to SEQ ID NO: 40656

SEQ ID NO: 185432 - RNA, 64 nt, hsa; identical to SEQ ID NO: 40657

SEQ ID NO: 185433 - RNA, 64 nt, hsa; identical to SEQ ID NO: 40658

SEQ ID NO: 185434 - RNA, 64 nt, hsa; identical to SEQ ID NO: 40659

SEQ ID NO: 185435 - RNA, 64 nt, hsa; identical to SEQ ID NO: 40660

SEQ ID NO: 185436 - RNA, 64 nt, hsa; identical to SEQ ID NO: 40661

SEQ ID NO: 185437 - RNA, 64 nt, hsa; identical to SEQ ID NO: 40662

SEQ ID NO: 185438 - RNA, 64 nt, hsa; identical to SEQ ID NO: 40663

SEQ ID NO: 185439 - RNA, 64 nt, hsa; identical to SEQ ID NO: 40664

SEQ ID NO: 185440 - RNA, 64 nt, hsa; identical to SEQ ID NO: 40665

SEQ ID NO: 185441 - RNA, 64 nt, hsa; identical to SEQ ID NO: 40666

SEQ ID NO: 185442 - RNA, 64 nt, hsa; identical to SEQ ID NO: 40667

SEQ ID NO: 185443 - RNA, 64 nt, hsa; identical to SEQ ID NO: 40668

SEQ ID NO: 185444 - RNA, 64 nt, hsa; identical to SEQ ID NO: 40669

SEQ ID NO: 185445 - RNA, 64 nt, hsa; identical to SEQ ID NO: 40670

SEQ ID NO: 185446 - RNA, 64 nt, hsa; identical to SEQ ID NO: 40671

SEQ ID NO: 185447 - RNA, 64 nt, hsa; identical to SEQ ID NO: 40672

SEQ ID NO: 185448 - RNA, 64 nt, hsa; identical to SEQ ID NO: 40673

SEQ ID NO: 185449 - RNA, 64 nt, hsa; identical to SEQ ID NO: 40674

SEQ ID NO: 185450 - RNA, 64 nt, hsa; identical to SEQ ID NO: 40675

SEQ ID NO: 185451 - RNA, 64 nt, hsa; identical to SEQ ID NO: 40676

SEQ ID NO: 185452 - RNA, 64 nt, hsa; identical to SEQ ID NO: 40677

SEQ ID NO: 185453 - RNA, 64 nt, hsa; identical to SEQ ID NO: 40678

SEQ ID NO: 185454 - RNA, 64 nt, hsa; identical to SEQ ID NO: 40679

SEQ ID NO: 185455 - RNA, 64 nt, hsa; identical to SEQ ID NO: 40680

SEQ ID NO: 185456 - RNA, 64 nt, hsa; identical to SEQ ID NO: 40681

SEQ ID NO: 185457 - RNA, 64 nt, hsa; identical to SEQ ID NO: 40682

SEQ ID NO: 185458 - RNA, 64 nt, hsa; identical to SEQ ID NO: 40683

SEQ ID NO: 185459 - RNA, 64 nt, hsa; identical to SEQ ID NO: 40684

SEQ ID NO: 185460 - RNA, 64 nt, hsa; identical to SEQ ID NO: 40685

SEQ ID NO: 185461 - RNA, 64 nt, hsa; identical to SEQ ID NO: 40686

SEQ ID NO: 185462 - RNA, 64 nt, hsa; identical to SEQ ID NO: 40687

SEQ ID NO: 185463 - RNA, 64 nt, hsa; identical to SEQ ID NO: 40688

SEQ ID NO: 185464 - RNA, 64 nt, hsa; identical to SEQ ID NO: 40689

SEQ ID NO: 185465 - RNA, 64 nt, hsa; identical to SEQ ID NO: 40690

SEQ ID NO: 185466 - RNA, 64 nt, hsa; identical to SEQ ID NO: 40691

SEQ ID NO: 185467 - RNA, 64 nt, hsa; identical to SEQ ID NO: 40692

SEQ ID NO: 185468 - RNA, 64 nt, hsa; identical to SEQ ID NO: 40693

SEQ ID NO: 185469 - RNA, 64 nt, hsa; identical to SEQ ID NO: 40694

SEQ ID NO: 185470 - RNA, 64 nt, hsa; identical to SEQ ID NO: 40695

SEQ ID NO: 185471 - RNA, 64 nt, hsa; identical to SEQ ID NO: 40696

SEQ ID NO: 185472 - RNA, 64 nt, hsa; identical to SEQ ID NO: 40697

SEQ ID NO: 185473 - RNA, 64 nt, hsa; identical to SEQ ID NO: 40698

SEQ ID NO: 185474 - RNA, 64 nt, hsa; identical to SEQ ID NO: 40699

SEQ ID NO: 185475 - RNA, 64 nt, hsa; identical to SEQ ID NO: 40700

SEQ ID NO: 185476 - RNA, 64 nt, hsa; identical to SEQ ID NO: 40701

SEQ ID NO: 185477 - RNA, 64 nt, hsa; identical to SEQ ID NO: 40702

SEQ ID NO: 185478 - RNA, 64 nt, hsa; identical to SEQ ID NO: 40703

SEQ ID NO: 185479 - RNA, 64 nt, hsa; identical to SEQ ID NO: 40704

SEQ ID NO: 185480 - RNA, 64 nt, hsa; identical to SEQ ID NO: 40705

SEQ ID NO: 185481 - RNA, 64 nt, hsa; identical to SEQ ID NO: 40706

SEQ ID NO: 185482 - RNA, 64 nt, hsa; identical to SEQ ID NO: 40707

SEQ ID NO: 185483 - RNA, 64 nt, hsa; identical to SEQ ID NO: 40708

SEQ ID NO: 185484 - RNA, 64 nt, hsa; identical to SEQ ID NO: 40709

SEQ ID NO: 185485 - RNA, 64 nt, hsa; identical to SEQ ID NO: 40710

SEQ ID NO: 185486 - RNA, 64 nt, hsa; identical to SEQ ID NO: 40711

SEQ ID NO: 185487 - RNA, 64 nt, hsa; identical to SEQ ID NO: 40712

SEQ ID NO: 185488 - RNA, 64 nt, hsa; identical to SEQ ID NO: 40713

SEQ ID NO: 185489 - RNA, 64 nt, hsa; identical to SEQ ID NO: 40714

SEQ ID NO: 185490 - RNA, 64 nt, hsa; identical to SEQ ID NO: 40715

SEQ ID NO: 185491 - RNA, 64 nt, hsa; identical to SEQ ID NO: 40716

SEQ ID NO: 185492 - RNA, 64 nt, hsa; identical to SEQ ID NO: 40717

SEQ ID NO: 185493 - RNA, 64 nt, hsa; identical to SEQ ID NO: 40718

SEQ ID NO: 185494 - RNA, 64 nt, hsa; identical to SEQ ID NO: 40719

SEQ ID NO: 185495 - RNA, 64 nt, hsa; identical to SEQ ID NO: 40720

SEQ ID NO: 185496 - RNA, 64 nt, hsa; identical to SEQ ID NO: 40721

SEQ ID NO: 185497 - RNA, 64 nt, hsa; identical to SEQ ID NO: 40722

SEQ ID NO: 185498 - RNA, 64 nt, hsa; identical to SEQ ID NO: 40723

SEQ ID NO: 185499 - RNA, 64 nt, hsa; identical to SEQ ID NO: 40724

SEQ ID NO: 185500 - RNA, 64 nt, hsa; identical to SEQ ID NO: 40725

SEQ ID NO: 185501 - RNA, 64 nt, hsa; identical to SEQ ID NO: 40726

SEQ ID NO: 185502 - RNA, 64 nt, hsa; identical to SEQ ID NO: 40727

SEQ ID NO: 185503 - RNA, 64 nt, hsa; identical to SEQ ID NO: 40728

SEQ ID NO: 185504 - RNA, 64 nt, hsa; identical to SEQ ID NO: 40729

SEQ ID NO: 185505 - RNA, 64 nt, hsa; identical to SEQ ID NO: 40730

SEQ ID NO: 185506 - RNA, 64 nt, hsa; identical to SEQ ID NO: 40731

SEQ ID NO: 185507 - RNA, 64 nt, hsa; identical to SEQ ID NO: 40732

SEQ ID NO: 185508 - RNA, 64 nt, hsa; identical to SEQ ID NO: 40733

SEQ ID NO: 185509 - RNA, 64 nt, hsa; identical to SEQ ID NO: 40734

SEQ ID NO: 185510 - RNA, 64 nt, hsa; identical to SEQ ID NO: 40735

SEQ ID NO: 185511 - RNA, 64 nt, hsa; identical to SEQ ID NO: 40736

SEQ ID NO: 185512 - RNA, 64 nt, hsa; identical to SEQ ID NO: 40737

SEQ ID NO: 185513 - RNA, 64 nt, hsa; identical to SEQ ID NO: 40738

SEQ ID NO: 185514 - RNA, 64 nt, hsa; identical to SEQ ID NO: 40739

SEQ ID NO: 185515 - RNA, 64 nt, hsa; identical to SEQ ID NO: 40740

SEQ ID NO: 185516 - RNA, 64 nt, hsa; identical to SEQ ID NO: 40741

SEQ ID NO: 185517 - RNA, 64 nt, hsa; identical to SEQ ID NO: 40742

SEQ ID NO: 185518 - RNA, 64 nt, hsa; identical to SEQ ID NO: 40743

SEQ ID NO: 185519 - RNA, 64 nt, hsa; identical to SEQ ID NO: 40744

SEQ ID NO: 185520 - RNA, 64 nt, hsa; identical to SEQ ID NO: 40745

SEQ ID NO: 185521 - RNA, 64 nt, hsa; identical to SEQ ID NO: 40746

SEQ ID NO: 185522 - RNA, 64 nt, hsa; identical to SEQ ID NO: 40747

SEQ ID NO: 185523 - RNA, 64 nt, hsa; identical to SEQ ID NO: 40748

SEQ ID NO: 185524 - RNA, 64 nt, hsa; identical to SEQ ID NO: 40749

SEQ ID NO: 185525 - RNA, 64 nt, hsa; identical to SEQ ID NO: 40750

SEQ ID NO: 185526 - RNA, 64 nt, hsa; identical to SEQ ID NO: 40751

SEQ ID NO: 185527 - RNA, 64 nt, hsa; identical to SEQ ID NO: 40752

SEQ ID NO: 185528 - RNA, 64 nt, hsa; identical to SEQ ID NO: 40753

SEQ ID NO: 185529 - RNA, 64 nt, hsa; identical to SEQ ID NO: 40754

SEQ ID NO: 185530 - RNA, 64 nt, hsa; identical to SEQ ID NO: 40755

SEQ ID NO: 185531 - RNA, 64 nt, hsa; identical to SEQ ID NO: 40756

SEQ ID NO: 185532 - RNA, 64 nt, hsa; identical to SEQ ID NO: 40757

SEQ ID NO: 185533 - RNA, 64 nt, hsa; identical to SEQ ID NO: 40758

SEQ ID NO: 185534 - RNA, 64 nt, hsa; identical to SEQ ID NO: 40759

SEQ ID NO: 185535 - RNA, 64 nt, hsa; identical to SEQ ID NO: 40760

SEQ ID NO: 185536 - RNA, 64 nt, hsa; identical to SEQ ID NO: 40761

SEQ ID NO: 185537 - RNA, 64 nt, hsa; identical to SEQ ID NO: 40762

SEQ ID NO: 185538 - RNA, 64 nt, hsa; identical to SEQ ID NO: 40763

SEQ ID NO: 185539 - RNA, 64 nt, hsa; identical to SEQ ID NO: 40764

SEQ ID NO: 185540 - RNA, 64 nt, hsa; identical to SEQ ID NO: 40765

SEQ ID NO: 185541 - RNA, 64 nt, hsa; identical to SEQ ID NO: 40766

SEQ ID NO: 185542 - RNA, 64 nt, hsa; identical to SEQ ID NO: 40767

SEQ ID NO: 185543 - RNA, 64 nt, hsa; identical to SEQ ID NO: 40768

SEQ ID NO: 185544 - RNA, 64 nt, hsa; identical to SEQ ID NO: 40769

SEQ ID NO: 185545 - RNA, 64 nt, hsa; identical to SEQ ID NO: 40770

SEQ ID NO: 185546 - RNA, 64 nt, hsa; identical to SEQ ID NO: 40771

SEQ ID NO: 185547 - RNA, 64 nt, hsa; identical to SEQ ID NO: 40772

SEQ ID NO: 185548 - RNA, 64 nt, hsa; identical to SEQ ID NO: 40773

SEQ ID NO: 185549 - RNA, 64 nt, hsa; identical to SEQ ID NO: 40774

SEQ ID NO: 185550 - RNA, 64 nt, hsa; identical to SEQ ID NO: 40775

SEQ ID NO: 185551 - RNA, 64 nt, hsa; identical to SEQ ID NO: 40776

SEQ ID NO: 185552 - RNA, 64 nt, hsa; identical to SEQ ID NO: 40777

SEQ ID NO: 185553 - RNA, 64 nt, hsa; identical to SEQ ID NO: 40778

SEQ ID NO: 185554 - RNA, 64 nt, hsa; identical to SEQ ID NO: 40779

SEQ ID NO: 185555 - RNA, 64 nt, hsa; identical to SEQ ID NO: 40780

SEQ ID NO: 185556 - RNA, 64 nt, hsa; identical to SEQ ID NO: 40781

SEQ ID NO: 185557 - RNA, 64 nt, hsa; identical to SEQ ID NO: 40782

SEQ ID NO: 185558 - RNA, 64 nt, hsa; identical to SEQ ID NO: 40783

SEQ ID NO: 185559 - RNA, 64 nt, hsa; identical to SEQ ID NO: 40784

SEQ ID NO: 185560 - RNA, 64 nt, hsa; identical to SEQ ID NO: 40785

SEQ ID NO: 185561 - RNA, 64 nt, hsa; identical to SEQ ID NO: 40786

SEQ ID NO: 185562 - RNA, 64 nt, hsa; identical to SEQ ID NO: 40787

SEQ ID NO: 185563 - RNA, 64 nt, hsa; identical to SEQ ID NO: 40788

SEQ ID NO: 185564 - RNA, 64 nt, hsa; identical to SEQ ID NO: 40789

SEQ ID NO: 185565 - RNA, 64 nt, hsa; identical to SEQ ID NO: 40790

SEQ ID NO: 185566 - RNA, 64 nt, hsa; identical to SEQ ID NO: 40791

SEQ ID NO: 185567 - RNA, 64 nt, hsa; identical to SEQ ID NO: 40792

SEQ ID NO: 185568 - RNA, 64 nt, hsa; identical to SEQ ID NO: 40793

SEQ ID NO: 185569 - RNA, 64 nt, hsa; identical to SEQ ID NO: 40794

SEQ ID NO: 185570 - RNA, 64 nt, hsa; identical to SEQ ID NO: 40795

SEQ ID NO: 185571 - RNA, 64 nt, hsa; identical to SEQ ID NO: 40796

SEQ ID NO: 185572 - RNA, 64 nt, hsa; identical to SEQ ID NO: 40797

SEQ ID NO: 185573 - RNA, 64 nt, hsa; identical to SEQ ID NO: 40798

SEQ ID NO: 185574 - RNA, 64 nt, hsa; identical to SEQ ID NO: 40799

SEQ ID NO: 185575 - RNA, 64 nt, hsa; identical to SEQ ID NO: 40800

SEQ ID NO: 185576 - RNA, 64 nt, hsa; identical to SEQ ID NO: 40801

SEQ ID NO: 185577 - RNA, 64 nt, hsa; identical to SEQ ID NO: 40802

SEQ ID NO: 185578 - RNA, 64 nt, hsa; identical to SEQ ID NO: 40803

SEQ ID NO: 185579 - RNA, 64 nt, hsa; identical to SEQ ID NO: 40804

SEQ ID NO: 185580 - RNA, 64 nt, hsa; identical to SEQ ID NO: 40805

SEQ ID NO: 185581 - RNA, 64 nt, hsa; identical to SEQ ID NO: 40806

SEQ ID NO: 185582 - RNA, 64 nt, hsa; identical to SEQ ID NO: 40807

SEQ ID NO: 185583 - RNA, 64 nt, hsa; identical to SEQ ID NO: 40808

SEQ ID NO: 185584 - RNA, 64 nt, hsa; identical to SEQ ID NO: 40809

SEQ ID NO: 185585 - RNA, 64 nt, hsa; identical to SEQ ID NO: 40810

SEQ ID NO: 185586 - RNA, 64 nt, hsa; identical to SEQ ID NO: 40811

SEQ ID NO: 185587 - RNA, 64 nt, hsa; identical to SEQ ID NO: 40812

SEQ ID NO: 185588 - RNA, 64 nt, hsa; identical to SEQ ID NO: 40813

SEQ ID NO: 185589 - RNA, 64 nt, hsa; identical to SEQ ID NO: 40814

SEQ ID NO: 185590 - RNA, 64 nt, hsa; identical to SEQ ID NO: 40815

SEQ ID NO: 185591 - RNA, 64 nt, hsa; identical to SEQ ID NO: 40816

SEQ ID NO: 185592 - RNA, 64 nt, hsa; identical to SEQ ID NO: 40817

SEQ ID NO: 185593 - RNA, 64 nt, hsa; identical to SEQ ID NO: 40818

SEQ ID NO: 185594 - RNA, 64 nt, hsa; identical to SEQ ID NO: 40819

SEQ ID NO: 185595 - RNA, 64 nt, hsa; identical to SEQ ID NO: 40820

SEQ ID NO: 185596 - RNA, 64 nt, hsa; identical to SEQ ID NO: 40821

SEQ ID NO: 185597 - RNA, 64 nt, hsa; identical to SEQ ID NO: 40822

SEQ ID NO: 185598 - RNA, 64 nt, hsa; identical to SEQ ID NO: 40823

SEQ ID NO: 185599 - RNA, 64 nt, hsa; identical to SEQ ID NO: 40824

SEQ ID NO: 185600 - RNA, 64 nt, hsa; identical to SEQ ID NO: 40825

SEQ ID NO: 185601 - RNA, 64 nt, hsa; identical to SEQ ID NO: 40826

SEQ ID NO: 185602 - RNA, 64 nt, hsa; identical to SEQ ID NO: 40827

SEQ ID NO: 185603 - RNA, 64 nt, hsa; identical to SEQ ID NO: 40828

SEQ ID NO: 185604 - RNA, 64 nt, hsa; identical to SEQ ID NO: 40829

SEQ ID NO: 185605 - RNA, 64 nt, hsa; identical to SEQ ID NO: 40830

SEQ ID NO: 185606 - RNA, 64 nt, hsa; identical to SEQ ID NO: 40831

SEQ ID NO: 185607 - RNA, 64 nt, hsa; identical to SEQ ID NO: 40832

SEQ ID NO: 185608 - RNA, 64 nt, hsa; identical to SEQ ID NO: 40833

SEQ ID NO: 185609 - RNA, 64 nt, hsa; identical to SEQ ID NO: 40834

SEQ ID NO: 185610 - RNA, 64 nt, hsa; identical to SEQ ID NO: 40835

SEQ ID NO: 185611 - RNA, 64 nt, hsa; identical to SEQ ID NO: 40836

SEQ ID NO: 185612 - RNA, 64 nt, hsa; identical to SEQ ID NO: 40837

SEQ ID NO: 185613 - RNA, 64 nt, hsa; identical to SEQ ID NO: 40838

SEQ ID NO: 185614 - RNA, 64 nt, hsa; identical to SEQ ID NO: 40839

SEQ ID NO: 185615 - RNA, 64 nt, hsa; identical to SEQ ID NO: 40840

SEQ ID NO: 185616 - RNA, 64 nt, hsa; identical to SEQ ID NO: 40841

SEQ ID NO: 185617 - RNA, 64 nt, hsa; identical to SEQ ID NO: 40842

SEQ ID NO: 185618 - RNA, 64 nt, hsa; identical to SEQ ID NO: 40843

SEQ ID NO: 185619 - RNA, 64 nt, hsa; identical to SEQ ID NO: 40844

SEQ ID NO: 185620 - RNA, 64 nt, hsa; identical to SEQ ID NO: 40845

SEQ ID NO: 185621 - RNA, 64 nt, hsa; identical to SEQ ID NO: 40846

SEQ ID NO: 185622 - RNA, 64 nt, hsa; identical to SEQ ID NO: 40847

SEQ ID NO: 185623 - RNA, 64 nt, hsa; identical to SEQ ID NO: 40848

SEQ ID NO: 185624 - RNA, 64 nt, hsa; identical to SEQ ID NO: 40849

SEQ ID NO: 185625 - RNA, 64 nt, hsa; identical to SEQ ID NO: 40850

SEQ ID NO: 185626 - RNA, 64 nt, hsa; identical to SEQ ID NO: 40851

SEQ ID NO: 185627 - RNA, 64 nt, hsa; identical to SEQ ID NO: 40852

SEQ ID NO: 185628 - RNA, 64 nt, hsa; identical to SEQ ID NO: 40853

SEQ ID NO: 185629 - RNA, 64 nt, hsa; identical to SEQ ID NO: 40854

SEQ ID NO: 185630 - RNA, 64 nt, hsa; identical to SEQ ID NO: 40855

SEQ ID NO: 185631 - RNA, 64 nt, hsa; identical to SEQ ID NO: 40856

SEQ ID NO: 185632 - RNA, 64 nt, hsa; identical to SEQ ID NO: 40857

SEQ ID NO: 185633 - RNA, 64 nt, hsa; identical to SEQ ID NO: 40858

SEQ ID NO: 185634 - RNA, 64 nt, hsa; identical to SEQ ID NO: 40859

SEQ ID NO: 185635 - RNA, 64 nt, hsa; identical to SEQ ID NO: 40860

SEQ ID NO: 185636 - RNA, 64 nt, hsa; identical to SEQ ID NO: 40861

SEQ ID NO: 185637 - RNA, 64 nt, hsa; identical to SEQ ID NO: 40862

SEQ ID NO: 185638 - RNA, 64 nt, hsa; identical to SEQ ID NO: 40863

SEQ ID NO: 185639 - RNA, 64 nt, hsa; identical to SEQ ID NO: 40864

SEQ ID NO: 185640 - RNA, 64 nt, hsa; identical to SEQ ID NO: 40865

SEQ ID NO: 185641 - RNA, 64 nt, hsa; identical to SEQ ID NO: 40866

SEQ ID NO: 185642 - RNA, 64 nt, hsa; identical to SEQ ID NO: 40867

SEQ ID NO: 185643 - RNA, 64 nt, hsa; identical to SEQ ID NO: 40868

SEQ ID NO: 185644 - RNA, 64 nt, hsa; identical to SEQ ID NO: 40869

SEQ ID NO: 185645 - RNA, 64 nt, hsa; identical to SEQ ID NO: 40870

SEQ ID NO: 185646 - RNA, 64 nt, hsa; identical to SEQ ID NO: 40871

SEQ ID NO: 185647 - RNA, 64 nt, hsa; identical to SEQ ID NO: 40872

SEQ ID NO: 185648 - RNA, 64 nt, hsa; identical to SEQ ID NO: 40873

SEQ ID NO: 185649 - RNA, 64 nt, hsa; identical to SEQ ID NO: 40874

SEQ ID NO: 185650 - RNA, 64 nt, hsa; identical to SEQ ID NO: 40875

SEQ ID NO: 185651 - RNA, 64 nt, hsa; identical to SEQ ID NO: 40876

SEQ ID NO: 185652 - RNA, 64 nt, hsa; identical to SEQ ID NO: 40877

SEQ ID NO: 185653 - RNA, 64 nt, hsa; identical to SEQ ID NO: 40878

SEQ ID NO: 185654 - RNA, 64 nt, hsa; identical to SEQ ID NO: 40879

SEQ ID NO: 185655 - RNA, 64 nt, hsa; identical to SEQ ID NO: 40880

SEQ ID NO: 185656 - RNA, 64 nt, hsa; identical to SEQ ID NO: 40881

SEQ ID NO: 185657 - RNA, 64 nt, hsa; identical to SEQ ID NO: 40882

SEQ ID NO: 185658 - RNA, 64 nt, hsa; identical to SEQ ID NO: 40883

SEQ ID NO: 185659 - RNA, 64 nt, hsa; identical to SEQ ID NO: 40884

SEQ ID NO: 185660 - RNA, 64 nt, hsa; identical to SEQ ID NO: 40885

SEQ ID NO: 185661 - RNA, 64 nt, hsa; identical to SEQ ID NO: 40886

SEQ ID NO: 185662 - RNA, 64 nt, hsa; identical to SEQ ID NO: 40887

SEQ ID NO: 185663 - RNA, 64 nt, hsa; identical to SEQ ID NO: 40888

SEQ ID NO: 185664 - RNA, 64 nt, hsa; identical to SEQ ID NO: 40889

SEQ ID NO: 185665 - RNA, 64 nt, hsa; identical to SEQ ID NO: 40890

SEQ ID NO: 185666 - RNA, 64 nt, hsa; identical to SEQ ID NO: 40891

SEQ ID NO: 185667 - RNA, 64 nt, hsa; identical to SEQ ID NO: 40892

SEQ ID NO: 185668 - RNA, 64 nt, hsa; identical to SEQ ID NO: 40893

SEQ ID NO: 185669 - RNA, 64 nt, hsa; identical to SEQ ID NO: 40894

SEQ ID NO: 185670 - RNA, 64 nt, hsa; identical to SEQ ID NO: 40895

SEQ ID NO: 185671 - RNA, 64 nt, hsa; identical to SEQ ID NO: 40896

SEQ ID NO: 185672 - RNA, 64 nt, hsa; identical to SEQ ID NO: 40897

SEQ ID NO: 185673 - RNA, 64 nt, hsa; identical to SEQ ID NO: 40898

SEQ ID NO: 185674 - RNA, 64 nt, hsa; identical to SEQ ID NO: 40899

SEQ ID NO: 185675 - RNA, 64 nt, hsa; identical to SEQ ID NO: 40900

SEQ ID NO: 185676 - RNA, 64 nt, hsa; identical to SEQ ID NO: 40901

SEQ ID NO: 185677 - RNA, 64 nt, hsa; identical to SEQ ID NO: 40902

SEQ ID NO: 185678 - RNA, 64 nt, hsa; identical to SEQ ID NO: 40903

SEQ ID NO: 185679 - RNA, 64 nt, hsa; identical to SEQ ID NO: 40904

SEQ ID NO: 185680 - RNA, 64 nt, hsa; identical to SEQ ID NO: 40905

SEQ ID NO: 185681 - RNA, 64 nt, hsa; identical to SEQ ID NO: 40906

SEQ ID NO: 185682 - RNA, 64 nt, hsa; identical to SEQ ID NO: 40907

SEQ ID NO: 185683 - RNA, 64 nt, hsa; identical to SEQ ID NO: 40908

SEQ ID NO: 185684 - RNA, 64 nt, hsa; identical to SEQ ID NO: 40909

SEQ ID NO: 185685 - RNA, 64 nt, hsa; identical to SEQ ID NO: 40910

SEQ ID NO: 185686 - RNA, 64 nt, hsa; identical to SEQ ID NO: 40911

SEQ ID NO: 185687 - RNA, 64 nt, hsa; identical to SEQ ID NO: 40912

SEQ ID NO: 185688 - RNA, 64 nt, hsa; identical to SEQ ID NO: 40913

SEQ ID NO: 185689 - RNA, 64 nt, hsa; identical to SEQ ID NO: 40914

SEQ ID NO: 185690 - RNA, 64 nt, hsa; identical to SEQ ID NO: 40915

SEQ ID NO: 185691 - RNA, 64 nt, hsa; identical to SEQ ID NO: 40916

SEQ ID NO: 185692 - RNA, 64 nt, hsa; identical to SEQ ID NO: 40917

SEQ ID NO: 185693 - RNA, 64 nt, hsa; identical to SEQ ID NO: 40918

SEQ ID NO: 185694 - RNA, 64 nt, hsa; identical to SEQ ID NO: 40919

SEQ ID NO: 185695 - RNA, 64 nt, hsa; identical to SEQ ID NO: 40920

SEQ ID NO: 185696 - RNA, 64 nt, hsa; identical to SEQ ID NO: 40921

SEQ ID NO: 185697 - RNA, 64 nt, hsa; identical to SEQ ID NO: 40922

SEQ ID NO: 185698 - RNA, 64 nt, hsa; identical to SEQ ID NO: 40923

SEQ ID NO: 185699 - RNA, 64 nt, hsa; identical to SEQ ID NO: 40924

SEQ ID NO: 185700 - RNA, 64 nt, hsa; identical to SEQ ID NO: 40925

SEQ ID NO: 185701 - RNA, 64 nt, hsa; identical to SEQ ID NO: 40926

SEQ ID NO: 185702 - RNA, 64 nt, hsa; identical to SEQ ID NO: 40927

SEQ ID NO: 185703 - RNA, 64 nt, hsa; identical to SEQ ID NO: 40928

SEQ ID NO: 185704 - RNA, 64 nt, hsa; identical to SEQ ID NO: 40929

SEQ ID NO: 185705 - RNA, 64 nt, hsa; identical to SEQ ID NO: 40930

SEQ ID NO: 185706 - RNA, 64 nt, hsa; identical to SEQ ID NO: 40931

SEQ ID NO: 185707 - RNA, 64 nt, hsa; identical to SEQ ID NO: 40932

SEQ ID NO: 185708 - RNA, 64 nt, hsa; identical to SEQ ID NO: 40933

SEQ ID NO: 185709 - RNA, 64 nt, hsa; identical to SEQ ID NO: 40934

SEQ ID NO: 185710 - RNA, 64 nt, hsa; identical to SEQ ID NO: 40935

SEQ ID NO: 185711 - RNA, 64 nt, hsa; identical to SEQ ID NO: 40936

SEQ ID NO: 185712 - RNA, 64 nt, hsa; identical to SEQ ID NO: 40937

SEQ ID NO: 185713 - RNA, 64 nt, hsa; identical to SEQ ID NO: 40938

SEQ ID NO: 185714 - RNA, 64 nt, hsa; identical to SEQ ID NO: 40939

SEQ ID NO: 185715 - RNA, 64 nt, hsa; identical to SEQ ID NO: 40940

SEQ ID NO: 185716 - RNA, 64 nt, hsa; identical to SEQ ID NO: 40941

SEQ ID NO: 185717 - RNA, 64 nt, hsa; identical to SEQ ID NO: 40942

SEQ ID NO: 185718 - RNA, 64 nt, hsa; identical to SEQ ID NO: 40943

SEQ ID NO: 185719 - RNA, 64 nt, hsa; identical to SEQ ID NO: 40944

SEQ ID NO: 185720 - RNA, 64 nt, hsa; identical to SEQ ID NO: 40945

SEQ ID NO: 185721 - RNA, 64 nt, hsa; identical to SEQ ID NO: 40946

SEQ ID NO: 185722 - RNA, 64 nt, hsa; identical to SEQ ID NO: 40947

SEQ ID NO: 185723 - RNA, 64 nt, hsa; identical to SEQ ID NO: 40948

SEQ ID NO: 185724 - RNA, 64 nt, hsa; identical to SEQ ID NO: 40949

SEQ ID NO: 185725 - RNA, 64 nt, hsa; identical to SEQ ID NO: 40950

SEQ ID NO: 185726 - RNA, 64 nt, hsa; identical to SEQ ID NO: 40951

SEQ ID NO: 185727 - RNA, 64 nt, hsa; identical to SEQ ID NO: 40952

SEQ ID NO: 185728 - RNA, 64 nt, hsa; identical to SEQ ID NO: 40953

SEQ ID NO: 185729 - RNA, 64 nt, hsa; identical to SEQ ID NO: 40954

SEQ ID NO: 185730 - RNA, 64 nt, hsa; identical to SEQ ID NO: 40955

SEQ ID NO: 185731 - RNA, 64 nt, hsa; identical to SEQ ID NO: 40956

SEQ ID NO: 185732 - RNA, 64 nt, hsa; identical to SEQ ID NO: 40957

SEQ ID NO: 185733 - RNA, 64 nt, hsa; identical to SEQ ID NO: 40958

SEQ ID NO: 185734 - RNA, 64 nt, hsa; identical to SEQ ID NO: 40959

SEQ ID NO: 185735 - RNA, 64 nt, hsa; identical to SEQ ID NO: 40960

SEQ ID NO: 185736 - RNA, 64 nt, hsa; identical to SEQ ID NO: 40961

SEQ ID NO: 185737 - RNA, 64 nt, hsa; identical to SEQ ID NO: 40962

SEQ ID NO: 185738 - RNA, 64 nt, hsa; identical to SEQ ID NO: 40963

SEQ ID NO: 185739 - RNA, 64 nt, hsa; identical to SEQ ID NO: 40964

SEQ ID NO: 185740 - RNA, 64 nt, hsa; identical to SEQ ID NO: 40965

SEQ ID NO: 185741 - RNA, 64 nt, hsa; identical to SEQ ID NO: 40966

SEQ ID NO: 185742 - RNA, 64 nt, hsa; identical to SEQ ID NO: 40967

SEQ ID NO: 185743 - RNA, 64 nt, hsa; identical to SEQ ID NO: 40968

SEQ ID NO: 185744 - RNA, 64 nt, hsa; identical to SEQ ID NO: 40969

SEQ ID NO: 185745 - RNA, 64 nt, hsa; identical to SEQ ID NO: 40970

SEQ ID NO: 185746 - RNA, 64 nt, hsa; identical to SEQ ID NO: 40971

SEQ ID NO: 185747 - RNA, 64 nt, hsa; identical to SEQ ID NO: 40972

SEQ ID NO: 185748 - RNA, 64 nt, hsa; identical to SEQ ID NO: 40973

SEQ ID NO: 185749 - RNA, 64 nt, hsa; identical to SEQ ID NO: 40974

SEQ ID NO: 185750 - RNA, 64 nt, hsa; identical to SEQ ID NO: 40975

SEQ ID NO: 185751 - RNA, 64 nt, hsa; identical to SEQ ID NO: 40976

SEQ ID NO: 185752 - RNA, 64 nt, hsa; identical to SEQ ID NO: 40977

SEQ ID NO: 185753 - RNA, 64 nt, hsa; identical to SEQ ID NO: 40978

SEQ ID NO: 185754 - RNA, 64 nt, hsa; identical to SEQ ID NO: 40979

SEQ ID NO: 185755 - RNA, 64 nt, hsa; identical to SEQ ID NO: 40980

SEQ ID NO: 185756 - RNA, 64 nt, hsa; identical to SEQ ID NO: 40981

SEQ ID NO: 185757 - RNA, 64 nt, hsa; identical to SEQ ID NO: 40982

SEQ ID NO: 185758 - RNA, 64 nt, hsa; identical to SEQ ID NO: 40983

SEQ ID NO: 185759 - RNA, 64 nt, hsa; identical to SEQ ID NO: 40984

SEQ ID NO: 185760 - RNA, 64 nt, hsa; identical to SEQ ID NO: 40985

SEQ ID NO: 185761 - RNA, 64 nt, hsa; identical to SEQ ID NO: 40986

SEQ ID NO: 185762 - RNA, 64 nt, hsa; identical to SEQ ID NO: 40987

SEQ ID NO: 185763 - RNA, 64 nt, hsa; identical to SEQ ID NO: 40988

SEQ ID NO: 185764 - RNA, 64 nt, hsa; identical to SEQ ID NO: 40989

SEQ ID NO: 185765 - RNA, 64 nt, hsa; identical to SEQ ID NO: 40990

SEQ ID NO: 185766 - RNA, 64 nt, hsa; identical to SEQ ID NO: 40991

SEQ ID NO: 185767 - RNA, 64 nt, hsa; identical to SEQ ID NO: 40992

SEQ ID NO: 185768 - RNA, 64 nt, hsa; identical to SEQ ID NO: 40993

SEQ ID NO: 185769 - RNA, 64 nt, hsa; identical to SEQ ID NO: 40994

SEQ ID NO: 185770 - RNA, 64 nt, hsa; identical to SEQ ID NO: 40995

SEQ ID NO: 185771 - RNA, 64 nt, hsa; identical to SEQ ID NO: 40996

SEQ ID NO: 185772 - RNA, 64 nt, hsa; identical to SEQ ID NO: 40997

SEQ ID NO: 185773 - RNA, 64 nt, hsa; identical to SEQ ID NO: 40998

SEQ ID NO: 185774 - RNA, 64 nt, hsa; identical to SEQ ID NO: 40999

SEQ ID NO: 185775 - RNA, 64 nt, hsa; identical to SEQ ID NO: 41000

SEQ ID NO: 185776 - RNA, 64 nt, hsa; identical to SEQ ID NO: 41001

SEQ ID NO: 185777 - RNA, 64 nt, hsa; identical to SEQ ID NO: 41002

SEQ ID NO: 185778 - RNA, 64 nt, hsa; identical to SEQ ID NO: 41003

SEQ ID NO: 185779 - RNA, 64 nt, hsa; identical to SEQ ID NO: 41004

SEQ ID NO: 185780 - RNA, 64 nt, hsa; identical to SEQ ID NO: 41005

SEQ ID NO: 185781 - RNA, 64 nt, hsa; identical to SEQ ID NO: 41006

SEQ ID NO: 185782 - RNA, 63 nt, hsa; identical to SEQ ID NO: 41007

SEQ ID NO: 185783 - RNA, 64 nt, hsa; identical to SEQ ID NO: 41008

SEQ ID NO: 185784 - RNA, 64 nt, hsa; identical to SEQ ID NO: 41009

SEQ ID NO: 185785 - RNA, 64 nt, hsa; identical to SEQ ID NO: 41010

SEQ ID NO: 185786 - RNA, 64 nt, hsa; identical to SEQ ID NO: 41011

SEQ ID NO: 185787 - RNA, 64 nt, hsa; identical to SEQ ID NO: 41012

SEQ ID NO: 185788 - RNA, 64 nt, hsa; identical to SEQ ID NO: 41013

SEQ ID NO: 185789 - RNA, 64 nt, hsa; identical to SEQ ID NO: 41014

SEQ ID NO: 185790 - RNA, 64 nt, hsa; identical to SEQ ID NO: 41015

SEQ ID NO: 185791 - RNA, 64 nt, hsa; identical to SEQ ID NO: 41016

SEQ ID NO: 185792 - RNA, 64 nt, hsa; identical to SEQ ID NO: 41017

SEQ ID NO: 185793 - RNA, 64 nt, hsa; identical to SEQ ID NO: 41018

SEQ ID NO: 185794 - RNA, 64 nt, hsa; identical to SEQ ID NO: 41019

SEQ ID NO: 185795 - RNA, 64 nt, hsa; identical to SEQ ID NO: 41020

SEQ ID NO: 185796 - RNA, 64 nt, hsa; identical to SEQ ID NO: 41021

SEQ ID NO: 185797 - RNA, 64 nt, hsa; identical to SEQ ID NO: 41022

SEQ ID NO: 185798 - RNA, 64 nt, hsa; identical to SEQ ID NO: 41023

SEQ ID NO: 185799 - RNA, 64 nt, hsa; identical to SEQ ID NO: 41024

SEQ ID NO: 185800 - RNA, 64 nt, hsa; identical to SEQ ID NO: 41025

SEQ ID NO: 185801 - RNA, 64 nt, hsa; identical to SEQ ID NO: 41026

SEQ ID NO: 185802 - RNA, 64 nt, hsa; identical to SEQ ID NO: 41027

SEQ ID NO: 185803 - RNA, 64 nt, hsa; identical to SEQ ID NO: 41028

SEQ ID NO: 185804 - RNA, 64 nt, hsa; identical to SEQ ID NO: 41029

SEQ ID NO: 185805 - RNA, 64 nt, hsa; identical to SEQ ID NO: 41030

SEQ ID NO: 185806 - RNA, 64 nt, hsa; identical to SEQ ID NO: 41031

SEQ ID NO: 185807 - RNA, 64 nt, hsa; identical to SEQ ID NO: 41032

SEQ ID NO: 185808 - RNA, 64 nt, hsa; identical to SEQ ID NO: 41033

SEQ ID NO: 185809 - RNA, 64 nt, hsa; identical to SEQ ID NO: 41034

SEQ ID NO: 185810 - RNA, 64 nt, hsa; identical to SEQ ID NO: 41035

SEQ ID NO: 185811 - RNA, 64 nt, hsa; identical to SEQ ID NO: 41036

SEQ ID NO: 185812 - RNA, 64 nt, hsa; identical to SEQ ID NO: 41037

SEQ ID NO: 185813 - RNA, 64 nt, hsa; identical to SEQ ID NO: 41038

SEQ ID NO: 185814 - RNA, 64 nt, hsa; identical to SEQ ID NO: 41039

SEQ ID NO: 185815 - RNA, 64 nt, hsa; identical to SEQ ID NO: 41040

SEQ ID NO: 185816 - RNA, 64 nt, hsa; identical to SEQ ID NO: 41041

SEQ ID NO: 185817 - RNA, 64 nt, hsa; identical to SEQ ID NO: 41042

SEQ ID NO: 185818 - RNA, 64 nt, hsa; identical to SEQ ID NO: 41043

SEQ ID NO: 185819 - RNA, 64 nt, hsa; identical to SEQ ID NO: 41044

SEQ ID NO: 185820 - RNA, 64 nt, hsa; identical to SEQ ID NO: 41045

SEQ ID NO: 185821 - RNA, 64 nt, hsa; identical to SEQ ID NO: 41046

SEQ ID NO: 185822 - RNA, 64 nt, hsa; identical to SEQ ID NO: 41047

SEQ ID NO: 185823 - RNA, 64 nt, hsa; identical to SEQ ID NO: 41048

SEQ ID NO: 185824 - RNA, 64 nt, hsa; identical to SEQ ID NO: 41049

SEQ ID NO: 185825 - RNA, 64 nt, hsa; identical to SEQ ID NO: 41050

SEQ ID NO: 185826 - RNA, 64 nt, hsa; identical to SEQ ID NO: 41051

SEQ ID NO: 185827 - RNA, 64 nt, hsa; identical to SEQ ID NO: 41052

SEQ ID NO: 185828 - RNA, 64 nt, hsa; identical to SEQ ID NO: 41053

SEQ ID NO: 185829 - RNA, 64 nt, hsa; identical to SEQ ID NO: 41054

SEQ ID NO: 185830 - RNA, 64 nt, hsa; identical to SEQ ID NO: 41055

SEQ ID NO: 185831 - RNA, 64 nt, hsa; identical to SEQ ID NO: 41056

SEQ ID NO: 185832 - RNA, 64 nt, hsa; identical to SEQ ID NO: 41057

SEQ ID NO: 185833 - RNA, 64 nt, hsa; identical to SEQ ID NO: 41058

SEQ ID NO: 185834 - RNA, 64 nt, hsa; identical to SEQ ID NO: 41059

SEQ ID NO: 185835 - RNA, 64 nt, hsa; identical to SEQ ID NO: 41060

SEQ ID NO: 185836 - RNA, 64 nt, hsa; identical to SEQ ID NO: 41061

SEQ ID NO: 185837 - RNA, 64 nt, hsa; identical to SEQ ID NO: 41062

SEQ ID NO: 185838 - RNA, 64 nt, hsa; identical to SEQ ID NO: 41063

SEQ ID NO: 185839 - RNA, 64 nt, hsa; identical to SEQ ID NO: 41064

SEQ ID NO: 185840 - RNA, 64 nt, hsa; identical to SEQ ID NO: 41065

SEQ ID NO: 185841 - RNA, 64 nt, hsa; identical to SEQ ID NO: 41066

SEQ ID NO: 185842 - RNA, 64 nt, hsa; identical to SEQ ID NO: 41067

SEQ ID NO: 185843 - RNA, 64 nt, hsa; identical to SEQ ID NO: 41068

SEQ ID NO: 185844 - RNA, 64 nt, hsa; identical to SEQ ID NO: 41069

SEQ ID NO: 185845 - RNA, 64 nt, hsa; identical to SEQ ID NO: 41070

SEQ ID NO: 185846 - RNA, 64 nt, hsa; identical to SEQ ID NO: 41071

SEQ ID NO: 185847 - RNA, 64 nt, hsa; identical to SEQ ID NO: 41072

SEQ ID NO: 185848 - RNA, 64 nt, hsa; identical to SEQ ID NO: 41073

SEQ ID NO: 185849 - RNA, 64 nt, hsa; identical to SEQ ID NO: 41074

SEQ ID NO: 185850 - RNA, 64 nt, hsa; identical to SEQ ID NO: 41075

SEQ ID NO: 185851 - RNA, 64 nt, hsa; identical to SEQ ID NO: 41076

SEQ ID NO: 185852 - RNA, 64 nt, hsa; identical to SEQ ID NO: 41077

SEQ ID NO: 185853 - RNA, 64 nt, hsa; identical to SEQ ID NO: 41078

SEQ ID NO: 185854 - RNA, 64 nt, hsa; identical to SEQ ID NO: 41079

SEQ ID NO: 185855 - RNA, 64 nt, hsa; identical to SEQ ID NO: 41080

SEQ ID NO: 185856 - RNA, 64 nt, hsa; identical to SEQ ID NO: 41081

SEQ ID NO: 185857 - RNA, 64 nt, hsa; identical to SEQ ID NO: 41082

SEQ ID NO: 185858 - RNA, 64 nt, hsa; identical to SEQ ID NO: 41083

SEQ ID NO: 185859 - RNA, 64 nt, hsa; identical to SEQ ID NO: 41084

SEQ ID NO: 185860 - RNA, 64 nt, hsa; identical to SEQ ID NO: 41085

SEQ ID NO: 185861 - RNA, 64 nt, hsa; identical to SEQ ID NO: 41086

SEQ ID NO: 185862 - RNA, 64 nt, hsa; identical to SEQ ID NO: 41087

SEQ ID NO: 185863 - RNA, 64 nt, hsa; identical to SEQ ID NO: 41088

SEQ ID NO: 185864 - RNA, 64 nt, hsa; identical to SEQ ID NO: 41089

SEQ ID NO: 185865 - RNA, 64 nt, hsa; identical to SEQ ID NO: 41090

SEQ ID NO: 185866 - RNA, 64 nt, hsa; identical to SEQ ID NO: 41091

SEQ ID NO: 185867 - RNA, 64 nt, hsa; identical to SEQ ID NO: 41092

SEQ ID NO: 185868 - RNA, 64 nt, hsa; identical to SEQ ID NO: 41093

SEQ ID NO: 185869 - RNA, 64 nt, hsa; identical to SEQ ID NO: 41094

SEQ ID NO: 185870 - RNA, 64 nt, hsa; identical to SEQ ID NO: 41095

SEQ ID NO: 185871 - RNA, 64 nt, hsa; identical to SEQ ID NO: 41096

SEQ ID NO: 185872 - RNA, 64 nt, hsa; identical to SEQ ID NO: 41097

SEQ ID NO: 185873 - RNA, 64 nt, hsa; identical to SEQ ID NO: 41098

SEQ ID NO: 185874 - RNA, 64 nt, hsa; identical to SEQ ID NO: 41099

SEQ ID NO: 185875 - RNA, 64 nt, hsa; identical to SEQ ID NO: 41100

SEQ ID NO: 185876 - RNA, 64 nt, hsa; identical to SEQ ID NO: 41101

SEQ ID NO: 185877 - RNA, 64 nt, hsa; identical to SEQ ID NO: 41102

SEQ ID NO: 185878 - RNA, 64 nt, hsa; identical to SEQ ID NO: 41103

SEQ ID NO: 185879 - RNA, 64 nt, hsa; identical to SEQ ID NO: 41104

SEQ ID NO: 185880 - RNA, 64 nt, hsa; identical to SEQ ID NO: 41105

SEQ ID NO: 185881 - RNA, 64 nt, hsa; identical to SEQ ID NO: 41106

SEQ ID NO: 185882 - RNA, 64 nt, hsa; identical to SEQ ID NO: 41107

SEQ ID NO: 185883 - RNA, 64 nt, hsa; identical to SEQ ID NO: 41108

SEQ ID NO: 185884 - RNA, 64 nt, hsa; identical to SEQ ID NO: 41109

SEQ ID NO: 185885 - RNA, 64 nt, hsa; identical to SEQ ID NO: 41110

SEQ ID NO: 185886 - RNA, 64 nt, hsa; identical to SEQ ID NO: 41111

SEQ ID NO: 185887 - RNA, 64 nt, hsa; identical to SEQ ID NO: 41112

SEQ ID NO: 185888 - RNA, 64 nt, hsa; identical to SEQ ID NO: 41113

SEQ ID NO: 185889 - RNA, 64 nt, hsa; identical to SEQ ID NO: 41114

SEQ ID NO: 185890 - RNA, 64 nt, hsa; identical to SEQ ID NO: 41115

SEQ ID NO: 185891 - RNA, 64 nt, hsa; identical to SEQ ID NO: 41116

SEQ ID NO: 185892 - RNA, 64 nt, hsa; identical to SEQ ID NO: 41117

SEQ ID NO: 185893 - RNA, 64 nt, hsa; identical to SEQ ID NO: 41118

SEQ ID NO: 185894 - RNA, 64 nt, hsa; identical to SEQ ID NO: 41119

SEQ ID NO: 185895 - RNA, 64 nt, hsa; identical to SEQ ID NO: 41120

SEQ ID NO: 185896 - RNA, 64 nt, hsa; identical to SEQ ID NO: 41121

SEQ ID NO: 185897 - RNA, 64 nt, hsa; identical to SEQ ID NO: 41122

SEQ ID NO: 185898 - RNA, 64 nt, hsa; identical to SEQ ID NO: 41123

SEQ ID NO: 185899 - RNA, 64 nt, hsa; identical to SEQ ID NO: 41124

SEQ ID NO: 185900 - RNA, 64 nt, hsa; identical to SEQ ID NO: 41125

SEQ ID NO: 185901 - RNA, 64 nt, hsa; identical to SEQ ID NO: 41126

SEQ ID NO: 185902 - RNA, 64 nt, hsa; identical to SEQ ID NO: 41127

SEQ ID NO: 185903 - RNA, 64 nt, hsa; identical to SEQ ID NO: 41128

SEQ ID NO: 185904 - RNA, 64 nt, hsa; identical to SEQ ID NO: 41129

SEQ ID NO: 185905 - RNA, 64 nt, hsa; identical to SEQ ID NO: 41130

SEQ ID NO: 185906 - RNA, 64 nt, hsa; identical to SEQ ID NO: 41131

SEQ ID NO: 185907 - RNA, 64 nt, hsa; identical to SEQ ID NO: 41132

SEQ ID NO: 185908 - RNA, 64 nt, hsa; identical to SEQ ID NO: 41133

SEQ ID NO: 185909 - RNA, 64 nt, hsa; identical to SEQ ID NO: 41134

SEQ ID NO: 185910 - RNA, 64 nt, hsa; identical to SEQ ID NO: 41135

SEQ ID NO: 185911 - RNA, 64 nt, hsa; identical to SEQ ID NO: 41136

SEQ ID NO: 185912 - RNA, 64 nt, hsa; identical to SEQ ID NO: 41137

SEQ ID NO: 185913 - RNA, 64 nt, hsa; identical to SEQ ID NO: 41138

SEQ ID NO: 185914 - RNA, 64 nt, hsa; identical to SEQ ID NO: 41139

SEQ ID NO: 185915 - RNA, 64 nt, hsa; identical to SEQ ID NO: 41140

SEQ ID NO: 185916 - RNA, 64 nt, hsa; identical to SEQ ID NO: 41141

SEQ ID NO: 185917 - RNA, 64 nt, hsa; identical to SEQ ID NO: 41142

SEQ ID NO: 185918 - RNA, 64 nt, hsa; identical to SEQ ID NO: 41143

SEQ ID NO: 185919 - RNA, 64 nt, hsa; identical to SEQ ID NO: 41144

SEQ ID NO: 185920 - RNA, 64 nt, hsa; identical to SEQ ID NO: 41145

SEQ ID NO: 185921 - RNA, 64 nt, hsa; identical to SEQ ID NO: 41146

SEQ ID NO: 185922 - RNA, 64 nt, hsa; identical to SEQ ID NO: 41147

SEQ ID NO: 185923 - RNA, 64 nt, hsa; identical to SEQ ID NO: 41148

SEQ ID NO: 185924 - RNA, 64 nt, hsa; identical to SEQ ID NO: 41149

SEQ ID NO: 185925 - RNA, 64 nt, hsa; identical to SEQ ID NO: 41150

SEQ ID NO: 185926 - RNA, 64 nt, hsa; identical to SEQ ID NO: 41151

SEQ ID NO: 185927 - RNA, 64 nt, hsa; identical to SEQ ID NO: 41152

SEQ ID NO: 185928 - RNA, 64 nt, hsa; identical to SEQ ID NO: 41153

SEQ ID NO: 185929 - RNA, 64 nt, hsa; identical to SEQ ID NO: 41154

SEQ ID NO: 185930 - RNA, 64 nt, hsa; identical to SEQ ID NO: 41155

SEQ ID NO: 185931 - RNA, 64 nt, hsa; identical to SEQ ID NO: 41156

SEQ ID NO: 185932 - RNA, 64 nt, hsa; identical to SEQ ID NO: 41157

SEQ ID NO: 185933 - RNA, 64 nt, hsa; identical to SEQ ID NO: 41158

SEQ ID NO: 185934 - RNA, 64 nt, hsa; identical to SEQ ID NO: 41159

SEQ ID NO: 185935 - RNA, 64 nt, hsa; identical to SEQ ID NO: 41160

SEQ ID NO: 185936 - RNA, 64 nt, hsa; identical to SEQ ID NO: 41161

SEQ ID NO: 185937 - RNA, 64 nt, hsa; identical to SEQ ID NO: 41162

SEQ ID NO: 185938 - RNA, 64 nt, hsa; identical to SEQ ID NO: 41163

SEQ ID NO: 185939 - RNA, 64 nt, hsa; identical to SEQ ID NO: 41164

SEQ ID NO: 185940 - RNA, 64 nt, hsa; identical to SEQ ID NO: 41165

SEQ ID NO: 185941 - RNA, 64 nt, hsa; identical to SEQ ID NO: 41166

SEQ ID NO: 185942 - RNA, 64 nt, hsa; identical to SEQ ID NO: 41167

SEQ ID NO: 185943 - RNA, 64 nt, hsa; identical to SEQ ID NO: 41168

SEQ ID NO: 185944 - RNA, 64 nt, hsa; identical to SEQ ID NO: 41169

SEQ ID NO: 185945 - RNA, 64 nt, hsa; identical to SEQ ID NO: 41170

SEQ ID NO: 185946 - RNA, 64 nt, hsa; identical to SEQ ID NO: 41171

SEQ ID NO: 185947 - RNA, 64 nt, hsa; identical to SEQ ID NO: 41172

SEQ ID NO: 185948 - RNA, 64 nt, hsa; identical to SEQ ID NO: 41173

SEQ ID NO: 185949 - RNA, 64 nt, hsa; identical to SEQ ID NO: 41174

SEQ ID NO: 185950 - RNA, 64 nt, hsa; identical to SEQ ID NO: 41175

SEQ ID NO: 185951 - RNA, 64 nt, hsa; identical to SEQ ID NO: 41176

SEQ ID NO: 185952 - RNA, 64 nt, hsa; identical to SEQ ID NO: 41177

SEQ ID NO: 185953 - RNA, 64 nt, hsa; identical to SEQ ID NO: 41178

SEQ ID NO: 185954 - RNA, 64 nt, hsa; identical to SEQ ID NO: 41179

SEQ ID NO: 185955 - RNA, 64 nt, hsa; identical to SEQ ID NO: 41180

SEQ ID NO: 185956 - RNA, 64 nt, hsa; identical to SEQ ID NO: 41181

SEQ ID NO: 185957 - RNA, 64 nt, hsa; identical to SEQ ID NO: 41182

SEQ ID NO: 185958 - RNA, 64 nt, hsa; identical to SEQ ID NO: 41183

SEQ ID NO: 185959 - RNA, 64 nt, hsa; identical to SEQ ID NO: 41184

SEQ ID NO: 185960 - RNA, 64 nt, hsa; identical to SEQ ID NO: 41185

SEQ ID NO: 185961 - RNA, 64 nt, hsa; identical to SEQ ID NO: 41186

SEQ ID NO: 185962 - RNA, 64 nt, hsa; identical to SEQ ID NO: 41187

SEQ ID NO: 185963 - RNA, 64 nt, hsa; identical to SEQ ID NO: 41188

SEQ ID NO: 185964 - RNA, 64 nt, hsa; identical to SEQ ID NO: 41189

SEQ ID NO: 185965 - RNA, 64 nt, hsa; identical to SEQ ID NO: 41190

SEQ ID NO: 185966 - RNA, 64 nt, hsa; identical to SEQ ID NO: 41191

SEQ ID NO: 185967 - RNA, 64 nt, hsa; identical to SEQ ID NO: 41192

SEQ ID NO: 185968 - RNA, 64 nt, hsa; identical to SEQ ID NO: 41193

SEQ ID NO: 185969 - RNA, 64 nt, hsa; identical to SEQ ID NO: 41194

SEQ ID NO: 185970 - RNA, 64 nt, hsa; identical to SEQ ID NO: 41195

SEQ ID NO: 185971 - RNA, 64 nt, hsa; identical to SEQ ID NO: 41196

SEQ ID NO: 185972 - RNA, 64 nt, hsa; identical to SEQ ID NO: 41197

SEQ ID NO: 185973 - RNA, 64 nt, hsa; identical to SEQ ID NO: 41198

SEQ ID NO: 185974 - RNA, 64 nt, hsa; identical to SEQ ID NO: 41199

SEQ ID NO: 185975 - RNA, 64 nt, hsa; identical to SEQ ID NO: 41200

SEQ ID NO: 185976 - RNA, 64 nt, hsa; identical to SEQ ID NO: 41201

SEQ ID NO: 185977 - RNA, 64 nt, hsa; identical to SEQ ID NO: 41202

SEQ ID NO: 185978 - RNA, 64 nt, hsa; identical to SEQ ID NO: 41203

SEQ ID NO: 185979 - RNA, 64 nt, hsa; identical to SEQ ID NO: 41204

SEQ ID NO: 185980 - RNA, 64 nt, hsa; identical to SEQ ID NO: 41205

SEQ ID NO: 185981 - RNA, 64 nt, hsa; identical to SEQ ID NO: 41206

SEQ ID NO: 185982 - RNA, 64 nt, hsa; identical to SEQ ID NO: 41207

SEQ ID NO: 185983 - RNA, 64 nt, hsa; identical to SEQ ID NO: 41208

SEQ ID NO: 185984 - RNA, 64 nt, hsa; identical to SEQ ID NO: 41209

SEQ ID NO: 185985 - RNA, 64 nt, hsa; identical to SEQ ID NO: 41210

SEQ ID NO: 185986 - RNA, 64 nt, hsa; identical to SEQ ID NO: 41211

SEQ ID NO: 185987 - RNA, 64 nt, hsa; identical to SEQ ID NO: 41212

SEQ ID NO: 185988 - RNA, 64 nt, hsa; identical to SEQ ID NO: 41213

SEQ ID NO: 185989 - RNA, 64 nt, hsa; identical to SEQ ID NO: 41214

SEQ ID NO: 185990 - RNA, 64 nt, hsa; identical to SEQ ID NO: 41215

SEQ ID NO: 185991 - RNA, 64 nt, hsa; identical to SEQ ID NO: 41216

SEQ ID NO: 185992 - RNA, 64 nt, hsa; identical to SEQ ID NO: 41217

SEQ ID NO: 185993 - RNA, 64 nt, hsa; identical to SEQ ID NO: 41218

SEQ ID NO: 185994 - RNA, 64 nt, hsa; identical to SEQ ID NO: 41219

SEQ ID NO: 185995 - RNA, 64 nt, hsa; identical to SEQ ID NO: 41220

SEQ ID NO: 185996 - RNA, 64 nt, hsa; identical to SEQ ID NO: 41221

SEQ ID NO: 185997 - RNA, 64 nt, hsa; identical to SEQ ID NO: 41222

SEQ ID NO: 185998 - RNA, 64 nt, hsa; identical to SEQ ID NO: 41223

SEQ ID NO: 185999 - RNA, 64 nt, hsa; identical to SEQ ID NO: 41224

SEQ ID NO: 186000 - RNA, 64 nt, hsa; identical to SEQ ID NO: 41225

SEQ ID NO: 186001 - RNA, 64 nt, hsa; identical to SEQ ID NO: 41226

SEQ ID NO: 186002 - RNA, 64 nt, hsa; identical to SEQ ID NO: 41227

SEQ ID NO: 186003 - RNA, 64 nt, hsa; identical to SEQ ID NO: 41228

SEQ ID NO: 186004 - RNA, 64 nt, hsa; identical to SEQ ID NO: 41229

SEQ ID NO: 186005 - RNA, 64 nt, hsa; identical to SEQ ID NO: 41230

SEQ ID NO: 186006 - RNA, 64 nt, hsa; identical to SEQ ID NO: 41231

SEQ ID NO: 186007 - RNA, 64 nt, hsa; identical to SEQ ID NO: 41232

SEQ ID NO: 186008 - RNA, 64 nt, hsa; identical to SEQ ID NO: 41233

SEQ ID NO: 186009 - RNA, 64 nt, hsa; identical to SEQ ID NO: 41234

SEQ ID NO: 186010 - RNA, 64 nt, hsa; identical to SEQ ID NO: 41235

SEQ ID NO: 186011 - RNA, 62 nt, hsa; identical to SEQ ID NO: 41236

SEQ ID NO: 186012 - RNA, 60 nt, hsa; identical to SEQ ID NO: 41237

SEQ ID NO: 186013 - RNA, 58 nt, hsa; identical to SEQ ID NO: 41238

SEQ ID NO: 186014 - RNA, 56 nt, hsa; identical to SEQ ID NO: 41239

SEQ ID NO: 186015 - RNA, 54 nt, hsa; identical to SEQ ID NO: 41240

SEQ ID NO: 186016 - RNA, 64 nt, hsa; identical to SEQ ID NO: 41241

SEQ ID NO: 186017 - RNA, 64 nt, hsa; identical to SEQ ID NO: 41242

SEQ ID NO: 186018 - RNA, 64 nt, hsa; identical to SEQ ID NO: 41243

SEQ ID NO: 186019 - RNA, 64 nt, hsa; identical to SEQ ID NO: 41244

SEQ ID NO: 186020 - RNA, 64 nt, hsa; identical to SEQ ID NO: 41245

SEQ ID NO: 186021 - RNA, 64 nt, hsa; identical to SEQ ID NO: 41246

SEQ ID NO: 186022 - RNA, 64 nt, hsa; identical to SEQ ID NO: 41247

SEQ ID NO: 186023 - RNA, 64 nt, hsa; identical to SEQ ID NO: 41248

SEQ ID NO: 186024 - RNA, 64 nt, hsa; identical to SEQ ID NO: 41249

SEQ ID NO: 186025 - RNA, 64 nt, hsa; identical to SEQ ID NO: 41250

SEQ ID NO: 186026 - RNA, 64 nt, hsa; identical to SEQ ID NO: 41251

SEQ ID NO: 186027 - RNA, 64 nt, hsa; identical to SEQ ID NO: 41252

SEQ ID NO: 186028 - RNA, 64 nt, hsa; identical to SEQ ID NO: 41253

SEQ ID NO: 186029 - RNA, 64 nt, hsa; identical to SEQ ID NO: 41254

SEQ ID NO: 186030 - RNA, 64 nt, hsa; identical to SEQ ID NO: 41255

SEQ ID NO: 186031 - RNA, 64 nt, hsa; identical to SEQ ID NO: 41256

SEQ ID NO: 186032 - RNA, 64 nt, hsa; identical to SEQ ID NO: 41257

SEQ ID NO: 186033 - RNA, 64 nt, hsa; identical to SEQ ID NO: 41258

SEQ ID NO: 186034 - RNA, 64 nt, hsa; identical to SEQ ID NO: 41259

SEQ ID NO: 186035 - RNA, 64 nt, hsa; identical to SEQ ID NO: 41260

SEQ ID NO: 186036 - RNA, 64 nt, hsa; identical to SEQ ID NO: 41261

SEQ ID NO: 186037 - RNA, 64 nt, hsa; identical to SEQ ID NO: 41262

SEQ ID NO: 186038 - RNA, 64 nt, hsa; identical to SEQ ID NO: 41263

SEQ ID NO: 186039 - RNA, 64 nt, hsa; identical to SEQ ID NO: 41264

SEQ ID NO: 186040 - RNA, 64 nt, hsa; identical to SEQ ID NO: 41265

SEQ ID NO: 186041 - RNA, 64 nt, hsa; identical to SEQ ID NO: 41266

SEQ ID NO: 186042 - RNA, 64 nt, hsa; identical to SEQ ID NO: 41267

SEQ ID NO: 186043 - RNA, 64 nt, hsa; identical to SEQ ID NO: 41268

SEQ ID NO: 186044 - RNA, 64 nt, hsa; identical to SEQ ID NO: 41269

SEQ ID NO: 186045 - RNA, 64 nt, hsa; identical to SEQ ID NO: 41270

SEQ ID NO: 186046 - RNA, 64 nt, hsa; identical to SEQ ID NO: 41271

SEQ ID NO: 186047 - RNA, 64 nt, hsa; identical to SEQ ID NO: 41272

SEQ ID NO: 186048 - RNA, 64 nt, hsa; identical to SEQ ID NO: 41273

SEQ ID NO: 186049 - RNA, 64 nt, hsa; identical to SEQ ID NO: 41274

SEQ ID NO: 186050 - RNA, 64 nt, hsa; identical to SEQ ID NO: 41275

SEQ ID NO: 186051 - RNA, 64 nt, hsa; identical to SEQ ID NO: 41276

SEQ ID NO: 186052 - RNA, 64 nt, hsa; identical to SEQ ID NO: 41277

SEQ ID NO: 186053 - RNA, 64 nt, hsa; identical to SEQ ID NO: 41278

SEQ ID NO: 186054 - RNA, 64 nt, hsa; identical to SEQ ID NO: 41279

SEQ ID NO: 186055 - RNA, 64 nt, hsa; identical to SEQ ID NO: 41280

SEQ ID NO: 186056 - RNA, 64 nt, hsa; identical to SEQ ID NO: 41281

SEQ ID NO: 186057 - RNA, 64 nt, hsa; identical to SEQ ID NO: 41282

SEQ ID NO: 186058 - RNA, 64 nt, hsa; identical to SEQ ID NO: 41283

SEQ ID NO: 186059 - RNA, 64 nt, hsa; identical to SEQ ID NO: 41284

SEQ ID NO: 186060 - RNA, 64 nt, hsa; identical to SEQ ID NO: 41285

SEQ ID NO: 186061 - RNA, 64 nt, hsa; identical to SEQ ID NO: 41286

SEQ ID NO: 186062 - RNA, 64 nt, hsa; identical to SEQ ID NO: 41287

SEQ ID NO: 186063 - RNA, 64 nt, hsa; identical to SEQ ID NO: 41288

SEQ ID NO: 186064 - RNA, 64 nt, hsa; identical to SEQ ID NO: 41289

SEQ ID NO: 186065 - RNA, 64 nt, hsa; identical to SEQ ID NO: 41290

SEQ ID NO: 186066 - RNA, 64 nt, hsa; identical to SEQ ID NO: 41291

SEQ ID NO: 186067 - RNA, 64 nt, hsa; identical to SEQ ID NO: 41292

SEQ ID NO: 186068 - RNA, 64 nt, hsa; identical to SEQ ID NO: 41293

SEQ ID NO: 186069 - RNA, 64 nt, hsa; identical to SEQ ID NO: 41294

SEQ ID NO: 186070 - RNA, 64 nt, hsa; identical to SEQ ID NO: 41295

SEQ ID NO: 186071 - RNA, 64 nt, hsa; identical to SEQ ID NO: 41296

SEQ ID NO: 186072 - RNA, 64 nt, hsa; identical to SEQ ID NO: 41297

SEQ ID NO: 186073 - RNA, 64 nt, hsa; identical to SEQ ID NO: 41298

SEQ ID NO: 186074 - RNA, 64 nt, hsa; identical to SEQ ID NO: 41299

SEQ ID NO: 186075 - RNA, 64 nt, hsa; identical to SEQ ID NO: 41300

SEQ ID NO: 186076 - RNA, 64 nt, hsa; identical to SEQ ID NO: 41301

SEQ ID NO: 186077 - RNA, 64 nt, hsa; identical to SEQ ID NO: 41302

SEQ ID NO: 186078 - RNA, 64 nt, hsa; identical to SEQ ID NO: 41303

SEQ ID NO: 186079 - RNA, 64 nt, hsa; identical to SEQ ID NO: 41304

SEQ ID NO: 186080 - RNA, 64 nt, hsa; identical to SEQ ID NO: 41305

SEQ ID NO: 186081 - RNA, 64 nt, hsa; identical to SEQ ID NO: 41306

SEQ ID NO: 186082 - RNA, 64 nt, hsa; identical to SEQ ID NO: 41307

SEQ ID NO: 186083 - RNA, 64 nt, hsa; identical to SEQ ID NO: 41308

SEQ ID NO: 186084 - RNA, 64 nt, hsa; identical to SEQ ID NO: 41309

SEQ ID NO: 186085 - RNA, 64 nt, hsa; identical to SEQ ID NO: 41310

SEQ ID NO: 186086 - RNA, 64 nt, hsa; identical to SEQ ID NO: 41311

SEQ ID NO: 186087 - RNA, 64 nt, hsa; identical to SEQ ID NO: 41312

SEQ ID NO: 186088 - RNA, 64 nt, hsa; identical to SEQ ID NO: 41313

SEQ ID NO: 186089 - RNA, 64 nt, hsa; identical to SEQ ID NO: 41314

SEQ ID NO: 186090 - RNA, 64 nt, hsa; identical to SEQ ID NO: 41315

SEQ ID NO: 186091 - RNA, 64 nt, hsa; identical to SEQ ID NO: 41316

SEQ ID NO: 186092 - RNA, 64 nt, hsa; identical to SEQ ID NO: 41317

SEQ ID NO: 186093 - RNA, 64 nt, hsa; identical to SEQ ID NO: 41318

SEQ ID NO: 186094 - RNA, 64 nt, hsa; identical to SEQ ID NO: 41319

SEQ ID NO: 186095 - RNA, 64 nt, hsa; identical to SEQ ID NO: 41320

SEQ ID NO: 186096 - RNA, 64 nt, hsa; identical to SEQ ID NO: 41321

SEQ ID NO: 186097 - RNA, 64 nt, hsa; identical to SEQ ID NO: 41322

SEQ ID NO: 186098 - RNA, 64 nt, hsa; identical to SEQ ID NO: 41323

SEQ ID NO: 186099 - RNA, 64 nt, hsa; identical to SEQ ID NO: 41324

SEQ ID NO: 186100 - RNA, 64 nt, hsa; identical to SEQ ID NO: 41325

SEQ ID NO: 186101 - RNA, 64 nt, hsa; identical to SEQ ID NO: 41326

SEQ ID NO: 186102 - RNA, 64 nt, hsa; identical to SEQ ID NO: 41327

SEQ ID NO: 186103 - RNA, 64 nt, hsa; identical to SEQ ID NO: 41328

SEQ ID NO: 186104 - RNA, 64 nt, hsa; identical to SEQ ID NO: 41329

SEQ ID NO: 186105 - RNA, 64 nt, hsa; identical to SEQ ID NO: 41330

SEQ ID NO: 186106 - RNA, 64 nt, hsa; identical to SEQ ID NO: 41331

SEQ ID NO: 186107 - RNA, 64 nt, hsa; identical to SEQ ID NO: 41332

SEQ ID NO: 186108 - RNA, 64 nt, hsa; identical to SEQ ID NO: 41333

SEQ ID NO: 186109 - RNA, 64 nt, hsa; identical to SEQ ID NO: 41334

SEQ ID NO: 186110 - RNA, 64 nt, hsa; identical to SEQ ID NO: 41335

SEQ ID NO: 186111 - RNA, 64 nt, hsa; identical to SEQ ID NO: 41336

SEQ ID NO: 186112 - RNA, 64 nt, hsa; identical to SEQ ID NO: 41337

SEQ ID NO: 186113 - RNA, 64 nt, hsa; identical to SEQ ID NO: 41338

SEQ ID NO: 186114 - RNA, 64 nt, hsa; identical to SEQ ID NO: 41339

SEQ ID NO: 186115 - RNA, 64 nt, hsa; identical to SEQ ID NO: 41340

SEQ ID NO: 186116 - RNA, 64 nt, hsa; identical to SEQ ID NO: 41341

SEQ ID NO: 186117 - RNA, 64 nt, hsa; identical to SEQ ID NO: 41342

SEQ ID NO: 186118 - RNA, 64 nt, hsa; identical to SEQ ID NO: 41343

SEQ ID NO: 186119 - RNA, 64 nt, hsa; identical to SEQ ID NO: 41344

SEQ ID NO: 186120 - RNA, 64 nt, hsa; identical to SEQ ID NO: 41345

SEQ ID NO: 186121 - RNA, 64 nt, hsa; identical to SEQ ID NO: 41346

SEQ ID NO: 186122 - RNA, 64 nt, hsa; identical to SEQ ID NO: 41347

SEQ ID NO: 186123 - RNA, 64 nt, hsa; identical to SEQ ID NO: 41348

SEQ ID NO: 186124 - RNA, 64 nt, hsa; identical to SEQ ID NO: 41349

SEQ ID NO: 186125 - RNA, 64 nt, hsa; identical to SEQ ID NO: 41350

SEQ ID NO: 186126 - RNA, 64 nt, hsa; identical to SEQ ID NO: 41351

SEQ ID NO: 186127 - RNA, 64 nt, hsa; identical to SEQ ID NO: 41352

SEQ ID NO: 186128 - RNA, 64 nt, hsa; identical to SEQ ID NO: 41353

SEQ ID NO: 186129 - RNA, 64 nt, hsa; identical to SEQ ID NO: 41354

SEQ ID NO: 186130 - RNA, 64 nt, hsa; identical to SEQ ID NO: 41355

SEQ ID NO: 186131 - RNA, 64 nt, hsa; identical to SEQ ID NO: 41356

SEQ ID NO: 186132 - RNA, 64 nt, hsa; identical to SEQ ID NO: 41357

SEQ ID NO: 186133 - RNA, 64 nt, hsa; identical to SEQ ID NO: 41358

SEQ ID NO: 186134 - RNA, 64 nt, hsa; identical to SEQ ID NO: 41359

SEQ ID NO: 186135 - RNA, 64 nt, hsa; identical to SEQ ID NO: 41360

SEQ ID NO: 186136 - RNA, 64 nt, hsa; identical to SEQ ID NO: 41361

SEQ ID NO: 186137 - RNA, 64 nt, hsa; identical to SEQ ID NO: 41362

SEQ ID NO: 186138 - RNA, 64 nt, hsa; identical to SEQ ID NO: 41363

SEQ ID NO: 186139 - RNA, 64 nt, hsa; identical to SEQ ID NO: 41364

SEQ ID NO: 186140 - RNA, 64 nt, hsa; identical to SEQ ID NO: 41365

SEQ ID NO: 186141 - RNA, 64 nt, hsa; identical to SEQ ID NO: 41366

SEQ ID NO: 186142 - RNA, 64 nt, hsa; identical to SEQ ID NO: 41367

SEQ ID NO: 186143 - RNA, 64 nt, hsa; identical to SEQ ID NO: 41368

SEQ ID NO: 186144 - RNA, 64 nt, hsa; identical to SEQ ID NO: 41369

SEQ ID NO: 186145 - RNA, 64 nt, hsa; identical to SEQ ID NO: 41370

SEQ ID NO: 186146 - RNA, 64 nt, hsa; identical to SEQ ID NO: 41371

SEQ ID NO: 186147 - RNA, 64 nt, hsa; identical to SEQ ID NO: 41372

SEQ ID NO: 186148 - RNA, 64 nt, hsa; identical to SEQ ID NO: 41373

SEQ ID NO: 186149 - RNA, 64 nt, hsa; identical to SEQ ID NO: 41374

SEQ ID NO: 186150 - RNA, 64 nt, hsa; identical to SEQ ID NO: 41375

SEQ ID NO: 186151 - RNA, 64 nt, hsa; identical to SEQ ID NO: 41376

SEQ ID NO: 186152 - RNA, 64 nt, hsa; identical to SEQ ID NO: 41377

SEQ ID NO: 186153 - RNA, 64 nt, hsa; identical to SEQ ID NO: 41378

SEQ ID NO: 186154 - RNA, 64 nt, hsa; identical to SEQ ID NO: 41379

SEQ ID NO: 186155 - RNA, 64 nt, hsa; identical to SEQ ID NO: 41380

SEQ ID NO: 186156 - RNA, 64 nt, hsa; identical to SEQ ID NO: 41381

SEQ ID NO: 186157 - RNA, 64 nt, hsa; identical to SEQ ID NO: 41382

SEQ ID NO: 186158 - RNA, 64 nt, hsa; identical to SEQ ID NO: 41383

SEQ ID NO: 186159 - RNA, 64 nt, hsa; identical to SEQ ID NO: 41384

SEQ ID NO: 186160 - RNA, 64 nt, hsa; identical to SEQ ID NO: 41385

SEQ ID NO: 186161 - RNA, 64 nt, hsa; identical to SEQ ID NO: 41386

SEQ ID NO: 186162 - RNA, 64 nt, hsa; identical to SEQ ID NO: 41387

SEQ ID NO: 186163 - RNA, 64 nt, hsa; identical to SEQ ID NO: 41388

SEQ ID NO: 186164 - RNA, 64 nt, hsa; identical to SEQ ID NO: 41389

SEQ ID NO: 186165 - RNA, 64 nt, hsa; identical to SEQ ID NO: 41390

SEQ ID NO: 186166 - RNA, 64 nt, hsa; identical to SEQ ID NO: 41391

SEQ ID NO: 186167 - RNA, 64 nt, hsa; identical to SEQ ID NO: 41392

SEQ ID NO: 186168 - RNA, 64 nt, hsa; identical to SEQ ID NO: 41393

SEQ ID NO: 186169 - RNA, 64 nt, hsa; identical to SEQ ID NO: 41394

SEQ ID NO: 186170 - RNA, 64 nt, hsa; identical to SEQ ID NO: 41395

SEQ ID NO: 186171 - RNA, 64 nt, hsa; identical to SEQ ID NO: 41396

SEQ ID NO: 186172 - RNA, 64 nt, hsa; identical to SEQ ID NO: 41397

SEQ ID NO: 186173 - RNA, 64 nt, hsa; identical to SEQ ID NO: 41398

SEQ ID NO: 186174 - RNA, 64 nt, hsa; identical to SEQ ID NO: 41399

SEQ ID NO: 186175 - RNA, 64 nt, hsa; identical to SEQ ID NO: 41400

SEQ ID NO: 186176 - RNA, 64 nt, hsa; identical to SEQ ID NO: 41401

SEQ ID NO: 186177 - RNA, 64 nt, hsa; identical to SEQ ID NO: 41402

SEQ ID NO: 186178 - RNA, 64 nt, hsa; identical to SEQ ID NO: 41403

SEQ ID NO: 186179 - RNA, 64 nt, hsa; identical to SEQ ID NO: 41404

SEQ ID NO: 186180 - RNA, 64 nt, hsa; identical to SEQ ID NO: 41405

SEQ ID NO: 186181 - RNA, 64 nt, hsa; identical to SEQ ID NO: 41406

SEQ ID NO: 186182 - RNA, 64 nt, hsa; identical to SEQ ID NO: 41407

SEQ ID NO: 186183 - RNA, 64 nt, hsa; identical to SEQ ID NO: 41408

SEQ ID NO: 186184 - RNA, 64 nt, hsa; identical to SEQ ID NO: 41409

SEQ ID NO: 186185 - RNA, 64 nt, hsa; identical to SEQ ID NO: 41410

SEQ ID NO: 186186 - RNA, 64 nt, hsa; identical to SEQ ID NO: 41411

SEQ ID NO: 186187 - RNA, 64 nt, hsa; identical to SEQ ID NO: 41412

SEQ ID NO: 186188 - RNA, 64 nt, hsa; identical to SEQ ID NO: 41413

SEQ ID NO: 186189 - RNA, 64 nt, hsa; identical to SEQ ID NO: 41414

SEQ ID NO: 186190 - RNA, 64 nt, hsa; identical to SEQ ID NO: 41415

SEQ ID NO: 186191 - RNA, 64 nt, hsa; identical to SEQ ID NO: 41416

SEQ ID NO: 186192 - RNA, 64 nt, hsa; identical to SEQ ID NO: 41417

SEQ ID NO: 186193 - RNA, 64 nt, hsa; identical to SEQ ID NO: 41418

SEQ ID NO: 186194 - RNA, 64 nt, hsa; identical to SEQ ID NO: 41419

SEQ ID NO: 186195 - RNA, 64 nt, hsa; identical to SEQ ID NO: 41420

SEQ ID NO: 186196 - RNA, 64 nt, hsa; identical to SEQ ID NO: 41421

SEQ ID NO: 186197 - RNA, 64 nt, hsa; identical to SEQ ID NO: 41422

SEQ ID NO: 186198 - RNA, 64 nt, hsa; identical to SEQ ID NO: 41423

SEQ ID NO: 186199 - RNA, 64 nt, hsa; identical to SEQ ID NO: 41424

SEQ ID NO: 186200 - RNA, 64 nt, hsa; identical to SEQ ID NO: 41425

SEQ ID NO: 186201 - RNA, 64 nt, hsa; identical to SEQ ID NO: 41426

SEQ ID NO: 186202 - RNA, 64 nt, hsa; identical to SEQ ID NO: 41427

SEQ ID NO: 186203 - RNA, 64 nt, hsa; identical to SEQ ID NO: 41428

SEQ ID NO: 186204 - RNA, 64 nt, hsa; identical to SEQ ID NO: 41429

SEQ ID NO: 186205 - RNA, 64 nt, hsa; identical to SEQ ID NO: 41430

SEQ ID NO: 186206 - RNA, 64 nt, hsa; identical to SEQ ID NO: 41431

SEQ ID NO: 186207 - RNA, 64 nt, hsa; identical to SEQ ID NO: 41432

SEQ ID NO: 186208 - RNA, 64 nt, hsa; identical to SEQ ID NO: 41433

SEQ ID NO: 186209 - RNA, 64 nt, hsa; identical to SEQ ID NO: 41434

SEQ ID NO: 186210 - RNA, 64 nt, hsa; identical to SEQ ID NO: 41435

SEQ ID NO: 186211 - RNA, 64 nt, hsa; identical to SEQ ID NO: 41436

SEQ ID NO: 186212 - RNA, 64 nt, hsa; identical to SEQ ID NO: 41437

SEQ ID NO: 186213 - RNA, 64 nt, hsa; identical to SEQ ID NO: 41438

SEQ ID NO: 186214 - RNA, 64 nt, hsa; identical to SEQ ID NO: 41439

SEQ ID NO: 186215 - RNA, 64 nt, hsa; identical to SEQ ID NO: 41440

SEQ ID NO: 186216 - RNA, 64 nt, hsa; identical to SEQ ID NO: 41441

SEQ ID NO: 186217 - RNA, 64 nt, hsa; identical to SEQ ID NO: 41442

SEQ ID NO: 186218 - RNA, 64 nt, hsa; identical to SEQ ID NO: 41443

SEQ ID NO: 186219 - RNA, 64 nt, hsa; identical to SEQ ID NO: 41444

SEQ ID NO: 186220 - RNA, 64 nt, hsa; identical to SEQ ID NO: 41445

SEQ ID NO: 186221 - RNA, 64 nt, hsa; identical to SEQ ID NO: 41446

SEQ ID NO: 186222 - RNA, 64 nt, hsa; identical to SEQ ID NO: 41447

SEQ ID NO: 186223 - RNA, 64 nt, hsa; identical to SEQ ID NO: 41448

SEQ ID NO: 186224 - RNA, 64 nt, hsa; identical to SEQ ID NO: 41449

SEQ ID NO: 186225 - RNA, 64 nt, hsa; identical to SEQ ID NO: 41450

SEQ ID NO: 186226 - RNA, 64 nt, hsa; identical to SEQ ID NO: 41451

SEQ ID NO: 186227 - RNA, 64 nt, hsa; identical to SEQ ID NO: 41452

SEQ ID NO: 186228 - RNA, 64 nt, hsa; identical to SEQ ID NO: 41453

SEQ ID NO: 186229 - RNA, 64 nt, hsa; identical to SEQ ID NO: 41454

SEQ ID NO: 186230 - RNA, 64 nt, hsa; identical to SEQ ID NO: 41455

SEQ ID NO: 186231 - RNA, 64 nt, hsa; identical to SEQ ID NO: 41456

SEQ ID NO: 186232 - RNA, 64 nt, hsa; identical to SEQ ID NO: 41457

SEQ ID NO: 186233 - RNA, 64 nt, hsa; identical to SEQ ID NO: 41458

SEQ ID NO: 186234 - RNA, 64 nt, hsa; identical to SEQ ID NO: 41459

SEQ ID NO: 186235 - RNA, 64 nt, hsa; identical to SEQ ID NO: 41460

SEQ ID NO: 186236 - RNA, 64 nt, hsa; identical to SEQ ID NO: 41461

SEQ ID NO: 186237 - RNA, 64 nt, hsa; identical to SEQ ID NO: 41462

SEQ ID NO: 186238 - RNA, 64 nt, hsa; identical to SEQ ID NO: 41463

SEQ ID NO: 186239 - RNA, 64 nt, hsa; identical to SEQ ID NO: 41464

SEQ ID NO: 186240 - RNA, 64 nt, hsa; identical to SEQ ID NO: 41465

SEQ ID NO: 186241 - RNA, 64 nt, hsa; identical to SEQ ID NO: 41466

SEQ ID NO: 186242 - RNA, 64 nt, hsa; identical to SEQ ID NO: 41467

SEQ ID NO: 186243 - RNA, 64 nt, hsa; identical to SEQ ID NO: 41468

SEQ ID NO: 186244 - RNA, 64 nt, hsa; identical to SEQ ID NO: 41469

SEQ ID NO: 186245 - RNA, 64 nt, hsa; identical to SEQ ID NO: 41470

SEQ ID NO: 186246 - RNA, 64 nt, hsa; identical to SEQ ID NO: 41471

SEQ ID NO: 186247 - RNA, 64 nt, hsa; identical to SEQ ID NO: 41472

SEQ ID NO: 186248 - RNA, 64 nt, hsa; identical to SEQ ID NO: 41473

SEQ ID NO: 186249 - RNA, 64 nt, hsa; identical to SEQ ID NO: 41474

SEQ ID NO: 186250 - RNA, 64 nt, hsa; identical to SEQ ID NO: 41475

SEQ ID NO: 186251 - RNA, 64 nt, hsa; identical to SEQ ID NO: 41476

SEQ ID NO: 186252 - RNA, 64 nt, hsa; identical to SEQ ID NO: 41477

SEQ ID NO: 186253 - RNA, 64 nt, hsa; identical to SEQ ID NO: 41478

SEQ ID NO: 186254 - RNA, 64 nt, hsa; identical to SEQ ID NO: 41479

SEQ ID NO: 186255 - RNA, 64 nt, hsa; identical to SEQ ID NO: 41480

SEQ ID NO: 186256 - RNA, 64 nt, hsa; identical to SEQ ID NO: 41481

SEQ ID NO: 186257 - RNA, 64 nt, hsa; identical to SEQ ID NO: 41482

SEQ ID NO: 186258 - RNA, 64 nt, hsa; identical to SEQ ID NO: 41483

SEQ ID NO: 186259 - RNA, 64 nt, hsa; identical to SEQ ID NO: 41484

SEQ ID NO: 186260 - RNA, 64 nt, hsa; identical to SEQ ID NO: 41485

SEQ ID NO: 186261 - RNA, 64 nt, hsa; identical to SEQ ID NO: 41486

SEQ ID NO: 186262 - RNA, 64 nt, hsa; identical to SEQ ID NO: 41487

SEQ ID NO: 186263 - RNA, 64 nt, hsa; identical to SEQ ID NO: 41488

SEQ ID NO: 186264 - RNA, 64 nt, hsa; identical to SEQ ID NO: 41489

SEQ ID NO: 186265 - RNA, 64 nt, hsa; identical to SEQ ID NO: 41490

SEQ ID NO: 186266 - RNA, 64 nt, hsa; identical to SEQ ID NO: 41491

SEQ ID NO: 186267 - RNA, 64 nt, hsa; identical to SEQ ID NO: 41492

SEQ ID NO: 186268 - RNA, 64 nt, hsa; identical to SEQ ID NO: 41493

SEQ ID NO: 186269 - RNA, 64 nt, hsa; identical to SEQ ID NO: 41494

SEQ ID NO: 186270 - RNA, 64 nt, hsa; identical to SEQ ID NO: 41495

SEQ ID NO: 186271 - RNA, 64 nt, hsa; identical to SEQ ID NO: 41496

SEQ ID NO: 186272 - RNA, 64 nt, hsa; identical to SEQ ID NO: 41497

SEQ ID NO: 186273 - RNA, 64 nt, hsa; identical to SEQ ID NO: 41498

SEQ ID NO: 186274 - RNA, 64 nt, hsa; identical to SEQ ID NO: 41499

SEQ ID NO: 186275 - RNA, 64 nt, hsa; identical to SEQ ID NO: 41500

SEQ ID NO: 186276 - RNA, 64 nt, hsa; identical to SEQ ID NO: 41501

SEQ ID NO: 186277 - RNA, 64 nt, hsa; identical to SEQ ID NO: 41502

SEQ ID NO: 186278 - RNA, 64 nt, hsa; identical to SEQ ID NO: 41503

SEQ ID NO: 186279 - RNA, 64 nt, hsa; identical to SEQ ID NO: 41504

SEQ ID NO: 186280 - RNA, 64 nt, hsa; identical to SEQ ID NO: 41505

SEQ ID NO: 186281 - RNA, 64 nt, hsa; identical to SEQ ID NO: 41506

SEQ ID NO: 186282 - RNA, 64 nt, hsa; identical to SEQ ID NO: 41507

SEQ ID NO: 186283 - RNA, 64 nt, hsa; identical to SEQ ID NO: 41508

SEQ ID NO: 186284 - RNA, 64 nt, hsa; identical to SEQ ID NO: 41509

SEQ ID NO: 186285 - RNA, 64 nt, hsa; identical to SEQ ID NO: 41510

SEQ ID NO: 186286 - RNA, 64 nt, hsa; identical to SEQ ID NO: 41511

SEQ ID NO: 186287 - RNA, 64 nt, hsa; identical to SEQ ID NO: 41512

SEQ ID NO: 186288 - RNA, 64 nt, hsa; identical to SEQ ID NO: 41513

SEQ ID NO: 186289 - RNA, 64 nt, hsa; identical to SEQ ID NO: 41514

SEQ ID NO: 186290 - RNA, 64 nt, hsa; identical to SEQ ID NO: 41515

SEQ ID NO: 186291 - RNA, 64 nt, hsa; identical to SEQ ID NO: 41516

SEQ ID NO: 186292 - RNA, 64 nt, hsa; identical to SEQ ID NO: 41517

SEQ ID NO: 186293 - RNA, 64 nt, hsa; identical to SEQ ID NO: 41518

SEQ ID NO: 186294 - RNA, 64 nt, hsa; identical to SEQ ID NO: 41519

SEQ ID NO: 186295 - RNA, 64 nt, hsa; identical to SEQ ID NO: 41520

SEQ ID NO: 186296 - RNA, 64 nt, hsa; identical to SEQ ID NO: 41521

SEQ ID NO: 186297 - RNA, 64 nt, hsa; identical to SEQ ID NO: 41522

SEQ ID NO: 186298 - RNA, 64 nt, hsa; identical to SEQ ID NO: 41523

SEQ ID NO: 186299 - RNA, 64 nt, hsa; identical to SEQ ID NO: 41524

SEQ ID NO: 186300 - RNA, 64 nt, hsa; identical to SEQ ID NO: 41525

SEQ ID NO: 186301 - RNA, 64 nt, hsa; identical to SEQ ID NO: 41526

SEQ ID NO: 186302 - RNA, 64 nt, hsa; identical to SEQ ID NO: 41527

SEQ ID NO: 186303 - RNA, 64 nt, hsa; identical to SEQ ID NO: 41528

SEQ ID NO: 186304 - RNA, 64 nt, hsa; identical to SEQ ID NO: 41529

SEQ ID NO: 186305 - RNA, 64 nt, hsa; identical to SEQ ID NO: 41530

SEQ ID NO: 186306 - RNA, 64 nt, hsa; identical to SEQ ID NO: 41531

SEQ ID NO: 186307 - RNA, 64 nt, hsa; identical to SEQ ID NO: 41532

SEQ ID NO: 186308 - RNA, 64 nt, hsa; identical to SEQ ID NO: 41533

SEQ ID NO: 186309 - RNA, 64 nt, hsa; identical to SEQ ID NO: 41534

SEQ ID NO: 186310 - RNA, 64 nt, hsa; identical to SEQ ID NO: 41535

SEQ ID NO: 186311 - RNA, 64 nt, hsa; identical to SEQ ID NO: 41536

SEQ ID NO: 186312 - RNA, 64 nt, hsa; identical to SEQ ID NO: 41537

SEQ ID NO: 186313 - RNA, 64 nt, hsa; identical to SEQ ID NO: 41538

SEQ ID NO: 186314 - RNA, 64 nt, hsa; identical to SEQ ID NO: 41539

SEQ ID NO: 186315 - RNA, 64 nt, hsa; identical to SEQ ID NO: 41540

SEQ ID NO: 186316 - RNA, 64 nt, hsa; identical to SEQ ID NO: 41541

SEQ ID NO: 186317 - RNA, 64 nt, hsa; identical to SEQ ID NO: 41542

SEQ ID NO: 186318 - RNA, 64 nt, hsa; identical to SEQ ID NO: 41543

SEQ ID NO: 186319 - RNA, 64 nt, hsa; identical to SEQ ID NO: 41544

SEQ ID NO: 186320 - RNA, 64 nt, hsa; identical to SEQ ID NO: 41545

SEQ ID NO: 186321 - RNA, 64 nt, hsa; identical to SEQ ID NO: 41546

SEQ ID NO: 186322 - RNA, 64 nt, hsa; identical to SEQ ID NO: 41547

SEQ ID NO: 186323 - RNA, 64 nt, hsa; identical to SEQ ID NO: 41548

SEQ ID NO: 186324 - RNA, 64 nt, hsa; identical to SEQ ID NO: 41549

SEQ ID NO: 186325 - RNA, 64 nt, hsa; identical to SEQ ID NO: 41550

SEQ ID NO: 186326 - RNA, 64 nt, hsa; identical to SEQ ID NO: 41551

SEQ ID NO: 186327 - RNA, 64 nt, hsa; identical to SEQ ID NO: 41552

SEQ ID NO: 186328 - RNA, 64 nt, hsa; identical to SEQ ID NO: 41553

SEQ ID NO: 186329 - RNA, 64 nt, hsa; identical to SEQ ID NO: 41554

SEQ ID NO: 186330 - RNA, 64 nt, hsa; identical to SEQ ID NO: 41555

SEQ ID NO: 186331 - RNA, 64 nt, hsa; identical to SEQ ID NO: 41556

SEQ ID NO: 186332 - RNA, 64 nt, hsa; identical to SEQ ID NO: 41557

SEQ ID NO: 186333 - RNA, 64 nt, hsa; identical to SEQ ID NO: 41558

SEQ ID NO: 186334 - RNA, 64 nt, hsa; identical to SEQ ID NO: 41559

SEQ ID NO: 186335 - RNA, 64 nt, hsa; identical to SEQ ID NO: 41560

SEQ ID NO: 186336 - RNA, 64 nt, hsa; identical to SEQ ID NO: 41561

SEQ ID NO: 186337 - RNA, 64 nt, hsa; identical to SEQ ID NO: 41562

SEQ ID NO: 186338 - RNA, 64 nt, hsa; identical to SEQ ID NO: 41563

SEQ ID NO: 186339 - RNA, 64 nt, hsa; identical to SEQ ID NO: 41564

SEQ ID NO: 186340 - RNA, 64 nt, hsa; identical to SEQ ID NO: 41565

SEQ ID NO: 186341 - RNA, 64 nt, hsa; identical to SEQ ID NO: 41566

SEQ ID NO: 186342 - RNA, 64 nt, hsa; identical to SEQ ID NO: 41567

SEQ ID NO: 186343 - RNA, 64 nt, hsa; identical to SEQ ID NO: 41568

SEQ ID NO: 186344 - RNA, 64 nt, hsa; identical to SEQ ID NO: 41569

SEQ ID NO: 186345 - RNA, 64 nt, hsa; identical to SEQ ID NO: 41570

SEQ ID NO: 186346 - RNA, 64 nt, hsa; identical to SEQ ID NO: 41571

SEQ ID NO: 186347 - RNA, 64 nt, hsa; identical to SEQ ID NO: 41572

SEQ ID NO: 186348 - RNA, 64 nt, hsa; identical to SEQ ID NO: 41573

SEQ ID NO: 186349 - RNA, 64 nt, hsa; identical to SEQ ID NO: 41574

SEQ ID NO: 186350 - RNA, 64 nt, hsa; identical to SEQ ID NO: 41575

SEQ ID NO: 186351 - RNA, 64 nt, hsa; identical to SEQ ID NO: 41576

SEQ ID NO: 186352 - RNA, 64 nt, hsa; identical to SEQ ID NO: 41577

SEQ ID NO: 186353 - RNA, 64 nt, hsa; identical to SEQ ID NO: 41578

SEQ ID NO: 186354 - RNA, 64 nt, hsa; identical to SEQ ID NO: 41579

SEQ ID NO: 186355 - RNA, 64 nt, hsa; identical to SEQ ID NO: 41580

SEQ ID NO: 186356 - RNA, 64 nt, hsa; identical to SEQ ID NO: 41581

SEQ ID NO: 186357 - RNA, 64 nt, hsa; identical to SEQ ID NO: 41582

SEQ ID NO: 186358 - RNA, 64 nt, hsa; identical to SEQ ID NO: 41583

SEQ ID NO: 186359 - RNA, 64 nt, hsa; identical to SEQ ID NO: 41584

SEQ ID NO: 186360 - RNA, 64 nt, hsa; identical to SEQ ID NO: 41585

SEQ ID NO: 186361 - RNA, 64 nt, hsa; identical to SEQ ID NO: 41586

SEQ ID NO: 186362 - RNA, 64 nt, hsa; identical to SEQ ID NO: 41587

SEQ ID NO: 186363 - RNA, 64 nt, hsa; identical to SEQ ID NO: 41588

SEQ ID NO: 186364 - RNA, 64 nt, hsa; identical to SEQ ID NO: 41589

SEQ ID NO: 186365 - RNA, 64 nt, hsa; identical to SEQ ID NO: 41590

SEQ ID NO: 186366 - RNA, 64 nt, hsa; identical to SEQ ID NO: 41591

SEQ ID NO: 186367 - RNA, 64 nt, hsa; identical to SEQ ID NO: 41592

SEQ ID NO: 186368 - RNA, 64 nt, hsa; identical to SEQ ID NO: 41593

SEQ ID NO: 186369 - RNA, 64 nt, hsa; identical to SEQ ID NO: 41594

SEQ ID NO: 186370 - RNA, 64 nt, hsa; identical to SEQ ID NO: 41595

SEQ ID NO: 186371 - RNA, 64 nt, hsa; identical to SEQ ID NO: 41596

SEQ ID NO: 186372 - RNA, 64 nt, hsa; identical to SEQ ID NO: 41597

SEQ ID NO: 186373 - RNA, 64 nt, hsa; identical to SEQ ID NO: 41598

SEQ ID NO: 186374 - RNA, 64 nt, hsa; identical to SEQ ID NO: 41599

SEQ ID NO: 186375 - RNA, 64 nt, hsa; identical to SEQ ID NO: 41600

SEQ ID NO: 186376 - RNA, 64 nt, hsa; identical to SEQ ID NO: 41601

SEQ ID NO: 186377 - RNA, 64 nt, hsa; identical to SEQ ID NO: 41602

SEQ ID NO: 186378 - RNA, 64 nt, hsa; identical to SEQ ID NO: 41603

SEQ ID NO: 186379 - RNA, 64 nt, hsa; identical to SEQ ID NO: 41604

SEQ ID NO: 186380 - RNA, 64 nt, hsa; identical to SEQ ID NO: 41605

SEQ ID NO: 186381 - RNA, 64 nt, hsa; identical to SEQ ID NO: 41606

SEQ ID NO: 186382 - RNA, 64 nt, hsa; identical to SEQ ID NO: 41607

SEQ ID NO: 186383 - RNA, 64 nt, hsa; identical to SEQ ID NO: 41608

SEQ ID NO: 186384 - RNA, 64 nt, hsa; identical to SEQ ID NO: 41609

SEQ ID NO: 186385 - RNA, 64 nt, hsa; identical to SEQ ID NO: 41610

SEQ ID NO: 186386 - RNA, 64 nt, hsa; identical to SEQ ID NO: 41611

SEQ ID NO: 186387 - RNA, 64 nt, hsa; identical to SEQ ID NO: 41612

SEQ ID NO: 186388 - RNA, 64 nt, hsa; identical to SEQ ID NO: 41613

SEQ ID NO: 186389 - RNA, 64 nt, hsa; identical to SEQ ID NO: 41614

SEQ ID NO: 186390 - RNA, 64 nt, hsa; identical to SEQ ID NO: 41615

SEQ ID NO: 186391 - RNA, 64 nt, hsa; identical to SEQ ID NO: 41616

SEQ ID NO: 186392 - RNA, 64 nt, hsa; identical to SEQ ID NO: 41617

SEQ ID NO: 186393 - RNA, 64 nt, hsa; identical to SEQ ID NO: 41618

SEQ ID NO: 186394 - RNA, 64 nt, hsa; identical to SEQ ID NO: 41619

SEQ ID NO: 186395 - RNA, 64 nt, hsa; identical to SEQ ID NO: 41620

SEQ ID NO: 186396 - RNA, 64 nt, hsa; identical to SEQ ID NO: 41621

SEQ ID NO: 186397 - RNA, 63 nt, hsa; identical to SEQ ID NO: 41622

SEQ ID NO: 186398 - RNA, 64 nt, hsa; identical to SEQ ID NO: 41623

SEQ ID NO: 186399 - RNA, 64 nt, hsa; identical to SEQ ID NO: 41624

SEQ ID NO: 186400 - RNA, 64 nt, hsa; identical to SEQ ID NO: 41625

SEQ ID NO: 186401 - RNA, 64 nt, hsa; identical to SEQ ID NO: 41626

SEQ ID NO: 186402 - RNA, 64 nt, hsa; identical to SEQ ID NO: 41627

SEQ ID NO: 186403 - RNA, 64 nt, hsa; identical to SEQ ID NO: 41628

SEQ ID NO: 186404 - RNA, 64 nt, hsa; identical to SEQ ID NO: 41629

SEQ ID NO: 186405 - RNA, 64 nt, hsa; identical to SEQ ID NO: 41630

SEQ ID NO: 186406 - RNA, 64 nt, hsa; identical to SEQ ID NO: 41631

SEQ ID NO: 186407 - RNA, 64 nt, hsa; identical to SEQ ID NO: 41632

SEQ ID NO: 186408 - RNA, 64 nt, hsa; identical to SEQ ID NO: 41633

SEQ ID NO: 186409 - RNA, 64 nt, hsa; identical to SEQ ID NO: 41634

SEQ ID NO: 186410 - RNA, 64 nt, hsa; identical to SEQ ID NO: 41635

SEQ ID NO: 186411 - RNA, 64 nt, hsa; identical to SEQ ID NO: 41636

SEQ ID NO: 186412 - RNA, 64 nt, hsa; identical to SEQ ID NO: 41637

SEQ ID NO: 186413 - RNA, 64 nt, hsa; identical to SEQ ID NO: 41638

SEQ ID NO: 186414 - RNA, 64 nt, hsa; identical to SEQ ID NO: 41639

SEQ ID NO: 186415 - RNA, 64 nt, hsa; identical to SEQ ID NO: 41640

SEQ ID NO: 186416 - RNA, 64 nt, hsa; identical to SEQ ID NO: 41641

SEQ ID NO: 186417 - RNA, 64 nt, hsa; identical to SEQ ID NO: 41642

SEQ ID NO: 186418 - RNA, 64 nt, hsa; identical to SEQ ID NO: 41643

SEQ ID NO: 186419 - RNA, 64 nt, hsa; identical to SEQ ID NO: 41644

SEQ ID NO: 186420 - RNA, 64 nt, hsa; identical to SEQ ID NO: 41645

SEQ ID NO: 186421 - RNA, 64 nt, hsa; identical to SEQ ID NO: 41646

SEQ ID NO: 186422 - RNA, 64 nt, hsa; identical to SEQ ID NO: 41647

SEQ ID NO: 186423 - RNA, 64 nt, hsa; identical to SEQ ID NO: 41648

SEQ ID NO: 186424 - RNA, 64 nt, hsa; identical to SEQ ID NO: 41649

SEQ ID NO: 186425 - RNA, 64 nt, hsa; identical to SEQ ID NO: 41650

SEQ ID NO: 186426 - RNA, 64 nt, hsa; identical to SEQ ID NO: 41651

SEQ ID NO: 186427 - RNA, 64 nt, hsa; identical to SEQ ID NO: 41652

SEQ ID NO: 186428 - RNA, 64 nt, hsa; identical to SEQ ID NO: 41653

SEQ ID NO: 186429 - RNA, 64 nt, hsa; identical to SEQ ID NO: 41654

SEQ ID NO: 186430 - RNA, 64 nt, hsa; identical to SEQ ID NO: 41655

SEQ ID NO: 186431 - RNA, 64 nt, hsa; identical to SEQ ID NO: 41656

SEQ ID NO: 186432 - RNA, 64 nt, hsa; identical to SEQ ID NO: 41657

SEQ ID NO: 186433 - RNA, 64 nt, hsa; identical to SEQ ID NO: 41658

SEQ ID NO: 186434 - RNA, 64 nt, hsa; identical to SEQ ID NO: 41659

SEQ ID NO: 186435 - RNA, 64 nt, hsa; identical to SEQ ID NO: 41660

SEQ ID NO: 186436 - RNA, 64 nt, hsa; identical to SEQ ID NO: 41661

SEQ ID NO: 186437 - RNA, 64 nt, hsa; identical to SEQ ID NO: 41662

SEQ ID NO: 186438 - RNA, 64 nt, hsa; identical to SEQ ID NO: 41663

SEQ ID NO: 186439 - RNA, 64 nt, hsa; identical to SEQ ID NO: 41664

SEQ ID NO: 186440 - RNA, 64 nt, hsa; identical to SEQ ID NO: 41665

SEQ ID NO: 186441 - RNA, 64 nt, hsa; identical to SEQ ID NO: 41666

SEQ ID NO: 186442 - RNA, 64 nt, hsa; identical to SEQ ID NO: 41667

SEQ ID NO: 186443 - RNA, 64 nt, hsa; identical to SEQ ID NO: 41668

SEQ ID NO: 186444 - RNA, 64 nt, hsa; identical to SEQ ID NO: 41669

SEQ ID NO: 186445 - RNA, 64 nt, hsa; identical to SEQ ID NO: 41670

SEQ ID NO: 186446 - RNA, 64 nt, hsa; identical to SEQ ID NO: 41671

SEQ ID NO: 186447 - RNA, 64 nt, hsa; identical to SEQ ID NO: 41672

SEQ ID NO: 186448 - RNA, 64 nt, hsa; identical to SEQ ID NO: 41673

SEQ ID NO: 186449 - RNA, 64 nt, hsa; identical to SEQ ID NO: 41674

SEQ ID NO: 186450 - RNA, 64 nt, hsa; identical to SEQ ID NO: 41675

SEQ ID NO: 186451 - RNA, 64 nt, hsa; identical to SEQ ID NO: 41676

SEQ ID NO: 186452 - RNA, 64 nt, hsa; identical to SEQ ID NO: 41677

SEQ ID NO: 186453 - RNA, 64 nt, hsa; identical to SEQ ID NO: 41678

SEQ ID NO: 186454 - RNA, 64 nt, hsa; identical to SEQ ID NO: 41679

SEQ ID NO: 186455 - RNA, 64 nt, hsa; identical to SEQ ID NO: 41680

SEQ ID NO: 186456 - RNA, 64 nt, hsa; identical to SEQ ID NO: 41681

SEQ ID NO: 186457 - RNA, 64 nt, hsa; identical to SEQ ID NO: 41682

SEQ ID NO: 186458 - RNA, 64 nt, hsa; identical to SEQ ID NO: 41683

SEQ ID NO: 186459 - RNA, 64 nt, hsa; identical to SEQ ID NO: 41684

SEQ ID NO: 186460 - RNA, 64 nt, hsa; identical to SEQ ID NO: 41685

SEQ ID NO: 186461 - RNA, 64 nt, hsa; identical to SEQ ID NO: 41686

SEQ ID NO: 186462 - RNA, 64 nt, hsa; identical to SEQ ID NO: 41687

SEQ ID NO: 186463 - RNA, 64 nt, hsa; identical to SEQ ID NO: 41688

SEQ ID NO: 186464 - RNA, 64 nt, hsa; identical to SEQ ID NO: 41689

SEQ ID NO: 186465 - RNA, 64 nt, hsa; identical to SEQ ID NO: 41690

SEQ ID NO: 186466 - RNA, 64 nt, hsa; identical to SEQ ID NO: 41691

SEQ ID NO: 186467 - RNA, 64 nt, hsa; identical to SEQ ID NO: 41692

SEQ ID NO: 186468 - RNA, 64 nt, hsa; identical to SEQ ID NO: 41693

SEQ ID NO: 186469 - RNA, 64 nt, hsa; identical to SEQ ID NO: 41694

SEQ ID NO: 186470 - RNA, 64 nt, hsa; identical to SEQ ID NO: 41695

SEQ ID NO: 186471 - RNA, 64 nt, hsa; identical to SEQ ID NO: 41696

SEQ ID NO: 186472 - RNA, 64 nt, hsa; identical to SEQ ID NO: 41697

SEQ ID NO: 186473 - RNA, 64 nt, hsa; identical to SEQ ID NO: 41698

SEQ ID NO: 186474 - RNA, 64 nt, hsa; identical to SEQ ID NO: 41699

SEQ ID NO: 186475 - RNA, 64 nt, hsa; identical to SEQ ID NO: 41700

SEQ ID NO: 186476 - RNA, 64 nt, hsa; identical to SEQ ID NO: 41701

SEQ ID NO: 186477 - RNA, 64 nt, hsa; identical to SEQ ID NO: 41702

SEQ ID NO: 186478 - RNA, 64 nt, hsa; identical to SEQ ID NO: 41703

SEQ ID NO: 186479 - RNA, 64 nt, hsa; identical to SEQ ID NO: 41704

SEQ ID NO: 186480 - RNA, 64 nt, hsa; identical to SEQ ID NO: 41705

SEQ ID NO: 186481 - RNA, 64 nt, hsa; identical to SEQ ID NO: 41706

SEQ ID NO: 186482 - RNA, 64 nt, hsa; identical to SEQ ID NO: 41707

SEQ ID NO: 186483 - RNA, 64 nt, hsa; identical to SEQ ID NO: 41708

SEQ ID NO: 186484 - RNA, 64 nt, hsa; identical to SEQ ID NO: 41709

SEQ ID NO: 186485 - RNA, 64 nt, hsa; identical to SEQ ID NO: 41710

SEQ ID NO: 186486 - RNA, 64 nt, hsa; identical to SEQ ID NO: 41711

SEQ ID NO: 186487 - RNA, 64 nt, hsa; identical to SEQ ID NO: 41712

SEQ ID NO: 186488 - RNA, 64 nt, hsa; identical to SEQ ID NO: 41713

SEQ ID NO: 186489 - RNA, 64 nt, hsa; identical to SEQ ID NO: 41714

SEQ ID NO: 186490 - RNA, 64 nt, hsa; identical to SEQ ID NO: 41715

SEQ ID NO: 186491 - RNA, 64 nt, hsa; identical to SEQ ID NO: 41716

SEQ ID NO: 186492 - RNA, 64 nt, hsa; identical to SEQ ID NO: 41717

SEQ ID NO: 186493 - RNA, 64 nt, hsa; identical to SEQ ID NO: 41718

SEQ ID NO: 186494 - RNA, 64 nt, hsa; identical to SEQ ID NO: 41719

SEQ ID NO: 186495 - RNA, 64 nt, hsa; identical to SEQ ID NO: 41720

SEQ ID NO: 186496 - RNA, 64 nt, hsa; identical to SEQ ID NO: 41721

SEQ ID NO: 186497 - RNA, 64 nt, hsa; identical to SEQ ID NO: 41722

SEQ ID NO: 186498 - RNA, 64 nt, hsa; identical to SEQ ID NO: 41723

SEQ ID NO: 186499 - RNA, 64 nt, hsa; identical to SEQ ID NO: 41724

SEQ ID NO: 186500 - RNA, 64 nt, hsa; identical to SEQ ID NO: 41725

SEQ ID NO: 186501 - RNA, 64 nt, hsa; identical to SEQ ID NO: 41726

SEQ ID NO: 186502 - RNA, 64 nt, hsa; identical to SEQ ID NO: 41727

SEQ ID NO: 186503 - RNA, 64 nt, hsa; identical to SEQ ID NO: 41728

SEQ ID NO: 186504 - RNA, 64 nt, hsa; identical to SEQ ID NO: 41729

SEQ ID NO: 186505 - RNA, 64 nt, hsa; identical to SEQ ID NO: 41730

SEQ ID NO: 186506 - RNA, 64 nt, hsa; identical to SEQ ID NO: 41731

SEQ ID NO: 186507 - RNA, 64 nt, hsa; identical to SEQ ID NO: 41732

SEQ ID NO: 186508 - RNA, 64 nt, hsa; identical to SEQ ID NO: 41733

SEQ ID NO: 186509 - RNA, 64 nt, hsa; identical to SEQ ID NO: 41734

SEQ ID NO: 186510 - RNA, 64 nt, hsa; identical to SEQ ID NO: 41735

SEQ ID NO: 186511 - RNA, 64 nt, hsa; identical to SEQ ID NO: 41736

SEQ ID NO: 186512 - RNA, 64 nt, hsa; identical to SEQ ID NO: 41737

SEQ ID NO: 186513 - RNA, 64 nt, hsa; identical to SEQ ID NO: 41738

SEQ ID NO: 186514 - RNA, 64 nt, hsa; identical to SEQ ID NO: 41739

SEQ ID NO: 186515 - RNA, 64 nt, hsa; identical to SEQ ID NO: 41740

SEQ ID NO: 186516 - RNA, 64 nt, hsa; identical to SEQ ID NO: 41741

SEQ ID NO: 186517 - RNA, 64 nt, hsa; identical to SEQ ID NO: 41742

SEQ ID NO: 186518 - RNA, 64 nt, hsa; identical to SEQ ID NO: 41743

SEQ ID NO: 186519 - RNA, 64 nt, hsa; identical to SEQ ID NO: 41744

SEQ ID NO: 186520 - RNA, 64 nt, hsa; identical to SEQ ID NO: 41745

SEQ ID NO: 186521 - RNA, 64 nt, hsa; identical to SEQ ID NO: 41746

SEQ ID NO: 186522 - RNA, 64 nt, hsa; identical to SEQ ID NO: 41747

SEQ ID NO: 186523 - RNA, 64 nt, hsa; identical to SEQ ID NO: 41748

SEQ ID NO: 186524 - RNA, 64 nt, hsa; identical to SEQ ID NO: 41749

SEQ ID NO: 186525 - RNA, 64 nt, hsa; identical to SEQ ID NO: 41750

SEQ ID NO: 186526 - RNA, 64 nt, hsa; identical to SEQ ID NO: 41751

SEQ ID NO: 186527 - RNA, 64 nt, hsa; identical to SEQ ID NO: 41752

SEQ ID NO: 186528 - RNA, 64 nt, hsa; identical to SEQ ID NO: 41753

SEQ ID NO: 186529 - RNA, 64 nt, hsa; identical to SEQ ID NO: 41754

SEQ ID NO: 186530 - RNA, 64 nt, hsa; identical to SEQ ID NO: 41755

SEQ ID NO: 186531 - RNA, 64 nt, hsa; identical to SEQ ID NO: 41756

SEQ ID NO: 186532 - RNA, 64 nt, hsa; identical to SEQ ID NO: 41757

SEQ ID NO: 186533 - RNA, 64 nt, hsa; identical to SEQ ID NO: 41758

SEQ ID NO: 186534 - RNA, 64 nt, hsa; identical to SEQ ID NO: 41759

SEQ ID NO: 186535 - RNA, 64 nt, hsa; identical to SEQ ID NO: 41760

SEQ ID NO: 186536 - RNA, 64 nt, hsa; identical to SEQ ID NO: 41761

SEQ ID NO: 186537 - RNA, 64 nt, hsa; identical to SEQ ID NO: 41762

SEQ ID NO: 186538 - RNA, 64 nt, hsa; identical to SEQ ID NO: 41763

SEQ ID NO: 186539 - RNA, 64 nt, hsa; identical to SEQ ID NO: 41764

SEQ ID NO: 186540 - RNA, 64 nt, hsa; identical to SEQ ID NO: 41765

SEQ ID NO: 186541 - RNA, 64 nt, hsa; identical to SEQ ID NO: 41766

SEQ ID NO: 186542 - RNA, 64 nt, hsa; identical to SEQ ID NO: 41767

SEQ ID NO: 186543 - RNA, 64 nt, hsa; identical to SEQ ID NO: 41768

SEQ ID NO: 186544 - RNA, 64 nt, hsa; identical to SEQ ID NO: 41769

SEQ ID NO: 186545 - RNA, 64 nt, hsa; identical to SEQ ID NO: 41770

SEQ ID NO: 186546 - RNA, 64 nt, hsa; identical to SEQ ID NO: 41771

SEQ ID NO: 186547 - RNA, 64 nt, hsa; identical to SEQ ID NO: 41772

SEQ ID NO: 186548 - RNA, 64 nt, hsa; identical to SEQ ID NO: 41773

SEQ ID NO: 186549 - RNA, 64 nt, hsa; identical to SEQ ID NO: 41774

SEQ ID NO: 186550 - RNA, 64 nt, hsa; identical to SEQ ID NO: 41775

SEQ ID NO: 186551 - RNA, 64 nt, hsa; identical to SEQ ID NO: 41776

SEQ ID NO: 186552 - RNA, 64 nt, hsa; identical to SEQ ID NO: 41777

SEQ ID NO: 186553 - RNA, 64 nt, hsa; identical to SEQ ID NO: 41778

SEQ ID NO: 186554 - RNA, 64 nt, hsa; identical to SEQ ID NO: 41779

SEQ ID NO: 186555 - RNA, 64 nt, hsa; identical to SEQ ID NO: 41780

SEQ ID NO: 186556 - RNA, 64 nt, hsa; identical to SEQ ID NO: 41781

SEQ ID NO: 186557 - RNA, 64 nt, hsa; identical to SEQ ID NO: 41782

SEQ ID NO: 186558 - RNA, 64 nt, hsa; identical to SEQ ID NO: 41783

SEQ ID NO: 186559 - RNA, 64 nt, hsa; identical to SEQ ID NO: 41784

SEQ ID NO: 186560 - RNA, 64 nt, hsa; identical to SEQ ID NO: 41785

SEQ ID NO: 186561 - RNA, 64 nt, hsa; identical to SEQ ID NO: 41786

SEQ ID NO: 186562 - RNA, 64 nt, hsa; identical to SEQ ID NO: 41787

SEQ ID NO: 186563 - RNA, 64 nt, hsa; identical to SEQ ID NO: 41788

SEQ ID NO: 186564 - RNA, 64 nt, hsa; identical to SEQ ID NO: 41789

SEQ ID NO: 186565 - RNA, 64 nt, hsa; identical to SEQ ID NO: 41790

SEQ ID NO: 186566 - RNA, 64 nt, hsa; identical to SEQ ID NO: 41791

SEQ ID NO: 186567 - RNA, 64 nt, hsa; identical to SEQ ID NO: 41792

SEQ ID NO: 186568 - RNA, 64 nt, hsa; identical to SEQ ID NO: 41793

SEQ ID NO: 186569 - RNA, 64 nt, hsa; identical to SEQ ID NO: 41794

SEQ ID NO: 186570 - RNA, 64 nt, hsa; identical to SEQ ID NO: 41795

SEQ ID NO: 186571 - RNA, 64 nt, hsa; identical to SEQ ID NO: 41796

SEQ ID NO: 186572 - RNA, 64 nt, hsa; identical to SEQ ID NO: 41797

SEQ ID NO: 186573 - RNA, 64 nt, hsa; identical to SEQ ID NO: 41798

SEQ ID NO: 186574 - RNA, 64 nt, hsa; identical to SEQ ID NO: 41799

SEQ ID NO: 186575 - RNA, 64 nt, hsa; identical to SEQ ID NO: 41800

SEQ ID NO: 186576 - RNA, 64 nt, hsa; identical to SEQ ID NO: 41801

SEQ ID NO: 186577 - RNA, 64 nt, hsa; identical to SEQ ID NO: 41802

SEQ ID NO: 186578 - RNA, 64 nt, hsa; identical to SEQ ID NO: 41803

SEQ ID NO: 186579 - RNA, 64 nt, hsa; identical to SEQ ID NO: 41804

SEQ ID NO: 186580 - RNA, 64 nt, hsa; identical to SEQ ID NO: 41805

SEQ ID NO: 186581 - RNA, 64 nt, hsa; identical to SEQ ID NO: 41806

SEQ ID NO: 186582 - RNA, 64 nt, hsa; identical to SEQ ID NO: 41807

SEQ ID NO: 186583 - RNA, 64 nt, hsa; identical to SEQ ID NO: 41808

SEQ ID NO: 186584 - RNA, 64 nt, hsa; identical to SEQ ID NO: 41809

SEQ ID NO: 186585 - RNA, 64 nt, hsa; identical to SEQ ID NO: 41810

SEQ ID NO: 186586 - RNA, 64 nt, hsa; identical to SEQ ID NO: 41811

SEQ ID NO: 186587 - RNA, 64 nt, hsa; identical to SEQ ID NO: 41812

SEQ ID NO: 186588 - RNA, 64 nt, hsa; identical to SEQ ID NO: 41813

SEQ ID NO: 186589 - RNA, 64 nt, hsa; identical to SEQ ID NO: 41814

SEQ ID NO: 186590 - RNA, 64 nt, hsa; identical to SEQ ID NO: 41815

SEQ ID NO: 186591 - RNA, 64 nt, hsa; identical to SEQ ID NO: 41816

SEQ ID NO: 186592 - RNA, 64 nt, hsa; identical to SEQ ID NO: 41817

SEQ ID NO: 186593 - RNA, 64 nt, hsa; identical to SEQ ID NO: 41818

SEQ ID NO: 186594 - RNA, 64 nt, hsa; identical to SEQ ID NO: 41819

SEQ ID NO: 186595 - RNA, 64 nt, hsa; identical to SEQ ID NO: 41820

SEQ ID NO: 186596 - RNA, 64 nt, hsa; identical to SEQ ID NO: 41821

SEQ ID NO: 186597 - RNA, 64 nt, hsa; identical to SEQ ID NO: 41822

SEQ ID NO: 186598 - RNA, 64 nt, hsa; identical to SEQ ID NO: 41823

SEQ ID NO: 186599 - RNA, 64 nt, hsa; identical to SEQ ID NO: 41824

SEQ ID NO: 186600 - RNA, 64 nt, hsa; identical to SEQ ID NO: 41825

SEQ ID NO: 186601 - RNA, 64 nt, hsa; identical to SEQ ID NO: 41826

SEQ ID NO: 186602 - RNA, 64 nt, hsa; identical to SEQ ID NO: 41827

SEQ ID NO: 186603 - RNA, 64 nt, hsa; identical to SEQ ID NO: 41828

SEQ ID NO: 186604 - RNA, 64 nt, hsa; identical to SEQ ID NO: 41829

SEQ ID NO: 186605 - RNA, 64 nt, hsa; identical to SEQ ID NO: 41830

SEQ ID NO: 186606 - RNA, 64 nt, hsa; identical to SEQ ID NO: 41831

SEQ ID NO: 186607 - RNA, 64 nt, hsa; identical to SEQ ID NO: 41832

SEQ ID NO: 186608 - RNA, 64 nt, hsa; identical to SEQ ID NO: 41833

SEQ ID NO: 186609 - RNA, 64 nt, hsa; identical to SEQ ID NO: 41834

SEQ ID NO: 186610 - RNA, 64 nt, hsa; identical to SEQ ID NO: 41835

SEQ ID NO: 186611 - RNA, 64 nt, hsa; identical to SEQ ID NO: 41836

SEQ ID NO: 186612 - RNA, 64 nt, hsa; identical to SEQ ID NO: 41837

SEQ ID NO: 186613 - RNA, 64 nt, hsa; identical to SEQ ID NO: 41838

SEQ ID NO: 186614 - RNA, 64 nt, hsa; identical to SEQ ID NO: 41839

SEQ ID NO: 186615 - RNA, 64 nt, hsa; identical to SEQ ID NO: 41840

SEQ ID NO: 186616 - RNA, 64 nt, hsa; identical to SEQ ID NO: 41841

SEQ ID NO: 186617 - RNA, 64 nt, hsa; identical to SEQ ID NO: 41842

SEQ ID NO: 186618 - RNA, 64 nt, hsa; identical to SEQ ID NO: 41843

SEQ ID NO: 186619 - RNA, 64 nt, hsa; identical to SEQ ID NO: 41844

SEQ ID NO: 186620 - RNA, 64 nt, hsa; identical to SEQ ID NO: 41845

SEQ ID NO: 186621 - RNA, 64 nt, hsa; identical to SEQ ID NO: 41846

SEQ ID NO: 186622 - RNA, 64 nt, hsa; identical to SEQ ID NO: 41847

SEQ ID NO: 186623 - RNA, 64 nt, hsa; identical to SEQ ID NO: 41848

SEQ ID NO: 186624 - RNA, 64 nt, hsa; identical to SEQ ID NO: 41849

SEQ ID NO: 186625 - RNA, 64 nt, hsa; identical to SEQ ID NO: 41850

SEQ ID NO: 186626 - RNA, 64 nt, hsa; identical to SEQ ID NO: 41851

SEQ ID NO: 186627 - RNA, 64 nt, hsa; identical to SEQ ID NO: 41852

SEQ ID NO: 186628 - RNA, 64 nt, hsa; identical to SEQ ID NO: 41853

SEQ ID NO: 186629 - RNA, 64 nt, hsa; identical to SEQ ID NO: 41854

SEQ ID NO: 186630 - RNA, 64 nt, hsa; identical to SEQ ID NO: 41855

SEQ ID NO: 186631 - RNA, 64 nt, hsa; identical to SEQ ID NO: 41856

SEQ ID NO: 186632 - RNA, 64 nt, hsa; identical to SEQ ID NO: 41857

SEQ ID NO: 186633 - RNA, 64 nt, hsa; identical to SEQ ID NO: 41858

SEQ ID NO: 186634 - RNA, 64 nt, hsa; identical to SEQ ID NO: 41859

SEQ ID NO: 186635 - RNA, 64 nt, hsa; identical to SEQ ID NO: 41860

SEQ ID NO: 186636 - RNA, 64 nt, hsa; identical to SEQ ID NO: 41861

SEQ ID NO: 186637 - RNA, 64 nt, hsa; identical to SEQ ID NO: 41862

SEQ ID NO: 186638 - RNA, 64 nt, hsa; identical to SEQ ID NO: 41863

SEQ ID NO: 186639 - RNA, 64 nt, hsa; identical to SEQ ID NO: 41864

SEQ ID NO: 186640 - RNA, 64 nt, hsa; identical to SEQ ID NO: 41865

SEQ ID NO: 186641 - RNA, 64 nt, hsa; identical to SEQ ID NO: 41866

SEQ ID NO: 186642 - RNA, 64 nt, hsa; identical to SEQ ID NO: 41867

SEQ ID NO: 186643 - RNA, 64 nt, hsa; identical to SEQ ID NO: 41868

SEQ ID NO: 186644 - RNA, 64 nt, hsa; identical to SEQ ID NO: 41869

SEQ ID NO: 186645 - RNA, 64 nt, hsa; identical to SEQ ID NO: 41870

SEQ ID NO: 186646 - RNA, 64 nt, hsa; identical to SEQ ID NO: 41871

SEQ ID NO: 186647 - RNA, 64 nt, hsa; identical to SEQ ID NO: 41872

SEQ ID NO: 186648 - RNA, 64 nt, hsa; identical to SEQ ID NO: 41873

SEQ ID NO: 186649 - RNA, 64 nt, hsa; identical to SEQ ID NO: 41874

SEQ ID NO: 186650 - RNA, 64 nt, hsa; identical to SEQ ID NO: 41875

SEQ ID NO: 186651 - RNA, 64 nt, hsa; identical to SEQ ID NO: 41876

SEQ ID NO: 186652 - RNA, 64 nt, hsa; identical to SEQ ID NO: 41877

SEQ ID NO: 186653 - RNA, 64 nt, hsa; identical to SEQ ID NO: 41878

SEQ ID NO: 186654 - RNA, 64 nt, hsa; identical to SEQ ID NO: 41879

SEQ ID NO: 186655 - RNA, 64 nt, hsa; identical to SEQ ID NO: 41880

SEQ ID NO: 186656 - RNA, 64 nt, hsa; identical to SEQ ID NO: 41881

SEQ ID NO: 186657 - RNA, 64 nt, hsa; identical to SEQ ID NO: 41882

SEQ ID NO: 186658 - RNA, 64 nt, hsa; identical to SEQ ID NO: 41883

SEQ ID NO: 186659 - RNA, 64 nt, hsa; identical to SEQ ID NO: 41884

SEQ ID NO: 186660 - RNA, 64 nt, hsa; identical to SEQ ID NO: 41885

SEQ ID NO: 186661 - RNA, 64 nt, hsa; identical to SEQ ID NO: 41886

SEQ ID NO: 186662 - RNA, 64 nt, hsa; identical to SEQ ID NO: 41887

SEQ ID NO: 186663 - RNA, 64 nt, hsa; identical to SEQ ID NO: 41888

SEQ ID NO: 186664 - RNA, 64 nt, hsa; identical to SEQ ID NO: 41889

SEQ ID NO: 186665 - RNA, 64 nt, hsa; identical to SEQ ID NO: 41890

SEQ ID NO: 186666 - RNA, 64 nt, hsa; identical to SEQ ID NO: 41891

SEQ ID NO: 186667 - RNA, 64 nt, hsa; identical to SEQ ID NO: 41892

SEQ ID NO: 186668 - RNA, 64 nt, hsa; identical to SEQ ID NO: 41893

SEQ ID NO: 186669 - RNA, 64 nt, hsa; identical to SEQ ID NO: 41894

SEQ ID NO: 186670 - RNA, 64 nt, hsa; identical to SEQ ID NO: 41895

SEQ ID NO: 186671 - RNA, 64 nt, hsa; identical to SEQ ID NO: 41896

SEQ ID NO: 186672 - RNA, 64 nt, hsa; identical to SEQ ID NO: 41897

SEQ ID NO: 186673 - RNA, 64 nt, hsa; identical to SEQ ID NO: 41898

SEQ ID NO: 186674 - RNA, 64 nt, hsa; identical to SEQ ID NO: 41899

SEQ ID NO: 186675 - RNA, 64 nt, hsa; identical to SEQ ID NO: 41900

SEQ ID NO: 186676 - RNA, 64 nt, hsa; identical to SEQ ID NO: 41901

SEQ ID NO: 186677 - RNA, 64 nt, hsa; identical to SEQ ID NO: 41902

SEQ ID NO: 186678 - RNA, 64 nt, hsa; identical to SEQ ID NO: 41903

SEQ ID NO: 186679 - RNA, 64 nt, hsa; identical to SEQ ID NO: 41904

SEQ ID NO: 186680 - RNA, 64 nt, hsa; identical to SEQ ID NO: 41905

SEQ ID NO: 186681 - RNA, 64 nt, hsa; identical to SEQ ID NO: 41906

SEQ ID NO: 186682 - RNA, 64 nt, hsa; identical to SEQ ID NO: 41907

SEQ ID NO: 186683 - RNA, 64 nt, hsa; identical to SEQ ID NO: 41908

SEQ ID NO: 186684 - RNA, 64 nt, hsa; identical to SEQ ID NO: 41909

SEQ ID NO: 186685 - RNA, 64 nt, hsa; identical to SEQ ID NO: 41910

SEQ ID NO: 186686 - RNA, 64 nt, hsa; identical to SEQ ID NO: 41911

SEQ ID NO: 186687 - RNA, 64 nt, hsa; identical to SEQ ID NO: 41912

SEQ ID NO: 186688 - RNA, 64 nt, hsa; identical to SEQ ID NO: 41913

SEQ ID NO: 186689 - RNA, 64 nt, hsa; identical to SEQ ID NO: 41914

SEQ ID NO: 186690 - RNA, 64 nt, hsa; identical to SEQ ID NO: 41915

SEQ ID NO: 186691 - RNA, 64 nt, hsa; identical to SEQ ID NO: 41916

SEQ ID NO: 186692 - RNA, 64 nt, hsa; identical to SEQ ID NO: 41917

SEQ ID NO: 186693 - RNA, 64 nt, hsa; identical to SEQ ID NO: 41918

SEQ ID NO: 186694 - RNA, 64 nt, hsa; identical to SEQ ID NO: 41919

SEQ ID NO: 186695 - RNA, 64 nt, hsa; identical to SEQ ID NO: 41920

SEQ ID NO: 186696 - RNA, 64 nt, hsa; identical to SEQ ID NO: 41921

SEQ ID NO: 186697 - RNA, 64 nt, hsa; identical to SEQ ID NO: 41922

SEQ ID NO: 186698 - RNA, 64 nt, hsa; identical to SEQ ID NO: 41923

SEQ ID NO: 186699 - RNA, 64 nt, hsa; identical to SEQ ID NO: 41924

SEQ ID NO: 186700 - RNA, 64 nt, hsa; identical to SEQ ID NO: 41925

SEQ ID NO: 186701 - RNA, 64 nt, hsa; identical to SEQ ID NO: 41926

SEQ ID NO: 186702 - RNA, 64 nt, hsa; identical to SEQ ID NO: 41927

SEQ ID NO: 186703 - RNA, 64 nt, hsa; identical to SEQ ID NO: 41928

SEQ ID NO: 186704 - RNA, 64 nt, hsa; identical to SEQ ID NO: 41929

SEQ ID NO: 186705 - RNA, 64 nt, hsa; identical to SEQ ID NO: 41930

SEQ ID NO: 186706 - RNA, 64 nt, hsa; identical to SEQ ID NO: 41931

SEQ ID NO: 186707 - RNA, 64 nt, hsa; identical to SEQ ID NO: 41932

SEQ ID NO: 186708 - RNA, 64 nt, hsa; identical to SEQ ID NO: 41933

SEQ ID NO: 186709 - RNA, 64 nt, hsa; identical to SEQ ID NO: 41934

SEQ ID NO: 186710 - RNA, 64 nt, hsa; identical to SEQ ID NO: 41935

SEQ ID NO: 186711 - RNA, 64 nt, hsa; identical to SEQ ID NO: 41936

SEQ ID NO: 186712 - RNA, 64 nt, hsa; identical to SEQ ID NO: 41937

SEQ ID NO: 186713 - RNA, 64 nt, hsa; identical to SEQ ID NO: 41938

SEQ ID NO: 186714 - RNA, 64 nt, hsa; identical to SEQ ID NO: 41939

SEQ ID NO: 186715 - RNA, 64 nt, hsa; identical to SEQ ID NO: 41940

SEQ ID NO: 186716 - RNA, 64 nt, hsa; identical to SEQ ID NO: 41941

SEQ ID NO: 186717 - RNA, 64 nt, hsa; identical to SEQ ID NO: 41942

SEQ ID NO: 186718 - RNA, 64 nt, hsa; identical to SEQ ID NO: 41943

SEQ ID NO: 186719 - RNA, 64 nt, hsa; identical to SEQ ID NO: 41944

SEQ ID NO: 186720 - RNA, 64 nt, hsa; identical to SEQ ID NO: 41945

SEQ ID NO: 186721 - RNA, 64 nt, hsa; identical to SEQ ID NO: 41946

SEQ ID NO: 186722 - RNA, 64 nt, hsa; identical to SEQ ID NO: 41947

SEQ ID NO: 186723 - RNA, 64 nt, hsa; identical to SEQ ID NO: 41948

SEQ ID NO: 186724 - RNA, 64 nt, hsa; identical to SEQ ID NO: 41949

SEQ ID NO: 186725 - RNA, 64 nt, hsa; identical to SEQ ID NO: 41950

SEQ ID NO: 186726 - RNA, 64 nt, hsa; identical to SEQ ID NO: 41951

SEQ ID NO: 186727 - RNA, 64 nt, hsa; identical to SEQ ID NO: 41952

SEQ ID NO: 186728 - RNA, 64 nt, hsa; identical to SEQ ID NO: 41953

SEQ ID NO: 186729 - RNA, 64 nt, hsa; identical to SEQ ID NO: 41954

SEQ ID NO: 186730 - RNA, 64 nt, hsa; identical to SEQ ID NO: 41955

SEQ ID NO: 186731 - RNA, 64 nt, hsa; identical to SEQ ID NO: 41956

SEQ ID NO: 186732 - RNA, 64 nt, hsa; identical to SEQ ID NO: 41957

SEQ ID NO: 186733 - RNA, 64 nt, hsa; identical to SEQ ID NO: 41958

SEQ ID NO: 186734 - RNA, 64 nt, hsa; identical to SEQ ID NO: 41959

SEQ ID NO: 186735 - RNA, 64 nt, hsa; identical to SEQ ID NO: 41960

SEQ ID NO: 186736 - RNA, 64 nt, hsa; identical to SEQ ID NO: 41961

SEQ ID NO: 186737 - RNA, 64 nt, hsa; identical to SEQ ID NO: 41962

SEQ ID NO: 186738 - RNA, 64 nt, hsa; identical to SEQ ID NO: 41963

SEQ ID NO: 186739 - RNA, 64 nt, hsa; identical to SEQ ID NO: 41964

SEQ ID NO: 186740 - RNA, 64 nt, hsa; identical to SEQ ID NO: 41965

SEQ ID NO: 186741 - RNA, 64 nt, hsa; identical to SEQ ID NO: 41966

SEQ ID NO: 186742 - RNA, 64 nt, hsa; identical to SEQ ID NO: 41967

SEQ ID NO: 186743 - RNA, 64 nt, hsa; identical to SEQ ID NO: 41968

SEQ ID NO: 186744 - RNA, 64 nt, hsa; identical to SEQ ID NO: 41969

SEQ ID NO: 186745 - RNA, 64 nt, hsa; identical to SEQ ID NO: 41970

SEQ ID NO: 186746 - RNA, 64 nt, hsa; identical to SEQ ID NO: 41971

SEQ ID NO: 186747 - RNA, 64 nt, hsa; identical to SEQ ID NO: 41972

SEQ ID NO: 186748 - RNA, 64 nt, hsa; identical to SEQ ID NO: 41973

SEQ ID NO: 186749 - RNA, 64 nt, hsa; identical to SEQ ID NO: 41974

SEQ ID NO: 186750 - RNA, 64 nt, hsa; identical to SEQ ID NO: 41975

SEQ ID NO: 186751 - RNA, 64 nt, hsa; identical to SEQ ID NO: 41976

SEQ ID NO: 186752 - RNA, 64 nt, hsa; identical to SEQ ID NO: 41977

SEQ ID NO: 186753 - RNA, 64 nt, hsa; identical to SEQ ID NO: 41978

SEQ ID NO: 186754 - RNA, 64 nt, hsa; identical to SEQ ID NO: 41979

SEQ ID NO: 186755 - RNA, 64 nt, hsa; identical to SEQ ID NO: 41980

SEQ ID NO: 186756 - RNA, 64 nt, hsa; identical to SEQ ID NO: 41981

SEQ ID NO: 186757 - RNA, 64 nt, hsa; identical to SEQ ID NO: 41982

SEQ ID NO: 186758 - RNA, 64 nt, hsa; identical to SEQ ID NO: 41983

SEQ ID NO: 186759 - RNA, 64 nt, hsa; identical to SEQ ID NO: 41984

SEQ ID NO: 186760 - RNA, 64 nt, hsa; identical to SEQ ID NO: 41985

SEQ ID NO: 186761 - RNA, 64 nt, hsa; identical to SEQ ID NO: 41986

SEQ ID NO: 186762 - RNA, 64 nt, hsa; identical to SEQ ID NO: 41987

SEQ ID NO: 186763 - RNA, 64 nt, hsa; identical to SEQ ID NO: 41988

SEQ ID NO: 186764 - RNA, 64 nt, hsa; identical to SEQ ID NO: 41989

SEQ ID NO: 186765 - RNA, 64 nt, hsa; identical to SEQ ID NO: 41990

SEQ ID NO: 186766 - RNA, 64 nt, hsa; identical to SEQ ID NO: 41991

SEQ ID NO: 186767 - RNA, 64 nt, hsa; identical to SEQ ID NO: 41992

SEQ ID NO: 186768 - RNA, 64 nt, hsa; identical to SEQ ID NO: 41993

SEQ ID NO: 186769 - RNA, 64 nt, hsa; identical to SEQ ID NO: 41994

SEQ ID NO: 186770 - RNA, 64 nt, hsa; identical to SEQ ID NO: 41995

SEQ ID NO: 186771 - RNA, 64 nt, hsa; identical to SEQ ID NO: 41996

SEQ ID NO: 186772 - RNA, 64 nt, hsa; identical to SEQ ID NO: 41997

SEQ ID NO: 186773 - RNA, 64 nt, hsa; identical to SEQ ID NO: 41998

SEQ ID NO: 186774 - RNA, 64 nt, hsa; identical to SEQ ID NO: 41999

SEQ ID NO: 186775 - RNA, 64 nt, hsa; identical to SEQ ID NO: 42000

SEQ ID NO: 186776 - RNA, 64 nt, hsa; identical to SEQ ID NO: 42001

SEQ ID NO: 186777 - RNA, 64 nt, hsa; identical to SEQ ID NO: 42002

SEQ ID NO: 186778 - RNA, 64 nt, hsa; identical to SEQ ID NO: 42003

SEQ ID NO: 186779 - RNA, 64 nt, hsa; identical to SEQ ID NO: 42004

SEQ ID NO: 186780 - RNA, 64 nt, hsa; identical to SEQ ID NO: 42005

SEQ ID NO: 186781 - RNA, 64 nt, hsa; identical to SEQ ID NO: 42006

SEQ ID NO: 186782 - RNA, 64 nt, hsa; identical to SEQ ID NO: 42007

SEQ ID NO: 186783 - RNA, 64 nt, hsa; identical to SEQ ID NO: 42008

SEQ ID NO: 186784 - RNA, 64 nt, hsa; identical to SEQ ID NO: 42009

SEQ ID NO: 186785 - RNA, 64 nt, hsa; identical to SEQ ID NO: 42010

SEQ ID NO: 186786 - RNA, 64 nt, hsa; identical to SEQ ID NO: 42011

SEQ ID NO: 186787 - RNA, 64 nt, hsa; identical to SEQ ID NO: 42012

SEQ ID NO: 186788 - RNA, 64 nt, hsa; identical to SEQ ID NO: 42013

SEQ ID NO: 186789 - RNA, 64 nt, hsa; identical to SEQ ID NO: 42014

SEQ ID NO: 186790 - RNA, 64 nt, hsa; identical to SEQ ID NO: 42015

SEQ ID NO: 186791 - RNA, 64 nt, hsa; identical to SEQ ID NO: 42016

SEQ ID NO: 186792 - RNA, 64 nt, hsa; identical to SEQ ID NO: 42017

SEQ ID NO: 186793 - RNA, 64 nt, hsa; identical to SEQ ID NO: 42018

SEQ ID NO: 186794 - RNA, 64 nt, hsa; identical to SEQ ID NO: 42019

SEQ ID NO: 186795 - RNA, 64 nt, hsa; identical to SEQ ID NO: 42020

SEQ ID NO: 186796 - RNA, 64 nt, hsa; identical to SEQ ID NO: 42021

SEQ ID NO: 186797 - RNA, 64 nt, hsa; identical to SEQ ID NO: 42022

SEQ ID NO: 186798 - RNA, 64 nt, hsa; identical to SEQ ID NO: 42023

SEQ ID NO: 186799 - RNA, 64 nt, hsa; identical to SEQ ID NO: 42024

SEQ ID NO: 186800 - RNA, 64 nt, hsa; identical to SEQ ID NO: 42025

SEQ ID NO: 186801 - RNA, 64 nt, hsa; identical to SEQ ID NO: 42026

SEQ ID NO: 186802 - RNA, 64 nt, hsa; identical to SEQ ID NO: 42027

SEQ ID NO: 186803 - RNA, 64 nt, hsa; identical to SEQ ID NO: 42028

SEQ ID NO: 186804 - RNA, 64 nt, hsa; identical to SEQ ID NO: 42029

SEQ ID NO: 186805 - RNA, 64 nt, hsa; identical to SEQ ID NO: 42030

SEQ ID NO: 186806 - RNA, 64 nt, hsa; identical to SEQ ID NO: 42031

SEQ ID NO: 186807 - RNA, 64 nt, hsa; identical to SEQ ID NO: 42032

SEQ ID NO: 186808 - RNA, 64 nt, hsa; identical to SEQ ID NO: 42033

SEQ ID NO: 186809 - RNA, 64 nt, hsa; identical to SEQ ID NO: 42034

SEQ ID NO: 186810 - RNA, 64 nt, hsa; identical to SEQ ID NO: 42035

SEQ ID NO: 186811 - RNA, 64 nt, hsa; identical to SEQ ID NO: 42036

SEQ ID NO: 186812 - RNA, 64 nt, hsa; identical to SEQ ID NO: 42037

SEQ ID NO: 186813 - RNA, 64 nt, hsa; identical to SEQ ID NO: 42038

SEQ ID NO: 186814 - RNA, 64 nt, hsa; identical to SEQ ID NO: 42039

SEQ ID NO: 186815 - RNA, 64 nt, hsa; identical to SEQ ID NO: 42040

SEQ ID NO: 186816 - RNA, 64 nt, hsa; identical to SEQ ID NO: 42041

SEQ ID NO: 186817 - RNA, 64 nt, hsa; identical to SEQ ID NO: 42042

SEQ ID NO: 186818 - RNA, 64 nt, hsa; identical to SEQ ID NO: 42043

SEQ ID NO: 186819 - RNA, 64 nt, hsa; identical to SEQ ID NO: 42044

SEQ ID NO: 186820 - RNA, 64 nt, hsa; identical to SEQ ID NO: 42045

SEQ ID NO: 186821 - RNA, 64 nt, hsa; identical to SEQ ID NO: 42046

SEQ ID NO: 186822 - RNA, 64 nt, hsa; identical to SEQ ID NO: 42047

SEQ ID NO: 186823 - RNA, 64 nt, hsa; identical to SEQ ID NO: 42048

SEQ ID NO: 186824 - RNA, 64 nt, hsa; identical to SEQ ID NO: 42049

SEQ ID NO: 186825 - RNA, 64 nt, hsa; identical to SEQ ID NO: 42050

SEQ ID NO: 186826 - RNA, 64 nt, hsa; identical to SEQ ID NO: 42051

SEQ ID NO: 186827 - RNA, 64 nt, hsa; identical to SEQ ID NO: 42052

SEQ ID NO: 186828 - RNA, 64 nt, hsa; identical to SEQ ID NO: 42053

SEQ ID NO: 186829 - RNA, 64 nt, hsa; identical to SEQ ID NO: 42054

SEQ ID NO: 186830 - RNA, 64 nt, hsa; identical to SEQ ID NO: 42055

SEQ ID NO: 186831 - RNA, 64 nt, hsa; identical to SEQ ID NO: 42056

SEQ ID NO: 186832 - RNA, 64 nt, hsa; identical to SEQ ID NO: 42057

SEQ ID NO: 186833 - RNA, 64 nt, hsa; identical to SEQ ID NO: 42058

SEQ ID NO: 186834 - RNA, 64 nt, hsa; identical to SEQ ID NO: 42059

SEQ ID NO: 186835 - RNA, 64 nt, hsa; identical to SEQ ID NO: 42060

SEQ ID NO: 186836 - RNA, 64 nt, hsa; identical to SEQ ID NO: 42061

SEQ ID NO: 186837 - RNA, 64 nt, hsa; identical to SEQ ID NO: 42062

SEQ ID NO: 186838 - RNA, 64 nt, hsa; identical to SEQ ID NO: 42063

SEQ ID NO: 186839 - RNA, 64 nt, hsa; identical to SEQ ID NO: 42064

SEQ ID NO: 186840 - RNA, 64 nt, hsa; identical to SEQ ID NO: 42065

SEQ ID NO: 186841 - RNA, 64 nt, hsa; identical to SEQ ID NO: 42066

SEQ ID NO: 186842 - RNA, 64 nt, hsa; identical to SEQ ID NO: 42067

SEQ ID NO: 186843 - RNA, 64 nt, hsa; identical to SEQ ID NO: 42068

SEQ ID NO: 186844 - RNA, 64 nt, hsa; identical to SEQ ID NO: 42069

SEQ ID NO: 186845 - RNA, 64 nt, hsa; identical to SEQ ID NO: 42070

SEQ ID NO: 186846 - RNA, 64 nt, hsa; identical to SEQ ID NO: 42071

SEQ ID NO: 186847 - RNA, 64 nt, hsa; identical to SEQ ID NO: 42072

SEQ ID NO: 186848 - RNA, 64 nt, hsa; identical to SEQ ID NO: 42073

SEQ ID NO: 186849 - RNA, 64 nt, hsa; identical to SEQ ID NO: 42074

SEQ ID NO: 186850 - RNA, 64 nt, hsa; identical to SEQ ID NO: 42075

SEQ ID NO: 186851 - RNA, 64 nt, hsa; identical to SEQ ID NO: 42076

SEQ ID NO: 186852 - RNA, 64 nt, hsa; identical to SEQ ID NO: 42077

SEQ ID NO: 186853 - RNA, 64 nt, hsa; identical to SEQ ID NO: 42078

SEQ ID NO: 186854 - RNA, 64 nt, hsa; identical to SEQ ID NO: 42079

SEQ ID NO: 186855 - RNA, 64 nt, hsa; identical to SEQ ID NO: 42080

SEQ ID NO: 186856 - RNA, 64 nt, hsa; identical to SEQ ID NO: 42081

SEQ ID NO: 186857 - RNA, 64 nt, hsa; identical to SEQ ID NO: 42082

SEQ ID NO: 186858 - RNA, 64 nt, hsa; identical to SEQ ID NO: 42083

SEQ ID NO: 186859 - RNA, 64 nt, hsa; identical to SEQ ID NO: 42084

SEQ ID NO: 186860 - RNA, 64 nt, hsa; identical to SEQ ID NO: 42085

SEQ ID NO: 186861 - RNA, 64 nt, hsa; identical to SEQ ID NO: 42086

SEQ ID NO: 186862 - RNA, 64 nt, hsa; identical to SEQ ID NO: 42087

SEQ ID NO: 186863 - RNA, 64 nt, hsa; identical to SEQ ID NO: 42088

SEQ ID NO: 186864 - RNA, 64 nt, hsa; identical to SEQ ID NO: 42089

SEQ ID NO: 186865 - RNA, 64 nt, hsa; identical to SEQ ID NO: 42090

SEQ ID NO: 186866 - RNA, 64 nt, hsa; identical to SEQ ID NO: 42091

SEQ ID NO: 186867 - RNA, 64 nt, hsa; identical to SEQ ID NO: 42092

SEQ ID NO: 186868 - RNA, 64 nt, hsa; identical to SEQ ID NO: 42093

SEQ ID NO: 186869 - RNA, 64 nt, hsa; identical to SEQ ID NO: 42094

SEQ ID NO: 186870 - RNA, 64 nt, hsa; identical to SEQ ID NO: 42095

SEQ ID NO: 186871 - RNA, 64 nt, hsa; identical to SEQ ID NO: 42096

SEQ ID NO: 186872 - RNA, 64 nt, hsa; identical to SEQ ID NO: 42097

SEQ ID NO: 186873 - RNA, 64 nt, hsa; identical to SEQ ID NO: 42098

SEQ ID NO: 186874 - RNA, 64 nt, hsa; identical to SEQ ID NO: 42099

SEQ ID NO: 186875 - RNA, 64 nt, hsa; identical to SEQ ID NO: 42100

SEQ ID NO: 186876 - RNA, 64 nt, hsa; identical to SEQ ID NO: 42101

SEQ ID NO: 186877 - RNA, 64 nt, hsa; identical to SEQ ID NO: 41907

SEQ ID NO: 186878 - RNA, 64 nt, hsa; identical to SEQ ID NO: 41906

SEQ ID NO: 186879 - RNA, 64 nt, hsa; identical to SEQ ID NO: 41905

SEQ ID NO: 186880 - RNA, 64 nt, hsa; identical to SEQ ID NO: 41904

SEQ ID NO: 186881 - RNA, 64 nt, hsa; identical to SEQ ID NO: 42106

SEQ ID NO: 186882 - RNA, 64 nt, hsa; identical to SEQ ID NO: 42107

SEQ ID NO: 186883 - RNA, 64 nt, hsa; identical to SEQ ID NO: 42108

SEQ ID NO: 186884 - RNA, 64 nt, hsa; identical to SEQ ID NO: 42109

SEQ ID NO: 186885 - RNA, 64 nt, hsa; identical to SEQ ID NO: 42110

SEQ ID NO: 186886 - RNA, 64 nt, hsa; identical to SEQ ID NO: 42111

SEQ ID NO: 186887 - RNA, 64 nt, hsa; identical to SEQ ID NO: 42112

SEQ ID NO: 186888 - RNA, 64 nt, hsa; identical to SEQ ID NO: 42113

SEQ ID NO: 186889 - RNA, 64 nt, hsa; identical to SEQ ID NO: 42114

SEQ ID NO: 186890 - RNA, 64 nt, hsa; identical to SEQ ID NO: 42115

SEQ ID NO: 186891 - RNA, 64 nt, hsa; identical to SEQ ID NO: 42116

SEQ ID NO: 186892 - RNA, 64 nt, hsa; identical to SEQ ID NO: 42117

SEQ ID NO: 186893 - RNA, 64 nt, hsa; identical to SEQ ID NO: 42118

SEQ ID NO: 186894 - RNA, 64 nt, hsa; identical to SEQ ID NO: 42119

SEQ ID NO: 186895 - RNA, 64 nt, hsa; identical to SEQ ID NO: 42120

SEQ ID NO: 186896 - RNA, 64 nt, hsa; identical to SEQ ID NO: 42121

SEQ ID NO: 186897 - RNA, 64 nt, hsa; identical to SEQ ID NO: 42122

SEQ ID NO: 186898 - RNA, 64 nt, hsa; identical to SEQ ID NO: 42123

SEQ ID NO: 186899 - RNA, 64 nt, hsa; identical to SEQ ID NO: 42124

SEQ ID NO: 186900 - RNA, 64 nt, hsa; identical to SEQ ID NO: 42125

SEQ ID NO: 186901 - RNA, 64 nt, hsa; identical to SEQ ID NO: 42126

SEQ ID NO: 186902 - RNA, 64 nt, hsa; identical to SEQ ID NO: 42127

SEQ ID NO: 186903 - RNA, 64 nt, hsa; identical to SEQ ID NO: 42128

SEQ ID NO: 186904 - RNA, 64 nt, hsa; identical to SEQ ID NO: 42129

SEQ ID NO: 186905 - RNA, 64 nt, hsa; identical to SEQ ID NO: 42130

SEQ ID NO: 186906 - RNA, 64 nt, hsa; identical to SEQ ID NO: 42131

SEQ ID NO: 186907 - RNA, 64 nt, hsa; identical to SEQ ID NO: 42132

SEQ ID NO: 186908 - RNA, 64 nt, hsa; identical to SEQ ID NO: 42133

SEQ ID NO: 186909 - RNA, 64 nt, hsa; identical to SEQ ID NO: 42134

SEQ ID NO: 186910 - RNA, 64 nt, hsa; identical to SEQ ID NO: 42135

SEQ ID NO: 186911 - RNA, 64 nt, hsa; identical to SEQ ID NO: 42136

SEQ ID NO: 186912 - RNA, 64 nt, hsa; identical to SEQ ID NO: 42137

SEQ ID NO: 186913 - RNA, 64 nt, hsa; identical to SEQ ID NO: 42138

SEQ ID NO: 186914 - RNA, 64 nt, hsa; identical to SEQ ID NO: 42139

SEQ ID NO: 186915 - RNA, 64 nt, hsa; identical to SEQ ID NO: 42140

SEQ ID NO: 186916 - RNA, 64 nt, hsa; identical to SEQ ID NO: 42141

SEQ ID NO: 186917 - RNA, 64 nt, hsa; identical to SEQ ID NO: 42142

SEQ ID NO: 186918 - RNA, 64 nt, hsa; identical to SEQ ID NO: 42143

SEQ ID NO: 186919 - RNA, 64 nt, hsa; identical to SEQ ID NO: 42144

SEQ ID NO: 186920 - RNA, 64 nt, hsa; identical to SEQ ID NO: 42145

SEQ ID NO: 186921 - RNA, 64 nt, hsa; identical to SEQ ID NO: 42146

SEQ ID NO: 186922 - RNA, 64 nt, hsa; identical to SEQ ID NO: 42147

SEQ ID NO: 186923 - RNA, 64 nt, hsa; identical to SEQ ID NO: 42148

SEQ ID NO: 186924 - RNA, 64 nt, hsa; identical to SEQ ID NO: 42149

SEQ ID NO: 186925 - RNA, 64 nt, hsa; identical to SEQ ID NO: 42150

SEQ ID NO: 186926 - RNA, 64 nt, hsa; identical to SEQ ID NO: 42151

SEQ ID NO: 186927 - RNA, 64 nt, hsa; identical to SEQ ID NO: 42152

SEQ ID NO: 186928 - RNA, 64 nt, hsa; identical to SEQ ID NO: 42153

SEQ ID NO: 186929 - RNA, 64 nt, hsa; identical to SEQ ID NO: 42154

SEQ ID NO: 186930 - RNA, 64 nt, hsa; identical to SEQ ID NO: 42155

SEQ ID NO: 186931 - RNA, 64 nt, hsa; identical to SEQ ID NO: 42156

SEQ ID NO: 186932 - RNA, 64 nt, hsa; identical to SEQ ID NO: 42157

SEQ ID NO: 186933 - RNA, 64 nt, hsa; identical to SEQ ID NO: 42158

SEQ ID NO: 186934 - RNA, 64 nt, hsa; identical to SEQ ID NO: 42159

SEQ ID NO: 186935 - RNA, 64 nt, hsa; identical to SEQ ID NO: 42160

SEQ ID NO: 186936 - RNA, 64 nt, hsa; identical to SEQ ID NO: 42161

SEQ ID NO: 186937 - RNA, 64 nt, hsa; identical to SEQ ID NO: 42162

SEQ ID NO: 186938 - RNA, 64 nt, hsa; identical to SEQ ID NO: 42163

SEQ ID NO: 186939 - RNA, 64 nt, hsa; identical to SEQ ID NO: 42164

SEQ ID NO: 186940 - RNA, 64 nt, hsa; identical to SEQ ID NO: 42165

SEQ ID NO: 186941 - RNA, 64 nt, hsa; identical to SEQ ID NO: 42166

SEQ ID NO: 186942 - RNA, 64 nt, hsa; identical to SEQ ID NO: 42167

SEQ ID NO: 186943 - RNA, 64 nt, hsa; identical to SEQ ID NO: 42168

SEQ ID NO: 186944 - RNA, 64 nt, hsa; identical to SEQ ID NO: 42169

SEQ ID NO: 186945 - RNA, 64 nt, hsa; identical to SEQ ID NO: 42170

SEQ ID NO: 186946 - RNA, 64 nt, hsa; identical to SEQ ID NO: 42171

SEQ ID NO: 186947 - RNA, 64 nt, hsa; identical to SEQ ID NO: 42172

SEQ ID NO: 186948 - RNA, 64 nt, hsa; identical to SEQ ID NO: 42173

SEQ ID NO: 186949 - RNA, 64 nt, hsa; identical to SEQ ID NO: 42174

SEQ ID NO: 186950 - RNA, 64 nt, hsa; identical to SEQ ID NO: 42175

SEQ ID NO: 186951 - RNA, 64 nt, hsa; identical to SEQ ID NO: 42176

SEQ ID NO: 186952 - RNA, 64 nt, hsa; identical to SEQ ID NO: 42177

SEQ ID NO: 186953 - RNA, 64 nt, hsa; identical to SEQ ID NO: 42178

SEQ ID NO: 186954 - RNA, 64 nt, hsa; identical to SEQ ID NO: 42179

SEQ ID NO: 186955 - RNA, 64 nt, hsa; identical to SEQ ID NO: 42180

SEQ ID NO: 186956 - RNA, 64 nt, hsa; identical to SEQ ID NO: 42181

SEQ ID NO: 186957 - RNA, 64 nt, hsa; identical to SEQ ID NO: 42182

SEQ ID NO: 186958 - RNA, 64 nt, hsa; identical to SEQ ID NO: 42183

SEQ ID NO: 186959 - RNA, 64 nt, hsa; identical to SEQ ID NO: 42184

SEQ ID NO: 186960 - RNA, 64 nt, hsa; identical to SEQ ID NO: 42185

SEQ ID NO: 186961 - RNA, 64 nt, hsa; identical to SEQ ID NO: 42186

SEQ ID NO: 186962 - RNA, 64 nt, hsa; identical to SEQ ID NO: 42187

SEQ ID NO: 186963 - RNA, 64 nt, hsa; identical to SEQ ID NO: 42188

SEQ ID NO: 186964 - RNA, 64 nt, hsa; identical to SEQ ID NO: 42189

SEQ ID NO: 186965 - RNA, 64 nt, hsa; identical to SEQ ID NO: 42190

SEQ ID NO: 186966 - RNA, 64 nt, hsa; identical to SEQ ID NO: 42191

SEQ ID NO: 186967 - RNA, 64 nt, hsa; identical to SEQ ID NO: 42192

SEQ ID NO: 186968 - RNA, 64 nt, hsa; identical to SEQ ID NO: 42193

SEQ ID NO: 186969 - RNA, 64 nt, hsa; identical to SEQ ID NO: 42194

SEQ ID NO: 186970 - RNA, 64 nt, hsa; identical to SEQ ID NO: 42195

SEQ ID NO: 186971 - RNA, 64 nt, hsa; identical to SEQ ID NO: 42196

SEQ ID NO: 186972 - RNA, 64 nt, hsa; identical to SEQ ID NO: 42197

SEQ ID NO: 186973 - RNA, 64 nt, hsa; identical to SEQ ID NO: 42198

SEQ ID NO: 186974 - RNA, 64 nt, hsa; identical to SEQ ID NO: 42199

SEQ ID NO: 186975 - RNA, 64 nt, hsa; identical to SEQ ID NO: 42200

SEQ ID NO: 186976 - RNA, 64 nt, hsa; identical to SEQ ID NO: 42201

SEQ ID NO: 186977 - RNA, 64 nt, hsa; identical to SEQ ID NO: 42202

SEQ ID NO: 186978 - RNA, 64 nt, hsa; identical to SEQ ID NO: 42203

SEQ ID NO: 186979 - RNA, 64 nt, hsa; identical to SEQ ID NO: 42204

SEQ ID NO: 186980 - RNA, 64 nt, hsa; identical to SEQ ID NO: 42205

SEQ ID NO: 186981 - RNA, 64 nt, hsa; identical to SEQ ID NO: 42206

SEQ ID NO: 186982 - RNA, 64 nt, hsa; identical to SEQ ID NO: 42207

SEQ ID NO: 186983 - RNA, 64 nt, hsa; identical to SEQ ID NO: 42208

SEQ ID NO: 186984 - RNA, 64 nt, hsa; identical to SEQ ID NO: 42209

SEQ ID NO: 186985 - RNA, 64 nt, hsa; identical to SEQ ID NO: 42210

SEQ ID NO: 186986 - RNA, 64 nt, hsa; identical to SEQ ID NO: 42211

SEQ ID NO: 186987 - RNA, 64 nt, hsa; identical to SEQ ID NO: 42212

SEQ ID NO: 186988 - RNA, 64 nt, hsa; identical to SEQ ID NO: 42213

SEQ ID NO: 186989 - RNA, 64 nt, hsa; identical to SEQ ID NO: 42214

SEQ ID NO: 186990 - RNA, 64 nt, hsa; identical to SEQ ID NO: 42215

SEQ ID NO: 186991 - RNA, 64 nt, hsa; identical to SEQ ID NO: 42216

SEQ ID NO: 186992 - RNA, 64 nt, hsa; identical to SEQ ID NO: 42217

SEQ ID NO: 186993 - RNA, 64 nt, hsa; identical to SEQ ID NO: 42218

SEQ ID NO: 186994 - RNA, 64 nt, hsa; identical to SEQ ID NO: 42219

SEQ ID NO: 186995 - RNA, 64 nt, hsa; identical to SEQ ID NO: 42220

SEQ ID NO: 186996 - RNA, 64 nt, hsa; identical to SEQ ID NO: 42221

SEQ ID NO: 186997 - RNA, 64 nt, hsa; identical to SEQ ID NO: 42222

SEQ ID NO: 186998 - RNA, 64 nt, hsa; identical to SEQ ID NO: 42223

SEQ ID NO: 186999 - RNA, 64 nt, hsa; identical to SEQ ID NO: 42224

SEQ ID NO: 187000 - RNA, 64 nt, hsa; identical to SEQ ID NO: 42225

SEQ ID NO: 187001 - RNA, 64 nt, hsa; identical to SEQ ID NO: 42226

SEQ ID NO: 187002 - RNA, 64 nt, hsa; identical to SEQ ID NO: 42227

SEQ ID NO: 187003 - RNA, 64 nt, hsa; identical to SEQ ID NO: 42228

SEQ ID NO: 187004 - RNA, 64 nt, hsa; identical to SEQ ID NO: 42229

SEQ ID NO: 187005 - RNA, 64 nt, hsa; identical to SEQ ID NO: 42230

SEQ ID NO: 187006 - RNA, 64 nt, hsa; identical to SEQ ID NO: 42231

SEQ ID NO: 187007 - RNA, 64 nt, hsa; identical to SEQ ID NO: 42232

SEQ ID NO: 187008 - RNA, 64 nt, hsa; identical to SEQ ID NO: 42233

SEQ ID NO: 187009 - RNA, 64 nt, hsa; identical to SEQ ID NO: 42234

SEQ ID NO: 187010 - RNA, 64 nt, hsa; identical to SEQ ID NO: 42235

SEQ ID NO: 187011 - RNA, 64 nt, hsa
aggauuugagaauaguuucaucucagcccccauuagagagaaguuggggugaauucuggaaaaa

SEQ ID NO: 187012 - RNA, 64 nt, hsa
ggagaaccacaaugcacauuagcauauuagucugagagagaacuuauaguaaggaaacucacuu

SEQ ID NO: 187013 - RNA, 64 nt, hsa
augaaauaaaaagaagagagggaggaagaaagggagagagaagaaaagaaaaaugaagaaaagu

SEQ ID NO: 187014 - RNA, 64 nt, hsa
ucccuagggucugcuuuagagaagggggauaaagagagagaaggacuguuaugaaaaacagaag

SEQ ID NO: 187015 - RNA, 64 nt, hsa
guaaccaagauggaugcaaagaggcuagugccucagagagaacuguacgggguuugugacugga

SEQ ID NO: 187016 - RNA, 64 nt, hsa
uuuggaaaacaguuuuuauucuguuuuauaaaccagagagaaaugaguuuugacgucuuuuuac

SEQ ID NO: 187017 - RNA, 56 nt, hsa
uaccaucugauaacucuugaagauacagagagaaauccaucuuuucccaggucucc

SEQ ID NO: 187018 - RNA, 64 nt, hsa
uaaauuuuguauuuuccauccaacagcaguguguagagagaauauuaugcagaugccguuaauu

SEQ ID NO: 187019 - RNA, 64 nt, hsa
uguguguguguguguguguguguguguggcagagagagagaaagagagagagagagagaaauuc

SEQ ID NO: 187020 - RNA, 64 nt, hsa
uguguguguggcagagagagagaaagagagagagagagagaaauucuguuaaaaucuauucugu

SEQ ID NO: 187021 - RNA, 64 nt, hsa
cuuuaaucagaaacccucauuguguuucuaccggagagagaauguauuugcugacaaccauuaa

SEQ ID NO: 187022 - RNA, 64 nt, hsa
augugugugugggguggggggaugguaagagaaaagagagaaacacugaaaagaaggaaagaug

SEQ ID NO: 187023 - RNA, 64 nt, hsa
ugcaaauuauuuguaugcuucaaaaaaaaaaaaaagagagaaacaaaaaagugugacauuacag

SEQ ID NO: 187024 - RNA, 64 nt, hsa
guuuccaguuccguucugagagaaaaagagagagagagagaaaaagaccaugcugcauacauuc

SEQ ID NO: 187025 - RNA, 64 nt, hsa
aauaaaccuucggagaacgucacuaagcuuuuccagagagaagacccuagaugaaguuggaaaa

SEQ ID NO: 187026 - RNA, 64 nt, hsa
caagucaacaaagaacuuaccuuggaggauagagagagagaagggaccaauuaugaggacugac

SEQ ID NO: 187027 - RNA, 64 nt, hsa
agguugacuuuuugcacuucuguauauagucaaaagagagaaaccuguauaauaguaagaucuu

SEQ ID NO: 187028 - RNA, 64 nt, hsa
aaaacuacugcauguuuaaaacuucaacaaaaaaagagagaaagaacuauacuaagaacauaua

SEQ ID NO: 187029 - RNA, 64 nt, hsa
guuuuuuuuaaacaugauucuaguuaaauguagaagagagaagaaagaggaaguguucacuuuu

SEQ ID NO: 187030 - RNA, 64 nt, hsa
auagcauuuagaaguuuuggauaugaaaaacagaagagagaaaaauauacauuauaaaagcaga

SEQ ID NO: 187031 - RNA, 64 nt, hsa
aucuaguaaaaaaggaguugcaauagccaaguauagagagaauagugaaaaauuaaucuugccc

SEQ ID NO: 187032 - RNA, 64 nt, hsa
uuggaauuacuuuaauugauggaguaguggugguagagagaaauuaauaacaaaaagagugaaa

SEQ ID NO: 187033 - RNA, 64 nt, hsa
ccaaagaaaaaggcuaugagaugagcugaguuauagagagaaagggagaggcauguacggugug

SEQ ID NO: 187034 - RNA, 64 nt, hsa
uccuauccauggauaggucuagucauaacacuuuagagagaaugucagagcaggagggaggcaa

SEQ ID NO: 187035 - RNA, 64 nt, hsa
uucaauaauguucaacugaaucucacagaugaggagagagaagaaacggaagaggaaguuuauu

SEQ ID NO: 187036 - RNA, 64 nt, hsa
gguggaauggaggaguuguuuggggagggaaaggagagagaaggaaaggagugagguauuuccc

SEQ ID NO: 187037 - RNA, 64 nt, hsa
augggucccucucuguggaagaauacugaauagaagagagaaaucacucaauauguggaaugac

SEQ ID NO: 187038 - RNA, 64 nt, hsa
gucagaaacuaaaugcugagucucucaaaggcguagagagaauuucagagggccuuaccaugac

SEQ ID NO: 187039 - RNA, 64 nt, hsa
gagagugagagcacaaagauaacgcaggagagagagagagaaagaaugagaaagaaaaggaaug

SEQ ID NO: 187040 - RNA, 64 nt, hsa
agauguaaugacagagaguucuggugagauacccagagagaaaaagagagagcaggguggggua

SEQ ID NO: 187041 - RNA, 64 nt, hsa
agggcccaggaucccaugccugggaggagcugccagagagaagcaaaaaggcggcuguggaucg

SEQ ID NO: 187042 - RNA, 64 nt, hsa
ucgagacaccaucccagguguguguaagagagagagagagaacagggaggauacagaaguauug

SEQ ID NO: 187043 - RNA, 64 nt, hsa
caauguuaagggguuguuguguaguugcauuggaagagagaaaggaaacacacucuuucauugc

SEQ ID NO: 187044 - RNA, 64 nt, hsa
ggaagugaggacuguccugcugggacaacuaagaagagagaauguggacucugaaucccuuuuu

SEQ ID NO: 187045 - RNA, 64 nt, hsa
auuucuugaguuuuuaguuugagaagcuggaaagagagagaagggccucacagugauggguuca

SEQ ID NO: 187046 - RNA, 64 nt, hsa
uuuuguuuaauuugcucuuucccugauuguguucagagagaaagguuaugauuaaaugggcucc

SEQ ID NO: 187047 - RNA, 64 nt, hsa
acccaguccugcagugucugugagcuguggaaugagagagaaaaccauggcugcucaggaagga

SEQ ID NO: 187048 - RNA, 64 nt, hsa
cacugaagaugaguuugaccuguggugaccugacagagagaacauucagauccucagauugcac

SEQ ID NO: 187049 - RNA, 64 nt, hsa
uacacacacacgagagacagaaggaaagagaggaagagagaagcaaacauguaggaaaaaauau

SEQ ID NO: 187050 - RNA, 64 nt, hsa
uuauacacuaugagguaaaauguaauaacaaaagagagagaaguaccacuguggcuagauauau

SEQ ID NO: 187051 - RNA, 64 nt, hsa
uuaacaacuuacugaacauaagaaaauuuacacuagagagaaagccuacaaaugugaagaaugu

SEQ ID NO: 187052 - RNA, 64 nt, hsa
cucaaaccuuacuaaacacaagaagauucauacuagagagaaacccuacaaaugugaagaaugu

SEQ ID NO: 187053 - RNA, 64 nt, hsa
cucagcccuuacuagacaucagagaauccauacuagagagaagcccuacaaauguaaagaaugu

SEQ ID NO: 187054 - RNA, 64 nt, hsa
cucagccauugcucagcaucagauaauucacaccagagagaaacccucugaaugugacgaauga

SEQ ID NO: 187055 - RNA, 64 nt, hsa
gaaagaagagggagggagagagaaagacgaagggagagagaaagcaguuuccaaggauauguuu

SEQ ID NO: 187056 - RNA, 64 nt, hsa
aguacugaagagaaaugggaaagaagagggagggagagagaaagacgaagggagagagaaagca

SEQ ID NO: 187057 - RNA, 64 nt, hsa
gaaucauagccauaagccuguuaguaucauaugaagagagaacaguuaucuuaguaccuaugga

SEQ ID NO: 187058 - RNA, 64 nt, hsa
uucuucagcuaaauacuuuaagaggggugaggggagagagaaauucauaacaaauccgacuacc

SEQ ID NO: 187059 - RNA, 64 nt, hsa
ugaauuuccagguacuuggacuuuuuguagaaggagagagaagaagaugaaguuugccaggagg

SEQ ID NO: 187060 - RNA, 64 nt, hsa
uagcguuacuucuccuguggucaguaaguugcccagagagaaggaacaaaggucuggaguuuac

SEQ ID NO: 187061 - RNA, 64 nt, hsa
uccauccccgcuaccguccuggccagcuaccgucagagagaaccagagcuccaagucuuuaauu

SEQ ID NO: 187062 - RNA, 64 nt, hsa
aaccugcuaucaggaaaucuacaugugugcacagagagagaaaaguagaacaguucuuugcauu

SEQ ID NO: 187063 - RNA, 64 nt, hsa
cccucgucuaaagaggcagcugagugagagacacagagagaaggagaaagagggagggagagag

SEQ ID NO: 187064 - RNA, 64 nt, hsa
agagacacagagagaaggagaaagagggagggagagagagaaagagagagaaagagagagagag

SEQ ID NO: 187065 - RNA, 64 nt, hsa
agagaaggagaaagagggagggagagagagaaagagagagaaagagagagagagagagagagag

SEQ ID NO: 187066 - RNA, 64 nt, hsa
agagaaagagagagaaagagagagagagagagagagagagaaagcugaacgugcacucugacaa

SEQ ID NO: 187067 - RNA, 64 nt, hsa
cagucccucuaucccuucuccuguccaggggcccagagagaaacacaccuaccccuggccuugc

SEQ ID NO: 187068 - RNA, 64 nt, hsa
cuccucuuuccguggcuggggguagacuuaauaaagagagaaauucaagaacugcuugcuuuau

SEQ ID NO: 187069 - RNA, 64 nt, hsa
cucccuguuuccugggcuagucuuggaccccacgagagagaaucguuccucagccucaugguga

SEQ ID NO: 187070 - RNA, 64 nt, hsa
ugcaucuccguaaaugugcucugcuccucagcugagagagaaaaaaauaaacuguauuuggcug

SEQ ID NO: 187071 - RNA, 64 nt, hsa
guguguguguguguguacucuguguguguaugagagagagaaaugcuaaccuuguagcauguga

SEQ ID NO: 187072 - RNA, 64 nt, hsa
uccuggagggguguuguauggcugagcaagagagagagagaaugagagagagacugugugugug

SEQ ID NO: 187073 - RNA, 64 nt, hsa
aguucggggauauauuaagauauuuuuguacauaagagagaaagagagagaaaaauuuauagaa

SEQ ID NO: 187074 - RNA, 64 nt, hsa
uauauuaagauauuuuuguacauaagagagaaagagagagaaaaauuuauagaaguuuuguaca

SEQ ID NO: 187075 - RNA, 64 nt, hsa
uuuacuggcaugguaucauuccuagaagaaaaaaagagagaaacuugacugcacauuaaaaaaa

SEQ ID NO: 187076 - RNA, 64 nt, hsa
acucaacuuugaggaaagacagggccuuggucagagagagaaugcucugaacucugcuaaggac

SEQ ID NO: 187077 - RNA, 64 nt, hsa
uccccaaaauagcugcccuuaaagaguuguuagcagagagaaaaauaacagugaaugugcuccu

SEQ ID NO: 187078 - RNA, 64 nt, hsa
uaaguauacacucagcaauaauuagaaaaaaaggagagagaaaagugauuuaaacaggguggau

SEQ ID NO: 187079 - RNA, 64 nt, hsa
ccacugcgcccagccacugccaucaucuuuaggaagagagaagugaccaugccugaaccaguca

SEQ ID NO: 187080 - RNA, 64 nt, hsa
gccuggcugggauccucaggaccugaggcuccacagagagaaauuccuggaaucuggaccccau

SEQ ID NO: 187081 - RNA, 64 nt, hsa
aaagaggcuaaauaaaaugagacuaguuuaauauagagagaaaaauaccuuuauggaguaaacg

SEQ ID NO: 187082 - RNA, 64 nt, hsa
ccccacccaagacauuuuaauaguaaauagagagagagagaagaguuaaugaacaugagguagu

SEQ ID NO: 187083 - RNA, 64 nt, hsa
ugaauguccaccagacaccagccccggggggcacagagagaacaacauuccucucugucaacau

SEQ ID NO: 187084 - RNA, 57 nt, hsa
cuggaagaacaaugcagugagaucaacagagagaaggagaagaacacgcagcugaag

SEQ ID NO: 187085 - RNA, 64 nt, hsa
ccagagagugagagagagaaagagagugagagagagagagaaagagagagagagaugcuguuga

SEQ ID NO: 187086 - RNA, 64 nt, hsa
agaguaaccaguuuccagagagccagagagugagagagagaaagagagugagagagagagagaa

SEQ ID NO: 187087 - RNA, 64 nt, hsa
ugaaugggcagaggugagagagagagagagaaagagagagaaugaaugcaguugcauugauuca

SEQ ID NO: 187088 - RNA, 64 nt, hsa
cagugccuuuugaaugggcagaggugagagagagagagagaaagagagagaaugaaugcaguug

SEQ ID NO: 187089 - RNA, 64 nt, hsa
ccuauuugugugguuauauagcccuuuauuuaaaagagagaaguuccuuuuacaaaguuauuaa

SEQ ID NO: 187090 - RNA, 64 nt, hsa
ggugcugugggaacggacuagagagaguugcgggagagagaaggagcaggcacgcugggccucg

SEQ ID NO: 187091 - RNA, 64 nt, hsa
cgcccgaacaugaagaaaaaugaccugacccuguagagagaacacagugugaauguuuccccuc

SEQ ID NO: 187092 - RNA, 64 nt, hsa
cugcuuuccuaaggacucccauuuccaguauuaaagagagaaucaucaucaaggcaccguaggu

SEQ ID NO: 187093 - RNA, 64 nt, hsa
aguugaaaugaaggaaaaaauguuaagggcagccagagagaaaggucggguuacccacaaaggg

SEQ ID NO: 187094 - RNA, 64 nt, hsa
aauugauagaccgcuagcaagacuaaugaagaaaagagagaagaaucaaauagaugcaauaaaa

SEQ ID NO: 187095 - RNA, 64 nt, hsa
ccugcgggacagagugagacccugucugaaagaaagagagaaagaaagaaagaaagagagagaa

SEQ ID NO: 187096 - RNA, 64 nt, hsa
ugucugaaagaaagagagaaagaaagaaagaaagagagagaaagaaagaaagaaagaaagggaa

SEQ ID NO: 187097 - RNA, 64 nt, hsa
aaggaaggaaggaaaaagaaagagaaagagagagagagagaaagaaaaagaaagaaaaguaaga

SEQ ID NO: 187098 - RNA, 64 nt, hsa
ccccagggucuggugauggcagggauggggggagagagagaaaauccacaaauuccaaugucac

SEQ ID NO: 187099 - RNA, 64 nt, hsa
agaaaacagaaacccgagaaagagagagacagagagagagaaaaaaaaucacccaccacccccc

SEQ ID NO: 187100 - RNA, 64 nt, hsa
agccaacuugagaaauaaagggacagaguacaaaagagagaaauuuuaaagcuggguguccggg

SEQ ID NO: 187101 - RNA, 64 nt, hsa
ucuguauuccucaccccaccugugaacuccuaccagagagaaaccuuuuguauguaaagaauuu

SEQ ID NO: 187102 - RNA, 64 nt, hsa
cagcagagagagagagagagaaagagagagagagagagagaaggggcccaagagagacagcaca

SEQ ID NO: 187103 - RNA, 64 nt, hsa
ccucccacccccuccccgggcagcagagagagagagagagaaagagagagagagagagagaagg

SEQ ID NO: 187104 - RNA, 64 nt, hsa
uaaagauacagagagucaaauagagagaauggagagagagaaacauauauuauauauuauauag

SEQ ID NO: 187105 - RNA, 64 nt, hsa
uugccuccuagaauaaagauacagagagucaaauagagagaauggagagagagaaacauauauu

SEQ ID NO: 187106 - RNA, 64 nt, hsa
aggcaaugacugcgcagaguggauuaaaggcaaaagagagaagaguccaggaaggggcggggag

SEQ ID NO: 187107 - RNA, 64 nt, hsa
cuuccucuuaggauguuucaccaaggaaauauugagagagaagucggccagguaggaugaacac

SEQ ID NO: 187108 - RNA, 64 nt, hsa
uccucuccggaucugucgauuuggagaccuuccgagagagaaccaagggugcagucagcuuaaa

SEQ ID NO: 187109 - RNA, 64 nt, hsa
uucauauuuagaaguaaaacacaaaacaaaaaagagagagaaaagaaaagaaaucacaauguau

SEQ ID NO: 187110 - RNA, 64 nt, hsa
augagauuuugcccagcacauggagcuguaauccagagagaaggaaacguagaaauuuauuauu

SEQ ID NO: 187111 - RNA, 64 nt, hsa
cauagaagagggaaggaaagagagaaggaaagagagagagaaagaaagucuccagaccaggaau

SEQ ID NO: 187112 - RNA, 64 nt, hsa
ccuacccgcucagcaacauagaagagggaaggaaagagagaaggaaagagagagagaaagaaag

SEQ ID NO: 187113 - RNA, 64 nt, hsa
cugcaugauuggcauuaguuaccacagccugcccagagagaaacuaucuucucccaacauuuac

SEQ ID NO: 187114 - RNA, 64 nt, hsa
caaaauguuacaaccgcuguaaaaugacggagagagagagaaagaaucccagacauuaacggua

SEQ ID NO: 187115 - RNA, 64 nt, hsa
ugccgaguuccuuaaaucucagcugggauccuggaccugggaggccccugugagggccagcucu

SEQ ID NO: 187116 - RNA, 64 nt, hsa
cugggaggccccugugagggccagcucuggaaaaaccugggaguugaugccggaggcuguggaa

SEQ ID NO: 187117 - RNA, 64 nt, hsa
cuacuugggagacugaggcaggagaaucgcuugaaccugggaguuagagguugcagugagcuga

SEQ ID NO: 187118 - RNA, 64 nt, hsa
agucagugguucccaaaucuggcuggucgggaauaccugggaaguuuguuaaaauuuuuuaaaa

SEQ ID NO: 187119 - RNA, 64 nt, hsa
guucaagcaauucugcugcaucagccucccgaguaccugggauuacaggcaugugccaccacgc

SEQ ID NO: 187120 - RNA, 64 nt, hsa
uauuuauugaguaccuacugugugcuaggcauugaccugggaacuagagauacuucacagaaua

SEQ ID NO: 187121 - RNA, 64 nt, hsa
auucaguguccccaccuugcagcgcauuccaaccaccugggagcauuuaaaacuccagaugccc

SEQ ID NO: 187122 - RNA, 64 nt, hsa
cccacucacagucaccgucuuacaacucagggccaccugggaucagucaucagucagggugcgu

SEQ ID NO: 187123 - RNA, 64 nt, hsa
auuugcacagauaucuuugaagacacaaacacucaccugggacguuggccggagaugucuuuuu

SEQ ID NO: 187124 - RNA, 64 nt, hsa
gaugaugccagccuugagcaugaagcugagauggaccugggaacuccaacauaugaugaaaacc

SEQ ID NO: 187125 - RNA, 64 nt, hsa
cgggaggcucagaaacaacagcaacagaugcagaaccugggaaugacaucaccacugcccuaug

SEQ ID NO: 187126 - RNA, 64 nt, hsa
cccagaggagaugggggcuucugaagauggacuuaccugggaccugccccccaugagccaggac

SEQ ID NO: 187127 - RNA, 64 nt, hsa
cuggagcagggcuggggaaugaugggacuggaggaccugggaauuucaucuuucugccuccacc

SEQ ID NO: 187128 - RNA, 64 nt, hsa
cuacuagggaggcugaggcaggagaauugcuugaaccugggagacggagguugcggugagcugc

SEQ ID NO: 187129 - RNA, 64 nt, hsa
cuacuugagaggcugaggcaggagaaucgcuugaaccugggaggcagagguugcagugagcuga

SEQ ID NO: 187130 - RNA, 64 nt, hsa
aggguggcuaagucccaccauaacagcuaaggggaccugggagaugauggcucauuuccaccca

SEQ ID NO: 187131 - RNA, 64 nt, hsa
ccaggauuuccagagcgcacauccacaggccuggaccugggaugaagaugaaugaagaacaugg

SEQ ID NO: 187132 - RNA, 64 nt, hsa
uugggcaugguggcaugcaccuguagucccagcuaccugggaggcugaggcaggagaauugcuu

SEQ ID NO: 187133 - RNA, 64 nt, hsa
cuaccugggaggcugaggcaggagaauugcuugaaccugggaggcagagguugcagugagccaa

SEQ ID NO: 187134 - RNA, 64 nt, hsa
uguuguuguuguugucauuguuguuguuguuuuaaccugggaaguguucuuccugccuuucugc

SEQ ID NO: 187135 - RNA, 64 nt, hsa
gcucaggugauccucacaccuuagccucccaaguaccugggacuacaggcacgcaccaccaugc

SEQ ID NO: 187136 - RNA, 64 nt, hsa
ucacaaacccaccucuguugggagcuauugagccaccugggaugagaugacacaaggcacuccu

SEQ ID NO: 187137 - RNA, 64 nt, hsa
ggucagcauuauccugccagaccucggggaggauaccugggagacagaagccucugcaccuacu

SEQ ID NO: 187138 - RNA, 64 nt, hsa
guaaaaccuccacgugacuguuuggugcaucuugaccugggaagacgccucaugggaacgaacu

SEQ ID NO: 187139 - RNA, 64 nt, hsa
uucucuguguucuguguauuugucugaauuaaugaccugggauauaaagcuaugcuagcuuuca

SEQ ID NO: 187140 - RNA, 64 nt, hsa
cagggccuaggcugauagucagagccuguggcacaccugggaugggccagggcccugggugggg

SEQ ID NO: 187141 - RNA, 64 nt, hsa
gggccccuagaaaugcugccuuugugugugggguaccugggaaaggguguggcugaggcaguca

SEQ ID NO: 187142 - RNA, 64 nt, hsa
ugucucacuuuuuguuaauguugcugccucauugaccugggaaaaaugaaaaaaaaaaauaaag

SEQ ID NO: 187143 - RNA, 64 nt, hsa
aaagcugaugggagugagagaacucagcaagccaaccugggaaucagagagagaaggagaagga

SEQ ID NO: 187144 - RNA, 64 nt, hsa
cacucggguccucuugagcaguggagcaagggagaccugggagcgugggagccaggaucagcgc

SEQ ID NO: 187145 - RNA, 64 nt, hsa
cuauuugggaggcugaggcaggagaaucacuugaaccugggaggcggagguugcagugagccga

SEQ ID NO: 187146 - RNA, 64 nt, hsa
gggagcacagugaagacccugagagcauccuggcaccugggagcgcagguuggccccugaacug

SEQ ID NO: 187147 - RNA, 64 nt, hsa
gggagcacagugaagaccaugggagcacccuggcaccugggagcacagugaagacccugagagc

SEQ ID NO: 187148 - RNA, 64 nt, hsa
cuacuggggaggcugaggcaggagaaucgcuugaaccugggaggcagagguugcagugagccgg

SEQ ID NO: 187149 - RNA, 64 nt, hsa
cucucucucaauuacugggaccaccaagcuaggaaccugggagucauccuugauacuuucucuu

SEQ ID NO: 187150 - RNA, 64 nt, hsa
caccucaggaggcugaggcaggagaaucgcuugaaccugggaggcagagguugcagugagccaa

SEQ ID NO: 187151 - RNA, 64 nt, hsa
cuacuugggaggcugaggcaggagaaucgcuugaaccugggaggcggaaguugcagugagccga

SEQ ID NO: 187152 - RNA, 64 nt, hsa
cauugaugucucuagaccugcagauacgaagcaaaccugggauugcuucuuccagguaugggca

SEQ ID NO: 187153 - RNA, 64 nt, hsa
ugagcccucagguccccagcuccuugagggaugaaccugggagcccaagagccaguggcugagc

SEQ ID NO: 187154 - RNA, 64 nt, hsa
aggccccccuacagucacugccacacugguggggaccugggacccagacccggaaccagcccag

SEQ ID NO: 187155 - RNA, 64 nt, hsa
caugaggacagaaggcaggagacuuuggucaguuaccugggaauucugggcugccaggaaacga

SEQ ID NO: 187156 - RNA, 64 nt, hsa
cuuaccugggagcacacuuuucccuuccccgaugaccugggaugguggccaggccgugcccuug

SEQ ID NO: 187157 - RNA, 64 nt, hsa
aagugaggcucuugggggugguuugacccugcuuaccugggagcacacuuuucccuuccccgau

SEQ ID NO: 187158 - RNA, 64 nt, hsa
cuacucaggauccugaggcaugagaauugcuugaaccugggaggcagaggcugcagugagccaa

SEQ ID NO: 187159 - RNA, 64 nt, hsa
gcuuaagcgauccuccucccucagccuugugaauaccugggacuucaggcacgcgccacuacac

SEQ ID NO: 187160 - RNA, 64 nt, hsa
cuacucaggagacugaggcagaaggaucgcuugaaccugggaggcagagguugcagugagccga

SEQ ID NO: 187161 - RNA, 64 nt, hsa
cuacuggggaggcugagucaggagaaucgcuugaaccugggaggcggagguugcggucagcuga

SEQ ID NO: 187162 - RNA, 64 nt, hsa
gagggugagcugaagcaggguggggcguaaccucaccugggaagugcaaggagucggggaucuc

SEQ ID NO: 187163 - RNA, 64 nt, hsa
gaauucucccugccagcacagcagucugaagucaaccugggaugaucaagcuugguggggggag

SEQ ID NO: 187164 - RNA, 64 nt, hsa
cuacucgggaggcagaggcaggagaauggcuugaaccugggaagcgguugcagugagccaagau

SEQ ID NO: 187165 - RNA, 64 nt, hsa
ugacagugaugaggagguggacagcgagcugggcaccugggagcaccagcugcggcgcauggag

SEQ ID NO: 187166 - RNA, 64 nt, hsa
cagcagccucccagaagcucucuucugcuucaaaaccugggaucucuggcauuacccuauuggg

SEQ ID NO: 187167 - RNA, 64 nt, hsa
ccguggguaaguccugccauucaagacuggagacaccugggaaauaaaaagagcagggcacugc

SEQ ID NO: 187168 - RNA, 64 nt, hsa
aaagucaucuucucuuuuuucuugcucagaguuuaccugggagauuucaccaguuugacucacc

SEQ ID NO: 187169 - RNA, 64 nt, hsa
ugccacaugccguucccaugcccggcugcugggcaccugggagagcuuccagaauccucgcaga

SEQ ID NO: 187170 - RNA, 64 nt, hsa
ugcacacagcugcucagcaccacuuucauucuggaccugggaccuuaggagccgggugacagca

SEQ ID NO: 187171 - RNA, 64 nt, hsa
aaauaaacacgacauauuuaaagaagguucuuucaccugggagcaaaugaacaauagcuaagug

SEQ ID NO: 187172 - RNA, 64 nt, hsa
auggcccuccugccacuucagcacaccuugccccaccugggaccaucacacgugaagcaccagg

SEQ ID NO: 187173 - RNA, 64 nt, hsa
uacgaauggacaggaaagggagccagagcuguauaccugggacaggccagggagccuuuagugc

SEQ ID NO: 187174 - RNA, 64 nt, hsa
cauggagccuaccucugucugagacaggugccuaaccugggaccuguggucaugugagucuggg

SEQ ID NO: 187175 - RNA, 64 nt, hsa
ucagccugguuucugggugcuagauccagcccaaaccugggaaggccagccuuguacagucugc

SEQ ID NO: 187176 - RNA, 64 nt, hsa
gggagugugguuucuuuuugaaucuuuaauuaaaaccugggauuauauaucccugauaaauauu

SEQ ID NO: 187177 - RNA, 64 nt, hsa
aguauuuggaauuagaacccuugcacagcacugaaccugggaaagagauuuaaacucugaauuu

SEQ ID NO: 187178 - RNA, 64 nt, hsa
ccuccacugccuggcucagcgggccggagcugaucgcucucacuggccugcugcagaugagcca

SEQ ID NO: 187179 - RNA, 64 nt, hsa
ggaccccgggagcagaagacgcgccugggcuccgcgcucucagagaagcacguggugagggugg

SEQ ID NO: 187180 - RNA, 61 nt, hsa
auucccuagaagagaacccucuacuuuuuguaagcacuacugacucucgcuguauuuaaga

SEQ ID NO: 187181 - RNA, 61 nt, hsa
acuuuacauuguaucuaaguuaaucuuuauaaagcacuagaauuuuuggucaaaagucaaa

SEQ ID NO: 187182 - RNA, 61 nt, hsa
ggcagaaagcucuuagacaauggacuauccaaagcacuauuuaaauucugccucuuccuac

SEQ ID NO: 187183 - RNA, 61 nt, hsa
uagucuccccgccucauucccacccccaacaaagcacuaucauuuucauuuggaaugggua

SEQ ID NO: 187184 - RNA, 61 nt, hsa
uauugaucuuuuuaucaugauccucccuaucaagcacuaaaaaguugaaccauuauacuuu

SEQ ID NO: 187185 - RNA, 61 nt, hsa
acugauccuuaguaacauguuaacauuuaugaagcacuauauauugauuugcaaaaucuuu

SEQ ID NO: 187186 - RNA, 61 nt, hsa
ccaauguaauuggcugcgucuggcuaauucuaagcacuaaagucuacaucuaagcuauaga

SEQ ID NO: 187187 - RNA, 61 nt, hsa
cuuagguucauugugccucaguuccucucaaaagcacuaaaucuaagugcaaacaaguauu

SEQ ID NO: 187188 - RNA, 61 nt, hsa
cuuuuugguaauauguuacaauuaaaaugacaagcacuauaucacaaucucuguuuguaug

SEQ ID NO: 187189 - RNA, 61 nt, hsa
uuccagugagagaaaccaaccacaggcacccaagcacuaccagacaaagcguauuaaacag

SEQ ID NO: 187190 - RNA, 61 nt, hsa
ccagagcugaucucucauccgcucuggccccaagcacuauuucuuccuuuuccacuuaggc

SEQ ID NO: 187191 - RNA, 61 nt, hsa
gagaauguaugugaaagauuuguaaaugguaaagcacuauauucuuguuuguuaguccuuu

SEQ ID NO: 187192 - RNA, 61 nt, hsa
uguuuggggucuuugugguagcuuaucuuagaagcacuacaccuugccuugcuguuugucc

SEQ ID NO: 187193 - RNA, 61 nt, hsa
gggucuuuguaggaguugcucuugcuguguaaagcacuauugucuugggguugagcccuag

SEQ ID NO: 187194 - RNA, 61 nt, hsa
cacaaugaauuguccuuaauuaccaacagugaagcacuacaggaggcaacuguggcauugc

SEQ ID NO: 187195 - RNA, 61 nt, hsa
aaggaauguauagauguuuggauggaaacaaaagcacuagacugaguuuccucuuauaggu

SEQ ID NO: 187196 - RNA, 61 nt, hsa
uuuacaaggccuaucauguccuugucaugaaaagcacuaaaaaaaaaaagaguuuaagugg

SEQ ID NO: 187197 - RNA, 61 nt, hsa
gcacccacaaauaaaugacaagugagacaaaaagcacuaguauaaagauuauauaaagacc

SEQ ID NO: 187198 - RNA, 61 nt, hsa
cgaauucauuaauuuacuguaguguuaagagaagcacuaagaaugccagugaccuguguaa

SEQ ID NO: 187199 - RNA, 61 nt, hsa
agcagaucugcuuuuuuuccagagcaaaaugaagcacuagguauaaauauguuguuacugc

SEQ ID NO: 187200 - RNA, 61 nt, hsa
uguucgcugcaguuguuccccaucaguacucaagcacuauaagccuuagauuccuuuccuc

SEQ ID NO: 187201 - RNA, 61 nt, hsa
cucucuucaaccuucaucucaaauugucucuaagcacuaccuuccccagagcuugccaggu

SEQ ID NO: 187202 - RNA, 61 nt, hsa
uacugcacaguggcacaaaaaaauaucagacaagcacuauuuuauauuuaaaaauuguuuc

SEQ ID NO: 187203 - RNA, 61 nt, hsa
aucuguaguuuuuuguuuuuguuuuuuuuuaaagcacuacaucuguuuucacuaauuguua

SEQ ID NO: 187204 - RNA, 61 nt, hsa
aaccaguuagcugcuauauaaacacuauaccaagcacuaggcuuagaggaaaagaugucag

SEQ ID NO: 187205 - RNA, 61 nt, hsa
aauaagguauauuuuuuagaaucaacuuuguaagcacuauaaaaucuuuaauaaguuauaa

SEQ ID NO: 187206 - RNA, 61 nt, hsa
uaguuuucuguccugcaauauguauauaauuaagcacuaauuuguacugcuuagcauaaaa

SEQ ID NO: 187207 - RNA, 61 nt, hsa
uacuucguggagcccagcgagcaucccgggcaagcacuaccaggcugugggucugcaccuc

SEQ ID NO: 187208 - RNA, 61 nt, hsa
uguauccauuuaaacuaaccuuuuaucaauaaagcacuauuguuuagauauuaaaugagua

SEQ ID NO: 187209 - RNA, 61 nt, hsa
uaugguuaacuucacgcagcugcuuuugcagaagcacuaauaaaaacaaauauuuuguacc

SEQ ID NO: 187210 - RNA, 61 nt, hsa
uuuaagucagccaaagaauauuguuaccuuaaagcacuauuuuauuuauagauauaucuag

SEQ ID NO: 187211 - RNA, 61 nt, hsa
gcccggcaggagagccugcaggagcgcaagcaagcacuauaugaauacgcaagaaggugag

SEQ ID NO: 187212 - RNA, 61 nt, hsa
aaggaaguucauucaaggauaaguuggaauaaagcacuauguuaaaacaucugcuuuuuaa

SEQ ID NO: 187213 - RNA, 61 nt, hsa
uuaaaacuucacuaauauagcauugugugauaagcacuaagcagucaguccccugggggaa

SEQ ID NO: 187214 - RNA, 61 nt, hsa
gauacaagugucaguuucuuaguucucauuuaagcacuaguggaauuuuuuuuuuuugaua

SEQ ID NO: 187215 - RNA, 61 nt, hsa
uuguuguuaauugggacuuucuguuaaugaaaagcacuauucccaagauuaauaguguucu

SEQ ID NO: 187216 - RNA, 61 nt, hsa
ggacuuuagcugugaccucucuaacacagagaagcacuaacuuagauccucauucuuaaua

SEQ ID NO: 187217 - RNA, 61 nt, hsa
aagaucugucaaucaagcaguagugugaaaaaagcacuauaagaaaaugcaucaucaguuu

SEQ ID NO: 187218 - RNA, 61 nt, hsa
cugggguuggaagugugacuucuuacacauaaagcacuaccuaaguaauucucucucuguu

SEQ ID NO: 187219 - RNA, 61 nt, hsa
uugaguucuguagagccuucugaugucucuaaagcacuaccgauucuuuggaguugucaca

SEQ ID NO: 187220 - RNA, 61 nt, hsa
caagagggcuuuauuacaccucagaaauugaaagcacuaugaauuuguccauuuaaaaaug

SEQ ID NO: 187221 - RNA, 61 nt, hsa
aagguggggccaguugcgauucuaaaggaagaagcacuaaauggcagggugaucaguccaa

SEQ ID NO: 187222 - RNA, 61 nt, hsa
aacccccaccccuucaggaucagucaagggaaagcacuagaaccccuggguagggaaagaa

SEQ ID NO: 187223 - RNA, 61 nt, hsa
agaagaaaacagguuaacaaucaaguagugaaagcacuauauucuagucauuaacucaacg

SEQ ID NO: 187224 - RNA, 61 nt, hsa
ccaggggcagguaaagcccugcugggcucagaagcacuauagaauuugcuguacacacuga

SEQ ID NO: 187225 - RNA, 61 nt, hsa
ugaauugugagcaaaagaucuugaaagcaaaaagcacuaauuaguuuaaaaugucacuuuu

SEQ ID NO: 187226 - RNA, 61 nt, hsa
ucccaacaugaaauuauauuacucagauuuaaagcacuaucauuaaucuuucaaucuaauu

SEQ ID NO: 187227 - RNA, 61 nt, hsa
guauacaggaggaugugaauagguuauaugcaagcacuaugcccuuuuauauaagugacuu

SEQ ID NO: 187228 - RNA, 61 nt, hsa
guuauuauacuacuaauaauagagcacuuguaagcacuaaguuaucuuuauccaacauuuc

SEQ ID NO: 187229 - RNA, 61 nt, hsa
auugacuuggagcaccuggaggauguaccagaagcacuagaccaggacgaccuccagcgcg

SEQ ID NO: 187230 - RNA, 61 nt, hsa
ugaacuugcuguuaacacaguguuauaacucaagcacuagcuucaggaagcauguuguguu

SEQ ID NO: 187231 - RNA, 61 nt, hsa
ucuagaaagaucacuaauggucaaguggaacaagcacuacacgacuaaccccuauuggggu

SEQ ID NO: 187232 - RNA, 61 nt, hsa
cucccaucucuccucccuaaugccucacuucaagcacuaauuuggcucuuucugcucacua

SEQ ID NO: 187233 - RNA, 54 nt, hsa
uagagaggaugaagcauuagcuugaagcacuacaggaggaaugcaccacggcag

SEQ ID NO: 187234 - RNA, 61 nt, hsa
uucuguaaccuuuugaaaucuaguuacuaauaagcacuacuguaauuuagcacaguuuaac

SEQ ID NO: 187235 - RNA, 61 nt, hsa
uucuaaagguguugucacuguauaaaacagaaagcacuaggauacaaaugaagcuuaauua

SEQ ID NO: 187236 - RNA, 61 nt, hsa
gagcuauggcugcuuuuguagccuuuccaagaagcacuaaccugaaauaagauuagauaau

SEQ ID NO: 187237 - RNA, 61 nt, hsa
uuccuaaagccacuauuguguuuucucuaagaagcacuacaugccaccagaauugugcacu

SEQ ID NO: 187238 - RNA, 61 nt, hsa
uuugggcugugagcauuuagaacgagccuggaagcacuacagagcaucccacaggaccaca

SEQ ID NO: 187239 - RNA, 61 nt, hsa
uuccauuccagaauaucugggauucuacuuuaagcacuacauaaacugacuuuauccucag

SEQ ID NO: 187240 - RNA, 61 nt, hsa
guaaaaaaccaaaaaggacuuuuuguauagaaagcacuacccuaagccaugaagaacucca

SEQ ID NO: 187241 - RNA, 61 nt, hsa
gguagugaauguguaguuggggaauaaagaaaagcacuaaauccugcccuuuuuguguggu

SEQ ID NO: 187242 - RNA, 61 nt, hsa
agcucuuuuuuccuuucugcugauuugcuggaagcacuacaagacuucuguuuguucguuc

SEQ ID NO: 187243 - RNA, 61 nt, hsa
uguuuauacacagggaguguaugguuccuguaagcacuaaguuagcuguuuucauuuaaug

SEQ ID NO: 187244 - RNA, 61 nt, hsa
ccuguucgugugguauaugaaaaagauaccuaagcacuagaauauccagcuaaauggugca

SEQ ID NO: 187245 - RNA, 61 nt, hsa
cauauacgugaaaauuauuugaaaacauauaaagcacuauacagauucgaaacuccauuga

SEQ ID NO: 187246 - RNA, 61 nt, hsa
uaguuaagaguggggucaccccuuuaacuccaagcacuacauuuuggcggcugccggccuc

SEQ ID NO: 187247 - RNA, 61 nt, hsa
cuaauucuggggauagaaugauaaaagacucaagcacuaaaaauauacauugccgaaucuc

SEQ ID NO: 187248 - RNA, 61 nt, hsa
uuuauguuuaaguauuuagaaaaaggugaaaaagcacuauuaucaguucugccuagguaaa

SEQ ID NO: 187249 - RNA, 61 nt, hsa
aagcaaaaauuuuaacuguuuucuaauugucaagcacuauuuucauuaaaagugucuaaug

SEQ ID NO: 187250 - RNA, 61 nt, hsa
acuucucaaaaauuguacaucuguguaacuaaagcacuaacaaaaacaugaauaguccuuc

SEQ ID NO: 187251 - RNA, 61 nt, hsa
gugaugggcuggggugggucccuggaaucagaagcacuagugcugccauuaaugaauuguu

SEQ ID NO: 187252 - RNA, 61 nt, hsa
gcccugaaauggccugucccuagggcucuccaagcacuagccuucccagcuucccgccgcc

SEQ ID NO: 187253 - RNA, 61 nt, hsa
gagcagagugauuucuugcuuccucccuucaaagcacuaccacaccuagacuggaaaugug

SEQ ID NO: 187254 - RNA, 61 nt, hsa
uuuagcaacacagguaaaaaugcaccuuuuaaagcacuacguuuucacagacaauaacugu

SEQ ID NO: 187255 - RNA, 61 nt, hsa
ucucaagaauuacuggcuuuaaaagaagccaaagcacuacuagcuuuuuuuccauauuggu

SEQ ID NO: 187256 - RNA, 61 nt, hsa
cauuuauugaaaaaaaaaaaaaaugcccccaaagcacuaugcuggucaugaacugcuucaa

SEQ ID NO: 187257 - RNA, 61 nt, hsa
caaauacaucucucccuucuugaaaucccuaaagcacuaucgcacuccuaaaugcauuucu

SEQ ID NO: 187258 - RNA, 61 nt, hsa
cauucuuuuuucuauuaagccauugaaagagaagcacuaagacugcuucuaggcuuuauuu

SEQ ID NO: 187259 - RNA, 61 nt, hsa
uuuauuucuuuuuuuuuuaauugggggaaauaagcacuauuaacagauucagcacuacaag

SEQ ID NO: 187260 - RNA, 61 nt, hsa
cgugauucucagugugauuccaauuauuacgaagcacuaaucaguaacgcuacaaugauca

SEQ ID NO: 187261 - RNA, 61 nt, hsa
auauauacauguaauaugaaaauugagauugaagcacuaauuccaaaauuauggcugaaua

SEQ ID NO: 187262 - RNA, 61 nt, hsa
acccuuguuaguuauuuuaggagacagucucaagcacuaaaaaguggcuaauucaauuuau

SEQ ID NO: 187263 - RNA, 61 nt, hsa
auggcagauaugguauggaucguaaaauuuuaagcacuaaaaauuuuuucauaaccuuuca

SEQ ID NO: 187264 - RNA, 61 nt, hsa
aaucuucuaaaggcuauacaauugaaugaggaagcacuaacaaaagcaguaguucaguaca

SEQ ID NO: 187265 - RNA, 61 nt, hsa
ucaggcuaauuaguggauuaagcaauaaugaaagcacuaaguuugguuuugcuuuugugag

SEQ ID NO: 187266 - RNA, 61 nt, hsa
gggcaauggaugcauuucccaaaacgugugaaagcacuaacagcuuauauugcugaaugag

SEQ ID NO: 187267 - RNA, 61 nt, hsa
acuacuuacucugauggaccaauaaugaagaaagcacuaggagcucuuuuggggguguagu

SEQ ID NO: 187268 - RNA, 61 nt, hsa
uguccauagagaagagguuuucuaugucuucaagcacuauaucauaguccguguucaaagu

SEQ ID NO: 187269 - RNA, 61 nt, hsa
uuuaaauagaaaucacaaauagcaaguguggaagcacuacuuuauucuguuuaaaauguac

SEQ ID NO: 187270 - RNA, 61 nt, hsa
gaguacaaacugauucaguucuaaaguuccaaagcacuaaaaacuuaucuauggugauuac

SEQ ID NO: 187271 - RNA, 61 nt, hsa
uauaucaaggucucagaugagcuuagugcacaagcacuaucacuuuaaauacuauuauuug

SEQ ID NO: 187272 - RNA, 61 nt, hsa
ggacucaccucuggagccuauggcuuuaagcaagcacuacugcacuuuacagaauuacccc

SEQ ID NO: 187273 - RNA, 61 nt, hsa
agagcuuucuggguuaacgcuuuucagggccaagcacuauaaggguuuagcuguggcgcag

SEQ ID NO: 187274 - RNA, 61 nt, hsa
uacaaauuccagauaucuacaaaagaugugaaagcacuaaaaauaccauuuuuaagcagua

SEQ ID NO: 187275 - RNA, 61 nt, hsa
agacuuuaaaacucuggcuggacagaguuuuaagcacuaugcugcaggaauccugagaaaa

SEQ ID NO: 187276 - RNA, 61 nt, hsa
ucuucccgaugagggaaggagcccagccagaaagcacuacaaucauggucaaguucccaac

SEQ ID NO: 187277 - RNA, 61 nt, hsa
gauauguauuccaaaaaagucauagaagaugaagcacuauaauauuguucccauauauuua

SEQ ID NO: 187278 - RNA, 61 nt, hsa
agccucuguguaggugguagggagugagucaaagcacuaauagaccaggcaacuuaccacu

SEQ ID NO: 187279 - RNA, 61 nt, hsa
uuaguccuucuacuuaccugcuggauuuuucaagcacuaaauuuauaacuuuuugaaacaa

SEQ ID NO: 187280 - RNA, 61 nt, hsa
cugcguaaugagacucaccuuuucucgcugaaagcacuaagaggugggaggaggccugcac

SEQ ID NO: 187281 - RNA, 61 nt, hsa
uugauaugauauuacuguauuuauuuuaagaaagcacuaagauguaauaaagugaugaacu

SEQ ID NO: 187282 - RNA, 61 nt, hsa
aaagggaagcagcauuucuuguuaacuaguuaagcacuaugcugcuaguuacaguguaggc

SEQ ID NO: 187283 - RNA, 61 nt, hsa
acuuuugguuucucgcauugccucucagacuaagcacuaaaaagcaaagcaaaacagaacu

SEQ ID NO: 187284 - RNA, 61 nt, hsa
augccuuucaaacauugagacugcuagaaccaagcacuaccaguaucuccauccuuaacug

SEQ ID NO: 187285 - RNA, 61 nt, hsa
cucucucuuuuuuugaguguagauuauuuuaaagcacuaauugcauuacauugguaacugc

SEQ ID NO: 187286 - RNA, 61 nt, hsa
acuuuaauacaggcagugcucaaacuagaauaagcacuaauuaaaggaauuguuggggguc

SEQ ID NO: 187287 - RNA, 61 nt, hsa
ucauuuaguugauauaauccuaccagaaggaaagcacuaagaaacacucguuuguuguuuu

SEQ ID NO: 187288 - RNA, 61 nt, hsa
accaaucgguaaucugauccaccacuuuucaaagcacuacuauaaaauucgucuuguuaga

SEQ ID NO: 187289 - RNA, 61 nt, hsa
caaauugacuucuccugagguggaucuuggaaagcacuagaaacuaaacaucuucaccagg

SEQ ID NO: 187290 - RNA, 61 nt, hsa
aaauggaggcaacauuuuggccaacauuggaaagcacuagagggcaaugggauuaaaccaa

SEQ ID NO: 187291 - RNA, 61 nt, hsa
aauaauggggaaaauauuugggaccaagcugaagcacuaaucccacuaaguuaaagacuuc

SEQ ID NO: 187292 - RNA, 61 nt, hsa
cagggaguuuauuggaggaucaaagaacugaaagcacuagagcagccuuggggacugcuag

SEQ ID NO: 187293 - RNA, 61 nt, hsa
accaaguggaaaggcaaguuggucuuauagaaagcacuacugcacuuaguagcuaugugau

SEQ ID NO: 187294 - RNA, 61 nt, hsa
gggacgaaugacgaugcccauccacuaccugaagcacuaggacacucuugcagggccaggc

SEQ ID NO: 187295 - RNA, 61 nt, hsa
agcacauugauuuggaguuucagaucuuccaaagcacuauuuguuguaauaacuuuucuaa

SEQ ID NO: 187296 - RNA, 61 nt, hsa
ggcucuccuuggccucgccguccuuguccacaagcacuauggcccccggcucaagugcugc

SEQ ID NO: 187297 - RNA, 61 nt, hsa
acgccuuuuuuagcaagccuucugcugauggaagcacuaggaugauucuaggcuguuaaau

SEQ ID NO: 187298 - RNA, 61 nt, hsa
uuaauggcugcugucuccaguuucugggguuaagcacuaaggacacaagaaucaaucagac

SEQ ID NO: 187299 - RNA, 61 nt, hsa
uuuugccagggaacaguucacugacuaggaaaagcacuacauuuuaaauucagcauuagug

SEQ ID NO: 187300 - RNA, 61 nt, hsa
aagaagaaagggaagacaauuuacaaacuccaagcacuaaaaggcaguauauuacagaaac

SEQ ID NO: 187301 - RNA, 61 nt, hsa
caauuuucugugaugauguauaccaacuauaaagcacuauguugguuuacuacuucaguaa

SEQ ID NO: 187302 - RNA, 61 nt, hsa
ggcauggagacuguggagggaauauuuuuuaaagcacuacucauauccuuuaaacuaaauu

SEQ ID NO: 187303 - RNA, 61 nt, hsa
uucucccuccucugucucaaacugcgcaggcaagcacuaugcaagcccaggcccucugcug

SEQ ID NO: 187304 - RNA, 61 nt, hsa
cuauuuuuaaacauacuagucugcugauagaaagcacuauacauccuauuguuucuuucuu

SEQ ID NO: 187305 - RNA, 61 nt, hsa
aagcauuguauuuuuuuuaacaaaucuaaaaaagcacuaugaacuacagguguuugacuuu

SEQ ID NO: 187306 - RNA, 61 nt, hsa
cccugguacugccuggugccugccacaaaauaagcacuaacaaaaguguauuguuuaaaaa

SEQ ID NO: 187307 - RNA, 61 nt, hsa
aagauuuugaauuauuauccagcagggcuggaagcacuagaugcagcaugagcacaacuau

SEQ ID NO: 187308 - RNA, 61 nt, hsa
uuaaacaaaugauuuccacaaacagaucaggaagcacuagguuggcagagacacuuugucu

SEQ ID NO: 187309 - RNA, 61 nt, hsa
gaucuaucaacaucaccccauuaagaauacaaagcacuacauucuuuuaucuuuuuugcuc

SEQ ID NO: 187310 - RNA, 61 nt, hsa
uagaagauggagaacuccagccaccuuuguaaagcacuaguguuugucauuuauguaaguc

SEQ ID NO: 187311 - RNA, 61 nt, hsa
uuagaccguuaccuauaagaauuaagggguaaagcacuaaacagaaaagaaaaaaaaaaua

SEQ ID NO: 187312 - RNA, 61 nt, hsa
aauguucuguuuaauggccauucauaaauucaagcacuaccacuggucaguuuugugugau

SEQ ID NO: 187313 - RNA, 61 nt, hsa
gauuauccacauaaucaaagcuuaucuuuuuaagcacuaaaacuuacuucauuguaacuau

SEQ ID NO: 187314 - RNA, 61 nt, hsa
caguuaggugaugagcacugcuuugaggcccaagcacuaguagagaugcgcgauacagguc

SEQ ID NO: 187315 - RNA, 61 nt, hsa
uaugcaaagcauccaggcgguucugaaugugaagcacuacacccagcagagucccggugcc

SEQ ID NO: 187316 - RNA, 61 nt, hsa
cacuaagggcaaaaaccaauauuuauaauguaagcacuauccagguaaaacacuggcccaa

SEQ ID NO: 187317 - RNA, 61 nt, hsa
cagcguauuagaguaaaagucuaccccucugaagcacuauuaagcgcuuaacguauauuua

SEQ ID NO: 187318 - RNA, 61 nt, hsa
auaauguguuaauauugcuauuaccuagguuaagcacuauugucugugcuaguaagaaaaa

SEQ ID NO: 187319 - RNA, 61 nt, hsa
uguucagaaaguuuguuuuaaaguuuauuuuaagcacuaucguaccaaauauuucauauuu

SEQ ID NO: 187320 - RNA, 61 nt, hsa
aaagccuuuguacaguuccugggauucacagaagcacuacuccagagcagaaugaugccuu

SEQ ID NO: 187321 - RNA, 61 nt, hsa
aaauuacugcuuucucuagaaauauaaagcaaagcacuauuccaaggcuauggaguagcuc

SEQ ID NO: 187322 - RNA, 61 nt, hsa
ggucucuuaaccuggcaccaguauaacuauaaagcacuagcugagaaggaacugauacuua

SEQ ID NO: 187323 - RNA, 61 nt, hsa
aaugcagcucucacuaacaacuucuugguaaaagcacuaaaaaagcucuugauagaauguu

SEQ ID NO: 187324 - RNA, 61 nt, hsa
uuaaauugaagagucuacauucagaacauaaaagcacuagguauacaaguuugaaauauga

SEQ ID NO: 187325 - RNA, 61 nt, hsa
ucuuaugaagcagcauuaugcaaggggaaaaaagcacuaugucuguguauguauguauaua

SEQ ID NO: 187326 - RNA, 61 nt, hsa
aaaacaacugguuauaugccucccuugcagcaagcacuacaauguaugugaucgucaaugu

SEQ ID NO: 187327 - RNA, 61 nt, hsa
gacaauauggcaauguccuucaaaauuauaaaagcacuaacucuuugauccaguaguuucc

SEQ ID NO: 187328 - RNA, 61 nt, hsa
ugugacagaugcagaucuuagaggacuuacaaagcacuauauugguaauucuuacaauggc

SEQ ID NO: 187329 - RNA, 61 nt, hsa
gggaggaacaaauuuaaucauuucuucuguuaagcacuaaucaguauagugcaacuccugg

SEQ ID NO: 187330 - RNA, 61 nt, hsa
ccuccuucaggaacacggggagcagaggccaaagcacuaaggggagggcgcauacccgaga

SEQ ID NO: 187331 - RNA, 61 nt, hsa
cuuaucucagagugaagauacugcggcugaaaagcacuaguuugauauaaaauuaaaauga

SEQ ID NO: 187332 - RNA, 61 nt, hsa
auuucauccucgaugggaauucuugcuagguaagcacuaauaacucggcaucuugacgaua

SEQ ID NO: 187333 - RNA, 61 nt, hsa
cacacuauauuuuaauugaauucaaacuaucaagcacuacuuagaaacuggaaaacauaua

SEQ ID NO: 187334 - RNA, 61 nt, hsa
gauguaccucuccccacuccccuugcuugagaagcacuacucaaaaauuuaccagaccuua

SEQ ID NO: 187335 - RNA, 61 nt, hsa
cauuuagauaugccaaaagaauuaaaaucaaaagcacuaagaaauacauaguugugugaug

SEQ ID NO: 187336 - RNA, 61 nt, hsa
ucuuuuaagagcugugaaugaaacuuuuucuaagcacuauucuauugcacacaaacagaaa

SEQ ID NO: 187337 - RNA, 61 nt, hsa
caccaugccuggccuguauguguguguuuuaaagcacuagauagggauggacauuaaaucu

SEQ ID NO: 187338 - RNA, 61 nt, hsa
acaaucuuucaccaaguaaauuuguauaaauaagcacuauucuuuguauuaccaaagcaag

SEQ ID NO: 187339 - RNA, 61 nt, hsa
uuaccuauccucucaaucacuacucuucuugaagcacuauuauuuauucuuccgcugucug

SEQ ID NO: 187340 - RNA, 61 nt, hsa
cccugcuucugguuugcugaagauuuucuagaagcacuauuuacacaaauaugcaaaugug

SEQ ID NO: 187341 - RNA, 61 nt, hsa
uugaugacucugccccucagcagggcuuacuaagcacuaccccuuaacagggaugacuccg

SEQ ID NO: 187342 - RNA, 61 nt, hsa
uuaugaaauacaaugguguuccaaaagaagaaagcacuaaaaacucaacuagcaggaagcg

SEQ ID NO: 187343 - RNA, 61 nt, hsa
guuaaacuccucuacuuaugugccaccuacaaagcacuagagacuguaggagaaaagaaag

SEQ ID NO: 187344 - RNA, 61 nt, hsa; identical to SEQ ID NO: 187343

SEQ ID NO: 187345 - RNA, 61 nt, hsa
ccuuguuggguaacucagccauggagaugccaagcacuagccaggaggugaguuccucuuu

SEQ ID NO: 187346 - RNA, 61 nt, hsa
aaacccacaggugcugcugcuuauaucugugaagcacuagcuuauucuaggaaugccugau

SEQ ID NO: 187347 - RNA, 61 nt, hsa
cccucaaacgagaacaaaaaguauucccugcaagcacuaugaauggaccuuacuacucucu

SEQ ID NO: 187348 - RNA, 61 nt, hsa
aagaaagacuguaagcuccaugauuagcauaaagcacuaaccaugucuccaugugacccga

SEQ ID NO: 187349 - RNA, 61 nt, hsa
uugccaagagaggaugcaucuggggagagcaaagcacuaaggaauucagcaucagccugca

SEQ ID NO: 187350 - RNA, 61 nt, hsa
uggagcugugccgaggcuugggcucccacauaagcacuagucuauagaugccucuuaggac

SEQ ID NO: 187351 - RNA, 61 nt, hsa
cuuugcucccugcaagaaaucagccauaagaaagcacuauuaauacucugcagugauuaga

SEQ ID NO: 187352 - RNA, 61 nt, hsa
uuuuacauguaacugaaguuccccugucuucaagcacuaaaacguugaucuuaaccuuuuu

SEQ ID NO: 187353 - RNA, 61 nt, hsa
uggaaguugucauccguaaaagcugaaguguaagcacuaggaaaucucaauauagagauuu

SEQ ID NO: 187354 - RNA, 61 nt, hsa
cauacugcacggacguagcguuucccucuacaagcacuaggagcaccuuucucaaggacaa

SEQ ID NO: 187355 - RNA, 61 nt, hsa
uuuugauaauaauauuguuuuucuuucuacaaagcacuagagaaugcacagauauacuuug

SEQ ID NO: 187356 - RNA, 61 nt, hsa
gguuauuacuuuuuuuauaaccagauuuuuaaagcacuagguuuuaaaucaguggguauca

SEQ ID NO: 187357 - RNA, 61 nt, hsa
ugaauucuuugggccuagaauauacuugagaaagcacuaguggcuuguguucagggagagg

SEQ ID NO: 187358 - RNA, 61 nt, hsa
aaacaauauaaaagccaauauaaauucucauaagcacuauagaauuugcaaauucagaaca

SEQ ID NO: 187359 - RNA, 61 nt, hsa
cccagaaggagugauuuuucuaucggcacaaaagcacuauauggacugguaaugguuacag

SEQ ID NO: 187360 - RNA, 61 nt, hsa
accaggccugcccuaaaagagcuccugaaggaagcacuaaacauggaaaggaacaacugau

SEQ ID NO: 187361 - RNA, 61 nt, hsa
aacugaccaaagucacacugccaggaacuggaagcacuaggauuugacagcauauccaaau

SEQ ID NO: 187362 - RNA, 61 nt, hsa
ccuucugcugacugccagaucccugcauuucaagcacuacgccuuccacccccaggcacug

SEQ ID NO: 187363 - RNA, 61 nt, hsa
gaucauaggcagcaagggcugauucuaggauaagcacuagaucucccuuaauaaacucaca

SEQ ID NO: 187364 - RNA, 61 nt, hsa
gccauaaauguuugcauaaugacauagcuuuaagcacuacaugauuuuaaucugcucacau

SEQ ID NO: 187365 - RNA, 61 nt, hsa
uguuuuaaaugcuuucuacuugugguucaagaagcacuagauuuaguaagaaacucuaccu

SEQ ID NO: 187366 - RNA, 61 nt, hsa
caagaagaugacugaguucuagagaccccacaagcacuauggacgaagcgugggaccccag

SEQ ID NO: 187367 - RNA, 61 nt, hsa
auuuauucagauauggcucuaauguauuaggaagcacuaaauggccuaaaaaagcuacuac

SEQ ID NO: 187368 - RNA, 61 nt, hsa
caaguggauggauauucuagcgcucccaaaaaagcacuauggccuuauaugcagggaaggc

SEQ ID NO: 187369 - RNA, 61 nt, hsa
ucuuaaauaccucacugucuuggccauggggaagcacuauggccucagcugggggaaagac

SEQ ID NO: 187370 - RNA, 61 nt, hsa
aguugccucauagccugcugguccuguaagcaagcacuaagcuccacagugccaguuccuu

SEQ ID NO: 187371 - RNA, 61 nt, hsa
gaagagauaauuacaaucaggcuaccaaaggaagcacuaacuuuggugcuuucaaguuggc

SEQ ID NO: 187372 - RNA, 61 nt, hsa
uugaaauuuaugugaauuauuuugauuguagaagcacuauaauaugugcugaaacuaaauu

SEQ ID NO: 187373 - RNA, 61 nt, hsa
auuuuugaagcuguauacugugugcuaaaacaagcacuaaacaaagagugaaggauuuaug

SEQ ID NO: 187374 - RNA, 61 nt, hsa
agauucugagaucuucccauucuaggccuacaagcacuacuugcuguagcugagacuuguc

SEQ ID NO: 187375 - RNA, 61 nt, hsa
guguauuuuguuuccuuauagccauuaaagaaagcacuaaggaugaugggagcuccaaauc

SEQ ID NO: 187376 - RNA, 61 nt, hsa
ccuaaugaaagcuauauacuugugcuaucuaaagcacuacuuuguaaagaugacuacccaa

SEQ ID NO: 187377 - RNA, 61 nt, hsa
acauaggggaaaaaacgaggucauuucuacuaagcacuaggaccugccauagugaguuuaa

SEQ ID NO: 187378 - RNA, 61 nt, hsa
aaaagcauuggcauuauuuucaauaaauaucaagcacuaaaaaaagaaaugauugucuuuu

SEQ ID NO: 187379 - RNA, 61 nt, hsa
aaacuggcuuauacuguaaucuacaacuaauaagcacuaauuuagaguucagcuauauugu

SEQ ID NO: 187380 - RNA, 61 nt, hsa
gugaauacuuacauagugcuuacuauaugcuaagcacuauuuuuagcauguuauuuauauu

SEQ ID NO: 187381 - RNA, 62 nt, hsa
gauucccuagaagagaacccucuacuuuuuguaagcacuacugacucucgcuguauuuaaga

SEQ ID NO: 187382 - RNA, 62 nt, hsa
gacuuuacauuguaucuaaguuaaucuuuauaaagcacuagaauuuuuggucaaaagucaaa

SEQ ID NO: 187383 - RNA, 62 nt, hsa
gggcagaaagcucuuagacaauggacuauccaaagcacuauuuaaauucugccucuuccuac

SEQ ID NO: 187384 - RNA, 62 nt, hsa
uuagucuccccgccucauucccacccccaacaaagcacuaucauuuucauuuggaaugggua

SEQ ID NO: 187385 - RNA, 62 nt, hsa
auauugaucuuuuuaucaugauccucccuaucaagcacuaaaaaguugaaccauuauacuuu

SEQ ID NO: 187386 - RNA, 62 nt, hsa
cacugauccuuaguaacauguuaacauuuaugaagcacuauauauugauuugcaaaaucuuu

SEQ ID NO: 187387 - RNA, 62 nt, hsa
uccaauguaauuggcugcgucuggcuaauucuaagcacuaaagucuacaucuaagcuauaga

SEQ ID NO: 187388 - RNA, 62 nt, hsa
acuuagguucauugugccucaguuccucucaaaagcacuaaaucuaagugcaaacaaguauu

SEQ ID NO: 187389 - RNA, 62 nt, hsa
gcuuuuugguaauauguuacaauuaaaaugacaagcacuauaucacaaucucuguuuguaug

SEQ ID NO: 187390 - RNA, 62 nt, hsa
guuccagugagagaaaccaaccacaggcacccaagcacuaccagacaaagcguauuaaacag

SEQ ID NO: 187391 - RNA, 62 nt, hsa
cccagagcugaucucucauccgcucuggccccaagcacuauuucuuccuuuuccacuuaggc

SEQ ID NO: 187392 - RNA, 62 nt, hsa
ugagaauguaugugaaagauuuguaaaugguaaagcacuauauucuuguuuguuaguccuuu

SEQ ID NO: 187393 - RNA, 62 nt, hsa
auguuuggggucuuugugguagcuuaucuuagaagcacuacaccuugccuugcuguuugucc

SEQ ID NO: 187394 - RNA, 62 nt, hsa
agggucuuuguaggaguugcucuugcuguguaaagcacuauugucuugggguugagcccuag

SEQ ID NO: 187395 - RNA, 62 nt, hsa
ccacaaugaauuguccuuaauuaccaacagugaagcacuacaggaggcaacuguggcauugc

SEQ ID NO: 187396 - RNA, 62 nt, hsa
aaaggaauguauagauguuuggauggaaacaaaagcacuagacugaguuuccucuuauaggu

SEQ ID NO: 187397 - RNA, 62 nt, hsa
auuuacaaggccuaucauguccuugucaugaaaagcacuaaaaaaaaaaagaguuuaagugg

SEQ ID NO: 187398 - RNA, 62 nt, hsa
ggcacccacaaauaaaugacaagugagacaaaaagcacuaguauaaagauuauauaaagacc

SEQ ID NO: 187399 - RNA, 62 nt, hsa
ccgaauucauuaauuuacuguaguguuaagagaagcacuaagaaugccagugaccuguguaa

SEQ ID NO: 187400 - RNA, 62 nt, hsa
gagcagaucugcuuuuuuuccagagcaaaaugaagcacuagguauaaauauguuguuacugc

SEQ ID NO: 187401 - RNA, 62 nt, hsa
cuguucgcugcaguuguuccccaucaguacucaagcacuauaagccuuagauuccuuuccuc

SEQ ID NO: 187402 - RNA, 62 nt, hsa
ucucucuucaaccuucaucucaaauugucucuaagcacuaccuuccccagagcuugccaggu

SEQ ID NO: 187403 - RNA, 62 nt, hsa
auacugcacaguggcacaaaaaaauaucagacaagcacuauuuuauauuuaaaaauuguuuc

SEQ ID NO: 187404 - RNA, 62 nt, hsa
uaucuguaguuuuuuguuuuuguuuuuuuuuaaagcacuacaucuguuuucacuaauuguua

SEQ ID NO: 187405 - RNA, 62 nt, hsa
aaaccaguuagcugcuauauaaacacuauaccaagcacuaggcuuagaggaaaagaugucag

SEQ ID NO: 187406 - RNA, 62 nt, hsa
aaauaagguauauuuuuuagaaucaacuuuguaagcacuauaaaaucuuuaauaaguuauaa

SEQ ID NO: 187407 - RNA, 62 nt, hsa
cuaguuuucuguccugcaauauguauauaauuaagcacuaauuuguacugcuuagcauaaaa

SEQ ID NO: 187408 - RNA, 62 nt, hsa
auacuucguggagcccagcgagcaucccgggcaagcacuaccaggcugugggucugcaccuc

SEQ ID NO: 187409 - RNA, 62 nt, hsa
uuguauccauuuaaacuaaccuuuuaucaauaaagcacuauuguuuagauauuaaaugagua

SEQ ID NO: 187410 - RNA, 62 nt, hsa
guaugguuaacuucacgcagcugcuuuugcagaagcacuaauaaaaacaaauauuuuguacc

SEQ ID NO: 187411 - RNA, 62 nt, hsa
auuuaagucagccaaagaauauuguuaccuuaaagcacuauuuuauuuauagauauaucuag

SEQ ID NO: 187412 - RNA, 62 nt, hsa
ggcccggcaggagagccugcaggagcgcaagcaagcacuauaugaauacgcaagaaggugag

SEQ ID NO: 187413 - RNA, 62 nt, hsa
gaaggaaguucauucaaggauaaguuggaauaaagcacuauguuaaaacaucugcuuuuuaa

SEQ ID NO: 187414 - RNA, 62 nt, hsa
uuuaaaacuucacuaauauagcauugugugauaagcacuaagcagucaguccccugggggaa

SEQ ID NO: 187415 - RNA, 62 nt, hsa
agauacaagugucaguuucuuaguucucauuuaagcacuaguggaauuuuuuuuuuuugaua

SEQ ID NO: 187416 - RNA, 62 nt, hsa
auuguuguuaauugggacuuucuguuaaugaaaagcacuauucccaagauuaauaguguucu

SEQ ID NO: 187417 - RNA, 62 nt, hsa
aggacuuuagcugugaccucucuaacacagagaagcacuaacuuagauccucauucuuaaua

SEQ ID NO: 187418 - RNA, 62 nt, hsa
aaagaucugucaaucaagcaguagugugaaaaaagcacuauaagaaaaugcaucaucaguuu

SEQ ID NO: 187419 - RNA, 62 nt, hsa
ucugggguuggaagugugacuucuuacacauaaagcacuaccuaaguaauucucucucuguu

SEQ ID NO: 187420 - RNA, 62 nt, hsa
guugaguucuguagagccuucugaugucucuaaagcacuaccgauucuuuggaguugucaca

SEQ ID NO: 187421 - RNA, 62 nt, hsa
ccaagagggcuuuauuacaccucagaaauugaaagcacuaugaauuuguccauuuaaaaaug

SEQ ID NO: 187422 - RNA, 62 nt, hsa
caagguggggccaguugcgauucuaaaggaagaagcacuaaauggcagggugaucaguccaa

SEQ ID NO: 187423 - RNA, 62 nt, hsa
uaacccccaccccuucaggaucagucaagggaaagcacuagaaccccuggguagggaaagaa

SEQ ID NO: 187424 - RNA, 62 nt, hsa
cagaagaaaacagguuaacaaucaaguagugaaagcacuauauucuagucauuaacucaacg

SEQ ID NO: 187425 - RNA, 62 nt, hsa
uccaggggcagguaaagcccugcugggcucagaagcacuauagaauuugcuguacacacuga

SEQ ID NO: 187426 - RNA, 62 nt, hsa
gugaauugugagcaaaagaucuugaaagcaaaaagcacuaauuaguuuaaaaugucacuuuu

SEQ ID NO: 187427 - RNA, 62 nt, hsa
aucccaacaugaaauuauauuacucagauuuaaagcacuaucauuaaucuuucaaucuaauu

SEQ ID NO: 187428 - RNA, 62 nt, hsa
aguauacaggaggaugugaauagguuauaugcaagcacuaugcccuuuuauauaagugacuu

SEQ ID NO: 187429 - RNA, 62 nt, hsa
uguuauuauacuacuaauaauagagcacuuguaagcacuaaguuaucuuuauccaacauuuc

SEQ ID NO: 187430 - RNA, 62 nt, hsa
cauugacuuggagcaccuggaggauguaccagaagcacuagaccaggacgaccuccagcgcg

SEQ ID NO: 187431 - RNA, 62 nt, hsa
cugaacuugcuguuaacacaguguuauaacucaagcacuagcuucaggaagcauguuguguu

SEQ ID NO: 187432 - RNA, 62 nt, hsa
uucuagaaagaucacuaauggucaaguggaacaagcacuacacgacuaaccccuauuggggu

SEQ ID NO: 187433 - RNA, 62 nt, hsa
gcucccaucucuccucccuaaugccucacuucaagcacuaauuuggcucuuucugcucacua

SEQ ID NO: 187434 - RNA, 54 nt, hsa; identical to SEQ ID NO: 187233

SEQ ID NO: 187435 - RNA, 62 nt, hsa
uuucuguaaccuuuugaaaucuaguuacuaauaagcacuacuguaauuuagcacaguuuaac

SEQ ID NO: 187436 - RNA, 62 nt, hsa
auucuaaagguguugucacuguauaaaacagaaagcacuaggauacaaaugaagcuuaauua

SEQ ID NO: 187437 - RNA, 62 nt, hsa
ugagcuauggcugcuuuuguagccuuuccaagaagcacuaaccugaaauaagauuagauaau

SEQ ID NO: 187438 - RNA, 62 nt, hsa
auuccuaaagccacuauuguguuuucucuaagaagcacuacaugccaccagaauugugcacu

SEQ ID NO: 187439 - RNA, 62 nt, hsa
cuuugggcugugagcauuuagaacgagccuggaagcacuacagagcaucccacaggaccaca

SEQ ID NO: 187440 - RNA, 62 nt, hsa
uuuccauuccagaauaucugggauucuacuuuaagcacuacauaaacugacuuuauccucag

SEQ ID NO: 187441 - RNA, 62 nt, hsa
uguaaaaaaccaaaaaggacuuuuuguauagaaagcacuacccuaagccaugaagaacucca

SEQ ID NO: 187442 - RNA, 62 nt, hsa
ugguagugaauguguaguuggggaauaaagaaaagcacuaaauccugcccuuuuuguguggu

SEQ ID NO: 187443 - RNA, 62 nt, hsa
gagcucuuuuuuccuuucugcugauuugcuggaagcacuacaagacuucuguuuguucguuc

SEQ ID NO: 187444 - RNA, 62 nt, hsa
auguuuauacacagggaguguaugguuccuguaagcacuaaguuagcuguuuucauuuaaug

SEQ ID NO: 187445 - RNA, 62 nt, hsa
accuguucgugugguauaugaaaaagauaccuaagcacuagaauauccagcuaaauggugca

SEQ ID NO: 187446 - RNA, 62 nt, hsa
ucauauacgugaaaauuauuugaaaacauauaaagcacuauacagauucgaaacuccauuga

SEQ ID NO: 187447 - RNA, 62 nt, hsa
guaguuaagaguggggucaccccuuuaacuccaagcacuacauuuuggcggcugccggccuc

SEQ ID NO: 187448 - RNA, 62 nt, hsa
gcuaauucuggggauagaaugauaaaagacucaagcacuaaaaauauacauugccgaaucuc

SEQ ID NO: 187449 - RNA, 62 nt, hsa
auuuauguuuaaguauuuagaaaaaggugaaaaagcacuauuaucaguucugccuagguaaa

SEQ ID NO: 187450 - RNA, 62 nt, hsa
aaagcaaaaauuuuaacuguuuucuaauugucaagcacuauuuucauuaaaagugucuaaug

SEQ ID NO: 187451 - RNA, 62 nt, hsa
aacuucucaaaaauuguacaucuguguaacuaaagcacuaacaaaaacaugaauaguccuuc

SEQ ID NO: 187452 - RNA, 62 nt, hsa
ggugaugggcuggggugggucccuggaaucagaagcacuagugcugccauuaaugaauuguu

SEQ ID NO: 187453 - RNA, 62 nt, hsa
ggcccugaaauggccugucccuagggcucuccaagcacuagccuucccagcuucccgccgcc

SEQ ID NO: 187454 - RNA, 62 nt, hsa
ggagcagagugauuucuugcuuccucccuucaaagcacuaccacaccuagacuggaaaugug

SEQ ID NO: 187455 - RNA, 62 nt, hsa
auuuagcaacacagguaaaaaugcaccuuuuaaagcacuacguuuucacagacaauaacugu

SEQ ID NO: 187456 - RNA, 62 nt, hsa
uucucaagaauuacuggcuuuaaaagaagccaaagcacuacuagcuuuuuuuccauauuggu

SEQ ID NO: 187457 - RNA, 62 nt, hsa
ucauuuauugaaaaaaaaaaaaaaugcccccaaagcacuaugcuggucaugaacugcuucaa

SEQ ID NO: 187458 - RNA, 62 nt, hsa
ccaaauacaucucucccuucuugaaaucccuaaagcacuaucgcacuccuaaaugcauuucu

SEQ ID NO: 187459 - RNA, 62 nt, hsa
ucauucuuuuuucuauuaagccauugaaagagaagcacuaagacugcuucuaggcuuuauuu

SEQ ID NO: 187460 - RNA, 62 nt, hsa
uuuuauuucuuuuuuuuuuaauugggggaaauaagcacuauuaacagauucagcacuacaag

SEQ ID NO: 187461 - RNA, 62 nt, hsa
acgugauucucagugugauuccaauuauuacgaagcacuaaucaguaacgcuacaaugauca

SEQ ID NO: 187462 - RNA, 62 nt, hsa
aauauauacauguaauaugaaaauugagauugaagcacuaauuccaaaauuauggcugaaua

SEQ ID NO: 187463 - RNA, 62 nt, hsa
uacccuuguuaguuauuuuaggagacagucucaagcacuaaaaaguggcuaauucaauuuau

SEQ ID NO: 187464 - RNA, 62 nt, hsa
uauggcagauaugguauggaucguaaaauuuuaagcacuaaaaauuuuuucauaaccuuuca

SEQ ID NO: 187465 - RNA, 62 nt, hsa
uaaucuucuaaaggcuauacaauugaaugaggaagcacuaacaaaagcaguaguucaguaca

SEQ ID NO: 187466 - RNA, 62 nt, hsa
uucaggcuaauuaguggauuaagcaauaaugaaagcacuaaguuugguuuugcuuuugugag

SEQ ID NO: 187467 - RNA, 62 nt, hsa
ggggcaauggaugcauuucccaaaacgugugaaagcacuaacagcuuauauugcugaaugag

SEQ ID NO: 187468 - RNA, 62 nt, hsa
aacuacuuacucugauggaccaauaaugaagaaagcacuaggagcucuuuuggggguguagu

SEQ ID NO: 187469 - RNA, 62 nt, hsa
auguccauagagaagagguuuucuaugucuucaagcacuauaucauaguccguguucaaagu

SEQ ID NO: 187470 - RNA, 62 nt, hsa
uuuuaaauagaaaucacaaauagcaaguguggaagcacuacuuuauucuguuuaaaauguac

SEQ ID NO: 187471 - RNA, 62 nt, hsa
ugaguacaaacugauucaguucuaaaguuccaaagcacuaaaaacuuaucuauggugauuac

SEQ ID NO: 187472 - RNA, 62 nt, hsa
uuauaucaaggucucagaugagcuuagugcacaagcacuaucacuuuaaauacuauuauuug

SEQ ID NO: 187473 - RNA, 62 nt, hsa
uggacucaccucuggagccuauggcuuuaagcaagcacuacugcacuuuacagaauuacccc

SEQ ID NO: 187474 - RNA, 62 nt, hsa
aagagcuuucuggguuaacgcuuuucagggccaagcacuauaaggguuuagcuguggcgcag

SEQ ID NO: 187475 - RNA, 62 nt, hsa
uuacaaauuccagauaucuacaaaagaugugaaagcacuaaaaauaccauuuuuaagcagua

SEQ ID NO: 187476 - RNA, 62 nt, hsa
aagacuuuaaaacucuggcuggacagaguuuuaagcacuaugcugcaggaauccugagaaaa

SEQ ID NO: 187477 - RNA, 62 nt, hsa
gucuucccgaugagggaaggagcccagccagaaagcacuacaaucauggucaaguucccaac

SEQ ID NO: 187478 - RNA, 62 nt, hsa
ugauauguauuccaaaaaagucauagaagaugaagcacuauaauauuguucccauauauuua

SEQ ID NO: 187479 - RNA, 62 nt, hsa
aagccucuguguaggugguagggagugagucaaagcacuaauagaccaggcaacuuaccacu

SEQ ID NO: 187480 - RNA, 62 nt, hsa
guuaguccuucuacuuaccugcuggauuuuucaagcacuaaauuuauaacuuuuugaaacaa

SEQ ID NO: 187481 - RNA, 62 nt, hsa
ucugcguaaugagacucaccuuuucucgcugaaagcacuaagaggugggaggaggccugcac

SEQ ID NO: 187482 - RNA, 62 nt, hsa
uuugauaugauauuacuguauuuauuuuaagaaagcacuaagauguaauaaagugaugaacu

SEQ ID NO: 187483 - RNA, 62 nt, hsa
caaagggaagcagcauuucuuguuaacuaguuaagcacuaugcugcuaguuacaguguaggc

SEQ ID NO: 187484 - RNA, 62 nt, hsa
gacuuuugguuucucgcauugccucucagacuaagcacuaaaaagcaaagcaaaacagaacu

SEQ ID NO: 187485 - RNA, 62 nt, hsa
aaugccuuucaaacauugagacugcuagaaccaagcacuaccaguaucuccauccuuaacug

SEQ ID NO: 187486 - RNA, 62 nt, hsa
ucucucucuuuuuuugaguguagauuauuuuaaagcacuaauugcauuacauugguaacugc

SEQ ID NO: 187487 - RNA, 62 nt, hsa
gacuuuaauacaggcagugcucaaacuagaauaagcacuaauuaaaggaauuguuggggguc

SEQ ID NO: 187488 - RNA, 62 nt, hsa
uucauuuaguugauauaauccuaccagaaggaaagcacuaagaaacacucguuuguuguuuu

SEQ ID NO: 187489 - RNA, 62 nt, hsa
aaccaaucgguaaucugauccaccacuuuucaaagcacuacuauaaaauucgucuuguuaga

SEQ ID NO: 187490 - RNA, 62 nt, hsa
acaaauugacuucuccugagguggaucuuggaaagcacuagaaacuaaacaucuucaccagg

SEQ ID NO: 187491 - RNA, 62 nt, hsa
aaaauggaggcaacauuuuggccaacauuggaaagcacuagagggcaaugggauuaaaccaa

SEQ ID NO: 187492 - RNA, 62 nt, hsa
caauaauggggaaaauauuugggaccaagcugaagcacuaaucccacuaaguuaaagacuuc

SEQ ID NO: 187493 - RNA, 62 nt, hsa
ucagggaguuuauuggaggaucaaagaacugaaagcacuagagcagccuuggggacugcuag

SEQ ID NO: 187494 - RNA, 62 nt, hsa
aaccaaguggaaaggcaaguuggucuuauagaaagcacuacugcacuuaguagcuaugugau

SEQ ID NO: 187495 - RNA, 62 nt, hsa
ugggacgaaugacgaugcccauccacuaccugaagcacuaggacacucuugcagggccaggc

SEQ ID NO: 187496 - RNA, 62 nt, hsa
gagcacauugauuuggaguuucagaucuuccaaagcacuauuuguuguaauaacuuuucuaa

SEQ ID NO: 187497 - RNA, 62 nt, hsa
uggcucuccuuggccucgccguccuuguccacaagcacuauggcccccggcucaagugcugc

SEQ ID NO: 187498 - RNA, 62 nt, hsa
cacgccuuuuuuagcaagccuucugcugauggaagcacuaggaugauucuaggcuguuaaau

SEQ ID NO: 187499 - RNA, 62 nt, hsa
auuaauggcugcugucuccaguuucugggguuaagcacuaaggacacaagaaucaaucagac

SEQ ID NO: 187500 - RNA, 62 nt, hsa
auuuugccagggaacaguucacugacuaggaaaagcacuacauuuuaaauucagcauuagug

SEQ ID NO: 187501 - RNA, 62 nt, hsa
aaagaagaaagggaagacaauuuacaaacuccaagcacuaaaaggcaguauauuacagaaac

SEQ ID NO: 187502 - RNA, 62 nt, hsa
ucaauuuucugugaugauguauaccaacuauaaagcacuauguugguuuacuacuucaguaa

SEQ ID NO: 187503 - RNA, 62 nt, hsa
uggcauggagacuguggagggaauauuuuuuaaagcacuacucauauccuuuaaacuaaauu

SEQ ID NO: 187504 - RNA, 62 nt, hsa
cuucucccuccucugucucaaacugcgcaggcaagcacuaugcaagcccaggcccucugcug

SEQ ID NO: 187505 - RNA, 62 nt, hsa
acuauuuuuaaacauacuagucugcugauagaaagcacuauacauccuauuguuucuuucuu

SEQ ID NO: 187506 - RNA, 62 nt, hsa
uaagcauuguauuuuuuuuaacaaaucuaaaaaagcacuaugaacuacagguguuugacuuu

SEQ ID NO: 187507 - RNA, 62 nt, hsa
acccugguacugccuggugccugccacaaaauaagcacuaacaaaaguguauuguuuaaaaa

SEQ ID NO: 187508 - RNA, 62 nt, hsa
gaagauuuugaauuauuauccagcagggcuggaagcacuagaugcagcaugagcacaacuau

SEQ ID NO: 187509 - RNA, 62 nt, hsa
guuaaacaaaugauuuccacaaacagaucaggaagcacuagguuggcagagacacuuugucu

SEQ ID NO: 187510 - RNA, 62 nt, hsa
ugaucuaucaacaucaccccauuaagaauacaaagcacuacauucuuuuaucuuuuuugcuc

SEQ ID NO: 187511 - RNA, 62 nt, hsa
uuagaagauggagaacuccagccaccuuuguaaagcacuaguguuugucauuuauguaaguc

SEQ ID NO: 187512 - RNA, 62 nt, hsa
auuagaccguuaccuauaagaauuaagggguaaagcacuaaacagaaaagaaaaaaaaaaua

SEQ ID NO: 187513 - RNA, 62 nt, hsa
aaauguucuguuuaauggccauucauaaauucaagcacuaccacuggucaguuuugugugau

SEQ ID NO: 187514 - RNA, 62 nt, hsa
ggauuauccacauaaucaaagcuuaucuuuuuaagcacuaaaacuuacuucauuguaacuau

SEQ ID NO: 187515 - RNA, 62 nt, hsa
gcaguuaggugaugagcacugcuuugaggcccaagcacuaguagagaugcgcgauacagguc

SEQ ID NO: 187516 - RNA, 62 nt, hsa
cuaugcaaagcauccaggcgguucugaaugugaagcacuacacccagcagagucccggugcc

SEQ ID NO: 187517 - RNA, 62 nt, hsa
gcacuaagggcaaaaaccaauauuuauaauguaagcacuauccagguaaaacacuggcccaa

SEQ ID NO: 187518 - RNA, 62 nt, hsa
gcagcguauuagaguaaaagucuaccccucugaagcacuauuaagcgcuuaacguauauuua

SEQ ID NO: 187519 - RNA, 62 nt, hsa
gauaauguguuaauauugcuauuaccuagguuaagcacuauugucugugcuaguaagaaaaa

SEQ ID NO: 187520 - RNA, 62 nt, hsa
uuguucagaaaguuuguuuuaaaguuuauuuuaagcacuaucguaccaaauauuucauauuu

SEQ ID NO: 187521 - RNA, 62 nt, hsa
gaaagccuuuguacaguuccugggauucacagaagcacuacuccagagcagaaugaugccuu

SEQ ID NO: 187522 - RNA, 62 nt, hsa
gaaauuacugcuuucucuagaaauauaaagcaaagcacuauuccaaggcuauggaguagcuc

SEQ ID NO: 187523 - RNA, 62 nt, hsa
aggucucuuaaccuggcaccaguauaacuauaaagcacuagcugagaaggaacugauacuua

SEQ ID NO: 187524 - RNA, 62 nt, hsa
gaaugcagcucucacuaacaacuucuugguaaaagcacuaaaaaagcucuugauagaauguu

SEQ ID NO: 187525 - RNA, 62 nt, hsa
auuaaauugaagagucuacauucagaacauaaaagcacuagguauacaaguuugaaauauga

SEQ ID NO: 187526 - RNA, 62 nt, hsa
uucuuaugaagcagcauuaugcaaggggaaaaaagcacuaugucuguguauguauguauaua

SEQ ID NO: 187527 - RNA, 62 nt, hsa
caaaacaacugguuauaugccucccuugcagcaagcacuacaauguaugugaucgucaaugu

SEQ ID NO: 187528 - RNA, 62 nt, hsa
ggacaauauggcaauguccuucaaaauuauaaaagcacuaacucuuugauccaguaguuucc

SEQ ID NO: 187529 - RNA, 62 nt, hsa
augugacagaugcagaucuuagaggacuuacaaagcacuauauugguaauucuuacaauggc

SEQ ID NO: 187530 - RNA, 62 nt, hsa
ugggaggaacaaauuuaaucauuucuucuguuaagcacuaaucaguauagugcaacuccugg

SEQ ID NO: 187531 - RNA, 62 nt, hsa
uccuccuucaggaacacggggagcagaggccaaagcacuaaggggagggcgcauacccgaga

SEQ ID NO: 187532 - RNA, 62 nt, hsa
gcuuaucucagagugaagauacugcggcugaaaagcacuaguuugauauaaaauuaaaauga

SEQ ID NO: 187533 - RNA, 62 nt, hsa
uauuucauccucgaugggaauucuugcuagguaagcacuaauaacucggcaucuugacgaua

SEQ ID NO: 187534 - RNA, 62 nt, hsa
acacacuauauuuuaauugaauucaaacuaucaagcacuacuuagaaacuggaaaacauaua

SEQ ID NO: 187535 - RNA, 62 nt, hsa
ggauguaccucuccccacuccccuugcuugagaagcacuacucaaaaauuuaccagaccuua

SEQ ID NO: 187536 - RNA, 62 nt, hsa
acauuuagauaugccaaaagaauuaaaaucaaaagcacuaagaaauacauaguugugugaug

SEQ ID NO: 187537 - RNA, 62 nt, hsa
uucuuuuaagagcugugaaugaaacuuuuucuaagcacuauucuauugcacacaaacagaaa

SEQ ID NO: 187538 - RNA, 62 nt, hsa
ccaccaugccuggccuguauguguguguuuuaaagcacuagauagggauggacauuaaaucu

SEQ ID NO: 187539 - RNA, 62 nt, hsa
uacaaucuuucaccaaguaaauuuguauaaauaagcacuauucuuuguauuaccaaagcaag

SEQ ID NO: 187540 - RNA, 62 nt, hsa
uuuaccuauccucucaaucacuacucuucuugaagcacuauuauuuauucuuccgcugucug

SEQ ID NO: 187541 - RNA, 62 nt, hsa
ucccugcuucugguuugcugaagauuuucuagaagcacuauuuacacaaauaugcaaaugug

SEQ ID NO: 187542 - RNA, 62 nt, hsa
uuugaugacucugccccucagcagggcuuacuaagcacuaccccuuaacagggaugacuccg

SEQ ID NO: 187543 - RNA, 62 nt, hsa
auuaugaaauacaaugguguuccaaaagaagaaagcacuaaaaacucaacuagcaggaagcg

SEQ ID NO: 187544 - RNA, 62 nt, hsa
aguuaaacuccucuacuuaugugccaccuacaaagcacuagagacuguaggagaaaagaaag

SEQ ID NO: 187545 - RNA, 62 nt, hsa; identical to SEQ ID NO: 187544

SEQ ID NO: 187546 - RNA, 62 nt, hsa
uccuuguuggguaacucagccauggagaugccaagcacuagccaggaggugaguuccucuuu

SEQ ID NO: 187547 - RNA, 62 nt, hsa
aaaacccacaggugcugcugcuuauaucugugaagcacuagcuuauucuaggaaugccugau

SEQ ID NO: 187548 - RNA, 62 nt, hsa
ccccucaaacgagaacaaaaaguauucccugcaagcacuaugaauggaccuuacuacucucu

SEQ ID NO: 187549 - RNA, 62 nt, hsa
aaagaaagacuguaagcuccaugauuagcauaaagcacuaaccaugucuccaugugacccga

SEQ ID NO: 187550 - RNA, 62 nt, hsa
auugccaagagaggaugcaucuggggagagcaaagcacuaaggaauucagcaucagccugca

SEQ ID NO: 187551 - RNA, 62 nt, hsa
auggagcugugccgaggcuugggcucccacauaagcacuagucuauagaugccucuuaggac

SEQ ID NO: 187552 - RNA, 62 nt, hsa
ucuuugcucccugcaagaaaucagccauaagaaagcacuauuaauacucugcagugauuaga

SEQ ID NO: 187553 - RNA, 62 nt, hsa
auuuuacauguaacugaaguuccccugucuucaagcacuaaaacguugaucuuaaccuuuuu

SEQ ID NO: 187554 - RNA, 62 nt, hsa
auggaaguugucauccguaaaagcugaaguguaagcacuaggaaaucucaauauagagauuu

SEQ ID NO: 187555 - RNA, 62 nt, hsa
ccauacugcacggacguagcguuucccucuacaagcacuaggagcaccuuucucaaggacaa

SEQ ID NO: 187556 - RNA, 62 nt, hsa
auuuugauaauaauauuguuuuucuuucuacaaagcacuagagaaugcacagauauacuuug

SEQ ID NO: 187557 - RNA, 62 nt, hsa
agguuauuacuuuuuuuauaaccagauuuuuaaagcacuagguuuuaaaucaguggguauca

SEQ ID NO: 187558 - RNA, 62 nt, hsa
uugaauucuuugggccuagaauauacuugagaaagcacuaguggcuuguguucagggagagg

SEQ ID NO: 187559 - RNA, 62 nt, hsa
caaacaauauaaaagccaauauaaauucucauaagcacuauagaauuugcaaauucagaaca

SEQ ID NO: 187560 - RNA, 62 nt, hsa
ccccagaaggagugauuuuucuaucggcacaaaagcacuauauggacugguaaugguuacag

SEQ ID NO: 187561 - RNA, 62 nt, hsa
caccaggccugcccuaaaagagcuccugaaggaagcacuaaacauggaaaggaacaacugau

SEQ ID NO: 187562 - RNA, 62 nt, hsa
uaacugaccaaagucacacugccaggaacuggaagcacuaggauuugacagcauauccaaau

SEQ ID NO: 187563 - RNA, 62 nt, hsa
uccuucugcugacugccagaucccugcauuucaagcacuacgccuuccacccccaggcacug

SEQ ID NO: 187564 - RNA, 62 nt, hsa
agaucauaggcagcaagggcugauucuaggauaagcacuagaucucccuuaauaaacucaca

SEQ ID NO: 187565 - RNA, 62 nt, hsa
ugccauaaauguuugcauaaugacauagcuuuaagcacuacaugauuuuaaucugcucacau

SEQ ID NO: 187566 - RNA, 62 nt, hsa
auguuuuaaaugcuuucuacuugugguucaagaagcacuagauuuaguaagaaacucuaccu

SEQ ID NO: 187567 - RNA, 62 nt, hsa
acaagaagaugacugaguucuagagaccccacaagcacuauggacgaagcgugggaccccag

SEQ ID NO: 187568 - RNA, 62 nt, hsa
cauuuauucagauauggcucuaauguauuaggaagcacuaaauggccuaaaaaagcuacuac

SEQ ID NO: 187569 - RNA, 62 nt, hsa
ucaaguggauggauauucuagcgcucccaaaaaagcacuauggccuuauaugcagggaaggc

SEQ ID NO: 187570 - RNA, 62 nt, hsa
uucuuaaauaccucacugucuuggccauggggaagcacuauggccucagcugggggaaagac

SEQ ID NO: 187571 - RNA, 62 nt, hsa
caguugccucauagccugcugguccuguaagcaagcacuaagcuccacagugccaguuccuu

SEQ ID NO: 187572 - RNA, 62 nt, hsa
agaagagauaauuacaaucaggcuaccaaaggaagcacuaacuuuggugcuuucaaguuggc

SEQ ID NO: 187573 - RNA, 62 nt, hsa
auugaaauuuaugugaauuauuuugauuguagaagcacuauaauaugugcugaaacuaaauu

SEQ ID NO: 187574 - RNA, 62 nt, hsa
gauuuuugaagcuguauacugugugcuaaaacaagcacuaaacaaagagugaaggauuuaug

SEQ ID NO: 187575 - RNA, 62 nt, hsa
uagauucugagaucuucccauucuaggccuacaagcacuacuugcuguagcugagacuuguc

SEQ ID NO: 187576 - RNA, 62 nt, hsa
uguguauuuuguuuccuuauagccauuaaagaaagcacuaaggaugaugggagcuccaaauc

SEQ ID NO: 187577 - RNA, 62 nt, hsa
gccuaaugaaagcuauauacuugugcuaucuaaagcacuacuuuguaaagaugacuacccaa

SEQ ID NO: 187578 - RNA, 62 nt, hsa
aacauaggggaaaaaacgaggucauuucuacuaagcacuaggaccugccauagugaguuuaa

SEQ ID NO: 187579 - RNA, 62 nt, hsa
aaaaagcauuggcauuauuuucaauaaauaucaagcacuaaaaaaagaaaugauugucuuuu

SEQ ID NO: 187580 - RNA, 62 nt, hsa
aaaacuggcuuauacuguaaucuacaacuaauaagcacuaauuuagaguucagcuauauugu

SEQ ID NO: 187581 - RNA, 62 nt, hsa
agugaauacuuacauagugcuuacuauaugcuaagcacuauuuuuagcauguuauuuauauu

SEQ ID NO: 187582 - RNA, 63 nt, hsa
ugauucccuagaagagaacccucuacuuuuuguaagcacuacugacucucgcuguauuuaaga

SEQ ID NO: 187583 - RNA, 63 nt, hsa
agacuuuacauuguaucuaaguuaaucuuuauaaagcacuagaauuuuuggucaaaagucaaa

SEQ ID NO: 187584 - RNA, 63 nt, hsa
ugggcagaaagcucuuagacaauggacuauccaaagcacuauuuaaauucugccucuuccuac

SEQ ID NO: 187585 - RNA, 63 nt, hsa
uuuagucuccccgccucauucccacccccaacaaagcacuaucauuuucauuuggaaugggua

SEQ ID NO: 187586 - RNA, 63 nt, hsa
cauauugaucuuuuuaucaugauccucccuaucaagcacuaaaaaguugaaccauuauacuuu

SEQ ID NO: 187587 - RNA, 63 nt, hsa
ucacugauccuuaguaacauguuaacauuuaugaagcacuauauauugauuugcaaaaucuuu

SEQ ID NO: 187588 - RNA, 63 nt, hsa
auccaauguaauuggcugcgucuggcuaauucuaagcacuaaagucuacaucuaagcuauaga

SEQ ID NO: 187589 - RNA, 63 nt, hsa
cacuuagguucauugugccucaguuccucucaaaagcacuaaaucuaagugcaaacaaguauu

SEQ ID NO: 187590 - RNA, 63 nt, hsa
agcuuuuugguaauauguuacaauuaaaaugacaagcacuauaucacaaucucuguuuguaug

SEQ ID NO: 187591 - RNA, 63 nt, hsa
gguuccagugagagaaaccaaccacaggcacccaagcacuaccagacaaagcguauuaaacag

SEQ ID NO: 187592 - RNA, 63 nt, hsa
gcccagagcugaucucucauccgcucuggccccaagcacuauuucuuccuuuuccacuuaggc

SEQ ID NO: 187593 - RNA, 63 nt, hsa
augagaauguaugugaaagauuuguaaaugguaaagcacuauauucuuguuuguuaguccuuu

SEQ ID NO: 187594 - RNA, 63 nt, hsa
gauguuuggggucuuugugguagcuuaucuuagaagcacuacaccuugccuugcuguuugucc

SEQ ID NO: 187595 - RNA, 63 nt, hsa
gagggucuuuguaggaguugcucuugcuguguaaagcacuauugucuugggguugagcccuag

SEQ ID NO: 187596 - RNA, 63 nt, hsa
accacaaugaauuguccuuaauuaccaacagugaagcacuacaggaggcaacuguggcauugc

SEQ ID NO: 187597 - RNA, 63 nt, hsa
uaaaggaauguauagauguuuggauggaaacaaaagcacuagacugaguuuccucuuauaggu

SEQ ID NO: 187598 - RNA, 63 nt, hsa
aauuuacaaggccuaucauguccuugucaugaaaagcacuaaaaaaaaaaagaguuuaagugg

SEQ ID NO: 187599 - RNA, 63 nt, hsa
aggcacccacaaauaaaugacaagugagacaaaaagcacuaguauaaagauuauauaaagacc

SEQ ID NO: 187600 - RNA, 63 nt, hsa
gccgaauucauuaauuuacuguaguguuaagagaagcacuaagaaugccagugaccuguguaa

SEQ ID NO: 187601 - RNA, 63 nt, hsa
agagcagaucugcuuuuuuuccagagcaaaaugaagcacuagguauaaauauguuguuacugc

SEQ ID NO: 187602 - RNA, 63 nt, hsa
gcuguucgcugcaguuguuccccaucaguacucaagcacuauaagccuuagauuccuuuccuc

SEQ ID NO: 187603 - RNA, 63 nt, hsa
gucucucuucaaccuucaucucaaauugucucuaagcacuaccuuccccagagcuugccaggu

SEQ ID NO: 187604 - RNA, 63 nt, hsa
uauacugcacaguggcacaaaaaaauaucagacaagcacuauuuuauauuuaaaaauuguuuc

SEQ ID NO: 187605 - RNA, 63 nt, hsa
auaucuguaguuuuuuguuuuuguuuuuuuuuaaagcacuacaucuguuuucacuaauuguua

SEQ ID NO: 187606 - RNA, 63 nt, hsa
aaaaccaguuagcugcuauauaaacacuauaccaagcacuaggcuuagaggaaaagaugucag

SEQ ID NO: 187607 - RNA, 63 nt, hsa
caaauaagguauauuuuuuagaaucaacuuuguaagcacuauaaaaucuuuaauaaguuauaa

SEQ ID NO: 187608 - RNA, 63 nt, hsa
ucuaguuuucuguccugcaauauguauauaauuaagcacuaauuuguacugcuuagcauaaaa

SEQ ID NO: 187609 - RNA, 63 nt, hsa
cauacuucguggagcccagcgagcaucccgggcaagcacuaccaggcugugggucugcaccuc

SEQ ID NO: 187610 - RNA, 63 nt, hsa
uuuguauccauuuaaacuaaccuuuuaucaauaaagcacuauuguuuagauauuaaaugagua

SEQ ID NO: 187611 - RNA, 63 nt, hsa
aguaugguuaacuucacgcagcugcuuuugcagaagcacuaauaaaaacaaauauuuuguacc

SEQ ID NO: 187612 - RNA, 63 nt, hsa
cauuuaagucagccaaagaauauuguuaccuuaaagcacuauuuuauuuauagauauaucuag

SEQ ID NO: 187613 - RNA, 63 nt, hsa
gggcccggcaggagagccugcaggagcgcaagcaagcacuauaugaauacgcaagaaggugag

SEQ ID NO: 187614 - RNA, 63 nt, hsa
ugaaggaaguucauucaaggauaaguuggaauaaagcacuauguuaaaacaucugcuuuuuaa

SEQ ID NO: 187615 - RNA, 63 nt, hsa
uuuuaaaacuucacuaauauagcauugugugauaagcacuaagcagucaguccccugggggaa

SEQ ID NO: 187616 - RNA, 63 nt, hsa
cagauacaagugucaguuucuuaguucucauuuaagcacuaguggaauuuuuuuuuuuugaua

SEQ ID NO: 187617 - RNA, 63 nt, hsa
uauuguuguuaauugggacuuucuguuaaugaaaagcacuauucccaagauuaauaguguucu

SEQ ID NO: 187618 - RNA, 63 nt, hsa
uaggacuuuagcugugaccucucuaacacagagaagcacuaacuuagauccucauucuuaaua

SEQ ID NO: 187619 - RNA, 63 nt, hsa
gaaagaucugucaaucaagcaguagugugaaaaaagcacuauaagaaaaugcaucaucaguuu

SEQ ID NO: 187620 - RNA, 63 nt, hsa
uucugggguuggaagugugacuucuuacacauaaagcacuaccuaaguaauucucucucuguu

SEQ ID NO: 187621 - RNA, 63 nt, hsa
uguugaguucuguagagccuucugaugucucuaaagcacuaccgauucuuuggaguugucaca

SEQ ID NO: 187622 - RNA, 63 nt, hsa
cccaagagggcuuuauuacaccucagaaauugaaagcacuaugaauuuguccauuuaaaaaug

SEQ ID NO: 187623 - RNA, 63 nt, hsa
ccaagguggggccaguugcgauucuaaaggaagaagcacuaaauggcagggugaucaguccaa

SEQ ID NO: 187624 - RNA, 63 nt, hsa
guaacccccaccccuucaggaucagucaagggaaagcacuagaaccccuggguagggaaagaa

SEQ ID NO: 187625 - RNA, 63 nt, hsa
ucagaagaaaacagguuaacaaucaaguagugaaagcacuauauucuagucauuaacucaacg

SEQ ID NO: 187626 - RNA, 63 nt, hsa
cuccaggggcagguaaagcccugcugggcucagaagcacuauagaauuugcuguacacacuga

SEQ ID NO: 187627 - RNA, 63 nt, hsa
agugaauugugagcaaaagaucuugaaagcaaaaagcacuaauuaguuuaaaaugucacuuuu

SEQ ID NO: 187628 - RNA, 63 nt, hsa
aaucccaacaugaaauuauauuacucagauuuaaagcacuaucauuaaucuuucaaucuaauu

SEQ ID NO: 187629 - RNA, 63 nt, hsa
aaguauacaggaggaugugaauagguuauaugcaagcacuaugcccuuuuauauaagugacuu

SEQ ID NO: 187630 - RNA, 63 nt, hsa
uuguuauuauacuacuaauaauagagcacuuguaagcacuaaguuaucuuuauccaacauuuc

SEQ ID NO: 187631 - RNA, 63 nt, hsa
gcauugacuuggagcaccuggaggauguaccagaagcacuagaccaggacgaccuccagcgcg

SEQ ID NO: 187632 - RNA, 63 nt, hsa
ucugaacuugcuguuaacacaguguuauaacucaagcacuagcuucaggaagcauguuguguu

SEQ ID NO: 187633 - RNA, 63 nt, hsa
guucuagaaagaucacuaauggucaaguggaacaagcacuacacgacuaaccccuauuggggu

SEQ ID NO: 187634 - RNA, 63 nt, hsa
agcucccaucucuccucccuaaugccucacuucaagcacuaauuuggcucuuucugcucacua

SEQ ID NO: 187635 - RNA, 54 nt, hsa; identical to SEQ ID NO: 187233

SEQ ID NO: 187636 - RNA, 63 nt, hsa
uuuucuguaaccuuuugaaaucuaguuacuaauaagcacuacuguaauuuagcacaguuuaac

SEQ ID NO: 187637 - RNA, 63 nt, hsa
gauucuaaagguguugucacuguauaaaacagaaagcacuaggauacaaaugaagcuuaauua

SEQ ID NO: 187638 - RNA, 63 nt, hsa
cugagcuauggcugcuuuuguagccuuuccaagaagcacuaaccugaaauaagauuagauaau

SEQ ID NO: 187639 - RNA, 63 nt, hsa
uauuccuaaagccacuauuguguuuucucuaagaagcacuacaugccaccagaauugugcacu

SEQ ID NO: 187640 - RNA, 63 nt, hsa
acuuugggcugugagcauuuagaacgagccuggaagcacuacagagcaucccacaggaccaca

SEQ ID NO: 187641 - RNA, 63 nt, hsa
auuuccauuccagaauaucugggauucuacuuuaagcacuacauaaacugacuuuauccucag

SEQ ID NO: 187642 - RNA, 63 nt, hsa
cuguaaaaaaccaaaaaggacuuuuuguauagaaagcacuacccuaagccaugaagaacucca

SEQ ID NO: 187643 - RNA, 63 nt, hsa
cugguagugaauguguaguuggggaauaaagaaaagcacuaaauccugcccuuuuuguguggu

SEQ ID NO: 187644 - RNA, 63 nt, hsa
agagcucuuuuuuccuuucugcugauuugcuggaagcacuacaagacuucuguuuguucguuc

SEQ ID NO: 187645 - RNA, 63 nt, hsa
cauguuuauacacagggaguguaugguuccuguaagcacuaaguuagcuguuuucauuuaaug

SEQ ID NO: 187646 - RNA, 63 nt, hsa
aaccuguucgugugguauaugaaaaagauaccuaagcacuagaauauccagcuaaauggugca

SEQ ID NO: 187647 - RNA, 63 nt, hsa
aucauauacgugaaaauuauuugaaaacauauaaagcacuauacagauucgaaacuccauuga

SEQ ID NO: 187648 - RNA, 63 nt, hsa
gguaguuaagaguggggucaccccuuuaacuccaagcacuacauuuuggcggcugccggccuc

SEQ ID NO: 187649 - RNA, 63 nt, hsa
agcuaauucuggggauagaaugauaaaagacucaagcacuaaaaauauacauugccgaaucuc

SEQ ID NO: 187650 - RNA, 63 nt, hsa
uauuuauguuuaaguauuuagaaaaaggugaaaaagcacuauuaucaguucugccuagguaaa

SEQ ID NO: 187651 - RNA, 63 nt, hsa
uaaagcaaaaauuuuaacuguuuucuaauugucaagcacuauuuucauuaaaagugucuaaug

SEQ ID NO: 187652 - RNA, 63 nt, hsa
aaacuucucaaaaauuguacaucuguguaacuaaagcacuaacaaaaacaugaauaguccuuc

SEQ ID NO: 187653 - RNA, 63 nt, hsa
gggugaugggcuggggugggucccuggaaucagaagcacuagugcugccauuaaugaauuguu

SEQ ID NO: 187654 - RNA, 63 nt, hsa
gggcccugaaauggccugucccuagggcucuccaagcacuagccuucccagcuucccgccgcc

SEQ ID NO: 187655 - RNA, 63 nt, hsa
gggagcagagugauuucuugcuuccucccuucaaagcacuaccacaccuagacuggaaaugug

SEQ ID NO: 187656 - RNA, 63 nt, hsa
gauuuagcaacacagguaaaaaugcaccuuuuaaagcacuacguuuucacagacaauaacugu

SEQ ID NO: 187657 - RNA, 63 nt, hsa
uuucucaagaauuacuggcuuuaaaagaagccaaagcacuacuagcuuuuuuuccauauuggu

SEQ ID NO: 187658 - RNA, 63 nt, hsa
uucauuuauugaaaaaaaaaaaaaaugcccccaaagcacuaugcuggucaugaacugcuucaa

SEQ ID NO: 187659 - RNA, 63 nt, hsa
uccaaauacaucucucccuucuugaaaucccuaaagcacuaucgcacuccuaaaugcauuucu

SEQ ID NO: 187660 - RNA, 63 nt, hsa
cucauucuuuuuucuauuaagccauugaaagagaagcacuaagacugcuucuaggcuuuauuu

SEQ ID NO: 187661 - RNA, 63 nt, hsa
uuuuuauuucuuuuuuuuuuaauugggggaaauaagcacuauuaacagauucagcacuacaag

SEQ ID NO: 187662 - RNA, 63 nt, hsa
aacgugauucucagugugauuccaauuauuacgaagcacuaaucaguaacgcuacaaugauca

SEQ ID NO: 187663 - RNA, 63 nt, hsa
uaauauauacauguaauaugaaaauugagauugaagcacuaauuccaaaauuauggcugaaua

SEQ ID NO: 187664 - RNA, 63 nt, hsa
cuacccuuguuaguuauuuuaggagacagucucaagcacuaaaaaguggcuaauucaauuuau

SEQ ID NO: 187665 - RNA, 63 nt, hsa
cuauggcagauaugguauggaucguaaaauuuuaagcacuaaaaauuuuuucauaaccuuuca

SEQ ID NO: 187666 - RNA, 63 nt, hsa
auaaucuucuaaaggcuauacaauugaaugaggaagcacuaacaaaagcaguaguucaguaca

SEQ ID NO: 187667 - RNA, 63 nt, hsa
uuucaggcuaauuaguggauuaagcaauaaugaaagcacuaaguuugguuuugcuuuugugag

SEQ ID NO: 187668 - RNA, 63 nt, hsa
uggggcaauggaugcauuucccaaaacgugugaaagcacuaacagcuuauauugcugaaugag

SEQ ID NO: 187669 - RNA, 63 nt, hsa
aaacuacuuacucugauggaccaauaaugaagaaagcacuaggagcucuuuuggggguguagu

SEQ ID NO: 187670 - RNA, 63 nt, hsa
cauguccauagagaagagguuuucuaugucuucaagcacuauaucauaguccguguucaaagu

SEQ ID NO: 187671 - RNA, 63 nt, hsa
uuuuuaaauagaaaucacaaauagcaaguguggaagcacuacuuuauucuguuuaaaauguac

SEQ ID NO: 187672 - RNA, 63 nt, hsa
augaguacaaacugauucaguucuaaaguuccaaagcacuaaaaacuuaucuauggugauuac

SEQ ID NO: 187673 - RNA, 63 nt, hsa
auuauaucaaggucucagaugagcuuagugcacaagcacuaucacuuuaaauacuauuauuug

SEQ ID NO: 187674 - RNA, 63 nt, hsa
cuggacucaccucuggagccuauggcuuuaagcaagcacuacugcacuuuacagaauuacccc

SEQ ID NO: 187675 - RNA, 63 nt, hsa
aaagagcuuucuggguuaacgcuuuucagggccaagcacuauaaggguuuagcuguggcgcag

SEQ ID NO: 187676 - RNA, 63 nt, hsa
cuuacaaauuccagauaucuacaaaagaugugaaagcacuaaaaauaccauuuuuaagcagua

SEQ ID NO: 187677 - RNA, 63 nt, hsa
aaagacuuuaaaacucuggcuggacagaguuuuaagcacuaugcugcaggaauccugagaaaa

SEQ ID NO: 187678 - RNA, 63 nt, hsa
ugucuucccgaugagggaaggagcccagccagaaagcacuacaaucauggucaaguucccaac

SEQ ID NO: 187679 - RNA, 63 nt, hsa
gugauauguauuccaaaaaagucauagaagaugaagcacuauaauauuguucccauauauuua

SEQ ID NO: 187680 - RNA, 63 nt, hsa
aaagccucuguguaggugguagggagugagucaaagcacuaauagaccaggcaacuuaccacu

SEQ ID NO: 187681 - RNA, 63 nt, hsa
uguuaguccuucuacuuaccugcuggauuuuucaagcacuaaauuuauaacuuuuugaaacaa

SEQ ID NO: 187682 - RNA, 63 nt, hsa
uucugcguaaugagacucaccuuuucucgcugaaagcacuaagaggugggaggaggccugcac

SEQ ID NO: 187683 - RNA, 63 nt, hsa
guuugauaugauauuacuguauuuauuuuaagaaagcacuaagauguaauaaagugaugaacu

SEQ ID NO: 187684 - RNA, 63 nt, hsa
ucaaagggaagcagcauuucuuguuaacuaguuaagcacuaugcugcuaguuacaguguaggc

SEQ ID NO: 187685 - RNA, 63 nt, hsa
agacuuuugguuucucgcauugccucucagacuaagcacuaaaaagcaaagcaaaacagaacu

SEQ ID NO: 187686 - RNA, 63 nt, hsa
gaaugccuuucaaacauugagacugcuagaaccaagcacuaccaguaucuccauccuuaacug

SEQ ID NO: 187687 - RNA, 63 nt, hsa
uucucucucuuuuuuugaguguagauuauuuuaaagcacuaauugcauuacauugguaacugc

SEQ ID NO: 187688 - RNA, 63 nt, hsa
ugacuuuaauacaggcagugcucaaacuagaauaagcacuaauuaaaggaauuguuggggguc

SEQ ID NO: 187689 - RNA, 63 nt, hsa
auucauuuaguugauauaauccuaccagaaggaaagcacuaagaaacacucguuuguuguuuu

SEQ ID NO: 187690 - RNA, 63 nt, hsa
aaaccaaucgguaaucugauccaccacuuuucaaagcacuacuauaaaauucgucuuguuaga

SEQ ID NO: 187691 - RNA, 63 nt, hsa
gacaaauugacuucuccugagguggaucuuggaaagcacuagaaacuaaacaucuucaccagg

SEQ ID NO: 187692 - RNA, 63 nt, hsa
uaaaauggaggcaacauuuuggccaacauuggaaagcacuagagggcaaugggauuaaaccaa

SEQ ID NO: 187693 - RNA, 63 nt, hsa
acaauaauggggaaaauauuugggaccaagcugaagcacuaaucccacuaaguuaaagacuuc

SEQ ID NO: 187694 - RNA, 63 nt, hsa
uucagggaguuuauuggaggaucaaagaacugaaagcacuagagcagccuuggggacugcuag

SEQ ID NO: 187695 - RNA, 63 nt, hsa
caaccaaguggaaaggcaaguuggucuuauagaaagcacuacugcacuuaguagcuaugugau

SEQ ID NO: 187696 - RNA, 63 nt, hsa
gugggacgaaugacgaugcccauccacuaccugaagcacuaggacacucuugcagggccaggc

SEQ ID NO: 187697 - RNA, 63 nt, hsa
ggagcacauugauuuggaguuucagaucuuccaaagcacuauuuguuguaauaacuuuucuaa

SEQ ID NO: 187698 - RNA, 63 nt, hsa
cuggcucuccuuggccucgccguccuuguccacaagcacuauggcccccggcucaagugcugc

SEQ ID NO: 187699 - RNA, 63 nt, hsa
ucacgccuuuuuuagcaagccuucugcugauggaagcacuaggaugauucuaggcuguuaaau

SEQ ID NO: 187700 - RNA, 63 nt, hsa
uauuaauggcugcugucuccaguuucugggguuaagcacuaaggacacaagaaucaaucagac

SEQ ID NO: 187701 - RNA, 63 nt, hsa
gauuuugccagggaacaguucacugacuaggaaaagcacuacauuuuaaauucagcauuagug

SEQ ID NO: 187702 - RNA, 63 nt, hsa
uaaagaagaaagggaagacaauuuacaaacuccaagcacuaaaaggcaguauauuacagaaac

SEQ ID NO: 187703 - RNA, 63 nt, hsa
aucaauuuucugugaugauguauaccaacuauaaagcacuauguugguuuacuacuucaguaa

SEQ ID NO: 187704 - RNA, 63 nt, hsa
guggcauggagacuguggagggaauauuuuuuaaagcacuacucauauccuuuaaacuaaauu

SEQ ID NO: 187705 - RNA, 63 nt, hsa
ccuucucccuccucugucucaaacugcgcaggcaagcacuaugcaagcccaggcccucugcug

SEQ ID NO: 187706 - RNA, 63 nt, hsa
gacuauuuuuaaacauacuagucugcugauagaaagcacuauacauccuauuguuucuuucuu

SEQ ID NO: 187707 - RNA, 63 nt, hsa
cuaagcauuguauuuuuuuuaacaaaucuaaaaaagcacuaugaacuacagguguuugacuuu

SEQ ID NO: 187708 - RNA, 63 nt, hsa
cacccugguacugccuggugccugccacaaaauaagcacuaacaaaaguguauuguuuaaaaa

SEQ ID NO: 187709 - RNA, 63 nt, hsa
agaagauuuugaauuauuauccagcagggcuggaagcacuagaugcagcaugagcacaacuau

SEQ ID NO: 187710 - RNA, 63 nt, hsa
uguuaaacaaaugauuuccacaaacagaucaggaagcacuagguuggcagagacacuuugucu

SEQ ID NO: 187711 - RNA, 63 nt, hsa
cugaucuaucaacaucaccccauuaagaauacaaagcacuacauucuuuuaucuuuuuugcuc

SEQ ID NO: 187712 - RNA, 63 nt, hsa
uuuagaagauggagaacuccagccaccuuuguaaagcacuaguguuugucauuuauguaaguc

SEQ ID NO: 187713 - RNA, 63 nt, hsa
uauuagaccguuaccuauaagaauuaagggguaaagcacuaaacagaaaagaaaaaaaaaaua

SEQ ID NO: 187714 - RNA, 63 nt, hsa
uaaauguucuguuuaauggccauucauaaauucaagcacuaccacuggucaguuuugugugau

SEQ ID NO: 187715 - RNA, 63 nt, hsa
uggauuauccacauaaucaaagcuuaucuuuuuaagcacuaaaacuuacuucauuguaacuau

SEQ ID NO: 187716 - RNA, 63 nt, hsa
ugcaguuaggugaugagcacugcuuugaggcccaagcacuaguagagaugcgcgauacagguc

SEQ ID NO: 187717 - RNA, 63 nt, hsa
acuaugcaaagcauccaggcgguucugaaugugaagcacuacacccagcagagucccggugcc

SEQ ID NO: 187718 - RNA, 63 nt, hsa
agcacuaagggcaaaaaccaauauuuauaauguaagcacuauccagguaaaacacuggcccaa

SEQ ID NO: 187719 - RNA, 63 nt, hsa
ugcagcguauuagaguaaaagucuaccccucugaagcacuauuaagcgcuuaacguauauuua

SEQ ID NO: 187720 - RNA, 63 nt, hsa
agauaauguguuaauauugcuauuaccuagguuaagcacuauugucugugcuaguaagaaaaa

SEQ ID NO: 187721 - RNA, 63 nt, hsa
uuuguucagaaaguuuguuuuaaaguuuauuuuaagcacuaucguaccaaauauuucauauuu

SEQ ID NO: 187722 - RNA, 63 nt, hsa
ggaaagccuuuguacaguuccugggauucacagaagcacuacuccagagcagaaugaugccuu

SEQ ID NO: 187723 - RNA, 63 nt, hsa
ggaaauuacugcuuucucuagaaauauaaagcaaagcacuauuccaaggcuauggaguagcuc

SEQ ID NO: 187724 - RNA, 63 nt, hsa
uaggucucuuaaccuggcaccaguauaacuauaaagcacuagcugagaaggaacugauacuua

SEQ ID NO: 187725 - RNA, 63 nt, hsa
ugaaugcagcucucacuaacaacuucuugguaaaagcacuaaaaaagcucuugauagaauguu

SEQ ID NO: 187726 - RNA, 63 nt, hsa
cauuaaauugaagagucuacauucagaacauaaaagcacuagguauacaaguuugaaauauga

SEQ ID NO: 187727 - RNA, 63 nt, hsa
guucuuaugaagcagcauuaugcaaggggaaaaaagcacuaugucuguguauguauguauaua

SEQ ID NO: 187728 - RNA, 63 nt, hsa
ccaaaacaacugguuauaugccucccuugcagcaagcacuacaauguaugugaucgucaaugu

SEQ ID NO: 187729 - RNA, 63 nt, hsa
aggacaauauggcaauguccuucaaaauuauaaaagcacuaacucuuugauccaguaguuucc

SEQ ID NO: 187730 - RNA, 63 nt, hsa
aaugugacagaugcagaucuuagaggacuuacaaagcacuauauugguaauucuuacaauggc

SEQ ID NO: 187731 - RNA, 63 nt, hsa
cugggaggaacaaauuuaaucauuucuucuguuaagcacuaaucaguauagugcaacuccugg

SEQ ID NO: 187732 - RNA, 63 nt, hsa
auccuccuucaggaacacggggagcagaggccaaagcacuaaggggagggcgcauacccgaga

SEQ ID NO: 187733 - RNA, 63 nt, hsa
ugcuuaucucagagugaagauacugcggcugaaaagcacuaguuugauauaaaauuaaaauga

SEQ ID NO: 187734 - RNA, 63 nt, hsa
uuauuucauccucgaugggaauucuugcuagguaagcacuaauaacucggcaucuugacgaua

SEQ ID NO: 187735 - RNA, 63 nt, hsa
uacacacuauauuuuaauugaauucaaacuaucaagcacuacuuagaaacuggaaaacauaua

SEQ ID NO: 187736 - RNA, 63 nt, hsa
gggauguaccucuccccacuccccuugcuugagaagcacuacucaaaaauuuaccagaccuua

SEQ ID NO: 187737 - RNA, 63 nt, hsa
gacauuuagauaugccaaaagaauuaaaaucaaaagcacuaagaaauacauaguugugugaug

SEQ ID NO: 187738 - RNA, 63 nt, hsa
uuucuuuuaagagcugugaaugaaacuuuuucuaagcacuauucuauugcacacaaacagaaa

SEQ ID NO: 187739 - RNA, 63 nt, hsa
gccaccaugccuggccuguauguguguguuuuaaagcacuagauagggauggacauuaaaucu

SEQ ID NO: 187740 - RNA, 63 nt, hsa
guacaaucuuucaccaaguaaauuuguauaaauaagcacuauucuuuguauuaccaaagcaag

SEQ ID NO: 187741 - RNA, 63 nt, hsa
cuuuaccuauccucucaaucacuacucuucuugaagcacuauuauuuauucuuccgcugucug

SEQ ID NO: 187742 - RNA, 63 nt, hsa
uucccugcuucugguuugcugaagauuuucuagaagcacuauuuacacaaauaugcaaaugug

SEQ ID NO: 187743 - RNA, 63 nt, hsa
cuuugaugacucugccccucagcagggcuuacuaagcacuaccccuuaacagggaugacuccg

SEQ ID NO: 187744 - RNA, 63 nt, hsa
uauuaugaaauacaaugguguuccaaaagaagaaagcacuaaaaacucaacuagcaggaagcg

SEQ ID NO: 187745 - RNA, 63 nt, hsa
aaguuaaacuccucuacuuaugugccaccuacaaagcacuagagacuguaggagaaaagaaag

SEQ ID NO: 187746 - RNA, 63 nt, hsa; identical to SEQ ID NO: 187745

SEQ ID NO: 187747 - RNA, 63 nt, hsa
cuccuuguuggguaacucagccauggagaugccaagcacuagccaggaggugaguuccucuuu

SEQ ID NO: 187748 - RNA, 63 nt, hsa
aaaaacccacaggugcugcugcuuauaucugugaagcacuagcuuauucuaggaaugccugau

SEQ ID NO: 187749 - RNA, 63 nt, hsa
uccccucaaacgagaacaaaaaguauucccugcaagcacuaugaauggaccuuacuacucucu

SEQ ID NO: 187750 - RNA, 63 nt, hsa
caaagaaagacuguaagcuccaugauuagcauaaagcacuaaccaugucuccaugugacccga

SEQ ID NO: 187751 - RNA, 63 nt, hsa
cauugccaagagaggaugcaucuggggagagcaaagcacuaaggaauucagcaucagccugca

SEQ ID NO: 187752 - RNA, 63 nt, hsa
uauggagcugugccgaggcuugggcucccacauaagcacuagucuauagaugccucuuaggac

SEQ ID NO: 187753 - RNA, 63 nt, hsa
aucuuugcucccugcaagaaaucagccauaagaaagcacuauuaauacucugcagugauuaga

SEQ ID NO: 187754 - RNA, 63 nt, hsa
gauuuuacauguaacugaaguuccccugucuucaagcacuaaaacguugaucuuaaccuuuuu

SEQ ID NO: 187755 - RNA, 63 nt, hsa
aauggaaguugucauccguaaaagcugaaguguaagcacuaggaaaucucaauauagagauuu

SEQ ID NO: 187756 - RNA, 63 nt, hsa
gccauacugcacggacguagcguuucccucuacaagcacuaggagcaccuuucucaaggacaa

SEQ ID NO: 187757 - RNA, 63 nt, hsa
uauuuugauaauaauauuguuuuucuuucuacaaagcacuagagaaugcacagauauacuuug

SEQ ID NO: 187758 - RNA, 63 nt, hsa
uagguuauuacuuuuuuuauaaccagauuuuuaaagcacuagguuuuaaaucaguggguauca

SEQ ID NO: 187759 - RNA, 63 nt, hsa
guugaauucuuugggccuagaauauacuugagaaagcacuaguggcuuguguucagggagagg

SEQ ID NO: 187760 - RNA, 63 nt, hsa
ucaaacaauauaaaagccaauauaaauucucauaagcacuauagaauuugcaaauucagaaca

SEQ ID NO: 187761 - RNA, 63 nt, hsa
uccccagaaggagugauuuuucuaucggcacaaaagcacuauauggacugguaaugguuacag

SEQ ID NO: 187762 - RNA, 63 nt, hsa
ccaccaggccugcccuaaaagagcuccugaaggaagcacuaaacauggaaaggaacaacugau

SEQ ID NO: 187763 - RNA, 63 nt, hsa
guaacugaccaaagucacacugccaggaacuggaagcacuaggauuugacagcauauccaaau

SEQ ID NO: 187764 - RNA, 63 nt, hsa
auccuucugcugacugccagaucccugcauuucaagcacuacgccuuccacccccaggcacug

SEQ ID NO: 187765 - RNA, 63 nt, hsa
aagaucauaggcagcaagggcugauucuaggauaagcacuagaucucccuuaauaaacucaca

SEQ ID NO: 187766 - RNA, 63 nt, hsa
uugccauaaauguuugcauaaugacauagcuuuaagcacuacaugauuuuaaucugcucacau

SEQ ID NO: 187767 - RNA, 63 nt, hsa
cauguuuuaaaugcuuucuacuugugguucaagaagcacuagauuuaguaagaaacucuaccu

SEQ ID NO: 187768 - RNA, 63 nt, hsa
cacaagaagaugacugaguucuagagaccccacaagcacuauggacgaagcgugggaccccag

SEQ ID NO: 187769 - RNA, 63 nt, hsa
acauuuauucagauauggcucuaauguauuaggaagcacuaaauggccuaaaaaagcuacuac

SEQ ID NO: 187770 - RNA, 63 nt, hsa
gucaaguggauggauauucuagcgcucccaaaaaagcacuauggccuuauaugcagggaaggc

SEQ ID NO: 187771 - RNA, 63 nt, hsa
auucuuaaauaccucacugucuuggccauggggaagcacuauggccucagcugggggaaagac

SEQ ID NO: 187772 - RNA, 63 nt, hsa
ucaguugccucauagccugcugguccuguaagcaagcacuaagcuccacagugccaguuccuu

SEQ ID NO: 187773 - RNA, 63 nt, hsa
gagaagagauaauuacaaucaggcuaccaaaggaagcacuaacuuuggugcuuucaaguuggc

SEQ ID NO: 187774 - RNA, 63 nt, hsa
aauugaaauuuaugugaauuauuuugauuguagaagcacuauaauaugugcugaaacuaaauu

SEQ ID NO: 187775 - RNA, 63 nt, hsa
ggauuuuugaagcuguauacugugugcuaaaacaagcacuaaacaaagagugaaggauuuaug

SEQ ID NO: 187776 - RNA, 63 nt, hsa
cuagauucugagaucuucccauucuaggccuacaagcacuacuugcuguagcugagacuuguc

SEQ ID NO: 187777 - RNA, 63 nt, hsa
uuguguauuuuguuuccuuauagccauuaaagaaagcacuaaggaugaugggagcuccaaauc

SEQ ID NO: 187778 - RNA, 63 nt, hsa
ggccuaaugaaagcuauauacuugugcuaucuaaagcacuacuuuguaaagaugacuacccaa

SEQ ID NO: 187779 - RNA, 63 nt, hsa
aaacauaggggaaaaaacgaggucauuucuacuaagcacuaggaccugccauagugaguuuaa

SEQ ID NO: 187780 - RNA, 63 nt, hsa
gaaaaagcauuggcauuauuuucaauaaauaucaagcacuaaaaaaagaaaugauugucuuuu

SEQ ID NO: 187781 - RNA, 63 nt, hsa
caaaacuggcuuauacuguaaucuacaacuaauaagcacuaauuuagaguucagcuauauugu

SEQ ID NO: 187782 - RNA, 63 nt, hsa
uagugaauacuuacauagugcuuacuauaugcuaagcacuauuuuuagcauguuauuuauauu

SEQ ID NO: 187783 - RNA, 64 nt, hsa
cugauucccuagaagagaacccucuacuuuuuguaagcacuacugacucucgcuguauuuaaga

SEQ ID NO: 187784 - RNA, 64 nt, hsa
uagacuuuacauuguaucuaaguuaaucuuuauaaagcacuagaauuuuuggucaaaagucaaa

SEQ ID NO: 187785 - RNA, 64 nt, hsa
uugggcagaaagcucuuagacaauggacuauccaaagcacuauuuaaauucugccucuuccuac

SEQ ID NO: 187786 - RNA, 64 nt, hsa
auuuagucuccccgccucauucccacccccaacaaagcacuaucauuuucauuuggaaugggua

SEQ ID NO: 187787 - RNA, 64 nt, hsa
ucauauugaucuuuuuaucaugauccucccuaucaagcacuaaaaaguugaaccauuauacuuu

SEQ ID NO: 187788 - RNA, 64 nt, hsa
uucacugauccuuaguaacauguuaacauuuaugaagcacuauauauugauuugcaaaaucuuu

SEQ ID NO: 187789 - RNA, 64 nt, hsa
gauccaauguaauuggcugcgucuggcuaauucuaagcacuaaagucuacaucuaagcuauaga

SEQ ID NO: 187790 - RNA, 64 nt, hsa
gcacuuagguucauugugccucaguuccucucaaaagcacuaaaucuaagugcaaacaaguauu

SEQ ID NO: 187791 - RNA, 64 nt, hsa
aagcuuuuugguaauauguuacaauuaaaaugacaagcacuauaucacaaucucuguuuguaug

SEQ ID NO: 187792 - RNA, 64 nt, hsa
ugguuccagugagagaaaccaaccacaggcacccaagcacuaccagacaaagcguauuaaacag

SEQ ID NO: 187793 - RNA, 64 nt, hsa
ggcccagagcugaucucucauccgcucuggccccaagcacuauuucuuccuuuuccacuuaggc

SEQ ID NO: 187794 - RNA, 64 nt, hsa
aaugagaauguaugugaaagauuuguaaaugguaaagcacuauauucuuguuuguuaguccuuu

SEQ ID NO: 187795 - RNA, 64 nt, hsa
ugauguuuggggucuuugugguagcuuaucuuagaagcacuacaccuugccuugcuguuugucc

SEQ ID NO: 187796 - RNA, 64 nt, hsa
ugagggucuuuguaggaguugcucuugcuguguaaagcacuauugucuugggguugagcccuag

SEQ ID NO: 187797 - RNA, 64 nt, hsa
aaccacaaugaauuguccuuaauuaccaacagugaagcacuacaggaggcaacuguggcauugc

SEQ ID NO: 187798 - RNA, 64 nt, hsa
auaaaggaauguauagauguuuggauggaaacaaaagcacuagacugaguuuccucuuauaggu

SEQ ID NO: 187799 - RNA, 64 nt, hsa
aaauuuacaaggccuaucauguccuugucaugaaaagcacuaaaaaaaaaaagaguuuaagugg

SEQ ID NO: 187800 - RNA, 64 nt, hsa
aaggcacccacaaauaaaugacaagugagacaaaaagcacuaguauaaagauuauauaaagacc

SEQ ID NO: 187801 - RNA, 64 nt, hsa
cgccgaauucauuaauuuacuguaguguuaagagaagcacuaagaaugccagugaccuguguaa

SEQ ID NO: 187802 - RNA, 64 nt, hsa
cagagcagaucugcuuuuuuuccagagcaaaaugaagcacuagguauaaauauguuguuacugc

SEQ ID NO: 187803 - RNA, 64 nt, hsa
ugcuguucgcugcaguuguuccccaucaguacucaagcacuauaagccuuagauuccuuuccuc

SEQ ID NO: 187804 - RNA, 64 nt, hsa
ugucucucuucaaccuucaucucaaauugucucuaagcacuaccuuccccagagcuugccaggu

SEQ ID NO: 187805 - RNA, 64 nt, hsa
uuauacugcacaguggcacaaaaaaauaucagacaagcacuauuuuauauuuaaaaauuguuuc

SEQ ID NO: 187806 - RNA, 64 nt, hsa
uauaucuguaguuuuuuguuuuuguuuuuuuuuaaagcacuacaucuguuuucacuaauuguua

SEQ ID NO: 187807 - RNA, 64 nt, hsa
aaaaaccaguuagcugcuauauaaacacuauaccaagcacuaggcuuagaggaaaagaugucag

SEQ ID NO: 187808 - RNA, 64 nt, hsa
acaaauaagguauauuuuuuagaaucaacuuuguaagcacuauaaaaucuuuaauaaguuauaa

SEQ ID NO: 187809 - RNA, 64 nt, hsa
uucuaguuuucuguccugcaauauguauauaauuaagcacuaauuuguacugcuuagcauaaaa

SEQ ID NO: 187810 - RNA, 64 nt, hsa
ucauacuucguggagcccagcgagcaucccgggcaagcacuaccaggcugugggucugcaccuc

SEQ ID NO: 187811 - RNA, 64 nt, hsa
uuuuguauccauuuaaacuaaccuuuuaucaauaaagcacuauuguuuagauauuaaaugagua

SEQ ID NO: 187812 - RNA, 64 nt, hsa
gaguaugguuaacuucacgcagcugcuuuugcagaagcacuaauaaaaacaaauauuuuguacc

SEQ ID NO: 187813 - RNA, 64 nt, hsa
gcauuuaagucagccaaagaauauuguuaccuuaaagcacuauuuuauuuauagauauaucuag

SEQ ID NO: 187814 - RNA, 64 nt, hsa
ugggcccggcaggagagccugcaggagcgcaagcaagcacuauaugaauacgcaagaaggugag

SEQ ID NO: 187815 - RNA, 64 nt, hsa
uugaaggaaguucauucaaggauaaguuggaauaaagcacuauguuaaaacaucugcuuuuuaa

SEQ ID NO: 187816 - RNA, 64 nt, hsa
cuuuuaaaacuucacuaauauagcauugugugauaagcacuaagcagucaguccccugggggaa

SEQ ID NO: 187817 - RNA, 64 nt, hsa
acagauacaagugucaguuucuuaguucucauuuaagcacuaguggaauuuuuuuuuuuugaua

SEQ ID NO: 187818 - RNA, 64 nt, hsa
uuauuguuguuaauugggacuuucuguuaaugaaaagcacuauucccaagauuaauaguguucu

SEQ ID NO: 187819 - RNA, 64 nt, hsa
cuaggacuuuagcugugaccucucuaacacagagaagcacuaacuuagauccucauucuuaaua

SEQ ID NO: 187820 - RNA, 64 nt, hsa
agaaagaucugucaaucaagcaguagugugaaaaaagcacuauaagaaaaugcaucaucaguuu

SEQ ID NO: 187821 - RNA, 64 nt, hsa
cuucugggguuggaagugugacuucuuacacauaaagcacuaccuaaguaauucucucucuguu

SEQ ID NO: 187822 - RNA, 64 nt, hsa
uuguugaguucuguagagccuucugaugucucuaaagcacuaccgauucuuuggaguugucaca

SEQ ID NO: 187823 - RNA, 64 nt, hsa
ucccaagagggcuuuauuacaccucagaaauugaaagcacuaugaauuuguccauuuaaaaaug

SEQ ID NO: 187824 - RNA, 64 nt, hsa
uccaagguggggccaguugcgauucuaaaggaagaagcacuaaauggcagggugaucaguccaa

SEQ ID NO: 187825 - RNA, 64 nt, hsa
aguaacccccaccccuucaggaucagucaagggaaagcacuagaaccccuggguagggaaagaa

SEQ ID NO: 187826 - RNA, 64 nt, hsa
aucagaagaaaacagguuaacaaucaaguagugaaagcacuauauucuagucauuaacucaacg

SEQ ID NO: 187827 - RNA, 64 nt, hsa
ucuccaggggcagguaaagcccugcugggcucagaagcacuauagaauuugcuguacacacuga

SEQ ID NO: 187828 - RNA, 64 nt, hsa
cagugaauugugagcaaaagaucuugaaagcaaaaagcacuaauuaguuuaaaaugucacuuuu

SEQ ID NO: 187829 - RNA, 64 nt, hsa
caaucccaacaugaaauuauauuacucagauuuaaagcacuaucauuaaucuuucaaucuaauu

SEQ ID NO: 187830 - RNA, 64 nt, hsa
uaaguauacaggaggaugugaauagguuauaugcaagcacuaugcccuuuuauauaagugacuu

SEQ ID NO: 187831 - RNA, 64 nt, hsa
auuguuauuauacuacuaauaauagagcacuuguaagcacuaaguuaucuuuauccaacauuuc

SEQ ID NO: 187832 - RNA, 64 nt, hsa
cgcauugacuuggagcaccuggaggauguaccagaagcacuagaccaggacgaccuccagcgcg

SEQ ID NO: 187833 - RNA, 64 nt, hsa
aucugaacuugcuguuaacacaguguuauaacucaagcacuagcuucaggaagcauguuguguu

SEQ ID NO: 187834 - RNA, 64 nt, hsa
uguucuagaaagaucacuaauggucaaguggaacaagcacuacacgacuaaccccuauuggggu

SEQ ID NO: 187835 - RNA, 64 nt, hsa
cagcucccaucucuccucccuaaugccucacuucaagcacuaauuuggcucuuucugcucacua

SEQ ID NO: 187836 - RNA, 54 nt, hsa; identical to SEQ ID NO: 187233

SEQ ID NO: 187837 - RNA, 64 nt, hsa
auuuucuguaaccuuuugaaaucuaguuacuaauaagcacuacuguaauuuagcacaguuuaac

SEQ ID NO: 187838 - RNA, 64 nt, hsa
ggauucuaaagguguugucacuguauaaaacagaaagcacuaggauacaaaugaagcuuaauua

SEQ ID NO: 187839 - RNA, 64 nt, hsa
ucugagcuauggcugcuuuuguagccuuuccaagaagcacuaaccugaaauaagauuagauaau

SEQ ID NO: 187840 - RNA, 64 nt, hsa
auauuccuaaagccacuauuguguuuucucuaagaagcacuacaugccaccagaauugugcacu

SEQ ID NO: 187841 - RNA, 64 nt, hsa
gacuuugggcugugagcauuuagaacgagccuggaagcacuacagagcaucccacaggaccaca

SEQ ID NO: 187842 - RNA, 64 nt, hsa
uauuuccauuccagaauaucugggauucuacuuuaagcacuacauaaacugacuuuauccucag

SEQ ID NO: 187843 - RNA, 64 nt, hsa
ccuguaaaaaaccaaaaaggacuuuuuguauagaaagcacuacccuaagccaugaagaacucca

SEQ ID NO: 187844 - RNA, 64 nt, hsa
ccugguagugaauguguaguuggggaauaaagaaaagcacuaaauccugcccuuuuuguguggu

SEQ ID NO: 187845 - RNA, 64 nt, hsa
uagagcucuuuuuuccuuucugcugauuugcuggaagcacuacaagacuucuguuuguucguuc

SEQ ID NO: 187846 - RNA, 64 nt, hsa
gcauguuuauacacagggaguguaugguuccuguaagcacuaaguuagcuguuuucauuuaaug

SEQ ID NO: 187847 - RNA, 64 nt, hsa
uaaccuguucgugugguauaugaaaaagauaccuaagcacuagaauauccagcuaaauggugca

SEQ ID NO: 187848 - RNA, 64 nt, hsa
gaucauauacgugaaaauuauuugaaaacauauaaagcacuauacagauucgaaacuccauuga

SEQ ID NO: 187849 - RNA, 64 nt, hsa
ggguaguuaagaguggggucaccccuuuaacuccaagcacuacauuuuggcggcugccggccuc

SEQ ID NO: 187850 - RNA, 64 nt, hsa
aagcuaauucuggggauagaaugauaaaagacucaagcacuaaaaauauacauugccgaaucuc

SEQ ID NO: 187851 - RNA, 64 nt, hsa
cuauuuauguuuaaguauuuagaaaaaggugaaaaagcacuauuaucaguucugccuagguaaa

SEQ ID NO: 187852 - RNA, 64 nt, hsa
cuaaagcaaaaauuuuaacuguuuucuaauugucaagcacuauuuucauuaaaagugucuaaug

SEQ ID NO: 187853 - RNA, 64 nt, hsa
uaaacuucucaaaaauuguacaucuguguaacuaaagcacuaacaaaaacaugaauaguccuuc

SEQ ID NO: 187854 - RNA, 64 nt, hsa
ggggugaugggcuggggugggucccuggaaucagaagcacuagugcugccauuaaugaauuguu

SEQ ID NO: 187855 - RNA, 64 nt, hsa
agggcccugaaauggccugucccuagggcucuccaagcacuagccuucccagcuucccgccgcc

SEQ ID NO: 187856 - RNA, 64 nt, hsa
ggggagcagagugauuucuugcuuccucccuucaaagcacuaccacaccuagacuggaaaugug

SEQ ID NO: 187857 - RNA, 64 nt, hsa
ugauuuagcaacacagguaaaaaugcaccuuuuaaagcacuacguuuucacagacaauaacugu

SEQ ID NO: 187858 - RNA, 64 nt, hsa
auuucucaagaauuacuggcuuuaaaagaagccaaagcacuacuagcuuuuuuuccauauuggu

SEQ ID NO: 187859 - RNA, 64 nt, hsa
uuucauuuauugaaaaaaaaaaaaaaugcccccaaagcacuaugcuggucaugaacugcuucaa

SEQ ID NO: 187860 - RNA, 64 nt, hsa
cuccaaauacaucucucccuucuugaaaucccuaaagcacuaucgcacuccuaaaugcauuucu

SEQ ID NO: 187861 - RNA, 64 nt, hsa
acucauucuuuuuucuauuaagccauugaaagagaagcacuaagacugcuucuaggcuuuauuu

SEQ ID NO: 187862 - RNA, 64 nt, hsa
auuuuuauuucuuuuuuuuuuaauugggggaaauaagcacuauuaacagauucagcacuacaag

SEQ ID NO: 187863 - RNA, 64 nt, hsa
aaacgugauucucagugugauuccaauuauuacgaagcacuaaucaguaacgcuacaaugauca

SEQ ID NO: 187864 - RNA, 64 nt, hsa
uuaauauauacauguaauaugaaaauugagauugaagcacuaauuccaaaauuauggcugaaua

SEQ ID NO: 187865 - RNA, 64 nt, hsa
ccuacccuuguuaguuauuuuaggagacagucucaagcacuaaaaaguggcuaauucaauuuau

SEQ ID NO: 187866 - RNA, 64 nt, hsa
acuauggcagauaugguauggaucguaaaauuuuaagcacuaaaaauuuuuucauaaccuuuca

SEQ ID NO: 187867 - RNA, 64 nt, hsa
gauaaucuucuaaaggcuauacaauugaaugaggaagcacuaacaaaagcaguaguucaguaca

SEQ ID NO: 187868 - RNA, 64 nt, hsa
uuuucaggcuaauuaguggauuaagcaauaaugaaagcacuaaguuugguuuugcuuuugugag

SEQ ID NO: 187869 - RNA, 64 nt, hsa
auggggcaauggaugcauuucccaaaacgugugaaagcacuaacagcuuauauugcugaaugag

SEQ ID NO: 187870 - RNA, 64 nt, hsa
aaaacuacuuacucugauggaccaauaaugaagaaagcacuaggagcucuuuuggggguguagu

SEQ ID NO: 187871 - RNA, 64 nt, hsa
gcauguccauagagaagagguuuucuaugucuucaagcacuauaucauaguccguguucaaagu

SEQ ID NO: 187872 - RNA, 64 nt, hsa
auuuuuaaauagaaaucacaaauagcaaguguggaagcacuacuuuauucuguuuaaaauguac

SEQ ID NO: 187873 - RNA, 64 nt, hsa
aaugaguacaaacugauucaguucuaaaguuccaaagcacuaaaaacuuaucuauggugauuac

SEQ ID NO: 187874 - RNA, 64 nt, hsa
aauuauaucaaggucucagaugagcuuagugcacaagcacuaucacuuuaaauacuauuauuug

SEQ ID NO: 187875 - RNA, 64 nt, hsa
ucuggacucaccucuggagccuauggcuuuaagcaagcacuacugcacuuuacagaauuacccc

SEQ ID NO: 187876 - RNA, 64 nt, hsa
caaagagcuuucuggguuaacgcuuuucagggccaagcacuauaaggguuuagcuguggcgcag

SEQ ID NO: 187877 - RNA, 64 nt, hsa
ucuuacaaauuccagauaucuacaaaagaugugaaagcacuaaaaauaccauuuuuaagcagua

SEQ ID NO: 187878 - RNA, 64 nt, hsa
caaagacuuuaaaacucuggcuggacagaguuuuaagcacuaugcugcaggaauccugagaaaa

SEQ ID NO: 187879 - RNA, 64 nt, hsa
cugucuucccgaugagggaaggagcccagccagaaagcacuacaaucauggucaaguucccaac

SEQ ID NO: 187880 - RNA, 64 nt, hsa
agugauauguauuccaaaaaagucauagaagaugaagcacuauaauauuguucccauauauuua

SEQ ID NO: 187881 - RNA, 64 nt, hsa
caaagccucuguguaggugguagggagugagucaaagcacuaauagaccaggcaacuuaccacu

SEQ ID NO: 187882 - RNA, 64 nt, hsa
cuguuaguccuucuacuuaccugcuggauuuuucaagcacuaaauuuauaacuuuuugaaacaa

SEQ ID NO: 187883 - RNA, 64 nt, hsa
guucugcguaaugagacucaccuuuucucgcugaaagcacuaagaggugggaggaggccugcac

SEQ ID NO: 187884 - RNA, 64 nt, hsa
uguuugauaugauauuacuguauuuauuuuaagaaagcacuaagauguaauaaagugaugaacu

SEQ ID NO: 187885 - RNA, 64 nt, hsa
uucaaagggaagcagcauuucuuguuaacuaguuaagcacuaugcugcuaguuacaguguaggc

SEQ ID NO: 187886 - RNA, 64 nt, hsa
aagacuuuugguuucucgcauugccucucagacuaagcacuaaaaagcaaagcaaaacagaacu

SEQ ID NO: 187887 - RNA, 64 nt, hsa
ugaaugccuuucaaacauugagacugcuagaaccaagcacuaccaguaucuccauccuuaacug

SEQ ID NO: 187888 - RNA, 64 nt, hsa
uuucucucucuuuuuuugaguguagauuauuuuaaagcacuaauugcauuacauugguaacugc

SEQ ID NO: 187889 - RNA, 64 nt, hsa
cugacuuuaauacaggcagugcucaaacuagaauaagcacuaauuaaaggaauuguuggggguc

SEQ ID NO: 187890 - RNA, 64 nt, hsa
cauucauuuaguugauauaauccuaccagaaggaaagcacuaagaaacacucguuuguuguuuu

SEQ ID NO: 187891 - RNA, 64 nt, hsa
gaaaccaaucgguaaucugauccaccacuuuucaaagcacuacuauaaaauucgucuuguuaga

SEQ ID NO: 187892 - RNA, 63 nt, hsa; identical to SEQ ID NO: 187691

SEQ ID NO: 187893 - RNA, 64 nt, hsa
uuaaaauggaggcaacauuuuggccaacauuggaaagcacuagagggcaaugggauuaaaccaa

SEQ ID NO: 187894 - RNA, 64 nt, hsa
aacaauaauggggaaaauauuugggaccaagcugaagcacuaaucccacuaaguuaaagacuuc

SEQ ID NO: 187895 - RNA, 64 nt, hsa
uuucagggaguuuauuggaggaucaaagaacugaaagcacuagagcagccuuggggacugcuag

SEQ ID NO: 187896 - RNA, 64 nt, hsa
ccaaccaaguggaaaggcaaguuggucuuauagaaagcacuacugcacuuaguagcuaugugau

SEQ ID NO: 187897 - RNA, 64 nt, hsa
ggugggacgaaugacgaugcccauccacuaccugaagcacuaggacacucuugcagggccaggc

SEQ ID NO: 187898 - RNA, 64 nt, hsa
uggagcacauugauuuggaguuucagaucuuccaaagcacuauuuguuguaauaacuuuucuaa

SEQ ID NO: 187899 - RNA, 64 nt, hsa
gcuggcucuccuuggccucgccguccuuguccacaagcacuauggcccccggcucaagugcugc

SEQ ID NO: 187900 - RNA, 64 nt, hsa
cucacgccuuuuuuagcaagccuucugcugauggaagcacuaggaugauucuaggcuguuaaau

SEQ ID NO: 187901 - RNA, 64 nt, hsa
uuauuaauggcugcugucuccaguuucugggguuaagcacuaaggacacaagaaucaaucagac

SEQ ID NO: 187902 - RNA, 64 nt, hsa
ggauuuugccagggaacaguucacugacuaggaaaagcacuacauuuuaaauucagcauuagug

SEQ ID NO: 187903 - RNA, 64 nt, hsa
cuaaagaagaaagggaagacaauuuacaaacuccaagcacuaaaaggcaguauauuacagaaac

SEQ ID NO: 187904 - RNA, 64 nt, hsa
uaucaauuuucugugaugauguauaccaacuauaaagcacuauguugguuuacuacuucaguaa

SEQ ID NO: 187905 - RNA, 64 nt, hsa
gguggcauggagacuguggagggaauauuuuuuaaagcacuacucauauccuuuaaacuaaauu

SEQ ID NO: 187906 - RNA, 64 nt, hsa
uccuucucccuccucugucucaaacugcgcaggcaagcacuaugcaagcccaggcccucugcug

SEQ ID NO: 187907 - RNA, 64 nt, hsa
agacuauuuuuaaacauacuagucugcugauagaaagcacuauacauccuauuguuucuuucuu

SEQ ID NO: 187908 - RNA, 64 nt, hsa
acuaagcauuguauuuuuuuuaacaaaucuaaaaaagcacuaugaacuacagguguuugacuuu

SEQ ID NO: 187909 - RNA, 64 nt, hsa
ccacccugguacugccuggugccugccacaaaauaagcacuaacaaaaguguauuguuuaaaaa

SEQ ID NO: 187910 - RNA, 64 nt, hsa
cagaagauuuugaauuauuauccagcagggcuggaagcacuagaugcagcaugagcacaacuau

SEQ ID NO: 187911 - RNA, 64 nt, hsa
uuguuaaacaaaugauuuccacaaacagaucaggaagcacuagguuggcagagacacuuugucu

SEQ ID NO: 187912 - RNA, 64 nt, hsa
gcugaucuaucaacaucaccccauuaagaauacaaagcacuacauucuuuuaucuuuuuugcuc

SEQ ID NO: 187913 - RNA, 64 nt, hsa
uuuuagaagauggagaacuccagccaccuuuguaaagcacuaguguuugucauuuauguaaguc

SEQ ID NO: 187914 - RNA, 64 nt, hsa
guauuagaccguuaccuauaagaauuaagggguaaagcacuaaacagaaaagaaaaaaaaaaua

SEQ ID NO: 187915 - RNA, 64 nt, hsa
uuaaauguucuguuuaauggccauucauaaauucaagcacuaccacuggucaguuuugugugau

SEQ ID NO: 187916 - RNA, 64 nt, hsa
auggauuauccacauaaucaaagcuuaucuuuuuaagcacuaaaacuuacuucauuguaacuau

SEQ ID NO: 187917 - RNA, 64 nt, hsa
gugcaguuaggugaugagcacugcuuugaggcccaagcacuaguagagaugcgcgauacagguc

SEQ ID NO: 187918 - RNA, 64 nt, hsa
aacuaugcaaagcauccaggcgguucugaaugugaagcacuacacccagcagagucccggugcc

SEQ ID NO: 187919 - RNA, 64 nt, hsa
uagcacuaagggcaaaaaccaauauuuauaauguaagcacuauccagguaaaacacuggcccaa

SEQ ID NO: 187920 - RNA, 64 nt, hsa
cugcagcguauuagaguaaaagucuaccccucugaagcacuauuaagcgcuuaacguauauuua

SEQ ID NO: 187921 - RNA, 64 nt, hsa
uagauaauguguuaauauugcuauuaccuagguuaagcacuauugucugugcuaguaagaaaaa

SEQ ID NO: 187922 - RNA, 64 nt, hsa
uuuuguucagaaaguuuguuuuaaaguuuauuuuaagcacuaucguaccaaauauuucauauuu

SEQ ID NO: 187923 - RNA, 64 nt, hsa
cggaaagccuuuguacaguuccugggauucacagaagcacuacuccagagcagaaugaugccuu

SEQ ID NO: 187924 - RNA, 64 nt, hsa
uggaaauuacugcuuucucuagaaauauaaagcaaagcacuauuccaaggcuauggaguagcuc

SEQ ID NO: 187925 - RNA, 64 nt, hsa
auaggucucuuaaccuggcaccaguauaacuauaaagcacuagcugagaaggaacugauacuua

SEQ ID NO: 187926 - RNA, 64 nt, hsa
cugaaugcagcucucacuaacaacuucuugguaaaagcacuaaaaaagcucuugauagaauguu

SEQ ID NO: 187927 - RNA, 64 nt, hsa
ucauuaaauugaagagucuacauucagaacauaaaagcacuagguauacaaguuugaaauauga

SEQ ID NO: 187928 - RNA, 64 nt, hsa
uguucuuaugaagcagcauuaugcaaggggaaaaaagcacuaugucuguguauguauguauaua

SEQ ID NO: 187929 - RNA, 64 nt, hsa
gccaaaacaacugguuauaugccucccuugcagcaagcacuacaauguaugugaucgucaaugu

SEQ ID NO: 187930 - RNA, 64 nt, hsa
gaggacaauauggcaauguccuucaaaauuauaaaagcacuaacucuuugauccaguaguuucc

SEQ ID NO: 187931 - RNA, 64 nt, hsa
aaaugugacagaugcagaucuuagaggacuuacaaagcacuauauugguaauucuuacaauggc

SEQ ID NO: 187932 - RNA, 64 nt, hsa
ucugggaggaacaaauuuaaucauuucuucuguuaagcacuaaucaguauagugcaacuccugg

SEQ ID NO: 187933 - RNA, 64 nt, hsa
cauccuccuucaggaacacggggagcagaggccaaagcacuaaggggagggcgcauacccgaga

SEQ ID NO: 187934 - RNA, 64 nt, hsa
cugcuuaucucagagugaagauacugcggcugaaaagcacuaguuugauauaaaauuaaaauga

SEQ ID NO: 187935 - RNA, 64 nt, hsa
uuuauuucauccucgaugggaauucuugcuagguaagcacuaauaacucggcaucuugacgaua

SEQ ID NO: 187936 - RNA, 64 nt, hsa
uuacacacuauauuuuaauugaauucaaacuaucaagcacuacuuagaaacuggaaaacauaua

SEQ ID NO: 187937 - RNA, 64 nt, hsa
ugggauguaccucuccccacuccccuugcuugagaagcacuacucaaaaauuuaccagaccuua

SEQ ID NO: 187938 - RNA, 64 nt, hsa
ugacauuuagauaugccaaaagaauuaaaaucaaaagcacuaagaaauacauaguugugugaug

SEQ ID NO: 187939 - RNA, 64 nt, hsa
cuuucuuuuaagagcugugaaugaaacuuuuucuaagcacuauucuauugcacacaaacagaaa

SEQ ID NO: 187940 - RNA, 64 nt, hsa
agccaccaugccuggccuguauguguguguuuuaaagcacuagauagggauggacauuaaaucu

SEQ ID NO: 187941 - RNA, 64 nt, hsa
gguacaaucuuucaccaaguaaauuuguauaaauaagcacuauucuuuguauuaccaaagcaag

SEQ ID NO: 187942 - RNA, 64 nt, hsa
ucuuuaccuauccucucaaucacuacucuucuugaagcacuauuauuuauucuuccgcugucug

SEQ ID NO: 187943 - RNA, 64 nt, hsa
uuucccugcuucugguuugcugaagauuuucuagaagcacuauuuacacaaauaugcaaaugug

SEQ ID NO: 187944 - RNA, 64 nt, hsa
acuuugaugacucugccccucagcagggcuuacuaagcacuaccccuuaacagggaugacuccg

SEQ ID NO: 187945 - RNA, 64 nt, hsa
cuauuaugaaauacaaugguguuccaaaagaagaaagcacuaaaaacucaacuagcaggaagcg

SEQ ID NO: 187946 - RNA, 64 nt, hsa
gaaguuaaacuccucuacuuaugugccaccuacaaagcacuagagacuguaggagaaaagaaag

SEQ ID NO: 187947 - RNA, 64 nt, hsa; identical to SEQ ID NO: 187946

SEQ ID NO: 187948 - RNA, 64 nt, hsa
acuccuuguuggguaacucagccauggagaugccaagcacuagccaggaggugaguuccucuuu

SEQ ID NO: 187949 - RNA, 64 nt, hsa
uaaaaacccacaggugcugcugcuuauaucugugaagcacuagcuuauucuaggaaugccugau

SEQ ID NO: 187950 - RNA, 64 nt, hsa
auccccucaaacgagaacaaaaaguauucccugcaagcacuaugaauggaccuuacuacucucu

SEQ ID NO: 187951 - RNA, 64 nt, hsa
ucaaagaaagacuguaagcuccaugauuagcauaaagcacuaaccaugucuccaugugacccga

SEQ ID NO: 187952 - RNA, 64 nt, hsa
ccauugccaagagaggaugcaucuggggagagcaaagcacuaaggaauucagcaucagccugca

SEQ ID NO: 187953 - RNA, 64 nt, hsa
guauggagcugugccgaggcuugggcucccacauaagcacuagucuauagaugccucuuaggac

SEQ ID NO: 187954 - RNA, 64 nt, hsa
uaucuuugcucccugcaagaaaucagccauaagaaagcacuauuaauacucugcagugauuaga

SEQ ID NO: 187955 - RNA, 64 nt, hsa
ggauuuuacauguaacugaaguuccccugucuucaagcacuaaaacguugaucuuaaccuuuuu

SEQ ID NO: 187956 - RNA, 64 nt, hsa
gaauggaaguugucauccguaaaagcugaaguguaagcacuaggaaaucucaauauagagauuu

SEQ ID NO: 187957 - RNA, 64 nt, hsa
agccauacugcacggacguagcguuucccucuacaagcacuaggagcaccuuucucaaggacaa

SEQ ID NO: 187958 - RNA, 64 nt, hsa
auauuuugauaauaauauuguuuuucuuucuacaaagcacuagagaaugcacagauauacuuug

SEQ ID NO: 187959 - RNA, 64 nt, hsa
uuagguuauuacuuuuuuuauaaccagauuuuuaaagcacuagguuuuaaaucaguggguauca

SEQ ID NO: 187960 - RNA, 64 nt, hsa
uguugaauucuuugggccuagaauauacuugagaaagcacuaguggcuuguguucagggagagg

SEQ ID NO: 187961 - RNA, 64 nt, hsa
aucaaacaauauaaaagccaauauaaauucucauaagcacuauagaauuugcaaauucagaaca

SEQ ID NO: 187962 - RNA, 64 nt, hsa
uuccccagaaggagugauuuuucuaucggcacaaaagcacuauauggacugguaaugguuacag

SEQ ID NO: 187963 - RNA, 64 nt, hsa
accaccaggccugcccuaaaagagcuccugaaggaagcacuaaacauggaaaggaacaacugau

SEQ ID NO: 187964 - RNA, 64 nt, hsa
uguaacugaccaaagucacacugccaggaacuggaagcacuaggauuugacagcauauccaaau

SEQ ID NO: 187965 - RNA, 64 nt, hsa
gauccuucugcugacugccagaucccugcauuucaagcacuacgccuuccacccccaggcacug

SEQ ID NO: 187966 - RNA, 64 nt, hsa
gaagaucauaggcagcaagggcugauucuaggauaagcacuagaucucccuuaauaaacucaca

SEQ ID NO: 187967 - RNA, 64 nt, hsa
guugccauaaauguuugcauaaugacauagcuuuaagcacuacaugauuuuaaucugcucacau

SEQ ID NO: 187968 - RNA, 64 nt, hsa
ucauguuuuaaaugcuuucuacuugugguucaagaagcacuagauuuaguaagaaacucuaccu

SEQ ID NO: 187969 - RNA, 64 nt, hsa
ccacaagaagaugacugaguucuagagaccccacaagcacuauggacgaagcgugggaccccag

SEQ ID NO: 187970 - RNA, 64 nt, hsa
aacauuuauucagauauggcucuaauguauuaggaagcacuaaauggccuaaaaaagcuacuac

SEQ ID NO: 187971 - RNA, 64 nt, hsa
ugucaaguggauggauauucuagcgcucccaaaaaagcacuauggccuuauaugcagggaaggc

SEQ ID NO: 187972 - RNA, 64 nt, hsa
cauucuuaaauaccucacugucuuggccauggggaagcacuauggccucagcugggggaaagac

SEQ ID NO: 187973 - RNA, 64 nt, hsa
gucaguugccucauagccugcugguccuguaagcaagcacuaagcuccacagugccaguuccuu

SEQ ID NO: 187974 - RNA, 64 nt, hsa
cgagaagagauaauuacaaucaggcuaccaaaggaagcacuaacuuuggugcuuucaaguuggc

SEQ ID NO: 187975 - RNA, 64 nt, hsa
caauugaaauuuaugugaauuauuuugauuguagaagcacuauaauaugugcugaaacuaaauu

SEQ ID NO: 187976 - RNA, 64 nt, hsa
gggauuuuugaagcuguauacugugugcuaaaacaagcacuaaacaaagagugaaggauuuaug

SEQ ID NO: 187977 - RNA, 64 nt, hsa
ccuagauucugagaucuucccauucuaggccuacaagcacuacuugcuguagcugagacuuguc

SEQ ID NO: 187978 - RNA, 64 nt, hsa
guuguguauuuuguuuccuuauagccauuaaagaaagcacuaaggaugaugggagcuccaaauc

SEQ ID NO: 187979 - RNA, 64 nt, hsa
uggccuaaugaaagcuauauacuugugcuaucuaaagcacuacuuuguaaagaugacuacccaa

SEQ ID NO: 187980 - RNA, 64 nt, hsa
aaaacauaggggaaaaaacgaggucauuucuacuaagcacuaggaccugccauagugaguuuaa

SEQ ID NO: 187981 - RNA, 64 nt, hsa
ggaaaaagcauuggcauuauuuucaauaaauaucaagcacuaaaaaaagaaaugauugucuuuu

SEQ ID NO: 187982 - RNA, 64 nt, hsa
ucaaaacuggcuuauacuguaaucuacaacuaauaagcacuaauuuagaguucagcuauauugu

SEQ ID NO: 187983 - RNA, 64 nt, hsa
auagugaauacuuacauagugcuuacuauaugcuaagcacuauuuuuagcauguuauuuauauu

SEQ ID NO: 187984 - RNA, 65 nt, hsa; identical to SEQ ID NO: 65694

SEQ ID NO: 187985 - RNA, 65 nt, hsa; identical to SEQ ID NO: 65695

SEQ ID NO: 187986 - RNA, 65 nt, hsa; identical to SEQ ID NO: 65696

SEQ ID NO: 187987 - RNA, 65 nt, hsa; identical to SEQ ID NO: 65697

SEQ ID NO: 187988 - RNA, 65 nt, hsa; identical to SEQ ID NO: 65698

SEQ ID NO: 187989 - RNA, 65 nt, hsa; identical to SEQ ID NO: 65699

SEQ ID NO: 187990 - RNA, 65 nt, hsa; identical to SEQ ID NO: 65700

SEQ ID NO: 187991 - RNA, 65 nt, hsa; identical to SEQ ID NO: 65701

SEQ ID NO: 187992 - RNA, 65 nt, hsa; identical to SEQ ID NO: 65702

SEQ ID NO: 187993 - RNA, 65 nt, hsa; identical to SEQ ID NO: 65703

SEQ ID NO: 187994 - RNA, 65 nt, hsa; identical to SEQ ID NO: 65704

SEQ ID NO: 187995 - RNA, 65 nt, hsa; identical to SEQ ID NO: 65705

SEQ ID NO: 187996 - RNA, 65 nt, hsa; identical to SEQ ID NO: 65706

SEQ ID NO: 187997 - RNA, 65 nt, hsa; identical to SEQ ID NO: 65707

SEQ ID NO: 187998 - RNA, 65 nt, hsa; identical to SEQ ID NO: 65708

SEQ ID NO: 187999 - RNA, 65 nt, hsa; identical to SEQ ID NO: 65709

SEQ ID NO: 188000 - RNA, 65 nt, hsa; identical to SEQ ID NO: 65710

SEQ ID NO: 188001 - RNA, 65 nt, hsa; identical to SEQ ID NO: 65711

SEQ ID NO: 188002 - RNA, 65 nt, hsa; identical to SEQ ID NO: 65712

SEQ ID NO: 188003 - RNA, 65 nt, hsa; identical to SEQ ID NO: 65713

SEQ ID NO: 188004 - RNA, 65 nt, hsa; identical to SEQ ID NO: 65714

SEQ ID NO: 188005 - RNA, 65 nt, hsa; identical to SEQ ID NO: 65715

SEQ ID NO: 188006 - RNA, 65 nt, hsa; identical to SEQ ID NO: 65716

SEQ ID NO: 188007 - RNA, 65 nt, hsa; identical to SEQ ID NO: 65717

SEQ ID NO: 188008 - RNA, 65 nt, hsa; identical to SEQ ID NO: 65718

SEQ ID NO: 188009 - RNA, 65 nt, hsa; identical to SEQ ID NO: 65719

SEQ ID NO: 188010 - RNA, 65 nt, hsa; identical to SEQ ID NO: 65720

SEQ ID NO: 188011 - RNA, 65 nt, hsa; identical to SEQ ID NO: 65721

SEQ ID NO: 188012 - RNA, 65 nt, hsa; identical to SEQ ID NO: 65722

SEQ ID NO: 188013 - RNA, 65 nt, hsa; identical to SEQ ID NO: 65723

SEQ ID NO: 188014 - RNA, 65 nt, hsa; identical to SEQ ID NO: 65724

SEQ ID NO: 188015 - RNA, 65 nt, hsa; identical to SEQ ID NO: 65725

SEQ ID NO: 188016 - RNA, 65 nt, hsa; identical to SEQ ID NO: 65726

SEQ ID NO: 188017 - RNA, 65 nt, hsa; identical to SEQ ID NO: 65727

SEQ ID NO: 188018 - RNA, 65 nt, hsa; identical to SEQ ID NO: 65728

SEQ ID NO: 188019 - RNA, 65 nt, hsa; identical to SEQ ID NO: 65729

SEQ ID NO: 188020 - RNA, 65 nt, hsa; identical to SEQ ID NO: 65730

SEQ ID NO: 188021 - RNA, 65 nt, hsa; identical to SEQ ID NO: 65731

SEQ ID NO: 188022 - RNA, 65 nt, hsa; identical to SEQ ID NO: 65732

SEQ ID NO: 188023 - RNA, 65 nt, hsa; identical to SEQ ID NO: 65733

SEQ ID NO: 188024 - RNA, 65 nt, hsa; identical to SEQ ID NO: 65734

SEQ ID NO: 188025 - RNA, 65 nt, hsa; identical to SEQ ID NO: 65735

SEQ ID NO: 188026 - RNA, 65 nt, hsa; identical to SEQ ID NO: 65736

SEQ ID NO: 188027 - RNA, 65 nt, hsa; identical to SEQ ID NO: 65737

SEQ ID NO: 188028 - RNA, 65 nt, hsa; identical to SEQ ID NO: 65738

SEQ ID NO: 188029 - RNA, 65 nt, hsa; identical to SEQ ID NO: 65739

SEQ ID NO: 188030 - RNA, 65 nt, hsa; identical to SEQ ID NO: 65740

SEQ ID NO: 188031 - RNA, 65 nt, hsa; identical to SEQ ID NO: 65741

SEQ ID NO: 188032 - RNA, 65 nt, hsa; identical to SEQ ID NO: 65742

SEQ ID NO: 188033 - RNA, 65 nt, hsa; identical to SEQ ID NO: 65743

SEQ ID NO: 188034 - RNA, 65 nt, hsa; identical to SEQ ID NO: 65744

SEQ ID NO: 188035 - RNA, 65 nt, hsa; identical to SEQ ID NO: 65745

SEQ ID NO: 188036 - RNA, 65 nt, hsa; identical to SEQ ID NO: 65746

SEQ ID NO: 188037 - RNA, 65 nt, hsa; identical to SEQ ID NO: 65747

SEQ ID NO: 188038 - RNA, 65 nt, hsa; identical to SEQ ID NO: 65748

SEQ ID NO: 188039 - RNA, 65 nt, hsa; identical to SEQ ID NO: 65749

SEQ ID NO: 188040 - RNA, 65 nt, hsa; identical to SEQ ID NO: 65750

SEQ ID NO: 188041 - RNA, 65 nt, hsa; identical to SEQ ID NO: 65751

SEQ ID NO: 188042 - RNA, 65 nt, hsa; identical to SEQ ID NO: 65752

SEQ ID NO: 188043 - RNA, 65 nt, hsa; identical to SEQ ID NO: 65753

SEQ ID NO: 188044 - RNA, 65 nt, hsa; identical to SEQ ID NO: 65754

SEQ ID NO: 188045 - RNA, 65 nt, hsa; identical to SEQ ID NO: 65755

SEQ ID NO: 188046 - RNA, 65 nt, hsa; identical to SEQ ID NO: 65756

SEQ ID NO: 188047 - RNA, 65 nt, hsa; identical to SEQ ID NO: 65757

SEQ ID NO: 188048 - RNA, 65 nt, hsa; identical to SEQ ID NO: 65758

SEQ ID NO: 188049 - RNA, 65 nt, hsa; identical to SEQ ID NO: 65759

SEQ ID NO: 188050 - RNA, 65 nt, hsa; identical to SEQ ID NO: 65760

SEQ ID NO: 188051 - RNA, 65 nt, hsa; identical to SEQ ID NO: 65761

SEQ ID NO: 188052 - RNA, 65 nt, hsa; identical to SEQ ID NO: 65762

SEQ ID NO: 188053 - RNA, 65 nt, hsa; identical to SEQ ID NO: 65763

SEQ ID NO: 188054 - RNA, 65 nt, hsa; identical to SEQ ID NO: 65764

SEQ ID NO: 188055 - RNA, 65 nt, hsa; identical to SEQ ID NO: 65765

SEQ ID NO: 188056 - RNA, 65 nt, hsa; identical to SEQ ID NO: 65766

SEQ ID NO: 188057 - RNA, 65 nt, hsa; identical to SEQ ID NO: 65767

SEQ ID NO: 188058 - RNA, 65 nt, hsa; identical to SEQ ID NO: 65768

SEQ ID NO: 188059 - RNA, 65 nt, hsa; identical to SEQ ID NO: 65769

SEQ ID NO: 188060 - RNA, 65 nt, hsa; identical to SEQ ID NO: 65770

SEQ ID NO: 188061 - RNA, 65 nt, hsa; identical to SEQ ID NO: 65771

SEQ ID NO: 188062 - RNA, 65 nt, hsa; identical to SEQ ID NO: 65772

SEQ ID NO: 188063 - RNA, 65 nt, hsa; identical to SEQ ID NO: 65773

SEQ ID NO: 188064 - RNA, 65 nt, hsa; identical to SEQ ID NO: 65774

SEQ ID NO: 188065 - RNA, 65 nt, hsa; identical to SEQ ID NO: 65775

SEQ ID NO: 188066 - RNA, 65 nt, hsa; identical to SEQ ID NO: 65776

SEQ ID NO: 188067 - RNA, 65 nt, hsa; identical to SEQ ID NO: 65777

SEQ ID NO: 188068 - RNA, 65 nt, hsa; identical to SEQ ID NO: 65778

SEQ ID NO: 188069 - RNA, 65 nt, hsa; identical to SEQ ID NO: 65779

SEQ ID NO: 188070 - RNA, 65 nt, hsa; identical to SEQ ID NO: 65780

SEQ ID NO: 188071 - RNA, 65 nt, hsa; identical to SEQ ID NO: 65781

SEQ ID NO: 188072 - RNA, 65 nt, hsa; identical to SEQ ID NO: 65782

SEQ ID NO: 188073 - RNA, 65 nt, hsa; identical to SEQ ID NO: 65783

SEQ ID NO: 188074 - RNA, 65 nt, hsa; identical to SEQ ID NO: 65784

SEQ ID NO: 188075 - RNA, 65 nt, hsa; identical to SEQ ID NO: 65785

SEQ ID NO: 188076 - RNA, 65 nt, hsa; identical to SEQ ID NO: 65786

SEQ ID NO: 188077 - RNA, 65 nt, hsa; identical to SEQ ID NO: 65787

SEQ ID NO: 188078 - RNA, 65 nt, hsa; identical to SEQ ID NO: 65788

SEQ ID NO: 188079 - RNA, 65 nt, hsa; identical to SEQ ID NO: 65789

SEQ ID NO: 188080 - RNA, 65 nt, hsa; identical to SEQ ID NO: 65790

SEQ ID NO: 188081 - RNA, 65 nt, hsa; identical to SEQ ID NO: 65791

SEQ ID NO: 188082 - RNA, 65 nt, hsa; identical to SEQ ID NO: 65792

SEQ ID NO: 188083 - RNA, 65 nt, hsa; identical to SEQ ID NO: 65793

SEQ ID NO: 188084 - RNA, 65 nt, hsa; identical to SEQ ID NO: 65794

SEQ ID NO: 188085 - RNA, 65 nt, hsa; identical to SEQ ID NO: 65795

SEQ ID NO: 188086 - RNA, 65 nt, hsa; identical to SEQ ID NO: 65796

SEQ ID NO: 188087 - RNA, 65 nt, hsa; identical to SEQ ID NO: 65797

SEQ ID NO: 188088 - RNA, 65 nt, hsa; identical to SEQ ID NO: 65798

SEQ ID NO: 188089 - RNA, 65 nt, hsa; identical to SEQ ID NO: 65799

SEQ ID NO: 188090 - RNA, 65 nt, hsa; identical to SEQ ID NO: 65800

SEQ ID NO: 188091 - RNA, 65 nt, hsa; identical to SEQ ID NO: 65801

SEQ ID NO: 188092 - RNA, 65 nt, hsa; identical to SEQ ID NO: 65802

SEQ ID NO: 188093 - RNA, 65 nt, hsa; identical to SEQ ID NO: 65803

SEQ ID NO: 188094 - RNA, 65 nt, hsa; identical to SEQ ID NO: 65804

SEQ ID NO: 188095 - RNA, 65 nt, hsa; identical to SEQ ID NO: 65805

SEQ ID NO: 188096 - RNA, 65 nt, hsa; identical to SEQ ID NO: 65806

SEQ ID NO: 188097 - RNA, 65 nt, hsa; identical to SEQ ID NO: 65807

SEQ ID NO: 188098 - RNA, 65 nt, hsa; identical to SEQ ID NO: 65808

SEQ ID NO: 188099 - RNA, 65 nt, hsa; identical to SEQ ID NO: 65809

SEQ ID NO: 188100 - RNA, 65 nt, hsa; identical to SEQ ID NO: 65810

SEQ ID NO: 188101 - RNA, 65 nt, hsa; identical to SEQ ID NO: 65811

SEQ ID NO: 188102 - RNA, 65 nt, hsa; identical to SEQ ID NO: 65812

SEQ ID NO: 188103 - RNA, 65 nt, hsa; identical to SEQ ID NO: 65813

SEQ ID NO: 188104 - RNA, 65 nt, hsa; identical to SEQ ID NO: 65814

SEQ ID NO: 188105 - RNA, 65 nt, hsa; identical to SEQ ID NO: 65815

SEQ ID NO: 188106 - RNA, 65 nt, hsa; identical to SEQ ID NO: 65816

SEQ ID NO: 188107 - RNA, 65 nt, hsa; identical to SEQ ID NO: 65817

SEQ ID NO: 188108 - RNA, 65 nt, hsa; identical to SEQ ID NO: 65818

SEQ ID NO: 188109 - RNA, 65 nt, hsa; identical to SEQ ID NO: 65819

SEQ ID NO: 188110 - RNA, 65 nt, hsa; identical to SEQ ID NO: 65820

SEQ ID NO: 188111 - RNA, 65 nt, hsa; identical to SEQ ID NO: 65821

SEQ ID NO: 188112 - RNA, 65 nt, hsa; identical to SEQ ID NO: 65822

SEQ ID NO: 188113 - RNA, 65 nt, hsa; identical to SEQ ID NO: 65823

SEQ ID NO: 188114 - RNA, 65 nt, hsa; identical to SEQ ID NO: 65824

SEQ ID NO: 188115 - RNA, 65 nt, hsa; identical to SEQ ID NO: 65825

SEQ ID NO: 188116 - RNA, 65 nt, hsa; identical to SEQ ID NO: 65826

SEQ ID NO: 188117 - RNA, 65 nt, hsa; identical to SEQ ID NO: 65827

SEQ ID NO: 188118 - RNA, 65 nt, hsa; identical to SEQ ID NO: 65828

SEQ ID NO: 188119 - RNA, 65 nt, hsa; identical to SEQ ID NO: 65829

SEQ ID NO: 188120 - RNA, 65 nt, hsa; identical to SEQ ID NO: 65830

SEQ ID NO: 188121 - RNA, 65 nt, hsa; identical to SEQ ID NO: 65831

SEQ ID NO: 188122 - RNA, 56 nt, hsa; identical to SEQ ID NO: 61369

SEQ ID NO: 188123 - RNA, 65 nt, hsa; identical to SEQ ID NO: 65833

SEQ ID NO: 188124 - RNA, 65 nt, hsa; identical to SEQ ID NO: 65834

SEQ ID NO: 188125 - RNA, 65 nt, hsa; identical to SEQ ID NO: 65835

SEQ ID NO: 188126 - RNA, 65 nt, hsa; identical to SEQ ID NO: 65836

SEQ ID NO: 188127 - RNA, 65 nt, hsa; identical to SEQ ID NO: 65837

SEQ ID NO: 188128 - RNA, 65 nt, hsa; identical to SEQ ID NO: 65838

SEQ ID NO: 188129 - RNA, 65 nt, hsa; identical to SEQ ID NO: 65839

SEQ ID NO: 188130 - RNA, 65 nt, hsa; identical to SEQ ID NO: 65840

SEQ ID NO: 188131 - RNA, 65 nt, hsa; identical to SEQ ID NO: 65841

SEQ ID NO: 188132 - RNA, 65 nt, hsa; identical to SEQ ID NO: 65842

SEQ ID NO: 188133 - RNA, 65 nt, hsa; identical to SEQ ID NO: 65843

SEQ ID NO: 188134 - RNA, 65 nt, hsa; identical to SEQ ID NO: 65844

SEQ ID NO: 188135 - RNA, 65 nt, hsa; identical to SEQ ID NO: 65845

SEQ ID NO: 188136 - RNA, 65 nt, hsa; identical to SEQ ID NO: 65846

SEQ ID NO: 188137 - RNA, 65 nt, hsa; identical to SEQ ID NO: 65847

SEQ ID NO: 188138 - RNA, 65 nt, hsa; identical to SEQ ID NO: 65848

SEQ ID NO: 188139 - RNA, 65 nt, hsa; identical to SEQ ID NO: 65849

SEQ ID NO: 188140 - RNA, 65 nt, hsa; identical to SEQ ID NO: 65850

SEQ ID NO: 188141 - RNA, 65 nt, hsa; identical to SEQ ID NO: 65851

SEQ ID NO: 188142 - RNA, 65 nt, hsa; identical to SEQ ID NO: 65852

SEQ ID NO: 188143 - RNA, 65 nt, hsa; identical to SEQ ID NO: 65853

SEQ ID NO: 188144 - RNA, 65 nt, hsa; identical to SEQ ID NO: 65854

SEQ ID NO: 188145 - RNA, 65 nt, hsa; identical to SEQ ID NO: 65855

SEQ ID NO: 188146 - RNA, 65 nt, hsa; identical to SEQ ID NO: 65856

SEQ ID NO: 188147 - RNA, 65 nt, hsa; identical to SEQ ID NO: 65857

SEQ ID NO: 188148 - RNA, 65 nt, hsa; identical to SEQ ID NO: 65858

SEQ ID NO: 188149 - RNA, 65 nt, hsa; identical to SEQ ID NO: 65859

SEQ ID NO: 188150 - RNA, 65 nt, hsa; identical to SEQ ID NO: 65860

SEQ ID NO: 188151 - RNA, 65 nt, hsa; identical to SEQ ID NO: 65861

SEQ ID NO: 188152 - RNA, 65 nt, hsa; identical to SEQ ID NO: 65862

SEQ ID NO: 188153 - RNA, 65 nt, hsa; identical to SEQ ID NO: 65863

SEQ ID NO: 188154 - RNA, 65 nt, hsa; identical to SEQ ID NO: 65864

SEQ ID NO: 188155 - RNA, 65 nt, hsa; identical to SEQ ID NO: 65865

SEQ ID NO: 188156 - RNA, 65 nt, hsa; identical to SEQ ID NO: 65866

SEQ ID NO: 188157 - RNA, 65 nt, hsa; identical to SEQ ID NO: 65867

SEQ ID NO: 188158 - RNA, 65 nt, hsa; identical to SEQ ID NO: 65868

SEQ ID NO: 188159 - RNA, 65 nt, hsa; identical to SEQ ID NO: 65869

SEQ ID NO: 188160 - RNA, 65 nt, hsa; identical to SEQ ID NO: 65870

SEQ ID NO: 188161 - RNA, 65 nt, hsa; identical to SEQ ID NO: 65871

SEQ ID NO: 188162 - RNA, 65 nt, hsa; identical to SEQ ID NO: 65872

SEQ ID NO: 188163 - RNA, 65 nt, hsa; identical to SEQ ID NO: 65873

SEQ ID NO: 188164 - RNA, 65 nt, hsa; identical to SEQ ID NO: 65874

SEQ ID NO: 188165 - RNA, 65 nt, hsa; identical to SEQ ID NO: 65875

SEQ ID NO: 188166 - RNA, 65 nt, hsa; identical to SEQ ID NO: 65876

SEQ ID NO: 188167 - RNA, 65 nt, hsa; identical to SEQ ID NO: 65877

SEQ ID NO: 188168 - RNA, 65 nt, hsa; identical to SEQ ID NO: 65878

SEQ ID NO: 188169 - RNA, 65 nt, hsa; identical to SEQ ID NO: 65879

SEQ ID NO: 188170 - RNA, 65 nt, hsa; identical to SEQ ID NO: 65880

SEQ ID NO: 188171 - RNA, 65 nt, hsa; identical to SEQ ID NO: 65881

SEQ ID NO: 188172 - RNA, 65 nt, hsa; identical to SEQ ID NO: 65882

SEQ ID NO: 188173 - RNA, 65 nt, hsa; identical to SEQ ID NO: 65883

SEQ ID NO: 188174 - RNA, 65 nt, hsa; identical to SEQ ID NO: 65884

SEQ ID NO: 188175 - RNA, 65 nt, hsa; identical to SEQ ID NO: 65885

SEQ ID NO: 188176 - RNA, 65 nt, hsa; identical to SEQ ID NO: 65886

SEQ ID NO: 188177 - RNA, 65 nt, hsa; identical to SEQ ID NO: 65887

SEQ ID NO: 188178 - RNA, 65 nt, hsa; identical to SEQ ID NO: 65888

SEQ ID NO: 188179 - RNA, 65 nt, hsa; identical to SEQ ID NO: 65889

SEQ ID NO: 188180 - RNA, 65 nt, hsa; identical to SEQ ID NO: 65890

SEQ ID NO: 188181 - RNA, 65 nt, hsa; identical to SEQ ID NO: 65891

SEQ ID NO: 188182 - RNA, 65 nt, hsa; identical to SEQ ID NO: 65892

SEQ ID NO: 188183 - RNA, 65 nt, hsa; identical to SEQ ID NO: 65893

SEQ ID NO: 188184 - RNA, 65 nt, hsa; identical to SEQ ID NO: 65894

SEQ ID NO: 188185 - RNA, 65 nt, hsa; identical to SEQ ID NO: 65895

SEQ ID NO: 188186 - RNA, 65 nt, hsa; identical to SEQ ID NO: 65896

SEQ ID NO: 188187 - RNA, 65 nt, hsa; identical to SEQ ID NO: 65897

SEQ ID NO: 188188 - RNA, 65 nt, hsa; identical to SEQ ID NO: 65898

SEQ ID NO: 188189 - RNA, 65 nt, hsa; identical to SEQ ID NO: 65899

SEQ ID NO: 188190 - RNA, 65 nt, hsa; identical to SEQ ID NO: 65900

SEQ ID NO: 188191 - RNA, 65 nt, hsa; identical to SEQ ID NO: 65901

SEQ ID NO: 188192 - RNA, 65 nt, hsa; identical to SEQ ID NO: 65902

SEQ ID NO: 188193 - RNA, 65 nt, hsa; identical to SEQ ID NO: 65903

SEQ ID NO: 188194 - RNA, 65 nt, hsa; identical to SEQ ID NO: 65904

SEQ ID NO: 188195 - RNA, 65 nt, hsa; identical to SEQ ID NO: 65905

SEQ ID NO: 188196 - RNA, 65 nt, hsa; identical to SEQ ID NO: 65906

SEQ ID NO: 188197 - RNA, 65 nt, hsa; identical to SEQ ID NO: 65907

SEQ ID NO: 188198 - RNA, 65 nt, hsa; identical to SEQ ID NO: 65908

SEQ ID NO: 188199 - RNA, 65 nt, hsa; identical to SEQ ID NO: 65909

SEQ ID NO: 188200 - RNA, 65 nt, hsa; identical to SEQ ID NO: 65910

SEQ ID NO: 188201 - RNA, 65 nt, hsa; identical to SEQ ID NO: 65911

SEQ ID NO: 188202 - RNA, 65 nt, hsa; identical to SEQ ID NO: 65912

SEQ ID NO: 188203 - RNA, 65 nt, hsa; identical to SEQ ID NO: 65913

SEQ ID NO: 188204 - RNA, 65 nt, hsa; identical to SEQ ID NO: 65914

SEQ ID NO: 188205 - RNA, 65 nt, hsa; identical to SEQ ID NO: 65915

SEQ ID NO: 188206 - RNA, 65 nt, hsa; identical to SEQ ID NO: 65916

SEQ ID NO: 188207 - RNA, 65 nt, hsa; identical to SEQ ID NO: 65917

SEQ ID NO: 188208 - RNA, 65 nt, hsa; identical to SEQ ID NO: 65918

SEQ ID NO: 188209 - RNA, 65 nt, hsa; identical to SEQ ID NO: 65919

SEQ ID NO: 188210 - RNA, 65 nt, hsa; identical to SEQ ID NO: 65920

SEQ ID NO: 188211 - RNA, 65 nt, hsa; identical to SEQ ID NO: 65921

SEQ ID NO: 188212 - RNA, 65 nt, hsa; identical to SEQ ID NO: 65922

SEQ ID NO: 188213 - RNA, 65 nt, hsa; identical to SEQ ID NO: 65923

SEQ ID NO: 188214 - RNA, 60 nt, hsa; identical to SEQ ID NO: 65087

SEQ ID NO: 188215 - RNA, 65 nt, hsa; identical to SEQ ID NO: 65925

SEQ ID NO: 188216 - RNA, 65 nt, hsa; identical to SEQ ID NO: 65926

SEQ ID NO: 188217 - RNA, 65 nt, hsa; identical to SEQ ID NO: 65927

SEQ ID NO: 188218 - RNA, 65 nt, hsa; identical to SEQ ID NO: 65928

SEQ ID NO: 188219 - RNA, 65 nt, hsa; identical to SEQ ID NO: 65929

SEQ ID NO: 188220 - RNA, 65 nt, hsa; identical to SEQ ID NO: 65930

SEQ ID NO: 188221 - RNA, 51 nt, hsa; identical to SEQ ID NO: 65094

SEQ ID NO: 188222 - RNA, 65 nt, hsa; identical to SEQ ID NO: 65932

SEQ ID NO: 188223 - RNA, 65 nt, hsa; identical to SEQ ID NO: 65933

SEQ ID NO: 188224 - RNA, 65 nt, hsa; identical to SEQ ID NO: 65934

SEQ ID NO: 188225 - RNA, 65 nt, hsa; identical to SEQ ID NO: 65935

SEQ ID NO: 188226 - RNA, 65 nt, hsa; identical to SEQ ID NO: 65936

SEQ ID NO: 188227 - RNA, 65 nt, hsa; identical to SEQ ID NO: 65937

SEQ ID NO: 188228 - RNA, 65 nt, hsa; identical to SEQ ID NO: 65938

SEQ ID NO: 188229 - RNA, 65 nt, hsa; identical to SEQ ID NO: 65939

SEQ ID NO: 188230 - RNA, 65 nt, hsa; identical to SEQ ID NO: 65940

SEQ ID NO: 188231 - RNA, 65 nt, hsa; identical to SEQ ID NO: 65941

SEQ ID NO: 188232 - RNA, 65 nt, hsa; identical to SEQ ID NO: 65942

SEQ ID NO: 188233 - RNA, 65 nt, hsa; identical to SEQ ID NO: 65943

SEQ ID NO: 188234 - RNA, 65 nt, hsa; identical to SEQ ID NO: 65944

SEQ ID NO: 188235 - RNA, 65 nt, hsa; identical to SEQ ID NO: 65945

SEQ ID NO: 188236 - RNA, 65 nt, hsa; identical to SEQ ID NO: 65946

SEQ ID NO: 188237 - RNA, 65 nt, hsa; identical to SEQ ID NO: 65947

SEQ ID NO: 188238 - RNA, 65 nt, hsa; identical to SEQ ID NO: 65948

SEQ ID NO: 188239 - RNA, 65 nt, hsa; identical to SEQ ID NO: 65949

SEQ ID NO: 188240 - RNA, 65 nt, hsa; identical to SEQ ID NO: 65950

SEQ ID NO: 188241 - RNA, 65 nt, hsa; identical to SEQ ID NO: 65951

SEQ ID NO: 188242 - RNA, 65 nt, hsa; identical to SEQ ID NO: 65952

SEQ ID NO: 188243 - RNA, 65 nt, hsa; identical to SEQ ID NO: 65953

SEQ ID NO: 188244 - RNA, 65 nt, hsa; identical to SEQ ID NO: 65954

SEQ ID NO: 188245 - RNA, 65 nt, hsa; identical to SEQ ID NO: 65955

SEQ ID NO: 188246 - RNA, 65 nt, hsa; identical to SEQ ID NO: 65956

SEQ ID NO: 188247 - RNA, 65 nt, hsa; identical to SEQ ID NO: 65957

SEQ ID NO: 188248 - RNA, 65 nt, hsa; identical to SEQ ID NO: 65958

SEQ ID NO: 188249 - RNA, 65 nt, hsa; identical to SEQ ID NO: 65959

SEQ ID NO: 188250 - RNA, 65 nt, hsa; identical to SEQ ID NO: 65960

SEQ ID NO: 188251 - RNA, 65 nt, hsa; identical to SEQ ID NO: 65961

SEQ ID NO: 188252 - RNA, 65 nt, hsa; identical to SEQ ID NO: 65962

SEQ ID NO: 188253 - RNA, 65 nt, hsa; identical to SEQ ID NO: 65963

SEQ ID NO: 188254 - RNA, 65 nt, hsa; identical to SEQ ID NO: 65964

SEQ ID NO: 188255 - RNA, 65 nt, hsa; identical to SEQ ID NO: 65965

SEQ ID NO: 188256 - RNA, 65 nt, hsa; identical to SEQ ID NO: 65966

SEQ ID NO: 188257 - RNA, 65 nt, hsa; identical to SEQ ID NO: 65967

SEQ ID NO: 188258 - RNA, 65 nt, hsa; identical to SEQ ID NO: 65968

SEQ ID NO: 188259 - RNA, 65 nt, hsa; identical to SEQ ID NO: 65969

SEQ ID NO: 188260 - RNA, 65 nt, hsa; identical to SEQ ID NO: 65970

SEQ ID NO: 188261 - RNA, 65 nt, hsa; identical to SEQ ID NO: 65971

SEQ ID NO: 188262 - RNA, 65 nt, hsa; identical to SEQ ID NO: 65972

SEQ ID NO: 188263 - RNA, 64 nt, hsa
uugaagcggaagcagccugugcggaaacgccagugacacguacacaccacguccuggucuuugu

SEQ ID NO: 188264 - RNA, 64 nt, hsa
gacugaagaaacaagaagaaaccucaaguguauugacacguaaagaagcagcaguccugcccca

SEQ ID NO: 188265 - RNA, 64 nt, hsa
uugaacaaacacucuuaacuccuaauuguucuuugacacguaguaauucugugacauacuuuuu

SEQ ID NO: 188266 - RNA, 64 nt, hsa
ugggaauguuuuuagcugguggcaauaaauaccagacacguacaaaauccagcuaugaauauag

SEQ ID NO: 188267 - RNA, 64 nt, hsa
ugggggcagccgaugccugguccaggcugugagggacacguauggagcagauaaagaauucacu

SEQ ID NO: 188268 - RNA, 64 nt, hsa
ccugauugaucuucugagagcucgaaugcugcuggacacguaccccuuucuauuauuacuuugu

SEQ ID NO: 188269 - RNA, 64 nt, hsa
ugcucuguuuucucuuccucagcauccaccccgugacacguagugguggcugaugucgccacag

SEQ ID NO: 188270 - RNA, 64 nt, hsa
cucucauuugcccucuuuuucuaagugaauacaggacacguauuaguuguucuuaauuuuuuuc

SEQ ID NO: 188271 - RNA, 64 nt, hsa
acauuuuggugaaaaugugccuagaaucaaaugugacacguaggcuggaacugaguaccauuca

SEQ ID NO: 188272 - RNA, 64 nt, hsa
acaacuaguuaaguauaaaaugccaaauaaaagugacacguacaaugugguuuauaaaaauaag

SEQ ID NO: 188273 - RNA, 64 nt, hsa
accaaagcuacucucucugcugcuuagaacuguggacacguauggaaagacuggacccccauug

SEQ ID NO: 188274 - RNA, 64 nt, hsa
gcaccugucucucucugagaacacggugugucucgacacguaccacguacguggaaacacaaga

SEQ ID NO: 188275 - RNA, 64 nt, hsa
aaaaguuuauauguaggauaaaaaccuuuuagaggacacguaggcgguaccacuaagguuuugg

SEQ ID NO: 188276 - RNA, 64 nt, hsa
uuuucauuuaguuugauuauucagugucacuggcgacacguagcagcuuagacuaaggccauua

SEQ ID NO: 188277 - RNA, 64 nt, hsa
gugguaagaaggauauuuaaucaugacaugcacggacacguacauauuuaacugaaacaaguuu

SEQ ID NO: 188278 - RNA, 64 nt, hsa
accucaugucuguucucauaagucugaaagcucugacacguagagcucuuuuguaagauuuauu

SEQ ID NO: 188279 - RNA, 64 nt, hsa
ucgggacagcccugcugucagaugaaaacagaaugacacguaaaauccaggauuuuuuuuuucu

SEQ ID NO: 188280 - RNA, 64 nt, hsa
uuuuguauuuuggcugcuagagugcagcauuugugacacguauuugaaauuugaaauuuccuuc

SEQ ID NO: 188281 - RNA, 64 nt, hsa
accgacugcccgccccuccccugccacacacacagacacguaauaccagaccaaccucaauccc

SEQ ID NO: 188282 - RNA, 64 nt, hsa
uuugcugugaggagcuagaugacaccaagacacagacacguacucuucaccggcuccuuuugcu

SEQ ID NO: 188283 - RNA, 64 nt, hsa
uuguauuacaauuuuuauuuuaggaacuuauucagacacguaaauguuguuuaauucuguaggu

SEQ ID NO: 188284 - RNA, 64 nt, hsa
ggagaccacccucuggguccuugcuggggccgcagacacguaggcuggggugaggagugucugc

SEQ ID NO: 188285 - RNA, 64 nt, hsa
agggguagcuagcgugugccaggcagauccucuggacacguaaccuaugucagacacuacauga

SEQ ID NO: 188286 - RNA, 64 nt, hsa
uuaaguuuuuucuuuuauaucauccagaaauaaagacacguacacuaaggugugucagggucua

SEQ ID NO: 188287 - RNA, 64 nt, hsa
uucgaugcccauuaguuuuauauaacauuuauuugacacguacugacuucuaucugagaagaac

SEQ ID NO: 188288 - RNA, 64 nt, hsa
aauaauguuuuaccaucucuucaccagucaaguugacacguaaaauuaaccaucacauugguaa

SEQ ID NO: 188289 - RNA, 64 nt, hsa
acaccugucauugagccaagaaaguccaguuuaugacacguauguacuagugaacaccguccuc

SEQ ID NO: 188290 - RNA, 64 nt, hsa
uucagaguacaaauugguggaugguggaaggcaggacacguaucucugucugacggaaaacaga

SEQ ID NO: 188291 - RNA, 64 nt, hsa
aauugugaaaugcauuauugauuuaaauaaugcugacacguacucuuuaaaaguguucuuuaac

SEQ ID NO: 188292 - RNA, 64 nt, hsa
guuccggggcccccucagccaggugggaaugacggacacguacuauccaaguguaugggauuaa

SEQ ID NO: 188293 - RNA, 64 nt, hsa
cuuuggggaccagaggaacauuaggggccggucagacacguagggggcagugaggaaacggggu

SEQ ID NO: 188294 - RNA, 64 nt, hsa
augggagccaggaaagauuuaggggcaggagacagacacguaacaggaacucggaagguagaac

SEQ ID NO: 188295 - RNA, 64 nt, hsa
auacuuugaaagcaaaaauacaaucaaacacauugacacguauauaaagauccacgcguggcug

SEQ ID NO: 188296 - RNA, 64 nt, hsa
cugcaucaaugcaagccugguuggaccauuguccaugccucaggauagaacagccuggcuuauu

SEQ ID NO: 188297 - RNA, 64 nt, hsa
agaaauggugccauugaagccacaaagccgguaaaugccucaauacguucugggagaaaacuua

SEQ ID NO: 188298 - RNA, 64 nt, hsa
ccuccuccucagggcagcgcuaggggccuccccuaugccucagccccaucucugcuccuguuug

SEQ ID NO: 188299 - RNA, 64 nt, hsa
ccacacaccucucgaggcaccucccagacaccaaaugccucauccccaggcaaccccacugcuc

SEQ ID NO: 188300 - RNA, 64 nt, hsa
augcaauuaaauaccucacuauuaaacugccaugaugccucaguuaaaaaaaaaauuaaauguc

SEQ ID NO: 188301 - RNA, 64 nt, hsa
ccuuccacuuagcaauagcccugacucaggcagaaugccucauaaauuagccuucgaaagaaaa

SEQ ID NO: 188302 - RNA, 64 nt, hsa
cauaggagauaaaacccccacugagaugccucucaugccucagcugggacccaccguguagaca

SEQ ID NO: 188303 - RNA, 64 nt, hsa
acuaacauucuuguaggagugguuagagaagcugaugccucauuucuacauucugucauuagcu

SEQ ID NO: 188304 - RNA, 64 nt, hsa
ugucauauuucauguugggaccaaguaguuugcccauggcaaaccuaaauuuaugaccugcuga

SEQ ID NO: 188305 - RNA, 64 nt, hsa
aagcaagauugaaauuugaacuaugagucuccugcauggcaacaaaaugugugucaccaucagg

SEQ ID NO: 188306 - RNA, 64 nt, hsa
acacauauucacauggcgcucaagaaguuaggcucauggcaacgugugucuuucucuggacaac

SEQ ID NO: 188307 - RNA, 64 nt, hsa
ccuuccuacaaucaggaagauagauccaacuggccauggcaaaagcccuggggauuuccgauuc

SEQ ID NO: 188308 - RNA, 64 nt, hsa
uuuucuguuuuuggaaauaauuuguaauaaaaaucauggcaacauaauucacuuuccaucuuuu

SEQ ID NO: 188309 - RNA, 64 nt, hsa
cagucugcugguuaaauggaaacuuaaaaauauccauggcaagcuuuguauauaaaugaacaaa

SEQ ID NO: 188310 - RNA, 64 nt, hsa
gccccugguuaagggagaucuggcugugagucaucauggcaaggguaaucuuuacaagcauagc

SEQ ID NO: 188311 - RNA, 64 nt, hsa
cugcccgaaugaaauccgaacaguuggggcuguucauggcaaguggggcugguuuuucauuucc

SEQ ID NO: 188312 - RNA, 64 nt, hsa
ccugaggucaggaguucgagagcagccuggccaacauggcaaaaccccuuauuuacuaaaaaua

SEQ ID NO: 188313 - RNA, 64 nt, hsa
acauauauauacauauauauguauauauagaacacauggcaagagcaggaaaugggaagacuac

SEQ ID NO: 188314 - RNA, 64 nt, hsa
uuauuuuuaaacacccuuaaagacagauauaucucauggcaaauuugguauccuguuacagccu

SEQ ID NO: 188315 - RNA, 64 nt, hsa
uguucacaggcuuucacagcaaggguaccuauuucauggcaaaauaggcaguuuuaaaagaaua

SEQ ID NO: 188316 - RNA, 64 nt, hsa
cuugagcccaggaguuugagaccagccugggcaacauggcaaaaccccaucucuacaaaaaaua

SEQ ID NO: 188317 - RNA, 64 nt, hsa
cuugagcccaggaguuugaaaccagccuggguaacauggcaaaauccugucuuuacaaaaaaua

SEQ ID NO: 188318 - RNA, 64 nt, hsa
ccugaagucagaaguuugagaccagccuggcaaacauggcaaaacugucucuauuaaaaauaca

SEQ ID NO: 188319 - RNA, 64 nt, hsa
ggccagccucagccucuauggcaaggcccugcuacauggcaacugcuacaacagguacggcagc

SEQ ID NO: 188320 - RNA, 64 nt, hsa
gcuucucugcuaccauggguggauguuugagaugcauggcaagaccagcaacuugaccaggauc

SEQ ID NO: 188321 - RNA, 64 nt, hsa
acccuggcagccccaccagcuggcuggucgucaucauggcaacaguggguuccuccuucugcaa

SEQ ID NO: 188322 - RNA, 61 nt, hsa
uacccaggucagauugacgggaccagaagggaacaucgacuucuaauccagcuuucuuguu

SEQ ID NO: 188323 - RNA, 61 nt, hsa
auaaauuuagaaacguaucacccauacguccaacaucgaaagaaaaccaguguuaugacuu

SEQ ID NO: 188324 - RNA, 61 nt, hsa
ugacgcccucgcugcuccuaccuggcuacuaaacaucgacuucgguucacuucacggaugu

SEQ ID NO: 188325 - RNA, 61 nt, hsa
caaacauuguucuucuccguguccuggguacaacaucgaauaauauuucuuggccuccuuu

SEQ ID NO: 188326 - RNA, 61 nt, hsa
guuuuauucaucugcaaagagccauguauucaacaucgagugugaaaagaucuauuggaaa

SEQ ID NO: 188327 - RNA, 61 nt, hsa
uuuuuuaauggaacaugaaaaccuccacagcaacaucgaaaccagggagaaagugauccuu

SEQ ID NO: 188328 - RNA, 61 nt, hsa
uaaucauaggaucccauuaaauaagugugcuaacaucgaauauagagaaaacugguaaaga

SEQ ID NO: 188329 - RNA, 61 nt, hsa
ccuacuaauaauuauuagaaauacauuuaaaaacaucgaguaccucaagucaguuugccuu

SEQ ID NO: 188330 - RNA, 61 nt, hsa
caaaguggaacuuuggauuguuuuuacagacaacaucgaguaauggcuuguaaaugugaau

SEQ ID NO: 188331 - RNA, 61 nt, hsa
uaacgaaugguacguuuaaaaucagaaacaaaacaucgaacaaaacccuauuuaagagacu

SEQ ID NO: 188332 - RNA, 61 nt, hsa
ugauuuguauauuucacugguuuaaaaaacaaacaucgaaaggcuuaugccaaauggaaga

SEQ ID NO: 188333 - RNA, 61 nt, hsa
guucuuguacucuacaaaauauagcuuucauaacaucgaaaaguuauuuuguagcguacau

SEQ ID NO: 188334 - RNA, 61 nt, hsa
auugcuguuuagcuugacuguuuuccucaagaacaucgaucugaaggauucauaaggagcu

SEQ ID NO: 188335 - RNA, 61 nt, hsa
gcucgguuugcuauauagggaauauauaaggaacaucgaaauuguauacaaagauuuguac

SEQ ID NO: 188336 - RNA, 61 nt, hsa
ggaguuucuggaagaggaaagccaugcguggaacaucgaagccucagagagugggagacug

SEQ ID NO: 188337 - RNA, 61 nt, hsa
aucuauacuccuauuggaguggaugcugaugaacaucgaacauaucuacuucauuagagca

SEQ ID NO: 188338 - RNA, 61 nt, hsa
cagaccuucaccugacuggaucaagcccacuaacaucgaggaggacagucugcauuacuca

SEQ ID NO: 188339 - RNA, 61 nt, hsa
aaaacucgacaccacauuucaggcuuuacccaacaucgaaauaauggagagaaaauuguug

SEQ ID NO: 188340 - RNA, 61 nt, hsa
uaacuagugauuccuucagaaggcaacggauaacaucgagagucucgcuaagaaaugaaaa

SEQ ID NO: 188341 - RNA, 61 nt, hsa
cuuucagauuuugaacaagcggccuuuucuaaacaucgacuucuacuacucucuagccuua

SEQ ID NO: 188342 - RNA, 61 nt, hsa
aaacuugugcuucaccgaagaaaaauaucuaaacaucgaaaaacuuaaauauuauggaaaa

SEQ ID NO: 188343 - RNA, 61 nt, hsa
guccaaucuuguucgaucacuagaugauucuaacaucgaaauaaaccucuuuuuauauggc

SEQ ID NO: 188344 - RNA, 61 nt, hsa
agcugucaaauaagacauucugugaaagguaaacaucgaaacugguuauaaguaaaaccau

SEQ ID NO: 188345 - RNA, 61 nt, hsa
cucgugucccccucgcaggccucauucuuugaacaucgacucugaaguuugauacagauag

SEQ ID NO: 188346 - RNA, 61 nt, hsa
ccuucccacccaucgcuguguguuaguucccaacaucgaauguguacaacuuaaguugguc

SEQ ID NO: 188347 - RNA, 61 nt, hsa
aggguauaaacacuauuuguuucuuuuuuaaaacaucgauaguuuugcuguaaauaauaac

SEQ ID NO: 188348 - RNA, 61 nt, hsa
gcuguuagugaccugcuguccaccccuccucaacaucgagcucuguuguaaauacgucgca

SEQ ID NO: 188349 - RNA, 61 nt, hsa
gguaguugagaacuuaaaaagugaacauugaaacaucgacguaacuggaaauuagguggga

SEQ ID NO: 188350 - RNA, 61 nt, hsa
cacccccuucccccaccacuucuauuuauuuaacaucgaggguugggggagggguuggucc

SEQ ID NO: 188351 - RNA, 61 nt, hsa
accaaaacagaacagaaagguguggugcuggaacaucgaugaaggagcccuacuuacugag

SEQ ID NO: 188352 - RNA, 61 nt, hsa
aaauuugugcuucaccgaagaaaaauaucuaaacaucgagaaacuaugggaaaaaaaauug

SEQ ID NO: 188353 - RNA, 61 nt, hsa
cauuaccaugcgguacgcagacaaacacaugaacaucgacuuugacaguuucaucugcugc

SEQ ID NO: 188354 - RNA, 61 nt, hsa
aggagauccaacccaggggacuggcaacuauaacaucgaagacuuugccgaccugggcaug

SEQ ID NO: 188355 - RNA, 61 nt, hsa
gggcacagagagaacaacauuccucucugucaacaucgagaggcuuuaaaacaacuguuua

SEQ ID NO: 188356 - RNA, 61 nt, hsa
uuggaucaacagcuuuuucuccgucucccacaacaucgaggagguuagccuggccacaggc

SEQ ID NO: 188357 - RNA, 61 nt, hsa
uuagguccccgaggugcccagcaucacguaaaacaucgauaugcuaagaagaacaaaaaga

SEQ ID NO: 188358 - RNA, 61 nt, hsa
cuuuccccuuucuaaauacccucagauuccuaacaucgagcccaugcuuuguuugauuugu

SEQ ID NO: 188359 - RNA, 61 nt, hsa
uuuaaaacgucuuagagccuuuuaucugcagaacaucgauauguauaucauucuacagaau

SEQ ID NO: 188360 - RNA, 61 nt, hsa
gauagaaacgcuuaagcaguugccuuuuuuaaacaucgauacgagaccucugaauuuguau

SEQ ID NO: 188361 - RNA, 61 nt, hsa
gaucuucccugagggccggcccgugguagccaacaucgagccacucuuugaccgguugcuc

SEQ ID NO: 188362 - RNA, 61 nt, hsa
gugugccacccucccuguaagucuauuuaaaaacaucgacgauacauugaaaugugugaac

SEQ ID NO: 188363 - RNA, 61 nt, hsa
uugggggccucagugcaggacaucuggccugaacaucgacuguggggacagcccucgcccu

SEQ ID NO: 188364 - RNA, 61 nt, hsa
agggacaaauggauagagaagaaaagggucaaacaucgagauuacauggauguuaaauuau

SEQ ID NO: 188365 - RNA, 59 nt, hsa
ucgggcccccgcugcccugacacccccugagcccccaucugcugaacccugacugguaa

SEQ ID NO: 188366 - RNA, 64 nt, hsa
aggcccggcccccucuggcuuggagagcauuccaagcccccaccccaccccuagaacugccauu

SEQ ID NO: 188367 - RNA, 64 nt, hsa
cgauugagaagccaaucagugaacccuuuggcaaagcccccauccacaccuggcacuccccucu

SEQ ID NO: 188368 - RNA, 64 nt, hsa
gggaccaauuuaguguccuuccaccugugagccaagcccccauuugaggacaucuaucguauuc

SEQ ID NO: 188369 - RNA, 64 nt, hsa
agagagggaaggagggaggaggcaucuucccugaagcccccaaucuggccccccccuccccaga

SEQ ID NO: 188370 - RNA, 64 nt, hsa
ugguuguccccgccaggccggggaagguuggagcagcccccagggaggggggcacuagguguca

SEQ ID NO: 188371 - RNA, 64 nt, hsa
cugcccucgggggccucucccaggguccagccugagcccccaccaggggucucugcccagcaca

SEQ ID NO: 188372 - RNA, 64 nt, hsa
cugcagaaccagcugcaacagcugcgugcacaggagcccccaggcagucagcagccccugcaga

SEQ ID NO: 188373 - RNA, 64 nt, hsa
uuccagcugggggaugggggggagucauaggaaaagcccccaucucccaucugggauagggacc

SEQ ID NO: 188374 - RNA, 64 nt, hsa
uacaacagcuccaggacaucucagcccagguucuagcccccacgcaccccagaccccaggugga

SEQ ID NO: 188375 - RNA, 64 nt, hsa
cccaccccaucugaggcagagaagacucgaguccagcccccaggaagccugcuccccucucugg

SEQ ID NO: 188376 - RNA, 64 nt, hsa
cuucuggcugcccccaaugccccgaggccuggggagcccccagcucacccaucuguagcucccu

SEQ ID NO: 188377 - RNA, 64 nt, hsa
cucucccagucucucccugcaguccugcagcagcagcccccacccccaagcuuggugcugagcc

SEQ ID NO: 188378 - RNA, 64 nt, hsa
ucuccuccagccccugcacacucccacccaggacagcccccagcccaacuaggaaagggccaug

SEQ ID NO: 188379 - RNA, 64 nt, hsa
cagccaagaauuucgggcuguuugacuuucugugagcccccagcgaggggaggcccagccuccg

SEQ ID NO: 188380 - RNA, 64 nt, hsa
uucagcagccccucagggcuucccaaggauguccagcccccacacccacacguuaacauaauga

SEQ ID NO: 188381 - RNA, 64 nt, hsa
gagguguagauaaucuagaggcauagacugcuagagcccccagggaucugggguggucagggcu

SEQ ID NO: 188382 - RNA, 64 nt, hsa
gggguggucaggaugggcuggggggcccacuagcagcccccagcaucucccacccacccagcua

SEQ ID NO: 188383 - RNA, 64 nt, hsa
aaaggaaacaaagcaauagguuugggggacgcccagcccccacccccgucaccccgcucuuccc

SEQ ID NO: 188384 - RNA, 64 nt, hsa
cuccgcggaggccccugagggacgagcagagcgcagcccccacgccgauauaagccauagcccc

SEQ ID NO: 188385 - RNA, 64 nt, hsa
ugggaucuagaucuuuccuccuugacaucaccugagcccccaccuagccauccaugggagagag

SEQ ID NO: 188386 - RNA, 64 nt, hsa
gggacuccugagaacacgguucucuccuagccucagcccccagcugggucucagaggagcuggg

SEQ ID NO: 188387 - RNA, 64 nt, hsa
cugugugcggugcccaggcccuaggagcucccccagcccccagguccuccugaccacuccccuc

SEQ ID NO: 188388 - RNA, 64 nt, hsa
ccccucugaugcugucugcagcucagucccugccagcccccaggagcgccuccagggccccgcc

SEQ ID NO: 188389 - RNA, 64 nt, hsa
cuggggcaucuggcuggugccugcugccauggccagcccccacucucacccugcacaggggguc

SEQ ID NO: 188390 - RNA, 64 nt, hsa
agcccccacucucacccugcacagggggucuugcagcccccaggcccacagccucguugggagg

SEQ ID NO: 188391 - RNA, 64 nt, hsa
ucggucacaucaggcccgcuagguccagagagcgagcccccaaugcccggccaggcuaagccgc

SEQ ID NO: 188392 - RNA, 64 nt, hsa
augcccggccaggcuaagccgcagagacccucucagcccccaccucagguuagggcucugcccg

SEQ ID NO: 188393 - RNA, 64 nt, hsa
aagccaccguguccagccaguuucuguuguuugaagcccccaacuucuagauugggaaacgaag

SEQ ID NO: 188394 - RNA, 52 nt, hsa
acaacucccccagccgcugaggagcccccagcagagcugggguugaagaggc

SEQ ID NO: 188395 - RNA, 62 nt, hsa
gacccagguugaggaagugagauccagcccccagcccccagcuggccccugacuccaugugg

SEQ ID NO: 188396 - RNA, 55 nt, hsa
gacccagguugaggaagugagauccagcccccagcccccagcuggccccugacuc

SEQ ID NO: 188397 - RNA, 64 nt, hsa
gcugcccaccaagcccugcccccagcccaagaggagcccccacugccugcggggcagugauguc

SEQ ID NO: 188398 - RNA, 64 nt, hsa
caguguguccaaccagcuguucucuccucaaagcagcccccaagcaagucccuucucuagggug

SEQ ID NO: 188399 - RNA, 64 nt, hsa
ccgagggaggacccugagggccgcgaagcauccgagcccccagcugggaaggggcaggccggug

SEQ ID NO: 188400 - RNA, 64 nt, hsa
aaucugcuucucggaucucccucagucugcccccagcccccaaacuccuccuggcuagacugua

SEQ ID NO: 188401 - RNA, 64 nt, hsa
uggucccuaccugggcagucucauuugcacccauagcccccaucuauggacaggcugggacaga

SEQ ID NO: 188402 - RNA, 64 nt, hsa
cucagacucccaaagcgguggaauuagaggcgugagcccccaugcuuggccuuaccuuucuacu

SEQ ID NO: 188403 - RNA, 64 nt, hsa
cccuccuccaggcccccggacgcucagcccccacagcccccacagccuggcgccagggcucaca

SEQ ID NO: 188404 - RNA, 64 nt, hsa
ugacggcugcccuccuccaggcccccggacgcucagcccccacagcccccacagccuggcgcca

SEQ ID NO: 188405 - RNA, 64 nt, hsa
ugagggcggcugcaggagaggaaggggcucccacagcccccacugaugccgcugcaggccccug

SEQ ID NO: 188406 - RNA, 64 nt, hsa
uaaggaugaaagcaaaggagggccuugaggaagcagcccccaggccuggcagccacgcagcggc

SEQ ID NO: 188407 - RNA, 64 nt, hsa
cgaguguugagcccaaggggggauuuguagaacaagcccccaugagaaacagcuguuacucuac

SEQ ID NO: 188408 - RNA, 64 nt, hsa
cagcucagcuuccccaacacgcaggagcacacccagcccccacauccugugccuccaucagcua

SEQ ID NO: 188409 - RNA, 64 nt, hsa
aggauugcagggguccagccuugccuguuuccgaagcccccacacugccuuucgcccuacugag

SEQ ID NO: 188410 - RNA, 64 nt, hsa
ccacccacaggccauguccagccccacuucccucagcccccagggcuuccuucuggccccucug

SEQ ID NO: 188411 - RNA, 64 nt, hsa
cuuacccucccaguuggccagaaucugaggggagagcccccagagagcccccuuccccaucaga

SEQ ID NO: 188412 - RNA, 64 nt, hsa
augagguccaugcagcucuuugacaaugucaucuagcccccaggagagggggucaguguuuccu

SEQ ID NO: 188413 - RNA, 64 nt, hsa
guggacggugccagcugaggcugaggcaugcagcagcccccagcuaccuuugcuuagggcuggg

SEQ ID NO: 188414 - RNA, 64 nt, hsa
cuucuuaaaaaucagcuuuaaggagcuggcagaaagcccccagccccacagcccugagagaugg

SEQ ID NO: 188415 - RNA, 64 nt, hsa
ggcccaggcagggcuggggugugcuggcaucgacagcccccacucugggcacuaggugggcccu

SEQ ID NO: 188416 - RNA, 64 nt, hsa
cccgccugccccgcggaagaccgcccagugagccagcccccaccuuccaggcgccuucgcccug

SEQ ID NO: 188417 - RNA, 64 nt, hsa
gcgccaggcccccacagucuguggccguggucuuagcccccaguuccacucuggaugggccugu

SEQ ID NO: 188418 - RNA, 64 nt, hsa
caggugagcuguguccucuaggcugccagcucacagcccccaccccagggcccuguaagcugug

SEQ ID NO: 188419 - RNA, 64 nt, hsa
auggggagcccaccgccuacacaguaggggcaguagcccccagcuccacgccuguugccaugug

SEQ ID NO: 188420 - RNA, 64 nt, hsa
uuccuccugagucuggguaauuauaccucucccaagcccccauuguguguugaaauccugucau

SEQ ID NO: 188421 - RNA, 64 nt, hsa
ugccauuacugcaucauaauacaaggaaccucagagcccccauuuguucauuaaagaggcaacu

SEQ ID NO: 188422 - RNA, 64 nt, hsa
ccuggaacucuuccagccuuucuacuugaucuccagcccccaggucuuugccagaugaugggaa

SEQ ID NO: 188423 - RNA, 64 nt, hsa
uucaucacugcugucugcuagagcccuuccucucagcccccauguugggagaggggaguggauu

SEQ ID NO: 188424 - RNA, 64 nt, hsa
ccuggaagauguggggugcugggugagaggcaucagcccccacaaguauguuuuugugucuuaa

SEQ ID NO: 188425 - RNA, 64 nt, hsa
uuuuccuccuacuggucuccaccaaggcuuuguuagcccccacccugccuggugugcagcuaac

SEQ ID NO: 188426 - RNA, 64 nt, hsa
uauauauauauauauauguauaugucuguaccccagcccccaccuuucagauucugcucuuggc

SEQ ID NO: 188427 - RNA, 64 nt, hsa
cuuguggugcuagauguguguuuagagcuaaaccagcccccacccccacccuccaccugccccu

SEQ ID NO: 188428 - RNA, 64 nt, hsa
ccgcuuccuuucucagcugaaccccuacucccggagcccccagcagggcccuccgagguggagc

SEQ ID NO: 188429 - RNA, 64 nt, hsa
ggccgcuuccuuucucagcugaaccccuacccggagcccccagcagggcccuccgagguggaac

SEQ ID NO: 188430 - RNA, 64 nt, hsa
guccacagcagucugagcuggcaggucauggagcagcccccaaagagcuguggcuggggggaug

SEQ ID NO: 188431 - RNA, 64 nt, hsa
cgugcugcuuacacuccagguguggaccggccgcagcccccacugaccugcccauguccagagg

SEQ ID NO: 188432 - RNA, 64 nt, hsa
ccuccacaagccuaguccauccugccugagcuccagcccccagcccccacugugcccagacaug

SEQ ID NO: 188433 - RNA, 64 nt, hsa
aagccuaguccauccugccugagcuccagcccccagcccccacugugcccagacaugugugcuc

SEQ ID NO: 188434 - RNA, 64 nt, hsa
ggccuuaagcuuuccaggggccggggcaguggggagcccccaucccuucacaccgccaccaacu

SEQ ID NO: 188435 - RNA, 64 nt, hsa
cccacaggccaacccuggcacaggucaugucugcagcccccagaauguucuggacaugcaccac

SEQ ID NO: 188436 - RNA, 64 nt, hsa
ucgcucacuucgcucgcuccgcgucccccaugccagcccccaacgcagggcgcccggcgaagcc

SEQ ID NO: 188437 - RNA, 64 nt, hsa
ccggaggaaauccugaagcugacccucaccuccgagcccccacucccaccccagccgcacaguu

SEQ ID NO: 188438 - RNA, 64 nt, hsa
cuugggaagcagcuccugcugggagcauggccucagcccccagcaucuccuggggcccccaugg

SEQ ID NO: 188439 - RNA, 64 nt, hsa
ugcaaggugcuagaccaaugggcugcaguauuauagcccccaggccuggcaggcaugcgcuggg

SEQ ID NO: 188440 - RNA, 64 nt, hsa
uggcacugucuuccuggccggggccugaaaccuuagcccccagccggccugagugggggauauu

SEQ ID NO: 188441 - RNA, 64 nt, hsa
cgugaagugccaacgcccuccccacccugggccgagcccccaccccucccugggcccccaagug

SEQ ID NO: 188442 - RNA, 64 nt, hsa
gugagagcucagaguuucugggguccucauuaggagcccccaucccuguguuccccaagaauuc

SEQ ID NO: 188443 - RNA, 64 nt, hsa
uacggggggaccgggugagccagugacccccuguagcccccagcuucaggccucagugucugcc

SEQ ID NO: 188444 - RNA, 64 nt, hsa
aagcugagcacagaccagcagcgaccucccuuccagcccccagaaagcucggucacuugagugu

SEQ ID NO: 188445 - RNA, 64 nt, hsa
gcccuccuccacucccuuuuuguaacucccuuacagcccccagacccuucuugaaacgagagcc

SEQ ID NO: 188446 - RNA, 64 nt, hsa
cuggccauggguccuugcccccgacagacagagcagcccccacccgggagccuugauggggguc

SEQ ID NO: 188447 - RNA, 64 nt, hsa
agucccucccaccacccucgccgcaggcagcugcagcccccagaggggaccacaagcccaaaaa

SEQ ID NO: 188448 - RNA, 64 nt, hsa
agggccagcacagaggggccuuccucccccacagagcccccaugacauagucugcucugggcgg

SEQ ID NO: 188449 - RNA, 64 nt, hsa
cuuucccuccuugucuggccccaguggucuggggagcccccaggcacaccuaagcgucguggag

SEQ ID NO: 188450 - RNA, 64 nt, hsa
cuccgagccugcuaccugguugccaaccuucccuagcccccaaaccgaagccaucugccaaauu

SEQ ID NO: 188451 - RNA, 64 nt, hsa
uuggaaggaggaagggcugaccuggguucucuccagcccccaggugcgccgggucacccgugcc

SEQ ID NO: 188452 - RNA, 64 nt, hsa
cggcuggcccgggccaugggcugcgcaaaucaccagcccccaacccagggaggaacuggccccu

SEQ ID NO: 188453 - RNA, 64 nt, hsa
aggccagggggguggggggccgcccucaucaggcagcccccagcccccugaggcccuguccauc

SEQ ID NO: 188454 - RNA, 64 nt, hsa
gggaucuggggcuuccuggccuggccagagcuggagcccccacaggguaaggaagagagagugg

SEQ ID NO: 188455 - RNA, 64 nt, hsa
ccugucccaguuuaucaggaacgcaggccuggggagcccccaguggcggggacagggccagauu

SEQ ID NO: 188456 - RNA, 64 nt, hsa
accuguuccagaggugcagacaagagguggcgagagcccccaucaugccccucaaccuaucccg

SEQ ID NO: 188457 - RNA, 64 nt, hsa
agcggcuggagggaugccacaccccucacagggcagcccccaacuacaucuucccugcuuacuc

SEQ ID NO: 188458 - RNA, 64 nt, hsa
ccacacugaggccaggucuaccccccaucauaccagcccccaggaccacuaccccacggccagc

SEQ ID NO: 188459 - RNA, 59 nt, hsa
aggcugcugucacuagccccuccugagugugucacuaacagcccacugugcuugcaaag

SEQ ID NO: 188460 - RNA, 59 nt, hsa
gucugugcacucucucuguggaaggcugcugucacuagccccuccugagugugucacua

SEQ ID NO: 188461 - RNA, 59 nt, hsa
uccagagaacuuguucuucagcaagaaugugucacuaguaaggacaucucuagcauuuc

SEQ ID NO: 188462 - RNA, 59 nt, hsa
auacuugugauauagucauggggcuucagugucacuauuuucuccuuaaagcuccagcc

SEQ ID NO: 188463 - RNA, 59 nt, hsa
agaaacagccugggcuggggcuacaggucugucacuaugcucucuugccuucagacaga

SEQ ID NO: 188464 - RNA, 59 nt, hsa
gugaauguuguauacgauuguaaggcuuaugucacuaaagauuuuuauucugauuuuuu

SEQ ID NO: 188465 - RNA, 59 nt, hsa
cuuaggagaaaaugauucuguaauuccagugucacuaauuuauauuguucuuuccucug

SEQ ID NO: 188466 - RNA, 59 nt, hsa
cccgucacuacagccucaccucccaccccugucacuacggccucaccucccaccccugu

SEQ ID NO: 188467 - RNA, 59 nt, hsa
ccugucacuacggccucaccucccaccccugucacuacagccucaccuccuacagccuu

SEQ ID NO: 188468 - RNA, 59 nt, hsa
caaauugugcugcacaugaggaaauaggcugucacuaucacauuguccugaaaacagca

SEQ ID NO: 188469 - RNA, 59 nt, hsa
ucuuuuccuagagcuggucaccacuaggcugucacuauaaauuccuugaauauaaguaa

SEQ ID NO: 188470 - RNA, 59 nt, hsa
uacucucaaagccauguguggagggggcuugucacuauuguaggcucacuggauugguc

SEQ ID NO: 188471 - RNA, 59 nt, hsa
cugugcaccagugugacaggaaagauucaugucacuacuguccguggcuacaauucaaa

SEQ ID NO: 188472 - RNA, 64 nt, hsa; identical to SEQ ID NO: 183969

SEQ ID NO: 188473 - RNA, 64 nt, hsa; identical to SEQ ID NO: 183970

SEQ ID NO: 188474 - RNA, 64 nt, hsa; identical to SEQ ID NO: 183971

SEQ ID NO: 188475 - RNA, 64 nt, hsa; identical to SEQ ID NO: 183972

SEQ ID NO: 188476 - RNA, 64 nt, hsa; identical to SEQ ID NO: 183973

SEQ ID NO: 188477 - RNA, 64 nt, hsa; identical to SEQ ID NO: 183974

SEQ ID NO: 188478 - RNA, 64 nt, hsa; identical to SEQ ID NO: 183975

SEQ ID NO: 188479 - RNA, 64 nt, hsa; identical to SEQ ID NO: 183976

SEQ ID NO: 188480 - RNA, 64 nt, hsa; identical to SEQ ID NO: 183977

SEQ ID NO: 188481 - RNA, 64 nt, hsa; identical to SEQ ID NO: 183978

SEQ ID NO: 188482 - RNA, 64 nt, hsa; identical to SEQ ID NO: 183979

SEQ ID NO: 188483 - RNA, 64 nt, hsa; identical to SEQ ID NO: 183980

SEQ ID NO: 188484 - RNA, 64 nt, hsa; identical to SEQ ID NO: 183981

SEQ ID NO: 188485 - RNA, 64 nt, hsa; identical to SEQ ID NO: 183982

SEQ ID NO: 188486 - RNA, 64 nt, hsa
ugugggcugaccaggaccucugacccuggagcuucuaccaaagacacagcugggucuggacccc

SEQ ID NO: 188487 - RNA, 64 nt, hsa
ugggucauugcggucuuagauuauguuucucuugcuaccaaacagucauguauuaacucucuuu

SEQ ID NO: 188488 - RNA, 64 nt, hsa
cugcucaguagucaucucuguaaaucugcaauuucuaccaaaaugugugaucguagaucucaaa

SEQ ID NO: 188489 - RNA, 64 nt, hsa
uuuccccuugcagcuacacuuacuuucucccugacuaccaaauggagugacgguugaagaauca

SEQ ID NO: 188490 - RNA, 64 nt, hsa
acaccagccugagcaacaugguaaaaccccaucucuaccaaaaauacaaaaauuagcugggcuu

SEQ ID NO: 188491 - RNA, 64 nt, hsa
agaccagccuggcuaacauggugaaauccuaucucuaccaaaaauacaaaaauuagccaggcgu

SEQ ID NO: 188492 - RNA, 64 nt, hsa
uguucuguuuuuaaaccaacaaacauguuacuauucauuggacagauaucauuuuauguauaaa

SEQ ID NO: 188493 - RNA, 64 nt, hsa
agggguagcccucaaaaauagauuuaucauuuacucauuggaauuuucuucaaguguuaaaggu

SEQ ID NO: 188494 - RNA, 64 nt, hsa
ggcucuguauaaaaaacuucuggaccaaaagccaucauuggaagauuuaaaagaacucaguccu

SEQ ID NO: 188495 - RNA, 64 nt, hsa
agacauuucuacccugaagaacuaaugacagcaaucauuggaaauacugauuaugacuggaaac

SEQ ID NO: 188496 - RNA, 64 nt, hsa
aaaugacaaaaagccuuuuccagaagaucugaaaucauuggaccuguucaaaaaggaaaaaauu

SEQ ID NO: 188497 - RNA, 64 nt, hsa
uuuaucagaaauuauacuauauuuuauagaaccaucauuggaaaugaaacugguaauaaaacug

SEQ ID NO: 188498 - RNA, 64 nt, hsa
uggaaagagaugugaucauggauuaaacaccagcucauuggaaacucauuggaugagaucagaa

SEQ ID NO: 188499 - RNA, 64 nt, hsa
gugaucauggauuaaacaccagcucauuggaaacucauuggaugagaucagaaaacguucauga

SEQ ID NO: 188500 - RNA, 64 nt, hsa
cacagguccuuauugccauuauuuuuaaguaucuucauuggagaugaacacugacuuuugcaua

SEQ ID NO: 188501 - RNA, 64 nt, hsa
aucugcugagaugacuuucuuccauauaugugguucauuggaaguucuuuguaauuuuaauucc

SEQ ID NO: 188502 - RNA, 64 nt, hsa
aauuguauauuugucuuacguauggcaaaagcauucauuggagagccuuacuuggguuugcacc

SEQ ID NO: 188503 - RNA, 64 nt, hsa
cagugucaguugugcugcagacaguaugaacaucucauuggaccucagaaaacccacccugggg

SEQ ID NO: 188504 - RNA, 64 nt, hsa
auuuuaaaaugcaaaauacauugauauuuauuaaucauuggauuuagggaaagggacagauuuu

SEQ ID NO: 188505 - RNA, 64 nt, hsa
uuaaauaccuuucagguaguuacaucauguuucuucauuggauuuguaaaacuugaagccauaa

SEQ ID NO: 188506 - RNA, 64 nt, hsa
gucuguguauucaugacuuugggaguggguaggaucauuggagagagaauugcacagaaagucc

SEQ ID NO: 188507 - RNA, 64 nt, hsa
aaauagccuuuaaggguuucuuugcagacugauuucauuggauggauacuuaaugcugugaaac

SEQ ID NO: 188508 - RNA, 64 nt, hsa
guucucucagcuccuugcacagacacaaaaggacucauuggaaagauacucuauaaaugugugg

SEQ ID NO: 188509 - RNA, 64 nt, hsa
aaaugcaagauaugugggaaagccuuuguuuauuucauuggauuucaaagacaugaaaggacuc

SEQ ID NO: 188510 - RNA, 64 nt, hsa
agcuccuuggauguggagacagaugucuuuacuagagcugaaaggcccccuugacacauccagg

SEQ ID NO: 188511 - RNA, 64 nt, hsa
ccccacuuucuggaugacagacuugaggcucugagagcugaaaacacuuguccaaggucucacg

SEQ ID NO: 188512 - RNA, 64 nt, hsa
aaagacgggacauaaggggaaaauucauuccauagagcugaaaucugguuuucaaggccucugu

SEQ ID NO: 188513 - RNA, 64 nt, hsa
ggccgcauuuugcugcuaaagcaagagaaacuuggagcugaagcacacaccuggucugccccua

SEQ ID NO: 188514 - RNA, 64 nt, hsa
aggugguggccguggguuccugaugucggugcaggagcugaaggugaguggagugcugccaaga

SEQ ID NO: 188515 - RNA, 64 nt, hsa
gcucacccccaggauguguacccgguuguaguaggagcugaaauccaugcugagcuguaccagg

SEQ ID NO: 188516 - RNA, 64 nt, hsa
agguuuugguuccaaacucaaccagcaauguugagagcugaacuuaagauagcuguuguacuuu

SEQ ID NO: 188517 - RNA, 64 nt, hsa
caaagaaucuagugugcucagggcuugguacaaugagcugaauuagauggccuuaugaaacucu

SEQ ID NO: 188518 - RNA, 64 nt, hsa
uguuugccacuucauuucauuuccuugaguaaaugagcugaaguguaaagcaaagaauagcaga

SEQ ID NO: 188519 - RNA, 64 nt, hsa
cuagccacauucccaaggucccaaggagaaggaagagcugaaauucaucuccuagugacagugc

SEQ ID NO: 188520 - RNA, 64 nt, hsa
gaucugagucccaggagcugcccagaguugcugggagcugaaaaaucacauccuggccuggcac

SEQ ID NO: 188521 - RNA, 64 nt, hsa
uaucauucauucuuagcucuuaauuguucauuuugagcugaaaugcugcauuuuaauuuuaacc

SEQ ID NO: 188522 - RNA, 64 nt, hsa
aagucucagcacauuccaaggagugguagaaacagagcugaagguguccccauuguagauuagu

SEQ ID NO: 188523 - RNA, 64 nt, hsa
cuucuuuagcucaucuguggugucagaauccuuggagcugaagagagaaaucaaaagagcauga

SEQ ID NO: 188524 - RNA, 64 nt, hsa
auggggagccagcagaguuccugcccauggucuugagcugaaugagagaauaaaaugccaaucc

SEQ ID NO: 188525 - RNA, 64 nt, hsa
ugugcggguugucauuuuccuggacauccaugaagagcugaaggaaauuguuuacugccaauug

SEQ ID NO: 188526 - RNA, 64 nt, hsa
cucacucugacaugacaguauuuuuucugaccaggagcugaaagacccugacauucaugaucca

SEQ ID NO: 188527 - RNA, 64 nt, hsa
uacuaaggaaaauaacugaaaagauuaaaagugagagcugaaaagagaaaugauaaugcuucca

SEQ ID NO: 188528 - RNA, 64 nt, hsa
cgagcagcgggccgagccacgcagcggcuucgaggagcugaacaacgagaacaagagcacacug

SEQ ID NO: 188529 - RNA, 64 nt, hsa
caagagcacacugcaguuggagcagcaaguaaaggagcugaagaagucgggugagcugaaagag

SEQ ID NO: 188530 - RNA, 64 nt, hsa
gagcagcaaguaaaggagcugaagaagucggguggagcugaagagccaagaggcuccgagucug

SEQ ID NO: 188531 - RNA, 64 nt, hsa
ccgcccaugcuggauaggaccugggaugcugcuggagcugaaucggaugccaccaaggcucggu

SEQ ID NO: 188532 - RNA, 64 nt, hsa
auguagguaccagcucaaccccacgcaaguuccugagcugaacauggagcaaggggagggugac

SEQ ID NO: 188533 - RNA, 64 nt, hsa
acugguuagacagugggugcagcccacggagggugagcugaagcaggguggggcguaaccucac

SEQ ID NO: 188534 - RNA, 64 nt, hsa
aaccaguuuagagaagaacauaaaugaccugauggagcugaaaaacacagcaugagaacuucgu

SEQ ID NO: 188535 - RNA, 64 nt, hsa; identical to SEQ ID NO: 21812

SEQ ID NO: 188536 - RNA, 64 nt, hsa; identical to SEQ ID NO: 21813

SEQ ID NO: 188537 - RNA, 64 nt, hsa; identical to SEQ ID NO: 21814

SEQ ID NO: 188538 - RNA, 64 nt, hsa; identical to SEQ ID NO: 21815

SEQ ID NO: 188539 - RNA, 64 nt, hsa; identical to SEQ ID NO: 21816

SEQ ID NO: 188540 - RNA, 64 nt, hsa; identical to SEQ ID NO: 21817

SEQ ID NO: 188541 - RNA, 64 nt, hsa; identical to SEQ ID NO: 21818

SEQ ID NO: 188542 - RNA, 64 nt, hsa; identical to SEQ ID NO: 21819

SEQ ID NO: 188543 - RNA, 64 nt, hsa; identical to SEQ ID NO: 21820

SEQ ID NO: 188544 - RNA, 64 nt, hsa; identical to SEQ ID NO: 21821

SEQ ID NO: 188545 - RNA, 64 nt, hsa; identical to SEQ ID NO: 21822

SEQ ID NO: 188546 - RNA, 64 nt, hsa; identical to SEQ ID NO: 21823

SEQ ID NO: 188547 - RNA, 64 nt, hsa; identical to SEQ ID NO: 21824

SEQ ID NO: 188548 - RNA, 64 nt, hsa; identical to SEQ ID NO: 21825

SEQ ID NO: 188549 - RNA, 64 nt, hsa; identical to SEQ ID NO: 21826

SEQ ID NO: 188550 - RNA, 64 nt, hsa; identical to SEQ ID NO: 21827

SEQ ID NO: 188551 - RNA, 64 nt, hsa; identical to SEQ ID NO: 21828

SEQ ID NO: 188552 - RNA, 64 nt, hsa; identical to SEQ ID NO: 21829

SEQ ID NO: 188553 - RNA, 64 nt, hsa; identical to SEQ ID NO: 21830

SEQ ID NO: 188554 - RNA, 64 nt, hsa; identical to SEQ ID NO: 21831

SEQ ID NO: 188555 - RNA, 50 nt, hsa; identical to SEQ ID NO: 21832

SEQ ID NO: 188556 - RNA, 64 nt, hsa; identical to SEQ ID NO: 21833

SEQ ID NO: 188557 - RNA, 64 nt, hsa; identical to SEQ ID NO: 21834

SEQ ID NO: 188558 - RNA, 64 nt, hsa; identical to SEQ ID NO: 21835

SEQ ID NO: 188559 - RNA, 64 nt, hsa; identical to SEQ ID NO: 21836

SEQ ID NO: 188560 - RNA, 64 nt, hsa; identical to SEQ ID NO: 21837

SEQ ID NO: 188561 - RNA, 64 nt, hsa; identical to SEQ ID NO: 21838

SEQ ID NO: 188562 - RNA, 64 nt, hsa; identical to SEQ ID NO: 21839

SEQ ID NO: 188563 - RNA, 64 nt, hsa; identical to SEQ ID NO: 21840

SEQ ID NO: 188564 - RNA, 64 nt, hsa; identical to SEQ ID NO: 21841

SEQ ID NO: 188565 - RNA, 64 nt, hsa; identical to SEQ ID NO: 21842

SEQ ID NO: 188566 - RNA, 64 nt, hsa; identical to SEQ ID NO: 21843

SEQ ID NO: 188567 - RNA, 64 nt, hsa; identical to SEQ ID NO: 21844

SEQ ID NO: 188568 - RNA, 64 nt, hsa; identical to SEQ ID NO: 21845

SEQ ID NO: 188569 - RNA, 64 nt, hsa; identical to SEQ ID NO: 21846

SEQ ID NO: 188570 - RNA, 64 nt, hsa; identical to SEQ ID NO: 21847

SEQ ID NO: 188571 - RNA, 64 nt, hsa; identical to SEQ ID NO: 21848

SEQ ID NO: 188572 - RNA, 64 nt, hsa; identical to SEQ ID NO: 21849

SEQ ID NO: 188573 - RNA, 64 nt, hsa; identical to SEQ ID NO: 21850

SEQ ID NO: 188574 - RNA, 64 nt, hsa; identical to SEQ ID NO: 21851

SEQ ID NO: 188575 - RNA, 64 nt, hsa; identical to SEQ ID NO: 21852

SEQ ID NO: 188576 - RNA, 64 nt, hsa; identical to SEQ ID NO: 21853

SEQ ID NO: 188577 - RNA, 64 nt, hsa; identical to SEQ ID NO: 21854

SEQ ID NO: 188578 - RNA, 64 nt, hsa; identical to SEQ ID NO: 21855

SEQ ID NO: 188579 - RNA, 64 nt, hsa; identical to SEQ ID NO: 21856

SEQ ID NO: 188580 - RNA, 64 nt, hsa; identical to SEQ ID NO: 21857

SEQ ID NO: 188581 - RNA, 64 nt, hsa; identical to SEQ ID NO: 21858

SEQ ID NO: 188582 - RNA, 64 nt, hsa; identical to SEQ ID NO: 21859

SEQ ID NO: 188583 - RNA, 64 nt, hsa; identical to SEQ ID NO: 21860

SEQ ID NO: 188584 - RNA, 64 nt, hsa; identical to SEQ ID NO: 21861

SEQ ID NO: 188585 - RNA, 64 nt, hsa; identical to SEQ ID NO: 21862

SEQ ID NO: 188586 - RNA, 64 nt, hsa; identical to SEQ ID NO: 21863

SEQ ID NO: 188587 - RNA, 64 nt, hsa; identical to SEQ ID NO: 21864

SEQ ID NO: 188588 - RNA, 64 nt, hsa; identical to SEQ ID NO: 21865

SEQ ID NO: 188589 - RNA, 64 nt, hsa; identical to SEQ ID NO: 21866

SEQ ID NO: 188590 - RNA, 64 nt, hsa; identical to SEQ ID NO: 21867

SEQ ID NO: 188591 - RNA, 64 nt, hsa; identical to SEQ ID NO: 21868

SEQ ID NO: 188592 - RNA, 64 nt, hsa; identical to SEQ ID NO: 21869

SEQ ID NO: 188593 - RNA, 64 nt, hsa; identical to SEQ ID NO: 21870

SEQ ID NO: 188594 - RNA, 64 nt, hsa; identical to SEQ ID NO: 21871

SEQ ID NO: 188595 - RNA, 64 nt, hsa; identical to SEQ ID NO: 21872

SEQ ID NO: 188596 - RNA, 64 nt, hsa; identical to SEQ ID NO: 21873

SEQ ID NO: 188597 - RNA, 64 nt, hsa; identical to SEQ ID NO: 21874

SEQ ID NO: 188598 - RNA, 63 nt, hsa
gcaucggaauauauuuggagcacacccuaguaaccucuugagauuaaauuacauagucuuaau

SEQ ID NO: 188599 - RNA, 63 nt, hsa
gccccagcuucacugcuuggaagcaugucccucccucuugaguuggcucugauuugaaaucgg

SEQ ID NO: 188600 - RNA, 63 nt, hsa
gugaaaaccucuuucggaaaugauugagagcagccucuugaaugcuuaaaugaucaaggaggg

SEQ ID NO: 188601 - RNA, 63 nt, hsa
guguacucugaguccucauuguucagaaaagcaccucuugaagaacugacuuccugaacuccc

SEQ ID NO: 188602 - RNA, 63 nt, hsa
ugugauccagaaagauuuuugugcccccagaugccucuugauaggagaggcaacauacuccaa

SEQ ID NO: 188603 - RNA, 63 nt, hsa
aaugaaaaggcauugccaucuccauuccucugcccucuugagccagcacaggaaggugaggcc

SEQ ID NO: 188604 - RNA, 63 nt, hsa
agaagcaguggccuuauugcaucccaaaccacgccucuugaccaggcugccucccuuguggca

SEQ ID NO: 188605 - RNA, 63 nt, hsa
gaaggacggggggcgguaggggucuugaugaaaccucuugaacgaagcacaguuugucccauc

SEQ ID NO: 188606 - RNA, 64 nt, hsa
ucuaugucuggaccuguguuaggcacuucagauaccacacgaguaagacaagggcccugcaggg

SEQ ID NO: 188607 - RNA, 64 nt, hsa
uuuuauggcucuucugggaaacuccuccccuuuuccacacgaaccuuguggggcugugaauucu

SEQ ID NO: 188608 - RNA, 64 nt, hsa
aagcugaucaagaaaguuaacaacaacauagaaaccacacgauuguuccacugucuggaagcac

SEQ ID NO: 188609 - RNA, 64 nt, hsa
uguuccuggaagacccagaguuaaaugcagauguccacacgaggggucggaguuaccugaucac

SEQ ID NO: 188610 - RNA, 64 nt, hsa
caggggacgcccaugccaggcccggggaccugugccacacgaccagcugugcucccagcagagg

SEQ ID NO: 188611 - RNA, 64 nt, hsa
ggggcagaaggcagagccugugucccagggggacccacacgaagucaccagcccauagguccag

SEQ ID NO: 188612 - RNA, 64 nt, hsa
ccccucgcucuggugauuauuucuugcagaaucaccacacgagaccaucccggcagucaugguu

SEQ ID NO: 188613 - RNA, 64 nt, hsa
ggcgugugggagacccuguggccggcacccaccuccacacgaggacuaagcucugauuuuuuua

SEQ ID NO: 188614 - RNA, 64 nt, hsa
ccaaacagccuguccugcaagugacaucacucacccacacgaaggagggggacugcaccuuaga

SEQ ID NO: 188615 - RNA, 64 nt, hsa
ggcacuagggcagguuccgugccagagucgggggccacacgagggccuggugccggugaggggg

SEQ ID NO: 188616 - RNA, 64 nt, hsa
gacaugcauucuguuucuuccagaguucugucugccacacgaaagagaauauuugcuuacuuga

SEQ ID NO: 188617 - RNA, 64 nt, hsa
gcgugcaccacccuaagcggcuaggcugacagggccacacgacauagcugaaauuuguucugua

SEQ ID NO: 188618 - RNA, 64 nt, hsa
caggggguagccccuggauucaggcacacgaccaccacacgagcacgugccacgcaugccucgu

SEQ ID NO: 188619 - RNA, 64 nt, hsa
ccauguaaagcuggcuuucuggagucugccagguccacacgaagugcuacccccaguuucugcu

SEQ ID NO: 188620 - RNA, 64 nt, hsa
aaaaguuuuaaggacuugggccaacuaagucuacccacacgaaaaaagaaauuugccuuguccc

SEQ ID NO: 188621 - RNA, 64 nt, hsa
cuaaaucacuuuucucgcagaagccaugcgacucccacacgacacgggcagcuucacaagccau

SEQ ID NO: 188622 - RNA, 64 nt, hsa
agagguggaaguuacagaagaggagguaccugggccacacgacaugagcuggaaaaucucucuu

SEQ ID NO: 188623 - RNA, 64 nt, hsa
cguuggcuagauuaaccuucucuguccgagugugccacacgagaaccugaaggggaaggaaaua

SEQ ID NO: 188624 - RNA, 64 nt, hsa
ugccagcugggcacgucaggaccuccccacacacccacacgaugccacaggucagggggcugug

SEQ ID NO: 188625 - RNA, 64 nt, hsa
cccgucagggcaccuuuuccucagagcaauccggccacacgaauagaaggcugucgugaaucac

SEQ ID NO: 188626 - RNA, 64 nt, hsa
ggacuugaguguugcauuuguuuugugggcauuuccacacgaagccuacucacacccucacugg

SEQ ID NO: 188627 - RNA, 64 nt, hsa
ggaaggacaaguaagagugaggccacaguucccaccacacgagggcuuuuguauuguucuacuu

SEQ ID NO: 188628 - RNA, 64 nt, hsa
uaguaggagccguuaggggaggaguuuggggucuccacacgaugccuagagaaugcugcagucu

SEQ ID NO: 188629 - RNA, 64 nt, hsa
cccccggcaccugacucugcccuuuauguauuauccacacgauguuuucacagagugaaaggac

SEQ ID NO: 188630 - RNA, 64 nt, hsa
caggaucucucaauguucaguguuuuguguuuccccacacgauuugucagagagaaaugaaagc

SEQ ID NO: 188631 - RNA, 64 nt, hsa
uguccagggcacuuugcagcuccauccucaaguuccacacgaagaugcuuggaugagucagcug

SEQ ID NO: 188632 - RNA, 64 nt, hsa
aauguguuuguuucccaugggauuauucucuaucccacacgaauguaaaaaaauccacauuaau

SEQ ID NO: 188633 - RNA, 64 nt, hsa
cuguuuuguuaaaucugguggguaccuggaucuuccacacgagugggauucuggccuucagaga

SEQ ID NO: 188634 - RNA, 64 nt, hsa
aaggaagagcaagaacauggccacacccaccgccccacacgagaaauuugugcgcugaacuuca

SEQ ID NO: 188635 - RNA, 64 nt, hsa
cacacaucucacaucauggggaggccagagggggccacacgagagcuccaggcucugggcuggu

SEQ ID NO: 188636 - RNA, 64 nt, hsa
gcccgcugccaaucuaagccagucucacugugaaccacacgaaaccucaacugggggagugagg

SEQ ID NO: 188637 - RNA, 64 nt, hsa
caugccgcagaggaugcgccuagcugggcuggggccacacgacuauuauguuggccuugaacgg

SEQ ID NO: 188638 - RNA, 64 nt, hsa
accgaggaaucguaugugggaacguccccgagaaccacacgagcgugcugcucagugcugacug

SEQ ID NO: 188639 - RNA, 64 nt, hsa
ggcucgaggggcucagggccucaggcacccguccccacacgagggccccgugggugggccuggc

SEQ ID NO: 188640 - RNA, 64 nt, hsa
aaacccaaagccacuaguauuagaagacuucuuuccacacgauuuccuaucucccuugaaaagu

SEQ ID NO: 188641 - RNA, 64 nt, hsa
acaaauaauauuacucuaugaugauugcuuccacccacacgacugcaacauacaggugccuugg

SEQ ID NO: 188642 - RNA, 64 nt, hsa
aaaccugcuggugcugaguccuguguggggcaccccacacgacaccccucuucccucaggaggc

SEQ ID NO: 188643 - RNA, 64 nt, hsa
cuccuggaccuuuccagccuguaucaggcuguggccacacgagaggacagcgcgagcucaggag

SEQ ID NO: 188644 - RNA, 64 nt, hsa
ccuugcgcugcagugggggcuccugagugcagccccacacgacugagccacccagacccucaca

SEQ ID NO: 188645 - RNA, 64 nt, hsa
agcccagcgacuuccaaguccucucacagaagaaccacacgauuggguaucacucacaguuugc

SEQ ID NO: 188646 - RNA, 64 nt, hsa
ggaggaggcagcagacacuggagaugacauucuuccacacgagacggggcuucagccgggcaug

SEQ ID NO: 188647 - RNA, 64 nt, hsa
guccccaccuguacaacaacggaaagguguguggccacacgaagaagccaaacgccguggccuc

SEQ ID NO: 188648 - RNA, 64 nt, hsa
ggaaggagugagguguguucccaccguacacuucccacacgagcugcggcugccagccucgggc

SEQ ID NO: 188649 - RNA, 64 nt, hsa
accccacacacacucaaggggucgaaaacaaaccccacacgagggcucucaccuccuucuccua

SEQ ID NO: 188650 - RNA, 64 nt, hsa
cuccgcgggugcuucgcggacaaggugcagccaaccacacgagcaauacugugcuggagaguga

SEQ ID NO: 188651 - RNA, 64 nt, hsa
acucccccacccugaccgugcugaacagacccccccacacgagagaaaauaaaggagcaauaaa

SEQ ID NO: 188652 - RNA, 64 nt, hsa
ccuggccaaucaaggcuugcccagcugggaggccccacacgaaagacucuuaccauuuuauuaa

SEQ ID NO: 188653 - RNA, 64 nt, hsa
uggccuccagggacgggagagauugugucaugugccacacgagaccaacguggaaaagucugaa

SEQ ID NO: 188654 - RNA, 64 nt, hsa
cugcaagucuccuacccugggaucccauccaguuccacacgaacuagggcaguggucacugugg

SEQ ID NO: 188655 - RNA, 64 nt, hsa
gccuuuauauuucacaggcuguaaauugaacuucccacacgauuagcuuuauuauggcuuguga

SEQ ID NO: 188656 - RNA, 64 nt, hsa
cacccagcaucggcuuugacugcagacuguucacccacacgagcccugugcuuuugguguaaau

SEQ ID NO: 188657 - RNA, 64 nt, hsa
uucacagaguggaucuuucucugcaguacuguauccacacgagccaacugcuguauuuaacauc

SEQ ID NO: 188658 - RNA, 64 nt, hsa
cucccgauguucccacccgcaugaucccuucccgccacacgaugcuccguuuucuuccguugug

SEQ ID NO: 188659 - RNA, 54 nt, hsa
aaggaacugaaagagauugagccaccacacgagcaauucacaaaggucuguucu

SEQ ID NO: 188660 - RNA, 64 nt, hsa
uccuuggcccacagcagauaggucccgagcagcaggacuggaggccuguggcggucagggcagg

SEQ ID NO: 188661 - RNA, 64 nt, hsa
cuuggaaggcguggggagaguucugccuggagggggacuggacccagugcccucugcagacccc

SEQ ID NO: 188662 - RNA, 64 nt, hsa
uaaauuguuuuuuguucccaucaguuucaggccaggacuggagaggccacauuaccaaguagaa

SEQ ID NO: 188663 - RNA, 64 nt, hsa
ggcgugcagccaggguagcugaaguuugggucugggacuggagauuggccauuaggccuccuga

SEQ ID NO: 188664 - RNA, 64 nt, hsa
acauuucuuuacucagacuaaauagcauucaguaggacuggacuggaccccagguuuccuuuac

SEQ ID NO: 188665 - RNA, 64 nt, hsa
ucuuuacucagacuaaauagcauucaguaggacuggacuggaccccagguuuccuuuacaugag

SEQ ID NO: 188666 - RNA, 64 nt, hsa
gagcucugagcacgccccacgcauggugcaggagggacuggacagaucugaggaaggccguaaa

SEQ ID NO: 188667 - RNA, 64 nt, hsa
uggcuguuccaccagagcagagggaaucauugcuggacuggauuucuucuggagggaagcacca

SEQ ID NO: 188668 - RNA, 64 nt, hsa
gcgauuagcggacuggagucugguggcgauuagcggacuggagucuggggacauccguggcaaa

SEQ ID NO: 188669 - RNA, 64 nt, hsa
agccuccucuucaaaauucacaguggcgauuagcggacuggagucugguggcgauuagcggacu

SEQ ID NO: 188670 - RNA, 64 nt, hsa
aagaucugguuuuuuggucaaagggaacauguucggacuggaaacauuucuuuacauuugcauu

SEQ ID NO: 188671 - RNA, 64 nt, hsa
uuccaaaggggcacccacauuuuuuugaaagacuggacuggaaucuuagcaaacaauuguaagu

SEQ ID NO: 188672 - RNA, 64 nt, hsa
agcaucggaauauauuuggagcacacccuaguaaccucuugagauuaaauuacauagucuuaau

SEQ ID NO: 188673 - RNA, 64 nt, hsa
ggccccagcuucacugcuuggaagcaugucccucccucuugaguuggcucugauuugaaaucgg

SEQ ID NO: 188674 - RNA, 64 nt, hsa
agugaaaaccucuuucggaaaugauugagagcagccucuugaaugcuuaaaugaucaaggaggg

SEQ ID NO: 188675 - RNA, 64 nt, hsa
aguguacucugaguccucauuguucagaaaagcaccucuugaagaacugacuuccugaacuccc

SEQ ID NO: 188676 - RNA, 64 nt, hsa
cugugauccagaaagauuuuugugcccccagaugccucuugauaggagaggcaacauacuccaa

SEQ ID NO: 188677 - RNA, 64 nt, hsa
gaaugaaaaggcauugccaucuccauuccucugcccucuugagccagcacaggaaggugaggcc

SEQ ID NO: 188678 - RNA, 64 nt, hsa
aagaagcaguggccuuauugcaucccaaaccacgccucuugaccaggcugccucccuuguggca

SEQ ID NO: 188679 - RNA, 64 nt, hsa
ugaaggacggggggcgguaggggucuugaugaaaccucuugaacgaagcacaguuugucccauc

SEQ ID NO: 188680 - RNA, 64 nt, hsa
ccuggacuuaaauugugauugaaguggagagguacucuaggaauuuaaaaagacacaaaauuau

SEQ ID NO: 188681 - RNA, 64 nt, hsa
auauuggaaaucaugacugugagacuuuauuguccucuaggauggauguauauuggagaagggu

SEQ ID NO: 188682 - RNA, 64 nt, hsa
uuuucucaaaagcaucuuucccccaaauguaugucucuaggacauuuuauaguuuuaagaggaa

SEQ ID NO: 188683 - RNA, 64 nt, hsa
uggcacaaaccuguguuuauauauuuaaaagauacucuaggaugaucacuugugcuuagcuuag

SEQ ID NO: 188684 - RNA, 64 nt, hsa
ccgucgcugccugcuggguccccaccagggcucccucuaggaaugcgccauggcugcuaugaca

SEQ ID NO: 188685 - RNA, 64 nt, hsa
ucucuggaugcucugaggcagaugggcuugggggcucuaggaggaggcagggacuccagggugu

SEQ ID NO: 188686 - RNA, 64 nt, hsa
caaaugccucuucccucuggucaugccucacuaucucuaggagcuccauccuguggcuuccaga

SEQ ID NO: 188687 - RNA, 64 nt, hsa
gcaguuucugcucuuuuucaucaggggggauagucucuaggauuuuucagugaggacccuuggg

SEQ ID NO: 188688 - RNA, 64 nt, hsa; identical to SEQ ID NO: 76961

SEQ ID NO: 188689 - RNA, 64 nt, hsa; identical to SEQ ID NO: 76962

SEQ ID NO: 188690 - RNA, 64 nt, hsa; identical to SEQ ID NO: 76963

SEQ ID NO: 188691 - RNA, 64 nt, hsa; identical to SEQ ID NO: 76964

SEQ ID NO: 188692 - RNA, 64 nt, hsa; identical to SEQ ID NO: 76965

SEQ ID NO: 188693 - RNA, 64 nt, hsa; identical to SEQ ID NO: 76966

SEQ ID NO: 188694 - RNA, 64 nt, hsa; identical to SEQ ID NO: 76967

SEQ ID NO: 188695 - RNA, 64 nt, hsa; identical to SEQ ID NO: 76968

SEQ ID NO: 188696 - RNA, 64 nt, hsa; identical to SEQ ID NO: 76969

SEQ ID NO: 188697 - RNA, 64 nt, hsa; identical to SEQ ID NO: 76970

SEQ ID NO: 188698 - RNA, 64 nt, hsa; identical to SEQ ID NO: 76971

SEQ ID NO: 188699 - RNA, 64 nt, hsa; identical to SEQ ID NO: 76972

SEQ ID NO: 188700 - RNA, 64 nt, hsa; identical to SEQ ID NO: 76973

SEQ ID NO: 188701 - RNA, 64 nt, hsa; identical to SEQ ID NO: 76974

SEQ ID NO: 188702 - RNA, 64 nt, hsa; identical to SEQ ID NO: 76975

SEQ ID NO: 188703 - RNA, 64 nt, hsa; identical to SEQ ID NO: 76976

SEQ ID NO: 188704 - RNA, 64 nt, hsa; identical to SEQ ID NO: 76977

SEQ ID NO: 188705 - RNA, 64 nt, hsa; identical to SEQ ID NO: 76978

SEQ ID NO: 188706 - RNA, 64 nt, hsa; identical to SEQ ID NO: 76979

SEQ ID NO: 188707 - RNA, 64 nt, hsa; identical to SEQ ID NO: 76980

SEQ ID NO: 188708 - RNA, 64 nt, hsa; identical to SEQ ID NO: 76981

SEQ ID NO: 188709 - RNA, 64 nt, hsa; identical to SEQ ID NO: 76982

SEQ ID NO: 188710 - RNA, 64 nt, hsa; identical to SEQ ID NO: 76983

SEQ ID NO: 188711 - RNA, 64 nt, hsa; identical to SEQ ID NO: 76984

SEQ ID NO: 188712 - RNA, 64 nt, hsa; identical to SEQ ID NO: 76985

SEQ ID NO: 188713 - RNA, 64 nt, hsa; identical to SEQ ID NO: 76986

SEQ ID NO: 188714 - RNA, 64 nt, hsa; identical to SEQ ID NO: 76987

SEQ ID NO: 188715 - RNA, 64 nt, hsa; identical to SEQ ID NO: 76988

SEQ ID NO: 188716 - RNA, 64 nt, hsa; identical to SEQ ID NO: 76989

SEQ ID NO: 188717 - RNA, 64 nt, hsa; identical to SEQ ID NO: 76990

SEQ ID NO: 188718 - RNA, 64 nt, hsa; identical to SEQ ID NO: 76991

SEQ ID NO: 188719 - RNA, 64 nt, hsa; identical to SEQ ID NO: 76992

SEQ ID NO: 188720 - RNA, 64 nt, hsa; identical to SEQ ID NO: 76993

SEQ ID NO: 188721 - RNA, 64 nt, hsa; identical to SEQ ID NO: 76994

SEQ ID NO: 188722 - RNA, 64 nt, hsa; identical to SEQ ID NO: 76995

SEQ ID NO: 188723 - RNA, 64 nt, hsa; identical to SEQ ID NO: 76996

SEQ ID NO: 188724 - RNA, 64 nt, hsa; identical to SEQ ID NO: 76997

SEQ ID NO: 188725 - RNA, 64 nt, hsa; identical to SEQ ID NO: 76998

SEQ ID NO: 188726 - RNA, 64 nt, hsa; identical to SEQ ID NO: 76999

SEQ ID NO: 188727 - RNA, 64 nt, hsa; identical to SEQ ID NO: 77000

SEQ ID NO: 188728 - RNA, 64 nt, hsa; identical to SEQ ID NO: 77001

SEQ ID NO: 188729 - RNA, 64 nt, hsa; identical to SEQ ID NO: 77002

SEQ ID NO: 188730 - RNA, 64 nt, hsa; identical to SEQ ID NO: 77003

SEQ ID NO: 188731 - RNA, 64 nt, hsa; identical to SEQ ID NO: 77004

SEQ ID NO: 188732 - RNA, 64 nt, hsa; identical to SEQ ID NO: 77005

SEQ ID NO: 188733 - RNA, 64 nt, hsa; identical to SEQ ID NO: 77006

SEQ ID NO: 188734 - RNA, 64 nt, hsa; identical to SEQ ID NO: 77007

SEQ ID NO: 188735 - RNA, 64 nt, hsa; identical to SEQ ID NO: 77008

SEQ ID NO: 188736 - RNA, 64 nt, hsa; identical to SEQ ID NO: 77009

SEQ ID NO: 188737 - RNA, 64 nt, hsa; identical to SEQ ID NO: 77010

SEQ ID NO: 188738 - RNA, 64 nt, hsa; identical to SEQ ID NO: 77011

SEQ ID NO: 188739 - RNA, 64 nt, hsa; identical to SEQ ID NO: 77012

SEQ ID NO: 188740 - RNA, 64 nt, hsa; identical to SEQ ID NO: 77013

SEQ ID NO: 188741 - RNA, 64 nt, hsa; identical to SEQ ID NO: 77014

SEQ ID NO: 188742 - RNA, 64 nt, hsa; identical to SEQ ID NO: 77015

SEQ ID NO: 188743 - RNA, 64 nt, hsa; identical to SEQ ID NO: 77016

SEQ ID NO: 188744 - RNA, 64 nt, hsa; identical to SEQ ID NO: 77017

SEQ ID NO: 188745 - RNA, 64 nt, hsa; identical to SEQ ID NO: 77018

SEQ ID NO: 188746 - RNA, 64 nt, hsa; identical to SEQ ID NO: 77019

SEQ ID NO: 188747 - RNA, 64 nt, hsa; identical to SEQ ID NO: 154420

SEQ ID NO: 188748 - RNA, 64 nt, hsa; identical to SEQ ID NO: 154421

SEQ ID NO: 188749 - RNA, 64 nt, hsa; identical to SEQ ID NO: 154422

SEQ ID NO: 188750 - RNA, 64 nt, hsa; identical to SEQ ID NO: 154423

SEQ ID NO: 188751 - RNA, 64 nt, hsa; identical to SEQ ID NO: 154424

SEQ ID NO: 188752 - RNA, 64 nt, hsa; identical to SEQ ID NO: 154425

SEQ ID NO: 188753 - RNA, 64 nt, hsa; identical to SEQ ID NO: 154426

SEQ ID NO: 188754 - RNA, 64 nt, hsa; identical to SEQ ID NO: 154427

SEQ ID NO: 188755 - RNA, 64 nt, hsa; identical to SEQ ID NO: 154428

SEQ ID NO: 188756 - RNA, 64 nt, hsa; identical to SEQ ID NO: 154429

SEQ ID NO: 188757 - RNA, 64 nt, hsa; identical to SEQ ID NO: 154430

SEQ ID NO: 188758 - RNA, 64 nt, hsa; identical to SEQ ID NO: 154431

SEQ ID NO: 188759 - RNA, 64 nt, hsa; identical to SEQ ID NO: 154432

SEQ ID NO: 188760 - RNA, 64 nt, hsa
aaugcucauuuucugguuuggcauggugaguguugggguugacauuuagaacuuuaagucucac

SEQ ID NO: 188761 - RNA, 64 nt, hsa
ggcagcagagagagaggacagagggguaagaugagggguugagggaagguucuucaugauccac

SEQ ID NO: 188762 - RNA, 64 nt, hsa
gaaccgaaaaaucgcgaguguuucgcggguaacugggguugagggccaaaauauuuggaaugaa

SEQ ID NO: 188763 - RNA, 64 nt, hsa
uaccaaacaugcggugccaugaagggacccuuuggggguugaauaggaguuaaccccugcgcuc

SEQ ID NO: 188764 - RNA, 64 nt, hsa
gaugccuccugacugcacacugaggacugggacugggguugaguucugucugguuuuguugcca

SEQ ID NO: 188765 - RNA, 64 nt, hsa
augaacuaccugcaguggugauggccugaggccugggguugaccacuaacuggcuccugacagg

SEQ ID NO: 188766 - RNA, 64 nt, hsa
ugcuagucucuaugagguccuuauugcacuuauugggguugaagcucuucagaggagcuggaac

SEQ ID NO: 188767 - RNA, 64 nt, hsa
cccacuuccauuggucuccaggccccaauaaucugggguugaaacuuugaggaaaugccaguga

SEQ ID NO: 188768 - RNA, 64 nt, hsa
agguuuacugaaauugauuugcugaauuuuucugcuaguucaaaaugugaauuaggaccugguc

SEQ ID NO: 188769 - RNA, 64 nt, hsa
aguguguagaaauuugugcugcccagagcugugccuaguucauagaaacugacuggaagcacau

SEQ ID NO: 188770 - RNA, 64 nt, hsa
cuaggauuacaggcauaagccacugagcccagcccuaguucaguaucuuuuauguaaauuacaa

SEQ ID NO: 188771 - RNA, 64 nt, hsa
aaagggccaaguggacaucuuggaugucaagugccuaguucaguaucuuuuuuuuuuuuuuuuu

SEQ ID NO: 188772 - RNA, 64 nt, hsa
auuacuucugucagaagugucuuagggugguuaucuaguucaguacuccaaauuauuggggacc

SEQ ID NO: 188773 - RNA, 64 nt, hsa
uggugcaccaugcacuuuccugcuagacucuggccuaguucaagcugaccaauggcagaggacu

SEQ ID NO: 188774 - RNA, 64 nt, hsa
aacguuagagcuggaaggaaucuuaacuauuaaucuaguucaaugcccuuauuuuacagauggg

SEQ ID NO: 188775 - RNA, 64 nt, hsa
cagaauugagacuggaauauaggccuucugacuccuaguucaguauucuuaccccuguaccaca

SEQ ID NO: 188776 - RNA, 63 nt, hsa
cugcuguucccagugauauuugggaucugacugaagccagaggcucuguaaaaucagaccaua

SEQ ID NO: 188777 - RNA, 63 nt, hsa
gucuuaaaaguuguuuuuaaaugacaauaaaacaagccagaaugucuuuugugcuggaguguc

SEQ ID NO: 188778 - RNA, 63 nt, hsa
accacucaacccccaccuggaaggggcaaagaaaagccagaguuccauguuuguacuccugug

SEQ ID NO: 188779 - RNA, 63 nt, hsa
aaccuucccucucuccuuggugaagaacaucccaagccagaaagaaguuaacuacaguguuuu

SEQ ID NO: 188780 - RNA, 63 nt, hsa
gggaggggagggcuggcugcuggaagaaggaagaagccagacugguuagacaguacucuuaac

SEQ ID NO: 188781 - RNA, 63 nt, hsa
ucuuauaacaccucccaagaaagauaggggaagaagccagaaccccaccuggccugcccacag

SEQ ID NO: 188782 - RNA, 63 nt, hsa
ccuccuuggcuggcaugguucuguguuacguugaagccagagucuuauaacaccucccaagaa

SEQ ID NO: 188783 - RNA, 63 nt, hsa
aaaaugugcaugacaacacuagagguaugggcgaagccagaaagaagggaaguuuuggcugaa

SEQ ID NO: 188784 - RNA, 63 nt, hsa
ccuugccuuuaaccuuuucugcagugaucuaagaagccagauucaucugcacaaauacguggu

SEQ ID NO: 188785 - RNA, 63 nt, hsa
agggaaaagacacacaagucgcguggguuggagaagccagagccauuccaccuccccuccccc

SEQ ID NO: 188786 - RNA, 63 nt, hsa
accuccccucccccagcaucucucagagaugugaagccagauccucauggcagcgaggcccuc

SEQ ID NO: 188787 - RNA, 63 nt, hsa
aacacuaagcugugaugaagaaagugugguaaaaagccagaguaguuuuauacagacaaaacc

SEQ ID NO: 188788 - RNA, 63 nt, hsa
gaggcaaccugaccagaaacacuucgcugcugcaagccagacaggaaaaagauuccaugucag

SEQ ID NO: 188789 - RNA, 63 nt, hsa
uuaucuagugauaugaccucacugucuugaccaaagccagaauagaaggcaggauuccugaau

SEQ ID NO: 188790 - RNA, 63 nt, hsa
gaauaauaugcagagaugcauauuaggaaugugaagccagaaugggucaguuguagcugcugc

SEQ ID NO: 188791 - RNA, 63 nt, hsa
uuuucuuuuuugcuuucuugucuuuucagaagcaagccagaccuagcaggcuguuccauguuc

SEQ ID NO: 188792 - RNA, 63 nt, hsa
cuagaggucaggacggcuccucagagcgccaggaagccagagccccaagcaggacgaaaaaga

SEQ ID NO: 188793 - RNA, 63 nt, hsa
gauuucugaaacuugaacucagagcccagugggaagccagaggucuugaaagacuucagccau

SEQ ID NO: 188794 - RNA, 61 nt, hsa
guaaugugaagggucccuaaaggacucuggaaagccagaagacugcaguggauuucugaaa

SEQ ID NO: 188795 - RNA, 63 nt, hsa
ggcucccuccucuucacauuccccccgaccccaaagccagagaaagccagauggcaccagcug

SEQ ID NO: 188796 - RNA, 63 nt, hsa
ucuucacauuccccccgaccccaaagccagagaaagccagauggcaccagcugcuccggaugu

SEQ ID NO: 188797 - RNA, 63 nt, hsa
accaaaguucucaggccaaggucucgcccaccaaagccagaaagugcaagcacccgucuaccc

SEQ ID NO: 188798 - RNA, 63 nt, hsa
gccuucuggagagccucuggguucugagucagcaagccagaggucaugccacaggccuggcug

SEQ ID NO: 188799 - RNA, 63 nt, hsa
aaaaccugcagcaaagagaagcaucagucuaacaagccagaacucauuuugugccacccauuu

SEQ ID NO: 188800 - RNA, 63 nt, hsa
cacccauugucaggugcucucccucaccccuguaagccagacaguuuguucaaaaccugcagc

SEQ ID NO: 188801 - RNA, 63 nt, hsa
guaguuaacauuuauguucccuacucccuacguaagccagacuuuggcaacagugauaguuga

SEQ ID NO: 188802 - RNA, 63 nt, hsa
aucuucauuuuacaggcagaccugucuaacuacaagccagacuuggguuuucuccuguaguuu

SEQ ID NO: 188803 - RNA, 63 nt, hsa
uguguuuccuucauguguuagauauuggcaacaaagccagagguguaauguugguuauaugaa

SEQ ID NO: 188804 - RNA, 63 nt, hsa
uagaucuuggaaggagagauccauugaguccagaagccagaucagcaaauggaggaaccucgg

SEQ ID NO: 188805 - RNA, 63 nt, hsa
uuauuuagccauucaccuagagaguaaguguugaagccagagccaccuccaacucuggagccu

SEQ ID NO: 188806 - RNA, 63 nt, hsa
ugggauguggcgggacaggguugcuggguacagaagccagacuucuuuuacaaguaacucuag

SEQ ID NO: 188807 - RNA, 63 nt, hsa
aggaucauggucaugugagcuucuggucaccggaagccagaaauacucagcugccauguugau

SEQ ID NO: 188808 - RNA, 63 nt, hsa
ugugaagagauccuggcauuucugguccaacccaagccagagaaccauuaagaaggggccuuc

SEQ ID NO: 188809 - RNA, 63 nt, hsa
gcucaccccuuucccccgccaaauaagaaacgcaagccagaccacgaugauuguagaaguccc

SEQ ID NO: 188810 - RNA, 63 nt, hsa
aagaugaacuugaagauuacauaaaagugcagaaagccagaggacuagagccaaaaacuuguu

SEQ ID NO: 188811 - RNA, 63 nt, hsa
aagaugaacuugaagauuacaucaaaguacagaaagccagaggacuagauccaaagacuuguu

SEQ ID NO: 188812 - RNA, 63 nt, hsa
aaaaugagugugcagauuacaucaaugugcagaaagccagaggacuagaggccaagacuuguu

SEQ ID NO: 188813 - RNA, 64 nt, hsa
uaucugucuguuagcaaugauuauuacaucaucagaucagcaugugcuauacucccugcaagaa

SEQ ID NO: 188814 - RNA, 64 nt, hsa
uuucuuuaaguaccuggggaauacagcucucagugaucagcagggaguuuauuugaggacauca

SEQ ID NO: 188815 - RNA, 64 nt, hsa
uuguuuuuuuuuuuuuuaauuauuucucuuagcagaucagcaaucccucuagggaccuaaauac

SEQ ID NO: 188816 - RNA, 64 nt, hsa
ccuaugauuuauuuccuucaugaauuugucacuggaucagcagcuguggaaauaaagcuuguga

SEQ ID NO: 188817 - RNA, 64 nt, hsa
gcagcuauugacuuuguaauuuaggaaaaauguauaauaagauaaaaucuauuaaauuuuucuc

SEQ ID NO: 188818 - RNA, 64 nt, hsa
acuuuuuuuucaaaauuuuaguuuuaccuguaauuaauaagaacugauacaagacaaaaacagu

SEQ ID NO: 188819 - RNA, 64 nt, hsa
agaacaacuugauaucauucagcuguccaaaaaauaauaagagcauucauuaaauacugauuuu

SEQ ID NO: 188820 - RNA, 64 nt, hsa
agcucuacagggacagaaugcuuaauaaauacuuuaauaagauaugggaaaauauuuuaauaaa

SEQ ID NO: 188821 - RNA, 64 nt, hsa
uacucgauguguaaugaaaccugaaauaauaagauaauaagaaaagcaauaauuuucuaaagcu

SEQ ID NO: 188822 - RNA, 64 nt, hsa
ugcauggguacucgauguguaaugaaaccugaaauaauaagauaauaagaaaagcaauaauuuu

SEQ ID NO: 188823 - RNA, 64 nt, hsa
gcagcuauguaaaugaccuaauugauagcagguguaauaagacuaucgucuuccuacacauagg

SEQ ID NO: 188824 - RNA, 64 nt, hsa
aacauugugaugauuauuauuuaaaaccauuauuuaauaagaguaaaaauaugugaaucuggau

SEQ ID NO: 188825 - RNA, 64 nt, hsa
guuaaugugguuaaugccaaaaagugguuaauauuaauaagacuguuuccacaccauaggcaau

SEQ ID NO: 188826 - RNA, 64 nt, hsa
uauuuuacuggaaauuaagaacuugcugcuguuuuaauaagauguaguauauuuucugacuaca

SEQ ID NO: 188827 - RNA, 64 nt, hsa
gagaccuaaugagaaauaguuacucaguuguaaaaauuuugauuuauucucuuucuucugaccu

SEQ ID NO: 188828 - RNA, 64 nt, hsa
uuuauauucucaacauacaauguuaagaaccaucaauuuugacuuuuacuaaguuguuaaauaa

SEQ ID NO: 188829 - RNA, 64 nt, hsa
uucuaagguugaucaucuuauaccacgaaucguuaauuuugacaguucuacugauccguaaaug

SEQ ID NO: 188830 - RNA, 64 nt, hsa
auacaucaguuggugcauaaucgaaaaaaauaggaauuuugaacacuguucuuccuucuacauu

SEQ ID NO: 188831 - RNA, 64 nt, hsa
uaacuaaaauaguguuaucugacuaauuccucugaauuuugauguaagaucuauauaggccccc

SEQ ID NO: 188832 - RNA, 64 nt, hsa
gaaaaaaaccaaaacuuuauaccaaugauuuaguaauuuugaggcauaggguagcuuacguagu

SEQ ID NO: 188833 - RNA, 64 nt, hsa
acuuuggaaagaauuuugagucuagaugugguuaaauuuugacuucugggaacuugguucagau

SEQ ID NO: 188834 - RNA, 64 nt, hsa
gaaacagcuuuggucaacauucuacuuuggaaagaauuuugagucuagaugugguuaaauuuug

SEQ ID NO: 188835 - RNA, 64 nt, hsa
acagcagaaugaauaaaagauggugaaggcuguuaauuuugagucaauucuaccccugacauuu

SEQ ID NO: 188836 - RNA, 64 nt, hsa
aucagcuguuuuucuuaauuucagccagacuauuaauuuugagccauuauguaauauaugccau

SEQ ID NO: 188837 - RNA, 64 nt, hsa
uuuugucauucuguguuaaaucauuucaggguuuaauuuugaaauaaaagauuaauauaaaaug

SEQ ID NO: 188838 - RNA, 64 nt, hsa
guaagcagugaguuauuacccacaauuuaaagcaaauuuugaaugaaucuuuaaguuagguauc

SEQ ID NO: 188839 - RNA, 64 nt, hsa
guguauuuuugaagaguguuauguccuuaguuuuaauuuugaguaaagaaaaggcuaaaaucau

SEQ ID NO: 188840 - RNA, 64 nt, hsa
agagauaaaaauagccaaagauaggagacgucugaauuuugaaugauaaacagugauguuuuaa

SEQ ID NO: 188841 - RNA, 64 nt, hsa
aacccuggguauagucuuaaaauucugcacaauaaauuuugagaaagaauuguuccucuuugua

SEQ ID NO: 188842 - RNA, 64 nt, hsa
accaucugaggucuucuggauucuuugugggguuaauuuugauuugaugucaucuguuugcccu

SEQ ID NO: 188843 - RNA, 64 nt, hsa
cuggugcuaaauaacagucuuuauuauauuaucuaauuuugacuaaagaaauacuuuugaagua

SEQ ID NO: 188844 - RNA, 64 nt, hsa
agccaugacuuuaacugaaguguucacauucacuaauuuugauagauugcuguccuuaauaauu

SEQ ID NO: 188845 - RNA, 64 nt, hsa
aacgccaaacuaaaguuuacagucuuucuuucugaauuuugaguaucuucuguuguagaauaau

SEQ ID NO: 188846 - RNA, 64 nt, hsa
guaagauggauuucacccccaggccaaugcagcuaauuuugauagcugcauucauuuaucacca

SEQ ID NO: 188847 - RNA, 64 nt, hsa
cauggcagcauggaggaggcaagaccugugggucaauuuugaacuggccuuacuuugauuuuua

SEQ ID NO: 188848 - RNA, 64 nt, hsa
gucucgcauauuauauuauagcaggccaagauaaaauuuugacagcucuuuaagcccacaugca

SEQ ID NO: 188849 - RNA, 64 nt, hsa
ugaccaccuacugugugcacagcacuacugguaaaauuuugaagacauuguuaacauuaaaaaa

SEQ ID NO: 188850 - RNA, 64 nt, hsa
cuuugaaaauggcuguuuuaccuuauaagguuaaaauuuugauccauauguuaagugauagaag

SEQ ID NO: 188851 - RNA, 64 nt, hsa
uuucugugcauugaacuuugugaaaaugcuguauaauuuugacuuacuaguauuuuugaacaau

SEQ ID NO: 188852 - RNA, 64 nt, hsa
auaaaauuuuauguauuuaccacguacaacaugaaauuuugaaacauguauacauucuggaaug

SEQ ID NO: 188853 - RNA, 64 nt, hsa
uuuuaaauauuucuggcuuuuauuaauaugucuuaauuuugaguuugaaaauguuaagugcaau

SEQ ID NO: 188854 - RNA, 64 nt, hsa
uagauuuuuaaacaaaugaaauuaaagcaacaauaauuuugaagcauuugaaaaagccaaagug

SEQ ID NO: 188855 - RNA, 64 nt, hsa
caaccuuauucuguguguagacauuguauuccacaauuuugaauggcuguguuuuaccucuaaa

SEQ ID NO: 188856 - RNA, 64 nt, hsa
aaaauauauauauauugaaaaucaaaggaggcaaaauuuugacagggaaggaaguaacugcaaa

SEQ ID NO: 188857 - RNA, 64 nt, hsa
agacuuuaauaguguuacuuggauagcuuauaugaauuuugagaauuuuauaugaauuuugaga

SEQ ID NO: 188858 - RNA, 64 nt, hsa
ggauagcuuauaugaauuuugagaauuuuauaugaauuuugagaaagcaaguucaaaagaacuc

SEQ ID NO: 188859 - RNA, 64 nt, hsa
aauuuaauucugguauugugagugguuagcaaucaauuuugaauuuauaauucugcuauuuuaa

SEQ ID NO: 188860 - RNA, 64 nt, hsa
caugucugcauucauuuacauucaacuuauuguaaauuuugagauuuuauuuagaaaugaauug

SEQ ID NO: 188861 - RNA, 64 nt, hsa
cucuauggcuuuaaggccuugcuuacugccugcaaauuuugagaaauuuaaaaauaagcauucu

SEQ ID NO: 188862 - RNA, 64 nt, hsa
uuaccucuuguauaagcauguuguacuaaaaaaaaauuuugaaacauuuuguauauuggagauc

SEQ ID NO: 188863 - RNA, 64 nt, hsa
caguaaaaucacccuuuuuagugucuagucugugaauuuugacaaaugcaugguuuuguaacca

SEQ ID NO: 188864 - RNA, 64 nt, hsa
ugguagaccaaaaagaaccaaauccauagggugaaauuuugagaccuagacucuguaaaaauaa

SEQ ID NO: 188865 - RNA, 64 nt, hsa
aaauacaaaguaacccugacuagggcccaacuuuaauuuugaaugcauuuccagaguggccaug

SEQ ID NO: 188866 - RNA, 64 nt, hsa
cauguuugacagaaacagcagcuaugaagccuugaauuuugaaaaaaagacaagaaggugcaaa

SEQ ID NO: 188867 - RNA, 64 nt, hsa
aaguuaugguuauuuuuuuuuuuaguuuuucauuaauuuugaucaauuguaucuuacuaggaga

SEQ ID NO: 188868 - RNA, 64 nt, hsa
cacuguaaaauagcuucugcaacaagggaaguuaaauuuugagacuuuuuuccccaaaggauac

SEQ ID NO: 188869 - RNA, 64 nt, hsa
uguguguauauaugcauacacuuuuuuauauuaaaauuuugaggcuauacagccacugugcccu

SEQ ID NO: 188870 - RNA, 64 nt, hsa
uuacauaauguugacaucucauacuucaugaaguaauuuugacucaugcagucgugugugugug

SEQ ID NO: 188871 - RNA, 64 nt, hsa
aauuaaagacugguuucuauaguaugaaugucuuaauuuugaguuauaugauguuuauuugaau

SEQ ID NO: 188872 - RNA, 64 nt, hsa
cacugcucaauuaacaaaccuacauggagaccuuaauuuugacuuaacaaauaguuuauguacu

SEQ ID NO: 188873 - RNA, 64 nt, hsa
aacaguuagugguuuucacuauuuauaaaaaauuaauuuugaacuuuuuguuaaauuuuuaagu

SEQ ID NO: 188874 - RNA, 64 nt, hsa
uccuaauguugaauuuugaugaacaaaauuuccuaauuuugagaaagucuuauuuauucauauu

SEQ ID NO: 188875 - RNA, 64 nt, hsa
uauuuugcuaguuuuugacuugcuccuaauguugaauuuugaugaacaaaauuuccuaauuuug

SEQ ID NO: 188876 - RNA, 64 nt, hsa
aguccuacaaaagacaauguauaagcuguaacagaauuuugaauuguuuuucuuugcaaaaccc

SEQ ID NO: 188877 - RNA, 64 nt, hsa
gauaaauuuauuuuuaaauuuugaaacacaaaacaauuuugaaucuugcucucuuaaagaaagc

SEQ ID NO: 188878 - RNA, 64 nt, hsa
ucuuuagaaaauuuaggagauaaauuuauuuuuaaauuuugaaacacaaaacaauuuugaaucu

SEQ ID NO: 188879 - RNA, 64 nt, hsa
auggacaggcugaccucaguguuuacaaauucagaauuuugauagggguagauauggagaaaga

SEQ ID NO: 188880 - RNA, 64 nt, hsa
gaauggguacuuucuauuuuguuucuaaacgagcaauuuugaggaugaaaugggaagauaucau

SEQ ID NO: 188881 - RNA, 64 nt, hsa
ucuuguuuuuaaacaaucucuugaaggcaauuccaauuuugagaaucacuaucuucaaauuacc

SEQ ID NO: 188882 - RNA, 64 nt, hsa
aaaagauuaaaugaaugagaagaaaugauucauaaauuuugaacuaacaguaauaacuucuuga

SEQ ID NO: 188883 - RNA, 64 nt, hsa
gaaacauauaauggaagaugcagaugauaaaacuaauuuugaacuuuuuaauuuauauaaauua

SEQ ID NO: 188884 - RNA, 64 nt, hsa
gaaauguguagcagcaaauuauauuggggauuagaauuuugaauuaauagcucuccuacuauua

SEQ ID NO: 188885 - RNA, 64 nt, hsa
uaacaugaacuugccccuagagguaguuguuaauaauuuugaaauauuaaggucuugccaagcu

SEQ ID NO: 188886 - RNA, 64 nt, hsa
uuauguagaaggggaacaaaaaaaaaaauaucugaauuuugaaaaaccacaaagcuacaaacug

SEQ ID NO: 188887 - RNA, 64 nt, hsa
gaucugugguaguauaacaugagugaaugucauuaauuuugaaguaauaacugccacauguggg

SEQ ID NO: 188888 - RNA, 64 nt, hsa
aaaaguguuuggagacuuuucaccuguccuauaaaauuuugaauuguguaugugaucuacauag

SEQ ID NO: 188889 - RNA, 64 nt, hsa
caugucaguaucauguucucuaauuaucuugccaaauuuugaaacuacacacaaaaagcauacu

SEQ ID NO: 188890 - RNA, 64 nt, hsa
cauagaagucauuuuagacucucaauuuuaaauuaauuuugaaucacuaauauuuucacaguuu

SEQ ID NO: 188891 - RNA, 64 nt, hsa
gaaaccugacaauauuuuugcucucuucaaaaguaauuuugacugaucucauuuucaguuuaag

SEQ ID NO: 188892 - RNA, 64 nt, hsa
gauaaccaggauauuaucuaauggugaauuguagaauuuugaucuucuuauucacugaguuucu

SEQ ID NO: 188893 - RNA, 64 nt, hsa
uccuaauucucacauguuuuggggaaaaaauuuuaauuuugaaaaaauuuaggaaaguuccuac

SEQ ID NO: 188894 - RNA, 64 nt, hsa
guaccaacagaauuauuugugagaagaaugaacaaauuuugauaaaguaugaauuuguuuuauu

SEQ ID NO: 188895 - RNA, 64 nt, hsa
cauaguguguugagguucaucauagcagggaaugaauuuugaaacuaagcaacuucguguuuua

SEQ ID NO: 188896 - RNA, 64 nt, hsa
uucucucuauauuuacauuuuaauauaauauacaaauuuugaauaaaagaucaugggcaaugca

SEQ ID NO: 188897 - RNA, 64 nt, hsa
auucuuagagcuuucuaaagaacaggaaguaggaaauuuugaugaagaaauugauacaacaaug

SEQ ID NO: 188898 - RNA, 64 nt, hsa
agaccaggagcacuacagagaauuuccagaggcaaauuuugaauugagugccacugauuuucua

SEQ ID NO: 188899 - RNA, 64 nt, hsa
uccagagaaauuuuaaaauaauagaagaaauagaaauuuugaauguauaaaagaaaaagaucaa

SEQ ID NO: 188900 - RNA, 64 nt, hsa
uuucaacauguauguauaugaugauuuuuuucucaauuuugaauuaugcuacucaccaauuuau

SEQ ID NO: 188901 - RNA, 64 nt, hsa
uaguuugaaaucaacagucuugagaauagaugaaaauuuugaugaauaguggaauucuuuuaaa

SEQ ID NO: 188902 - RNA, 64 nt, hsa
auagcuuauaugcccagaaggccuucaaaauaagaauuuugaaagaauacagaaaacaaacuuu

SEQ ID NO: 188903 - RNA, 64 nt, hsa
ggccacaaaaaaucuugauauaacuccuaguuauaauuuugaugcaaccaaguuauuuuuuaua

SEQ ID NO: 188904 - RNA, 64 nt, hsa
uggaauuuuuuuaaaaaguauuuuguaacugaggaauuuugauaauuuggggauuuuguuuucc

SEQ ID NO: 188905 - RNA, 64 nt, hsa
gauauucauguaaauauauuuuaggauuguaauuaauuuugaaaauguagaaagcucuuuauuc

SEQ ID NO: 188906 - RNA, 64 nt, hsa
uuugucuaagcaaggaauauaagauuucaaauaaaauuuugaaccaaaaacauuuauaaugccg

SEQ ID NO: 188907 - RNA, 64 nt, hsa
uuaggacaaaaaacaaagcuaaccauauggcacuaauuuugauuuuaacauuaguguaacaaau

SEQ ID NO: 188908 - RNA, 64 nt, hsa
auuuuccacuucuagcgucauguuggcauucagaaauuuugaaauuuuggagcauuuuggauuu

SEQ ID NO: 188909 - RNA, 64 nt, hsa
guauggaaaggauggcagggaacaugcuguaaguaauuuugaguaagaaaaugagucacugugu

SEQ ID NO: 188910 - RNA, 64 nt, hsa
uagacucuuuccucagaggcuuuuaacuacacacaauuuugacauguuuuccaagcucagaaag

SEQ ID NO: 188911 - RNA, 64 nt, hsa
uacaaaguuucagagaacuaccaacucucuaguuaauuuugaugaagauguuuucauuaauagu

SEQ ID NO: 188912 - RNA, 64 nt, hsa; identical to SEQ ID NO: 95596

SEQ ID NO: 188913 - RNA, 64 nt, hsa; identical to SEQ ID NO: 95597

SEQ ID NO: 188914 - RNA, 64 nt, hsa; identical to SEQ ID NO: 95598

SEQ ID NO: 188915 - RNA, 64 nt, hsa; identical to SEQ ID NO: 95599

SEQ ID NO: 188916 - RNA, 64 nt, hsa; identical to SEQ ID NO: 95600

SEQ ID NO: 188917 - RNA, 64 nt, hsa; identical to SEQ ID NO: 95601

SEQ ID NO: 188918 - RNA, 64 nt, hsa; identical to SEQ ID NO: 95602

SEQ ID NO: 188919 - RNA, 64 nt, hsa; identical to SEQ ID NO: 95603

SEQ ID NO: 188920 - RNA, 64 nt, hsa; identical to SEQ ID NO: 95604

SEQ ID NO: 188921 - RNA, 64 nt, hsa; identical to SEQ ID NO: 95605

SEQ ID NO: 188922 - RNA, 64 nt, hsa
cacagugaaagggauuccucccacgccagaucugcacaacgaggcaagacaggacccaccugug

SEQ ID NO: 188923 - RNA, 64 nt, hsa
cuaagugcuggaauacauuaucucauugaauuaucacaacgaccuuuucaaguaggcauuauca

SEQ ID NO: 188924 - RNA, 64 nt, hsa
cgcuaaacauccuauaaugcacagggcaguaccccacaacgaaaaauaaucuggcccaaaaugu

SEQ ID NO: 188925 - RNA, 64 nt, hsa
uuuagauggaaggaauccaggcaacauucuucaccacaacgaagaaacagauaaaagauaccca

SEQ ID NO: 188926 - RNA, 64 nt, hsa
aacaaaaaacuguucuggacugcaaaucugcacacacaacgaacaguugcauuucagagaguuc

SEQ ID NO: 188927 - RNA, 64 nt, hsa
aauuuaauguaauuucauuccauucuauuguuuacacaacgauuacucgaagaugacugcaaag

SEQ ID NO: 188928 - RNA, 64 nt, hsa
cugggcaacauagcaagaccccgucucuacaaagcacaacgaaaaacaacaaauggaguugugc

SEQ ID NO: 188929 - RNA, 64 nt, hsa
cgauacccagccagagucuacucacugucacaagcacaacgaguuuauaugagaaagcacugag

SEQ ID NO: 188930 - RNA, 64 nt, hsa
uuagaauucgcauuuugccagcucagcgcaccuccacaacgaaugaaaugcuccguaugauuug

SEQ ID NO: 188931 - RNA, 64 nt, hsa
uacaaugauccuggaaauugcaguaacaaaagcacacaacgauuauaguaacuauaagauacaa

SEQ ID NO: 188932 - RNA, 64 nt, hsa
ccacgggggacugacgccagguuccccagccgcccacaacgacuuuauuuucuuacccaauuuc

SEQ ID NO: 188933 - RNA, 64 nt, hsa
gcucaagccagggaaugcauugcagaggcaccugcacaacgacaaacuugaguguuucccugcc

SEQ ID NO: 188934 - RNA, 64 nt, hsa
aaagaguugauuauuucaacaguauugguuaagucacaacgacgaagugcugagaagguuaugg

SEQ ID NO: 188935 - RNA, 64 nt, hsa
ggggcuucagcccgccgcagacuucacagcuggccacaacgagccuguagccaacggcagucac

SEQ ID NO: 188936 - RNA, 64 nt, hsa
aaccuucaggccacaaagcaaaaaguugcauagccacaacgaagaucuaguuggauauaguuuu

SEQ ID NO: 188937 - RNA, 64 nt, hsa
aaaaaaaaaauuauucuguaccaucacaacuuuucacaacgauggcaagccuuaugucuuggga

SEQ ID NO: 188938 - RNA, 64 nt, hsa
caccaucaagagagcuguguguucucucuggucccacaacgaugacucugccucuugucagccc

SEQ ID NO: 188939 - RNA, 60 nt, hsa
caguccuacagcaaguuugacacaaaaucgcacaacgaugacgcacugcucaagaacuac

SEQ ID NO: 188940 - RNA, 64 nt, hsa
gcugcuaagucggcuccagcacacaggagccccccacaacgaagaguuagugcccccaaacguc

SEQ ID NO: 188941 - RNA, 64 nt, hsa
aguaccagauggcuuaaauaauagucuggcuuggcacaacgauguuuuuuuucuuugagacaga

SEQ ID NO: 188942 - RNA, 64 nt, hsa
accagauugaccaagcgccagagacaaaauguggcacaacgagaaccccagcccuguccaggug

SEQ ID NO: 188943 - RNA, 64 nt, hsa
guccuucgggguggccaagcaggccauccucauccacaacgagcgccggguggacuggcuguuc

SEQ ID NO: 188944 - RNA, 64 nt, hsa
cuguggcuucucacagcuguggucuccccugccucacaacgacuccuuucucuuguguggcggg

SEQ ID NO: 188945 - RNA, 64 nt, hsa
cugagaaaacgagccuguuucagaggaacaucgucacaacgaauacuucuggaagcuuaacaaa

SEQ ID NO: 188946 - RNA, 64 nt, hsa
uacauaaaaauuguuucuauaaauuguagaacauagaugcuacaguauuuuuuauuuaauuaua

SEQ ID NO: 188947 - RNA, 64 nt, hsa
aacaacugagauguuaaaauagucauacgucuuuagaugcuauuaaaguuucauuagucauauu

SEQ ID NO: 188948 - RNA, 64 nt, hsa
cuuuuugucuuuuaaguagcagucacuuugcuuaagaugcuaauagaaaacugugguuaaagau

SEQ ID NO: 188949 - RNA, 64 nt, hsa
gcaaucauuuacuucuacugagugcugcauuuuaagaugcuagaugagaagaguaguugguuuu

SEQ ID NO: 188950 - RNA, 64 nt, hsa
uaggugcuuuuauguauaacuuuaaugauuuauaagaugcuaaaugaauuguuuuuguaccuaa

SEQ ID NO: 188951 - RNA, 64 nt, hsa
caaugcaaaccuguugagaagauccaggagaacaagaugcuaguucccaugucugugaagacuu

SEQ ID NO: 188952 - RNA, 64 nt, hsa
aucacaaugauaucuuugcuguauuuguauaguuagaugcuaaaugcucauugaaacaaucagc

SEQ ID NO: 188953 - RNA, 64 nt, hsa
gauaaugcauuuguaaagggucugccagauaggaagaugcuaguuauggauuuacaagguuguu

SEQ ID NO: 188954 - RNA, 64 nt, hsa
gaguagauaaguggagcucaugguauuuccugaaagaugcuaaucuauuugccaaacuuggucu

SEQ ID NO: 188955 - RNA, 64 nt, hsa
caggaacuguuaacucagggguucuuaacuugggguccaucaccccaggggguccauaguugga

SEQ ID NO: 188956 - RNA, 64 nt, hsa
gacagguuuuuaaucauaaguggucuuuucaaauguccaucaauugauggggaaggcuggcacc

SEQ ID NO: 188957 - RNA, 64 nt, hsa
auugaauguugcccagccaccccuaggaacaccuguccaucaccuccuggauggauuccacugu

SEQ ID NO: 188958 - RNA, 64 nt, hsa
agaaggcucccuaagaccuugagagccaugacagguccaucagcaugaaguuggccaagccaua

SEQ ID NO: 188959 - RNA, 64 nt, hsa; identical to SEQ ID NO: 68831

SEQ ID NO: 188960 - RNA, 64 nt, hsa; identical to SEQ ID NO: 68832

SEQ ID NO: 188961 - RNA, 64 nt, hsa; identical to SEQ ID NO: 68833

SEQ ID NO: 188962 - RNA, 64 nt, hsa; identical to SEQ ID NO: 68834

SEQ ID NO: 188963 - RNA, 64 nt, hsa; identical to SEQ ID NO: 68835

SEQ ID NO: 188964 - RNA, 64 nt, hsa; identical to SEQ ID NO: 68836

SEQ ID NO: 188965 - RNA, 64 nt, hsa; identical to SEQ ID NO: 68837

SEQ ID NO: 188966 - RNA, 64 nt, hsa; identical to SEQ ID NO: 68838

SEQ ID NO: 188967 - RNA, 64 nt, hsa; identical to SEQ ID NO: 68839

SEQ ID NO: 188968 - RNA, 64 nt, hsa; identical to SEQ ID NO: 68840

SEQ ID NO: 188969 - RNA, 64 nt, hsa; identical to SEQ ID NO: 68841

SEQ ID NO: 188970 - RNA, 64 nt, hsa; identical to SEQ ID NO: 68842

SEQ ID NO: 188971 - RNA, 64 nt, hsa; identical to SEQ ID NO: 68843

SEQ ID NO: 188972 - RNA, 64 nt, hsa; identical to SEQ ID NO: 68844

SEQ ID NO: 188973 - RNA, 64 nt, hsa; identical to SEQ ID NO: 68845

SEQ ID NO: 188974 - RNA, 64 nt, hsa; identical to SEQ ID NO: 68846

SEQ ID NO: 188975 - RNA, 64 nt, hsa; identical to SEQ ID NO: 68847

SEQ ID NO: 188976 - RNA, 64 nt, hsa; identical to SEQ ID NO: 68848

SEQ ID NO: 188977 - RNA, 64 nt, hsa; identical to SEQ ID NO: 68849

SEQ ID NO: 188978 - RNA, 64 nt, hsa; identical to SEQ ID NO: 68850

SEQ ID NO: 188979 - RNA, 64 nt, hsa; identical to SEQ ID NO: 68851

SEQ ID NO: 188980 - RNA, 64 nt, hsa; identical to SEQ ID NO: 68852

SEQ ID NO: 188981 - RNA, 64 nt, hsa; identical to SEQ ID NO: 68853

SEQ ID NO: 188982 - RNA, 64 nt, hsa; identical to SEQ ID NO: 68854

SEQ ID NO: 188983 - RNA, 64 nt, hsa; identical to SEQ ID NO: 68855

SEQ ID NO: 188984 - RNA, 64 nt, hsa; identical to SEQ ID NO: 68856

SEQ ID NO: 188985 - RNA, 64 nt, hsa; identical to SEQ ID NO: 68857

SEQ ID NO: 188986 - RNA, 64 nt, hsa; identical to SEQ ID NO: 68858

SEQ ID NO: 188987 - RNA, 64 nt, hsa; identical to SEQ ID NO: 68859

SEQ ID NO: 188988 - RNA, 64 nt, hsa; identical to SEQ ID NO: 68860

SEQ ID NO: 188989 - RNA, 64 nt, hsa; identical to SEQ ID NO: 68861

SEQ ID NO: 188990 - RNA, 64 nt, hsa; identical to SEQ ID NO: 68862

SEQ ID NO: 188991 - RNA, 64 nt, hsa; identical to SEQ ID NO: 68863

SEQ ID NO: 188992 - RNA, 64 nt, hsa; identical to SEQ ID NO: 68864

SEQ ID NO: 188993 - RNA, 64 nt, hsa; identical to SEQ ID NO: 68865

SEQ ID NO: 188994 - RNA, 64 nt, hsa; identical to SEQ ID NO: 68866

SEQ ID NO: 188995 - RNA, 64 nt, hsa; identical to SEQ ID NO: 68867

SEQ ID NO: 188996 - RNA, 64 nt, hsa; identical to SEQ ID NO: 68868

SEQ ID NO: 188997 - RNA, 64 nt, hsa; identical to SEQ ID NO: 68869

SEQ ID NO: 188998 - RNA, 64 nt, hsa; identical to SEQ ID NO: 68870

SEQ ID NO: 188999 - RNA, 64 nt, hsa; identical to SEQ ID NO: 68871

SEQ ID NO: 189000 - RNA, 64 nt, hsa; identical to SEQ ID NO: 68872

SEQ ID NO: 189001 - RNA, 64 nt, hsa; identical to SEQ ID NO: 68873

SEQ ID NO: 189002 - RNA, 64 nt, hsa; identical to SEQ ID NO: 68874

SEQ ID NO: 189003 - RNA, 64 nt, hsa; identical to SEQ ID NO: 68875

SEQ ID NO: 189004 - RNA, 64 nt, hsa; identical to SEQ ID NO: 68876

SEQ ID NO: 189005 - RNA, 64 nt, hsa; identical to SEQ ID NO: 68877

SEQ ID NO: 189006 - RNA, 64 nt, hsa; identical to SEQ ID NO: 68877

SEQ ID NO: 189007 - RNA, 64 nt, hsa; identical to SEQ ID NO: 68879

SEQ ID NO: 189008 - RNA, 64 nt, hsa; identical to SEQ ID NO: 68880

SEQ ID NO: 189009 - RNA, 64 nt, hsa; identical to SEQ ID NO: 68881

SEQ ID NO: 189010 - RNA, 64 nt, hsa; identical to SEQ ID NO: 68882

SEQ ID NO: 189011 - RNA, 64 nt, hsa; identical to SEQ ID NO: 68883

SEQ ID NO: 189012 - RNA, 64 nt, hsa; identical to SEQ ID NO: 68884

SEQ ID NO: 189013 - RNA, 64 nt, hsa; identical to SEQ ID NO: 68885

SEQ ID NO: 189014 - RNA, 64 nt, hsa; identical to SEQ ID NO: 68886

SEQ ID NO: 189015 - RNA, 64 nt, hsa; identical to SEQ ID NO: 68887

SEQ ID NO: 189016 - RNA, 64 nt, hsa; identical to SEQ ID NO: 68888

SEQ ID NO: 189017 - RNA, 64 nt, hsa; identical to SEQ ID NO: 68889

SEQ ID NO: 189018 - RNA, 64 nt, hsa; identical to SEQ ID NO: 68890

SEQ ID NO: 189019 - RNA, 64 nt, hsa; identical to SEQ ID NO: 68891

SEQ ID NO: 189020 - RNA, 64 nt, hsa; identical to SEQ ID NO: 68892

SEQ ID NO: 189021 - RNA, 64 nt, hsa; identical to SEQ ID NO: 68893

SEQ ID NO: 189022 - RNA, 64 nt, hsa; identical to SEQ ID NO: 68894

SEQ ID NO: 189023 - RNA, 64 nt, hsa; identical to SEQ ID NO: 68895

SEQ ID NO: 189024 - RNA, 64 nt, hsa; identical to SEQ ID NO: 68896

SEQ ID NO: 189025 - RNA, 64 nt, hsa; identical to SEQ ID NO: 68897

SEQ ID NO: 189026 - RNA, 64 nt, hsa; identical to SEQ ID NO: 68898

SEQ ID NO: 189027 - RNA, 64 nt, hsa; identical to SEQ ID NO: 68899

SEQ ID NO: 189028 - RNA, 64 nt, hsa; identical to SEQ ID NO: 68900

SEQ ID NO: 189029 - RNA, 64 nt, hsa; identical to SEQ ID NO: 68901

SEQ ID NO: 189030 - RNA, 64 nt, hsa; identical to SEQ ID NO: 68902

SEQ ID NO: 189031 - RNA, 64 nt, hsa; identical to SEQ ID NO: 68903

SEQ ID NO: 189032 - RNA, 64 nt, hsa; identical to SEQ ID NO: 68904

SEQ ID NO: 189033 - RNA, 64 nt, hsa; identical to SEQ ID NO: 68905

SEQ ID NO: 189034 - RNA, 64 nt, hsa; identical to SEQ ID NO: 68906

SEQ ID NO: 189035 - RNA, 64 nt, hsa; identical to SEQ ID NO: 68907

SEQ ID NO: 189036 - RNA, 64 nt, hsa; identical to SEQ ID NO: 68908

SEQ ID NO: 189037 - RNA, 64 nt, hsa; identical to SEQ ID NO: 68909

SEQ ID NO: 189038 - RNA, 64 nt, hsa; identical to SEQ ID NO: 68910

SEQ ID NO: 189039 - RNA, 64 nt, hsa; identical to SEQ ID NO: 68911

SEQ ID NO: 189040 - RNA, 64 nt, hsa; identical to SEQ ID NO: 68912

SEQ ID NO: 189041 - RNA, 64 nt, hsa; identical to SEQ ID NO: 68913

SEQ ID NO: 189042 - RNA, 64 nt, hsa; identical to SEQ ID NO: 68914

SEQ ID NO: 189043 - RNA, 64 nt, hsa; identical to SEQ ID NO: 68915

SEQ ID NO: 189044 - RNA, 64 nt, hsa; identical to SEQ ID NO: 68916

SEQ ID NO: 189045 - RNA, 64 nt, hsa; identical to SEQ ID NO: 68917

SEQ ID NO: 189046 - RNA, 64 nt, hsa; identical to SEQ ID NO: 68918

SEQ ID NO: 189047 - RNA, 64 nt, hsa; identical to SEQ ID NO: 68919

SEQ ID NO: 189048 - RNA, 64 nt, hsa; identical to SEQ ID NO: 68920

SEQ ID NO: 189049 - RNA, 64 nt, hsa; identical to SEQ ID NO: 68921

SEQ ID NO: 189050 - RNA, 64 nt, hsa; identical to SEQ ID NO: 68922

SEQ ID NO: 189051 - RNA, 64 nt, hsa; identical to SEQ ID NO: 68923

SEQ ID NO: 189052 - RNA, 64 nt, hsa; identical to SEQ ID NO: 68924

SEQ ID NO: 189053 - RNA, 64 nt, hsa; identical to SEQ ID NO: 68925

SEQ ID NO: 189054 - RNA, 64 nt, hsa; identical to SEQ ID NO: 68926

SEQ ID NO: 189055 - RNA, 64 nt, hsa; identical to SEQ ID NO: 68927

SEQ ID NO: 189056 - RNA, 64 nt, hsa; identical to SEQ ID NO: 68928

SEQ ID NO: 189057 - RNA, 64 nt, hsa; identical to SEQ ID NO: 68929

SEQ ID NO: 189058 - RNA, 64 nt, hsa; identical to SEQ ID NO: 68930

SEQ ID NO: 189059 - RNA, 64 nt, hsa; identical to SEQ ID NO: 68931

SEQ ID NO: 189060 - RNA, 64 nt, hsa; identical to SEQ ID NO: 68932

SEQ ID NO: 189061 - RNA, 64 nt, hsa; identical to SEQ ID NO: 68933

SEQ ID NO: 189062 - RNA, 64 nt, hsa; identical to SEQ ID NO: 68934

SEQ ID NO: 189063 - RNA, 64 nt, hsa; identical to SEQ ID NO: 68935

SEQ ID NO: 189064 - RNA, 64 nt, hsa; identical to SEQ ID NO: 141401

SEQ ID NO: 189065 - RNA, 64 nt, hsa; identical to SEQ ID NO: 141402

SEQ ID NO: 189066 - RNA, 64 nt, hsa
ugugagauuuauuuaauaggacuuccuuugaaagcuguauaauaguguuucucgggcuucuguc

SEQ ID NO: 189067 - RNA, 64 nt, hsa
uucucuuuuucauucauauaccauuuuaugaguucuguauaauuuuuugugguuuuuguuuugu

SEQ ID NO: 189068 - RNA, 64 nt, hsa
gcccuguuggcauuagcacuaccauuguacccugcuguauaauaaacaaucuuagacauuuauc

SEQ ID NO: 189069 - RNA, 64 nt, hsa
uuuugaaacauuugccaaacuaaauacuguaacacuguauaacauuuaaaaauguuaaagaacu

SEQ ID NO: 189070 - RNA, 64 nt, hsa
aaugcauuguaguguaauauuuaugcauacuauacuguauaacauguuauucaaaagggauugc

SEQ ID NO: 189071 - RNA, 64 nt, hsa
uuugcacuucuguauauagucaaaagagagaaaccuguauaauaguaagaucuuauuuugaaua

SEQ ID NO: 189072 - RNA, 64 nt, hsa
caaucaauuuuaaagcuacaucuguauaaaauuucuguauaaagguguauuucuuuuuuaugag

SEQ ID NO: 189073 - RNA, 64 nt, hsa
uuccuuugguuuacaaucaauuuuaaagcuacaucuguauaaaauuucuguauaaagguguauu

SEQ ID NO: 189074 - RNA, 64 nt, hsa
aacugaacuugaagaaaauauauugaaauuaaagcuguauaaugggccauuuacugaguguuuc

SEQ ID NO: 189075 - RNA, 64 nt, hsa
guaacagagaagaaaccuaaauaauacaacauuccuguauaaugguauuucaaagaaucguguu

SEQ ID NO: 189076 - RNA, 64 nt, hsa
ccucagaccaacucucuccuguauaaucucucuccuguauaaccccaccuugccaagcuuucuu

SEQ ID NO: 189077 - RNA, 64 nt, hsa
ccuugaacuguucuggccucagaccaacucucuccuguauaaucucucuccuguauaaccccac

SEQ ID NO: 189078 - RNA, 64 nt, hsa
guuuuaaauccguaugacccaguguucuagaguucuguauaaaaugauaccaacaacaaauaaa

SEQ ID NO: 189079 - RNA, 64 nt, hsa
uuaucauacaacagaaaauggccaauuaaugguccuguauaaguggaaaacuguuaaggagguc

SEQ ID NO: 189080 - RNA, 64 nt, hsa
aaaacacauguaaaaugcuuuuuaacagcugauacuguauaagacaaagccaagaugcaaaauu

SEQ ID NO: 189081 - RNA, 64 nt, hsa
ucucauuaagaucugaaucuugguucuaagcauucuguauaauaugugauugcuuguccuagcu

SEQ ID NO: 189082 - RNA, 64 nt, hsa
ugauguaaaacagaauauucuguaaaccuaaugucuguauaaauaaugagcguuaacacaguaa

SEQ ID NO: 189083 - RNA, 64 nt, hsa
augcacaguuugcuauuugcuuuagagacagggacuguauaaacaagccuaacauuggugcaaa

SEQ ID NO: 189084 - RNA, 64 nt, hsa
ucuagcugucuggcuguauaacucuuacaguagucuguauaauaagggcaucucuauuagaucu

SEQ ID NO: 189085 - RNA, 64 nt, hsa
agaggacugaacagcucuuccucuagcugucuggcuguauaacucuuacaguagucuguauaau

SEQ ID NO: 189086 - RNA, 64 nt, hsa
aauaaauaaguaaauacauuauugaaaagcaaaucuguauaaaugugaaauuuuuauuuguauu

SEQ ID NO: 189087 - RNA, 64 nt, hsa
auuuuuguauguuuuauuguaaucauaaauacugcuguauaagguaauaaaacucugcaccuaa

SEQ ID NO: 189088 - RNA, 64 nt, hsa
ccuagucaaacaaggaagcuguaggugaggagaucuguauaauauucuaauuuaaguaaguuug

SEQ ID NO: 189089 - RNA, 64 nt, hsa
auucugggauuugagaggaucuaaaacuauuuuucuguauaaauauuauuugccaaaaguuugu

SEQ ID NO: 189090 - RNA, 64 nt, hsa
uaaauaaaauaguguugauguacugaaauaugaacuguauaaaaaguauuaguaauuguauaug

SEQ ID NO: 189091 - RNA, 64 nt, hsa
aauuaacuauuaaccacauucaccuuguaaaugacuguauaaaacuuguugacaaugcacugac

SEQ ID NO: 189092 - RNA, 64 nt, hsa
uggguuucaguuuuugaaucuuguauuuauuuuucuguauaaugaaauuaauaucuagacuuga

SEQ ID NO: 189093 - RNA, 64 nt, hsa
ccgagaggaaagugccgucuuucauagcuggucucuguauaaagaguauguagcaacaacuguu

SEQ ID NO: 189094 - RNA, 64 nt, hsa
ugucaccccaagucuuccagcugguggaucugggcccagcaaagacuguucuccucccgaggga

SEQ ID NO: 189095 - RNA, 64 nt, hsa
acccgcggggcaccucccuggccacacgccuguucccagcaagugcugaaacucacuagaccgu

SEQ ID NO: 189096 - RNA, 64 nt, hsa
caaguagcugggaugacaggcgcacaccaccacgcccagcaaauuuuuuguauuuuuaguagaa

SEQ ID NO: 189097 - RNA, 64 nt, hsa
uuucaggcucuuagaagccauagauuuggacaagcccagcaagauggguguccuuccaggccuc

SEQ ID NO: 189098 - RNA, 64 nt, hsa
caggccgagcgcagacuguuuaggacucagcagacccagcaagaggcaucugcccuuuccccag

SEQ ID NO: 189099 - RNA, 64 nt, hsa
agcaagaggcaucugcccuuuccccagccaccuccccagcaagcaaccugaaaucucagcagau

SEQ ID NO: 189100 - RNA, 64 nt, hsa
aggauggagaagggcaacuugcuuauuaagaucacccagcaaguuaggagugaucagaaccagu

SEQ ID NO: 189101 - RNA, 64 nt, hsa
ucuugaagaagaugucauggcauugccucagcaccccagcaagagcauugcaucuuugcugaau

SEQ ID NO: 189102 - RNA, 64 nt, hsa
cacaggauccuauucucaccaggaaggggguccacccagcaaagagugggcugcaucugggauu

SEQ ID NO: 189103 - RNA, 64 nt, hsa
uuccaugaagaccacauccacacacgcaggaacucccagcaacacaagcuggaagcacauguuu

SEQ ID NO: 189104 - RNA, 64 nt, hsa
acauggaacuuucaaugcuaaaacugggacaguacccagcaaguggggaugguugguccccuac

SEQ ID NO: 189105 - RNA, 64 nt, hsa
gccccccuaccuuaggccacccuccucaugcccacccagcaaggggcagaggccacaggccugg

SEQ ID NO: 189106 - RNA, 64 nt, hsa
guuucucucccaucauccggauuucugguuguggcccagcaauuaacaaaaacagcuucaacug

SEQ ID NO: 189107 - RNA, 64 nt, hsa
guaaaacuaauuagugcccacccacccuccccgccccagcaacugcauauugaaauuuguuaaa

SEQ ID NO: 189108 - RNA, 64 nt, hsa
acugggaggccagacggcacgaggucuccaaggccccagcaaagccauggcuucuaccccuagu

SEQ ID NO: 189109 - RNA, 64 nt, hsa
ggacccagccuuugggccuccccagccagagcagcccagcaacaguguguccuguggucauaaa

SEQ ID NO: 189110 - RNA, 64 nt, hsa
aaacugggauggcccaggucccccagcaaggguacccagcaaggguagcuccggggcuuccugg

SEQ ID NO: 189111 - RNA, 64 nt, hsa
ggccgcucugcacaaacugggauggcccaggucccccagcaaggguacccagcaaggguagcuc

SEQ ID NO: 189112 - RNA, 64 nt, hsa
gaugacaggcuggcagcuauguucagagaauuuacccagcaaaauguaaguucuugauugggug

SEQ ID NO: 189113 - RNA, 64 nt, hsa
uggcuguguacuagccaaaaugcaacuggacaaccccagcaagguucagcaggugaguaggaag

SEQ ID NO: 189114 - RNA, 64 nt, hsa
aggagugaccacaaagccugaaaacacuuugccacccagcaaagaacuggcacaauugguuugg

SEQ ID NO: 189115 - RNA, 64 nt, hsa
caggguaaggugcuggggcugccagaggaccugccccagcaagauuuuugucaagagcgagacu

SEQ ID NO: 189116 - RNA, 64 nt, hsa
caaaacuggggucccagcaacccuggcccccaaccccagcaaaucucuaacaccuccuagaggc

SEQ ID NO: 189117 - RNA, 64 nt, hsa
caaucucuuacagcucccuccccaaaacuggggucccagcaacccuggcccccaaccccagcaa

SEQ ID NO: 189118 - RNA, 64 nt, hsa
ggggggagcuauuuccaaggccccucccuguuuccccagcaauuaaaacggacucaucucuggc

SEQ ID NO: 189119 - RNA, 64 nt, hsa
agcugcugcccuccacagcgguucuucacaggaucccagcaaugaacuguucuagggaaagugg

SEQ ID NO: 189120 - RNA, 64 nt, hsa
gcagugagcugagaucacaccacugcacuccagccugggagagacagagugagacuccaucucg

SEQ ID NO: 189121 - RNA, 64 nt, hsa
ucccuggauccagaucuucucugcccaacucuuacugggagauugcaaacugccacaucucagc

SEQ ID NO: 189122 - RNA, 64 nt, hsa
uuugcauacauuuaaguaauuaaggcauuuauugcugggagaauaggaguagcaaaaauauggu

SEQ ID NO: 189123 - RNA, 64 nt, hsa
gguacuacauccugucauuuaaucuuaaccuagucugggagaugcguaauauaauucuggugaa

SEQ ID NO: 189124 - RNA, 64 nt, hsa
acaaaugguccuuucacaugugcuuuauuagacucugggagagaaaaguaaccaagugcuucag

SEQ ID NO: 189125 - RNA, 64 nt, hsa
cuuccucauccccucauugcaacaaaaccuuaaacugggagaaccuuaguccccucucuuuccu

SEQ ID NO: 189126 - RNA, 64 nt, hsa
ccuuauacuuuauugcuuuucugucuucuucaaccugggagagacccugaauuugaguguguuc

SEQ ID NO: 189127 - RNA, 64 nt, hsa
ucccccugggucugucccacaacacgugggaauucugggagauacaauucaaguugagauuugu

SEQ ID NO: 189128 - RNA, 64 nt, hsa
uguaucaugguuucaguauguuauucauguauuacugggagaugcuaccaagaaaccaacccaa

SEQ ID NO: 189129 - RNA, 64 nt, hsa
cuuuguuccuuucuggcugagcaagcuccugaggcugggagagacuaggaaggcuugguaggag

SEQ ID NO: 189130 - RNA, 64 nt, hsa
aguaugguccaauaggcagcauccucugcugcagcugggagagcugaguuccagggcugugucc

SEQ ID NO: 189131 - RNA, 64 nt, hsa
agacaggaguguaggagucccuguuugauguacucugggagaguaauucuaucuccucuucuga

SEQ ID NO: 189132 - RNA, 64 nt, hsa
agcacuucucuaaucaugcccucccgaagacuggcugggagaagguuuaaaaacaaaaaaucca

SEQ ID NO: 189133 - RNA, 64 nt, hsa
aaacauugcucuugaguuaagugaccuaauuccccugggagacauacgcaucaacuguggaggu

SEQ ID NO: 189134 - RNA, 64 nt, hsa
aagcugcaaggcuuucuuaagguuucgaguguugcugggagaaaucugcugcauguuguggguu

SEQ ID NO: 189135 - RNA, 64 nt, hsa
ccuuaagccuccaggccagcagcaucagcaucaccugggagauuguuaggaaugcagauucuca

SEQ ID NO: 189136 - RNA, 64 nt, hsa
ccuuucugccacaucucgcccuucuggaccugcacugggagaaauucaggacaggagugaacuc

SEQ ID NO: 189137 - RNA, 64 nt, hsa
ugagcauuaaaguuccuaagacccagugacaguacugggagaaaccaaggcugaagagucaggu

SEQ ID NO: 189138 - RNA, 64 nt, hsa
ccagguugaucuaccgacaccuuccacuucuuuccugggagagacugcuggcuucauuggugau

SEQ ID NO: 189139 - RNA, 64 nt, hsa
gccuuaagcugugaucaugccacugcauuccagccugggagagagagaggaccugucuguugaa

SEQ ID NO: 189140 - RNA, 64 nt, hsa
cgucuuuucaaauggccugggagagucaaauggccugggagagggggccugcccuucucugcug

SEQ ID NO: 189141 - RNA, 64 nt, hsa
ugguaugugaagaugcaccgucuuuucaaauggccugggagagucaaauggccugggagagggg

SEQ ID NO: 189142 - RNA, 64 nt, hsa
cugagccugugcucagccuccucccuaacccacccugggagacacuuggccuguuagauuguuc

SEQ ID NO: 189143 - RNA, 64 nt, hsa
gucccuggacuggugggaaccugaacuaggaguccugggagagcuguggugggaauaugggcug

SEQ ID NO: 189144 - RNA, 64 nt, hsa
ucuguguucaaggucacgguuugcugugggguuccugggagagcuuacucaccccggagucuuu

SEQ ID NO: 189145 - RNA, 64 nt, hsa
cccgggccauccaagcccaaggaccugggauaaacugggagaacuauggcagcuacuugcaucg

SEQ ID NO: 189146 - RNA, 64 nt, hsa
uuuuuuggagucuuuguugcuauauuuuguggggcugggagagagagauuagauuauuuugaca

SEQ ID NO: 189147 - RNA, 64 nt, hsa
gaaacuguaguugagauacagcuauuuaauauuucugggagaugugcaucccucuucuuugugg

SEQ ID NO: 189148 - RNA, 64 nt, hsa
cacgcgguauggggagggcugagcucagugccuccugggagacuugucccguguacagugaccc

SEQ ID NO: 189149 - RNA, 64 nt, hsa
acuugggaugcugaggugggaggaucacuugaaccugggagacacaggcugcagugggcccuga

SEQ ID NO: 189150 - RNA, 64 nt, hsa
ccugcaagcauuuguugaugcccuugcaggcccacugggagaaagaugccucaggcaggucuca

SEQ ID NO: 189151 - RNA, 64 nt, hsa
ccaggagacacauggcuggacaaggcuuugcagccugggagaccccgacuuucucuaacccagu

SEQ ID NO: 189152 - RNA, 64 nt, hsa
aauuggacucgauuuccuuauaucuaauauauaucugggagaaaaggcugcuugaaaauaucuu

SEQ ID NO: 189153 - RNA, 64 nt, hsa
gcagugagccgagaucacaccacugcacuccagccugggagacagaacgagacuccuaaucaaa

SEQ ID NO: 189154 - RNA, 64 nt, hsa
gcaucuacucuaggcauauugaucauuuuagacacugggagaagagaaccucaaacuaggagga

SEQ ID NO: 189155 - RNA, 64 nt, hsa
agggauagguaugaccuaugucugccuuaggcugcugggagaugccauucuccaguuucagaag

SEQ ID NO: 189156 - RNA, 64 nt, hsa
cuuccucauccccucauuggaacaaaaccuuaaacugggagaaccuuaguccccucucuuuccu

SEQ ID NO: 189157 - RNA, 64 nt, hsa
acaaauggcucuuucacaugugcuuuauuagacucugggagagaaaauuaaccaagugcuucag

SEQ ID NO: 189158 - RNA, 64 nt, hsa
uacauaauuuguuggugacuaacaaagcucacaucugggagauuaacuuuuuuuaacgcaaaaa

SEQ ID NO: 189159 - RNA, 64 nt, hsa
gccauuacuauucuauaaaccuuauaaacuugcucugggagaaugcauucuaaauuauauauag

SEQ ID NO: 189160 - RNA, 64 nt, hsa
cacgggcaccaggaccccuaagaccaagugacaacugggagagccucagcauauacucuucucc

SEQ ID NO: 189161 - RNA, 64 nt, hsa
ccaggugaggcccuuucuccaguuugcccauuaacugggagagguacuuucgccuccaaggacu

SEQ ID NO: 189162 - RNA, 64 nt, hsa
gacagcugcuuggagacccgugccuuccagauggcugggagaugccucuguggggaugaaaugg

SEQ ID NO: 189163 - RNA, 64 nt, hsa
aguggggugggauucagagugcuuagucugcucacugggagaagaagaguuccugcgcaugcaa

SEQ ID NO: 189164 - RNA, 64 nt, hsa
aauugaggggacggcaggcccggcugcccuggaacugggagacagggagaauccccugccgggg

SEQ ID NO: 189165 - RNA, 64 nt, hsa
acugagggggcugaggcaugagaaucacuugaaccugggagacagagguugcaaugaaccgaga

SEQ ID NO: 189166 - RNA, 64 nt, hsa
ggaauugcagccacugggcaguugggguggcuuccugggagaugagccgcgaccagguccuggg

SEQ ID NO: 189167 - RNA, 64 nt, hsa
cauuccaaauaaagaauaggccccugccuggcuccugggagauaaccucuaagccauuagaaua

SEQ ID NO: 189168 - RNA, 64 nt, hsa
ucugugcacacaucauuguagccacacaucauugcugggagaauuaagcauuauccugaagacu

SEQ ID NO: 189169 - RNA, 64 nt, hsa
uccucgcaagaccgcucugggagagaaauaagcacugggagauuggaagcacugcuaacauuuu

SEQ ID NO: 189170 - RNA, 64 nt, hsa
aggacucuucucacgaccuccucgcaagaccgcucugggagagaaauaagcacugggagauugg

SEQ ID NO: 189171 - RNA, 64 nt, hsa
ucugagaaccuuguggggugucgggaugggggugcugggagacacagaccugauacaguauguc

SEQ ID NO: 189172 - RNA, 64 nt, hsa
uaaaaucuuuauugagugccuaccggugcaggcgcugggagagacaauagcuuugaggagcuca

SEQ ID NO: 189173 - RNA, 64 nt, hsa
agucaucuucucuuuuuucuugcucagaguuuaccugggagauuucaccaguuugacucaccau

SEQ ID NO: 189174 - RNA, 64 nt, hsa
ccacaugccguucccaugcccggcugcugggcaccugggagagcuuccagaauccucgcagaca

SEQ ID NO: 189175 - RNA, 64 nt, hsa
uccucggccagagcucccaggacgcagggagacccugggagagugaggucaucccggggccaug

SEQ ID NO: 189176 - RNA, 64 nt, hsa
gggagcuggugggggcauccuugaggaccuccaccugggagaugcugggacccucggggcagga

SEQ ID NO: 189177 - RNA, 64 nt, hsa
agcuggagaagaacgaggaggcggcccugcuauccugggagaucuaccugaaggagaacuaccu

SEQ ID NO: 189178 - RNA, 64 nt, hsa
ucacgcgcuuccccgugcccaacgagaaggugcccugggagacggaguuccugaucuaugaccc

SEQ ID NO: 189179 - RNA, 64 nt, hsa
uuuugagacggcgacagaaccugacccguggagacugggagagcccagcaggcaccuguauugc

SEQ ID NO: 189180 - RNA, 64 nt, hsa
ugcuuuccagugguagcccuuuugccauggaggucugggagagagagcagagggcggcagggcu

SEQ ID NO: 189181 - RNA, 64 nt, hsa
uugucguccuggacaccacaggggcaccugcaggcugggagaccagguccucugugcaugggcc

SEQ ID NO: 189182 - RNA, 64 nt, hsa
uuccaggccugggguuagcagccugugcccccggcugggagaucagacccgguguugguccugc

SEQ ID NO: 189183 - RNA, 64 nt, hsa
ccacaagcccagggacaccuggagcccccaggagcugggagaggcaggaaggauccuccccuag

SEQ ID NO: 189184 - RNA, 64 nt, hsa
ccccaagcccagggaugccuggaguccccaggagcugggagaggcaggaaggacccuccccuag

SEQ ID NO: 189185 - RNA, 64 nt, hsa
aaacacauuuacuggccuccucuaaugacuuuggggaaaagaugauucugggucuuucccuuga

SEQ ID NO: 189186 - RNA, 64 nt, hsa
aaaaacaaaaacaagcaaacaaacaaaaaacaauggaaaagaugaagcuggagagagaggaacc

SEQ ID NO: 189187 - RNA, 64 nt, hsa
aggugggaagagagccuggaaaagaaccaggccuggaaaagaaccagaaggaggcugggcagaa

SEQ ID NO: 189188 - RNA, 64 nt, hsa
cuucugucauuguucaaaggugggaagagagccuggaaaagaaccaggccuggaaaagaaccag

SEQ ID NO: 189189 - RNA, 64 nt, hsa
uuaccugaucauuuucuuuaggaagagguuuuagggaaaagaaaauggggugggggugggggug

SEQ ID NO: 189190 - RNA, 64 nt, hsa
ccagucagccacagagacccuccuccuuucacgaggaaaagaccuuccccugaaccccuaaaaa

SEQ ID NO: 189191 - RNA, 64 nt, hsa
ccccagcccucuugcaagaggagaggcacgguagggaaaagaacugcugggugggggccuguuu

SEQ ID NO: 189192 - RNA, 64 nt, hsa
aaguucuuugcagauuuggggcgaggggugauuuggaaaagaagaccuggguggaaagcgguuu

SEQ ID NO: 189193 - RNA, 64 nt, hsa
cuuauuuaauaugcuuauaaccuaguuaaagaaaggaaaagaaaacaaaaaacgaaugaaaaua

SEQ ID NO: 189194 - RNA, 64 nt, hsa
agucagaaucagaagauagucuuggaagcuguuuggaaaagacaguggagaugaggucaguugu

SEQ ID NO: 189195 - RNA, 64 nt, hsa
uuucaguguaaagugugugauugaaggugauaagggaaaagauaaagaccagaaauucccuuuu

SEQ ID NO: 189196 - RNA, 64 nt, hsa
ugcuguggaugaacgaugaaugucaaugucagaaggaaaagagaauuuuggccaucaaaaucca

SEQ ID NO: 189197 - RNA, 64 nt, hsa
ucaacccagcagcugaaaagcuucaagagaucuaggaaaagacauuuucauguuaaugagaauu

SEQ ID NO: 189198 - RNA, 64 nt, hsa
uuuccuucauccuugugacauuucauuucaguaaggaaaagauaacaaagugcaauuaucagca

SEQ ID NO: 189199 - RNA, 64 nt, hsa
uggaauccuccuucuagcugaaggugauugaaaaggaaaagagugagugaacagaaccauagcu

SEQ ID NO: 189200 - RNA, 64 nt, hsa
accuuugagguagaccaggauuucuaaucaaaagggaaaagaagauguugaagaauacaguuag

SEQ ID NO: 189201 - RNA, 64 nt, hsa
ggaccuucuagaauuauaagucacaaagaguucuggaaaagaacuguuuacugcuugauaggaa

SEQ ID NO: 189202 - RNA, 64 nt, hsa
aaugagggauaaauagaaagcagaaugaauuaauggaaaagaacucggcuguuaggccauucuc

SEQ ID NO: 189203 - RNA, 64 nt, hsa
aguuaaguugcagcauaaauccaagggcccacugggaaaagauacugucggguuuuuccauuca

SEQ ID NO: 189204 - RNA, 64 nt, hsa
uucauauuuuagagguguuaauaaaauccucaucggaaaagauccaaagugcaaggauuugauu

SEQ ID NO: 189205 - RNA, 64 nt, hsa
auuauaaacauaauuuccuagacugaaaguuuuuggaaaagaugcagggucugagucaggccuu

SEQ ID NO: 189206 - RNA, 64 nt, hsa
ugcuuccuguaaugaaauccacucucuaugugugggaaaagaggcagggaggaaugaagagagc

SEQ ID NO: 189207 - RNA, 64 nt, hsa
uauccugacugaaauagacaaaguaagagggaaaggaaaagagguaucaaguaaauacugaaac

SEQ ID NO: 189208 - RNA, 64 nt, hsa
uuuucaaauagaaaaacaacaaaacccaugaaauggaaaagagaguuccaaaaaagaagaccug

SEQ ID NO: 189209 - RNA, 64 nt, hsa
uauuuaccaacuuuacucauuuucccauuuuagaggaaaagagguugccugcuuccuaucaaag

SEQ ID NO: 189210 - RNA, 64 nt, hsa
cucuuccauccauuguuggcacccccuugcaaaaggaaaagaacagcaaaagucaggagcagua

SEQ ID NO: 189211 - RNA, 64 nt, hsa
cagggaaaauaacaaccacccuuacugauaguugggaaaagaagauuggguuauuuugccauau

SEQ ID NO: 189212 - RNA, 64 nt, hsa
aagacacaucaaacaggccuauacaaaagguuuaggaaaagaaaacaauggugagucccggccc

SEQ ID NO: 189213 - RNA, 64 nt, hsa
uagguugcaguaccagccacagccagcagauagaggaaaagacacacauaaacucgcuucugag

SEQ ID NO: 189214 - RNA, 50 nt, hsa
ugccucccccaggugacuaaggaaaagagcagaagcuccuugguuuaacc

SEQ ID NO: 189215 - RNA, 64 nt, hsa
aguaaaauugaacuuugaugggggauucaguucuggaaaagaauuugguauuuuccagucugcu

SEQ ID NO: 189216 - RNA, 64 nt, hsa
cacaagaaagcaggaacguggagaaauuggagcaggaaaagaaauuaucaaagcaauagaaaua

SEQ ID NO: 189217 - RNA, 64 nt, hsa
uaaugcuauuagcaauuuccauauacuauauuguggaaaagacugaagaauacaauucugagaa

SEQ ID NO: 189218 - RNA, 64 nt, hsa
uucuguguuuugaauuuuuauuuucuaaugcaguggaaaagaaacagaucauccuaaaugagga

SEQ ID NO: 189219 - RNA, 64 nt, hsa
uuaaucccuucugucuuucuguucucacaaagauggaaaagauacaagagcuugccggaaauaa

SEQ ID NO: 189220 - RNA, 64 nt, hsa
uuucagagaaaagcccuauacguguagugaauguggaaaagacuucagauugaauucacaucuu

SEQ ID NO: 189221 - RNA, 64 nt, hsa
ucaccagacagaaagccuuugauugugauguaugggaaaagaacuccagucagagagcacaucu

SEQ ID NO: 189222 - RNA, 64 nt, hsa
accaaagcgaauuuuaaaagaugcaauguagaggggaaaagagaugaugaaaauauuuaaaggc

SEQ ID NO: 189223 - RNA, 64 nt, hsa
gcuuugagguggaagagggcugcaaauccuugugggaaaagaaaucuaugauuccagguggcau

SEQ ID NO: 189224 - RNA, 64 nt, hsa
aaaagguagaauagggcugaagcaucugauaauaggaaaagaaaaggacaaaaguccucaacuu

SEQ ID NO: 189225 - RNA, 64 nt, hsa
ugacacuuaucagaaucuuccucaagcacuugcuggaaaagauaucagauuggaacuucuuguu

SEQ ID NO: 189226 - RNA, 64 nt, hsa
aggaauggagagaggacucaacugggacccacguggaaaagaccgagcaggccacagaggcucg

SEQ ID NO: 189227 - RNA, 64 nt, hsa
agccacccaaagccuagccgcuguucuagggaacggaaaagaguucauggccaagcgucuaacc

SEQ ID NO: 189228 - RNA, 64 nt, hsa
uuuuuuucuuuuuuccuuuuuuuuuaaguggaggggaaaagaagagauaaacaaggaauauuuu

SEQ ID NO: 189229 - RNA, 64 nt, hsa
auuuuuacaguuacauccagcuguuagauaugcaggaaaagauaguuugcuggcuagcucuauu

SEQ ID NO: 189230 - RNA, 64 nt, hsa
aaaagagcaugauuuuaaaaaaucaaucauaggaggaaaagaaauucgcuuuucaaguaggaag

SEQ ID NO: 189231 - RNA, 64 nt, hsa
auuuaguauccaaagacuguuuauguugauguauggaaaagagcaugauuuuaaaaaaucaauc

SEQ ID NO: 189232 - RNA, 64 nt, hsa
ggccauucccuguaggaguaaagauaaaaggauaggaaaagauucaaagcucuaauagagucac

SEQ ID NO: 189233 - RNA, 64 nt, hsa
ugugaggugauaggcaaggaugaaagacaaagaaggaaaagaguaucaaaggcagaaaggagau

SEQ ID NO: 189234 - RNA, 64 nt, hsa
uucuuucuuuacuccuuuggcuucaaaggauuuuggaaaagaaacaauaugcuuuacacucauu

SEQ ID NO: 189235 - RNA, 64 nt, hsa
uugccaggauggggcacagcagcucagguuugggggaaaagacccgaauccagagugcagggga

SEQ ID NO: 189236 - RNA, 64 nt, hsa
acagagggagcuucacugagacucagagggaaaaggaaaagagccucaaacauuuuuaggaggu

SEQ ID NO: 189237 - RNA, 64 nt, hsa
uaaaaacuugaaguuccucaggccuguaacuucuggaaaagaugauuauucaaaauaauguuuu

SEQ ID NO: 189238 - RNA, 64 nt, hsa
uaccaacugugaaagcuggcuuuaauuuuuaggaggaaaagaaaagccugcauguguucuuuau

SEQ ID NO: 189239 - RNA, 64 nt, hsa
ccuguccuucaaaagaguuugaaaugucauuuugggaaaagagagccagucaagcuaguaggcu

SEQ ID NO: 189240 - RNA, 64 nt, hsa
aagaaaugccagcuguuuaaucacaccuaccccuggaaaagagguaaaccuuuugaacaguuga

SEQ ID NO: 189241 - RNA, 64 nt, hsa
uaauuugguuuguggacugggcaugguggcuuauggaaaagaggugagccuuugugaagaacau

SEQ ID NO: 189242 - RNA, 64 nt, hsa
cuaagaacugguuuguuuaaagguuuaaauuguuggaaaagagcauuugccuucuuuaaugaau

SEQ ID NO: 189243 - RNA, 64 nt, hsa
ccuucuugagugauaccuauuacggaugaguucuggaaaagacccagcuaugauucauaaaaac

SEQ ID NO: 189244 - RNA, 64 nt, hsa
uuuucagaaaaacguggagugcuaggggcagccuggaaaagauggggaaccugcuagugaacua

SEQ ID NO: 189245 - RNA, 64 nt, hsa
ucugaggugggucugaaauucauacaugaagucaggaaaagaaaagaaacuuaguucuaccuug

SEQ ID NO: 189246 - RNA, 64 nt, hsa
uauucagcuaaaauaguacuucacaggaaauauaggaaaagaaacacuaguucaguuuuauucc

SEQ ID NO: 189247 - RNA, 64 nt, hsa
uuacaagaaaacucccugugggugcaaugagucuggaaaagaccauugagucuucuagaagaaa

SEQ ID NO: 189248 - RNA, 64 nt, hsa
aaguucuguucaucaaaugaugcuguuaagauagggaaaagacaagaaacaggacuggaagaag

SEQ ID NO: 189249 - RNA, 64 nt, hsa
aggaaagugucuaugauauauagugaaaagugugggaaaagaauauagaaauaauauucacuuc

SEQ ID NO: 189250 - RNA, 64 nt, hsa
gcccucuguuaauugugugucucaaauuuguucuggaaaagaaagggggaaagucuaugaacga

SEQ ID NO: 189251 - RNA, 64 nt, hsa
ucuguguuugguaaccccuauaaacuggggcagaggaaaagaaugaugguucaaggccauacuu

SEQ ID NO: 189252 - RNA, 64 nt, hsa
gggaagguagauaacuuuuaggaccuugaugugaggaaaagauaaaauuuaaacaauaaauuug

SEQ ID NO: 189253 - RNA, 64 nt, hsa
agaaaguuaaaaauguauaguaacugauugagggggaaaagaaugaucuuuauuaaugacaagg

SEQ ID NO: 189254 - RNA, 64 nt, hsa
uuucucagucauccuggcagccaaaaaugugccaggaaaagaaagaauguggagcacgcguggc

SEQ ID NO: 189255 - RNA, 64 nt, hsa
uagaacacgguuacagcugguucuguagaaagagggaaaagaugauugugacaauucagagcau

SEQ ID NO: 189256 - RNA, 64 nt, hsa
uucacugugcaaagccccaguagucggauuccggggaaaagaacaaguaucuaguuuugaugac

SEQ ID NO: 189257 - RNA, 64 nt, hsa
uuugaaauauauggucuaauguuuaagcagaauuggaaaagacuaagaucgguuaacaaauaac

SEQ ID NO: 189258 - RNA, 64 nt, hsa
ccuuacaaaugauugcuuuuaaaauuuuaagcuaggaaaagaaaucuauagaaaguguucuguu

SEQ ID NO: 189259 - RNA, 64 nt, hsa
ggcuucuggacacacauacccaugggugauuuuugcuccucaggcccaauauucucagacagcc

SEQ ID NO: 189260 - RNA, 64 nt, hsa
ggggaauugcaucugcaggaaagagaugcagcaugcuccucacuccugagugcccaccuguccu

SEQ ID NO: 189261 - RNA, 64 nt, hsa
gagagagagaaucagaccuggguggaacucuccugcuccucaggaacuaugggagccucagacu

SEQ ID NO: 189262 - RNA, 64 nt, hsa
accauuguucagaagaccucccugugagagaguugcuccucagggucccucaggaccaaagaac

SEQ ID NO: 189263 - RNA, 56 nt, hsa
uccggaccauucacugcuaagcacaggcuccucacucuucuccaucaggcauuaaa

SEQ ID NO: 189264 - RNA, 64 nt, hsa
uguuugggcuccaaacuaaccaucucggagcugggcuccucauuuacugccaaacccucagcuu

SEQ ID NO: 189265 - RNA, 64 nt, hsa
ucgauucugggaggagaggcugccgcauucugcugcuccucacagcgagcaaagcugcacccac

SEQ ID NO: 189266 - RNA, 64 nt, hsa
ugaaggagggcagaccacacgcccucucagccaggcuccucagcuuuguggcucugacuggugu

SEQ ID NO: 189267 - RNA, 64 nt, hsa
caccccggcgucucuggcccuuucuuauucuuuggcuccucauccaccgugaugagaagcgcug

SEQ ID NO: 189268 - RNA, 64 nt, hsa
ugaaaaagggaugggggaaauggagauggcacgggcuccucagagcgugguagccgacugugag

SEQ ID NO: 189269 - RNA, 64 nt, hsa
acgcauccacagcaguggcacccgcggcucaggggcuccucacagcccgggcuggugggagcca

SEQ ID NO: 189270 - RNA, 64 nt, hsa
gggaggaacuuggucugggaggaagagagaacucgcuccucaaccaccccagacacuggagugu

SEQ ID NO: 189271 - RNA, 64 nt, hsa
ccugccgauagcuauccccuguaugauguuggaugcuccucacaugcugaguuuccagccuuuu

SEQ ID NO: 189272 - RNA, 64 nt, hsa
uauuccuacaucccuuucucccuucccuccucuugcuccucaaguaagaggugcagagaugagg

SEQ ID NO: 189273 - RNA, 64 nt, hsa
cccucuguucucuccccucacauccuccugcccagcuccucacauacccacacauuccagggcu

SEQ ID NO: 189274 - RNA, 64 nt, hsa
ccccaggaucuggguuagguggccgcuccucccugcuccucaugggaagaugucucagagccuu

SEQ ID NO: 189275 - RNA, 64 nt, hsa
gcuacaagguagggaguucugagggaagccgcgugcuccucaggagagagcuguuuagguuuuc

SEQ ID NO: 189276 - RNA, 64 nt, hsa
gccuagcuccugcugagacccagguccuauggcagcuccucauuagauuaaaggagaccacuuc

SEQ ID NO: 189277 - RNA, 64 nt, hsa
uucggagagggcgccccgccgcgcagagaccagagcuccucagugccaguuuggccccuggguc

SEQ ID NO: 189278 - RNA, 64 nt, hsa
cuuaugcaaguuggggccaggauaggggaggggugcuccucaagaggaagaaaccgagaggccc

SEQ ID NO: 189279 - RNA, 64 nt, hsa
acaaagauucuccacuuggccaaacuuuagccaagcuccucaaccuucucccaggcccaaucug

SEQ ID NO: 189280 - RNA, 64 nt, hsa
cccccauaucuguucaaccucaguaucugaucaggcuccucagccuccaccaucccccagguga

SEQ ID NO: 189281 - RNA, 64 nt, hsa
uguguguucaugugugcccuguaugaauguggcuggcucccauauccccugggcugcccccugc

SEQ ID NO: 189282 - RNA, 64 nt, hsa
agggggcacgugcacuggucacgagaaaacccugggcucccacuggggcucagcccagccuccu

SEQ ID NO: 189283 - RNA, 64 nt, hsa
cugggaggugaggaagaagcuggcuagaggagggggcucccaccuaccuuuuauuuaagccagu

SEQ ID NO: 189284 - RNA, 64 nt, hsa
aggagacaaagccuaaguuuggggauuggaguggggcucccagucugaaagaucuaggaggaac

SEQ ID NO: 189285 - RNA, 64 nt, hsa
ccuucaguguugaccuaaguccucgccgggccauggcucccagccaagaaauaaguacacacua

SEQ ID NO: 189286 - RNA, 64 nt, hsa
accgaggcccucccaaagaggcccgcccugcccgggcucccacaccgucagguacuccugccag

SEQ ID NO: 189287 - RNA, 64 nt, hsa
ggccagcgccccucagccucugccacugugaaccggcucccacccucaaggugcggggagaaga

SEQ ID NO: 189288 - RNA, 64 nt, hsa
cucacuucccauacccagucuaggagcuccuucuggcucccaagcacccagagcuuuccuccgc

SEQ ID NO: 189289 - RNA, 64 nt, hsa
ugauggaguuccuucuggugucagccccacaggaggcucccaggccucccucacuucccauacc

SEQ ID NO: 189290 - RNA, 64 nt, hsa
gcccuuucuccccugcagacuggcaggugggauuggcucccaggucauuuccucucucucucuu

SEQ ID NO: 189291 - RNA, 64 nt, hsa
aagacaaggugaugagagauggggagaggccauuggcucccagagggaacagugcuggcugugg

SEQ ID NO: 189292 - RNA, 64 nt, hsa
accccugaacaauggaggccuuucuuucccgcuaggcucccagccuccuucccgcuacagaauc

SEQ ID NO: 189293 - RNA, 64 nt, hsa
cgcacaagccugcaacccccagagcucuuugacaggcucccaggccucccaguccuggacaagc

SEQ ID NO: 189294 - RNA, 64 nt, hsa
cucuggccuggcugccuggccguggcuucucuuuggcucccaaagagaaggacaguguugggag

SEQ ID NO: 189295 - RNA, 64 nt, hsa
acaguguugggaguaucugccguggcuucucuuuggcucccaaagagaaggacaguguugggag

SEQ ID NO: 189296 - RNA, 64 nt, hsa
acacacggaggccagacacaggccgugggacccaggcucccagccuaagggagacaggccuuuc

SEQ ID NO: 189297 - RNA, 64 nt, hsa
agucuguucucaaagcagaaguggaauccaguguggcucccacaggucuucacugcccaggggu

SEQ ID NO: 189298 - RNA, 64 nt, hsa
ggaagugaagcccgcuguguucauagcaggagagggcucccagacacaggcccguccucggaag

SEQ ID NO: 189299 - RNA, 64 nt, hsa
uuccgugagccacaaauaccagaaacugaggcgaggcucccagcagccgguagggaaagguguu

SEQ ID NO: 189300 - RNA, 64 nt, hsa
uugauuggauaaaugcuuauaggcugggccagguggcucccaccuguagucccagcacuuuggg

SEQ ID NO: 189301 - RNA, 64 nt, hsa
uugauacaaaugggaauucacucacuggaaucguggcucccaaaaagaugcuuuaauugugugg

SEQ ID NO: 189302 - RNA, 64 nt, hsa
cagcuccaaagcgaaucuuugaaaacacccacucggcucccaucucugucaccuagccaggagg

SEQ ID NO: 189303 - RNA, 64 nt, hsa
accuggcuggaguggccggagcggcggggcucauggcucccaucuuggccccuggaggugagcu

SEQ ID NO: 189304 - RNA, 64 nt, hsa
gaccucacuguacagagcugacuccccaaacccaggcucccauauguaccccaucccccauacu

SEQ ID NO: 189305 - RNA, 64 nt, hsa
ccugaaauggggcuucuguguuguccccagugaaggcucccacaaggaccugaugaccucacug

SEQ ID NO: 189306 - RNA, 64 nt, hsa
aagcaagagccagcccggcucccagugucugcccggcucccagugucugcccagcccucuccca

SEQ ID NO: 189307 - RNA, 64 nt, hsa
cccagggcucugggccugaagcaagagccagcccggcucccagugucugcccggcucccagugu

SEQ ID NO: 189308 - RNA, 64 nt, hsa
ugagguugugcugccuguggugagguccuguccuggcucccaggguccugggggcugcugcacu

SEQ ID NO: 189309 - RNA, 64 nt, hsa
gucccgggugccccccaugcccucccugcugccaggcucccacugccccugcaccugcuucuca

SEQ ID NO: 189310 - RNA, 64 nt, hsa
caauuaggcugcacuggggccgaacgcuucccugggcucccacugccuucuaaggagccaagga

SEQ ID NO: 189311 - RNA, 64 nt, hsa
ggaggaaggcgcgccgccccgagcuggagggccuggcucccaccaugccccccaguggcugcag

SEQ ID NO: 189312 - RNA, 64 nt, hsa
cucgguggugccuucucaaggcaguguuccuggaggcucccaucagggucagcccaugcaccug

SEQ ID NO: 189313 - RNA, 64 nt, hsa
acagccgccucugacgcauugacacgugagcacuggcucccacggagggugcgccugccgccag

SEQ ID NO: 189314 - RNA, 64 nt, hsa
ccucugccacugacugcagggacacgggcagccuggcucccaggacacgacuuguaaugaaagu

SEQ ID NO: 189315 - RNA, 64 nt, hsa
gggcacccucccacccggcugcauacccgggcagggcucccacagagacaaggagggcacaggu

SEQ ID NO: 189316 - RNA, 64 nt, hsa
gucacccauguugagccgcuccugauggcugacgggcucccagacccucaccucggacauggug

SEQ ID NO: 189317 - RNA, 64 nt, hsa
cucccugggcaggguggaugccacaggccccucuggcucccaggugcugcuucuccacaggugc

SEQ ID NO: 189318 - RNA, 64 nt, hsa
cgugggccaccuucccugcaaugggugcacacgcggcucccauccagcccucucagcguggggc

SEQ ID NO: 189319 - RNA, 64 nt, hsa
uagaggaugcucuuggccggcuggagcaagaccuggcucccaccagagggacgugugugugccu

SEQ ID NO: 189320 - RNA, 50 nt, hsa
aggaggaggccggcuacugaggcucccagcacgcucucuccccacaucgu

SEQ ID NO: 189321 - RNA, 64 nt, hsa
gaaaggggaccgggccgugauguuaaauaucuccggcucccaagugacuggauuugccuaggac

SEQ ID NO: 189322 - RNA, 64 nt, hsa
aggggaaauguggcucucuccaucuugcauacagggcucccaauagaaaugaacacagagauau

SEQ ID NO: 189323 - RNA, 64 nt, hsa
aaagaugucagaacaagacuccccaucaugauaaggcucccaccccucuuaaccguccuugcuc

SEQ ID NO: 189324 - RNA, 62 nt, hsa
gcuacaagugacgacaaagauucuguuucaaauauagccacagaaauaaaggagggaccaau

SEQ ID NO: 189325 - RNA, 62 nt, hsa
gcuacaagugacgagaaagauucuguuucaaauauagccacagaaauaaagaagggacaaca

SEQ ID NO: 189326 - RNA, 62 nt, hsa
gcuacaacugacgaggaagacucuguuucgaauauagccacagaaauaaaggauggagaaaa

SEQ ID NO: 189327 - RNA, 62 nt, hsa
gcuacaagugacgaggaagguucuguuuugaguauagccagagaaaacaaggauggagaaaa

SEQ ID NO: 189328 - RNA, 62 nt, hsa
gguacaagugacgaggaagauucuguuuuggguauagccagagaaaacaaggauggagaaaa

SEQ ID NO: 189329 - RNA, 62 nt, hsa
gcuacaagugaugagaaagauucuguuuugaauauagccagaggaaaaaaggauggagaaaa

SEQ ID NO: 189330 - RNA, 62 nt, hsa
gaacguauuguuguauuccuccaguguuaagcuauagccauguuaaaagucacugugcauuu

SEQ ID NO: 189331 - RNA, 62 nt, hsa
cggagaguucacgaacugugcccaacgcauguuauagccaggguccuacuaacuacucagua

SEQ ID NO: 189332 - RNA, 62 nt, hsa
uugcuaaugaaaauacaauacauauaaaaauguauagccauguuauuuucuaguauaaauuc

SEQ ID NO: 189333 - RNA, 62 nt, hsa
uguuuguuguaaaugguuucaaaaauacaaauuauagccaaucaaaacauugcuuugguugg

SEQ ID NO: 189334 - RNA, 62 nt, hsa
uauuuuuucaaguaauaccaguacuguuuaacuauagccagaacuggcuaaaauuuuuauau

SEQ ID NO: 189335 - RNA, 62 nt, hsa
aaugcacagauaaauagaaguacagugaggucuauagccauuuuauuaaaauagcuuaaaag

SEQ ID NO: 189336 - RNA, 64 nt, hsa
agaaaacuggaucaagauucuagcccacuggaguugcaaggaaugagaggcaaaaauucuaaag

SEQ ID NO: 189337 - RNA, 64 nt, hsa
aaauuaagaggggccaagaggaagacauucuuucugcaaggaaauuucuuuuaaauucugaacu

SEQ ID NO: 189338 - RNA, 64 nt, hsa
gaaaauaacugugccccaagaagugcuccagauuugcaaggaauagccccaagagaauaccaag

SEQ ID NO: 189339 - RNA, 64 nt, hsa
aagacaagcaggcuguucccuggaaaaaaucuaaugcaaggagggcuaguucacagcaaauuca

SEQ ID NO: 189340 - RNA, 64 nt, hsa
cccagguuccccucuggugucaugucaggcauuuugcaaggaaaagccacuuggggaaagaugg

SEQ ID NO: 189341 - RNA, 63 nt, hsa
auuuccauuggcccucgggugagcugaggguuuuugcaaggaaguugugguggccaagugugg

SEQ ID NO: 189342 - RNA, 64 nt, hsa
gacucauuuugaauugaguuucaaacuuugaaagugcaaggauuuaauuuuuaaguugaauccc

SEQ ID NO: 189343 - RNA, 64 nt, hsa
cuuuuauuuuugugaaauucuagagcugcucugcugcaaggauuuccugccuucagacugaaga

SEQ ID NO: 189344 - RNA, 64 nt, hsa
aaauaagcaauaagaggcucuaagcugacugaguugcaaggacccuuuccgcccucccuuggau

SEQ ID NO: 189345 - RNA, 64 nt, hsa
agucugcuuuucagggauucucugcuggugcuggugcaaggacuucuguuccaaaggcugggaa

SEQ ID NO: 189346 - RNA, 64 nt, hsa
ugaagcaggguggggcguaaccucaccugggaagugcaaggagucggggaucucccuccccuag

SEQ ID NO: 189347 - RNA, 64 nt, hsa
cuccucugagcuaaaggagcauguucuaacccaaugcaaggaagcuaagaaccuugaaaaaagg

SEQ ID NO: 189348 - RNA, 64 nt, hsa
uuaccucauagaugugggcucuguuuggggaagaugcaaggaaguaaugagaagcccaggaaau

SEQ ID NO: 189349 - RNA, 64 nt, hsa
uccagcccaaugccccagcuggccuuccccagccugcaaggagccuguagcauggcaaaucugc

SEQ ID NO: 189350 - RNA, 64 nt, hsa; identical to SEQ ID NO: 154084

SEQ ID NO: 189351 - RNA, 64 nt, hsa; identical to SEQ ID NO: 154085

SEQ ID NO: 189352 - RNA, 64 nt, hsa; identical to SEQ ID NO: 154086

SEQ ID NO: 189353 - RNA, 64 nt, hsa; identical to SEQ ID NO: 154087

SEQ ID NO: 189354 - RNA, 64 nt, hsa; identical to SEQ ID NO: 154088

SEQ ID NO: 189355 - RNA, 64 nt, hsa; identical to SEQ ID NO: 154089

SEQ ID NO: 189356 - RNA, 64 nt, hsa; identical to SEQ ID NO: 154090

SEQ ID NO: 189357 - RNA, 64 nt, hsa; identical to SEQ ID NO: 154091

SEQ ID NO: 189358 - RNA, 64 nt, hsa; identical to SEQ ID NO: 154092

SEQ ID NO: 189359 - RNA, 64 nt, hsa; identical to SEQ ID NO: 154093

SEQ ID NO: 189360 - RNA, 64 nt, hsa; identical to SEQ ID NO: 154094

SEQ ID NO: 189361 - RNA, 64 nt, hsa; identical to SEQ ID NO: 154095

SEQ ID NO: 189362 - RNA, 64 nt, hsa; identical to SEQ ID NO: 154096

SEQ ID NO: 189363 - RNA, 64 nt, hsa; identical to SEQ ID NO: 154097

SEQ ID NO: 189364 - RNA, 64 nt, hsa; identical to SEQ ID NO: 154098

SEQ ID NO: 189365 - RNA, 64 nt, hsa; identical to SEQ ID NO: 154099

SEQ ID NO: 189366 - RNA, 64 nt, hsa; identical to SEQ ID NO: 154100

SEQ ID NO: 189367 - RNA, 64 nt, hsa; identical to SEQ ID NO: 154101

SEQ ID NO: 189368 - RNA, 64 nt, hsa; identical to SEQ ID NO: 154102

SEQ ID NO: 189369 - RNA, 64 nt, hsa; identical to SEQ ID NO: 154103

SEQ ID NO: 189370 - RNA, 64 nt, hsa; identical to SEQ ID NO: 154104

SEQ ID NO: 189371 - RNA, 64 nt, hsa; identical to SEQ ID NO: 154105

SEQ ID NO: 189372 - RNA, 64 nt, hsa; identical to SEQ ID NO: 154106

SEQ ID NO: 189373 - RNA, 64 nt, hsa; identical to SEQ ID NO: 154107

SEQ ID NO: 189374 - RNA, 51 nt, hsa; identical to SEQ ID NO: 154108

SEQ ID NO: 189375 - RNA, 64 nt, hsa; identical to SEQ ID NO: 154109

SEQ ID NO: 189376 - RNA, 64 nt, hsa; identical to SEQ ID NO: 154110

SEQ ID NO: 189377 - RNA, 64 nt, hsa; identical to SEQ ID NO: 154111

SEQ ID NO: 189378 - RNA, 64 nt, hsa; identical to SEQ ID NO: 154112

SEQ ID NO: 189379 - RNA, 64 nt, hsa; identical to SEQ ID NO: 154113

SEQ ID NO: 189380 - RNA, 64 nt, hsa; identical to SEQ ID NO: 154114

SEQ ID NO: 189381 - RNA, 64 nt, hsa; identical to SEQ ID NO: 154115

SEQ ID NO: 189382 - RNA, 64 nt, hsa; identical to SEQ ID NO: 154116

SEQ ID NO: 189383 - RNA, 64 nt, hsa; identical to SEQ ID NO: 154117

SEQ ID NO: 189384 - RNA, 64 nt, hsa; identical to SEQ ID NO: 154118

SEQ ID NO: 189385 - RNA, 64 nt, hsa; identical to SEQ ID NO: 154118

SEQ ID NO: 189386 - RNA, 64 nt, hsa; identical to SEQ ID NO: 154120

SEQ ID NO: 189387 - RNA, 64 nt, hsa; identical to SEQ ID NO: 154121

SEQ ID NO: 189388 - RNA, 64 nt, hsa; identical to SEQ ID NO: 154122

SEQ ID NO: 189389 - RNA, 64 nt, hsa; identical to SEQ ID NO: 154123

SEQ ID NO: 189390 - RNA, 64 nt, hsa; identical to SEQ ID NO: 154124

SEQ ID NO: 189391 - RNA, 64 nt, hsa; identical to SEQ ID NO: 154125

SEQ ID NO: 189392 - RNA, 64 nt, hsa; identical to SEQ ID NO: 154126

SEQ ID NO: 189393 - RNA, 64 nt, hsa; identical to SEQ ID NO: 154127

SEQ ID NO: 189394 - RNA, 64 nt, hsa; identical to SEQ ID NO: 154128

SEQ ID NO: 189395 - RNA, 64 nt, hsa; identical to SEQ ID NO: 154129

SEQ ID NO: 189396 - RNA, 64 nt, hsa; identical to SEQ ID NO: 154130

SEQ ID NO: 189397 - RNA, 64 nt, hsa; identical to SEQ ID NO: 154131

SEQ ID NO: 189398 - RNA, 64 nt, hsa; identical to SEQ ID NO: 154132

SEQ ID NO: 189399 - RNA, 64 nt, hsa; identical to SEQ ID NO: 154133

SEQ ID NO: 189400 - RNA, 64 nt, hsa; identical to SEQ ID NO: 154134

SEQ ID NO: 189401 - RNA, 57 nt, hsa; identical to SEQ ID NO: 154135

SEQ ID NO: 189402 - RNA, 64 nt, hsa; identical to SEQ ID NO: 154136

SEQ ID NO: 189403 - RNA, 64 nt, hsa; identical to SEQ ID NO: 154137

SEQ ID NO: 189404 - RNA, 64 nt, hsa; identical to SEQ ID NO: 154138

SEQ ID NO: 189405 - RNA, 64 nt, hsa; identical to SEQ ID NO: 154139

SEQ ID NO: 189406 - RNA, 64 nt, hsa; identical to SEQ ID NO: 154140

SEQ ID NO: 189407 - RNA, 64 nt, hsa; identical to SEQ ID NO: 154141

SEQ ID NO: 189408 - RNA, 64 nt, hsa; identical to SEQ ID NO: 154142

SEQ ID NO: 189409 - RNA, 64 nt, hsa; identical to SEQ ID NO: 154143

SEQ ID NO: 189410 - RNA, 64 nt, hsa; identical to SEQ ID NO: 154144

SEQ ID NO: 189411 - RNA, 64 nt, hsa; identical to SEQ ID NO: 154145

SEQ ID NO: 189412 - RNA, 64 nt, hsa; identical to SEQ ID NO: 154146

SEQ ID NO: 189413 - RNA, 64 nt, hsa; identical to SEQ ID NO: 154147

SEQ ID NO: 189414 - RNA, 64 nt, hsa; identical to SEQ ID NO: 154148

SEQ ID NO: 189415 - RNA, 64 nt, hsa; identical to SEQ ID NO: 154149

SEQ ID NO: 189416 - RNA, 64 nt, hsa; identical to SEQ ID NO: 154150

SEQ ID NO: 189417 - RNA, 64 nt, hsa; identical to SEQ ID NO: 154151

SEQ ID NO: 189418 - RNA, 64 nt, hsa; identical to SEQ ID NO: 154152

SEQ ID NO: 189419 - RNA, 64 nt, hsa; identical to SEQ ID NO: 154153

SEQ ID NO: 189420 - RNA, 64 nt, hsa; identical to SEQ ID NO: 154154

SEQ ID NO: 189421 - RNA, 64 nt, hsa; identical to SEQ ID NO: 154155

SEQ ID NO: 189422 - RNA, 64 nt, hsa; identical to SEQ ID NO: 154156

SEQ ID NO: 189423 - RNA, 64 nt, hsa; identical to SEQ ID NO: 154157

SEQ ID NO: 189424 - RNA, 64 nt, hsa; identical to SEQ ID NO: 154158

SEQ ID NO: 189425 - RNA, 64 nt, hsa; identical to SEQ ID NO: 154159

SEQ ID NO: 189426 - RNA, 64 nt, hsa; identical to SEQ ID NO: 154160

SEQ ID NO: 189427 - RNA, 64 nt, hsa; identical to SEQ ID NO: 154161

SEQ ID NO: 189428 - RNA, 64 nt, hsa; identical to SEQ ID NO: 154162

SEQ ID NO: 189429 - RNA, 64 nt, hsa; identical to SEQ ID NO: 154163

SEQ ID NO: 189430 - RNA, 64 nt, hsa; identical to SEQ ID NO: 154164

SEQ ID NO: 189431 - RNA, 63 nt, hsa; identical to SEQ ID NO: 154165

SEQ ID NO: 189432 - RNA, 64 nt, hsa; identical to SEQ ID NO: 154166

SEQ ID NO: 189433 - RNA, 50 nt, hsa; identical to SEQ ID NO: 154167

SEQ ID NO: 189434 - RNA, 64 nt, hsa; identical to SEQ ID NO: 154168

SEQ ID NO: 189435 - RNA, 64 nt, hsa; identical to SEQ ID NO: 154169

SEQ ID NO: 189436 - RNA, 64 nt, hsa; identical to SEQ ID NO: 154170

SEQ ID NO: 189437 - RNA, 64 nt, hsa; identical to SEQ ID NO: 154171

SEQ ID NO: 189438 - RNA, 64 nt, hsa; identical to SEQ ID NO: 154172

SEQ ID NO: 189439 - RNA, 64 nt, hsa; identical to SEQ ID NO: 154173

SEQ ID NO: 189440 - RNA, 64 nt, hsa; identical to SEQ ID NO: 154174

SEQ ID NO: 189441 - RNA, 64 nt, hsa; identical to SEQ ID NO: 154175

SEQ ID NO: 189442 - RNA, 64 nt, hsa; identical to SEQ ID NO: 154176

SEQ ID NO: 189443 - RNA, 64 nt, hsa; identical to SEQ ID NO: 154177

SEQ ID NO: 189444 - RNA, 64 nt, hsa; identical to SEQ ID NO: 154178

SEQ ID NO: 189445 - RNA, 64 nt, hsa; identical to SEQ ID NO: 154179

SEQ ID NO: 189446 - RNA, 64 nt, hsa; identical to SEQ ID NO: 154180

SEQ ID NO: 189447 - RNA, 64 nt, hsa; identical to SEQ ID NO: 154181

SEQ ID NO: 189448 - RNA, 64 nt, hsa; identical to SEQ ID NO: 154182

SEQ ID NO: 189449 - RNA, 64 nt, hsa; identical to SEQ ID NO: 154183

SEQ ID NO: 189450 - RNA, 64 nt, hsa; identical to SEQ ID NO: 154184

SEQ ID NO: 189451 - RNA, 64 nt, hsa; identical to SEQ ID NO: 154185

SEQ ID NO: 189452 - RNA, 64 nt, hsa; identical to SEQ ID NO: 154186

SEQ ID NO: 189453 - RNA, 64 nt, hsa; identical to SEQ ID NO: 154187

SEQ ID NO: 189454 - RNA, 64 nt, hsa; identical to SEQ ID NO: 154188

SEQ ID NO: 189455 - RNA, 64 nt, hsa; identical to SEQ ID NO: 154189

SEQ ID NO: 189456 - RNA, 64 nt, hsa; identical to SEQ ID NO: 154190

SEQ ID NO: 189457 - RNA, 64 nt, hsa; identical to SEQ ID NO: 154191

SEQ ID NO: 189458 - RNA, 64 nt, hsa; identical to SEQ ID NO: 154192

SEQ ID NO: 189459 - RNA, 64 nt, hsa; identical to SEQ ID NO: 154193

SEQ ID NO: 189460 - RNA, 64 nt, hsa; identical to SEQ ID NO: 154194

SEQ ID NO: 189461 - RNA, 64 nt, hsa; identical to SEQ ID NO: 154195

SEQ ID NO: 189462 - RNA, 64 nt, hsa; identical to SEQ ID NO: 154196

SEQ ID NO: 189463 - RNA, 64 nt, hsa; identical to SEQ ID NO: 154197

SEQ ID NO: 189464 - RNA, 64 nt, hsa; identical to SEQ ID NO: 154198

SEQ ID NO: 189465 - RNA, 64 nt, hsa; identical to SEQ ID NO: 154199

SEQ ID NO: 189466 - RNA, 64 nt, hsa; identical to SEQ ID NO: 154200

SEQ ID NO: 189467 - RNA, 64 nt, hsa; identical to SEQ ID NO: 154201

SEQ ID NO: 189468 - RNA, 64 nt, hsa; identical to SEQ ID NO: 154202

SEQ ID NO: 189469 - RNA, 64 nt, hsa; identical to SEQ ID NO: 154203

SEQ ID NO: 189470 - RNA, 64 nt, hsa; identical to SEQ ID NO: 154204

SEQ ID NO: 189471 - RNA, 64 nt, hsa; identical to SEQ ID NO: 154205

SEQ ID NO: 189472 - RNA, 64 nt, hsa; identical to SEQ ID NO: 154206

SEQ ID NO: 189473 - RNA, 64 nt, hsa; identical to SEQ ID NO: 154207

SEQ ID NO: 189474 - RNA, 59 nt, hsa; identical to SEQ ID NO: 154208

SEQ ID NO: 189475 - RNA, 64 nt, hsa; identical to SEQ ID NO: 154209

SEQ ID NO: 189476 - RNA, 64 nt, hsa; identical to SEQ ID NO: 154210

SEQ ID NO: 189477 - RNA, 64 nt, hsa; identical to SEQ ID NO: 154211

SEQ ID NO: 189478 - RNA, 64 nt, hsa; identical to SEQ ID NO: 154212

SEQ ID NO: 189479 - RNA, 64 nt, hsa; identical to SEQ ID NO: 154213

SEQ ID NO: 189480 - RNA, 64 nt, hsa; identical to SEQ ID NO: 154214

SEQ ID NO: 189481 - RNA, 64 nt, hsa; identical to SEQ ID NO: 154215

SEQ ID NO: 189482 - RNA, 64 nt, hsa; identical to SEQ ID NO: 154216

SEQ ID NO: 189483 - RNA, 64 nt, hsa; identical to SEQ ID NO: 154217

SEQ ID NO: 189484 - RNA, 64 nt, hsa; identical to SEQ ID NO: 154218

SEQ ID NO: 189485 - RNA, 64 nt, hsa; identical to SEQ ID NO: 154219

SEQ ID NO: 189486 - RNA, 64 nt, hsa; identical to SEQ ID NO: 154220

SEQ ID NO: 189487 - RNA, 61 nt, hsa; identical to SEQ ID NO: 154221

SEQ ID NO: 189488 - RNA, 64 nt, hsa; identical to SEQ ID NO: 154222

SEQ ID NO: 189489 - RNA, 64 nt, hsa; identical to SEQ ID NO: 154223

SEQ ID NO: 189490 - RNA, 64 nt, hsa; identical to SEQ ID NO: 154224

SEQ ID NO: 189491 - RNA, 64 nt, hsa; identical to SEQ ID NO: 154225

SEQ ID NO: 189492 - RNA, 64 nt, hsa; identical to SEQ ID NO: 154226

SEQ ID NO: 189493 - RNA, 64 nt, hsa; identical to SEQ ID NO: 154227

SEQ ID NO: 189494 - RNA, 64 nt, hsa; identical to SEQ ID NO: 154228

SEQ ID NO: 189495 - RNA, 64 nt, hsa; identical to SEQ ID NO: 154229

SEQ ID NO: 189496 - RNA, 64 nt, hsa; identical to SEQ ID NO: 154230

SEQ ID NO: 189497 - RNA, 64 nt, hsa; identical to SEQ ID NO: 154231

SEQ ID NO: 189498 - RNA, 64 nt, hsa; identical to SEQ ID NO: 154232

SEQ ID NO: 189499 - RNA, 64 nt, hsa; identical to SEQ ID NO: 154233

SEQ ID NO: 189500 - RNA, 64 nt, hsa; identical to SEQ ID NO: 154234

SEQ ID NO: 189501 - RNA, 64 nt, hsa; identical to SEQ ID NO: 154235

SEQ ID NO: 189502 - RNA, 64 nt, hsa; identical to SEQ ID NO: 154236

SEQ ID NO: 189503 - RNA, 64 nt, hsa; identical to SEQ ID NO: 154237

SEQ ID NO: 189504 - RNA, 62 nt, hsa; identical to SEQ ID NO: 154238

SEQ ID NO: 189505 - RNA, 64 nt, hsa; identical to SEQ ID NO: 154239

SEQ ID NO: 189506 - RNA, 62 nt, hsa; identical to SEQ ID NO: 154240

SEQ ID NO: 189507 - RNA, 64 nt, hsa; identical to SEQ ID NO: 154241

SEQ ID NO: 189508 - RNA, 64 nt, hsa; identical to SEQ ID NO: 154242

SEQ ID NO: 189509 - RNA, 64 nt, hsa; identical to SEQ ID NO: 154243

SEQ ID NO: 189510 - RNA, 64 nt, hsa; identical to SEQ ID NO: 154244

SEQ ID NO: 189511 - RNA, 64 nt, hsa; identical to SEQ ID NO: 154245

SEQ ID NO: 189512 - RNA, 64 nt, hsa; identical to SEQ ID NO: 154246

SEQ ID NO: 189513 - RNA, 64 nt, hsa; identical to SEQ ID NO: 154247

SEQ ID NO: 189514 - RNA, 64 nt, hsa; identical to SEQ ID NO: 154248

SEQ ID NO: 189515 - RNA, 64 nt, hsa; identical to SEQ ID NO: 154249

SEQ ID NO: 189516 - RNA, 64 nt, hsa
cagcagugccuucccuuuaugaaagacaucacauggcauccagggccaggcaggcagcuugagg

SEQ ID NO: 189517 - RNA, 64 nt, hsa
cuuagggcccuuaaagaagaaaaucuccccagaaggcauccaucauguugcuuaauugucuucu

SEQ ID NO: 189518 - RNA, 64 nt, hsa
ccucuuaagggacucuaauauaugcuaacgcugguccucuuagcucugugcucucaccagacaa

SEQ ID NO: 189519 - RNA, 64 nt, hsa
uuucuuuuucauuuugugaaaaacuccauguuaguccucuuagaugacugcuuauuuaugugua

SEQ ID NO: 189520 - RNA, 64 nt, hsa
gaguuuuaauagauucuguccaaaagggguuuguuccucuuauuuccucuauguaggaaguugu

SEQ ID NO: 189521 - RNA, 64 nt, hsa
ccuuaaaugcaauacagccucugauuauugagcuuccucuuaaaaagauuuuuuuauuuuaugu

SEQ ID NO: 189522 - RNA, 64 nt, hsa
gauaaauuguaucauauuuaaguuccacugcuguuccucuuaccuugauuaaaugccuaugcau

SEQ ID NO: 189523 - RNA, 64 nt, hsa
cauuucuuuaucaaggaugguauuuagauuuuuuuccucuuaaccuuuuuucaaaaacuauuuu

SEQ ID NO: 189524 - RNA, 64 nt, hsa
aauuaaaaaaaaaauaauauaauaauaauucuuguccucuuauuuuacacucauaaugagaaau

SEQ ID NO: 189525 - RNA, 64 nt, hsa
agggccacauguagacagcuaggccagugcuuuuuccucuuaggguuucuuugcagaaagaaac

SEQ ID NO: 189526 - RNA, 64 nt, hsa
gaaaaagcccucuucaauccccauaaugcuucuuuccucuuaaugucucaaaauaaaaccagaa

SEQ ID NO: 189527 - RNA, 64 nt, hsa
cugacaccuuuucagguuggagugcauucauucauccucuuauaugugccccuuccccaugcuc

SEQ ID NO: 189528 - RNA, 64 nt, hsa
gaauuauuacaugagacuggcagauagcuauuaauccucuuacagauuugagaaaguugauucu

SEQ ID NO: 189529 - RNA, 64 nt, hsa
ugcaccuucuccuucauuguuuucuuuaaaucuguccucuuaaaaagcuucuuaagagcucagu

SEQ ID NO: 189530 - RNA, 64 nt, hsa
guaacaaauagacagcaagaaagguuuugcaccauccucuuacggccuagagaguugacaaguu

SEQ ID NO: 189531 - RNA, 64 nt, hsa
aggaggcccccgagcuggcuguucuaacuuagaaggaagagaagacuggaugggccugcuuggg

SEQ ID NO: 189532 - RNA, 64 nt, hsa
gaguaacuauuuccuaaaguauucuaaaagaguaggaagagagaaaugguagccugcugcuucu

SEQ ID NO: 189533 - RNA, 64 nt, hsa
ucgaaggacucauuacaacaaacagggaaguaaaggaagagacacauccucucauacucccuga

SEQ ID NO: 189534 - RNA, 64 nt, hsa
acucccugagacucugagaacaguggacgcagagggaagagaugaucauuggaagcaaucaguu

SEQ ID NO: 189535 - RNA, 64 nt, hsa
uacccaaagcccugccaauucucagugugguagaggaagagaagcaugucugaguuggauggga

SEQ ID NO: 189536 - RNA, 64 nt, hsa
agagguaaugcaccccugaaggauaugaggggauggaagagagggcuggcugcccaagggaaug

SEQ ID NO: 189537 - RNA, 64 nt, hsa
uuuaaagaacuucaacauaguuucggaauuguggggaagagaagagugacugagcugagaagua

SEQ ID NO: 189538 - RNA, 64 nt, hsa
gaagccuuaucucagucuauuuggaagagagggaggaagagaaggaaguaacccaaaguacuac

SEQ ID NO: 189539 - RNA, 64 nt, hsa
ccaugguucugagaagccuuaucucagucuauuuggaagagagggaggaagagaaggaaguaac

SEQ ID NO: 189540 - RNA, 64 nt, hsa
augaauugaggaagugaaagaaggcaaggagguaggaagagagggaggaggaaaggaaggagag

SEQ ID NO: 189541 - RNA, 64 nt, hsa
aaaggagaaaagggaaaagcagaaaggaaaaaaaggaagagagaggaagggagaagggagagga

SEQ ID NO: 189542 - RNA, 64 nt, hsa
cggauggugaccuauaaccauuaauguugaaaauggaagagacuugcuuccaaaagauuaaaag

SEQ ID NO: 189543 - RNA, 64 nt, hsa
agcauaaauuaaaagguccaagggaauuuaaucuggaagagaacauaugccaauuuuuaaacua

SEQ ID NO: 189544 - RNA, 64 nt, hsa
auagcagacauccuuuugaacacuaaugaugccaggaagagaguaaggcuagaggaggagacuc

SEQ ID NO: 189545 - RNA, 64 nt, hsa
ucccacaaggaaaaagugaugccaguaaagugggggaagagaugguaaauaauucuagaaugag

SEQ ID NO: 189546 - RNA, 64 nt, hsa
ccugacccaccuggcaaagcagggcacauggggaggaagagacuggaaccuuucuuugacagcc

SEQ ID NO: 189547 - RNA, 64 nt, hsa
gaugaacagagaagggaagagaggaagaacgagaggaagagaagggaaggaaguguuuguguag

SEQ ID NO: 189548 - RNA, 64 nt, hsa
uuucuuuuugaggcaaguuggaugaacagagaagggaagagaggaagaacgagaggaagagaag

SEQ ID NO: 189549 - RNA, 64 nt, hsa
auauaaaauauauauguggaguuuugugggauggggaagagauuuuaguuguuauuuaacuuga

SEQ ID NO: 189550 - RNA, 64 nt, hsa
cccggcagccagcgagguacaccagguggugcuuggaagagaugaaagaucuucauggcuguuu

SEQ ID NO: 189551 - RNA, 64 nt, hsa
accgauaugagaauggggaaaugaaaccaggaagggaagagagcuaguaugggguauguuaaug

SEQ ID NO: 189552 - RNA, 64 nt, hsa
agagagagagaagggaggaugagaacgaauggggggaagagauaaacuuuaugcauaacauuag

SEQ ID NO: 189553 - RNA, 64 nt, hsa
uagaaucccagucaccuuuauauaucauauuauuggaagagauucaucuucauaaucuccaguu

SEQ ID NO: 189554 - RNA, 64 nt, hsa
gaaucacaauuaccuuuauauaucauauguuauuggaagagauuccucaguaaucuccaaucuc

SEQ ID NO: 189555 - RNA, 64 nt, hsa
cucucugaaagcagaaaaaggcacugauauaaagggaagagaaggaggcucaccggagggaaga

SEQ ID NO: 189556 - RNA, 64 nt, hsa
ugauauaaagggaagagaaggaggcucaccggagggaagagaacauagugaagauucccgccuu

SEQ ID NO: 189557 - RNA, 64 nt, hsa
gcaucuccugaggacuugcuucuccugccucuggggaagagagggaagagaaagcacagagcag

SEQ ID NO: 189558 - RNA, 64 nt, hsa
gaggacuugcuucuccugccucuggggaagagagggaagagaaagcacagagcagagaagcaga

SEQ ID NO: 189559 - RNA, 64 nt, hsa
ucuaaaucauuagggcagcaguuucucugguaacggaagagaccguccgccagaucugcaggcu

SEQ ID NO: 189560 - RNA, 53 nt, hsa
aucugaucugccuccuuuaguuuggaagagacaaugccauuuucucccuugag

SEQ ID NO: 189561 - RNA, 64 nt, hsa
aaaugcaaaugaacuagacaugccaacagcuuggggaagagaauuccauacugaaagaagagca

SEQ ID NO: 189562 - RNA, 64 nt, hsa
gcaaacuauacacggucguccaucaaaauccuggggaagagaauaacucauuuaauauucugac

SEQ ID NO: 189563 - RNA, 63 nt, hsa
gcccucagagugcucuguaggagcuguagacugggaagagaggccaggcgugguggcucacuc

SEQ ID NO: 189564 - RNA, 64 nt, hsa
cuagacccugucucaaaaaaaaaaaaaaagacugggaagagagcuagagggacuaggagauaau

SEQ ID NO: 189565 - RNA, 64 nt, hsa
cauugcuugucuuugagaaauugacugacauacuggaagagaacaccauuuuaucucagguuag

SEQ ID NO: 189566 - RNA, 64 nt, hsa
aucuuguguacagcccacacccugguguacggugggaagagauuccucagcccuucaaaucuca

SEQ ID NO: 189567 - RNA, 64 nt, hsa
ccuauggguuuaagcagagggcuacagaaaacagggaagagacauaccccugggcuuggauucc

SEQ ID NO: 189568 - RNA, 64 nt, hsa
accugcccaggauuuaguaagggaaagucaaucaggaagagaauggaaaacuuauacagcuuca

SEQ ID NO: 189569 - RNA, 64 nt, hsa
ucccucucugugcucaaggaguuccauuccaggaggaagagaucuauacccuaagcagauagca

SEQ ID NO: 189570 - RNA, 64 nt, hsa
ggacguugcuguacugucuuguuuaguguagaagggaagagaauuggugcugcagaaguguacc

SEQ ID NO: 189571 - RNA, 64 nt, hsa
uucucauugugggaaucugacauaguucagcugaggaagagaaucagcugauccucauggucug

SEQ ID NO: 189572 - RNA, 64 nt, hsa
cuauauugaaaaucauuuacauuggccuauauuuggaagagagauagucuuuuguuuuuaauaa

SEQ ID NO: 189573 - RNA, 64 nt, hsa
agcagacaugauggggagagccuucuaauaagagggaagagacugcuuggaagcaugaagggag

SEQ ID NO: 189574 - RNA, 64 nt, hsa
ggcuagaugaccaucacacagcaaaggagggaguggaagagagaugagaaaauugagagcuauu

SEQ ID NO: 189575 - RNA, 64 nt, hsa
aagccacugcgcccagccacugccaucaucuuuaggaagagagaagugaccaugccugaaccag

SEQ ID NO: 189576 - RNA, 64 nt, hsa
uaacauucaugauuagggucucagaagguaaggaggaagagaguggaauggaaaaaguauucaa

SEQ ID NO: 189577 - RNA, 64 nt, hsa
aaaaacaauuccaaaugugaaacuagaaugagagggaagagauagcauggcaugcagcacacac

SEQ ID NO: 189578 - RNA, 64 nt, hsa
ucgugacaauguacgccuuucccucagaauucagggaagagacugucgccugccuuccuccguu

SEQ ID NO: 189579 - RNA, 64 nt, hsa
gguguuuuuuaaagcaaugugaguccacugaggaggaagagacccugggauuucacccucuggg

SEQ ID NO: 189580 - RNA, 64 nt, hsa
caagccccaacaggccccugucauuccacuucauggaagagacggagccuucugaaaugagauc

SEQ ID NO: 189581 - RNA, 64 nt, hsa
caggcuucuauccugcuaacccaguaacccagugggaagagauuuacuuauuccaauaauucca

SEQ ID NO: 189582 - RNA, 64 nt, hsa
gugcaugcuaggaugauggggcuugaugcaguagggaagagacgauguaaaaauaauaaacaau

SEQ ID NO: 189583 - RNA, 64 nt, hsa
ggaagagaaugcccaaaggaacguuuauuuccgaggaagagaaugcugagccaggguuuaaguc

SEQ ID NO: 189584 - RNA, 64 nt, hsa
ggugucuuuaacguagaugagacgagacuugauuggaagagaaugcccaaaggaacguuuauuu

SEQ ID NO: 189585 - RNA, 64 nt, hsa
ggauggaaagggagggaaagacaagaugcaacuaggaagagacacaccugaccagccccucccc

SEQ ID NO: 189586 - RNA, 64 nt, hsa
ugguagucagaggagggaggaggaauaaggggaaggaagagagagggagcaggcggagcgagag

SEQ ID NO: 189587 - RNA, 64 nt, hsa
gaaagggcagaggaagagacaugagaaagggagaggaagagaagcccagcucugggaacugaau

SEQ ID NO: 189588 - RNA, 64 nt, hsa
gaagaggaagagugagggauggagaaagggcagaggaagagacaugagaaagggagaggaagag

SEQ ID NO: 189589 - RNA, 64 nt, hsa
uauauuauuauauguuaagagaaaaagguggaaaggaagagaagccacauacuauaaagaucua

SEQ ID NO: 189590 - RNA, 64 nt, hsa
uuuaagugggagaagggugggcaguuaucacuggggaagagaggaccggccaccuguccagcau

SEQ ID NO: 189591 - RNA, 64 nt, hsa
uacuaagagaauaucucuuggugucauaucuaggggaagagaauuaacuagaauuaaauuuaau

SEQ ID NO: 189592 - RNA, 64 nt, hsa
uccaaaggaagucaaggaagaaaaagcauggaaaggaagagaacugauuccuacugaaaauuca

SEQ ID NO: 189593 - RNA, 64 nt, hsa
gcgagggcaccagcaguuguggguggggagcaagggaagagagaaacucuucagcgaauccuuc

SEQ ID NO: 189594 - RNA, 64 nt, hsa
gccuuuugacugaguggcagaaggaaacugcucaggaagagaaacaggugacugaugggaaggu

SEQ ID NO: 189595 - RNA, 64 nt, hsa
uggggagugagaugaguaauucagggaagagaagggaagagagaagagucuauuaugagcuggu

SEQ ID NO: 189596 - RNA, 64 nt, hsa
acauacaagauggggagugagaugaguaauucagggaagagaagggaagagagaagagucuauu

SEQ ID NO: 189597 - RNA, 64 nt, hsa
uucccaaacuaucagccuugauuaauuucuaguaggaagagaauaauuacauuugcgggggggg

SEQ ID NO: 189598 - RNA, 64 nt, hsa
uguauuuuguuugggaaaaaaacuaucaaaaugaggaagagaauuuccccuauuuaugcacuag

SEQ ID NO: 189599 - RNA, 59 nt, hsa; identical to SEQ ID NO: 188365

SEQ ID NO: 189600 - RNA, 64 nt, hsa; identical to SEQ ID NO: 188366

SEQ ID NO: 189601 - RNA, 64 nt, hsa; identical to SEQ ID NO: 188367

SEQ ID NO: 189602 - RNA, 64 nt, hsa; identical to SEQ ID NO: 188368

SEQ ID NO: 189603 - RNA, 64 nt, hsa; identical to SEQ ID NO: 188369

SEQ ID NO: 189604 - RNA, 64 nt, hsa; identical to SEQ ID NO: 188370

SEQ ID NO: 189605 - RNA, 64 nt, hsa; identical to SEQ ID NO: 188371

SEQ ID NO: 189606 - RNA, 64 nt, hsa; identical to SEQ ID NO: 188372

SEQ ID NO: 189607 - RNA, 64 nt, hsa; identical to SEQ ID NO: 188373

SEQ ID NO: 189608 - RNA, 64 nt, hsa; identical to SEQ ID NO: 188374

SEQ ID NO: 189609 - RNA, 64 nt, hsa; identical to SEQ ID NO: 188375

SEQ ID NO: 189610 - RNA, 64 nt, hsa; identical to SEQ ID NO: 188376

SEQ ID NO: 189611 - RNA, 64 nt, hsa; identical to SEQ ID NO: 188377

SEQ ID NO: 189612 - RNA, 64 nt, hsa; identical to SEQ ID NO: 188378

SEQ ID NO: 189613 - RNA, 64 nt, hsa; identical to SEQ ID NO: 188379

SEQ ID NO: 189614 - RNA, 64 nt, hsa; identical to SEQ ID NO: 188380

SEQ ID NO: 189615 - RNA, 64 nt, hsa; identical to SEQ ID NO: 188381

SEQ ID NO: 189616 - RNA, 64 nt, hsa; identical to SEQ ID NO: 188382

SEQ ID NO: 189617 - RNA, 64 nt, hsa; identical to SEQ ID NO: 188383

SEQ ID NO: 189618 - RNA, 64 nt, hsa; identical to SEQ ID NO: 188384

SEQ ID NO: 189619 - RNA, 64 nt, hsa; identical to SEQ ID NO: 188385

SEQ ID NO: 189620 - RNA, 64 nt, hsa; identical to SEQ ID NO: 188386

SEQ ID NO: 189621 - RNA, 64 nt, hsa; identical to SEQ ID NO: 188387

SEQ ID NO: 189622 - RNA, 64 nt, hsa; identical to SEQ ID NO: 188388

SEQ ID NO: 189623 - RNA, 64 nt, hsa; identical to SEQ ID NO: 188389

SEQ ID NO: 189624 - RNA, 64 nt, hsa; identical to SEQ ID NO: 188390

SEQ ID NO: 189625 - RNA, 64 nt, hsa; identical to SEQ ID NO: 188391

SEQ ID NO: 189626 - RNA, 64 nt, hsa; identical to SEQ ID NO: 188392

SEQ ID NO: 189627 - RNA, 64 nt, hsa; identical to SEQ ID NO: 188393

SEQ ID NO: 189628 - RNA, 52 nt, hsa; identical to SEQ ID NO: 188394

SEQ ID NO: 189629 - RNA, 62 nt, hsa; identical to SEQ ID NO: 188395

SEQ ID NO: 189630 - RNA, 55 nt, hsa; identical to SEQ ID NO: 188396

SEQ ID NO: 189631 - RNA, 64 nt, hsa; identical to SEQ ID NO: 188397

SEQ ID NO: 189632 - RNA, 64 nt, hsa; identical to SEQ ID NO: 188398

SEQ ID NO: 189633 - RNA, 64 nt, hsa; identical to SEQ ID NO: 188399

SEQ ID NO: 189634 - RNA, 64 nt, hsa; identical to SEQ ID NO: 188400

SEQ ID NO: 189635 - RNA, 64 nt, hsa; identical to SEQ ID NO: 188401

SEQ ID NO: 189636 - RNA, 64 nt, hsa; identical to SEQ ID NO: 188402

SEQ ID NO: 189637 - RNA, 64 nt, hsa; identical to SEQ ID NO: 188403

SEQ ID NO: 189638 - RNA, 64 nt, hsa; identical to SEQ ID NO: 188404

SEQ ID NO: 189639 - RNA, 64 nt, hsa; identical to SEQ ID NO: 188405

SEQ ID NO: 189640 - RNA, 64 nt, hsa; identical to SEQ ID NO: 188406

SEQ ID NO: 189641 - RNA, 64 nt, hsa; identical to SEQ ID NO: 188407

SEQ ID NO: 189642 - RNA, 64 nt, hsa; identical to SEQ ID NO: 188408

SEQ ID NO: 189643 - RNA, 64 nt, hsa; identical to SEQ ID NO: 188409

SEQ ID NO: 189644 - RNA, 64 nt, hsa; identical to SEQ ID NO: 188410

SEQ ID NO: 189645 - RNA, 64 nt, hsa; identical to SEQ ID NO: 188411

SEQ ID NO: 189646 - RNA, 64 nt, hsa; identical to SEQ ID NO: 188412

SEQ ID NO: 189647 - RNA, 64 nt, hsa; identical to SEQ ID NO: 188413

SEQ ID NO: 189648 - RNA, 64 nt, hsa; identical to SEQ ID NO: 188414

SEQ ID NO: 189649 - RNA, 64 nt, hsa; identical to SEQ ID NO: 188415

SEQ ID NO: 189650 - RNA, 64 nt, hsa; identical to SEQ ID NO: 188416

SEQ ID NO: 189651 - RNA, 64 nt, hsa; identical to SEQ ID NO: 188417

SEQ ID NO: 189652 - RNA, 64 nt, hsa; identical to SEQ ID NO: 188418

SEQ ID NO: 189653 - RNA, 64 nt, hsa; identical to SEQ ID NO: 188419

SEQ ID NO: 189654 - RNA, 64 nt, hsa; identical to SEQ ID NO: 188420

SEQ ID NO: 189655 - RNA, 64 nt, hsa; identical to SEQ ID NO: 188421

SEQ ID NO: 189656 - RNA, 64 nt, hsa; identical to SEQ ID NO: 188422

SEQ ID NO: 189657 - RNA, 64 nt, hsa; identical to SEQ ID NO: 188423

SEQ ID NO: 189658 - RNA, 64 nt, hsa; identical to SEQ ID NO: 188424

SEQ ID NO: 189659 - RNA, 64 nt, hsa; identical to SEQ ID NO: 188425

SEQ ID NO: 189660 - RNA, 64 nt, hsa; identical to SEQ ID NO: 188426

SEQ ID NO: 189661 - RNA, 64 nt, hsa; identical to SEQ ID NO: 188427

SEQ ID NO: 189662 - RNA, 64 nt, hsa; identical to SEQ ID NO: 188428

SEQ ID NO: 189663 - RNA, 64 nt, hsa; identical to SEQ ID NO: 188429

SEQ ID NO: 189664 - RNA, 64 nt, hsa; identical to SEQ ID NO: 188430

SEQ ID NO: 189665 - RNA, 64 nt, hsa; identical to SEQ ID NO: 188431

SEQ ID NO: 189666 - RNA, 64 nt, hsa; identical to SEQ ID NO: 188432

SEQ ID NO: 189667 - RNA, 64 nt, hsa; identical to SEQ ID NO: 188433

SEQ ID NO: 189668 - RNA, 64 nt, hsa; identical to SEQ ID NO: 188434

SEQ ID NO: 189669 - RNA, 64 nt, hsa; identical to SEQ ID NO: 188435

SEQ ID NO: 189670 - RNA, 64 nt, hsa; identical to SEQ ID NO: 188436

SEQ ID NO: 189671 - RNA, 64 nt, hsa; identical to SEQ ID NO: 188437

SEQ ID NO: 189672 - RNA, 64 nt, hsa; identical to SEQ ID NO: 188438

SEQ ID NO: 189673 - RNA, 64 nt, hsa; identical to SEQ ID NO: 188439

SEQ ID NO: 189674 - RNA, 64 nt, hsa; identical to SEQ ID NO: 188440

SEQ ID NO: 189675 - RNA, 64 nt, hsa; identical to SEQ ID NO: 188441

SEQ ID NO: 189676 - RNA, 64 nt, hsa; identical to SEQ ID NO: 188442

SEQ ID NO: 189677 - RNA, 64 nt, hsa; identical to SEQ ID NO: 188443

SEQ ID NO: 189678 - RNA, 64 nt, hsa; identical to SEQ ID NO: 188444

SEQ ID NO: 189679 - RNA, 64 nt, hsa; identical to SEQ ID NO: 188445

SEQ ID NO: 189680 - RNA, 64 nt, hsa; identical to SEQ ID NO: 188446

SEQ ID NO: 189681 - RNA, 64 nt, hsa; identical to SEQ ID NO: 188447

SEQ ID NO: 189682 - RNA, 64 nt, hsa; identical to SEQ ID NO: 188448

SEQ ID NO: 189683 - RNA, 64 nt, hsa; identical to SEQ ID NO: 188449

SEQ ID NO: 189684 - RNA, 64 nt, hsa; identical to SEQ ID NO: 188450

SEQ ID NO: 189685 - RNA, 64 nt, hsa; identical to SEQ ID NO: 188451

SEQ ID NO: 189686 - RNA, 64 nt, hsa; identical to SEQ ID NO: 188452

SEQ ID NO: 189687 - RNA, 64 nt, hsa; identical to SEQ ID NO: 188453

SEQ ID NO: 189688 - RNA, 64 nt, hsa; identical to SEQ ID NO: 188454

SEQ ID NO: 189689 - RNA, 64 nt, hsa; identical to SEQ ID NO: 188455

SEQ ID NO: 189690 - RNA, 64 nt, hsa; identical to SEQ ID NO: 188456

SEQ ID NO: 189691 - RNA, 64 nt, hsa; identical to SEQ ID NO: 188457

SEQ ID NO: 189692 - RNA, 64 nt, hsa; identical to SEQ ID NO: 188458

SEQ ID NO: 189693 - RNA, 64 nt, hsa
guccaucaaggcagagcggcagagcggcaagcagagcggcaaggcaggucagcuuccggcucuu

SEQ ID NO: 189694 - RNA, 64 nt, hsa
guguccauaggaguccaucaaggcagagcggcagagcggcaagcagagcggcaaggcaggucag

SEQ ID NO: 189695 - RNA, 64 nt, hsa
cacuugaagccucccgacuuccacagagugcuucaggacacauuuugagugguauuuucuuuuc

SEQ ID NO: 189696 - RNA, 64 nt, hsa
cuagaccucccaggcuaagccucagauucagugcaggacacaagcucaugcccccgucuugcca

SEQ ID NO: 189697 - RNA, 64 nt, hsa
ggcucgggaagccacgccugggaaggcaggacacaggacacagcagcuuucuuuggaaaucucc

SEQ ID NO: 189698 - RNA, 64 nt, hsa
gaaucagggcucgggaagccacgccugggaaggcaggacacaggacacagcagcuuucuuugga

SEQ ID NO: 189699 - RNA, 64 nt, hsa
ucuuccccuccuguaagaguauuaacaaaaccaaaggacacaagggugcaagccccauucacgg

SEQ ID NO: 189700 - RNA, 64 nt, hsa
ugaguccaucgugugagccucggccuggcuggccaggacacacugaaaagcagccuuuuucacc

SEQ ID NO: 189701 - RNA, 64 nt, hsa
ggagagagggacagguucuguugggggugacaccaggacacaggaauagguucugucgggagga

SEQ ID NO: 189702 - RNA, 64 nt, hsa
ggacacagggacagguucugucaugggugacacgaggacacagggacagguucuaucaugggug

SEQ ID NO: 189703 - RNA, 64 nt, hsa
ggacacagggacagguucugucgggggugacaccaggacacagggacagguucugucaugggug

SEQ ID NO: 189704 - RNA, 64 nt, hsa
ggagagagggacagguucugucaggggugacaccaggacacagggacagguucugucgggggug

SEQ ID NO: 189705 - RNA, 64 nt, hsa
ugagcagagcccauccaggacacuccacacugccaggacacacccaggcggcccgcccuugccu

SEQ ID NO: 189706 - RNA, 64 nt, hsa
augaaugaaaugcaguguagggagaggagauggcaggacacagcaaacaggacacauuugccug

SEQ ID NO: 189707 - RNA, 64 nt, hsa
guguagggagaggagauggcaggacacagcaaacaggacacauuugccugcuucucucuugccu

SEQ ID NO: 189708 - RNA, 64 nt, hsa
ugacgcuccucccagaucgcucuacaugacauucaggacacacacacacacacacacacaccac

SEQ ID NO: 189709 - RNA, 64 nt, hsa
ugccucuugcaaugacagcugaucugucggaaccaggacacaaaagcagcaagaagcggggaga

SEQ ID NO: 189710 - RNA, 64 nt, hsa
cuacauaaguucucuggaaauaucuacaacuaauaggacacauguaaauccuugaagacacauc

SEQ ID NO: 189711 - RNA, 64 nt, hsa
gaaguuuguaauuacugaaagucugauuucauucaggacacauuuuuuccuucauauuuuuucu

SEQ ID NO: 189712 - RNA, 64 nt, hsa
cuaaagaaaacaauuacauucuuauacaauaaaaaggacacauuuguguauguuuaaaauuacu

SEQ ID NO: 189713 - RNA, 64 nt, hsa
ucugacaugaaaugugguuaccauuaauagguuuaggacacaagucauauuccccauugcucuc

SEQ ID NO: 189714 - RNA, 64 nt, hsa
ugaguaggccagguaggcgauuggaagagugagcaggacacagaggggaggggaauguuuuggc

SEQ ID NO: 189715 - RNA, 64 nt, hsa
uauggagcacacucuucacccuacccucuaccacaggacacauaucccuguuagcauuccccgg

SEQ ID NO: 189716 - RNA, 64 nt, hsa
gacuccgucccuguccccgacugugccacgugguaggacacauaggacacaggaauuccugggu

SEQ ID NO: 189717 - RNA, 64 nt, hsa
ccuguccccgacugugccacgugguaggacacauaggacacaggaauuccuggguccuugccca

SEQ ID NO: 189718 - RNA, 64 nt, hsa
uccuggguccuugcccaugacugugccaugugguaggacacaggacacaggaauuccuggaaag

SEQ ID NO: 189719 - RNA, 64 nt, hsa
uccuugcccaugacugugccaugugguaggacacaggacacaggaauuccuggaaagugguggc

SEQ ID NO: 189720 - RNA, 64 nt, hsa
ggccaacuuggcaggacuuggccagcagcugcccaggacacagugcaggccagagcgggcuuga

SEQ ID NO: 189721 - RNA, 64 nt, hsa
uggccugcagcuucauuugcgagagcgccgaggcaggacacagagcacagcugugcuggaagug

SEQ ID NO: 189722 - RNA, 64 nt, hsa
cuuuagccggaagucaguccuccucauucaccagaggacacacaggggagacgccccagucugc

SEQ ID NO: 189723 - RNA, 64 nt, hsa
cuuuagccggaagucagaccuccucagucaccagaggacacacacaggggagaagccuuauguc

SEQ ID NO: 189724 - RNA, 64 nt, hsa
uuucagugauaagucagauguuauuacacaccaaaggacacacacaggggggaagcccuacguc

SEQ ID NO: 189725 - RNA, 64 nt, hsa
cuucagaucugccucacaccuucaaauucaugaaaggacacaaacacacauaagaauacacucu

SEQ ID NO: 189726 - RNA, 64 nt, hsa
cuucagaucugccaagaaccuucgaauucaugaaaggacacaaacacacguaagaaugcacucu

SEQ ID NO: 189727 - RNA, 64 nt, hsa
uuuuaaauuuaaaccauugagacuucagaagagcaggacacaaugcuguggacaggcaccaauu

SEQ ID NO: 189728 - RNA, 64 nt, hsa
gggaaucuggggguuucuucuggaacggggcgugaggacacaaggaggccucugggccacgccu

SEQ ID NO: 189729 - RNA, 64 nt, hsa
uagcaauaaguuaaaccucaucuuguacuaaaggaggacacacucagggagaagaccucugugg

SEQ ID NO: 189730 - RNA, 64 nt, hsa
cuguagccaucagucagccuugagcaugcacaaaaggacacacuuaggagagaaguuuaugugu

SEQ ID NO: 189731 - RNA, 64 nt, hsa
uuuguccuguggcccuucuauuuucugcucugugaggacacaaugcuccucccuuccaaaagau

SEQ ID NO: 189732 - RNA, 64 nt, hsa
cuucaucuugaaguuauaucucaccauccaucagaggacacacucaggagaguaacuuugcuuu

SEQ ID NO: 189733 - RNA, 64 nt, hsa
ccucuucccuuugcccuucuccuccaauacauaaaggacacagacaaggaacuugcugaaaggc

SEQ ID NO: 189734 - RNA, 64 nt, hsa
auacccacauggggacauaagcuaauuuuuuuacaggacacagaauucuguucaaugcuguuaa

SEQ ID NO: 189735 - RNA, 64 nt, hsa
cacagcuccuuggugguuucaucuccucugugggaggacacaucucugcagccucaagaguuag

SEQ ID NO: 189736 - RNA, 64 nt, hsa
uauggagccuccugggacaagccucaggaugaaaaggacacagaaggccagaugagaaaggucu

SEQ ID NO: 189737 - RNA, 64 nt, hsa
auugugaagcacagaugagcucuuucacacuccaaggacacagcucauccuaugcuuuuggaca

SEQ ID NO: 189738 - RNA, 64 nt, hsa
ugagaucagcagaauccagacuauaagaaacuacaggacacaugaccuaguuucuucuguaaau

SEQ ID NO: 189739 - RNA, 64 nt, hsa; identical to SEQ ID NO: 93637

SEQ ID NO: 189740 - RNA, 64 nt, hsa; identical to SEQ ID NO: 93638

SEQ ID NO: 189741 - RNA, 64 nt, hsa; identical to SEQ ID NO: 93639

SEQ ID NO: 189742 - RNA, 64 nt, hsa; identical to SEQ ID NO: 93640

SEQ ID NO: 189743 - RNA, 64 nt, hsa; identical to SEQ ID NO: 93641

SEQ ID NO: 189744 - RNA, 64 nt, hsa; identical to SEQ ID NO: 93642

SEQ ID NO: 189745 - RNA, 64 nt, hsa
uaccccaacucugcccuucucccauccaagagaaaccagcaaaaugauaaagaagcuaaccugc

SEQ ID NO: 189746 - RNA, 64 nt, hsa
ugugaggauugauccacuuuuaaauuucucuucuaccagcaacuugggaaaaauuaaauauggg

SEQ ID NO: 189747 - RNA, 64 nt, hsa
caucugucuuuucacccacggagggcacagaaccaccagcaaagccggcggcuggacuggcgcc

SEQ ID NO: 189748 - RNA, 64 nt, hsa
gcucaggacccagugcccaugguuccucacuccuaccagcaagcagcaccaucccgcaggcuuc

SEQ ID NO: 189749 - RNA, 64 nt, hsa
cuuuuagaugaaaacaaaagccuuucuacuuacuaccagcaaugcaaaaaacaacuagagguca

SEQ ID NO: 189750 - RNA, 55 nt, hsa
gcagaacuggaccaggaugaaaaggaccagcaaaauacaucucgccugguacagg

SEQ ID NO: 189751 - RNA, 64 nt, hsa
aaccaggggaacugguuaugaauaugugaaugcaaccagcaaauuuauccuugaaggugugaug

SEQ ID NO: 189752 - RNA, 64 nt, hsa
gggacuggcagaagcccaggcccucucuacuuuuaccagcaacugaucaugucuuucagaaucc

SEQ ID NO: 189753 - RNA, 64 nt, hsa
uuuaauguugcuucacuuaucccacccuacagagaccagcaagguucugccaggccucgagcau

SEQ ID NO: 189754 - RNA, 64 nt, hsa
uuuacuguugcuucauuuaucccauccuucagagaccagcaagguucugccaggccccaagcau

SEQ ID NO: 189755 - RNA, 64 nt, hsa
acccaguuuucaauaaaccuuccaggcugcaauaaccagcaagguuuucaguuaaagcccuauc

SEQ ID NO: 189756 - RNA, 64 nt, hsa
guuuaaggagggugagauaagagacccuuuuccuaccagcaaccaaacuuacuacuagccugca

SEQ ID NO: 189757 - RNA, 64 nt, hsa
uugguauauguucuuuauauuuuaaugugaguauauacacuaagaacaaacuaaauugugauuu

SEQ ID NO: 189758 - RNA, 64 nt, hsa
uauuuuuucugugaaacuucauauugcugaagacauacacuaagaauuuauguagauaauguac

SEQ ID NO: 189759 - RNA, 64 nt, hsa
ucugaccaagcuucuauuaauguuauuucuaauaauacacuaucuugauuguacucuccagaaa

SEQ ID NO: 189760 - RNA, 64 nt, hsa
uagucguguagaaacuagccacuguucaaaucugauacacuauucaaccacaaaguguaaaggc

SEQ ID NO: 189761 - RNA, 64 nt, hsa
uaagaaagagcagaguuauucaugacuguucuuuauacacuaaaagcaugcaucuaaucuaaua

SEQ ID NO: 189762 - RNA, 64 nt, hsa
gagaaaugauggaauaauagacauaauuaauucaauacacuacuguuaaaaucauuugcaaagc

SEQ ID NO: 189763 - RNA, 64 nt, hsa
aacugugaaccuaacuuucucuuauugguggguaauaacugaaaauaaagauuuauuuucaugc

SEQ ID NO: 189764 - RNA, 64 nt, hsa
ccuugcuccuugcauggcucauuagguucaaauuauaacugauuuacauuuucagcuauauuua

SEQ ID NO: 189765 - RNA, 64 nt, hsa
gcuguucaaauuaaguagaaagugagacucaauaauaacugaacuacagcaaaaggcagagaau

SEQ ID NO: 189766 - RNA, 64 nt, hsa
augaacuaggagaaagcaauuuguugcccugaugauaacugaugauuuucacccucucuagcug

SEQ ID NO: 189767 - RNA, 64 nt, hsa
augugcagaacaagcauucccacuuuuccucaagauaacugaccaaguguuuucuuagaaccaa

SEQ ID NO: 189768 - RNA, 64 nt, hsa
auaagcuggaaguuuguuguaguaugccucaaauauaacugacuguauacuauagugguaacuu

SEQ ID NO: 189769 - RNA, 64 nt, hsa
uguccagauccauuuagaaauuuaauauuuauuaauaacugaaacuguuugucuuccuuuggua

SEQ ID NO: 189770 - RNA, 64 nt, hsa
uuuuuuuuuuuucugaaaaggauaccaaagugcgauaacugaacauuuccaauugcauauaaua

SEQ ID NO: 189771 - RNA, 64 nt, hsa
agaauccacuggaggucauuacugccauuaaauaauaacugaaaagacuauguagugaaaugua

SEQ ID NO: 189772 - RNA, 64 nt, hsa
uacauggauacaucaaguucauuugcagaaacaaauaacugaaauaaaaaacauguuaauccuu

SEQ ID NO: 189773 - RNA, 64 nt, hsa
ccaagaauuugcauuuuuaacaaauuccuaggugauaacugauaauguugguucagggaacaca

SEQ ID NO: 189774 - RNA, 64 nt, hsa
aagauguggauuuacaggaagaacccugguuugaauaacugaucugaaauuaguaguuaccugu

SEQ ID NO: 189775 - RNA, 64 nt, hsa
ucaggcugacauaaaguuuacgaggacugcuacuauaacugagagugcugaccaagcaaagaaa

SEQ ID NO: 189776 - RNA, 64 nt, hsa
uuuuuguuccuguucauagaugggaagcuuccuuauaacugaugcagagaaaaauuaguccuuc

SEQ ID NO: 189777 - RNA, 64 nt, hsa
agcauuacaugacuauuggugaguugugccuuuuauaacugaaauacuuuacuuuuucucauau

SEQ ID NO: 189778 - RNA, 64 nt, hsa
uaagucuuuccuuugguucuaugcaaauaaaaaaauaacugauuuuuuaagacugugucuguau

SEQ ID NO: 189779 - RNA, 64 nt, hsa
uaaagauguauaggcaucugguguuucagcauacauaacugaagcaugugaaacaguaucaucc

SEQ ID NO: 189780 - RNA, 64 nt, hsa
guaacaacagaaaccccaguugggaguuuaacaaauaacugacuaccacucacucaugcauuuu

SEQ ID NO: 189781 - RNA, 64 nt, hsa
aaguuuuuaguuuucaguguucagguuauagaauauaacugaccauaaaaauuaccugcaggua

SEQ ID NO: 189782 - RNA, 64 nt, hsa
uuacaagggggaggaagucccuaguuuaaaauguauaacugagugguagaucaguacuuucagc

SEQ ID NO: 189783 - RNA, 64 nt, hsa
ucaccauacuuuaucuaauuauuauucucuguauauaacugaggaaauaagaauaguccuacaa

SEQ ID NO: 189784 - RNA, 64 nt, hsa; identical to SEQ ID NO: 80857

SEQ ID NO: 189785 - RNA, 64 nt, hsa; identical to SEQ ID NO: 80858

SEQ ID NO: 189786 - RNA, 64 nt, hsa; identical to SEQ ID NO: 80859

SEQ ID NO: 189787 - RNA, 64 nt, hsa; identical to SEQ ID NO: 80860

SEQ ID NO: 189788 - RNA, 64 nt, hsa; identical to SEQ ID NO: 80861

SEQ ID NO: 189789 - RNA, 64 nt, hsa; identical to SEQ ID NO: 80862

SEQ ID NO: 189790 - RNA, 64 nt, hsa; identical to SEQ ID NO: 80863

SEQ ID NO: 189791 - RNA, 64 nt, hsa; identical to SEQ ID NO: 80864

SEQ ID NO: 189792 - RNA, 64 nt, hsa; identical to SEQ ID NO: 80865

SEQ ID NO: 189793 - RNA, 64 nt, hsa; identical to SEQ ID NO: 80866

SEQ ID NO: 189794 - RNA, 64 nt, hsa; identical to SEQ ID NO: 80867

SEQ ID NO: 189795 - RNA, 64 nt, hsa; identical to SEQ ID NO: 80868

SEQ ID NO: 189796 - RNA, 64 nt, hsa; identical to SEQ ID NO: 80869

SEQ ID NO: 189797 - RNA, 64 nt, hsa; identical to SEQ ID NO: 80870

SEQ ID NO: 189798 - RNA, 64 nt, hsa; identical to SEQ ID NO: 80871

SEQ ID NO: 189799 - RNA, 64 nt, hsa; identical to SEQ ID NO: 80872

SEQ ID NO: 189800 - RNA, 64 nt, hsa; identical to SEQ ID NO: 80873

SEQ ID NO: 189801 - RNA, 64 nt, hsa; identical to SEQ ID NO: 80874

SEQ ID NO: 189802 - RNA, 64 nt, hsa; identical to SEQ ID NO: 80875

SEQ ID NO: 189803 - RNA, 64 nt, hsa; identical to SEQ ID NO: 80876

SEQ ID NO: 189804 - RNA, 64 nt, hsa; identical to SEQ ID NO: 80877

SEQ ID NO: 189805 - RNA, 64 nt, hsa; identical to SEQ ID NO: 80878

SEQ ID NO: 189806 - RNA, 64 nt, hsa; identical to SEQ ID NO: 80879

SEQ ID NO: 189807 - RNA, 64 nt, hsa; identical to SEQ ID NO: 80880

SEQ ID NO: 189808 - RNA, 64 nt, hsa; identical to SEQ ID NO: 80881

SEQ ID NO: 189809 - RNA, 64 nt, hsa; identical to SEQ ID NO: 80882

SEQ ID NO: 189810 - RNA, 59 nt, hsa; identical to SEQ ID NO: 80883

SEQ ID NO: 189811 - RNA, 64 nt, hsa; identical to SEQ ID NO: 80884

SEQ ID NO: 189812 - RNA, 64 nt, hsa; identical to SEQ ID NO: 80885

SEQ ID NO: 189813 - RNA, 64 nt, hsa; identical to SEQ ID NO: 80886

SEQ ID NO: 189814 - RNA, 64 nt, hsa; identical to SEQ ID NO: 80887

SEQ ID NO: 189815 - RNA, 64 nt, hsa; identical to SEQ ID NO: 80888

SEQ ID NO: 189816 - RNA, 64 nt, hsa; identical to SEQ ID NO: 80889

SEQ ID NO: 189817 - RNA, 64 nt, hsa; identical to SEQ ID NO: 80890

SEQ ID NO: 189818 - RNA, 64 nt, hsa; identical to SEQ ID NO: 80891

SEQ ID NO: 189819 - RNA, 64 nt, hsa; identical to SEQ ID NO: 80892

SEQ ID NO: 189820 - RNA, 64 nt, hsa; identical to SEQ ID NO: 80893

SEQ ID NO: 189821 - RNA, 64 nt, hsa; identical to SEQ ID NO: 80894

SEQ ID NO: 189822 - RNA, 64 nt, hsa; identical to SEQ ID NO: 80895

SEQ ID NO: 189823 - RNA, 64 nt, hsa; identical to SEQ ID NO: 80896

SEQ ID NO: 189824 - RNA, 64 nt, hsa; identical to SEQ ID NO: 80897

SEQ ID NO: 189825 - RNA, 64 nt, hsa; identical to SEQ ID NO: 80898

SEQ ID NO: 189826 - RNA, 64 nt, hsa; identical to SEQ ID NO: 80899

SEQ ID NO: 189827 - RNA, 64 nt, hsa; identical to SEQ ID NO: 80900

SEQ ID NO: 189828 - RNA, 64 nt, hsa; identical to SEQ ID NO: 80901

SEQ ID NO: 189829 - RNA, 64 nt, hsa; identical to SEQ ID NO: 80902

SEQ ID NO: 189830 - RNA, 64 nt, hsa; identical to SEQ ID NO: 80903

SEQ ID NO: 189831 - RNA, 64 nt, hsa; identical to SEQ ID NO: 80904

SEQ ID NO: 189832 - RNA, 64 nt, hsa; identical to SEQ ID NO: 80905

SEQ ID NO: 189833 - RNA, 64 nt, hsa
gaugccccagggauucccaccccacuucugcaaccccagguauccuucauuauccaccccaucc

SEQ ID NO: 189834 - RNA, 64 nt, hsa
auagaucugggagauccugcauuucuaacaagcucccagguaaggcggaggcugcuggugugag

SEQ ID NO: 189835 - RNA, 64 nt, hsa
gggggaaaaagggcaggguggcucaggcuuuaggcccagguacuggggaggccugaggagcccu

SEQ ID NO: 189836 - RNA, 64 nt, hsa
caccucccaggcucaagagauccucccacagccucccagguagcugggacuacaggcgugcacc

SEQ ID NO: 189837 - RNA, 64 nt, hsa
accuccccugccugagcccucacuccacagcccucccagguaccuagcagaggcugucaguccu

SEQ ID NO: 189838 - RNA, 64 nt, hsa
acagggccaggcuggcaggggccagugggcucagcccagguaggggcaggauggagggcugagc

SEQ ID NO: 189839 - RNA, 64 nt, hsa
cuucuagggaauagcaaagaccuauuucauuguccccagguaaguaugugaugagcaaugagga

SEQ ID NO: 189840 - RNA, 64 nt, hsa
agaauccgccagcacuugguagcgucugcagccacccagguagcauacgcucuuugcuguguag

SEQ ID NO: 189841 - RNA, 64 nt, hsa
uauuuugccaggcuggugcaaaguaauuaaagaugucaaucagaaaugucaaugagacuaaagu

SEQ ID NO: 189842 - RNA, 64 nt, hsa
uugaccacauucccaacuagaaaaaucuucuugcgucaaucaagccucaccuggcucauuuggc

SEQ ID NO: 189843 - RNA, 64 nt, hsa
ucuuaaggagccauccuuaagucugcucccacccucaguagaauuuauuuucuacaaaguggua

SEQ ID NO: 189844 - RNA, 64 nt, hsa
ggguggcuuaugggggagaaaagggaaaaugcugucaguagauggaggcaagguuacagguuga

SEQ ID NO: 189845 - RNA, 64 nt, hsa
ucuaccaggcauauucaugcgcuugaacuaguagucaguagaaaucuaagcccaccuaauugua

SEQ ID NO: 189846 - RNA, 64 nt, hsa
uuuaauauguaaaagugaaagaguucacuccaaaucaguagagaguaauauugaagacaaaaua

SEQ ID NO: 189847 - RNA, 64 nt, hsa
auagcaagucugggaaauccuggggugaguggagucaccccacucccaguugcuggcagagacu

SEQ ID NO: 189848 - RNA, 64 nt, hsa
ugcccucccuggcagccaggaccagcaccuguagucaccccaccacacgcagacucaugcacgc

SEQ ID NO: 189849 - RNA, 64 nt, hsa
uuaccagaaagaccaaaauuaaacuccuggaucuucaccccauccagugggaaacacagaugcu

SEQ ID NO: 189850 - RNA, 64 nt, hsa
guucccucgacucuuucaaagcuucacaucugccucaccccaagcgaggcucucuacuggcaca

SEQ ID NO: 189851 - RNA, 64 nt, hsa
uggcaggcguaucagagcacauuagugaugcccuucaccccagggaggugucuguucccaacua

SEQ ID NO: 189852 - RNA, 64 nt, hsa
uugcaguauuucugccucccuuucuuucugccuuucaccccacuaaauguauguuauugaaugc

SEQ ID NO: 189853 - RNA, 64 nt, hsa
ggggacucuuccuggguucuggcuccugcauagcucaccccaccucaucaugagccucaacugc

SEQ ID NO: 189854 - RNA, 64 nt, hsa
caaccuaugucacugacucagaugcagggucugcucaccccaacacaugccuucccuccccagc

SEQ ID NO: 189855 - RNA, 64 nt, hsa
aggacccuugaagaugcuuuuggcucaccucauuucaccccacgcucugcuggcuggcagagga

SEQ ID NO: 189856 - RNA, 64 nt, hsa
cucauuuggugacgucuuacuggugaucaucuccucaccccaucucccaccuuguggaauaaau

SEQ ID NO: 189857 - RNA, 64 nt, hsa
gugggccacaucuucugccccuucucagccucccucaccccagccccuuccccuagacccacug

SEQ ID NO: 189858 - RNA, 64 nt, hsa
cuccaucccgacuccaucucccccaccaggcuggucaccccaggccagcgucuguugaaggaug

SEQ ID NO: 189859 - RNA, 64 nt, hsa
uggccccggccaccuuccccagggaaaccccuggucaccccagaaccucacugagccuugaccu

SEQ ID NO: 189860 - RNA, 64 nt, hsa
ugagucuggcucagcagcccccucccgggcagcuucaccccacacccaggggccaggcucuccc

SEQ ID NO: 189861 - RNA, 64 nt, hsa
ccaggucaagacauagaauguuucaacauuuccaucaccccagaaacuccccuuguacccccuu

SEQ ID NO: 189862 - RNA, 64 nt, hsa
gucaggaucucccaaagaagauaaagaccacuccucaccccagcucaagccauggcaggcgugg

SEQ ID NO: 189863 - RNA, 64 nt, hsa
acaucuuuuacauucugcaagcacaucugcauuuucaccccacccuuccccuccuucucccuuu

SEQ ID NO: 189864 - RNA, 64 nt, hsa
ccucuuggugaaccuuaguaccuaaaaggaaaucucaccccaucccacacccuggaggauuuca

SEQ ID NO: 189865 - RNA, 64 nt, hsa
ucuccagggggcacccuuugagcugugggucugaucaccccaagucccgcccggaggagaggca

SEQ ID NO: 189866 - RNA, 64 nt, hsa
ggccucgucucaagcccccccuuggaggcugaaaucaccccaggcacugugagggcuucuccag

SEQ ID NO: 189867 - RNA, 64 nt, hsa
gugcuuuuuggagcuaagccugggaugaccaaauucaccccagcuccuucauucacagggcugg

SEQ ID NO: 189868 - RNA, 64 nt, hsa
ucccuucugagccaucugcugcucucucauuucaucaccccaacugucccuuguuuuugaucaa

SEQ ID NO: 189869 - RNA, 60 nt, hsa
aacaacuguuacaguuuuauugcucugaguaacugacaaagcagaaacuauucaguuuuu

SEQ ID NO: 189870 - RNA, 60 nt, hsa
cuguggugaauggaugaacguacaucguaaaacugacaaaauauuuuaaaaauauauaaa

SEQ ID NO: 189871 - RNA, 60 nt, hsa
gaaggaaaagaagaagagaugacaaaccauaacugacaagagaggcgucugcugucucau

SEQ ID NO: 189872 - RNA, 60 nt, hsa
auguauuacuuggaaaguucugcuuugacaaacugacaaagucuaaaugagcacauguau

SEQ ID NO: 189873 - RNA, 60 nt, hsa
auuauguuuuauuacuuuccaauuaccuguaacugacagaccaaauuaauuggcuuugug

SEQ ID NO: 189874 - RNA, 60 nt, hsa
aguuuaguuucuucuggacuuuccuuacuuaacugacaguuaccuuuuaaaauuugcaca

SEQ ID NO: 189875 - RNA, 60 nt, hsa
aaguacaagccaaaugauuuucauugguggaacugacacaaaaaaaguaacuuaaaaaca

SEQ ID NO: 189876 - RNA, 60 nt, hsa
ggucugggcgucugcaccuggggccuagggaacugacacgugggaagcgcagugagccgg

SEQ ID NO: 189877 - RNA, 60 nt, hsa
augguuuaaauaccccacagcaaauagaguaacugacaaaccaccaaaaacugaaacccc

SEQ ID NO: 189878 - RNA, 60 nt, hsa
cagaccccaaccucccugacuuccuucaguaacugacaguguagcauuguucuugauuag

SEQ ID NO: 189879 - RNA, 60 nt, hsa
acccaaaaucacacagcucagaagcagcagaacugacauugggacccagguccauuggag

SEQ ID NO: 189880 - RNA, 64 nt, hsa; identical to SEQ ID NO: 189847

SEQ ID NO: 189881 - RNA, 64 nt, hsa; identical to SEQ ID NO: 189848

SEQ ID NO: 189882 - RNA, 64 nt, hsa; identical to SEQ ID NO: 189849

SEQ ID NO: 189883 - RNA, 64 nt, hsa; identical to SEQ ID NO: 189850

SEQ ID NO: 189884 - RNA, 64 nt, hsa; identical to SEQ ID NO: 189851

SEQ ID NO: 189885 - RNA, 64 nt, hsa; identical to SEQ ID NO: 189852

SEQ ID NO: 189886 - RNA, 64 nt, hsa; identical to SEQ ID NO: 189853

SEQ ID NO: 189887 - RNA, 64 nt, hsa; identical to SEQ ID NO: 189854

SEQ ID NO: 189888 - RNA, 64 nt, hsa; identical to SEQ ID NO: 189855

SEQ ID NO: 189889 - RNA, 64 nt, hsa; identical to SEQ ID NO: 189856

SEQ ID NO: 189890 - RNA, 64 nt, hsa; identical to SEQ ID NO: 189857

SEQ ID NO: 189891 - RNA, 64 nt, hsa; identical to SEQ ID NO: 189858

SEQ ID NO: 189892 - RNA, 64 nt, hsa; identical to SEQ ID NO: 189859

SEQ ID NO: 189893 - RNA, 64 nt, hsa; identical to SEQ ID NO: 189860

SEQ ID NO: 189894 - RNA, 64 nt, hsa; identical to SEQ ID NO: 189861

SEQ ID NO: 189895 - RNA, 64 nt, hsa; identical to SEQ ID NO: 189862

SEQ ID NO: 189896 - RNA, 64 nt, hsa; identical to SEQ ID NO: 189863

SEQ ID NO: 189897 - RNA, 64 nt, hsa; identical to SEQ ID NO: 189864

SEQ ID NO: 189898 - RNA, 64 nt, hsa; identical to SEQ ID NO: 189865

SEQ ID NO: 189899 - RNA, 64 nt, hsa; identical to SEQ ID NO: 189866

SEQ ID NO: 189900 - RNA, 64 nt, hsa; identical to SEQ ID NO: 189867

SEQ ID NO: 189901 - RNA, 64 nt, hsa; identical to SEQ ID NO: 189868

SEQ ID NO: 189902 - RNA, 60 nt, hsa; identical to SEQ ID NO: 189869

SEQ ID NO: 189903 - RNA, 60 nt, hsa; identical to SEQ ID NO: 189870

SEQ ID NO: 189904 - RNA, 60 nt, hsa; identical to SEQ ID NO: 189871

SEQ ID NO: 189905 - RNA, 60 nt, hsa; identical to SEQ ID NO: 189872

SEQ ID NO: 189906 - RNA, 60 nt, hsa; identical to SEQ ID NO: 189873

SEQ ID NO: 189907 - RNA, 60 nt, hsa; identical to SEQ ID NO: 189874

SEQ ID NO: 189908 - RNA, 60 nt, hsa; identical to SEQ ID NO: 189875

SEQ ID NO: 189909 - RNA, 60 nt, hsa; identical to SEQ ID NO: 189876

SEQ ID NO: 189910 - RNA, 60 nt, hsa; identical to SEQ ID NO: 189877

SEQ ID NO: 189911 - RNA, 60 nt, hsa; identical to SEQ ID NO: 189878

SEQ ID NO: 189912 - RNA, 60 nt, hsa; identical to SEQ ID NO: 189879

SEQ ID NO: 189913 - RNA, 64 nt, hsa; identical to SEQ ID NO: 189847

SEQ ID NO: 189914 - RNA, 64 nt, hsa; identical to SEQ ID NO: 189848

SEQ ID NO: 189915 - RNA, 64 nt, hsa; identical to SEQ ID NO: 189849

SEQ ID NO: 189916 - RNA, 64 nt, hsa; identical to SEQ ID NO: 189850

SEQ ID NO: 189917 - RNA, 64 nt, hsa; identical to SEQ ID NO: 189851

SEQ ID NO: 189918 - RNA, 64 nt, hsa; identical to SEQ ID NO: 189852

SEQ ID NO: 189919 - RNA, 64 nt, hsa; identical to SEQ ID NO: 189853

SEQ ID NO: 189920 - RNA, 64 nt, hsa; identical to SEQ ID NO: 189854

SEQ ID NO: 189921 - RNA, 64 nt, hsa; identical to SEQ ID NO: 189855

SEQ ID NO: 189922 - RNA, 64 nt, hsa; identical to SEQ ID NO: 189856

SEQ ID NO: 189923 - RNA, 64 nt, hsa; identical to SEQ ID NO: 189857

SEQ ID NO: 189924 - RNA, 64 nt, hsa; identical to SEQ ID NO: 189858

SEQ ID NO: 189925 - RNA, 64 nt, hsa; identical to SEQ ID NO: 189859

SEQ ID NO: 189926 - RNA, 64 nt, hsa; identical to SEQ ID NO: 189860

SEQ ID NO: 189927 - RNA, 64 nt, hsa; identical to SEQ ID NO: 189861

SEQ ID NO: 189928 - RNA, 64 nt, hsa; identical to SEQ ID NO: 189862

SEQ ID NO: 189929 - RNA, 64 nt, hsa; identical to SEQ ID NO: 189863

SEQ ID NO: 189930 - RNA, 64 nt, hsa; identical to SEQ ID NO: 189864

SEQ ID NO: 189931 - RNA, 64 nt, hsa; identical to SEQ ID NO: 189865

SEQ ID NO: 189932 - RNA, 64 nt, hsa; identical to SEQ ID NO: 189866

SEQ ID NO: 189933 - RNA, 64 nt, hsa; identical to SEQ ID NO: 189867

SEQ ID NO: 189934 - RNA, 64 nt, hsa; identical to SEQ ID NO: 189868

SEQ ID NO: 189935 - RNA, 60 nt, hsa; identical to SEQ ID NO: 189869

SEQ ID NO: 189936 - RNA, 60 nt, hsa; identical to SEQ ID NO: 189870

SEQ ID NO: 189937 - RNA, 60 nt, hsa; identical to SEQ ID NO: 189871

SEQ ID NO: 189938 - RNA, 60 nt, hsa; identical to SEQ ID NO: 189872

SEQ ID NO: 189939 - RNA, 60 nt, hsa; identical to SEQ ID NO: 189873

SEQ ID NO: 189940 - RNA, 60 nt, hsa; identical to SEQ ID NO: 189874

SEQ ID NO: 189941 - RNA, 60 nt, hsa; identical to SEQ ID NO: 189875

SEQ ID NO: 189942 - RNA, 60 nt, hsa; identical to SEQ ID NO: 189876

SEQ ID NO: 189943 - RNA, 60 nt, hsa; identical to SEQ ID NO: 189877

SEQ ID NO: 189944 - RNA, 60 nt, hsa; identical to SEQ ID NO: 189878

SEQ ID NO: 189945 - RNA, 60 nt, hsa; identical to SEQ ID NO: 189879

SEQ ID NO: 189946 - RNA, 64 nt, hsa
cugaugaagcaggcagagcucagaggaucuuggcaucacccaccaaaguuagcugaaagcaggg

SEQ ID NO: 189947 - RNA, 64 nt, hsa
cagccuuuucagcaucucacccauuagcagccccaucacccagugaucagucgccucaguaaag

SEQ ID NO: 189948 - RNA, 64 nt, hsa
aaacaauucugcaaaaaaaggaugaauuuccuccaucacccagauuuauacuuagagucagacg

SEQ ID NO: 189949 - RNA, 64 nt, hsa
guauuucgcuguccugaaacuuucagugaaagagaucacccaacaucaauaacuugucauaaua

SEQ ID NO: 189950 - RNA, 64 nt, hsa
uuauuaguauuauuuugagacugagucuugcucuaucacccaggcuggagugcaguggugcaau

SEQ ID NO: 189951 - RNA, 64 nt, hsa
guguaaauaaguucaucaccccaguaaaagugucaucacccagugaauaggaccaccucugccu

SEQ ID NO: 189952 - RNA, 64 nt, hsa
ucucuuucuucuuuauuucuugggucucacucucaucacccaggcuagagugcaguggcacaaa

SEQ ID NO: 189953 - RNA, 64 nt, hsa
cuucaguggugauuucugagauuuuggugcacccaucacccaaggguagucuuuuuuauccauc

SEQ ID NO: 189954 - RNA, 64 nt, hsa
ucuuuuuuuuuuuuuugagacugagucucauucuaucacccaggcuggaguggagugguaugau

SEQ ID NO: 189955 - RNA, 64 nt, hsa; identical to SEQ ID NO: 75208

SEQ ID NO: 189956 - RNA, 64 nt, hsa; identical to SEQ ID NO: 75209

SEQ ID NO: 189957 - RNA, 64 nt, hsa; identical to SEQ ID NO: 75210

SEQ ID NO: 189958 - RNA, 64 nt, hsa; identical to SEQ ID NO: 75211

SEQ ID NO: 189959 - RNA, 64 nt, hsa; identical to SEQ ID NO: 75212

SEQ ID NO: 189960 - RNA, 64 nt, hsa; identical to SEQ ID NO: 75213

SEQ ID NO: 189961 - RNA, 64 nt, hsa; identical to SEQ ID NO: 75214

SEQ ID NO: 189962 - RNA, 64 nt, hsa; identical to SEQ ID NO: 75215

SEQ ID NO: 189963 - RNA, 64 nt, hsa; identical to SEQ ID NO: 75216

SEQ ID NO: 189964 - RNA, 64 nt, hsa; identical to SEQ ID NO: 75217

SEQ ID NO: 189965 - RNA, 64 nt, hsa; identical to SEQ ID NO: 75218

SEQ ID NO: 189966 - RNA, 64 nt, hsa; identical to SEQ ID NO: 75219

SEQ ID NO: 189967 - RNA, 64 nt, hsa; identical to SEQ ID NO: 75220

SEQ ID NO: 189968 - RNA, 64 nt, hsa; identical to SEQ ID NO: 75221

SEQ ID NO: 189969 - RNA, 64 nt, hsa; identical to SEQ ID NO: 75222

SEQ ID NO: 189970 - RNA, 60 nt, hsa; identical to SEQ ID NO: 75223

SEQ ID NO: 189971 - RNA, 64 nt, hsa; identical to SEQ ID NO: 75224

SEQ ID NO: 189972 - RNA, 64 nt, hsa; identical to SEQ ID NO: 75225

SEQ ID NO: 189973 - RNA, 64 nt, hsa; identical to SEQ ID NO: 75226

SEQ ID NO: 189974 - RNA, 64 nt, hsa; identical to SEQ ID NO: 75227

SEQ ID NO: 189975 - RNA, 64 nt, hsa; identical to SEQ ID NO: 75228

SEQ ID NO: 189976 - RNA, 64 nt, hsa; identical to SEQ ID NO: 75229

SEQ ID NO: 189977 - RNA, 64 nt, hsa; identical to SEQ ID NO: 75230

SEQ ID NO: 189978 - RNA, 64 nt, hsa; identical to SEQ ID NO: 75231

SEQ ID NO: 189979 - RNA, 64 nt, hsa; identical to SEQ ID NO: 75232

SEQ ID NO: 189980 - RNA, 64 nt, hsa; identical to SEQ ID NO: 75233

SEQ ID NO: 189981 - RNA, 64 nt, hsa; identical to SEQ ID NO: 75234

SEQ ID NO: 189982 - RNA, 64 nt, hsa; identical to SEQ ID NO: 75235

SEQ ID NO: 189983 - RNA, 64 nt, hsa; identical to SEQ ID NO: 75236

SEQ ID NO: 189984 - RNA, 64 nt, hsa; identical to SEQ ID NO: 75237

SEQ ID NO: 189985 - RNA, 64 nt, hsa; identical to SEQ ID NO: 75238

SEQ ID NO: 189986 - RNA, 64 nt, hsa; identical to SEQ ID NO: 75239

SEQ ID NO: 189987 - RNA, 64 nt, hsa; identical to SEQ ID NO: 75240

SEQ ID NO: 189988 - RNA, 64 nt, hsa; identical to SEQ ID NO: 75241

SEQ ID NO: 189989 - RNA, 64 nt, hsa; identical to SEQ ID NO: 75242

SEQ ID NO: 189990 - RNA, 64 nt, hsa; identical to SEQ ID NO: 75243

SEQ ID NO: 189991 - RNA, 64 nt, hsa; identical to SEQ ID NO: 75244

SEQ ID NO: 189992 - RNA, 64 nt, hsa; identical to SEQ ID NO: 75245

SEQ ID NO: 189993 - RNA, 64 nt, hsa; identical to SEQ ID NO: 75246

SEQ ID NO: 189994 - RNA, 64 nt, hsa
cucuccuuauuacacaagcacagccgcccagugugcacaucaugugcagacaccuuggaaaccu

SEQ ID NO: 189995 - RNA, 64 nt, hsa
agcccgaggcccagaugggggcugaacagguagggcacaucaguuaaugccagugaggucagcu

SEQ ID NO: 189996 - RNA, 64 nt, hsa
cuacccaagagaaaaugcuacaguuuuauagauugcacaucauucuuuaaggcauacuuuuacc

SEQ ID NO: 189997 - RNA, 64 nt, hsa
aaaaagguacuuagaggucgcacuuaaagauuaugcacaucagcagaggaaaggccagccaagc

SEQ ID NO: 189998 - RNA, 64 nt, hsa
gcuuugaaaauauuuugggugauacuuucauuuugcacaucaugcacaucaugguauucagggg

SEQ ID NO: 189999 - RNA, 64 nt, hsa
auauuuugggugauacuuucauuuugcacaucaugcacaucaugguauucaggggcuagaguga

SEQ ID NO: 190000 - RNA, 64 nt, hsa
gguggaggcugcagugaacagagacagugccacugcacaucagccugagugacagagagacuuu

SEQ ID NO: 190001 - RNA, 64 nt, hsa
gguugaugcugggcuguacugguugcuaaauauugcacaucauuuuaaaacuauuugagaugca

SEQ ID NO: 190002 - RNA, 64 nt, hsa
uugucacaaaguuuucaguaaugcuacaaccauugcacaucauuggagaauccacagugaagag

SEQ ID NO: 190003 - RNA, 64 nt, hsa
auguggcaagguuuuuaaucaaaaagcaaccuuugcacaucaccauagacuucauacuggagag

SEQ ID NO: 190004 - RNA, 64 nt, hsa; identical to SEQ ID NO: 93869

SEQ ID NO: 190005 - RNA, 64 nt, hsa; identical to SEQ ID NO: 93870

SEQ ID NO: 190006 - RNA, 64 nt, hsa; identical to SEQ ID NO: 93871

SEQ ID NO: 190007 - RNA, 64 nt, hsa; identical to SEQ ID NO: 93872

SEQ ID NO: 190008 - RNA, 64 nt, hsa; identical to SEQ ID NO: 93873

SEQ ID NO: 190009 - RNA, 64 nt, hsa; identical to SEQ ID NO: 93874

SEQ ID NO: 190010 - RNA, 64 nt, hsa; identical to SEQ ID NO: 93875

SEQ ID NO: 190011 - RNA, 64 nt, hsa; identical to SEQ ID NO: 93876

SEQ ID NO: 190012 - RNA, 64 nt, hsa; identical to SEQ ID NO: 93877

SEQ ID NO: 190013 - RNA, 64 nt, hsa; identical to SEQ ID NO: 93878

SEQ ID NO: 190014 - RNA, 64 nt, hsa; identical to SEQ ID NO: 93879

SEQ ID NO: 190015 - RNA, 64 nt, hsa; identical to SEQ ID NO: 93880

SEQ ID NO: 190016 - RNA, 64 nt, hsa; identical to SEQ ID NO: 93881

SEQ ID NO: 190017 - RNA, 64 nt, hsa; identical to SEQ ID NO: 93882

SEQ ID NO: 190018 - RNA, 64 nt, hsa; identical to SEQ ID NO: 93883

SEQ ID NO: 190019 - RNA, 64 nt, hsa; identical to SEQ ID NO: 93884

SEQ ID NO: 190020 - RNA, 64 nt, hsa; identical to SEQ ID NO: 93885

SEQ ID NO: 190021 - RNA, 64 nt, hsa; identical to SEQ ID NO: 93886

SEQ ID NO: 190022 - RNA, 64 nt, hsa; identical to SEQ ID NO: 93887

SEQ ID NO: 190023 - RNA, 64 nt, hsa; identical to SEQ ID NO: 93888

SEQ ID NO: 190024 - RNA, 64 nt, hsa; identical to SEQ ID NO: 93889

SEQ ID NO: 190025 - RNA, 64 nt, hsa; identical to SEQ ID NO: 93890

SEQ ID NO: 190026 - RNA, 64 nt, hsa; identical to SEQ ID NO: 93891

SEQ ID NO: 190027 - RNA, 64 nt, hsa; identical to SEQ ID NO: 93892

SEQ ID NO: 190028 - RNA, 64 nt, hsa; identical to SEQ ID NO: 93893

SEQ ID NO: 190029 - RNA, 64 nt, hsa; identical to SEQ ID NO: 93894

SEQ ID NO: 190030 - RNA, 64 nt, hsa; identical to SEQ ID NO: 93895

SEQ ID NO: 190031 - RNA, 64 nt, hsa; identical to SEQ ID NO: 93896

SEQ ID NO: 190032 - RNA, 64 nt, hsa; identical to SEQ ID NO: 93897

SEQ ID NO: 190033 - RNA, 64 nt, hsa; identical to SEQ ID NO: 93898

SEQ ID NO: 190034 - RNA, 64 nt, hsa; identical to SEQ ID NO: 93899

SEQ ID NO: 190035 - RNA, 64 nt, hsa; identical to SEQ ID NO: 93900

SEQ ID NO: 190036 - RNA, 64 nt, hsa; identical to SEQ ID NO: 93901

SEQ ID NO: 190037 - RNA, 64 nt, hsa; identical to SEQ ID NO: 93902

SEQ ID NO: 190038 - RNA, 64 nt, hsa; identical to SEQ ID NO: 93903

SEQ ID NO: 190039 - RNA, 64 nt, hsa; identical to SEQ ID NO: 93904

SEQ ID NO: 190040 - RNA, 64 nt, hsa; identical to SEQ ID NO: 93905

SEQ ID NO: 190041 - RNA, 64 nt, hsa; identical to SEQ ID NO: 93906

SEQ ID NO: 190042 - RNA, 64 nt, hsa; identical to SEQ ID NO: 93907

SEQ ID NO: 190043 - RNA, 64 nt, hsa; identical to SEQ ID NO: 93908

SEQ ID NO: 190044 - RNA, 64 nt, hsa; identical to SEQ ID NO: 93909

SEQ ID NO: 190045 - RNA, 64 nt, hsa; identical to SEQ ID NO: 93910

SEQ ID NO: 190046 - RNA, 64 nt, hsa; identical to SEQ ID NO: 93911

SEQ ID NO: 190047 - RNA, 64 nt, hsa; identical to SEQ ID NO: 93912

SEQ ID NO: 190048 - RNA, 64 nt, hsa; identical to SEQ ID NO: 93913

SEQ ID NO: 190049 - RNA, 64 nt, hsa; identical to SEQ ID NO: 93914

SEQ ID NO: 190050 - RNA, 64 nt, hsa; identical to SEQ ID NO: 93915

SEQ ID NO: 190051 - RNA, 64 nt, hsa; identical to SEQ ID NO: 93916

SEQ ID NO: 190052 - RNA, 64 nt, hsa; identical to SEQ ID NO: 93917

SEQ ID NO: 190053 - RNA, 64 nt, hsa; identical to SEQ ID NO: 93918

SEQ ID NO: 190054 - RNA, 64 nt, hsa; identical to SEQ ID NO: 93919

SEQ ID NO: 190055 - RNA, 64 nt, hsa; identical to SEQ ID NO: 93920

SEQ ID NO: 190056 - RNA, 64 nt, hsa; identical to SEQ ID NO: 93921

SEQ ID NO: 190057 - RNA, 64 nt, hsa; identical to SEQ ID NO: 93922

SEQ ID NO: 190058 - RNA, 64 nt, hsa; identical to SEQ ID NO: 93923

SEQ ID NO: 190059 - RNA, 64 nt, hsa; identical to SEQ ID NO: 93924

SEQ ID NO: 190060 - RNA, 64 nt, hsa; identical to SEQ ID NO: 93925

SEQ ID NO: 190061 - RNA, 64 nt, hsa; identical to SEQ ID NO: 93926

SEQ ID NO: 190062 - RNA, 64 nt, hsa; identical to SEQ ID NO: 93927

SEQ ID NO: 190063 - RNA, 64 nt, hsa; identical to SEQ ID NO: 93928

SEQ ID NO: 190064 - RNA, 64 nt, hsa; identical to SEQ ID NO: 93929

SEQ ID NO: 190065 - RNA, 64 nt, hsa; identical to SEQ ID NO: 93930

SEQ ID NO: 190066 - RNA, 64 nt, hsa; identical to SEQ ID NO: 93931

SEQ ID NO: 190067 - RNA, 64 nt, hsa; identical to SEQ ID NO: 93932

SEQ ID NO: 190068 - RNA, 64 nt, hsa; identical to SEQ ID NO: 93933

SEQ ID NO: 190069 - RNA, 64 nt, hsa; identical to SEQ ID NO: 93934

SEQ ID NO: 190070 - RNA, 64 nt, hsa; identical to SEQ ID NO: 93935

SEQ ID NO: 190071 - RNA, 64 nt, hsa; identical to SEQ ID NO: 93936

SEQ ID NO: 190072 - RNA, 64 nt, hsa; identical to SEQ ID NO: 93937

SEQ ID NO: 190073 - RNA, 64 nt, hsa; identical to SEQ ID NO: 93938

SEQ ID NO: 190074 - RNA, 64 nt, hsa; identical to SEQ ID NO: 93939

SEQ ID NO: 190075 - RNA, 64 nt, hsa; identical to SEQ ID NO: 48511

SEQ ID NO: 190076 - RNA, 64 nt, hsa; identical to SEQ ID NO: 48512

SEQ ID NO: 190077 - RNA, 64 nt, hsa; identical to SEQ ID NO: 48513

SEQ ID NO: 190078 - RNA, 64 nt, hsa; identical to SEQ ID NO: 48514

SEQ ID NO: 190079 - RNA, 64 nt, hsa; identical to SEQ ID NO: 48515

SEQ ID NO: 190080 - RNA, 64 nt, hsa; identical to SEQ ID NO: 48516

SEQ ID NO: 190081 - RNA, 64 nt, hsa; identical to SEQ ID NO: 48517

SEQ ID NO: 190082 - RNA, 64 nt, hsa; identical to SEQ ID NO: 48518

SEQ ID NO: 190083 - RNA, 64 nt, hsa; identical to SEQ ID NO: 48519

SEQ ID NO: 190084 - RNA, 64 nt, hsa; identical to SEQ ID NO: 48520

SEQ ID NO: 190085 - RNA, 64 nt, hsa; identical to SEQ ID NO: 48521

SEQ ID NO: 190086 - RNA, 64 nt, hsa; identical to SEQ ID NO: 48522

SEQ ID NO: 190087 - RNA, 64 nt, hsa; identical to SEQ ID NO: 48523

SEQ ID NO: 190088 - RNA, 64 nt, hsa; identical to SEQ ID NO: 48524

SEQ ID NO: 190089 - RNA, 64 nt, hsa; identical to SEQ ID NO: 48525

SEQ ID NO: 190090 - RNA, 64 nt, hsa; identical to SEQ ID NO: 48526

SEQ ID NO: 190091 - RNA, 64 nt, hsa; identical to SEQ ID NO: 48527

SEQ ID NO: 190092 - RNA, 64 nt, hsa; identical to SEQ ID NO: 48528

SEQ ID NO: 190093 - RNA, 64 nt, hsa
uccuucgucgaucccuaauuggccaggccugacccucuuggaccuuucuucuuugccgacaacc

SEQ ID NO: 190094 - RNA, 64 nt, hsa
ccaguccagccuccuggcuguugacuucccauugcucuuggagccaccaaucaaagagauucaa

SEQ ID NO: 190095 - RNA, 64 nt, hsa
ucuaccagacucuaccucugaaugugcugggaaccucuuggagccugucaggaacuccucacug

SEQ ID NO: 190096 - RNA, 64 nt, hsa
uuccuggaugugcccucucugaguucugugcugucucuuggaggcagggcccaggagaacaaag

SEQ ID NO: 190097 - RNA, 64 nt, hsa
ggguuuccuguccagcuucuuggaaaggagcucacucuuggaaagacugaucuuuccaaaauau

SEQ ID NO: 190098 - RNA, 64 nt, hsa
cucuuauugcacacccccagcccauuuugcuucucucuuggauuuuguuuuuucagauccacau

SEQ ID NO: 190099 - RNA, 64 nt, hsa
aagagaacuccaguguugcuaugugcaagauccucucuuggagcuuuuuugcauagcaauuaaa

SEQ ID NO: 190100 - RNA, 64 nt, hsa
aauauguaguaaacucucauuuauuugggguucgcucuuggaucucauccauccauuguguucu

SEQ ID NO: 190101 - RNA, 64 nt, hsa
ucuagaugagguaaagggaaucauucuuauggugcucuuggagaguuucaggccugugcaugug

SEQ ID NO: 190102 - RNA, 64 nt, hsa
gaagaagucagagcaauggauacaaaugaccuugcucuuggauuugcugagcaugaucccuauu

SEQ ID NO: 190103 - RNA, 64 nt, hsa
aagcuaugaagucaccuggagaaaaggaacguugcucuuggacagcaagcaaaccauuucucuc

SEQ ID NO: 190104 - RNA, 64 nt, hsa
agaaauagagacgugucaacagaugcauucauuucucuuggaauguguauuguuuuuauuuugc

SEQ ID NO: 190105 - RNA, 64 nt, hsa
gagcugggcaaacaggucccacuggggacugugacucuuggagauuaaaggacagggcauugau

SEQ ID NO: 190106 - RNA, 64 nt, hsa
cagggcccaccaugucgggguaugguuguaggcccucuuggagccagguucacggggcuguuuc

SEQ ID NO: 190107 - RNA, 64 nt, hsa
aucagcuaggagaccaguuauucaggguccauuucucuuggauguaaaggaguccuggguaaaa

SEQ ID NO: 190108 - RNA, 64 nt, hsa
aauacuuuaauuugugcauuucauaagcccccugcucuuggacugaauuuugugcuuuuuauug

SEQ ID NO: 190109 - RNA, 64 nt, hsa
uacagagaaagguuuuagacuccaguuuaccuuucucuuggagaaacucaaugcuaaucccacc

SEQ ID NO: 190110 - RNA, 64 nt, hsa
uauuuuaguucuuuaaauauauaggcagaugcuucucuuggaauccagaucaucuggcugaagc

SEQ ID NO: 190111 - RNA, 64 nt, hsa
gcuguggaaguaacaaauuucuucucccuccagacucuuggaugacuaccuagauccccagcuu

SEQ ID NO: 190112 - RNA, 64 nt, hsa
gcaacggcccugccccaagccccagaaaaagaaacucuuggagggagucugcgggcuucucuga

SEQ ID NO: 190113 - RNA, 64 nt, hsa
gagguuuugcauuuuagguaaauaacugucuguacucuuggaguaacaagaauuuggaaacagg

SEQ ID NO: 190114 - RNA, 64 nt, hsa
acuuccuugagcaaguggagcugugggaauugcacucuuggaagaucccgcauggguucgaggu

SEQ ID NO: 190115 - RNA, 64 nt, hsa
augugacgagacuuuugaaaaaauggugaacacacucuuggagagguaaauaguaaauaaggcc

SEQ ID NO: 190116 - RNA, 64 nt, hsa
cuaccuuguauugugauauuaacuggcaaagauccucuuggagaaaccuuucccagguacaguu

SEQ ID NO: 190117 - RNA, 64 nt, hsa
aaucuucuagcacuuuguaaacacagugaauaaccucuuggaguauuuuuggcuuuauauaaaa

SEQ ID NO: 190118 - RNA, 64 nt, hsa
ccagaaccuccuucucuuuggagaauggggaggccucuuggagacacagaggguuucaccuugg

SEQ ID NO: 190119 - RNA, 64 nt, hsa
uccacccugggcugcuaccgcuucuauuuaaggauguagagaguaauccauagggaccauggug

SEQ ID NO: 190120 - RNA, 64 nt, hsa
ccgauacuucuuggugugcaagaggaaggguaccuguagagagcuucuuuuuguuucuaccugg

SEQ ID NO: 190121 - RNA, 64 nt, hsa
aauagaucuauuuaguccuacaaaucaggagugguguagagacauccaaauuuaaagaaaaaaa

SEQ ID NO: 190122 - RNA, 64 nt, hsa
aaggguaccaguaauacacuaaauuuucaagguguguagagaaauaauauggaauuagcagcua

SEQ ID NO: 190123 - RNA, 64 nt, hsa
cauuuuggaaggacuuuugaggaaugaugugauguguagagaauagaaagauuuagauauaugc

SEQ ID NO: 190124 - RNA, 64 nt, hsa
auuguucucacuaaaguucuaaaauaauagcaaguguagagaagagccguugcuuugaaaauac

SEQ ID NO: 190125 - RNA, 64 nt, hsa
cccagacagggucauggggcucagaccagcccacuguagagaaucacucugaggcuccaacuuc

SEQ ID NO: 190126 - RNA, 64 nt, hsa
aauauuuauuuucuuguauuagaaaagauuccuuuguagagaaaaaauguauuuuucauuaacg

SEQ ID NO: 190127 - RNA, 64 nt, hsa
caccaagauggcgagccagugugguuguagagauuguagagaggguggaauuggcacuguggac

SEQ ID NO: 190128 - RNA, 64 nt, hsa
gccaggaaacaccaagauggcgagccagugugguuguagagauuguagagaggguggaauuggc

SEQ ID NO: 190129 - RNA, 64 nt, hsa
cuuuugggggccuauuuugugcuuuuuuaccuuauguagagaucuuauuacaaagugauuuucu

SEQ ID NO: 190130 - RNA, 64 nt, hsa
gugccugcccccauggcuaauuuuuuguauuuuuuguagagaugggguuucaccauguuggcug

SEQ ID NO: 190131 - RNA, 64 nt, hsa
cugcauuaacccagaaauaccucgcuucuaucugugcacuuagcugggaacuuacccacuguaa

SEQ ID NO: 190132 - RNA, 64 nt, hsa
gcguccuggcuccaguuggaacacuuuccugagaugcacuuacuucucagcuucugcgaucaga

SEQ ID NO: 190133 - RNA, 64 nt, hsa
caagggcccaaaugcauaaguuucuuugcacuguugcacuuacuuaauacaaauaaauguuuuu

SEQ ID NO: 190134 - RNA, 64 nt, hsa
acuacuguucaguuuuuuaaaaguuuugaaaugcugcacuuacauuuaaaaaaacaacaacaac

SEQ ID NO: 190135 - RNA, 64 nt, hsa
ucaccauuucccccugcucccccacagccgguucugcacuuaucaccgagucgccccuggaagc

SEQ ID NO: 190136 - RNA, 64 nt, hsa
uugaccaagaaauuggguuucuuuucccucagccugcacuuacucuucuauuaagaccagaaaa

SEQ ID NO: 190137 - RNA, 64 nt, hsa
cauccuucuucucuguguuuucugguuuaaaagcugcacuuauauuuuagccuuauuauuuucu

SEQ ID NO: 190138 - RNA, 64 nt, hsa
aaugaaaugaugucauaagcgaucacuuccuauaugcacuuauucucaagaagaacaucuuuau

SEQ ID NO: 190139 - RNA, 64 nt, hsa
ugaaaauuguuuuauuucaggcauguucccuuugugcacuuagguucauugugccucaguuccu

SEQ ID NO: 190140 - RNA, 64 nt, hsa
aucucuguaaaauaauuggaaugaaaauacuucuugcacuuaaacacugcacaugccguacuuu

SEQ ID NO: 190141 - RNA, 64 nt, hsa
uuuucuuuagugggggaggguaagaaaagcaguuugcacuuaaaaagaaaaaaaaaaaacgggu

SEQ ID NO: 190142 - RNA, 64 nt, hsa
aaaagcauuuugcacaguguuuguuuuccugucuugcacuuacaaauaaggucuaugggaguag

SEQ ID NO: 190143 - RNA, 64 nt, hsa
aggaagacagucuuagcacugucacuuagcagauugcacuuaagucccuugugcuggccagaug

SEQ ID NO: 190144 - RNA, 64 nt, hsa
ucugaggggcuguccagucugcuagaaugcuaauugcacuuaggccucaugguucuaguaaacg

SEQ ID NO: 190145 - RNA, 64 nt, hsa
acuuguuugagcucuugagcuuagaaguugauuuugcacuuauuuuuuuggggggugggaaugu

SEQ ID NO: 190146 - RNA, 64 nt, hsa
gugaggcugacacgucugugugaugcaguguggcugcacuuaagggucuguuucucagcaucau

SEQ ID NO: 190147 - RNA, 64 nt, hsa
gccaguauucuaagacauuugaguaauugcuguuugcacuuacugcauggucagaccacgucac

SEQ ID NO: 190148 - RNA, 64 nt, hsa
uuuuuacaugugauagucaguuguacaaagaaaaugcacuuaaaccuguuucuaaauuauauau

SEQ ID NO: 190149 - RNA, 64 nt, hsa
gguucagccagucagugacugguggguuugaaucugcacuuauccccaccaccuggggaccccc

SEQ ID NO: 190150 - RNA, 64 nt, hsa
caugacuaggaguguuaggggcagaaguuuugaaugcacuuaaccggaggagggcgcagggugg

SEQ ID NO: 190151 - RNA, 64 nt, hsa
uaauuucauacuauuuagauuuucuuuuuuaucuugcacuuauuguccccuuuuuaguuuuuuu

SEQ ID NO: 190152 - RNA, 64 nt, hsa
cguagcagcuuagauuaacguugauuucauuccaugcacuuagaguugcuuucaguaacauuuu

SEQ ID NO: 190153 - RNA, 64 nt, hsa
ccuccuugggcucuucccgcaaaucaacacuuucugcacuuaucuuuuggagcaaauugacaug

SEQ ID NO: 190154 - RNA, 64 nt, hsa
agugcaggugacagcaggacuugcuaaagcacuuugcacuuaauggcuguugagggccacuuuu

SEQ ID NO: 190155 - RNA, 64 nt, hsa
cauagauuuaaguaaacagauguauuuugcacagugcacuuaugucuauuuuaacaauccuccu

SEQ ID NO: 190156 - RNA, 64 nt, hsa
aaucacgucuuuuguuaugcuaguaucagucagaugcacuuagagugaagaaacacuguaauua

SEQ ID NO: 190157 - RNA, 64 nt, hsa
gaaaacaguucuuguggccuucuauuaaauaguuugcacuuaagccuugccaguguucugagcu

SEQ ID NO: 190158 - RNA, 64 nt, hsa
uucuuacugccaucauuauuuguuaaagauauuuugcacuuaauuuugugggaaaaauauugcu

SEQ ID NO: 190159 - RNA, 64 nt, hsa
acacgguucuaauuaagugugaagguauagcuauugcacuuaugccaucuccaaaauuucuuaa

SEQ ID NO: 190160 - RNA, 64 nt, hsa
accccacccaucacauggcuggcuggcugcugggugcacuuacccuccuuggcuugguuacuuc

SEQ ID NO: 190161 - RNA, 64 nt, hsa
cugcacaggccucagcuuugaagaacggagucuuugcacuuacacacacucuuccuguucugcc

SEQ ID NO: 190162 - RNA, 64 nt, hsa
guuugcagcggaucacuggacaucaaagauucauugcacuuaugaacaaggaaccuucuuuuca

SEQ ID NO: 190163 - RNA, 64 nt, hsa
aagggagaauuuuagacuuaauuuuuaacucuauugcacuuaaagauuuuaguuagguuaccac

SEQ ID NO: 190164 - RNA, 64 nt, hsa
uuacaucuaaauuacaacccuuaauugccacgugugcacuuacuacucuccaguaugucuuauu

SEQ ID NO: 190165 - RNA, 64 nt, hsa
auacaaauuuaguuuaaguguuugaacaacuauaugcacuuacgguuguguguuuaaaaugucu

SEQ ID NO: 190166 - RNA, 64 nt, hsa
cguaaaaagauauuucuaauuuacuguugcccauugcacuuacauaccaccaccaagaaagccu

SEQ ID NO: 190167 - RNA, 64 nt, hsa
uguuuaaaauuuuugugcaauucauauauuaaauugcacuuacuugcauacgcucauauucuag

SEQ ID NO: 190168 - RNA, 64 nt, hsa
ggucauuguccccacaaugugccagucgacuauuugcacuuaccuuguccuauauauccguacg

SEQ ID NO: 190169 - RNA, 64 nt, hsa
cugcagaggccagaggcccccagcccagggcuccugcacuuacuugcuuauuugacaacguuuc

SEQ ID NO: 190170 - RNA, 64 nt, hsa
agucaagcaagacuuugugaauuugugacaaguuugcacuuacaaaaucauguaaauaugucac

SEQ ID NO: 190171 - RNA, 64 nt, hsa
aaaaugccuuaaaaggaaugcauauggauaaaguugcacuuauaacacccuucaacaaaaucua

SEQ ID NO: 190172 - RNA, 64 nt, hsa
auggagaguugugacaaguacagguuaucaaguuugcacuuaacuaugccaaaaaaaguuugaa

SEQ ID NO: 190173 - RNA, 64 nt, hsa
ggccugauggagugagaagaaaguccuugguguuugcacuuaaaugaaaaccuuuucagugaug

SEQ ID NO: 190174 - RNA, 64 nt, hsa
uuuauacacaacuuugcaaauuauuuauuacuugugcacuuaguaguuuuuacaaaacugcuuu

SEQ ID NO: 190175 - RNA, 64 nt, hsa
ugaauuaguguucuagacucugcuuugcacagcuugcacuuacagugauuguacauauuguaca

SEQ ID NO: 190176 - RNA, 64 nt, hsa
uaagucuuuuuuuuuuuugucuagguagucagucugcacuuaaauaucaaucauuuuccuuuuu

SEQ ID NO: 190177 - RNA, 64 nt, hsa
uuauaaucacaggagacucugccuucauuauccuugcacuuaacggaaguuacaucaggcaagu

SEQ ID NO: 190178 - RNA, 64 nt, hsa
uaugucuaccuggcagauacucagaaauguaguuugcacuuaagcuguaauuuuauuuguucuu

SEQ ID NO: 190179 - RNA, 64 nt, hsa
ccuaugaaguaaagaacugcacaugaagaaauacugcacuuacaaucccaccuuuccucaaaug

SEQ ID NO: 190180 - RNA, 64 nt, hsa
aagagaucuguuauuuucagguagugccauaaucugcacuuagcauuggcuugcuucaguuguu

SEQ ID NO: 190181 - RNA, 64 nt, hsa
agcauacaauuugagcaugcuguauucuaccacuugcacuuacucaucuucuagccuuaugacc

SEQ ID NO: 190182 - RNA, 64 nt, hsa
ugagcgugacacucauuuuagugcuuuguuuccgugcacuuaaaaauaauugagaagaaaaacu

SEQ ID NO: 190183 - RNA, 64 nt, hsa
aucaggguaauuguauugagaacucaaauauacgugcacuuacaugugugguucguacucaagu

SEQ ID NO: 190184 - RNA, 64 nt, hsa
ucuuauaaauggagcacuuagaaauuuguuguucugcacuuaaccuagagagagaaaaaaugcu

SEQ ID NO: 190185 - RNA, 64 nt, hsa
uuacaauuaaaaccucauuuuuuuuuuccauuuuugcacuuaacagugaugaauacuuuuacgu

SEQ ID NO: 190186 - RNA, 64 nt, hsa
auaauuucuuaauuuaaaaugauagcacuucucuugcacuuaagaauggcauccauaagauucu

SEQ ID NO: 190187 - RNA, 64 nt, hsa
cugugauuccacuggcggaggauucuuggaagcuugcacuuaguuuccccugacuucaccccau

SEQ ID NO: 190188 - RNA, 64 nt, hsa
aaauuagaagcggauuuggaaaugcaaacuaacgugcacuuagauauccaagugggugagcuua

SEQ ID NO: 190189 - RNA, 64 nt, hsa
auuuaauuaaaaaggcaaaaccugaaccaccuucugcacuuaaagaagucuaacaguacaaaua

SEQ ID NO: 190190 - RNA, 64 nt, hsa
guauccagccuucacuccagcugguuaaaaauguugcacuuaucagcaacccuaccacuuucau

SEQ ID NO: 190191 - RNA, 64 nt, hsa
uuauucaagaaaaugaacaugcucuucaaaaagaugcacuuaguauuaaguugaaacuugaaca

SEQ ID NO: 190192 - RNA, 64 nt, hsa
ggcucuauaaauuaaguuugugcuuuccuugaaaugcacuuauucuuauuacaagcauuuuaua

SEQ ID NO: 190193 - RNA, 64 nt, hsa
uuuaaaauguaauuuaaaugaaagaaaauugaguugcacuuauugaccauuuuuuaauuuacuu

SEQ ID NO: 190194 - RNA, 64 nt, hsa
gaggaggagcacaagauccucagcaacgaacaccugcacuuagaaaaaguggacagcuucugcc

SEQ ID NO: 190195 - RNA, 64 nt, hsa
uauuucauuaggaucuaaaguugucugaguuaaaugcacuuaugugacucauguguccucuuag

SEQ ID NO: 190196 - RNA, 64 nt, hsa
gauuaaaauuuaaaaaaaaaacauuucacucaguugcacuuagucguaugucuugcaugcuuag

SEQ ID NO: 190197 - RNA, 64 nt, hsa
gaauuuuuccaggagggagaccuguugguuauugugcacuuaaaagaaccacccacaccucucu

SEQ ID NO: 190198 - RNA, 64 nt, hsa
gcuuuaaacauauucagaacagaugcuugaaauaugcacuuagcacuuugguuccacaucuguc

SEQ ID NO: 190199 - RNA, 64 nt, hsa
auuuuaaguguaacauaacuguguuuacuucccaugcacuuaauacccuuaugcgcuaauuuug

SEQ ID NO: 190200 - RNA, 64 nt, hsa
caacacagucugcugcuauauagugggggaagcgugcacuuauuucuaaacauggguuuuuaac

SEQ ID NO: 190201 - RNA, 64 nt, hsa
gcuuucauugucuucaucuuccugccauacuuugugcacuuauugcucuccuucugagucagga

SEQ ID NO: 190202 - RNA, 64 nt, hsa
uugcagccagucacuguguaaagccucucugaugugcacuuaagaguggguugcuuucucacaa

SEQ ID NO: 190203 - RNA, 64 nt, hsa
gaaggcaucagucccuauguauuugcaguucaccugcacuuaaggcacucuguuauuuagacuc

SEQ ID NO: 190204 - RNA, 64 nt, hsa
gcagaaugaaaccacauuuuuugguuugauaauaugcacuuauugacucccacucauuguuaug

SEQ ID NO: 190205 - RNA, 64 nt, hsa
guugcaauuuagcuugcuuucaagcuucaccccuugcacuuaacauaagcuauuuuuggcauug

SEQ ID NO: 190206 - RNA, 64 nt, hsa
uuuaauaauguauauucuuucaugcuuuuuucugugcacuuaccuaagugugaauauguaaagg

SEQ ID NO: 190207 - RNA, 64 nt, hsa
uuaguagguucuguuacaguuuuucuuuugaucgugcacuuauagucuucauuuaauuccucau

SEQ ID NO: 190208 - RNA, 64 nt, hsa
uguauuuguggaaauugguauuaucucuguuuuaugcacuuacauuuaucccuuacauuuuguu

SEQ ID NO: 190209 - RNA, 64 nt, hsa
cagagcuaauauauuuauugccuauggcuuguuuugcacuuaauaaaauaauuuguuuuugcaa

SEQ ID NO: 190210 - RNA, 64 nt, hsa
aaacaccggcauaagaaauuugacauuucacagaugcacuuacauauuuugaccacaaggggga

SEQ ID NO: 190211 - RNA, 64 nt, hsa
acauaugcaaucacucguuuaugcugucuagucaugcacuuaaagcaauuuucaaauguacuca

SEQ ID NO: 190212 - RNA, 64 nt, hsa
acgcgugcaguucauuucuaguucuugauagaacugcacuuaauuuucaguaguagucuugacu

SEQ ID NO: 190213 - RNA, 64 nt, hsa
aaccguuuauuuaacauauauuuuuauuuuugauugcacuuaaauuuuguauaauuuguguuuc

SEQ ID NO: 190214 - RNA, 64 nt, hsa
ggaauugauugcauaugcaagcccuggccacagcugcacuuacaggaugccucauagacgauga

SEQ ID NO: 190215 - RNA, 64 nt, hsa
auacaauuauugaaugaagcguuuuacaauacauugcacuuaauccauuguuuaaauuuacaac

SEQ ID NO: 190216 - RNA, 64 nt, hsa
uuaggaagugacuugaauguacaaagauacuugaugcacuuauuuuuuaaugugagacagcaag

SEQ ID NO: 190217 - RNA, 64 nt, hsa
uuacuguguuauuuaaaugcuaagccaaaguaucugcacuuagguauaccucuuuaugccaaua

SEQ ID NO: 190218 - RNA, 64 nt, hsa
acaaaaagacaaaugauuguaggauccauggaagugcacuuaggcuugcugugguggaggccau

SEQ ID NO: 190219 - RNA, 64 nt, hsa
gguggagaguggcaggaagcaagcauguuugcugugcacuuaggaaaggcuggugagccagagg

SEQ ID NO: 190220 - RNA, 64 nt, hsa
aagcuaaauuugucccuuuuuuauuguuauuaauugcacuuaacauuuuuaguuauacuggaua

SEQ ID NO: 190221 - RNA, 64 nt, hsa
aaauuguguucuuaaaauauuguguaagaaucacugcacuuagcuguuggaauguuguuaaaug

SEQ ID NO: 190222 - RNA, 64 nt, hsa
uguaaaaauuggguaaauuuacuacugaggggagugcacuuauuuauuuaacuuacuuaucugg

SEQ ID NO: 190223 - RNA, 64 nt, hsa
caagaucuggggcugcagagaacagaagagcuggugcacuuaauccagcucugcccuugggggg

SEQ ID NO: 190224 - RNA, 64 nt, hsa
gggccguggggucucaggggugccuggugaauucugcacuuacacguacucaagggagcgcgcc

SEQ ID NO: 190225 - RNA, 64 nt, hsa
acacuuugcuuguauuuuaaaaggaggauauauuugcacuuauguauacuuuuacaguuugcca

SEQ ID NO: 190226 - RNA, 64 nt, hsa
ugauuaaauaauacauuuauaaucuacaacuguuugcacuuacagcuuuuuuuguaaauauaaa

SEQ ID NO: 190227 - RNA, 64 nt, hsa
cccccaugauguaaguuuaccuauguaacaaaccugcacuuauacccaugaacuuaaaaugaaa

SEQ ID NO: 190228 - RNA, 64 nt, hsa
ggcaaagccuaguagagaaccagugcaccucaggugcacuuacauaugguggggcugaggcaaa

SEQ ID NO: 190229 - RNA, 64 nt, hsa
caucaaacaaaaaauaaaucucgaagaaaaaaaaugcacuuacaugugcuuauuuggcuuuucu

SEQ ID NO: 190230 - RNA, 64 nt, hsa
uguggcacuucaaaaggcagcaccacugggcgccugcacuuauuugaaaauggaacuuugggag

SEQ ID NO: 190231 - RNA, 64 nt, hsa
gcaauuuucucuuggugcuaccugauggaauuccugcacuuaaaguucuggcugacuaaacaag

SEQ ID NO: 190232 - RNA, 64 nt, hsa
cugggagggcaaaaaaaaaaaaaaaguuuuuaugugcacuuaaauuuggggacaauuuuaugua

SEQ ID NO: 190233 - RNA, 64 nt, hsa
ggaaggcuucugacgcuuguggccagacugcaauugcacuuauguguuaugcuacuaauauuug

SEQ ID NO: 190234 - RNA, 54 nt, hsa
gcagguucucaucgccauaaagggugcacuuaccgugcacucggccauuucccu

SEQ ID NO: 190235 - RNA, 64 nt, hsa
aggucauagauucuugagcuguugugguuuuuagugcacuuaauauuagcuugcuuaaggcaua

SEQ ID NO: 190236 - RNA, 64 nt, hsa
ccacaugcacacagaacucugacacaggaucagcugcacuuaagaaaucaucccagcuaaguuc

SEQ ID NO: 190237 - RNA, 64 nt, hsa
aagcuacauugacgagacacuuacugguuuaauuugcacuuauuaaccaucuauugaauacaca

SEQ ID NO: 190238 - RNA, 64 nt, hsa
guaaacaagauauuuaaacuagaguaucuuauucugcacuuaugcauuaguuaaaaaaagauaa

SEQ ID NO: 190239 - RNA, 64 nt, hsa
ugucauagcuaugacauuuguuaaaaauaaacucugcacuuauuuugauuugaauuaauuuugg

SEQ ID NO: 190240 - RNA, 64 nt, hsa
ccgagggcaggaguggcucaacuuggucucgucuugcacuuagugcaaauaccaauaauuaaga

SEQ ID NO: 190241 - RNA, 64 nt, hsa
uguucacauggucaaaauuucaccacugaaacccugcacuuagcuagaaccucauuuuuaaaga

SEQ ID NO: 190242 - RNA, 64 nt, hsa
uuuuuuuuccuauuuuucuucuuuuugcuuuuuuugcacuuaucagaaauauuugaugugugca

SEQ ID NO: 190243 - RNA, 64 nt, hsa
cugauuuagaagagacucuuugcugaaauugaauugcacuuauacauguaaauugucaacaugu

SEQ ID NO: 190244 - RNA, 64 nt, hsa
aguuuuucauuuuaaaaaguccauaccuuauauaugcacuuaauuuguuggggcuuuacauacu

SEQ ID NO: 190245 - RNA, 64 nt, hsa
caauuccaccagggccagagcagcuccaccacugugcacuuagccaugauggcaacagaaacca

SEQ ID NO: 190246 - RNA, 64 nt, hsa
auucuucaaccagaaaaaccuauuguucuaaaagugcacuuaagagaugggauuacaaguggac

SEQ ID NO: 190247 - RNA, 64 nt, hsa
uugucaucauaaucuuuauggugggggcagacuuugcacuuacugcagugcaacacuugcacuu

SEQ ID NO: 190248 - RNA, 64 nt, hsa
augaauguucuuuucaaaaaauaaaguagaaaaaugcacuuacuaagaacaugaaaaaaaauga

SEQ ID NO: 190249 - RNA, 64 nt, hsa
gauaaacuauaauuguagaaagggguaauuucugugcacuuacaacaagcugaguguucauguu

SEQ ID NO: 190250 - RNA, 64 nt, hsa
aucauugaaaaaguccauagccaaaaccugacugugcacuuacuauaggacccugaccugccug

SEQ ID NO: 190251 - RNA, 64 nt, hsa
cugauuuuuaaaccugguuuacagguauuacuucugcacuuaccaaauaaugccagauggaaau

SEQ ID NO: 190252 - RNA, 64 nt, hsa
cuugccuuaaaacuggagagaggaaucuaguauuugcacuuagcaaaauauuuaaaaacugaaa

SEQ ID NO: 190253 - RNA, 64 nt, hsa
ccuggaauacaguuuucaguguaauuaauucaacugcacuuaacacuaauguccguguugguau

SEQ ID NO: 190254 - RNA, 64 nt, hsa
guauuuuggcauauuauucuccagguguuucuuaugcacuuauaaaaugauuugaacaaauaaa

SEQ ID NO: 190255 - RNA, 64 nt, hsa
gugccucagccuagauguuuugucuucucuuuucugcacuuaauaccugacaguaugaccgauc

SEQ ID NO: 190256 - RNA, 64 nt, hsa
gcccauccccucccagaaauagagugacaaacucugcacuuaaguccccuguuucuguuuaacu

SEQ ID NO: 190257 - RNA, 64 nt, hsa
ugaggggaaggaggagccccucuuucucccaugcugcacuuacuccuuuugcuaauaaaagugu

SEQ ID NO: 190258 - RNA, 64 nt, hsa
cccccaccgugguucuuuucacagcccucgacuuugcacuuaaaaagggauauuguaaaugaaa

SEQ ID NO: 190259 - RNA, 64 nt, hsa
ugguugacuuaauauauuugcuuuuuuucucaccugcacuuagaggaaauuugaacaaguugga

SEQ ID NO: 190260 - RNA, 64 nt, hsa
ccucauuuagagaggaaaaguaaccaucacugguugcacuuaugauuucaugugcggggaucau

SEQ ID NO: 190261 - RNA, 64 nt, hsa
acugucaagguacuugcuugugucugaacucuagugcacuuaugauuuuguagaccaugugaaa

SEQ ID NO: 190262 - RNA, 64 nt, hsa
uuuguuguuuuguuugcuuugggaucuuguuggaugcacuuagauauggaaaauggaagccaaa

SEQ ID NO: 190263 - RNA, 64 nt, hsa
uugucucuaaauugauguucacccauuucaauauugcacuuauuaauggucuuuauuuuucuag

SEQ ID NO: 190264 - RNA, 64 nt, hsa
cuguuuuguaagaaucacuguuacauucuucuuuugcacuuaaaguugcauugccuacuguuau

SEQ ID NO: 190265 - RNA, 64 nt, hsa
uauaaugauguaaacauggaaaaacuuuaggaaaugcacuuauuaggcuguuuacauggguugc

SEQ ID NO: 190266 - RNA, 64 nt, hsa
acucucuugaauuuaggaaucauugaaaacuccuugcacuuagauuuaauuuauauguuaguua

SEQ ID NO: 190267 - RNA, 64 nt, hsa
aaauauuuuuaacauuacugaggugaauuauuuaugcacuuaggaagugcuaaauuuuaaaagc

SEQ ID NO: 190268 - RNA, 64 nt, hsa
cuccucucaagccacauuuccucccagugcugggugcacuuaacaacugcguucuggcuaacac

SEQ ID NO: 190269 - RNA, 64 nt, hsa
cuuacacuaaaaauccuugcauuuuaaagagagaugcacuuaagaauagagugaacugcucaua

SEQ ID NO: 190270 - RNA, 64 nt, hsa
auuguugcugcauuaguguaauguggugugguuuugcacuuaaaagagguauucauaugcucua

SEQ ID NO: 190271 - RNA, 61 nt, hsa
auuuugacguccaggacuaagaagaucaugaugcacuuagauaaaagaaugauuagguaua

SEQ ID NO: 190272 - RNA, 64 nt, hsa
cguguuucuagguugaccuuguguuuuagaaauuugcacuuaauggaauuugcauuucagagau

SEQ ID NO: 190273 - RNA, 64 nt, hsa
gaaaaaugucacuacugcaacauuaggaauguccugcacuuaauagaauuauuuuucaccgcua

SEQ ID NO: 190274 - RNA, 63 nt, hsa
ugaguuuucggagaccaagaaauuaaaauacaauugcacuuacuguuuacuuguaaauguuau

SEQ ID NO: 190275 - RNA, 64 nt, hsa
ucuacugcuuuguacgaauucuaaguauucuuguugcacuuaauuagccuguauauccucagaa

SEQ ID NO: 190276 - RNA, 64 nt, hsa
agagccuauagccagaacucagaaaaaauucaaaugcacuuauguucucauucuauggccauug

SEQ ID NO: 190277 - RNA, 64 nt, hsa
uaagaaauauuccaaaugucuuuuagaagauagaugcacuuaugcaguaaauuaucuugggaua

SEQ ID NO: 190278 - RNA, 64 nt, hsa
ugggaguauuauaucccuguauagugaugcaaaaugcacuuauguguaaccaguggugauuugg

SEQ ID NO: 190279 - RNA, 64 nt, hsa
auucaaaccuuuaaguuagcuuuccauaauucacugcacuuaaauaaguuuaaaucaaauacag

SEQ ID NO: 190280 - RNA, 64 nt, hsa
ugcuaaaauuccugaaguucagcugcauacaguuugcacuuauggacuccuguuguugaaguuc

SEQ ID NO: 190281 - RNA, 64 nt, hsa
uagagguauggagcagugcaacuuaaacucaaguugcacuuacauuuugaauuuuaaaaugaug

SEQ ID NO: 190282 - RNA, 64 nt, hsa
uuuucauucugagcauguuugucccaaaaggugaugcacuuaagcugacagucccuucaguggu

SEQ ID NO: 190283 - RNA, 64 nt, hsa
ccaaaaacuugcugaaacacuugauauugcacagugcacuuauuuuguggccaaagcauggccu

SEQ ID NO: 190284 - RNA, 64 nt, hsa
acaguaagcguuuuuuuucuuugaagauuuaugaugcacuuauucaauagcugucagccguucc

SEQ ID NO: 190285 - RNA, 64 nt, hsa
uaaagucuacaccaauggaauuagaugagugcuaugcacuuaauuuuaaaauaaaacuaguuuu

SEQ ID NO: 190286 - RNA, 64 nt, hsa
aggacaggagacuccaagcgcuaguauugcacgcugcacuuaauggacuggacucuugccaugg

SEQ ID NO: 190287 - RNA, 64 nt, hsa
gaacccauuugagggguggggggguguuaauuuaugcacuuauaagguguuuucuguguaacca

SEQ ID NO: 190288 - RNA, 64 nt, hsa
cuggcugcagcagaacacguugagggagucuuggugcacuuaggucacuguaagguucuagggc

SEQ ID NO: 190289 - RNA, 64 nt, hsa
cugcaagugacaaucagaggugacuaucuauauuugcacuuaaaaucaaaguaguucaacaugc

SEQ ID NO: 190290 - RNA, 64 nt, hsa
uuuugacuccccuuauucccucuccaagaguaguugcacuuaacuuuuuuuuuuuuuuuuuagu

SEQ ID NO: 190291 - RNA, 64 nt, hsa
gagguuaucagaauuaauaaaaguaucuguuaugugcacuuaagccgcagcugcuauagauagc

SEQ ID NO: 190292 - RNA, 64 nt, hsa
cuacuuugaagucauaccaaugaaaaaauguauaugcacuuauaauuuuccuaauaaaguucug

SEQ ID NO: 190293 - RNA, 64 nt, hsa
ugugguguuguucugauuguuuugaacuggagcaugcacuuauuuucagaaacuuagagaguug

SEQ ID NO: 190294 - RNA, 64 nt, hsa
ucauaaauguacuucaccagugauuuuacugaaaugcacuuauauuagucuuuauguauuugcu

SEQ ID NO: 190295 - RNA, 64 nt, hsa
uggaaaggcaaguuggucuuauagaaagcacuacugcacuuaguagcuaugugauuuugagcaa

SEQ ID NO: 190296 - RNA, 64 nt, hsa
aguuaagaagccaaagcuacuugaucaugcaaaaugcacuuauauauuuguuacacuguauugc

SEQ ID NO: 190297 - RNA, 64 nt, hsa
uaugguuuaucuccagcaacauuucucuaguacuugcacuuauuaucuuuugucuaauuuaacc

SEQ ID NO: 190298 - RNA, 64 nt, hsa
uuuuacucccaguagcaagggauucuaaguuaguugcacuuacaugauuauuguuauuuaaaac

SEQ ID NO: 190299 - RNA, 64 nt, hsa
ccgacuuacuugcuagucucuaugagguccuuauugcacuuauugggguugaagcucuucagag

SEQ ID NO: 190300 - RNA, 64 nt, hsa
acucccuucuucccuguguggggcucaagccuggugcacuuaguauagaagagcuaacguacuc

SEQ ID NO: 190301 - RNA, 64 nt, hsa
ggggcagaagcucugccuaaaaugaagugaaagcugcacuuaacccuuugugauaaugaugaca

SEQ ID NO: 190302 - RNA, 64 nt, hsa
ggaacuucuuuauuucaaaacagaagugucuccuugcacuuagccuuggcagacccuugacucc

SEQ ID NO: 190303 - RNA, 64 nt, hsa
ugauccaggaggccggggccggguacugagagucugcacuuaacaagcucccaggccgagaagc

SEQ ID NO: 190304 - RNA, 64 nt, hsa
aauguaugaaggaugaccccaucacucucuuuguugcacuuagcccucagguaagugcauaggc

SEQ ID NO: 190305 - RNA, 64 nt, hsa
aaacauuuaugcgguaggcucagaugucguaauuugcacuuagguaccaggugucaggaaacag

SEQ ID NO: 190306 - RNA, 64 nt, hsa
auauauaaauagacuauauguucaauauuaucacugcacuuauaaaaaaagaaugauaugugag

SEQ ID NO: 190307 - RNA, 64 nt, hsa
aaaaucacuugguaaggauuauaaacuuaauuacugcacuuaaaaugaaacauuacuuuuuuua

SEQ ID NO: 190308 - RNA, 64 nt, hsa
aguucagcguuguaugucucucucuacacuguggugcacuuaacuuguggaauuuuuauacuaa

SEQ ID NO: 190309 - RNA, 64 nt, hsa
accagugaaaaugaaaggaaguuucaguauuagaugcacuuaaguuagccuccaccacccuuuc

SEQ ID NO: 190310 - RNA, 64 nt, hsa
guuuuauauuugucgacgccaggucagucauuuuugcacuuaauuguauaugagauaacuagau

SEQ ID NO: 190311 - RNA, 64 nt, hsa
aaauauaaaugaagauauuuuaccaugaagagauugcacuuauccuugagaacagucuaaauau

SEQ ID NO: 190312 - RNA, 64 nt, hsa
aaauauaaaugaagauauuuuaccaugaagagauugcacuuauccuugagaacagucuaaugau

SEQ ID NO: 190313 - RNA, 64 nt, hsa
guagucuccuuauaguugaagauaaaauguugagugcacuuauuuuagaauauccuagacauaa

SEQ ID NO: 190314 - RNA, 64 nt, hsa
agccucgcuagucaagcugugaauguauauuguuugcacuuaauccuuaacuguauuaacguuc

SEQ ID NO: 190315 - RNA, 64 nt, hsa
aacaggaaaagucaucccuauuuccuuguuuuacugcacuuaauauuauuugguugaauuuguu

SEQ ID NO: 190316 - RNA, 64 nt, hsa
gcucccaagugccuaggccaugccuuacgacugcugcacuuaccauuugucauaugauggcacu

SEQ ID NO: 190317 - RNA, 64 nt, hsa
uugaauguuuauacuuuuauucuauaauuugcccugcacuuauuuuacaaccuaguaauaaugu

SEQ ID NO: 190318 - RNA, 64 nt, hsa
aggccaagaauauugcaaaauacaugaagcuucaugcacuuaaagaaguauuuuuagaauaaga

SEQ ID NO: 190319 - RNA, 64 nt, hsa
auuuucucuauuuuccccuguucuuuuuguguuaugcacuuaauuuuaugacugccgggggggu

SEQ ID NO: 190320 - RNA, 64 nt, hsa
uggaggcuuggaugggaauaugcugauuuuguucugcacuuaaaggcuucuccuccuggagggc

SEQ ID NO: 190321 - RNA, 64 nt, hsa
gauaauuauaacuuaauguuagagaugguaaagcugcacuuacuugaacagcccaaaagcauua

SEQ ID NO: 190322 - RNA, 64 nt, hsa
agcagcuccccaccccagagccaaaugacaguagugcacuuaaaaaggaaaaucaggccuguug

SEQ ID NO: 190323 - RNA, 64 nt, hsa
uuuggucauuugacaucagagauguuguaaguauugcacuuaauacgcaccuauuucucaauag

SEQ ID NO: 190324 - RNA, 64 nt, hsa
augagaaucaaauggaaacauaucauucuggaggugcacuuacucuucuacaauguggccggau

SEQ ID NO: 190325 - RNA, 64 nt, hsa
auauuaaaacgacuccccaauuauuuugcagaauugcacuuaauauugaaauguacuguauagg

SEQ ID NO: 190326 - RNA, 64 nt, hsa
cagacgcugcaaucacagauuuuaaaaaauuguuugcacuuaaaaauaguugaaugcuggugga

SEQ ID NO: 190327 - RNA, 64 nt, hsa
uaaacugauuuuauuugggagaaacaaggaagggugcacuuaacuagcaaccuaagcaugauuu

SEQ ID NO: 190328 - RNA, 64 nt, hsa
gcagcuuauuggacacauggauuuucuucagauuugcacuuacugcuagcucugcuuuuuaugc

SEQ ID NO: 190329 - RNA, 64 nt, hsa
auccuauuguacucucuucugcuuuuuagaagccugcacuuaagcuuagauuugugaagggaga

SEQ ID NO: 190330 - RNA, 64 nt, hsa
uuccuaauggauucaauuacggacucuggauauuugcacuuauguacuugauacugaaugcaua

SEQ ID NO: 190331 - RNA, 64 nt, hsa
acagugguacgauuucuagcccguggcuuuaaaaugcacuuaaaguccuguccuugccuuuuau

SEQ ID NO: 190332 - RNA, 64 nt, hsa
aauuaucccagcuauuagauagaagggauguuacugcacuuauguguaaucagaucuuuauuua

SEQ ID NO: 190333 - RNA, 64 nt, hsa
uguaaggugacuuuauugugugaacaucauggagugcacuuauacaaaccuagaugggacaccu

SEQ ID NO: 190334 - RNA, 64 nt, hsa
uguuuguuuauuauaaacaaaaagcaugugaaagugcacuuaagauagaguuuuuauuaauuac

SEQ ID NO: 190335 - RNA, 64 nt, hsa
acagugguacgauuucucgcccguggcuuuaaaaugcacuuaaaguccuguccuugccuuuuau

SEQ ID NO: 190336 - RNA, 64 nt, hsa
uacuucaugcauggcuucuccuccaacuuccuccugcacuuaaaaagggccagguuccaaauua

SEQ ID NO: 190337 - RNA, 64 nt, hsa
caguccuuucugucauucugugugugugugugugugcacuuauguguauggguccauauguacg

SEQ ID NO: 190338 - RNA, 64 nt, hsa
caugcauucaagaagcuaggggaaaaauaucucaugcacuuaaauaauggucuucaauuuaauu

SEQ ID NO: 190339 - RNA, 64 nt, hsa
agccuuguaaauaaugacauggaagacccugugcugcacuuaaaauauugcugcuugauuauuu

SEQ ID NO: 190340 - RNA, 61 nt, hsa
auucuaguaaugaagacugauucccagacucugcacuuaaaauaugaacugauuuuggauu

SEQ ID NO: 190341 - RNA, 64 nt, hsa
uacuuuauuacagagcuccuugguuuuuuacuucugcacuuaaauuuuuuuaaauaacaugaug

SEQ ID NO: 190342 - RNA, 64 nt, hsa
uuuuuuuuuaauuuucaggucaaguuuuuuauacugcacuuauuugucaaaauaaagauucuca

SEQ ID NO: 190343 - RNA, 64 nt, hsa
caguggcugaaauccagcauuuuuacauaggagaugcacuuagccucuaagccucguuuuacuc

SEQ ID NO: 190344 - RNA, 64 nt, hsa
ucuuuggauggaggggagggccuuuguuaccuuuugcacuuauucuuucugugggugcuuugac

SEQ ID NO: 190345 - RNA, 64 nt, hsa
uggaucccucugucuggggugggaugccuuacuuugcacuuaauuuaauaagggcauucucgga

SEQ ID NO: 190346 - RNA, 64 nt, hsa
aggaaugucugacaggcuuaagcuuucguccccuugcacuuagacucgaaguuaguaaauccuu

SEQ ID NO: 190347 - RNA, 64 nt, hsa
agugcagaucacgaaugcaccugcuuccaggcagugcacuuagagaaaggucacuggcccgggc

SEQ ID NO: 190348 - RNA, 64 nt, hsa
agggauuguagguagauaacauccaaucacuguuugcacuuaucugaaaucuucccucuuggcu

SEQ ID NO: 190349 - RNA, 64 nt, hsa
aucauggcucuccacucagacugugccuggccccugcacuuacaacuuccugccgcucuguggc

SEQ ID NO: 190350 - RNA, 64 nt, hsa
cauugaaaaguaaauguuuuauuaguucauugccugcacuuacugaucggaagagagaaagaac

SEQ ID NO: 190351 - RNA, 64 nt, hsa
auugggcuguuuucucaacaaauggaaugccauuugcacuuacacaagacuuuccccauacucu

SEQ ID NO: 190352 - RNA, 64 nt, hsa
agcugggagcagcacaaggacccagccuuuguucugcacuuaauaaaugguuuugcuacugcua

SEQ ID NO: 190353 - RNA, 64 nt, hsa
agugccgggaaggaacugccgggacucaccgagcugcacuuaacuguucucuuucuggcuauuu

SEQ ID NO: 190354 - RNA, 64 nt, hsa
gcugagccugaaucugacucuugaggguuggggcugcacuuauuuauugcggggagacagcucu

SEQ ID NO: 190355 - RNA, 64 nt, hsa
gaaucaaacaguccugaauucaaauccuuguuuuugcacuuauugucuggagagcuuuggauaa

SEQ ID NO: 190356 - RNA, 64 nt, hsa
uguuuucacuggauuuuuaucucucucaacuuccugcacuuaacaauaugaaauagaaacuuuu

SEQ ID NO: 190357 - RNA, 64 nt, hsa
caagaagggggcucccugggaucuccagguguacugcacuuacccucaauccagccccggagaa

SEQ ID NO: 190358 - RNA, 64 nt, hsa
aggguuucaguacaaaugcugcugucuauuucugugcacuuaacaauggaacccaaacagaaga

SEQ ID NO: 190359 - RNA, 64 nt, hsa
ucguguaaagagauuacacaugacuguaccauguugcacuuaaucaaauaguauguggggauuu

SEQ ID NO: 190360 - RNA, 64 nt, hsa
aagaacagauaaucccuguauuucaagaccucugugcacuuauuuaugaaccugcccugcuccc

SEQ ID NO: 190361 - RNA, 64 nt, hsa
gugccgacuggcugccugacuucaucaugcucccugcacuuaggcugcgugggacaagggcugu

SEQ ID NO: 190362 - RNA, 64 nt, hsa
uaauuaacaaaauguucuuccuuuaguuugcuuuugcacuuaaaauauauauaauugacuuuuu

SEQ ID NO: 190363 - RNA, 64 nt, hsa
guauaaguaugcguuacaggguuugauacuuuccugcacuuagguuuguccuauucuucauuua

SEQ ID NO: 190364 - RNA, 64 nt, hsa
guuagcauaauuuuagaugccugugaaauaguacugcacuuacauaaagugagacauugugaaa

SEQ ID NO: 190365 - RNA, 64 nt, hsa
ucauaauacauguaguauuuugugucuggcgucuugcacuuagcaugguguucuugagguucau

SEQ ID NO: 190366 - RNA, 64 nt, hsa
uacauccuuaaacaaaguaguauguacaugaaauugcacuuaaccaaaacuauuguguaaaaca

SEQ ID NO: 190367 - RNA, 63 nt, hsa
augugaaaauauccuggaaauaaauacauguuucugcacuuagagccagggaccugccgcguu

SEQ ID NO: 190368 - RNA, 64 nt, hsa
aagccccagcgagauuuuccggugaauacgggauugcacuuacucuuucaucacggaaacagac

SEQ ID NO: 190369 - RNA, 64 nt, hsa
gauaagcccccgcggggcggagauuucuaccuucugcacuuacuccccaucagaagaucgaguu

SEQ ID NO: 190370 - RNA, 64 nt, hsa
agguuuauuucaccugaauauaauuccuaacugaugcacuuaguauaugucaguuuuuauaaau

SEQ ID NO: 190371 - RNA, 64 nt, hsa
ggaaucucuaacaugcucuguuuacaucgauaaaugcacuuaaggaaaacaaacaaauuaaagc

SEQ ID NO: 190372 - RNA, 64 nt, hsa
uugacucauauguuuuaacaugauuuuaacaaacugcacuuauuaagaaauguguuugcccugu

SEQ ID NO: 190373 - RNA, 64 nt, hsa
aucacugugacucuagaguggccagacucagagcugcacuuaguagggguuccucaaaggaagg

SEQ ID NO: 190374 - RNA, 64 nt, hsa
uaauucacccaugaaagagacccagugguuacugugcacuuaggaaaaccuucagccacaucuu

SEQ ID NO: 190375 - RNA, 64 nt, hsa
gaauucacccaugagagagacccagugguugcuaugcacuuaggaaaacuuucagccacaucuu

SEQ ID NO: 190376 - RNA, 64 nt, hsa
gaagacagccuacaugguccauugcuacucuugcugcacuuauguaaacaaucagaccacauuu

SEQ ID NO: 190377 - RNA, 58 nt, hsa
aaagaauucacuccagauaggagccccaugcacuuaaaaaaacaugggaagauauggu

SEQ ID NO: 190378 - RNA, 64 nt, hsa
uguauacaaauacaguauuuuccaugguucugccugcacuuacuuuguaaugccacgguugaga

SEQ ID NO: 190379 - RNA, 64 nt, hsa
gcuuuucccguugaugucuugaugcuccuaucugugcacuuaccguagguagggacacgugucc

SEQ ID NO: 190380 - RNA, 64 nt, hsa
aagaaaugaaugugaaagaaagccaagcaucacuugcacuuaaaucauuaccacggaagauaua

SEQ ID NO: 190381 - RNA, 64 nt, hsa
uuggggaguaccuguccaagacagggcucauuuuugcacuuaucucgaauuugaagagauugcu

SEQ ID NO: 190382 - RNA, 64 nt, hsa
ccugcaguaacuaucuauacaccuaccuccagugugcacuuagggggugagcgcgggugucgag

SEQ ID NO: 190383 - RNA, 64 nt, hsa
aaggaagcacaugugcaccuuuccuuuacacuaaugcacuuaggauguuucugcaucaugucua

SEQ ID NO: 190384 - RNA, 64 nt, hsa
ggcucagcgaccuuuccucucaaaugcggaagcgugcacuuacaguucagaccguucuccugua

SEQ ID NO: 190385 - RNA, 64 nt, hsa
uauauuuucuggauucuggagguugauaaccauaugcacuuaacauuauauucuauaaacauua

SEQ ID NO: 190386 - RNA, 64 nt, hsa
auauguagaauguuaaaagcacagcaaacugcacugcacuuauaaagcaaaucuauuagaaaaa

SEQ ID NO: 190387 - RNA, 64 nt, hsa
ggacuucgguguccucggcucugaaggcgcucucugcacuuagaugcugucagcccucaacgua

SEQ ID NO: 190388 - RNA, 64 nt, hsa
auugagggugaugacaagagacauccggggacugugcacuuacagucgguguggaaugucacuc

SEQ ID NO: 190389 - RNA, 64 nt, hsa
agggagaccagcaguuaacggugagggagguaggugcacuuacccucuccucucuucuccuauc

SEQ ID NO: 190390 - RNA, 64 nt, hsa
ccagcuaacucugaccugggagcccucaggcaccugcacuuacaggccuugcucacagcugauu

SEQ ID NO: 190391 - RNA, 64 nt, hsa
uaagacuuucugcugcacucacaggauccugagcugcacuuaccugugagagucuucaaacuuu

SEQ ID NO: 190392 - RNA, 64 nt, hsa
gcuuaugugugugggcuugggacgagugcugguaugcacuuaggaccuucuugauagcucccug

SEQ ID NO: 190393 - RNA, 64 nt, hsa
aaugcuggucagucugaaaaggugaagcuggcugugcacuuacccccaucuuucucccucgggg

SEQ ID NO: 190394 - RNA, 64 nt, hsa
guccccuuucccugucccagccccaucuguggguugcacuuacaaacccccacccaccuucaga

SEQ ID NO: 190395 - RNA, 64 nt, hsa
uuagaaaacuauugaaagaaaucacaggggaaacugcacuuagacugacagaauugaacaccaa

SEQ ID NO: 190396 - RNA, 64 nt, hsa
aaaauguaugcaauuccugaguguagaaacuucuugcacuuauuuaaaauuuaggagagaacau

SEQ ID NO: 190397 - RNA, 64 nt, hsa
aauuuuaaaagucuauuuuauuaugagcuuucuuugcacuuaaaaauuagcaugcugcuuuuug

SEQ ID NO: 190398 - RNA, 64 nt, hsa
cugcccaugccgcucaggcuacccuuaucuccucugcacuuauguuaucaauaaagaggcaaau

SEQ ID NO: 190399 - RNA, 64 nt, hsa
aaugccaguguguccuagaaccuagauaacgaagugcacuuacacuuauaaaauaacuugcauc

SEQ ID NO: 190400 - RNA, 67 nt, hsa
cuccugcauuaacccagaaauaccucgcuucuaucugugcacuuagcugggaacuuacccacuguaa

SEQ ID NO: 190401 - RNA, 67 nt, hsa
acagcguccuggcuccaguuggaacacuuuccugagaugcacuuacuucucagcuucugcgaucaga

SEQ ID NO: 190402 - RNA, 67 nt, hsa
aagcaagggcccaaaugcauaaguuucuuugcacuguugcacuuacuuaauacaaauaaauguuuuu

SEQ ID NO: 190403 - RNA, 67 nt, hsa
acuacuacuguucaguuuuuuaaaaguuuugaaaugcugcacuuacauuuaaaaaaacaacaacaac

SEQ ID NO: 190404 - RNA, 67 nt, hsa
ggcucaccauuucccccugcucccccacagccgguucugcacuuaucaccgagucgccccuggaagc

SEQ ID NO: 190405 - RNA, 67 nt, hsa
cccuugaccaagaaauuggguuucuuuucccucagccugcacuuacucuucuauuaagaccagaaaa

SEQ ID NO: 190406 - RNA, 67 nt, hsa
acucauccuucuucucuguguuuucugguuuaaaagcugcacuuauauuuuagccuuauuauuuucu

SEQ ID NO: 190407 - RNA, 67 nt, hsa
aucaaugaaaugaugucauaagcgaucacuuccuauaugcacuuauucucaagaagaacaucuuuau

SEQ ID NO: 190408 - RNA, 67 nt, hsa
cauugaaaauuguuuuauuucaggcauguucccuuugugcacuuagguucauugugccucaguuccu

SEQ ID NO: 190409 - RNA, 67 nt, hsa
agcaucucuguaaaauaauuggaaugaaaauacuucuugcacuuaaacacugcacaugccguacuuu

SEQ ID NO: 190410 - RNA, 67 nt, hsa
gucuuuucuuuagugggggaggguaagaaaagcaguuugcacuuaaaaagaaaaaaaaaaaacgggu

SEQ ID NO: 190411 - RNA, 67 nt, hsa
ggcaaaagcauuuugcacaguguuuguuuuccugucuugcacuuacaaauaaggucuaugggaguag

SEQ ID NO: 190412 - RNA, 67 nt, hsa
agcaggaagacagucuuagcacugucacuuagcagauugcacuuaagucccuugugcuggccagaug

SEQ ID NO: 190413 - RNA, 67 nt, hsa
gacucugaggggcuguccagucugcuagaaugcuaauugcacuuaggccucaugguucuaguaaacg

SEQ ID NO: 190414 - RNA, 67 nt, hsa
uugacuuguuugagcucuugagcuuagaaguugauuuugcacuuauuuuuuuggggggugggaaugu

SEQ ID NO: 190415 - RNA, 67 nt, hsa
ugugugaggcugacacgucugugugaugcaguguggcugcacuuaagggucuguuucucagcaucau

SEQ ID NO: 190416 - RNA, 67 nt, hsa
cuugccaguauucuaagacauuugaguaauugcuguuugcacuuacugcauggucagaccacgucac

SEQ ID NO: 190417 - RNA, 67 nt, hsa
caguuuuuacaugugauagucaguuguacaaagaaaaugcacuuaaaccuguuucuaaauuauauau

SEQ ID NO: 190418 - RNA, 67 nt, hsa
cuggguucagccagucagugacugguggguuugaaucugcacuuauccccaccaccuggggaccccc

SEQ ID NO: 190419 - RNA, 67 nt, hsa
ggacaugacuaggaguguuaggggcagaaguuuugaaugcacuuaaccggaggagggcgcagggugg

SEQ ID NO: 190420 - RNA, 67 nt, hsa
aacuaauuucauacuauuuagauuuucuuuuuuaucuugcacuuauuguccccuuuuuaguuuuuuu

SEQ ID NO: 190421 - RNA, 67 nt, hsa
uuccguagcagcuuagauuaacguugauuucauuccaugcacuuagaguugcuuucaguaacauuuu

SEQ ID NO: 190422 - RNA, 67 nt, hsa
uucccuccuugggcucuucccgcaaaucaacacuuucugcacuuaucuuuuggagcaaauugacaug

SEQ ID NO: 190423 - RNA, 67 nt, hsa
uugagugcaggugacagcaggacuugcuaaagcacuuugcacuuaauggcuguugagggccacuuuu

SEQ ID NO: 190424 - RNA, 67 nt, hsa
ucucauagauuuaaguaaacagauguauuuugcacagugcacuuaugucuauuuuaacaauccuccu

SEQ ID NO: 190425 - RNA, 67 nt, hsa
ugcaaucacgucuuuuguuaugcuaguaucagucagaugcacuuagagugaagaaacacuguaauua

SEQ ID NO: 190426 - RNA, 67 nt, hsa
uaggaaaacaguucuuguggccuucuauuaaauaguuugcacuuaagccuugccaguguucugagcu

SEQ ID NO: 190427 - RNA, 67 nt, hsa
uauuucuuacugccaucauuauuuguuaaagauauuuugcacuuaauuuugugggaaaaauauugcu

SEQ ID NO: 190428 - RNA, 67 nt, hsa
aacacacgguucuaauuaagugugaagguauagcuauugcacuuaugccaucuccaaaauuucuuaa

SEQ ID NO: 190429 - RNA, 67 nt, hsa
ggcaccccacccaucacauggcuggcuggcugcugggugcacuuacccuccuuggcuugguuacuuc

SEQ ID NO: 190430 - RNA, 67 nt, hsa
ccucugcacaggccucagcuuugaagaacggagucuuugcacuuacacacacucuuccuguucugcc

SEQ ID NO: 190431 - RNA, 67 nt, hsa
auuguuugcagcggaucacuggacaucaaagauucauugcacuuaugaacaaggaaccuucuuuuca

SEQ ID NO: 190432 - RNA, 67 nt, hsa
ugaaagggagaauuuuagacuuaauuuuuaacucuauugcacuuaaagauuuuaguuagguuaccac

SEQ ID NO: 190433 - RNA, 67 nt, hsa
guguuacaucuaaauuacaacccuuaauugccacgugugcacuuacuacucuccaguaugucuuauu

SEQ ID NO: 190434 - RNA, 67 nt, hsa
caaauacaaauuuaguuuaaguguuugaacaacuauaugcacuuacgguuguguguuuaaaaugucu

SEQ ID NO: 190435 - RNA, 67 nt, hsa
uuacguaaaaagauauuucuaauuuacuguugcccauugcacuuacauaccaccaccaagaaagccu

SEQ ID NO: 190436 - RNA, 67 nt, hsa
acuuguuuaaaauuuuugugcaauucauauauuaaauugcacuuacuugcauacgcucauauucuag

SEQ ID NO: 190437 - RNA, 67 nt, hsa
cagggucauuguccccacaaugugccagucgacuauuugcacuuaccuuguccuauauauccguacg

SEQ ID NO: 190438 - RNA, 67 nt, hsa
cggcugcagaggccagaggcccccagcccagggcuccugcacuuacuugcuuauuugacaacguuuc

SEQ ID NO: 190439 - RNA, 67 nt, hsa
cuaagucaagcaagacuuugugaauuugugacaaguuugcacuuacaaaaucauguaaauaugucac

SEQ ID NO: 190440 - RNA, 67 nt, hsa
augaaaaugccuuaaaaggaaugcauauggauaaaguugcacuuauaacacccuucaacaaaaucua

SEQ ID NO: 190441 - RNA, 67 nt, hsa
acaauggagaguugugacaaguacagguuaucaaguuugcacuuaacuaugccaaaaaaaguuugaa

SEQ ID NO: 190442 - RNA, 67 nt, hsa
aaaggccugauggagugagaagaaaguccuugguguuugcacuuaaaugaaaaccuuuucagugaug

SEQ ID NO: 190443 - RNA, 67 nt, hsa
uuguuuauacacaacuuugcaaauuauuuauuacuugugcacuuaguaguuuuuacaaaacugcuuu

SEQ ID NO: 190444 - RNA, 67 nt, hsa
gcaugaauuaguguucuagacucugcuuugcacagcuugcacuuacagugauuguacauauuguaca

SEQ ID NO: 190445 - RNA, 67 nt, hsa
uuuuaagucuuuuuuuuuuuugucuagguagucagucugcacuuaaauaucaaucauuuuccuuuuu

SEQ ID NO: 190446 - RNA, 67 nt, hsa
ucauuauaaucacaggagacucugccuucauuauccuugcacuuaacggaaguuacaucaggcaagu

SEQ ID NO: 190447 - RNA, 67 nt, hsa
ggguaugucuaccuggcagauacucagaaauguaguuugcacuuaagcuguaauuuuauuuguucuu

SEQ ID NO: 190448 - RNA, 67 nt, hsa
accccuaugaaguaaagaacugcacaugaagaaauacugcacuuacaaucccaccuuuccucaaaug

SEQ ID NO: 190449 - RNA, 67 nt, hsa
uuaaagagaucuguuauuuucagguagugccauaaucugcacuuagcauuggcuugcuucaguuguu

SEQ ID NO: 190450 - RNA, 67 nt, hsa
ccaagcauacaauuugagcaugcuguauucuaccacuugcacuuacucaucuucuagccuuaugacc

SEQ ID NO: 190451 - RNA, 67 nt, hsa
ucaugagcgugacacucauuuuagugcuuuguuuccgugcacuuaaaaauaauugagaagaaaaacu

SEQ ID NO: 190452 - RNA, 67 nt, hsa
cccaucaggguaauuguauugagaacucaaauauacgugcacuuacaugugugguucguacucaagu

SEQ ID NO: 190453 - RNA, 67 nt, hsa
accucuuauaaauggagcacuuagaaauuuguuguucugcacuuaaccuagagagagaaaaaaugcu

SEQ ID NO: 190454 - RNA, 67 nt, hsa
auauuacaauuaaaaccucauuuuuuuuuuccauuuuugcacuuaacagugaugaauacuuuuacgu

SEQ ID NO: 190455 - RNA, 67 nt, hsa
aaaauaauuucuuaauuuaaaaugauagcacuucucuugcacuuaagaauggcauccauaagauucu

SEQ ID NO: 190456 - RNA, 67 nt, hsa
ccucugugauuccacuggcggaggauucuuggaagcuugcacuuaguuuccccugacuucaccccau

SEQ ID NO: 190457 - RNA, 67 nt, hsa
uccaaauuagaagcggauuuggaaaugcaaacuaacgugcacuuagauauccaagugggugagcuua

SEQ ID NO: 190458 - RNA, 67 nt, hsa
guuauuuaauuaaaaaggcaaaaccugaaccaccuucugcacuuaaagaagucuaacaguacaaaua

SEQ ID NO: 190459 - RNA, 67 nt, hsa
aguguauccagccuucacuccagcugguuaaaaauguugcacuuaucagcaacccuaccacuuucau

SEQ ID NO: 190460 - RNA, 67 nt, hsa
aaguuauucaagaaaaugaacaugcucuucaaaaagaugcacuuaguauuaaguugaaacuugaaca

SEQ ID NO: 190461 - RNA, 67 nt, hsa
acuggcucuauaaauuaaguuugugcuuuccuugaaaugcacuuauucuuauuacaagcauuuuaua

SEQ ID NO: 190462 - RNA, 67 nt, hsa
uuguuuaaaauguaauuuaaaugaaagaaaauugaguugcacuuauugaccauuuuuuaauuuacuu

SEQ ID NO: 190463 - RNA, 67 nt, hsa
agggaggaggagcacaagauccucagcaacgaacaccugcacuuagaaaaaguggacagcuucugcc

SEQ ID NO: 190464 - RNA, 67 nt, hsa
uaguauuucauuaggaucuaaaguugucugaguuaaaugcacuuaugugacucauguguccucuuag

SEQ ID NO: 190465 - RNA, 67 nt, hsa
aaugauuaaaauuuaaaaaaaaaacauuucacucaguugcacuuagucguaugucuugcaugcuuag

SEQ ID NO: 190466 - RNA, 67 nt, hsa
ugagaauuuuuccaggagggagaccuguugguuauugugcacuuaaaagaaccacccacaccucucu

SEQ ID NO: 190467 - RNA, 67 nt, hsa
guggcuuuaaacauauucagaacagaugcuugaaauaugcacuuagcacuuugguuccacaucuguc

SEQ ID NO: 190468 - RNA, 67 nt, hsa
guaauuuuaaguguaacauaacuguguuuacuucccaugcacuuaauacccuuaugcgcuaauuuug

SEQ ID NO: 190469 - RNA, 67 nt, hsa
gggcaacacagucugcugcuauauagugggggaagcgugcacuuauuucuaaacauggguuuuuaac

SEQ ID NO: 190470 - RNA, 67 nt, hsa
cuugcuuucauugucuucaucuuccugccauacuuugugcacuuauugcucuccuucugagucagga

SEQ ID NO: 190471 - RNA, 67 nt, hsa
ugcuugcagccagucacuguguaaagccucucugaugugcacuuaagaguggguugcuuucucacaa

SEQ ID NO: 190472 - RNA, 67 nt, hsa
guggaaggcaucagucccuauguauuugcaguucaccugcacuuaaggcacucuguuauuuagacuc

SEQ ID NO: 190473 - RNA, 67 nt, hsa
gaagcagaaugaaaccacauuuuuugguuugauaauaugcacuuauugacucccacucauuguuaug

SEQ ID NO: 190474 - RNA, 67 nt, hsa
guuguugcaauuuagcuugcuuucaagcuucaccccuugcacuuaacauaagcuauuuuuggcauug

SEQ ID NO: 190475 - RNA, 67 nt, hsa
gaauuuaauaauguauauucuuucaugcuuuuuucugugcacuuaccuaagugugaauauguaaagg

SEQ ID NO: 190476 - RNA, 67 nt, hsa
ugauuaguagguucuguuacaguuuuucuuuugaucgugcacuuauagucuucauuuaauuccucau

SEQ ID NO: 190477 - RNA, 67 nt, hsa
aguuguauuuguggaaauugguauuaucucuguuuuaugcacuuacauuuaucccuuacauuuuguu

SEQ ID NO: 190478 - RNA, 67 nt, hsa
uaccagagcuaauauauuuauugccuauggcuuguuuugcacuuaauaaaauaauuuguuuuugcaa

SEQ ID NO: 190479 - RNA, 67 nt, hsa
ccaaaacaccggcauaagaaauuugacauuucacagaugcacuuacauauuuugaccacaaggggga

SEQ ID NO: 190480 - RNA, 67 nt, hsa
aguacauaugcaaucacucguuuaugcugucuagucaugcacuuaaagcaauuuucaaauguacuca

SEQ ID NO: 190481 - RNA, 67 nt, hsa
acuacgcgugcaguucauuucuaguucuugauagaacugcacuuaauuuucaguaguagucuugacu

SEQ ID NO: 190482 - RNA, 67 nt, hsa
cauaaccguuuauuuaacauauauuuuuauuuuugauugcacuuaaauuuuguauaauuuguguuuc

SEQ ID NO: 190483 - RNA, 67 nt, hsa
ucaggaauugauugcauaugcaagcccuggccacagcugcacuuacaggaugccucauagacgauga

SEQ ID NO: 190484 - RNA, 67 nt, hsa
acgauacaauuauugaaugaagcguuuuacaauacauugcacuuaauccauuguuuaaauuuacaac

SEQ ID NO: 190485 - RNA, 67 nt, hsa
gccuuaggaagugacuugaauguacaaagauacuugaugcacuuauuuuuuaaugugagacagcaag

SEQ ID NO: 190486 - RNA, 67 nt, hsa
cauuuacuguguuauuuaaaugcuaagccaaaguaucugcacuuagguauaccucuuuaugccaaua

SEQ ID NO: 190487 - RNA, 67 nt, hsa
gucacaaaaagacaaaugauuguaggauccauggaagugcacuuaggcuugcugugguggaggccau

SEQ ID NO: 190488 - RNA, 67 nt, hsa
gaggguggagaguggcaggaagcaagcauguuugcugugcacuuaggaaaggcuggugagccagagg

SEQ ID NO: 190489 - RNA, 67 nt, hsa
auaaagcuaaauuugucccuuuuuuauuguuauuaauugcacuuaacauuuuuaguuauacuggaua

SEQ ID NO: 190490 - RNA, 67 nt, hsa
uuaaaauuguguucuuaaaauauuguguaagaaucacugcacuuagcuguuggaauguuguuaaaug

SEQ ID NO: 190491 - RNA, 67 nt, hsa
gaauguaaaaauuggguaaauuuacuacugaggggagugcacuuauuuauuuaacuuacuuaucugg

SEQ ID NO: 190492 - RNA, 67 nt, hsa
cagcaagaucuggggcugcagagaacagaagagcuggugcacuuaauccagcucugcccuugggggg

SEQ ID NO: 190493 - RNA, 67 nt, hsa
cuggggccguggggucucaggggugccuggugaauucugcacuuacacguacucaagggagcgcgcc

SEQ ID NO: 190494 - RNA, 67 nt, hsa
cucacacuuugcuuguauuuuaaaaggaggauauauuugcacuuauguauacuuuuacaguuugcca

SEQ ID NO: 190495 - RNA, 67 nt, hsa
aacugauuaaauaauacauuuauaaucuacaacuguuugcacuuacagcuuuuuuuguaaauauaaa

SEQ ID NO: 190496 - RNA, 67 nt, hsa
gaacccccaugauguaaguuuaccuauguaacaaaccugcacuuauacccaugaacuuaaaaugaaa

SEQ ID NO: 190497 - RNA, 67 nt, hsa
gugggcaaagccuaguagagaaccagugcaccucaggugcacuuacauaugguggggcugaggcaaa

SEQ ID NO: 190498 - RNA, 67 nt, hsa
auucaucaaacaaaaaauaaaucucgaagaaaaaaaaugcacuuacaugugcuuauuuggcuuuucu

SEQ ID NO: 190499 - RNA, 67 nt, hsa
acauguggcacuucaaaaggcagcaccacugggcgccugcacuuauuugaaaauggaacuuugggag

SEQ ID NO: 190500 - RNA, 67 nt, hsa
uaugcaauuuucucuuggugcuaccugauggaauuccugcacuuaaaguucuggcugacuaaacaag

SEQ ID NO: 190501 - RNA, 67 nt, hsa
aaucugggagggcaaaaaaaaaaaaaaaguuuuuaugugcacuuaaauuuggggacaauuuuaugua

SEQ ID NO: 190502 - RNA, 67 nt, hsa
cacggaaggcuucugacgcuuguggccagacugcaauugcacuuauguguuaugcuacuaauauuug

SEQ ID NO: 190503 - RNA, 54 nt, hsa; identical to SEQ ID NO: 190234

SEQ ID NO: 190504 - RNA, 67 nt, hsa
auaaggucauagauucuugagcuguugugguuuuuagugcacuuaauauuagcuugcuuaaggcaua

SEQ ID NO: 190505 - RNA, 67 nt, hsa
uccccacaugcacacagaacucugacacaggaucagcugcacuuaagaaaucaucccagcuaaguuc

SEQ ID NO: 190506 - RNA, 67 nt, hsa
ccaaagcuacauugacgagacacuuacugguuuaauuugcacuuauuaaccaucuauugaauacaca

SEQ ID NO: 190507 - RNA, 67 nt, hsa
auuguaaacaagauauuuaaacuagaguaucuuauucugcacuuaugcauuaguuaaaaaaagauaa

SEQ ID NO: 190508 - RNA, 67 nt, hsa
aggugucauagcuaugacauuuguuaaaaauaaacucugcacuuauuuugauuugaauuaauuuugg

SEQ ID NO: 190509 - RNA, 67 nt, hsa
gagccgagggcaggaguggcucaacuuggucucgucuugcacuuagugcaaauaccaauaauuaaga

SEQ ID NO: 190510 - RNA, 67 nt, hsa
auguguucacauggucaaaauuucaccacugaaacccugcacuuagcuagaaccucauuuuuaaaga

SEQ ID NO: 190511 - RNA, 67 nt, hsa
gaauuuuuuuuccuauuuuucuucuuuuugcuuuuuuugcacuuaucagaaauauuugaugugugca

SEQ ID NO: 190512 - RNA, 67 nt, hsa
gaacugauuuagaagagacucuuugcugaaauugaauugcacuuauacauguaaauugucaacaugu

SEQ ID NO: 190513 - RNA, 67 nt, hsa
ugcaguuuuucauuuuaaaaaguccauaccuuauauaugcacuuaauuuguuggggcuuuacauacu

SEQ ID NO: 190514 - RNA, 67 nt, hsa
uuucaauuccaccagggccagagcagcuccaccacugugcacuuagccaugauggcaacagaaacca

SEQ ID NO: 190515 - RNA, 67 nt, hsa
ccaauucuucaaccagaaaaaccuauuguucuaaaagugcacuuaagagaugggauuacaaguggac

SEQ ID NO: 190516 - RNA, 67 nt, hsa
auuuugucaucauaaucuuuauggugggggcagacuuugcacuuacugcagugcaacacuugcacuu

SEQ ID NO: 190517 - RNA, 67 nt, hsa
aaaaugaauguucuuuucaaaaaauaaaguagaaaaaugcacuuacuaagaacaugaaaaaaaauga

SEQ ID NO: 190518 - RNA, 67 nt, hsa
caugauaaacuauaauuguagaaagggguaauuucugugcacuuacaacaagcugaguguucauguu

SEQ ID NO: 190519 - RNA, 67 nt, hsa
cuuaucauugaaaaaguccauagccaaaaccugacugugcacuuacuauaggacccugaccugccug

SEQ ID NO: 190520 - RNA, 67 nt, hsa
uuucugauuuuuaaaccugguuuacagguauuacuucugcacuuaccaaauaaugccagauggaaau

SEQ ID NO: 190521 - RNA, 67 nt, hsa
uuacuugccuuaaaacuggagagaggaaucuaguauuugcacuuagcaaaauauuuaaaaacugaaa

SEQ ID NO: 190522 - RNA, 67 nt, hsa
aguccuggaauacaguuuucaguguaauuaauucaacugcacuuaacacuaauguccguguugguau

SEQ ID NO: 190523 - RNA, 67 nt, hsa
uuaguauuuuggcauauuauucuccagguguuucuuaugcacuuauaaaaugauuugaacaaauaaa

SEQ ID NO: 190524 - RNA, 67 nt, hsa
caugugccucagccuagauguuuugucuucucuuuucugcacuuaauaccugacaguaugaccgauc

SEQ ID NO: 190525 - RNA, 67 nt, hsa
gcagcccauccccucccagaaauagagugacaaacucugcacuuaaguccccuguuucuguuuaacu

SEQ ID NO: 190526 - RNA, 67 nt, hsa
cuuugaggggaaggaggagccccucuuucucccaugcugcacuuacuccuuuugcuaauaaaagugu

SEQ ID NO: 190527 - RNA, 67 nt, hsa
gaccccccaccgugguucuuuucacagcccucgacuuugcacuuaaaaagggauauuguaaaugaaa

SEQ ID NO: 190528 - RNA, 67 nt, hsa
aauugguugacuuaauauauuugcuuuuuuucucaccugcacuuagaggaaauuugaacaaguugga

SEQ ID NO: 190529 - RNA, 67 nt, hsa
cugccucauuuagagaggaaaaguaaccaucacugguugcacuuaugauuucaugugcggggaucau

SEQ ID NO: 190530 - RNA, 67 nt, hsa
uauacugucaagguacuugcuugugucugaacucuagugcacuuaugauuuuguagaccaugugaaa

SEQ ID NO: 190531 - RNA, 67 nt, hsa
uguuuuguuguuuuguuugcuuugggaucuuguuggaugcacuuagauauggaaaauggaagccaaa

SEQ ID NO: 190532 - RNA, 67 nt, hsa
uacuugucucuaaauugauguucacccauuucaauauugcacuuauuaauggucuuuauuuuucuag

SEQ ID NO: 190533 - RNA, 67 nt, hsa
gcacuguuuuguaagaaucacuguuacauucuucuuuugcacuuaaaguugcauugccuacuguuau

SEQ ID NO: 190534 - RNA, 67 nt, hsa
uuguauaaugauguaaacauggaaaaacuuuaggaaaugcacuuauuaggcuguuuacauggguugc

SEQ ID NO: 190535 - RNA, 67 nt, hsa
aacacucucuugaauuuaggaaucauugaaaacuccuugcacuuagauuuaauuuauauguuaguua

SEQ ID NO: 190536 - RNA, 67 nt, hsa
ucuaaauauuuuuaacauuacugaggugaauuauuuaugcacuuaggaagugcuaaauuuuaaaagc

SEQ ID NO: 190537 - RNA, 67 nt, hsa
ccgcuccucucaagccacauuuccucccagugcugggugcacuuaacaacugcguucuggcuaacac

SEQ ID NO: 190538 - RNA, 67 nt, hsa
auucuuacacuaaaaauccuugcauuuuaaagagagaugcacuuaagaauagagugaacugcucaua

SEQ ID NO: 190539 - RNA, 67 nt, hsa
ugcauuguugcugcauuaguguaauguggugugguuuugcacuuaaaagagguauucauaugcucua

SEQ ID NO: 190540 - RNA, 61 nt, hsa; identical to SEQ ID NO: 190271

SEQ ID NO: 190541 - RNA, 67 nt, hsa
aaacguguuucuagguugaccuuguguuuuagaaauuugcacuuaauggaauuugcauuucagagau

SEQ ID NO: 190542 - RNA, 67 nt, hsa
uaagaaaaaugucacuacugcaacauuaggaauguccugcacuuaauagaauuauuuuucaccgcua

SEQ ID NO: 190543 - RNA, 66 nt, hsa
agcugaguuuucggagaccaagaaauuaaaauacaauugcacuuacuguuuacuuguaaauguuau

SEQ ID NO: 190544 - RNA, 67 nt, hsa
cagucuacugcuuuguacgaauucuaaguauucuuguugcacuuaauuagccuguauauccucagaa

SEQ ID NO: 190545 - RNA, 67 nt, hsa
gucagagccuauagccagaacucagaaaaaauucaaaugcacuuauguucucauucuauggccauug

SEQ ID NO: 190546 - RNA, 67 nt, hsa
gacuaagaaauauuccaaaugucuuuuagaagauagaugcacuuaugcaguaaauuaucuugggaua

SEQ ID NO: 190547 - RNA, 67 nt, hsa
ugaugggaguauuauaucccuguauagugaugcaaaaugcacuuauguguaaccaguggugauuugg

SEQ ID NO: 190548 - RNA, 67 nt, hsa
auuauucaaaccuuuaaguuagcuuuccauaauucacugcacuuaaauaaguuuaaaucaaauacag

SEQ ID NO: 190549 - RNA, 67 nt, hsa
ggaugcuaaaauuccugaaguucagcugcauacaguuugcacuuauggacuccuguuguugaaguuc

SEQ ID NO: 190550 - RNA, 67 nt, hsa
uauuagagguauggagcagugcaacuuaaacucaaguugcacuuacauuuugaauuuuaaaaugaug

SEQ ID NO: 190551 - RNA, 67 nt, hsa
uauuuuucauucugagcauguuugucccaaaaggugaugcacuuaagcugacagucccuucaguggu

SEQ ID NO: 190552 - RNA, 67 nt, hsa
auuccaaaaacuugcugaaacacuugauauugcacagugcacuuauuuuguggccaaagcauggccu

SEQ ID NO: 190553 - RNA, 67 nt, hsa
ucuacaguaagcguuuuuuuucuuugaagauuuaugaugcacuuauucaauagcugucagccguucc

SEQ ID NO: 190554 - RNA, 67 nt, hsa
ugcuaaagucuacaccaauggaauuagaugagugcuaugcacuuaauuuuaaaauaaaacuaguuuu

SEQ ID NO: 190555 - RNA, 67 nt, hsa
augaggacaggagacuccaagcgcuaguauugcacgcugcacuuaauggacuggacucuugccaugg

SEQ ID NO: 190556 - RNA, 67 nt, hsa
ccagaacccauuugagggguggggggguguuaauuuaugcacuuauaagguguuuucuguguaacca

SEQ ID NO: 190557 - RNA, 67 nt, hsa
ucacuggcugcagcagaacacguugagggagucuuggugcacuuaggucacuguaagguucuagggc

SEQ ID NO: 190558 - RNA, 67 nt, hsa
cuacugcaagugacaaucagaggugacuaucuauauuugcacuuaaaaucaaaguaguucaacaugc

SEQ ID NO: 190559 - RNA, 67 nt, hsa
uucuuuugacuccccuuauucccucuccaagaguaguugcacuuaacuuuuuuuuuuuuuuuuuagu

SEQ ID NO: 190560 - RNA, 67 nt, hsa
caggagguuaucagaauuaauaaaaguaucuguuaugugcacuuaagccgcagcugcuauagauagc

SEQ ID NO: 190561 - RNA, 67 nt, hsa
uuucuacuuugaagucauaccaaugaaaaaauguauaugcacuuauaauuuuccuaauaaaguucug

SEQ ID NO: 190562 - RNA, 67 nt, hsa
uguugugguguuguucugauuguuuugaacuggagcaugcacuuauuuucagaaacuuagagaguug

SEQ ID NO: 190563 - RNA, 67 nt, hsa
ugaucauaaauguacuucaccagugauuuuacugaaaugcacuuauauuagucuuuauguauuugcu

SEQ ID NO: 190564 - RNA, 67 nt, hsa
aaguggaaaggcaaguuggucuuauagaaagcacuacugcacuuaguagcuaugugauuuugagcaa

SEQ ID NO: 190565 - RNA, 67 nt, hsa
aaaaguuaagaagccaaagcuacuugaucaugcaaaaugcacuuauauauuuguuacacuguauugc

SEQ ID NO: 190566 - RNA, 67 nt, hsa
uuuuaugguuuaucuccagcaacauuucucuaguacuugcacuuauuaucuuuugucuaauuuaacc

SEQ ID NO: 190567 - RNA, 67 nt, hsa
gguuuuuacucccaguagcaagggauucuaaguuaguugcacuuacaugauuauuguuauuuaaaac

SEQ ID NO: 190568 - RNA, 67 nt, hsa
uacccgacuuacuugcuagucucuaugagguccuuauugcacuuauugggguugaagcucuucagag

SEQ ID NO: 190569 - RNA, 67 nt, hsa
cccacucccuucuucccuguguggggcucaagccuggugcacuuaguauagaagagcuaacguacuc

SEQ ID NO: 190570 - RNA, 67 nt, hsa
acuggggcagaagcucugccuaaaaugaagugaaagcugcacuuaacccuuugugauaaugaugaca

SEQ ID NO: 190571 - RNA, 67 nt, hsa
uguggaacuucuuuauuucaaaacagaagugucuccuugcacuuagccuuggcagacccuugacucc

SEQ ID NO: 190572 - RNA, 67 nt, hsa
gucugauccaggaggccggggccggguacugagagucugcacuuaacaagcucccaggccgagaagc

SEQ ID NO: 190573 - RNA, 67 nt, hsa
cagaauguaugaaggaugaccccaucacucucuuuguugcacuuagcccucagguaagugcauaggc

SEQ ID NO: 190574 - RNA, 67 nt, hsa
uacaaacauuuaugcgguaggcucagaugucguaauuugcacuuagguaccaggugucaggaaacag

SEQ ID NO: 190575 - RNA, 67 nt, hsa
uggauauauaaauagacuauauguucaauauuaucacugcacuuauaaaaaaagaaugauaugugag

SEQ ID NO: 190576 - RNA, 67 nt, hsa
guaaaaaucacuugguaaggauuauaaacuuaauuacugcacuuaaaaugaaacauuacuuuuuuua

SEQ ID NO: 190577 - RNA, 67 nt, hsa
ggaaguucagcguuguaugucucucucuacacuguggugcacuuaacuuguggaauuuuuauacuaa

SEQ ID NO: 190578 - RNA, 67 nt, hsa
ggaaccagugaaaaugaaaggaaguuucaguauuagaugcacuuaaguuagccuccaccacccuuuc

SEQ ID NO: 190579 - RNA, 67 nt, hsa
uaaguuuuauauuugucgacgccaggucagucauuuuugcacuuaauuguauaugagauaacuagau

SEQ ID NO: 190580 - RNA, 67 nt, hsa
acaaaauauaaaugaagauauuuuaccaugaagagauugcacuuauccuugagaacagucuaaauau

SEQ ID NO: 190581 - RNA, 67 nt, hsa
ucuaaauauaaaugaagauauuuuaccaugaagagauugcacuuauccuugagaacagucuaaugau

SEQ ID NO: 190582 - RNA, 67 nt, hsa
uugguagucuccuuauaguugaagauaaaauguugagugcacuuauuuuagaauauccuagacauaa

SEQ ID NO: 190583 - RNA, 67 nt, hsa
uguagccucgcuagucaagcugugaauguauauuguuugcacuuaauccuuaacuguauuaacguuc

SEQ ID NO: 190584 - RNA, 67 nt, hsa
ucuaacaggaaaagucaucccuauuuccuuguuuuacugcacuuaauauuauuugguugaauuuguu

SEQ ID NO: 190585 - RNA, 67 nt, hsa
ugggcucccaagugccuaggccaugccuuacgacugcugcacuuaccauuugucauaugauggcacu

SEQ ID NO: 190586 - RNA, 67 nt, hsa
gacuugaauguuuauacuuuuauucuauaauuugcccugcacuuauuuuacaaccuaguaauaaugu

SEQ ID NO: 190587 - RNA, 67 nt, hsa
uugaggccaagaauauugcaaaauacaugaagcuucaugcacuuaaagaaguauuuuuagaauaaga

SEQ ID NO: 190588 - RNA, 67 nt, hsa
aauauuuucucuauuuuccccuguucuuuuuguguuaugcacuuaauuuuaugacugccgggggggu

SEQ ID NO: 190589 - RNA, 67 nt, hsa
ugauggaggcuuggaugggaauaugcugauuuuguucugcacuuaaaggcuucuccuccuggagggc

SEQ ID NO: 190590 - RNA, 67 nt, hsa
gaugauaauuauaacuuaauguuagagaugguaaagcugcacuuacuugaacagcccaaaagcauua

SEQ ID NO: 190591 - RNA, 67 nt, hsa
cccagcagcuccccaccccagagccaaaugacaguagugcacuuaaaaaggaaaaucaggccuguug

SEQ ID NO: 190592 - RNA, 67 nt, hsa
aauuuuggucauuugacaucagagauguuguaaguauugcacuuaauacgcaccuauuucucaauag

SEQ ID NO: 190593 - RNA, 67 nt, hsa
ucaaugagaaucaaauggaaacauaucauucuggaggugcacuuacucuucuacaauguggccggau

SEQ ID NO: 190594 - RNA, 67 nt, hsa
uaaauauuaaaacgacuccccaauuauuuugcagaauugcacuuaauauugaaauguacuguauagg

SEQ ID NO: 190595 - RNA, 67 nt, hsa
agacagacgcugcaaucacagauuuuaaaaaauuguuugcacuuaaaaauaguugaaugcuggugga

SEQ ID NO: 190596 - RNA, 67 nt, hsa
uaauaaacugauuuuauuugggagaaacaaggaagggugcacuuaacuagcaaccuaagcaugauuu

SEQ ID NO: 190597 - RNA, 67 nt, hsa
auggcagcuuauuggacacauggauuuucuucagauuugcacuuacugcuagcucugcuuuuuaugc

SEQ ID NO: 190598 - RNA, 67 nt, hsa
cucauccuauuguacucucuucugcuuuuuagaagccugcacuuaagcuuagauuugugaagggaga

SEQ ID NO: 190599 - RNA, 67 nt, hsa
uaguuccuaauggauucaauuacggacucuggauauuugcacuuauguacuugauacugaaugcaua

SEQ ID NO: 190600 - RNA, 67 nt, hsa
uuaacagugguacgauuucuagcccguggcuuuaaaaugcacuuaaaguccuguccuugccuuuuau

SEQ ID NO: 190601 - RNA, 67 nt, hsa
uuaaauuaucccagcuauuagauagaagggauguuacugcacuuauguguaaucagaucuuuauuua

SEQ ID NO: 190602 - RNA, 67 nt, hsa
cauuguaaggugacuuuauugugugaacaucauggagugcacuuauacaaaccuagaugggacaccu

SEQ ID NO: 190603 - RNA, 67 nt, hsa
uguuguuuguuuauuauaaacaaaaagcaugugaaagugcacuuaagauagaguuuuuauuaauuac

SEQ ID NO: 190604 - RNA, 67 nt, hsa
uuaacagugguacgauuucucgcccguggcuuuaaaaugcacuuaaaguccuguccuugccuuuuau

SEQ ID NO: 190605 - RNA, 67 nt, hsa
uuuuacuucaugcauggcuucuccuccaacuuccuccugcacuuaaaaagggccagguuccaaauua

SEQ ID NO: 190606 - RNA, 67 nt, hsa
uuccaguccuuucugucauucugugugugugugugugugcacuuauguguauggguccauauguacg

SEQ ID NO: 190607 - RNA, 67 nt, hsa
uaacaugcauucaagaagcuaggggaaaaauaucucaugcacuuaaauaauggucuucaauuuaauu

SEQ ID NO: 190608 - RNA, 67 nt, hsa
ucaagccuuguaaauaaugacauggaagacccugugcugcacuuaaaauauugcugcuugauuauuu

SEQ ID NO: 190609 - RNA, 61 nt, hsa; identical to SEQ ID NO: 190340

SEQ ID NO: 190610 - RNA, 67 nt, hsa
uguuacuuuauuacagagcuccuugguuuuuuacuucugcacuuaaauuuuuuuaaauaacaugaug

SEQ ID NO: 190611 - RNA, 67 nt, hsa
uuuuuuuuuuuuaauuuucaggucaaguuuuuuauacugcacuuauuugucaaaauaaagauucuca

SEQ ID NO: 190612 - RNA, 67 nt, hsa
acacaguggcugaaauccagcauuuuuacauaggagaugcacuuagccucuaagccucguuuuacuc

SEQ ID NO: 190613 - RNA, 67 nt, hsa
guuucuuuggauggaggggagggccuuuguuaccuuuugcacuuauucuuucugugggugcuuugac

SEQ ID NO: 190614 - RNA, 67 nt, hsa
auguggaucccucugucuggggugggaugccuuacuuugcacuuaauuuaauaagggcauucucgga

SEQ ID NO: 190615 - RNA, 67 nt, hsa
aaaaggaaugucugacaggcuuaagcuuucguccccuugcacuuagacucgaaguuaguaaauccuu

SEQ ID NO: 190616 - RNA, 67 nt, hsa
gagagugcagaucacgaaugcaccugcuuccaggcagugcacuuagagaaaggucacuggcccgggc

SEQ ID NO: 190617 - RNA, 67 nt, hsa
uaaagggauuguagguagauaacauccaaucacuguuugcacuuaucugaaaucuucccucuuggcu

SEQ ID NO: 190618 - RNA, 67 nt, hsa
gccaucauggcucuccacucagacugugccuggccccugcacuuacaacuuccugccgcucuguggc

SEQ ID NO: 190619 - RNA, 67 nt, hsa
uuacauugaaaaguaaauguuuuauuaguucauugccugcacuuacugaucggaagagagaaagaac

SEQ ID NO: 190620 - RNA, 67 nt, hsa
uucauugggcuguuuucucaacaaauggaaugccauuugcacuuacacaagacuuuccccauacucu

SEQ ID NO: 190621 - RNA, 67 nt, hsa
aagagcugggagcagcacaaggacccagccuuuguucugcacuuaauaaaugguuuugcuacugcua

SEQ ID NO: 190622 - RNA, 67 nt, hsa
gccagugccgggaaggaacugccgggacucaccgagcugcacuuaacuguucucuuucuggcuauuu

SEQ ID NO: 190623 - RNA, 67 nt, hsa
ccagcugagccugaaucugacucuugaggguuggggcugcacuuauuuauugcggggagacagcucu

SEQ ID NO: 190624 - RNA, 67 nt, hsa
uuggaaucaaacaguccugaauucaaauccuuguuuuugcacuuauugucuggagagcuuuggauaa

SEQ ID NO: 190625 - RNA, 67 nt, hsa
auguguuuucacuggauuuuuaucucucucaacuuccugcacuuaacaauaugaaauagaaacuuuu

SEQ ID NO: 190626 - RNA, 67 nt, hsa
ucucaagaagggggcucccugggaucuccagguguacugcacuuacccucaauccagccccggagaa

SEQ ID NO: 190627 - RNA, 67 nt, hsa
gugaggguuucaguacaaaugcugcugucuauuucugugcacuuaacaauggaacccaaacagaaga

SEQ ID NO: 190628 - RNA, 67 nt, hsa
cuaucguguaaagagauuacacaugacuguaccauguugcacuuaaucaaauaguauguggggauuu

SEQ ID NO: 190629 - RNA, 67 nt, hsa
gagaagaacagauaaucccuguauuucaagaccucugugcacuuauuuaugaaccugcccugcuccc

SEQ ID NO: 190630 - RNA, 67 nt, hsa
ugggugccgacuggcugccugacuucaucaugcucccugcacuuaggcugcgugggacaagggcugu

SEQ ID NO: 190631 - RNA, 67 nt, hsa
uccuaauuaacaaaauguucuuccuuuaguuugcuuuugcacuuaaaauauauauaauugacuuuuu

SEQ ID NO: 190632 - RNA, 67 nt, hsa
ucaguauaaguaugcguuacaggguuugauacuuuccugcacuuagguuuguccuauucuucauuua

SEQ ID NO: 190633 - RNA, 67 nt, hsa
aaaguuagcauaauuuuagaugccugugaaauaguacugcacuuacauaaagugagacauugugaaa

SEQ ID NO: 190634 - RNA, 67 nt, hsa
gaaucauaauacauguaguauuuugugucuggcgucuugcacuuagcaugguguucuugagguucau

SEQ ID NO: 190635 - RNA, 67 nt, hsa
aaguacauccuuaaacaaaguaguauguacaugaaauugcacuuaaccaaaacuauuguguaaaaca

SEQ ID NO: 190636 - RNA, 66 nt, hsa
guuaugugaaaauauccuggaaauaaauacauguuucugcacuuagagccagggaccugccgcguu

SEQ ID NO: 190637 - RNA, 67 nt, hsa
gagaagccccagcgagauuuuccggugaauacgggauugcacuuacucuuucaucacggaaacagac

SEQ ID NO: 190638 - RNA, 67 nt, hsa
acagauaagcccccgcggggcggagauuucuaccuucugcacuuacuccccaucagaagaucgaguu

SEQ ID NO: 190639 - RNA, 67 nt, hsa
gggagguuuauuucaccugaauauaauuccuaacugaugcacuuaguauaugucaguuuuuauaaau

SEQ ID NO: 190640 - RNA, 67 nt, hsa
ccgggaaucucuaacaugcucuguuuacaucgauaaaugcacuuaaggaaaacaaacaaauuaaagc

SEQ ID NO: 190641 - RNA, 67 nt, hsa
cccuugacucauauguuuuaacaugauuuuaacaaacugcacuuauuaagaaauguguuugcccugu

SEQ ID NO: 190642 - RNA, 67 nt, hsa
ccaaucacugugacucuagaguggccagacucagagcugcacuuaguagggguuccucaaaggaagg

SEQ ID NO: 190643 - RNA, 67 nt, hsa
ugauaauucacccaugaaagagacccagugguuacugugcacuuaggaaaaccuucagccacaucuu

SEQ ID NO: 190644 - RNA, 67 nt, hsa
ugagaauucacccaugagagagacccagugguugcuaugcacuuaggaaaacuuucagccacaucuu

SEQ ID NO: 190645 - RNA, 67 nt, hsa
uuagaagacagccuacaugguccauugcuacucuugcugcacuuauguaaacaaucagaccacauuu

SEQ ID NO: 190646 - RNA, 58 nt, hsa; identical to SEQ ID NO: 190377

SEQ ID NO: 190647 - RNA, 67 nt, hsa
cuguguauacaaauacaguauuuuccaugguucugccugcacuuacuuuguaaugccacgguugaga

SEQ ID NO: 190648 - RNA, 67 nt, hsa
ucggcuuuucccguugaugucuugaugcuccuaucugugcacuuaccguagguagggacacgugucc

SEQ ID NO: 190649 - RNA, 67 nt, hsa
gaaaagaaaugaaugugaaagaaagccaagcaucacuugcacuuaaaucauuaccacggaagauaua

SEQ ID NO: 190650 - RNA, 67 nt, hsa
uuuuuggggaguaccuguccaagacagggcucauuuuugcacuuaucucgaauuugaagagauugcu

SEQ ID NO: 190651 - RNA, 67 nt, hsa
uucccugcaguaacuaucuauacaccuaccuccagugugcacuuagggggugagcgcgggugucgag

SEQ ID NO: 190652 - RNA, 67 nt, hsa
uugaaggaagcacaugugcaccuuuccuuuacacuaaugcacuuaggauguuucugcaucaugucua

SEQ ID NO: 190653 - RNA, 67 nt, hsa
uccggcucagcgaccuuuccucucaaaugcggaagcgugcacuuacaguucagaccguucuccugua

SEQ ID NO: 190654 - RNA, 67 nt, hsa
aacuauauuuucuggauucuggagguugauaaccauaugcacuuaacauuauauucuauaaacauua

SEQ ID NO: 190655 - RNA, 67 nt, hsa
cgaauauguagaauguuaaaagcacagcaaacugcacugcacuuauaaagcaaaucuauuagaaaaa

SEQ ID NO: 190656 - RNA, 67 nt, hsa
ucuggacuucgguguccucggcucugaaggcgcucucugcacuuagaugcugucagcccucaacgua

SEQ ID NO: 190657 - RNA, 67 nt, hsa
cucauugagggugaugacaagagacauccggggacugugcacuuacagucgguguggaaugucacuc

SEQ ID NO: 190658 - RNA, 67 nt, hsa
uggagggagaccagcaguuaacggugagggagguaggugcacuuacccucuccucucuucuccuauc

SEQ ID NO: 190659 - RNA, 67 nt, hsa
gucccagcuaacucugaccugggagcccucaggcaccugcacuuacaggccuugcucacagcugauu

SEQ ID NO: 190660 - RNA, 67 nt, hsa
ucuuaagacuuucugcugcacucacaggauccugagcugcacuuaccugugagagucuucaaacuuu

SEQ ID NO: 190661 - RNA, 67 nt, hsa
ggugcuuaugugugugggcuugggacgagugcugguaugcacuuaggaccuucuugauagcucccug

SEQ ID NO: 190662 - RNA, 67 nt, hsa
gugaaugcuggucagucugaaaaggugaagcuggcugugcacuuacccccaucuuucucccucgggg

SEQ ID NO: 190663 - RNA, 67 nt, hsa
ggaguccccuuucccugucccagccccaucuguggguugcacuuacaaacccccacccaccuucaga

SEQ ID NO: 190664 - RNA, 67 nt, hsa
auuuuagaaaacuauugaaagaaaucacaggggaaacugcacuuagacugacagaauugaacaccaa

SEQ ID NO: 190665 - RNA, 67 nt, hsa
auaaaaauguaugcaauuccugaguguagaaacuucuugcacuuauuuaaaauuuaggagagaacau

SEQ ID NO: 190666 - RNA, 67 nt, hsa
uguaauuuuaaaagucuauuuuauuaugagcuuucuuugcacuuaaaaauuagcaugcugcuuuuug

SEQ ID NO: 190667 - RNA, 67 nt, hsa
gggcugcccaugccgcucaggcuacccuuaucuccucugcacuuauguuaucaauaaagaggcaaau

SEQ ID NO: 190668 - RNA, 67 nt, hsa
agaaaugccaguguguccuagaaccuagauaacgaagugcacuuacacuuauaaaauaacuugcauc

SEQ ID NO: 190669 - RNA, 64 nt, hsa; identical to SEQ ID NO: 104928

SEQ ID NO: 190670 - RNA, 64 nt, hsa; identical to SEQ ID NO: 104929

SEQ ID NO: 190671 - RNA, 64 nt, hsa; identical to SEQ ID NO: 104930

SEQ ID NO: 190672 - RNA, 64 nt, hsa; identical to SEQ ID NO: 104931

SEQ ID NO: 190673 - RNA, 64 nt, hsa; identical to SEQ ID NO: 104932

SEQ ID NO: 190674 - RNA, 64 nt, hsa; identical to SEQ ID NO: 104933

SEQ ID NO: 190675 - RNA, 64 nt, hsa; identical to SEQ ID NO: 104934

SEQ ID NO: 190676 - RNA, 64 nt, hsa; identical to SEQ ID NO: 104935

SEQ ID NO: 190677 - RNA, 64 nt, hsa; identical to SEQ ID NO: 104936

SEQ ID NO: 190678 - RNA, 64 nt, hsa; identical to SEQ ID NO: 104937

SEQ ID NO: 190679 - RNA, 64 nt, hsa; identical to SEQ ID NO: 104938

SEQ ID NO: 190680 - RNA, 64 nt, hsa; identical to SEQ ID NO: 104939

SEQ ID NO: 190681 - RNA, 64 nt, hsa; identical to SEQ ID NO: 104940

SEQ ID NO: 190682 - RNA, 64 nt, hsa; identical to SEQ ID NO: 104941

SEQ ID NO: 190683 - RNA, 64 nt, hsa; identical to SEQ ID NO: 104942

SEQ ID NO: 190684 - RNA, 64 nt, hsa; identical to SEQ ID NO: 104943

SEQ ID NO: 190685 - RNA, 64 nt, hsa; identical to SEQ ID NO: 104944

SEQ ID NO: 190686 - RNA, 64 nt, hsa; identical to SEQ ID NO: 104945

SEQ ID NO: 190687 - RNA, 64 nt, hsa; identical to SEQ ID NO: 104946

SEQ ID NO: 190688 - RNA, 64 nt, hsa; identical to SEQ ID NO: 104947

SEQ ID NO: 190689 - RNA, 64 nt, hsa; identical to SEQ ID NO: 104948

SEQ ID NO: 190690 - RNA, 64 nt, hsa; identical to SEQ ID NO: 104949

SEQ ID NO: 190691 - RNA, 63 nt, hsa
cuugguguagggggagaggggaaaggggucuggcccaucgaggggccccuucugccagggccu

SEQ ID NO: 190692 - RNA, 63 nt, hsa
uuuuuuguuuuuuggcucuuucaaagguaauggcccaucgaugagcauuuuuaacauacucca

SEQ ID NO: 190693 - RNA, 63 nt, hsa
acuguuuccccuacaucuuuugagccacagucgcccaucgaauaagcaaauuuguuuuugaga

SEQ ID NO: 190694 - RNA, 63 nt, hsa
agagauuuuagcauugccuuggcauaacaagggcccaucgauucccuacuaaugagaggcagg

SEQ ID NO: 190695 - RNA, 63 nt, hsa
cuuuuacaaugaguuccuuaggugguauuuuaacccaucgaucuauaaugaugacucuuggca

SEQ ID NO: 190696 - RNA, 63 nt, hsa
aaaugaagccucuuuggggugaagccuggacaucccaucgaaugaaaggacacuaguacagcg

SEQ ID NO: 190697 - RNA, 63 nt, hsa
ugcaugucucacucacccuccacagcacucagucccaucgacguucacugaacauuggcuuuc

SEQ ID NO: 190698 - RNA, 63 nt, hsa
gaaaagcuugggcggugcccagcgugcccgcugcccaucgacgucuguccuggggacguggag

SEQ ID NO: 190699 - RNA, 63 nt, hsa
cuaugugcccuacauggcaaggcaccaugacugcccaucgagaugccaagaagggcuauggaa

SEQ ID NO: 190700 - RNA, 63 nt, hsa
aaugcugagaaugagagcggcggagacaagccccccaucgaucccaguaagugucuccucccu

SEQ ID NO: 190701 - RNA, 63 nt, hsa
aggccugcagucucauccugcccuugccauccucccaucgaugugccacgugggugucacgug

SEQ ID NO: 190702 - RNA, 63 nt, hsa
gacuggucgcacucgcagcugcuggacuugggccccaucgacgcgcucaacuucuucugugag

SEQ ID NO: 190703 - RNA, 63 nt, hsa
gcacccggugagugaggacagucccagcugagucccaucgauguugaaucucaugccacugca

SEQ ID NO: 190704 - RNA, 63 nt, hsa
gacaguggcaacugaaaacagucccagaaugaccccaucgagaugaaauuaaacagauuagaa

SEQ ID NO: 190705 - RNA, 63 nt, hsa
cacagccaccuccccaccuccccgcaagcuggucccaucgaccagcaagcccagccccagggc

SEQ ID NO: 190706 - RNA, 63 nt, hsa
caaugucaucacucaauauugcgaagcacaugccccaucgagccuacugggcagagcagcaga

SEQ ID NO: 190707 - RNA, 63 nt, hsa
aaacaggcuucuggcaguagcuuugguuccuaucccaucgaaauuccccaaagcccugggcca

SEQ ID NO: 190708 - RNA, 63 nt, hsa
aauguaaauauaaacagucacaauuaguauagacccaucgauauauuuuugauaauuuuucau

SEQ ID NO: 190709 - RNA, 63 nt, hsa
uacugagccugcggugcauggcucaggccuuuucccaucgacgucuagggggacucuggaccg

SEQ ID NO: 190710 - RNA, 63 nt, hsa
gacuaaucaucuucuuagcauuuuacugcgggucccaucgacuuagaaauggcuguugcguau

SEQ ID NO: 190711 - RNA, 63 nt, hsa
aguggcgcucccugucagagcuggaucaggccccccaucgaggagggagggcagacggaggcc

SEQ ID NO: 190712 - RNA, 63 nt, hsa
auuucaccuguuuacuuaggguaucuacccagacccaucgauucugaguucgggagaugauuu

SEQ ID NO: 190713 - RNA, 63 nt, hsa
aggagcgccgcccccugcuccacagcgcccagucccaucgaccacccaagggcugaggagugc

SEQ ID NO: 190714 - RNA, 63 nt, hsa
gaaccuuguauaauuaacuuucaguuaugauuucccaucgacauuuucuuugcccuguuugua

SEQ ID NO: 190715 - RNA, 63 nt, hsa
cagccugaguggacagcagugucccggcacaggcccaucgagccggguccaguacccaaccuu

SEQ ID NO: 190716 - RNA, 63 nt, hsa
aauaacuuuuucaagcaauaucagugagugggucccaucgacaggguuccaggaccuggaaca

SEQ ID NO: 190717 - RNA, 63 nt, hsa
aaaggggauagaaagcuccuuccucuauguccucccaucgagaucuguucuggggauggagcu

SEQ ID NO: 190718 - RNA, 63 nt, hsa
cugcaugaaaauaaccuccaaggacccucugaccccaucgaccugggcccugcccacacaaca

SEQ ID NO: 190719 - RNA, 63 nt, hsa
ggcaccguggguguaagaugccuuucuccuccacccaucgaaaccagccaccccuucccugug

SEQ ID NO: 190720 - RNA, 63 nt, hsa
ccagggguuaggucugcaggcccgucugcgguccccaucgagcaucaaggggacgcugugugu

SEQ ID NO: 190721 - RNA, 63 nt, hsa
caacuccagaaggucauuccagauccagagauccccaucgaacugaaggaucacuggguugca

SEQ ID NO: 190722 - RNA, 63 nt, hsa
ggcaccaacuuugugauugguuugucagugucccccaucgacucucuggggcugaucacuuag

SEQ ID NO: 190723 - RNA, 63 nt, hsa
gggacccucgggagaccccguggcugucuccgccccaucgaggaggaggcccgucagccaugg

SEQ ID NO: 190724 - RNA, 63 nt, hsa
ccaggcccaacucugcuagcuucccagaccacccccaucgagugcggagagagugggagugcu

SEQ ID NO: 190725 - RNA, 63 nt, hsa
cccggccagcgcccaccccagccuucugcccgccccaucgaggaggccccucgggggcagcac

SEQ ID NO: 190726 - RNA, 63 nt, hsa
cgcccccgccccacccaucgcgccccggcccgucccaucgaggcccaugcaacccacgcucgg

SEQ ID NO: 190727 - RNA, 64 nt, hsa; identical to SEQ ID NO: 88035

SEQ ID NO: 190728 - RNA, 64 nt, hsa; identical to SEQ ID NO: 88036

SEQ ID NO: 190729 - RNA, 64 nt, hsa; identical to SEQ ID NO: 88037

SEQ ID NO: 190730 - RNA, 64 nt, hsa; identical to SEQ ID NO: 88038

SEQ ID NO: 190731 - RNA, 64 nt, hsa; identical to SEQ ID NO: 88039

SEQ ID NO: 190732 - RNA, 64 nt, hsa; identical to SEQ ID NO: 88040

SEQ ID NO: 190733 - RNA, 64 nt, hsa; identical to SEQ ID NO: 88041

SEQ ID NO: 190734 - RNA, 64 nt, hsa; identical to SEQ ID NO: 88042

SEQ ID NO: 190735 - RNA, 64 nt, hsa; identical to SEQ ID NO: 88043

SEQ ID NO: 190736 - RNA, 64 nt, hsa; identical to SEQ ID NO: 88044

SEQ ID NO: 190737 - RNA, 64 nt, hsa; identical to SEQ ID NO: 88045

SEQ ID NO: 190738 - RNA, 64 nt, hsa; identical to SEQ ID NO: 88046

SEQ ID NO: 190739 - RNA, 64 nt, hsa; identical to SEQ ID NO: 88047

SEQ ID NO: 190740 - RNA, 64 nt, hsa; identical to SEQ ID NO: 88048

SEQ ID NO: 190741 - RNA, 64 nt, hsa; identical to SEQ ID NO: 88049

SEQ ID NO: 190742 - RNA, 64 nt, hsa; identical to SEQ ID NO: 88050

SEQ ID NO: 190743 - RNA, 64 nt, hsa; identical to SEQ ID NO: 88051

SEQ ID NO: 190744 - RNA, 64 nt, hsa; identical to SEQ ID NO: 88052

SEQ ID NO: 190745 - RNA, 64 nt, hsa; identical to SEQ ID NO: 88053

SEQ ID NO: 190746 - RNA, 64 nt, hsa; identical to SEQ ID NO: 88054

SEQ ID NO: 190747 - RNA, 64 nt, hsa; identical to SEQ ID NO: 88055

SEQ ID NO: 190748 - RNA, 64 nt, hsa; identical to SEQ ID NO: 88056

SEQ ID NO: 190749 - RNA, 64 nt, hsa; identical to SEQ ID NO: 88057

SEQ ID NO: 190750 - RNA, 64 nt, hsa; identical to SEQ ID NO: 88058

SEQ ID NO: 190751 - RNA, 64 nt, hsa; identical to SEQ ID NO: 88059

SEQ ID NO: 190752 - RNA, 64 nt, hsa; identical to SEQ ID NO: 88060

SEQ ID NO: 190753 - RNA, 64 nt, hsa; identical to SEQ ID NO: 88061

SEQ ID NO: 190754 - RNA, 64 nt, hsa; identical to SEQ ID NO: 88062

SEQ ID NO: 190755 - RNA, 64 nt, hsa; identical to SEQ ID NO: 88063

SEQ ID NO: 190756 - RNA, 64 nt, hsa; identical to SEQ ID NO: 88064

SEQ ID NO: 190757 - RNA, 64 nt, hsa; identical to SEQ ID NO: 88065

SEQ ID NO: 190758 - RNA, 64 nt, hsa; identical to SEQ ID NO: 88066

SEQ ID NO: 190759 - RNA, 64 nt, hsa; identical to SEQ ID NO: 88067

SEQ ID NO: 190760 - RNA, 64 nt, hsa; identical to SEQ ID NO: 88068

SEQ ID NO: 190761 - RNA, 64 nt, hsa; identical to SEQ ID NO: 88069

SEQ ID NO: 190762 - RNA, 64 nt, hsa; identical to SEQ ID NO: 88070

SEQ ID NO: 190763 - RNA, 64 nt, hsa; identical to SEQ ID NO: 88071

SEQ ID NO: 190764 - RNA, 64 nt, hsa; identical to SEQ ID NO: 88072

SEQ ID NO: 190765 - RNA, 64 nt, hsa; identical to SEQ ID NO: 88073

SEQ ID NO: 190766 - RNA, 64 nt, hsa; identical to SEQ ID NO: 88074

SEQ ID NO: 190767 - RNA, 64 nt, hsa; identical to SEQ ID NO: 88075

SEQ ID NO: 190768 - RNA, 64 nt, hsa; identical to SEQ ID NO: 88076

SEQ ID NO: 190769 - RNA, 64 nt, hsa; identical to SEQ ID NO: 88077

SEQ ID NO: 190770 - RNA, 64 nt, hsa; identical to SEQ ID NO: 88078

SEQ ID NO: 190771 - RNA, 64 nt, hsa; identical to SEQ ID NO: 88079

SEQ ID NO: 190772 - RNA, 64 nt, hsa; identical to SEQ ID NO: 88080

SEQ ID NO: 190773 - RNA, 64 nt, hsa; identical to SEQ ID NO: 88081

SEQ ID NO: 190774 - RNA, 64 nt, hsa; identical to SEQ ID NO: 88082

SEQ ID NO: 190775 - RNA, 64 nt, hsa; identical to SEQ ID NO: 88083

SEQ ID NO: 190776 - RNA, 64 nt, hsa; identical to SEQ ID NO: 88084

SEQ ID NO: 190777 - RNA, 64 nt, hsa; identical to SEQ ID NO: 88085

SEQ ID NO: 190778 - RNA, 64 nt, hsa; identical to SEQ ID NO: 88086

SEQ ID NO: 190779 - RNA, 64 nt, hsa; identical to SEQ ID NO: 88087

SEQ ID NO: 190780 - RNA, 64 nt, hsa; identical to SEQ ID NO: 88088

SEQ ID NO: 190781 - RNA, 64 nt, hsa; identical to SEQ ID NO: 88089

SEQ ID NO: 190782 - RNA, 64 nt, hsa; identical to SEQ ID NO: 88090

SEQ ID NO: 190783 - RNA, 64 nt, hsa; identical to SEQ ID NO: 88091

SEQ ID NO: 190784 - RNA, 64 nt, hsa; identical to SEQ ID NO: 88092

SEQ ID NO: 190785 - RNA, 64 nt, hsa; identical to SEQ ID NO: 88093

SEQ ID NO: 190786 - RNA, 64 nt, hsa; identical to SEQ ID NO: 88094

SEQ ID NO: 190787 - RNA, 64 nt, hsa; identical to SEQ ID NO: 88095

SEQ ID NO: 190788 - RNA, 64 nt, hsa; identical to SEQ ID NO: 88096

SEQ ID NO: 190789 - RNA, 64 nt, hsa; identical to SEQ ID NO: 88097

SEQ ID NO: 190790 - RNA, 64 nt, hsa; identical to SEQ ID NO: 88098

SEQ ID NO: 190791 - RNA, 64 nt, hsa; identical to SEQ ID NO: 88099

SEQ ID NO: 190792 - RNA, 64 nt, hsa; identical to SEQ ID NO: 88100

SEQ ID NO: 190793 - RNA, 64 nt, hsa; identical to SEQ ID NO: 88101

SEQ ID NO: 190794 - RNA, 64 nt, hsa; identical to SEQ ID NO: 88102

SEQ ID NO: 190795 - RNA, 64 nt, hsa; identical to SEQ ID NO: 88103

SEQ ID NO: 190796 - RNA, 64 nt, hsa; identical to SEQ ID NO: 88104

SEQ ID NO: 190797 - RNA, 64 nt, hsa; identical to SEQ ID NO: 88105

SEQ ID NO: 190798 - RNA, 64 nt, hsa; identical to SEQ ID NO: 88106

SEQ ID NO: 190799 - RNA, 64 nt, hsa; identical to SEQ ID NO: 88107

SEQ ID NO: 190800 - RNA, 64 nt, hsa; identical to SEQ ID NO: 88108

SEQ ID NO: 190801 - RNA, 64 nt, hsa; identical to SEQ ID NO: 88109

SEQ ID NO: 190802 - RNA, 64 nt, hsa; identical to SEQ ID NO: 88110

SEQ ID NO: 190803 - RNA, 64 nt, hsa; identical to SEQ ID NO: 88111

SEQ ID NO: 190804 - RNA, 64 nt, hsa; identical to SEQ ID NO: 88112

SEQ ID NO: 190805 - RNA, 64 nt, hsa; identical to SEQ ID NO: 88113

SEQ ID NO: 190806 - RNA, 64 nt, hsa; identical to SEQ ID NO: 88114

SEQ ID NO: 190807 - RNA, 64 nt, hsa; identical to SEQ ID NO: 88115

SEQ ID NO: 190808 - RNA, 64 nt, hsa; identical to SEQ ID NO: 88116

SEQ ID NO: 190809 - RNA, 64 nt, hsa; identical to SEQ ID NO: 88117

SEQ ID NO: 190810 - RNA, 64 nt, hsa; identical to SEQ ID NO: 88118

SEQ ID NO: 190811 - RNA, 64 nt, hsa; identical to SEQ ID NO: 88119

SEQ ID NO: 190812 - RNA, 64 nt, hsa; identical to SEQ ID NO: 88120

SEQ ID NO: 190813 - RNA, 64 nt, hsa; identical to SEQ ID NO: 88121

SEQ ID NO: 190814 - RNA, 64 nt, hsa; identical to SEQ ID NO: 88122

SEQ ID NO: 190815 - RNA, 64 nt, hsa; identical to SEQ ID NO: 88123

SEQ ID NO: 190816 - RNA, 64 nt, hsa; identical to SEQ ID NO: 88124

SEQ ID NO: 190817 - RNA, 64 nt, hsa; identical to SEQ ID NO: 88125

SEQ ID NO: 190818 - RNA, 64 nt, hsa; identical to SEQ ID NO: 88126

SEQ ID NO: 190819 - RNA, 64 nt, hsa
aauguuuaaaucgcuaaaggaaaauacaguaagugcuugaaagaugaaggaccaaaaggccaaa

SEQ ID NO: 190820 - RNA, 64 nt, hsa
uacuggcacuggaagaguuuaguguuucuuguaugcuugaaaauaaaguauguacuguuuugaa

SEQ ID NO: 190821 - RNA, 64 nt, hsa
cugggugagucugccaacucacaggugcuuuuaggcuugaaaucuccauccuaucauuuccguu

SEQ ID NO: 190822 - RNA, 64 nt, hsa
aguuuuguuugguuuacuuucaaaagaguagaaagcuugaaaagauucugaaaccacaguuuca

SEQ ID NO: 190823 - RNA, 64 nt, hsa
uccagcugggccaugucagucucaucgucccaaggcuugaaauccagcaggauggaggacuugg

SEQ ID NO: 190824 - RNA, 64 nt, hsa
ccaguguuggugaaucuuuuggccuuuccccaaugcuugaaagaagaucaccacugcuggaggc

SEQ ID NO: 190825 - RNA, 64 nt, hsa
agggugauaauaaucuccauaguuauuugaaguggcuugaaaaaggcaagauugacuuuuauga

SEQ ID NO: 190826 - RNA, 64 nt, hsa
aucauaacacucucggucacauguuuuuccuucagcuugaaagcuuuuuuuuaaaaggaaaaga

SEQ ID NO: 190827 - RNA, 64 nt, hsa
gcccaguuugucuuucagaaggugacuuucaugugcuugaaaaguuuaauauuugaauauugug

SEQ ID NO: 190828 - RNA, 64 nt, hsa
guuguuuucuuuaggagucuaccuuuguguaugugcuugaaaguauuuuuguaauccaagaaug

SEQ ID NO: 190829 - RNA, 64 nt, hsa
ugugcuaccaguuugcugguggcuaacggcuugugcuugaaagucuucugaagucugaugugaa

SEQ ID NO: 190830 - RNA, 64 nt, hsa
ugcaugcauguugaaauuuuuuagcaguacuuuagcuugaaaguacucguacaaauacuguuag

SEQ ID NO: 190831 - RNA, 64 nt, hsa
uaguaaauaaaacaguguauuuugaaguuugacugcuugaaaaagauuagcauacaucuaaugu

SEQ ID NO: 190832 - RNA, 64 nt, hsa
aaacugucagaauuguuaacugaaacaaauauuugcuugaaaaaaaaaguucaugaaguaccaa

SEQ ID NO: 190833 - RNA, 62 nt, hsa; identical to SEQ ID NO: 64857

SEQ ID NO: 190834 - RNA, 62 nt, hsa; identical to SEQ ID NO: 64858

SEQ ID NO: 190835 - RNA, 62 nt, hsa; identical to SEQ ID NO: 64859

SEQ ID NO: 190836 - RNA, 62 nt, hsa; identical to SEQ ID NO: 64860

SEQ ID NO: 190837 - RNA, 62 nt, hsa; identical to SEQ ID NO: 64861

SEQ ID NO: 190838 - RNA, 62 nt, hsa; identical to SEQ ID NO: 64862

SEQ ID NO: 190839 - RNA, 62 nt, hsa; identical to SEQ ID NO: 64863

SEQ ID NO: 190840 - RNA, 62 nt, hsa; identical to SEQ ID NO: 64864

SEQ ID NO: 190841 - RNA, 62 nt, hsa; identical to SEQ ID NO: 64865

SEQ ID NO: 190842 - RNA, 62 nt, hsa; identical to SEQ ID NO: 64866

SEQ ID NO: 190843 - RNA, 62 nt, hsa; identical to SEQ ID NO: 64867

SEQ ID NO: 190844 - RNA, 62 nt, hsa; identical to SEQ ID NO: 64868

SEQ ID NO: 190845 - RNA, 62 nt, hsa; identical to SEQ ID NO: 64869

SEQ ID NO: 190846 - RNA, 62 nt, hsa; identical to SEQ ID NO: 64870

SEQ ID NO: 190847 - RNA, 62 nt, hsa; identical to SEQ ID NO: 64871

SEQ ID NO: 190848 - RNA, 62 nt, hsa; identical to SEQ ID NO: 64872

SEQ ID NO: 190849 - RNA, 62 nt, hsa; identical to SEQ ID NO: 64873

SEQ ID NO: 190850 - RNA, 62 nt, hsa; identical to SEQ ID NO: 64874

SEQ ID NO: 190851 - RNA, 62 nt, hsa; identical to SEQ ID NO: 64875

SEQ ID NO: 190852 - RNA, 62 nt, hsa; identical to SEQ ID NO: 64876

SEQ ID NO: 190853 - RNA, 62 nt, hsa; identical to SEQ ID NO: 64877

SEQ ID NO: 190854 - RNA, 62 nt, hsa; identical to SEQ ID NO: 64878

SEQ ID NO: 190855 - RNA, 62 nt, hsa; identical to SEQ ID NO: 64879

SEQ ID NO: 190856 - RNA, 62 nt, hsa; identical to SEQ ID NO: 64880

SEQ ID NO: 190857 - RNA, 62 nt, hsa; identical to SEQ ID NO: 64881

SEQ ID NO: 190858 - RNA, 62 nt, hsa; identical to SEQ ID NO: 64882

SEQ ID NO: 190859 - RNA, 62 nt, hsa; identical to SEQ ID NO: 64883

SEQ ID NO: 190860 - RNA, 62 nt, hsa; identical to SEQ ID NO: 64884

SEQ ID NO: 190861 - RNA, 62 nt, hsa; identical to SEQ ID NO: 64885

SEQ ID NO: 190862 - RNA, 62 nt, hsa; identical to SEQ ID NO: 64886

SEQ ID NO: 190863 - RNA, 62 nt, hsa; identical to SEQ ID NO: 64887

SEQ ID NO: 190864 - RNA, 62 nt, hsa; identical to SEQ ID NO: 64888

SEQ ID NO: 190865 - RNA, 62 nt, hsa; identical to SEQ ID NO: 64889

SEQ ID NO: 190866 - RNA, 62 nt, hsa; identical to SEQ ID NO: 64890

SEQ ID NO: 190867 - RNA, 62 nt, hsa; identical to SEQ ID NO: 64891

SEQ ID NO: 190868 - RNA, 62 nt, hsa; identical to SEQ ID NO: 64892

SEQ ID NO: 190869 - RNA, 62 nt, hsa; identical to SEQ ID NO: 64893

SEQ ID NO: 190870 - RNA, 62 nt, hsa; identical to SEQ ID NO: 64894

SEQ ID NO: 190871 - RNA, 62 nt, hsa; identical to SEQ ID NO: 64895

SEQ ID NO: 190872 - RNA, 62 nt, hsa; identical to SEQ ID NO: 64896

SEQ ID NO: 190873 - RNA, 62 nt, hsa; identical to SEQ ID NO: 64897

SEQ ID NO: 190874 - RNA, 62 nt, hsa; identical to SEQ ID NO: 64898

SEQ ID NO: 190875 - RNA, 62 nt, hsa; identical to SEQ ID NO: 64899

SEQ ID NO: 190876 - RNA, 62 nt, hsa; identical to SEQ ID NO: 64900

SEQ ID NO: 190877 - RNA, 62 nt, hsa; identical to SEQ ID NO: 64901

SEQ ID NO: 190878 - RNA, 62 nt, hsa; identical to SEQ ID NO: 64902

SEQ ID NO: 190879 - RNA, 62 nt, hsa; identical to SEQ ID NO: 64903

SEQ ID NO: 190880 - RNA, 62 nt, hsa; identical to SEQ ID NO: 64904

SEQ ID NO: 190881 - RNA, 62 nt, hsa; identical to SEQ ID NO: 64905

SEQ ID NO: 190882 - RNA, 62 nt, hsa; identical to SEQ ID NO: 64906

SEQ ID NO: 190883 - RNA, 62 nt, hsa; identical to SEQ ID NO: 64907

SEQ ID NO: 190884 - RNA, 62 nt, hsa; identical to SEQ ID NO: 64908

SEQ ID NO: 190885 - RNA, 62 nt, hsa; identical to SEQ ID NO: 64909

SEQ ID NO: 190886 - RNA, 62 nt, hsa; identical to SEQ ID NO: 64910

SEQ ID NO: 190887 - RNA, 62 nt, hsa; identical to SEQ ID NO: 64911

SEQ ID NO: 190888 - RNA, 62 nt, hsa; identical to SEQ ID NO: 64912

SEQ ID NO: 190889 - RNA, 62 nt, hsa; identical to SEQ ID NO: 64913

SEQ ID NO: 190890 - RNA, 62 nt, hsa; identical to SEQ ID NO: 64914

SEQ ID NO: 190891 - RNA, 62 nt, hsa; identical to SEQ ID NO: 64915

SEQ ID NO: 190892 - RNA, 62 nt, hsa; identical to SEQ ID NO: 64916

SEQ ID NO: 190893 - RNA, 62 nt, hsa; identical to SEQ ID NO: 64917

SEQ ID NO: 190894 - RNA, 62 nt, hsa; identical to SEQ ID NO: 64918

SEQ ID NO: 190895 - RNA, 62 nt, hsa; identical to SEQ ID NO: 64919

SEQ ID NO: 190896 - RNA, 62 nt, hsa; identical to SEQ ID NO: 64920

SEQ ID NO: 190897 - RNA, 62 nt, hsa; identical to SEQ ID NO: 64921

SEQ ID NO: 190898 - RNA, 62 nt, hsa; identical to SEQ ID NO: 64922

SEQ ID NO: 190899 - RNA, 62 nt, hsa; identical to SEQ ID NO: 64923

SEQ ID NO: 190900 - RNA, 62 nt, hsa; identical to SEQ ID NO: 64924

SEQ ID NO: 190901 - RNA, 62 nt, hsa; identical to SEQ ID NO: 64925

SEQ ID NO: 190902 - RNA, 62 nt, hsa; identical to SEQ ID NO: 64926

SEQ ID NO: 190903 - RNA, 62 nt, hsa; identical to SEQ ID NO: 64927

SEQ ID NO: 190904 - RNA, 62 nt, hsa; identical to SEQ ID NO: 64928

SEQ ID NO: 190905 - RNA, 62 nt, hsa; identical to SEQ ID NO: 64929

SEQ ID NO: 190906 - RNA, 62 nt, hsa; identical to SEQ ID NO: 64930

SEQ ID NO: 190907 - RNA, 62 nt, hsa; identical to SEQ ID NO: 64931

SEQ ID NO: 190908 - RNA, 62 nt, hsa; identical to SEQ ID NO: 64932

SEQ ID NO: 190909 - RNA, 62 nt, hsa; identical to SEQ ID NO: 64933

SEQ ID NO: 190910 - RNA, 62 nt, hsa; identical to SEQ ID NO: 64934

SEQ ID NO: 190911 - RNA, 62 nt, hsa; identical to SEQ ID NO: 64935

SEQ ID NO: 190912 - RNA, 62 nt, hsa; identical to SEQ ID NO: 64936

SEQ ID NO: 190913 - RNA, 62 nt, hsa; identical to SEQ ID NO: 64937

SEQ ID NO: 190914 - RNA, 62 nt, hsa; identical to SEQ ID NO: 64938

SEQ ID NO: 190915 - RNA, 62 nt, hsa; identical to SEQ ID NO: 64939

SEQ ID NO: 190916 - RNA, 62 nt, hsa; identical to SEQ ID NO: 64940

SEQ ID NO: 190917 - RNA, 62 nt, hsa; identical to SEQ ID NO: 64941

SEQ ID NO: 190918 - RNA, 62 nt, hsa; identical to SEQ ID NO: 64942

SEQ ID NO: 190919 - RNA, 62 nt, hsa; identical to SEQ ID NO: 64943

SEQ ID NO: 190920 - RNA, 62 nt, hsa; identical to SEQ ID NO: 64944

SEQ ID NO: 190921 - RNA, 62 nt, hsa; identical to SEQ ID NO: 64945

SEQ ID NO: 190922 - RNA, 62 nt, hsa; identical to SEQ ID NO: 64946

SEQ ID NO: 190923 - RNA, 62 nt, hsa; identical to SEQ ID NO: 64947

SEQ ID NO: 190924 - RNA, 62 nt, hsa; identical to SEQ ID NO: 64948

SEQ ID NO: 190925 - RNA, 62 nt, hsa; identical to SEQ ID NO: 64949

SEQ ID NO: 190926 - RNA, 62 nt, hsa; identical to SEQ ID NO: 64950

SEQ ID NO: 190927 - RNA, 62 nt, hsa; identical to SEQ ID NO: 64951

SEQ ID NO: 190928 - RNA, 62 nt, hsa; identical to SEQ ID NO: 64952

SEQ ID NO: 190929 - RNA, 62 nt, hsa; identical to SEQ ID NO: 64953

SEQ ID NO: 190930 - RNA, 62 nt, hsa; identical to SEQ ID NO: 64954

SEQ ID NO: 190931 - RNA, 62 nt, hsa; identical to SEQ ID NO: 64955

SEQ ID NO: 190932 - RNA, 62 nt, hsa; identical to SEQ ID NO: 64956

SEQ ID NO: 190933 - RNA, 62 nt, hsa; identical to SEQ ID NO: 64957

SEQ ID NO: 190934 - RNA, 62 nt, hsa; identical to SEQ ID NO: 64958

SEQ ID NO: 190935 - RNA, 62 nt, hsa; identical to SEQ ID NO: 64959

SEQ ID NO: 190936 - RNA, 62 nt, hsa; identical to SEQ ID NO: 64960

SEQ ID NO: 190937 - RNA, 62 nt, hsa; identical to SEQ ID NO: 64961

SEQ ID NO: 190938 - RNA, 62 nt, hsa; identical to SEQ ID NO: 64962

SEQ ID NO: 190939 - RNA, 62 nt, hsa; identical to SEQ ID NO: 64963

SEQ ID NO: 190940 - RNA, 62 nt, hsa; identical to SEQ ID NO: 64964

SEQ ID NO: 190941 - RNA, 62 nt, hsa; identical to SEQ ID NO: 64965

SEQ ID NO: 190942 - RNA, 62 nt, hsa; identical to SEQ ID NO: 64966

SEQ ID NO: 190943 - RNA, 62 nt, hsa; identical to SEQ ID NO: 64967

SEQ ID NO: 190944 - RNA, 62 nt, hsa; identical to SEQ ID NO: 64968

SEQ ID NO: 190945 - RNA, 62 nt, hsa; identical to SEQ ID NO: 64969

SEQ ID NO: 190946 - RNA, 62 nt, hsa; identical to SEQ ID NO: 64970

SEQ ID NO: 190947 - RNA, 62 nt, hsa; identical to SEQ ID NO: 64971

SEQ ID NO: 190948 - RNA, 62 nt, hsa; identical to SEQ ID NO: 64972

SEQ ID NO: 190949 - RNA, 62 nt, hsa; identical to SEQ ID NO: 64973

SEQ ID NO: 190950 - RNA, 62 nt, hsa; identical to SEQ ID NO: 64974

SEQ ID NO: 190951 - RNA, 62 nt, hsa; identical to SEQ ID NO: 64975

SEQ ID NO: 190952 - RNA, 62 nt, hsa; identical to SEQ ID NO: 64976

SEQ ID NO: 190953 - RNA, 62 nt, hsa; identical to SEQ ID NO: 64977

SEQ ID NO: 190954 - RNA, 62 nt, hsa; identical to SEQ ID NO: 64978

SEQ ID NO: 190955 - RNA, 62 nt, hsa; identical to SEQ ID NO: 64979

SEQ ID NO: 190956 - RNA, 62 nt, hsa; identical to SEQ ID NO: 64980

SEQ ID NO: 190957 - RNA, 62 nt, hsa; identical to SEQ ID NO: 64981

SEQ ID NO: 190958 - RNA, 62 nt, hsa; identical to SEQ ID NO: 64982

SEQ ID NO: 190959 - RNA, 62 nt, hsa; identical to SEQ ID NO: 64983

SEQ ID NO: 190960 - RNA, 62 nt, hsa; identical to SEQ ID NO: 64984

SEQ ID NO: 190961 - RNA, 62 nt, hsa; identical to SEQ ID NO: 64985

SEQ ID NO: 190962 - RNA, 62 nt, hsa; identical to SEQ ID NO: 64986

SEQ ID NO: 190963 - RNA, 62 nt, hsa; identical to SEQ ID NO: 64987

SEQ ID NO: 190964 - RNA, 62 nt, hsa; identical to SEQ ID NO: 64988

SEQ ID NO: 190965 - RNA, 62 nt, hsa; identical to SEQ ID NO: 64989

SEQ ID NO: 190966 - RNA, 62 nt, hsa; identical to SEQ ID NO: 64990

SEQ ID NO: 190967 - RNA, 62 nt, hsa; identical to SEQ ID NO: 64991

SEQ ID NO: 190968 - RNA, 62 nt, hsa; identical to SEQ ID NO: 64992

SEQ ID NO: 190969 - RNA, 62 nt, hsa; identical to SEQ ID NO: 64993

SEQ ID NO: 190970 - RNA, 62 nt, hsa; identical to SEQ ID NO: 64994

SEQ ID NO: 190971 - RNA, 56 nt, hsa; identical to SEQ ID NO: 61369

SEQ ID NO: 190972 - RNA, 62 nt, hsa; identical to SEQ ID NO: 64996

SEQ ID NO: 190973 - RNA, 62 nt, hsa; identical to SEQ ID NO: 64997

SEQ ID NO: 190974 - RNA, 62 nt, hsa; identical to SEQ ID NO: 64998

SEQ ID NO: 190975 - RNA, 62 nt, hsa; identical to SEQ ID NO: 64999

SEQ ID NO: 190976 - RNA, 62 nt, hsa; identical to SEQ ID NO: 65000

SEQ ID NO: 190977 - RNA, 62 nt, hsa; identical to SEQ ID NO: 65001

SEQ ID NO: 190978 - RNA, 62 nt, hsa; identical to SEQ ID NO: 65002

SEQ ID NO: 190979 - RNA, 62 nt, hsa; identical to SEQ ID NO: 65003

SEQ ID NO: 190980 - RNA, 62 nt, hsa; identical to SEQ ID NO: 65004

SEQ ID NO: 190981 - RNA, 62 nt, hsa; identical to SEQ ID NO: 65005

SEQ ID NO: 190982 - RNA, 62 nt, hsa; identical to SEQ ID NO: 65006

SEQ ID NO: 190983 - RNA, 62 nt, hsa; identical to SEQ ID NO: 65007

SEQ ID NO: 190984 - RNA, 62 nt, hsa; identical to SEQ ID NO: 65008

SEQ ID NO: 190985 - RNA, 62 nt, hsa; identical to SEQ ID NO: 65009

SEQ ID NO: 190986 - RNA, 62 nt, hsa; identical to SEQ ID NO: 65010

SEQ ID NO: 190987 - RNA, 62 nt, hsa; identical to SEQ ID NO: 65011

SEQ ID NO: 190988 - RNA, 62 nt, hsa; identical to SEQ ID NO: 65012

SEQ ID NO: 190989 - RNA, 62 nt, hsa; identical to SEQ ID NO: 65013

SEQ ID NO: 190990 - RNA, 62 nt, hsa; identical to SEQ ID NO: 65014

SEQ ID NO: 190991 - RNA, 62 nt, hsa; identical to SEQ ID NO: 65015

SEQ ID NO: 190992 - RNA, 62 nt, hsa; identical to SEQ ID NO: 65016

SEQ ID NO: 190993 - RNA, 62 nt, hsa; identical to SEQ ID NO: 65017

SEQ ID NO: 190994 - RNA, 62 nt, hsa; identical to SEQ ID NO: 65018

SEQ ID NO: 190995 - RNA, 62 nt, hsa; identical to SEQ ID NO: 65019

SEQ ID NO: 190996 - RNA, 62 nt, hsa; identical to SEQ ID NO: 65020

SEQ ID NO: 190997 - RNA, 62 nt, hsa; identical to SEQ ID NO: 65021

SEQ ID NO: 190998 - RNA, 62 nt, hsa; identical to SEQ ID NO: 65022

SEQ ID NO: 190999 - RNA, 62 nt, hsa; identical to SEQ ID NO: 65023

SEQ ID NO: 191000 - RNA, 62 nt, hsa; identical to SEQ ID NO: 65024

SEQ ID NO: 191001 - RNA, 62 nt, hsa; identical to SEQ ID NO: 65025

SEQ ID NO: 191002 - RNA, 62 nt, hsa; identical to SEQ ID NO: 65026

SEQ ID NO: 191003 - RNA, 62 nt, hsa; identical to SEQ ID NO: 65027

SEQ ID NO: 191004 - RNA, 62 nt, hsa; identical to SEQ ID NO: 65028

SEQ ID NO: 191005 - RNA, 62 nt, hsa; identical to SEQ ID NO: 65029

SEQ ID NO: 191006 - RNA, 62 nt, hsa; identical to SEQ ID NO: 65030

SEQ ID NO: 191007 - RNA, 62 nt, hsa; identical to SEQ ID NO: 65031

SEQ ID NO: 191008 - RNA, 62 nt, hsa; identical to SEQ ID NO: 65032

SEQ ID NO: 191009 - RNA, 62 nt, hsa; identical to SEQ ID NO: 65033

SEQ ID NO: 191010 - RNA, 62 nt, hsa; identical to SEQ ID NO: 65034

SEQ ID NO: 191011 - RNA, 62 nt, hsa; identical to SEQ ID NO: 65035

SEQ ID NO: 191012 - RNA, 62 nt, hsa; identical to SEQ ID NO: 65036

SEQ ID NO: 191013 - RNA, 62 nt, hsa; identical to SEQ ID NO: 65037

SEQ ID NO: 191014 - RNA, 62 nt, hsa; identical to SEQ ID NO: 65038

SEQ ID NO: 191015 - RNA, 62 nt, hsa; identical to SEQ ID NO: 65039

SEQ ID NO: 191016 - RNA, 62 nt, hsa; identical to SEQ ID NO: 65040

SEQ ID NO: 191017 - RNA, 62 nt, hsa; identical to SEQ ID NO: 65041

SEQ ID NO: 191018 - RNA, 62 nt, hsa; identical to SEQ ID NO: 65042

SEQ ID NO: 191019 - RNA, 62 nt, hsa; identical to SEQ ID NO: 65043

SEQ ID NO: 191020 - RNA, 62 nt, hsa; identical to SEQ ID NO: 65044

SEQ ID NO: 191021 - RNA, 62 nt, hsa; identical to SEQ ID NO: 65045

SEQ ID NO: 191022 - RNA, 62 nt, hsa; identical to SEQ ID NO: 65046

SEQ ID NO: 191023 - RNA, 62 nt, hsa; identical to SEQ ID NO: 65047

SEQ ID NO: 191024 - RNA, 62 nt, hsa; identical to SEQ ID NO: 65048

SEQ ID NO: 191025 - RNA, 62 nt, hsa; identical to SEQ ID NO: 65049

SEQ ID NO: 191026 - RNA, 62 nt, hsa; identical to SEQ ID NO: 65050

SEQ ID NO: 191027 - RNA, 62 nt, hsa; identical to SEQ ID NO: 65051

SEQ ID NO: 191028 - RNA, 62 nt, hsa; identical to SEQ ID NO: 65052

SEQ ID NO: 191029 - RNA, 62 nt, hsa; identical to SEQ ID NO: 65053

SEQ ID NO: 191030 - RNA, 62 nt, hsa; identical to SEQ ID NO: 65054

SEQ ID NO: 191031 - RNA, 62 nt, hsa; identical to SEQ ID NO: 65055

SEQ ID NO: 191032 - RNA, 62 nt, hsa; identical to SEQ ID NO: 65056

SEQ ID NO: 191033 - RNA, 62 nt, hsa; identical to SEQ ID NO: 65057

SEQ ID NO: 191034 - RNA, 62 nt, hsa; identical to SEQ ID NO: 65058

SEQ ID NO: 191035 - RNA, 62 nt, hsa; identical to SEQ ID NO: 65059

SEQ ID NO: 191036 - RNA, 62 nt, hsa; identical to SEQ ID NO: 65060

SEQ ID NO: 191037 - RNA, 62 nt, hsa; identical to SEQ ID NO: 65061

SEQ ID NO: 191038 - RNA, 62 nt, hsa; identical to SEQ ID NO: 65062

SEQ ID NO: 191039 - RNA, 62 nt, hsa; identical to SEQ ID NO: 65063

SEQ ID NO: 191040 - RNA, 62 nt, hsa; identical to SEQ ID NO: 65064

SEQ ID NO: 191041 - RNA, 62 nt, hsa; identical to SEQ ID NO: 65065

SEQ ID NO: 191042 - RNA, 62 nt, hsa; identical to SEQ ID NO: 65066

SEQ ID NO: 191043 - RNA, 62 nt, hsa; identical to SEQ ID NO: 65067

SEQ ID NO: 191044 - RNA, 62 nt, hsa; identical to SEQ ID NO: 65068

SEQ ID NO: 191045 - RNA, 62 nt, hsa; identical to SEQ ID NO: 65069

SEQ ID NO: 191046 - RNA, 62 nt, hsa; identical to SEQ ID NO: 65070

SEQ ID NO: 191047 - RNA, 62 nt, hsa; identical to SEQ ID NO: 65071

SEQ ID NO: 191048 - RNA, 62 nt, hsa; identical to SEQ ID NO: 65072

SEQ ID NO: 191049 - RNA, 62 nt, hsa; identical to SEQ ID NO: 65073

SEQ ID NO: 191050 - RNA, 62 nt, hsa; identical to SEQ ID NO: 65074

SEQ ID NO: 191051 - RNA, 62 nt, hsa; identical to SEQ ID NO: 65075

SEQ ID NO: 191052 - RNA, 62 nt, hsa; identical to SEQ ID NO: 65076

SEQ ID NO: 191053 - RNA, 62 nt, hsa; identical to SEQ ID NO: 65077

SEQ ID NO: 191054 - RNA, 62 nt, hsa; identical to SEQ ID NO: 65078

SEQ ID NO: 191055 - RNA, 62 nt, hsa; identical to SEQ ID NO: 65079

SEQ ID NO: 191056 - RNA, 62 nt, hsa; identical to SEQ ID NO: 65080

SEQ ID NO: 191057 - RNA, 62 nt, hsa; identical to SEQ ID NO: 65081

SEQ ID NO: 191058 - RNA, 62 nt, hsa; identical to SEQ ID NO: 65082

SEQ ID NO: 191059 - RNA, 62 nt, hsa; identical to SEQ ID NO: 65083

SEQ ID NO: 191060 - RNA, 62 nt, hsa; identical to SEQ ID NO: 65084

SEQ ID NO: 191061 - RNA, 62 nt, hsa; identical to SEQ ID NO: 65085

SEQ ID NO: 191062 - RNA, 62 nt, hsa; identical to SEQ ID NO: 65086

SEQ ID NO: 191063 - RNA, 60 nt, hsa; identical to SEQ ID NO: 65087

SEQ ID NO: 191064 - RNA, 62 nt, hsa; identical to SEQ ID NO: 65088

SEQ ID NO: 191065 - RNA, 62 nt, hsa; identical to SEQ ID NO: 65089

SEQ ID NO: 191066 - RNA, 62 nt, hsa; identical to SEQ ID NO: 65090

SEQ ID NO: 191067 - RNA, 62 nt, hsa; identical to SEQ ID NO: 65091

SEQ ID NO: 191068 - RNA, 62 nt, hsa; identical to SEQ ID NO: 65092

SEQ ID NO: 191069 - RNA, 62 nt, hsa; identical to SEQ ID NO: 65093

SEQ ID NO: 191070 - RNA, 51 nt, hsa; identical to SEQ ID NO: 65094

SEQ ID NO: 191071 - RNA, 62 nt, hsa; identical to SEQ ID NO: 65095

SEQ ID NO: 191072 - RNA, 62 nt, hsa; identical to SEQ ID NO: 65096

SEQ ID NO: 191073 - RNA, 62 nt, hsa; identical to SEQ ID NO: 65097

SEQ ID NO: 191074 - RNA, 62 nt, hsa; identical to SEQ ID NO: 65098

SEQ ID NO: 191075 - RNA, 62 nt, hsa; identical to SEQ ID NO: 65099

SEQ ID NO: 191076 - RNA, 62 nt, hsa; identical to SEQ ID NO: 65100

SEQ ID NO: 191077 - RNA, 62 nt, hsa; identical to SEQ ID NO: 65101

SEQ ID NO: 191078 - RNA, 62 nt, hsa; identical to SEQ ID NO: 65102

SEQ ID NO: 191079 - RNA, 62 nt, hsa; identical to SEQ ID NO: 65103

SEQ ID NO: 191080 - RNA, 62 nt, hsa; identical to SEQ ID NO: 65104

SEQ ID NO: 191081 - RNA, 62 nt, hsa; identical to SEQ ID NO: 65105

SEQ ID NO: 191082 - RNA, 62 nt, hsa; identical to SEQ ID NO: 65106

SEQ ID NO: 191083 - RNA, 62 nt, hsa; identical to SEQ ID NO: 65107

SEQ ID NO: 191084 - RNA, 62 nt, hsa; identical to SEQ ID NO: 65108

SEQ ID NO: 191085 - RNA, 62 nt, hsa; identical to SEQ ID NO: 65109

SEQ ID NO: 191086 - RNA, 62 nt, hsa; identical to SEQ ID NO: 65110

SEQ ID NO: 191087 - RNA, 62 nt, hsa; identical to SEQ ID NO: 65111

SEQ ID NO: 191088 - RNA, 62 nt, hsa; identical to SEQ ID NO: 65112

SEQ ID NO: 191089 - RNA, 62 nt, hsa; identical to SEQ ID NO: 65113

SEQ ID NO: 191090 - RNA, 62 nt, hsa; identical to SEQ ID NO: 65114

SEQ ID NO: 191091 - RNA, 62 nt, hsa; identical to SEQ ID NO: 65115

SEQ ID NO: 191092 - RNA, 62 nt, hsa; identical to SEQ ID NO: 65116

SEQ ID NO: 191093 - RNA, 62 nt, hsa; identical to SEQ ID NO: 65117

SEQ ID NO: 191094 - RNA, 62 nt, hsa; identical to SEQ ID NO: 65118

SEQ ID NO: 191095 - RNA, 62 nt, hsa; identical to SEQ ID NO: 65119

SEQ ID NO: 191096 - RNA, 62 nt, hsa; identical to SEQ ID NO: 65120

SEQ ID NO: 191097 - RNA, 62 nt, hsa; identical to SEQ ID NO: 65121

SEQ ID NO: 191098 - RNA, 62 nt, hsa; identical to SEQ ID NO: 65122

SEQ ID NO: 191099 - RNA, 62 nt, hsa; identical to SEQ ID NO: 65123

SEQ ID NO: 191100 - RNA, 62 nt, hsa; identical to SEQ ID NO: 65124

SEQ ID NO: 191101 - RNA, 62 nt, hsa; identical to SEQ ID NO: 65125

SEQ ID NO: 191102 - RNA, 62 nt, hsa; identical to SEQ ID NO: 65126

SEQ ID NO: 191103 - RNA, 62 nt, hsa; identical to SEQ ID NO: 65127

SEQ ID NO: 191104 - RNA, 62 nt, hsa; identical to SEQ ID NO: 65128

SEQ ID NO: 191105 - RNA, 62 nt, hsa; identical to SEQ ID NO: 65129

SEQ ID NO: 191106 - RNA, 62 nt, hsa; identical to SEQ ID NO: 65130

SEQ ID NO: 191107 - RNA, 62 nt, hsa; identical to SEQ ID NO: 65131

SEQ ID NO: 191108 - RNA, 62 nt, hsa; identical to SEQ ID NO: 65132

SEQ ID NO: 191109 - RNA, 62 nt, hsa; identical to SEQ ID NO: 65133

SEQ ID NO: 191110 - RNA, 62 nt, hsa; identical to SEQ ID NO: 65134

SEQ ID NO: 191111 - RNA, 62 nt, hsa; identical to SEQ ID NO: 65135

SEQ ID NO: 191112 - RNA, 63 nt, hsa; identical to SEQ ID NO: 65136

SEQ ID NO: 191113 - RNA, 63 nt, hsa; identical to SEQ ID NO: 65137

SEQ ID NO: 191114 - RNA, 63 nt, hsa; identical to SEQ ID NO: 65138

SEQ ID NO: 191115 - RNA, 63 nt, hsa; identical to SEQ ID NO: 65139

SEQ ID NO: 191116 - RNA, 63 nt, hsa; identical to SEQ ID NO: 65140

SEQ ID NO: 191117 - RNA, 63 nt, hsa; identical to SEQ ID NO: 65141

SEQ ID NO: 191118 - RNA, 63 nt, hsa; identical to SEQ ID NO: 65142

SEQ ID NO: 191119 - RNA, 63 nt, hsa; identical to SEQ ID NO: 65143

SEQ ID NO: 191120 - RNA, 63 nt, hsa; identical to SEQ ID NO: 65144

SEQ ID NO: 191121 - RNA, 63 nt, hsa; identical to SEQ ID NO: 65145

SEQ ID NO: 191122 - RNA, 63 nt, hsa; identical to SEQ ID NO: 65146

SEQ ID NO: 191123 - RNA, 63 nt, hsa; identical to SEQ ID NO: 65147

SEQ ID NO: 191124 - RNA, 63 nt, hsa; identical to SEQ ID NO: 65148

SEQ ID NO: 191125 - RNA, 63 nt, hsa; identical to SEQ ID NO: 65149

SEQ ID NO: 191126 - RNA, 63 nt, hsa; identical to SEQ ID NO: 65150

SEQ ID NO: 191127 - RNA, 63 nt, hsa; identical to SEQ ID NO: 65151

SEQ ID NO: 191128 - RNA, 63 nt, hsa; identical to SEQ ID NO: 65152

SEQ ID NO: 191129 - RNA, 63 nt, hsa; identical to SEQ ID NO: 65153

SEQ ID NO: 191130 - RNA, 63 nt, hsa; identical to SEQ ID NO: 65154

SEQ ID NO: 191131 - RNA, 63 nt, hsa; identical to SEQ ID NO: 65155

SEQ ID NO: 191132 - RNA, 63 nt, hsa; identical to SEQ ID NO: 65156

SEQ ID NO: 191133 - RNA, 63 nt, hsa; identical to SEQ ID NO: 65157

SEQ ID NO: 191134 - RNA, 63 nt, hsa; identical to SEQ ID NO: 65158

SEQ ID NO: 191135 - RNA, 63 nt, hsa; identical to SEQ ID NO: 65159

SEQ ID NO: 191136 - RNA, 63 nt, hsa; identical to SEQ ID NO: 65160

SEQ ID NO: 191137 - RNA, 63 nt, hsa; identical to SEQ ID NO: 65161

SEQ ID NO: 191138 - RNA, 63 nt, hsa; identical to SEQ ID NO: 65162

SEQ ID NO: 191139 - RNA, 63 nt, hsa; identical to SEQ ID NO: 65163

SEQ ID NO: 191140 - RNA, 63 nt, hsa; identical to SEQ ID NO: 65164

SEQ ID NO: 191141 - RNA, 63 nt, hsa; identical to SEQ ID NO: 65165

SEQ ID NO: 191142 - RNA, 63 nt, hsa; identical to SEQ ID NO: 65166

SEQ ID NO: 191143 - RNA, 63 nt, hsa; identical to SEQ ID NO: 65167

SEQ ID NO: 191144 - RNA, 63 nt, hsa; identical to SEQ ID NO: 65168

SEQ ID NO: 191145 - RNA, 63 nt, hsa; identical to SEQ ID NO: 65169

SEQ ID NO: 191146 - RNA, 63 nt, hsa; identical to SEQ ID NO: 65170

SEQ ID NO: 191147 - RNA, 63 nt, hsa; identical to SEQ ID NO: 65171

SEQ ID NO: 191148 - RNA, 63 nt, hsa; identical to SEQ ID NO: 65172

SEQ ID NO: 191149 - RNA, 63 nt, hsa; identical to SEQ ID NO: 65173

SEQ ID NO: 191150 - RNA, 63 nt, hsa; identical to SEQ ID NO: 65174

SEQ ID NO: 191151 - RNA, 63 nt, hsa; identical to SEQ ID NO: 65175

SEQ ID NO: 191152 - RNA, 63 nt, hsa; identical to SEQ ID NO: 65176

SEQ ID NO: 191153 - RNA, 63 nt, hsa; identical to SEQ ID NO: 65177

SEQ ID NO: 191154 - RNA, 63 nt, hsa; identical to SEQ ID NO: 65178

SEQ ID NO: 191155 - RNA, 63 nt, hsa; identical to SEQ ID NO: 65179

SEQ ID NO: 191156 - RNA, 63 nt, hsa; identical to SEQ ID NO: 65180

SEQ ID NO: 191157 - RNA, 63 nt, hsa; identical to SEQ ID NO: 65181

SEQ ID NO: 191158 - RNA, 63 nt, hsa; identical to SEQ ID NO: 65182

SEQ ID NO: 191159 - RNA, 63 nt, hsa; identical to SEQ ID NO: 65183

SEQ ID NO: 191160 - RNA, 63 nt, hsa; identical to SEQ ID NO: 65184

SEQ ID NO: 191161 - RNA, 63 nt, hsa; identical to SEQ ID NO: 65185

SEQ ID NO: 191162 - RNA, 63 nt, hsa; identical to SEQ ID NO: 65186

SEQ ID NO: 191163 - RNA, 63 nt, hsa; identical to SEQ ID NO: 65187

SEQ ID NO: 191164 - RNA, 63 nt, hsa; identical to SEQ ID NO: 65188

SEQ ID NO: 191165 - RNA, 63 nt, hsa; identical to SEQ ID NO: 65189

SEQ ID NO: 191166 - RNA, 63 nt, hsa; identical to SEQ ID NO: 65190

SEQ ID NO: 191167 - RNA, 63 nt, hsa; identical to SEQ ID NO: 65191

SEQ ID NO: 191168 - RNA, 63 nt, hsa; identical to SEQ ID NO: 65192

SEQ ID NO: 191169 - RNA, 63 nt, hsa; identical to SEQ ID NO: 65193

SEQ ID NO: 191170 - RNA, 63 nt, hsa; identical to SEQ ID NO: 65194

SEQ ID NO: 191171 - RNA, 63 nt, hsa; identical to SEQ ID NO: 65195

SEQ ID NO: 191172 - RNA, 63 nt, hsa; identical to SEQ ID NO: 65196

SEQ ID NO: 191173 - RNA, 63 nt, hsa; identical to SEQ ID NO: 65197

SEQ ID NO: 191174 - RNA, 63 nt, hsa; identical to SEQ ID NO: 65198

SEQ ID NO: 191175 - RNA, 63 nt, hsa; identical to SEQ ID NO: 65199

SEQ ID NO: 191176 - RNA, 63 nt, hsa; identical to SEQ ID NO: 65200

SEQ ID NO: 191177 - RNA, 63 nt, hsa; identical to SEQ ID NO: 65201

SEQ ID NO: 191178 - RNA, 63 nt, hsa; identical to SEQ ID NO: 65202

SEQ ID NO: 191179 - RNA, 63 nt, hsa; identical to SEQ ID NO: 65203

SEQ ID NO: 191180 - RNA, 63 nt, hsa; identical to SEQ ID NO: 65204

SEQ ID NO: 191181 - RNA, 63 nt, hsa; identical to SEQ ID NO: 65205

SEQ ID NO: 191182 - RNA, 63 nt, hsa; identical to SEQ ID NO: 65206

SEQ ID NO: 191183 - RNA, 63 nt, hsa; identical to SEQ ID NO: 65207

SEQ ID NO: 191184 - RNA, 63 nt, hsa; identical to SEQ ID NO: 65208

SEQ ID NO: 191185 - RNA, 63 nt, hsa; identical to SEQ ID NO: 65209

SEQ ID NO: 191186 - RNA, 63 nt, hsa; identical to SEQ ID NO: 65210

SEQ ID NO: 191187 - RNA, 63 nt, hsa; identical to SEQ ID NO: 65211

SEQ ID NO: 191188 - RNA, 63 nt, hsa; identical to SEQ ID NO: 65212

SEQ ID NO: 191189 - RNA, 63 nt, hsa; identical to SEQ ID NO: 65213

SEQ ID NO: 191190 - RNA, 63 nt, hsa; identical to SEQ ID NO: 65214

SEQ ID NO: 191191 - RNA, 63 nt, hsa; identical to SEQ ID NO: 65215

SEQ ID NO: 191192 - RNA, 63 nt, hsa; identical to SEQ ID NO: 65216

SEQ ID NO: 191193 - RNA, 63 nt, hsa; identical to SEQ ID NO: 65217

SEQ ID NO: 191194 - RNA, 63 nt, hsa; identical to SEQ ID NO: 65218

SEQ ID NO: 191195 - RNA, 63 nt, hsa; identical to SEQ ID NO: 65219

SEQ ID NO: 191196 - RNA, 63 nt, hsa; identical to SEQ ID NO: 65220

SEQ ID NO: 191197 - RNA, 63 nt, hsa; identical to SEQ ID NO: 65221

SEQ ID NO: 191198 - RNA, 63 nt, hsa; identical to SEQ ID NO: 65222

SEQ ID NO: 191199 - RNA, 63 nt, hsa; identical to SEQ ID NO: 65223

SEQ ID NO: 191200 - RNA, 63 nt, hsa; identical to SEQ ID NO: 65224

SEQ ID NO: 191201 - RNA, 63 nt, hsa; identical to SEQ ID NO: 65225

SEQ ID NO: 191202 - RNA, 63 nt, hsa; identical to SEQ ID NO: 65226

SEQ ID NO: 191203 - RNA, 63 nt, hsa; identical to SEQ ID NO: 65227

SEQ ID NO: 191204 - RNA, 63 nt, hsa; identical to SEQ ID NO: 65228

SEQ ID NO: 191205 - RNA, 63 nt, hsa; identical to SEQ ID NO: 65229

SEQ ID NO: 191206 - RNA, 63 nt, hsa; identical to SEQ ID NO: 65230

SEQ ID NO: 191207 - RNA, 63 nt, hsa; identical to SEQ ID NO: 65231

SEQ ID NO: 191208 - RNA, 63 nt, hsa; identical to SEQ ID NO: 65232

SEQ ID NO: 191209 - RNA, 63 nt, hsa; identical to SEQ ID NO: 65233

SEQ ID NO: 191210 - RNA, 63 nt, hsa; identical to SEQ ID NO: 65234

SEQ ID NO: 191211 - RNA, 63 nt, hsa; identical to SEQ ID NO: 65235

SEQ ID NO: 191212 - RNA, 63 nt, hsa; identical to SEQ ID NO: 65236

SEQ ID NO: 191213 - RNA, 63 nt, hsa; identical to SEQ ID NO: 65237

SEQ ID NO: 191214 - RNA, 63 nt, hsa; identical to SEQ ID NO: 65238

SEQ ID NO: 191215 - RNA, 63 nt, hsa; identical to SEQ ID NO: 65239

SEQ ID NO: 191216 - RNA, 63 nt, hsa; identical to SEQ ID NO: 65240

SEQ ID NO: 191217 - RNA, 63 nt, hsa; identical to SEQ ID NO: 65241

SEQ ID NO: 191218 - RNA, 63 nt, hsa; identical to SEQ ID NO: 65242

SEQ ID NO: 191219 - RNA, 63 nt, hsa; identical to SEQ ID NO: 65243

SEQ ID NO: 191220 - RNA, 63 nt, hsa; identical to SEQ ID NO: 65244

SEQ ID NO: 191221 - RNA, 63 nt, hsa; identical to SEQ ID NO: 65245

SEQ ID NO: 191222 - RNA, 63 nt, hsa; identical to SEQ ID NO: 65246

SEQ ID NO: 191223 - RNA, 63 nt, hsa; identical to SEQ ID NO: 65247

SEQ ID NO: 191224 - RNA, 63 nt, hsa; identical to SEQ ID NO: 65248

SEQ ID NO: 191225 - RNA, 63 nt, hsa; identical to SEQ ID NO: 65249

SEQ ID NO: 191226 - RNA, 63 nt, hsa; identical to SEQ ID NO: 65250

SEQ ID NO: 191227 - RNA, 63 nt, hsa; identical to SEQ ID NO: 65251

SEQ ID NO: 191228 - RNA, 63 nt, hsa; identical to SEQ ID NO: 65252

SEQ ID NO: 191229 - RNA, 63 nt, hsa; identical to SEQ ID NO: 65253

SEQ ID NO: 191230 - RNA, 63 nt, hsa; identical to SEQ ID NO: 65254

SEQ ID NO: 191231 - RNA, 63 nt, hsa; identical to SEQ ID NO: 65255

SEQ ID NO: 191232 - RNA, 63 nt, hsa; identical to SEQ ID NO: 65256

SEQ ID NO: 191233 - RNA, 63 nt, hsa; identical to SEQ ID NO: 65257

SEQ ID NO: 191234 - RNA, 63 nt, hsa; identical to SEQ ID NO: 65258

SEQ ID NO: 191235 - RNA, 63 nt, hsa; identical to SEQ ID NO: 65259

SEQ ID NO: 191236 - RNA, 63 nt, hsa; identical to SEQ ID NO: 65260

SEQ ID NO: 191237 - RNA, 63 nt, hsa; identical to SEQ ID NO: 65261

SEQ ID NO: 191238 - RNA, 63 nt, hsa; identical to SEQ ID NO: 65262

SEQ ID NO: 191239 - RNA, 63 nt, hsa; identical to SEQ ID NO: 65263

SEQ ID NO: 191240 - RNA, 63 nt, hsa; identical to SEQ ID NO: 65264

SEQ ID NO: 191241 - RNA, 63 nt, hsa; identical to SEQ ID NO: 65265

SEQ ID NO: 191242 - RNA, 63 nt, hsa; identical to SEQ ID NO: 65266

SEQ ID NO: 191243 - RNA, 63 nt, hsa; identical to SEQ ID NO: 65267

SEQ ID NO: 191244 - RNA, 63 nt, hsa; identical to SEQ ID NO: 65268

SEQ ID NO: 191245 - RNA, 63 nt, hsa; identical to SEQ ID NO: 65269

SEQ ID NO: 191246 - RNA, 63 nt, hsa; identical to SEQ ID NO: 65270

SEQ ID NO: 191247 - RNA, 63 nt, hsa; identical to SEQ ID NO: 65271

SEQ ID NO: 191248 - RNA, 63 nt, hsa; identical to SEQ ID NO: 65272

SEQ ID NO: 191249 - RNA, 63 nt, hsa; identical to SEQ ID NO: 65273

SEQ ID NO: 191250 - RNA, 56 nt, hsa; identical to SEQ ID NO: 61369

SEQ ID NO: 191251 - RNA, 63 nt, hsa; identical to SEQ ID NO: 65275

SEQ ID NO: 191252 - RNA, 63 nt, hsa; identical to SEQ ID NO: 65276

SEQ ID NO: 191253 - RNA, 63 nt, hsa; identical to SEQ ID NO: 65277

SEQ ID NO: 191254 - RNA, 63 nt, hsa; identical to SEQ ID NO: 65278

SEQ ID NO: 191255 - RNA, 63 nt, hsa; identical to SEQ ID NO: 65279

SEQ ID NO: 191256 - RNA, 63 nt, hsa; identical to SEQ ID NO: 65280

SEQ ID NO: 191257 - RNA, 63 nt, hsa; identical to SEQ ID NO: 65281

SEQ ID NO: 191258 - RNA, 63 nt, hsa; identical to SEQ ID NO: 65282

SEQ ID NO: 191259 - RNA, 63 nt, hsa; identical to SEQ ID NO: 65283

SEQ ID NO: 191260 - RNA, 63 nt, hsa; identical to SEQ ID NO: 65284

SEQ ID NO: 191261 - RNA, 63 nt, hsa; identical to SEQ ID NO: 65285

SEQ ID NO: 191262 - RNA, 63 nt, hsa; identical to SEQ ID NO: 65286

SEQ ID NO: 191263 - RNA, 63 nt, hsa; identical to SEQ ID NO: 65287

SEQ ID NO: 191264 - RNA, 63 nt, hsa; identical to SEQ ID NO: 65288

SEQ ID NO: 191265 - RNA, 63 nt, hsa; identical to SEQ ID NO: 65289

SEQ ID NO: 191266 - RNA, 63 nt, hsa; identical to SEQ ID NO: 65290

SEQ ID NO: 191267 - RNA, 63 nt, hsa; identical to SEQ ID NO: 65291

SEQ ID NO: 191268 - RNA, 63 nt, hsa; identical to SEQ ID NO: 65292

SEQ ID NO: 191269 - RNA, 63 nt, hsa; identical to SEQ ID NO: 65293

SEQ ID NO: 191270 - RNA, 63 nt, hsa; identical to SEQ ID NO: 65294

SEQ ID NO: 191271 - RNA, 63 nt, hsa; identical to SEQ ID NO: 65295

SEQ ID NO: 191272 - RNA, 63 nt, hsa; identical to SEQ ID NO: 65296

SEQ ID NO: 191273 - RNA, 63 nt, hsa; identical to SEQ ID NO: 65297

SEQ ID NO: 191274 - RNA, 63 nt, hsa; identical to SEQ ID NO: 65298

SEQ ID NO: 191275 - RNA, 63 nt, hsa; identical to SEQ ID NO: 65299

SEQ ID NO: 191276 - RNA, 63 nt, hsa; identical to SEQ ID NO: 65300

SEQ ID NO: 191277 - RNA, 63 nt, hsa; identical to SEQ ID NO: 65301

SEQ ID NO: 191278 - RNA, 63 nt, hsa; identical to SEQ ID NO: 65302

SEQ ID NO: 191279 - RNA, 63 nt, hsa; identical to SEQ ID NO: 65303

SEQ ID NO: 191280 - RNA, 63 nt, hsa; identical to SEQ ID NO: 65304

SEQ ID NO: 191281 - RNA, 63 nt, hsa; identical to SEQ ID NO: 65305

SEQ ID NO: 191282 - RNA, 63 nt, hsa; identical to SEQ ID NO: 65306

SEQ ID NO: 191283 - RNA, 63 nt, hsa; identical to SEQ ID NO: 65307

SEQ ID NO: 191284 - RNA, 63 nt, hsa; identical to SEQ ID NO: 65308

SEQ ID NO: 191285 - RNA, 63 nt, hsa; identical to SEQ ID NO: 65309

SEQ ID NO: 191286 - RNA, 63 nt, hsa; identical to SEQ ID NO: 65310

SEQ ID NO: 191287 - RNA, 63 nt, hsa; identical to SEQ ID NO: 65311

SEQ ID NO: 191288 - RNA, 63 nt, hsa; identical to SEQ ID NO: 65312

SEQ ID NO: 191289 - RNA, 63 nt, hsa; identical to SEQ ID NO: 65313

SEQ ID NO: 191290 - RNA, 63 nt, hsa; identical to SEQ ID NO: 65314

SEQ ID NO: 191291 - RNA, 63 nt, hsa; identical to SEQ ID NO: 65315

SEQ ID NO: 191292 - RNA, 63 nt, hsa; identical to SEQ ID NO: 65316

SEQ ID NO: 191293 - RNA, 63 nt, hsa; identical to SEQ ID NO: 65317

SEQ ID NO: 191294 - RNA, 63 nt, hsa; identical to SEQ ID NO: 65318

SEQ ID NO: 191295 - RNA, 63 nt, hsa; identical to SEQ ID NO: 65319

SEQ ID NO: 191296 - RNA, 63 nt, hsa; identical to SEQ ID NO: 65320

SEQ ID NO: 191297 - RNA, 63 nt, hsa; identical to SEQ ID NO: 65321

SEQ ID NO: 191298 - RNA, 63 nt, hsa; identical to SEQ ID NO: 65322

SEQ ID NO: 191299 - RNA, 63 nt, hsa; identical to SEQ ID NO: 65323

SEQ ID NO: 191300 - RNA, 63 nt, hsa; identical to SEQ ID NO: 65324

SEQ ID NO: 191301 - RNA, 63 nt, hsa; identical to SEQ ID NO: 65325

SEQ ID NO: 191302 - RNA, 63 nt, hsa; identical to SEQ ID NO: 65326

SEQ ID NO: 191303 - RNA, 63 nt, hsa; identical to SEQ ID NO: 65327

SEQ ID NO: 191304 - RNA, 63 nt, hsa; identical to SEQ ID NO: 65328

SEQ ID NO: 191305 - RNA, 63 nt, hsa; identical to SEQ ID NO: 65329

SEQ ID NO: 191306 - RNA, 63 nt, hsa; identical to SEQ ID NO: 65330

SEQ ID NO: 191307 - RNA, 63 nt, hsa; identical to SEQ ID NO: 65331

SEQ ID NO: 191308 - RNA, 63 nt, hsa; identical to SEQ ID NO: 65332

SEQ ID NO: 191309 - RNA, 63 nt, hsa; identical to SEQ ID NO: 65333

SEQ ID NO: 191310 - RNA, 63 nt, hsa; identical to SEQ ID NO: 65334

SEQ ID NO: 191311 - RNA, 63 nt, hsa; identical to SEQ ID NO: 65335

SEQ ID NO: 191312 - RNA, 63 nt, hsa; identical to SEQ ID NO: 65336

SEQ ID NO: 191313 - RNA, 63 nt, hsa; identical to SEQ ID NO: 65337

SEQ ID NO: 191314 - RNA, 63 nt, hsa; identical to SEQ ID NO: 65338

SEQ ID NO: 191315 - RNA, 63 nt, hsa; identical to SEQ ID NO: 65339

SEQ ID NO: 191316 - RNA, 63 nt, hsa; identical to SEQ ID NO: 65340

SEQ ID NO: 191317 - RNA, 63 nt, hsa; identical to SEQ ID NO: 65341

SEQ ID NO: 191318 - RNA, 63 nt, hsa; identical to SEQ ID NO: 65342

SEQ ID NO: 191319 - RNA, 63 nt, hsa; identical to SEQ ID NO: 65343

SEQ ID NO: 191320 - RNA, 63 nt, hsa; identical to SEQ ID NO: 65344

SEQ ID NO: 191321 - RNA, 63 nt, hsa; identical to SEQ ID NO: 65345

SEQ ID NO: 191322 - RNA, 63 nt, hsa; identical to SEQ ID NO: 65346

SEQ ID NO: 191323 - RNA, 63 nt, hsa; identical to SEQ ID NO: 65347

SEQ ID NO: 191324 - RNA, 63 nt, hsa; identical to SEQ ID NO: 65348

SEQ ID NO: 191325 - RNA, 63 nt, hsa; identical to SEQ ID NO: 65349

SEQ ID NO: 191326 - RNA, 63 nt, hsa; identical to SEQ ID NO: 65350

SEQ ID NO: 191327 - RNA, 63 nt, hsa; identical to SEQ ID NO: 65351

SEQ ID NO: 191328 - RNA, 63 nt, hsa; identical to SEQ ID NO: 65352

SEQ ID NO: 191329 - RNA, 63 nt, hsa; identical to SEQ ID NO: 65353

SEQ ID NO: 191330 - RNA, 63 nt, hsa; identical to SEQ ID NO: 65354

SEQ ID NO: 191331 - RNA, 63 nt, hsa; identical to SEQ ID NO: 65355

SEQ ID NO: 191332 - RNA, 63 nt, hsa; identical to SEQ ID NO: 65356

SEQ ID NO: 191333 - RNA, 63 nt, hsa; identical to SEQ ID NO: 65357

SEQ ID NO: 191334 - RNA, 63 nt, hsa; identical to SEQ ID NO: 65358

SEQ ID NO: 191335 - RNA, 63 nt, hsa; identical to SEQ ID NO: 65359

SEQ ID NO: 191336 - RNA, 63 nt, hsa; identical to SEQ ID NO: 65360

SEQ ID NO: 191337 - RNA, 63 nt, hsa; identical to SEQ ID NO: 65361

SEQ ID NO: 191338 - RNA, 63 nt, hsa; identical to SEQ ID NO: 65362

SEQ ID NO: 191339 - RNA, 63 nt, hsa; identical to SEQ ID NO: 65363

SEQ ID NO: 191340 - RNA, 63 nt, hsa; identical to SEQ ID NO: 65364

SEQ ID NO: 191341 - RNA, 63 nt, hsa; identical to SEQ ID NO: 65365

SEQ ID NO: 191342 - RNA, 60 nt, hsa; identical to SEQ ID NO: 65087

SEQ ID NO: 191343 - RNA, 63 nt, hsa; identical to SEQ ID NO: 65367

SEQ ID NO: 191344 - RNA, 63 nt, hsa; identical to SEQ ID NO: 65368

SEQ ID NO: 191345 - RNA, 63 nt, hsa; identical to SEQ ID NO: 65369

SEQ ID NO: 191346 - RNA, 63 nt, hsa; identical to SEQ ID NO: 65370

SEQ ID NO: 191347 - RNA, 63 nt, hsa; identical to SEQ ID NO: 65371

SEQ ID NO: 191348 - RNA, 63 nt, hsa; identical to SEQ ID NO: 65372

SEQ ID NO: 191349 - RNA, 51 nt, hsa; identical to SEQ ID NO: 65094

SEQ ID NO: 191350 - RNA, 63 nt, hsa; identical to SEQ ID NO: 65374

SEQ ID NO: 191351 - RNA, 63 nt, hsa; identical to SEQ ID NO: 65375

SEQ ID NO: 191352 - RNA, 63 nt, hsa; identical to SEQ ID NO: 65376

SEQ ID NO: 191353 - RNA, 63 nt, hsa; identical to SEQ ID NO: 65377

SEQ ID NO: 191354 - RNA, 63 nt, hsa; identical to SEQ ID NO: 65378

SEQ ID NO: 191355 - RNA, 63 nt, hsa; identical to SEQ ID NO: 65379

SEQ ID NO: 191356 - RNA, 63 nt, hsa; identical to SEQ ID NO: 65380

SEQ ID NO: 191357 - RNA, 63 nt, hsa; identical to SEQ ID NO: 65381

SEQ ID NO: 191358 - RNA, 63 nt, hsa; identical to SEQ ID NO: 65382

SEQ ID NO: 191359 - RNA, 63 nt, hsa; identical to SEQ ID NO: 65383

SEQ ID NO: 191360 - RNA, 63 nt, hsa; identical to SEQ ID NO: 65384

SEQ ID NO: 191361 - RNA, 63 nt, hsa; identical to SEQ ID NO: 65385

SEQ ID NO: 191362 - RNA, 63 nt, hsa; identical to SEQ ID NO: 65386

SEQ ID NO: 191363 - RNA, 63 nt, hsa; identical to SEQ ID NO: 65387

SEQ ID NO: 191364 - RNA, 63 nt, hsa; identical to SEQ ID NO: 65388

SEQ ID NO: 191365 - RNA, 63 nt, hsa; identical to SEQ ID NO: 65389

SEQ ID NO: 191366 - RNA, 63 nt, hsa; identical to SEQ ID NO: 65390

SEQ ID NO: 191367 - RNA, 63 nt, hsa; identical to SEQ ID NO: 65391

SEQ ID NO: 191368 - RNA, 63 nt, hsa; identical to SEQ ID NO: 65392

SEQ ID NO: 191369 - RNA, 63 nt, hsa; identical to SEQ ID NO: 65393

SEQ ID NO: 191370 - RNA, 63 nt, hsa; identical to SEQ ID NO: 65394

SEQ ID NO: 191371 - RNA, 63 nt, hsa; identical to SEQ ID NO: 65395

SEQ ID NO: 191372 - RNA, 63 nt, hsa; identical to SEQ ID NO: 65396

SEQ ID NO: 191373 - RNA, 63 nt, hsa; identical to SEQ ID NO: 65397

SEQ ID NO: 191374 - RNA, 63 nt, hsa; identical to SEQ ID NO: 65398

SEQ ID NO: 191375 - RNA, 63 nt, hsa; identical to SEQ ID NO: 65399

SEQ ID NO: 191376 - RNA, 63 nt, hsa; identical to SEQ ID NO: 65400

SEQ ID NO: 191377 - RNA, 63 nt, hsa; identical to SEQ ID NO: 65401

SEQ ID NO: 191378 - RNA, 63 nt, hsa; identical to SEQ ID NO: 65402

SEQ ID NO: 191379 - RNA, 63 nt, hsa; identical to SEQ ID NO: 65403

SEQ ID NO: 191380 - RNA, 63 nt, hsa; identical to SEQ ID NO: 65404

SEQ ID NO: 191381 - RNA, 63 nt, hsa; identical to SEQ ID NO: 65405

SEQ ID NO: 191382 - RNA, 63 nt, hsa; identical to SEQ ID NO: 65406

SEQ ID NO: 191383 - RNA, 63 nt, hsa; identical to SEQ ID NO: 65407

SEQ ID NO: 191384 - RNA, 63 nt, hsa; identical to SEQ ID NO: 65408

SEQ ID NO: 191385 - RNA, 63 nt, hsa; identical to SEQ ID NO: 65409

SEQ ID NO: 191386 - RNA, 63 nt, hsa; identical to SEQ ID NO: 65410

SEQ ID NO: 191387 - RNA, 63 nt, hsa; identical to SEQ ID NO: 65411

SEQ ID NO: 191388 - RNA, 63 nt, hsa; identical to SEQ ID NO: 65412

SEQ ID NO: 191389 - RNA, 63 nt, hsa; identical to SEQ ID NO: 65413

SEQ ID NO: 191390 - RNA, 63 nt, hsa; identical to SEQ ID NO: 65414

SEQ ID NO: 191391 - RNA, 64 nt, hsa; identical to SEQ ID NO: 65415

SEQ ID NO: 191392 - RNA, 64 nt, hsa; identical to SEQ ID NO: 65416

SEQ ID NO: 191393 - RNA, 64 nt, hsa; identical to SEQ ID NO: 65417

SEQ ID NO: 191394 - RNA, 64 nt, hsa; identical to SEQ ID NO: 65418

SEQ ID NO: 191395 - RNA, 64 nt, hsa; identical to SEQ ID NO: 61352

SEQ ID NO: 191396 - RNA, 64 nt, hsa; identical to SEQ ID NO: 61353

SEQ ID NO: 191397 - RNA, 64 nt, hsa; identical to SEQ ID NO: 65421

SEQ ID NO: 191398 - RNA, 64 nt, hsa; identical to SEQ ID NO: 65422

SEQ ID NO: 191399 - RNA, 64 nt, hsa; identical to SEQ ID NO: 65423

SEQ ID NO: 191400 - RNA, 64 nt, hsa; identical to SEQ ID NO: 65424

SEQ ID NO: 191401 - RNA, 64 nt, hsa; identical to SEQ ID NO: 65425

SEQ ID NO: 191402 - RNA, 64 nt, hsa; identical to SEQ ID NO: 65426

SEQ ID NO: 191403 - RNA, 64 nt, hsa; identical to SEQ ID NO: 61354

SEQ ID NO: 191404 - RNA, 64 nt, hsa; identical to SEQ ID NO: 61355

SEQ ID NO: 191405 - RNA, 64 nt, hsa; identical to SEQ ID NO: 65429

SEQ ID NO: 191406 - RNA, 64 nt, hsa; identical to SEQ ID NO: 65430

SEQ ID NO: 191407 - RNA, 64 nt, hsa; identical to SEQ ID NO: 65431

SEQ ID NO: 191408 - RNA, 64 nt, hsa; identical to SEQ ID NO: 65432

SEQ ID NO: 191409 - RNA, 64 nt, hsa; identical to SEQ ID NO: 65433

SEQ ID NO: 191410 - RNA, 64 nt, hsa; identical to SEQ ID NO: 65434

SEQ ID NO: 191411 - RNA, 64 nt, hsa; identical to SEQ ID NO: 65435

SEQ ID NO: 191412 - RNA, 64 nt, hsa; identical to SEQ ID NO: 65436

SEQ ID NO: 191413 - RNA, 64 nt, hsa; identical to SEQ ID NO: 65437

SEQ ID NO: 191414 - RNA, 64 nt, hsa; identical to SEQ ID NO: 65438

SEQ ID NO: 191415 - RNA, 64 nt, hsa; identical to SEQ ID NO: 65439

SEQ ID NO: 191416 - RNA, 64 nt, hsa; identical to SEQ ID NO: 65440

SEQ ID NO: 191417 - RNA, 64 nt, hsa; identical to SEQ ID NO: 61356

SEQ ID NO: 191418 - RNA, 64 nt, hsa; identical to SEQ ID NO: 61357

SEQ ID NO: 191419 - RNA, 64 nt, hsa; identical to SEQ ID NO: 65443

SEQ ID NO: 191420 - RNA, 64 nt, hsa; identical to SEQ ID NO: 65444

SEQ ID NO: 191421 - RNA, 64 nt, hsa; identical to SEQ ID NO: 65445

SEQ ID NO: 191422 - RNA, 64 nt, hsa; identical to SEQ ID NO: 65446

SEQ ID NO: 191423 - RNA, 64 nt, hsa; identical to SEQ ID NO: 65447

SEQ ID NO: 191424 - RNA, 64 nt, hsa; identical to SEQ ID NO: 65448

SEQ ID NO: 191425 - RNA, 64 nt, hsa; identical to SEQ ID NO: 65449

SEQ ID NO: 191426 - RNA, 64 nt, hsa; identical to SEQ ID NO: 65450

SEQ ID NO: 191427 - RNA, 64 nt, hsa; identical to SEQ ID NO: 65451

SEQ ID NO: 191428 - RNA, 64 nt, hsa; identical to SEQ ID NO: 65452

SEQ ID NO: 191429 - RNA, 64 nt, hsa; identical to SEQ ID NO: 65453

SEQ ID NO: 191430 - RNA, 64 nt, hsa; identical to SEQ ID NO: 65454

SEQ ID NO: 191431 - RNA, 64 nt, hsa; identical to SEQ ID NO: 65455

SEQ ID NO: 191432 - RNA, 64 nt, hsa; identical to SEQ ID NO: 65456

SEQ ID NO: 191433 - RNA, 64 nt, hsa; identical to SEQ ID NO: 65457

SEQ ID NO: 191434 - RNA, 64 nt, hsa; identical to SEQ ID NO: 65458

SEQ ID NO: 191435 - RNA, 64 nt, hsa; identical to SEQ ID NO: 65459

SEQ ID NO: 191436 - RNA, 64 nt, hsa; identical to SEQ ID NO: 65460

SEQ ID NO: 191437 - RNA, 64 nt, hsa; identical to SEQ ID NO: 65461

SEQ ID NO: 191438 - RNA, 64 nt, hsa; identical to SEQ ID NO: 65462

SEQ ID NO: 191439 - RNA, 64 nt, hsa; identical to SEQ ID NO: 65463

SEQ ID NO: 191440 - RNA, 64 nt, hsa; identical to SEQ ID NO: 65464

SEQ ID NO: 191441 - RNA, 64 nt, hsa; identical to SEQ ID NO: 61358

SEQ ID NO: 191442 - RNA, 64 nt, hsa; identical to SEQ ID NO: 61359

SEQ ID NO: 191443 - RNA, 64 nt, hsa; identical to SEQ ID NO: 65467

SEQ ID NO: 191444 - RNA, 64 nt, hsa; identical to SEQ ID NO: 65468

SEQ ID NO: 191445 - RNA, 64 nt, hsa; identical to SEQ ID NO: 65469

SEQ ID NO: 191446 - RNA, 64 nt, hsa; identical to SEQ ID NO: 65470

SEQ ID NO: 191447 - RNA, 64 nt, hsa; identical to SEQ ID NO: 65471

SEQ ID NO: 191448 - RNA, 64 nt, hsa; identical to SEQ ID NO: 65472

SEQ ID NO: 191449 - RNA, 64 nt, hsa; identical to SEQ ID NO: 65473

SEQ ID NO: 191450 - RNA, 64 nt, hsa; identical to SEQ ID NO: 65474

SEQ ID NO: 191451 - RNA, 64 nt, hsa; identical to SEQ ID NO: 65475

SEQ ID NO: 191452 - RNA, 64 nt, hsa; identical to SEQ ID NO: 65476

SEQ ID NO: 191453 - RNA, 64 nt, hsa; identical to SEQ ID NO: 65477

SEQ ID NO: 191454 - RNA, 64 nt, hsa; identical to SEQ ID NO: 65478

SEQ ID NO: 191455 - RNA, 64 nt, hsa; identical to SEQ ID NO: 65479

SEQ ID NO: 191456 - RNA, 64 nt, hsa; identical to SEQ ID NO: 65480

SEQ ID NO: 191457 - RNA, 64 nt, hsa; identical to SEQ ID NO: 65481

SEQ ID NO: 191458 - RNA, 64 nt, hsa; identical to SEQ ID NO: 65482

SEQ ID NO: 191459 - RNA, 64 nt, hsa; identical to SEQ ID NO: 65483

SEQ ID NO: 191460 - RNA, 64 nt, hsa; identical to SEQ ID NO: 65484

SEQ ID NO: 191461 - RNA, 64 nt, hsa; identical to SEQ ID NO: 65485

SEQ ID NO: 191462 - RNA, 64 nt, hsa; identical to SEQ ID NO: 65486

SEQ ID NO: 191463 - RNA, 64 nt, hsa; identical to SEQ ID NO: 65487

SEQ ID NO: 191464 - RNA, 64 nt, hsa; identical to SEQ ID NO: 65488

SEQ ID NO: 191465 - RNA, 64 nt, hsa; identical to SEQ ID NO: 65489

SEQ ID NO: 191466 - RNA, 64 nt, hsa; identical to SEQ ID NO: 65490

SEQ ID NO: 191467 - RNA, 64 nt, hsa; identical to SEQ ID NO: 65491

SEQ ID NO: 191468 - RNA, 64 nt, hsa; identical to SEQ ID NO: 65492

SEQ ID NO: 191469 - RNA, 64 nt, hsa; identical to SEQ ID NO: 65493

SEQ ID NO: 191470 - RNA, 64 nt, hsa; identical to SEQ ID NO: 65494

SEQ ID NO: 191471 - RNA, 64 nt, hsa; identical to SEQ ID NO: 65495

SEQ ID NO: 191472 - RNA, 64 nt, hsa; identical to SEQ ID NO: 65496

SEQ ID NO: 191473 - RNA, 64 nt, hsa; identical to SEQ ID NO: 65497

SEQ ID NO: 191474 - RNA, 64 nt, hsa; identical to SEQ ID NO: 65498

SEQ ID NO: 191475 - RNA, 64 nt, hsa; identical to SEQ ID NO: 65499

SEQ ID NO: 191476 - RNA, 64 nt, hsa; identical to SEQ ID NO: 65500

SEQ ID NO: 191477 - RNA, 64 nt, hsa; identical to SEQ ID NO: 65501

SEQ ID NO: 191478 - RNA, 64 nt, hsa; identical to SEQ ID NO: 65502

SEQ ID NO: 191479 - RNA, 64 nt, hsa; identical to SEQ ID NO: 65503

SEQ ID NO: 191480 - RNA, 64 nt, hsa; identical to SEQ ID NO: 65504

SEQ ID NO: 191481 - RNA, 64 nt, hsa; identical to SEQ ID NO: 65505

SEQ ID NO: 191482 - RNA, 64 nt, hsa; identical to SEQ ID NO: 65506

SEQ ID NO: 191483 - RNA, 64 nt, hsa; identical to SEQ ID NO: 65507

SEQ ID NO: 191484 - RNA, 64 nt, hsa; identical to SEQ ID NO: 65508

SEQ ID NO: 191485 - RNA, 64 nt, hsa; identical to SEQ ID NO: 61360

SEQ ID NO: 191486 - RNA, 64 nt, hsa; identical to SEQ ID NO: 61361

SEQ ID NO: 191487 - RNA, 64 nt, hsa; identical to SEQ ID NO: 65511

SEQ ID NO: 191488 - RNA, 64 nt, hsa; identical to SEQ ID NO: 65512

SEQ ID NO: 191489 - RNA, 64 nt, hsa; identical to SEQ ID NO: 65513

SEQ ID NO: 191490 - RNA, 64 nt, hsa; identical to SEQ ID NO: 65514

SEQ ID NO: 191491 - RNA, 64 nt, hsa; identical to SEQ ID NO: 65515

SEQ ID NO: 191492 - RNA, 64 nt, hsa; identical to SEQ ID NO: 65516

SEQ ID NO: 191493 - RNA, 64 nt, hsa; identical to SEQ ID NO: 65517

SEQ ID NO: 191494 - RNA, 64 nt, hsa; identical to SEQ ID NO: 65518

SEQ ID NO: 191495 - RNA, 64 nt, hsa; identical to SEQ ID NO: 65519

SEQ ID NO: 191496 - RNA, 64 nt, hsa; identical to SEQ ID NO: 65520

SEQ ID NO: 191497 - RNA, 64 nt, hsa; identical to SEQ ID NO: 65521

SEQ ID NO: 191498 - RNA, 64 nt, hsa; identical to SEQ ID NO: 65522

SEQ ID NO: 191499 - RNA, 64 nt, hsa; identical to SEQ ID NO: 65523

SEQ ID NO: 191500 - RNA, 64 nt, hsa; identical to SEQ ID NO: 65524

SEQ ID NO: 191501 - RNA, 64 nt, hsa; identical to SEQ ID NO: 65525

SEQ ID NO: 191502 - RNA, 64 nt, hsa; identical to SEQ ID NO: 65526

SEQ ID NO: 191503 - RNA, 64 nt, hsa; identical to SEQ ID NO: 65527

SEQ ID NO: 191504 - RNA, 64 nt, hsa; identical to SEQ ID NO: 65528

SEQ ID NO: 191505 - RNA, 64 nt, hsa; identical to SEQ ID NO: 61362

SEQ ID NO: 191506 - RNA, 64 nt, hsa; identical to SEQ ID NO: 61363

SEQ ID NO: 191507 - RNA, 64 nt, hsa; identical to SEQ ID NO: 61364

SEQ ID NO: 191508 - RNA, 64 nt, hsa; identical to SEQ ID NO: 61365

SEQ ID NO: 191509 - RNA, 64 nt, hsa; identical to SEQ ID NO: 65533

SEQ ID NO: 191510 - RNA, 64 nt, hsa; identical to SEQ ID NO: 65534

SEQ ID NO: 191511 - RNA, 64 nt, hsa; identical to SEQ ID NO: 65535

SEQ ID NO: 191512 - RNA, 64 nt, hsa; identical to SEQ ID NO: 65536

SEQ ID NO: 191513 - RNA, 64 nt, hsa; identical to SEQ ID NO: 65537

SEQ ID NO: 191514 - RNA, 64 nt, hsa; identical to SEQ ID NO: 65538

SEQ ID NO: 191515 - RNA, 64 nt, hsa; identical to SEQ ID NO: 65539

SEQ ID NO: 191516 - RNA, 64 nt, hsa; identical to SEQ ID NO: 65540

SEQ ID NO: 191517 - RNA, 64 nt, hsa; identical to SEQ ID NO: 65541

SEQ ID NO: 191518 - RNA, 64 nt, hsa; identical to SEQ ID NO: 65542

SEQ ID NO: 191519 - RNA, 64 nt, hsa; identical to SEQ ID NO: 65543

SEQ ID NO: 191520 - RNA, 64 nt, hsa; identical to SEQ ID NO: 65544

SEQ ID NO: 191521 - RNA, 64 nt, hsa; identical to SEQ ID NO: 65545

SEQ ID NO: 191522 - RNA, 64 nt, hsa; identical to SEQ ID NO: 65546

SEQ ID NO: 191523 - RNA, 64 nt, hsa; identical to SEQ ID NO: 65547

SEQ ID NO: 191524 - RNA, 64 nt, hsa; identical to SEQ ID NO: 61366

SEQ ID NO: 191525 - RNA, 64 nt, hsa; identical to SEQ ID NO: 61367

SEQ ID NO: 191526 - RNA, 64 nt, hsa; identical to SEQ ID NO: 65550

SEQ ID NO: 191527 - RNA, 64 nt, hsa; identical to SEQ ID NO: 65551

SEQ ID NO: 191528 - RNA, 64 nt, hsa; identical to SEQ ID NO: 61368

SEQ ID NO: 191529 - RNA, 56 nt, hsa; identical to SEQ ID NO: 61369

SEQ ID NO: 191530 - RNA, 64 nt, hsa; identical to SEQ ID NO: 65554

SEQ ID NO: 191531 - RNA, 64 nt, hsa; identical to SEQ ID NO: 65555

SEQ ID NO: 191532 - RNA, 64 nt, hsa; identical to SEQ ID NO: 65556

SEQ ID NO: 191533 - RNA, 64 nt, hsa; identical to SEQ ID NO: 65557

SEQ ID NO: 191534 - RNA, 64 nt, hsa; identical to SEQ ID NO: 65558

SEQ ID NO: 191535 - RNA, 64 nt, hsa; identical to SEQ ID NO: 65559

SEQ ID NO: 191536 - RNA, 64 nt, hsa; identical to SEQ ID NO: 65560

SEQ ID NO: 191537 - RNA, 64 nt, hsa; identical to SEQ ID NO: 65561

SEQ ID NO: 191538 - RNA, 64 nt, hsa; identical to SEQ ID NO: 65562

SEQ ID NO: 191539 - RNA, 64 nt, hsa; identical to SEQ ID NO: 65563

SEQ ID NO: 191540 - RNA, 64 nt, hsa; identical to SEQ ID NO: 65564

SEQ ID NO: 191541 - RNA, 64 nt, hsa; identical to SEQ ID NO: 65565

SEQ ID NO: 191542 - RNA, 64 nt, hsa; identical to SEQ ID NO: 65566

SEQ ID NO: 191543 - RNA, 64 nt, hsa; identical to SEQ ID NO: 65567

SEQ ID NO: 191544 - RNA, 64 nt, hsa; identical to SEQ ID NO: 65568

SEQ ID NO: 191545 - RNA, 64 nt, hsa; identical to SEQ ID NO: 65569

SEQ ID NO: 191546 - RNA, 64 nt, hsa; identical to SEQ ID NO: 65570

SEQ ID NO: 191547 - RNA, 64 nt, hsa; identical to SEQ ID NO: 65571

SEQ ID NO: 191548 - RNA, 64 nt, hsa; identical to SEQ ID NO: 65572

SEQ ID NO: 191549 - RNA, 64 nt, hsa; identical to SEQ ID NO: 65573

SEQ ID NO: 191550 - RNA, 64 nt, hsa; identical to SEQ ID NO: 61370

SEQ ID NO: 191551 - RNA, 64 nt, hsa; identical to SEQ ID NO: 61371

SEQ ID NO: 191552 - RNA, 64 nt, hsa; identical to SEQ ID NO: 65576

SEQ ID NO: 191553 - RNA, 64 nt, hsa; identical to SEQ ID NO: 65577

SEQ ID NO: 191554 - RNA, 64 nt, hsa; identical to SEQ ID NO: 65578

SEQ ID NO: 191555 - RNA, 64 nt, hsa; identical to SEQ ID NO: 65579

SEQ ID NO: 191556 - RNA, 64 nt, hsa; identical to SEQ ID NO: 65580

SEQ ID NO: 191557 - RNA, 64 nt, hsa; identical to SEQ ID NO: 65581

SEQ ID NO: 191558 - RNA, 64 nt, hsa; identical to SEQ ID NO: 65582

SEQ ID NO: 191559 - RNA, 64 nt, hsa; identical to SEQ ID NO: 65583

SEQ ID NO: 191560 - RNA, 64 nt, hsa; identical to SEQ ID NO: 65584

SEQ ID NO: 191561 - RNA, 64 nt, hsa; identical to SEQ ID NO: 65585

SEQ ID NO: 191562 - RNA, 64 nt, hsa; identical to SEQ ID NO: 65586

SEQ ID NO: 191563 - RNA, 64 nt, hsa; identical to SEQ ID NO: 65587

SEQ ID NO: 191564 - RNA, 64 nt, hsa; identical to SEQ ID NO: 65588

SEQ ID NO: 191565 - RNA, 64 nt, hsa; identical to SEQ ID NO: 65589

SEQ ID NO: 191566 - RNA, 64 nt, hsa; identical to SEQ ID NO: 65590

SEQ ID NO: 191567 - RNA, 64 nt, hsa; identical to SEQ ID NO: 65591

SEQ ID NO: 191568 - RNA, 64 nt, hsa; identical to SEQ ID NO: 65592

SEQ ID NO: 191569 - RNA, 64 nt, hsa; identical to SEQ ID NO: 65593

SEQ ID NO: 191570 - RNA, 64 nt, hsa; identical to SEQ ID NO: 65594

SEQ ID NO: 191571 - RNA, 64 nt, hsa; identical to SEQ ID NO: 65595

SEQ ID NO: 191572 - RNA, 64 nt, hsa; identical to SEQ ID NO: 65596

SEQ ID NO: 191573 - RNA, 64 nt, hsa; identical to SEQ ID NO: 65597

SEQ ID NO: 191574 - RNA, 64 nt, hsa; identical to SEQ ID NO: 65598

SEQ ID NO: 191575 - RNA, 64 nt, hsa; identical to SEQ ID NO: 65599

SEQ ID NO: 191576 - RNA, 64 nt, hsa; identical to SEQ ID NO: 65600

SEQ ID NO: 191577 - RNA, 64 nt, hsa; identical to SEQ ID NO: 65601

SEQ ID NO: 191578 - RNA, 64 nt, hsa; identical to SEQ ID NO: 65602

SEQ ID NO: 191579 - RNA, 64 nt, hsa; identical to SEQ ID NO: 65603

SEQ ID NO: 191580 - RNA, 64 nt, hsa; identical to SEQ ID NO: 65604

SEQ ID NO: 191581 - RNA, 64 nt, hsa; identical to SEQ ID NO: 65605

SEQ ID NO: 191582 - RNA, 64 nt, hsa; identical to SEQ ID NO: 65606

SEQ ID NO: 191583 - RNA, 64 nt, hsa; identical to SEQ ID NO: 65607

SEQ ID NO: 191584 - RNA, 64 nt, hsa; identical to SEQ ID NO: 65608

SEQ ID NO: 191585 - RNA, 64 nt, hsa; identical to SEQ ID NO: 65609

SEQ ID NO: 191586 - RNA, 64 nt, hsa; identical to SEQ ID NO: 65610

SEQ ID NO: 191587 - RNA, 64 nt, hsa; identical to SEQ ID NO: 65611

SEQ ID NO: 191588 - RNA, 64 nt, hsa; identical to SEQ ID NO: 61372

SEQ ID NO: 191589 - RNA, 64 nt, hsa; identical to SEQ ID NO: 61373

SEQ ID NO: 191590 - RNA, 64 nt, hsa; identical to SEQ ID NO: 65614

SEQ ID NO: 191591 - RNA, 64 nt, hsa; identical to SEQ ID NO: 65615

SEQ ID NO: 191592 - RNA, 64 nt, hsa; identical to SEQ ID NO: 65616

SEQ ID NO: 191593 - RNA, 64 nt, hsa; identical to SEQ ID NO: 61374

SEQ ID NO: 191594 - RNA, 64 nt, hsa; identical to SEQ ID NO: 61375

SEQ ID NO: 191595 - RNA, 64 nt, hsa; identical to SEQ ID NO: 65619

SEQ ID NO: 191596 - RNA, 64 nt, hsa; identical to SEQ ID NO: 65620

SEQ ID NO: 191597 - RNA, 64 nt, hsa; identical to SEQ ID NO: 65621

SEQ ID NO: 191598 - RNA, 64 nt, hsa; identical to SEQ ID NO: 65622

SEQ ID NO: 191599 - RNA, 64 nt, hsa; identical to SEQ ID NO: 65623

SEQ ID NO: 191600 - RNA, 64 nt, hsa; identical to SEQ ID NO: 65624

SEQ ID NO: 191601 - RNA, 64 nt, hsa; identical to SEQ ID NO: 65625

SEQ ID NO: 191602 - RNA, 64 nt, hsa; identical to SEQ ID NO: 65626

SEQ ID NO: 191603 - RNA, 64 nt, hsa; identical to SEQ ID NO: 65627

SEQ ID NO: 191604 - RNA, 64 nt, hsa; identical to SEQ ID NO: 65628

SEQ ID NO: 191605 - RNA, 64 nt, hsa; identical to SEQ ID NO: 65629

SEQ ID NO: 191606 - RNA, 64 nt, hsa; identical to SEQ ID NO: 65630

SEQ ID NO: 191607 - RNA, 64 nt, hsa; identical to SEQ ID NO: 65631

SEQ ID NO: 191608 - RNA, 64 nt, hsa; identical to SEQ ID NO: 65632

SEQ ID NO: 191609 - RNA, 64 nt, hsa; identical to SEQ ID NO: 65633

SEQ ID NO: 191610 - RNA, 64 nt, hsa; identical to SEQ ID NO: 65634

SEQ ID NO: 191611 - RNA, 64 nt, hsa; identical to SEQ ID NO: 65635

SEQ ID NO: 191612 - RNA, 64 nt, hsa; identical to SEQ ID NO: 65636

SEQ ID NO: 191613 - RNA, 64 nt, hsa; identical to SEQ ID NO: 65637

SEQ ID NO: 191614 - RNA, 64 nt, hsa; identical to SEQ ID NO: 65638

SEQ ID NO: 191615 - RNA, 64 nt, hsa; identical to SEQ ID NO: 65639

SEQ ID NO: 191616 - RNA, 64 nt, hsa; identical to SEQ ID NO: 65640

SEQ ID NO: 191617 - RNA, 64 nt, hsa; identical to SEQ ID NO: 65641

SEQ ID NO: 191618 - RNA, 64 nt, hsa; identical to SEQ ID NO: 65642

SEQ ID NO: 191619 - RNA, 64 nt, hsa; identical to SEQ ID NO: 65643

SEQ ID NO: 191620 - RNA, 64 nt, hsa; identical to SEQ ID NO: 65644

SEQ ID NO: 191621 - RNA, 60 nt, hsa; identical to SEQ ID NO: 65087

SEQ ID NO: 191622 - RNA, 64 nt, hsa; identical to SEQ ID NO: 65646

SEQ ID NO: 191623 - RNA, 64 nt, hsa; identical to SEQ ID NO: 65647

SEQ ID NO: 191624 - RNA, 64 nt, hsa; identical to SEQ ID NO: 65648

SEQ ID NO: 191625 - RNA, 64 nt, hsa; identical to SEQ ID NO: 65649

SEQ ID NO: 191626 - RNA, 64 nt, hsa; identical to SEQ ID NO: 65650

SEQ ID NO: 191627 - RNA, 64 nt, hsa; identical to SEQ ID NO: 65651

SEQ ID NO: 191628 - RNA, 51 nt, hsa; identical to SEQ ID NO: 65094

SEQ ID NO: 191629 - RNA, 64 nt, hsa; identical to SEQ ID NO: 65653

SEQ ID NO: 191630 - RNA, 64 nt, hsa; identical to SEQ ID NO: 65654

SEQ ID NO: 191631 - RNA, 64 nt, hsa; identical to SEQ ID NO: 65655

SEQ ID NO: 191632 - RNA, 64 nt, hsa; identical to SEQ ID NO: 65656

SEQ ID NO: 191633 - RNA, 64 nt, hsa; identical to SEQ ID NO: 65657

SEQ ID NO: 191634 - RNA, 64 nt, hsa; identical to SEQ ID NO: 65658

SEQ ID NO: 191635 - RNA, 64 nt, hsa; identical to SEQ ID NO: 65659

SEQ ID NO: 191636 - RNA, 64 nt, hsa; identical to SEQ ID NO: 65660

SEQ ID NO: 191637 - RNA, 64 nt, hsa; identical to SEQ ID NO: 65661

SEQ ID NO: 191638 - RNA, 64 nt, hsa; identical to SEQ ID NO: 65662

SEQ ID NO: 191639 - RNA, 64 nt, hsa; identical to SEQ ID NO: 65663

SEQ ID NO: 191640 - RNA, 64 nt, hsa; identical to SEQ ID NO: 65664

SEQ ID NO: 191641 - RNA, 64 nt, hsa; identical to SEQ ID NO: 65665

SEQ ID NO: 191642 - RNA, 64 nt, hsa; identical to SEQ ID NO: 65666

SEQ ID NO: 191643 - RNA, 64 nt, hsa; identical to SEQ ID NO: 65667

SEQ ID NO: 191644 - RNA, 64 nt, hsa; identical to SEQ ID NO: 65668

SEQ ID NO: 191645 - RNA, 64 nt, hsa; identical to SEQ ID NO: 65669

SEQ ID NO: 191646 - RNA, 64 nt, hsa; identical to SEQ ID NO: 65670

SEQ ID NO: 191647 - RNA, 64 nt, hsa; identical to SEQ ID NO: 65671

SEQ ID NO: 191648 - RNA, 64 nt, hsa; identical to SEQ ID NO: 65672

SEQ ID NO: 191649 - RNA, 64 nt, hsa; identical to SEQ ID NO: 65673

SEQ ID NO: 191650 - RNA, 64 nt, hsa; identical to SEQ ID NO: 65674

SEQ ID NO: 191651 - RNA, 64 nt, hsa; identical to SEQ ID NO: 65675

SEQ ID NO: 191652 - RNA, 64 nt, hsa; identical to SEQ ID NO: 65676

SEQ ID NO: 191653 - RNA, 64 nt, hsa; identical to SEQ ID NO: 65677

SEQ ID NO: 191654 - RNA, 64 nt, hsa; identical to SEQ ID NO: 65678

SEQ ID NO: 191655 - RNA, 64 nt, hsa; identical to SEQ ID NO: 65679

SEQ ID NO: 191656 - RNA, 64 nt, hsa; identical to SEQ ID NO: 65680

SEQ ID NO: 191657 - RNA, 64 nt, hsa; identical to SEQ ID NO: 65681

SEQ ID NO: 191658 - RNA, 64 nt, hsa; identical to SEQ ID NO: 65682

SEQ ID NO: 191659 - RNA, 64 nt, hsa; identical to SEQ ID NO: 65683

SEQ ID NO: 191660 - RNA, 64 nt, hsa; identical to SEQ ID NO: 65684

SEQ ID NO: 191661 - RNA, 64 nt, hsa; identical to SEQ ID NO: 65685

SEQ ID NO: 191662 - RNA, 64 nt, hsa; identical to SEQ ID NO: 65686

SEQ ID NO: 191663 - RNA, 64 nt, hsa; identical to SEQ ID NO: 65687

SEQ ID NO: 191664 - RNA, 64 nt, hsa; identical to SEQ ID NO: 65688

SEQ ID NO: 191665 - RNA, 64 nt, hsa; identical to SEQ ID NO: 65689

SEQ ID NO: 191666 - RNA, 64 nt, hsa; identical to SEQ ID NO: 65690

SEQ ID NO: 191667 - RNA, 64 nt, hsa; identical to SEQ ID NO: 65691

SEQ ID NO: 191668 - RNA, 64 nt, hsa; identical to SEQ ID NO: 65692

SEQ ID NO: 191669 - RNA, 64 nt, hsa; identical to SEQ ID NO: 65693

SEQ ID NO: 191670 - RNA, 65 nt, hsa; identical to SEQ ID NO: 65694

SEQ ID NO: 191671 - RNA, 65 nt, hsa; identical to SEQ ID NO: 65695

SEQ ID NO: 191672 - RNA, 65 nt, hsa; identical to SEQ ID NO: 65696

SEQ ID NO: 191673 - RNA, 65 nt, hsa; identical to SEQ ID NO: 65697

SEQ ID NO: 191674 - RNA, 65 nt, hsa; identical to SEQ ID NO: 65698

SEQ ID NO: 191675 - RNA, 65 nt, hsa; identical to SEQ ID NO: 65699

SEQ ID NO: 191676 - RNA, 65 nt, hsa; identical to SEQ ID NO: 65700

SEQ ID NO: 191677 - RNA, 65 nt, hsa; identical to SEQ ID NO: 65701

SEQ ID NO: 191678 - RNA, 65 nt, hsa; identical to SEQ ID NO: 65702

SEQ ID NO: 191679 - RNA, 65 nt, hsa; identical to SEQ ID NO: 65703

SEQ ID NO: 191680 - RNA, 65 nt, hsa; identical to SEQ ID NO: 65704

SEQ ID NO: 191681 - RNA, 65 nt, hsa; identical to SEQ ID NO: 65705

SEQ ID NO: 191682 - RNA, 65 nt, hsa; identical to SEQ ID NO: 65706

SEQ ID NO: 191683 - RNA, 65 nt, hsa; identical to SEQ ID NO: 65707

SEQ ID NO: 191684 - RNA, 65 nt, hsa; identical to SEQ ID NO: 65708

SEQ ID NO: 191685 - RNA, 65 nt, hsa; identical to SEQ ID NO: 65709

SEQ ID NO: 191686 - RNA, 65 nt, hsa; identical to SEQ ID NO: 65710

SEQ ID NO: 191687 - RNA, 65 nt, hsa; identical to SEQ ID NO: 65711

SEQ ID NO: 191688 - RNA, 65 nt, hsa; identical to SEQ ID NO: 65712

SEQ ID NO: 191689 - RNA, 65 nt, hsa; identical to SEQ ID NO: 65713

SEQ ID NO: 191690 - RNA, 65 nt, hsa; identical to SEQ ID NO: 65714

SEQ ID NO: 191691 - RNA, 65 nt, hsa; identical to SEQ ID NO: 65715

SEQ ID NO: 191692 - RNA, 65 nt, hsa; identical to SEQ ID NO: 65716

SEQ ID NO: 191693 - RNA, 65 nt, hsa; identical to SEQ ID NO: 65717

SEQ ID NO: 191694 - RNA, 65 nt, hsa; identical to SEQ ID NO: 65718

SEQ ID NO: 191695 - RNA, 65 nt, hsa; identical to SEQ ID NO: 65719

SEQ ID NO: 191696 - RNA, 65 nt, hsa; identical to SEQ ID NO: 65720

SEQ ID NO: 191697 - RNA, 65 nt, hsa; identical to SEQ ID NO: 65721

SEQ ID NO: 191698 - RNA, 65 nt, hsa; identical to SEQ ID NO: 65722

SEQ ID NO: 191699 - RNA, 65 nt, hsa; identical to SEQ ID NO: 65723

SEQ ID NO: 191700 - RNA, 65 nt, hsa; identical to SEQ ID NO: 65724

SEQ ID NO: 191701 - RNA, 65 nt, hsa; identical to SEQ ID NO: 65725

SEQ ID NO: 191702 - RNA, 65 nt, hsa; identical to SEQ ID NO: 65726

SEQ ID NO: 191703 - RNA, 65 nt, hsa; identical to SEQ ID NO: 65727

SEQ ID NO: 191704 - RNA, 65 nt, hsa; identical to SEQ ID NO: 65728

SEQ ID NO: 191705 - RNA, 65 nt, hsa; identical to SEQ ID NO: 65729

SEQ ID NO: 191706 - RNA, 65 nt, hsa; identical to SEQ ID NO: 65730

SEQ ID NO: 191707 - RNA, 65 nt, hsa; identical to SEQ ID NO: 65731

SEQ ID NO: 191708 - RNA, 65 nt, hsa; identical to SEQ ID NO: 65732

SEQ ID NO: 191709 - RNA, 65 nt, hsa; identical to SEQ ID NO: 65733

SEQ ID NO: 191710 - RNA, 65 nt, hsa; identical to SEQ ID NO: 65734

SEQ ID NO: 191711 - RNA, 65 nt, hsa; identical to SEQ ID NO: 65735

SEQ ID NO: 191712 - RNA, 65 nt, hsa; identical to SEQ ID NO: 65736

SEQ ID NO: 191713 - RNA, 65 nt, hsa; identical to SEQ ID NO: 65737

SEQ ID NO: 191714 - RNA, 65 nt, hsa; identical to SEQ ID NO: 65738

SEQ ID NO: 191715 - RNA, 65 nt, hsa; identical to SEQ ID NO: 65739

SEQ ID NO: 191716 - RNA, 65 nt, hsa; identical to SEQ ID NO: 65740

SEQ ID NO: 191717 - RNA, 65 nt, hsa; identical to SEQ ID NO: 65741

SEQ ID NO: 191718 - RNA, 65 nt, hsa; identical to SEQ ID NO: 65742

SEQ ID NO: 191719 - RNA, 65 nt, hsa; identical to SEQ ID NO: 65743

SEQ ID NO: 191720 - RNA, 65 nt, hsa; identical to SEQ ID NO: 65744

SEQ ID NO: 191721 - RNA, 65 nt, hsa; identical to SEQ ID NO: 65745

SEQ ID NO: 191722 - RNA, 65 nt, hsa; identical to SEQ ID NO: 65746

SEQ ID NO: 191723 - RNA, 65 nt, hsa; identical to SEQ ID NO: 65747

SEQ ID NO: 191724 - RNA, 65 nt, hsa; identical to SEQ ID NO: 65748

SEQ ID NO: 191725 - RNA, 65 nt, hsa; identical to SEQ ID NO: 65749

SEQ ID NO: 191726 - RNA, 65 nt, hsa; identical to SEQ ID NO: 65750

SEQ ID NO: 191727 - RNA, 65 nt, hsa; identical to SEQ ID NO: 65751

SEQ ID NO: 191728 - RNA, 65 nt, hsa; identical to SEQ ID NO: 65752

SEQ ID NO: 191729 - RNA, 65 nt, hsa; identical to SEQ ID NO: 65753

SEQ ID NO: 191730 - RNA, 65 nt, hsa; identical to SEQ ID NO: 65754

SEQ ID NO: 191731 - RNA, 65 nt, hsa; identical to SEQ ID NO: 65755

SEQ ID NO: 191732 - RNA, 65 nt, hsa; identical to SEQ ID NO: 65756

SEQ ID NO: 191733 - RNA, 65 nt, hsa; identical to SEQ ID NO: 65757

SEQ ID NO: 191734 - RNA, 65 nt, hsa; identical to SEQ ID NO: 65758

SEQ ID NO: 191735 - RNA, 65 nt, hsa; identical to SEQ ID NO: 65759

SEQ ID NO: 191736 - RNA, 65 nt, hsa; identical to SEQ ID NO: 65760

SEQ ID NO: 191737 - RNA, 65 nt, hsa; identical to SEQ ID NO: 65761

SEQ ID NO: 191738 - RNA, 65 nt, hsa; identical to SEQ ID NO: 65762

SEQ ID NO: 191739 - RNA, 65 nt, hsa; identical to SEQ ID NO: 65763

SEQ ID NO: 191740 - RNA, 65 nt, hsa; identical to SEQ ID NO: 65764

SEQ ID NO: 191741 - RNA, 65 nt, hsa; identical to SEQ ID NO: 65765

SEQ ID NO: 191742 - RNA, 65 nt, hsa; identical to SEQ ID NO: 65766

SEQ ID NO: 191743 - RNA, 65 nt, hsa; identical to SEQ ID NO: 65767

SEQ ID NO: 191744 - RNA, 65 nt, hsa; identical to SEQ ID NO: 65768

SEQ ID NO: 191745 - RNA, 65 nt, hsa; identical to SEQ ID NO: 65769

SEQ ID NO: 191746 - RNA, 65 nt, hsa; identical to SEQ ID NO: 65770

SEQ ID NO: 191747 - RNA, 65 nt, hsa; identical to SEQ ID NO: 65771

SEQ ID NO: 191748 - RNA, 65 nt, hsa; identical to SEQ ID NO: 65772

SEQ ID NO: 191749 - RNA, 65 nt, hsa; identical to SEQ ID NO: 65773

SEQ ID NO: 191750 - RNA, 65 nt, hsa; identical to SEQ ID NO: 65774

SEQ ID NO: 191751 - RNA, 65 nt, hsa; identical to SEQ ID NO: 65775

SEQ ID NO: 191752 - RNA, 65 nt, hsa; identical to SEQ ID NO: 65776

SEQ ID NO: 191753 - RNA, 65 nt, hsa; identical to SEQ ID NO: 65777

SEQ ID NO: 191754 - RNA, 65 nt, hsa; identical to SEQ ID NO: 65778

SEQ ID NO: 191755 - RNA, 65 nt, hsa; identical to SEQ ID NO: 65779

SEQ ID NO: 191756 - RNA, 65 nt, hsa; identical to SEQ ID NO: 65780

SEQ ID NO: 191757 - RNA, 65 nt, hsa; identical to SEQ ID NO: 65781

SEQ ID NO: 191758 - RNA, 65 nt, hsa; identical to SEQ ID NO: 65782

SEQ ID NO: 191759 - RNA, 65 nt, hsa; identical to SEQ ID NO: 65783

SEQ ID NO: 191760 - RNA, 65 nt, hsa; identical to SEQ ID NO: 65784

SEQ ID NO: 191761 - RNA, 65 nt, hsa; identical to SEQ ID NO: 65785

SEQ ID NO: 191762 - RNA, 65 nt, hsa; identical to SEQ ID NO: 65786

SEQ ID NO: 191763 - RNA, 65 nt, hsa; identical to SEQ ID NO: 65787

SEQ ID NO: 191764 - RNA, 65 nt, hsa; identical to SEQ ID NO: 65788

SEQ ID NO: 191765 - RNA, 65 nt, hsa; identical to SEQ ID NO: 65789

SEQ ID NO: 191766 - RNA, 65 nt, hsa; identical to SEQ ID NO: 65790

SEQ ID NO: 191767 - RNA, 65 nt, hsa; identical to SEQ ID NO: 65791

SEQ ID NO: 191768 - RNA, 65 nt, hsa; identical to SEQ ID NO: 65792

SEQ ID NO: 191769 - RNA, 65 nt, hsa; identical to SEQ ID NO: 65793

SEQ ID NO: 191770 - RNA, 65 nt, hsa; identical to SEQ ID NO: 65794

SEQ ID NO: 191771 - RNA, 65 nt, hsa; identical to SEQ ID NO: 65795

SEQ ID NO: 191772 - RNA, 65 nt, hsa; identical to SEQ ID NO: 65796

SEQ ID NO: 191773 - RNA, 65 nt, hsa; identical to SEQ ID NO: 65797

SEQ ID NO: 191774 - RNA, 65 nt, hsa; identical to SEQ ID NO: 65798

SEQ ID NO: 191775 - RNA, 65 nt, hsa; identical to SEQ ID NO: 65799

SEQ ID NO: 191776 - RNA, 65 nt, hsa; identical to SEQ ID NO: 65800

SEQ ID NO: 191777 - RNA, 65 nt, hsa; identical to SEQ ID NO: 65801

SEQ ID NO: 191778 - RNA, 65 nt, hsa; identical to SEQ ID NO: 65802

SEQ ID NO: 191779 - RNA, 65 nt, hsa; identical to SEQ ID NO: 65803

SEQ ID NO: 191780 - RNA, 65 nt, hsa; identical to SEQ ID NO: 65804

SEQ ID NO: 191781 - RNA, 65 nt, hsa; identical to SEQ ID NO: 65805

SEQ ID NO: 191782 - RNA, 65 nt, hsa; identical to SEQ ID NO: 65806

SEQ ID NO: 191783 - RNA, 65 nt, hsa; identical to SEQ ID NO: 65807

SEQ ID NO: 191784 - RNA, 65 nt, hsa; identical to SEQ ID NO: 65808

SEQ ID NO: 191785 - RNA, 65 nt, hsa; identical to SEQ ID NO: 65809

SEQ ID NO: 191786 - RNA, 65 nt, hsa; identical to SEQ ID NO: 65810

SEQ ID NO: 191787 - RNA, 65 nt, hsa; identical to SEQ ID NO: 65811

SEQ ID NO: 191788 - RNA, 65 nt, hsa; identical to SEQ ID NO: 65812

SEQ ID NO: 191789 - RNA, 65 nt, hsa; identical to SEQ ID NO: 65813

SEQ ID NO: 191790 - RNA, 65 nt, hsa; identical to SEQ ID NO: 65814

SEQ ID NO: 191791 - RNA, 65 nt, hsa; identical to SEQ ID NO: 65815

SEQ ID NO: 191792 - RNA, 65 nt, hsa; identical to SEQ ID NO: 65816

SEQ ID NO: 191793 - RNA, 65 nt, hsa; identical to SEQ ID NO: 65817

SEQ ID NO: 191794 - RNA, 65 nt, hsa; identical to SEQ ID NO: 65818

SEQ ID NO: 191795 - RNA, 65 nt, hsa; identical to SEQ ID NO: 65819

SEQ ID NO: 191796 - RNA, 65 nt, hsa; identical to SEQ ID NO: 65820

SEQ ID NO: 191797 - RNA, 65 nt, hsa; identical to SEQ ID NO: 65821

SEQ ID NO: 191798 - RNA, 65 nt, hsa; identical to SEQ ID NO: 65822

SEQ ID NO: 191799 - RNA, 65 nt, hsa; identical to SEQ ID NO: 65823

SEQ ID NO: 191800 - RNA, 65 nt, hsa; identical to SEQ ID NO: 65824

SEQ ID NO: 191801 - RNA, 65 nt, hsa; identical to SEQ ID NO: 65825

SEQ ID NO: 191802 - RNA, 65 nt, hsa; identical to SEQ ID NO: 65826

SEQ ID NO: 191803 - RNA, 65 nt, hsa; identical to SEQ ID NO: 65827

SEQ ID NO: 191804 - RNA, 65 nt, hsa; identical to SEQ ID NO: 65828

SEQ ID NO: 191805 - RNA, 65 nt, hsa; identical to SEQ ID NO: 65829

SEQ ID NO: 191806 - RNA, 65 nt, hsa; identical to SEQ ID NO: 65830

SEQ ID NO: 191807 - RNA, 65 nt, hsa; identical to SEQ ID NO: 65831

SEQ ID NO: 191808 - RNA, 56 nt, hsa; identical to SEQ ID NO: 61369

SEQ ID NO: 191809 - RNA, 65 nt, hsa; identical to SEQ ID NO: 65833

SEQ ID NO: 191810 - RNA, 65 nt, hsa; identical to SEQ ID NO: 65834

SEQ ID NO: 191811 - RNA, 65 nt, hsa; identical to SEQ ID NO: 65835

SEQ ID NO: 191812 - RNA, 65 nt, hsa; identical to SEQ ID NO: 65836

SEQ ID NO: 191813 - RNA, 65 nt, hsa; identical to SEQ ID NO: 65837

SEQ ID NO: 191814 - RNA, 65 nt, hsa; identical to SEQ ID NO: 65838

SEQ ID NO: 191815 - RNA, 65 nt, hsa; identical to SEQ ID NO: 65839

SEQ ID NO: 191816 - RNA, 65 nt, hsa; identical to SEQ ID NO: 65840

SEQ ID NO: 191817 - RNA, 65 nt, hsa; identical to SEQ ID NO: 65841

SEQ ID NO: 191818 - RNA, 65 nt, hsa; identical to SEQ ID NO: 65842

SEQ ID NO: 191819 - RNA, 65 nt, hsa; identical to SEQ ID NO: 65843

SEQ ID NO: 191820 - RNA, 65 nt, hsa; identical to SEQ ID NO: 65844

SEQ ID NO: 191821 - RNA, 65 nt, hsa; identical to SEQ ID NO: 65845

SEQ ID NO: 191822 - RNA, 65 nt, hsa; identical to SEQ ID NO: 65846

SEQ ID NO: 191823 - RNA, 65 nt, hsa; identical to SEQ ID NO: 65847

SEQ ID NO: 191824 - RNA, 65 nt, hsa; identical to SEQ ID NO: 65848

SEQ ID NO: 191825 - RNA, 65 nt, hsa; identical to SEQ ID NO: 65849

SEQ ID NO: 191826 - RNA, 65 nt, hsa; identical to SEQ ID NO: 65850

SEQ ID NO: 191827 - RNA, 65 nt, hsa; identical to SEQ ID NO: 65851

SEQ ID NO: 191828 - RNA, 65 nt, hsa; identical to SEQ ID NO: 65852

SEQ ID NO: 191829 - RNA, 65 nt, hsa; identical to SEQ ID NO: 65853

SEQ ID NO: 191830 - RNA, 65 nt, hsa; identical to SEQ ID NO: 65854

SEQ ID NO: 191831 - RNA, 65 nt, hsa; identical to SEQ ID NO: 65855

SEQ ID NO: 191832 - RNA, 65 nt, hsa; identical to SEQ ID NO: 65856

SEQ ID NO: 191833 - RNA, 65 nt, hsa; identical to SEQ ID NO: 65857

SEQ ID NO: 191834 - RNA, 65 nt, hsa; identical to SEQ ID NO: 65858

SEQ ID NO: 191835 - RNA, 65 nt, hsa; identical to SEQ ID NO: 65859

SEQ ID NO: 191836 - RNA, 65 nt, hsa; identical to SEQ ID NO: 65860

SEQ ID NO: 191837 - RNA, 65 nt, hsa; identical to SEQ ID NO: 65861

SEQ ID NO: 191838 - RNA, 65 nt, hsa; identical to SEQ ID NO: 65862

SEQ ID NO: 191839 - RNA, 65 nt, hsa; identical to SEQ ID NO: 65863

SEQ ID NO: 191840 - RNA, 65 nt, hsa; identical to SEQ ID NO: 65864

SEQ ID NO: 191841 - RNA, 65 nt, hsa; identical to SEQ ID NO: 65865

SEQ ID NO: 191842 - RNA, 65 nt, hsa; identical to SEQ ID NO: 65866

SEQ ID NO: 191843 - RNA, 65 nt, hsa; identical to SEQ ID NO: 65867

SEQ ID NO: 191844 - RNA, 65 nt, hsa; identical to SEQ ID NO: 65868

SEQ ID NO: 191845 - RNA, 65 nt, hsa; identical to SEQ ID NO: 65869

SEQ ID NO: 191846 - RNA, 65 nt, hsa; identical to SEQ ID NO: 65870

SEQ ID NO: 191847 - RNA, 65 nt, hsa; identical to SEQ ID NO: 65871

SEQ ID NO: 191848 - RNA, 65 nt, hsa; identical to SEQ ID NO: 65872

SEQ ID NO: 191849 - RNA, 65 nt, hsa; identical to SEQ ID NO: 65873

SEQ ID NO: 191850 - RNA, 65 nt, hsa; identical to SEQ ID NO: 65874

SEQ ID NO: 191851 - RNA, 65 nt, hsa; identical to SEQ ID NO: 65875

SEQ ID NO: 191852 - RNA, 65 nt, hsa; identical to SEQ ID NO: 65876

SEQ ID NO: 191853 - RNA, 65 nt, hsa; identical to SEQ ID NO: 65877

SEQ ID NO: 191854 - RNA, 65 nt, hsa; identical to SEQ ID NO: 65878

SEQ ID NO: 191855 - RNA, 65 nt, hsa; identical to SEQ ID NO: 65879

SEQ ID NO: 191856 - RNA, 65 nt, hsa; identical to SEQ ID NO: 65880

SEQ ID NO: 191857 - RNA, 65 nt, hsa; identical to SEQ ID NO: 65881

SEQ ID NO: 191858 - RNA, 65 nt, hsa; identical to SEQ ID NO: 65882

SEQ ID NO: 191859 - RNA, 65 nt, hsa; identical to SEQ ID NO: 65883

SEQ ID NO: 191860 - RNA, 65 nt, hsa; identical to SEQ ID NO: 65884

SEQ ID NO: 191861 - RNA, 65 nt, hsa; identical to SEQ ID NO: 65885

SEQ ID NO: 191862 - RNA, 65 nt, hsa; identical to SEQ ID NO: 65886

SEQ ID NO: 191863 - RNA, 65 nt, hsa; identical to SEQ ID NO: 65887

SEQ ID NO: 191864 - RNA, 65 nt, hsa; identical to SEQ ID NO: 65888

SEQ ID NO: 191865 - RNA, 65 nt, hsa; identical to SEQ ID NO: 65889

SEQ ID NO: 191866 - RNA, 65 nt, hsa; identical to SEQ ID NO: 65890

SEQ ID NO: 191867 - RNA, 65 nt, hsa; identical to SEQ ID NO: 65891

SEQ ID NO: 191868 - RNA, 65 nt, hsa; identical to SEQ ID NO: 65892

SEQ ID NO: 191869 - RNA, 65 nt, hsa; identical to SEQ ID NO: 65893

SEQ ID NO: 191870 - RNA, 65 nt, hsa; identical to SEQ ID NO: 65894

SEQ ID NO: 191871 - RNA, 65 nt, hsa; identical to SEQ ID NO: 65895

SEQ ID NO: 191872 - RNA, 65 nt, hsa; identical to SEQ ID NO: 65896

SEQ ID NO: 191873 - RNA, 65 nt, hsa; identical to SEQ ID NO: 65897

SEQ ID NO: 191874 - RNA, 65 nt, hsa; identical to SEQ ID NO: 65898

SEQ ID NO: 191875 - RNA, 65 nt, hsa; identical to SEQ ID NO: 65899

SEQ ID NO: 191876 - RNA, 65 nt, hsa; identical to SEQ ID NO: 65900

SEQ ID NO: 191877 - RNA, 65 nt, hsa; identical to SEQ ID NO: 65901

SEQ ID NO: 191878 - RNA, 65 nt, hsa; identical to SEQ ID NO: 65902

SEQ ID NO: 191879 - RNA, 65 nt, hsa; identical to SEQ ID NO: 65903

SEQ ID NO: 191880 - RNA, 65 nt, hsa; identical to SEQ ID NO: 65904

SEQ ID NO: 191881 - RNA, 65 nt, hsa; identical to SEQ ID NO: 65905

SEQ ID NO: 191882 - RNA, 65 nt, hsa; identical to SEQ ID NO: 65906

SEQ ID NO: 191883 - RNA, 65 nt, hsa; identical to SEQ ID NO: 65907

SEQ ID NO: 191884 - RNA, 65 nt, hsa; identical to SEQ ID NO: 65908

SEQ ID NO: 191885 - RNA, 65 nt, hsa; identical to SEQ ID NO: 65909

SEQ ID NO: 191886 - RNA, 65 nt, hsa; identical to SEQ ID NO: 65910

SEQ ID NO: 191887 - RNA, 65 nt, hsa; identical to SEQ ID NO: 65911

SEQ ID NO: 191888 - RNA, 65 nt, hsa; identical to SEQ ID NO: 65912

SEQ ID NO: 191889 - RNA, 65 nt, hsa; identical to SEQ ID NO: 65913

SEQ ID NO: 191890 - RNA, 65 nt, hsa; identical to SEQ ID NO: 65914

SEQ ID NO: 191891 - RNA, 65 nt, hsa; identical to SEQ ID NO: 65915

SEQ ID NO: 191892 - RNA, 65 nt, hsa; identical to SEQ ID NO: 65916

SEQ ID NO: 191893 - RNA, 65 nt, hsa; identical to SEQ ID NO: 65917

SEQ ID NO: 191894 - RNA, 65 nt, hsa; identical to SEQ ID NO: 65918

SEQ ID NO: 191895 - RNA, 65 nt, hsa; identical to SEQ ID NO: 65919

SEQ ID NO: 191896 - RNA, 65 nt, hsa; identical to SEQ ID NO: 65920

SEQ ID NO: 191897 - RNA, 65 nt, hsa; identical to SEQ ID NO: 65921

SEQ ID NO: 191898 - RNA, 65 nt, hsa; identical to SEQ ID NO: 65922

SEQ ID NO: 191899 - RNA, 65 nt, hsa; identical to SEQ ID NO: 65923

SEQ ID NO: 191900 - RNA, 60 nt, hsa; identical to SEQ ID NO: 65087

SEQ ID NO: 191901 - RNA, 65 nt, hsa; identical to SEQ ID NO: 65925

SEQ ID NO: 191902 - RNA, 65 nt, hsa; identical to SEQ ID NO: 65926

SEQ ID NO: 191903 - RNA, 65 nt, hsa; identical to SEQ ID NO: 65927

SEQ ID NO: 191904 - RNA, 65 nt, hsa; identical to SEQ ID NO: 65928

SEQ ID NO: 191905 - RNA, 65 nt, hsa; identical to SEQ ID NO: 65929

SEQ ID NO: 191906 - RNA, 65 nt, hsa; identical to SEQ ID NO: 65930

SEQ ID NO: 191907 - RNA, 51 nt, hsa; identical to SEQ ID NO: 65094

SEQ ID NO: 191908 - RNA, 65 nt, hsa; identical to SEQ ID NO: 65932

SEQ ID NO: 191909 - RNA, 65 nt, hsa; identical to SEQ ID NO: 65933

SEQ ID NO: 191910 - RNA, 65 nt, hsa; identical to SEQ ID NO: 65934

SEQ ID NO: 191911 - RNA, 65 nt, hsa; identical to SEQ ID NO: 65935

SEQ ID NO: 191912 - RNA, 65 nt, hsa; identical to SEQ ID NO: 65936

SEQ ID NO: 191913 - RNA, 65 nt, hsa; identical to SEQ ID NO: 65937

SEQ ID NO: 191914 - RNA, 65 nt, hsa; identical to SEQ ID NO: 65938

SEQ ID NO: 191915 - RNA, 65 nt, hsa; identical to SEQ ID NO: 65939

SEQ ID NO: 191916 - RNA, 65 nt, hsa; identical to SEQ ID NO: 65940

SEQ ID NO: 191917 - RNA, 65 nt, hsa; identical to SEQ ID NO: 65941

SEQ ID NO: 191918 - RNA, 65 nt, hsa; identical to SEQ ID NO: 65942

SEQ ID NO: 191919 - RNA, 65 nt, hsa; identical to SEQ ID NO: 65943

SEQ ID NO: 191920 - RNA, 65 nt, hsa; identical to SEQ ID NO: 65944

SEQ ID NO: 191921 - RNA, 65 nt, hsa; identical to SEQ ID NO: 65945

SEQ ID NO: 191922 - RNA, 65 nt, hsa; identical to SEQ ID NO: 65946

SEQ ID NO: 191923 - RNA, 65 nt, hsa; identical to SEQ ID NO: 65947

SEQ ID NO: 191924 - RNA, 65 nt, hsa; identical to SEQ ID NO: 65948

SEQ ID NO: 191925 - RNA, 65 nt, hsa; identical to SEQ ID NO: 65949

SEQ ID NO: 191926 - RNA, 65 nt, hsa; identical to SEQ ID NO: 65950

SEQ ID NO: 191927 - RNA, 65 nt, hsa; identical to SEQ ID NO: 65951

SEQ ID NO: 191928 - RNA, 65 nt, hsa; identical to SEQ ID NO: 65952

SEQ ID NO: 191929 - RNA, 65 nt, hsa; identical to SEQ ID NO: 65953

SEQ ID NO: 191930 - RNA, 65 nt, hsa; identical to SEQ ID NO: 65954

SEQ ID NO: 191931 - RNA, 65 nt, hsa; identical to SEQ ID NO: 65955

SEQ ID NO: 191932 - RNA, 65 nt, hsa; identical to SEQ ID NO: 65956

SEQ ID NO: 191933 - RNA, 65 nt, hsa; identical to SEQ ID NO: 65957

SEQ ID NO: 191934 - RNA, 65 nt, hsa; identical to SEQ ID NO: 65958

SEQ ID NO: 191935 - RNA, 65 nt, hsa; identical to SEQ ID NO: 65959

SEQ ID NO: 191936 - RNA, 65 nt, hsa; identical to SEQ ID NO: 65960

SEQ ID NO: 191937 - RNA, 65 nt, hsa; identical to SEQ ID NO: 65961

SEQ ID NO: 191938 - RNA, 65 nt, hsa; identical to SEQ ID NO: 65962

SEQ ID NO: 191939 - RNA, 65 nt, hsa; identical to SEQ ID NO: 65963

SEQ ID NO: 191940 - RNA, 65 nt, hsa; identical to SEQ ID NO: 65964

SEQ ID NO: 191941 - RNA, 65 nt, hsa; identical to SEQ ID NO: 65965

SEQ ID NO: 191942 - RNA, 65 nt, hsa; identical to SEQ ID NO: 65966

SEQ ID NO: 191943 - RNA, 65 nt, hsa; identical to SEQ ID NO: 65967

SEQ ID NO: 191944 - RNA, 65 nt, hsa; identical to SEQ ID NO: 65968

SEQ ID NO: 191945 - RNA, 65 nt, hsa; identical to SEQ ID NO: 65969

SEQ ID NO: 191946 - RNA, 65 nt, hsa; identical to SEQ ID NO: 65970

SEQ ID NO: 191947 - RNA, 65 nt, hsa; identical to SEQ ID NO: 65971

SEQ ID NO: 191948 - RNA, 65 nt, hsa; identical to SEQ ID NO: 65972

SEQ ID NO: 191949 - RNA, 63 nt, hsa; identical to SEQ ID NO: 102980

SEQ ID NO: 191950 - RNA, 63 nt, hsa; identical to SEQ ID NO: 102981

SEQ ID NO: 191951 - RNA, 63 nt, hsa; identical to SEQ ID NO: 102982

SEQ ID NO: 191952 - RNA, 63 nt, hsa; identical to SEQ ID NO: 102983

SEQ ID NO: 191953 - RNA, 63 nt, hsa; identical to SEQ ID NO: 102984

SEQ ID NO: 191954 - RNA, 63 nt, hsa; identical to SEQ ID NO: 102985

SEQ ID NO: 191955 - RNA, 63 nt, hsa; identical to SEQ ID NO: 102986

SEQ ID NO: 191956 - RNA, 63 nt, hsa; identical to SEQ ID NO: 102987

SEQ ID NO: 191957 - RNA, 63 nt, hsa; identical to SEQ ID NO: 102988

SEQ ID NO: 191958 - RNA, 63 nt, hsa; identical to SEQ ID NO: 102989

SEQ ID NO: 191959 - RNA, 63 nt, hsa; identical to SEQ ID NO: 102990

SEQ ID NO: 191960 - RNA, 58 nt, hsa; identical to SEQ ID NO: 102991

SEQ ID NO: 191961 - RNA, 63 nt, hsa; identical to SEQ ID NO: 102992

SEQ ID NO: 191962 - RNA, 63 nt, hsa; identical to SEQ ID NO: 102993

SEQ ID NO: 191963 - RNA, 63 nt, hsa; identical to SEQ ID NO: 102994

SEQ ID NO: 191964 - RNA, 63 nt, hsa; identical to SEQ ID NO: 102995

SEQ ID NO: 191965 - RNA, 63 nt, hsa; identical to SEQ ID NO: 102996

SEQ ID NO: 191966 - RNA, 63 nt, hsa; identical to SEQ ID NO: 102997

SEQ ID NO: 191967 - RNA, 63 nt, hsa; identical to SEQ ID NO: 102998

SEQ ID NO: 191968 - RNA, 63 nt, hsa; identical to SEQ ID NO: 102999

SEQ ID NO: 191969 - RNA, 63 nt, hsa; identical to SEQ ID NO: 103000

SEQ ID NO: 191970 - RNA, 63 nt, hsa; identical to SEQ ID NO: 103001

SEQ ID NO: 191971 - RNA, 63 nt, hsa; identical to SEQ ID NO: 103002

SEQ ID NO: 191972 - RNA, 63 nt, hsa; identical to SEQ ID NO: 103003

SEQ ID NO: 191973 - RNA, 63 nt, hsa; identical to SEQ ID NO: 103004

SEQ ID NO: 191974 - RNA, 63 nt, hsa; identical to SEQ ID NO: 103005

SEQ ID NO: 191975 - RNA, 63 nt, hsa; identical to SEQ ID NO: 103006

SEQ ID NO: 191976 - RNA, 63 nt, hsa; identical to SEQ ID NO: 103007

SEQ ID NO: 191977 - RNA, 63 nt, hsa; identical to SEQ ID NO: 103008

SEQ ID NO: 191978 - RNA, 63 nt, hsa; identical to SEQ ID NO: 103009

SEQ ID NO: 191979 - RNA, 63 nt, hsa; identical to SEQ ID NO: 103010

SEQ ID NO: 191980 - RNA, 63 nt, hsa; identical to SEQ ID NO: 103011

SEQ ID NO: 191981 - RNA, 63 nt, hsa; identical to SEQ ID NO: 103012

SEQ ID NO: 191982 - RNA, 63 nt, hsa; identical to SEQ ID NO: 103013

SEQ ID NO: 191983 - RNA, 53 nt, hsa; identical to SEQ ID NO: 103014

SEQ ID NO: 191984 - RNA, 63 nt, hsa; identical to SEQ ID NO: 103015

SEQ ID NO: 191985 - RNA, 63 nt, hsa; identical to SEQ ID NO: 103016

SEQ ID NO: 191986 - RNA, 63 nt, hsa; identical to SEQ ID NO: 103017

SEQ ID NO: 191987 - RNA, 63 nt, hsa; identical to SEQ ID NO: 103018

SEQ ID NO: 191988 - RNA, 63 nt, hsa; identical to SEQ ID NO: 103019

SEQ ID NO: 191989 - RNA, 63 nt, hsa; identical to SEQ ID NO: 103020

SEQ ID NO: 191990 - RNA, 63 nt, hsa; identical to SEQ ID NO: 103021

SEQ ID NO: 191991 - RNA, 63 nt, hsa; identical to SEQ ID NO: 103022

SEQ ID NO: 191992 - RNA, 63 nt, hsa; identical to SEQ ID NO: 103023

SEQ ID NO: 191993 - RNA, 63 nt, hsa; identical to SEQ ID NO: 103024

SEQ ID NO: 191994 - RNA, 63 nt, hsa; identical to SEQ ID NO: 103025

SEQ ID NO: 191995 - RNA, 63 nt, hsa; identical to SEQ ID NO: 103026

SEQ ID NO: 191996 - RNA, 63 nt, hsa; identical to SEQ ID NO: 103027

SEQ ID NO: 191997 - RNA, 63 nt, hsa; identical to SEQ ID NO: 103028

SEQ ID NO: 191998 - RNA, 63 nt, hsa; identical to SEQ ID NO: 103029

SEQ ID NO: 191999 - RNA, 63 nt, hsa; identical to SEQ ID NO: 103030

SEQ ID NO: 192000 - RNA, 63 nt, hsa; identical to SEQ ID NO: 103031

SEQ ID NO: 192001 - RNA, 63 nt, hsa; identical to SEQ ID NO: 103032

SEQ ID NO: 192002 - RNA, 63 nt, hsa; identical to SEQ ID NO: 103033

SEQ ID NO: 192003 - RNA, 63 nt, hsa; identical to SEQ ID NO: 103034

SEQ ID NO: 192004 - RNA, 63 nt, hsa; identical to SEQ ID NO: 103035

SEQ ID NO: 192005 - RNA, 63 nt, hsa; identical to SEQ ID NO: 103036

SEQ ID NO: 192006 - RNA, 63 nt, hsa; identical to SEQ ID NO: 103037

SEQ ID NO: 192007 - RNA, 63 nt, hsa; identical to SEQ ID NO: 103038

SEQ ID NO: 192008 - RNA, 63 nt, hsa; identical to SEQ ID NO: 103039

SEQ ID NO: 192009 - RNA, 63 nt, hsa; identical to SEQ ID NO: 103040

SEQ ID NO: 192010 - RNA, 63 nt, hsa; identical to SEQ ID NO: 103041

SEQ ID NO: 192011 - RNA, 63 nt, hsa; identical to SEQ ID NO: 103042

SEQ ID NO: 192012 - RNA, 63 nt, hsa; identical to SEQ ID NO: 103043

SEQ ID NO: 192013 - RNA, 63 nt, hsa; identical to SEQ ID NO: 103044

SEQ ID NO: 192014 - RNA, 63 nt, hsa; identical to SEQ ID NO: 103045

SEQ ID NO: 192015 - RNA, 63 nt, hsa; identical to SEQ ID NO: 103046

SEQ ID NO: 192016 - RNA, 63 nt, hsa; identical to SEQ ID NO: 103047

SEQ ID NO: 192017 - RNA, 63 nt, hsa; identical to SEQ ID NO: 103048

SEQ ID NO: 192018 - RNA, 63 nt, hsa; identical to SEQ ID NO: 103049

SEQ ID NO: 192019 - RNA, 63 nt, hsa; identical to SEQ ID NO: 103050

SEQ ID NO: 192020 - RNA, 63 nt, hsa; identical to SEQ ID NO: 103051

SEQ ID NO: 192021 - RNA, 63 nt, hsa; identical to SEQ ID NO: 103052

SEQ ID NO: 192022 - RNA, 63 nt, hsa; identical to SEQ ID NO: 103053

SEQ ID NO: 192023 - RNA, 63 nt, hsa; identical to SEQ ID NO: 103054

SEQ ID NO: 192024 - RNA, 63 nt, hsa; identical to SEQ ID NO: 103055

SEQ ID NO: 192025 - RNA, 63 nt, hsa; identical to SEQ ID NO: 103056

SEQ ID NO: 192026 - RNA, 63 nt, hsa; identical to SEQ ID NO: 103057

SEQ ID NO: 192027 - RNA, 63 nt, hsa; identical to SEQ ID NO: 103058

SEQ ID NO: 192028 - RNA, 63 nt, hsa; identical to SEQ ID NO: 103059

SEQ ID NO: 192029 - RNA, 63 nt, hsa; identical to SEQ ID NO: 103060

SEQ ID NO: 192030 - RNA, 63 nt, hsa; identical to SEQ ID NO: 103061

SEQ ID NO: 192031 - RNA, 63 nt, hsa; identical to SEQ ID NO: 103062

SEQ ID NO: 192032 - RNA, 63 nt, hsa; identical to SEQ ID NO: 103063

SEQ ID NO: 192033 - RNA, 63 nt, hsa; identical to SEQ ID NO: 103064

SEQ ID NO: 192034 - RNA, 63 nt, hsa; identical to SEQ ID NO: 103065

SEQ ID NO: 192035 - RNA, 63 nt, hsa; identical to SEQ ID NO: 103066

SEQ ID NO: 192036 - RNA, 63 nt, hsa; identical to SEQ ID NO: 103067

SEQ ID NO: 192037 - RNA, 63 nt, hsa; identical to SEQ ID NO: 103068

SEQ ID NO: 192038 - RNA, 63 nt, hsa; identical to SEQ ID NO: 103069

SEQ ID NO: 192039 - RNA, 63 nt, hsa; identical to SEQ ID NO: 103070

SEQ ID NO: 192040 - RNA, 63 nt, hsa; identical to SEQ ID NO: 103071

SEQ ID NO: 192041 - RNA, 63 nt, hsa; identical to SEQ ID NO: 103072

SEQ ID NO: 192042 - RNA, 63 nt, hsa; identical to SEQ ID NO: 103073

SEQ ID NO: 192043 - RNA, 63 nt, hsa; identical to SEQ ID NO: 103074

SEQ ID NO: 192044 - RNA, 63 nt, hsa; identical to SEQ ID NO: 103075

SEQ ID NO: 192045 - RNA, 63 nt, hsa; identical to SEQ ID NO: 103076

SEQ ID NO: 192046 - RNA, 63 nt, hsa; identical to SEQ ID NO: 103077

SEQ ID NO: 192047 - RNA, 63 nt, hsa; identical to SEQ ID NO: 103078

SEQ ID NO: 192048 - RNA, 63 nt, hsa; identical to SEQ ID NO: 103079

SEQ ID NO: 192049 - RNA, 63 nt, hsa; identical to SEQ ID NO: 103080

SEQ ID NO: 192050 - RNA, 63 nt, hsa; identical to SEQ ID NO: 103081

SEQ ID NO: 192051 - RNA, 63 nt, hsa; identical to SEQ ID NO: 103082

SEQ ID NO: 192052 - RNA, 63 nt, hsa; identical to SEQ ID NO: 103083

SEQ ID NO: 192053 - RNA, 63 nt, hsa; identical to SEQ ID NO: 103084

SEQ ID NO: 192054 - RNA, 63 nt, hsa; identical to SEQ ID NO: 103085

SEQ ID NO: 192055 - RNA, 63 nt, hsa; identical to SEQ ID NO: 103086

SEQ ID NO: 192056 - RNA, 63 nt, hsa; identical to SEQ ID NO: 103087

SEQ ID NO: 192057 - RNA, 63 nt, hsa; identical to SEQ ID NO: 103088

SEQ ID NO: 192058 - RNA, 63 nt, hsa; identical to SEQ ID NO: 103089

SEQ ID NO: 192059 - RNA, 63 nt, hsa; identical to SEQ ID NO: 103090

SEQ ID NO: 192060 - RNA, 63 nt, hsa; identical to SEQ ID NO: 103091

SEQ ID NO: 192061 - RNA, 63 nt, hsa; identical to SEQ ID NO: 103092

SEQ ID NO: 192062 - RNA, 63 nt, hsa; identical to SEQ ID NO: 103093

SEQ ID NO: 192063 - RNA, 63 nt, hsa; identical to SEQ ID NO: 103094

SEQ ID NO: 192064 - RNA, 63 nt, hsa; identical to SEQ ID NO: 103095

SEQ ID NO: 192065 - RNA, 63 nt, hsa; identical to SEQ ID NO: 103096

SEQ ID NO: 192066 - RNA, 63 nt, hsa; identical to SEQ ID NO: 103097

SEQ ID NO: 192067 - RNA, 60 nt, hsa; identical to SEQ ID NO: 103098

SEQ ID NO: 192068 - RNA, 63 nt, hsa; identical to SEQ ID NO: 103099

SEQ ID NO: 192069 - RNA, 63 nt, hsa; identical to SEQ ID NO: 103100

SEQ ID NO: 192070 - RNA, 63 nt, hsa; identical to SEQ ID NO: 103101

SEQ ID NO: 192071 - RNA, 63 nt, hsa; identical to SEQ ID NO: 103102

SEQ ID NO: 192072 - RNA, 63 nt, hsa; identical to SEQ ID NO: 103103

SEQ ID NO: 192073 - RNA, 63 nt, hsa; identical to SEQ ID NO: 103104

SEQ ID NO: 192074 - RNA, 63 nt, hsa; identical to SEQ ID NO: 103105

SEQ ID NO: 192075 - RNA, 63 nt, hsa; identical to SEQ ID NO: 103106

SEQ ID NO: 192076 - RNA, 63 nt, hsa; identical to SEQ ID NO: 103107

SEQ ID NO: 192077 - RNA, 63 nt, hsa; identical to SEQ ID NO: 103108

SEQ ID NO: 192078 - RNA, 63 nt, hsa; identical to SEQ ID NO: 103109

SEQ ID NO: 192079 - RNA, 63 nt, hsa; identical to SEQ ID NO: 103110

SEQ ID NO: 192080 - RNA, 63 nt, hsa; identical to SEQ ID NO: 103111

SEQ ID NO: 192081 - RNA, 63 nt, hsa; identical to SEQ ID NO: 103112

SEQ ID NO: 192082 - RNA, 63 nt, hsa; identical to SEQ ID NO: 103113

SEQ ID NO: 192083 - RNA, 63 nt, hsa; identical to SEQ ID NO: 103114

SEQ ID NO: 192084 - RNA, 63 nt, hsa; identical to SEQ ID NO: 103115

SEQ ID NO: 192085 - RNA, 63 nt, hsa; identical to SEQ ID NO: 103116

SEQ ID NO: 192086 - RNA, 63 nt, hsa; identical to SEQ ID NO: 103117

SEQ ID NO: 192087 - RNA, 63 nt, hsa; identical to SEQ ID NO: 103118

SEQ ID NO: 192088 - RNA, 63 nt, hsa; identical to SEQ ID NO: 103119

SEQ ID NO: 192089 - RNA, 63 nt, hsa; identical to SEQ ID NO: 103120

SEQ ID NO: 192090 - RNA, 63 nt, hsa; identical to SEQ ID NO: 103121

SEQ ID NO: 192091 - RNA, 63 nt, hsa; identical to SEQ ID NO: 103122

SEQ ID NO: 192092 - RNA, 63 nt, hsa; identical to SEQ ID NO: 103123

SEQ ID NO: 192093 - RNA, 63 nt, hsa; identical to SEQ ID NO: 103124

SEQ ID NO: 192094 - RNA, 63 nt, hsa; identical to SEQ ID NO: 103125

SEQ ID NO: 192095 - RNA, 63 nt, hsa; identical to SEQ ID NO: 103126

SEQ ID NO: 192096 - RNA, 63 nt, hsa; identical to SEQ ID NO: 103127

SEQ ID NO: 192097 - RNA, 63 nt, hsa; identical to SEQ ID NO: 103128

SEQ ID NO: 192098 - RNA, 63 nt, hsa; identical to SEQ ID NO: 103129

SEQ ID NO: 192099 - RNA, 63 nt, hsa; identical to SEQ ID NO: 103130

SEQ ID NO: 192100 - RNA, 63 nt, hsa; identical to SEQ ID NO: 103131

SEQ ID NO: 192101 - RNA, 63 nt, hsa; identical to SEQ ID NO: 103132

SEQ ID NO: 192102 - RNA, 63 nt, hsa; identical to SEQ ID NO: 103133

SEQ ID NO: 192103 - RNA, 63 nt, hsa; identical to SEQ ID NO: 103134

SEQ ID NO: 192104 - RNA, 63 nt, hsa; identical to SEQ ID NO: 103135

SEQ ID NO: 192105 - RNA, 63 nt, hsa; identical to SEQ ID NO: 103136

SEQ ID NO: 192106 - RNA, 63 nt, hsa; identical to SEQ ID NO: 103137

SEQ ID NO: 192107 - RNA, 63 nt, hsa; identical to SEQ ID NO: 103138

SEQ ID NO: 192108 - RNA, 63 nt, hsa; identical to SEQ ID NO: 103139

SEQ ID NO: 192109 - RNA, 63 nt, hsa; identical to SEQ ID NO: 103140

SEQ ID NO: 192110 - RNA, 63 nt, hsa; identical to SEQ ID NO: 103141

SEQ ID NO: 192111 - RNA, 63 nt, hsa; identical to SEQ ID NO: 103142

SEQ ID NO: 192112 - RNA, 63 nt, hsa; identical to SEQ ID NO: 103143

SEQ ID NO: 192113 - RNA, 63 nt, hsa; identical to SEQ ID NO: 103144

SEQ ID NO: 192114 - RNA, 63 nt, hsa; identical to SEQ ID NO: 103145

SEQ ID NO: 192115 - RNA, 63 nt, hsa; identical to SEQ ID NO: 103146

SEQ ID NO: 192116 - RNA, 63 nt, hsa; identical to SEQ ID NO: 103147

SEQ ID NO: 192117 - RNA, 63 nt, hsa; identical to SEQ ID NO: 103148

SEQ ID NO: 192118 - RNA, 63 nt, hsa; identical to SEQ ID NO: 103149

SEQ ID NO: 192119 - RNA, 63 nt, hsa; identical to SEQ ID NO: 103150

SEQ ID NO: 192120 - RNA, 63 nt, hsa; identical to SEQ ID NO: 103151

SEQ ID NO: 192121 - RNA, 63 nt, hsa; identical to SEQ ID NO: 103152

SEQ ID NO: 192122 - RNA, 63 nt, hsa; identical to SEQ ID NO: 103153

SEQ ID NO: 192123 - RNA, 63 nt, hsa; identical to SEQ ID NO: 103154

SEQ ID NO: 192124 - RNA, 63 nt, hsa; identical to SEQ ID NO: 103155

SEQ ID NO: 192125 - RNA, 63 nt, hsa; identical to SEQ ID NO: 103156

SEQ ID NO: 192126 - RNA, 63 nt, hsa; identical to SEQ ID NO: 103157

SEQ ID NO: 192127 - RNA, 63 nt, hsa; identical to SEQ ID NO: 103158

SEQ ID NO: 192128 - RNA, 63 nt, hsa; identical to SEQ ID NO: 103159

SEQ ID NO: 192129 - RNA, 63 nt, hsa; identical to SEQ ID NO: 103160

SEQ ID NO: 192130 - RNA, 63 nt, hsa; identical to SEQ ID NO: 103161

SEQ ID NO: 192131 - RNA, 63 nt, hsa; identical to SEQ ID NO: 103162

SEQ ID NO: 192132 - RNA, 63 nt, hsa; identical to SEQ ID NO: 103163

SEQ ID NO: 192133 - RNA, 63 nt, hsa; identical to SEQ ID NO: 103164

SEQ ID NO: 192134 - RNA, 63 nt, hsa; identical to SEQ ID NO: 103165

SEQ ID NO: 192135 - RNA, 63 nt, hsa; identical to SEQ ID NO: 103166

SEQ ID NO: 192136 - RNA, 63 nt, hsa; identical to SEQ ID NO: 103167

SEQ ID NO: 192137 - RNA, 63 nt, hsa; identical to SEQ ID NO: 103168

SEQ ID NO: 192138 - RNA, 63 nt, hsa; identical to SEQ ID NO: 103169

SEQ ID NO: 192139 - RNA, 63 nt, hsa; identical to SEQ ID NO: 103170

SEQ ID NO: 192140 - RNA, 63 nt, hsa; identical to SEQ ID NO: 103171

SEQ ID NO: 192141 - RNA, 63 nt, hsa; identical to SEQ ID NO: 103172

SEQ ID NO: 192142 - RNA, 63 nt, hsa; identical to SEQ ID NO: 103173

SEQ ID NO: 192143 - RNA, 63 nt, hsa; identical to SEQ ID NO: 103174

SEQ ID NO: 192144 - RNA, 63 nt, hsa; identical to SEQ ID NO: 103175

SEQ ID NO: 192145 - RNA, 63 nt, hsa; identical to SEQ ID NO: 103176

SEQ ID NO: 192146 - RNA, 63 nt, hsa; identical to SEQ ID NO: 103177

SEQ ID NO: 192147 - RNA, 63 nt, hsa; identical to SEQ ID NO: 103178

SEQ ID NO: 192148 - RNA, 63 nt, hsa; identical to SEQ ID NO: 103179

SEQ ID NO: 192149 - RNA, 63 nt, hsa; identical to SEQ ID NO: 103180

SEQ ID NO: 192150 - RNA, 63 nt, hsa; identical to SEQ ID NO: 103181

SEQ ID NO: 192151 - RNA, 63 nt, hsa; identical to SEQ ID NO: 103182

SEQ ID NO: 192152 - RNA, 63 nt, hsa; identical to SEQ ID NO: 103183

SEQ ID NO: 192153 - RNA, 63 nt, hsa; identical to SEQ ID NO: 103184

SEQ ID NO: 192154 - RNA, 63 nt, hsa; identical to SEQ ID NO: 103185

SEQ ID NO: 192155 - RNA, 63 nt, hsa; identical to SEQ ID NO: 103186

SEQ ID NO: 192156 - RNA, 63 nt, hsa; identical to SEQ ID NO: 103187

SEQ ID NO: 192157 - RNA, 63 nt, hsa; identical to SEQ ID NO: 103188

SEQ ID NO: 192158 - RNA, 63 nt, hsa; identical to SEQ ID NO: 103189

SEQ ID NO: 192159 - RNA, 63 nt, hsa; identical to SEQ ID NO: 103190

SEQ ID NO: 192160 - RNA, 63 nt, hsa; identical to SEQ ID NO: 103191

SEQ ID NO: 192161 - RNA, 63 nt, hsa; identical to SEQ ID NO: 103192

SEQ ID NO: 192162 - RNA, 63 nt, hsa; identical to SEQ ID NO: 103193

SEQ ID NO: 192163 - RNA, 63 nt, hsa; identical to SEQ ID NO: 103194

SEQ ID NO: 192164 - RNA, 63 nt, hsa; identical to SEQ ID NO: 103195

SEQ ID NO: 192165 - RNA, 51 nt, hsa; identical to SEQ ID NO: 103196

SEQ ID NO: 192166 - RNA, 63 nt, hsa; identical to SEQ ID NO: 103197

SEQ ID NO: 192167 - RNA, 63 nt, hsa; identical to SEQ ID NO: 103198

SEQ ID NO: 192168 - RNA, 63 nt, hsa; identical to SEQ ID NO: 103199

SEQ ID NO: 192169 - RNA, 63 nt, hsa; identical to SEQ ID NO: 103200

SEQ ID NO: 192170 - RNA, 63 nt, hsa; identical to SEQ ID NO: 103201

SEQ ID NO: 192171 - RNA, 63 nt, hsa; identical to SEQ ID NO: 103202

SEQ ID NO: 192172 - RNA, 63 nt, hsa; identical to SEQ ID NO: 103203

SEQ ID NO: 192173 - RNA, 63 nt, hsa; identical to SEQ ID NO: 103204

SEQ ID NO: 192174 - RNA, 63 nt, hsa; identical to SEQ ID NO: 103205

SEQ ID NO: 192175 - RNA, 63 nt, hsa; identical to SEQ ID NO: 103206

SEQ ID NO: 192176 - RNA, 63 nt, hsa; identical to SEQ ID NO: 103207

SEQ ID NO: 192177 - RNA, 63 nt, hsa; identical to SEQ ID NO: 103208

SEQ ID NO: 192178 - RNA, 63 nt, hsa; identical to SEQ ID NO: 103209

SEQ ID NO: 192179 - RNA, 63 nt, hsa; identical to SEQ ID NO: 103210

SEQ ID NO: 192180 - RNA, 63 nt, hsa; identical to SEQ ID NO: 103211

SEQ ID NO: 192181 - RNA, 63 nt, hsa; identical to SEQ ID NO: 103212

SEQ ID NO: 192182 - RNA, 63 nt, hsa; identical to SEQ ID NO: 103213

SEQ ID NO: 192183 - RNA, 63 nt, hsa; identical to SEQ ID NO: 103214

SEQ ID NO: 192184 - RNA, 63 nt, hsa; identical to SEQ ID NO: 103215

SEQ ID NO: 192185 - RNA, 63 nt, hsa; identical to SEQ ID NO: 103216

SEQ ID NO: 192186 - RNA, 63 nt, hsa; identical to SEQ ID NO: 103217

SEQ ID NO: 192187 - RNA, 63 nt, hsa; identical to SEQ ID NO: 103218

SEQ ID NO: 192188 - RNA, 63 nt, hsa; identical to SEQ ID NO: 103219

SEQ ID NO: 192189 - RNA, 63 nt, hsa; identical to SEQ ID NO: 103220

SEQ ID NO: 192190 - RNA, 63 nt, hsa; identical to SEQ ID NO: 103221

SEQ ID NO: 192191 - RNA, 63 nt, hsa; identical to SEQ ID NO: 103222

SEQ ID NO: 192192 - RNA, 63 nt, hsa; identical to SEQ ID NO: 103223

SEQ ID NO: 192193 - RNA, 63 nt, hsa; identical to SEQ ID NO: 103224

SEQ ID NO: 192194 - RNA, 63 nt, hsa; identical to SEQ ID NO: 103225

SEQ ID NO: 192195 - RNA, 63 nt, hsa; identical to SEQ ID NO: 103226

SEQ ID NO: 192196 - RNA, 63 nt, hsa; identical to SEQ ID NO: 103227

SEQ ID NO: 192197 - RNA, 63 nt, hsa; identical to SEQ ID NO: 103228

SEQ ID NO: 192198 - RNA, 63 nt, hsa; identical to SEQ ID NO: 103229

SEQ ID NO: 192199 - RNA, 63 nt, hsa; identical to SEQ ID NO: 103230

SEQ ID NO: 192200 - RNA, 63 nt, hsa; identical to SEQ ID NO: 103231

SEQ ID NO: 192201 - RNA, 63 nt, hsa; identical to SEQ ID NO: 103232

SEQ ID NO: 192202 - RNA, 63 nt, hsa; identical to SEQ ID NO: 103233

SEQ ID NO: 192203 - RNA, 63 nt, hsa; identical to SEQ ID NO: 103234

SEQ ID NO: 192204 - RNA, 63 nt, hsa; identical to SEQ ID NO: 103235

SEQ ID NO: 192205 - RNA, 63 nt, hsa; identical to SEQ ID NO: 103236

SEQ ID NO: 192206 - RNA, 63 nt, hsa; identical to SEQ ID NO: 103237

SEQ ID NO: 192207 - RNA, 63 nt, hsa; identical to SEQ ID NO: 103238

SEQ ID NO: 192208 - RNA, 63 nt, hsa; identical to SEQ ID NO: 103239

SEQ ID NO: 192209 - RNA, 63 nt, hsa; identical to SEQ ID NO: 103240

SEQ ID NO: 192210 - RNA, 63 nt, hsa; identical to SEQ ID NO: 103241

SEQ ID NO: 192211 - RNA, 63 nt, hsa; identical to SEQ ID NO: 103242

SEQ ID NO: 192212 - RNA, 63 nt, hsa; identical to SEQ ID NO: 103243

SEQ ID NO: 192213 - RNA, 63 nt, hsa; identical to SEQ ID NO: 103244

SEQ ID NO: 192214 - RNA, 63 nt, hsa; identical to SEQ ID NO: 103245

SEQ ID NO: 192215 - RNA, 63 nt, hsa; identical to SEQ ID NO: 103246

SEQ ID NO: 192216 - RNA, 63 nt, hsa; identical to SEQ ID NO: 103247

SEQ ID NO: 192217 - RNA, 63 nt, hsa; identical to SEQ ID NO: 103248

SEQ ID NO: 192218 - RNA, 63 nt, hsa; identical to SEQ ID NO: 103249

SEQ ID NO: 192219 - RNA, 63 nt, hsa; identical to SEQ ID NO: 103250

SEQ ID NO: 192220 - RNA, 63 nt, hsa; identical to SEQ ID NO: 103251

SEQ ID NO: 192221 - RNA, 63 nt, hsa; identical to SEQ ID NO: 103252

SEQ ID NO: 192222 - RNA, 63 nt, hsa; identical to SEQ ID NO: 103253

SEQ ID NO: 192223 - RNA, 63 nt, hsa; identical to SEQ ID NO: 103254

SEQ ID NO: 192224 - RNA, 63 nt, hsa; identical to SEQ ID NO: 103255

SEQ ID NO: 192225 - RNA, 63 nt, hsa; identical to SEQ ID NO: 103256

SEQ ID NO: 192226 - RNA, 63 nt, hsa; identical to SEQ ID NO: 103257

SEQ ID NO: 192227 - RNA, 63 nt, hsa; identical to SEQ ID NO: 103258

SEQ ID NO: 192228 - RNA, 63 nt, hsa; identical to SEQ ID NO: 103259

SEQ ID NO: 192229 - RNA, 63 nt, hsa; identical to SEQ ID NO: 103260

SEQ ID NO: 192230 - RNA, 63 nt, hsa; identical to SEQ ID NO: 103261

SEQ ID NO: 192231 - RNA, 63 nt, hsa; identical to SEQ ID NO: 103262

SEQ ID NO: 192232 - RNA, 63 nt, hsa; identical to SEQ ID NO: 103263

SEQ ID NO: 192233 - RNA, 63 nt, hsa; identical to SEQ ID NO: 103264

SEQ ID NO: 192234 - RNA, 63 nt, hsa; identical to SEQ ID NO: 103265

SEQ ID NO: 192235 - RNA, 63 nt, hsa; identical to SEQ ID NO: 103266

SEQ ID NO: 192236 - RNA, 63 nt, hsa; identical to SEQ ID NO: 103267

SEQ ID NO: 192237 - RNA, 63 nt, hsa; identical to SEQ ID NO: 103268

SEQ ID NO: 192238 - RNA, 63 nt, hsa; identical to SEQ ID NO: 103269

SEQ ID NO: 192239 - RNA, 63 nt, hsa; identical to SEQ ID NO: 103270

SEQ ID NO: 192240 - RNA, 63 nt, hsa; identical to SEQ ID NO: 103271

SEQ ID NO: 192241 - RNA, 63 nt, hsa; identical to SEQ ID NO: 103272

SEQ ID NO: 192242 - RNA, 63 nt, hsa; identical to SEQ ID NO: 103273

SEQ ID NO: 192243 - RNA, 63 nt, hsa; identical to SEQ ID NO: 103274

SEQ ID NO: 192244 - RNA, 63 nt, hsa; identical to SEQ ID NO: 103275

SEQ ID NO: 192245 - RNA, 63 nt, hsa; identical to SEQ ID NO: 103276

SEQ ID NO: 192246 - RNA, 63 nt, hsa; identical to SEQ ID NO: 103277

SEQ ID NO: 192247 - RNA, 63 nt, hsa; identical to SEQ ID NO: 103278

SEQ ID NO: 192248 - RNA, 63 nt, hsa; identical to SEQ ID NO: 103279

SEQ ID NO: 192249 - RNA, 63 nt, hsa; identical to SEQ ID NO: 103280

SEQ ID NO: 192250 - RNA, 63 nt, hsa; identical to SEQ ID NO: 103281

SEQ ID NO: 192251 - RNA, 63 nt, hsa; identical to SEQ ID NO: 103282

SEQ ID NO: 192252 - RNA, 63 nt, hsa; identical to SEQ ID NO: 103283

SEQ ID NO: 192253 - RNA, 63 nt, hsa; identical to SEQ ID NO: 103284

SEQ ID NO: 192254 - RNA, 63 nt, hsa; identical to SEQ ID NO: 103285

SEQ ID NO: 192255 - RNA, 63 nt, hsa; identical to SEQ ID NO: 103286

SEQ ID NO: 192256 - RNA, 63 nt, hsa; identical to SEQ ID NO: 103287

SEQ ID NO: 192257 - RNA, 63 nt, hsa; identical to SEQ ID NO: 103288

SEQ ID NO: 192258 - RNA, 65 nt, hsa
uuaaagggaaucggguacuuugcuuguugaauaaugcacuuuaaaacaaggaaccguaucaggcc

SEQ ID NO: 192259 - RNA, 65 nt, hsa
ggguaguaaucaucuuguccccuuuuucauguucagcacuuuaauuuuuuugccuuacuuucaug

SEQ ID NO: 192260 - RNA, 65 nt, hsa
gggagagacccuuucugaaagaaguauggccaaaagcacuuuaaugcugcugacauuguuguuuu

SEQ ID NO: 192261 - RNA, 65 nt, hsa
gcuccccaauucugccugccuccucccucccagcugcacuuuaacccuagaagguggggaccugg

SEQ ID NO: 192262 - RNA, 65 nt, hsa
aaggggcagcuccugaccaaagacgauacagcuuggcacuuuaaagcauuaacagcaggugugac

SEQ ID NO: 192263 - RNA, 65 nt, hsa
aagaacuagcauugggcagaaugugucuuuuuuaggcacuuuauauucucaacauacaauguuaa

SEQ ID NO: 192264 - RNA, 65 nt, hsa
gacuuguugcaacagcagucauacccaaaucauuugcacuuuaaaacuggaagauuaagcuuuug

SEQ ID NO: 192265 - RNA, 65 nt, hsa
augauguucuuucuggagguucaacacuacguaccgcacuuuauaauuuaacuggaauugagaug

SEQ ID NO: 192266 - RNA, 65 nt, hsa
aaaggacaucugaccuccuuuuuugguacauuaaggcacuuuauaaauggacuuuuauugucuca

SEQ ID NO: 192267 - RNA, 65 nt, hsa
cuggcagaugauugaccaguauccuuugaccaucugcacuuuauuuggaaggaagcaggggcugu

SEQ ID NO: 192268 - RNA, 65 nt, hsa
ccuuauucugguagauuugacuuguuuauaauucugcacuuuagaagaaaaacaguguuaaucug

SEQ ID NO: 192269 - RNA, 65 nt, hsa
aaguccuuggaauugauucuaaggugauguucuuagcacuuuaauuccugucaaauuuuuuguuc

SEQ ID NO: 192270 - RNA, 65 nt, hsa
ggcauguuuagucuaccaaaaacaauacuuuucaggcacuuuagaaauauccuuuuagaagcagc

SEQ ID NO: 192271 - RNA, 65 nt, hsa
aaauaaaaagucauuaauuuauuaaaacuuguguggcacuuuaacauugcuuucaccuauauuuu

SEQ ID NO: 192272 - RNA, 65 nt, hsa
ccuccccuguguccuguccagcugaagcuuuugcagcacuuuaccucucugaaagccccagagga

SEQ ID NO: 192273 - RNA, 65 nt, hsa
aucuaggaaaacucugagcuacugcauuuaggcaggcacuuuaauaccaaacuguaacaugucuc

SEQ ID NO: 192274 - RNA, 65 nt, hsa
ccccauuaaaauaccagagauaauggagauauuuugcacuuuagccuugaugaaaaguacaagau

SEQ ID NO: 192275 - RNA, 65 nt, hsa
accaagggauggaagaaguaaauauagcucagguagcacuuuauacucaggcagaucucagcccu

SEQ ID NO: 192276 - RNA, 65 nt, hsa
cuggaaauaaaaaguugggauauuaacuuguuuuugcacuuuagaauagcaugagaaucucacua

SEQ ID NO: 192277 - RNA, 65 nt, hsa
guuccuccuucuccaucccccauggaggaggcaucgcacuuuaccaagcugaugcauuccuacag

SEQ ID NO: 192278 - RNA, 65 nt, hsa
aacccaggaaagcaccuacagaccggcuccuccaugcacuuuaccagcucaacgcauccacucuc

SEQ ID NO: 192279 - RNA, 65 nt, hsa
agaagaaaacugauggcuaaguuugcaugaaaacugcacuuuauugcaaguuaguguuucuagca

SEQ ID NO: 192280 - RNA, 65 nt, hsa
cuucucccuccccagggccacuuguugaagucugagcacuuuauguaaauuucuaggugugagcc

SEQ ID NO: 192281 - RNA, 65 nt, hsa
uuuugaaacuguuuuaauugcuuggguagcaaugugcacuuuaaacaauuuggauauuggaaugc

SEQ ID NO: 192282 - RNA, 65 nt, hsa
cuguguaauuuuaguaauguauaacaugcaaugaugcacuuuaacugaagauagagacuauguua

SEQ ID NO: 192283 - RNA, 65 nt, hsa
uauucugggcaccuuccuaauaugcuuuacaaucugcacuuuaacugacuuaaguggcauuaaac

SEQ ID NO: 192284 - RNA, 65 nt, hsa
cccuuugaccuuccccaaaggauggucacacaccagcacuuuauacacuucuggcucacaggaaa

SEQ ID NO: 192285 - RNA, 65 nt, hsa
gcuuauuuauaucauguaucucuaaggaccuaaaagcacuuuauguaguuuuuaauuaaucuuaa

SEQ ID NO: 192286 - RNA, 65 nt, hsa
cucagacauagaguuaaaacucaaaccucuuaugugcacuuuaaagauagacuuuaggggcuggc

SEQ ID NO: 192287 - RNA, 65 nt, hsa
cgggccaggcgcuguggcucacaccuauaaucccagcacuuuaggaggccgaggcaggcggauug

SEQ ID NO: 192288 - RNA, 65 nt, hsa
agccugcagauaaugcccagccauccucccauccugcacuuuagccagcugcagggcgggcaagg

SEQ ID NO: 192289 - RNA, 65 nt, hsa
ggcugaggcacuucuuuuucagaugccaauaaagagcacuuuaugaguccuccuguguacagcug

SEQ ID NO: 192290 - RNA, 65 nt, hsa
ucuccuccauuauuacccaggcuuugcuuuaaguugcacuuuaaaucacacuguccuauuaaugc

SEQ ID NO: 192291 - RNA, 65 nt, hsa
auugagugcuugcuguaugccaggcgcugauguaagcacuuuagguaucauugaauucucacagc

SEQ ID NO: 192292 - RNA, 65 nt, hsa
gagcuacuggcccaagauuauucaauuuauaccuagcacuuuauaaauuuaugugguguuauugg

SEQ ID NO: 192293 - RNA, 65 nt, hsa
auacucugcacuuuucaauugugcaaucuucuugugcacuuuaaggcuuuuuaauuuuguuugag

SEQ ID NO: 192294 - RNA, 65 nt, hsa
ucaucacaauucauggugcuaaaaugaaaaccucugcacuuuaauuuuuuucaguaauuuccagc

SEQ ID NO: 192295 - RNA, 65 nt, hsa
acaggggaccuguuuaagagaacaaaauguuccaagcacuuuaggcagacaccagcuguuugcaa

SEQ ID NO: 192296 - RNA, 65 nt, hsa
ugauuaauuuuauuuuacuuaaaauaagaaaaggagcacuuuaauuacaacugaaaaaucagauu

SEQ ID NO: 192297 - RNA, 65 nt, hsa
ccgggugaaugcgaaugaacuucacguucuccaaagcacuuuaacuccaaacuagauuuguugac

SEQ ID NO: 192298 - RNA, 65 nt, hsa
auaaacauaaaacaaauuuuuuacuuaacaugagugcacuuuacuaauccucauggcacaguggc

SEQ ID NO: 192299 - RNA, 65 nt, hsa
ugcugacggccgcuggagaggugggcuccccucgugcacuuuauugccugggcaguuuugcuuga

SEQ ID NO: 192300 - RNA, 65 nt, hsa
acgcagauuuuaauguuuacuuaaauauaaaccuggcacuuuacaaacaaauaaacauuguuugu

SEQ ID NO: 192301 - RNA, 65 nt, hsa
gcccugcccccuggcugacuggccaguugcccagagcacuuuagcagaugugguuucaaaguaaa

SEQ ID NO: 192302 - RNA, 65 nt, hsa
gucauugguauauuuuuacuuacuggauucuccuugcacuuuaccuguucuuuuccagagcugac

SEQ ID NO: 192303 - RNA, 65 nt, hsa
acccagccccuccugcguaccaggagcuguguuaggcacuuuauauacauuauucuauguggccc

SEQ ID NO: 192304 - RNA, 65 nt, hsa
ccuuuuuacaaaaacaaacauagaagaaaauaaaugcacuuuauccacuccccaauuggacugca

SEQ ID NO: 192305 - RNA, 65 nt, hsa
cucuggacuguucuguaaaguggcugguaacaacagcacuuuacaguuuguagauguaaccagua

SEQ ID NO: 192306 - RNA, 65 nt, hsa
ccucuugucugagaaccuaggccccagguaucacugcacuuuaagaaacuggaggcugcaacagg

SEQ ID NO: 192307 - RNA, 65 nt, hsa
gaaaaucuggguaguaaaucuacccaauuaaaauggcacuuuauaaaagggaauagagaagagau

SEQ ID NO: 192308 - RNA, 65 nt, hsa
gaucccuguacucacgugccagucuccugacuagagcacuuuacucuguuuccucagcccugcag

SEQ ID NO: 192309 - RNA, 65 nt, hsa
gaacucaaaaaaacuuugaaaacuucagcacuguugcacuuuauguuuuaaaaaaugucacucuu

SEQ ID NO: 192310 - RNA, 65 nt, hsa
uauuauuagggcauguuaacaguauaccaguaacagcacuuuaucucauuuauaugaacaccuuu

SEQ ID NO: 192311 - RNA, 65 nt, hsa
acagcaccuuuaagcucuacccccuacaucaaaaugcacuuuagugccccuucacgguaccucgu

SEQ ID NO: 192312 - RNA, 65 nt, hsa
ucaagaguugauaaagauuaccugugcagugcagagcacuuuaaugcaaccagcuuucaagaaaa

SEQ ID NO: 192313 - RNA, 65 nt, hsa
acacagcacuuacuaugcuccaaacacuccucuaagcacuuuacacauauuagcucauucagucc

SEQ ID NO: 192314 - RNA, 65 nt, hsa
ucauugugcggauuaaaagaaauaauauauguaaagcacuuuaacacagcaccaggcccacggaa

SEQ ID NO: 192315 - RNA, 65 nt, hsa
gcaaggggaucuuuggggcuaacuucgggaucccugcacuuuauguaagaauguaaaccuggagu

SEQ ID NO: 192316 - RNA, 65 nt, hsa
uuguuauagggaguaguuuuuucccuuaggacucugcacuuuauagaauguuguaaaacagacaa

SEQ ID NO: 192317 - RNA, 65 nt, hsa
gggcugauaguuuuguuuaagguuuuggauaaggagcacuuuaaaacaaacugguguguuguuuu

SEQ ID NO: 192318 - RNA, 65 nt, hsa
ccuuuuucauuaaggauacaaccuauuuguagcucgcacuuuaaaagaugcuugagauacauuuu

SEQ ID NO: 192319 - RNA, 65 nt, hsa
aggcggagguugcagugggccaggaucgugccacugcacuuuauuuagccaggacaacacucugu

SEQ ID NO: 192320 - RNA, 65 nt, hsa
aauggagacaccaccacccuugccauggagguuaagcacuuuaacacagugucuggcacuuggga

SEQ ID NO: 192321 - RNA, 65 nt, hsa
ccacacaaauaacaagaauacuacuuaugaaaugugcacuuuauccucauuccauaaaugucggu

SEQ ID NO: 192322 - RNA, 65 nt, hsa
gugugcgaaacacccuuuuuaucacuuuuaaauuugcacuuuauuuuuuuucuuccaugcuuguu

SEQ ID NO: 192323 - RNA, 65 nt, hsa
guuacagaauaggaagaguagcacuuuccgccuaagcacuuuaggaaaucaccuuucuaagcccu

SEQ ID NO: 192324 - RNA, 65 nt, hsa
ucuauucagaaucaaaccuuuuuauauuuuauacugcacuuuaguguauuuucugucacuguagg

SEQ ID NO: 192325 - RNA, 65 nt, hsa
auauauauguguauaaauauauguauaucccagcggcacuuuauacuguucacuguacaaaagcu

SEQ ID NO: 192326 - RNA, 65 nt, hsa
cagccagccaagagccgggcguuauauugcgauuggcacuuuaugcugaccaucgguaacggaca

SEQ ID NO: 192327 - RNA, 65 nt, hsa
ggaggcauuucaaauucaucuucuaaccuaccuaagcacuuuaaaauacagccuccuucuguucc

SEQ ID NO: 192328 - RNA, 65 nt, hsa
uccaccgugggaacagagaauaccuguuuaguguugcacuuuagacuggugucuguuuuguuaau

SEQ ID NO: 192329 - RNA, 65 nt, hsa
uucuggcuaauuaaaaaagacaacuuuauaaaauggcacuuuaagcaagccauaguuaguuuuau

SEQ ID NO: 192330 - RNA, 65 nt, hsa
uuauugaacuguaauucucucaauaacucaguguagcacuuuaaagucugaaggacagcaacaug

SEQ ID NO: 192331 - RNA, 65 nt, hsa
cccugcuccuaccuaucauaaggucuuauucuugugcacuuuaucuugggaccaaaacugccuac

SEQ ID NO: 192332 - RNA, 65 nt, hsa
ggcucuuuauaaagagcuuguucuucauguuuuaagcacuuuaugaagaauaaaacauucaugua

SEQ ID NO: 192333 - RNA, 65 nt, hsa
uccuccuagcccugugggcagggguuggaaacuuagcacuuuauauuuauacagaacauucagga

SEQ ID NO: 192334 - RNA, 65 nt, hsa
uuuuauaauguacugaugugguucagagagauaaagcacuuuaguacauagucacucuuuuuagu

SEQ ID NO: 192335 - RNA, 65 nt, hsa
ugcuugacugacacuucauugcuauacaugaaggggcacuuuaaaucaggaaaaucucucagcuu

SEQ ID NO: 192336 - RNA, 65 nt, hsa
aaaauaaagcaagcaaauuugagucaaauauuggugcacuuuaauacuaucacaucuuugaaaac

SEQ ID NO: 192337 - RNA, 65 nt, hsa
acucaaaacucuugaaauuaguuuaccucauccaugcacuuuaauugaagaacugcacuuuuuuu

SEQ ID NO: 192338 - RNA, 65 nt, hsa
aaagaggcgcuggcuuuccacagugucaugcuuuggcacuuuagcuaugguuuucuuucugugug

SEQ ID NO: 192339 - RNA, 65 nt, hsa
ggccuugggggcacuggcugggagucagcaagcgagcacuuuauaucccuuugagggaaacccug

SEQ ID NO: 192340 - RNA, 65 nt, hsa
uacgagaaggcaaugugagguuuuaguacaucauagcacuuuauuuuaugaaaacauguagcaga

SEQ ID NO: 192341 - RNA, 65 nt, hsa
ugagaagcuaucaguaacagcuacucucaucgaaagcacuuuauuauuuuacggagcugcaaccu

SEQ ID NO: 192342 - RNA, 65 nt, hsa
aacuugugggaguaauaccagcuugcaaugggucagcacuuuaccuuuuuucuuuaaggcuccca

SEQ ID NO: 192343 - RNA, 65 nt, hsa
gggagcuggggacauuuuaaucaucaauaaacgaagcacuuuauucuguacagauuugggcaggc

SEQ ID NO: 192344 - RNA, 65 nt, hsa
guaagguaccaaacuauuuauauugaaagcuauaugcacuuuauuucuuaacugaauugcaucaa

SEQ ID NO: 192345 - RNA, 65 nt, hsa
gccaccacagagcacauggcugugucuaggcgcaagcacuuuagcaguaucuguuuacaugcgca

SEQ ID NO: 192346 - RNA, 65 nt, hsa
ucuuauucucuagguucugagagugaaugcauugggcacuuuaaguugauauuuucucuucuccg

SEQ ID NO: 192347 - RNA, 65 nt, hsa
aaaguguccacaacaguuagggaaaugaugcuagagcacuuuaaaaaucagcaggacaacccuga

SEQ ID NO: 192348 - RNA, 65 nt, hsa
guauuuacuaaguuauuggauuuacaugaaaucuggcacuuuaggguguucuuuuucucacagag

SEQ ID NO: 192349 - RNA, 65 nt, hsa
caggaagcugaagugugugaaguacaaagcugacagcacuuuauuuuauugcucuccauuauuug

SEQ ID NO: 192350 - RNA, 65 nt, hsa
gguccuuaggaaaauuccuaaggaagucaauuaaugcacuuuagauguuaaaaguauuugggcua

SEQ ID NO: 192351 - RNA, 65 nt, hsa
ccaagccucauuuggaaggcucaacauuuggaauugcacuuuaauugauuaauccucaauucaug

SEQ ID NO: 192352 - RNA, 65 nt, hsa
aguuugccuggggccuagcccugcuagaggcuacagcacuuuacaagcaagguaugcuuucuucc

SEQ ID NO: 192353 - RNA, 65 nt, hsa
ggucuagacguguuaauaaguuagacagaacuuuggcacuuuagaacaaaugcaugagugguauu

SEQ ID NO: 192354 - RNA, 65 nt, hsa
uacuacaucuaagaggcuaaacucugauaggaaaagcacuuuaaacauaauuaaaagcuuaaugu

SEQ ID NO: 192355 - RNA, 65 nt, hsa
uggcuaaaaaaaaaaaaaaaguguaaauaauacuggcacuuuagaacagauuaaucaagaguggg

SEQ ID NO: 192356 - RNA, 65 nt, hsa
cagccaccauuuauucagcaccuguuaugcaccaggcacuuuauguaucuuauugcuaacccuca

SEQ ID NO: 192357 - RNA, 65 nt, hsa
gugaaacacauuagucacaagaaucccugauugcugcacuuuaaaaaauucuuuaccuuuuccuu

SEQ ID NO: 192358 - RNA, 65 nt, hsa
uuucaugcuguuuaaaagacuguguaucaaauugugcacuuuaaguaugugcaguuuguuguaug

SEQ ID NO: 192359 - RNA, 65 nt, hsa
auaagugaguacacucuaauuaacuugcuucuguugcacuuuaguuuucuaccugcauauggacu

SEQ ID NO: 192360 - RNA, 65 nt, hsa
auguuuuuaaauuuggaaauaugacauuuuauguagcacuuuauaaaaagugaaagcgacaaauu

SEQ ID NO: 192361 - RNA, 65 nt, hsa
uacaauuugaagucuugugguuuuuauauagcuaggcacuuuauuacucuuuugaacugaaagca

SEQ ID NO: 192362 - RNA, 65 nt, hsa
guucccaaucuaaacuuuucugguauuguauauaugcacuuuaauaucuuauuuaugccuugcug

SEQ ID NO: 192363 - RNA, 65 nt, hsa
cuuaauuauuaacaaagugccagagucuaggcuaagcacuuuaucuauaucucauuucauucuca

SEQ ID NO: 192364 - RNA, 65 nt, hsa
gcacauuugugaagagguucgcagggauaaggggugcacuuuauagcuauggaaacaugagauuc

SEQ ID NO: 192365 - RNA, 65 nt, hsa
accauuacccaggucugacugaccaccagucagaggcacuuuauuuguaucaugaaaugauuuga

SEQ ID NO: 192366 - RNA, 65 nt, hsa
ccaggcuagacuaggagguuccggugucuggaaaagcacuuuacagaugagauucccucuccucc

SEQ ID NO: 192367 - RNA, 65 nt, hsa
auagccaggcauaguggcucacgccuguaaucccagcacuuuaggaggccaaggcggguggauca

SEQ ID NO: 192368 - RNA, 65 nt, hsa
gaacaggggcuaccugccacauccccuccacagaugcacuuuaaaaagccacucaugcuuuggcu

SEQ ID NO: 192369 - RNA, 65 nt, hsa
cuuaccucacagugauguugugaggacauguggaagcacuuuaaguuuuuucaucauaacauaaa

SEQ ID NO: 192370 - RNA, 65 nt, hsa
ugccucuuaaaccauuaacaguacuuuagacauuggcacuuuauuuuucucguagaucuuuagcu

SEQ ID NO: 192371 - RNA, 65 nt, hsa
ucucccacucaaaccucucccaucucccaacaacugcacuuuagaauaccagcagugaaauggua

SEQ ID NO: 192372 - RNA, 65 nt, hsa
ggaugcuagucuuugugaccgauugcuaaucuucugcacuuuaauuuauuuuauauaaacuuuac

SEQ ID NO: 192373 - RNA, 65 nt, hsa
cgacaaucaagaauguuauuaauguguaauacugagcacuuuacuucuuaauaaaaacuugauau

SEQ ID NO: 192374 - RNA, 65 nt, hsa
aauucaccagcaguaauccuuuaauaacuggcagagcacuuuauucuucuggugagcucccugaa

SEQ ID NO: 192375 - RNA, 65 nt, hsa
uuagaaaacgguccuaagagauucuuugguguuuggcacuuuaaggucaucguugggcagaaguu

SEQ ID NO: 192376 - RNA, 65 nt, hsa
gugacugagaaucuagcacuucuccacuuguagcugcacuuuaagucucagcagaagauacgauc

SEQ ID NO: 192377 - RNA, 65 nt, hsa
gucuacuucauuuagcugagcaggcuuucuuucaugcacuuuacucauagcacauuucuuguguu

SEQ ID NO: 192378 - RNA, 65 nt, hsa
auguuucuuggcauuguucagcauagguaaugugugcacuuuauguguacacauaaucauauuua

SEQ ID NO: 192379 - RNA, 65 nt, hsa
auguuaguggccauuuugcaacaaugaagaggauagcacuuuaucuagaugaaaacuggauuucu

SEQ ID NO: 192380 - RNA, 65 nt, hsa
uaggccauggacgguggcucacgccuguaaucccagcacuuuaggaggccaagguagguggauca

SEQ ID NO: 192381 - RNA, 65 nt, hsa
ucucaccugaaguuauggggauugcacggguuuuggcacuuuagaaaaagccugaugugggucuu

SEQ ID NO: 192382 - RNA, 65 nt, hsa
uuaaacgaaacugagaaaaacuuugccccggaauagcacuuuaauagucaaaaauguguuuaccu

SEQ ID NO: 192383 - RNA, 65 nt, hsa
uacaggcgugagucacagcccccggccauaauuuagcacuuuaaaaaauaauagccauguugggc

SEQ ID NO: 192384 - RNA, 65 nt, hsa
cacacauauauuauuugcagugcaguauagaauaggcacuuuaaaacacucuuuccccgcacccc

SEQ ID NO: 192385 - RNA, 65 nt, hsa
uuuuauaaugucccugcccagggaccuguuagaaagcacuuuauuuuuuauauauuaaauauuua

SEQ ID NO: 192386 - RNA, 65 nt, hsa
uggcauuuucuguuccagguuucuuccacccacgagcacuuuauucuccuccgagacccccuuuu

SEQ ID NO: 192387 - RNA, 65 nt, hsa
cagagaacugaugcgacuuguuuugcugcuugguagcacuuuaaaaaauuuuuugauuaaugaag

SEQ ID NO: 192388 - RNA, 65 nt, hsa
ccaucauaauucagucucuucuuauucuacagugugcacuuuaugccucucgccuuuugauaaua

SEQ ID NO: 192389 - RNA, 65 nt, hsa
guuaaauuuguaaacaaucuaauuaaauggcaucagcacuuuaaccaaugacguuugcauagaga

SEQ ID NO: 192390 - RNA, 65 nt, hsa
uucaaaauuguaucaugauacagaaacacuccuuagcacuuuaagaaagugagauggaacugcca

SEQ ID NO: 192391 - RNA, 65 nt, hsa
cuuuucaaaucuaguaauuugaauauagacacaaugcacuuuauugcacuuucaauucuuauaaa

SEQ ID NO: 192392 - RNA, 65 nt, hsa
ucuuugcuuacuuuuacugucuauauauauagggagcacuuuaaacuuaaugcagugggcagugu

SEQ ID NO: 192393 - RNA, 65 nt, hsa
uguuuagcaggcuguuaauuucccaucuaugaauagcacuuuaugauguaggcuaaacuaagcaa

SEQ ID NO: 192394 - RNA, 65 nt, hsa
aaaguacuaaaaaagauucagguaauuaucauucagcacuuuauuguaauucagaauaaaauuua

SEQ ID NO: 192395 - RNA, 65 nt, hsa
uuuuuuuuuuggcccccaagaaagucccuuuuauagcacuuuagcacaggcaaugcuacaggaac

SEQ ID NO: 192396 - RNA, 65 nt, hsa
aagaccuuacaaccacauuucuggccauuuaacuagcacuuuauaagccaaugaagcaaacacac

SEQ ID NO: 192397 - RNA, 65 nt, hsa
uucauuuuuaaaauuaggagauguuacguaacuuggcacuuuaguaguguauacacuagcauuag

SEQ ID NO: 192398 - RNA, 65 nt, hsa
gcaaaguggugguggggucaagacagaugacaccagcacuuuaaacucuuuguguggguaugcgu

SEQ ID NO: 192399 - RNA, 65 nt, hsa
caaucacaaccauaaagcuacaagcacgcacugaagcacuuuacugauacucauucaauuauuca

SEQ ID NO: 192400 - RNA, 65 nt, hsa
uaaaauacccuaaucacauuaugaucuugacaggugcacuuuacuggggagaauaaaaaggacca

SEQ ID NO: 192401 - RNA, 65 nt, hsa
uagaacaucagagaaggcacauugacuagcaaacagcacuuuaggaaaagucaccguagcccacu

SEQ ID NO: 192402 - RNA, 65 nt, hsa
acaccuucccgacacuuuuuuaauguuguagcugagcacuuuaacaaguugagcauuccauguuu

SEQ ID NO: 192403 - RNA, 65 nt, hsa
aguuggcucagcugugugcccaguuccuccugugggcacuuuagcaggcuccgagcuuuccuggc

SEQ ID NO: 192404 - RNA, 65 nt, hsa
acaccuauuccacagagacugauuuauagggggcagcacuuuauuuuuuucuggaaacccaaguu

SEQ ID NO: 192405 - RNA, 65 nt, hsa
cuaaggcuucugcaggauuuauuaucuccugauaugcacuuuaaaauuagucuuuguaguucuau

SEQ ID NO: 192406 - RNA, 65 nt, hsa
auguaacaaacuuacaaggacaaagaggcuuguuggcacuuuacauauacaguguauacaugugu

SEQ ID NO: 192407 - RNA, 65 nt, hsa
gucaaacgaagacauuccaauacugcuuaauuauagcacuuuauuuuuagcugcugaacugccaa

SEQ ID NO: 192408 - RNA, 65 nt, hsa
aaaucaagauaaccucuugaauguaauagcucauagcacuuuaauuuggcaagccauuuuuccug

SEQ ID NO: 192409 - RNA, 65 nt, hsa
uagaauacuuugccucgauauauaagcauacagaugcacuuuaaaugaaaacccuugauuauaaa

SEQ ID NO: 192410 - RNA, 65 nt, hsa
aauguguguauuuauuuuggucauuuuuacgagaagcacuuuauucccucucccucucacugauc

SEQ ID NO: 192411 - RNA, 65 nt, hsa
aauggccuucuggacuuguuaauugcccucagccagcacuuuaggacaucugguuggauggcucu

SEQ ID NO: 192412 - RNA, 65 nt, hsa
uuuuguuuuauuuuuuguuuuuguauccauggcuggcacuuuacucauugcacuugaguuuauug

SEQ ID NO: 192413 - RNA, 65 nt, hsa
ccucaggcgaguggcuuauagccuccauucauggugcacuuuauuuaugguacuaagauaaagac

SEQ ID NO: 192414 - RNA, 65 nt, hsa
gaaaggccaugccaaccgugcuuguacugcuagaagcacuuuauguuuccuuuuugggugaaaug

SEQ ID NO: 192415 - RNA, 65 nt, hsa
ccaaacugaccaggggacggccacgguccccgcgugcacuuuagggccggucaggcccuaaagua

SEQ ID NO: 192416 - RNA, 65 nt, hsa
aaauuucucuccugauggguacuuuaauuugaaaugcacuuuaugcacaguuaugucuuauaacu

SEQ ID NO: 192417 - RNA, 65 nt, hsa
agcaacuuugcacuauguaaaguaccuuauguauugcacuuuaaauuucucuccugauggguacu

SEQ ID NO: 192418 - RNA, 65 nt, hsa
uuuugccuucuuauguauuuucaagauuauucugugcacuuuaaauuuacuuaacuuaccauaaa

SEQ ID NO: 192419 - RNA, 65 nt, hsa
uuuucaaaauuuauguaauguggggcuuuuauguagcacuuuacguuuucaugcugcuuauuguu

SEQ ID NO: 192420 - RNA, 65 nt, hsa
acuggaguucuuauucaauauaaggaaaguuugcugcacuuuauuaccaagccucugggauuuua

SEQ ID NO: 192421 - RNA, 65 nt, hsa
guaaaaaccauuguuuuuggauauaaagcuaauaagcacuuuaaaaaggaaaaggcagccuuuac

SEQ ID NO: 192422 - RNA, 65 nt, hsa
gggugggaaaaucgaagggagaggagaaaggcgcugcacuuuaaauccaguauuuguuuacucau

SEQ ID NO: 192423 - RNA, 65 nt, hsa
gugucuuacuacuguuugagacuagugucguuguagcacuuuacuguaauauauaacuuauuuag

SEQ ID NO: 192424 - RNA, 65 nt, hsa
ccuucaguucagagccaaaaugggucuagaaucuggcacuuuacucauuuccuuugauaaauugu

SEQ ID NO: 192425 - RNA, 65 nt, hsa
ucucucuggacaucaauguagaguccaucuuucaagcacuuuaauuuuuuuagcugccaaagggu

SEQ ID NO: 192426 - RNA, 65 nt, hsa
uaccaucgagcuuacccgggcccggcuccugucaagcacuuuaguuagcuguuggugucauguuu

SEQ ID NO: 192427 - RNA, 65 nt, hsa
uuuacaaccaugaccccuuggacacuggacugcaugcacuuuacauaucacaaaaugcucucaua

SEQ ID NO: 192428 - RNA, 65 nt, hsa
ggggcagacuuugcacuuacugcagugcaacacuugcacuuuaauuuuccuccaacugucuaaaa

SEQ ID NO: 192429 - RNA, 65 nt, hsa
uuuaaaagcucuaguuuugcuuagugugaauucuggcacuuuaaaaagauuaagcaagugaaauu

SEQ ID NO: 192430 - RNA, 65 nt, hsa
uuuguuuuuuuaaauacagaagucauguuguuucugcacuuuauaauaaagcauggaagaaauua

SEQ ID NO: 192431 - RNA, 65 nt, hsa
auaaacgagcuccuaguuuuaaaaucucugccauugcacuuuauagucugauuacaaaacgugca

SEQ ID NO: 192432 - RNA, 65 nt, hsa
cccauauuuguguucaguuccagcuuuuguagauggcacuuuagugauugcuuuuauuacauuag

SEQ ID NO: 192433 - RNA, 65 nt, hsa
ccagggaagaggagugucgguaguucuugcaguaggcacuuuaucaggaccugaccuguugcugg

SEQ ID NO: 192434 - RNA, 65 nt, hsa
uacaaacugguaucagaauuccuuauacugaugaggcacuuuauauuuuuuauuagaaaguagaa

SEQ ID NO: 192435 - RNA, 65 nt, hsa
ccuguugcauuauucuauggucugccauggacugugcacuuuauuugagggugggugggaguaau

SEQ ID NO: 192436 - RNA, 65 nt, hsa
guauucguuaucuaauagggcaauuaauuccuucagcacuuuagaauaugccuuguuucauauuu

SEQ ID NO: 192437 - RNA, 65 nt, hsa
aaacacacgaugcaccuuaacucacccaccacgaggcacuuuacagacugggggaggggguuuuu

SEQ ID NO: 192438 - RNA, 65 nt, hsa
guauucacguguacuguuuaacugagggucucaaagcacuuuaaacuguuguguucuauuuccac

SEQ ID NO: 192439 - RNA, 65 nt, hsa
cucugaaaaauguguagauuaaaugaguuuuuaaagcacuuuagaaaauauaagggagaaaauga

SEQ ID NO: 192440 - RNA, 65 nt, hsa
cuggaggcccauucuguauuccuaauccagucucagcacuuuauucauacaaaauaaucaaaaua

SEQ ID NO: 192441 - RNA, 65 nt, hsa
guggcucuggguuauaagaugucauucucuauauggcacuuuaaaggaagaaaagauauguuucu

SEQ ID NO: 192442 - RNA, 65 nt, hsa
uguuuacagauccggccaggaccccggcccccaaugcacuuuacgcgcgaagaaguugccggaug

SEQ ID NO: 192443 - RNA, 65 nt, hsa
aacauuccccuauuuuucuuuaaauuuuauacaaagcacuuuaaugauagaugcaaccuuauuuu

SEQ ID NO: 192444 - RNA, 65 nt, hsa
ucaucacccuuccgacaggagcacugcaugucagagcacuuuaaaaacaggccagccugcuuggg

SEQ ID NO: 192445 - RNA, 65 nt, hsa
ugaccccauagcacuuuguuucuucgccuugauuugcacuuuacaauguccccagccccucugca

SEQ ID NO: 192446 - RNA, 65 nt, hsa
ccuaacacaggcaggcaccagaaauaaaugucucagcacuuuacagaugacuaaaaauguuaauu

SEQ ID NO: 192447 - RNA, 65 nt, hsa
uugaacuuuuacaaaaccacuugagaauuucaugagcacuuuaaaaucugaacuuucaaagcuug

SEQ ID NO: 192448 - RNA, 65 nt, hsa
uuuucuaauauuaguuuuagauuuucacguauuaggcacuuuaguugaaucuuccagcaaaagcu

SEQ ID NO: 192449 - RNA, 65 nt, hsa
cagugaacagauuuugugaagugccuucuguuuuagcacuuuaaguuuaucacauuuuguugacu

SEQ ID NO: 192450 - RNA, 65 nt, hsa
ucuuuguuuuuuguuuucauuaaagagccauucuggcacuuuaaugauaaaaucccauuguauuu

SEQ ID NO: 192451 - RNA, 65 nt, hsa
uaagauuucaauucuuggauaaucaggcucuguuugcacuuuauauuuuagcagauacagucucu

SEQ ID NO: 192452 - RNA, 65 nt, hsa
aaaaaugccacuuaacaggaaguuuaguuuguuaugcacuuuaaauggaauaauuagcuuguuac

SEQ ID NO: 192453 - RNA, 65 nt, hsa
guuuuagcuauuugagaucguggaccaucaguuuugcacuuuagagaguguuucugacucuaaac

SEQ ID NO: 192454 - RNA, 65 nt, hsa
accaguuugcaugauucuucucuugugauuugguugcacuuuagacauuuuugugccauuauauu

SEQ ID NO: 192455 - RNA, 65 nt, hsa
aggauuucguuugcuguggcauugguuauaucagagcacuuuaaucugaaggaugauacuguaac

SEQ ID NO: 192456 - RNA, 65 nt, hsa
gcugauuuucuuuuuaauauauuuagccaagugaugcacuuuaugauaauuaaacucuuuugugc

SEQ ID NO: 192457 - RNA, 65 nt, hsa
uauagcuguuuacaaaaucuccaaguuaauuaagggcacuuuaggaaguuguccucaugaauuag

SEQ ID NO: 192458 - RNA, 65 nt, hsa
aacuuggcuauuuucuugacacuuuuaugggugcugcacuuuauuuuuguucgguuuuugauggg

SEQ ID NO: 192459 - RNA, 65 nt, hsa
ccauuugcacuuuucaaaugccuuuggaugacccagcacuuuaaucugaaaccugcaacaagacu

SEQ ID NO: 192460 - RNA, 65 nt, hsa
accucuggagccuauggcuuuaagcaagcacuacugcacuuuacagaauuaccccacuggauccu

SEQ ID NO: 192461 - RNA, 65 nt, hsa
auaaguugaagauuguggggcuacuuuuucucauagcacuuuauuuugaauguuguuaguuugug

SEQ ID NO: 192462 - RNA, 65 nt, hsa
ucaagccuuuauggcugcugggcugagugacacaagcacuuuaauggccuggagggacuuuuaau

SEQ ID NO: 192463 - RNA, 65 nt, hsa
uauacuuaaaaacacacaauguuaaaaaaaauaaagcacuuuauccaauuaggccaagauuuaac

SEQ ID NO: 192464 - RNA, 51 nt, hsa
aguugcuaaauuuugcuugaagcacuuuaauauaacuugaauauuaucuau

SEQ ID NO: 192465 - RNA, 65 nt, hsa
gacagaacuuuuguucagauguaaaagacaaaauugcacuuuaauguuuuuuguuacuugaaaac

SEQ ID NO: 192466 - RNA, 65 nt, hsa
uaaaauuggcgcuuguuuuauuuucgauauucaaugcacuuuauguagcauugaaugaucaaaua

SEQ ID NO: 192467 - RNA, 65 nt, hsa
gucuguucccagcaaacacgauaaagaaagauugugcacuuuaaccucucucaucagggcccaag

SEQ ID NO: 192468 - RNA, 65 nt, hsa
uugugcucuuuguucaucauuggcccucauuccaagcacuuuacgcugucuguaaugggaucuau

SEQ ID NO: 192469 - RNA, 65 nt, hsa
agcugugggaaaggaaugggcaccucugaacccaggcacuuuaaacuucuauagaaaagauaucg

SEQ ID NO: 192470 - RNA, 65 nt, hsa
gaaaaagagaacagugacguaggcaaauguuucaagcacuuuagaaacaguacuuuuccuauaau

SEQ ID NO: 192471 - RNA, 65 nt, hsa
ugauucuuaguugauugauauguauuugccccagggcacuuuaauuugggcuguaguuauuuuuu

SEQ ID NO: 192472 - RNA, 65 nt, hsa
uaucaccuggguucuguccccuggcucuguaucaggcacuuuauuaaagcugggccucagugggg

SEQ ID NO: 192473 - RNA, 65 nt, hsa
agcccugagagucccuuccugccccaccgauacuggcacuuuaaaaaggaagcugaccgcacagu

SEQ ID NO: 192474 - RNA, 65 nt, hsa
uaaucacugauuucaaauauuaagcaaaauguaaagcacuuuaauuuauagcuaugguuauaaac

SEQ ID NO: 192475 - RNA, 65 nt, hsa
cugucuguuuuuguaacacuuaaguuauuuuaucagcacuuuaugcacguauuauugacauuaau

SEQ ID NO: 192476 - RNA, 65 nt, hsa
gaugguuuuuuggaguaccaagcaaggggaauggagcacuuuaagggcgccuguuaguaacauga

SEQ ID NO: 192477 - RNA, 65 nt, hsa
uucaaagcuuuuuucauuuauuuauuuuguuuauugcacuuuaugaaaacugaagcaucaauaaa

SEQ ID NO: 192478 - RNA, 65 nt, hsa
cagcuugaaggccuuuugaguucugcuggacaggagcacuuuaucugaagacaaacucauuuaau

SEQ ID NO: 192479 - RNA, 65 nt, hsa
cugcuccuagagcagguccauaccaaguaauagaggcacuuuagcuuccacuugguggguaaggc

SEQ ID NO: 192480 - RNA, 65 nt, hsa
gcuguguucauacacagaaggggccugagauuucugcacuuuaaacaagcuccuccuaggugagg

SEQ ID NO: 192481 - RNA, 65 nt, hsa
cagagacagguaugguccaguuccucuuuuauauagcacuuuaucauucuccacaaguaguuugu

SEQ ID NO: 192482 - RNA, 65 nt, hsa
uguacaguguuuucuaaauauuuccuguuuuuucagcacuuuaacagaugccauuccagguuaaa

SEQ ID NO: 192483 - RNA, 65 nt, hsa
ucagaggaagguaucccaaugaauaucaauuaagggcacuuuaauauauaaauuauaaacuaagu

SEQ ID NO: 192484 - RNA, 65 nt, hsa
gucucaaucuuggauguuucauuuuaugaauggaggcacuuuacuaggucuagaauauuuuuuua

SEQ ID NO: 192485 - RNA, 65 nt, hsa
uuuaauugaauacuguuucuucagucaugguuauugcacuuuauccugaauaauaauucagaaau

SEQ ID NO: 192486 - RNA, 65 nt, hsa
ggauguuuucaguuugaucagucugauacucaguggcacuuuauuaaaacaucagcuguggagug

SEQ ID NO: 192487 - RNA, 65 nt, hsa
uagcagacaccacaugcccuugagccuaagaucuagcacuuuacaaaguaaguuuuucuguuacu

SEQ ID NO: 192488 - RNA, 65 nt, hsa
ugcucugugguggcgcaugauucacugagcaaacagcacuuuacagaagaaaaucuuuauuuugu

SEQ ID NO: 192489 - RNA, 65 nt, hsa
auauugcaguuuuacuaggcaaaucuucaaaagaugcacuuuaggaaacgaaauauuuccuaaau

SEQ ID NO: 192490 - RNA, 65 nt, hsa
ccuugcuaaguaguuuugacacaaugaaaauggaagcacuuuagugguaguauuagcuguuuuua

SEQ ID NO: 192491 - RNA, 65 nt, hsa
uacuuguauguugccuuucuucgaaggcgccugaagcacuuuauaaacacaaauccucacaauac

SEQ ID NO: 192492 - RNA, 65 nt, hsa
aguggggacagcaaaaagacaagcaaaacugaugugcacuuuauggcuugggacugauuuggggg

SEQ ID NO: 192493 - RNA, 65 nt, hsa
ugcauuuuagcaagacccccagcugauuccuauaagcacuuuagaguuugagaagcaaggaccua

SEQ ID NO: 192494 - RNA, 65 nt, hsa
augauaaagaagugguucauuauuuuuuaauuaaugcacuuuaaauaagguagaauggaaaaaac

SEQ ID NO: 192495 - RNA, 65 nt, hsa
cugggaaaccaaguuugcaccuggaaacuuacaaugcacuuuagcgcaguaagggcuuggcaucc

SEQ ID NO: 192496 - RNA, 65 nt, hsa
acauuauuuaauuaauggcuucaaaagguggagaugcacuuuauuuaaugucuuucccuagcuaa

SEQ ID NO: 192497 - RNA, 65 nt, hsa
uguucaccagaaggaaaaaaaaaaaucaguuuuaugcacuuuauuuuguuuugauuuucauuuuu

SEQ ID NO: 192498 - RNA, 65 nt, hsa
ggccagcauggggaagagaugguugcaggcaaaaugcacuuuauagagauuuucuauugcuggga

SEQ ID NO: 192499 - RNA, 65 nt, hsa
gaauucuaaucucuggaggcuggcagcuugacuuggcacuuuagggccccuuagcagggugagcu

SEQ ID NO: 192500 - RNA, 65 nt, hsa
ucagcugggcgcaguggcucaugcuuguaaucacagcacuuuaggaggcugaggcaggaggacug

SEQ ID NO: 192501 - RNA, 65 nt, hsa
aaagauccucucucuagggcagcagagagcuuuuugcacuuuaaaaaaaaaaagaaagaaagaaa

SEQ ID NO: 192502 - RNA, 65 nt, hsa
ccugauggcugaugccggcccggcaaauaggcaccgcacuuuacucuugggacucggggacuugg

SEQ ID NO: 192503 - RNA, 65 nt, hsa
gggcugagugggaacuuggcaagcagaaguggggagcacuuuaaugcaacccagguaugcuccau

SEQ ID NO: 192504 - RNA, 65 nt, hsa
ucugcugaacgguccuaguguuuggacacaauagugcacuuuaaaaccugcuugguuaccaagug

SEQ ID NO: 192505 - RNA, 65 nt, hsa
augacuggcgaaaauacuucacaagcucauuuugagcacuuuaggaaguaagugaaaguaccuaa

SEQ ID NO: 192506 - RNA, 65 nt, hsa
ggcuuguagcuaugcaucauuuuccuacggcguuagcacuuuaagcacauccccuaggggagggg

SEQ ID NO: 192507 - RNA, 65 nt, hsa
uguuucucucccaccugccacuggaacuggagaaugcacuuuauucugggcggggggugaguggg

SEQ ID NO: 192508 - RNA, 65 nt, hsa
acagucagaaauuugagaagcuucucacaagugaugcacuuuaaauaaucugcaugccauugaga

SEQ ID NO: 192509 - RNA, 65 nt, hsa
cuggccgguccugagcccucccucccaggcacccagcacuuuaagccugcuccauggaggcagag

SEQ ID NO: 192510 - RNA, 65 nt, hsa
ggugcccucccucuccuacccccacccccacgguugcacuuuauuuauucgguucuugcuuuggu

SEQ ID NO: 192511 - RNA, 65 nt, hsa
cacaccucagauaaaaugcagaguaauauauaguugcacuuuauaaauggugguuaaauggaaau

SEQ ID NO: 192512 - RNA, 65 nt, hsa
aauuaccuaccaaaaaauggaaaagaauuuuacaugcacuuuaaaauaguaaaauggaaagugaa

SEQ ID NO: 192513 - RNA, 65 nt, hsa
ccuggugaacagugagccuggcucccacgcaaguggcacuuuaagcccugcauccucgguugaga

SEQ ID NO: 192514 - RNA, 65 nt, hsa
uuuaacaaauguuaucaugauuaagaaaauuuccagcacuuuaauggccaauuaacugagaaugu

SEQ ID NO: 192515 - RNA, 65 nt, hsa
aagccugugucuauuuucauauuacucugcuuugugcacuuuauggaggaggaagcuagaggaaa

SEQ ID NO: 192516 - RNA, 65 nt, hsa
gccccagggccacagcuagccugcauguguguacugcacuuuacaguuugcaaagcucuuccaua

SEQ ID NO: 192517 - RNA, 65 nt, hsa
ugcuaugacaugcaagugagaagcugggcaugaacgcacuuuauaaaagcaaaagcucuguguaa

SEQ ID NO: 192518 - RNA, 65 nt, hsa
auuguugaaagagauauguagaaggcacaauaugggcacuuuaaaugaagcuaauaauucuucac

SEQ ID NO: 192519 - RNA, 65 nt, hsa
uauggaacauaugcacaggggaaggaaauaacauugcacuuuauaaacacuguauuguaagugga

SEQ ID NO: 192520 - RNA, 65 nt, hsa
uucuguuaaaagaacuuuauugauguguagauuucgcacuuuauuucugagacugcguucaugua

SEQ ID NO: 192521 - RNA, 65 nt, hsa
aaguaaaggggcaagauagggcaguuaacuaaagagcacuuuauuucuuugaagccuuucuaaga

SEQ ID NO: 192522 - RNA, 65 nt, hsa
guaguggugcaucauuuuuaacccaaauauugcaagcacuuuaaagauuugaaaccacauuuuua

SEQ ID NO: 192523 - RNA, 65 nt, hsa
aaguaacuugccugaggucacucagcucauaaauugcacuuuagggauugugcacucagucacuc

SEQ ID NO: 192524 - RNA, 65 nt, hsa
ucaagacauucccagcucuucuuacacaucugcuagcacuuuauguugaaaaauauaggcccaua

SEQ ID NO: 192525 - RNA, 65 nt, hsa
auucggggcaguagauaaauguucauuuuacugaugcacuuuaguuuuuggucuguuaccuguuu

SEQ ID NO: 192526 - RNA, 65 nt, hsa
gaaagggccccuccccaccugacacccacuggggugcacuuuaauguuccggcagcaagacuggg

SEQ ID NO: 192527 - RNA, 65 nt, hsa
gccucagccccagccaccauauaccccugcaguuugcacuuuaauugaugguaguucaguugggg

SEQ ID NO: 192528 - RNA, 65 nt, hsa
agagggggcauccugucucucuccagaccaucacugcacuuuaaccagggucuuagguacaaaau

SEQ ID NO: 192529 - RNA, 65 nt, hsa
ggcccaguccucugaggcacggcggcucuguucaagcacuuuaugcggcaggggaggccgccugg

SEQ ID NO: 192530 - RNA, 65 nt, hsa
uggcugugaguggcaagcugacauucugcacgcuagcacuuuacaaaaauauugugcaagaccua

SEQ ID NO: 192531 - RNA, 65 nt, hsa
uccgagauacccacccagcuuugucaaucacccaagcacuuuaugcauauagagacagaaccugg

SEQ ID NO: 192532 - RNA, 53 nt, hsa
accauuuauuaccaauguagauugcacuuuauauguccagccucuuccucagu

SEQ ID NO: 192533 - RNA, 65 nt, hsa
caagaaugagaagaaugacuaugcaaccuuuggaugcacuuuauauuauuuugaauccagaaaua

SEQ ID NO: 192534 - RNA, 65 nt, hsa
aaaaaucaagcugaaugacaauuagcacuaaucuggcacuuuauaaauugugauguagccucgcu

SEQ ID NO: 192535 - RNA, 65 nt, hsa
uugagaaaauugacacucagacuugcccuaaucaugcacuuuacuuaaggaaagaucgagaaauc

SEQ ID NO: 192536 - RNA, 65 nt, hsa
accuuccguaugacguuuuacucugauaucauugugcacuuuagccagauccagaaaacacucaa

SEQ ID NO: 192537 - RNA, 65 nt, hsa
gaaggaauuuaggggcuuaaacauuacgacugaaugcacuuuaguauaaagggcacaguuuguau

SEQ ID NO: 192538 - RNA, 65 nt, hsa
ccucuccauguguauauaguauuuccuuguauaaagcacuuuacuaccuaccacuuguguuguga

SEQ ID NO: 192539 - RNA, 65 nt, hsa
guagaauuacuucuguuaucugaaauaccugagaugcacuuuaaacuguugaaauguaagcucug

SEQ ID NO: 192540 - RNA, 65 nt, hsa
ugccacccuucccccaaagcugauagggcagaggugcacuuuaugaaacuggcacuugacugaac

SEQ ID NO: 192541 - RNA, 65 nt, hsa
ggaagccuguaucaccuguguaaguugguauuugggcacuuuauauuuuucuaaaaacguguuuu

SEQ ID NO: 192542 - RNA, 65 nt, hsa
ugaugaaaaaaaaaaaggcuuuacuucuuuugcaugcacuuuaaaaacaaaacaaaacauuuuuc

SEQ ID NO: 192543 - RNA, 65 nt, hsa
caauauuucuauaguauaccaaccaccccaggaaugcacuuuaacaauaucaggauuuuauauaa

SEQ ID NO: 192544 - RNA, 65 nt, hsa
cagaaagcuguaugcaggaugcucacugauguuuugcacuuuaaaacugaaauucaacucuuuau

SEQ ID NO: 192545 - RNA, 65 nt, hsa
gcaggaguucuuagcuccucagcgagcaacagagagcacuuuagauggcaccuuucaccacuugg

SEQ ID NO: 192546 - RNA, 65 nt, hsa
uauucuauuuauaucuuauuacaauaaaauuaguggcacuuuauucauaaauauucaugagccug

SEQ ID NO: 192547 - RNA, 65 nt, hsa
ugaaugcagucucccugcagggcagauuaugccaggcacuuuacauuuguugaucccauuugaca

SEQ ID NO: 192548 - RNA, 65 nt, hsa
ccauuuucagugcuuauauuguuagguagaggcuggcacuuuauuagaaugcaagccacaaaaau

SEQ ID NO: 192549 - RNA, 65 nt, hsa
gugagcagauauggcuauaaagaccuauagcuuuugcacuuuaugcauauauaaucaauccuuuc

SEQ ID NO: 192550 - RNA, 65 nt, hsa
agugugaagguaguacuuuuuagagugcacugagugcacuuuacaucuuuauuuaaauuuuuuuu

SEQ ID NO: 192551 - RNA, 65 nt, hsa
ggauuugaaugauugggaugauacaucauugaacugcacuuuauauaaccaaagcuuagcaguuu

SEQ ID NO: 192552 - RNA, 65 nt, hsa
aaggauguggaagagcauuagcuggcgcauauuaagcacuuuaagcuccuugaguaaaaaggugg

SEQ ID NO: 192553 - RNA, 65 nt, hsa
gaaaaauauauaaaaguuuuuuuccccuauuuuuugcacuuuaaaucuguuuugaaauuagaacu

SEQ ID NO: 192554 - RNA, 65 nt, hsa
cuuaauuagacauuauuugaagcugucugaagaaugcacuuuaugaauuaaaaaacugaauugcc

SEQ ID NO: 192555 - RNA, 65 nt, hsa
gaguuuagaagugauuagggcaagcuaguugaccugcacuuuaucaaagguugggguuaaaggaa

SEQ ID NO: 192556 - RNA, 65 nt, hsa
uccagcccuggcugcagccucccaguucccaaacugcacuuuacauaucaauccaugcugccuga

SEQ ID NO: 192557 - RNA, 65 nt, hsa
gucuaacuaucaaaaagggcagacuuccugcaacugcacuuuaucuguggucugcugcccagaaa

SEQ ID NO: 192558 - RNA, 65 nt, hsa
uucccucuucccugaccucccaacucuaaagccaagcacuuuauauuuuccucuuagauauucac

SEQ ID NO: 192559 - RNA, 65 nt, hsa
uggagcagcauauagccgaaaaggagcacaacugagcacuuuaauaguaauuuaaaaguuuucaa

SEQ ID NO: 192560 - RNA, 65 nt, hsa
gauagcaucacaucauacagaaugugauaagaauggcacuuuaccucugugguccuccuccccag

SEQ ID NO: 192561 - RNA, 65 nt, hsa
agccuaggagcacagcgagggaaugaaccuuacuugcacuuuauguauacuuccugauuugaaag

SEQ ID NO: 192562 - RNA, 65 nt, hsa
gucauagccaaaccaaaggguacacucauauuugugcacuuuacugaaauagaugaacauuucag

SEQ ID NO: 192563 - RNA, 65 nt, hsa
guuuucuuuagggcaacauauauuugaauuuaaaagcacuuuauuuaaaaaaaaaagaaguuuuc

SEQ ID NO: 192564 - RNA, 65 nt, hsa
cccuucugagucugccuuuuuugcacugaacauaagcacuuuauacuaaugggucacaaaucuug

SEQ ID NO: 192565 - RNA, 65 nt, hsa
ucugaacaaaugaaacucuucuccauuuaaaagaggcacuuuacuuuagacuugccacucugaaa

SEQ ID NO: 192566 - RNA, 65 nt, hsa
ccgcccugaagcucucugggcuccucagcaauaaagcacuuuauuuucaaauucugccugaugaa

SEQ ID NO: 192567 - RNA, 65 nt, hsa
auuaagguacaugucucucuguuuuaaguaauauugcacuuuauaaaaaaguaugaauaaagcaa

SEQ ID NO: 192568 - RNA, 65 nt, hsa
aagcaauagaugauucucaagccagagacaaucuagcacuuuaaagaaaccaugaacacuauaug

SEQ ID NO: 192569 - RNA, 65 nt, hsa
acuguuaagauuagacauuugaauucuguugacccgcacuuuaaagcuuuuguuugcauuuaaau

SEQ ID NO: 192570 - RNA, 65 nt, hsa
uuugggacaaaacuauuuuucagagcguuguaccggcacuuuauauauauugaucucuguacggc

SEQ ID NO: 192571 - RNA, 65 nt, hsa
aacauaauggaaaagugcauguacgggaaauaacagcacuuuagguguaguucaggugagcaaga

SEQ ID NO: 192572 - RNA, 65 nt, hsa
ccacuucaaaagucuuucauuggcagaucuugguagcacuuuauauguucaccaaugggagguca

SEQ ID NO: 192573 - RNA, 65 nt, hsa
cacguagaaugaccacagccacucgcauccguauagcacuuuaaaguuucugcaguccuuugaca

SEQ ID NO: 192574 - RNA, 65 nt, hsa
auaaacaaaugcugcuauuuauuagcugcaagaaugcacuuuagaacuauuugacaauucagacu

SEQ ID NO: 192575 - RNA, 65 nt, hsa
ccagggaaugaaugguggucuccccacucccggcagcacuuuaggcagcccauaagcuaugcgag

SEQ ID NO: 192576 - RNA, 65 nt, hsa; identical to SEQ ID NO: 192296

SEQ ID NO: 192577 - RNA, 65 nt, hsa
ccagucaucucagucguugucguuaggugacaugugcacuuuaaaugcucucaucgguuggcuuc

SEQ ID NO: 192578 - RNA, 65 nt, hsa
aauuuaugugguuuuuauacauuuuuuaauaagaugcacuuuaugucauuuuuuaauaaagucug

SEQ ID NO: 192579 - RNA, 65 nt, hsa
uauucugugccuuccaucaugauuuccacaugaaagcacuuuaaggcacugauuuuaagauaaug

SEQ ID NO: 192580 - RNA, 65 nt, hsa
uccauauuauuucuuugaaucaauucauuuucagagcacuuuaaagucugauauuucucgaugug

SEQ ID NO: 192581 - RNA, 65 nt, hsa
gaaaacaggggcugcuuuuuaaacucucacuaugggcacuuuaccaaaauacuuccauaucaauu

SEQ ID NO: 192582 - RNA, 65 nt, hsa
gacacaauuauuauuugcugauacaugaaaauacugcacuuuaaguuucucaagacucugaaaua

SEQ ID NO: 192583 - RNA, 65 nt, hsa
uuuaguuggucccuauguuggaaguaaaaagugaagcacuuuauuuugguuguguuugcucacgu

SEQ ID NO: 192584 - RNA, 65 nt, hsa
ggggcugugcacagacggaccccccacccccacacgcacuuuaugagggagaccccgacagagga

SEQ ID NO: 192585 - RNA, 65 nt, hsa
guuuugggaugauucaagugcauuacauuuauugugcacuuuauuucuauuaugauuacauugua

SEQ ID NO: 192586 - RNA, 65 nt, hsa
ugggcugggcaugguggcucacgccuguaacccuagcacuuuaggaaaucgaggcgaguggauca

SEQ ID NO: 192587 - RNA, 65 nt, hsa
gugugcaaugucugagugaaccuguauaaguggaggcacuuuagggcuguaaaaugcaugauuuu

SEQ ID NO: 192588 - RNA, 65 nt, hsa
uuuauucagugccccaaacacagauuucucuucuagcacuuuagaguugauccuugaagucucuc

SEQ ID NO: 192589 - RNA, 65 nt, hsa
augaacuacuauugauaccagcauacaaguguacagcacuuuacacacaagagguuuauugaugu

SEQ ID NO: 192590 - RNA, 65 nt, hsa
aaaggcagcgcugacuucguugggcuuuuuuccaagcacuuuaacuucagaaauggucuugacac

SEQ ID NO: 192591 - RNA, 65 nt, hsa
agcucugggugaggggacacuuggcuuugguguuugcacuuuacagauccugcgguccacgaggg

SEQ ID NO: 192592 - RNA, 65 nt, hsa
agcaggcaggggcaucugucugucugugggcuucagcacuuuaaagaggcuguguggccaaccag

SEQ ID NO: 192593 - RNA, 65 nt, hsa
agcaguuacuguauaugucccaggcaaugugcuaagcacuuuacacacauucccauguaauacuu

SEQ ID NO: 192594 - RNA, 65 nt, hsa
ucucuaugcaacaccccauccuugccgcaccgagugcacuuuaggggccccuacggccggcggga

SEQ ID NO: 192595 - RNA, 65 nt, hsa
caccucgucggggggcccaguccagccaccccccagcacuuuauguagagagugugacauagacc

SEQ ID NO: 192596 - RNA, 65 nt, hsa
gcguggagccuaguugccuguugucacggcaucuugcacuuuaggagacuaagaccguccugguu

SEQ ID NO: 192597 - RNA, 65 nt, hsa
uccaggggcagggaccauuucuucauuuucugaaagcacuuuaaugauuccccuucccccaaacu

SEQ ID NO: 192598 - RNA, 65 nt, hsa
cacaauuagugguuauucuuuucuguguuuguuuugcacuuuaaaaaagagagaacacaugcaaa

SEQ ID NO: 192599 - RNA, 65 nt, hsa
cuacccggcccagagaccccuuccuuuccucugcagcacuuuaacccucucuucccuauuauuuc

SEQ ID NO: 192600 - RNA, 65 nt, hsa
aauauuaaagcaaggaaaaguguaacugaaacacugcacuuuacuguuuuauacuuuuguacaua

SEQ ID NO: 192601 - RNA, 65 nt, hsa
auauacugauugacaaugcauauuagccagguaaugcacuuuagcuacccuggacaaugcuauca

SEQ ID NO: 192602 - RNA, 65 nt, hsa
auagcaccacacgcaaaccaaccuuucugacaucagcacuuuaccagaggcauaaacacaacuga

SEQ ID NO: 192603 - RNA, 65 nt, hsa
uauuuucauuccaggugaaaagcaggauguaccgagcacuuuauucagugcauagcuuuaagcca

SEQ ID NO: 192604 - RNA, 65 nt, hsa
cacuuuugacagcuuggcagauuuuaacuccagaagcacuuuaugaaaugguacacugacuaauc

SEQ ID NO: 192605 - RNA, 65 nt, hsa
aaaaucacuaaaaauucccacaaaucuuguuucuggcacuuuagaaaaacugcaaaaaaauacgu

SEQ ID NO: 192606 - RNA, 65 nt, hsa
agugaaacugcacaaaggaacacaaaacaaaacuugcacuuuaacgguaguuccggugucaacau

SEQ ID NO: 192607 - RNA, 65 nt, hsa
cacaauuaguggugguucuuuuccauguuuguuuugcacuuuaaaaaagagagaacacaugcaaa

SEQ ID NO: 192608 - RNA, 65 nt, hsa
uuguaaaaggggcagguguaauauguaaggaacaugcacuuuauugguuaauuuuauaauauuuu

SEQ ID NO: 192609 - RNA, 65 nt, hsa
agaggaucugcuuggucuugauaagcuauguuguugcacuuuaaacauuuaaauuauacaaucau

SEQ ID NO: 192610 - RNA, 65 nt, hsa
accccugcucacuuguuugcccucaggcagccaaagcacuuuaaccccugcauagggagcagagg

SEQ ID NO: 192611 - RNA, 65 nt, hsa
gguauacaugcggcuucauugccaauaaauuucaugcacuuuaaaguccuguggcuugugaccuc

SEQ ID NO: 192612 - RNA, 65 nt, hsa
uggugccacccucucuggcauucaugcagagcaaagcacuuuaaccauuucuuuuaaaaggucua

SEQ ID NO: 192613 - RNA, 65 nt, hsa
gcagccaggugcaguggcucacgccuguaaucccagcacuuuaggaggccgaggcuggcagauca

SEQ ID NO: 192614 - RNA, 65 nt, hsa
cacaauuagugguuguucuuuucuguguuugucuugcacuuuaaaaaagagagaacacaugcaaa

SEQ ID NO: 192615 - RNA, 65 nt, hsa
cuguacaucucuuggauuuguuucauuaaaaagaagcacuuuauguacugcugucuuuuuuuuuu

SEQ ID NO: 192616 - RNA, 65 nt, hsa
ccuuaguaaguacgugccugaaacugaaaccaugugcacuuuaauggaagguaagcugaacuucu

SEQ ID NO: 192617 - RNA, 65 nt, hsa
ugauucugguuuugaguuacucuuuguucaguaaugcacuuuauuuuauuguccaaagagaguca

SEQ ID NO: 192618 - RNA, 65 nt, hsa
auagguuacaggaaagccagccagaggaagugucagcacuuuaaaauucuagaccccaaaaaacu

SEQ ID NO: 192619 - RNA, 65 nt, hsa
uuuccacuuguuaaaaaaauuaaauauauuuuaaagcacuuuaagaauaugaaacuuucauauau

SEQ ID NO: 192620 - RNA, 65 nt, hsa
uuugauuauaccauuuugagggugaauauggcuaggcacuuuagauaagccuuuuuaaaauucuu

SEQ ID NO: 192621 - RNA, 65 nt, hsa
aaccaguuuuuguuguaaaugcaccaauucugaaggcacuuuauguacuacauggaggucauauc

SEQ ID NO: 192622 - RNA, 65 nt, hsa
auaagccugagauacaaguucagggacucagcaaugcacuuuaggacugagcuaggaggcaaaua

SEQ ID NO: 192623 - RNA, 65 nt, hsa
uauuccuuugaaagggaucaaaacuuauauucaaugcacuuuauaauuaauggugucuaaaugcc

SEQ ID NO: 192624 - RNA, 65 nt, hsa
agggcauaguuaccuuauaccagcaacaagucuaagcacuuuacuuguauuaauuuauuuuaucu

SEQ ID NO: 192625 - RNA, 65 nt, hsa
auuuauauggacaaaauuaagucuuuaaaauuuaggcacuuuaaggagaacuaauaacuuuuucc

SEQ ID NO: 192626 - RNA, 65 nt, hsa
gaacaaugacauaaaucaagggagaaagaaaaugggcacuuuaugucucagaauuacucaaauca

SEQ ID NO: 192627 - RNA, 65 nt, hsa
ccgggcgggcgugggaggagggaggcggccuccaugcacuuuauguggagacuacuggccccgcc

SEQ ID NO: 192628 - RNA, 65 nt, hsa
cagguuuuaagucaaaaaugucgauaugucauuaugcacuuuacagaugaggggaggggccgcag

SEQ ID NO: 192629 - RNA, 65 nt, hsa
gcugcuucugggccacggggagccccaggaccuaugcacuuuauuucugaccccguggcuucggc

SEQ ID NO: 192630 - RNA, 65 nt, hsa
caucaguguuuuguauuuuuguacugaguaucggagcacuuuacagaagcugacuguacauuccu

SEQ ID NO: 192631 - RNA, 65 nt, hsa
ggguggcuggggccaagccccgagggccccugcaagcacuuuacuuccuguuccuccccagccuu

SEQ ID NO: 192632 - RNA, 65 nt, hsa
aagguuuuguuucaguuuguaagauuucuuuucuggcacuuuaauggcuugagguaucauuauca

SEQ ID NO: 192633 - RNA, 65 nt, hsa
uuggcagggcacgguagcucacaccuguaaucccagcacuuuaggaggucaaggugggcagauca

SEQ ID NO: 192634 - RNA, 65 nt, hsa
gaggccaggccugguggcucacgccuguaaucccagcacuuuaagaggccaaggcggauggauca

SEQ ID NO: 192635 - RNA, 65 nt, hsa
ucaacaauuacauuacuugcuuucacauuuuaaaggcacuuuaaaaaaaucuacuucucuuguag

SEQ ID NO: 192636 - RNA, 65 nt, hsa
gagggccccaugccagacagcccuuggggcucguugcacuuuaagaaauaggaucugugguguau

SEQ ID NO: 192637 - RNA, 65 nt, hsa
ucacaucucaaucaggaugcuucucuccauugguagcacuuuagaguccaugaaauaugguaaaa

SEQ ID NO: 192638 - RNA, 65 nt, hsa
ugcacucucuuccuguacaguauuuauuguuccuggcacuuuauuuaaagauauuugacccucac

SEQ ID NO: 192639 - RNA, 65 nt, hsa
cuccuaaccccgccaggcagccucguucugcacaggcacuuuagcccgagccaggcacaccugcg

SEQ ID NO: 192640 - RNA, 65 nt, hsa
uaauuuaaguuuuccuuuuuuacaguuuuucuccagcacuuuacucuucuuaagugccuggccuu

SEQ ID NO: 192641 - RNA, 65 nt, hsa
uaggcugggcaugguggcucaugccuauaaucccagcacuuuaggagccccagacaggaggauca

SEQ ID NO: 192642 - RNA, 65 nt, hsa
aacuuaugacaguuuaauaaguuaucagcaauuuagcacuuuacuuccauuagguuccuuuagcu

SEQ ID NO: 192643 - RNA, 65 nt, hsa
caaaaguuuuuuuaaagugggggaaaaacauccaagcacuuuaauuccaauguaccaggugaacu

SEQ ID NO: 192644 - RNA, 65 nt, hsa
uugucaugacucaugguuacauucaggauacuugagcacuuuauauacuaccguagcacuguagc

SEQ ID NO: 192645 - RNA, 65 nt, hsa
uucacaggccugauggucucccuccucugccuccugcacuuuagcaucguguccguggccgcgca

SEQ ID NO: 192646 - RNA, 65 nt, hsa
guuaucacauuuguaccacuuaaaguggaaucuaggcacuuuaucaccauuuagauccuauuacc

SEQ ID NO: 192647 - RNA, 65 nt, hsa
auggugguuucaugaugcccccuccccaauuccucgcacuuuauucuccugggugguuucgaacu

SEQ ID NO: 192648 - RNA, 65 nt, hsa
aaaaauaagauaaaauaaaauaaacaaauaagacagcacuuuauacuuuuagggaugauuucuau

SEQ ID NO: 192649 - RNA, 65 nt, hsa
gugaagaugacaccccuccccaccaccucucauaagcacuuuaggaacacacagaggguagggau

SEQ ID NO: 192650 - RNA, 51 nt, hsa
cagcugugaugcauuauugaagcacuuuagcugaagcauuggaccacaaac

SEQ ID NO: 192651 - RNA, 65 nt, hsa
ccagggucucccauagacagccugggggcaaguuagcacuuuauucccgcagcaguuccugaaug

SEQ ID NO: 192652 - RNA, 65 nt, hsa
uagcaaacuuuucacaugcuaaugugcagcugagugcacuuuauuuaaaaagaauggauaaaugc

SEQ ID NO: 192653 - RNA, 65 nt, hsa
ccaggcuuuuggucuuucaaaauuugugauugaaagcacuuuagugacuuggauuuuguaaaucu

SEQ ID NO: 192654 - RNA, 65 nt, hsa
cuauuucauucuagaauggaaacgguuccuuaauggcacuuuaaccaguuaacuuggugcaaaac

SEQ ID NO: 192655 - RNA, 65 nt, hsa
agguuuugguuguugguaguagccgaauuuaacuggcacuuuauuuuacuucuaaccuuguuucc

SEQ ID NO: 192656 - RNA, 65 nt, hsa
uuuuugaucaauggggaccagccacugccccaggagcacuuuagggcucucaguucaaacugaag

SEQ ID NO: 192657 - RNA, 65 nt, hsa
ccagggugaacacacgccacuucccagcuaggagugcacuuuaugggacugugacuggacucuuc

SEQ ID NO: 192658 - RNA, 65 nt, hsa
aaguuauugagaauaaucuuucuuaaaaaauauaugcacuuuagauauugauauaguuugagaaa

SEQ ID NO: 192659 - RNA, 65 nt, hsa
augaacuuacgugacaaugauuguauuccucaguagcacuuuaaacgccgaagacagcccugcag

SEQ ID NO: 192660 - RNA, 65 nt, hsa
uccagcugaaaaccugcugugagaguuuugacagagcacuuuauuuucgucaaguuucaagucug

SEQ ID NO: 192661 - RNA, 65 nt, hsa
aaauagguuuucauuuauggcuuuuugugguuuuagcacuuuaagaaguuuaauuuuuuguaauu

SEQ ID NO: 192662 - RNA, 65 nt, hsa
aaccauuguguguuuccucuuugaagcaaugacaagcacuuuacuuucacggugguuuuuguuuu

SEQ ID NO: 192663 - RNA, 65 nt, hsa
gaaguaggggugcauggcucaugccuguaaucccagcacuuuaagaggcugaggcaggaggauca

SEQ ID NO: 192664 - RNA, 65 nt, hsa
ugcagggcagugaaacccacgcagccuaggccagagcacuuuacuccaggcagggccccugcccc

SEQ ID NO: 192665 - RNA, 65 nt, hsa
aucucacuuuaugauagggaaggcuacuaccuagggcacuuuaagucagugacagccccuuauuu

SEQ ID NO: 192666 - RNA, 65 nt, hsa
aaaaaaaaaaaaaacuucuacuuuuccucuuaaaggcacuuuacucucuccccacucuuuucuuc

SEQ ID NO: 192667 - RNA, 65 nt, hsa
ucacucacuuugcaccuuucccugucgcucucuaagcacuuuaccuggauggcgcgugggcagug

SEQ ID NO: 192668 - RNA, 65 nt, hsa
aaccuguuccccucugcuacuagccacugagaagugcacuuuaagaggugggagcugggcagacc

SEQ ID NO: 192669 - RNA, 65 nt, hsa
cauccccauaauggcauuucuccuuucugugcacagcacuuuauuguuacaaaguacucuuccaa

SEQ ID NO: 192670 - RNA, 65 nt, hsa
aaucauuuuuaaaauacuaauggaagaacuuucuagcacuuuaccacuacauaaauguucauuga

SEQ ID NO: 192671 - RNA, 65 nt, hsa
ucauccaccaaaguuaaauagagcuauuuaaaaaugcacuuuauuuguacucuguguggcuuuug

SEQ ID NO: 192672 - RNA, 65 nt, hsa
ccuaguacaucuuacagcuuuccccuuccauguuagcacuuuacugcugaauucucaauuuucuu

SEQ ID NO: 192673 - RNA, 65 nt, hsa
cuucagcccuuuuucugccacuagcaaccagaauagcacuuuaccuuuugguuggcuagauaagu

SEQ ID NO: 192674 - RNA, 65 nt, hsa
cacuggguaucacuacuuuguguuaaagugccuucgcacuuuaaguacauuacuuaaauguugcu

SEQ ID NO: 192675 - RNA, 65 nt, hsa
uauuugaauuauuacuuagcacauggauauaagaggcacuuuauuagaauuugacaacgucauua

SEQ ID NO: 192676 - RNA, 65 nt, hsa
cccuuacaccuaccccaccuacaacugaagacaaugcacuuuacagauaucacccacacacaccu

SEQ ID NO: 192677 - RNA, 65 nt, hsa
ccucuuuagaaucugagagagaucacugucaaguugcacuuuacuggguuuuauccaguuuuagg

SEQ ID NO: 192678 - RNA, 65 nt, hsa
uaagccucucaaaauuguguuggcacaucuaccuagcacuuuagggacaaaaucaaacccuucuc

SEQ ID NO: 192679 - RNA, 65 nt, hsa
uugggggacucuuauaauggagcugcuuuugaaaagcacuuuaauuagauaauguauuuugacua

SEQ ID NO: 192680 - RNA, 65 nt, hsa
augaacugcuugaagugaauacuuaauuuaaguuugcacuuuaauaccaaacuuaaaaccaaaca

SEQ ID NO: 192681 - RNA, 62 nt, hsa; identical to SEQ ID NO: 103289

SEQ ID NO: 192682 - RNA, 62 nt, hsa; identical to SEQ ID NO: 103290

SEQ ID NO: 192683 - RNA, 62 nt, hsa; identical to SEQ ID NO: 103291

SEQ ID NO: 192684 - RNA, 62 nt, hsa; identical to SEQ ID NO: 103292

SEQ ID NO: 192685 - RNA, 62 nt, hsa; identical to SEQ ID NO: 103293

SEQ ID NO: 192686 - RNA, 62 nt, hsa; identical to SEQ ID NO: 103294

SEQ ID NO: 192687 - RNA, 62 nt, hsa; identical to SEQ ID NO: 103295

SEQ ID NO: 192688 - RNA, 62 nt, hsa; identical to SEQ ID NO: 103296

SEQ ID NO: 192689 - RNA, 62 nt, hsa; identical to SEQ ID NO: 103297

SEQ ID NO: 192690 - RNA, 62 nt, hsa; identical to SEQ ID NO: 103298

SEQ ID NO: 192691 - RNA, 62 nt, hsa; identical to SEQ ID NO: 103299

SEQ ID NO: 192692 - RNA, 57 nt, hsa; identical to SEQ ID NO: 103300

SEQ ID NO: 192693 - RNA, 62 nt, hsa; identical to SEQ ID NO: 103301

SEQ ID NO: 192694 - RNA, 62 nt, hsa; identical to SEQ ID NO: 103302

SEQ ID NO: 192695 - RNA, 62 nt, hsa; identical to SEQ ID NO: 103303

SEQ ID NO: 192696 - RNA, 62 nt, hsa; identical to SEQ ID NO: 103304

SEQ ID NO: 192697 - RNA, 62 nt, hsa; identical to SEQ ID NO: 103305

SEQ ID NO: 192698 - RNA, 62 nt, hsa; identical to SEQ ID NO: 103306

SEQ ID NO: 192699 - RNA, 62 nt, hsa; identical to SEQ ID NO: 103307

SEQ ID NO: 192700 - RNA, 62 nt, hsa; identical to SEQ ID NO: 103308

SEQ ID NO: 192701 - RNA, 62 nt, hsa; identical to SEQ ID NO: 103309

SEQ ID NO: 192702 - RNA, 62 nt, hsa; identical to SEQ ID NO: 103310

SEQ ID NO: 192703 - RNA, 62 nt, hsa; identical to SEQ ID NO: 103311

SEQ ID NO: 192704 - RNA, 62 nt, hsa; identical to SEQ ID NO: 103312

SEQ ID NO: 192705 - RNA, 62 nt, hsa; identical to SEQ ID NO: 103313

SEQ ID NO: 192706 - RNA, 62 nt, hsa; identical to SEQ ID NO: 103314

SEQ ID NO: 192707 - RNA, 62 nt, hsa; identical to SEQ ID NO: 103315

SEQ ID NO: 192708 - RNA, 62 nt, hsa; identical to SEQ ID NO: 103316

SEQ ID NO: 192709 - RNA, 62 nt, hsa; identical to SEQ ID NO: 103317

SEQ ID NO: 192710 - RNA, 62 nt, hsa; identical to SEQ ID NO: 103318

SEQ ID NO: 192711 - RNA, 62 nt, hsa; identical to SEQ ID NO: 103319

SEQ ID NO: 192712 - RNA, 62 nt, hsa; identical to SEQ ID NO: 103320

SEQ ID NO: 192713 - RNA, 62 nt, hsa; identical to SEQ ID NO: 103321

SEQ ID NO: 192714 - RNA, 62 nt, hsa; identical to SEQ ID NO: 103322

SEQ ID NO: 192715 - RNA, 62 nt, hsa; identical to SEQ ID NO: 103323

SEQ ID NO: 192716 - RNA, 62 nt, hsa; identical to SEQ ID NO: 103324

SEQ ID NO: 192717 - RNA, 62 nt, hsa; identical to SEQ ID NO: 103325

SEQ ID NO: 192718 - RNA, 62 nt, hsa; identical to SEQ ID NO: 103326

SEQ ID NO: 192719 - RNA, 62 nt, hsa; identical to SEQ ID NO: 103327

SEQ ID NO: 192720 - RNA, 62 nt, hsa; identical to SEQ ID NO: 103328

SEQ ID NO: 192721 - RNA, 62 nt, hsa; identical to SEQ ID NO: 103329

SEQ ID NO: 192722 - RNA, 62 nt, hsa; identical to SEQ ID NO: 103330

SEQ ID NO: 192723 - RNA, 62 nt, hsa; identical to SEQ ID NO: 103331

SEQ ID NO: 192724 - RNA, 62 nt, hsa; identical to SEQ ID NO: 103332

SEQ ID NO: 192725 - RNA, 62 nt, hsa; identical to SEQ ID NO: 103333

SEQ ID NO: 192726 - RNA, 62 nt, hsa; identical to SEQ ID NO: 103334

SEQ ID NO: 192727 - RNA, 62 nt, hsa; identical to SEQ ID NO: 103335

SEQ ID NO: 192728 - RNA, 62 nt, hsa; identical to SEQ ID NO: 103336

SEQ ID NO: 192729 - RNA, 62 nt, hsa; identical to SEQ ID NO: 103337

SEQ ID NO: 192730 - RNA, 62 nt, hsa; identical to SEQ ID NO: 103338

SEQ ID NO: 192731 - RNA, 62 nt, hsa; identical to SEQ ID NO: 103339

SEQ ID NO: 192732 - RNA, 62 nt, hsa; identical to SEQ ID NO: 103340

SEQ ID NO: 192733 - RNA, 62 nt, hsa; identical to SEQ ID NO: 103341

SEQ ID NO: 192734 - RNA, 62 nt, hsa; identical to SEQ ID NO: 103342

SEQ ID NO: 192735 - RNA, 62 nt, hsa; identical to SEQ ID NO: 103343

SEQ ID NO: 192736 - RNA, 62 nt, hsa; identical to SEQ ID NO: 103344

SEQ ID NO: 192737 - RNA, 62 nt, hsa; identical to SEQ ID NO: 103345

SEQ ID NO: 192738 - RNA, 62 nt, hsa; identical to SEQ ID NO: 103346

SEQ ID NO: 192739 - RNA, 62 nt, hsa; identical to SEQ ID NO: 103347

SEQ ID NO: 192740 - RNA, 62 nt, hsa; identical to SEQ ID NO: 103348

SEQ ID NO: 192741 - RNA, 62 nt, hsa; identical to SEQ ID NO: 103349

SEQ ID NO: 192742 - RNA, 62 nt, hsa; identical to SEQ ID NO: 103350

SEQ ID NO: 192743 - RNA, 62 nt, hsa; identical to SEQ ID NO: 103351

SEQ ID NO: 192744 - RNA, 62 nt, hsa; identical to SEQ ID NO: 103352

SEQ ID NO: 192745 - RNA, 62 nt, hsa; identical to SEQ ID NO: 103353

SEQ ID NO: 192746 - RNA, 62 nt, hsa; identical to SEQ ID NO: 103354

SEQ ID NO: 192747 - RNA, 62 nt, hsa; identical to SEQ ID NO: 103355

SEQ ID NO: 192748 - RNA, 62 nt, hsa; identical to SEQ ID NO: 103356

SEQ ID NO: 192749 - RNA, 62 nt, hsa; identical to SEQ ID NO: 103357

SEQ ID NO: 192750 - RNA, 62 nt, hsa; identical to SEQ ID NO: 103358

SEQ ID NO: 192751 - RNA, 62 nt, hsa; identical to SEQ ID NO: 103359

SEQ ID NO: 192752 - RNA, 62 nt, hsa; identical to SEQ ID NO: 103360

SEQ ID NO: 192753 - RNA, 62 nt, hsa; identical to SEQ ID NO: 103361

SEQ ID NO: 192754 - RNA, 62 nt, hsa; identical to SEQ ID NO: 103362

SEQ ID NO: 192755 - RNA, 62 nt, hsa; identical to SEQ ID NO: 103363

SEQ ID NO: 192756 - RNA, 62 nt, hsa; identical to SEQ ID NO: 103364

SEQ ID NO: 192757 - RNA, 62 nt, hsa; identical to SEQ ID NO: 103365

SEQ ID NO: 192758 - RNA, 62 nt, hsa; identical to SEQ ID NO: 103366

SEQ ID NO: 192759 - RNA, 62 nt, hsa; identical to SEQ ID NO: 103367

SEQ ID NO: 192760 - RNA, 62 nt, hsa; identical to SEQ ID NO: 103368

SEQ ID NO: 192761 - RNA, 62 nt, hsa; identical to SEQ ID NO: 103369

SEQ ID NO: 192762 - RNA, 62 nt, hsa; identical to SEQ ID NO: 103370

SEQ ID NO: 192763 - RNA, 62 nt, hsa; identical to SEQ ID NO: 103371

SEQ ID NO: 192764 - RNA, 59 nt, hsa; identical to SEQ ID NO: 103372

SEQ ID NO: 192765 - RNA, 62 nt, hsa; identical to SEQ ID NO: 103373

SEQ ID NO: 192766 - RNA, 62 nt, hsa; identical to SEQ ID NO: 103374

SEQ ID NO: 192767 - RNA, 62 nt, hsa; identical to SEQ ID NO: 103375

SEQ ID NO: 192768 - RNA, 62 nt, hsa; identical to SEQ ID NO: 103376

SEQ ID NO: 192769 - RNA, 62 nt, hsa; identical to SEQ ID NO: 103377

SEQ ID NO: 192770 - RNA, 62 nt, hsa; identical to SEQ ID NO: 103378

SEQ ID NO: 192771 - RNA, 62 nt, hsa; identical to SEQ ID NO: 103379

SEQ ID NO: 192772 - RNA, 62 nt, hsa; identical to SEQ ID NO: 103380

SEQ ID NO: 192773 - RNA, 62 nt, hsa; identical to SEQ ID NO: 103381

SEQ ID NO: 192774 - RNA, 62 nt, hsa; identical to SEQ ID NO: 103382

SEQ ID NO: 192775 - RNA, 62 nt, hsa; identical to SEQ ID NO: 103383

SEQ ID NO: 192776 - RNA, 62 nt, hsa; identical to SEQ ID NO: 103384

SEQ ID NO: 192777 - RNA, 62 nt, hsa; identical to SEQ ID NO: 103385

SEQ ID NO: 192778 - RNA, 62 nt, hsa; identical to SEQ ID NO: 103386

SEQ ID NO: 192779 - RNA, 62 nt, hsa; identical to SEQ ID NO: 103387

SEQ ID NO: 192780 - RNA, 62 nt, hsa; identical to SEQ ID NO: 103388

SEQ ID NO: 192781 - RNA, 62 nt, hsa; identical to SEQ ID NO: 103389

SEQ ID NO: 192782 - RNA, 62 nt, hsa; identical to SEQ ID NO: 103390

SEQ ID NO: 192783 - RNA, 62 nt, hsa; identical to SEQ ID NO: 103391

SEQ ID NO: 192784 - RNA, 62 nt, hsa; identical to SEQ ID NO: 103392

SEQ ID NO: 192785 - RNA, 60 nt, hsa; identical to SEQ ID NO: 103393

SEQ ID NO: 192786 - RNA, 62 nt, hsa; identical to SEQ ID NO: 103394

SEQ ID NO: 192787 - RNA, 62 nt, hsa; identical to SEQ ID NO: 103395

SEQ ID NO: 192788 - RNA, 62 nt, hsa; identical to SEQ ID NO: 103396

SEQ ID NO: 192789 - RNA, 62 nt, hsa; identical to SEQ ID NO: 103397

SEQ ID NO: 192790 - RNA, 62 nt, hsa; identical to SEQ ID NO: 103398

SEQ ID NO: 192791 - RNA, 62 nt, hsa; identical to SEQ ID NO: 103399

SEQ ID NO: 192792 - RNA, 62 nt, hsa; identical to SEQ ID NO: 103400

SEQ ID NO: 192793 - RNA, 62 nt, hsa; identical to SEQ ID NO: 103401

SEQ ID NO: 192794 - RNA, 62 nt, hsa; identical to SEQ ID NO: 103402

SEQ ID NO: 192795 - RNA, 62 nt, hsa; identical to SEQ ID NO: 103403

SEQ ID NO: 192796 - RNA, 62 nt, hsa; identical to SEQ ID NO: 103404

SEQ ID NO: 192797 - RNA, 62 nt, hsa; identical to SEQ ID NO: 103405

SEQ ID NO: 192798 - RNA, 62 nt, hsa; identical to SEQ ID NO: 103406

SEQ ID NO: 192799 - RNA, 62 nt, hsa; identical to SEQ ID NO: 103407

SEQ ID NO: 192800 - RNA, 62 nt, hsa; identical to SEQ ID NO: 103408

SEQ ID NO: 192801 - RNA, 62 nt, hsa; identical to SEQ ID NO: 103409

SEQ ID NO: 192802 - RNA, 62 nt, hsa; identical to SEQ ID NO: 103410

SEQ ID NO: 192803 - RNA, 62 nt, hsa; identical to SEQ ID NO: 103411

SEQ ID NO: 192804 - RNA, 62 nt, hsa; identical to SEQ ID NO: 103412

SEQ ID NO: 192805 - RNA, 62 nt, hsa; identical to SEQ ID NO: 103413

SEQ ID NO: 192806 - RNA, 62 nt, hsa; identical to SEQ ID NO: 103414

SEQ ID NO: 192807 - RNA, 62 nt, hsa; identical to SEQ ID NO: 103415

SEQ ID NO: 192808 - RNA, 62 nt, hsa; identical to SEQ ID NO: 103416

SEQ ID NO: 192809 - RNA, 62 nt, hsa; identical to SEQ ID NO: 103417

SEQ ID NO: 192810 - RNA, 62 nt, hsa; identical to SEQ ID NO: 103418

SEQ ID NO: 192811 - RNA, 62 nt, hsa; identical to SEQ ID NO: 103419

SEQ ID NO: 192812 - RNA, 62 nt, hsa; identical to SEQ ID NO: 103420

SEQ ID NO: 192813 - RNA, 62 nt, hsa; identical to SEQ ID NO: 103421

SEQ ID NO: 192814 - RNA, 62 nt, hsa; identical to SEQ ID NO: 103422

SEQ ID NO: 192815 - RNA, 62 nt, hsa; identical to SEQ ID NO: 103423

SEQ ID NO: 192816 - RNA, 62 nt, hsa; identical to SEQ ID NO: 103424

SEQ ID NO: 192817 - RNA, 62 nt, hsa; identical to SEQ ID NO: 103425

SEQ ID NO: 192818 - RNA, 62 nt, hsa; identical to SEQ ID NO: 103426

SEQ ID NO: 192819 - RNA, 62 nt, hsa; identical to SEQ ID NO: 103427

SEQ ID NO: 192820 - RNA, 62 nt, hsa; identical to SEQ ID NO: 103428

SEQ ID NO: 192821 - RNA, 62 nt, hsa; identical to SEQ ID NO: 103429

SEQ ID NO: 192822 - RNA, 62 nt, hsa; identical to SEQ ID NO: 103430

SEQ ID NO: 192823 - RNA, 62 nt, hsa; identical to SEQ ID NO: 103431

SEQ ID NO: 192824 - RNA, 62 nt, hsa; identical to SEQ ID NO: 103432

SEQ ID NO: 192825 - RNA, 62 nt, hsa; identical to SEQ ID NO: 103433

SEQ ID NO: 192826 - RNA, 62 nt, hsa; identical to SEQ ID NO: 103434

SEQ ID NO: 192827 - RNA, 62 nt, hsa; identical to SEQ ID NO: 103435

SEQ ID NO: 192828 - RNA, 62 nt, hsa; identical to SEQ ID NO: 103436

SEQ ID NO: 192829 - RNA, 62 nt, hsa; identical to SEQ ID NO: 103437

SEQ ID NO: 192830 - RNA, 62 nt, hsa; identical to SEQ ID NO: 103438

SEQ ID NO: 192831 - RNA, 62 nt, hsa; identical to SEQ ID NO: 103439

SEQ ID NO: 192832 - RNA, 62 nt, hsa; identical to SEQ ID NO: 103440

SEQ ID NO: 192833 - RNA, 62 nt, hsa; identical to SEQ ID NO: 103441

SEQ ID NO: 192834 - RNA, 62 nt, hsa; identical to SEQ ID NO: 103442

SEQ ID NO: 192835 - RNA, 62 nt, hsa; identical to SEQ ID NO: 103443

SEQ ID NO: 192836 - RNA, 62 nt, hsa; identical to SEQ ID NO: 103444

SEQ ID NO: 192837 - RNA, 62 nt, hsa; identical to SEQ ID NO: 103445

SEQ ID NO: 192838 - RNA, 62 nt, hsa; identical to SEQ ID NO: 103446

SEQ ID NO: 192839 - RNA, 62 nt, hsa; identical to SEQ ID NO: 103447

SEQ ID NO: 192840 - RNA, 62 nt, hsa; identical to SEQ ID NO: 103448

SEQ ID NO: 192841 - RNA, 62 nt, hsa; identical to SEQ ID NO: 103449

SEQ ID NO: 192842 - RNA, 62 nt, hsa; identical to SEQ ID NO: 103450

SEQ ID NO: 192843 - RNA, 62 nt, hsa; identical to SEQ ID NO: 103451

SEQ ID NO: 192844 - RNA, 62 nt, hsa; identical to SEQ ID NO: 103452

SEQ ID NO: 192845 - RNA, 62 nt, hsa; identical to SEQ ID NO: 103453

SEQ ID NO: 192846 - RNA, 62 nt, hsa; identical to SEQ ID NO: 103454

SEQ ID NO: 192847 - RNA, 62 nt, hsa; identical to SEQ ID NO: 103455

SEQ ID NO: 192848 - RNA, 62 nt, hsa; identical to SEQ ID NO: 103456

SEQ ID NO: 192849 - RNA, 62 nt, hsa; identical to SEQ ID NO: 103457

SEQ ID NO: 192850 - RNA, 62 nt, hsa; identical to SEQ ID NO: 103458

SEQ ID NO: 192851 - RNA, 62 nt, hsa; identical to SEQ ID NO: 103459

SEQ ID NO: 192852 - RNA, 62 nt, hsa; identical to SEQ ID NO: 103460

SEQ ID NO: 192853 - RNA, 62 nt, hsa; identical to SEQ ID NO: 103461

SEQ ID NO: 192854 - RNA, 62 nt, hsa; identical to SEQ ID NO: 103462

SEQ ID NO: 192855 - RNA, 62 nt, hsa; identical to SEQ ID NO: 103463

SEQ ID NO: 192856 - RNA, 62 nt, hsa; identical to SEQ ID NO: 103464

SEQ ID NO: 192857 - RNA, 62 nt, hsa; identical to SEQ ID NO: 103465

SEQ ID NO: 192858 - RNA, 62 nt, hsa; identical to SEQ ID NO: 103466

SEQ ID NO: 192859 - RNA, 62 nt, hsa; identical to SEQ ID NO: 103467

SEQ ID NO: 192860 - RNA, 62 nt, hsa; identical to SEQ ID NO: 103468

SEQ ID NO: 192861 - RNA, 62 nt, hsa; identical to SEQ ID NO: 103469

SEQ ID NO: 192862 - RNA, 62 nt, hsa; identical to SEQ ID NO: 103470

SEQ ID NO: 192863 - RNA, 62 nt, hsa; identical to SEQ ID NO: 103471

SEQ ID NO: 192864 - RNA, 62 nt, hsa; identical to SEQ ID NO: 103472

SEQ ID NO: 192865 - RNA, 62 nt, hsa; identical to SEQ ID NO: 103473

SEQ ID NO: 192866 - RNA, 62 nt, hsa; identical to SEQ ID NO: 103474

SEQ ID NO: 192867 - RNA, 62 nt, hsa; identical to SEQ ID NO: 103475

SEQ ID NO: 192868 - RNA, 62 nt, hsa; identical to SEQ ID NO: 103476

SEQ ID NO: 192869 - RNA, 62 nt, hsa; identical to SEQ ID NO: 103477

SEQ ID NO: 192870 - RNA, 62 nt, hsa; identical to SEQ ID NO: 103478

SEQ ID NO: 192871 - RNA, 62 nt, hsa; identical to SEQ ID NO: 103479

SEQ ID NO: 192872 - RNA, 62 nt, hsa; identical to SEQ ID NO: 103480

SEQ ID NO: 192873 - RNA, 62 nt, hsa; identical to SEQ ID NO: 103481

SEQ ID NO: 192874 - RNA, 62 nt, hsa; identical to SEQ ID NO: 103482

SEQ ID NO: 192875 - RNA, 62 nt, hsa; identical to SEQ ID NO: 103483

SEQ ID NO: 192876 - RNA, 62 nt, hsa; identical to SEQ ID NO: 103484

SEQ ID NO: 192877 - RNA, 62 nt, hsa; identical to SEQ ID NO: 103485

SEQ ID NO: 192878 - RNA, 62 nt, hsa; identical to SEQ ID NO: 103486

SEQ ID NO: 192879 - RNA, 62 nt, hsa; identical to SEQ ID NO: 103487

SEQ ID NO: 192880 - RNA, 62 nt, hsa; identical to SEQ ID NO: 103488

SEQ ID NO: 192881 - RNA, 62 nt, hsa; identical to SEQ ID NO: 103489

SEQ ID NO: 192882 - RNA, 62 nt, hsa; identical to SEQ ID NO: 103490

SEQ ID NO: 192883 - RNA, 62 nt, hsa; identical to SEQ ID NO: 103491

SEQ ID NO: 192884 - RNA, 62 nt, hsa; identical to SEQ ID NO: 103492

SEQ ID NO: 192885 - RNA, 62 nt, hsa; identical to SEQ ID NO: 103493

SEQ ID NO: 192886 - RNA, 62 nt, hsa; identical to SEQ ID NO: 103494

SEQ ID NO: 192887 - RNA, 62 nt, hsa; identical to SEQ ID NO: 103495

SEQ ID NO: 192888 - RNA, 62 nt, hsa; identical to SEQ ID NO: 103496

SEQ ID NO: 192889 - RNA, 62 nt, hsa; identical to SEQ ID NO: 103497

SEQ ID NO: 192890 - RNA, 62 nt, hsa; identical to SEQ ID NO: 103498

SEQ ID NO: 192891 - RNA, 62 nt, hsa; identical to SEQ ID NO: 103499

SEQ ID NO: 192892 - RNA, 62 nt, hsa; identical to SEQ ID NO: 103500

SEQ ID NO: 192893 - RNA, 62 nt, hsa; identical to SEQ ID NO: 103501

SEQ ID NO: 192894 - RNA, 62 nt, hsa; identical to SEQ ID NO: 103502

SEQ ID NO: 192895 - RNA, 62 nt, hsa; identical to SEQ ID NO: 103503

SEQ ID NO: 192896 - RNA, 62 nt, hsa; identical to SEQ ID NO: 103504

SEQ ID NO: 192897 - RNA, 62 nt, hsa; identical to SEQ ID NO: 103505

SEQ ID NO: 192898 - RNA, 62 nt, hsa; identical to SEQ ID NO: 103506

SEQ ID NO: 192899 - RNA, 62 nt, hsa; identical to SEQ ID NO: 103507

SEQ ID NO: 192900 - RNA, 63 nt, hsa; identical to SEQ ID NO: 103508

SEQ ID NO: 192901 - RNA, 63 nt, hsa; identical to SEQ ID NO: 103509

SEQ ID NO: 192902 - RNA, 63 nt, hsa; identical to SEQ ID NO: 103510

SEQ ID NO: 192903 - RNA, 63 nt, hsa; identical to SEQ ID NO: 103511

SEQ ID NO: 192904 - RNA, 63 nt, hsa; identical to SEQ ID NO: 103512

SEQ ID NO: 192905 - RNA, 63 nt, hsa; identical to SEQ ID NO: 103513

SEQ ID NO: 192906 - RNA, 63 nt, hsa; identical to SEQ ID NO: 103514

SEQ ID NO: 192907 - RNA, 63 nt, hsa; identical to SEQ ID NO: 103515

SEQ ID NO: 192908 - RNA, 63 nt, hsa; identical to SEQ ID NO: 103516

SEQ ID NO: 192909 - RNA, 63 nt, hsa; identical to SEQ ID NO: 103517

SEQ ID NO: 192910 - RNA, 63 nt, hsa; identical to SEQ ID NO: 103518

SEQ ID NO: 192911 - RNA, 57 nt, hsa; identical to SEQ ID NO: 103300

SEQ ID NO: 192912 - RNA, 63 nt, hsa; identical to SEQ ID NO: 103520

SEQ ID NO: 192913 - RNA, 63 nt, hsa; identical to SEQ ID NO: 103521

SEQ ID NO: 192914 - RNA, 63 nt, hsa; identical to SEQ ID NO: 103522

SEQ ID NO: 192915 - RNA, 63 nt, hsa; identical to SEQ ID NO: 103523

SEQ ID NO: 192916 - RNA, 63 nt, hsa; identical to SEQ ID NO: 103524

SEQ ID NO: 192917 - RNA, 63 nt, hsa; identical to SEQ ID NO: 103525

SEQ ID NO: 192918 - RNA, 63 nt, hsa; identical to SEQ ID NO: 103526

SEQ ID NO: 192919 - RNA, 63 nt, hsa; identical to SEQ ID NO: 103527

SEQ ID NO: 192920 - RNA, 63 nt, hsa; identical to SEQ ID NO: 103528

SEQ ID NO: 192921 - RNA, 63 nt, hsa; identical to SEQ ID NO: 103529

SEQ ID NO: 192922 - RNA, 63 nt, hsa; identical to SEQ ID NO: 103530

SEQ ID NO: 192923 - RNA, 63 nt, hsa; identical to SEQ ID NO: 103531

SEQ ID NO: 192924 - RNA, 63 nt, hsa; identical to SEQ ID NO: 103532

SEQ ID NO: 192925 - RNA, 63 nt, hsa; identical to SEQ ID NO: 103533

SEQ ID NO: 192926 - RNA, 63 nt, hsa; identical to SEQ ID NO: 103534

SEQ ID NO: 192927 - RNA, 63 nt, hsa; identical to SEQ ID NO: 103535

SEQ ID NO: 192928 - RNA, 63 nt, hsa; identical to SEQ ID NO: 103536

SEQ ID NO: 192929 - RNA, 63 nt, hsa; identical to SEQ ID NO: 103537

SEQ ID NO: 192930 - RNA, 63 nt, hsa; identical to SEQ ID NO: 103538

SEQ ID NO: 192931 - RNA, 63 nt, hsa; identical to SEQ ID NO: 103539

SEQ ID NO: 192932 - RNA, 63 nt, hsa; identical to SEQ ID NO: 103540

SEQ ID NO: 192933 - RNA, 63 nt, hsa; identical to SEQ ID NO: 103541

SEQ ID NO: 192934 - RNA, 63 nt, hsa; identical to SEQ ID NO: 103542

SEQ ID NO: 192935 - RNA, 63 nt, hsa; identical to SEQ ID NO: 103543

SEQ ID NO: 192936 - RNA, 63 nt, hsa; identical to SEQ ID NO: 103544

SEQ ID NO: 192937 - RNA, 63 nt, hsa; identical to SEQ ID NO: 103545

SEQ ID NO: 192938 - RNA, 63 nt, hsa; identical to SEQ ID NO: 103546

SEQ ID NO: 192939 - RNA, 63 nt, hsa; identical to SEQ ID NO: 103547

SEQ ID NO: 192940 - RNA, 63 nt, hsa; identical to SEQ ID NO: 103548

SEQ ID NO: 192941 - RNA, 63 nt, hsa; identical to SEQ ID NO: 103549

SEQ ID NO: 192942 - RNA, 63 nt, hsa; identical to SEQ ID NO: 103550

SEQ ID NO: 192943 - RNA, 63 nt, hsa; identical to SEQ ID NO: 103551

SEQ ID NO: 192944 - RNA, 63 nt, hsa; identical to SEQ ID NO: 103552

SEQ ID NO: 192945 - RNA, 63 nt, hsa; identical to SEQ ID NO: 103553

SEQ ID NO: 192946 - RNA, 63 nt, hsa; identical to SEQ ID NO: 103554

SEQ ID NO: 192947 - RNA, 63 nt, hsa; identical to SEQ ID NO: 103555

SEQ ID NO: 192948 - RNA, 63 nt, hsa; identical to SEQ ID NO: 103556

SEQ ID NO: 192949 - RNA, 63 nt, hsa; identical to SEQ ID NO: 103557

SEQ ID NO: 192950 - RNA, 63 nt, hsa; identical to SEQ ID NO: 103558

SEQ ID NO: 192951 - RNA, 63 nt, hsa; identical to SEQ ID NO: 103559

SEQ ID NO: 192952 - RNA, 63 nt, hsa; identical to SEQ ID NO: 103560

SEQ ID NO: 192953 - RNA, 63 nt, hsa; identical to SEQ ID NO: 103561

SEQ ID NO: 192954 - RNA, 63 nt, hsa; identical to SEQ ID NO: 103562

SEQ ID NO: 192955 - RNA, 63 nt, hsa; identical to SEQ ID NO: 103563

SEQ ID NO: 192956 - RNA, 63 nt, hsa; identical to SEQ ID NO: 103564

SEQ ID NO: 192957 - RNA, 63 nt, hsa; identical to SEQ ID NO: 103565

SEQ ID NO: 192958 - RNA, 63 nt, hsa; identical to SEQ ID NO: 103566

SEQ ID NO: 192959 - RNA, 63 nt, hsa; identical to SEQ ID NO: 103567

SEQ ID NO: 192960 - RNA, 63 nt, hsa; identical to SEQ ID NO: 103568

SEQ ID NO: 192961 - RNA, 63 nt, hsa; identical to SEQ ID NO: 103569

SEQ ID NO: 192962 - RNA, 63 nt, hsa; identical to SEQ ID NO: 103570

SEQ ID NO: 192963 - RNA, 63 nt, hsa; identical to SEQ ID NO: 103571

SEQ ID NO: 192964 - RNA, 63 nt, hsa; identical to SEQ ID NO: 103572

SEQ ID NO: 192965 - RNA, 63 nt, hsa; identical to SEQ ID NO: 103573

SEQ ID NO: 192966 - RNA, 63 nt, hsa; identical to SEQ ID NO: 103574

SEQ ID NO: 192967 - RNA, 63 nt, hsa; identical to SEQ ID NO: 103575

SEQ ID NO: 192968 - RNA, 63 nt, hsa; identical to SEQ ID NO: 103576

SEQ ID NO: 192969 - RNA, 63 nt, hsa; identical to SEQ ID NO: 103577

SEQ ID NO: 192970 - RNA, 63 nt, hsa; identical to SEQ ID NO: 103578

SEQ ID NO: 192971 - RNA, 63 nt, hsa; identical to SEQ ID NO: 103579

SEQ ID NO: 192972 - RNA, 63 nt, hsa; identical to SEQ ID NO: 103580

SEQ ID NO: 192973 - RNA, 63 nt, hsa; identical to SEQ ID NO: 103581

SEQ ID NO: 192974 - RNA, 63 nt, hsa; identical to SEQ ID NO: 103582

SEQ ID NO: 192975 - RNA, 63 nt, hsa; identical to SEQ ID NO: 103583

SEQ ID NO: 192976 - RNA, 63 nt, hsa; identical to SEQ ID NO: 103584

SEQ ID NO: 192977 - RNA, 63 nt, hsa; identical to SEQ ID NO: 103585

SEQ ID NO: 192978 - RNA, 63 nt, hsa; identical to SEQ ID NO: 103586

SEQ ID NO: 192979 - RNA, 63 nt, hsa; identical to SEQ ID NO: 103587

SEQ ID NO: 192980 - RNA, 63 nt, hsa; identical to SEQ ID NO: 103588

SEQ ID NO: 192981 - RNA, 63 nt, hsa; identical to SEQ ID NO: 103589

SEQ ID NO: 192982 - RNA, 63 nt, hsa; identical to SEQ ID NO: 103590

SEQ ID NO: 192983 - RNA, 59 nt, hsa; identical to SEQ ID NO: 103372

SEQ ID NO: 192984 - RNA, 63 nt, hsa; identical to SEQ ID NO: 103592

SEQ ID NO: 192985 - RNA, 63 nt, hsa; identical to SEQ ID NO: 103593

SEQ ID NO: 192986 - RNA, 63 nt, hsa; identical to SEQ ID NO: 103594

SEQ ID NO: 192987 - RNA, 63 nt, hsa; identical to SEQ ID NO: 103595

SEQ ID NO: 192988 - RNA, 63 nt, hsa; identical to SEQ ID NO: 103596

SEQ ID NO: 192989 - RNA, 63 nt, hsa; identical to SEQ ID NO: 103597

SEQ ID NO: 192990 - RNA, 63 nt, hsa; identical to SEQ ID NO: 103598

SEQ ID NO: 192991 - RNA, 63 nt, hsa; identical to SEQ ID NO: 103599

SEQ ID NO: 192992 - RNA, 63 nt, hsa; identical to SEQ ID NO: 103600

SEQ ID NO: 192993 - RNA, 63 nt, hsa; identical to SEQ ID NO: 103601

SEQ ID NO: 192994 - RNA, 63 nt, hsa; identical to SEQ ID NO: 103602

SEQ ID NO: 192995 - RNA, 63 nt, hsa; identical to SEQ ID NO: 103603

SEQ ID NO: 192996 - RNA, 63 nt, hsa; identical to SEQ ID NO: 103604

SEQ ID NO: 192997 - RNA, 63 nt, hsa; identical to SEQ ID NO: 103605

SEQ ID NO: 192998 - RNA, 63 nt, hsa; identical to SEQ ID NO: 103606

SEQ ID NO: 192999 - RNA, 63 nt, hsa; identical to SEQ ID NO: 103607

SEQ ID NO: 193000 - RNA, 63 nt, hsa; identical to SEQ ID NO: 103608

SEQ ID NO: 193001 - RNA, 63 nt, hsa; identical to SEQ ID NO: 103609

SEQ ID NO: 193002 - RNA, 63 nt, hsa; identical to SEQ ID NO: 103610

SEQ ID NO: 193003 - RNA, 63 nt, hsa; identical to SEQ ID NO: 103611

SEQ ID NO: 193004 - RNA, 61 nt, hsa; identical to SEQ ID NO: 103612

SEQ ID NO: 193005 - RNA, 63 nt, hsa; identical to SEQ ID NO: 103613

SEQ ID NO: 193006 - RNA, 63 nt, hsa; identical to SEQ ID NO: 103614

SEQ ID NO: 193007 - RNA, 63 nt, hsa; identical to SEQ ID NO: 103615

SEQ ID NO: 193008 - RNA, 63 nt, hsa; identical to SEQ ID NO: 103616

SEQ ID NO: 193009 - RNA, 63 nt, hsa; identical to SEQ ID NO: 103617

SEQ ID NO: 193010 - RNA, 63 nt, hsa; identical to SEQ ID NO: 103618

SEQ ID NO: 193011 - RNA, 63 nt, hsa; identical to SEQ ID NO: 103619

SEQ ID NO: 193012 - RNA, 63 nt, hsa; identical to SEQ ID NO: 103620

SEQ ID NO: 193013 - RNA, 63 nt, hsa; identical to SEQ ID NO: 103621

SEQ ID NO: 193014 - RNA, 63 nt, hsa; identical to SEQ ID NO: 103622

SEQ ID NO: 193015 - RNA, 63 nt, hsa; identical to SEQ ID NO: 103623

SEQ ID NO: 193016 - RNA, 63 nt, hsa; identical to SEQ ID NO: 103624

SEQ ID NO: 193017 - RNA, 63 nt, hsa; identical to SEQ ID NO: 103625

SEQ ID NO: 193018 - RNA, 63 nt, hsa; identical to SEQ ID NO: 103626

SEQ ID NO: 193019 - RNA, 63 nt, hsa; identical to SEQ ID NO: 103627

SEQ ID NO: 193020 - RNA, 63 nt, hsa; identical to SEQ ID NO: 103628

SEQ ID NO: 193021 - RNA, 63 nt, hsa; identical to SEQ ID NO: 103629

SEQ ID NO: 193022 - RNA, 63 nt, hsa; identical to SEQ ID NO: 103630

SEQ ID NO: 193023 - RNA, 63 nt, hsa; identical to SEQ ID NO: 103631

SEQ ID NO: 193024 - RNA, 63 nt, hsa; identical to SEQ ID NO: 103632

SEQ ID NO: 193025 - RNA, 63 nt, hsa; identical to SEQ ID NO: 103633

SEQ ID NO: 193026 - RNA, 63 nt, hsa; identical to SEQ ID NO: 103634

SEQ ID NO: 193027 - RNA, 63 nt, hsa; identical to SEQ ID NO: 103635

SEQ ID NO: 193028 - RNA, 63 nt, hsa; identical to SEQ ID NO: 103636

SEQ ID NO: 193029 - RNA, 63 nt, hsa; identical to SEQ ID NO: 103637

SEQ ID NO: 193030 - RNA, 63 nt, hsa; identical to SEQ ID NO: 103638

SEQ ID NO: 193031 - RNA, 63 nt, hsa; identical to SEQ ID NO: 103639

SEQ ID NO: 193032 - RNA, 63 nt, hsa; identical to SEQ ID NO: 103640

SEQ ID NO: 193033 - RNA, 63 nt, hsa; identical to SEQ ID NO: 103641

SEQ ID NO: 193034 - RNA, 63 nt, hsa; identical to SEQ ID NO: 103642

SEQ ID NO: 193035 - RNA, 63 nt, hsa; identical to SEQ ID NO: 103643

SEQ ID NO: 193036 - RNA, 63 nt, hsa; identical to SEQ ID NO: 103644

SEQ ID NO: 193037 - RNA, 63 nt, hsa; identical to SEQ ID NO: 103645

SEQ ID NO: 193038 - RNA, 63 nt, hsa; identical to SEQ ID NO: 103646

SEQ ID NO: 193039 - RNA, 63 nt, hsa; identical to SEQ ID NO: 103647

SEQ ID NO: 193040 - RNA, 63 nt, hsa; identical to SEQ ID NO: 103648

SEQ ID NO: 193041 - RNA, 63 nt, hsa; identical to SEQ ID NO: 103649

SEQ ID NO: 193042 - RNA, 63 nt, hsa; identical to SEQ ID NO: 103650

SEQ ID NO: 193043 - RNA, 63 nt, hsa; identical to SEQ ID NO: 103651

SEQ ID NO: 193044 - RNA, 63 nt, hsa; identical to SEQ ID NO: 103652

SEQ ID NO: 193045 - RNA, 63 nt, hsa; identical to SEQ ID NO: 103653

SEQ ID NO: 193046 - RNA, 63 nt, hsa; identical to SEQ ID NO: 103654

SEQ ID NO: 193047 - RNA, 63 nt, hsa; identical to SEQ ID NO: 103655

SEQ ID NO: 193048 - RNA, 63 nt, hsa; identical to SEQ ID NO: 103656

SEQ ID NO: 193049 - RNA, 63 nt, hsa; identical to SEQ ID NO: 103657

SEQ ID NO: 193050 - RNA, 63 nt, hsa; identical to SEQ ID NO: 103658

SEQ ID NO: 193051 - RNA, 63 nt, hsa; identical to SEQ ID NO: 103659

SEQ ID NO: 193052 - RNA, 63 nt, hsa; identical to SEQ ID NO: 103660

SEQ ID NO: 193053 - RNA, 63 nt, hsa; identical to SEQ ID NO: 103661

SEQ ID NO: 193054 - RNA, 63 nt, hsa; identical to SEQ ID NO: 103662

SEQ ID NO: 193055 - RNA, 63 nt, hsa; identical to SEQ ID NO: 103663

SEQ ID NO: 193056 - RNA, 63 nt, hsa; identical to SEQ ID NO: 103664

SEQ ID NO: 193057 - RNA, 63 nt, hsa; identical to SEQ ID NO: 103665

SEQ ID NO: 193058 - RNA, 63 nt, hsa; identical to SEQ ID NO: 103666

SEQ ID NO: 193059 - RNA, 63 nt, hsa; identical to SEQ ID NO: 103667

SEQ ID NO: 193060 - RNA, 63 nt, hsa; identical to SEQ ID NO: 103668

SEQ ID NO: 193061 - RNA, 63 nt, hsa; identical to SEQ ID NO: 103669

SEQ ID NO: 193062 - RNA, 63 nt, hsa; identical to SEQ ID NO: 103670

SEQ ID NO: 193063 - RNA, 63 nt, hsa; identical to SEQ ID NO: 103671

SEQ ID NO: 193064 - RNA, 63 nt, hsa; identical to SEQ ID NO: 103672

SEQ ID NO: 193065 - RNA, 63 nt, hsa; identical to SEQ ID NO: 103673

SEQ ID NO: 193066 - RNA, 63 nt, hsa; identical to SEQ ID NO: 103674

SEQ ID NO: 193067 - RNA, 63 nt, hsa; identical to SEQ ID NO: 103675

SEQ ID NO: 193068 - RNA, 63 nt, hsa; identical to SEQ ID NO: 103676

SEQ ID NO: 193069 - RNA, 63 nt, hsa; identical to SEQ ID NO: 103677

SEQ ID NO: 193070 - RNA, 63 nt, hsa; identical to SEQ ID NO: 103678

SEQ ID NO: 193071 - RNA, 63 nt, hsa; identical to SEQ ID NO: 103679

SEQ ID NO: 193072 - RNA, 63 nt, hsa; identical to SEQ ID NO: 103680

SEQ ID NO: 193073 - RNA, 63 nt, hsa; identical to SEQ ID NO: 103681

SEQ ID NO: 193074 - RNA, 63 nt, hsa; identical to SEQ ID NO: 103682

SEQ ID NO: 193075 - RNA, 63 nt, hsa; identical to SEQ ID NO: 103683

SEQ ID NO: 193076 - RNA, 63 nt, hsa; identical to SEQ ID NO: 103684

SEQ ID NO: 193077 - RNA, 63 nt, hsa; identical to SEQ ID NO: 103685

SEQ ID NO: 193078 - RNA, 63 nt, hsa; identical to SEQ ID NO: 103686

SEQ ID NO: 193079 - RNA, 63 nt, hsa; identical to SEQ ID NO: 103687

SEQ ID NO: 193080 - RNA, 63 nt, hsa; identical to SEQ ID NO: 103688

SEQ ID NO: 193081 - RNA, 63 nt, hsa; identical to SEQ ID NO: 103689

SEQ ID NO: 193082 - RNA, 63 nt, hsa; identical to SEQ ID NO: 103690

SEQ ID NO: 193083 - RNA, 63 nt, hsa; identical to SEQ ID NO: 103691

SEQ ID NO: 193084 - RNA, 63 nt, hsa; identical to SEQ ID NO: 103692

SEQ ID NO: 193085 - RNA, 63 nt, hsa; identical to SEQ ID NO: 103693

SEQ ID NO: 193086 - RNA, 63 nt, hsa; identical to SEQ ID NO: 103694

SEQ ID NO: 193087 - RNA, 63 nt, hsa; identical to SEQ ID NO: 103695

SEQ ID NO: 193088 - RNA, 63 nt, hsa; identical to SEQ ID NO: 103696

SEQ ID NO: 193089 - RNA, 63 nt, hsa; identical to SEQ ID NO: 103697

SEQ ID NO: 193090 - RNA, 63 nt, hsa; identical to SEQ ID NO: 103698

SEQ ID NO: 193091 - RNA, 63 nt, hsa; identical to SEQ ID NO: 103699

SEQ ID NO: 193092 - RNA, 63 nt, hsa; identical to SEQ ID NO: 103700

SEQ ID NO: 193093 - RNA, 63 nt, hsa; identical to SEQ ID NO: 103701

SEQ ID NO: 193094 - RNA, 63 nt, hsa; identical to SEQ ID NO: 103702

SEQ ID NO: 193095 - RNA, 63 nt, hsa; identical to SEQ ID NO: 103703

SEQ ID NO: 193096 - RNA, 63 nt, hsa; identical to SEQ ID NO: 103704

SEQ ID NO: 193097 - RNA, 63 nt, hsa; identical to SEQ ID NO: 103705

SEQ ID NO: 193098 - RNA, 63 nt, hsa; identical to SEQ ID NO: 103706

SEQ ID NO: 193099 - RNA, 63 nt, hsa; identical to SEQ ID NO: 103707

SEQ ID NO: 193100 - RNA, 63 nt, hsa; identical to SEQ ID NO: 103708

SEQ ID NO: 193101 - RNA, 63 nt, hsa; identical to SEQ ID NO: 103709

SEQ ID NO: 193102 - RNA, 63 nt, hsa; identical to SEQ ID NO: 103710

SEQ ID NO: 193103 - RNA, 63 nt, hsa; identical to SEQ ID NO: 103711

SEQ ID NO: 193104 - RNA, 63 nt, hsa; identical to SEQ ID NO: 103712

SEQ ID NO: 193105 - RNA, 63 nt, hsa; identical to SEQ ID NO: 103713

SEQ ID NO: 193106 - RNA, 63 nt, hsa; identical to SEQ ID NO: 103714

SEQ ID NO: 193107 - RNA, 63 nt, hsa; identical to SEQ ID NO: 103715

SEQ ID NO: 193108 - RNA, 63 nt, hsa; identical to SEQ ID NO: 103716

SEQ ID NO: 193109 - RNA, 63 nt, hsa; identical to SEQ ID NO: 103717

SEQ ID NO: 193110 - RNA, 63 nt, hsa; identical to SEQ ID NO: 103718

SEQ ID NO: 193111 - RNA, 63 nt, hsa; identical to SEQ ID NO: 103719

SEQ ID NO: 193112 - RNA, 63 nt, hsa; identical to SEQ ID NO: 103720

SEQ ID NO: 193113 - RNA, 63 nt, hsa; identical to SEQ ID NO: 103721

SEQ ID NO: 193114 - RNA, 63 nt, hsa; identical to SEQ ID NO: 103722

SEQ ID NO: 193115 - RNA, 63 nt, hsa; identical to SEQ ID NO: 103723

SEQ ID NO: 193116 - RNA, 63 nt, hsa; identical to SEQ ID NO: 103724

SEQ ID NO: 193117 - RNA, 63 nt, hsa; identical to SEQ ID NO: 103725

SEQ ID NO: 193118 - RNA, 63 nt, hsa; identical to SEQ ID NO: 103726

SEQ ID NO: 193119 - RNA, 64 nt, hsa
auauggauugaaucugguuggucauuuccaccaggaaucagaggcagcuguuaccagguuucgg

SEQ ID NO: 193120 - RNA, 64 nt, hsa
ucccuccacuguccaggcugucucaggaggaggugaaucagagcuagucugucaccuuuccaau

SEQ ID NO: 193121 - RNA, 64 nt, hsa
ucucaaauguagcauuaguauuucuaagugaacagaaucagaaguuaauuuuuaaguguuugua

SEQ ID NO: 193122 - RNA, 64 nt, hsa
caugauauuaagcaucuaggaucacgugcucauugaaucagaaaaaaaguggaagguuugguuu

SEQ ID NO: 193123 - RNA, 64 nt, hsa
ggagaaggaaggagacucaccucugccucaaugugaaucagacccuaccccaccacgauguggc

SEQ ID NO: 193124 - RNA, 64 nt, hsa
accugcauccguaguucccugaaaacccagagaggaaucagacuucacacugcaagagccuugg

SEQ ID NO: 193125 - RNA, 64 nt, hsa
gccuaaaucuuggguuuauuagaugaaguuuacugaaucagaggaaucagacagaggaggauag

SEQ ID NO: 193126 - RNA, 64 nt, hsa
uuggguuuauuagaugaaguuuacugaaucagaggaaucagacagaggaggauagcucuuucca

SEQ ID NO: 193127 - RNA, 64 nt, hsa
guguuuacuuucaauuccuaggauaugugaucgugaaucagaucacauauaaaaagucuggauu

SEQ ID NO: 193128 - RNA, 64 nt, hsa
acuaauaauacuuaccaacccacuuuguggauaugaaucagaagaguuuguuuauucuuuagug

SEQ ID NO: 193129 - RNA, 64 nt, hsa
auuuuguuuucaaaacuagaauaaucucaccacagaaucagaauuuucuaccguuccacaccca

SEQ ID NO: 193130 - RNA, 64 nt, hsa
ugcuccuggaaacccauuuagagccaagucugaagaaucagaggcaacuucaugguucuccaaa

SEQ ID NO: 193131 - RNA, 64 nt, hsa
cgucacuuaauuccugaauguuucagagaaacaggaaucagaaaauagcagauaucauguagga

SEQ ID NO: 193132 - RNA, 64 nt, hsa
agaaccccguuggggcagauguuacugaaccugugaaucagacgccaggagugagggcugggga

SEQ ID NO: 193133 - RNA, 64 nt, hsa
uuauuagggacucccacccucuucaaguuauaaauauccccagaaccuuggcuacgugcccgga

SEQ ID NO: 193134 - RNA, 64 nt, hsa
uaaaauggaauccuggaggguccccuagaggcaguauccccaguggaaagagcgugggccucaa

SEQ ID NO: 193135 - RNA, 64 nt, hsa
uauaagcuaaguugaggguucagagggagacaaauauccccaagugaaauauguugcgguagag

SEQ ID NO: 193136 - RNA, 64 nt, hsa
caguaggaaacauaaagaaacaauguccccuacauauccccaugacuacauaauccaucaucgu

SEQ ID NO: 193137 - RNA, 64 nt, hsa
uaaucauuauccccaacccuaugagguugguuauuauccccauuuuacagaugaggaaacugaa

SEQ ID NO: 193138 - RNA, 64 nt, hsa
uaaguguuuuucauguauuaucguuuuuaaucauuauccccaacccuaugagguugguuauuau

SEQ ID NO: 193139 - RNA, 64 nt, hsa
cauaaaacaacucacauuguuggaguuaacuaauuauccccauuucaugguuuucaguggcaac

SEQ ID NO: 193140 - RNA, 64 nt, hsa
aaauggacauucuuaccuacuccuccuagcccccuauccccaguaacagugaucccuuuucuua

SEQ ID NO: 193141 - RNA, 64 nt, hsa
accccucccacaaccccuguaccucccaccccuguauccccaccccuccacccaccccucuccc

SEQ ID NO: 193142 - RNA, 64 nt, hsa
gggggcagcugccccaucccucccccaaccccuguauccccaccccguacucccaccccuccca

SEQ ID NO: 193143 - RNA, 64 nt, hsa
aacuucuuucugggggauuggggugggcaguaccuauccccaguccccuccuagcuugacuuua

SEQ ID NO: 193144 - RNA, 64 nt, hsa
cucacaggccccaaacuaccagccguaucuagcauauccccacccuccacccacuaccuccucc

SEQ ID NO: 193145 - RNA, 64 nt, hsa
gaugacucugcacucucauugucaagguuagauauauccccaguugcaaaacagccagacuuga

SEQ ID NO: 193146 - RNA, 64 nt, hsa
aaagcaaugaacugcuugcuuagagaagcaucacuauccccauugagaaaaauguguggcaaga

SEQ ID NO: 193147 - RNA, 64 nt, hsa
ucgaacccagagauuuuugagggaugaacggguagacaaggacugagauugccucugacuuccu

SEQ ID NO: 193148 - RNA, 64 nt, hsa
gccugacaaugguaccuauuagggaugagauacagacaaggauagcuaucugggacauuauugg

SEQ ID NO: 193149 - RNA, 64 nt, hsa
ggacgugguuuuagagucuaccuaauauguuaaggacaaggaaaccucugagucuaccuaauau

SEQ ID NO: 193150 - RNA, 64 nt, hsa
caaggaaaccucugagucuaccuaauauguuaaggacaaggaaaccucuggacagugguauauu

SEQ ID NO: 193151 - RNA, 64 nt, hsa
ucccugaacuuaagauagccacaaucagaaaaaggacaaggacaugagacaguggugauggcca

SEQ ID NO: 193152 - RNA, 64 nt, hsa
gaccguuccuaggaugggacagugggucaggcaggacaaggagaaagcagggcagaaugaugcc

SEQ ID NO: 193153 - RNA, 64 nt, hsa
aaggagcagggcuuggagcucgggugguggagaugacaaggacacuguggggucugggucccca

SEQ ID NO: 193154 - RNA, 64 nt, hsa
gcaccccauauuauuuccaaaaauaucuuggacagacaaggaccaaaaugccaaaaucucagcg

SEQ ID NO: 193155 - RNA, 64 nt, hsa
cccaggaaacagcaugugguucagagaaaagagcgacaaggaaaaguuaggacuccugaggucc

SEQ ID NO: 193156 - RNA, 64 nt, hsa
ugagcgggagcgcagagagcggagccgggagcgagacaaggagcgagaacggcgacgcucccgc

SEQ ID NO: 193157 - RNA, 64 nt, hsa
cucccgggaccggcggaggcgcucacggagucgcgacaaggaggagcggaggcgcuccagggag

SEQ ID NO: 193158 - RNA, 64 nt, hsa
ggaggagcggaggcgcuccagggagcggagcaaggacaaggaccgggaccggaagcggcgaagc

SEQ ID NO: 193159 - RNA, 64 nt, hsa
acaggagaccguugcuccagugcaugucugcugggacaaggauuccuggccucgaagcccuggg

SEQ ID NO: 193160 - RNA, 64 nt, hsa
gccuuugggaccauuaguccauuuccauuuuacagacaaggaaaucaagacccagcuuggggga

SEQ ID NO: 193161 - RNA, 64 nt, hsa
ccaaacuuaaccuuggugggguuuggauuugauagccaauuaguucugugcugguugcaaagaa

SEQ ID NO: 193162 - RNA, 64 nt, hsa
acugguuugggcagaauauuaaacuuauuuuguugccaauuauuguuuaccgaguauaauguug

SEQ ID NO: 193163 - RNA, 64 nt, hsa
ucucuuuaccuccuuggccauuuucauguucucugccaauuacuauaggcagucuucauuuugc

SEQ ID NO: 193164 - RNA, 64 nt, hsa
aguaauuuuuuuuuaaauugcaaauguaauuuuugccaauuagagaaaccaaccggugucagua

SEQ ID NO: 193165 - RNA, 64 nt, hsa
uuuucauaguaagugcgaagacugagccagauuggccaauuaaaaacgaaaaccugacuagguu

SEQ ID NO: 193166 - RNA, 64 nt, hsa
aauuaaaaacgaaaaccugacuagguucuguagagccaauuagacuugaaauacguuuguguuu

SEQ ID NO: 193167 - RNA, 64 nt, hsa
caccuccggugucaaaaggcugucaugggguugugccaauuaauuaccaaacauugagccugca

SEQ ID NO: 193168 - RNA, 64 nt, hsa
gagugggaguguugcccccaggagccuuaucucagccaauuaccuuucuugacaguaggagcgg

SEQ ID NO: 193169 - RNA, 64 nt, hsa
agugcuaugcuuccuauagccuggagaacugugagccaauuauaccucuuuucuuauaaauuac

SEQ ID NO: 193170 - RNA, 64 nt, hsa
uuguaguuguccuuuacguaacuacuccuuuacugccaauuaacuaucaccauaaaaguaauaa

SEQ ID NO: 193171 - RNA, 64 nt, hsa
ucuucuuuuguuuagccaagaaaacauucuuaguuggaaacaggugguaaaguaguuuggccug

SEQ ID NO: 193172 - RNA, 64 nt, hsa
ucauagaaacaaagucucagauauuuuaguucuuuggaaacaaaugcuguaauucaaaagcauu

SEQ ID NO: 193173 - RNA, 64 nt, hsa
uauuguuuuauaagccugcuuuaccuccccgucuuggaaacaaguuuuaguuuauugcuuugga

SEQ ID NO: 193174 - RNA, 64 nt, hsa
gaaaguaacaaccaugcuaagauggcaaacacacuggaaacaauugggccacuuggcuuucuuu

SEQ ID NO: 193175 - RNA, 64 nt, hsa
ucaauuauauacuucugaauggcaccuuacuuuuuggaaacaaaucuucuguuauuuacaaaau

SEQ ID NO: 193176 - RNA, 64 nt, hsa
auuggaaaauagaaauugcaaauacauacauguauggaaacauauucagauugggaaaaacaau

SEQ ID NO: 193177 - RNA, 64 nt, hsa
gguacaagaugugguuagaaacauuucuuuguucuggaaacaaaguacuguugaaaccagcuug

SEQ ID NO: 193178 - RNA, 64 nt, hsa
gaaaaguuuucuuaucuucugugcuuuuggucccuggaaacaaauccgccuauguaugaagcua

SEQ ID NO: 193179 - RNA, 64 nt, hsa
aguuugauggaaugaaucaccuggguggggaccuuggaaacaaguuuguccguccacucuacaa

SEQ ID NO: 193180 - RNA, 64 nt, hsa
auggaaaucuaugaauuauugcaaauuguaaugcuggaaacaaaaaauaaauccuugguuaaag

SEQ ID NO: 193181 - RNA, 64 nt, hsa
ugguuguuauugugcuguugacaugaauagaccauggaaacauuuucaucauuauuauucagcc

SEQ ID NO: 193182 - RNA, 64 nt, hsa
ccucccauuuuaacuaucuacuguggccuuuuuauggaaacagagcaagaucaaugaaggcuaa

SEQ ID NO: 193183 - RNA, 64 nt, hsa
aagaguaucuucauuauucucauuuucucugaguuggaaacaaaaacaugaaggacuccaacua

SEQ ID NO: 193184 - RNA, 64 nt, hsa
uuuacuuuuuuuguacacuuuuucagauuauuucuggaaacauaucaauauaauuacaguguuu

SEQ ID NO: 193185 - RNA, 64 nt, hsa
uaaggguugggggaaagcauggacaaaacaucacuggaaacaaaggcuguaaccacagcaacag

SEQ ID NO: 193186 - RNA, 64 nt, hsa
caacuuuuuauuuagaacugugagaccgguauuuuggaaacauuucaaaggaaacauaugaauu

SEQ ID NO: 193187 - RNA, 64 nt, hsa
acccggcccacgcgugcugcagauguggggagucuggaaacacccggcccacgcgugcugcaga

SEQ ID NO: 193188 - RNA, 64 nt, hsa
acccggcccacgcgugcugcagauguggggagccuggaaacacccggcccacgcgugcugcaga

SEQ ID NO: 193189 - RNA, 64 nt, hsa; identical to SEQ ID NO: 193188

SEQ ID NO: 193190 - RNA, 64 nt, hsa
cgaggcagaguuaagaccugugacguggggagccuggaaacacccggcccacgcgugcugcaga

SEQ ID NO: 193191 - RNA, 64 nt, hsa
guuuauguucucagcagccagaguggaaacagaguggaaacacauggagcaucagguagaauuc

SEQ ID NO: 193192 - RNA, 64 nt, hsa
ggcugggaauaguuuauguucucagcagccagaguggaaacagaguggaaacacauggagcauc

SEQ ID NO: 193193 - RNA, 64 nt, hsa
ugcaggccuucugcaaaucagugcuggccugggcuggaaacagcucugugugugaaggugagga

SEQ ID NO: 193194 - RNA, 64 nt, hsa
cagccguaggggaccccagaccccuugguuuccuuggaaacaacauaccucuucccccuuaucc

SEQ ID NO: 193195 - RNA, 64 nt, hsa
aacugugccuggacccucccucuuggugggucuguggaaacauaagcgguuuuuuuaaugggcc

SEQ ID NO: 193196 - RNA, 64 nt, hsa
cuaggaaacgguucaugugucacuuuucaggauguggaaacacugagccauacacccuccauug

SEQ ID NO: 193197 - RNA, 64 nt, hsa
ggugacccaacauccaguucuccggcucucaccauggaaacaaacugucccuguccccaggccc

SEQ ID NO: 193198 - RNA, 64 nt, hsa
cuccugaagacuggccacgccuccugagaccacuuggaaacagaccaacugcccccguggucgc

SEQ ID NO: 193199 - RNA, 64 nt, hsa
uauuugaggggagagaaauaucuacagguauauauggaaacaaauaauguggucugcuuuauaa

SEQ ID NO: 193200 - RNA, 64 nt, hsa
uuacuaagaaaggguguaggacacauuagccuucuggaaacaaguagaagccaucaccuggccc

SEQ ID NO: 193201 - RNA, 64 nt, hsa
uucagcauuguacuggaagugcuaucuaaugcagugauaccaaaaaaaaaggaaauaaaaugca

SEQ ID NO: 193202 - RNA, 64 nt, hsa
ugaugugcauuuuucgagauacuuaagguagaaaugauaccaagucuguacugucucuuucaga

SEQ ID NO: 193203 - RNA, 64 nt, hsa
uucaguuacucuuaauucuuuauaaaacuuuaaaugauaccacauauuuguuuguuuaaaaugg

SEQ ID NO: 193204 - RNA, 64 nt, hsa
ggaaaaaagugaugugacagggagugaagacacuugauaccagacucugggagauacucugcaa

SEQ ID NO: 193205 - RNA, 64 nt, hsa
uggugguuuggcuucuguucuuauucuugaguuuugauaccacgcagaccuuggguggggagag

SEQ ID NO: 193206 - RNA, 64 nt, hsa
aucagagucuagugguugugcuuuuaagaugcucugauaccauuggguuaaggggcagauuggc

SEQ ID NO: 193207 - RNA, 64 nt, hsa
agugggaaaugggucauuuucaaaggggcaacagugauaccaucccugcacuccuggguccugc

SEQ ID NO: 193208 - RNA, 64 nt, hsa
aagugcugcauaugccccugugcccagugguugaugauaccaccaccaccugccuacccauggg

SEQ ID NO: 193209 - RNA, 64 nt, hsa
uuguaugucuuuugagauccugaguucauccccugugaaucagagugcacaagcaccucuccug

SEQ ID NO: 193210 - RNA, 64 nt, hsa
agaggagauuaaccucuuguuuuuuuaccaccuggugaaucagccauaacgcacacacacgcca

SEQ ID NO: 193211 - RNA, 64 nt, hsa; identical to SEQ ID NO: 101915

SEQ ID NO: 193212 - RNA, 64 nt, hsa; identical to SEQ ID NO: 101916

SEQ ID NO: 193213 - RNA, 64 nt, hsa; identical to SEQ ID NO: 101917

SEQ ID NO: 193214 - RNA, 64 nt, hsa; identical to SEQ ID NO: 101918

SEQ ID NO: 193215 - RNA, 64 nt, hsa; identical to SEQ ID NO: 101919

SEQ ID NO: 193216 - RNA, 64 nt, hsa; identical to SEQ ID NO: 101920

SEQ ID NO: 193217 - RNA, 64 nt, hsa; identical to SEQ ID NO: 101921

SEQ ID NO: 193218 - RNA, 64 nt, hsa; identical to SEQ ID NO: 101922

SEQ ID NO: 193219 - RNA, 64 nt, hsa; identical to SEQ ID NO: 101923

SEQ ID NO: 193220 - RNA, 64 nt, hsa; identical to SEQ ID NO: 101924

SEQ ID NO: 193221 - RNA, 51 nt, hsa; identical to SEQ ID NO: 101925

SEQ ID NO: 193222 - RNA, 64 nt, hsa; identical to SEQ ID NO: 101926

SEQ ID NO: 193223 - RNA, 64 nt, hsa; identical to SEQ ID NO: 101927

SEQ ID NO: 193224 - RNA, 64 nt, hsa; identical to SEQ ID NO: 101928

SEQ ID NO: 193225 - RNA, 64 nt, hsa; identical to SEQ ID NO: 161097

SEQ ID NO: 193226 - RNA, 64 nt, hsa; identical to SEQ ID NO: 161098

SEQ ID NO: 193227 - RNA, 64 nt, hsa; identical to SEQ ID NO: 161099

SEQ ID NO: 193228 - RNA, 64 nt, hsa; identical to SEQ ID NO: 161100

SEQ ID NO: 193229 - RNA, 64 nt, hsa; identical to SEQ ID NO: 161101

SEQ ID NO: 193230 - RNA, 64 nt, hsa; identical to SEQ ID NO: 161102

SEQ ID NO: 193231 - RNA, 64 nt, hsa; identical to SEQ ID NO: 161103

SEQ ID NO: 193232 - RNA, 64 nt, hsa; identical to SEQ ID NO: 161104

SEQ ID NO: 193233 - RNA, 64 nt, hsa; identical to SEQ ID NO: 161105

SEQ ID NO: 193234 - RNA, 64 nt, hsa; identical to SEQ ID NO: 161106

SEQ ID NO: 193235 - RNA, 64 nt, hsa; identical to SEQ ID NO: 161107

SEQ ID NO: 193236 - RNA, 64 nt, hsa; identical to SEQ ID NO: 161108

SEQ ID NO: 193237 - RNA, 64 nt, hsa; identical to SEQ ID NO: 161109

SEQ ID NO: 193238 - RNA, 64 nt, hsa; identical to SEQ ID NO: 161110

SEQ ID NO: 193239 - RNA, 64 nt, hsa; identical to SEQ ID NO: 161111

SEQ ID NO: 193240 - RNA, 64 nt, hsa; identical to SEQ ID NO: 161112

SEQ ID NO: 193241 - RNA, 64 nt, hsa; identical to SEQ ID NO: 161113

SEQ ID NO: 193242 - RNA, 64 nt, hsa; identical to SEQ ID NO: 161114

SEQ ID NO: 193243 - RNA, 64 nt, hsa; identical to SEQ ID NO: 161115

SEQ ID NO: 193244 - RNA, 64 nt, hsa; identical to SEQ ID NO: 161116

SEQ ID NO: 193245 - RNA, 64 nt, hsa; identical to SEQ ID NO: 161117

SEQ ID NO: 193246 - RNA, 64 nt, hsa; identical to SEQ ID NO: 161118

SEQ ID NO: 193247 - RNA, 64 nt, hsa; identical to SEQ ID NO: 161119

SEQ ID NO: 193248 - RNA, 64 nt, hsa; identical to SEQ ID NO: 161120

SEQ ID NO: 193249 - RNA, 64 nt, hsa; identical to SEQ ID NO: 161121

SEQ ID NO: 193250 - RNA, 64 nt, hsa; identical to SEQ ID NO: 161122

SEQ ID NO: 193251 - RNA, 64 nt, hsa; identical to SEQ ID NO: 161123

SEQ ID NO: 193252 - RNA, 64 nt, hsa; identical to SEQ ID NO: 161124

SEQ ID NO: 193253 - RNA, 64 nt, hsa; identical to SEQ ID NO: 161125

SEQ ID NO: 193254 - RNA, 64 nt, hsa; identical to SEQ ID NO: 161126

SEQ ID NO: 193255 - RNA, 64 nt, hsa; identical to SEQ ID NO: 161127

SEQ ID NO: 193256 - RNA, 64 nt, hsa; identical to SEQ ID NO: 161128

SEQ ID NO: 193257 - RNA, 64 nt, hsa; identical to SEQ ID NO: 161129

SEQ ID NO: 193258 - RNA, 64 nt, hsa; identical to SEQ ID NO: 161130

SEQ ID NO: 193259 - RNA, 64 nt, hsa; identical to SEQ ID NO: 161131

SEQ ID NO: 193260 - RNA, 64 nt, hsa; identical to SEQ ID NO: 161132

SEQ ID NO: 193261 - RNA, 64 nt, hsa; identical to SEQ ID NO: 161133

SEQ ID NO: 193262 - RNA, 64 nt, hsa; identical to SEQ ID NO: 161134

SEQ ID NO: 193263 - RNA, 64 nt, hsa; identical to SEQ ID NO: 161135

SEQ ID NO: 193264 - RNA, 64 nt, hsa; identical to SEQ ID NO: 161136

SEQ ID NO: 193265 - RNA, 64 nt, hsa; identical to SEQ ID NO: 161137

SEQ ID NO: 193266 - RNA, 64 nt, hsa; identical to SEQ ID NO: 161138

SEQ ID NO: 193267 - RNA, 64 nt, hsa; identical to SEQ ID NO: 161139

SEQ ID NO: 193268 - RNA, 64 nt, hsa; identical to SEQ ID NO: 161140

SEQ ID NO: 193269 - RNA, 64 nt, hsa; identical to SEQ ID NO: 161141

SEQ ID NO: 193270 - RNA, 64 nt, hsa; identical to SEQ ID NO: 161142

SEQ ID NO: 193271 - RNA, 64 nt, hsa; identical to SEQ ID NO: 161143

SEQ ID NO: 193272 - RNA, 64 nt, hsa
agaaguccacgugaaggcugggcuaaugcuccuggauauucauuuacgaccuuccucuauggcc

SEQ ID NO: 193273 - RNA, 64 nt, hsa
gucagaauaaagggagaucauagugaguuaauuugauauucauauccuggaaguauacauauuu

SEQ ID NO: 193274 - RNA, 64 nt, hsa
ucagccaacuguggcucuuaauuuauugcauaaugauauucacauccccucaguugcagugaau

SEQ ID NO: 193275 - RNA, 64 nt, hsa
cauuacuuguucguuauagacauggacguuaagagauauucaaaacucagaagcaucagcaaug

SEQ ID NO: 193276 - RNA, 64 nt, hsa
uuacuaacuuaucugucucuuauuugcacucauggauauucacaguaagcauuguuugacauau

SEQ ID NO: 193277 - RNA, 64 nt, hsa
ggcuauuuacacuguaaugaauuauaccauauaugauauucacucaguaauguuaauaaugaac

SEQ ID NO: 193278 - RNA, 64 nt, hsa
ugcuaacugaauaucauugcagcaacuagacuaagauauucaagaucucuuuauuggggauggg

SEQ ID NO: 193279 - RNA, 64 nt, hsa
uaccccccuucuugacuuuuucugauaauuagcugauauucaugguuguuuagcacacaguuca

SEQ ID NO: 193280 - RNA, 64 nt, hsa
uugcagccauaguaccuuuuugcguaauguuugggauauucaguagcccaggauugcuacaaaa

SEQ ID NO: 193281 - RNA, 64 nt, hsa
uuuuaaacauuacacuugagaucagucaugacuugauauucagguaaauuuucuuuuccaagaa

SEQ ID NO: 193282 - RNA, 64 nt, hsa
uucuguuacgaacucuaagagggcugaaacuucugauauucagguggaucaccugaauucucuc

SEQ ID NO: 193283 - RNA, 64 nt, hsa
ugaaccuucuauuucacuaccgcucccuguuuuagauauucagauuuaaaagguuuucaaagaa

SEQ ID NO: 193284 - RNA, 64 nt, hsa
uagucaaagcuauguucuuacaaaaaccccagacagcucagagcucagaaaauccuguggagug

SEQ ID NO: 193285 - RNA, 64 nt, hsa
agcuauguucuuacaaaaaccccagacagcucagagcucagaaaauccuguggaguggcugcuc

SEQ ID NO: 193286 - RNA, 64 nt, hsa
auaggaaaggggcccuauuuuccugcugcuucccagcucagaacauauacugaauggaauguau

SEQ ID NO: 193287 - RNA, 64 nt, hsa
uuuaguuucuguauguuuuaaucucauggggaugagcucagagaagcuccgugggccuguuucc

SEQ ID NO: 193288 - RNA, 64 nt, hsa
uggggcucggcuguggcccuggggucuccugcucagcucagaagagccuucuggagaggacagu

SEQ ID NO: 193289 - RNA, 64 nt, hsa
uacccgcccuugaaguauagccagccaagguuggagcucagaccgugucuagguuggggcucgg

SEQ ID NO: 193290 - RNA, 64 nt, hsa
uucccuuugggcuucggcuuggggagauggaucaagcucagagacuggcagugagagcccagaa

SEQ ID NO: 193291 - RNA, 64 nt, hsa
gcucccuggaugaauagaaugcaauucauucagaagcucagaagcuaagaauaagccuuugaaa

SEQ ID NO: 193292 - RNA, 64 nt, hsa
ccuggacaccacccugacgugaugccucuauugcagcucagaggcuuuauuuuuuccauuuuga

SEQ ID NO: 193293 - RNA, 64 nt, hsa
uguugccaccaguuauacuugacaauuuaguugaagcucagaaaguuauauucaucccucuuag

SEQ ID NO: 193294 - RNA, 64 nt, hsa
ggaaucuauguagacaaugggacguuaggcagagagcucagauggcccuuuuaagggggcucca

SEQ ID NO: 193295 - RNA, 64 nt, hsa
uccuuugagcauguaugugucugccucuaggaugagcucagagcgagagaugacacaaugccuc

SEQ ID NO: 193296 - RNA, 64 nt, hsa
gccagugcugcugacagaugcuuucagacuguagagcucagagaaagggagcggcagcuagagg

SEQ ID NO: 193297 - RNA, 64 nt, hsa
aaaaagaaauuugauugaaaauagaaacaucuacagcucagauacugaucucuuucuaaugggc

SEQ ID NO: 193298 - RNA, 64 nt, hsa
ucuggaguuguggugaggccaccaggcugaagucagcucagacccagaccucccugcuuaggcc

SEQ ID NO: 193299 - RNA, 64 nt, hsa
gacaaagggagccgagacccuggauggggcuuccagcucagaacccaucccucugguggguacc

SEQ ID NO: 193300 - RNA, 64 nt, hsa
guccccagaauggcuccacugggaguggaggaagagcucagaggcccaggugcagauaguucug

SEQ ID NO: 193301 - RNA, 64 nt, hsa
cccauagucgccagacuuucucauguucccaggaagcucagaaguauggcagcuaagaacacag

SEQ ID NO: 193302 - RNA, 64 nt, hsa
ccuggcuggcaggguagcuagaccucucacaugcagcucagagcucccaagagcucaaaagcag

SEQ ID NO: 193303 - RNA, 64 nt, hsa
uaugcccucuacuuacuaaacaagucacaagcccagcucagauucaagaaaagggugugaagua

SEQ ID NO: 193304 - RNA, 64 nt, hsa
caaaaaaccacccuguacgaaggccacaaagaacagcucagaugcacaaagauucacaccauac

SEQ ID NO: 193305 - RNA, 64 nt, hsa
ggggcugggaggggcugugaggggcuggcaccucagcucagaaaagguagcagcaaucccaaag

SEQ ID NO: 193306 - RNA, 64 nt, hsa
ggcccaggaagaggcccugguuuggggcugugccagcucagagcccuugaaccagaaccaacug

SEQ ID NO: 193307 - RNA, 64 nt, hsa
auauuucacaugugaagcggggacaaaaccaugcagcucagaggucccugugggggcuggggga

SEQ ID NO: 193308 - RNA, 64 nt, hsa
uuugaguugcaauugcuauuuucuucucagucccagcucagaucgaauuauauauccauauaua

SEQ ID NO: 193309 - RNA, 64 nt, hsa
ugccacccacgggggcuccucccugccgggguccagcucagaaccacgggggucugugccggca

SEQ ID NO: 193310 - RNA, 64 nt, hsa
cagagcagggaguguggagaagguggaagagcugagcucagaggcagagaagcuccuugcaggg

SEQ ID NO: 193311 - RNA, 64 nt, hsa
guaaagcccgucugcugucuucccccaaauccucagcucagagccuuccgcuuccagggccaac

SEQ ID NO: 193312 - RNA, 64 nt, hsa
acaauguuacaaguggaauaagccuuacgggugaagcucagagaagggucggaucugagagaau

SEQ ID NO: 193313 - RNA, 64 nt, hsa
cucuggguaaaggucuguaagaaggggcugggguagcucagaguagcagcucacaucugaggcc

SEQ ID NO: 193314 - RNA, 64 nt, hsa
guaaguguacauguaguggugugguguucugucuagaggauacaacugaauguuuuuaauuugc

SEQ ID NO: 193315 - RNA, 64 nt, hsa
uaggaaaauauaccuaaaagcgaauuuguggcugagaggauaaacagaagcuguuugcucaugu

SEQ ID NO: 193316 - RNA, 64 nt, hsa
agaucagugaucuugggucauugaucccuggcucagaggauagcgguuuccaucauaaaccaag

SEQ ID NO: 193317 - RNA, 64 nt, hsa
cuggcauucgagacuuccuccuguucccugggucagaggauagcgguuuccaucauaaaccaag

SEQ ID NO: 193318 - RNA, 64 nt, hsa
ggacagaacuuacuguaaagaaagaaaucugccuagaggauauauguaaggaagauuccacauc

SEQ ID NO: 193319 - RNA, 64 nt, hsa
uuuaagccguuuucuuagugauucuguaucaaguagaggauaaguguaguuuaacuuaguuuuu

SEQ ID NO: 193320 - RNA, 64 nt, hsa
gguaauuuuccacacaaucccucugaaauaagggagaggauauagaccuuuuuaacuuuauagu

SEQ ID NO: 193321 - RNA, 64 nt, hsa
gacucauacagggcucaacugaauaagaggcuuaagaggauaaacuggagcagaaauaagccuu

SEQ ID NO: 193322 - RNA, 64 nt, hsa
uccugaauggaaaauagaggauacaauggaaaauagaggauaccaacuguaugcuacugggaca

SEQ ID NO: 193323 - RNA, 59 nt, hsa
ggacaauugugcuauccugaauggaaaauagaggauacaauggaaaauagaggauacca

SEQ ID NO: 193324 - RNA, 64 nt, hsa
uuaggaaggagaggaaacuugccuuuuuuauggcagaggauaguaaugaaaaugucucaguauu

SEQ ID NO: 193325 - RNA, 64 nt, hsa
uacagaagaggcaacaauuugguucuugacagugagaggauauugagggcuucagcugcugcua

SEQ ID NO: 193326 - RNA, 64 nt, hsa; identical to SEQ ID NO: 129417

SEQ ID NO: 193327 - RNA, 64 nt, hsa; identical to SEQ ID NO: 129418

SEQ ID NO: 193328 - RNA, 64 nt, hsa; identical to SEQ ID NO: 129419

SEQ ID NO: 193329 - RNA, 64 nt, hsa; identical to SEQ ID NO: 129420

SEQ ID NO: 193330 - RNA, 64 nt, hsa; identical to SEQ ID NO: 129421

SEQ ID NO: 193331 - RNA, 64 nt, hsa; identical to SEQ ID NO: 129422

SEQ ID NO: 193332 - RNA, 64 nt, hsa; identical to SEQ ID NO: 129423

SEQ ID NO: 193333 - RNA, 64 nt, hsa; identical to SEQ ID NO: 129424

SEQ ID NO: 193334 - RNA, 64 nt, hsa; identical to SEQ ID NO: 129425

SEQ ID NO: 193335 - RNA, 64 nt, hsa; identical to SEQ ID NO: 129426

SEQ ID NO: 193336 - RNA, 64 nt, hsa; identical to SEQ ID NO: 129427

SEQ ID NO: 193337 - RNA, 64 nt, hsa; identical to SEQ ID NO: 129428

SEQ ID NO: 193338 - RNA, 64 nt, hsa; identical to SEQ ID NO: 129429

SEQ ID NO: 193339 - RNA, 64 nt, hsa; identical to SEQ ID NO: 129430

SEQ ID NO: 193340 - RNA, 64 nt, hsa; identical to SEQ ID NO: 129431

SEQ ID NO: 193341 - RNA, 64 nt, hsa; identical to SEQ ID NO: 129432

SEQ ID NO: 193342 - RNA, 64 nt, hsa; identical to SEQ ID NO: 129433

SEQ ID NO: 193343 - RNA, 64 nt, hsa; identical to SEQ ID NO: 129434

SEQ ID NO: 193344 - RNA, 64 nt, hsa; identical to SEQ ID NO: 129435

SEQ ID NO: 193345 - RNA, 64 nt, hsa; identical to SEQ ID NO: 129436

SEQ ID NO: 193346 - RNA, 64 nt, hsa; identical to SEQ ID NO: 129437

SEQ ID NO: 193347 - RNA, 64 nt, hsa; identical to SEQ ID NO: 129438

SEQ ID NO: 193348 - RNA, 64 nt, hsa; identical to SEQ ID NO: 129439

SEQ ID NO: 193349 - RNA, 64 nt, hsa; identical to SEQ ID NO: 129440

SEQ ID NO: 193350 - RNA, 64 nt, hsa; identical to SEQ ID NO: 129441

SEQ ID NO: 193351 - RNA, 64 nt, hsa; identical to SEQ ID NO: 129442

SEQ ID NO: 193352 - RNA, 64 nt, hsa; identical to SEQ ID NO: 129443

SEQ ID NO: 193353 - RNA, 64 nt, hsa; identical to SEQ ID NO: 129444

SEQ ID NO: 193354 - RNA, 64 nt, hsa; identical to SEQ ID NO: 129445

SEQ ID NO: 193355 - RNA, 64 nt, hsa; identical to SEQ ID NO: 129446

SEQ ID NO: 193356 - RNA, 64 nt, hsa; identical to SEQ ID NO: 129447

SEQ ID NO: 193357 - RNA, 64 nt, hsa; identical to SEQ ID NO: 129448

SEQ ID NO: 193358 - RNA, 64 nt, hsa; identical to SEQ ID NO: 129449

SEQ ID NO: 193359 - RNA, 64 nt, hsa; identical to SEQ ID NO: 129450

SEQ ID NO: 193360 - RNA, 64 nt, hsa; identical to SEQ ID NO: 129451

SEQ ID NO: 193361 - RNA, 64 nt, hsa; identical to SEQ ID NO: 129452

SEQ ID NO: 193362 - RNA, 64 nt, hsa; identical to SEQ ID NO: 129453

SEQ ID NO: 193363 - RNA, 64 nt, hsa; identical to SEQ ID NO: 129454

SEQ ID NO: 193364 - RNA, 64 nt, hsa; identical to SEQ ID NO: 129455

SEQ ID NO: 193365 - RNA, 64 nt, hsa; identical to SEQ ID NO: 129456

SEQ ID NO: 193366 - RNA, 64 nt, hsa; identical to SEQ ID NO: 129457

SEQ ID NO: 193367 - RNA, 64 nt, hsa; identical to SEQ ID NO: 129458

SEQ ID NO: 193368 - RNA, 64 nt, hsa
uuacucuggacuuuauuguccuguuucuaucaaauuggacuaacaaaaauugauauaauacauu

SEQ ID NO: 193369 - RNA, 64 nt, hsa
caucuauugcagaauguauaauuaucuauuuguuuuggacuauauguuacaaaaauuuaaaaca

SEQ ID NO: 193370 - RNA, 64 nt, hsa
uauaaaucuaggaaagggaucuucuaguuucuguguuguuuagacucaaagaaucacaaauuug

SEQ ID NO: 193371 - RNA, 64 nt, hsa
acucaaagaaucacaaauuugucaguaacauguaguuguuuaguuauaauucagaguguacaga

SEQ ID NO: 193372 - RNA, 64 nt, hsa
gacaaaauuuucaugaucuucucuaacaaaaaaaguuguuuauuaacuguacagacuguuuacu

SEQ ID NO: 193373 - RNA, 64 nt, hsa
uuuuguuuuuguuuuucucagucuuaccugugauguuguuuaggaucaggccccucuccugggc

SEQ ID NO: 193374 - RNA, 64 nt, hsa
agcuuccugacgacaugaaauaauuggggguuuuguuguuuaguuacauuaggcuuugcuauau

SEQ ID NO: 193375 - RNA, 64 nt, hsa
aaccuuacaaguauaugaguauuauuuauagguaguuguuuacauaugagucgggaccaaagag

SEQ ID NO: 193376 - RNA, 64 nt, hsa
ggccaaaggaaagcuuucugggcuuuggaaaguaguuguuuaacuuuguuuuaagccguuuucu

SEQ ID NO: 193377 - RNA, 64 nt, hsa
uaagcacaguuugccugaauuucugcuugguuguguuguuuaccguaaguacugaggguaguuu

SEQ ID NO: 193378 - RNA, 64 nt, hsa
ugaguucucacucugguuguuuaugcaagagcugguuguuuaaaagagccuggaacuuccuccu

SEQ ID NO: 193379 - RNA, 64 nt, hsa
ccauccccauaguaaugagugaguucucacucugguuguuuaugcaagagcugguuguuuaaaa

SEQ ID NO: 193380 - RNA, 64 nt, hsa
ccuauaaauggcagcucuccuguuguauucagguguuguuuacagacuaacaaauguguuggca

SEQ ID NO: 193381 - RNA, 64 nt, hsa
ugaaaaccuuggaguuuuuuuuuuuccugauaggguuguuuauacuucuugauugguuucuugc

SEQ ID NO: 193382 - RNA, 64 nt, hsa
ccacaaaauaugaucuucguuuauauucugugauguuguuuauaaaugaaugccucaguucucu

SEQ ID NO: 193383 - RNA, 64 nt, hsa
caaaaaauauguaauucauggucuggacacugacguuguuuagggauuuagucaucaaggacag

SEQ ID NO: 193384 - RNA, 64 nt, hsa
uguguucuuuuuuauuguuccucuguuauuugggguuguuuacuagucuuccuauagguuacuu

SEQ ID NO: 193385 - RNA, 64 nt, hsa
gcagugaguuuucauuuugguuuuguauuuuccaguuguuuaauuuccauuggguggguucuuu

SEQ ID NO: 193386 - RNA, 64 nt, hsa
gaagccaguucaguccacaccaucucuucuuugaguuguuuauggccucccuuaaggcauuuua

SEQ ID NO: 193387 - RNA, 64 nt, hsa
gaguaauguaauugacaaaauaucugauaaucauguuguuuaagggcuaggugaagaaaguuuc

SEQ ID NO: 193388 - RNA, 64 nt, hsa
cuaaugaagcauucaaaaugagcaaugcuaauggguuguuuagcuuuuuguuuucuuuguacuc

SEQ ID NO: 193389 - RNA, 64 nt, hsa
aaccaggcauuuuucccaaauuaauuacaaucugguuguuuagccuaugcuaauuaagcccucu

SEQ ID NO: 193390 - RNA, 64 nt, hsa
agauuguaaacuaaagugugcuuuauaaaaaaaaguuguuuauaaaaaccccuaaaaacaaaac

SEQ ID NO: 193391 - RNA, 64 nt, hsa
aacuugccauuucuuuauauggaacgcauuuuggguuguuuaaaaauuuauaacaguuauaaag

SEQ ID NO: 193392 - RNA, 64 nt, hsa
ccaaaauauacaugcagacuuguuuuuuauuauuguuguuuaagcauaauuuaagaaaaaaaau

SEQ ID NO: 193393 - RNA, 64 nt, hsa
auuugucaguguauccuuuccaaaaagaguaauaguuguuuacuagugugcuagaugaaaagcg

SEQ ID NO: 193394 - RNA, 64 nt, hsa
uaacaaucucggaaggaaaauauaucacaucaauaaucaauaaaaauaaguaaaaggcuuuuug

SEQ ID NO: 193395 - RNA, 64 nt, hsa
gauagugaccgagacuaagaggauuguuugacuuaaucaauauuaguggaaguacugucuaugu

SEQ ID NO: 193396 - RNA, 64 nt, hsa
gagcguuagccaaguuauuuucauguuguuauguaaucaauauuuuucaauagaaguauuagag

SEQ ID NO: 193397 - RNA, 64 nt, hsa
cuaggcauagcuguuuuucucccaugaguaugcaaaucaauaguuuuaaccauuguuaaaaugc

SEQ ID NO: 193398 - RNA, 64 nt, hsa
auccuuuccucaguguguauaugacagccaguauaaucaauacccuagguuaugcgucuauaug

SEQ ID NO: 193399 - RNA, 64 nt, hsa
guacuuuucucauacaccaaaaacacaccaaaaaaaucaauaaaauaagcaaucuucuauucuc

SEQ ID NO: 193400 - RNA, 64 nt, hsa
ugauaaacaacuucagcuaacuuucaggagacaaaaucaauauacaaaauaugguagcauuuuu

SEQ ID NO: 193401 - RNA, 64 nt, hsa
aauggaaaaacauuccauacuuauggauaggaagaaucaauauuguuaaaauggccauacuacc

SEQ ID NO: 193402 - RNA, 64 nt, hsa
auagaccaauaacagccucugggguugaggugauaaucaauagcuuaccaaccaaaaagagucc

SEQ ID NO: 193403 - RNA, 64 nt, hsa
aucccugggaugcaaggcugguucaacauacgcaaaucaauaaauguaauccagcauauaaaca

SEQ ID NO: 193404 - RNA, 64 nt, hsa
aauggaagagcauuccaugcucauggguaggaagaaucaauaucaugaaaauggcccauacugc

SEQ ID NO: 193405 - RNA, 64 nt, hsa
ucaauauaauuuauuuauguaagaaaaauaacucaaucaauauauuuuugaaccuuuuaaguac

SEQ ID NO: 193406 - RNA, 64 nt, hsa
gcagaaaggguuuuuucagcuguuaaauccuaaaaaucaauauaauuuauuuauguaagaaaaa

SEQ ID NO: 193407 - RNA, 64 nt, hsa
gucugacaccuuucagucucuuuuuauagcaagaaaucaauauccuuuuuauaaaaauucaugu

SEQ ID NO: 193408 - RNA, 64 nt, hsa
auuccuggucaaucucuccacugaggcaauuuggaaucaauaagcaauugauaauaguuuggag

SEQ ID NO: 193409 - RNA, 64 nt, hsa; identical to SEQ ID NO: 72602

SEQ ID NO: 193410 - RNA, 64 nt, hsa; identical to SEQ ID NO: 72603

SEQ ID NO: 193411 - RNA, 64 nt, hsa; identical to SEQ ID NO: 72604

SEQ ID NO: 193412 - RNA, 64 nt, hsa; identical to SEQ ID NO: 72605

SEQ ID NO: 193413 - RNA, 64 nt, hsa; identical to SEQ ID NO: 72606

SEQ ID NO: 193414 - RNA, 64 nt, hsa; identical to SEQ ID NO: 72607

SEQ ID NO: 193415 - RNA, 64 nt, hsa; identical to SEQ ID NO: 72608

SEQ ID NO: 193416 - RNA, 64 nt, hsa; identical to SEQ ID NO: 72609

SEQ ID NO: 193417 - RNA, 64 nt, hsa; identical to SEQ ID NO: 72610

SEQ ID NO: 193418 - RNA, 64 nt, hsa; identical to SEQ ID NO: 72611

SEQ ID NO: 193419 - RNA, 64 nt, hsa; identical to SEQ ID NO: 72612

SEQ ID NO: 193420 - RNA, 64 nt, hsa; identical to SEQ ID NO: 72613

SEQ ID NO: 193421 - RNA, 64 nt, hsa; identical to SEQ ID NO: 72614

SEQ ID NO: 193422 - RNA, 64 nt, hsa; identical to SEQ ID NO: 72615

SEQ ID NO: 193423 - RNA, 64 nt, hsa; identical to SEQ ID NO: 72616

SEQ ID NO: 193424 - RNA, 64 nt, hsa; identical to SEQ ID NO: 72617

SEQ ID NO: 193425 - RNA, 64 nt, hsa; identical to SEQ ID NO: 72618

SEQ ID NO: 193426 - RNA, 64 nt, hsa; identical to SEQ ID NO: 72619

SEQ ID NO: 193427 - RNA, 64 nt, hsa; identical to SEQ ID NO: 72620

SEQ ID NO: 193428 - RNA, 64 nt, hsa; identical to SEQ ID NO: 72621

SEQ ID NO: 193429 - RNA, 64 nt, hsa; identical to SEQ ID NO: 72622

SEQ ID NO: 193430 - RNA, 64 nt, hsa; identical to SEQ ID NO: 72623

SEQ ID NO: 193431 - RNA, 64 nt, hsa; identical to SEQ ID NO: 72624

SEQ ID NO: 193432 - RNA, 64 nt, hsa; identical to SEQ ID NO: 72625

SEQ ID NO: 193433 - RNA, 64 nt, hsa; identical to SEQ ID NO: 72626

SEQ ID NO: 193434 - RNA, 64 nt, hsa; identical to SEQ ID NO: 72627

SEQ ID NO: 193435 - RNA, 64 nt, hsa; identical to SEQ ID NO: 72628

SEQ ID NO: 193436 - RNA, 64 nt, hsa; identical to SEQ ID NO: 72629

SEQ ID NO: 193437 - RNA, 64 nt, hsa; identical to SEQ ID NO: 72630

SEQ ID NO: 193438 - RNA, 64 nt, hsa; identical to SEQ ID NO: 72631

SEQ ID NO: 193439 - RNA, 64 nt, hsa; identical to SEQ ID NO: 72632

SEQ ID NO: 193440 - RNA, 64 nt, hsa; identical to SEQ ID NO: 72633

SEQ ID NO: 193441 - RNA, 64 nt, hsa; identical to SEQ ID NO: 72634

SEQ ID NO: 193442 - RNA, 64 nt, hsa; identical to SEQ ID NO: 72635

SEQ ID NO: 193443 - RNA, 64 nt, hsa; identical to SEQ ID NO: 72636

SEQ ID NO: 193444 - RNA, 64 nt, hsa; identical to SEQ ID NO: 72637

SEQ ID NO: 193445 - RNA, 64 nt, hsa; identical to SEQ ID NO: 72638

SEQ ID NO: 193446 - RNA, 64 nt, hsa; identical to SEQ ID NO: 72639

SEQ ID NO: 193447 - RNA, 64 nt, hsa; identical to SEQ ID NO: 72640

SEQ ID NO: 193448 - RNA, 64 nt, hsa; identical to SEQ ID NO: 72641

SEQ ID NO: 193449 - RNA, 64 nt, hsa; identical to SEQ ID NO: 72642

SEQ ID NO: 193450 - RNA, 64 nt, hsa; identical to SEQ ID NO: 72643

SEQ ID NO: 193451 - RNA, 64 nt, hsa; identical to SEQ ID NO: 72644

SEQ ID NO: 193452 - RNA, 64 nt, hsa; identical to SEQ ID NO: 72645

SEQ ID NO: 193453 - RNA, 64 nt, hsa
uuuuugauaacuguguacuucuggugacuguacaguuugaaauacuauuuuuuaucaaguuuua

SEQ ID NO: 193454 - RNA, 64 nt, hsa
cuuucugauuuuugguaguccauugaagaagggaguuugaaaguuguuguauacuguuaacgau

SEQ ID NO: 193455 - RNA, 64 nt, hsa
uggguuaccuuaaaaaguugauuuccuugaagcaguuugaaaauuugaauugagucuuaacuuu

SEQ ID NO: 193456 - RNA, 64 nt, hsa
gcaggcaguaucgauuuuaugaagagaaagugaaguuugaaaacuuuucaaacuuuucuaguua

SEQ ID NO: 193457 - RNA, 64 nt, hsa
ugucuuuguuaguggagaccgcuaaacuaaugauguuugaaaacaguuccucuguuuuagauug

SEQ ID NO: 193458 - RNA, 64 nt, hsa
agcagugauauuauuuccauaacuuaaaaagugaguuugaaaaagaaaaucuccagcaagcauc

SEQ ID NO: 193459 - RNA, 64 nt, hsa
ucuauuacuuucuguucccaauguccuucuagugguuugaaaauguuaaaacaucccuaaaauc

SEQ ID NO: 193460 - RNA, 64 nt, hsa
auuguacagcuucuaauucacuuuucagaucaguguuugaaauggcaauuaucaguguuggauu

SEQ ID NO: 193461 - RNA, 64 nt, hsa
cuauuucuuuucuaaacuaucaaaaacucuagcaguuugaaaagccuaauauuuauuuguaugu

SEQ ID NO: 193462 - RNA, 64 nt, hsa
guucuuugaaagaaucucuaaaaggcuuauaaauguuugaaauaucacacaaaggcugauuucu

SEQ ID NO: 193463 - RNA, 64 nt, hsa
gucucaguguuugguuauuaugcaaacaaguaauguuugaaauauauaauagcacuggagauuu

SEQ ID NO: 193464 - RNA, 64 nt, hsa
cuguuccugcccuguugcuuccagccacugugauguuugaaauaugugauaguaccugguugug

SEQ ID NO: 193465 - RNA, 64 nt, hsa
gcuugugggucuguucagacugucuccucucaugguuugaaacugcaucugaaugccugccuuc

SEQ ID NO: 193466 - RNA, 64 nt, hsa
uuaaacuguaguuguagauccuugucauuuugcuguuugaaaauaaccaauguguuuucuaaaa

SEQ ID NO: 193467 - RNA, 64 nt, hsa
ugaagauaacuuuuacuuaaauaugaaaauuauaguuugaaaauuaggcucaagcaaauaucaa

SEQ ID NO: 193468 - RNA, 64 nt, hsa
auacaccaggauaaaucuuauuuaaaggaagccuguuugaaaaucaccaacuuuaacuuauugc

SEQ ID NO: 193469 - RNA, 64 nt, hsa
aaaaaacauucuauauuuguagcagaaaucagugguuugaaaagucauacuuugcagauaugaa

SEQ ID NO: 193470 - RNA, 64 nt, hsa
ccuucuuagguuuaaauguuauaccaaugcauguguuugaaauauccauuaagaugauuuaaaa

SEQ ID NO: 193471 - RNA, 64 nt, hsa
auaaaugugugucuauaugcuuuccuuuaaauauguuugaaaagauguuugaaacuugauuaua

SEQ ID NO: 193472 - RNA, 64 nt, hsa
cuauaugcuuuccuuuaaauauguuugaaaagauguuugaaacuugauuauacuauuuauaauu

SEQ ID NO: 193473 - RNA, 64 nt, hsa
gucucaaagcaguaaccuuauacacuacuuauaaguuugaaaggggaaagguuaccuuuacaau

SEQ ID NO: 193474 - RNA, 64 nt, hsa
uguucauuguacuaucaauguggcuuugcuguggguuugaaauuuugcaaacuaagaguugggu

SEQ ID NO: 193475 - RNA, 64 nt, hsa
caggcauuuugaggugucucuuuggguucuuucuguuugaaaggauauuugucgaaaaaaagag

SEQ ID NO: 193476 - RNA, 64 nt, hsa
uuuuauccauguacucuuuugauguauagaaguaguuugaaacucauuguuuccuugugguaag

SEQ ID NO: 193477 - RNA, 64 nt, hsa
uacuuaucagaaguguguuuaccaacuuauuuuuguuugaaagugugauuuuuuuuuuccuucc

SEQ ID NO: 193478 - RNA, 64 nt, hsa
ugugccaucaugauuaaugaaaacuaucuuuugaguuugaaaagaaauuaauuugcaguguuug

SEQ ID NO: 193479 - RNA, 64 nt, hsa
uuggaaaaucaaugauuuuaaugcauagcaguauguuugaaaaauagaccauucuaaaaagccc

SEQ ID NO: 193480 - RNA, 64 nt, hsa
aaguuucaguucuauaugaaguauuugauguuuuguuugaaacaauacagcauuaaagaaccaa

SEQ ID NO: 193481 - RNA, 64 nt, hsa
acaaaaacgcuaacuuuguuugaaaugcaaacagguuugaaaauauguauuaaguacuuuguau

SEQ ID NO: 193482 - RNA, 64 nt, hsa
guuaucaaauuugauuuacaaaaacgcuaacuuuguuugaaaugcaaacagguuugaaaauaug

SEQ ID NO: 193483 - RNA, 64 nt, hsa
auuacaggcgugagccacugcgcccggccgaaguguuugaaaucuuuaagcauccugguaaaua

SEQ ID NO: 193484 - RNA, 64 nt, hsa
uagauuuccagguauggaauaauuagguugaaguguuugaaaucuuuuuuuguugguuuguuug

SEQ ID NO: 193485 - RNA, 64 nt, hsa
gcugcauucucguguucagugaugcccucuucuuguuugaaacaaaagaaaauaaugcauugug

SEQ ID NO: 193486 - RNA, 64 nt, hsa
aacuuguuuaccuuaaaauuaucagaaucucaguguuugaaaguacugaagcacaaacauauau

SEQ ID NO: 193487 - RNA, 64 nt, hsa
aaaagcuacagagaggagagugaaauauagaaguguuugaaauguucaagcucacaauaagcuu

SEQ ID NO: 193488 - RNA, 64 nt, hsa
aucaacuggaauaauauaguaauccuguaacuggguuugaaaaaauaaucaacaaaagauacaa

SEQ ID NO: 193489 - RNA, 64 nt, hsa
cuuguuauuguuuacacacuugcaguguagcccaguuugaaauauuuauuugguuaucaacugc

SEQ ID NO: 193490 - RNA, 64 nt, hsa
uagagaaguugauugucccuuaaauguaguguguguuugaaacuucuuagcugucacuuuggaa

SEQ ID NO: 193491 - RNA, 64 nt, hsa
uugaauugaagcuuuacuuuagaauuuagcccugguuugaaauuuuccauuacaugaucuuggu

SEQ ID NO: 193492 - RNA, 64 nt, hsa
gacuuucuauuaauauuuauguguuuuaauaaacguuugaaauuauuuaugacuacuuaaaaug

SEQ ID NO: 193493 - RNA, 64 nt, hsa
cugaauguaauacuugaguagauuuuuuuuucuaguuugaaauuuagucugucuuuuugaccuu

SEQ ID NO: 193494 - RNA, 64 nt, hsa
guuuuaugacaugguauacuacuauauuuacucaguuugaaacuauucauuucuacacacuauu

SEQ ID NO: 193495 - RNA, 64 nt, hsa
ccaagucuggggagggguauagguuugaaaggcuguuugaaagaggaauguuuaauaaaggcuu

SEQ ID NO: 193496 - RNA, 64 nt, hsa
cucuggcaguucccaagucuggggagggguauagguuugaaaggcuguuugaaagaggaauguu

SEQ ID NO: 193497 - RNA, 64 nt, hsa
auugacaguaaaaacaacaaaccaggauucuacuguuugaaaagaaguuucguuuuaauuuugg

SEQ ID NO: 193498 - RNA, 64 nt, hsa
ugauuaacuucugguuugguuuagaaaaaguaauguuugaaauacgaagguaauuuaauguuac

SEQ ID NO: 193499 - RNA, 64 nt, hsa
uuaagaaucccuuuucauggucugaucuuaaguuguuugaaaaaagauucacgcuucugcaucc

SEQ ID NO: 193500 - RNA, 64 nt, hsa
guaccacaauuaaagauuaugcuccccuuuucuuguuugaaaacaguuauuuggugacuagaaa

SEQ ID NO: 193501 - RNA, 64 nt, hsa
gaggcaggagccaaggccaaaagugaacguacagguuugaaauggcugugauaaggaccagcug

SEQ ID NO: 193502 - RNA, 64 nt, hsa
agcagugaaucuaaaacucuggaagaagucuucuguuugaaaggcuuauuuaagccacacguac

SEQ ID NO: 193503 - RNA, 63 nt, hsa
uuuauggaaaguaucuuuaauaaagcuggauacaguuugaaagaaaaaaaaaaguguggcaau

SEQ ID NO: 193504 - RNA, 64 nt, hsa
gcggcugauuuuugguaguccauugaagaagagaguuugaaaguuguauacuguuaaugacugu

SEQ ID NO: 193505 - RNA, 64 nt, hsa
cauuuuuuauaacuguacuucuggugacuguacaguuugaaauauucuuuaucaaguuuuauaa

SEQ ID NO: 193506 - RNA, 57 nt, hsa
uaacuguguacuucuggugacuguacaguuugaaauacuauuuuuuaaucaaguuuu

SEQ ID NO: 193507 - RNA, 64 nt, hsa; identical to SEQ ID NO: 193454

SEQ ID NO: 193508 - RNA, 64 nt, hsa
aagaauagguggaaggucauagccuggaacccaaguuugaaaacauuucauuguguucaguagu

SEQ ID NO: 193509 - RNA, 64 nt, hsa
gcucucgggucccuuuauugcuuuuuaaaauaggguuugaaacaugccacaggaagguugcucu

SEQ ID NO: 193510 - RNA, 64 nt, hsa
uuuugugagggcaaaggggaggaaaugggguucuguuugaaaaaaaugaggggaucuuagaugc

SEQ ID NO: 193511 - RNA, 64 nt, hsa
ccucaugugcuucuucugaauacugaaugugacuguuugaaagcugguagaauucaucccucuu

SEQ ID NO: 193512 - RNA, 64 nt, hsa
cucaguugagugagcaaggauacgaaaacaguguguuugaaaacaaauuagguuuggguucaau

SEQ ID NO: 193513 - RNA, 64 nt, hsa
uuuuuaauguguacaccugcucuagggacgauucguuugaaagagaguaagaugcauuaacaga

SEQ ID NO: 193514 - RNA, 64 nt, hsa
ccacguuuguuccccacguuuguuccccuuuucuguuugaaaaaccuguucugguagcuccaca

SEQ ID NO: 193515 - RNA, 64 nt, hsa
cuuagugacuuaguucuuagaagcucacgccuuaguuugaaacagauucuccacgguggucccc

SEQ ID NO: 193516 - RNA, 64 nt, hsa
caucagccuccagguugacuaagggucaggucauguuugaaaccaugcuuggcuggaccgggac

SEQ ID NO: 193517 - RNA, 64 nt, hsa
uuggcaacagacucaugacaaaggauucaagauuguuugaaaaaaaaaaaaggggagcagggag

SEQ ID NO: 193518 - RNA, 64 nt, hsa
ggcgugagccaccuugcccagcccacaucauacaguuugaaaugaaacuuugccacaaccagcc

SEQ ID NO: 193519 - RNA, 64 nt, hsa
cuuugcuguagcacacacauauaucacugaaccuguuugaaauaaaguuuuuuuucuuuuucau

SEQ ID NO: 193520 - RNA, 64 nt, hsa
uuuuucaaaagcucaguauaugaaucaucauacuguuugaaauugcuaaugacagaguaaguaa

SEQ ID NO: 193521 - RNA, 64 nt, hsa
guaacuauaaauuuugugaaugcauuuuccugguguuugaaaaagaagggggggagaauuccag

SEQ ID NO: 193522 - RNA, 64 nt, hsa
guuuaacuugguuagaugcaaacacguuggaugaguuugaaaggacuaugcugcccuuuugaca

SEQ ID NO: 193523 - RNA, 64 nt, hsa
aaugaaguuuaaucagcgugccauuuuuguuguuguuugaaagauuuuaauuuuuggaaugcac

SEQ ID NO: 193524 - RNA, 64 nt, hsa
caauauacuuguuuagaaaaacuucaagacauucaaaaacuaggaaggaguauguuuaauagua

SEQ ID NO: 193525 - RNA, 64 nt, hsa
guuuuuuuauuuuguuucuguuuuguguagagguaaaaacuauaguuuuauuacagcauaauuc

SEQ ID NO: 193526 - RNA, 64 nt, hsa
auuuugauaaauuuauaaauauauaaaauuauguaaaaacuacacuauauuuugauuuagauuu

SEQ ID NO: 193527 - RNA, 64 nt, hsa
ugaugaaaaaaacgaauuguaugauuuaggaaucaaaaacuaaaauaaguggaauuauguaucu

SEQ ID NO: 193528 - RNA, 64 nt, hsa
caacaauguacccaaaagaggguagaauucugagaaaaacuauuagcuuagaauuugcaacaag

SEQ ID NO: 193529 - RNA, 64 nt, hsa
agggaaaugauucuaaaaggauuaucugaaauugaaaaacuaguaagcaaauaaaugauaaaca

SEQ ID NO: 193530 - RNA, 64 nt, hsa
uuaauccguugaaacucuuguaauuuggacaacaaaaaacuagaaauaacacucuuuucuuuga

SEQ ID NO: 193531 - RNA, 64 nt, hsa
aauagaguagaagagauaaaaguaguuuucugucaaaaacuaggaguuaagccuucagguacgu

SEQ ID NO: 193532 - RNA, 64 nt, hsa
aaaaaaccaauguuuugcaguuuuuuucauugccaaaaacuaaauggugcuuuauauuuagauu

SEQ ID NO: 193533 - RNA, 64 nt, hsa
aaauugaacacaaucucauugaggagcauuuuuuaaaaacuaaaaaaaaaaaaacuuugccagc

SEQ ID NO: 193534 - RNA, 64 nt, hsa
auaugcucaucacugauaaaugcucccuggccuuaaaaacuaccaacauauaauauauaugcug

SEQ ID NO: 193535 - RNA, 64 nt, hsa
auucuguuauuucugauacuuuugaaaaacuaauaaaaacuaauaaaagaagcguaaaaaguga

SEQ ID NO: 193536 - RNA, 64 nt, hsa
uucucccaacauucuguuauuucugauacuuuugaaaaacuaauaaaaacuaauaaaagaagcg

SEQ ID NO: 193537 - RNA, 64 nt, hsa
uuauacugaguaaugcacucuugcaaguguauacaaaaacuaaauagacuucugcccuccaaca

SEQ ID NO: 193538 - RNA, 64 nt, hsa
uugcaauuaaaaugugauuggcuuagguaaucccaaaaacuaacaaauaacaaaggugcauaau

SEQ ID NO: 193539 - RNA, 64 nt, hsa
cuaugaauguaauucauaauuuaaaaggaaaacuaaaaacuauuuugauuugggaaaaugagcc

SEQ ID NO: 193540 - RNA, 64 nt, hsa
cuuuauauucagcuacucuugucauuucucguugaaaaacuaaaaucugacuagguuaguuuac

SEQ ID NO: 193541 - RNA, 64 nt, hsa
uuguuguuucuuaaauaagaaacuuuuuuauuuaaaaaacuaaaaacuagaggugagaaauuua

SEQ ID NO: 193542 - RNA, 64 nt, hsa
uucuuaaauaagaaacuuuuuuauuuaaaaaacuaaaaacuagaggugagaaauuuaaacuaua

SEQ ID NO: 193543 - RNA, 64 nt, hsa
ucuguguucuaagaacucaggcaauuuuaaggauaaaaacuaacauuggccaggcacgguggcu

SEQ ID NO: 193544 - RNA, 64 nt, hsa
caacauggugaaacuucaucucuacuaaaaauacaaaaacuagccaggugugguucuccaugcc

SEQ ID NO: 193545 - RNA, 64 nt, hsa
uuuggaaaaacccaugaagguaacuaacggaaggaaaaacuaagagaaugaaaaguauuugccu

SEQ ID NO: 193546 - RNA, 64 nt, hsa
uaaaauuuuauguauuaauauaugcauucacuugaaaaacuaaaaaaaaacaauaauuuggaaa

SEQ ID NO: 193547 - RNA, 64 nt, hsa
uucccaaaugaaauacugccuuggcuagaguuugaaaaacuaauugagccugugccuggcuaga

SEQ ID NO: 193548 - RNA, 64 nt, hsa
acacacagaguaaccuguaacucucaauucccugaaaaacuaguaauacugucuuaucugcuau

SEQ ID NO: 193549 - RNA, 64 nt, hsa
acuguaucagaaugaagaaacuaauauuuuacauaaaaacuaauacuuucaauuuuuuauauag

SEQ ID NO: 193550 - RNA, 64 nt, hsa
auugaucacuuguguacgaaaaauaaaucuccuuaaaaacuaaauaaaaugcacuguauucuua

SEQ ID NO: 193551 - RNA, 64 nt, hsa
agugccagcagaguagggaaaacugcauuugcauaaaaacuacucuugacaugauuguucauuu

SEQ ID NO: 193552 - RNA, 64 nt, hsa
aucaaacuuacauuccugccaagaugcauggccaaaaaacuaaguaucaaagcagcagaagguu

SEQ ID NO: 193553 - RNA, 64 nt, hsa
cugauuauuguauaugcaaauuacaugcauuuuuaaaaacuauucuuucugaacuuaucuaccu

SEQ ID NO: 193554 - RNA, 64 nt, hsa
uuugccccuaggagaaaacuuaauaauugugccuaaaaacuaugggcggauaguauaagacuau

SEQ ID NO: 193555 - RNA, 64 nt, hsa
aauaaguaucacaaaucuuuuacgcagaagaaauaaaaacuacggguagaaaacauaagaacua

SEQ ID NO: 193556 - RNA, 64 nt, hsa
uuaauaaauuaucuguuaauguagauuuuauuuaaaaaacuauauuugaacauuggucuuucuu

SEQ ID NO: 193557 - RNA, 64 nt, hsa
uaacugaaaagacuauguagugaaauguauuuuuaaaaacuauauucaguaaaagccugcucaa

SEQ ID NO: 193558 - RNA, 64 nt, hsa
aacacagucuuuaauuuucacucacuguggaaauaaaaacuaagguaacuucucagaaagauau

SEQ ID NO: 193559 - RNA, 64 nt, hsa
auaaauuaaguugacaugagguaaauguguugauaaaaacuaauuuuagaaguuugaagacuuu

SEQ ID NO: 193560 - RNA, 64 nt, hsa
acugaaccacugcccuaaguuucuuuauguggucaaaaacuagauaaugaaaguagcaggugcu

SEQ ID NO: 193561 - RNA, 64 nt, hsa
uugggaugguuucuuggcuuuaaguccacugaauaaaaacuaugaaauugcacucugugucaac

SEQ ID NO: 193562 - RNA, 64 nt, hsa
aucacuuaauuccccaugcuucugcaaugcauauaaaaacuauaaaugccgagugguagaaacu

SEQ ID NO: 193563 - RNA, 64 nt, hsa
uaugauucaguagucaacuugagggaaauuuuuaaaaaacuauucucaauuauauacgagguga

SEQ ID NO: 193564 - RNA, 64 nt, hsa
cacacuuaggcaauaguccuuuccaaaccaugacaaaaacuacaaguuuauuuauaauuuaaca

SEQ ID NO: 193565 - RNA, 64 nt, hsa
aucaaguccacucuucugccugcaacauuuguucaaaaacuaaccaagguaaaauauuuauuug

SEQ ID NO: 193566 - RNA, 64 nt, hsa
cauagcauuuuuacuaccagcaguauguuacuuaaaaaacuacauggcuuuccuugaauuuauu

SEQ ID NO: 193567 - RNA, 64 nt, hsa
agaugucacacaguugccauccacugcuuugggaaaaaacuagcaugcuccccugcucccuguu

SEQ ID NO: 193568 - RNA, 64 nt, hsa
ccaaucagaaagaaauccucuguggggucacuuuaaaaacuacuagcuucaacuaccacuuaca

SEQ ID NO: 193569 - RNA, 64 nt, hsa
aacaaaaaaaaaagcuuggaacuccaucacguggaaaaacuagauccuguugguuauagcauuu

SEQ ID NO: 193570 - RNA, 64 nt, hsa
uacaaugcaaucauuucauacuuuaaacuggucaaaaaacuaauugugauuucuagucuugcaa

SEQ ID NO: 193571 - RNA, 64 nt, hsa
aauauuugagaauguaugauacauguaaaauuaaaaaaacuauuagaacuguaccauaauuaug

SEQ ID NO: 193572 - RNA, 64 nt, hsa
gaaaagaaugacauuucaaaaaaaugguucaaugaaaaacuauagcuaaaauauguaaaccuuu

SEQ ID NO: 193573 - RNA, 64 nt, hsa
cauaaaguugcaguuaggaaagggaugggcagggaaaaacuaguuuugagugucuuuagauaga

SEQ ID NO: 193574 - RNA, 64 nt, hsa
aaaauuuucuaaauauuaauacuaacugggaaaaaaaaacuagugugaaguuuacaguuagaag

SEQ ID NO: 193575 - RNA, 64 nt, hsa
gccaaauuucacagucuuaauaacuuuuuuuaaaaaaaacuaaaaggcgcuucauguccagugu

SEQ ID NO: 193576 - RNA, 64 nt, hsa
guuccuuuuucacuaugggcaguucacacaaggcaaaaacuauugaacaguugguuuuagugug

SEQ ID NO: 193577 - RNA, 64 nt, hsa
gaagaaaaaaucaaugaacuugaagaguaagaauaaaaacuaccaaagugauauacagagagaa

SEQ ID NO: 193578 - RNA, 64 nt, hsa
aagcuacucuggaccuacaguguccggcauccaaaaaaacuaauguguuaugcaaagaagcaau

SEQ ID NO: 193579 - RNA, 64 nt, hsa
aguuauuuucuucagcuuuaauuucauaaaauuaaaaaacuauuuuaaaaauuccuguaguugu

SEQ ID NO: 193580 - RNA, 64 nt, hsa
uugggcccaacacuugcaguugccuuccugauguaaaaacuaacaugcuagauaauccaguguc

SEQ ID NO: 193581 - RNA, 64 nt, hsa
gacuauucacagcccuauuuacuuacauaggcuaaaaaacuauguaacuaaauaccuaauggua

SEQ ID NO: 193582 - RNA, 64 nt, hsa
augcuucucaaaauuuucaguguguaagcuaaacaaaaacuaaaacuaagaauucucaaaaaaa

SEQ ID NO: 193583 - RNA, 64 nt, hsa
uuuagcucuuguuugggagaacacguaacuguugaaaaacuaccugggaggagugaguuccucc

SEQ ID NO: 193584 - RNA, 64 nt, hsa
acuagauauuaguuuuagaggaaggaaauagcugaaaaacuaaauuugcuuuggugaaaugucc

SEQ ID NO: 193585 - RNA, 64 nt, hsa
ucuaguguucagaauucaugaaauuauccaugguaaaaacuaguuauaaaaauuacauaauuca

SEQ ID NO: 193586 - RNA, 64 nt, hsa
gaauagaaacuuuuaguauuaccgauggggaaaaaaaaacuacuguuaacacugcuaaugaaag

SEQ ID NO: 193587 - RNA, 64 nt, hsa
uuuucccuuagcucuucugacuggauuuuucuacaaaaacuauggaaaauaucuuuguucuugu

SEQ ID NO: 193588 - RNA, 64 nt, hsa
ucguuaaauagguuuucuuuaaacuuaauuaaagaaaaacuauuuaaagguaaaggauauuuug

SEQ ID NO: 193589 - RNA, 64 nt, hsa
cccagauugcaccacugcucucuagccugggcaaaaaaacuaguuccaaaaaagacacuuguac

SEQ ID NO: 193590 - RNA, 64 nt, hsa
ccuuauccuuguaaccaaaagccaucugcuccccaaaaacuauugaaauaaaauaaaauauaaa

SEQ ID NO: 193591 - RNA, 64 nt, hsa
uguacauauauuucuggguucccacgaugaugugaaaaacuaccagacuguuuuuugucuucuc

SEQ ID NO: 193592 - RNA, 64 nt, hsa
aucuaguccuuucugugguucucagccaagacauaaaaacuaggacucagagcacauacaaaac

SEQ ID NO: 193593 - RNA, 64 nt, hsa
uggaguugacuuucuucuguccaaacaaacaaacaaaaacuaaacacacacacaaacccccaga

SEQ ID NO: 193594 - RNA, 64 nt, hsa
acccccagaaacccacaauauguacacgcuaaggaaaaacuagcacccuucuguccacucagca

SEQ ID NO: 193595 - RNA, 64 nt, hsa
uagcaagcuaauggaaacaugauuuucggggaagaaaaacuacagaaaauguagaaauuuauua

SEQ ID NO: 193596 - RNA, 64 nt, hsa
uauuuaauuguguuggagcuucuuuuuccaaaagaaaaacuaguugcagucagggagccagcga

SEQ ID NO: 193597 - RNA, 64 nt, hsa
aggaaagaaaggagaguagaacauuuuuccucauuuuaucaaauccucucuugcccucccucaa

SEQ ID NO: 193598 - RNA, 64 nt, hsa
aacauuccugaagcuguucccacucccagaugguuuuaucaauagccuagagguaaagaacugu

SEQ ID NO: 193599 - RNA, 64 nt, hsa
uguuuucuugucacugaaaacaaacaacgcugaguuuaucaagaaaauuuaaauugggggauca

SEQ ID NO: 193600 - RNA, 64 nt, hsa
uggauaguuccuuuuuaguacuguuuuaugaagcuuuaucaacuuggcuucaugauccucacuu

SEQ ID NO: 193601 - RNA, 64 nt, hsa
ugcuuaauuuauuuuuuacugugccacuccaauauuuaucaaauccaaauagcaugaaugcuuc

SEQ ID NO: 193602 - RNA, 64 nt, hsa
caccaagguuaaaguggguaaucauaagcuccuuuuuaucaaugaaguuugaaguuuuucuauu

SEQ ID NO: 193603 - RNA, 64 nt, hsa
uaaaucugcaaaaggcaaugaaaaugccuuaaauuuuaucaauaacagaauuauuguauuuaaa

SEQ ID NO: 193604 - RNA, 64 nt, hsa
uggaucauucuaguaggaaaggacaauaagauuuuuuaucaaaaugugucaugccaguaagaga

SEQ ID NO: 193605 - RNA, 64 nt, hsa
uaucaauggauuaagaaguuuaagauuuugcagauuuaucaauuuggguuuuuguacugaaguu

SEQ ID NO: 193606 - RNA, 64 nt, hsa
uuuacgguguuugaagaccagcuacuccuuaauauuuaucaauggauuaagaaguuuaagauuu

SEQ ID NO: 193607 - RNA, 64 nt, hsa
agaccacaaguggguggugagaccauugaaagccuuuaucaacugaagaguccauuuaacagca

SEQ ID NO: 193608 - RNA, 64 nt, hsa
uugggauggaaaaugcuaaucaacuacccuuucuuuuaucaaguaauuaaaauaaaucuacaua

SEQ ID NO: 193609 - RNA, 64 nt, hsa
auacaccacuugaggacaauaucaugacucacgguuuaucaaguuuauguucuggacugguagc

SEQ ID NO: 193610 - RNA, 64 nt, hsa
gcuuaagaaauacauuuaaccuguuaugucaguauuuaucaaugaaguuugauaauucacuuuu

SEQ ID NO: 193611 - RNA, 64 nt, hsa
uuauaaaaaacaauuguauuuuuaagaauguuuauuuaucaaagucuuuccuucuucuauuaaa

SEQ ID NO: 193612 - RNA, 64 nt, hsa
aaauaaaugcauugcuuaaugguuucucauuauguuuaucaaaaaacaacuguagcuguuauuu

SEQ ID NO: 193613 - RNA, 64 nt, hsa
acuaagugcacucuuucaaaacuuauucuauaacuuuaucaauucaugugaauuuuagcucaau

SEQ ID NO: 193614 - RNA, 64 nt, hsa
gguuguuuuccuguaauauaaaagaaaaaguuaauuuaucaauugauugaauacaguuuuuacu

SEQ ID NO: 193615 - RNA, 64 nt, hsa
uaucaauugauugaauacaguuuuuacuaauuaguuuaucaaaccaaauacugugaacguacca

SEQ ID NO: 193616 - RNA, 64 nt, hsa
ccaauguaaagaauguguaucuguauauaaauaauuuaucaaauaguuuucucuuugugucugu

SEQ ID NO: 193617 - RNA, 64 nt, hsa
augaagacucaguugcauuuuuaucgaauacauuuuuaucaacaguuaaagacuauggugguuu

SEQ ID NO: 193618 - RNA, 64 nt, hsa
cacaguuucuguaaauuauuuagcagccuuaaaguuuaucaaaaaauuguccagauuccacgug

SEQ ID NO: 193619 - RNA, 64 nt, hsa
agccuuaagagccucagugaagauuguauuuuauuuuaucaaaagccaccuagcagucaucugu

SEQ ID NO: 193620 - RNA, 64 nt, hsa
ccuuauucccacacacucuugggcugaccuuuauuuuaucaauaagcucaauauuacuuuguuu

SEQ ID NO: 193621 - RNA, 64 nt, hsa
uagaagugauuagggcaagcuaguugaccugcacuuuaucaaagguugggguuaaaggaaggug

SEQ ID NO: 193622 - RNA, 64 nt, hsa
uuauauugugagaacacauuuagucaguuuggguuuuaucaauccuguuaaugcuuguccuugg

SEQ ID NO: 193623 - RNA, 64 nt, hsa
auuuuugcgcagacuuauacaugucuaggauccuuuuaucaaggcaguuaugaucaucguuuuc

SEQ ID NO: 193624 - RNA, 64 nt, hsa
aauccuaucugcugcuuguuuuuguaaauagaguuuuaucaaaccacagccaugcuuacuuguu

SEQ ID NO: 193625 - RNA, 64 nt, hsa
ucagaaacaagaaaacaaaugauaaaggaacucauuuaucaauagaggugaaaggaaauuauua

SEQ ID NO: 193626 - RNA, 64 nt, hsa
gguuuguauugcccaaaauuggauauaacaaauuuuuaucaauuguggaauagaugaauaagug

SEQ ID NO: 193627 - RNA, 64 nt, hsa
aaaccuaagaauaaacacaacaaugaguuaggucuuuaucaaguuauaaaauauguugaaaggc

SEQ ID NO: 193628 - RNA, 61 nt, hsa
uaguggugaagcuacccuaaagcuaucuaucuuuaucaaauggaaugaaacuagauaauuu

SEQ ID NO: 193629 - RNA, 64 nt, hsa
uaaauucagauccuuucuccacacagcaaugacauuuaucaaucugacucagguguggcuguug

SEQ ID NO: 193630 - RNA, 64 nt, hsa
aagacauuuucuacccuagauccaauugcauuuauuuaucaauaagugccauuaaauugaaauu

SEQ ID NO: 193631 - RNA, 64 nt, hsa
uaucuagcauagcacaaacguuuuuccagucuucuuuaucaacacuaaugccucuuaauugcau

SEQ ID NO: 193632 - RNA, 64 nt, hsa; identical to SEQ ID NO: 193524

SEQ ID NO: 193633 - RNA, 64 nt, hsa; identical to SEQ ID NO: 193525

SEQ ID NO: 193634 - RNA, 64 nt, hsa; identical to SEQ ID NO: 193526

SEQ ID NO: 193635 - RNA, 64 nt, hsa; identical to SEQ ID NO: 193527

SEQ ID NO: 193636 - RNA, 64 nt, hsa; identical to SEQ ID NO: 193528

SEQ ID NO: 193637 - RNA, 64 nt, hsa; identical to SEQ ID NO: 193529

SEQ ID NO: 193638 - RNA, 64 nt, hsa; identical to SEQ ID NO: 193530

SEQ ID NO: 193639 - RNA, 64 nt, hsa; identical to SEQ ID NO: 193531

SEQ ID NO: 193640 - RNA, 64 nt, hsa; identical to SEQ ID NO: 193532

SEQ ID NO: 193641 - RNA, 64 nt, hsa; identical to SEQ ID NO: 193533

SEQ ID NO: 193642 - RNA, 64 nt, hsa; identical to SEQ ID NO: 193534

SEQ ID NO: 193643 - RNA, 64 nt, hsa; identical to SEQ ID NO: 193535

SEQ ID NO: 193644 - RNA, 64 nt, hsa; identical to SEQ ID NO: 193536

SEQ ID NO: 193645 - RNA, 64 nt, hsa; identical to SEQ ID NO: 193537

SEQ ID NO: 193646 - RNA, 64 nt, hsa; identical to SEQ ID NO: 193538

SEQ ID NO: 193647 - RNA, 64 nt, hsa; identical to SEQ ID NO: 193539

SEQ ID NO: 193648 - RNA, 64 nt, hsa; identical to SEQ ID NO: 193540

SEQ ID NO: 193649 - RNA, 64 nt, hsa; identical to SEQ ID NO: 193541

SEQ ID NO: 193650 - RNA, 64 nt, hsa; identical to SEQ ID NO: 193542

SEQ ID NO: 193651 - RNA, 64 nt, hsa; identical to SEQ ID NO: 193543

SEQ ID NO: 193652 - RNA, 64 nt, hsa; identical to SEQ ID NO: 193544

SEQ ID NO: 193653 - RNA, 64 nt, hsa; identical to SEQ ID NO: 193545

SEQ ID NO: 193654 - RNA, 64 nt, hsa; identical to SEQ ID NO: 193546

SEQ ID NO: 193655 - RNA, 64 nt, hsa; identical to SEQ ID NO: 193547

SEQ ID NO: 193656 - RNA, 64 nt, hsa; identical to SEQ ID NO: 193548

SEQ ID NO: 193657 - RNA, 64 nt, hsa; identical to SEQ ID NO: 193549

SEQ ID NO: 193658 - RNA, 64 nt, hsa; identical to SEQ ID NO: 193550

SEQ ID NO: 193659 - RNA, 64 nt, hsa; identical to SEQ ID NO: 193551

SEQ ID NO: 193660 - RNA, 64 nt, hsa; identical to SEQ ID NO: 193552

SEQ ID NO: 193661 - RNA, 64 nt, hsa; identical to SEQ ID NO: 193553

SEQ ID NO: 193662 - RNA, 64 nt, hsa; identical to SEQ ID NO: 193554

SEQ ID NO: 193663 - RNA, 64 nt, hsa; identical to SEQ ID NO: 193555

SEQ ID NO: 193664 - RNA, 64 nt, hsa; identical to SEQ ID NO: 193556

SEQ ID NO: 193665 - RNA, 64 nt, hsa; identical to SEQ ID NO: 193557

SEQ ID NO: 193666 - RNA, 64 nt, hsa; identical to SEQ ID NO: 193558

SEQ ID NO: 193667 - RNA, 64 nt, hsa; identical to SEQ ID NO: 193559

SEQ ID NO: 193668 - RNA, 64 nt, hsa; identical to SEQ ID NO: 193560

SEQ ID NO: 193669 - RNA, 64 nt, hsa; identical to SEQ ID NO: 193561

SEQ ID NO: 193670 - RNA, 64 nt, hsa; identical to SEQ ID NO: 193562

SEQ ID NO: 193671 - RNA, 64 nt, hsa; identical to SEQ ID NO: 193563

SEQ ID NO: 193672 - RNA, 64 nt, hsa; identical to SEQ ID NO: 193564

SEQ ID NO: 193673 - RNA, 64 nt, hsa; identical to SEQ ID NO: 193565

SEQ ID NO: 193674 - RNA, 64 nt, hsa; identical to SEQ ID NO: 193566

SEQ ID NO: 193675 - RNA, 64 nt, hsa; identical to SEQ ID NO: 193567

SEQ ID NO: 193676 - RNA, 64 nt, hsa; identical to SEQ ID NO: 193568

SEQ ID NO: 193677 - RNA, 64 nt, hsa; identical to SEQ ID NO: 193569

SEQ ID NO: 193678 - RNA, 64 nt, hsa; identical to SEQ ID NO: 193570

SEQ ID NO: 193679 - RNA, 64 nt, hsa; identical to SEQ ID NO: 193571

SEQ ID NO: 193680 - RNA, 64 nt, hsa; identical to SEQ ID NO: 193572

SEQ ID NO: 193681 - RNA, 64 nt, hsa; identical to SEQ ID NO: 193573

SEQ ID NO: 193682 - RNA, 64 nt, hsa; identical to SEQ ID NO: 193574

SEQ ID NO: 193683 - RNA, 64 nt, hsa; identical to SEQ ID NO: 193575

SEQ ID NO: 193684 - RNA, 64 nt, hsa; identical to SEQ ID NO: 193576

SEQ ID NO: 193685 - RNA, 64 nt, hsa; identical to SEQ ID NO: 193577

SEQ ID NO: 193686 - RNA, 64 nt, hsa; identical to SEQ ID NO: 193578

SEQ ID NO: 193687 - RNA, 64 nt, hsa; identical to SEQ ID NO: 193579

SEQ ID NO: 193688 - RNA, 64 nt, hsa; identical to SEQ ID NO: 193580

SEQ ID NO: 193689 - RNA, 64 nt, hsa; identical to SEQ ID NO: 193581

SEQ ID NO: 193690 - RNA, 64 nt, hsa; identical to SEQ ID NO: 193582

SEQ ID NO: 193691 - RNA, 64 nt, hsa; identical to SEQ ID NO: 193583

SEQ ID NO: 193692 - RNA, 64 nt, hsa; identical to SEQ ID NO: 193584

SEQ ID NO: 193693 - RNA, 64 nt, hsa; identical to SEQ ID NO: 193585

SEQ ID NO: 193694 - RNA, 64 nt, hsa; identical to SEQ ID NO: 193586

SEQ ID NO: 193695 - RNA, 64 nt, hsa; identical to SEQ ID NO: 193587

SEQ ID NO: 193696 - RNA, 64 nt, hsa; identical to SEQ ID NO: 193588

SEQ ID NO: 193697 - RNA, 64 nt, hsa; identical to SEQ ID NO: 193589

SEQ ID NO: 193698 - RNA, 64 nt, hsa; identical to SEQ ID NO: 193590

SEQ ID NO: 193699 - RNA, 64 nt, hsa; identical to SEQ ID NO: 193591

SEQ ID NO: 193700 - RNA, 64 nt, hsa; identical to SEQ ID NO: 193592

SEQ ID NO: 193701 - RNA, 64 nt, hsa; identical to SEQ ID NO: 193593

SEQ ID NO: 193702 - RNA, 64 nt, hsa; identical to SEQ ID NO: 193594

SEQ ID NO: 193703 - RNA, 64 nt, hsa; identical to SEQ ID NO: 193595

SEQ ID NO: 193704 - RNA, 64 nt, hsa; identical to SEQ ID NO: 193596

SEQ ID NO: 193705 - RNA, 64 nt, hsa; identical to SEQ ID NO: 193597

SEQ ID NO: 193706 - RNA, 64 nt, hsa; identical to SEQ ID NO: 193598

SEQ ID NO: 193707 - RNA, 64 nt, hsa; identical to SEQ ID NO: 193599

SEQ ID NO: 193708 - RNA, 64 nt, hsa; identical to SEQ ID NO: 193600

SEQ ID NO: 193709 - RNA, 64 nt, hsa; identical to SEQ ID NO: 193601

SEQ ID NO: 193710 - RNA, 64 nt, hsa; identical to SEQ ID NO: 193602

SEQ ID NO: 193711 - RNA, 64 nt, hsa; identical to SEQ ID NO: 193603

SEQ ID NO: 193712 - RNA, 64 nt, hsa; identical to SEQ ID NO: 193604

SEQ ID NO: 193713 - RNA, 64 nt, hsa; identical to SEQ ID NO: 193605

SEQ ID NO: 193714 - RNA, 64 nt, hsa; identical to SEQ ID NO: 193606

SEQ ID NO: 193715 - RNA, 64 nt, hsa; identical to SEQ ID NO: 193607

SEQ ID NO: 193716 - RNA, 64 nt, hsa; identical to SEQ ID NO: 193608

SEQ ID NO: 193717 - RNA, 64 nt, hsa; identical to SEQ ID NO: 193609

SEQ ID NO: 193718 - RNA, 64 nt, hsa; identical to SEQ ID NO: 193610

SEQ ID NO: 193719 - RNA, 64 nt, hsa; identical to SEQ ID NO: 193611

SEQ ID NO: 193720 - RNA, 64 nt, hsa; identical to SEQ ID NO: 193612

SEQ ID NO: 193721 - RNA, 64 nt, hsa; identical to SEQ ID NO: 193613

SEQ ID NO: 193722 - RNA, 64 nt, hsa; identical to SEQ ID NO: 193614

SEQ ID NO: 193723 - RNA, 64 nt, hsa; identical to SEQ ID NO: 193615

SEQ ID NO: 193724 - RNA, 64 nt, hsa; identical to SEQ ID NO: 193616

SEQ ID NO: 193725 - RNA, 64 nt, hsa; identical to SEQ ID NO: 193617

SEQ ID NO: 193726 - RNA, 64 nt, hsa; identical to SEQ ID NO: 193618

SEQ ID NO: 193727 - RNA, 64 nt, hsa; identical to SEQ ID NO: 193619

SEQ ID NO: 193728 - RNA, 64 nt, hsa; identical to SEQ ID NO: 193620

SEQ ID NO: 193729 - RNA, 64 nt, hsa; identical to SEQ ID NO: 193621

SEQ ID NO: 193730 - RNA, 64 nt, hsa; identical to SEQ ID NO: 193622

SEQ ID NO: 193731 - RNA, 64 nt, hsa; identical to SEQ ID NO: 193623

SEQ ID NO: 193732 - RNA, 64 nt, hsa; identical to SEQ ID NO: 193624

SEQ ID NO: 193733 - RNA, 64 nt, hsa; identical to SEQ ID NO: 193625

SEQ ID NO: 193734 - RNA, 64 nt, hsa; identical to SEQ ID NO: 193626

SEQ ID NO: 193735 - RNA, 64 nt, hsa; identical to SEQ ID NO: 193627

SEQ ID NO: 193736 - RNA, 61 nt, hsa; identical to SEQ ID NO: 193628

SEQ ID NO: 193737 - RNA, 64 nt, hsa; identical to SEQ ID NO: 193629

SEQ ID NO: 193738 - RNA, 64 nt, hsa; identical to SEQ ID NO: 193630

SEQ ID NO: 193739 - RNA, 64 nt, hsa; identical to SEQ ID NO: 193631

SEQ ID NO: 193740 - RNA, 64 nt, hsa
ugguuuugguugcuccucccccagcugccaccccccaccuuacccuuauuccucucuguccaca

SEQ ID NO: 193741 - RNA, 64 nt, hsa
uuacccuuauuccucucuguccacauuuucugccccaccuuacuucuccucccugacagacauc

SEQ ID NO: 193742 - RNA, 64 nt, hsa
guagugaauguaaggaaagcuuaauggaucucucccaccuuaauaaaugggagagcaucccuaa

SEQ ID NO: 193743 - RNA, 64 nt, hsa
guagcaguugugaaagagucuucagucguaguguccaccuuacucaacaucagaaaauucacaa

SEQ ID NO: 193744 - RNA, 64 nt, hsa
aaugcaauccaugccauaagcaggaguugauacaccaccuuauuagcuaaaaauauauauaaca

SEQ ID NO: 193745 - RNA, 64 nt, hsa
uccuguccccuccuuccagccugagauguaggcuccaccuuaacugugcucagauacacaagug

SEQ ID NO: 193746 - RNA, 60 nt, hsa
uucuucugauuuuuaugugaccauagcuaugauguaaagacaauacuguccuucagagaa

SEQ ID NO: 193747 - RNA, 64 nt, hsa
uuuauuaauaguauuagaacucauucccugaacugauguaaaucuucauagugucagacauacu

SEQ ID NO: 193748 - RNA, 64 nt, hsa
gacagcucagauugucgaguuaguaaacaugagcgauguaaaaacuuuauuugaaaucuccuaa

SEQ ID NO: 193749 - RNA, 64 nt, hsa
uuguuggauuucauuuccccaggucuucaguguugauguaaauguguuuuguaguguugcuuag

SEQ ID NO: 193750 - RNA, 64 nt, hsa
ccugaagaugugauacacugaauggaaauaaauagauguaaauaaaauugaguucucauuuaac

SEQ ID NO: 193751 - RNA, 64 nt, hsa
auaacaaucagguaagaucauaacaaugucucaugauguaaaaaauauuaaagauaucaauacu

SEQ ID NO: 193752 - RNA, 64 nt, hsa
uuauauauuuaaagugcucauuaauagaaugauggauguaaauuggauguaaauauucaguuua

SEQ ID NO: 193753 - RNA, 64 nt, hsa
aagugcucauuaauagaaugauggauguaaauuggauguaaauauucaguuuauauaauuauau

SEQ ID NO: 193754 - RNA, 64 nt, hsa
aauuuuuucagauggacaaaauguauaugguacagauguaaaguuuucuauguaaaaaauucug

SEQ ID NO: 193755 - RNA, 64 nt, hsa
agguguggaagugaaacuuacccaaagaacuauagauguaaagauugaacuucuacaagaagua

SEQ ID NO: 193756 - RNA, 64 nt, hsa
uggaaggaaauaaacauuacgguacagacauggagauguaaaaugaguuuguauuauuacaaau

SEQ ID NO: 193757 - RNA, 64 nt, hsa
agaacuaacuuuggucucagcgggagccaguggugauguaaaaaugcuuccacugcaagucugu

SEQ ID NO: 193758 - RNA, 64 nt, hsa
auggauauguaaacaaugacuguaacguguuauagauguaaagacaaaauaaagguuaaagagg

SEQ ID NO: 193759 - RNA, 64 nt, hsa
ugcaaguuuuuuggugcuguaguauaugaugaaagauguaaagcugaauaaagcauuauuucug

SEQ ID NO: 193760 - RNA, 64 nt, hsa
gagcaagacucccucucaaaagaaaaagaaaaaagauguaaaaaccauucuuaguuugugggcc

SEQ ID NO: 193761 - RNA, 64 nt, hsa
agccacugugcccaggcagacccccuucuuuaaagauguaaaacccggccgggcgcgguggcuc

SEQ ID NO: 193762 - RNA, 64 nt, hsa
auaguuuuguuuguuagaaaaguugcucuuaaaagauguaaauagaugacaaacgauguaaaua

SEQ ID NO: 193763 - RNA, 64 nt, hsa
aguugcucuuaaaagauguaaauagaugacaaacgauguaaauaauuuuguaagaggcuucaaa

SEQ ID NO: 193764 - RNA, 64 nt, hsa
aauuugggagguuaauaccaaguauucauuucaugauguaaagaaacugaacagugaaguggcu

SEQ ID NO: 193765 - RNA, 64 nt, hsa; identical to SEQ ID NO: 193764

SEQ ID NO: 193766 - RNA, 64 nt, hsa
ugauaagucuuagaggcgagugaggaauaaaauggauguaaacauuuacaugggaugcauuaga

SEQ ID NO: 193767 - RNA, 64 nt, hsa
aaugaagcucuaauuauugcagacauauuuuugagauguaaaaaaaaaaauuuaaaguuaaaug

SEQ ID NO: 193768 - RNA, 64 nt, hsa
ucuuaaaaugggacaaucagccucaugaaaaauugauguaaaucagaagaauacccuagaauga

SEQ ID NO: 193769 - RNA, 64 nt, hsa
uuuuuaaggauugcacuacagaagaauguacccugauguaaaucucugcgguucugggagccaa

SEQ ID NO: 193770 - RNA, 64 nt, hsa
ccuuuuuaauaacuuauuuuauacauauugugcagauguaaaucuuguaauuaauggucaaacu

SEQ ID NO: 193771 - RNA, 64 nt, hsa
uacuuuaaaaaaaauccaguuucuccuauaacaugauguaaauuaaauauucaggaauauuuca

SEQ ID NO: 193772 - RNA, 64 nt, hsa
uucuuauuuaagaaaccuagaucaaguuuuuacagauguaaauaaaaguugaauaguuuaccuu

SEQ ID NO: 193773 - RNA, 64 nt, hsa
uaauaaugcacaguaaauaugugaauuuuuccuagauguaaaaaaaaaaaucuuucauauaaag

SEQ ID NO: 193774 - RNA, 64 nt, hsa
uccuuguagccuuuugacuuucauuggaaauuaggauguaaaucugcucaggagaccuggagga

SEQ ID NO: 193775 - RNA, 64 nt, hsa
uucucugaggaagcugggguucaugacaauggcagauguaaaguuauucuugaagucagauuga

SEQ ID NO: 193776 - RNA, 64 nt, hsa
cugggaagggagcggcagcccagccaggccuggcccauaaaaggcucccaugcugagcagccca

SEQ ID NO: 193777 - RNA, 64 nt, hsa
aaugaaauugaacuauugacugggccccagaaauccauaaaauggcugcagacaguuguuucug

SEQ ID NO: 193778 - RNA, 64 nt, hsa
auucagaccuuaguacagcaagacacucuggccaccauaaaaaacgcagaaaagaaaaaaaggu

SEQ ID NO: 193779 - RNA, 64 nt, hsa
caaauauuaaagagacugguagcucaucauccuaccauaaaagagaaaaaaauucggaaaguga

SEQ ID NO: 193780 - RNA, 64 nt, hsa
ucaaaagagaaaaaaguuucugaaaacaaugaaaccauaaaagauaauauucuaaaaacugaga

SEQ ID NO: 193781 - RNA, 64 nt, hsa
acaguugguuuucuuauccuuugauaaaagcaucccauaaaauauaaaguaguaaguuaacaua

SEQ ID NO: 193782 - RNA, 64 nt, hsa
ccucuguuagucauuuguaaauucuaaauggucaccauaaaauguauuagguaggagaagauac

SEQ ID NO: 193783 - RNA, 64 nt, hsa
uauuuaaaauuuagauuuauuagagggagcauggccauaaaauaaaauaaaauaaaauuuagau

SEQ ID NO: 193784 - RNA, 64 nt, hsa
aggcaacuccagaagaaagaagcccuuuacauuuccauaaaacacuuuagaaucagcuagucaa

SEQ ID NO: 193785 - RNA, 64 nt, hsa
uccugguucccauuagucuuaagucuucugguucccauaaaagacucaguuuuauugagguaga

SEQ ID NO: 193786 - RNA, 64 nt, hsa
auugagcagugcugcaacauguacuguaugaaggccauaaaauagagcuagucauggauaacag

SEQ ID NO: 193787 - RNA, 64 nt, hsa
ugccgucuuuugaggaaaucuagugaagaggucgccauaaaauauuagagucaacaaccaaaau

SEQ ID NO: 193788 - RNA, 64 nt, hsa
uuuugaacuucuuggaucuguggguuuauuguuuccauaaaauuuggaaauuuuuacaaucuuc

SEQ ID NO: 193789 - RNA, 64 nt, hsa
aucguuuuugaguuuggcaauaaaggcuaaucuaccauaaaacucuugaagcuuaagcuuuagg

SEQ ID NO: 193790 - RNA, 64 nt, hsa
auagucauaagaagagacaaucaaaaauaaucagccauaaaauauuaaaaagguauuauaaagg

SEQ ID NO: 193791 - RNA, 64 nt, hsa
aaacuugaccuugaccaugucacuuuacguuugaauuucugagcuaaagagucagagagauuag

SEQ ID NO: 193792 - RNA, 64 nt, hsa
gccauaccaggguaucccuugucccuucacccccauuucugaccucaguuccuggaggggggaa

SEQ ID NO: 193793 - RNA, 64 nt, hsa
uuaauuguguggguccauagacuuuuuaaugaagauuucugacuuugccacuguaaaugccuuu

SEQ ID NO: 193794 - RNA, 64 nt, hsa
uuaucagcuauuucuuauauaucauaaucuggcaauuucugaaaccagucagaaaagacauaua

SEQ ID NO: 193795 - RNA, 64 nt, hsa
caugcccccuuuaauguuaacaugacuuggaguaauuucugagguuuacugacaaacauaaaaa

SEQ ID NO: 193796 - RNA, 64 nt, hsa
augaugcucuggacauuuuaggaagcuuaaguaaauuucugauuuuccuuuauugauuauguaa

SEQ ID NO: 193797 - RNA, 64 nt, hsa
uuuacccuaacaguuuuaccaccuaguaacagucauuucugaaaauauguuggauagaaaguca

SEQ ID NO: 193798 - RNA, 64 nt, hsa
ugcagcaugcaauauaugcuuauauuucauuuuaauuucugauauauaaugaacuucuugggag

SEQ ID NO: 193799 - RNA, 64 nt, hsa
uauuucuuuaauuuaugcuugaaucugaaaaauuauuucugacuuacuccauggccuccuuaua

SEQ ID NO: 193800 - RNA, 64 nt, hsa
caacuucaagugauuuagauaucuaucuaucuagauuucugaaccaagauauauuuauaguuca

SEQ ID NO: 193801 - RNA, 64 nt, hsa
uguuaguuaaaugagcuauagauaaggcagcuaaauuucugaaagauagccagaguaaguaagc

SEQ ID NO: 193802 - RNA, 64 nt, hsa
ggaggaaucucuguaauuccugcuugggcuccaaauuucugaagaguaauauuuuuaaacuaua

SEQ ID NO: 193803 - RNA, 64 nt, hsa
ucugagcaaaaaucugggaaacucaagcaaaggaauuucugaaaguaucagucuucugaauucu

SEQ ID NO: 193804 - RNA, 64 nt, hsa
gaauuuuuuaaaacauuuauaauaaauaguagcaauuucugagcaaaaaucugggaaacucaag

SEQ ID NO: 193805 - RNA, 64 nt, hsa
gauccaggaaaaauaaaaugggaacauggacaccauuucugaccuucaaauaaaacuuauuaug

SEQ ID NO: 193806 - RNA, 64 nt, hsa
aguucugaucaaauccuuacauuuugcaacacucauuucugaauuuucaguaaagaaauacaca

SEQ ID NO: 193807 - RNA, 64 nt, hsa
cacuuuaggaaacaauagauuauuuuauauuauuauuucugauggugacaaguuugucuugagg

SEQ ID NO: 193808 - RNA, 64 nt, hsa
ccaucucuuggucuucuccuuugaagcacagccuauuucugagccaaggguuggggaagccugu

SEQ ID NO: 193809 - RNA, 64 nt, hsa
ugcgguuuuggcucgucuugguagucucaucuucauuucugauucugguucuggaacuucauga

SEQ ID NO: 193810 - RNA, 64 nt, hsa
acaauuauuaaaacaaacagauccauguuaggacauuucugaauaauaaagagaaaagguguuu

SEQ ID NO: 193811 - RNA, 64 nt, hsa
aaauuacuuuuuaaagauacuggauuuuccuaagauuucugauuuacacugauauuuuuuuuug

SEQ ID NO: 193812 - RNA, 64 nt, hsa
auuccccaauaucaucuaaucaagccauauuuaaauuucugaaguuaacuccaaauuucuuuau

SEQ ID NO: 193813 - RNA, 64 nt, hsa
guuucucuuguccucguaauaccauuuggauuuuauuucugaauuuaaauaguaaaauauuuau

SEQ ID NO: 193814 - RNA, 64 nt, hsa
agcagauacaaugaucugcuuuagugagaggacaauuucugauugauuguuuucucuucaggcc

SEQ ID NO: 193815 - RNA, 64 nt, hsa
acguuagauuugguuugaaaaacuaaaauuucagauuucugaggauauacugucuuagacuuau

SEQ ID NO: 193816 - RNA, 64 nt, hsa
gagauuauaucauuucuuuuucaauuauacuauuauuucugagaaugaaauggacgauuacacu

SEQ ID NO: 193817 - RNA, 64 nt, hsa
guguuuuguaguucaacaacucaagacgaagcuuauuucugaggauaagcucuuuaaaggcaaa

SEQ ID NO: 193818 - RNA, 64 nt, hsa
caugcuccuggagcucacagccuucuguggugucauuucugaaacaagggcguggaucccucaa

SEQ ID NO: 193819 - RNA, 64 nt, hsa
gaagagacacuuaagcuaaaaauucccuugucauauuucugaaacuccauuauaacauauguaa

SEQ ID NO: 193820 - RNA, 64 nt, hsa
uauagagaugagguccgcuucuguaguacugagcauuucugacugaucaaaaaggccuagucug

SEQ ID NO: 193821 - RNA, 64 nt, hsa
uuaacugcuaguaguggaauacuggaaaagcuucauuucugaagaugaauuuuauuuuuaaaaa

SEQ ID NO: 193822 - RNA, 64 nt, hsa
cucaaaacuuuuagcuuugaucacaaguggacaaauuucugaaaccaaaggcaacuaaguugcu

SEQ ID NO: 193823 - RNA, 64 nt, hsa
caaauaggcaucucagcuccucacacuuauggcuauuucugacguauagccaguuuucuucccu

SEQ ID NO: 193824 - RNA, 64 nt, hsa
cuugcuauacagaaacuauguauguauuuaggcuauuucugaagggcacagggaagggggaaca

SEQ ID NO: 193825 - RNA, 64 nt, hsa
acccaaacaaaaaaauaauaaucaaaugccuucaauuucugagaaaaugaggcagagcauggaa

SEQ ID NO: 193826 - RNA, 64 nt, hsa
gaccauaacccaggaauccagagcucgguuucucauuucugagaucaggaugcuuguauagugg

SEQ ID NO: 193827 - RNA, 64 nt, hsa
aagaaauauuuuauaaauccuguuuaacagcagaauuucugaauguguagagacuacuacaaaa

SEQ ID NO: 193828 - RNA, 64 nt, hsa
ccaauaaggggugcuucuuugugacaguauuuuuauuucugacauucauuuuauuuggguacau

SEQ ID NO: 193829 - RNA, 64 nt, hsa
ccuuuguuguauuuaacaaaauccaggugcaucaauuucugaugcuuuuuacuauuguguauua

SEQ ID NO: 193830 - RNA, 64 nt, hsa
acuacaugacagaaaugaccuaucacuacuuauuauuucugaagccuaacugcaagacugauuu

SEQ ID NO: 193831 - RNA, 64 nt, hsa
uacuuauuauuucugaagccuaacugcaagacugauuucugagaacaaguaaagaacuggaaua

SEQ ID NO: 193832 - RNA, 64 nt, hsa
cagaaaguugccaaacccuucucuauccucucguauuucugaguuuuuguccuucccgagggag

SEQ ID NO: 193833 - RNA, 64 nt, hsa
ggugggcauuugguauguccuuucucuuggggugauuucugauguuuuuacucuauauagugaa

SEQ ID NO: 193834 - RNA, 64 nt, hsa
gucucuauugucacacaugguuauauuuaaaguaauuucugaacuguguaaugugucuagagua

SEQ ID NO: 193835 - RNA, 64 nt, hsa
cacgacguguuccuaaaacauguuugaaaggugaauuucugaaagucuacaauaaauguaggug

SEQ ID NO: 193836 - RNA, 64 nt, hsa
aaacagacagcucccacuaagaucacguucugguauuucugagguuaacacuugauuuagcccc

SEQ ID NO: 193837 - RNA, 64 nt, hsa
uuuagccccuacauaucuuuccauauauccuauuauuucugaauauauguccucaaaaucccca

SEQ ID NO: 193838 - RNA, 64 nt, hsa
uugggacagauuuuauguaaucuuuauaaguaugauuucugaagaaaagcaaaugcauuaguau

SEQ ID NO: 193839 - RNA, 64 nt, hsa
ccuuauggcugccacucuuauuuaccuuuaaauaauuucugaaauuuaaccuuuucagaaugca

SEQ ID NO: 193840 - RNA, 64 nt, hsa
uggcagaugaaaugugcuggaggaaaaaaaugacauuucugaccuucccgggacacauucuucu

SEQ ID NO: 193841 - RNA, 64 nt, hsa
agccuuguuauuuuuaaguccuauuuugauauuaauuucugauuaguuaguaaauaacaccugg

SEQ ID NO: 193842 - RNA, 64 nt, hsa
uuacaaacaaaaagccuaaucccucuauuuuaagauuucugaaaaaacacuccauguuauauuc

SEQ ID NO: 193843 - RNA, 64 nt, hsa
uaggggggauauugcuguccugagggacccucucauuucugacauuugaagaaaacguauaaau

SEQ ID NO: 193844 - RNA, 64 nt, hsa
caaacuacuauaaacaaauuuauaaacauuacuaauuucugaugaaaauaaaguuguuucuccc

SEQ ID NO: 193845 - RNA, 64 nt, hsa
ugucucuuaaaguaagugguuuauagacauuacuauuucugauaauaauuuacaaacuacuaua

SEQ ID NO: 193846 - RNA, 64 nt, hsa
ggggcaagaaagagggagggaaaucuuucaacuuauuucugaaaaagagaaaaaaauauaaaau

SEQ ID NO: 193847 - RNA, 64 nt, hsa
uaauugccauagaaaguauaauuucagugcaguaauuucugagagcuaguaccuauaugcuacc

SEQ ID NO: 193848 - RNA, 64 nt, hsa
gacaauauuaauacuguuuauagcuagaaguuugauuucugaauucuuugagauuuuagcaaaa

SEQ ID NO: 193849 - RNA, 64 nt, hsa
uugcaaggacucuggaaacugccgccaaugaccaauuucugacuaaccagccaccuuuucucuc

SEQ ID NO: 193850 - RNA, 64 nt, hsa
uuaauuuaagccaccuaaaugaccucuaucagggauuucugaauaauguaaaacacucaaaagc

SEQ ID NO: 193851 - RNA, 64 nt, hsa
ccaacuacaguuuuuccucauuugaaucuaacccauuucugauauacugaaugguaaauuuuua

SEQ ID NO: 193852 - RNA, 64 nt, hsa
agcaaaacuaaagaacugcagucuucugaucuuuauuucugaagagcuagccuuuaacauauau

SEQ ID NO: 193853 - RNA, 64 nt, hsa
aaaucaucuguaacuucuuaauuacaguuuaccuauuucugacaugcagcacugccaucucuuc

SEQ ID NO: 193854 - RNA, 64 nt, hsa
agaaaauauuuaaaguggcucauagguaaugaauauuucugacuuagauguaaauccaucugga

SEQ ID NO: 193855 - RNA, 64 nt, hsa
cuagaaaaugauggauaaaagggcugauaagaaaauuucugacugucaguagaagugagauaag

SEQ ID NO: 193856 - RNA, 64 nt, hsa
auuuuauguuuuuccugcuuuguggaugaaaaauauuucugagugguaguuuuuugacagguag

SEQ ID NO: 193857 - RNA, 64 nt, hsa
gguagaccaugucuuaucuuguuucaaaauaaguauuucugauuuuguaaaaugaaauauaaaa

SEQ ID NO: 193858 - RNA, 64 nt, hsa; identical to SEQ ID NO: 87004

SEQ ID NO: 193859 - RNA, 64 nt, hsa; identical to SEQ ID NO: 87005

SEQ ID NO: 193860 - RNA, 64 nt, hsa; identical to SEQ ID NO: 87006

SEQ ID NO: 193861 - RNA, 64 nt, hsa; identical to SEQ ID NO: 87007

SEQ ID NO: 193862 - RNA, 64 nt, hsa; identical to SEQ ID NO: 87008

SEQ ID NO: 193863 - RNA, 64 nt, hsa; identical to SEQ ID NO: 87009

SEQ ID NO: 193864 - RNA, 64 nt, hsa; identical to SEQ ID NO: 87010

SEQ ID NO: 193865 - RNA, 64 nt, hsa; identical to SEQ ID NO: 87011

SEQ ID NO: 193866 - RNA, 64 nt, hsa; identical to SEQ ID NO: 87012

SEQ ID NO: 193867 - RNA, 64 nt, hsa; identical to SEQ ID NO: 87013

SEQ ID NO: 193868 - RNA, 64 nt, hsa; identical to SEQ ID NO: 87014

SEQ ID NO: 193869 - RNA, 64 nt, hsa; identical to SEQ ID NO: 87015

SEQ ID NO: 193870 - RNA, 64 nt, hsa; identical to SEQ ID NO: 87016

SEQ ID NO: 193871 - RNA, 64 nt, hsa; identical to SEQ ID NO: 87017

SEQ ID NO: 193872 - RNA, 64 nt, hsa; identical to SEQ ID NO: 87018

SEQ ID NO: 193873 - RNA, 64 nt, hsa; identical to SEQ ID NO: 87019

SEQ ID NO: 193874 - RNA, 64 nt, hsa; identical to SEQ ID NO: 87020

SEQ ID NO: 193875 - RNA, 64 nt, hsa; identical to SEQ ID NO: 87021

SEQ ID NO: 193876 - RNA, 64 nt, hsa; identical to SEQ ID NO: 87022

SEQ ID NO: 193877 - RNA, 64 nt, hsa; identical to SEQ ID NO: 87023

SEQ ID NO: 193878 - RNA, 64 nt, hsa; identical to SEQ ID NO: 87024

SEQ ID NO: 193879 - RNA, 64 nt, hsa; identical to SEQ ID NO: 87025

SEQ ID NO: 193880 - RNA, 64 nt, hsa; identical to SEQ ID NO: 87026

SEQ ID NO: 193881 - RNA, 64 nt, hsa; identical to SEQ ID NO: 87027

SEQ ID NO: 193882 - RNA, 64 nt, hsa; identical to SEQ ID NO: 87028

SEQ ID NO: 193883 - RNA, 64 nt, hsa; identical to SEQ ID NO: 87029

SEQ ID NO: 193884 - RNA, 64 nt, hsa; identical to SEQ ID NO: 87030

SEQ ID NO: 193885 - RNA, 64 nt, hsa; identical to SEQ ID NO: 87031

SEQ ID NO: 193886 - RNA, 64 nt, hsa; identical to SEQ ID NO: 87032

SEQ ID NO: 193887 - RNA, 64 nt, hsa; identical to SEQ ID NO: 87033

SEQ ID NO: 193888 - RNA, 64 nt, hsa; identical to SEQ ID NO: 87034

SEQ ID NO: 193889 - RNA, 64 nt, hsa; identical to SEQ ID NO: 87035

SEQ ID NO: 193890 - RNA, 64 nt, hsa; identical to SEQ ID NO: 87036

SEQ ID NO: 193891 - RNA, 64 nt, hsa; identical to SEQ ID NO: 87037

SEQ ID NO: 193892 - RNA, 64 nt, hsa; identical to SEQ ID NO: 87038

SEQ ID NO: 193893 - RNA, 51 nt, hsa; identical to SEQ ID NO: 87039

SEQ ID NO: 193894 - RNA, 64 nt, hsa; identical to SEQ ID NO: 87040

SEQ ID NO: 193895 - RNA, 64 nt, hsa; identical to SEQ ID NO: 87041

SEQ ID NO: 193896 - RNA, 64 nt, hsa; identical to SEQ ID NO: 87042

SEQ ID NO: 193897 - RNA, 64 nt, hsa; identical to SEQ ID NO: 87043

SEQ ID NO: 193898 - RNA, 64 nt, hsa
ucaagagcggugugcuuugcccgacugcucccaucaggaauaggagaguagacagagaucuucc

SEQ ID NO: 193899 - RNA, 64 nt, hsa
ugacaucugugagccaaagacugagccuuuuuggcaggaauaauaagcaauacuacacaacuug

SEQ ID NO: 193900 - RNA, 64 nt, hsa
uccugcccacgggaggacaagcaauaacucucuacaggaauauauuuuuuaaacgaagagacag

SEQ ID NO: 193901 - RNA, 64 nt, hsa
cccccacucccccuucccuuggagggagagguggcaggaauacuucaccuuuccucucccucag

SEQ ID NO: 193902 - RNA, 64 nt, hsa
aaguuuguaaaaauauacugauuuugaaaaguaucaggaauauaaauauuugguaauucugugu

SEQ ID NO: 193903 - RNA, 64 nt, hsa
uuaguuaguaaaaauccuauuaaugugaaccagccaggaauaacaguguuauuucuauuggaua

SEQ ID NO: 193904 - RNA, 64 nt, hsa
ggcuuaaacuaaaccuugacauccacaguagcaucaggaauagaaauguguauuuuggcuacag

SEQ ID NO: 193905 - RNA, 64 nt, hsa
caaacuaaguuacuuuuuuacuaacaaggaagaucaggaauaauauuucuuugaaagcugaaau

SEQ ID NO: 193906 - RNA, 64 nt, hsa
ugaagguacuaugaccaaagaaucagcugcucuacaggaauagcaugguuccagugaauuagag

SEQ ID NO: 193907 - RNA, 64 nt, hsa
aauccaucaucucuaucguugauauccuuccauccaggaauagauuuuucuuacucuacauaug

SEQ ID NO: 193908 - RNA, 64 nt, hsa
uucucagaaaucaguuuguagaaauauuuagcuucaggaauacugcucguuauaaacacuacua

SEQ ID NO: 193909 - RNA, 64 nt, hsa
cagaaauaucuucagaaguacgugaguuguuccucaggaauagauuuuucauaaagcagaauug

SEQ ID NO: 193910 - RNA, 64 nt, hsa
caaaggaaacaggaauaauaaaggcaucacugaccaggaauaucugggcuuuauugauaccaaa

SEQ ID NO: 193911 - RNA, 64 nt, hsa
uuaaacccagugaagcaacugaguacaaaggaaacaggaauaauaaaggcaucacugaccagga

SEQ ID NO: 193912 - RNA, 64 nt, hsa
ggugcuguggugcuugcauguagucccagcuauucaggaauauugcuugaguccagcuugggca

SEQ ID NO: 193913 - RNA, 64 nt, hsa
guggggaaaaaaaucagaauugcgucugugggaacaggaauaaaggagaaaccacuauugacug

SEQ ID NO: 193914 - RNA, 64 nt, hsa
acgggccuuuuaaucuuucaggaauacauauaagcaggaauacuuagccuguauugggaaggug

SEQ ID NO: 193915 - RNA, 64 nt, hsa
uugguaugaaugggugacgggccuuuuaaucuuucaggaauacauauaagcaggaauacuuagc

SEQ ID NO: 193916 - RNA, 64 nt, hsa
gggccuguucccagcacauuuuccuguaagcacucaggaauaaugaagcuuccuguguccuuua

SEQ ID NO: 193917 - RNA, 64 nt, hsa
aagaaagggacaggcucuggcuuguuaucugcaacaggaauauguccuuaaggcacaaaucacu

SEQ ID NO: 193918 - RNA, 64 nt, hsa
cuuggagggacguguuuaaugaaaucuugaaccccaggaauaguauuauguaaugaaaaccuau

SEQ ID NO: 193919 - RNA, 64 nt, hsa
gaugauaucucaauugguaucaaaagaauucuuacaggaauauuuaugaaagauugugauggug

SEQ ID NO: 193920 - RNA, 64 nt, hsa
ccuaauaccucauauuccccaucuuccucagcccagaaagcaauggggcuuuagugaugcuccu

SEQ ID NO: 193921 - RNA, 64 nt, hsa
acagagcagcccuuggguuuguaucugguaggggagaaagcagcaggacaguggaggugugugg

SEQ ID NO: 193922 - RNA, 64 nt, hsa
aggggcaaggcugcccccugccccagggcucuucagaaagcaucugcaugugaacaccaucaug

SEQ ID NO: 193923 - RNA, 64 nt, hsa
aaugggccaaacacaccucaaauuggcugaguugagaaagcagccccaguaguuccauucuugc

SEQ ID NO: 193924 - RNA, 64 nt, hsa
ugccuucucuguuccugcaccaaaaaugaucaggagaaagcauauuaccaggcugaacugucac

SEQ ID NO: 193925 - RNA, 64 nt, hsa
uuuagaaauauacauauuuuauacaaaauuauaaagaaagcauagagagguaagcauuaguggc

SEQ ID NO: 193926 - RNA, 64 nt, hsa
guauauauguuagaguuuugaaugagggauaaauagaaagcagaaugaauuaauggaaaagaac

SEQ ID NO: 193927 - RNA, 64 nt, hsa
ugucacgcaguugacugguuuucggccuuucuugagaaagcaaagugggucccagacauugaag

SEQ ID NO: 193928 - RNA, 64 nt, hsa
aaagauuaaauccuugacauaagaucucauuugcagaaagcagauuaaagaccaucagaaggaa

SEQ ID NO: 193929 - RNA, 64 nt, hsa
auuugcauuucauguuuaaccuccggcuggaaauagaaagcauucccuuagagaugaggauaaa

SEQ ID NO: 193930 - RNA, 64 nt, hsa
ucccauucugguagagggagacagucuacaaaccagaaagcaucagggaugcuaagugcaguga

SEQ ID NO: 193931 - RNA, 64 nt, hsa
cuggcuaggggccacagcguuagacagugcagagagaaagcacuuccaucgcugaggaaaguuc

SEQ ID NO: 193932 - RNA, 64 nt, hsa
aaggagagcaagaaggaaagauuugugaacuggaagaaagcaacaaagauugagaagccaugua

SEQ ID NO: 193933 - RNA, 64 nt, hsa
caaacagaguauguccgaugguaucuggguaagaagaaagcaaaagcaagggaccuucaugccc

SEQ ID NO: 193934 - RNA, 64 nt, hsa
gcaagacuccgucucaaaaaaaagaaaagaaaaaagaaagcauuguuuuaauugagaggggcag

SEQ ID NO: 193935 - RNA, 64 nt, hsa
ccucacaggcacaucaggcugcagaaugcgcuuuagaaagcauuguuuuaguccaggcacagug

SEQ ID NO: 193936 - RNA, 64 nt, hsa
auuuguggcuccugaguugagugauuuuggugaaagaaagcacauccaaagcauaguuuaccug

SEQ ID NO: 193937 - RNA, 64 nt, hsa
acagaggccacuggguucccagugguggcuguucagaaagcagaacauacuaagcgugagguau

SEQ ID NO: 193938 - RNA, 64 nt, hsa
gaagagggagggagagagaaagacgaagggagagagaaagcaguuuccaaggauauguuucaug

SEQ ID NO: 193939 - RNA, 64 nt, hsa
uuauugaaaauugccuuccauuaacacacaagaaagaaagcaggauuuucuccuguaucugaau

SEQ ID NO: 193940 - RNA, 64 nt, hsa
ucuuuuggaacuuguuucaagccaaaaacucucaagaaagcaaauugcaccucagcuggauuga

SEQ ID NO: 193941 - RNA, 64 nt, hsa
aacugugacuuuuccccaaacgucaaucuuuauuagaaagcauuuucuagguguguuuagugua

SEQ ID NO: 193942 - RNA, 64 nt, hsa
agcuaauuugaaauaaaaauuauuuguauaauuaagaaagcagauuagaugcacauggucaaca

SEQ ID NO: 193943 - RNA, 64 nt, hsa
uguucuuaugcuagugcuugcugagugcauacuaagaaagcaauuccaaauagauguauacauc

SEQ ID NO: 193944 - RNA, 64 nt, hsa
uuaaaacucaguagugucagccacuguacaguguagaaagcagugggaacugugauuggauuug

SEQ ID NO: 193945 - RNA, 64 nt, hsa
ggucucauuuagaacuugcagcugauguuggaagagaaagcacgugucucagacugcauguacc

SEQ ID NO: 193946 - RNA, 64 nt, hsa
agauuuaaaugaauuagugaauguaagauacuuuagaaagcauguaaaguacuagaaacaauga

SEQ ID NO: 193947 - RNA, 64 nt, hsa
accugcugaggaaaucguuuggugaaaugaauccagaaagcagagaaaaugcuucauuacuuua

SEQ ID NO: 193948 - RNA, 64 nt, hsa
auucacauccucagugucucagucuuuuuugccgagaaagcacaguagucugggacugggcauu

SEQ ID NO: 193949 - RNA, 64 nt, hsa
uggggguuuucuuugaaaguuuccagcccuauucagaaagcaacucuuggcugugugcauuuuu

SEQ ID NO: 193950 - RNA, 64 nt, hsa
caccauaacuagguaacaguuugauaacuagggaagaaagcagaacaguuaagcagccgccaca

SEQ ID NO: 193951 - RNA, 64 nt, hsa
ggcagcugaacaguguuggcuuucaugaggaggcagaaagcagaggcuggccucagacucauac

SEQ ID NO: 193952 - RNA, 64 nt, hsa
uggaggcucucucugccuagucuacaguacugacagaaagcaaggacaugcggccugcauggug

SEQ ID NO: 193953 - RNA, 64 nt, hsa
aggguucacauaggcucucaggugccagucuuccagaaagcaaggacugcccuucauucagccu

SEQ ID NO: 193954 - RNA, 64 nt, hsa
uagcccaaaaucccaaacucaaaccaaaccaaacagaaagcaguggagguggggguugcuguug

SEQ ID NO: 193955 - RNA, 64 nt, hsa
cugagcguacauagggaagggaggaagggaaaacagaaagcagacaaagaaaaaagagcuagcc

SEQ ID NO: 193956 - RNA, 64 nt, hsa
aauauaaguaaccaugacuuguaaaaaaaaaaaaagaaagcaguuacucuuggagcuuaugccu

SEQ ID NO: 193957 - RNA, 64 nt, hsa
gacgaugcauuucuuggccaaaguggcuuccucaagaaagcagcacuuaccuuugaaaaaugcu

SEQ ID NO: 193958 - RNA, 64 nt, hsa
uucuaaauuauguauuauaaauucguagagcuauagaaagcaaugaguguguaauuuggaguga

SEQ ID NO: 193959 - RNA, 64 nt, hsa
aauugacuuaaguaucuugaaaaagaaacuuuagagaaagcaucagggguguguacucaguauu

SEQ ID NO: 193960 - RNA, 64 nt, hsa
gccaaaccuuuccuguaacagagacggucaugcaagaaagcagacagcaagggcuugcagccua

SEQ ID NO: 193961 - RNA, 54 nt, hsa
aguucuuugaacaugagugagauuagaaagcagccaaaccuuuccuguaacaga

SEQ ID NO: 193962 - RNA, 64 nt, hsa
aaggcagagaaguaggccagagcuggguucuugcagaaagcaucagugccuacaaauggagcuc

SEQ ID NO: 193963 - RNA, 64 nt, hsa
ugcaugagcuacucuuggcuuccuuaaagggucaagaaagcaauuuuucugcuuacuagauuca

SEQ ID NO: 193964 - RNA, 64 nt, hsa
ggccucuguggauuuguaucaguuccaaaaauguagaaagcacaggcauagaaaaguacauuuu

SEQ ID NO: 193965 - RNA, 64 nt, hsa
augaucuguugaaugaauccuagacacuucugugagaaagcagggauugcauaguuauguacac

SEQ ID NO: 193966 - RNA, 64 nt, hsa
cuaggaagugauuuuuuaaaauuaggacuccuuaagaauaaacuuuuccagaagcacgagguag

SEQ ID NO: 193967 - RNA, 64 nt, hsa
uuauuugaaagugacaggaaucuccucagaaugaagaauaaagccuacuaggucucuaacuguu

SEQ ID NO: 193968 - RNA, 64 nt, hsa
uaaacaugcccucuaaaaguaggugguuuugaagagaauaaauucaucagauaaccucaaguca

SEQ ID NO: 193969 - RNA, 64 nt, hsa
gaggaagauaugauuggaaaaucaagaguguagaagaauaaauacuguuuuacuguccaaagac

SEQ ID NO: 193970 - RNA, 64 nt, hsa
uguuuauaugaauaugacuuucauuugcuuuuccagaauaaagaaguuauuaaucgaaagacag

SEQ ID NO: 193971 - RNA, 64 nt, hsa
gcaauaucuauaaugacugagaggaucugccaaaagaauaaagccuccuaccccaacuuccggu

SEQ ID NO: 193972 - RNA, 64 nt, hsa
cugugaucauuauuuggaaauauguccuauggaaagaauaaaagcauguacuucacagcuagca

SEQ ID NO: 193973 - RNA, 64 nt, hsa
gaaguuauaccuuuauuuugagcuguguauagguagaauaaaaaauuccuuucauaucguuauu

SEQ ID NO: 193974 - RNA, 64 nt, hsa
uuguuuuauccacaacuuuucaaguauugaaaguagaauaaaaacauggguucuuagucuuuag

SEQ ID NO: 193975 - RNA, 64 nt, hsa
cagggccuuuauuuggcaaauaacugagccaaccagaauaaaauaaccaauacuccacugcuca

SEQ ID NO: 193976 - RNA, 64 nt, hsa
ucuugccaguuaaaauuauaacuugcaaaugagcagaauaaaugagguuuuuuucaauuaaaaa

SEQ ID NO: 193977 - RNA, 64 nt, hsa
ucuaaaugacuaaacuucaaaguaagauuuugucagaauaaauugagaccauuaaucuaauaua

SEQ ID NO: 193978 - RNA, 64 nt, hsa
gcaaucauuucaaaucuauucugcaaauuguauaagaauaaaguuagaauuaacaauuuuauuu

SEQ ID NO: 193979 - RNA, 64 nt, hsa
uuucuaauuagguguauagccuauucacuuuccuagaauaaaucucuuaaccuaaauuugagua

SEQ ID NO: 193980 - RNA, 64 nt, hsa
auguucuaaguagugauaauauuacuagaaugaaagaauaaaaagaaauuguucuuuuaaaaua

SEQ ID NO: 193981 - RNA, 64 nt, hsa
agaagcauuccuuacauuaguagcaauaaauauuagaauaaauaugaaauugaacuauuuucag

SEQ ID NO: 193982 - RNA, 64 nt, hsa
augaaauuuugguaaaaucugaaaaucacauuucagaauaaaacaauugggcaaaacuaccuag

SEQ ID NO: 193983 - RNA, 64 nt, hsa
acaaacuaucaugcaaauaacgaguaaguagacaagaauaaagugguuugagaugaaaagaacc

SEQ ID NO: 193984 - RNA, 64 nt, hsa
aaacuguauaagcaauugcccuuaaaaauuaaaaagaauaaaagauuuucuauaaaagucuaac

SEQ ID NO: 193985 - RNA, 64 nt, hsa
guaccuuccauguuauauuauuuuuguuuuuauaagaauaaauuuggacccgguuucugauuau

SEQ ID NO: 193986 - RNA, 64 nt, hsa
gcaaaucauugaacacuuuaacgaaguauuguagagaauaaaucauaauggauaaaaaucguuu

SEQ ID NO: 193987 - RNA, 64 nt, hsa
gauggaggggucguuucgugauuuccugcugcugagaauaaaugucuuguuaaaaacguggcaa

SEQ ID NO: 193988 - RNA, 64 nt, hsa
ugcugcuauucugggagaauaaacuuguauauggagaauaaacuaauaaacuuguaucgaggaa

SEQ ID NO: 193989 - RNA, 64 nt, hsa
auccaauucaaguuuuauuugcugcuauucugggagaauaaacuuguauauggagaauaaacua

SEQ ID NO: 193990 - RNA, 64 nt, hsa
gaauaaaacaaucucagagcagcuccuaaacaagagaauaaaaaugggccaucccagcacuuau

SEQ ID NO: 193991 - RNA, 64 nt, hsa
uucacaguuucaccuccauuuaaauuuauggggaagaauaaauguuuccugacucagaaacaau

SEQ ID NO: 193992 - RNA, 64 nt, hsa
uacuuacaacugcaauuucacuuucauuuagaaaagaauaaauguuucuuaauugaacaacuau

SEQ ID NO: 193993 - RNA, 64 nt, hsa
uuuaagcuacaaauugagaaaaccguuauaaauaagaauaaaauaggccaggcacaguggcuca

SEQ ID NO: 193994 - RNA, 64 nt, hsa
cgagacccugucuccaaaggaaaaacaaaaaagaagaauaaaauaauuuggaugaaaaucaugu

SEQ ID NO: 193995 - RNA, 64 nt, hsa
guguguuacugguuuaaggauagacauacggagcagaauaaagaguacagauaugaacacuuau

SEQ ID NO: 193996 - RNA, 64 nt, hsa
aaguuaaauaauuccauuuauaauaccaucagaaagaauaaaauaggaaucaacuuaacaaaac

SEQ ID NO: 193997 - RNA, 64 nt, hsa
agucuuaagaagaugaauggaugagagaagggagagaauaaaaugcaauaacgagccagcauuu

SEQ ID NO: 193998 - RNA, 64 nt, hsa
cugcacuucuacaguuuagaaaguaucuggacucagaauaaauguaauauuuauacuuguuucc

SEQ ID NO: 193999 - RNA, 64 nt, hsa
ugugucacgggccauggccacucauauuuggcucagaauaaaucucuucaaauauuuuacagag

SEQ ID NO: 194000 - RNA, 64 nt, hsa
gcaaagcacccucaaaagcugcaccacagccuggagaauaaaauauccucagcccugaugccuc

SEQ ID NO: 194001 - RNA, 64 nt, hsa
aaccaauuuccugauggacuauuaaauucaucuuagaauaaauuagugaagaauuuaauuuuag

SEQ ID NO: 194002 - RNA, 64 nt, hsa
caucuuagaauaaauuagugaagaauuuaauuuuagaauaaauaauccaaucugaaauaauuau

SEQ ID NO: 194003 - RNA, 64 nt, hsa
uuuuggccucucauaguuuucucucucuuuaaagagaauaaauagagggccaggugugguggcu

SEQ ID NO: 194004 - RNA, 64 nt, hsa
aaaaaaaaaaaaaaaaaaaaaaaaagagagagagagaauaaauagaaaagaauguggcugggaa

SEQ ID NO: 194005 - RNA, 64 nt, hsa
ucauaaaauagacaauguuuuugucucaagaacaagaauaaaauugaaaucugcauucaugcca

SEQ ID NO: 194006 - RNA, 64 nt, hsa
gaauggcguacaaaucuuauuauuucuaaaaauaagaauaaaaagguaaaacuacauuuagacu

SEQ ID NO: 194007 - RNA, 64 nt, hsa
auuuaaggauaaauaaaaaauaaaguaguaauaaagaauaaaauacuuuacuaaaauauuguau

SEQ ID NO: 194008 - RNA, 64 nt, hsa
ucaguuaauaguuuuaaaaaugucucuuuuguuaagaauaaauuuaggcuucaaucauuauaau

SEQ ID NO: 194009 - RNA, 64 nt, hsa
caaccagaagguaaaacuuagauguccuuguaaaagaauaaaaaagguaaauauuuuaaguuau

SEQ ID NO: 194010 - RNA, 64 nt, hsa
cccuggagaauguccaccuuguguucagaugcuuagaauaaaaugucacuguaagaucacaagc

SEQ ID NO: 194011 - RNA, 64 nt, hsa
aaagcaauguaaaucagaauaaauauguuagaccagaauaaaauuaauuauauucuggucuuca

SEQ ID NO: 194012 - RNA, 64 nt, hsa
ucuguaauuauguuacauaaaagcaauguaaaucagaauaaauauguuagaccagaauaaaauu

SEQ ID NO: 194013 - RNA, 64 nt, hsa
uucuuuaacaggauugcaccuaucaauuucuuguagaauaaaaaaaaaucuuucaacaaacuga

SEQ ID NO: 194014 - RNA, 64 nt, hsa
auuugaacaucauaguuguauauauuuuuaaaguagaauaaauaauggaaagcaacuugauaua

SEQ ID NO: 194015 - RNA, 64 nt, hsa
aaaugaagaaagggaggcccagccgcaggaaggcagaauaaauccuugggagucauuaccacgc

SEQ ID NO: 194016 - RNA, 64 nt, hsa
ugguggguaacuuagaaggauggcaucuccauguagaauaaaugaagaaagggaggcccagccg

SEQ ID NO: 194017 - RNA, 64 nt, hsa
ugcagaaagguuuucucauugcauccauacugugagaauaaacugcagacugaaagaaacaugc

SEQ ID NO: 194018 - RNA, 64 nt, hsa
aauaauuccgaggaacauuggggguuaaauaccaagaauaaaaauugguucuucuuugacuuca

SEQ ID NO: 194019 - RNA, 64 nt, hsa
ugugcguggaaaaagacgauguuuauguucuuauagaauaaaagcuguggaaugaagcuuuuua

SEQ ID NO: 194020 - RNA, 64 nt, hsa
uaguucuagcucuauuuacuucuaaucuuaaaucagaauaaauuaauauuguauugcugcugug

SEQ ID NO: 194021 - RNA, 64 nt, hsa
aggugaaaagccaaauuuuaggaacagaaucaaaagaauaaaaaucugugaagagauccuacua

SEQ ID NO: 194022 - RNA, 64 nt, hsa
acuggcuuuugccaguuaauccagcugucuuucaagaauaaaaguugggguuuucaaggaucgc

SEQ ID NO: 194023 - RNA, 64 nt, hsa
gggacugucauaccagugaagaauaaaagggugaagaauaaaagggauaugaugacaagguuga

SEQ ID NO: 194024 - RNA, 64 nt, hsa
ggcuaagaugguauagggacugucauaccagugaagaauaaaagggugaagaauaaaagggaua

SEQ ID NO: 194025 - RNA, 64 nt, hsa
augucugugcugucuaguuuguguucaaaaugucagaauaaacacagaauaaauguucccacgg

SEQ ID NO: 194026 - RNA, 64 nt, hsa
gucuaguuuguguucaaaaugucagaauaaacacagaauaaauguucccacggccacacagucg

SEQ ID NO: 194027 - RNA, 64 nt, hsa
ucaagggauggcauaacuguaagaggucagugcuagaauaaaguccuguagguuuauuuuggaa

SEQ ID NO: 194028 - RNA, 64 nt, hsa
aaagaacacuggauuaauaaucuuuugggaggguagaauaaaauaauugauuacuauugcugca

SEQ ID NO: 194029 - RNA, 64 nt, hsa
uuuuuucucuuuugcagcuacauuugaaagugauagaauaaagagauuuuaaugaguuaucacu

SEQ ID NO: 194030 - RNA, 64 nt, hsa
ucuuuauaugucaaacugguugaacacuguaaugagaauaaacugcacagaguuuauucugacu

SEQ ID NO: 194031 - RNA, 64 nt, hsa
auucacaugaaaaggagacaauaaucaagucaaaagaauaaaugcuuacuaaucaucagaaaau

SEQ ID NO: 194032 - RNA, 64 nt, hsa
gccagauaaacacuuucuccuuacucaucaaucaagaauaaaauuuucuacaucaaaguaagac

SEQ ID NO: 194033 - RNA, 64 nt, hsa
aaagaguaacugguagauuuuguuaacaaauuaaagaauaaaguuagacaagcaacugguugac

SEQ ID NO: 194034 - RNA, 64 nt, hsa
uaaaauacaauuuuguuucuccaaauuugacagcagaauaaaaacccuacccuuucacugugua

SEQ ID NO: 194035 - RNA, 64 nt, hsa
agauauagcaggagaccaaaacauguuuggaaagagaauaaauauaugaagagagacugguugu

SEQ ID NO: 194036 - RNA, 64 nt, hsa
uacaguucuuuguacagaaaggcaccauuauguuagaauaaauuuccagaacuuagugggaaga

SEQ ID NO: 194037 - RNA, 64 nt, hsa
auggaugucauccugugacuuugaaguacaaaguagaauaaauucuguauucauggauuggaug

SEQ ID NO: 194038 - RNA, 64 nt, hsa
ggccaucuuguagauuacauuuaucauuaaugcaagaauaaagacaauuccuccugucaguugc

SEQ ID NO: 194039 - RNA, 64 nt, hsa
ggccacaguugccuuauauguaaaugaaguguuuagaauaaaauaguuaaauuuccuuauuuuu

SEQ ID NO: 194040 - RNA, 64 nt, hsa
ggauguuuuauuucucacaucauguccaagaaaaagaauaaauuauguucagcuuaauuuuagu

SEQ ID NO: 194041 - RNA, 64 nt, hsa
ucacuugagaacagaauaggauuucaacaauaagagaauaaaauaagaacauguauaacaaaaa

SEQ ID NO: 194042 - RNA, 64 nt, hsa
gaaaauugaaaaaauuaaaauguaaaaaaauuaaagaauaaaaauacuucuauuauucuuuuau

SEQ ID NO: 194043 - RNA, 64 nt, hsa
uuuugguauuucauuguuaccaaguucuauuuuuagaauaaaauuguucuccuucuaaaaguuu

SEQ ID NO: 194044 - RNA, 64 nt, hsa
cauuuuuauacuaaaacaaacaccaaaauauuuuagaauaaauucuuagaaaguuuugagagga

SEQ ID NO: 194045 - RNA, 64 nt, hsa
uaccugugugcuuuugugggcaccuuguuuaugaagaauaaaaaaugauuuguuaucugaagag

SEQ ID NO: 194046 - RNA, 64 nt, hsa
uuaugaagaauaaaaaaugauuuguuaucugaagagaauaaauuuuaaauucucaguuuauguc

SEQ ID NO: 194047 - RNA, 64 nt, hsa
auuaguagaaaagaggagcuauuuccgaaucuauagaauaaaguaccaccuaaaacugaauuuu

SEQ ID NO: 194048 - RNA, 64 nt, hsa
uuuuuuaguuguuuaaauaaguaauauuuucaaaagaauaaaauaaccaaugauaucucuugga

SEQ ID NO: 194049 - RNA, 64 nt, hsa
uuacugucauucccauuccuuuucguuuagaaucagaauaaaguuguauuucaaauaucuaagc

SEQ ID NO: 194050 - RNA, 64 nt, hsa
uagggaagcacuugcucaaaaucugugaccugucagaauaaaaaugugguuuguacauaucaaa

SEQ ID NO: 194051 - RNA, 64 nt, hsa
cucuuccuaauugugcuguaauaaccuguguaugagaauaaaaugauuuccaccaucaggauuc

SEQ ID NO: 194052 - RNA, 64 nt, hsa
cccacauauucaagaagcucaaaugaccugaaguagaauaaacauaauuuacaucacagcagug

SEQ ID NO: 194053 - RNA, 64 nt, hsa
aaaaagaagaaaaaaucaaugaacuugaagaguaagaauaaaaacuaccaaagugauauacaga

SEQ ID NO: 194054 - RNA, 64 nt, hsa
ucauuucuacuucaaaaacauuucaugcaauauuagaauaaaguuccugucauuccucuaaaaa

SEQ ID NO: 194055 - RNA, 64 nt, hsa
uguccuucuaccuugaauagaaguuuuccugauaagaauaaacgaggaaaagguccuugccucc

SEQ ID NO: 194056 - RNA, 64 nt, hsa
uguaaaguauauguuaaaugcuuuuaucacuuugagaauaaaaaguuacuaaugcuguuguauu

SEQ ID NO: 194057 - RNA, 64 nt, hsa
cuuagaucuacuuuuaaaacggauggccuucuuaagaauaaagcaaaaggugauuuucuacaua

SEQ ID NO: 194058 - RNA, 64 nt, hsa
aauucuuuuugauuauuuuuuguuuucauuuaccagaauaaaaacuaagaauuaaaaguuugau

SEQ ID NO: 194059 - RNA, 64 nt, hsa
uacggaaaaauuagaaaaauucugauaauagugcagaauaaaugaauuaauguuuuacuuaauu

SEQ ID NO: 194060 - RNA, 64 nt, hsa
guguuuggcugcaccugcauaagcugcuacaaauagaauaaagaauuucauagccuguaucuau

SEQ ID NO: 194061 - RNA, 64 nt, hsa
aagcuuuacaucuucauuuugacuguuccauagcagaauaaagcacuugaaaggaaacaagacu

SEQ ID NO: 194062 - RNA, 64 nt, hsa
caagaaugcaauccuauucacaauugccacaaaaagaauaaaauaccuaggaauacagcuaacc

SEQ ID NO: 194063 - RNA, 64 nt, hsa
auccuacacccacagaacccggcuuuguccccaaagaauaaaaacaccucucuaaaagcugcuc

SEQ ID NO: 194064 - RNA, 64 nt, hsa
uauuaaccauuauugagaauaaauuuuuuuauugagaauaaauuuucuaaaauuacauguuuca

SEQ ID NO: 194065 - RNA, 64 nt, hsa
ugcuguuucugaguuauuguauuaaccauuauugagaauaaauuuuuuuauugagaauaaauuu

SEQ ID NO: 194066 - RNA, 64 nt, hsa
ugcagaacauuguaucacauuuuaguccagagauagaauaaaguugaauaaccuugacuuacac

SEQ ID NO: 194067 - RNA, 64 nt, hsa
aauuuuaugugcuuucaucacaaauccaaaggaaagaauaaaaauuucuuaacacaacccagcg

SEQ ID NO: 194068 - RNA, 64 nt, hsa
agaaagaaaagaaaaagaaaaucuuuuuuaaaccagaauaaacauuaaaaacuauugcagaaaa

SEQ ID NO: 194069 - RNA, 64 nt, hsa
auguaaaauauuaaagcauuaauauaaauaugugagaauaaaaacaaucuaaauccagaaaaug

SEQ ID NO: 194070 - RNA, 64 nt, hsa
ucuugcccaaagucauugauuuugaugauuaaaaagaauaaacacaguguuuccugaguagcag

SEQ ID NO: 194071 - RNA, 64 nt, hsa
ugggauuacaggugugagccaccgcgcccagccaagaauaaaauacucuuaaguugaucuaaug

SEQ ID NO: 194072 - RNA, 64 nt, hsa
ucucuaaggaaggcagagaccuggguugagccucagaauaaaagaucuucuuccaagaaaugca

SEQ ID NO: 194073 - RNA, 64 nt, hsa
cauuacuuugaaucaaaaauuuauuuauauuucaagaauaaaguacuaagauugugcucaauac

SEQ ID NO: 194074 - RNA, 64 nt, hsa
ucaaggguccacagggugccagccucucacccucagaauaaagacaucagccauucccuucugg

SEQ ID NO: 194075 - RNA, 64 nt, hsa
gggccuuuguggacuagccaaggcugugagggccagaauaaacaacugcucaacaaaggguguu

SEQ ID NO: 194076 - RNA, 64 nt, hsa
guugcuucucaucuaaaauacaauuuugucuaucagaauaaacacaagugaaauuuucaccuac

SEQ ID NO: 194077 - RNA, 64 nt, hsa
cuguuucacuggaaagugucaauagaguugccuaagaauaaaaauugaaaugguguuaaucuga

SEQ ID NO: 194078 - RNA, 64 nt, hsa
caacugcauguuggauuagauugucucauauuucagaauaaaauguacuguauacuuuuccuca

SEQ ID NO: 194079 - RNA, 64 nt, hsa
accgaaucugaaacuuugggaauuugcuuuagccagaauaaagaaaccaaaucaugaaaauuau

SEQ ID NO: 194080 - RNA, 64 nt, hsa
gauaaugccgggcaggccgggcacaguggcucacgccuguaauccaagcacuuggggaggccga

SEQ ID NO: 194081 - RNA, 64 nt, hsa
aaaaauacaaaauuagucggguaugguggcacaugccuguaauuccagcugcuugggagccuga

SEQ ID NO: 194082 - RNA, 64 nt, hsa
cucuugaaagauucaaccgggugugguggcucacgccuguaaucccagcacauugggaggccaa

SEQ ID NO: 194083 - RNA, 64 nt, hsa
gaaaauagaaaauaggcuaggcacaguggcucacgccuguaaucucaacacuuugggaggccaa

SEQ ID NO: 194084 - RNA, 64 nt, hsa
aaagucugaagcucggccaggugcgguggcucacgccuguaaucccaaaacuuuggaaggcuga

SEQ ID NO: 194085 - RNA, 64 nt, hsa
cucuauaaaaguacaaaagggcaugauggcaggugccuguaaucucagcuacucaguaggcugg

SEQ ID NO: 194086 - RNA, 64 nt, hsa
aaucugggaaggcaguagaauggccagcauuccugccuguaagucuucccaagacagaggcccg

SEQ ID NO: 194087 - RNA, 64 nt, hsa
auaauacaaaaauuagcugggcgugguggcacaugccuguaaucccagcuacuugggaggcuga

SEQ ID NO: 194088 - RNA, 64 nt, hsa
gaaaaaggaaacuaggccaggcgugguggcucacgccuguaaucccaacacuuugggaggccga

SEQ ID NO: 194089 - RNA, 64 nt, hsa
aaauacaaaaaauuggccgggcgcagcggcucacgccuguaaucccagcacuuucggaggcaga

SEQ ID NO: 194090 - RNA, 64 nt, hsa
aaauacaaaaaauuagccgggcgugguggcaccugccuguaaucccagcuacuugggaggcuga

SEQ ID NO: 194091 - RNA, 64 nt, hsa
aauaugccuuaaaaggccgggcgcgguggcucacgccuguaaucccagcacuuugggaggccaa

SEQ ID NO: 194092 - RNA, 64 nt, hsa
aaaaauacaaaauuagccaggcaugauggcacaugccuguaaucccagauacuugggaggcuga

SEQ ID NO: 194093 - RNA, 64 nt, hsa
aagagauuugcuuuuucugggugcgguggcucaugccuguaaucccagcacuuugggaggccga

SEQ ID NO: 194094 - RNA, 64 nt, hsa
aaguacaaaaaauuagccagucaugguggcacacgccuguaaucucagcuacucaggaggcuga

SEQ ID NO: 194095 - RNA, 64 nt, hsa
uuaaagauuuuugaggccgggcacagugacucacgccuguaaccccagcacuuugggaggccga

SEQ ID NO: 194096 - RNA, 64 nt, hsa
acuaaaaauacagaauuagccgggcauggugcaugccuguaaucccagcugcuugggaggcuga

SEQ ID NO: 194097 - RNA, 64 nt, hsa
gauaagaugcucccggccgggcgcgguggcucacgccuguaaucccagcacuuugggaggccga

SEQ ID NO: 194098 - RNA, 64 nt, hsa
aaagucaucuugccagccaggcgugguggaucacgccuguaaucccagcacucugggaggccaa

SEQ ID NO: 194099 - RNA, 64 nt, hsa
uaaguacaaguuuaggcugggcgugguggcucacgccuguaaucccagcacuuugggaggccga

SEQ ID NO: 194100 - RNA, 64 nt, hsa
gaaauacaaaaauuagcuggauauggugguaugugccuguaaucccagcuacuugggaggcuga

SEQ ID NO: 194101 - RNA, 64 nt, hsa
uuauaagaccuuaaggcugggugcaguggcucacgccuguaaucccagcacuuugggaggcuga

SEQ ID NO: 194102 - RNA, 64 nt, hsa
aaaauagaaaaauuagcugggcaugguggcaggagccuguaaucccagcuauucuggaggugga

SEQ ID NO: 194103 - RNA, 64 nt, hsa
auacaaaaaaaauuagccagccaugguggcgggcgccuguaaucccagcuacuugggaggcuga

SEQ ID NO: 194104 - RNA, 64 nt, hsa
aauuggcagugauuggccaggcgcaguggcucacgccuguaaucccagcacugggaggccgagg

SEQ ID NO: 194105 - RNA, 64 nt, hsa
aaaagcccauggcaggcugggcgcgguggcucacgccuguaaucccagcacuuugggaggccaa

SEQ ID NO: 194106 - RNA, 64 nt, hsa
aaaauacaaaaauuagccaggcaucguggugggugccuguaaucccagcuauucaggaggcuga

SEQ ID NO: 194107 - RNA, 64 nt, hsa
aaagauaaagucuaggccaggcaugguggcucaugccuguaaucccaacacuuaggguggcuga

SEQ ID NO: 194108 - RNA, 64 nt, hsa
uuuuuucaauuucgguuuuaguaaucuaggcuuugccuguaaagaauacaacgauggauuuuaa

SEQ ID NO: 194109 - RNA, 64 nt, hsa
aaaauacaaaaauuauccgggcaugguggcacaugccuguaaucucagcuacucaggaggcuga

SEQ ID NO: 194110 - RNA, 64 nt, hsa
aaaauacaaaaauuagccaggcaugguggcaggugccuguaaucccggcuauucagaaggccga

SEQ ID NO: 194111 - RNA, 64 nt, hsa
aacaccuucauccaggcugggcgagguggcucacgccuguaaucccaguaguuugggaggccaa

SEQ ID NO: 194112 - RNA, 64 nt, hsa
aaacaaaaacaauuagcugggcaugguggccggcgccuguaaucccagcuacuagggaggcuga

SEQ ID NO: 194113 - RNA, 64 nt, hsa
acauacaggaaacaggcgggacacaguggcucacgccuguaaucccaccacuuuggaaagcuga

SEQ ID NO: 194114 - RNA, 64 nt, hsa
aaaauuaugugaaaucugcccgggcacaccucaugccuguaaucccagcacucugggaggccaa

SEQ ID NO: 194115 - RNA, 64 nt, hsa
aaaauacaaaaauuggcugggcgugguggcacucgccuguaaucucagcuacuugggaggcuga

SEQ ID NO: 194116 - RNA, 64 nt, hsa
agagaaaauugagauguguaaaaaucuaguuacugccuguaaauggugucauugaggcagauau

SEQ ID NO: 194117 - RNA, 64 nt, hsa
aaacauuauuuuuaaaauuagccugguggcucacgccuguaaucccagcacuuugggaggccga

SEQ ID NO: 194118 - RNA, 64 nt, hsa
gauuaacaaaauuaggccgggcaugguggcucacgccuguaaucccagcacuuugggaggccca

SEQ ID NO: 194119 - RNA, 64 nt, hsa
aauacguaaaaauuagccaggcgugguggcacacgccuguaaacccagcuacuugggaggcuga

SEQ ID NO: 194120 - RNA, 64 nt, hsa
cuuagcaccccgcaggcugggcgcuguggcucacgccuguaaucccagcacuuugggagggcaa

SEQ ID NO: 194121 - RNA, 64 nt, hsa
aagaggauucaaaacgccacguguaguggcucaugccuguaaucccaacacuuugggaggcuga

SEQ ID NO: 194122 - RNA, 64 nt, hsa
aaauacaaaaaauuagccgagcacgguggugcaugccuguaaucccagcuacuugggaggcuga

SEQ ID NO: 194123 - RNA, 64 nt, hsa
aaaauauaguuugaggccgggcacgguggcucacgccuguaaucccaguacuugggaggccaag

SEQ ID NO: 194124 - RNA, 64 nt, hsa
agauaaacggaagccggcuggggugguggcucacgccuguaaucccaacacuuugggaggccaa

SEQ ID NO: 194125 - RNA, 64 nt, hsa
cucuuacugggagauugcaaacugccacaucucagccuguaagcaaagcaggaaaccuucugcu

SEQ ID NO: 194126 - RNA, 64 nt, hsa
aaaagacaaaaauuagcugggcgugguaguacaugccuguaaucccagcuacacuggaggcuga

SEQ ID NO: 194127 - RNA, 64 nt, hsa
uauaucaguuggugagccgggcguggugggucacgccuguaaucccagcacuuugggaggccaa

SEQ ID NO: 194128 - RNA, 64 nt, hsa
agauacaaaaaauuagccgggcgugguggugcaugccuguaauccaagauacucaggaggcuga

SEQ ID NO: 194129 - RNA, 64 nt, hsa
aaaaaaaaaaaagaggccaggcaugguggcucacgccuguaaucucagcacuuugggaggcuga

SEQ ID NO: 194130 - RNA, 64 nt, hsa
uaaauagcuaauacgaccggguacagugguucaugccuguaaucccagaacuucgggaggccga

SEQ ID NO: 194131 - RNA, 64 nt, hsa
auauaaauaauuguggccgggugcaauggcucaugccuguaaucccagcacuuugggaggcuga

SEQ ID NO: 194132 - RNA, 64 nt, hsa
aaaaguaaacaugcggcugggcgugguggcucaugccuguaaucccagcacuuugggaggcuga

SEQ ID NO: 194133 - RNA, 64 nt, hsa
aaaaauacaaaacuagccggguauggugguacaugccuguaaucccagcuacucaggaggcuga

SEQ ID NO: 194134 - RNA, 64 nt, hsa
ggaagagcaaauggggcugagugcaguggcucaugccuguaaucccagcacuuagggugccaau

SEQ ID NO: 194135 - RNA, 64 nt, hsa
agauuuuaauaauuaguugggcguaguggugcaugccuguaaucccagcuacucuggagacagg

SEQ ID NO: 194136 - RNA, 64 nt, hsa
auuaaauguugaccuagccagcgcaguggcucaugccuguaaucccagcacuuugggaggcuga

SEQ ID NO: 194137 - RNA, 64 nt, hsa
aaaaauacaaaauuagcugggcaugguggugcaugccuguaauuccagcuacucgggaggcuga

SEQ ID NO: 194138 - RNA, 64 nt, hsa
uaugacuuguaguaagccgggcgcgguggcucacgccuguaaucccaacacuuugggaggccaa

SEQ ID NO: 194139 - RNA, 64 nt, hsa
aaaauguuaacgugggcugggcaugguggcucaugccuguaaucccagcacucugggaggcuga

SEQ ID NO: 194140 - RNA, 64 nt, hsa
aauuucucauuuggagccgggcgcaguggcucacgccuguaaucccagcacuuugggaggccaa

SEQ ID NO: 194141 - RNA, 64 nt, hsa
aaaauacaaaaauuagccaggcgugguggcuggcgccuguaaucccagcuacucaggagguuga

SEQ ID NO: 194142 - RNA, 64 nt, hsa
uuuuaaauguuuuuggccgggcgugguggcucaugccuguaaucucaguacauugggaggccaa

SEQ ID NO: 194143 - RNA, 64 nt, hsa
aaauacaaaaaauuggccgggcgugauggugggcgccuguaaucccagccacuccagaggcuga

SEQ ID NO: 194144 - RNA, 64 nt, hsa
aauauacaaaaauuagccgggcaugauggugguggccuguaaucccagcuacuugggaggcuga

SEQ ID NO: 194145 - RNA, 64 nt, hsa
uaaauacaucaucuggccaggcaugguggcuuacgccuguaauccuagcacuuugggaggccaa

SEQ ID NO: 194146 - RNA, 64 nt, hsa
agcaagucacaccugccagugcccucauccuuaugccuguaacacacaugcagugagaggccuc

SEQ ID NO: 194147 - RNA, 64 nt, hsa
agaugccugggugugccacagaccuuccuacuuggccuguaaucaccugugcagccuuuugugg

SEQ ID NO: 194148 - RNA, 64 nt, hsa
aaaauacaaaaauuagccagacgugguggugggugccuguaauccaacuacccaggaggcugag

SEQ ID NO: 194149 - RNA, 64 nt, hsa
aguggcuuuuugggggcugggugccguggcucacgccuguaaucccagcauuuugggaggcuga

SEQ ID NO: 194150 - RNA, 64 nt, hsa
aaaaacacaaaauuagcugggcgugguagugcgugccuguaaucccagcuacuugggaggcuga

SEQ ID NO: 194151 - RNA, 64 nt, hsa
ugaagguguuuccaggccaggcgcgguggcucacgccuguaaucccaacacuuugggaggccga

SEQ ID NO: 194152 - RNA, 64 nt, hsa
uuuaaaaacuagagggcuaggcuuaguggcucacgccuguaaucucagcacuuugggaggcuga

SEQ ID NO: 194153 - RNA, 64 nt, hsa
aaauacaaaaaauuaguugggugugguggcgggugccuguaaucccagcuacucaggaggcuga

SEQ ID NO: 194154 - RNA, 64 nt, hsa
uauaaaaugguguaggccgggcaugguggcucacgccuguaaucccaguacuuugggaggccga

SEQ ID NO: 194155 - RNA, 64 nt, hsa
aaaauacaaaaauuagccagguguggagguacaugccuguaaucccagcuacucaggaggcuga

SEQ ID NO: 194156 - RNA, 64 nt, hsa
aaugcuaaaacuuuggcugggcaugguggcucacgccuguaaucccagcacuuugggaggccau

SEQ ID NO: 194157 - RNA, 64 nt, hsa
uauacuuaauauuaccuccaaugacucgggaauugccuguaaauuauuauagacaauagauugc

SEQ ID NO: 194158 - RNA, 64 nt, hsa
auuggccucuuagaugauauaagcaugagguggggccuguaauauuuuuuucugaguuucuucu

SEQ ID NO: 194159 - RNA, 64 nt, hsa
agaaaugaaagcggggccaggcgcgguggcucgugccuguaaucccagcacuuugggaggcuga

SEQ ID NO: 194160 - RNA, 64 nt, hsa
aaaacacaaaaauuagccaggcaugguggcgcaugccuguaaucccagcuacuagagaggcuga

SEQ ID NO: 194161 - RNA, 64 nt, hsa
uaauuaaaagugugggcugggcgugggggcucaugccuguaaucccagcacuuugggaggccga

SEQ ID NO: 194162 - RNA, 64 nt, hsa
aaaauacaaaaauuagccaggcgugauggcaggugccuguaauccuagcuacuuggcaggcuaa

SEQ ID NO: 194163 - RNA, 64 nt, hsa
aaauugagcaucugggccgggcaugguggcucacgccuguaaucccagcacucugggaggucga

SEQ ID NO: 194164 - RNA, 64 nt, hsa
aaauacagaaaauuagcugggcaugguggugugugccuguaauuccagcuacucgggaggcuga

SEQ ID NO: 194165 - RNA, 64 nt, hsa
aauacaaaaaaauuagcugggagugguggcauaggccuguaauuccagcuacucuggcugcuga

SEQ ID NO: 194166 - RNA, 64 nt, hsa
ugaaaguggaucucagcugggcacgguggcucacgccuguaauccuagcaccuugggggucaag

SEQ ID NO: 194167 - RNA, 64 nt, hsa
guaguugaaauucuaggccggugcgguggcucaugccuguaaucccagcacuguaggcggccga

SEQ ID NO: 194168 - RNA, 64 nt, hsa
aaaaucaagcuuugggccaggugcgguggcucaugccuguaaucccagcacuaugggaggccag

SEQ ID NO: 194169 - RNA, 64 nt, hsa
uacaaaaaaaaauuagcuggaccugguggcgcaugccuguaauccuagcuacucaggaggcuga

SEQ ID NO: 194170 - RNA, 64 nt, hsa
auuccaugaaucuuggccaggcaugguggcucaugccuguaaucccaccacuuugggaggguga

SEQ ID NO: 194171 - RNA, 64 nt, hsa
aaaauacaaaaauuagcugggugcgguggcaggugccuguaaucccagcuacuugggacacuga

SEQ ID NO: 194172 - RNA, 64 nt, hsa
cccugcugggauuuuaauagaacuuacagcucacgccuguaaucucagcacuuugggaggcuga

SEQ ID NO: 194173 - RNA, 64 nt, hsa
aaaaaaaugucaauagccaggcauaguggcucacgccuguaaucccagcacuuuaggaggccaa

SEQ ID NO: 194174 - RNA, 64 nt, hsa
aaaacacaaaaauuagucaggcgugguagugggugccuguaaucccagcuacucgggaggcuaa

SEQ ID NO: 194175 - RNA, 64 nt, hsa
uuuuguuuauaauuggccuggugugguggcccacgccuguaaucccagcacuuugggaggccga

SEQ ID NO: 194176 - RNA, 64 nt, hsa
aaaauacaaaaauuagcugggugugguggcgugugccuguaaucccagcuacuugggaggcuga

SEQ ID NO: 194177 - RNA, 64 nt, hsa
aaaaauugcuuguaggcugagcgcgguggcucacgccuguaaucccagcacuuugggaggccaa

SEQ ID NO: 194178 - RNA, 64 nt, hsa
aaaauacaaaaauuagccggacgcaguggcacgcgccuguaaucccagcuacucaagaggcuga

SEQ ID NO: 194179 - RNA, 64 nt, hsa
aguaagaaguuacuggccaggagcggcggcucaugccuguaaucccaggacuuugguaggccaa

SEQ ID NO: 194180 - RNA, 64 nt, hsa
aaaauacaaaaauuagcugggcaugguggcaggcgccuguaaucccagcuacucaggaggcuga

SEQ ID NO: 194181 - RNA, 64 nt, hsa
ggcuuaaauuccauuuuauuaaaaaaaaaaaauugccuguaaucccagcacuucaggaggccga

SEQ ID NO: 194182 - RNA, 64 nt, hsa
gacaaugauuuuuaaagcauuggaaaaauauuuugccuguaaaaguuaguaacuaggugguuca

SEQ ID NO: 194183 - RNA, 64 nt, hsa
auaagaaaauuugaggccgggugugguggcucacgccuguaaucccagcacuuugggaggcuca

SEQ ID NO: 194184 - RNA, 64 nt, hsa
aaaccaucacauuuuuuucuuucuacgcccccuugccuguaaaacaccugggaaguuccacugg

SEQ ID NO: 194185 - RNA, 64 nt, hsa
aauacaaaaaaauuagcugggcgugguggcgcaugccuguaauccuagcuacuugggagucuga

SEQ ID NO: 194186 - RNA, 64 nt, hsa
aagauaaaaaucagggcagggugugguggcuuaugccuguaaucccaguacuuugggaggccga

SEQ ID NO: 194187 - RNA, 64 nt, hsa
acauaaaaauugauggccaggcaugguggcucacgccuguaaucccagaacuaugugaggcuga

SEQ ID NO: 194188 - RNA, 64 nt, hsa
aaaauacaaaaauuagccgggcauggugguaggggccuguaacccagcuacucgugaggccaag

SEQ ID NO: 194189 - RNA, 64 nt, hsa
aaauuauguaacucggccggguacaauggcucacgccuguaauccuaacacuuugggaggccga

SEQ ID NO: 194190 - RNA, 64 nt, hsa
uuacaaaaaaaauuauccaggcgugguggugcacgccuguaaucccagcuacucaggaggcuaa

SEQ ID NO: 194191 - RNA, 64 nt, hsa
auaaaaucaagauaguccggacgcgguggcacaugccuguaaucccagcacuuugggaggcuga

SEQ ID NO: 194192 - RNA, 64 nt, hsa
aaaacacaaaaauuagccaggcuugguggcuggcgccuguaauuccagcuacucagaaggcuga

SEQ ID NO: 194193 - RNA, 64 nt, hsa
ugaguuaauguccgggcuggucacagugguucaugccuguaaucccagcacuuugggaguccaa

SEQ ID NO: 194194 - RNA, 64 nt, hsa
aaaauacaaaaaugagcccgguauguuggcauaugccuguaaucccagcuacucgagaggcuga

SEQ ID NO: 194195 - RNA, 64 nt, hsa
aaaauacaaaaauuagcuggacaugguggcacgugccuguaaucccagcuacucaggaggcuga

SEQ ID NO: 194196 - RNA, 64 nt, hsa
aaucgcacaaagcaggccaggcacgguggcucacgccuguaaucccagcauuuugggaggccga

SEQ ID NO: 194197 - RNA, 64 nt, hsa
aaauacaaaaaauuagcugggcguggugacgggcgccuguaaucccagauacucaggaggcuga

SEQ ID NO: 194198 - RNA, 64 nt, hsa
gaaaaaugcgaagcggccgggcacgguggcucaugccuguaaucccagcacuuuggggggcuga

SEQ ID NO: 194199 - RNA, 64 nt, hsa
aaacacaaaaaauuagccgggcgugguggcacaugccuguaaucccagcuacucaggaggcuga

SEQ ID NO: 194200 - RNA, 64 nt, hsa
uauaaaaauaccccggccaggcacgguggcucacgccuguaaucccagcacuuugggagguggg

SEQ ID NO: 194201 - RNA, 64 nt, hsa
aaugguuugggauaggcugggugccgugggucacgccuguaaucccagcacuuugggaggcuga

SEQ ID NO: 194202 - RNA, 64 nt, hsa
aaaauacagaaauuagcugggugugguugcacacgccuguaaucccagcuacucaggaggcuga

SEQ ID NO: 194203 - RNA, 64 nt, hsa
auuaaaagggauagggccaggcacaguggcuuaugccuguaauugcagcacuuuuagaggccga

SEQ ID NO: 194204 - RNA, 64 nt, hsa
aaaacuuucaucuaggccacgugcgguggcucaugccuguaaucccggcacuuugggaggccug

SEQ ID NO: 194205 - RNA, 64 nt, hsa
aauauacaaaaauuaguuggguguuauggugcaugccuguaaucccagcuacucgggaggcuga

SEQ ID NO: 194206 - RNA, 64 nt, hsa
uagaaagcaacugaggccaggugcgguggcucacgccuguaaucccagcacuuugggaggccga

SEQ ID NO: 194207 - RNA, 64 nt, hsa
gggagcucaaucuuggccgggcgccguggcucacgccuguaaucgcagcacuuugggaggccga

SEQ ID NO: 194208 - RNA, 64 nt, hsa
cuuugaaaagaccgugcugggcgcgguggcucuugccuguaaucccagcacuuugggaggcuga

SEQ ID NO: 194209 - RNA, 64 nt, hsa
aagaacacaaaauuagcugggcaugguggugcaugccuguaaucccagcuacuugggaggccga

SEQ ID NO: 194210 - RNA, 64 nt, hsa
gcaaggccuguuuaggccgguugcgguggcucaugccuguaauccuagcacuuugggaggcuga

SEQ ID NO: 194211 - RNA, 64 nt, hsa
aaaauacaaaaguuagcugggugugguggcagaggccuguaaucccagcuccuugggaggcuga

SEQ ID NO: 194212 - RNA, 64 nt, hsa
uuagcuaugguuugcauuuaguacauggcagauugccuguaagucuguucauuuuaacaacaua

SEQ ID NO: 194213 - RNA, 64 nt, hsa
uuaacaacauacagggcugggcacgguggcucacgccuguaaucccagcacuuugggagguugc

SEQ ID NO: 194214 - RNA, 64 nt, hsa
caaaaacugaaguuagcugggugugguggcucaugccuguaaucccagcacuuugggggccaag

SEQ ID NO: 194215 - RNA, 64 nt, hsa
aaaaauacaaaaguagccgggcguggugaugcgugccuguaaucccagcuacccaggaaggcug

SEQ ID NO: 194216 - RNA, 64 nt, hsa
gaaacaagguuaauagccaggcaugguggcucaugccuguaaucccagcacuuugggaggcuga

SEQ ID NO: 194217 - RNA, 64 nt, hsa
aagauucucugcccagccgggcacaguggcgcaugccuguaaucccagaacuuugggaggccaa

SEQ ID NO: 194218 - RNA, 64 nt, hsa
aauuaccaagggguggccgggcacaguggcucacgccuguaaucccagcacuuugagaggcuga

SEQ ID NO: 194219 - RNA, 64 nt, hsa
aaaauacaaaaauuaaccaggcuuggugguguaugccuguaaucccagcuacuugggaggcuga

SEQ ID NO: 194220 - RNA, 64 nt, hsa
aaguuccacaaccaggccgggcaugguggcucaugccuguaaucccagcacuuugggaggugag

SEQ ID NO: 194221 - RNA, 64 nt, hsa
aaaaauacacaaauuagcuaggcaugguggacucgccuguaaucucacuacacaggaggcugag

SEQ ID NO: 194222 - RNA, 64 nt, hsa
auuaugccuuuuuugaucaggcacaguggcucacgccuguaauccuagcaguuugggaggcuga

SEQ ID NO: 194223 - RNA, 64 nt, hsa
aauuugaagugccuggcugggcgugguggcucacgccuguaaucccagcacuuugggaggccga

SEQ ID NO: 194224 - RNA, 64 nt, hsa
aaaauacaaaaauucacaggguguguuggcacacgccuguaauaccagcuacucagguggcuga

SEQ ID NO: 194225 - RNA, 64 nt, hsa
aaaauagaaaaaucagcuggguguggugccgcgugccuguaaucccagcuacuugggaggcuga

SEQ ID NO: 194226 - RNA, 64 nt, hsa
aaaauacaaaauuuagcugagugugguggcaggcgccuguaauccagcuacucgggaggcugag

SEQ ID NO: 194227 - RNA, 64 nt, hsa
aaagagaccucuggggccgagugugguggcuuaugccuguaaucccugcacuuugggaagccaa

SEQ ID NO: 194228 - RNA, 64 nt, hsa
ugaaagaauuuuggggccgggcgcgguggcuuaugccuguaaucccagcacuuugggaggccga

SEQ ID NO: 194229 - RNA, 64 nt, hsa
aaaaauacaaaauuugcugggagugguggugcaugccuguaaucccagcuacuuggaaggcuga

SEQ ID NO: 194230 - RNA, 64 nt, hsa
auaugcacagucuaggccgggcacgguggcucacgccuguaaucccagcacuuugggaggccga

SEQ ID NO: 194231 - RNA, 64 nt, hsa
aaauguacauguauggcuggacgcgguggcucacgccuguaaucccagcacuuugggaggcuga

SEQ ID NO: 194232 - RNA, 64 nt, hsa
aaaauacaaaaauuagcuuggcaugguggugcgugccuguaaucccagcuacucgggaggcugg

SEQ ID NO: 194233 - RNA, 64 nt, hsa
aagaagccccuucaggccagucgugguggcucaugccuguaaucccagcacuuugcaaggccga

SEQ ID NO: 194234 - RNA, 64 nt, hsa
caggagucaagagaauuuaugugagguggcucccgccuguaaucucagcacuuugggaggccaa

SEQ ID NO: 194235 - RNA, 64 nt, hsa
aaaaaaaucuaugcagcugggugcaguggcucacgccuguaaucccagcauuuugggaggcuga

SEQ ID NO: 194236 - RNA, 64 nt, hsa
aaauacagaaaauuagcugggcgugguggcaggcgccuguaaugccugcuacuugggagccuga

SEQ ID NO: 194237 - RNA, 64 nt, hsa
gaaaauagaagguaggccgggcacaguggcucaugccuguaaucccagcacuuugggaggcuga

SEQ ID NO: 194238 - RNA, 64 nt, hsa
cuguauuaaaagucugccgggcacaguggcucacgccuguaaucccaacacuuugggaggccaa

SEQ ID NO: 194239 - RNA, 64 nt, hsa
aaguacaaaaaauuagcugggcgugguggcucaugccuguaaucccagcuacucaggaggcuga

SEQ ID NO: 194240 - RNA, 64 nt, hsa
aaaauacaaaaauuagcugggcaugguggugcaugccuguaaucccagcuacucgggaggcuga

SEQ ID NO: 194241 - RNA, 64 nt, hsa
gcuaauacccaucaggcugggugugguggcucacgccuguaauccuagcacuuugggaggccga

SEQ ID NO: 194242 - RNA, 64 nt, hsa
aaaauaagguccagggccggacacaguggcccaugccuguaaucccagcacuuuggggggccaa

SEQ ID NO: 194243 - RNA, 64 nt, hsa
aaaauacaaaaauuagccgggcaugguggugggcgccuguaaucccagcuacucagaaggcuga

SEQ ID NO: 194244 - RNA, 64 nt, hsa
uaaucaguaaggccagcuagacccaauggcucaugccuguaaucccaacacuuugggaggccaa

SEQ ID NO: 194245 - RNA, 64 nt, hsa
aaaauacaaaaauuagcugggcgugguggugcaugccuguaaucccagcuacucgggaggcuga

SEQ ID NO: 194246 - RNA, 64 nt, hsa
uuugaaaccagucucaccaggcgcaguggcucacgccuguaauuccagcauguugggaggccga

SEQ ID NO: 194247 - RNA, 64 nt, hsa
auaggggaagacugggccagacgcaguggcucaugccuguaaucccagcacucugggaggcuga

SEQ ID NO: 194248 - RNA, 64 nt, hsa
aaaauacaaaaauuagccaggcaugguggcacgugccuguaaucccagcuacucgggaggcuga

SEQ ID NO: 194249 - RNA, 64 nt, hsa
aaguuaugaaaaaaggccaggugcaguggcucacgccuguaaucccagcacuuuugggaggcug

SEQ ID NO: 194250 - RNA, 64 nt, hsa
aauacagaaaaguuagccaggcgugguggcacaugccuguaaucccagcugcucaggaggcuga

SEQ ID NO: 194251 - RNA, 64 nt, hsa
aaaaauggcuuccuggccgggcgugguggcuccugccuguaaucccagcacuuugggaggccga

SEQ ID NO: 194252 - RNA, 64 nt, hsa
aaaauggccauuaaggccgggugggguggcacaugccuguaaucccagcacuuugggaggccaa

SEQ ID NO: 194253 - RNA, 64 nt, hsa
aaagaaagugugauggcugggugcaguggcucacgccuguaaucccagcacuuugggaggcuua

SEQ ID NO: 194254 - RNA, 64 nt, hsa
aaagaacauuucuuggcugggcgcugcggcuugcgccuguaaucucagcacuuugggaggcuga

SEQ ID NO: 194255 - RNA, 64 nt, hsa
aaaaaaaaaaauaaagccgggcgugguggcucacgccuguaaucccggcacuuugggaggcuga

SEQ ID NO: 194256 - RNA, 64 nt, hsa
cuacaaaaaaaauuagccaggcgugguggcgggcgccuguaaucccagcuacucaggaggcuga

SEQ ID NO: 194257 - RNA, 64 nt, hsa
guaccccauuuucaggccgggugugguggcucaugccuguaaucccagcacuuugggaggcgag

SEQ ID NO: 194258 - RNA, 64 nt, hsa
aaaauacaaaaauuagccgggugguguggugggcgccuguaaucccagcuccucaggaggcuga

SEQ ID NO: 194259 - RNA, 64 nt, hsa
aaaaauacaaaauuaccugggcgugguggugcaugccuguaaucccaucaucuacucaggaggc

SEQ ID NO: 194260 - RNA, 64 nt, hsa
gaaucucaagucaaggccaggcacggcggcucacgccuguaaucccagcacuuugggaggccga

SEQ ID NO: 194261 - RNA, 64 nt, hsa
uaagggaauuaaguuuugggaugauggauuaaaagccuguaaagaauuguuugggcucuaaaag

SEQ ID NO: 194262 - RNA, 64 nt, hsa
uaaaacauaaaguagaccaggugcaguagcucacgccuguaaucccagcacuuugggaagccaa

SEQ ID NO: 194263 - RNA, 64 nt, hsa
gaaacagcuuugggggccgggcgugguggcucacgccuguaaucccagcacuuugggaggccga

SEQ ID NO: 194264 - RNA, 64 nt, hsa
auacaaaaaaaauuagcugagcgugguggcgggcgccuguaaucccagcuacuugggaggcuga

SEQ ID NO: 194265 - RNA, 64 nt, hsa
uguguuauuugauaggccgggcaugguggcucaugccuguaaucccagcacuuugggaggccag

SEQ ID NO: 194266 - RNA, 64 nt, hsa
auuauccaaagucaggcugggcgcaguggcucacgccuguaaucccagcacuuugggagggaua

SEQ ID NO: 194267 - RNA, 64 nt, hsa
gguuaagauuguggggccgggcgagguggcucacgccuguaaucccagcacuuugggaggcuga

SEQ ID NO: 194268 - RNA, 64 nt, hsa
ggaguacaaaaauuagccggccauaguggcucgugccuguaaucucagcuauuugggaggcuga

SEQ ID NO: 194269 - RNA, 64 nt, hsa
aaugccaugaaucaagccagggccguuggcuuaugccuguaaucccagcacuuugcaggccgag

SEQ ID NO: 194270 - RNA, 64 nt, hsa
aauauaaaaauguuggcugugcacgguagcuuaugccuguaaucucagcacuuugggaggccaa

SEQ ID NO: 194271 - RNA, 64 nt, hsa
gaaaauuagaagcaagcuggaugcaguggcucaugccuguaaucccaacacuuuugggaggucc

SEQ ID NO: 194272 - RNA, 64 nt, hsa
uaaaauuccacucaugccgggcgugguggcacgcgccuguaaucccagcuacccaggaggcuga

SEQ ID NO: 194273 - RNA, 64 nt, hsa
aaaauacaaaaauuagccgggcgugguggcgggcgccuguaaucccagcuacuugggaggcuga

SEQ ID NO: 194274 - RNA, 64 nt, hsa
gaaagacgggccugggcugggugcgguggcucaugccuguaaucccagcacuuugagaggcugc

SEQ ID NO: 194275 - RNA, 64 nt, hsa
aaaauacaaaaauuagccaggcaugguggcauuugccuguaaucccagcuacucgggaggcuga

SEQ ID NO: 194276 - RNA, 64 nt, hsa
aaaauauguacucuggccgguugcaguggcucacgccuguaaucccagcacuuuggcaggccga

SEQ ID NO: 194277 - RNA, 64 nt, hsa
aaaauacaagaauuagcugggcgugguggcgugugccuguaaucccagcuauuugggaggcuga

SEQ ID NO: 194278 - RNA, 64 nt, hsa
aagugacaauuguaggccaggcacaguggcucacgccuguaaucccagcacuuugggaggccaa

SEQ ID NO: 194279 - RNA, 64 nt, hsa
agaaauauggauggggccggccacaguggcucacgccuguaaucccagaacucuggaaggcuga

SEQ ID NO: 194280 - RNA, 64 nt, hsa
aaaaauacaaaauuagccaggcgugguggcguacgccuguaaucccagcuacucaggaggcagg

SEQ ID NO: 194281 - RNA, 64 nt, hsa
aaaaucaguaauuggaccaggcgcgguggcucuugccuguaaucccagcacuuugggaggccga

SEQ ID NO: 194282 - RNA, 64 nt, hsa
aaaauacaaaaauuagccggggguggugacaugugccuguaaucccagcuacucaggaggcuaa

SEQ ID NO: 194283 - RNA, 64 nt, hsa
aaaauggucaaaggggcugggcaugguggcucacgccuguaaucucagcacuuugggaggccga

SEQ ID NO: 194284 - RNA, 64 nt, hsa
aaauaugaaacauuagccaggugugguggcacgcgccuguaaucccagcuacucgggaggcuga

SEQ ID NO: 194285 - RNA, 64 nt, hsa
uuuaaaaaaaaaaagguugggcguuguggcucaugccuguaaucccagcacuuugggaggcuga

SEQ ID NO: 194286 - RNA, 64 nt, hsa
aaaauacaaaaauuagcugagcaugguggcgugugccuguaaucucagcuacucaggaggcuga

SEQ ID NO: 194287 - RNA, 64 nt, hsa
uuuacacaaagggaagucgggcaugguggcucaugccuguaaucucagcacuuugggaggcuga

SEQ ID NO: 194288 - RNA, 64 nt, hsa
aaaaaaaacuuuagaacugggugcaguggcucaugccuguaaucccagccagcacuuugggagg

SEQ ID NO: 194289 - RNA, 64 nt, hsa
aaaaaaaaaaauugggccaggcacgguggcucacgccuguaaucccagcacuuugggaggccaa

SEQ ID NO: 194290 - RNA, 64 nt, hsa
aauaauacaaaauuagccaggcgugguggcgcaugccuguaaucccagcuacucgggaggcuga

SEQ ID NO: 194291 - RNA, 64 nt, hsa
aaaaugcaaaaauuagccgggcgugguggcgggcgccuguaaucccagcuacuugggaagcuga

SEQ ID NO: 194292 - RNA, 64 nt, hsa
augcacguagcugaggccggaugcgguggcucacgccuguaaucccagcacuuugggaggccua

SEQ ID NO: 194293 - RNA, 64 nt, hsa
aaaauacaaaaauuagcugggcgugguggcacgugccuguaaucccagcuacucgggaggcuga

SEQ ID NO: 194294 - RNA, 64 nt, hsa
auuuaucuuaguacugcugggcgcaguggcucaugccuguaaucugagcacuuugggaagcuga

SEQ ID NO: 194295 - RNA, 64 nt, hsa
aauagacaaaaauuagcgggggggugguggcagggccuguaauuccagcuacucaggaggcuga

SEQ ID NO: 194296 - RNA, 64 nt, hsa
aaaaacugggagcaggccagguacgguggcuaacgccuguaauccugacacuuugggagucuga

SEQ ID NO: 194297 - RNA, 64 nt, hsa
aaaaaaaaaaaaauagccgggcaugguggcgcaagccuguaaucccagcuacucaggaggcuga

SEQ ID NO: 194298 - RNA, 64 nt, hsa
agugggccaggacaggcccggcgcgguggcucacgccuguaaucccagcaguuugggaggucga

SEQ ID NO: 194299 - RNA, 64 nt, hsa
aaaauacaaaaauuagccgagcaugguggccugugccuguaaacccagcuacucaggagguugg

SEQ ID NO: 194300 - RNA, 64 nt, hsa
cucccagccuuugaggccgggugcaguggcucacgccuguaaucccagcacuuugggaggccga

SEQ ID NO: 194301 - RNA, 64 nt, hsa
auuuagaaagcagcagucaggcacgguggcucaugccuguaaucccagcacuuugggaggcuga

SEQ ID NO: 194302 - RNA, 64 nt, hsa
aaaaaaaaaaaauuagucgggcgugguggugcaugccuguaaucccagcuacuggggaggcuga

SEQ ID NO: 194303 - RNA, 64 nt, hsa
uaaagguugguguuggccaggcaugguggcucaugccuguaaucccagcauuuugggaggccaa

SEQ ID NO: 194304 - RNA, 64 nt, hsa
aaaaauauagaauuagccaggcaugguagcgcacgccuguaaucccaucuucuugggaggcuga

SEQ ID NO: 194305 - RNA, 64 nt, hsa
aauaagcacaugauggcugggcaccguggcucacgccuguaaucccagcacuuugggaggcuga

SEQ ID NO: 194306 - RNA, 64 nt, hsa
ucaaaaaaaaaaauugccgggcgcgguggcaaaugccuguaaucccagcacuuugggaggccga

SEQ ID NO: 194307 - RNA, 64 nt, hsa
aaaaauacaaaauuagccaggcgugguggugcaugccuguaauccagcuacuugggaggcugag

SEQ ID NO: 194308 - RNA, 64 nt, hsa
aaaaucaagcucuuggccaggcaugguggcucaugccuguaauuccagcacuuugggaggccaa

SEQ ID NO: 194309 - RNA, 64 nt, hsa
agcgaaguaaaagaggccgggugcgguggcucacgccuguaaucccaacacuuuaggaguccaa

SEQ ID NO: 194310 - RNA, 64 nt, hsa
uaacaauaauauauggccaggcgggauggcucacgccuguaaucccagcacuuugggaggcuga

SEQ ID NO: 194311 - RNA, 64 nt, hsa
aaaauacauaaaauuagccgggugcaguggugaggccuguaaucccagcuacucaggaggcuga

SEQ ID NO: 194312 - RNA, 64 nt, hsa
aaaauacaaaaauuagccgggcgugguggcuuacgccuguaaucccagcacuuugggaggccaa

SEQ ID NO: 194313 - RNA, 64 nt, hsa
agcaaaaaaaauuuagccaggcuuggucaugcaugccuguaauccuagcuacugggaaggcuga

SEQ ID NO: 194314 - RNA, 64 nt, hsa
aaacugcuaugcaaggcugggugcuguggcucaugccuguaaucccagcacuuugggaggccaa

SEQ ID NO: 194315 - RNA, 64 nt, hsa
auaauacaaaaauuagcugggcaugguggcgcaugccuguaaucccagcuacugggaaggcuga

SEQ ID NO: 194316 - RNA, 64 nt, hsa
caaagaacuuuacagaaaucaagcgaauuagaaggccuguaagaguaagguuugcuaaaacgug

SEQ ID NO: 194317 - RNA, 64 nt, hsa
gaaugggaccaggggaccuuuuggugcagugggugccuguaacucauuagacguacugaggcag

SEQ ID NO: 194318 - RNA, 64 nt, hsa
uacaaguugacaguugcuggguguaguggcucaugccuguaauccuagcaacucggggcugagg

SEQ ID NO: 194319 - RNA, 64 nt, hsa
aaaauacaaaaauuagcugggcgugguggcaugcgccuguaaucccagcuacccaggaggcuga

SEQ ID NO: 194320 - RNA, 64 nt, hsa
aagaaaaaaaugcaggcugggcgcgguggcucacgccuguaauccuagcacuuugggaggccga

SEQ ID NO: 194321 - RNA, 64 nt, hsa
aaauacaaaaacuuagcuggguguaacggcggaugccuguaaucccagcuacuugggaggcuga

SEQ ID NO: 194322 - RNA, 64 nt, hsa
uaaaaaaguuugccggcuaggugcgguggcucaugccuguaauccuagcauuuugggaggacga

SEQ ID NO: 194323 - RNA, 64 nt, hsa
ccaugggcuuugggccacagaaugaaccuuugaggccuguaaaguggauuguaauuuccuauaa

SEQ ID NO: 194324 - RNA, 64 nt, hsa
uuuuuugagaaguaaaauugacuucauauacaaagccuguaauuuuaggcgaaauggaagcaga

SEQ ID NO: 194325 - RNA, 64 nt, hsa
uaaaagaauaaacaagcuaggugugguggcucaugccuguaauccuagcacuuugggaagccaa

SEQ ID NO: 194326 - RNA, 64 nt, hsa
aauacaaaaaaacuagccggauaugguggcgggugccuguaaucucagcuacuugagaggcuga

SEQ ID NO: 194327 - RNA, 64 nt, hsa
gguauuauuaagggauuuaaaguuuggguugcaugccuguaaucccagcauuuugggaggccga

SEQ ID NO: 194328 - RNA, 64 nt, hsa
aaauacgaaaaauuagccaggcgugguggcgggcgccuguaaucccagcuacucgggaagcuga

SEQ ID NO: 194329 - RNA, 64 nt, hsa
uuaaaaagauugacagccgggccugaugucucaagccuguaauccuagcacuuugggaggcaga

SEQ ID NO: 194330 - RNA, 64 nt, hsa
aaaauacaaaaauuagcugggcgugguggcacacgccuguaaucccagcuacucaggaggcuga

SEQ ID NO: 194331 - RNA, 64 nt, hsa
aaaaaagaaaaauuagccagacgugguggcaugcgccuguaaucccagcuacucaggaagcuga

SEQ ID NO: 194332 - RNA, 64 nt, hsa
aauuagccugguaaggccgggugcaguggcucacgccuguaaucccagcacuuugggaggcuga

SEQ ID NO: 194333 - RNA, 64 nt, hsa
aauacaaaaaaauuagccaggcaugguggcacgugccuguaaucccagcuacucgcaaggcuga

SEQ ID NO: 194334 - RNA, 64 nt, hsa
acaaaguuuguucugacagggcgcgguggcucacgccuguaaucccagcgcuuugggaggcaga

SEQ ID NO: 194335 - RNA, 64 nt, hsa
aaaguuccuuucugggccgggcacaguggcucacgccuguaaucccagcacuuuggaaggccga

SEQ ID NO: 194336 - RNA, 64 nt, hsa
uacaaaaaaaaauuagcugggcauaguggugggugccuguaaucccagcuacuugggaggcuga

SEQ ID NO: 194337 - RNA, 64 nt, hsa
agaaauggguucugggccaggugugguggcucaagccuguaaucccagcacuuugggaggccga

SEQ ID NO: 194338 - RNA, 64 nt, hsa
aaaauaaaaaaauuagcugggcgugguggugggcgccuguaaucccagcuacucgggagguuua

SEQ ID NO: 194339 - RNA, 64 nt, hsa
uaaaagaggaagucagccaggcgcgguggcucaugccuguaaucccagcacuuugggaggccaa

SEQ ID NO: 194340 - RNA, 64 nt, hsa
aauacaaaauuagccgggcauugugguggugcaugccuguaaucccagcuacucgggaagcuga

SEQ ID NO: 194341 - RNA, 64 nt, hsa
caaagcuagaucucagcugggugcgauggcucacgccuguaaucccggcacuuugggaggccaa

SEQ ID NO: 194342 - RNA, 64 nt, hsa
aaaauacaaaaacuagccaggaaugguggcgcgcgccuguaaucccaguuacuuaggaggcuga

SEQ ID NO: 194343 - RNA, 64 nt, hsa
cuacuaaaaauacaaaaagccgggcguggugggcgccuguaaucccagcugcucaggaggcuga

SEQ ID NO: 194344 - RNA, 64 nt, hsa
aaaacucagaacguggccgggcgugguggcucacgccuguaaucccagcacuuugggaggcuga

SEQ ID NO: 194345 - RNA, 64 nt, hsa
auaaaaaaauuauuagcugggcaugguggugugugccuguaaucccagcuacucaggaggauga

SEQ ID NO: 194346 - RNA, 64 nt, hsa
aaaugccuaacacaggccgggucugguggcucaugccuguaaucccagcacuuugagaggccug

SEQ ID NO: 194347 - RNA, 64 nt, hsa
guaagcuuacccagcccggcgcacagugacucacgccuguaaucccagcacuuugggagggcga

SEQ ID NO: 194348 - RNA, 64 nt, hsa
aaaauacaaaaauuaacugggugugguggcgggcgccuguaaucccagcuacugagggggcuga

SEQ ID NO: 194349 - RNA, 64 nt, hsa
aaaaaucucaaagcgauuggaccuagcagcucaugccuguaaucuccagcacuuugggaggcgg

SEQ ID NO: 194350 - RNA, 64 nt, hsa
aaaauggaauuggaggccgggcgcaguggcucacgccuguaaucccagcacuuugggaggccaa

SEQ ID NO: 194351 - RNA, 64 nt, hsa
aaaauacaaaaauuagccaggugugauggugcaugccuguaaucccagcuccucaguaggcuga

SEQ ID NO: 194352 - RNA, 64 nt, hsa
ucucuacaaaaaauauacaggcguguuagcaugugccuguaaucccagcuucuugggaagcuga

SEQ ID NO: 194353 - RNA, 64 nt, hsa
gagaaggaagucugggcugggcaugguggcucacgccuguaacccuagcacuuuaggaaaucga

SEQ ID NO: 194354 - RNA, 64 nt, hsa
uaauauuccuucuuggcugggugcaguaguuuacgccuguaaucccagcacugugggaggccga

SEQ ID NO: 194355 - RNA, 64 nt, hsa
aaaaauacaaaauuagccaggugugguggugcaugccuguaaucccagcuacucgggaggcuga

SEQ ID NO: 194356 - RNA, 64 nt, hsa
aaaauacaaaaauuagccaggcaugguggcaggcgccuguaaucccagcuacucgggaggccaa

SEQ ID NO: 194357 - RNA, 64 nt, hsa
ucuuuaaaacucucggcugggcgcaguggcucaugccuguaaucccagcauuuugggaggcuga

SEQ ID NO: 194358 - RNA, 64 nt, hsa
auagaagaagaaaaggccgggcaugguggcucaugccuguaaucccaacacuuugggaggcuaa

SEQ ID NO: 194359 - RNA, 64 nt, hsa
auaaaaaucuugagggccgggcaugguggcucacgccuguaaucucagcacuuugggaggccaa

SEQ ID NO: 194360 - RNA, 64 nt, hsa
aaaauacaaaaauuagccgggcaugguggaaugugccuguaaucccaccuacucgagaggcuga

SEQ ID NO: 194361 - RNA, 64 nt, hsa
aaaaauacaaauuuagccgggcgugguggugcaggccuguaaucccagcuacucgggaggcuaa

SEQ ID NO: 194362 - RNA, 64 nt, hsa
guagaauaccuucaggccaggcgcgguggcucacgccuguaaucccagcacuuugggaggccga

SEQ ID NO: 194363 - RNA, 64 nt, hsa
aagaaaugugacuuggccgggcgcgguggcucacgccuguaaucccagcacuuugggaggccaa

SEQ ID NO: 194364 - RNA, 64 nt, hsa
aaaaauacaaaauuagccagguguggugguacaugccuguaaucccagcuacuagggaggcuga

SEQ ID NO: 194365 - RNA, 64 nt, hsa
aagaacaaaaagaaagccgggcaugacggcucaugccuguaaucccagcacuuugggaggcuga

SEQ ID NO: 194366 - RNA, 64 nt, hsa
caauuagccagguguggcggcguaaucccagcuggccuguaaucccagcuacuugggaggcuga

SEQ ID NO: 194367 - RNA, 64 nt, hsa
uauuaaaggaaucaggccaggcacaguggcucacgccuguaaucucagcacauugggaggcuga

SEQ ID NO: 194368 - RNA, 64 nt, hsa
aaaauacaaaaauuagcuaggcgggguagugcaugccuguaaucccagcuacucaggaggcuga

SEQ ID NO: 194369 - RNA, 64 nt, hsa
uaaaaaaaaaauuguagcacugggcguggugcaugccuguaaucccagccacucaggaggcuga

SEQ ID NO: 194370 - RNA, 64 nt, hsa
aagauaaaaaaauuagcugaguguguuggugggugccuguaauccagcuacuugggagacugag

SEQ ID NO: 194371 - RNA, 64 nt, hsa
aauuaaaagaauuuggccgggugcggcagcucaugccuguaaucccaacacuuugggaggcuga

SEQ ID NO: 194372 - RNA, 64 nt, hsa
aggaucuuggggagguggccgggugcaguggcucgccuguaaucccagcacuuugggaggccga

SEQ ID NO: 194373 - RNA, 64 nt, hsa
aaaagaaaaaaaauagccgggcgugguggcaggcgccuguaaucccagcuacuggggaggcuga

SEQ ID NO: 194374 - RNA, 64 nt, hsa
guaaauaguauauaaaauagcucugguggcucaugccuguaauccagcacuuugggaggccaag

SEQ ID NO: 194375 - RNA, 64 nt, hsa
uaaaaauacaaaaauuagccaggugguggcacacgccuguaaucccagcuacucaggaggcuga

SEQ ID NO: 194376 - RNA, 64 nt, hsa
aaaaaaaaauaagaggccgggugcgguggcucaagccuguaaucccagcacuuugggaggccga

SEQ ID NO: 194377 - RNA, 64 nt, hsa
aaagagguuuugcuggccagguaugguggcucacgccuguaaucccagcacuuugggaggcuaa

SEQ ID NO: 194378 - RNA, 64 nt, hsa
cuacuaaaaauacaagccgggcgugguggcgcaugccuguaaucccagcuacucaggaggcuga

SEQ ID NO: 194379 - RNA, 64 nt, hsa
uaaagcccauucuuggccgggcauguuggcucccgccuguaaucccagcacuuugggaagccca

SEQ ID NO: 194380 - RNA, 64 nt, hsa
aaaauacaaaaauuagccgggcgugguggcccacgccuguaaucccagcuacucgggaggcuaa

SEQ ID NO: 194381 - RNA, 64 nt, hsa
aaaaaccuuccccaggcuggacgugguggcucacgccuguaaucccagcacuuugggaggccaa

SEQ ID NO: 194382 - RNA, 64 nt, hsa
aaguacgaaacuuagccaggcaugaugggggucugccuguaaugccagcuacuccagaggcuga

SEQ ID NO: 194383 - RNA, 64 nt, hsa
aaaacccaagagcuggccaggugugguggcucaugccuguaaucccagcacuuugggaggcuga

SEQ ID NO: 194384 - RNA, 64 nt, hsa
aaauuacaaaaauuagcugggcaugguugcgcaugccuguaaucccagcuacuuuggaggcuga

SEQ ID NO: 194385 - RNA, 64 nt, hsa
aauagaagaaggucggccgggcuugguggcuuaugccuguaaccccagcacuuugggaggccga

SEQ ID NO: 194386 - RNA, 64 nt, hsa
ucuucucuccacuucugguccccuguggugaugugccuguaaucuuuuucuccacccaaacccc

SEQ ID NO: 194387 - RNA, 64 nt, hsa
agaaagcccaccugggcugggcgcgguggcucacgccuguaaucccagcacuuugggaggccaa

SEQ ID NO: 194388 - RNA, 64 nt, hsa
uuaagaaaaggcugggccaggcacgauggcucacgccuguaaucccagacuuugggaggccgag

SEQ ID NO: 194389 - RNA, 64 nt, hsa
aaaauacaaaaauuagccaggcgugguggcaggugccuguaaucccagcuacuugggaggcuga

SEQ ID NO: 194390 - RNA, 64 nt, hsa
aaaaauaaaaaauaaucagggcacaguggcucaugccuguaaucccagcacucugggaggcuga

SEQ ID NO: 194391 - RNA, 64 nt, hsa
aaaauacaaaaauuagccgggcaugguggugcaugccuguaaucccagcuacucgggaggcuga

SEQ ID NO: 194392 - RNA, 64 nt, hsa
aacaugcacggugaggccgggcgcaguggcucacgccuguaaucccagcacuuugggaggccga

SEQ ID NO: 194393 - RNA, 64 nt, hsa
aaaaaaugaauuuggccagacacaggugccucacgccuguaaucccagcacuuugggaggcuga

SEQ ID NO: 194394 - RNA, 64 nt, hsa
auaagauaaggagaggccaggccugguggcucacgccuguaaucccagcacuuuaagaggccaa

SEQ ID NO: 194395 - RNA, 64 nt, hsa
aaaauacaaaaauuagcugggcuugguggcuggcgccuguaaucccagcuacucaggagacuga

SEQ ID NO: 194396 - RNA, 64 nt, hsa
uaauuaaacucgcaggccaggcacgguggcucaugccuguaaucccagcacuuugggaggccaa

SEQ ID NO: 194397 - RNA, 64 nt, hsa
aaaauacaaaaauuagccgggcgugguggcggccgccuguaaucccagcuacuugggaggcuga

SEQ ID NO: 194398 - RNA, 64 nt, hsa
aaaacugaccaucgggccgggggcgguggcucacgccuguaaucccaacacuuugggagcccga

SEQ ID NO: 194399 - RNA, 64 nt, hsa
aguggagauguuggggccaggcacaguggcccaggccuguaaucccaucacuuugggaggugca

SEQ ID NO: 194400 - RNA, 64 nt, hsa
uuuuuaaaacugguggcugggcgugguggcucacgccuguaaucccagcacuuugggaggccga

SEQ ID NO: 194401 - RNA, 64 nt, hsa
aaaacuuaaaaguuagccaggccugguggcacaugccuguaauccgagugcuuugggaggcuga

SEQ ID NO: 194402 - RNA, 64 nt, hsa
caaaccuugagauaggcugggugcgguggcucacgccuguaaucccaacacuuugggaggccga

SEQ ID NO: 194403 - RNA, 64 nt, hsa
aaaaauacaaaauuagccgggugugguggcacaugccuguaaucccagcuacuccggaagcuga

SEQ ID NO: 194404 - RNA, 64 nt, hsa
aaaaaagaaaauuaggcugagagcaguggcucacgccuguaaucccagaacuuugggaggcuaa

SEQ ID NO: 194405 - RNA, 64 nt, hsa
aaauacaaaaaauuaacugggcaugguagugggugccuguaaucccagcuacuugggaggcuga

SEQ ID NO: 194406 - RNA, 64 nt, hsa
uauaagaaauuuagggcagggcacgguggcucacgccuguaauuccagcacuuugggaggccga

SEQ ID NO: 194407 - RNA, 64 nt, hsa
aaaaauacaaaaauuagcuggaugugguggcagugccuguaaucccagcuauuugggaggcuga

SEQ ID NO: 194408 - RNA, 64 nt, hsa
aaaauacaaaaauuagccggacgugguggugccugccuguaauccagcuacucaggaggcugag

SEQ ID NO: 194409 - RNA, 64 nt, hsa
acucacgaagcagaggcugggcgugguggcucucgccuguaaucccagcacuuugggaggccaa

SEQ ID NO: 194410 - RNA, 64 nt, hsa
uuugguacaaaauuacccggaugugauggcacaugccuguaaucccagcuacucaggaggcuga

SEQ ID NO: 194411 - RNA, 64 nt, hsa
uuaaaaguacaugaggcugggcacaguggcucacgccuguaaucccagcacuuagggugggcaa

SEQ ID NO: 194412 - RNA, 64 nt, hsa
cuaaaacaaaaauuagccaggcaugguggcaccugccuguaaucccagcuacuugggaggcuga

SEQ ID NO: 194413 - RNA, 64 nt, hsa
aagagucaguuuggggccaggcgugguggcucaugccuguaaucucagcacuuugggaggcuga

SEQ ID NO: 194414 - RNA, 64 nt, hsa
aaaauacaaaaauuggcugggcaugguggcgggugccuguaaucccagcuacuggggaggcuga

SEQ ID NO: 194415 - RNA, 64 nt, hsa
gaaaagaagggcugggcaaggcauaguggcuuaugccuguaaucccgguacuuugggaggcuga

SEQ ID NO: 194416 - RNA, 64 nt, hsa
aaagauacaaaauuagccaggcaugguggugcaugccuguaaucccagcuacuugggaggcuaa

SEQ ID NO: 194417 - RNA, 64 nt, hsa
aagaacagccaaguggccaggugcgguggcucaugccuguaaucccagcacuuugggaggccau

SEQ ID NO: 194418 - RNA, 64 nt, hsa
aaaauacaaaaauuagccaggcguggucacaugcgccuguaaucccagcuacucgggcagcuga

SEQ ID NO: 194419 - RNA, 64 nt, hsa
uaaaaaaaauuucuggcugggcccgguggcucaugccuguaaucccagcacuuugggaggccgg

SEQ ID NO: 194420 - RNA, 64 nt, hsa
uaaaaccaaaaguuaaccgggcgugguggugggugccuguaauccuagcuacuugggaggcuga

SEQ ID NO: 194421 - RNA, 64 nt, hsa
gaaaaaaacggugcggcugggagcgguggcucacgccuguaauccuagcaccuugggaggccga

SEQ ID NO: 194422 - RNA, 64 nt, hsa
cccaggggugaauuggauucuugaagagaccaaagccuguaacuguccagcuucuaauuucaaa

SEQ ID NO: 194423 - RNA, 64 nt, hsa
ucucuacaaaaauuagcugggcgugguggcgcgcgccuguaaucccagcuacucaggaggcuga

SEQ ID NO: 194424 - RNA, 64 nt, hsa
aaaacuuggcuguuggccgggcacgguggcucacgccuguaaucccagcacuuugggaggcuga

SEQ ID NO: 194425 - RNA, 64 nt, hsa
aaaaaggcagaaaaggccgggcgcgguggcucaugccuguaaccccagcacuuugggaggccga

SEQ ID NO: 194426 - RNA, 64 nt, hsa
gagcaggggauagaagccgggcgaaguggcccaugccuguaaucucagcacucugggagaccga

SEQ ID NO: 194427 - RNA, 64 nt, hsa
aaaauauagaaauuagccuggugugguggcgagugccuguaaucccagcuauucaggaggguga

SEQ ID NO: 194428 - RNA, 64 nt, hsa
aaaaaaaaaaaauagaccaggugcucuggcucaugccuguaaucccagcacuuugggaggccaa

SEQ ID NO: 194429 - RNA, 64 nt, hsa
caaauuugcgaugagaccagaugcuguggcucaggccuguaaucccauaauuuucagaggcuga

SEQ ID NO: 194430 - RNA, 64 nt, hsa
aaaaguacacaauuagcuaggccugguggcgugcgccuguaaucccagcuauauaggaggcuga

SEQ ID NO: 194431 - RNA, 64 nt, hsa
aaaaugcaaugacuggcugggugcaguggcucaugccuguaaucccaacacuuugggaguccga

SEQ ID NO: 194432 - RNA, 64 nt, hsa
agaaauucucuacuggccgggcacaguggcucacgccuguaaugccagcacuuugggaggccaa

SEQ ID NO: 194433 - RNA, 64 nt, hsa
aaaauacaaaaauuagcugggugugguggugcacgccuguaaucccagcuacucgggaggcuga

SEQ ID NO: 194434 - RNA, 64 nt, hsa
aaccuuacaaaggacgccgggcgugguggcucacgccuguaaucccagcacuuugggaggccga

SEQ ID NO: 194435 - RNA, 64 nt, hsa
aaacacuugaugcuggcuggguggggugacucacgccuguaaucccagcacuuugggaggccga

SEQ ID NO: 194436 - RNA, 64 nt, hsa
aaaaaagaaguuauggccgggcgcgguggcucaugccuguaauaccagcacuuugggaggcgga

SEQ ID NO: 194437 - RNA, 64 nt, hsa
aaauacaggaaauuaucugggcauaguagugugugccuguaaucccagcuacuugggaagcuga

SEQ ID NO: 194438 - RNA, 64 nt, hsa
gacugaaacaagcaggccagaugugguggcucacgccuguaauccuagcacuuugggaggccga

SEQ ID NO: 194439 - RNA, 64 nt, hsa
cuguuuuaaggaggggcugggcucgguggcucacgccuguaaucccagacuuugagaggccaag

SEQ ID NO: 194440 - RNA, 64 nt, hsa
uacaaaaaauacaaaaauuagccgggugggacacgccuguaaucccagcuacucaagaggcuga

SEQ ID NO: 194441 - RNA, 64 nt, hsa
aaaaauacaaaauuagucgggcguaguggugcaugccuguaaucccaguuacucgagaggcuga

SEQ ID NO: 194442 - RNA, 64 nt, hsa
uaagaauacgugcauggcuggcacaguggcuuacgccuguaaucccagcacuuugggaggcuga

SEQ ID NO: 194443 - RNA, 64 nt, hsa
aaaaauacaaaauuagccgggugugguggcgcaugccuguaaucccagcuacuugggaggcuga

SEQ ID NO: 194444 - RNA, 64 nt, hsa
aauacuaauaguccggccaggcgcuguggcucacgccuguaaucccaggacuuugggaggccaa

SEQ ID NO: 194445 - RNA, 64 nt, hsa
aacauaaaaaaauuagucagguguggcggugcgugccuguaaucccagcuauucaggaggcuga

SEQ ID NO: 194446 - RNA, 64 nt, hsa
uaucagugaugaaaauuugccuuugccccggcuugccuguaaucccagcacuuugggaggccga

SEQ ID NO: 194447 - RNA, 64 nt, hsa
gaaacauacuucuuugcugggcauggugacucacgccuguaaucccagcacuuuggaaggguga

SEQ ID NO: 194448 - RNA, 64 nt, hsa
aaaaaacaauucucggcugggcgcgguggcgcaugccuguaaucccagcacuuugggaggccaa

SEQ ID NO: 194449 - RNA, 64 nt, hsa
ggugggcucucucuggcccagcguggugguucaugccuguaauaccagcguuuugggaggcuga

SEQ ID NO: 194450 - RNA, 64 nt, hsa
uaagcagcccacacaacugggcauagugguucaugccuguaaucccagcacuuugggaggcuga

SEQ ID NO: 194451 - RNA, 64 nt, hsa
aaaaaaggaaaaauaggccgggcugguggcucacgccuguaaucccagcacuuuggcaggcuga

SEQ ID NO: 194452 - RNA, 64 nt, hsa
aaaauaaaaaauuagcgaggcguggugggcgggcgccuguaaucccagcuacuugggaggcuga

SEQ ID NO: 194453 - RNA, 64 nt, hsa
agauccagacaucagggcugggcacagcgguuccgccuguaaucccagcacuuugggaggucca

SEQ ID NO: 194454 - RNA, 64 nt, hsa
aaaauacaaaaaugagcugggugugaugauacaugccuguaauccuggcuacuugggaggcuga

SEQ ID NO: 194455 - RNA, 64 nt, hsa
aaaaaaugauuucuggccgggcgugguggcucaagccuguaaucccagcacuuugggaggccga

SEQ ID NO: 194456 - RNA, 64 nt, hsa
aaaauacgaaaauuagccgggcaugguggcgagugccuguaaucuuagcuacucaggaggcuaa

SEQ ID NO: 194457 - RNA, 64 nt, hsa
gaaaaccaaacuggggccgggugcgguggcucacgccuguaaucccagcacuuugggaggccaa

SEQ ID NO: 194458 - RNA, 64 nt, hsa
aaaauacacaacuuagccagucuuguuggcgcacgccuguaaucucagcuacuagggaugcuga

SEQ ID NO: 194459 - RNA, 64 nt, hsa
gguaaauguuucccggcugggcgcgguggcucacgccuguaaucccagcacuuugggaggccga

SEQ ID NO: 194460 - RNA, 64 nt, hsa
uaaauaaaaaaccaggccaggcgugguggcucacgccuguaaucccagcacuuugggaggccga

SEQ ID NO: 194461 - RNA, 64 nt, hsa
aaaauacaaaaauuagccaggugugguagcaggugccuguaaucacagcuacucgggaggcuga

SEQ ID NO: 194462 - RNA, 64 nt, hsa
aaaauggaaauauuggccgggcgcgguggcucacgccuguaaucccagcacuuugggaggccga

SEQ ID NO: 194463 - RNA, 64 nt, hsa
aaaaaugaaaaauuagccaggcagguuggcgggggccuguaauccuagcuacuuggggugcuga

SEQ ID NO: 194464 - RNA, 64 nt, hsa
agcauggcaaauuuaaaaaauaacacaauuucuugccuguaacccuagcacuuugggaggccga

SEQ ID NO: 194465 - RNA, 64 nt, hsa
aaaauacaaaaauuagcugggcgugguagugcaugccuguaaucccagcuacuugggaggcuga

SEQ ID NO: 194466 - RNA, 64 nt, hsa
cuuuuaacagucugggcuggguccgguggcucacgccuguaaucccagcaauuugggaguccga

SEQ ID NO: 194467 - RNA, 64 nt, hsa
aaacuacaaaaauuaacugggugugguggcgcgugccuguaaucccagcuacucgggaagcuga

SEQ ID NO: 194468 - RNA, 64 nt, hsa
aaaauacaaaaauuagcugggcguaguggcgcgugccuguaauuccaucuacucgggaggcuga

SEQ ID NO: 194469 - RNA, 64 nt, hsa
aauucuuaguucagggcugggcgcgguggcucaugccuguaacccuagcacuuugggaggcuga

SEQ ID NO: 194470 - RNA, 64 nt, hsa
aaaauauaaaaauuagcugggugugguggcaggagccuguaaucccagcuacacaggaggcuga

SEQ ID NO: 194471 - RNA, 64 nt, hsa
gaaaaggacucccuggccaggcgcagugacuuacgccuguaaucucagcacuuugggaggccaa

SEQ ID NO: 194472 - RNA, 64 nt, hsa
aaauacaaaaaauuagcugggcgugguggugggcgccuguaaucccaguuacucgggaggcuga

SEQ ID NO: 194473 - RNA, 64 nt, hsa
auaacuugcaucuaggcugggcguggcggcucacgccuguaaucccagcacuuugggaggccga

SEQ ID NO: 194474 - RNA, 64 nt, hsa
aaauacaagaaacuagccagaugcgguggcacccgccuguaaucccagcuacucgggaggcuga

SEQ ID NO: 194475 - RNA, 64 nt, hsa
aaaauacaaaaauuagccaggacugauggcaugugccuguaaucccagcuucuggaggcugagg

SEQ ID NO: 194476 - RNA, 64 nt, hsa
uucuguucuccuucuguuauuauacuuaaucuucuaaacuaaacuaaugugaacaguagggaag

SEQ ID NO: 194477 - RNA, 64 nt, hsa
uucuccuucuguuauuauacuuaaucuucuaaacuaaacuaaugugaacaguagggaagcaagg

SEQ ID NO: 194478 - RNA, 64 nt, hsa
aagccguuagacacacaggaaaaauccagaaggguaaacuaaacuaaagcuacaauuaauaugg

SEQ ID NO: 194479 - RNA, 64 nt, hsa
guuagacacacaggaaaaauccagaaggguaaacuaaacuaaagcuacaauuaauaugggaauu

SEQ ID NO: 194480 - RNA, 64 nt, hsa
aauuugauuagauuauucagaaacaauaggaugcuaaacuaauucauuguaucuuuuuuuuaca

SEQ ID NO: 194481 - RNA, 64 nt, hsa
aaacuuauuuuuuaaaucguuguacauuucuuauuaaacuaagugcuuaauuuuaaaguauuau

SEQ ID NO: 194482 - RNA, 64 nt, hsa
uguaaaagucaccaaaaacuuaaaggcauuaaaauaaacuaaaaaaguacucauuucuucauuu

SEQ ID NO: 194483 - RNA, 64 nt, hsa
uguggcuuugggaucuuuuuauuuugauuguugguaaacuaaucauuuuauuauauauaaaaau

SEQ ID NO: 194484 - RNA, 64 nt, hsa
uguuuucccucugauguauauagucacuguuguauaaacuaaucuuugcuuguuuucuacucug

SEQ ID NO: 194485 - RNA, 64 nt, hsa
auaugccauaguuuagaaagaauauuaaccuuucuaaacuaaauuuagguuugcagaaaguauu

SEQ ID NO: 194486 - RNA, 64 nt, hsa
gagcaucacaagcuuuugagcgcauggaacuccauaaacuaacaaauuacauaaacuaaagggg

SEQ ID NO: 194487 - RNA, 64 nt, hsa
gagcgcauggaacuccauaaacuaacaaauuacauaaacuaaagggggauuuucuuucuucuuu

SEQ ID NO: 194488 - RNA, 64 nt, hsa
uaaagcauaucuauuaauaauucccccaauuuuuuaaacuaacaaaauggaauguuaacugaau

SEQ ID NO: 194489 - RNA, 64 nt, hsa
gcaaagacugaauugaagguuacauguuuuaggauaaacuaauuucuuuugaguucauaaauca

SEQ ID NO: 194490 - RNA, 64 nt, hsa
acuuuuacccucaaguccgauuugucugugauuuuaaacuaacuguguauguauugauguuugg

SEQ ID NO: 194491 - RNA, 64 nt, hsa
aaagucagccuaaagaaguuaugguaucauauguuaaacuaagcuuucaaaaaccuuagugaaa

SEQ ID NO: 194492 - RNA, 64 nt, hsa
uauuaaacacaucugcaggacacauuuugccauguaaacuaacauucacugguuccagggauua

SEQ ID NO: 194493 - RNA, 64 nt, hsa
ggcagggccaagguccccacuuucuugcugacuguaaacuaaggccacuuccagcuuguagagg

SEQ ID NO: 194494 - RNA, 64 nt, hsa
agggaaacaaaugccuaaacuacagcacuguacauaaacuaacaggaaaugcugcuuuugaucc

SEQ ID NO: 194495 - RNA, 64 nt, hsa
caaauguaaucacuuaaauagcuucuugucaccuuaaacuaaagcagaauaaaaaguauccuuu

SEQ ID NO: 194496 - RNA, 64 nt, hsa
auuguucuaugucuuuguuggcugguguauuuuauaaacuaaagcugccuauguuucuuuuuaa

SEQ ID NO: 194497 - RNA, 64 nt, hsa
uaauacauauuauuuaccccacuguaacaucauguaaacuaaguauguuuuuaaacaauuuuua

SEQ ID NO: 194498 - RNA, 64 nt, hsa
uucccaaugcauugaugugaagggauagaaaaucuaaacuaauuuaguuauccauuggggggug

SEQ ID NO: 194499 - RNA, 64 nt, hsa
guuauuaaugaaagaauauggauuuaaaaauuuuuaaacuaaauaauuugugcugucacagaaa

SEQ ID NO: 194500 - RNA, 64 nt, hsa
acugguacauggaggcuauuuuaauccuucuaacuaaacuaaaauagauuaaaggaauuaaacu

SEQ ID NO: 194501 - RNA, 64 nt, hsa
uccuucuaacuaaacuaaaauagauuaaaggaauuaaacuaaaauacaaguaaagcuagacaaa

SEQ ID NO: 194502 - RNA, 64 nt, hsa
uagaagcuauuuuacuacauagguaaagaaaagauaaacuaacuuguaacaaagaccacaacug

SEQ ID NO: 194503 - RNA, 64 nt, hsa
gccuacgagguuuuugccccauuuuacagaauaguaaacuaagagccaugaaaaucacuuggcc

SEQ ID NO: 194504 - RNA, 64 nt, hsa
aaaaauggugagcgaucauuuauuucaugauucaaccugauacauuuacauagugcaaaacugu

SEQ ID NO: 194505 - RNA, 64 nt, hsa
agucaaauggauucaucaccugucaugcauugacaccugauacccagacuuaauugguauuugu

SEQ ID NO: 194506 - RNA, 64 nt, hsa
aagcauuuuaucuuuagaagagaaacugaugggcaccugauacucugucuaaauacguuuguua

SEQ ID NO: 194507 - RNA, 64 nt, hsa
uagaguguagacccuuucauguacuguacuguacaccugauacuguaaacauacuguaauaaua

SEQ ID NO: 194508 - RNA, 64 nt, hsa
ccugcccucccuuuauuuuuccaguucuuauuucaccugauaauauuccguccaauuggcaaug

SEQ ID NO: 194509 - RNA, 64 nt, hsa
uguugguuauauugcacaauugguuauauuuaugaccugauauucaaagacucuggcauugaua

SEQ ID NO: 194510 - RNA, 64 nt, hsa
uuuucuugcccuuggagaaaaagaaucauucucaaccugauaaucuguuaagaaaaaucccaua

SEQ ID NO: 194511 - RNA, 64 nt, hsa
cuuaugucaagguugcuucuuugcaccuugcuaaaccugauacgaaugcaggaguuuuaaauuc

SEQ ID NO: 194512 - RNA, 64 nt, hsa
cucuaaguagaaaaaucacccagagcacaugcugaccugauaacugggguguugagaccagcuu

SEQ ID NO: 194513 - RNA, 64 nt, hsa
caaauguagauuugagaaaucucaaccaguuguuaccugauaggagucuuuaauuuagggcacu

SEQ ID NO: 194514 - RNA, 64 nt, hsa
uaaauaugucgguggacggggcgucuccuaauaaaccugauaccaagaagacaacuugagccac

SEQ ID NO: 194515 - RNA, 64 nt, hsa
uugagaugucuguuucuucuagauguucugaaguaccugauacauguuaaaauuagagguagua

SEQ ID NO: 194516 - RNA, 64 nt, hsa
gccuauuuuguggcauaugccacauaaaaaaugaaccugauauagacaaguacuaccuuuucaa

SEQ ID NO: 194517 - RNA, 64 nt, hsa
uauuuaugcuguagaaaacgaaaaugguuuugcuaccugauaagcuucagauuagauauagccc

SEQ ID NO: 194518 - RNA, 64 nt, hsa
uuuagucaccuuucuccuguccaacuucaccaccaccugauaauggguauauaacaggaagcug

SEQ ID NO: 194519 - RNA, 64 nt, hsa
uguggacaguugacagcuuuuuuuuuuuccauauaccugauagucuguguacagcauuguuuug

SEQ ID NO: 194520 - RNA, 64 nt, hsa
ugucucugugauuguucuggagugaauuaaguucaccugauaacucaaaagugaauguauaaua

SEQ ID NO: 194521 - RNA, 64 nt, hsa
cucugauacuuuuuuuuuuuuuuuuuuuuuugcaaccugauaccuugaaaagcuucuauguguc

SEQ ID NO: 194522 - RNA, 64 nt, hsa
aaacugagcagaaaaaauaagcuguugauuuucuaccugauacuuaagccaguggccuacuuua

SEQ ID NO: 194523 - RNA, 64 nt, hsa
guuugccuuacucccuugggcuggggcuagcccuaccugauacccugugucaaugaguguaccu

SEQ ID NO: 194524 - RNA, 64 nt, hsa
cuucauuucuugaugcucuucccaauccuugucuaccugauaauaaauucuuacuuguccuuca

SEQ ID NO: 194525 - RNA, 64 nt, hsa
ugguucuaaguccuuuuuaaagccauggaacaaaaccugauacaucacccuaacagagcauuaa

SEQ ID NO: 194526 - RNA, 64 nt, hsa
gcccuuccuccacagguguugccuuuuuauaaagaccugauagcagaauaaauugguguuuccc

SEQ ID NO: 194527 - RNA, 64 nt, hsa
acagcaaaggcuuuacuucuuuuucucuaaugucaccugauauaaaguacuuuuguugaaguga

SEQ ID NO: 194528 - RNA, 64 nt, hsa
uaacuuucuaugcaugcauuugaaagcuguuuuuaccugauaauguaguaauaaguuguauuca

SEQ ID NO: 194529 - RNA, 64 nt, hsa
uaaauuuuugaggugcuuugcuauuucuugugugaccugauagcucccuggaacuuugggucug

SEQ ID NO: 194530 - RNA, 64 nt, hsa
augauuaguuauaucugagauuugaagcuggaaaaccugauaggugagacuacuucaguuuauu

SEQ ID NO: 194531 - RNA, 64 nt, hsa
uuuauuauccugaguuagcuguuacuuuuacaguaccugauacuccuaaaacuuuuaacuuaua

SEQ ID NO: 194532 - RNA, 64 nt, hsa
cuaauauaguauuuccacuauuuacuguuauuuuaccugauaaguuauugaacccuuuggcaau

SEQ ID NO: 194533 - RNA, 64 nt, hsa
auagauagaggaagacagcucuuucgggauaaccaccugauaccugcagaaacccccaguccug

SEQ ID NO: 194534 - RNA, 64 nt, hsa
aaaagaaauacagucuuacaccaucaaggaaucuaccugauagugacaguagcuucuugaaaac

SEQ ID NO: 194535 - RNA, 64 nt, hsa
agcccacgccucaucuuccccugugcacauguuuaccugauacagcagugcugcguguuguaca

SEQ ID NO: 194536 - RNA, 64 nt, hsa
uaggauuuuucacugauucuauaagcccagcauuaccugauaccaaaaccaggcaaagaaaaca

SEQ ID NO: 194537 - RNA, 64 nt, hsa
uagaaauauuuuuugauucagaacuuagaauuguaccugauauuuauagguauuuaaaugcuuu

SEQ ID NO: 194538 - RNA, 64 nt, hsa
aaaucuggaaucccuuucucauuagcaugaaugaaccugauacacaauuaugaccagaaaauau

SEQ ID NO: 194539 - RNA, 64 nt, hsa
auccaaaggcucaacaaccagagggaauggugagaccugauaacuaaaauacuguuauuggcaa

SEQ ID NO: 194540 - RNA, 64 nt, hsa
uguguucgcacuuagccaugggcugggcucaagaaccugauaccuggguugauguggauuaccu

SEQ ID NO: 194541 - RNA, 64 nt, hsa
gcauguaagaaacacaaugccuugcccuacucagaccugauaggauugccugcuuagaugauaa

SEQ ID NO: 194542 - RNA, 64 nt, hsa
aguugcaggccgcugauugccauguugauuuuuaaccugauauucuuuuuaauuguuuuaaauu

SEQ ID NO: 194543 - RNA, 64 nt, hsa
acagggggcgugaugcugcuggcacugguuggguaccugauacgggacuggcgauggcuucugc

SEQ ID NO: 194544 - RNA, 64 nt, hsa
ggcuaggagcugggucugaccguuguaugguuugaccugauauacuccauucuccccugcgccu

SEQ ID NO: 194545 - RNA, 64 nt, hsa
ugaucaucuuugggggaagcccugcuuccugaaaaccugauauugcacugggauuugaaugugu

SEQ ID NO: 194546 - RNA, 64 nt, hsa
aauaccaguuucucauuuauauuuaacguauuggaccugauauuuuuagugggugcauucuucc

SEQ ID NO: 194547 - RNA, 64 nt, hsa
ucgugaaggcgaucucaagaguguuucccuccaaaccugauagcugccuauuccugucugguug

SEQ ID NO: 194548 - RNA, 64 nt, hsa
uuuuauaaacuuacaguaaucaaagaucuaacagaccugauaaaucaccuguucccaccuccuu

SEQ ID NO: 194549 - RNA, 64 nt, hsa
uugguaaaagggcaguuugguuucaacacagcagaccugauaugggaucccuuagccacuuuag

SEQ ID NO: 194550 - RNA, 64 nt, hsa
cuuugccaguaacuuguuuuauaguggucauaugaccugauacuggguaaacaaaacaaagaug

SEQ ID NO: 194551 - RNA, 64 nt, hsa
aacauuguaugugagagaaauauaaauauuuacaaccugauauucguuguuguuuuauuguuaa

SEQ ID NO: 194552 - RNA, 64 nt, hsa
guacagagucuuacuguagcuacgcuaaugguuaaccugauagaauuaacucguauuuuucuau

SEQ ID NO: 194553 - RNA, 64 nt, hsa
uguauguuaauguaaguuuugcuuuccagugauuaccugauacguaagccuauuugaacaaagu

SEQ ID NO: 194554 - RNA, 64 nt, hsa
uugaucuaauuacuaaauaauuacauauuuauuuaccugauaaauauguaucuaguucuacaag

SEQ ID NO: 194555 - RNA, 64 nt, hsa
ugaaaggggcguggaguuucaauaucaauaaaccaccugauaucaauaagccaccuguugacau

SEQ ID NO: 194556 - RNA, 64 nt, hsa
uaaauacaaucacccauaugaaaaaauuguuuucaccugauaugaaaauguuagaaaaggcaaa

SEQ ID NO: 194557 - RNA, 64 nt, hsa
gcuguauguauuguacauaguggaguaguuaguuaccugauaacagucuuguuauuugggucuc

SEQ ID NO: 194558 - RNA, 64 nt, hsa
cacccccaaauccuguuccaaugaaaaaauuaaaaccugauacgaaaaaaaaaaaauuccaguu

SEQ ID NO: 194559 - RNA, 64 nt, hsa
ccaacauauccacaagcaaguuaucugucuuucuaccugauaaucuaaauuaucaggauauuug

SEQ ID NO: 194560 - RNA, 64 nt, hsa
cagaucugaaccuguggucuugggagccagggugaccugauaugacaucuaaagaagcuucugg

SEQ ID NO: 194561 - RNA, 64 nt, hsa
gucuaugacaguguaacucuacagucucaaaaugaccugauaaauugauaagacaaagaugaga

SEQ ID NO: 194562 - RNA, 64 nt, hsa
cgucuccagacucucacaugcaguaugugcaggcaccugauacuucuguugcccuugugcucca

SEQ ID NO: 194563 - RNA, 64 nt, hsa
agggucaaagacagaaugguggaguguagccuccaccugauauucaggcuacucauucaguccc

SEQ ID NO: 194564 - RNA, 64 nt, hsa
caaggucagucuaaaguggcagguccuaggugugaccugauaccaccacccuuuguggcagcac

SEQ ID NO: 194565 - RNA, 64 nt, hsa
guuuaaauaacuuguggaaucuuuccuaaugacaaccugauauuaagggaaacuaaagaaaaug

SEQ ID NO: 194566 - RNA, 64 nt, hsa
uaggaguaucagugucuucaagcaccacuggucuaccugauaugacugguucugucuacaauaa

SEQ ID NO: 194567 - RNA, 64 nt, hsa
cuguccccuugaaggagaaucaucaggacccuggaccugauacggcuccccaguacaccccacc

SEQ ID NO: 194568 - RNA, 64 nt, hsa
gacauccuuucaauguaaugaaauugauaguaccaccugauacagggcuuugcaugaaccuaaa

SEQ ID NO: 194569 - RNA, 64 nt, hsa
uaauuuuaaugauuaaaaagagcauaggguaaaaaccugauauuucacuuauacugcauaacaa

SEQ ID NO: 194570 - RNA, 64 nt, hsa
uggauggauaaauagaagaacugcuaugagcuggaccugauagcugugcagaaagugagagcag

SEQ ID NO: 194571 - RNA, 64 nt, hsa
uauacacacacauacauaaauauaccacauauacaccugauagucaaauaagguacagaaauuu

SEQ ID NO: 194572 - RNA, 64 nt, hsa
ugugucaagagagguuacaugguguuaaaucgguaccugauaauguacccaaauacuauggcca

SEQ ID NO: 194573 - RNA, 64 nt, hsa
acuccaaggaguggaaauuauguggaagaagcaaaccugauacaauuugcccaagguaaacagu

SEQ ID NO: 194574 - RNA, 64 nt, hsa
aaaccuaggagcauuaagacuugucacacaguaaaccugauacaucagaggugaauaccagcac

SEQ ID NO: 194575 - RNA, 64 nt, hsa
agacuaaaaugcaagcaaacccugcaauuccuggaccugauaguuauauucaugagugaaauug

SEQ ID NO: 194576 - RNA, 64 nt, hsa
uuaacuuugaaaaguuguuugauguuuaagaaggaccugauauguaagcgcuggucauuuuucu

SEQ ID NO: 194577 - RNA, 64 nt, hsa
agggcuggcaucagguagagggagcagaguggugaccugauagcuccugucaucguguuaguuu

SEQ ID NO: 194578 - RNA, 64 nt, hsa
ucccagcacuuugggaggcugaggcaggcagaucaccugauaucaagaguuugaggccagccug

SEQ ID NO: 194579 - RNA, 64 nt, hsa
gcuuccagguaugggaccugcuaaguguggaauuaccugauaagggagagggaaauacaaggag

SEQ ID NO: 194580 - RNA, 64 nt, hsa
gucccagguuggagucccuacccucccaccucccaccugauaugcagugcuuuugacuaucuua

SEQ ID NO: 194581 - RNA, 64 nt, hsa
ugagguacaagacgauggcucaugucacaggccuaccugauacggugucagagaaagugguggg

SEQ ID NO: 194582 - RNA, 64 nt, hsa
cugguuagaaacagguccucaggaguauucucuaaccugauauuuucuaaaaagauauguugau

SEQ ID NO: 194583 - RNA, 64 nt, hsa
uuuccuccuucugggugcccagcccccuuuccucaccugauacccaagcccaccacuuuuauuu

SEQ ID NO: 194584 - RNA, 64 nt, hsa
acuguaugacuugcaaucguagguauaguuuauaaccugauagcaaaaaacuugaaauauugca

SEQ ID NO: 194585 - RNA, 64 nt, hsa
cugaauuuucacaacugguauuaugucacuagcuaccugauacggcuauuucccuuauaacuca

SEQ ID NO: 194586 - RNA, 64 nt, hsa
accucuccaaagcccucccuaccuaccaagauauaccugauauauuccaccaggauauccuccc

SEQ ID NO: 194587 - RNA, 64 nt, hsa
auuaaguuacaaggcugaauggugcagccgcuggaccugauaguaaggugcaaagguccaaacc

SEQ ID NO: 194588 - RNA, 64 nt, hsa
uacagggauuuauaguaaaacaagugucuucccaaccugauaauucauuuuggauaggccuuuc

SEQ ID NO: 194589 - RNA, 64 nt, hsa
caauacagaaaaggaguauccaaacaaugucucaaccugauaauuuccuuagcagaauuaccua

SEQ ID NO: 194590 - RNA, 64 nt, hsa
cguggucccuagcuagauccccuuccuaucaaucaccugauagcaacagggacagcugccaaua

SEQ ID NO: 194591 - RNA, 64 nt, hsa
agugcuguaaggcuuguaacuggggaaauauuccaccugauaauagcccagauucuacuguauu

SEQ ID NO: 194592 - RNA, 64 nt, hsa
agcuuggagccucuagguugagaagagaggcaaaaccugauauugaacugagagagggguucaa

SEQ ID NO: 194593 - RNA, 64 nt, hsa
caggcucgagggagacugauccccugaccaauucaccugauaaacucuagggacacuggcagcu

SEQ ID NO: 194594 - RNA, 64 nt, hsa
uaguucagcuauaauuccuuuuauagagaaaccaaccugauacacacuuucaugaugggagaaa

SEQ ID NO: 194595 - RNA, 64 nt, hsa
uguucagaaaaugcaaauuacacuauaauauaaaaccugauauauacacauuagaaauauucca

SEQ ID NO: 194596 - RNA, 51 nt, hsa
uccuagguauguuucuauaaaaccugauaaccgaaaauuggccaacggaac

SEQ ID NO: 194597 - RNA, 64 nt, hsa
ucauguucuagagaguaggacuuuuauuccguguaccugauauauauacaauuaaaauaucugu

SEQ ID NO: 194598 - RNA, 64 nt, hsa
cuuuguagcuacuuguguuuuauugguauuauaaaccugauaauuauuuacauguuuauuacug

SEQ ID NO: 194599 - RNA, 64 nt, hsa
uaacuugcuuuguagguuuguauuguugaucuaaaccugauacaugcuucauuuaaucaggaau

SEQ ID NO: 194600 - RNA, 64 nt, hsa
gagacggcaucucguucacagcacccacccucuuaccugauaaguuccaucguaucaaacuuuc

SEQ ID NO: 194601 - RNA, 64 nt, hsa
aauuccugcagacauccuacucggccagcgguuuaccugauagauucgguaauacuaucaagag

SEQ ID NO: 194602 - RNA, 64 nt, hsa
aacguuuuuccagguggcuggaagaaggaagaaaaccugauauagccaaugcuguuguagucgu

SEQ ID NO: 194603 - RNA, 64 nt, hsa
uacuguguaaggugauguucccggucgcuguugcaccugauaguaagggacagauuuuuaauga

SEQ ID NO: 194604 - RNA, 64 nt, hsa
cauagaugaaaaauguguuuacugcuuucagucgaccugauaaaaagcaacguaugguaaauau

SEQ ID NO: 194605 - RNA, 64 nt, hsa
uuguugggguauaacaugaugaguacucauuagcaccugauagaaaucugaaaugugacaguag

SEQ ID NO: 194606 - RNA, 64 nt, hsa
ugaagagcacauuucuuucaucucucuuguccauaccugauagacacauuccucucugccaccu

SEQ ID NO: 194607 - RNA, 64 nt, hsa
gugguacauuaacucuccauuuuagccagaagauaccugauaagagaagguguaagguuuuuau

SEQ ID NO: 194608 - RNA, 64 nt, hsa
acgguucuucccuagaagaaaaacaagucuuuacaccugauaaaauauuuugcgaagagaggug

SEQ ID NO: 194609 - RNA, 64 nt, hsa
uugcugagcgggagcucaguaugacuugccacccaccugauaccucagggcaaggcccuuuuuc

SEQ ID NO: 194610 - RNA, 64 nt, hsa
gccuucuggcuguauggcuuacauccuggaaauuaccugauaauaaagcaaguaaagguguaag

SEQ ID NO: 194611 - RNA, 64 nt, hsa
gagccccagcugcuggcggcugcuggaauauccuaccugauaggauuaaaaggccuaguggagc

SEQ ID NO: 194612 - RNA, 64 nt, hsa
uggagguaggaacaaaauugcgccgcuccuggagaccugauaacuuaggcuugaaauaauugac

SEQ ID NO: 194613 - RNA, 64 nt, hsa
aauuaugucuccaauugugaguaccuagcacuguaccugauacauaguaaacucacaauaaaua

SEQ ID NO: 194614 - RNA, 64 nt, hsa
uaucccaggugagguggaaagcgucucaccuggaaccugauauaacucaggcugcaauuccauc

SEQ ID NO: 194615 - RNA, 64 nt, hsa
aucauucuaacuucaacguauaauagggauugugaccugauauuuggagauguaaauauugcuc

SEQ ID NO: 194616 - RNA, 64 nt, hsa
gauguaagugauuuaauucauggguacuuuuagaaccugauagauaaucccauugccuuuauuu

SEQ ID NO: 194617 - RNA, 64 nt, hsa
uggggugucgggaugggggugcugggagacacagaccugauacaguaugucuuucugcaccacc

SEQ ID NO: 194618 - RNA, 64 nt, hsa
uucauaugacuguucucugaaaaaaggucuuacuaccugauaucaaguacauaucuuaauuuug

SEQ ID NO: 194619 - RNA, 64 nt, hsa
agaaguagcacguaauggcuuuuaucuaccaucaaccugauaaggcacaugugaaauggaaaug

SEQ ID NO: 194620 - RNA, 64 nt, hsa
cuugucugucucuggguccugggccagccaggauaccugauaauaaaagaucauugggugaaca

SEQ ID NO: 194621 - RNA, 64 nt, hsa
gucgccacacucaccucugaggucuguggaagucaccugauauucuggccccaggggugggagg

SEQ ID NO: 194622 - RNA, 64 nt, hsa
caugcccaggguucucauccacagcagcugggucaccugauagggccgcccuggacuugggguc

SEQ ID NO: 194623 - RNA, 64 nt, hsa
ggagccucuugucaccuucuuggacuuauuccccaccugauaccuuauagagaaaagugugaau

SEQ ID NO: 194624 - RNA, 64 nt, hsa
cugggauucccaacagguggacuugucgguugucaccugauaaucagaccagacuacccaccua

SEQ ID NO: 194625 - RNA, 64 nt, hsa
ugaacccaggacaggcacaguggggguggugaggaccugauagaguuggaucagugacuaagag

SEQ ID NO: 194626 - RNA, 64 nt, hsa
ugugugugcacacaugguacguguccaugugccuaccugauacuuucacauguaauuaaauucc

SEQ ID NO: 194627 - RNA, 64 nt, hsa
cugcccagaguaugggcacucaggugugggccgaaccugauaccugccugggacagccacugga

SEQ ID NO: 194628 - RNA, 64 nt, hsa
gauuugcucacucuauccuggauagguauuuagaaccugauagucuuuaagccauuccagucau

SEQ ID NO: 194629 - RNA, 64 nt, hsa
cauuuguaaacuaaccccugggaaauuugaaauuaccugauaacuuaagacucugugaucucug

SEQ ID NO: 194630 - RNA, 64 nt, hsa
cuuuuaagugaaaaaaauagguaacaaaacaaccaccugauaguaaguuuucugauaagacuau

SEQ ID NO: 194631 - RNA, 64 nt, hsa
caugucuuugggaaacacauuuauaaacauggauaccugauaauagauauugaaacccauuucc

SEQ ID NO: 194632 - RNA, 64 nt, hsa
aacuuuuguaguuuuguauguuacucaucuucuuaccugauaucccaugaugaucccaugguag

SEQ ID NO: 194633 - RNA, 64 nt, hsa
auaaaguccauaaugcauauggucaucauucuagaccugauaaccacugagaaccugcugagca

SEQ ID NO: 194634 - RNA, 64 nt, hsa
aucucaaaacaaacaauaauaauaaauaauaaaaaccugauauuuggcugggcgccguggcuca

SEQ ID NO: 194635 - RNA, 55 nt, hsa
ggccccgccggcaccucugauguacagccagcagggcccaggcagccaccaagcc

SEQ ID NO: 194636 - RNA, 58 nt, hsa
gcugcccagcccugcccccccuccccauagccagcacagcuaucccgcggggacacca

SEQ ID NO: 194637 - RNA, 58 nt, hsa
cugcacagacagcugcgaccaggacgucagccagcacugcacagacagcugcgaccag

SEQ ID NO: 194638 - RNA, 58 nt, hsa
cugugaggccgugguuagcguggacaucagccagcacugcacagacagcugcgaccag

SEQ ID NO: 194639 - RNA, 58 nt, hsa
aggagggacgagggacagggguuucaccagccagcaaccugggccuuguacugucugu

SEQ ID NO: 194640 - RNA, 58 nt, hsa
gaccucucccggaucugucuccuccucuagccagcaguauggacagcuggaccccuga

SEQ ID NO: 194641 - RNA, 58 nt, hsa
uccacucugagucccagagccaaucaguagccagcaucugccuccccuucacucccac

SEQ ID NO: 194642 - RNA, 58 nt, hsa
aagcaggcgugaccugccaggcacacugagccagcagccuggcucucccagccagguu

SEQ ID NO: 194643 - RNA, 58 nt, hsa
gacaagcagggcuugaugcuggugguggagccagcaucucaccugccaggcuuccuuu

SEQ ID NO: 194644 - RNA, 58 nt, hsa
gcaggauacccuggcgggccacccugccagccagcagcuggcccuccaccaucuucac

SEQ ID NO: 194645 - RNA, 58 nt, hsa
ccagauacacucaugggcugcccugggcagccagcauucauuguaaguucccucuuug

SEQ ID NO: 194646 - RNA, 58 nt, hsa
cuuugggauagguugcaguaccagccacagccagcagauagaggaaaagacacacaua

SEQ ID NO: 194647 - RNA, 58 nt, hsa
cccucccugccucuuuggugcucuuaaaagccagcagcugagaacauagcacaggccc

SEQ ID NO: 194648 - RNA, 58 nt, hsa
ugugcaguuucuagugcugggaagucuuagccagcaccagagcgccaggccucucccu

SEQ ID NO: 194649 - RNA, 58 nt, hsa
ccaggcuucagcaacacuccucuuucccagccagcaaaggcugugaauuugaauucuu

SEQ ID NO: 194650 - RNA, 58 nt, hsa
acagcugggagaggggagccagcuguccagccagcauguuccuguuguacagcccggu

SEQ ID NO: 194651 - RNA, 58 nt, hsa
ggccccauccuugagggccuucccagccagccagcaggagaggcaagaacugggggaa

SEQ ID NO: 194652 - RNA, 58 nt, hsa
ucccucccuccuugccccauccugggccagccagcagggcuccuccucuggcucuuca

SEQ ID NO: 194653 - RNA, 58 nt, hsa
gugggagcagacccgugggccucagggcagccagcaggcaggucuuguugccaauuua

SEQ ID NO: 194654 - RNA, 58 nt, hsa
ccggcccugccccacacaggccuggcccagccagcagguucucuccugugagcucccc

SEQ ID NO: 194655 - RNA, 58 nt, hsa
cuuguuugccuuuaggcaggaagucaggagccagcagggcgggccaggagaaagaagg

SEQ ID NO: 194656 - RNA, 58 nt, hsa
gaggggugggaccaggcugggaggacagagccagcagcugccaugcccuccugcuccc

SEQ ID NO: 194657 - RNA, 58 nt, hsa
cuggccaaggucaggaggagcaaaaaugagccagcaccagcgccuuggcuuuguguua

SEQ ID NO: 194658 - RNA, 58 nt, hsa
caccucucauugcaagccccaagcacugagccagcaggugccagggagccacccgccc

SEQ ID NO: 194659 - RNA, 58 nt, hsa
agcccugcacagcggucuccuuccccuaagccagcacugcugcucccuggagcccggg

SEQ ID NO: 194660 - RNA, 58 nt, hsa
cucugcuccacccacuuggcuaugggagagccagcagggguucuggagaaagaaacug

SEQ ID NO: 194661 - RNA, 58 nt, hsa
ucuccucccagcaucacaccagccaugcagccagcagguccuccggaucacugugguu

SEQ ID NO: 194662 - RNA, 58 nt, hsa
gaggggcggaggcacagcugcuuccagcagccagcauucaguggccuugucaccaagc

SEQ ID NO: 194663 - RNA, 58 nt, hsa
uguggcaggacuggcccagggaggaggaagccagcagcacaccuggggaauggggucc

SEQ ID NO: 194664 - RNA, 58 nt, hsa
gcccugcuuagcucaucuuagagcaaagagccagcacccugaugucccugggguggcu

SEQ ID NO: 194665 - RNA, 58 nt, hsa
ugcugcccgcucugcagacugcugcuagagccagcaacuccacuaagguggauuuuca

SEQ ID NO: 194666 - RNA, 58 nt, hsa
aaggaaaaggcaugaaguucuauaccucagccagcagcugccuucguuuggaacugaa

SEQ ID NO: 194667 - RNA, 58 nt, hsa
cagcugccuucguuuggaacugaaguccagccagcagacucucuagcuccaucucccc

SEQ ID NO: 194668 - RNA, 58 nt, hsa
ccccaagguugccccgggccagcagcccagccagcagcacagucucuauggugcugag

SEQ ID NO: 194669 - RNA, 58 nt, hsa
aggacaugguggagaccagggacaggagagccagcaggguggaugcaaggggccucua

SEQ ID NO: 194670 - RNA, 58 nt, hsa
cucccagaaugcuggguuuauagaugugagccagcacaccgggccaagugaagaaucu

SEQ ID NO: 194671 - RNA, 58 nt, hsa
acuuucugaaguagccugaucuuucuagagccagcaguacguggcuucagaggccugg

SEQ ID NO: 194672 - RNA, 58 nt, hsa
gggauuacaggcaugagccaccaugccuagccagcaagcaucauuucuauuauaccuu

SEQ ID NO: 194673 - RNA, 58 nt, hsa
ucucaccuccaccaccccucccugucccagccagcaucaucucuuuggggaccacucc

SEQ ID NO: 194674 - RNA, 58 nt, hsa
ucucaugccccuggcugggacguggcucagccagcacuuguccagcugagcgccagga

SEQ ID NO: 194675 - RNA, 58 nt, hsa
aggcugaggcuggcacaggacaugcgguagccagcacacagggcagugagggagggcu

SEQ ID NO: 194676 - RNA, 64 nt, hsa
gauuggcugguuaaugggaaacgguuuuuuucuuuggcugcagguguucugcugauaucaacag

SEQ ID NO: 194677 - RNA, 64 nt, hsa
guuuauaauuggcuuaaagggauggacuugugauuggcugcaggaagaaacuuuuuuauuuuuu

SEQ ID NO: 194678 - RNA, 64 nt, hsa
agggccagaagguuguccagcaguguuucugcaguggcugcagggagauggaaaagaagagccc

SEQ ID NO: 194679 - RNA, 64 nt, hsa
uugugugaggcugacacgucugugugaugcaguguggcugcacuuaagggucuguuucucagca

SEQ ID NO: 194680 - RNA, 64 nt, hsa
agacccccaagcauagacucggguacugugaugauggcugcaguccaguuuuaugauucugcuu

SEQ ID NO: 194681 - RNA, 64 nt, hsa
gaagagcccaagcauagacuuggugccguggugauggcugcaguccaguuuugugaugcugcuu

SEQ ID NO: 194682 - RNA, 64 nt, hsa
ucauagugagugucuucacucaagggugguuuccuggcugcacggcaccuguuccaacaccuac

SEQ ID NO: 194683 - RNA, 64 nt, hsa
gagagauggccuggguuaucauugcugauagcuuuggcugcaugaguugggcuuccccuuaccc

SEQ ID NO: 194684 - RNA, 64 nt, hsa
agccaggugugagggucaccggcaggugggcugguggcugcagccucagagcccucccagguug

SEQ ID NO: 194685 - RNA, 64 nt, hsa
cgauuaugguucugagaaaagcaaauaucacuuuuggcugcauuaaaagaagcaucauauauaa

SEQ ID NO: 194686 - RNA, 64 nt, hsa
ucugcccacccuuccccaggccucugccagccucuggcugcacggucaggcccugccccauggc

SEQ ID NO: 194687 - RNA, 64 nt, hsa
aaaggucggaggacuggcucuuguagucacagaguggcugcaggccuuugaaaaguggaggaaa

SEQ ID NO: 194688 - RNA, 64 nt, hsa
cagugggucagcugcggugugggaugcuggaguuuggcugcaggcugacaucauuuauuuuugc

SEQ ID NO: 194689 - RNA, 64 nt, hsa
cacuaacccacacacugcaggacaucguucucccuggcugcauccacucagugcugggaguagu

SEQ ID NO: 194690 - RNA, 64 nt, hsa
aaaaaaaaguaaaauugaagugcuauugcagacauggcugcaguacuguaccuuaucauucuga

SEQ ID NO: 194691 - RNA, 64 nt, hsa
agcggcguagccgugcgugugugugaugguuccguggcugcaaggaagggaaacagucuauuau

SEQ ID NO: 194692 - RNA, 64 nt, hsa
uuuuugguugauugcuggugagaauggccggcgguggcugcagugguagccugaggaaggccaa

SEQ ID NO: 194693 - RNA, 64 nt, hsa
caagccuccuccaucucccaucagugcugugggcuggcugcaagccucgaaacaguucuccugg

SEQ ID NO: 194694 - RNA, 64 nt, hsa
uugaaaaacaaccaaagaaagggagugaggacuauggcugcauguccucugcuugcccggcugc

SEQ ID NO: 194695 - RNA, 64 nt, hsa
ucuucagcuccuuccugugguuugccauccgcuguggcugcagcuuggaccgcaagggcaaaua

SEQ ID NO: 194696 - RNA, 64 nt, hsa
uauugguccaagaggaugcucggguagucuucgguggcugcaggagagcgaugcugcgccucug

SEQ ID NO: 194697 - RNA, 64 nt, hsa
ggugcuuggaccaagucucaggugugucugccuguggcugcacaggcucucuaaccgaaaccuc

SEQ ID NO: 194698 - RNA, 64 nt, hsa
uaacacugcauucucacuauaacgugcccuauaauggcugcaucccuuuugagcaaccuccaaa

SEQ ID NO: 194699 - RNA, 64 nt, hsa
accaccaccuggcguguagaaucuccaggaagccuggcugcagcuucccauuugguuacgaggu

SEQ ID NO: 194700 - RNA, 64 nt, hsa
ucaguauuucaaggaaaauuauggaugccagucuuggcugcacaagauauccauuacguacuua

SEQ ID NO: 194701 - RNA, 64 nt, hsa
cagggaauggaugcuucacuugaucuccggaccuuggcugcagaggccaucgcagcuuuugaaa

SEQ ID NO: 194702 - RNA, 64 nt, hsa
uggagaugguaucaucaagcucaacguucuggaguggcugcagcucaccauguaugccugaacc

SEQ ID NO: 194703 - RNA, 64 nt, hsa
ggcugguuacuuugggcuguccaacucauaaguuuggcugcauuuugaaaaaagcugaucuaaa

SEQ ID NO: 194704 - RNA, 64 nt, hsa
ugagcugguuuuuagcggagacggagucccaccuuggcugcagggaguccgaaagggacuugga

SEQ ID NO: 194705 - RNA, 64 nt, hsa
cuuugcagacaggcaagcaccuccugccucgaacuggcugcaaaggguaucaggugcugccauc

SEQ ID NO: 194706 - RNA, 60 nt, hsa
uccucgagaucaaacacuaaggcacggggcuggcugcagagcagccuuaggacccuggga

SEQ ID NO: 194707 - RNA, 64 nt, hsa
aacacaacucccaucccagucaguuuccuucccauggcugcaucuuaagauggaugcacggaga

SEQ ID NO: 194708 - RNA, 64 nt, hsa
ugaguauuuuaucuguaaaauguuaucugcccuuuggcugcauuggaauuucagagaaggcugc

SEQ ID NO: 194709 - RNA, 64 nt, hsa
ccuuccgccacuggggcucagagccggggugggguggcugcagccucaggacugggagccccca

SEQ ID NO: 194710 - RNA, 64 nt, hsa
guggcagcucggccucucuacgaccccaucuugguggcugcacacucuuccuggcccgcacccc

SEQ ID NO: 194711 - RNA, 64 nt, hsa
gaugggcuccccaggaagcccacugccuccucccuggcugcagccuccgggguucagccuccug

SEQ ID NO: 194712 - RNA, 64 nt, hsa
agggcagccccugcagacgucuggcccuggcggguggcugcaagcccaccucggcccucccugc

SEQ ID NO: 194713 - RNA, 64 nt, hsa
guguacguucccaugugccccgugaaagcauguguggcugcagacguguccacaugggccuugc

SEQ ID NO: 194714 - RNA, 64 nt, hsa
ucaccuggccugugcagaaacgcucaugcacaccuggcugcacaggugugcacgcauuacccuu

SEQ ID NO: 194715 - RNA, 64 nt, hsa
uaucucaaugaaaagggaguuucguaagcaaaauagaggacagaaaugcaguucaugaacuugc

SEQ ID NO: 194716 - RNA, 64 nt, hsa
cugcaggugucuagggucucagcuuuucauuugcagaggacauguucaacuuccucucuguuca

SEQ ID NO: 194717 - RNA, 64 nt, hsa
auagauaugaugccagcaaagggauggaaagucuagaggacaccuuuguaucucaagcuaaugc

SEQ ID NO: 194718 - RNA, 64 nt, hsa
ggaguuucccauaucauuguugaugaaguucaugagaggacagaagaaagguaaaacaaagacu

SEQ ID NO: 194719 - RNA, 64 nt, hsa
aauauaaaaaauguuauuacugaggaaagggaggagaggacaaguguaauaaaucaaaauugac

SEQ ID NO: 194720 - RNA, 64 nt, hsa
uuuuagugguucugugccucuuaucaaguguuacagaggacauaccacugccaugucagggguu

SEQ ID NO: 194721 - RNA, 64 nt, hsa
ucuuuguaauauaaucagaaugaaaaauaauuuaagaggacagaagacugguacuuuuuuguuu

SEQ ID NO: 194722 - RNA, 64 nt, hsa
ccaugcuucuucauuuuuuuacuuuaguuaaaaaagaggacauuuaauauucuacaugcuguaa

SEQ ID NO: 194723 - RNA, 64 nt, hsa
agagaugccaaaaauggggacaugacuucuggacagaggacaugggccacgcccccaugcaucc

SEQ ID NO: 194724 - RNA, 64 nt, hsa
cucacaaggcgacuugaagaggacgcaggcuuccagaggacaaaccccaauacaggagaagcac

SEQ ID NO: 194725 - RNA, 64 nt, hsa
acauguggauauccagccagaaugcccucucuccagaggacacacagcucuggauuucuacccc

SEQ ID NO: 194726 - RNA, 64 nt, hsa
uugaccugccuuggggagcagggcugaggggcgaagaggacauguggauauccagccagaaugc

SEQ ID NO: 194727 - RNA, 64 nt, hsa
uccugcaguugcuggauggauagggacaccaggaagaggacaaacugcauggacucaagcgagc

SEQ ID NO: 194728 - RNA, 64 nt, hsa
caguggggucacguaaaggaauugcaggucggugagaggacaagagggacucccauguucuaag

SEQ ID NO: 194729 - RNA, 64 nt, hsa
uuuuuuuucuaauuucagacuuggcuuuuuacuuagaggacauucugauuugcucucagaaaca

SEQ ID NO: 194730 - RNA, 64 nt, hsa
uguggguuucuuuugcccuuacuggaugacucucagaggacaugacuugacauaguaacauuag

SEQ ID NO: 194731 - RNA, 64 nt, hsa
uacucucauaacagcugacagaaguacauauugaagaggacaauauggcaauguccuucaaaau

SEQ ID NO: 194732 - RNA, 64 nt, hsa
aaugaagaagaacaaagagccugagaaagcagcaagaggacaugaugaaaaauacguggaguug

SEQ ID NO: 194733 - RNA, 64 nt, hsa
acagccaccaccauauugccauuaguggaaaaaaagaggacagugaaccugccuuccaccugcc

SEQ ID NO: 194734 - RNA, 64 nt, hsa
ggccggccaagccauucagagagaacauggguccagaggacauucucaguggaaagaguuugau

SEQ ID NO: 194735 - RNA, 64 nt, hsa
guggaagaaaagauuguggagcaugcagaaaagcagaggacacucagcaaaaauaaguagcuac

SEQ ID NO: 194736 - RNA, 64 nt, hsa
gcugaaagcuuugguuuugcugaugaaaucaggaagaggacaaguggccuggccagcccacaac

SEQ ID NO: 194737 - RNA, 64 nt, hsa
gagcuacaagauggcugcucugaggccuuugagaagaggacaucacagaaaggagaaucuccac

SEQ ID NO: 194738 - RNA, 64 nt, hsa
ggcuuuagccggaagucaguccuccucauucaccagaggacacacaggggagacgccccagucu

SEQ ID NO: 194739 - RNA, 64 nt, hsa
ggcuuuagccggaagucagaccuccucagucaccagaggacacacacaggggagaagccuuaug

SEQ ID NO: 194740 - RNA, 64 nt, hsa
uauuuuaaauggaauuuauucuaucaacugccugagaggacacaaugggggaggggcuucggac

SEQ ID NO: 194741 - RNA, 64 nt, hsa
ugugucuggccgggcccccucuccguagguguacagaggacauguaaauacacagcgguggugc

SEQ ID NO: 194742 - RNA, 64 nt, hsa
guauuaagccagcgguugugacucauugaacaucagaggacauauccuggagaaaagcccuacg

SEQ ID NO: 194743 - RNA, 64 nt, hsa
gccuucaaugaucgcucaacccuuaguaaacacgagaggacacacacuggaggcaaacccuaug

SEQ ID NO: 194744 - RNA, 64 nt, hsa
ucuguaagauuaugguacuguggaacaugagggcagaggacaccgggaggcuguuaggggguca

SEQ ID NO: 194745 - RNA, 64 nt, hsa
caacugaaauagcuauguggcggauacggaaaacagaggacaauuugaggaucuugcuggaaua

SEQ ID NO: 194746 - RNA, 64 nt, hsa
gcacagccccugcagagcaucuuggucauuuggaagaggacacgguauccccucuggccagagu

SEQ ID NO: 194747 - RNA, 64 nt, hsa
auuccagccucuuugagcuggccccuccagauggagaggacaucuccugggcugggcccaggua

SEQ ID NO: 194748 - RNA, 64 nt, hsa; identical to SEQ ID NO: 68448

SEQ ID NO: 194749 - RNA, 64 nt, hsa; identical to SEQ ID NO: 68449

SEQ ID NO: 194750 - RNA, 64 nt, hsa; identical to SEQ ID NO: 68450

SEQ ID NO: 194751 - RNA, 64 nt, hsa; identical to SEQ ID NO: 68451

SEQ ID NO: 194752 - RNA, 64 nt, hsa; identical to SEQ ID NO: 68452

SEQ ID NO: 194753 - RNA, 64 nt, hsa; identical to SEQ ID NO: 68453

SEQ ID NO: 194754 - RNA, 64 nt, hsa; identical to SEQ ID NO: 68454

SEQ ID NO: 194755 - RNA, 64 nt, hsa; identical to SEQ ID NO: 68455

SEQ ID NO: 194756 - RNA, 64 nt, hsa; identical to SEQ ID NO: 68456

SEQ ID NO: 194757 - RNA, 64 nt, hsa; identical to SEQ ID NO: 68457

SEQ ID NO: 194758 - RNA, 64 nt, hsa; identical to SEQ ID NO: 68458

SEQ ID NO: 194759 - RNA, 64 nt, hsa; identical to SEQ ID NO: 68459

SEQ ID NO: 194760 - RNA, 64 nt, hsa; identical to SEQ ID NO: 68460

SEQ ID NO: 194761 - RNA, 64 nt, hsa; identical to SEQ ID NO: 68461

SEQ ID NO: 194762 - RNA, 64 nt, hsa; identical to SEQ ID NO: 68462

SEQ ID NO: 194763 - RNA, 64 nt, hsa; identical to SEQ ID NO: 68463

SEQ ID NO: 194764 - RNA, 64 nt, hsa; identical to SEQ ID NO: 68464

SEQ ID NO: 194765 - RNA, 54 nt, hsa; identical to SEQ ID NO: 67612

SEQ ID NO: 194766 - RNA, 64 nt, hsa; identical to SEQ ID NO: 68466

SEQ ID NO: 194767 - RNA, 64 nt, hsa; identical to SEQ ID NO: 68467

SEQ ID NO: 194768 - RNA, 64 nt, hsa; identical to SEQ ID NO: 68468

SEQ ID NO: 194769 - RNA, 64 nt, hsa; identical to SEQ ID NO: 68469

SEQ ID NO: 194770 - RNA, 64 nt, hsa; identical to SEQ ID NO: 68470

SEQ ID NO: 194771 - RNA, 64 nt, hsa; identical to SEQ ID NO: 68471

SEQ ID NO: 194772 - RNA, 64 nt, hsa; identical to SEQ ID NO: 68472

SEQ ID NO: 194773 - RNA, 64 nt, hsa; identical to SEQ ID NO: 68473

SEQ ID NO: 194774 - RNA, 64 nt, hsa; identical to SEQ ID NO: 68474

SEQ ID NO: 194775 - RNA, 64 nt, hsa; identical to SEQ ID NO: 68475

SEQ ID NO: 194776 - RNA, 64 nt, hsa; identical to SEQ ID NO: 68476

SEQ ID NO: 194777 - RNA, 64 nt, hsa; identical to SEQ ID NO: 68477

SEQ ID NO: 194778 - RNA, 64 nt, hsa; identical to SEQ ID NO: 68478

SEQ ID NO: 194779 - RNA, 64 nt, hsa; identical to SEQ ID NO: 68479

SEQ ID NO: 194780 - RNA, 64 nt, hsa; identical to SEQ ID NO: 68480

SEQ ID NO: 194781 - RNA, 64 nt, hsa; identical to SEQ ID NO: 68481

SEQ ID NO: 194782 - RNA, 64 nt, hsa; identical to SEQ ID NO: 68482

SEQ ID NO: 194783 - RNA, 64 nt, hsa; identical to SEQ ID NO: 68483

SEQ ID NO: 194784 - RNA, 64 nt, hsa; identical to SEQ ID NO: 68484

SEQ ID NO: 194785 - RNA, 64 nt, hsa; identical to SEQ ID NO: 68485

SEQ ID NO: 194786 - RNA, 64 nt, hsa; identical to SEQ ID NO: 68486

SEQ ID NO: 194787 - RNA, 64 nt, hsa; identical to SEQ ID NO: 68487

SEQ ID NO: 194788 - RNA, 64 nt, hsa; identical to SEQ ID NO: 68488

SEQ ID NO: 194789 - RNA, 64 nt, hsa; identical to SEQ ID NO: 68489

SEQ ID NO: 194790 - RNA, 64 nt, hsa; identical to SEQ ID NO: 68490

SEQ ID NO: 194791 - RNA, 64 nt, hsa; identical to SEQ ID NO: 68491

SEQ ID NO: 194792 - RNA, 64 nt, hsa; identical to SEQ ID NO: 68492

SEQ ID NO: 194793 - RNA, 64 nt, hsa; identical to SEQ ID NO: 68493

SEQ ID NO: 194794 - RNA, 64 nt, hsa; identical to SEQ ID NO: 68494

SEQ ID NO: 194795 - RNA, 64 nt, hsa; identical to SEQ ID NO: 68495

SEQ ID NO: 194796 - RNA, 64 nt, hsa; identical to SEQ ID NO: 68496

SEQ ID NO: 194797 - RNA, 64 nt, hsa; identical to SEQ ID NO: 68497

SEQ ID NO: 194798 - RNA, 64 nt, hsa; identical to SEQ ID NO: 68498

SEQ ID NO: 194799 - RNA, 64 nt, hsa; identical to SEQ ID NO: 68499

SEQ ID NO: 194800 - RNA, 64 nt, hsa; identical to SEQ ID NO: 68500

SEQ ID NO: 194801 - RNA, 64 nt, hsa; identical to SEQ ID NO: 68501

SEQ ID NO: 194802 - RNA, 64 nt, hsa; identical to SEQ ID NO: 68502

SEQ ID NO: 194803 - RNA, 64 nt, hsa; identical to SEQ ID NO: 68503

SEQ ID NO: 194804 - RNA, 64 nt, hsa; identical to SEQ ID NO: 68504

SEQ ID NO: 194805 - RNA, 64 nt, hsa; identical to SEQ ID NO: 68505

SEQ ID NO: 194806 - RNA, 64 nt, hsa; identical to SEQ ID NO: 68506

SEQ ID NO: 194807 - RNA, 64 nt, hsa; identical to SEQ ID NO: 68507

SEQ ID NO: 194808 - RNA, 64 nt, hsa; identical to SEQ ID NO: 68508

SEQ ID NO: 194809 - RNA, 64 nt, hsa; identical to SEQ ID NO: 68509

SEQ ID NO: 194810 - RNA, 64 nt, hsa; identical to SEQ ID NO: 68510

SEQ ID NO: 194811 - RNA, 64 nt, hsa; identical to SEQ ID NO: 68511

SEQ ID NO: 194812 - RNA, 64 nt, hsa; identical to SEQ ID NO: 68512

SEQ ID NO: 194813 - RNA, 64 nt, hsa; identical to SEQ ID NO: 68513

SEQ ID NO: 194814 - RNA, 64 nt, hsa; identical to SEQ ID NO: 68514

SEQ ID NO: 194815 - RNA, 64 nt, hsa; identical to SEQ ID NO: 68515

SEQ ID NO: 194816 - RNA, 64 nt, hsa; identical to SEQ ID NO: 68516

SEQ ID NO: 194817 - RNA, 64 nt, hsa; identical to SEQ ID NO: 68517

SEQ ID NO: 194818 - RNA, 64 nt, hsa; identical to SEQ ID NO: 68518

SEQ ID NO: 194819 - RNA, 64 nt, hsa; identical to SEQ ID NO: 68519

SEQ ID NO: 194820 - RNA, 64 nt, hsa
auacucuuaaguguaaauaauauaaaauguuucaagcgcuuaacucccccucauucacaaagua

SEQ ID NO: 194821 - RNA, 64 nt, hsa
augacaguaaauaucagaauuuuaugguuugaccagcgcuuaucacauucccaauucagugaga

SEQ ID NO: 194822 - RNA, 64 nt, hsa
auguuuuuauaaaagcaaaaggauauucacuuucagcgcuuauacugaaguauuagauuaaagc

SEQ ID NO: 194823 - RNA, 64 nt, hsa
guaauuaaaugggggcucuuacugacuuuaaauuagcgcuuauaaaauaaaaauguuuaguuca

SEQ ID NO: 194824 - RNA, 64 nt, hsa
uagaguauaaagcagcugucacacuucaaagagcagcgcuuaaauuccuagcgaagugccguaa

SEQ ID NO: 194825 - RNA, 64 nt, hsa
agcagucugaaggauuccccaccuccaaucccccagcgcuuagaaacauguuccuguuccucgg

SEQ ID NO: 194826 - RNA, 50 nt, hsa; identical to SEQ ID NO: 57621

SEQ ID NO: 194827 - RNA, 64 nt, hsa
acuaugugaaguacuguguugcagaaguggcaaaagcgcuuauuuuuaaaaaugcaaaauauuu

SEQ ID NO: 194828 - RNA, 64 nt, hsa
cccaaguucccaucacgucagauuuggagcugguagcgcuuacgaugcccccacgugugaacau

SEQ ID NO: 194829 - RNA, 64 nt, hsa
cuggugagggucagaaggggacgguaccaagaguagcgcuuagcccuuacccaggaaauauccu

SEQ ID NO: 194830 - RNA, 64 nt, hsa
auggaggcaagaaagcauuuccuuugggguuuagagcgcuuaaguuguuccucuguuaucaugc

SEQ ID NO: 194831 - RNA, 64 nt, hsa
uagaguaaaagucuaccccucugaagcacuauuaagcgcuuaacguauauuuaaauacuaccau

SEQ ID NO: 194832 - RNA, 64 nt, hsa
auucauuuguggcaauuaaguggucccaaugcucagcgcuuaaaaaaacaaauuggacagcuac

SEQ ID NO: 194833 - RNA, 64 nt, hsa
ggcuaaaaugccagguaaaggguugguuggacacagcgcuuagugcacgcugucaucauggaca

SEQ ID NO: 194834 - RNA, 64 nt, hsa
acacuuaagccuagaauuucucuuuagguauaucagcgcuuaaauccaagacuauuuuuuauug

SEQ ID NO: 194835 - RNA, 64 nt, hsa
uuugagcauuguauuucucgcaucccuucucgugagcgcuuagaccuuuuucuauuuuagucgg

SEQ ID NO: 194836 - RNA, 64 nt, hsa
gugcacugcucgagacacaagugcugcuguaguuagcgcuuagugacacgcgggccuuuggugg

SEQ ID NO: 194837 - RNA, 64 nt, hsa
guauguuuuucuugaauagguauugauaaauggaagcgcuuaccagcccagcuuugccagcccu

SEQ ID NO: 194838 - RNA, 64 nt, hsa
ugcuggcuugcacuuucuuauuuucuuauuuuagagcgcuuaaaaaauccggaaaaaugggguu

SEQ ID NO: 194839 - RNA, 64 nt, hsa
aauugggcuguggcuggggcaggagcuauagggaguuaaggaaugaugauacggaaguuggagc

SEQ ID NO: 194840 - RNA, 64 nt, hsa
cgucugcucuacugaguacuuucugcaggggccuguuaaggacgaggccuccccagcccugccc

SEQ ID NO: 194841 - RNA, 64 nt, hsa
uacuugcaaauuacauccuugcugaauucaggagguuaaggaaacgauccaugcaagagaggcc

SEQ ID NO: 194842 - RNA, 64 nt, hsa
cuggcacauaguacaugcaauauguuugaaacuaguuaaggaauuauaaaaacaaaugaguucu

SEQ ID NO: 194843 - RNA, 64 nt, hsa
acccagggacgugguuuuagagucuaccuaauauguuaaggacaaggaaaccucugagucuacc

SEQ ID NO: 194844 - RNA, 64 nt, hsa
uaaggacaaggaaaccucugagucuaccuaauauguuaaggacaaggaaaccucuggacagugg

SEQ ID NO: 194845 - RNA, 64 nt, hsa
cucuaauucauuggucacugguagguaagcaugaguuaaggaaagucaaaaaugaaaauauauu

SEQ ID NO: 194846 - RNA, 64 nt, hsa
aaauuggaaaaaauuaaaacugaccuauaagaguguuaaggaccuaauagagugacauauauaa

SEQ ID NO: 194847 - RNA, 64 nt, hsa
aaauaaagaucuuaauaaaagcaagcuuaauguaguuaaggaucuucauauuagaauuguguca

SEQ ID NO: 194848 - RNA, 64 nt, hsa
aaagacagguaaauguuauauaauuguaggguuaguuaaggaaauuaguccauaaaauuggcaa

SEQ ID NO: 194849 - RNA, 64 nt, hsa
guuaaggauuaacuagcccuuuaaggauuaacuaguuaaggauuaauagcaaaagauauuaaau

SEQ ID NO: 194850 - RNA, 64 nt, hsa
auacuggaagauaaugcacaaaaugaagggacuaguuaaggauuaacuagcccuuuaaggauua

SEQ ID NO: 194851 - RNA, 64 nt, hsa
uuucuugaauugcuuucguaaaggucugaacacuguuaaggagaaagcugaguaucaacuugcc

SEQ ID NO: 194852 - RNA, 64 nt, hsa
ugcacauuuaggaagguuacaugucagacccuuuguuaaggauaacccuuggacucuggggcau

SEQ ID NO: 194853 - RNA, 64 nt, hsa
uuguuguuuuugccaccguggagagcaacuauuuggagugcacagccuauugaacuaccucauu

SEQ ID NO: 194854 - RNA, 64 nt, hsa
uuuuaaaauggagucucacugugucacccaggcuggagugcagugagcugagaucgcaccacug

SEQ ID NO: 194855 - RNA, 64 nt, hsa
uuugagacagagucucacucuuaucacccaggcaggagugcaguggugcgaucaaggcccacug

SEQ ID NO: 194856 - RNA, 64 nt, hsa
uguggcgacaaggucuugcucugucacccaggcuggagugcagugguauagucauagcucacug

SEQ ID NO: 194857 - RNA, 64 nt, hsa
agcaauucuccugccucagccucccgaguagcugggagugcaggugcacaccgccaugccuggc

SEQ ID NO: 194858 - RNA, 64 nt, hsa
uuuugagauggagucuugcccuguugcccaggcuggagugcaguggcacgaucucggcucacug

SEQ ID NO: 194859 - RNA, 64 nt, hsa
uuuugagauggacucuagcucugucacccaggcuggagugcaguggugcgaucucggcucacug

SEQ ID NO: 194860 - RNA, 64 nt, hsa
ucggagacggaguuucacucuugcugcccaggcuggagugcaauggugcaaugaccucggcuca

SEQ ID NO: 194861 - RNA, 64 nt, hsa
uuuuagauggaguuuggcucuugucacccaggcuggagugcaauggcgcaaucucagcucacug

SEQ ID NO: 194862 - RNA, 64 nt, hsa
uuugagacagaguuuugcucuuauugcccaggcuggagugcaguggcgugaucuuggcucacug

SEQ ID NO: 194863 - RNA, 64 nt, hsa
uuuugagacugagucucgcacugucacccaggguggagugcaguggcgggaucucagcucagug

SEQ ID NO: 194864 - RNA, 64 nt, hsa
accugccacagccucccaaagugcuaggaauacaggagugcaccaucgcacccggcuggguuau

SEQ ID NO: 194865 - RNA, 64 nt, hsa
uguuuuuuguagacagcacucugucacccaggcuggagugcaguggcaccaucuuggcucacug

SEQ ID NO: 194866 - RNA, 64 nt, hsa
uuuuugagacggagucugcucugucgcucgcgcuggagugcaguggcaugaucucggcucacug

SEQ ID NO: 194867 - RNA, 64 nt, hsa
uuuugagacagggucucacugugucccccaggcuggagugcaguggcacaaugacgacucacug

SEQ ID NO: 194868 - RNA, 64 nt, hsa
cuuuuuuauuuuuugagacaggguugcccaggguggagugcaguggcaggaucacagcuuacug

SEQ ID NO: 194869 - RNA, 64 nt, hsa
ugacugguguccucaggaaggaagccccugggauggagugcagggagccagcuggaagggaagg

SEQ ID NO: 194870 - RNA, 64 nt, hsa
cguugagauacaguuucacucugucacccaggcuggagugcaguggcaugaucucagcucacug

SEQ ID NO: 194871 - RNA, 64 nt, hsa
uuuuuggagacagagucucacugucacccaggcuggagugcaguggcaugaucucaguuuaugc

SEQ ID NO: 194872 - RNA, 64 nt, hsa
ggggggauggaguuucgcuguuguugcccaggcuggagugcaauagcacgaucuuggcucaccg

SEQ ID NO: 194873 - RNA, 64 nt, hsa
uuuugaaacagggucucacucuauugcccaggcuggagugcacuggcgugaucucggcucacug

SEQ ID NO: 194874 - RNA, 64 nt, hsa
cuugagacggagucuuggucuugucacccaggcuggagugcaguggcacgaucucggcucacua

SEQ ID NO: 194875 - RNA, 64 nt, hsa
uuugagacagaguuucacucuuguugcccaggcuggagugcaguagcgcagucucggcucacug

SEQ ID NO: 194876 - RNA, 64 nt, hsa
uucugagacagagucucgcucuguugcccaggcuggagugcaguggcacgaucucggcucacgg

SEQ ID NO: 194877 - RNA, 64 nt, hsa
uuuugagacggagucucgcucugucgcccaggcuggagugcaguggcgcgaucucggcucacug

SEQ ID NO: 194878 - RNA, 64 nt, hsa
uuuuugagauaauuucacucuuguugcccaggcuggagugcaauggcgugaucgcugcucaccg

SEQ ID NO: 194879 - RNA, 64 nt, hsa
uuuugagacauggucacgcugugucgccaaggcuggagugcaguggugcgaucucggcuggcug

SEQ ID NO: 194880 - RNA, 64 nt, hsa
uuugaaacagucuuacucugucucccaggcugcuggagugcaguggcacaaucucggcccgcug

SEQ ID NO: 194881 - RNA, 64 nt, hsa
ucuuaagacagagucuugcucugucucccaggcuggagugcaguggcacaaucauggcucacug

SEQ ID NO: 194882 - RNA, 64 nt, hsa
uuuugagacauggucuugcucuauugcccaggcuggagugcagugguacaaucuuagcucacug

SEQ ID NO: 194883 - RNA, 64 nt, hsa
ucucaggaacucauggcagugguuuaccuugucaggagugcauggacgggcugccccucccauu

SEQ ID NO: 194884 - RNA, 64 nt, hsa
ccgccauggugucccgguaccuuccauacacagaggagugcagccuucuccauaucuccauggc

SEQ ID NO: 194885 - RNA, 64 nt, hsa
uuaugagacagggucuugcucugucccccaggcuggagugcaguggcaugaucauagcucacug

SEQ ID NO: 194886 - RNA, 64 nt, hsa
uuuugagacagaaucucacucucucgcccaggcuggagugcaacgguacgaucuuggcucagug

SEQ ID NO: 194887 - RNA, 64 nt, hsa
ggggugcggggcaguucacucugucucccaggcuggagugcaauggugcaaucuuggcucacua

SEQ ID NO: 194888 - RNA, 64 nt, hsa
uuuugagacagagucucgcucugucaccuaggcuggagugcaguggcgcaaucucaccucacug

SEQ ID NO: 194889 - RNA, 64 nt, hsa
uuuuuuuuuuucgagacacucugucacccaggcuggagugcaauggugcaaucucggcucacug

SEQ ID NO: 194890 - RNA, 64 nt, hsa
uuuugagacagagucucacucugucccccaggcuggagugcaguggcgcgaucuuggcccacca

SEQ ID NO: 194891 - RNA, 64 nt, hsa
uuuuuuuuuugagucuugcucugucacugaggcuggagugcaguggcgcaauuucagcucacug

SEQ ID NO: 194892 - RNA, 64 nt, hsa
uuuugagacagagucucacucugucacccagacuggagugcaguggcgcgaucucggcucacug

SEQ ID NO: 194893 - RNA, 64 nt, hsa
uuuagugacagagucucauucuguugcccaugcuggagugcaguggcgugaucauagcucacug

SEQ ID NO: 194894 - RNA, 64 nt, hsa
uuuugagacggagucuugcucuguugcccaggcuggagugcaguggcacaaucucagcucacug

SEQ ID NO: 194895 - RNA, 64 nt, hsa
uuuuuuuuuugagacucgcuuugucacccaggcuggagugcaauggcacaaucucaacucaccg

SEQ ID NO: 194896 - RNA, 64 nt, hsa
uuuugagacagcaucucacacugucgcccaggcuggagugcaguggugcaaucucagcuuacug

SEQ ID NO: 194897 - RNA, 64 nt, hsa
uuuuggagacagagucuugcuuuguugccaggcuggagugcaguggcgcgaucucggcucacca

SEQ ID NO: 194898 - RNA, 64 nt, hsa
aauggagacagggucuugcacuaucacccaggcuggagugcaguggcauaaucauaccucauug

SEQ ID NO: 194899 - RNA, 64 nt, hsa
uuugagacagaguuucgcucuuguugcccaggcuggagugcaacggcacgaucucggcucaccg

SEQ ID NO: 194900 - RNA, 64 nt, hsa
uuuugagauagggucucacuuuguuacccaggcuggagugcaguggcacaaucucgacucacug

SEQ ID NO: 194901 - RNA, 64 nt, hsa
uuugagaugaagucucgcgguugucacccgggcuggagugcaguggcgugaucucggcucacug

SEQ ID NO: 194902 - RNA, 64 nt, hsa
aguggggacagagucucacuaugucacccaggcuggagugcaauggcaugaucucagcucacug

SEQ ID NO: 194903 - RNA, 64 nt, hsa
aucuguuaagagagucacuagucagaauguuaaaggagugcaugcaggaugccccaaaugucgu

SEQ ID NO: 194904 - RNA, 64 nt, hsa
uuuugagacggagucucgcuuugucauccaggcuggagugcaguggugcgaucucagcucacug

SEQ ID NO: 194905 - RNA, 64 nt, hsa
cuuaauuuuuuuuugagacagagucacccaggcuggagugcaguggugagauuuuggcucacua

SEQ ID NO: 194906 - RNA, 64 nt, hsa
uuugagauggaguuuugcucuuguugcccagacuggagugcaauggcacacgaucucggcucac

SEQ ID NO: 194907 - RNA, 64 nt, hsa
uuuugagacagagucuugcucugucacccaggcuggagugcaguggugcgaucgcucacugcaa

SEQ ID NO: 194908 - RNA, 64 nt, hsa
uuuugagauggagucucacucugucacccaggcuggagugcaguggcgugaucuuggcucacug

SEQ ID NO: 194909 - RNA, 64 nt, hsa
gucugagacagaaucucagucugucacccagguuggagugcaguggcgugaucucagcucacug

SEQ ID NO: 194910 - RNA, 64 nt, hsa
uuuuugagacagagucuuacucuguugccaggcuggagugcaguggcgcgaucucagcucacua

SEQ ID NO: 194911 - RNA, 64 nt, hsa
uuuugagacagagucuuccucugucuccuaagcuggagugcaguggcaucaucucagcucacug

SEQ ID NO: 194912 - RNA, 64 nt, hsa
uuuugagauggcaucuugcucugucgcccaggauggagugcaguggcgcgaucuuagcucacug

SEQ ID NO: 194913 - RNA, 64 nt, hsa
gcagccguguggagccugggacuuugagcagcagggagugcauuugcuggggugucggggaccc

SEQ ID NO: 194914 - RNA, 64 nt, hsa
uuugagauggaguuucgcucuugucacccacgcuggagugcaaugguguggucuuggcuuauug

SEQ ID NO: 194915 - RNA, 64 nt, hsa
uuuuauggcagggucucacucugucgcccaggcuggagugcaguggcgugaucucggcucacua

SEQ ID NO: 194916 - RNA, 64 nt, hsa
uuugagacaaaguuuugcucuugucacccaggcuggagugcaguggugcaaucuuggcucgcaa

SEQ ID NO: 194917 - RNA, 64 nt, hsa
uuuugagaccaaaucuugcucuguggcccaggcuggagugcaguggcacgaucucagcucacug

SEQ ID NO: 194918 - RNA, 64 nt, hsa
guuuuugagacgaggucucacugucacccaggcuggagugcaguggugccaucaugacucacug

SEQ ID NO: 194919 - RNA, 64 nt, hsa
guuugagauggagucucacucugucucccaggcuggagugcaguggcgugaucuuggcucacug

SEQ ID NO: 194920 - RNA, 64 nt, hsa
uuuugagacagauucuugcucugucacccaggcuggagugcaguagcaugaucagggaucacug

SEQ ID NO: 194921 - RNA, 64 nt, hsa
uuugagaugggggucuugcucuguugcccacgcaggagugcaguggcaugcucucagcucacug

SEQ ID NO: 194922 - RNA, 64 nt, hsa
uuuugagauggagucucgcucugucgcccaggcuggagugcaguggcgcaaucucagcucacug

SEQ ID NO: 194923 - RNA, 64 nt, hsa
uuuaaggacagagucucucucugucacccaggcuggagugcaauggcgcgaucuuggcucacug

SEQ ID NO: 194924 - RNA, 64 nt, hsa
uuuugagauggagucucgcucugucgcccagguuggagugcaguggcgcaaucucggcucacug

SEQ ID NO: 194925 - RNA, 64 nt, hsa
uuuuuugagacagucuccuggugucacccaggcuggagugcaguggugugaucuuggcucacug

SEQ ID NO: 194926 - RNA, 64 nt, hsa
uuuugagacggagucucacucugucgcccaggcuggagugcaguggugcgaucucagcucacug

SEQ ID NO: 194927 - RNA, 64 nt, hsa
uuugagacagaguuucacucuuguuguccagucuggagugcaauggcacaaucucagcucacag

SEQ ID NO: 194928 - RNA, 64 nt, hsa
uuuuuuugagauggauucucacuguugccaggcuggagugcaguggcacaaucuuggcucacug

SEQ ID NO: 194929 - RNA, 64 nt, hsa
uuuuuuuuuuugagacggaguccuugcccaggcuggagugcaguggcgcgaucucagcucacug

SEQ ID NO: 194930 - RNA, 64 nt, hsa
cccaagauggugucucacucuguugccccaggcuggagugcaguggugugauccuggcucacug

SEQ ID NO: 194931 - RNA, 64 nt, hsa
guugagauguaauuuugcucuuguugcccaggcuggagugcaguggugcgaucgcggcucaccg

SEQ ID NO: 194932 - RNA, 64 nt, hsa
uuugagacagagucucacucuuguugcccaagcuggagugcaguggugcaaugugggcucacug

SEQ ID NO: 194933 - RNA, 64 nt, hsa
uuuugagagguagucuugcucugucacccaggcuggagugcaguggcacgaucucggcucacug

SEQ ID NO: 194934 - RNA, 64 nt, hsa
auuuugagauagagccuugcucugucaccaggccggagugcaguggugucaucucagaucacug

SEQ ID NO: 194935 - RNA, 64 nt, hsa
uuuuagacagaguuuugcucuuguugccuaggcuggagugcaguggcgcagucuuggcucaccu

SEQ ID NO: 194936 - RNA, 64 nt, hsa
uuuugagauggagucucgcucugucaucuaggcuggagugcaguggugugaucucagcucacug

SEQ ID NO: 194937 - RNA, 64 nt, hsa
uucaagacagggucucaacucuguuacccaggcuggagugcaguggugcgaucucagcucacug

SEQ ID NO: 194938 - RNA, 64 nt, hsa
uuugagacagaauuuugcucuuguugcccaggcuggagugcaauggcgugaucuuggcucacag

SEQ ID NO: 194939 - RNA, 64 nt, hsa
uuuugagacagggucucacacugucacccaggcuggagugcaguguugcaguccggcucacugc

SEQ ID NO: 194940 - RNA, 64 nt, hsa
ggagggggcaggguuucacucugucacccaggcuggagugcaguggugcaaucacuguuuauug

SEQ ID NO: 194941 - RNA, 64 nt, hsa
uuuucgggccgccggugcgggcgcccuccugcugggagugcaggggcggccuuggguguggaga

SEQ ID NO: 194942 - RNA, 64 nt, hsa
uuuuagauggaguuuuacucuuguugcccaggcuggagugcaacggcaugauuuuggcucacug

SEQ ID NO: 194943 - RNA, 64 nt, hsa
uuuugaggcagagucucauucuguugcccaggcuggagugcaguggcgugaucuuggcucacua

SEQ ID NO: 194944 - RNA, 64 nt, hsa
gaagaugaaccuuccaccgucuucacugcauccuggagugcaaaaauaaaauccacucaagagu

SEQ ID NO: 194945 - RNA, 64 nt, hsa
uuuugagacagggucucacucugucacccaggcuggagugcaguggcacauucucggcucacug

SEQ ID NO: 194946 - RNA, 51 nt, hsa
ucccagccgacgacgucugauggagugcauugugcacaugaaguauuuauc

SEQ ID NO: 194947 - RNA, 64 nt, hsa
uuuugagacagggucuugcuuuguugcccaggcuggagugcagugacguggucauagcucacug

SEQ ID NO: 194948 - RNA, 64 nt, hsa
uuuugagauggaguuucgcucuguuguccaggcuggagugcaauggcaguuguuucaccguaac

SEQ ID NO: 194949 - RNA, 64 nt, hsa
uuugagauggagucuugcuccuguugugcaggcuggagugcaguggcacagucuuggcucacug

SEQ ID NO: 194950 - RNA, 64 nt, hsa
uuucugauacagagucucacucuguugccaggcuggagugcaguggcgcaaucuuggcucacug

SEQ ID NO: 194951 - RNA, 64 nt, hsa; identical to SEQ ID NO: 93186

SEQ ID NO: 194952 - RNA, 64 nt, hsa; identical to SEQ ID NO: 93187

SEQ ID NO: 194953 - RNA, 64 nt, hsa; identical to SEQ ID NO: 93188

SEQ ID NO: 194954 - RNA, 64 nt, hsa; identical to SEQ ID NO: 93189

SEQ ID NO: 194955 - RNA, 64 nt, hsa; identical to SEQ ID NO: 93190

SEQ ID NO: 194956 - RNA, 64 nt, hsa; identical to SEQ ID NO: 93191

SEQ ID NO: 194957 - RNA, 64 nt, hsa; identical to SEQ ID NO: 93192

SEQ ID NO: 194958 - RNA, 64 nt, hsa; identical to SEQ ID NO: 93193

SEQ ID NO: 194959 - RNA, 64 nt, hsa; identical to SEQ ID NO: 93194

SEQ ID NO: 194960 - RNA, 64 nt, hsa; identical to SEQ ID NO: 93195

SEQ ID NO: 194961 - RNA, 64 nt, hsa; identical to SEQ ID NO: 93196

SEQ ID NO: 194962 - RNA, 64 nt, hsa; identical to SEQ ID NO: 93197

SEQ ID NO: 194963 - RNA, 64 nt, hsa; identical to SEQ ID NO: 93198

SEQ ID NO: 194964 - RNA, 64 nt, hsa; identical to SEQ ID NO: 93199

SEQ ID NO: 194965 - RNA, 64 nt, hsa
gacuguggaguuccauucuuggcaucuacucuggaccaaggagcaucccuaauucuucauaggg

SEQ ID NO: 194966 - RNA, 64 nt, hsa
caaaugcuuguugauagccuuuuucuaucaagaaaccaaggagcuaauuauuaauaacaaucau

SEQ ID NO: 194967 - RNA, 64 nt, hsa
gagaucggaguuuugcagccacaagcuaagaaacaccaaggauuguggcaaccaucagaagcuu

SEQ ID NO: 194968 - RNA, 64 nt, hsa
acgaagaaagaauaaauuucggcuguuuuaagccaccaaggauaauugguuacagcagcucuag

SEQ ID NO: 194969 - RNA, 64 nt, hsa
gaagaagcagauccccuguguggucuccaugcucaccaaggaacucuacuucagucaauagcca

SEQ ID NO: 194970 - RNA, 64 nt, hsa
accuuacugcccaggccuaucuggaagccaccucaccaaggaccuuggaagagcaagggacagu

SEQ ID NO: 194971 - RNA, 64 nt, hsa
cuggauaccugugugucuccauaaaaguccugucaccaaggacguuaaaggcauuuuauuccag

SEQ ID NO: 194972 - RNA, 64 nt, hsa
accggccuugugacauucacucagagaagaccacaccaaggaggcggccgcuggcccaggagag

SEQ ID NO: 194973 - RNA, 64 nt, hsa
uggcggaagccccacggcggugagguccauccugaccaaggagcggcggccggagggcggguac

SEQ ID NO: 194974 - RNA, 64 nt, hsa
cgucaaugacaaugcccccgaauuccccuuuaagaccaaggagauaaggguggaggaggugagg

SEQ ID NO: 194975 - RNA, 64 nt, hsa
aucuaauuauuuccacuugcccuguucucuucacaccaaggaagcuccagauccaguaucuugu

SEQ ID NO: 194976 - RNA, 64 nt, hsa
cuugggaucagaucaagaguuuuggagaucagguaccaaggaaauaaggacagucuagcugccu

SEQ ID NO: 194977 - RNA, 64 nt, hsa
aagggcucuauguuugugucaugccucuucaaacaccaaggaguugaacaugcuuccagugauu

SEQ ID NO: 194978 - RNA, 64 nt, hsa
cuuuuuuaaagaacagaaaaagaugaaugaaagaaccaaggagagaugcagagacuauauuuag

SEQ ID NO: 194979 - RNA, 64 nt, hsa
uuaaaaaauacaauaaauuuguagagauaggaugaccaaggacaacaguuuuaggcuuccaaag

SEQ ID NO: 194980 - RNA, 64 nt, hsa
gcuggggcgcacggagaagcaggucccuauauugaccaaggaguuugugguacgaccccucccc

SEQ ID NO: 194981 - RNA, 64 nt, hsa
auuuaacaaauacuuaauuguauuaaggucauguaccaaggauuugauaaaguuuaaauaauuu

SEQ ID NO: 194982 - RNA, 64 nt, hsa
caguaauacaggaagcauggcaggcaccaugcaaaccaaggauggauggugcagucccuguguc

SEQ ID NO: 194983 - RNA, 64 nt, hsa; identical to SEQ ID NO: 73420

SEQ ID NO: 194984 - RNA, 64 nt, hsa; identical to SEQ ID NO: 73421

SEQ ID NO: 194985 - RNA, 64 nt, hsa
gggccgcagcagugcuggguguucucagaccugacugaggaaguuagcugcgggcugcccugug

SEQ ID NO: 194986 - RNA, 64 nt, hsa
gcuuuucuuucugcuucaaacacacaguucgucucugaggaaaguaaaauaaauggaauaagag

SEQ ID NO: 194987 - RNA, 64 nt, hsa
uuuccaucccacuccacuauguugucuauuuuuucugaggaauuaaggguuaccccacccugcc

SEQ ID NO: 194988 - RNA, 64 nt, hsa
agaccuagauaggucaugcaagugagaaagacaucugaggaaaauggaagaccuaaggcagaca

SEQ ID NO: 194989 - RNA, 64 nt, hsa
cugauuucaauuaggcagcacuucccaaagugcacugaggaagguggccccaagagaagcucuc

SEQ ID NO: 194990 - RNA, 64 nt, hsa
cccauagaucuaguauuguacagcacugcauucucugaggaagucccaguccaaacucugauuu

SEQ ID NO: 194991 - RNA, 64 nt, hsa
ucagaaagcaaacaacacaauuacaagguugaaucugaggaaaauaauccuugugccauagaag

SEQ ID NO: 194992 - RNA, 64 nt, hsa
uugcccaucuccugugucuucaaaggugugagagcugaggaauauguguuccuaugggaacuau

SEQ ID NO: 194993 - RNA, 64 nt, hsa
ccucucccgugccuuuagaggaaggagaggauugcugaggaaugcagggacgccuguuucuguc

SEQ ID NO: 194994 - RNA, 64 nt, hsa
ccuuguuuucagugcugcgguaucagucagugaucugaggaaauccuguaggggaaggcaggcu

SEQ ID NO: 194995 - RNA, 64 nt, hsa
gacagccaggaggcugcagcuaccacgagggccucugaggaaccuccuuccaggccugggauga

SEQ ID NO: 194996 - RNA, 64 nt, hsa
ugccuuaggcacuucucgggaauuugaggccagccugaggaacugcaggacucaggugcaaugu

SEQ ID NO: 194997 - RNA, 64 nt, hsa
ugauggucucucccuccuggccucaggcccauuccugaggaagggccuuggcgagcuuguggau

SEQ ID NO: 194998 - RNA, 64 nt, hsa
cuuucugcccagaaaaaugugcagcuugacucugcugaggaaaagguccaagccaagaggacug

SEQ ID NO: 194999 - RNA, 64 nt, hsa
uccuguuuuaauuccuaaagauccugacuuuuaucugaggaagucuagguaguuuuccuuuugg

SEQ ID NO: 195000 - RNA, 64 nt, hsa
uagauaaggauaaaaauauauuugugaauuacuucugaggaaaugcuaacuuccacagcauugu

SEQ ID NO: 195001 - RNA, 64 nt, hsa
aaaauacauuauuagaauauaaaaaauguuauuacugaggaaagggaggagaggacaaguguaa

SEQ ID NO: 195002 - RNA, 64 nt, hsa
aaggggauggcccauuaagaguuacucagaugaccugaggaaaggagggaaaguuccagcaguu

SEQ ID NO: 195003 - RNA, 64 nt, hsa
gcacugagccacugcgcccagccaacaauccgcucugaggaaagcguaagcaggaagaccucuu

SEQ ID NO: 195004 - RNA, 64 nt, hsa
ccuaguuguguuuggaaagggagagaagagaugucugaggaaggucauguucuuucagcuuaug

SEQ ID NO: 195005 - RNA, 64 nt, hsa
aaaguaguagucagaaugaauuaugguuggaaaacugaggaaucuucugguugcaggugcaaag

SEQ ID NO: 195006 - RNA, 64 nt, hsa
gaaagaggaaguggagucauuuugccuuugaaggcugaggaaagauugauacccaguuaauuuu

SEQ ID NO: 195007 - RNA, 64 nt, hsa
aagcugagcaccaggggaugaguggagguuaaggcugaggaaaggccagcuggcagcagagugu

SEQ ID NO: 195008 - RNA, 64 nt, hsa
ugacucuaggugcccuuggaggccagccagugaccugaggaagcgugaaggccgagaagcaaga

SEQ ID NO: 195009 - RNA, 64 nt, hsa
uuuuaucuccauuuuccaguuagguagagccaagcugaggaauccuuuuaagauuauuagaaaa

SEQ ID NO: 195010 - RNA, 64 nt, hsa
uucuaugauaauuuaaaauacauagguagggcuacugaggaaauuuggagagccacauucugug

SEQ ID NO: 195011 - RNA, 64 nt, hsa
gcucccucucccgugccucugcuuucuccagcagcugaggaaagaagggacacggaacaggguc

SEQ ID NO: 195012 - RNA, 64 nt, hsa
ucuguucauucuucacaggcaggaaccucaugcucugaggaagucuaaguccaguuuuccuucu

SEQ ID NO: 195013 - RNA, 64 nt, hsa
aaggaaacagauaucauagagcugaacaaggaaacugaggaaucacccaaaugagugccaccaa

SEQ ID NO: 195014 - RNA, 64 nt, hsa
ggaggccccaguccccagacaguuucagccagcgcugaggaaaauauauucaacugugaagaag

SEQ ID NO: 195015 - RNA, 64 nt, hsa
ugugcaaaguuaggucuucccaguugucucagugcugaggaaccucaucagagaagcauggaag

SEQ ID NO: 195016 - RNA, 64 nt, hsa
uggauugucuccugaugaguacauguggacucaccugaggaagggaaggaagggaauaaucuuu

SEQ ID NO: 195017 - RNA, 64 nt, hsa
ccaucuguugacaaugucuuguggagcauuuuugcugaggaaaaggucacuuguaaacagagga

SEQ ID NO: 195018 - RNA, 64 nt, hsa
cuuuguuucuuuuuaauuaaaauacaagaagcagcugaggaaagggagacaagguauuuuauuu

SEQ ID NO: 195019 - RNA, 64 nt, hsa
ggcagggcgggggagggggaacguucauuaaucucugaggaaaacaaaaccuguuuucuacuug

SEQ ID NO: 195020 - RNA, 64 nt, hsa
uggagucacuuuuuucccccuucaaaguauguuacugaggaaguaaacuuuuuuuuuuuuuuuu

SEQ ID NO: 195021 - RNA, 64 nt, hsa
guggcucagccuacaaucccaacacuuugggaggcugaggaaggggcaucacuugaaccaggag

SEQ ID NO: 195022 - RNA, 64 nt, hsa
guugcaguuaagacaucagccaaggccacuucgucugaggaaggcucaacuggggcuggagcca

SEQ ID NO: 195023 - RNA, 64 nt, hsa
uggaaagcucagguggcagcggacucugacuccacugaggaacugccucagaagcugcgaucac

SEQ ID NO: 195024 - RNA, 64 nt, hsa
ggcugggggaugacagugugggagcugugggguacugaggaagacaccauuccuugacgguguc

SEQ ID NO: 195025 - RNA, 64 nt, hsa
aagggugcagccugccacaggcuccucauccggacugaggaagacgaggacagggaggaggaaa

SEQ ID NO: 195026 - RNA, 64 nt, hsa
ggggauaaagaggggcccgacuuuugccacccuccugaggaagccccuagguccacacagugau

SEQ ID NO: 195027 - RNA, 64 nt, hsa
cacuauacaagaguggcuauaggaaaaaagaaaguguaucuauccuuuuguauucaaaugaagu

SEQ ID NO: 195028 - RNA, 64 nt, hsa
uauugccaauuuguguuaccagacaaucuguuaauguaucuaauucgaaucagcaaagacugac

SEQ ID NO: 195029 - RNA, 64 nt, hsa
aauuuguaguauuuucuuguuuugaugucuaaucuguaucuauaauguacccuaguagucgaac

SEQ ID NO: 195030 - RNA, 64 nt, hsa
auguacaugggaggccacauauuuuguucacuguuguaucuauauuucacauguggaaacuuuc

SEQ ID NO: 195031 - RNA, 64 nt, hsa
cccugcccuggaguccguuucuggagacuagaaauguaucuaaauugggggaacagaaugaaug

SEQ ID NO: 195032 - RNA, 64 nt, hsa
aguagucauuuguucuaaaucuauacauauuacuuguaucuagugcagaauaagcuauaacauc

SEQ ID NO: 195033 - RNA, 64 nt, hsa
agagauguucagcauccuguaucuacacgcauccuguaucuacacguguauuuuguagcuguca

SEQ ID NO: 195034 - RNA, 64 nt, hsa
ccuuggaaagacaacccagagauguucagcauccuguaucuacacgcauccuguaucuacacgu

SEQ ID NO: 195035 - RNA, 64 nt, hsa
cacuaccuuaucaggcaaauuggggaggggaggguguaucuagcucuaguucaaauuauuugga

SEQ ID NO: 195036 - RNA, 64 nt, hsa
guuugagaccagccuggccaacauggugaaacccuguaucuacuaaaaauacaaaaauuagccg

SEQ ID NO: 195037 - RNA, 64 nt, hsa
uacacuucuguaaaucucuugcauuauucauauguguaucuauaucugcauaauguuuguuaau

SEQ ID NO: 195038 - RNA, 64 nt, hsa
auaguuuuauuugauuaggauugaacaguucaguuguaucuaugccccacagugaccaguaaag

SEQ ID NO: 195039 - RNA, 64 nt, hsa
accaucuaaucuaugcauguauguaggcaauacauguaucuaaacaauguauuugucaaugcau

SEQ ID NO: 195040 - RNA, 64 nt, hsa
auagacaauuugcccuaucauuuauuuacaucuauguaucuaccaucuaaucuaugcauguaug

SEQ ID NO: 195041 - RNA, 64 nt, hsa
agcuaagggauuguaaauacaccgaugggcacucuguaucuagcucaagguuuguaaacacacc

SEQ ID NO: 195042 - RNA, 64 nt, hsa
gguggggacuuggagaaccuuuguguccacacucuguaucuagcuaaucuaguggggaugugga

SEQ ID NO: 195043 - RNA, 64 nt, hsa
ugaucucuguuuuaaagauuauuaaaaaacauuguguaucuauacauauggcucuugaggacuu

SEQ ID NO: 195044 - RNA, 64 nt, hsa
acuauauaaaauuuucauuugagaauuucucaauuguaucuaguuaaauagcacaguuuggaaa

SEQ ID NO: 195045 - RNA, 64 nt, hsa
auuccuuuagaugucucauaaaaugagacuuuuuauauguuaauguauaauaaaacugaaacaa

SEQ ID NO: 195046 - RNA, 64 nt, hsa
ugaaauauagaugggaaauguggacuuuacaaguauauguuauauauacuugcaaugugacaug

SEQ ID NO: 195047 - RNA, 64 nt, hsa
ccaucagugaggcagcaguuacuucaaggauaugauauguuaaugaauccaaagaagaugggag

SEQ ID NO: 195048 - RNA, 64 nt, hsa
gacuaaauggcuauucacaggaaacugauaagauauauguuauuuuuuuaaaugagcuagggca

SEQ ID NO: 195049 - RNA, 64 nt, hsa
uaccacagugucuguaucggagacagugaucuccauauguuacacuaaggguguaaguaauuau

SEQ ID NO: 195050 - RNA, 64 nt, hsa
agguucaacuguugauugcaggaauaaggccuuaauauguuaaccucagugucauuuaugaaaa

SEQ ID NO: 195051 - RNA, 64 nt, hsa
agucuauggaguauuuucaauucucagauuauacauauguuauaaaauauguucauuaaagcuc

SEQ ID NO: 195052 - RNA, 64 nt, hsa
gucauucaggacaacauggauggaauuggagggcauauguuaagugaaacaagccaggaacaga

SEQ ID NO: 195053 - RNA, 64 nt, hsa
uucucucugugaaauaaaugccauacuuuguuauauauguuagugguauguaucagacauauuu

SEQ ID NO: 195054 - RNA, 64 nt, hsa
aaacauugaugugauucuugaaagggaauuuagaauauguuaaggccaaguagguuaacuggug

SEQ ID NO: 195055 - RNA, 64 nt, hsa
gagcacccagggacgugguuuuagagucuaccuaauauguuaaggacaaggaaaccucugaguc

SEQ ID NO: 195056 - RNA, 64 nt, hsa
auguuaaggacaaggaaaccucugagucuaccuaauauguuaaggacaaggaaaccucuggaca

SEQ ID NO: 195057 - RNA, 64 nt, hsa
auuaaguugaauuugaauggcugaaagacaaaauauauguuaauacaaucucuuaccuagagca

SEQ ID NO: 195058 - RNA, 64 nt, hsa
gucugagccacagccaauugugugugcucuauuaauauguuaccauuauuuuugauuccuggcu

SEQ ID NO: 195059 - RNA, 64 nt, hsa
cccuuugaaaaaauaguccuaauaauuugaacaaauauguuaguaaugauggaacagaucaaug

SEQ ID NO: 195060 - RNA, 64 nt, hsa
agauauucaaaaguaugcauguagaauuuaaagaauauguuaaaaauuauuaauuuuaauauuu

SEQ ID NO: 195061 - RNA, 64 nt, hsa
acuaaauuauaaacagaguuaacuugaaccuuuuauauguuaugcauugauucuaacaaacugu

SEQ ID NO: 195062 - RNA, 64 nt, hsa
guguguuuuuccaugaaugaauauaccgugguucauauguuagcauggcagcauuuucagauag

SEQ ID NO: 195063 - RNA, 64 nt, hsa
acugacauaauuugauuacauacuaaauaagaggauauguuaauaugaggaaauguaaauuaaa

SEQ ID NO: 195064 - RNA, 64 nt, hsa
aaauauagauugagcuauguuaguuugcaauaauauauguuaacuuuaguaauuaaagacuggu

SEQ ID NO: 195065 - RNA, 64 nt, hsa
uuuuugcaguauauuuauuuugugcauuauauuuauauguuaagagccugagcuuagaaguauu

SEQ ID NO: 195066 - RNA, 64 nt, hsa
aagcacuuagaauagugucugagacacaagagcuauauguuagagguuaucaucauuauuugua

SEQ ID NO: 195067 - RNA, 64 nt, hsa
gcaaggggagcacauauuggauguauauguuaccauauguuaggaaauaaaauuauuuugcuga

SEQ ID NO: 195068 - RNA, 64 nt, hsa
gaauagaugugcaaggggagcacauauuggauguauauguuaccauauguuaggaaauaaaauu

SEQ ID NO: 195069 - RNA, 64 nt, hsa
uaaucgccaaaaacacacuggccaguguaccauaauauguuaccagaagaguuauuaucuauuu

SEQ ID NO: 195070 - RNA, 64 nt, hsa
uuuaaaugacaucugccugggauguaccacaaccauauguuaccuguaucuuaggggaauggau

SEQ ID NO: 195071 - RNA, 64 nt, hsa
gugcucucaaugcauuuacccauucguuauauaaauauguuacaucaggacaacuuugagaaaa

SEQ ID NO: 195072 - RNA, 64 nt, hsa
ggcauggaauuuuauaugcuagugagucauaaugauauguuaguguuaauuaguuuuuucuucc

SEQ ID NO: 195073 - RNA, 64 nt, hsa
agauugauguucuucaaacuaggcaaaacaacucauauguuaagaccauuuuccagauuggaaa

SEQ ID NO: 195074 - RNA, 64 nt, hsa
gaaaaaaucuuacauguaauaacacaaagcuauuauauguuauuucuagguaacucccuuugug

SEQ ID NO: 195075 - RNA, 64 nt, hsa
aaaaaaacucuagucauuugguauuauucuuuugauauguuauuagauuaaauuuauuaaaauu

SEQ ID NO: 195076 - RNA, 64 nt, hsa
gucuguuaauaugguacauuacauugauggcacgauauguuaaaccaaccuuucauuccugaaa

SEQ ID NO: 195077 - RNA, 64 nt, hsa
ucuaaaagucuauaaagaaucagaugcauaggcaauauguuaaguucacuuggaggcuaaaaau

SEQ ID NO: 195078 - RNA, 64 nt, hsa
caugaaagaguauuuggcugaauguuugcuauauauauguuacuugaaauguuaaauuuaauau

SEQ ID NO: 195079 - RNA, 64 nt, hsa
augcauaguacuuaauuuguuuauacuguaaaguauauguuaaaugcuuuuaucacuuugagaa

SEQ ID NO: 195080 - RNA, 64 nt, hsa
cuguaaucugcuaaaccauauacauucuuuugugauauguuauuauguauguggcacuugaggc

SEQ ID NO: 195081 - RNA, 64 nt, hsa
uuaaacaguuuacagucuaaaggaaacaaaaccuauauguuauaauauccaagaaguacuaaua

SEQ ID NO: 195082 - RNA, 64 nt, hsa
cuaucaagcacuacuuagaaacuggaaaacauauauauguuagcaucaaagggggcagaagcaa

SEQ ID NO: 195083 - RNA, 64 nt, hsa
ggcuuaccccuagcuuuugaccuuugcauuucauauauguuagaugucucagcaagaauaucug

SEQ ID NO: 195084 - RNA, 64 nt, hsa
guuucucuuccauuguacauguggguuauauaccauauguuaaauaugcaauaaaguguuuaca

SEQ ID NO: 195085 - RNA, 64 nt, hsa
uggaagugcauauaaaauagaguauuuauacaauauauguuacuagaaauaaaagaacacuuuu

SEQ ID NO: 195086 - RNA, 64 nt, hsa
gagaauaugauuuuuuccauauguauauaguaaaauauguuacuauaaauuacauguacuuuau

SEQ ID NO: 195087 - RNA, 64 nt, hsa
gauucaaaugguuuacauauuuaguggguaagggauauguuacaguaccccaccuguaaguuau

SEQ ID NO: 195088 - RNA, 64 nt, hsa
gacaguauuugacuacauauagcaagaguuugaaauauguuaaacacuagacauccugguuauc

SEQ ID NO: 195089 - RNA, 64 nt, hsa
aaagcuuaacacauggggcuucaucgcucauagaauauguuauuuucaaagaaguucaagaauu

SEQ ID NO: 195090 - RNA, 64 nt, hsa
guauuuacaaagaaagguacuuucuuaagagcauauauguuauuaauauuugauaugauuuuaa

SEQ ID NO: 195091 - RNA, 64 nt, hsa
gaaccaguucauuauaccuuaugcauuaaauuaaauauguuauaagguggcuuuacuugucuuu

SEQ ID NO: 195092 - RNA, 64 nt, hsa
uucucugucaauaugacaagcucaaagugacagaauauguuauagguugaagcacacauauuug

SEQ ID NO: 195093 - RNA, 64 nt, hsa
aagaagcauuagaaaaauuacuuuaaaaguagcuauauguuacuguauugcaaaaucuguuaag

SEQ ID NO: 195094 - RNA, 64 nt, hsa
uauggacaguucccggaaacgguugcccacuucacagguccaugggucugacccuuggacucug

SEQ ID NO: 195095 - RNA, 64 nt, hsa
uaauaccauguaaagcuggcuuucuggagucugccagguccacacgaagugcuacccccaguuu

SEQ ID NO: 195096 - RNA, 64 nt, hsa
cagccaggaggggagcgggcccaggagccaggcucagguccagcugguuccucucuggcgccuu

SEQ ID NO: 195097 - RNA, 64 nt, hsa
gguuccucucuggcgccuucugaacccgucucagcagguccacagcaccugggcagaggucaga

SEQ ID NO: 195098 - RNA, 64 nt, hsa
ugggugggcagggcuuggacccccgucuccauggcagguccauacagcauggguggcaggguuu

SEQ ID NO: 195099 - RNA, 64 nt, hsa
ggaagccaacccugagcgagccuguccucuguggcagguccacacggugugggugggcagggcu

SEQ ID NO: 195100 - RNA, 64 nt, hsa
gauguuuugguggaaggacacuucuuucuaucacccucuucagucaccucuauacacucuacau

SEQ ID NO: 195101 - RNA, 64 nt, hsa
uucuugugcugcuuggacagguaccuacugcuggccucuucaguggccacaauccucaguccuc

SEQ ID NO: 195102 - RNA, 64 nt, hsa
uguauuuauuuuauugagguucuuuauauuccugccucuucauagucaaggcucuuaguacagg

SEQ ID NO: 195103 - RNA, 64 nt, hsa
uuauauaauuucauguucuaugaggaauuuaguaccucuucacugugaaauucgaaauaaugau

SEQ ID NO: 195104 - RNA, 64 nt, hsa
uccuuuuuauccucucaaaaauuuaaacacuguaccucuucaguggucagaagaaaguuggaaa

SEQ ID NO: 195105 - RNA, 64 nt, hsa
ugagaugaucauucaguuacuugucaggauuucuccucuucagagagauuuuuuuuuauagcac

SEQ ID NO: 195106 - RNA, 64 nt, hsa
cugaaacaucacaugccuuugcacaggccaccccccucuucaggcugcugcaggaggccaggcc

SEQ ID NO: 195107 - RNA, 64 nt, hsa
ccagccccucaagacaccgcuggcugcuggacacccucuucacuuguguguguguguguagcgg

SEQ ID NO: 195108 - RNA, 64 nt, hsa
uacagaaagccaggcuuugggauacaaguucuuuccucuucauuugaugccgugcacuguguga

SEQ ID NO: 195109 - RNA, 64 nt, hsa
agcccuggauucagaguguuaaacagaggcuugcccucuucaggacaacaguuccaauuccaag

SEQ ID NO: 195110 - RNA, 64 nt, hsa
uauacccugguaggcuuccucuucagcaugccccccucuucaccccacacccauguguacacuc

SEQ ID NO: 195111 - RNA, 64 nt, hsa
gcaagcuaaagccccucuauacccugguaggcuuccucuucagcaugccccccucuucacccca

SEQ ID NO: 195112 - RNA, 64 nt, hsa
gcugggauuacaggcguaagccacuacaccuggcccucuucaucgaauuuuauuugagaaguag

SEQ ID NO: 195113 - RNA, 64 nt, hsa
cugugccuggcuuggcgucugguggagagaggggccucuucagugucuacugaguaaggggaca

SEQ ID NO: 195114 - RNA, 64 nt, hsa
augauguugcuaggauuagagccucucagucuggccucuucacccaagugcaagaacucagucu

SEQ ID NO: 195115 - RNA, 64 nt, hsa
auaaggauuucguaauuccccuaacugcaaauguccucuucauuuguucuuuaugagaaaaccc

SEQ ID NO: 195116 - RNA, 64 nt, hsa
caugacuguccuccucguggguggggccgagggcccucuucagcucucuggagacaggggccga

SEQ ID NO: 195117 - RNA, 64 nt, hsa
acaggcuggcccugcaauggggcccugagcccucccucuucaucccccaaggccucaacuagag

SEQ ID NO: 195118 - RNA, 64 nt, hsa
uucccaaaaacagcccacucauccuuuccccagcccucuucagcccuccccaguccuccccagc

SEQ ID NO: 195119 - RNA, 64 nt, hsa
uguucucgaauguuuauauuucaauaaaccucuaccucuucacacaagcaggucucucucaguu

SEQ ID NO: 195120 - RNA, 64 nt, hsa; identical to SEQ ID NO: 147094

SEQ ID NO: 195121 - RNA, 64 nt, hsa; identical to SEQ ID NO: 147095

SEQ ID NO: 195122 - RNA, 64 nt, hsa; identical to SEQ ID NO: 147096

SEQ ID NO: 195123 - RNA, 64 nt, hsa; identical to SEQ ID NO: 147097

SEQ ID NO: 195124 - RNA, 64 nt, hsa; identical to SEQ ID NO: 147098

SEQ ID NO: 195125 - RNA, 64 nt, hsa; identical to SEQ ID NO: 147099

SEQ ID NO: 195126 - RNA, 64 nt, hsa; identical to SEQ ID NO: 147100

SEQ ID NO: 195127 - RNA, 64 nt, hsa; identical to SEQ ID NO: 147101

SEQ ID NO: 195128 - RNA, 64 nt, hsa; identical to SEQ ID NO: 147102

SEQ ID NO: 195129 - RNA, 64 nt, hsa; identical to SEQ ID NO: 147103

SEQ ID NO: 195130 - RNA, 64 nt, hsa; identical to SEQ ID NO: 147104

SEQ ID NO: 195131 - RNA, 64 nt, hsa; identical to SEQ ID NO: 147105

SEQ ID NO: 195132 - RNA, 64 nt, hsa; identical to SEQ ID NO: 147106

SEQ ID NO: 195133 - RNA, 64 nt, hsa; identical to SEQ ID NO: 147107

SEQ ID NO: 195134 - RNA, 64 nt, hsa; identical to SEQ ID NO: 147108

SEQ ID NO: 195135 - RNA, 64 nt, hsa; identical to SEQ ID NO: 147109

SEQ ID NO: 195136 - RNA, 64 nt, hsa; identical to SEQ ID NO: 147110

SEQ ID NO: 195137 - RNA, 64 nt, hsa; identical to SEQ ID NO: 147111

SEQ ID NO: 195138 - RNA, 64 nt, hsa; identical to SEQ ID NO: 147112

SEQ ID NO: 195139 - RNA, 64 nt, hsa; identical to SEQ ID NO: 147113

SEQ ID NO: 195140 - RNA, 64 nt, hsa; identical to SEQ ID NO: 147114

SEQ ID NO: 195141 - RNA, 64 nt, hsa; identical to SEQ ID NO: 147115

SEQ ID NO: 195142 - RNA, 64 nt, hsa; identical to SEQ ID NO: 147116

SEQ ID NO: 195143 - RNA, 64 nt, hsa; identical to SEQ ID NO: 147117

SEQ ID NO: 195144 - RNA, 64 nt, hsa; identical to SEQ ID NO: 147118

SEQ ID NO: 195145 - RNA, 64 nt, hsa; identical to SEQ ID NO: 147119

SEQ ID NO: 195146 - RNA, 64 nt, hsa; identical to SEQ ID NO: 147120

SEQ ID NO: 195147 - RNA, 64 nt, hsa; identical to SEQ ID NO: 147121

SEQ ID NO: 195148 - RNA, 64 nt, hsa; identical to SEQ ID NO: 147122

SEQ ID NO: 195149 - RNA, 64 nt, hsa
guauauuuuuaucauggaaaaauuucaacuccucaagccguaauguugaacagaauuggaguau

SEQ ID NO: 195150 - RNA, 64 nt, hsa
auuacagauucgucuuuuuuuuuuuuucuuauaaaagccguaacccagucagacaaauucaccu

SEQ ID NO: 195151 - RNA, 64 nt, hsa
caggaauauugacuaccaaaucacaaugcaauugaagccguacugcuuuuuugagcaguuauuc

SEQ ID NO: 195152 - RNA, 64 nt, hsa
aaauugguugaaaggucuaguuuugggaggaaaaaagccguaguaagaaauggaucauauauau

SEQ ID NO: 195153 - RNA, 64 nt, hsa
aacaaagaaauaacaguaaugauuuccuuagcagaagccguauuuguacgcacaacauuaaauc

SEQ ID NO: 195154 - RNA, 64 nt, hsa
auaauuuauaugcuugguggcugugcugcugauuaagccguaauuaaaauucuucucaucccau

SEQ ID NO: 195155 - RNA, 64 nt, hsa
ugguguuuaccuacuuguucaucaccauuauugaaagccguacugaucaguuaguugacaacgg

SEQ ID NO: 195156 - RNA, 64 nt, hsa
cugcugucacagucucauuuguucuuccaacugaaagccguaaaaccuuuguugcuuuaauuga

SEQ ID NO: 195157 - RNA, 64 nt, hsa
ccaaugccaaugccuucagaccccgcugggaccgaagccguaaccgaagccaggcccgcagccg

SEQ ID NO: 195158 - RNA, 64 nt, hsa
acaaacaggaauguaccagaccuauguugaagcuaagccguauuuauaacaauguuuaagauuc

SEQ ID NO: 195159 - RNA, 64 nt, hsa
aaaaaaaaaaaaaaaaaggaaaaaaaagugauggaagccguaagugcuucuuugucaucgacgu

SEQ ID NO: 195160 - RNA, 64 nt, hsa
aucaguguuaagagcaugaugaaaggugucaauaaagccguaggaucgcgcaacccuuugugug

SEQ ID NO: 195161 - RNA, 64 nt, hsa
ugggccagcuucucagguggcuuuagaccucaacaagccguaucuucaccaguguucuaucuug

SEQ ID NO: 195162 - RNA, 64 nt, hsa
ccaugcaugcugcucacccuagacaaugacauauaagccguauauagaucaauguccacauaua

SEQ ID NO: 195163 - RNA, 64 nt, hsa
uuccaugcaccacgcuccguagaagccccggcggaagccguagcuuucccugccaccuggaggu

SEQ ID NO: 195164 - RNA, 64 nt, hsa
cccaaggguauaaacaaaagcaacaugaaaguggaagccguaucugucauuuauuuuauuucca

SEQ ID NO: 195165 - RNA, 64 nt, hsa
aauaggcuuucuuauauuugauauuuggaagaaaaagccguaagguguauguagaccacuuaau

SEQ ID NO: 195166 - RNA, 64 nt, hsa
ucauuucucuuacguugaauccccaaucauaauuaagccguauacacagauuaaauuaacagaa

SEQ ID NO: 195167 - RNA, 64 nt, hsa
ggagugggacugagcguccgcagaggugaccgaaaagccguaugaugauguucccgauuucucu

SEQ ID NO: 195168 - RNA, 64 nt, hsa
cagcaccugaaagcuuccucgacaucuguuaauaaagccguaggcccuugucuaagugcaaccg

SEQ ID NO: 195169 - RNA, 64 nt, hsa
uuugucuugcgggucugucaggguuggaaaguccaagccguaggacccaguuuccuuucuuagc

SEQ ID NO: 195170 - RNA, 64 nt, hsa
cagcugucuuuguaguuaggaaauagauccaauaaagccguauuuuuuugcuggacaggcguag

SEQ ID NO: 195171 - RNA, 64 nt, hsa
gcuccucagcuucgugucccugcuggagaccaacaagccguaccuggugaacugcguccgcauc

SEQ ID NO: 195172 - RNA, 64 nt, hsa
uugccguuuaugucacugacaguuucugaggcagaagccguaucaugucuaccaccugugaggu

SEQ ID NO: 195173 - RNA, 64 nt, hsa
cuuaaagcaacaugaaaggauucacacuggagagaagccguaugaauguaaggaaugcaggaaa

SEQ ID NO: 195174 - RNA, 64 nt, hsa
ucucuggcgcccccaugugguugcgacacucccaaagccguaagggccgacccaggcaucuugg

SEQ ID NO: 195175 - RNA, 64 nt, hsa
caggugacaggccuagcuauaguuaggaauacacaagccguaaaaucgaguccuuacagccaua

SEQ ID NO: 195176 - RNA, 64 nt, hsa
gcccagauaaaauuuucaugagaguaguuuacaaaagccguauuuaaaaguuaauauuuucaca

SEQ ID NO: 195177 - RNA, 64 nt, hsa; identical to SEQ ID NO: 160682

SEQ ID NO: 195178 - RNA, 64 nt, hsa; identical to SEQ ID NO: 160683

SEQ ID NO: 195179 - RNA, 64 nt, hsa; identical to SEQ ID NO: 160684

SEQ ID NO: 195180 - RNA, 64 nt, hsa; identical to SEQ ID NO: 160685

SEQ ID NO: 195181 - RNA, 64 nt, hsa; identical to SEQ ID NO: 160686

SEQ ID NO: 195182 - RNA, 64 nt, hsa; identical to SEQ ID NO: 160687

SEQ ID NO: 195183 - RNA, 64 nt, hsa; identical to SEQ ID NO: 160688

SEQ ID NO: 195184 - RNA, 64 nt, hsa; identical to SEQ ID NO: 160689

SEQ ID NO: 195185 - RNA, 64 nt, hsa; identical to SEQ ID NO: 160690

SEQ ID NO: 195186 - RNA, 64 nt, hsa; identical to SEQ ID NO: 160691

SEQ ID NO: 195187 - RNA, 64 nt, hsa; identical to SEQ ID NO: 160692

SEQ ID NO: 195188 - RNA, 64 nt, hsa; identical to SEQ ID NO: 160693

SEQ ID NO: 195189 - RNA, 64 nt, hsa; identical to SEQ ID NO: 160694

SEQ ID NO: 195190 - RNA, 64 nt, hsa; identical to SEQ ID NO: 160695

SEQ ID NO: 195191 - RNA, 64 nt, hsa; identical to SEQ ID NO: 160696

SEQ ID NO: 195192 - RNA, 64 nt, hsa; identical to SEQ ID NO: 160697

SEQ ID NO: 195193 - RNA, 64 nt, hsa; identical to SEQ ID NO: 160698

SEQ ID NO: 195194 - RNA, 64 nt, hsa; identical to SEQ ID NO: 160699

SEQ ID NO: 195195 - RNA, 64 nt, hsa; identical to SEQ ID NO: 160700

SEQ ID NO: 195196 - RNA, 64 nt, hsa; identical to SEQ ID NO: 160701

SEQ ID NO: 195197 - RNA, 64 nt, hsa; identical to SEQ ID NO: 160702

SEQ ID NO: 195198 - RNA, 64 nt, hsa; identical to SEQ ID NO: 160703

SEQ ID NO: 195199 - RNA, 64 nt, hsa; identical to SEQ ID NO: 160704

SEQ ID NO: 195200 - RNA, 64 nt, hsa; identical to SEQ ID NO: 160705

SEQ ID NO: 195201 - RNA, 64 nt, hsa; identical to SEQ ID NO: 160706

SEQ ID NO: 195202 - RNA, 64 nt, hsa; identical to SEQ ID NO: 160707

SEQ ID NO: 195203 - RNA, 64 nt, hsa; identical to SEQ ID NO: 160708

SEQ ID NO: 195204 - RNA, 64 nt, hsa; identical to SEQ ID NO: 160709

SEQ ID NO: 195205 - RNA, 64 nt, hsa; identical to SEQ ID NO: 160710

SEQ ID NO: 195206 - RNA, 64 nt, hsa; identical to SEQ ID NO: 160711

SEQ ID NO: 195207 - RNA, 64 nt, hsa; identical to SEQ ID NO: 160712

SEQ ID NO: 195208 - RNA, 64 nt, hsa; identical to SEQ ID NO: 160713

SEQ ID NO: 195209 - RNA, 64 nt, hsa; identical to SEQ ID NO: 160714

SEQ ID NO: 195210 - RNA, 64 nt, hsa; identical to SEQ ID NO: 160715

SEQ ID NO: 195211 - RNA, 64 nt, hsa; identical to SEQ ID NO: 160716

SEQ ID NO: 195212 - RNA, 51 nt, hsa; identical to SEQ ID NO: 160717

SEQ ID NO: 195213 - RNA, 64 nt, hsa; identical to SEQ ID NO: 160718

SEQ ID NO: 195214 - RNA, 64 nt, hsa; identical to SEQ ID NO: 160719

SEQ ID NO: 195215 - RNA, 64 nt, hsa; identical to SEQ ID NO: 160720

SEQ ID NO: 195216 - RNA, 52 nt, hsa; identical to SEQ ID NO: 160721

SEQ ID NO: 195217 - RNA, 64 nt, hsa; identical to SEQ ID NO: 160722

SEQ ID NO: 195218 - RNA, 64 nt, hsa; identical to SEQ ID NO: 160723

SEQ ID NO: 195219 - RNA, 64 nt, hsa; identical to SEQ ID NO: 160724

SEQ ID NO: 195220 - RNA, 64 nt, hsa; identical to SEQ ID NO: 160725

SEQ ID NO: 195221 - RNA, 64 nt, hsa; identical to SEQ ID NO: 160726

SEQ ID NO: 195222 - RNA, 64 nt, hsa; identical to SEQ ID NO: 160727

SEQ ID NO: 195223 - RNA, 64 nt, hsa; identical to SEQ ID NO: 160728

SEQ ID NO: 195224 - RNA, 64 nt, hsa; identical to SEQ ID NO: 160729

SEQ ID NO: 195225 - RNA, 64 nt, hsa; identical to SEQ ID NO: 160730

SEQ ID NO: 195226 - RNA, 64 nt, hsa; identical to SEQ ID NO: 160731

SEQ ID NO: 195227 - RNA, 64 nt, hsa; identical to SEQ ID NO: 160732

SEQ ID NO: 195228 - RNA, 64 nt, hsa; identical to SEQ ID NO: 160733

SEQ ID NO: 195229 - RNA, 64 nt, hsa; identical to SEQ ID NO: 160734

SEQ ID NO: 195230 - RNA, 64 nt, hsa; identical to SEQ ID NO: 160735

SEQ ID NO: 195231 - RNA, 64 nt, hsa; identical to SEQ ID NO: 160736

SEQ ID NO: 195232 - RNA, 64 nt, hsa; identical to SEQ ID NO: 160737

SEQ ID NO: 195233 - RNA, 64 nt, hsa; identical to SEQ ID NO: 160738

SEQ ID NO: 195234 - RNA, 64 nt, hsa; identical to SEQ ID NO: 160739

SEQ ID NO: 195235 - RNA, 64 nt, hsa; identical to SEQ ID NO: 160740

SEQ ID NO: 195236 - RNA, 64 nt, hsa; identical to SEQ ID NO: 160741

SEQ ID NO: 195237 - RNA, 64 nt, hsa; identical to SEQ ID NO: 160742

SEQ ID NO: 195238 - RNA, 64 nt, hsa; identical to SEQ ID NO: 160743

SEQ ID NO: 195239 - RNA, 64 nt, hsa; identical to SEQ ID NO: 160744

SEQ ID NO: 195240 - RNA, 64 nt, hsa; identical to SEQ ID NO: 160745

SEQ ID NO: 195241 - RNA, 64 nt, hsa; identical to SEQ ID NO: 160746

SEQ ID NO: 195242 - RNA, 64 nt, hsa; identical to SEQ ID NO: 160747

SEQ ID NO: 195243 - RNA, 62 nt, hsa
ucaguaauucucuuacauccuucccaaaaaucagugucuagggacuaguugaucuggaugag

SEQ ID NO: 195244 - RNA, 62 nt, hsa
caguaauucucuaaaaauccuucccaaaaaucagugucuagggacugguugaucuagaugag

SEQ ID NO: 195245 - RNA, 56 nt, hsa
agcggccccgcgggacuggggacugagcccaggagguuugcacaagccgggcgauu

SEQ ID NO: 195246 - RNA, 56 nt, hsa
acagauggcugaggcugcagacucaggcccaggacacucaaccccaggaggggagc

SEQ ID NO: 195247 - RNA, 56 nt, hsa
ccgcucggcgaaugagcugggugggugcccaggagccggcccgcagcaccugcaca

SEQ ID NO: 195248 - RNA, 56 nt, hsa
gaggcugagguugcaggaucacuugagcccaggaggucaaggcugcagugagccaa

SEQ ID NO: 195249 - RNA, 56 nt, hsa
aaggcugaggcagaaggaucacuugagcccaggaauuugagguuguaguaagcuac

SEQ ID NO: 195250 - RNA, 56 nt, hsa
augucuaagacaggaggaucacaagagcccaggagguugagaaugcagugagcuug

SEQ ID NO: 195251 - RNA, 56 nt, hsa
aggcugaaguaggaggaucgucuugagcccaggaguucaagaccagccuggacaac

SEQ ID NO: 195252 - RNA, 56 nt, hsa
aggccauccucuuauuccguucuggggcccaggaaguggggaagaguagguucucg

SEQ ID NO: 195253 - RNA, 56 nt, hsa
aacggcaucaugugacacgcuccucagcccaggaguggugggggguccagggcacc

SEQ ID NO: 195254 - RNA, 56 nt, hsa
gaacuacccagggcagccccuuuguggcccaggauaaucaacacuguucucucugu

SEQ ID NO: 195255 - RNA, 56 nt, hsa
gaugaacacuggagugggcagagguggcccaggaccauggcacccuuagagugcag

SEQ ID NO: 195256 - RNA, 56 nt, hsa
guucugugcugucucuuggaggcagggcccaggagaacaaaguguggaggccucgg

SEQ ID NO: 195257 - RNA, 56 nt, hsa
uccaccuccuuccaaguccagcucaggcccaggaggugggagaaggucacagagcc

SEQ ID NO: 195258 - RNA, 56 nt, hsa
gcuggccaagagccaacacauucuuggcccaggagcauugcuuuucugugaauuca

SEQ ID NO: 195259 - RNA, 56 nt, hsa
ccuuggccucggcgggcuuuucuggggcccaggaagcccacacuaugcacagagcc

SEQ ID NO: 195260 - RNA, 56 nt, hsa
cagacagaugucagcuucccagccaugcccaggacguccuaucucccccaacccac

SEQ ID NO: 195261 - RNA, 56 nt, hsa
uuagggugccaauguggauuaccugagcccaggaguuugagaccagccuggguaac

SEQ ID NO: 195262 - RNA, 56 nt, hsa
uaggcagugaacaagucuucauccuggcccaggaaauagccuauuaaaaaaugcug

SEQ ID NO: 195263 - RNA, 56 nt, hsa
gaugacaagccgcugcccaccuccaagcccaggaaacaguacaagauggcuaagga

SEQ ID NO: 195264 - RNA, 56 nt, hsa
ggguuuaucucaaggcagcagccugagcccaggagcagaggacccaguuguuauaa

SEQ ID NO: 195265 - RNA, 56 nt, hsa
gcaugugacacccacaaucccaccuagcccaggagagagcuacggcagggugugug

SEQ ID NO: 195266 - RNA, 56 nt, hsa
uacuugaacgcaggagaaucacugcagcccaggaggcagagguugcagugagccga

SEQ ID NO: 195267 - RNA, 56 nt, hsa
aaauuuuuuuucaugcuuuaucaauagcccaggauauauuuuauuuuuagaauuuu

SEQ ID NO: 195268 - RNA, 56 nt, hsa
aauuucugcagguggcaggugagcaagcccaggagaaugcugcaaucuugggggug

SEQ ID NO: 195269 - RNA, 56 nt, hsa
gaggcugaggcaggaggaucacuugagcccaggagguugaggcuggagugagccau

SEQ ID NO: 195270 - RNA, 56 nt, hsa
ggaggcugaugugggcggauaguugagcccaggaguucgagaccagccugggcaac

SEQ ID NO: 195271 - RNA, 56 nt, hsa
gaggcugaggugggaaaaucacuugagcccaggaggucgaggcugcagugugcugu

SEQ ID NO: 195272 - RNA, 56 nt, hsa
gaggcugaggcaagcagguuguuugagcccaggaauuugagaacaggauuuugaga

SEQ ID NO: 195273 - RNA, 56 nt, hsa
cugcaguucugcuaggucugcuuccugcccaggaaggugccugcacaugagaggag

SEQ ID NO: 195274 - RNA, 56 nt, hsa
uggugccugcauaccucuggcagcuggcccaggaagagccagcaagagcaaggcau

SEQ ID NO: 195275 - RNA, 56 nt, hsa
uaccacguuccacggaggagugaggagcccaggaacgacguggucuuccagcccau

SEQ ID NO: 195276 - RNA, 56 nt, hsa
aagauuggcuuggcaucugcacuccagcccaggacuguggucugccauugcaaugc

SEQ ID NO: 195277 - RNA, 56 nt, hsa
ggcacgugcagcguccuuggcaguuggcccaggaacuggagccacagagcuggugc

SEQ ID NO: 195278 - RNA, 56 nt, hsa
gaggccgaggagagaggaucacuuaagcccaggagucugagaccagccugggcaac

SEQ ID NO: 195279 - RNA, 56 nt, hsa
gaggcugaggugggaggaucacuugagcccaggaaguccagaacguagugagccuu

SEQ ID NO: 195280 - RNA, 56 nt, hsa
gcccucgaaugccauucacaggaacagcccaggaacccagggacuucagaagggcu

SEQ ID NO: 195281 - RNA, 56 nt, hsa
gcucuggaagcugaaggauagcuugagcccaggaguucgaggcugcagugagcuau

SEQ ID NO: 195282 - RNA, 56 nt, hsa
gaggcugaggugggaggauugcuugagcccaggaggcagagguugcagugagccaa

SEQ ID NO: 195283 - RNA, 56 nt, hsa
gaggcugagguggguagauuacuugagcccaggaauucaagaccagccugggcaac

SEQ ID NO: 195284 - RNA, 56 nt, hsa
gaggcuggggugggaagaucacuugagcccaggaggucgaggcugcagugagccau

SEQ ID NO: 195285 - RNA, 56 nt, hsa
gaggcugagucgggaggauagcgugagcccaggaguuugagaccagcuaaggcaau

SEQ ID NO: 195286 - RNA, 56 nt, hsa
guaccagcaaguagacuaggaacugagcccaggaaagggggauguuuuccuggugu

SEQ ID NO: 195287 - RNA, 56 nt, hsa
ccaagucauggcaacaggcuggagcagcccaggagaugggccuaaaauguucugga

SEQ ID NO: 195288 - RNA, 56 nt, hsa
ucgucccacccccacccaggcaggaagcccaggaggagugcgggcagggccugacc

SEQ ID NO: 195289 - RNA, 56 nt, hsa
gucccccauuguuuugcuuccccagcgcccaggaugagcgguuuaccaucgagcuu

SEQ ID NO: 195290 - RNA, 56 nt, hsa
gggcccaggaaggaugcucucauaaggcccaggaaggaugcucucauaagcaccuu

SEQ ID NO: 195291 - RNA, 56 nt, hsa
ccacggccuuuucuggcaagagaagggcccaggaaggaugcucucauaaggcccag

SEQ ID NO: 195292 - RNA, 56 nt, hsa
caaacagugauuguacagcaggcugggcccaggaggucagguucauuuuguuacau

SEQ ID NO: 195293 - RNA, 56 nt, hsa
aggaauuggagcagcuuuuccuggaggcccaggauauuucuuuucuggguaucuug

SEQ ID NO: 195294 - RNA, 56 nt, hsa
gcucugauaagaggaggcucacuugagcccaggagguugaggcugcagugagcaga

SEQ ID NO: 195295 - RNA, 56 nt, hsa
guggcuaggguggauggaucgcuugagcccaggagguggagguugcagugagcuga

SEQ ID NO: 195296 - RNA, 56 nt, hsa
gaggucgaggcaagcugaucgcuugagcccaggaguuuaagaccggccugaguagc

SEQ ID NO: 195297 - RNA, 56 nt, hsa
ggugcugaggugggaggaucgcuugagcccaggagagugaggcugcagugagcuga

SEQ ID NO: 195298 - RNA, 56 nt, hsa
aggaaucauguucaauauugaauucugcccaggagcaugaacugauccaugaaugc

SEQ ID NO: 195299 - RNA, 56 nt, hsa
gguggaagaauggaagaaucacuugagcccaggaguuugaggcugcagugagcuau

SEQ ID NO: 195300 - RNA, 56 nt, hsa
caccugcccugcacucugcccucuuugcccaggauacugaggagggcuggagcucg

SEQ ID NO: 195301 - RNA, 56 nt, hsa
ccacugccugggacccagcagacacugcccaggacucuuuagugcacucacucuug

SEQ ID NO: 195302 - RNA, 56 nt, hsa
aauaaccauacacugaccucauacuugcccaggacccauuaaaguugcgguauuua

SEQ ID NO: 195303 - RNA, 56 nt, hsa
guugggacacaguuggucugcagucggcccaggacggucuacucagcacaacugac

SEQ ID NO: 195304 - RNA, 56 nt, hsa
gaggcugaggcaggaggauugcuugagcccaggaguucgaggcugcagucagucau

SEQ ID NO: 195305 - RNA, 56 nt, hsa
agugaaaucaaaggugcuaaauggucgcccaggagacauccguugugcuugccugc

SEQ ID NO: 195306 - RNA, 56 nt, hsa
ucuggaggcccuugaggaucacuugagcccaggagauugaggcugcagugagccau

SEQ ID NO: 195307 - RNA, 56 nt, hsa
gcacuuugaggugggcaauggcuugagcccaggaguucgacaccagccuggccaac

SEQ ID NO: 195308 - RNA, 56 nt, hsa
uccuguaaugucucccggucagggcagcccaggacugcccagccuggugggcuggg

SEQ ID NO: 195309 - RNA, 56 nt, hsa
uagaaagacaaacggccaccuugggugcccaggauacuggugccuggccccacgua

SEQ ID NO: 195310 - RNA, 56 nt, hsa
gaggcugaggcaggaggacuguuugagcccaggaguuugagaccaaccugaguaag

SEQ ID NO: 195311 - RNA, 56 nt, hsa
ggugcugaggcgggaggauuacuugagcccaggaggauuacuucaaccugggaggu

SEQ ID NO: 195312 - RNA, 56 nt, hsa
gaggccaaggcaggaggacugcuugagcccaggaguuugagaccagccugggcaau

SEQ ID NO: 195313 - RNA, 56 nt, hsa
gaggccgaggcaggaagacugcuugagcccaggaguucaagaccagccugggcaac

SEQ ID NO: 195314 - RNA, 56 nt, hsa
gagguugaggugggaagauugcuugagcccaggaguuugagguugcagugagcuga

SEQ ID NO: 195315 - RNA, 56 nt, hsa
gaggccauagcaggaggauugcuugagcccaggaguucgagaccagccagagcaac

SEQ ID NO: 195316 - RNA, 56 nt, hsa
gagguugaggugggaggauugcuugagcccaggauuucaaggcugcagugagccau

SEQ ID NO: 195317 - RNA, 56 nt, hsa
gcuagcucagacaccaaagggguaaggcccaggacauucauaucuuuaaaagcugc

SEQ ID NO: 195318 - RNA, 56 nt, hsa
ccagagcuggagugaggaucaaacaggcccaggagccugaggaaauacccagucag

SEQ ID NO: 195319 - RNA, 56 nt, hsa
gcugugccagggugagggagggccaagcccaggaggauuugucugagacauuucca

SEQ ID NO: 195320 - RNA, 56 nt, hsa
cccagaacucuggucuccaaauuacagcccaggacaccuuucucugccgccugcug

SEQ ID NO: 195321 - RNA, 56 nt, hsa
uuuuuccucugcccugaucaacuggggcccaggaaaagcaaugucucuucacgggc

SEQ ID NO: 195322 - RNA, 56 nt, hsa
gcaggcaaagcuggacaugugcccuggcccaggaggccauguugggcccucguuuc

SEQ ID NO: 195323 - RNA, 56 nt, hsa
agccacuguaaauaacccucgucccugcccaggaacccagacuggacuucagucuc

SEQ ID NO: 195324 - RNA, 56 nt, hsa
gucauuuccaaacccauccuggaagggcccaggauccaaaggucaucaguccugcu

SEQ ID NO: 195325 - RNA, 56 nt, hsa
gaggccaagacaggcagaucacuugagcccaggaguuugaggccagccugggcaac

SEQ ID NO: 195326 - RNA, 56 nt, hsa
gaggcaaagaugggaggauuacuugagcccaggaggucaaggcuacagugagccau

SEQ ID NO: 195327 - RNA, 56 nt, hsa
agugaccaagcagcaccagcaggccugcccaggaugcugaaagcagauuucuucuu

SEQ ID NO: 195328 - RNA, 56 nt, hsa
aaaauaggggugauggagggggagaagcccaggacugggagaaucgcacaugcccc

SEQ ID NO: 195329 - RNA, 56 nt, hsa
aggaagcccaggagcuggguccugccgcccaggagcugggcccugccacccaggcc

SEQ ID NO: 195330 - RNA, 56 nt, hsa
cccaagggcggacccagcaggaggaagcccaggagcuggguccugccgcccaggag

SEQ ID NO: 195331 - RNA, 56 nt, hsa
augagcccacucuaggagccccaguagcccaggagcuugggugugcugacgagcag

SEQ ID NO: 195332 - RNA, 56 nt, hsa
ugagguccugagaaggggauagcacugcccaggacgugugucccuagccuggaaug

SEQ ID NO: 195333 - RNA, 56 nt, hsa
gcccucuacgaucaggugcaggggcugcccaggacaaagcgggggcaggggaaaga

SEQ ID NO: 195334 - RNA, 56 nt, hsa
gaggcccaggcagaaggaucgcugcagcccaggaguucgagacuagccugggcaac

SEQ ID NO: 195335 - RNA, 56 nt, hsa
gaggccaaggcaggaggauugcuugagcccaggaguuugagaccagccugggcaac

SEQ ID NO: 195336 - RNA, 56 nt, hsa
acugcuauccuuccccucaccccucagcccaggagggaaagggcauuuucuuuuuc

SEQ ID NO: 195337 - RNA, 56 nt, hsa
cugacucacgggcaugcuucauugaggcccaggaagaggcccugguuuggggcugu

SEQ ID NO: 195338 - RNA, 56 nt, hsa
ggaggcugaggcuagaggauccuugagcccaggagguugaggcugcagugaggugu

SEQ ID NO: 195339 - RNA, 56 nt, hsa
gaggcugaggcaggaggaucacuugagcccaggaguucaagacuagccuaggcaac

SEQ ID NO: 195340 - RNA, 56 nt, hsa
gcuuagguuguggaguggcugagagggcccaggagggcucgggacagcugugugcu

SEQ ID NO: 195341 - RNA, 56 nt, hsa
cucucuugcuacaaauaaggaaacaggcccaggagauuaagugacuuggcuaaagu

SEQ ID NO: 195342 - RNA, 56 nt, hsa
caccccugcagggucucgggcucugagcccaggacauucccugccccuuacucacc

SEQ ID NO: 195343 - RNA, 56 nt, hsa
ccacuggcuaccccuacugcgcggcggcccaggagcucggacugcugguccuggag

SEQ ID NO: 195344 - RNA, 56 nt, hsa
ucccaccucaggaagcuaguauucaugcccaggaucggugaguucaggggauccau

SEQ ID NO: 195345 - RNA, 56 nt, hsa
acaccccagggggaugagcucuccaagcccaggauucuggcaagagaggugaagaa

SEQ ID NO: 195346 - RNA, 56 nt, hsa
gugucggacugcucagaguccgcauggcccaggagcagguggucggaggccccugg

SEQ ID NO: 195347 - RNA, 56 nt, hsa
ggcgaaaggggcccagucguucuugggcccaggauggggccucuagacuugcaagg

SEQ ID NO: 195348 - RNA, 56 nt, hsa
aggccccuggcagugcucccggaggggcccaggaaggccugggcagagacccugua

SEQ ID NO: 195349 - RNA, 56 nt, hsa
gggcuggcaccgagaguucaaggagagcccaggagccagucucuggcuguggcucc

SEQ ID NO: 195350 - RNA, 56 nt, hsa
augugauaaaggaaaaauucuuuccugcccaggaccugcgccauccuuuaggccga

SEQ ID NO: 195351 - RNA, 56 nt, hsa
accauugccauuucuggccucgcuaggcccaggagaggagggaggcaagccagucg

SEQ ID NO: 195352 - RNA, 56 nt, hsa
gccagagcaccggccucccagagaaagcccaggaaguccccgugguguccccuggc

SEQ ID NO: 195353 - RNA, 56 nt, hsa
agccaucccggcuggguuugccaucagcccaggauacucaccgugucacagcugug

SEQ ID NO: 195354 - RNA, 56 nt, hsa
ucaagcccaggaggcugaaaacgagggcccaggaccagaaucgcugccuccucucc

SEQ ID NO: 195355 - RNA, 56 nt, hsa
ccagccccagcugccaucagauucaagcccaggaggcugaaaacgagggcccagga

SEQ ID NO: 195356 - RNA, 56 nt, hsa
gaggccaaggcggauggaucacuugagcccaggaguucaacaccagccugagcaac

SEQ ID NO: 195357 - RNA, 56 nt, hsa
cuggcauguggcacuuugucagggcagcccaggaaucugaaacaggaucaaacucu

SEQ ID NO: 195358 - RNA, 56 nt, hsa
ucccuggagacucacugcaaguuccugcccaggaggcugagggcaccccauccuca

SEQ ID NO: 195359 - RNA, 56 nt, hsa
agacaccacccccuccagcuucuggggcccaggagccucucccugcuacagggggu

SEQ ID NO: 195360 - RNA, 56 nt, hsa
gaggcugaggcaggaggaucacuugagcccaggagauugaggcugcagugagcaug

SEQ ID NO: 195361 - RNA, 56 nt, hsa
gcccacucaugggcccuucaccaccugcccaggaucucacccaguacugacagcuc

SEQ ID NO: 195362 - RNA, 56 nt, hsa
ggggucgacagguugaacgucuucaggcccaggaccccaagcuccucagccuggcc

SEQ ID NO: 195363 - RNA, 56 nt, hsa
cuccacgagagcagccccuccacucugcccaggagaggggccgacccuccucggga

SEQ ID NO: 195364 - RNA, 56 nt, hsa
gugggaaucccccacuuccaagaugugcccaggaugugaggagcuggaguggaagc

SEQ ID NO: 195365 - RNA, 56 nt, hsa
gcguccucgggcgccaccgggcgcucgcccaggacuccccgggccucgggcccggc

SEQ ID NO: 195366 - RNA, 56 nt, hsa
acggggggccacagcagcggccgcucgcccaggauggagaggcgggucccaggccc

SEQ ID NO: 195367 - RNA, 56 nt, hsa
cccggggauuccccccccccgagggugcccaggacucgacaagcuggacccccugc

SEQ ID NO: 195368 - RNA, 56 nt, hsa
ccuggggacccccccuccccgagugugcccaggaacucagagagggcgcggccccc

SEQ ID NO: 195369 - RNA, 56 nt, hsa
caccgggaaagcagccagcacaaagggcccaggaagccagcccccgagagcugagc

SEQ ID NO: 195370 - RNA, 56 nt, hsa
gcagcauggagccaaggucuguccccgcccaggagggugccuuccucggggguagg

SEQ ID NO: 195371 - RNA, 56 nt, hsa
ccauggggacagaagcuccagcauuugcccaggacccguccagaccucacccugug

SEQ ID NO: 195372 - RNA, 56 nt, hsa
ccuauccaaugacgucuccauaaaaggcccaggaacacgggagcuucugaagagcu

SEQ ID NO: 195373 - RNA, 56 nt, hsa
aggccaugagaaccugaggggcaucugcccaggacaggagccauggcauaugacaa

SEQ ID NO: 195374 - RNA, 56 nt, hsa
ugcagagagcacagcccuugccuggagcccaggaaccccauccuugcuucaucuca

SEQ ID NO: 195375 - RNA, 56 nt, hsa
gggaagaugcaaggaaguaaugagaagcccaggaaauuucuccaccuguguuuaug

SEQ ID NO: 195376 - RNA, 56 nt, hsa
aggcuuggaugagauggggcaccagugcccaggaauuugaacauuuuccuuuaccc

SEQ ID NO: 195377 - RNA, 56 nt, hsa
cuggauccccacgugagcaacagcuggcccaggaaaggcugccugcagaggacagg

SEQ ID NO: 195378 - RNA, 56 nt, hsa
acgguacccaggagaagggauuuugggcccaggagaaacacuuacauucuggugcc

SEQ ID NO: 195379 - RNA, 56 nt, hsa
auuucacaauccaaaaauggcccacagcccaggaagcuacccugaacaugccaguu

SEQ ID NO: 195380 - RNA, 56 nt, hsa
ugcaaaaguggcugcuuuggaugccagcccaggaugaguaguuccuguucucaggg

SEQ ID NO: 195381 - RNA, 56 nt, hsa
gaggcagaggugagagaaucgcuugagcccaggaauucgagaccagccugggccac

SEQ ID NO: 195382 - RNA, 56 nt, hsa
uucauguccuacgcagcuaaaacagagcccaggagccagggaggaaaagcagucag

SEQ ID NO: 195383 - RNA, 56 nt, hsa
aucaggcugggcucuggcagggaccugcccaggauggagaugagagagggugagag

SEQ ID NO: 195384 - RNA, 56 nt, hsa
cuccuccccaucaagcacaagagagggcccaggaaaaaagguuucacauaagugua

SEQ ID NO: 195385 - RNA, 56 nt, hsa
ucccaggcaggggugaggguggccuggcccaggaggccaggaaggagggcccuguc

SEQ ID NO: 195386 - RNA, 56 nt, hsa
cugugaguaaaacugggggcucaaaugcccaggaugaggggaucagugacugucua

SEQ ID NO: 195387 - RNA, 56 nt, hsa
gaggccgaggugggaggaucacuugagcccaggaguucgagaccagccuaggcaac

SEQ ID NO: 195388 - RNA, 56 nt, hsa
aaacccagaacucagcauucaaggaugcccaggagagcugucccuguuuuaaagag

SEQ ID NO: 195389 - RNA, 56 nt, hsa
caucuccauugccuuaaugccagguggcccaggaguacccaugcacagcagcugug

SEQ ID NO: 195390 - RNA, 56 nt, hsa
uaucuugauggagaagagggguuccugcccaggaucuuacaacacagcaaguagca

SEQ ID NO: 195391 - RNA, 56 nt, hsa
cagaucucuagagcuguccugucgcugcccaggauugaccuguguguaagucccaa

SEQ ID NO: 195392 - RNA, 56 nt, hsa
uuuuugagauggagucucgcucuaucgcccaggauggagugcaguggcucaaucuc

SEQ ID NO: 195393 - RNA, 56 nt, hsa
cugguagaaggccuuuaaugaucugggcccaggaugauuuccugcccuuuuaucau

SEQ ID NO: 195394 - RNA, 56 nt, hsa
ucuuccuuccugcuguaccacagauggcccaggagaggcacuugucuuuuauuaua

SEQ ID NO: 195395 - RNA, 63 nt, hsa
ucugcagcuggagagacagcauaccugaaaccugcaaggaaccgguuuauaaaacaacagaac

SEQ ID NO: 195396 - RNA, 63 nt, hsa
cucucaguucuugagggccuccccaccgcagcagcaaggaaagcucacgaaccccaaaccugg

SEQ ID NO: 195397 - RNA, 63 nt, hsa
gcccucuugcuagggaacccugccagggugaaggcaaggaacaaccaccuggccuccauucuc

SEQ ID NO: 195398 - RNA, 63 nt, hsa
caacaggaaccugccugaggacacccuucuagagcaaggaauugacuuuuaggagccguucuc

SEQ ID NO: 195399 - RNA, 63 nt, hsa
aagcaguucuccacguucucaccuaagcccagagcaaggaacagguauaauaaguggaaaauc

SEQ ID NO: 195400 - RNA, 63 nt, hsa
aaggaagagaugauguuuaauucaaguccgaaggcaaggaaaaagcugaugguccuguccaaa

SEQ ID NO: 195401 - RNA, 63 nt, hsa
gccuagucagggcacagcugcccugcugccacagcaaggaaauguccugcauggggcagaggc

SEQ ID NO: 195402 - RNA, 63 nt, hsa
gccaaggacucccagcccaggacucucuuuagagcaaggaagccucguucucuuucuucucaa

SEQ ID NO: 195403 - RNA, 63 nt, hsa
ugcucaugucugggguauucacuuggcuccucagcaaggaagcaaacgccuuggaggagaagc

SEQ ID NO: 195404 - RNA, 63 nt, hsa
cagccaccucuguccagggcaguaagaagggcugcaaggaaggggaggauggggacaaggaaa

SEQ ID NO: 195405 - RNA, 63 nt, hsa
caggacuguaaccuggggaggacgcgggucccugcaaggaagaguagauuuggagaggaagga

SEQ ID NO: 195406 - RNA, 63 nt, hsa
auuucauugcacuggaauuuugcuuuaucagaagcaaggaaguaagggagucauugccuuggg

SEQ ID NO: 195407 - RNA, 63 nt, hsa
uccagauggucuccuuagcaucucagcucuucugcaaggaagagcuuggguguuaggccucag

SEQ ID NO: 195408 - RNA, 63 nt, hsa
uucuuuuguuuuuuggaaaauggaaagaacaaggcaaggaaggaaaauuaauggggaagcuga

SEQ ID NO: 195409 - RNA, 63 nt, hsa
uccauacacaggugugcuucuagucaguguguagcaaggaaagccccguucacugcuccugug

SEQ ID NO: 195410 - RNA, 63 nt, hsa
accaugugcuuauuagaugguuccacucaggaagcaaggaagcuaaaacucaaguuaaugguc

SEQ ID NO: 195411 - RNA, 63 nt, hsa
aaaucugaggcugaagaauuaaguuuuccccaagcaaggaaggcagguggucagagagaucaa

SEQ ID NO: 195412 - RNA, 63 nt, hsa
aguggaauagaaagaaguucaugaguaagggcugcaaggaauucuuauccuggccacaugucc

SEQ ID NO: 195413 - RNA, 63 nt, hsa
acaauauugacuauauauuuuuauaaacuacuggcaaggaacuuacccagcuguuauacaugu

SEQ ID NO: 195414 - RNA, 63 nt, hsa
uguugcauuaugcuagagcaccagggucagggugcaaggaagaggcuuaaguauguucauuuu

SEQ ID NO: 195415 - RNA, 63 nt, hsa
aaugaaacugucaccacagguaaauccuuguuagcaaggaaucugucugcuccagucuacucc

SEQ ID NO: 195416 - RNA, 63 nt, hsa
accuuuuguauuuaauuuuaaagucaguguacugcaaggaagcuggaugcaagauagauacua

SEQ ID NO: 195417 - RNA, 63 nt, hsa
ucaauagggcuguugggacuuucuugaaaagaagcaaggaaauaugagucauccgcuaucaca

SEQ ID NO: 195418 - RNA, 63 nt, hsa
aaggagggggcaccugcaugucuccugcaaugagcaaggaauuaugucucauguuuugacuuc

SEQ ID NO: 195419 - RNA, 63 nt, hsa
auggccacucccugcccccagccuggcuggacagcaaggaauccacagcccacacgugagcuc

SEQ ID NO: 195420 - RNA, 63 nt, hsa
ccugcugaagcagguggaugcucaagauuacgugcaaggaaucccucccaucugguacuaaaa

SEQ ID NO: 195421 - RNA, 63 nt, hsa
uccucagguguaauauuguuaagaaagaaaggggcaaggaaaguaagaagacauggcacgugu

SEQ ID NO: 195422 - RNA, 63 nt, hsa
auugucuguguuuaguccuuguucaccacuaaggcaaggaauucuuaacuaggccucuguuua

SEQ ID NO: 195423 - RNA, 63 nt, hsa
gagcauggucagggcauuggucagagggacagagcaaggaaugcauccugagcccacagcuuu

SEQ ID NO: 195424 - RNA, 63 nt, hsa
ccagaucucucucuccuggaggcuuuagcaggggcaaggaaauaguaggggaaucuccagcuc

SEQ ID NO: 195425 - RNA, 63 nt, hsa
gggcccugcacuugcugagguuccccaucaugggcaaggaagggaauucccacagcccuccag

SEQ ID NO: 195426 - RNA, 63 nt, hsa
uacauuuucugccucugccuuccucccagcucagcaaggaaguauuugggcacccuacccuuu

SEQ ID NO: 195427 - RNA, 63 nt, hsa
uccugcacuuuagccagcugcagggcgggcaaggcaaggaaagcugcuucccuggaaguguau

SEQ ID NO: 195428 - RNA, 63 nt, hsa
gggugggaaagggagcaaggggcagauagcucagcaaggaaagaaugggcucagaaaaaggag

SEQ ID NO: 195429 - RNA, 63 nt, hsa
auaagauauccuaaaaucacgcuggaaccuugggcaaggaagaaugugagcaagaguagagag

SEQ ID NO: 195430 - RNA, 63 nt, hsa
ccucagccucuucucuuuaggcccagcugcugggcaaggaauuccagugccuccuacgggggc

SEQ ID NO: 195431 - RNA, 63 nt, hsa
cugauuauuccuuggccuuucccuuguauuuaugcaaggaaggauauacugagcugauacucu

SEQ ID NO: 195432 - RNA, 63 nt, hsa
aggcuuuucaaaaaaauuuuuauucaaggcaaagcaaggaacaucuugagauaugucucaaga

SEQ ID NO: 195433 - RNA, 63 nt, hsa
uggugggugggagguggggcaugugcaaagcaagcaaggaacauuugggguaagaaaacaaac

SEQ ID NO: 195434 - RNA, 63 nt, hsa
uuaacuaguuguuucaguuaugcucuuuuaguugcaaggaaucucaagugggacaaacauaaa

SEQ ID NO: 195435 - RNA, 63 nt, hsa
agaugauuuuuaaguacaaaaaaguuuaagauugcaaggaaggaaacaauggucacaaggucu

SEQ ID NO: 195436 - RNA, 63 nt, hsa
aggcuuuaaguuucuugguugcccaagggcagagcaaggaauaucugguguuucuugugauga

SEQ ID NO: 195437 - RNA, 63 nt, hsa
auaaaaauagauaauuaaaaagaugguugccaagcaaggaaaacuuauuuuauauuuucccuu

SEQ ID NO: 195438 - RNA, 63 nt, hsa
gagggggugcugggguacccgggggcuggggaagcaaggaaauaagucaucuguaugcugacu

SEQ ID NO: 195439 - RNA, 63 nt, hsa
uaacagugacuuuuuaaaauggugacaguguuggcaaggaaacagcaacacaggcugcgcugu

SEQ ID NO: 195440 - RNA, 63 nt, hsa
auuauuaauucugagaacagaaauuggugccuugcaaggaaguuuacuagcucuaucaacaag

SEQ ID NO: 195441 - RNA, 63 nt, hsa
aaauuucauggauuaaaccauggguuuaaugcagcaaggaaacuuacaaugucccuuuauaua

SEQ ID NO: 195442 - RNA, 63 nt, hsa
gaggcuguuugccaauucaggguucugcugggcgcaaggaacgcacuguucaaacgcacuguu

SEQ ID NO: 195443 - RNA, 63 nt, hsa
uggggcuuuuacaccaguuccuuucaaugguuugcaaggaagccacagcuggugguaucugag

SEQ ID NO: 195444 - RNA, 63 nt, hsa
uaggccaucugggugcugggcauggauuucucagcaaggaagacucauuaccuucccucccug

SEQ ID NO: 195445 - RNA, 63 nt, hsa
ugaaaauaacuacucacaacauucacuauguuugcaaggaauuaacacaaauaaaagaugccu

SEQ ID NO: 195446 - RNA, 63 nt, hsa
ggagagacgcagcccugggggccagcuggugcugcaaggaagggugggaagcuugcuggcuuc

SEQ ID NO: 195447 - RNA, 63 nt, hsa
aacauugaguaccaauuauuugcuagguccugugcaaggaauacaaaaaugauuaagacuucu

SEQ ID NO: 195448 - RNA, 63 nt, hsa
acucaagcuauugcaugauuagcccccuaucuggcaaggaaaccccauacagaagaaacaaca

SEQ ID NO: 195449 - RNA, 63 nt, hsa
cagcacauuaucuucauaugucaccuuugcuacgcaaggaaauuuguucaguucguauacuuc

SEQ ID NO: 195450 - RNA, 63 nt, hsa
gaaguccagcuucaaaaguuacuugccacuuaagcaaggaacuugucaagagaucaugguuca

SEQ ID NO: 195451 - RNA, 63 nt, hsa
cguggccagcccuggauuuuggagccuguggcugcaaggaacccagggacccuuguugccugg

SEQ ID NO: 195452 - RNA, 63 nt, hsa
gcugccagagcgccucagcacaggugucagggugcaaggaagaccuggcaauggacagcagga

SEQ ID NO: 195453 - RNA, 63 nt, hsa
guuauauacagccaaaguggauguuucuauuuggcaaggaagguaggauuucugaaacucagg

SEQ ID NO: 195454 - RNA, 63 nt, hsa
gcuuuguuuuguuagucauuucuuuuucuaacggcaaggaagauaugugcccuuuugagaauu

SEQ ID NO: 195455 - RNA, 63 nt, hsa
ggcccuucugugucugagaaaauuaauuauauagcaaggaaugaaauuugauaaagcaaauau

SEQ ID NO: 195456 - RNA, 63 nt, hsa
guguuuuauuguacuccuuccuuggagcugaaugcaaggaaugugaauucugaggaauuaagg

SEQ ID NO: 195457 - RNA, 63 nt, hsa
accaagucuacaaugaaaguuugaaauuuaacugcaaggaauuagaagcauauuugcaaucau

SEQ ID NO: 195458 - RNA, 63 nt, hsa
ucugauuuagaauuacugguagcuuauuuuaaagcaaggaaaagcagcugagcucaaguuugc

SEQ ID NO: 195459 - RNA, 63 nt, hsa
cacaugaggucaaaggagugacgaaaauacaaagcaaggaaaaaaugaaauaucugguuuuug

SEQ ID NO: 195460 - RNA, 63 nt, hsa
agaggcccucugagaucaugugaguccuccauggcaaggaagcaguuccagggagagucaggu

SEQ ID NO: 195461 - RNA, 61 nt, hsa
ggauggaaaaagacaucugaggccauccagggcaaggaacugucuuucugguucaauagac

SEQ ID NO: 195462 - RNA, 63 nt, hsa
cuagugucuaaauaccuauguuuuuuucagaaagcaaggaaguaaacucaaacaaaagugcgu

SEQ ID NO: 195463 - RNA, 63 nt, hsa
gccuaggaggcuguaugccagagcucaucucuagcaaggaauuuaucuucaggugaagaagag

SEQ ID NO: 195464 - RNA, 63 nt, hsa
cugaucuaaacgguuccuuccuucuucuacugugcaaggaagauguaaggaaaaacucgcaca

SEQ ID NO: 195465 - RNA, 56 nt, hsa
acaaaagggaaucggaauaaacuccagcaaggaaauggccaguuaaguagugucuu

SEQ ID NO: 195466 - RNA, 63 nt, hsa
gugagggagaauaaggguaagggaguauucuaggcaaggaacuaaggaaggaauccccuucuu

SEQ ID NO: 195467 - RNA, 63 nt, hsa
gucaggagaccgcugcuucugggcauaaguccugcaaggaaagcaacauggaaaacagcccca

SEQ ID NO: 195468 - RNA, 63 nt, hsa
guccacguaacuggcugcagagaaaucuaccgagcaaggaaaaggcacacacacacguuugca

SEQ ID NO: 195469 - RNA, 63 nt, hsa
aaaaucagguuucaauagaaugugacacaacgugcaaggaaaugaagcggaaagcaucugagg

SEQ ID NO: 195470 - RNA, 63 nt, hsa
guuucucucuugcucugaaacauuucugaaaaggcaaggaagggagggguagugucuggggca

SEQ ID NO: 195471 - RNA, 63 nt, hsa
aauguauaugaaugcuccuaauauggucaggaagcaaggaagcgaaggauauauuaugaguuu

SEQ ID NO: 195472 - RNA, 53 nt, hsa
uaucagaaaaauguauauaauaggcaaggaaagaaauacaguacuguuucugg

SEQ ID NO: 195473 - RNA, 63 nt, hsa
auagaauuggccccauggcuugaugugaagacagcaaggaaagaagcaccagucaaguuguga

SEQ ID NO: 195474 - RNA, 63 nt, hsa
uuauggguuucuugguaaagagccuuuaccacagcaaggaaugggaacauuuccccaucagca

SEQ ID NO: 195475 - RNA, 63 nt, hsa
agggcugggaaguucagugccuggaaauaaagagcaaggaaaaauggaccucaggcuucgugg

SEQ ID NO: 195476 - RNA, 63 nt, hsa
ggggugccugggcggccuuucgugggcaugcacgcaaggaauugggguggcacacgggacacc

SEQ ID NO: 195477 - RNA, 63 nt, hsa
aaaaaagaaaagaaaaaaagggaaaaaagaaaagcaaggaaaaggcucuuuauuacuuaaaag

SEQ ID NO: 195478 - RNA, 63 nt, hsa
ugaaggcacaaacucucaauaucuaaaauaagugcaaggaagcagucucuuuggucaguaaca

SEQ ID NO: 195479 - RNA, 63 nt, hsa
gggggaaacaucagaauuucccaggcaguuguugcaaggaauugguacuaaccgugacuacaa

SEQ ID NO: 195480 - RNA, 63 nt, hsa
gccuuacccagcugugcuacugucauuugcaaagcaaggaaauacuacuacugguaauaaaac

SEQ ID NO: 195481 - RNA, 63 nt, hsa
ccccaguuaaccaccauucugcggccugguucugcaaggaaccagggcugccccaccgcccgc

SEQ ID NO: 195482 - RNA, 63 nt, hsa
uucuccugugccccucagagaggcaugugaugugcaaggaaaauaauaggauauaaaacacau

SEQ ID NO: 195483 - RNA, 63 nt, hsa
aauggacgcuuuguauucagagauggcuuccaggcaaggaaguucuaucuugugauacggaaa

SEQ ID NO: 195484 - RNA, 63 nt, hsa
uucaaccuauacaaaggggacccuggauaggcugcaaggaaagaggccaagggccaagcugcu

SEQ ID NO: 195485 - RNA, 63 nt, hsa
uugucuuccauuccagccuaacauccaaugcaggcaaggaaaauaaaagauuuccagugacag

SEQ ID NO: 195486 - RNA, 63 nt, hsa
uggucucugauagguagcauuuuccagcacuuugcaaggaauguuuuguagcucuaggguaua

SEQ ID NO: 195487 - RNA, 63 nt, hsa
gaaaugagugugucauuuccacaugaaggagaggcaaggaaaagccccacaaaauuccuguua

SEQ ID NO: 195488 - RNA, 63 nt, hsa
caaaaacaugcuuuuccaaacccaggcuauucggcaaggaaguuaguuuuuaaucucuccacc

SEQ ID NO: 195489 - RNA, 63 nt, hsa
auuaaucuaccauuuauugaaugcauacucugugcaaggaaauuugcaaauauuagcuuauuu

SEQ ID NO: 195490 - RNA, 63 nt, hsa
cagccacugaacuccaagguccacuucucaccagcaaggaagagugggguauggaagucaucu

SEQ ID NO: 195491 - RNA, 63 nt, hsa
cccauggacaacacuaauuguccacagcaaagggcaaggaauccucugggagcuucuuccguu

SEQ ID NO: 195492 - RNA, 63 nt, hsa
acgccuuuuaggaaaaagaaaagugagugaacagcaaggaagaguguuugcacaguacaguaa

SEQ ID NO: 195493 - RNA, 63 nt, hsa
guuaccuucacaauggugcuaccccuugcccaggcaaggaaagacagcagugaugacacuguc

SEQ ID NO: 195494 - RNA, 63 nt, hsa
agaacauacucuccuaagugguuguaggaaauugcaaggaaaauagaaggucuguucuugcuc

SEQ ID NO: 195495 - RNA, 63 nt, hsa
ucaugugccagggcaucccauuccaggcuuccugcaaggaaacgguuggaagugggaaagggg

SEQ ID NO: 195496 - RNA, 63 nt, hsa
acucagaggugagaauuuuuucacauuauaguagcaaggaauuggugguauuauggaccgaac

SEQ ID NO: 195497 - RNA, 63 nt, hsa
acuaaucaccaccauagaagaaagaaacagacugcaaggaacagaguugagugucuggaguca

SEQ ID NO: 195498 - RNA, 63 nt, hsa
ccagaggccacuccacaaccccagcgccagucagcaaggaagccgggugucgcucacacaacc

SEQ ID NO: 195499 - RNA, 63 nt, hsa
auguagcauucaugguaaacuuuuaagugcuaagcaaggaauuauuuacugauugguuuuaaa

SEQ ID NO: 195500 - RNA, 63 nt, hsa
accuggagagagaguuuaggcaaauaacaaucagcaaggaaaccuucaccagugagaagaaca

SEQ ID NO: 195501 - RNA, 63 nt, hsa
uggccugguggaugaauuuggccgaaucuucaugcaaggaaauaacagauacgggcagcuagg

SEQ ID NO: 195502 - RNA, 63 nt, hsa
uuagugucugcagguguuaguggugugcuaaaagcaaggaaagcgaguuagucuuuucagugu

SEQ ID NO: 195503 - RNA, 63 nt, hsa
cauccugaaaguggguucgggaggucucuaugagcaaggaauacaagacaaaacuuccucaau

SEQ ID NO: 195504 - RNA, 63 nt, hsa
auagguccagcaacugaaccugccauuaccugggcaaggaaagaucccuuugcucuaggaaag

SEQ ID NO: 195505 - RNA, 63 nt, hsa
gugauugagucuucaaaaccaccgauucugagagcaaggaagauuuuggaagaaaaucugacu

SEQ ID NO: 195506 - RNA, 63 nt, hsa
uaagauuaauuucauuagaggaagaaaaccagcgcaaggaauccucuaguuuuaagaguaagu

SEQ ID NO: 195507 - RNA, 63 nt, hsa
gauuugacuuaccaccagagcauagaaaagcaugcaaggaagaccagaugggcuuagcauugg

SEQ ID NO: 195508 - RNA, 63 nt, hsa
agugugugaagcucugugcuugcaugagggcaagcaaggaauggcugugccugaggcugcucu

SEQ ID NO: 195509 - RNA, 63 nt, hsa
ccacccccuaggguccccaugggaaagggacaugcaaggaaacagcacagaacacgagguggu

SEQ ID NO: 195510 - RNA, 63 nt, hsa
aaugaagggggccuguaaaaaaagauugaaaaggcaaggaaacagauucuccauuagaguccc

SEQ ID NO: 195511 - RNA, 58 nt, hsa
acaaacgaagaucaaaaugaaaaagguugcaaggaacgaauauaugugauuaucacug

SEQ ID NO: 195512 - RNA, 63 nt, hsa
cuuaagaaauuaucaaguuggaaccaagaaauagcaaggaaauguacaauuuuaucuucuggc

SEQ ID NO: 195513 - RNA, 63 nt, hsa
cccagggcacugcgccccgcaacugacgcuccugcaaggaaaagcucugggugcguaugcggc

SEQ ID NO: 195514 - RNA, 63 nt, hsa
ggguaaggggaaaacuucccggaaggcaauggggcaaggaaaaagaaagccuaugggaaaugg

SEQ ID NO: 195515 - RNA, 63 nt, hsa
uuuccagaugcaccagcuccuauuaauaaguuagcaaggaaaguguaugucacgugcaggaac

SEQ ID NO: 195516 - RNA, 63 nt, hsa
uuuuaaucacuuuuuaaaauauaaggaccgaaugcaaggaaaccaaaguuuauuaauaauuuu

SEQ ID NO: 195517 - RNA, 60 nt, hsa
agaccgugcgcuugcucugaagccuugugagcaaggaaggcucccugcauguccugcuug

SEQ ID NO: 195518 - RNA, 63 nt, hsa
ggguucugaauucuacagacucaucaacaugaggcaaggaaucauugaaaaccaccugugucu

SEQ ID NO: 195519 - RNA, 63 nt, hsa
uuugucuuagcauuauuagcaugcuuuccagcugcaaggaaaagguaagacuuuucagaauua

SEQ ID NO: 195520 - RNA, 63 nt, hsa
uauauuaucuuuauguacucuuaagaaaaacgagcaaggaagaguaucuucauuauucucauu

SEQ ID NO: 195521 - RNA, 63 nt, hsa
aguucuguuuuaaguaacagaauugauaacugagcaaggaaacguaauuuggauuauaaaauu

SEQ ID NO: 195522 - RNA, 63 nt, hsa
uuuuucuuauuuaauuacaaauacuauaaaugagcaaggaaaaggaauagacuuucuuaauau

SEQ ID NO: 195523 - RNA, 63 nt, hsa
uauuguuuucugacaguuuuucuguuuuguuuggcaaggaaaggggagaagggaauccuccuc

SEQ ID NO: 195524 - RNA, 63 nt, hsa
acagcaaagacagcacuguuccugggcugggacgcaaggaaugagguccuuuaugaaagaaag

SEQ ID NO: 195525 - RNA, 63 nt, hsa
cuuucucugugggugccaguuaaauauuggagagcaaggaauguggacuuguauggcuuugaa

SEQ ID NO: 195526 - RNA, 63 nt, hsa
ugcauucccugaaucugugccugcacugagagggcaaggaagugggguguucuucuugggacc

SEQ ID NO: 195527 - RNA, 63 nt, hsa
guagccgugcgugugugugaugguuccguggcugcaaggaagggaaacagucuauuauacaua

SEQ ID NO: 195528 - RNA, 63 nt, hsa
cugcuccaggagaagggccuccugcuggccagagcaaggaaggcugagcagcuugguucuccc

SEQ ID NO: 195529 - RNA, 63 nt, hsa
uguaggcagaagagauccaucaacagauugcaagcaaggaaguauguucacuuuaaaguuuga

SEQ ID NO: 195530 - RNA, 63 nt, hsa
ucaucgcgcucugaucugguggcaucuggcugugcaaggaagacccggcuuugcccucacaag

SEQ ID NO: 195531 - RNA, 63 nt, hsa
uugacauggaaaugucagugaaauuucuuaccugcaaggaaagugaacauuuuguauuuaagu

SEQ ID NO: 195532 - RNA, 63 nt, hsa
uaaauuauucuagccaauuugucauaggcauaggcaaggaaagcuggccuugcuaacuauaua

SEQ ID NO: 195533 - RNA, 63 nt, hsa
acuagacacuuuccuacuaagaucaggaacauggcaaggaacaccacaccacugcuuuucagc

SEQ ID NO: 195534 - RNA, 63 nt, hsa
cucaacggaauuuacaguucagaguccaaaauagcaaggaaguggugggaagaaggugagaga

SEQ ID NO: 195535 - RNA, 63 nt, hsa
ucaaaaugaauguuuacuugugaacucgauagagcaaggaaaccagaaagguguaauauuuau

SEQ ID NO: 195536 - RNA, 63 nt, hsa
gcuuggaguuuuaguuuaaagaaucuauauguagcaaggaaaaggugcuuuuuaauuuuaauc

SEQ ID NO: 195537 - RNA, 63 nt, hsa
cuuacccuaggugggugugaaagagcacccguagcaaggaaaauuuucucuauuaguguguuc

SEQ ID NO: 195538 - RNA, 63 nt, hsa
cuguaguuuuauuuuauguuuagauagggcugggcaaggaaaaagaaaauaaagacaaccaua

SEQ ID NO: 195539 - RNA, 63 nt, hsa
uaaaaaauucauaccaaaucaaugagaauacuggcaaggaauacauagggacuuucugcuaua

SEQ ID NO: 195540 - RNA, 63 nt, hsa
cucugcuuuagcuaaagacgacugagaagaggugcaaggaagcgggcuccaggagcaagcuca

SEQ ID NO: 195541 - RNA, 63 nt, hsa
caccaaaaagggauccguacauucaauguuuaugcaaggaaggaaagaaagaaggaagugaag

SEQ ID NO: 195542 - RNA, 63 nt, hsa
aaaacuggaucaagauucuagcccacuggaguugcaaggaaugagaggcaaaaauucuaaaga

SEQ ID NO: 195543 - RNA, 63 nt, hsa
auuaagaggggccaagaggaagacauucuuucugcaaggaaauuucuuuuaaauucugaacug

SEQ ID NO: 195544 - RNA, 63 nt, hsa
acuaaaugcuuuccuacuaagaucaggaacauggcaaggaacaccacugcuuuucagcauugu

SEQ ID NO: 195545 - RNA, 63 nt, hsa
uuaaugaagaaaguggaaaacaaggaagucaaagcaaggaaacuauguaacauguaggaagua

SEQ ID NO: 195546 - RNA, 63 nt, hsa
uggcuggauguucucuuuacugaaaagacaguggcaaggaaaagcacaagugcaugaguucuu

SEQ ID NO: 195547 - RNA, 63 nt, hsa
ccuucccucucaauccacuagcuuucauguugggcaaggaaaaguugaggaaggauggcugau

SEQ ID NO: 195548 - RNA, 63 nt, hsa
caggagauaaaaauggagccugaagggaaucaggcaaggaaaugaacucaggauucagagauc

SEQ ID NO: 195549 - RNA, 63 nt, hsa
uuuuaucauuuucaagaugguuauuuguagaaggcaaggaaccaauuaugcuuguauucauaa

SEQ ID NO: 195550 - RNA, 63 nt, hsa
agauuccagcagaguugguucuuucugaggucugcaaggaagggcucuguuccaugccucucu

SEQ ID NO: 195551 - RNA, 63 nt, hsa
cccaguuuuuacucaguuugauuuauauucugggcaaggaagcuuugccuacuuuauuggcac

SEQ ID NO: 195552 - RNA, 63 nt, hsa
aaauaacugugccccaagaagugcuccagauuugcaaggaauagccccaagagaauaccaaga

SEQ ID NO: 195553 - RNA, 63 nt, hsa
aagacaugacuauccaacuuuuuaugacaaacugcaaggaauaaaggaagaauaaguccaugu

SEQ ID NO: 195554 - RNA, 63 nt, hsa
guccagagguccagucuggcugcuguuguggaggcaaggaaggcaacucaucccagaaggcau

SEQ ID NO: 195555 - RNA, 63 nt, hsa
guggcuuugcccagccugcugcaauccaagagagcaaggaagagaaauuccaugggugacuuu

SEQ ID NO: 195556 - RNA, 63 nt, hsa
ggaugaacaaccucagagaagaggugguuuagagcaaggaaaaaaaugaaaccagugaccaaa

SEQ ID NO: 195557 - RNA, 63 nt, hsa
cagguuccccucuggugucaugucaggcauuuugcaaggaaaagccacuuggggaaagaugga

SEQ ID NO: 195558 - RNA, 61 nt, hsa
uuccauuggcccucgggugagcugaggguuuuugcaaggaaguugugguggccaagugugg

SEQ ID NO: 195559 - RNA, 63 nt, hsa
uucccagagucaucugauuggacaggcaugggugcaaggaaaauuaggguacucaaccuaagu

SEQ ID NO: 195560 - RNA, 63 nt, hsa
ggcagaaaguaaaagaaaauucccuaaauuauagcaaggaacaugaauucucagacauuguga

SEQ ID NO: 195561 - RNA, 63 nt, hsa
aacaaaugauguauggggagaggagaaggaagggcaaggaaggaauugacagauaagaagcaa

SEQ ID NO: 195562 - RNA, 63 nt, hsa
uauaaauaaaaagaaauacagucuagacaugcugcaaggaaagaagauucuaaaguccguuua

SEQ ID NO: 195563 - RNA, 63 nt, hsa
ugcagacggaaggaggaggaaggaaggacggaagcaaggaaggaaggaagggcugcuggagcc

SEQ ID NO: 195564 - RNA, 63 nt, hsa
acucugcuaugugauggggacuuccugggacaagcaaggaaaguacugaggcagccacuugau

SEQ ID NO: 195565 - RNA, 63 nt, hsa
uggauuguccccuuggggggaugagcuaggggugcaaggaacaccugaugaguagauaagugg

SEQ ID NO: 195566 - RNA, 63 nt, hsa
ggcaguugaaccugaugagcaagaauuauaacagcaaggaaacauuaaugcuuagaauucuga

SEQ ID NO: 195567 - RNA, 63 nt, hsa
ggaaacuguguguugacauuugaggauggguaugcaaggaaaaaauauacuucuguuuacuua

SEQ ID NO: 195568 - RNA, 63 nt, hsa
ucuaguaccuuuggaguagguuuaccagagagagcaaggaagcuucaaaacauugauaauuca

SEQ ID NO: 195569 - RNA, 63 nt, hsa
aggugggguagagcacucuccguccugcugcuggcaaggaaugggaacaguggcugucugcga

SEQ ID NO: 195570 - RNA, 63 nt, hsa
aaccccacuccccguucagcacagccgccaucugcaaggaaggccuaaucauguuacaaucac

SEQ ID NO: 195571 - RNA, 63 nt, hsa
augcaugcuuuaauauuugccuauagcccggcagcaaggaagucggggcggggggacuuuuuu

SEQ ID NO: 195572 - RNA, 63 nt, hsa
cauucucuguaccuuuauaguaccacuccaaaggcaaggaaccaugauugacaacagucaagc

SEQ ID NO: 195573 - RNA, 63 nt, hsa
ggaccgauaucaucugucuggucucugugaacagcaaggaaucuucuugaccguucuugggca

SEQ ID NO: 195574 - RNA, 63 nt, hsa
uucuuuagagcuguauaacuauaguuugaacuagcaaggaaguuauuguuuugacaaccagaa

SEQ ID NO: 195575 - RNA, 63 nt, hsa
uucuccaagaggaggaauacauaguaugguaaggcaaggaacuggguggaaugucagguugcc

SEQ ID NO: 195576 - RNA, 63 nt, hsa
agaagacaaaacccugaagaguuaagaacaaacgcaaggaaauaauuuuuauuguuuaaagcc

SEQ ID NO: 195577 - RNA, 63 nt, hsa
ccuuguuuaucagauacaucacugcuugaugaagcaaggaagauauacaugaaaauuuuaaaa

SEQ ID NO: 195578 - RNA, 63 nt, hsa
gaaaccaaaucacaaaggagaugguguggcuuagcaaggaaacagugcaggaaauguagguua

SEQ ID NO: 195579 - RNA, 63 nt, hsa
agauguaauuauguuuucaacucaggaacuauggcaaggaacuuuccccagaucaaauucuau

SEQ ID NO: 195580 - RNA, 63 nt, hsa
aaggaagacaaauguaaagaaauaaggaaaaaagcaaggaauauccccucccccucccccucc

SEQ ID NO: 195581 - RNA, 63 nt, hsa
uauagcuauaccuucaggucuuuuguuacuuaggcaaggaaaaccacaugucugaccugguuc

SEQ ID NO: 195582 - RNA, 63 nt, hsa
aaagagugugugcucuacuuugauggaaacauggcaaggaauuuaaagacaggaauguauuaa

SEQ ID NO: 195583 - RNA, 63 nt, hsa
ggccucaaguccaaggcuuuaucuuuggagaaggcaaggaaggaggcggugacagacgggcug

SEQ ID NO: 195584 - RNA, 63 nt, hsa
uucucaaacagauccaggaagccuauggcaagugcaaggaauuuggugacgacaaggugcagc

SEQ ID NO: 195585 - RNA, 63 nt, hsa
acaauauuugggagagaaggauggggaagcauugcaaggaaauugugcuuuauccaacaaaau

SEQ ID NO: 195586 - RNA, 63 nt, hsa
augccacauccuauaugguguuauagaaauagugcaaggaaaguacauuuguuugccugucuu

SEQ ID NO: 195587 - RNA, 63 nt, hsa
cucccaucuuggccucuuccagaaaccggccaggcaaggaaagaggccggucaccagaagcca

SEQ ID NO: 195588 - RNA, 63 nt, hsa
aauauggguguugaaaacuagguuacuuauaaugcaaggaaucaggaaacuuuaguuauuuau

SEQ ID NO: 195589 - RNA, 63 nt, hsa
ugaucaggaaauuuaagaauuuaucuuaaaaaugcaaggaaaaaagacugccuuggcaauugu

SEQ ID NO: 195590 - RNA, 63 nt, hsa
ggugcaacaucagggcgcuugaguugcugagaugcaaggaauucuauaaauaacccauucaua

SEQ ID NO: 195591 - RNA, 63 nt, hsa
cuucugugagaguuaaaaaucucagguaagaaggcaaggaaggcucuguuaauuuauagcugu

SEQ ID NO: 195592 - RNA, 63 nt, hsa
gauaccuucaaugaauuaauucagauguuuuacgcaaggaaggacuuacccaguauuacugcu

SEQ ID NO: 195593 - RNA, 63 nt, hsa
cauucuguuuuaaguaacagaauugauaacugagcaaggaaacaugguuuggauuauaaaauu

SEQ ID NO: 195594 - RNA, 63 nt, hsa
gauuguuucuuuuaaacucacuuuaaaauuuuggcaaggaauucaugcauaacugagacuugg

SEQ ID NO: 195595 - RNA, 63 nt, hsa
aaugacuccauuuaaaaauaucacagggugggggcaaggaaauuagcugagauucaucucagg

SEQ ID NO: 195596 - RNA, 63 nt, hsa
ugagagaaauaagucauuuuaauugcauuuccagcaaggaaugacauucaguucuguaagaaa

SEQ ID NO: 195597 - RNA, 63 nt, hsa
auucaaaaacugagaguggagaucugggauaaagcaaggaaauaauaauuacuccuccuuaaa

SEQ ID NO: 195598 - RNA, 63 nt, hsa
agcaggguagcuauuacuguccacauuuuacaggcaaggaaacaggcuccaagaggcugagga

SEQ ID NO: 195599 - RNA, 63 nt, hsa
uuuccuacagaggaaaauagaacaauuuuagaagcaaggaacaaucucuuuucuaagucuugg

SEQ ID NO: 195600 - RNA, 63 nt, hsa
ucauuagaugacauucacgcaugcuggguauaggcaaggaaaguaauuuucaaaguacauuug

SEQ ID NO: 195601 - RNA, 63 nt, hsa
aggcaagcugugaucugaaaggagcaaggaacagcaaggaauuauuuuccagaaugacacccg

SEQ ID NO: 195602 - RNA, 63 nt, hsa
gggucugaccaggcaagcugugaucugaaaggagcaaggaacagcaaggaauuauuuuccaga

SEQ ID NO: 195603 - RNA, 63 nt, hsa
agguucccaaugggcucagggacgaagcuuguggcaaggaaacuccagcuggcuaugccggcc

SEQ ID NO: 195604 - RNA, 63 nt, hsa
cacaaaaugcccaaggcacucacuggggaggaagcaaggaagcaaacagucugagaaaaugau

SEQ ID NO: 195605 - RNA, 63 nt, hsa
uggugacaggcagacacaugcuguuggccucaagcaaggaagcagagcacuguguaaccagca

SEQ ID NO: 195606 - RNA, 63 nt, hsa
aguacccaccgagagcuguggggagcagcaugggcaaggaagacacagacucgcauuacccuu

SEQ ID NO: 195607 - RNA, 63 nt, hsa
gacucuuuguaaacgauagcugaucgugugcacgcaaggaaagaaccaggagggagagugcag

SEQ ID NO: 195608 - RNA, 63 nt, hsa
cuagggguuugguucauuugguuuuugucaugugcaaggaaggacaauaguccucuuuccaag

SEQ ID NO: 195609 - RNA, 63 nt, hsa
ggggccgugcugucccuggucccccagggaacagcaaggaaggaacugagccuucuccagcag

SEQ ID NO: 195610 - RNA, 63 nt, hsa
ccagcccccaggucuuugccagaugaugggaaggcaaggaagaagggacagggaaagauaauu

SEQ ID NO: 195611 - RNA, 63 nt, hsa
agagagcuuauuguuuuaaaaaguuauauaaaggcaaggaaauuaagaacugaauccauauuu

SEQ ID NO: 195612 - RNA, 63 nt, hsa
cguccccagaccaguagugaccaaucgggaguagcaaggaaggacacugcccaguguaucuug

SEQ ID NO: 195613 - RNA, 63 nt, hsa
agaugggugcugggagaggguugggggcagggggcaaggaaaauugcuaccugauuuguugaa

SEQ ID NO: 195614 - RNA, 63 nt, hsa
ccugggaaaggccuggaaaggaugagggaacaggcaaggaacaaaggcaaccuuugcacacuc

SEQ ID NO: 195615 - RNA, 63 nt, hsa
cauucaaaauagucacuugagcucacaaaaaaagcaaggaagaauucucauguccuuugucuu

SEQ ID NO: 195616 - RNA, 63 nt, hsa
acacaaaacuugucaagaacucaucuguuaaaagcaaggaauaacuaguuuauauuuuccaau

SEQ ID NO: 195617 - RNA, 63 nt, hsa
uugcucuggggauggguuuauuuaagggagauugcaaggaagcuauuuaacauggugcugagc

SEQ ID NO: 195618 - RNA, 63 nt, hsa
gagcgaaacugggucucaaguuaaaaaaagaaagcaaggaaagaguaauuuacaacgaaggaa

SEQ ID NO: 195619 - RNA, 63 nt, hsa
gcagaaugagccagaguucaccaagcaggcaaggcaaggaaggguguugcagagagggaacag

SEQ ID NO: 195620 - RNA, 63 nt, hsa
aggcuugcuggaaaagugacuaaugagucaggagcaaggaacguccagggagugggagcagca

SEQ ID NO: 195621 - RNA, 63 nt, hsa
cuggccaacgucagggucggggcuaggguaggggcaaggaaacucgaauaaaggaugggacca

SEQ ID NO: 195622 - RNA, 63 nt, hsa
gguucuggaacuuuucuucaugccacggccccugcaaggaaauagaugcugaggcagucuucc

SEQ ID NO: 195623 - RNA, 63 nt, hsa
acuguuuaagaucuccauguaauugaaauucaugcaaggaaacaacucauagaaaagauaaau

SEQ ID NO: 195624 - RNA, 63 nt, hsa
aacacuucugaugcaugaaaaaugugugauggugcaaggaauggauucaggauguuguuggag

SEQ ID NO: 195625 - RNA, 63 nt, hsa
uggcacuuggcagguacuccuggauguugaugagcaaggaagagcaacggcccugucagcugg

SEQ ID NO: 195626 - RNA, 63 nt, hsa
ccccagcccuugaauagguugguccucaucauugcaaggaaugagaaagggaggauuuugcac

SEQ ID NO: 195627 - RNA, 63 nt, hsa
guagagccacaauauguaucuuugcuguaaagugcaaggaaauuuuaaauucugggacacuga

SEQ ID NO: 195628 - RNA, 63 nt, hsa
uuucaaaagcagaaaaagacaacaaauauuaaagcaaggaaaaguguaacugaaacacugcac

SEQ ID NO: 195629 - RNA, 63 nt, hsa
ugaucuguuuuaaaggucauauuuggagaaagggcaaggaauugggucugcuuuauuuuuggg

SEQ ID NO: 195630 - RNA, 63 nt, hsa
cagaaucugaugcuuucugaucaacaaaacugagcaaggaagaucccaacacugaagggguag

SEQ ID NO: 195631 - RNA, 63 nt, hsa
uagggauagaugugcuagucuucuagcauaggagcaaggaaucagaggugggguuaaaggcau

SEQ ID NO: 195632 - RNA, 63 nt, hsa
uaauggcuaauauuuccugagcaucuacuaaaugcaaggaauugugcuuggugugucaugugg

SEQ ID NO: 195633 - RNA, 63 nt, hsa
cacaguggauguguuuucccugacuccagcagggcaaggaauguagccgagagguuguguggg

SEQ ID NO: 195634 - RNA, 63 nt, hsa
aguuucucaacugcuggaaggagcugugucccagcaaggaagggaaaccaucagggcugggcu

SEQ ID NO: 195635 - RNA, 63 nt, hsa
uucucauagacguccugagaaggacgguguaaugcaaggaaauggcugugguaacacugaucc

SEQ ID NO: 195636 - RNA, 63 nt, hsa
gcugauuacuguugauagaauauucauuuuauggcaaggaaaucaucuaaacccauaaccaua

SEQ ID NO: 195637 - RNA, 63 nt, hsa
uggccaccagaagagcagggccagccccggucagcaaggaagacccugagcaggaccguggau

SEQ ID NO: 195638 - RNA, 63 nt, hsa
gucucuaauaauccccacuuggaauucagcaccgcaaggaaauuauggguaugugagccauaa

SEQ ID NO: 195639 - RNA, 63 nt, hsa
ccuagagccgggcacagcccucagcgucagacagcaaggaacugucaccagccgcacgcgugg

SEQ ID NO: 195640 - RNA, 63 nt, hsa
uuguccugaccaguaacccaagccuauuucacagcaaggaaauucaccuucaaaagcacugau

SEQ ID NO: 195641 - RNA, 63 nt, hsa
uuuauuaguucaaaagugugacaccuuuucugggcaaggaacagccccuuuaaggagcaaauc

SEQ ID NO: 195642 - RNA, 63 nt, hsa
aaccuuuguauauuggagacuucagaguaaccagcaaggaagagaaaucuuaaucuucaaguu

SEQ ID NO: 195643 - RNA, 63 nt, hsa
agauguguuggagagcacgucgugaccuugggggcaaggaauccagaaagguaggaagauaug

SEQ ID NO: 195644 - RNA, 63 nt, hsa
uguauuuaauuuuucuuuccuuccaucugaggagcaaggaaauccuacugcugaauagcuguu

SEQ ID NO: 195645 - RNA, 63 nt, hsa
cauggcguggcucagcugucuguugaaguuguugcaaggaaaagaggaaacaucucgggccua

SEQ ID NO: 195646 - RNA, 63 nt, hsa
ucugccuggauggaacugaggaccaaucaugcugcaaggaacacuuccacgccccgugaggcc

SEQ ID NO: 195647 - RNA, 63 nt, hsa
aagcacucccagccccguuuaucagaaacacaggcaaggaaauuggaacugccacccagccca

SEQ ID NO: 195648 - RNA, 63 nt, hsa
acuccauggccuccuguccuggaccccacgucugcaaggaaacccuaggaccauggauaccuc

SEQ ID NO: 195649 - RNA, 63 nt, hsa
cccuguccccuuccuucaugaaggcaucuccaggcaaggaaaacugaagucauuggcccgaua

SEQ ID NO: 195650 - RNA, 63 nt, hsa
cgccagucagccccaaggagguggccacccugagcaaggaacuccugcaauucacggcaucca

SEQ ID NO: 195651 - RNA, 63 nt, hsa
ccacaggcagcccugggacauaggaagcugggagcaaggaaagggucuuagucacugccuccc

SEQ ID NO: 195652 - RNA, 63 nt, hsa
guugcuagugucugauuauaugguagaaauaaugcaaggaaaaagguagccaccuucuccauu

SEQ ID NO: 195653 - RNA, 63 nt, hsa
ccucugagcuaaaggagcauguucuaacccaaugcaaggaagcuaagaaccuugaaaaaaggu

SEQ ID NO: 195654 - RNA, 63 nt, hsa
gaucaucacggcacgguuuccagauguaauacugcaaggaaaaaugaugacgugucuccucac

SEQ ID NO: 195655 - RNA, 63 nt, hsa
guguuguuauuaaacgucuguggagcuucugcugcaaggaacaaaaaagaaaaaaaucaaaaa

SEQ ID NO: 195656 - RNA, 63 nt, hsa
aaaagacucauacuggagagaaacccuacaaaugcaaggaaugugggaaagccuucaguuacc

SEQ ID NO: 195657 - RNA, 63 nt, hsa
ucaguggggcucucugaguccuggcccaaagaagcaaggaaccaaauuuaagacucucgcauc

SEQ ID NO: 195658 - RNA, 63 nt, hsa
aaggccucucaucaccacaggaagcgggggcuugcaaggaaagugaaugggccuguggcccac

SEQ ID NO: 195659 - RNA, 63 nt, hsa
gggccugggcuggggucccccccacugccagcugcaaggaaccagcaaagacauuuaccagag

SEQ ID NO: 195660 - RNA, 63 nt, hsa
aaaagauuguguggucaaauauucaauuuaagagcaaggaaauucuuauaaauauaacaauag

SEQ ID NO: 195661 - RNA, 63 nt, hsa
gacauugaugaacgagucuuguuucucuccccugcaaggaagguccaagcaggcccuuaggga

SEQ ID NO: 195662 - RNA, 63 nt, hsa
ucuagacucuucuguaagacucacagaacaaaagcaaggaauugcugauuuggggggugccug

SEQ ID NO: 195663 - RNA, 63 nt, hsa
ggaaaaauggccuuuguaggcaguggaaaacuugcaaggaaagcugccgucucuuuggcaguc

SEQ ID NO: 195664 - RNA, 63 nt, hsa
ccaacaauggccugcuguucacauggacccugagcaaggaaggagggagggaggggcagagug

SEQ ID NO: 195665 - RNA, 63 nt, hsa
accucauagaugugggcucuguuuggggaagaugcaaggaaguaaugagaagcccaggaaauu

SEQ ID NO: 195666 - RNA, 63 nt, hsa
augcccaguucagacugaauaauuccugcugcagcaaggaaaguaccuacuauaauagaaauu

SEQ ID NO: 195667 - RNA, 63 nt, hsa
gauuguacuguacauaaaacauaugaggaaucugcaaggaacacuacaguuguguaaaguugu

SEQ ID NO: 195668 - RNA, 63 nt, hsa
cagcaggagggacugaggccagacucauguccagcaaggaacgugugguguguccccugggaa

SEQ ID NO: 195669 - RNA, 63 nt, hsa
aggguggccaagaggggcuuccuugggaccagugcaaggaaguucugcugucccugggaaguc

SEQ ID NO: 195670 - RNA, 63 nt, hsa
cccugcucccugcgucugggagagcgaggccgagcaaggaaagcauuucgaaccuuccagucc

SEQ ID NO: 195671 - RNA, 63 nt, hsa
uauccaacauauauuuuggaauaucuacuaugugcaaggaauuuuucuuaaacucuaagguua

SEQ ID NO: 195672 - RNA, 63 nt, hsa
uugcuucccccucaaucuggggucuagaguugugcaaggaauucagcuccaguaaggccugga

SEQ ID NO: 195673 - RNA, 63 nt, hsa
ugugaagccagauaugcaauguguaucugaaaagcaaggaauuugcagccguuuuacaaauau

SEQ ID NO: 195674 - RNA, 63 nt, hsa
cuaaaaggaaucuuugaggaaaaaagccuucuagcaaggaaauucaagauucuugaaguugaa

SEQ ID NO: 195675 - RNA, 63 nt, hsa
ugacugguguuuugucuucacauuuuugucuaagcaaggaauauaagauuucaaauaaaauuu

SEQ ID NO: 195676 - RNA, 63 nt, hsa
ucgccgggcccggccacccugccccaagggcaagcaaggaauacguucccccagccccagggg

SEQ ID NO: 195677 - RNA, 63 nt, hsa
agguuaaguagcagguuggguuuuuaugauagugcaaggaaugacucaugccucugagcuucu

SEQ ID NO: 195678 - RNA, 63 nt, hsa
ccauggaggaugagagacugaggcucagggagggcaaggaauaggcccaagaucacuuggcaa

SEQ ID NO: 195679 - RNA, 63 nt, hsa
uggccgccucugccccacugccagccugagugggcaaggaagcagguggaucccccagaagga

SEQ ID NO: 195680 - RNA, 63 nt, hsa
gcuuuuugucuggagcugcccacaagaaagagggcaaggaaaaaaggcuggacuccaugacua

SEQ ID NO: 195681 - RNA, 63 nt, hsa
uggcugaaggauucuagagaaccuuuuguucuugcaaggaaaacaagaauccaaaaccaguga

SEQ ID NO: 195682 - RNA, 63 nt, hsa
guguggggggugccccacaaggcccagcccugggcaaggaagcuuuggaagcagcaagguggg

SEQ ID NO: 195683 - RNA, 63 nt, hsa
aaugggagaaauaucgcugaauucuuuuucucagcaaggaacaucccugagaaagagaaugca

SEQ ID NO: 195684 - RNA, 63 nt, hsa
ggccugggcuaggugagcugccucugccccugggcaaggaagcgaggcccucugggaggaggg

SEQ ID NO: 195685 - RNA, 63 nt, hsa
cacauuaccuacccugugcaugguccuggggcagcaaggaagaagcucagaggguggggagaa

SEQ ID NO: 195686 - RNA, 63 nt, hsa
agggcagacacacaaccuccuccuccucuuccagcaaggaacgcaccgaaaagucacaugaug

SEQ ID NO: 195687 - RNA, 63 nt, hsa
aaaagguauuacauauucuuuugagcuggagcugcaaggaaauacaaaaauuuuuaaaaagaa

SEQ ID NO: 195688 - RNA, 63 nt, hsa
uuuaaguaucuagcacauuggauugguuauaaagcaaggaauguucacacaguaggauauuau

SEQ ID NO: 195689 - RNA, 63 nt, hsa
uuccucuccucuaaucuguguacacaucuccaagcaaggaagaaaaaacaaacucugcucaga

SEQ ID NO: 195690 - RNA, 59 nt, hsa
caacaauaacuggguggugagacacaauagcaaggaaauccccauugagccugcccccc

SEQ ID NO: 195691 - RNA, 63 nt, hsa
ccuuccccaugaacccugcccugcucugcccaggcaaggaacagaagugaggaugagacccag

SEQ ID NO: 195692 - RNA, 63 nt, hsa
uugacauugacagcucugagacaaugaaacccugcaaggaaaacuuuacuggaucugagaccc

SEQ ID NO: 195693 - RNA, 63 nt, hsa
uuuuacaucuuuagauauguuccggucccacaugcaaggaagugaacaucaaauuaaguaagu

SEQ ID NO: 195694 - RNA, 63 nt, hsa
guguuuauucaaacugaaaagcugagaccaagagcaaggaagguaaaaaguuaacaggcaaac

SEQ ID NO: 195695 - RNA, 63 nt, hsa
aguggaacccugccuccaugccagcaucugggggcaaggaaggcuggcaucauccagugagga

SEQ ID NO: 195696 - RNA, 63 nt, hsa
cccaauccaaauggcgucuggaaguccaauguggcaaggaaaaacaggucuucaucgaaucua

SEQ ID NO: 195697 - RNA, 64 nt, hsa
cacaaaagugucacauauuagaaugcugaccuuucauauggauuauugugagucaucagaguuu

SEQ ID NO: 195698 - RNA, 64 nt, hsa
aauaaaugagguuuuuugcauuccaaggaaauggcauauggauuaacuguaagaaaugaaauaa

SEQ ID NO: 195699 - RNA, 64 nt, hsa
caaaagaguaaaggauacuuucacaauuucccuucauauggauaugauuccagucaaaaauaaa

SEQ ID NO: 195700 - RNA, 64 nt, hsa
gcauuuccuaggcagcuccucgccugucagugugcauauggaaacagggacaucuccaucauua

SEQ ID NO: 195701 - RNA, 64 nt, hsa
ucucuccgucuucccgccaucauugugcuguagccauauggaacuccuuucaguucucugacca

SEQ ID NO: 195702 - RNA, 64 nt, hsa
auaauuucaucagguuuuuuguauguuacugacccauauggauuuuaguaacaucuugcuuagu

SEQ ID NO: 195703 - RNA, 64 nt, hsa
acauuuauauauuauguaaaauguuaacuaucaucauauggacucuauguaacacaaauucaaa

SEQ ID NO: 195704 - RNA, 64 nt, hsa
caaaauacaagagacaugggacuguuugcaauaccauauggaaaucuuuuaauaaauauaugua

SEQ ID NO: 195705 - RNA, 64 nt, hsa
ucuagaauuuuauaugugcuagucauucucaauucauauggaaucuagauggauauuucaugca

SEQ ID NO: 195706 - RNA, 64 nt, hsa
aaacagcuuauucugauacaagaaugcuugggugcauauggaaagauugugaaagagugugucu

SEQ ID NO: 195707 - RNA, 64 nt, hsa
uuucugcccuagaguuguucacagccuagucaggcauauggauauguaaacaaugacuguaacg

SEQ ID NO: 195708 - RNA, 64 nt, hsa
auuauuaagcuucuguguuugucuaaaaauguggcauauggauggcauuuaaaacuuugaauga

SEQ ID NO: 195709 - RNA, 64 nt, hsa
uauuaagccaagaauaagcagcagaacccuguuccauauggaaaaaagaaaaacaauuuuuugu

SEQ ID NO: 195710 - RNA, 64 nt, hsa
ccaaaugcuaucuuaaauuuugguccaaacugaacauauggaaauagauuuauuguaaguauuu

SEQ ID NO: 195711 - RNA, 64 nt, hsa; identical to SEQ ID NO: 78073

SEQ ID NO: 195712 - RNA, 64 nt, hsa; identical to SEQ ID NO: 78074

SEQ ID NO: 195713 - RNA, 64 nt, hsa; identical to SEQ ID NO: 78075

SEQ ID NO: 195714 - RNA, 64 nt, hsa; identical to SEQ ID NO: 78076

SEQ ID NO: 195715 - RNA, 64 nt, hsa; identical to SEQ ID NO: 78077

SEQ ID NO: 195716 - RNA, 64 nt, hsa; identical to SEQ ID NO: 78078

SEQ ID NO: 195717 - RNA, 64 nt, hsa; identical to SEQ ID NO: 78079

SEQ ID NO: 195718 - RNA, 64 nt, hsa; identical to SEQ ID NO: 78080

SEQ ID NO: 195719 - RNA, 64 nt, hsa; identical to SEQ ID NO: 78081

SEQ ID NO: 195720 - RNA, 64 nt, hsa; identical to SEQ ID NO: 78082

SEQ ID NO: 195721 - RNA, 64 nt, hsa; identical to SEQ ID NO: 78083

SEQ ID NO: 195722 - RNA, 64 nt, hsa; identical to SEQ ID NO: 78084

SEQ ID NO: 195723 - RNA, 64 nt, hsa; identical to SEQ ID NO: 78085

SEQ ID NO: 195724 - RNA, 64 nt, hsa; identical to SEQ ID NO: 78086

SEQ ID NO: 195725 - RNA, 64 nt, hsa; identical to SEQ ID NO: 78087

SEQ ID NO: 195726 - RNA, 64 nt, hsa; identical to SEQ ID NO: 78088

SEQ ID NO: 195727 - RNA, 64 nt, hsa; identical to SEQ ID NO: 78089

SEQ ID NO: 195728 - RNA, 64 nt, hsa; identical to SEQ ID NO: 78090

SEQ ID NO: 195729 - RNA, 64 nt, hsa; identical to SEQ ID NO: 78091

SEQ ID NO: 195730 - RNA, 64 nt, hsa; identical to SEQ ID NO: 78092

SEQ ID NO: 195731 - RNA, 64 nt, hsa; identical to SEQ ID NO: 78093

SEQ ID NO: 195732 - RNA, 64 nt, hsa; identical to SEQ ID NO: 78094

SEQ ID NO: 195733 - RNA, 64 nt, hsa; identical to SEQ ID NO: 78095

SEQ ID NO: 195734 - RNA, 64 nt, hsa; identical to SEQ ID NO: 78096

SEQ ID NO: 195735 - RNA, 64 nt, hsa; identical to SEQ ID NO: 78097

SEQ ID NO: 195736 - RNA, 64 nt, hsa; identical to SEQ ID NO: 78098

SEQ ID NO: 195737 - RNA, 64 nt, hsa; identical to SEQ ID NO: 78099

SEQ ID NO: 195738 - RNA, 64 nt, hsa; identical to SEQ ID NO: 78100

SEQ ID NO: 195739 - RNA, 64 nt, hsa
caucgggaaaugaucucccaagucgcugccagacaccacccacugcuucgccggacaaugucga

SEQ ID NO: 195740 - RNA, 64 nt, hsa
cacccaagccugucaccucugcucauccuccaagaccacccagcuuucucccagccacagccaa

SEQ ID NO: 195741 - RNA, 64 nt, hsa
uuaaggauauuuucuaaaacccacacuugagaaaaccacccaaugagucaaaaauauauauaua

SEQ ID NO: 195742 - RNA, 64 nt, hsa
uuuugaaguuugugguaaucgucugaucauauaaaccacccauuucagaguaguguuuaaguac

SEQ ID NO: 195743 - RNA, 64 nt, hsa
caaagaaccaucucuacuugccagaguauguuccaccacccaagcagggucucccuacuuuuuc

SEQ ID NO: 195744 - RNA, 64 nt, hsa
guaagacuuagucaguguugguagacaaagucauaccacccagggcagccugcaugcagcgagu

SEQ ID NO: 195745 - RNA, 64 nt, hsa
gcuacugaagccaaggugggaggcagcugacaacaccacccacggcccaugcagaggugguaga

SEQ ID NO: 195746 - RNA, 64 nt, hsa
ucagcaggaacaccaaaucccggaccaggcagaaaccacccaagacugaggggcucgugccaga

SEQ ID NO: 195747 - RNA, 64 nt, hsa
aacuacacaaaauuuuauuuaaagagaacacuuagcagccuaugauaguuuucaauaaaauguu

SEQ ID NO: 195748 - RNA, 64 nt, hsa
uuugggucgcguaguugcugaaaccuaaguaccugcagccuacaggauaaggaaguucacagcc

SEQ ID NO: 195749 - RNA, 64 nt, hsa
agggguuggccaguuggagccugggucagccucagcagccuauccccauguccucuaugccccu

SEQ ID NO: 195750 - RNA, 64 nt, hsa
aggccccucgggggauuggggggacuggggaggcgcagccuagacccaauugcuugcccccaug

SEQ ID NO: 195751 - RNA, 64 nt, hsa
gaaggcuuucccaggaugcacguccucagagggagcagccuaucucccccaagcuggaggcggc

SEQ ID NO: 195752 - RNA, 64 nt, hsa
uauuuuuaagugugugaggagaugcucaguagcagcagccuauggcaagagcuuauaaaugauu

SEQ ID NO: 195753 - RNA, 64 nt, hsa
ugcuggugcacagccacuccccggcaugagacucagugcagauggagagacagcuacacagagc

SEQ ID NO: 195754 - RNA, 64 nt, hsa
gcagcaccgaggggccuuuguucuggggggacccagugcagaauguaagugggcccacccggug

SEQ ID NO: 195755 - RNA, 64 nt, hsa
agcuuuccaagugccuggccagaccuugguccuuagugcagagcccguccuuuuguacuugggg

SEQ ID NO: 195756 - RNA, 64 nt, hsa
gcaguaucugacugcaaaucauauucaggaaagaagugcagaauuucuuccccaagcccagaga

SEQ ID NO: 195757 - RNA, 64 nt, hsa
cuuuugaagugcagauuccucgcugguucuucugagugcagaauaagugaacuuuuuuguuuug

SEQ ID NO: 195758 - RNA, 64 nt, hsa
uucaccuaauguuuucaguuucacuuccuuuugaagugcagauuccucgcugguucuucugagu

SEQ ID NO: 195759 - RNA, 64 nt, hsa
gguccuccccguccccugcuccgaugcauaccucagugcagaaccacagaaucucugcagcgga

SEQ ID NO: 195760 - RNA, 64 nt, hsa
gucuuucaaacacccugagccuuccuaaacagccagugcagacguucucucugggccacgaagc

SEQ ID NO: 195761 - RNA, 64 nt, hsa
gccuuaaaccaccgagcagcguucucuugaugccagugcagagaccagagucagaugcccgagg

SEQ ID NO: 195762 - RNA, 64 nt, hsa
gguguggaugucacugugugaagauaaggacagaagugcagagcugcgcuuuguguguugucua

SEQ ID NO: 195763 - RNA, 64 nt, hsa; identical to SEQ ID NO: 138909

SEQ ID NO: 195764 - RNA, 64 nt, hsa; identical to SEQ ID NO: 138910

SEQ ID NO: 195765 - RNA, 64 nt, hsa; identical to SEQ ID NO: 138911

SEQ ID NO: 195766 - RNA, 64 nt, hsa; identical to SEQ ID NO: 138912

SEQ ID NO: 195767 - RNA, 64 nt, hsa; identical to SEQ ID NO: 138913

SEQ ID NO: 195768 - RNA, 64 nt, hsa; identical to SEQ ID NO: 138914

SEQ ID NO: 195769 - RNA, 64 nt, hsa; identical to SEQ ID NO: 138915

SEQ ID NO: 195770 - RNA, 64 nt, hsa; identical to SEQ ID NO: 138916

SEQ ID NO: 195771 - RNA, 64 nt, hsa; identical to SEQ ID NO: 138917

SEQ ID NO: 195772 - RNA, 64 nt, hsa; identical to SEQ ID NO: 138918

SEQ ID NO: 195773 - RNA, 64 nt, hsa; identical to SEQ ID NO: 138919

SEQ ID NO: 195774 - RNA, 64 nt, hsa; identical to SEQ ID NO: 138920

SEQ ID NO: 195775 - RNA, 64 nt, hsa; identical to SEQ ID NO: 138921

SEQ ID NO: 195776 - RNA, 64 nt, hsa; identical to SEQ ID NO: 138922

SEQ ID NO: 195777 - RNA, 64 nt, hsa; identical to SEQ ID NO: 138923

SEQ ID NO: 195778 - RNA, 64 nt, hsa; identical to SEQ ID NO: 138924

SEQ ID NO: 195779 - RNA, 64 nt, hsa; identical to SEQ ID NO: 138925

SEQ ID NO: 195780 - RNA, 64 nt, hsa; identical to SEQ ID NO: 138926

SEQ ID NO: 195781 - RNA, 64 nt, hsa; identical to SEQ ID NO: 138927

SEQ ID NO: 195782 - RNA, 64 nt, hsa; identical to SEQ ID NO: 138928

SEQ ID NO: 195783 - RNA, 64 nt, hsa; identical to SEQ ID NO: 138929

SEQ ID NO: 195784 - RNA, 64 nt, hsa; identical to SEQ ID NO: 138930

SEQ ID NO: 195785 - RNA, 64 nt, hsa; identical to SEQ ID NO: 138931

SEQ ID NO: 195786 - RNA, 64 nt, hsa; identical to SEQ ID NO: 138932

SEQ ID NO: 195787 - RNA, 64 nt, hsa; identical to SEQ ID NO: 138933

SEQ ID NO: 195788 - RNA, 64 nt, hsa; identical to SEQ ID NO: 138934

SEQ ID NO: 195789 - RNA, 64 nt, hsa; identical to SEQ ID NO: 138935

SEQ ID NO: 195790 - RNA, 64 nt, hsa; identical to SEQ ID NO: 138936

SEQ ID NO: 195791 - RNA, 64 nt, hsa; identical to SEQ ID NO: 138937

SEQ ID NO: 195792 - RNA, 64 nt, hsa; identical to SEQ ID NO: 138938

SEQ ID NO: 195793 - RNA, 64 nt, hsa; identical to SEQ ID NO: 138939

SEQ ID NO: 195794 - RNA, 64 nt, hsa; identical to SEQ ID NO: 138940

SEQ ID NO: 195795 - RNA, 64 nt, hsa
ggcggugcuagcuugacacagucagcaugcuucccagagggagcaggccggaaccacagggcca

SEQ ID NO: 195796 - RNA, 64 nt, hsa
gcuucccagagggagcaggccggaaccacagggccagagggagcuggaacccgaggggccgggg

SEQ ID NO: 195797 - RNA, 64 nt, hsa
uagggggaggguuggaaaauuuauuuuuaugaaacagagggaagacuuuauuguuguuauuuuu

SEQ ID NO: 195798 - RNA, 64 nt, hsa
agagccuccacucugggaugccagaauggaaagccagagggaaccugagaaucauccagucuua

SEQ ID NO: 195799 - RNA, 64 nt, hsa
gaugcucagggagggauaugcuggugugagcagccagagggagagugugucuccuuccugaagg

SEQ ID NO: 195800 - RNA, 64 nt, hsa
ggguggggaggugcaguggcacccccagagccaacagagggagcaggcagagggugggggaccu

SEQ ID NO: 195801 - RNA, 64 nt, hsa
cccucccacccuuguccagaccuggugggcccuucagagggagggguggaccuguuucucuuuc

SEQ ID NO: 195802 - RNA, 64 nt, hsa
ccugccccugucugccagcagaggcaguagggcacagagggaagaggaggguggggcccuggau

SEQ ID NO: 195803 - RNA, 64 nt, hsa
gcaucaugggucauuacgggggcuugagcuggcucagagggaggcagggagcuuuuggacaauu

SEQ ID NO: 195804 - RNA, 64 nt, hsa
auguguguaguggacaaagugaaucagagaagagcagagggagugcuggauugggagaucaguc

SEQ ID NO: 195805 - RNA, 64 nt, hsa
ggguccuuauguacacaccacguucacacacacacagagggaccacgugugcacgcaugaccgu

SEQ ID NO: 195806 - RNA, 64 nt, hsa
guguuuuccugugaggccucccccaucaguggaccagagggagaagcccgaugccccaucccgg

SEQ ID NO: 195807 - RNA, 64 nt, hsa
uggggaaaaccagcagggagcacuuggcuccuggcagagggagaggacaggaggaggagccuuc

SEQ ID NO: 195808 - RNA, 64 nt, hsa
gccuuccccugcaaggugcccaccugcccggagacagagggagcagcugaggccucucuccacu

SEQ ID NO: 195809 - RNA, 64 nt, hsa
ccauaguguucuccaucucuagugaagacagaaccagagggaauaaggaucuuuuuuuuaaaga

SEQ ID NO: 195810 - RNA, 64 nt, hsa
ccgaaaucacgccacuacacuccagccugggcaacagagggagacuccaucucaaaaaaaaaaa

SEQ ID NO: 195811 - RNA, 64 nt, hsa
auguuggccugaggccugagagugucaccaaagacagagggagcuucacugagacucagaggga

SEQ ID NO: 195812 - RNA, 64 nt, hsa
ugucaccaaagacagagggagcuucacugagacucagagggaaaaggaaaagagccucaaacau

SEQ ID NO: 195813 - RNA, 64 nt, hsa
aucuucuggauguuccuacagagggaaagaccuacagagggaaagacccucgggccgcuccccu

SEQ ID NO: 195814 - RNA, 64 nt, hsa
ugugcuugcuuccagaaucuucuggauguuccuacagagggaaagaccuacagagggaaagacc

SEQ ID NO: 195815 - RNA, 64 nt, hsa
cagcugcugucuaaagcaugcgcacuggcgaagccagagggaucugucuuucuacuguggcagg

SEQ ID NO: 195816 - RNA, 64 nt, hsa
guggugugagucugcaggcccuggacccgcuggccagagggacaccuugguggcacugguggac

SEQ ID NO: 195817 - RNA, 64 nt, hsa
agacacugggaggucagcauguuccacagguguucagagggagucugcuacaaacuaucagggc

SEQ ID NO: 195818 - RNA, 64 nt, hsa
auuaccuggaagggagcugccaucugucccucugcagagggauaccuuccaauaguaaauuauc

SEQ ID NO: 195819 - RNA, 64 nt, hsa
ccucgcucucaacgugacccggggaaugaccacccagagggaugagcuagccuguagaggggaa

SEQ ID NO: 195820 - RNA, 64 nt, hsa
cccucucacugaccagggguggacaaugcccaagcagagggagcccccuugcccuguuuggcca

SEQ ID NO: 195821 - RNA, 64 nt, hsa
aaggcaugguuuguccugcuuagguugcccuucccagagggaugguuugaggggagcugaugag

SEQ ID NO: 195822 - RNA, 64 nt, hsa
gaagcuucggggagacaaguuuugagagaagccccagagggagcuauuuccuugcaccccccag

SEQ ID NO: 195823 - RNA, 64 nt, hsa
uaacugcuaggcaccucucucuaacccucauugucagagggaauuggaggauauccacagucug

SEQ ID NO: 195824 - RNA, 64 nt, hsa
aauagaaaacaaaacugacuucuguagaaguuuccagagggaggugcuguuaucucguaccucc

SEQ ID NO: 195825 - RNA, 64 nt, hsa
aauuccaguucaugcugcccacaucucauccaaacagagggaacaucccuacgcuaaacaggua

SEQ ID NO: 195826 - RNA, 64 nt, hsa
gaggaaguuggauauccaguaaugaucaaggccucagagggaggaggagggaagggaauuagaa

SEQ ID NO: 195827 - RNA, 64 nt, hsa
caagggaaugaacaagaagacuaccuugagcucacagagggacugucaucuaaaccaggggaac

SEQ ID NO: 195828 - RNA, 64 nt, hsa
cuccaggagacacguccccaugugugagcgugcacagagggagucggugagcauuuccuuaguu

SEQ ID NO: 195829 - RNA, 64 nt, hsa
ggauaagguagagcucccaccugcugaacuggugcagagggacguggaugccucucccucgccu

SEQ ID NO: 195830 - RNA, 64 nt, hsa
cccaguacugacagccuccuuaaaguuucacccccagagggagccgagacucggaaagugauag

SEQ ID NO: 195831 - RNA, 64 nt, hsa
ccugugccguaggaaagugacuggaaguggacuccagagggacaggugugguggcacaguccug

SEQ ID NO: 195832 - RNA, 64 nt, hsa
cauggaagagcagcuggaggguggauggggaggccagagggagcaaugagggguggucccagcu

SEQ ID NO: 195833 - RNA, 64 nt, hsa
ggaacugcuuuuagcuccugucuuuucaaaauggcagagggaguuccuacacacacuuuuuccc

SEQ ID NO: 195834 - RNA, 64 nt, hsa
cacaccaacaaggcaagccaaaggcgccccuccccagagggaucccuaacgugcccagcaugua

SEQ ID NO: 195835 - RNA, 64 nt, hsa
uggacuucaacccuccuguuguuuggccuuagcccagagggagcugcucaccugagcacccuug

SEQ ID NO: 195836 - RNA, 64 nt, hsa
accaaaaaaauaauaauaaguuagcucugaagggcagagggaauacccaagccccugaugccua

SEQ ID NO: 195837 - RNA, 64 nt, hsa; identical to SEQ ID NO: 120942

SEQ ID NO: 195838 - RNA, 64 nt, hsa; identical to SEQ ID NO: 120943

SEQ ID NO: 195839 - RNA, 64 nt, hsa; identical to SEQ ID NO: 120944

SEQ ID NO: 195840 - RNA, 64 nt, hsa; identical to SEQ ID NO: 120945

SEQ ID NO: 195841 - RNA, 64 nt, hsa; identical to SEQ ID NO: 120946

SEQ ID NO: 195842 - RNA, 64 nt, hsa; identical to SEQ ID NO: 120947

SEQ ID NO: 195843 - RNA, 64 nt, hsa; identical to SEQ ID NO: 120948

SEQ ID NO: 195844 - RNA, 64 nt, hsa; identical to SEQ ID NO: 120949

SEQ ID NO: 195845 - RNA, 64 nt, hsa; identical to SEQ ID NO: 120950

SEQ ID NO: 195846 - RNA, 64 nt, hsa; identical to SEQ ID NO: 120951

SEQ ID NO: 195847 - RNA, 64 nt, hsa; identical to SEQ ID NO: 120952

SEQ ID NO: 195848 - RNA, 64 nt, hsa; identical to SEQ ID NO: 120953

SEQ ID NO: 195849 - RNA, 64 nt, hsa; identical to SEQ ID NO: 120954

SEQ ID NO: 195850 - RNA, 64 nt, hsa; identical to SEQ ID NO: 120955

SEQ ID NO: 195851 - RNA, 64 nt, hsa; identical to SEQ ID NO: 120956

SEQ ID NO: 195852 - RNA, 64 nt, hsa; identical to SEQ ID NO: 120957

SEQ ID NO: 195853 - RNA, 64 nt, hsa; identical to SEQ ID NO: 120958

SEQ ID NO: 195854 - RNA, 64 nt, hsa; identical to SEQ ID NO: 120959

SEQ ID NO: 195855 - RNA, 64 nt, hsa; identical to SEQ ID NO: 120960

SEQ ID NO: 195856 - RNA, 64 nt, hsa; identical to SEQ ID NO: 120961

SEQ ID NO: 195857 - RNA, 64 nt, hsa; identical to SEQ ID NO: 120962

SEQ ID NO: 195858 - RNA, 64 nt, hsa; identical to SEQ ID NO: 120963

SEQ ID NO: 195859 - RNA, 64 nt, hsa; identical to SEQ ID NO: 120964

SEQ ID NO: 195860 - RNA, 62 nt, hsa; identical to SEQ ID NO: 120965

SEQ ID NO: 195861 - RNA, 64 nt, hsa; identical to SEQ ID NO: 120966

SEQ ID NO: 195862 - RNA, 64 nt, hsa; identical to SEQ ID NO: 120967

SEQ ID NO: 195863 - RNA, 64 nt, hsa; identical to SEQ ID NO: 120968

SEQ ID NO: 195864 - RNA, 64 nt, hsa; identical to SEQ ID NO: 120969

SEQ ID NO: 195865 - RNA, 64 nt, hsa; identical to SEQ ID NO: 120970

SEQ ID NO: 195866 - RNA, 64 nt, hsa; identical to SEQ ID NO: 120971

SEQ ID NO: 195867 - RNA, 64 nt, hsa; identical to SEQ ID NO: 89071

SEQ ID NO: 195868 - RNA, 64 nt, hsa; identical to SEQ ID NO: 89072

SEQ ID NO: 195869 - RNA, 64 nt, hsa; identical to SEQ ID NO: 89073

SEQ ID NO: 195870 - RNA, 64 nt, hsa; identical to SEQ ID NO: 89074

SEQ ID NO: 195871 - RNA, 64 nt, hsa; identical to SEQ ID NO: 89075

SEQ ID NO: 195872 - RNA, 64 nt, hsa; identical to SEQ ID NO: 89076

SEQ ID NO: 195873 - RNA, 64 nt, hsa; identical to SEQ ID NO: 89077

SEQ ID NO: 195874 - RNA, 64 nt, hsa; identical to SEQ ID NO: 89078

SEQ ID NO: 195875 - RNA, 64 nt, hsa; identical to SEQ ID NO: 89079

SEQ ID NO: 195876 - RNA, 64 nt, hsa; identical to SEQ ID NO: 89080

SEQ ID NO: 195877 - RNA, 64 nt, hsa; identical to SEQ ID NO: 89081

SEQ ID NO: 195878 - RNA, 64 nt, hsa; identical to SEQ ID NO: 89082

SEQ ID NO: 195879 - RNA, 64 nt, hsa; identical to SEQ ID NO: 89083

SEQ ID NO: 195880 - RNA, 64 nt, hsa; identical to SEQ ID NO: 89084

SEQ ID NO: 195881 - RNA, 64 nt, hsa; identical to SEQ ID NO: 89085

SEQ ID NO: 195882 - RNA, 64 nt, hsa; identical to SEQ ID NO: 89086

SEQ ID NO: 195883 - RNA, 64 nt, hsa; identical to SEQ ID NO: 89087

SEQ ID NO: 195884 - RNA, 64 nt, hsa; identical to SEQ ID NO: 89088

SEQ ID NO: 195885 - RNA, 64 nt, hsa; identical to SEQ ID NO: 89089

SEQ ID NO: 195886 - RNA, 64 nt, hsa; identical to SEQ ID NO: 89090

SEQ ID NO: 195887 - RNA, 64 nt, hsa; identical to SEQ ID NO: 89091

SEQ ID NO: 195888 - RNA, 64 nt, hsa; identical to SEQ ID NO: 89092

SEQ ID NO: 195889 - RNA, 64 nt, hsa; identical to SEQ ID NO: 89093

SEQ ID NO: 195890 - RNA, 64 nt, hsa; identical to SEQ ID NO: 89094

SEQ ID NO: 195891 - RNA, 64 nt, hsa; identical to SEQ ID NO: 89041

SEQ ID NO: 195892 - RNA, 64 nt, hsa; identical to SEQ ID NO: 89042

SEQ ID NO: 195893 - RNA, 64 nt, hsa; identical to SEQ ID NO: 89043

SEQ ID NO: 195894 - RNA, 64 nt, hsa; identical to SEQ ID NO: 89044

SEQ ID NO: 195895 - RNA, 64 nt, hsa; identical to SEQ ID NO: 89045

SEQ ID NO: 195896 - RNA, 64 nt, hsa; identical to SEQ ID NO: 89046

SEQ ID NO: 195897 - RNA, 64 nt, hsa; identical to SEQ ID NO: 89047

SEQ ID NO: 195898 - RNA, 64 nt, hsa; identical to SEQ ID NO: 89048

SEQ ID NO: 195899 - RNA, 64 nt, hsa; identical to SEQ ID NO: 89049

SEQ ID NO: 195900 - RNA, 64 nt, hsa; identical to SEQ ID NO: 89050

SEQ ID NO: 195901 - RNA, 64 nt, hsa; identical to SEQ ID NO: 89051

SEQ ID NO: 195902 - RNA, 64 nt, hsa; identical to SEQ ID NO: 89052

SEQ ID NO: 195903 - RNA, 64 nt, hsa; identical to SEQ ID NO: 89053

SEQ ID NO: 195904 - RNA, 64 nt, hsa; identical to SEQ ID NO: 89054

SEQ ID NO: 195905 - RNA, 64 nt, hsa; identical to SEQ ID NO: 89055

SEQ ID NO: 195906 - RNA, 64 nt, hsa; identical to SEQ ID NO: 89056

SEQ ID NO: 195907 - RNA, 64 nt, hsa; identical to SEQ ID NO: 89057

SEQ ID NO: 195908 - RNA, 64 nt, hsa; identical to SEQ ID NO: 89058

SEQ ID NO: 195909 - RNA, 64 nt, hsa; identical to SEQ ID NO: 89059

SEQ ID NO: 195910 - RNA, 64 nt, hsa; identical to SEQ ID NO: 89060

SEQ ID NO: 195911 - RNA, 64 nt, hsa; identical to SEQ ID NO: 89061

SEQ ID NO: 195912 - RNA, 64 nt, hsa; identical to SEQ ID NO: 89062

SEQ ID NO: 195913 - RNA, 64 nt, hsa; identical to SEQ ID NO: 89063

SEQ ID NO: 195914 - RNA, 64 nt, hsa; identical to SEQ ID NO: 89064

SEQ ID NO: 195915 - RNA, 64 nt, hsa; identical to SEQ ID NO: 89065

SEQ ID NO: 195916 - RNA, 64 nt, hsa; identical to SEQ ID NO: 89066

SEQ ID NO: 195917 - RNA, 64 nt, hsa; identical to SEQ ID NO: 89067

SEQ ID NO: 195918 - RNA, 64 nt, hsa; identical to SEQ ID NO: 89068

SEQ ID NO: 195919 - RNA, 64 nt, hsa; identical to SEQ ID NO: 89069

SEQ ID NO: 195920 - RNA, 64 nt, hsa; identical to SEQ ID NO: 89070

SEQ ID NO: 195921 - RNA, 64 nt, hsa
gacugacuuuuagcugucauaauguauuaaccuaacagaugaaauauguuaaauaugugguugc

SEQ ID NO: 195922 - RNA, 64 nt, hsa
uuaaaaauauguaaaauuaauaauuugcaugaacacagaugacuacauuuuccaaaacuuagug

SEQ ID NO: 195923 - RNA, 64 nt, hsa
ucuuaccguacuuuggaacuugcuguuuaaaaagacagaugaaauaaguugaagaaaccucaug

SEQ ID NO: 195924 - RNA, 64 nt, hsa
ccuuuauauagcagacaugucacccugcuucuacacagaugauggaugaaagcuuggagcaaug

SEQ ID NO: 195925 - RNA, 64 nt, hsa
agaacagaugaaaauccugccaucuuggaucuuuacagaugacaaacaaaugggauacgcagua

SEQ ID NO: 195926 - RNA, 64 nt, hsa
ugguguguuugccagagacccagcagggaccagaacagaugaaaauccugccaucuuggaucuu

SEQ ID NO: 195927 - RNA, 64 nt, hsa
uuuuuucaauuuaugcugcucauccaaaguugccacagaugauacuuccaagugauaauuuuau

SEQ ID NO: 195928 - RNA, 64 nt, hsa
uaaaguaagacaucucaggauuucaccagaaguuacagaugaggcacuggaagccaccaaauua

SEQ ID NO: 195929 - RNA, 64 nt, hsa
auaaaauacuuaaauuuguguuauuuuuugaaccacagaugaguaaauuuaauaaugaaccaau

SEQ ID NO: 195930 - RNA, 64 nt, hsa
aauuacauuaguugaucucgauaauuugaggauaacagaugacaauugaauuuuuaauugauuu

SEQ ID NO: 195931 - RNA, 64 nt, hsa
cccucaggucugcugcaaacacagcauggaggacacagaugacucuuugguguuggucuuuuug

SEQ ID NO: 195932 - RNA, 64 nt, hsa
caaucaaaggcugcaacccuauggccucuuggagacagaugaugacuggcaaggacuagagagc

SEQ ID NO: 195933 - RNA, 64 nt, hsa
guuuaauugugugacuaucugacuguugauggccacagaugauggucuccuaugguauaguuca

SEQ ID NO: 195934 - RNA, 64 nt, hsa
uugaaauuacucuaaguaauccauguguuagaauacagaugaaccuccguuugauuucacagcc

SEQ ID NO: 195935 - RNA, 59 nt, hsa
ggacaaccucuacuaggcgauggcucugcucugucuacauuuauuuguacccacacgug

SEQ ID NO: 195936 - RNA, 59 nt, hsa
guguguguguguguguuugugugugugugucugucuauuuuguauccuggaccacaagu

SEQ ID NO: 195937 - RNA, 59 nt, hsa
gcucugucuacacuggccgagucucugggucugucuacacuggccgagucuccgacugu

SEQ ID NO: 195938 - RNA, 59 nt, hsa
gccagcgucgccgggcugcccagccuggcucugucuacacuggccgagucucugggucu

SEQ ID NO: 195939 - RNA, 59 nt, hsa
gaauuucaggagcacaguaaauuucagggucugucuaucuuaagcuuucuuuauaucag

SEQ ID NO: 195940 - RNA, 59 nt, hsa
guccuugucuccuugacauagugcugguuucugucuauagguuuaugggcuauuacuuu

SEQ ID NO: 195941 - RNA, 59 nt, hsa
ccaauuagucaacucuuuuagggcagaagucugucuaauucaucuuugcuuccuguuac

SEQ ID NO: 195942 - RNA, 59 nt, hsa
aaguucuaguauuuggagucaaaugcaagucugucuaaaucuagagcccauguucuuua

SEQ ID NO: 195943 - RNA, 59 nt, hsa
acuaggcauagcaccguugcuaccgagugucugucuaagaacacagaggagaauuuauu

SEQ ID NO: 195944 - RNA, 59 nt, hsa
caaagcagcggauacaaccucaaaagacgucugucuacauugaauuggguaagggucuc

SEQ ID NO: 195945 - RNA, 59 nt, hsa
uggaagucugaauuggagauguuuguaccucugucuaaacaguucccuugagaacuucc

SEQ ID NO: 195946 - RNA, 59 nt, hsa
uagcuaguagcaaccguguuuucuccagaucugucuagauacaaaggucagaaaucuua

SEQ ID NO: 195947 - RNA, 64 nt, hsa
uggagcagaaggacuuacuguugcucugcaacucacccugcaucuccaagggcugugcuaagca

SEQ ID NO: 195948 - RNA, 64 nt, hsa
caucugggaacuuguaaguggaaagauuauugccacccugcacaucaaguauccuaaggacagg

SEQ ID NO: 195949 - RNA, 64 nt, hsa
gaaccucuggcaagccgcccgacugcaacugcugacccugcagagcuggcugcuggacgcaccg

SEQ ID NO: 195950 - RNA, 64 nt, hsa
gcccguggcuugguuucacgcgcagcggcgccagacccugcaggagggcggcgugguggucuug

SEQ ID NO: 195951 - RNA, 64 nt, hsa
guaaaauaggcaguagaguuguggcaugggcccaacccugcauucaaguguaacagcauucugu

SEQ ID NO: 195952 - RNA, 64 nt, hsa
gcauugcauguuuauauccccaauucucaccacaacccugcaaguaggugguauuauccaaguu

SEQ ID NO: 195953 - RNA, 64 nt, hsa
agucaggccugugagggccguagaccuuguauauacccugcaccagcagugaccgggcagagcc

SEQ ID NO: 195954 - RNA, 64 nt, hsa
ugaccccagccucuguccacuuccuaacccagggacccugcacagccagaacugccuuuggccc

SEQ ID NO: 195955 - RNA, 64 nt, hsa
ggaaaugucaaaucugguuuuuaaacaagguccaacccugcaaugaagcagccacuucagccca

SEQ ID NO: 195956 - RNA, 64 nt, hsa
caccgagguccaaguaugagccagggcugccuccacccugcaacuccuggcagcuuuggcccug

SEQ ID NO: 195957 - RNA, 64 nt, hsa
acauuccaaacagaguccugguuuccucagccucacccugcauagcuugcacaacauccucaga

SEQ ID NO: 195958 - RNA, 64 nt, hsa
auaccaaagcugcugcacagcuggccaccauggcacccugcaccaggccaucagcaccacgugc

SEQ ID NO: 195959 - RNA, 64 nt, hsa
uuaauguguguaugugaacucacauuggagagaaacccugcaauuuaaaugguauggucuggau

SEQ ID NO: 195960 - RNA, 64 nt, hsa
cuuaaugaacacauaugaauucacaguggagaagacccugcaucagggaauguggaaaugacuu

SEQ ID NO: 195961 - RNA, 64 nt, hsa
uauuuugcccauagugccauuuagagaugaaaaccagcuuuaacuuugcaaagugaacauguac

SEQ ID NO: 195962 - RNA, 64 nt, hsa
gcacccaaauccuugucgccaaucuccugaaguacagcuuuaccauauuaguggucauuauuua

SEQ ID NO: 195963 - RNA, 64 nt, hsa
ugucagaauaacuuacagaaaaauagaaaaugcacagcuuuaaaaugggcagaguuaaaaucua

SEQ ID NO: 195964 - RNA, 64 nt, hsa
cagcuuuaaaaugggcagaguuaaaaucuauucccagcuuuaucacuuauuuagccaugcuagc

SEQ ID NO: 195965 - RNA, 64 nt, hsa
agaaauggucuggguauaagcuauuucauaaaagcagcuuuaaauugucaguauuaagguuuuc

SEQ ID NO: 195966 - RNA, 64 nt, hsa
aaguuuaugaaaacauucauuugaaaguuccaugcagcuuuagcacagaguugaccaaacacug

SEQ ID NO: 195967 - RNA, 64 nt, hsa
acaccaaggucugcugucuuauagccaagaauuacagcuuuauuuauagagagugaauuauggg

SEQ ID NO: 195968 - RNA, 64 nt, hsa
agugagcagcgcaccagauguagcgugcuacagucagcuuuagcucucaagagucguauguaac

SEQ ID NO: 195969 - RNA, 64 nt, hsa
ggaaaaggaaagcguuuuuguagcccaccaucuacagcuuuacuguaaaaccuugucuuauucg

SEQ ID NO: 195970 - RNA, 64 nt, hsa
aaaagaguauuuauacaucccaccaaucaaaacacagcuuuauuaccucaugcgaacucauaca

SEQ ID NO: 195971 - RNA, 64 nt, hsa
ggaacuucuaaacacuucauucuuuauauauggacagcuuuauuuuaaaugugguuuuugaugc

SEQ ID NO: 195972 - RNA, 64 nt, hsa
gccauuuacuuugcaagugagauagcuuccccaccagcuuuauuuuuuaacaugaaagcugaug

SEQ ID NO: 195973 - RNA, 64 nt, hsa
cccugugggcaccuggugccugcccccugccgggcagcuuuaaggacagacccccaggggcagu

SEQ ID NO: 195974 - RNA, 64 nt, hsa
uggggccuuugaggcagggucgcagggacaagcucagcuuuaggcaccaucuguucccaucgcg

SEQ ID NO: 195975 - RNA, 64 nt, hsa
cacagaugaccacaucuaauccugcuucuacucucagcuuuaggacaaaagcucugucagaggc

SEQ ID NO: 195976 - RNA, 64 nt, hsa
ccuuacgaauaaaaaacuggauucugguuuacagcagcuuuacagugauaguuaaauuaacugg

SEQ ID NO: 195977 - RNA, 64 nt, hsa
cagcaguggcuucuaggaaacugggaguuuagaucagcuuuacagauacaucgaucagaggcua

SEQ ID NO: 195978 - RNA, 64 nt, hsa
gcagugggaacugugauuggauuuggcaacaugucagcuuuauaguugccgauuagugauaugg

SEQ ID NO: 195979 - RNA, 64 nt, hsa
cugguaacaguucauguuugcuucauaaaugaagcagcuuuaaacaaauucauauucugucugg

SEQ ID NO: 195980 - RNA, 64 nt, hsa
gucccuuaacagugccgcaucucagccuggaagucagcuuuaagucauucaagagaaccucagg

SEQ ID NO: 195981 - RNA, 64 nt, hsa
aacccuacagauuagcccaguucucucuuauuuucagcuuuacagacaagaacaauuuaaaucu

SEQ ID NO: 195982 - RNA, 64 nt, hsa
auuagauguaauugagcuuuguguaauauuaugucagcuuuaacauauaauauuuugaauauuu

SEQ ID NO: 195983 - RNA, 64 nt, hsa
auguaaucagucauuacacuagggagaaauuuaucagcuuuaguucuaaauaugcucaugaggu

SEQ ID NO: 195984 - RNA, 64 nt, hsa
cuuguuucucuuccuuucuuuuuuuaaaaaauagcagcuuuagccaagugcagggccuguaauc

SEQ ID NO: 195985 - RNA, 64 nt, hsa
aaaaaaaaaaccauauauauacauauauauauagcagcuuuauggagauauaauucuuaugcca

SEQ ID NO: 195986 - RNA, 64 nt, hsa
acaccugcggaaggagcuggagaaucugacaggacagcuuuaagcccaugugcaagaaaaugag

SEQ ID NO: 195987 - RNA, 64 nt, hsa
acaccugcggaaggagcuggagaaucuggcaggacagcuuuaagcccaaguggaagaaaaugag

SEQ ID NO: 195988 - RNA, 64 nt, hsa; identical to SEQ ID NO: 156555

SEQ ID NO: 195989 - RNA, 64 nt, hsa; identical to SEQ ID NO: 156556

SEQ ID NO: 195990 - RNA, 64 nt, hsa; identical to SEQ ID NO: 156557

SEQ ID NO: 195991 - RNA, 64 nt, hsa; identical to SEQ ID NO: 156558

SEQ ID NO: 195992 - RNA, 64 nt, hsa; identical to SEQ ID NO: 156559

SEQ ID NO: 195993 - RNA, 64 nt, hsa; identical to SEQ ID NO: 156560

SEQ ID NO: 195994 - RNA, 64 nt, hsa; identical to SEQ ID NO: 156561

SEQ ID NO: 195995 - RNA, 64 nt, hsa; identical to SEQ ID NO: 156562

SEQ ID NO: 195996 - RNA, 64 nt, hsa; identical to SEQ ID NO: 156563

SEQ ID NO: 195997 - RNA, 64 nt, hsa; identical to SEQ ID NO: 156564

SEQ ID NO: 195998 - RNA, 64 nt, hsa; identical to SEQ ID NO: 156565

SEQ ID NO: 195999 - RNA, 64 nt, hsa; identical to SEQ ID NO: 156566

SEQ ID NO: 196000 - RNA, 64 nt, hsa
cccgcuuaggggcuuagaaggagaagccagugagcaggcucacacuaaguuguaaacauaggag

SEQ ID NO: 196001 - RNA, 64 nt, hsa
agugaguuccaccugaccagucuugagcagccaacaggcucaauuaagcccgccugguuuuucc

SEQ ID NO: 196002 - RNA, 64 nt, hsa
aagaaggggaagaagaucaaaacccaccaugccccaggcucagcagcgugcugauggaagugga

SEQ ID NO: 196003 - RNA, 64 nt, hsa
aagaagaggaagaagaccaaggcccaccgugccccaggcucagcagggagcugcuggagguagu

SEQ ID NO: 196004 - RNA, 64 nt, hsa
aagaaguggaagaagaccaagacccaucaugccccaggcucagcagggagcugcuggcugagaa

SEQ ID NO: 196005 - RNA, 64 nt, hsa
auuucccaucuggaccugguacaaaugcacgucacaggcucagcuccuccccacuagcauuuuc

SEQ ID NO: 196006 - RNA, 64 nt, hsa
cuacugcacagagucaggaucucacauuucaccccaggcucaacugaggauguggcuuauuaaa

SEQ ID NO: 196007 - RNA, 64 nt, hsa
guucccauaggaaggagucugccucuucuguccccaggcucacucagccuggcggccauggggc

SEQ ID NO: 196008 - RNA, 64 nt, hsa
caggccugggugguguaccuccuggacuucuccccaggcucacucagugcgcacuuaggggugg

SEQ ID NO: 196009 - RNA, 64 nt, hsa
uuuggguguuuucuggggauguuaacaugggauucaggcucaacucacaagaaacuuuuccauc

SEQ ID NO: 196010 - RNA, 64 nt, hsa
caccuacauguagaaugugaugucagaacucaaacaggcucaccaggcagugugcuuccuuccu

SEQ ID NO: 196011 - RNA, 64 nt, hsa
ugaauccucagcaguggccguuuuuccucuuguccaggcucacgaguuaguccagggauuccau

SEQ ID NO: 196012 - RNA, 64 nt, hsa
ugguaaaugacuguuugccucauuuaauaguauacaggcucagcccauagacuacaguucuuca

SEQ ID NO: 196013 - RNA, 64 nt, hsa
ccaaugccacaggguuccgggaccucgaucaugacaggcucaucagccugugccugacccuucu

SEQ ID NO: 196014 - RNA, 64 nt, hsa
uagggacacugguccccauuuauuggugagaaaacaggcucaggguuucaugacuuguugaaag

SEQ ID NO: 196015 - RNA, 64 nt, hsa
aucucggcucacugcagccuugacuucccaggcucaggcucaggugauccucacaccuuagccu

SEQ ID NO: 196016 - RNA, 64 nt, hsa
acaaaaaucucggcucacugcagccuugacuucccaggcucaggcucaggugauccucacaccu

SEQ ID NO: 196017 - RNA, 64 nt, hsa
uagagaucaugaacccauuuaacagacgaggagacaggcucagagaggcaccgucccuugccua

SEQ ID NO: 196018 - RNA, 64 nt, hsa
uacagaugaggacauugaggagaagagacuuacccaggcucacacagcagcucagccuguucca

SEQ ID NO: 196019 - RNA, 64 nt, hsa
agcaucucuaccuucuccccagcucccaggaccacaggcucaggcaggggccuccaugggcccc

SEQ ID NO: 196020 - RNA, 64 nt, hsa
uacccccucccccaccguugucucaugccaguaacaggcucaaacaaugacaaagcagauucag

SEQ ID NO: 196021 - RNA, 64 nt, hsa
gcgccugaagacgcagccgaggugggagcacgggcaggcucaggcgggaagaaggaggcaucgu

SEQ ID NO: 196022 - RNA, 64 nt, hsa
gaggcagagccgggaggcugcgugggcuucugggcaggcucacgcagacgccggccacaccauc

SEQ ID NO: 196023 - RNA, 64 nt, hsa
gccagugagggcugggcccacagagaugcaugcgcaggcucauaugcgucccaagcagccgcag

SEQ ID NO: 196024 - RNA, 64 nt, hsa
gcuggcccagccaacugccccgggugccucagagcaggcucagacucugggucccucggagcug

SEQ ID NO: 196025 - RNA, 64 nt, hsa
gaugacuggcuuugagaaggaagggaagauggaacaggcucagaucucaugggauagcacgugg

SEQ ID NO: 196026 - RNA, 64 nt, hsa
cgcucauacaggaaugaagccuuagccaggaggccaggcucagcccugugccacucaccgaagc

SEQ ID NO: 196027 - RNA, 64 nt, hsa
uugccgcaucuacuucuagacucccaaaggagcccaggcucaggcaggccuggcccagagucac

SEQ ID NO: 196028 - RNA, 64 nt, hsa
gggccagggauugacccaagcgcgaugcagcaggcaggcucagaagacgaugcggggcugugug

SEQ ID NO: 196029 - RNA, 64 nt, hsa
gcaugagagcacaguagcccagccugcuggucagcaggcucaucugugguucaccuguagacag

SEQ ID NO: 196030 - RNA, 64 nt, hsa
gcagugagcugagauugcacuccagccugggcgacaggcucaaaaaagaaaaaaaaaagaacac

SEQ ID NO: 196031 - RNA, 64 nt, hsa
accccccuugcggcucagcucugguuuccucucccaggcucacccaggcucugcucaggcuggg

SEQ ID NO: 196032 - RNA, 64 nt, hsa
uuuccccaggagagugaugauggagcauauagaucuggcucaaauucagccuccaucacuuacc

SEQ ID NO: 196033 - RNA, 64 nt, hsa
augggccuccuggaaucccuacaguggauggagacuggcucauaccuugccagaucccucucuc

SEQ ID NO: 196034 - RNA, 64 nt, hsa
aucucuagucccagugccuggcagcucuuuggagcuggcucacauuuucccaaaaaaaguugau

SEQ ID NO: 196035 - RNA, 64 nt, hsa
agcccuguggccacaguucugggagccuucaacccuggcucaugcugccauagucuccacggug

SEQ ID NO: 196036 - RNA, 64 nt, hsa
gggucacggcccacagcuagguggggacugucugcuggcucagggcccaguguuuugccacuca

SEQ ID NO: 196037 - RNA, 64 nt, hsa
gcccccgcagcacucacagacaucucccuggggucuggcucacugccuuaucaggaccucugag

SEQ ID NO: 196038 - RNA, 64 nt, hsa
gucucccugucucuagaagccuuagccugggcaccuggcucaaucuuguaacugccugcuagcc

SEQ ID NO: 196039 - RNA, 64 nt, hsa
uuuuuuuuuuugucuccaggggaggggcuguuugcuggcucaggcugaggauggcccaaagucc

SEQ ID NO: 196040 - RNA, 64 nt, hsa
gcaaaauccaauagaaguauugcagcuuccuucucuggcucaagggcugaguuaagugaaagga

SEQ ID NO: 196041 - RNA, 64 nt, hsa
ucaagaaggagaauccauuuagcaccuccucagccuggcucagugauucauauguggcuuuggg

SEQ ID NO: 196042 - RNA, 64 nt, hsa
agaacugucuacuugaucuggagggcauugacaccuggcucagcuggaacaguggggacaggag

SEQ ID NO: 196043 - RNA, 64 nt, hsa
gguugaacugagcucuugucauuuuccaugcucucuggcucauugugucauuucaaaauguauu

SEQ ID NO: 196044 - RNA, 64 nt, hsa
guuggcuuuggaugucuuugcugcagucuucucucuggcucaggugugggugggaggggcccac

SEQ ID NO: 196045 - RNA, 64 nt, hsa
cucuguugcccaagcuggagugaagugguacaaucuggcucacugcagccuccgccucccgggu

SEQ ID NO: 196046 - RNA, 64 nt, hsa
uucucaguuuuguuuguuuguuuguuuccuuaaucuggcucauuugaaauuucuucucccucuc

SEQ ID NO: 196047 - RNA, 64 nt, hsa
ccagcuaacaagagcucccuggggcuggucacagcuggcucaugaugcugaacuugaaaguuuu

SEQ ID NO: 196048 - RNA, 64 nt, hsa
ccaagccucuagcauagagcacugcagacaggcccuggcucagaaucagagcccagaaaguggc

SEQ ID NO: 196049 - RNA, 64 nt, hsa
gcuggucucaaacuccugggcucaagcgauccuccuggcucagccucccaaagugcugggauua

SEQ ID NO: 196050 - RNA, 64 nt, hsa
caagaggagacaccucagucagcagaaaggccaccuggcucacuggcucauuccaggaguggga

SEQ ID NO: 196051 - RNA, 64 nt, hsa
gacaccucagucagcagaaaggccaccuggcucacuggcucauuccaggagugggagagacggc

SEQ ID NO: 196052 - RNA, 64 nt, hsa
cccgccuccuggccgacuugcccaggaggugucucuggcucaccuccgucuguucaucaccuuc

SEQ ID NO: 196053 - RNA, 64 nt, hsa
cgggcuggagcugucuugcagugauucuggccuucuggcucaugguucaguccagcagccuggc

SEQ ID NO: 196054 - RNA, 64 nt, hsa
caugacuccuggccuugggaugcccaagggauuucuggcucaggcuguaaaaguagcugagcca

SEQ ID NO: 196055 - RNA, 64 nt, hsa
guguggcaucugggagccacagugacccagccaccuggcucaggcuaguuccaaauuccaaaag

SEQ ID NO: 196056 - RNA, 64 nt, hsa; identical to SEQ ID NO: 51593

SEQ ID NO: 196057 - RNA, 64 nt, hsa; identical to SEQ ID NO: 51594

SEQ ID NO: 196058 - RNA, 64 nt, hsa
cucaacauggucaucauguuuucuauaugguuuuuccagcuagcaguacucccuuccauaccug

SEQ ID NO: 196059 - RNA, 64 nt, hsa
aucuucacucccaucaucaucuauuuucacacuauccagcuaagcaaagauuccuggaggcuga

SEQ ID NO: 196060 - RNA, 64 nt, hsa
gguaguagggagugggagggcuuauauugguuuuuccagcuauuaaggggacauauugugucgu

SEQ ID NO: 196061 - RNA, 64 nt, hsa
acaaaaauuaggcaugguggugcaugccuguaguuccagcuacuugggaggcugagacaggcga

SEQ ID NO: 196062 - RNA, 64 nt, hsa
aauuuucugugccauuuuaaauuuaacuuugacauccagcuauagacagaaauaauaagccacc

SEQ ID NO: 196063 - RNA, 64 nt, hsa
ccggggccuggggccuccuugccuggcuucuuccuccagcuauccucagggaagcuggagauuc

SEQ ID NO: 196064 - RNA, 64 nt, hsa
uguccuggacuaagccaaugacaccuuccaucuuuccagcuauggugacuggguuagguaugau

SEQ ID NO: 196065 - RNA, 64 nt, hsa
cagccauggucacgagucauuucugccugacugcuccagcuaacuuccagggucucagcaaacu

SEQ ID NO: 196066 - RNA, 64 nt, hsa
aaauuagccaggcaugguggugggugccuguaguuccagcuacuugggaggcugaggugggaaa

SEQ ID NO: 196067 - RNA, 64 nt, hsa
ggcuaccugaaccaaggcgucucuuuaaguggggcgcccgaagucauuuuggacggccaccuga

SEQ ID NO: 196068 - RNA, 55 nt, hsa
aacuaccccaugaggccugaggagccgcccgaaggucgcggugaccuggugccuu

SEQ ID NO: 196069 - RNA, 64 nt, hsa
gcaccaaacagcccaggacugccgagacucuggccgcccgaaggagccugcuuugguacuaugg

SEQ ID NO: 196070 - RNA, 64 nt, hsa
accugcugccacuucucaucuacguggugucgcgcgcccgaauucagcaccugggagccgagau

SEQ ID NO: 196071 - RNA, 64 nt, hsa
uuucccuuaggauagggcuauauuggcaaaaugccgcccgaacagacugcugacaguaaaccaa

SEQ ID NO: 196072 - RNA, 54 nt, hsa
ccgaggaggggggcagcuagcgagcgcccgaacuggccaggacccccgcgcccg

SEQ ID NO: 196073 - RNA, 55 nt, hsa
gcucccagaccguuaccuagcccagcgcccgaaagccgucucuucuaugcaauaa

SEQ ID NO: 196074 - RNA, 64 nt, hsa
gcauugcuuucuggccucagcuauguaauuaaaacgcccgaaguaaaauggccuucuccaaaau

SEQ ID NO: 196075 - RNA, 64 nt, hsa
gccccucacccccagcuggaaauuaagaaaaagucgcccgaaacaccaagugaggccauagcaa

SEQ ID NO: 196076 - RNA, 64 nt, hsa
ccuggcugcuguuguaaucuacuuguucugcugacgcccgaacugacuucuuucccggucucuc

SEQ ID NO: 196077 - RNA, 64 nt, hsa
cugacgggagucgcggccccaccgaggcgucggccgcccgaagagccucccaagccagcgcggc

SEQ ID NO: 196078 - RNA, 64 nt, hsa
uugccuuagaaaaggagaaaggaauuccuuuucccgcccgaacaugaagaaaaaugaccugacc

SEQ ID NO: 196079 - RNA, 64 nt, hsa
auaaaauucaacgugaggaagcaagugacaaggacgcccgaagcacaguggacggucaugaagg

SEQ ID NO: 196080 - RNA, 64 nt, hsa
cugugugacccucagucuuggccagccaugcaugcgcccgaagcucgugcaguuuguacgugag

SEQ ID NO: 196081 - RNA, 64 nt, hsa
guuccuuccucugaaucgaauggaugugggugaccgcccgaaggccuucacaggauggaaguag

SEQ ID NO: 196082 - RNA, 64 nt, hsa
uuggagagacugucauggaagaggguggagccgccgcccgaagcgccgaggaggcugagccacu

SEQ ID NO: 196083 - RNA, 64 nt, hsa
ucucaucuccauucggcccccaggccggcgggcgcgcccgaagcgcccauccucgugguaggca

SEQ ID NO: 196084 - RNA, 64 nt, hsa
ccauuuuacccauuuccugucccugagcaaacaacgcccgaaauacccucugcuacccacuagc

SEQ ID NO: 196085 - RNA, 64 nt, hsa
acguugcacacgcagucugcagagccgccgccgccgcccgaaccagcccggaucugagggcccu

SEQ ID NO: 196086 - RNA, 64 nt, hsa; identical to SEQ ID NO: 196058

SEQ ID NO: 196087 - RNA, 64 nt, hsa; identical to SEQ ID NO: 196059

SEQ ID NO: 196088 - RNA, 64 nt, hsa; identical to SEQ ID NO: 196060

SEQ ID NO: 196089 - RNA, 64 nt, hsa; identical to SEQ ID NO: 196061

SEQ ID NO: 196090 - RNA, 64 nt, hsa; identical to SEQ ID NO: 196062

SEQ ID NO: 196091 - RNA, 64 nt, hsa; identical to SEQ ID NO: 196063

SEQ ID NO: 196092 - RNA, 64 nt, hsa; identical to SEQ ID NO: 196064

SEQ ID NO: 196093 - RNA, 64 nt, hsa; identical to SEQ ID NO: 196065

SEQ ID NO: 196094 - RNA, 64 nt, hsa; identical to SEQ ID NO: 196066

SEQ ID NO: 196095 - RNA, 64 nt, hsa; identical to SEQ ID NO: 196067

SEQ ID NO: 196096 - RNA, 55 nt, hsa; identical to SEQ ID NO: 196068

SEQ ID NO: 196097 - RNA, 64 nt, hsa; identical to SEQ ID NO: 196069

SEQ ID NO: 196098 - RNA, 64 nt, hsa; identical to SEQ ID NO: 196070

SEQ ID NO: 196099 - RNA, 64 nt, hsa; identical to SEQ ID NO: 196071

SEQ ID NO: 196100 - RNA, 54 nt, hsa; identical to SEQ ID NO: 196072

SEQ ID NO: 196101 - RNA, 55 nt, hsa; identical to SEQ ID NO: 196073

SEQ ID NO: 196102 - RNA, 64 nt, hsa; identical to SEQ ID NO: 196074

SEQ ID NO: 196103 - RNA, 64 nt, hsa; identical to SEQ ID NO: 196075

SEQ ID NO: 196104 - RNA, 64 nt, hsa; identical to SEQ ID NO: 196076

SEQ ID NO: 196105 - RNA, 64 nt, hsa; identical to SEQ ID NO: 196077

SEQ ID NO: 196106 - RNA, 64 nt, hsa; identical to SEQ ID NO: 196078

SEQ ID NO: 196107 - RNA, 64 nt, hsa; identical to SEQ ID NO: 196079

SEQ ID NO: 196108 - RNA, 64 nt, hsa; identical to SEQ ID NO: 196080

SEQ ID NO: 196109 - RNA, 64 nt, hsa; identical to SEQ ID NO: 196081

SEQ ID NO: 196110 - RNA, 64 nt, hsa; identical to SEQ ID NO: 196082

SEQ ID NO: 196111 - RNA, 64 nt, hsa; identical to SEQ ID NO: 196083

SEQ ID NO: 196112 - RNA, 64 nt, hsa; identical to SEQ ID NO: 196084

SEQ ID NO: 196113 - RNA, 64 nt, hsa; identical to SEQ ID NO: 196085

SEQ ID NO: 196114 - RNA, 64 nt, hsa; identical to SEQ ID NO: 71314

SEQ ID NO: 196115 - RNA, 64 nt, hsa; identical to SEQ ID NO: 71315

SEQ ID NO: 196116 - RNA, 64 nt, hsa; identical to SEQ ID NO: 71316

SEQ ID NO: 196117 - RNA, 64 nt, hsa; identical to SEQ ID NO: 71317

SEQ ID NO: 196118 - RNA, 64 nt, hsa
ugacagauaucccaacuacgcugauuugaucuuuacaaauuauaugaguguaugaauuugucac

SEQ ID NO: 196119 - RNA, 64 nt, hsa
agaggucuccugauggaaguguacaauaccaccuacaaauuauccaugccccaaguguuaaaac

SEQ ID NO: 196120 - RNA, 64 nt, hsa
aaagauuuaaaauaauuccugguuugaagaaauaacaaauuaaaagcuauauauaaacgguuaa

SEQ ID NO: 196121 - RNA, 64 nt, hsa
uggugaaacauacgacagaccacuguaagugagaacaaauuacuggcccagcccaacccacacc

SEQ ID NO: 196122 - RNA, 64 nt, hsa
aauauauuuucaauuguguacaaauuaaggguguacaaauuauaauaaugcaucucuaucuuca

SEQ ID NO: 196123 - RNA, 64 nt, hsa
guaaaauuucacauaaauauauuuucaauuguguacaaauuaaggguguacaaauuauaauaau

SEQ ID NO: 196124 - RNA, 64 nt, hsa
uucaaaaaagcucucuugaaucuagguagcaugaacaaauuauaaaauuuguuuaaaaaagcaa

SEQ ID NO: 196125 - RNA, 64 nt, hsa
auugaagagccuuuucauguauuaaauaaugaacacaaauuauauaauuaaaauaauuggagau

SEQ ID NO: 196126 - RNA, 64 nt, hsa
acaguaccugauacuccuaaaacuuuuaacuuauacaaauuagucaauaaugaccccaauuuuu

SEQ ID NO: 196127 - RNA, 64 nt, hsa
uuugguggugguuuuguuucuaugcaaacuggacacaaauuacaacaguaaauuuuuuuauaag

SEQ ID NO: 196128 - RNA, 64 nt, hsa
cuauuugaaaauguucauauuaccaauaauguggacaaauuacuuugcagguuuaaauaugccu

SEQ ID NO: 196129 - RNA, 64 nt, hsa
agucaaaagguauucugaauauaauaaaagccucacaaauuauuuguaaaauuuaguaguucau

SEQ ID NO: 196130 - RNA, 64 nt, hsa
aauuguaugaagcaaugugauuauaugaagagacacaaauuaaaaagacaaauuaaaccugaaa

SEQ ID NO: 196131 - RNA, 64 nt, hsa
aaugugauuauaugaagagacacaaauuaaaaagacaaauuaaaccugaaauuauauuuaaaau

SEQ ID NO: 196132 - RNA, 64 nt, hsa
uacaugguugaaaccccaucucuacuaaaaauacacaaauuagcuaggcaugguggacucgccu

SEQ ID NO: 196133 - RNA, 64 nt, hsa
auaagagaaucaacauuucucaauaauuuccuccacaaauuauuaaugaaaauaagaauuauuu

SEQ ID NO: 196134 - RNA, 64 nt, hsa
cuugagaauguuuguuguaaaugguuucaaaaauacaaauuauagccaaucaaaacauugcuuu

SEQ ID NO: 196135 - RNA, 64 nt, hsa
auaauuauauggucauucugaccccagcucuuauacaaauuauacauguauuuuuguguauguu

SEQ ID NO: 196136 - RNA, 64 nt, hsa
uuagugggacuauuacacacaaaacaaauuaaaaacaaauuauuccagguggaccaagaauuca

SEQ ID NO: 196137 - RNA, 64 nt, hsa
cuaacaacuacuuagugggacuauuacacacaaaacaaauuaaaaacaaauuauuccaggugga

SEQ ID NO: 196138 - RNA, 64 nt, hsa
ugcugguucuuuggauaauggaguucuuguguuaacaaauuacgugcuauaugauuuuuuguua

SEQ ID NO: 196139 - RNA, 64 nt, hsa
ggaugaaaacuucagggcuucuuuucuguauauaacaaauuaagucuguacauauuuuuguacc

SEQ ID NO: 196140 - RNA, 64 nt, hsa
aguagaaaaaaaguauaguuaaaacauuuguucuacaaauuaaccuuuaaaaauauaauuacug

SEQ ID NO: 196141 - RNA, 64 nt, hsa
gccauaaauacagcugaacugaauauaaauguucacaaauuaaugcugucaaaggaaugaguaa

SEQ ID NO: 196142 - RNA, 64 nt, hsa
gcacuucugaacuuggguuucaugccugccccccacaaauuauguuuagaagcagcacugcauc

SEQ ID NO: 196143 - RNA, 64 nt, hsa
gaauauggaguuaguagauuuaugauucugaucuacaaauuaacauuuuugaugccaaaauuag

SEQ ID NO: 196144 - RNA, 64 nt, hsa
ucugaauccuugguucucuuuauacucaccagguacaaauuacugguauguuuuauaagccgca

SEQ ID NO: 196145 - RNA, 64 nt, hsa
cugaaaacguaagaaguuuuaaacagcuuuucacacaaauuagaugcaacuguucccaugucug

SEQ ID NO: 196146 - RNA, 64 nt, hsa
uuucacuguacaagcaacuuagauuuuuauuuguacaaauuacuucuuuguuuuucuuaaugau

SEQ ID NO: 196147 - RNA, 64 nt, hsa
aguaaaucugucuaaauuuauauuuuaaauuauuacaaauuacacaucuuugaggaaagaguau

SEQ ID NO: 196148 - RNA, 64 nt, hsa
ccuauuuuccucuuaauaauacguuugggugaagacaaauuaguguuuaguaauugcaucaucu

SEQ ID NO: 196149 - RNA, 64 nt, hsa
uggauuuacuuuuacagaauauugaaaagauaagacaaauuauaaauaaguucuaaaacauaaa

SEQ ID NO: 196150 - RNA, 64 nt, hsa
acuuggaaggauauauuaugccuaacccugcccaacaaauuaagguuugugccuaaaauguuag

SEQ ID NO: 196151 - RNA, 64 nt, hsa
guuucccaguggcauucacuagugagaguuuuagacaaauuauguuacgaguaaaguuuggcug

SEQ ID NO: 196152 - RNA, 64 nt, hsa
acacacacacacacacacacacaaauauuauuagacaaauuagaugacaaaaaucauuaagaag

SEQ ID NO: 196153 - RNA, 64 nt, hsa
cucacaguugaccaugauucugacuucuaacauuacaaauuaguuuuuacuauuauaaaccuuu

SEQ ID NO: 196154 - RNA, 64 nt, hsa
agugagcaaggauacgaaaacaguguguuugaaaacaaauuagguuuggguucaauuccuucaa

SEQ ID NO: 196155 - RNA, 64 nt, hsa
gauugacauaaacucuuugugccuugaaaaugaaacaaauuauaaaaauguuuaaauggaacca

SEQ ID NO: 196156 - RNA, 64 nt, hsa
cucaauuaucaucauacuuacuuaccuuauauuaacaaauuaagaugaugcugccaaaacaagu

SEQ ID NO: 196157 - RNA, 64 nt, hsa
cuaauugcauccaucaucuccuuuggcugcuguaacaaauuaccaccaauaauaugauggcuua

SEQ ID NO: 196158 - RNA, 64 nt, hsa
gaugauggggcagggguuucagaagaucuguaaaacaaauuaaggugcgaacaaguuaauuuga

SEQ ID NO: 196159 - RNA, 64 nt, hsa
aaauagccaugcagacaagucucucaucugaagaacaaauuagauuuagcuaauuagaauuaau

SEQ ID NO: 196160 - RNA, 64 nt, hsa
acuuuacuaucauaugaauguguuauguuauaugacaaauuaaugcagcaguuuuacuuaccuu

SEQ ID NO: 196161 - RNA, 64 nt, hsa
auaugguaucacaaugccuauuaagaggcuuuuuacaaauuacuuacuuaguaauaucuguuaa

SEQ ID NO: 196162 - RNA, 64 nt, hsa
agcagacgcuccgccccacccggugauggagccccggggggacagucgugccuggggaggagca

SEQ ID NO: 196163 - RNA, 64 nt, hsa
ggcaggcacccugggcagagagaugcagugggugcggggggauccuguggcccacagagcugcc

SEQ ID NO: 196164 - RNA, 64 nt, hsa; identical to SEQ ID NO: 83612

SEQ ID NO: 196165 - RNA, 64 nt, hsa; identical to SEQ ID NO: 83613

SEQ ID NO: 196166 - RNA, 64 nt, hsa; identical to SEQ ID NO: 83614

SEQ ID NO: 196167 - RNA, 64 nt, hsa; identical to SEQ ID NO: 83615

SEQ ID NO: 196168 - RNA, 64 nt, hsa; identical to SEQ ID NO: 83616

SEQ ID NO: 196169 - RNA, 64 nt, hsa; identical to SEQ ID NO: 83617

SEQ ID NO: 196170 - RNA, 64 nt, hsa; identical to SEQ ID NO: 83618

SEQ ID NO: 196171 - RNA, 64 nt, hsa; identical to SEQ ID NO: 83619

SEQ ID NO: 196172 - RNA, 64 nt, hsa; identical to SEQ ID NO: 83620

SEQ ID NO: 196173 - RNA, 64 nt, hsa; identical to SEQ ID NO: 83621

SEQ ID NO: 196174 - RNA, 64 nt, hsa; identical to SEQ ID NO: 83622

SEQ ID NO: 196175 - RNA, 64 nt, hsa; identical to SEQ ID NO: 83623

SEQ ID NO: 196176 - RNA, 64 nt, hsa; identical to SEQ ID NO: 83624

SEQ ID NO: 196177 - RNA, 64 nt, hsa; identical to SEQ ID NO: 83625

SEQ ID NO: 196178 - RNA, 64 nt, hsa; identical to SEQ ID NO: 83626

SEQ ID NO: 196179 - RNA, 64 nt, hsa; identical to SEQ ID NO: 83627

SEQ ID NO: 196180 - RNA, 64 nt, hsa; identical to SEQ ID NO: 83628

SEQ ID NO: 196181 - RNA, 64 nt, hsa; identical to SEQ ID NO: 83629

SEQ ID NO: 196182 - RNA, 64 nt, hsa; identical to SEQ ID NO: 83630

SEQ ID NO: 196183 - RNA, 64 nt, hsa; identical to SEQ ID NO: 83631

SEQ ID NO: 196184 - RNA, 64 nt, hsa; identical to SEQ ID NO: 83632

SEQ ID NO: 196185 - RNA, 60 nt, hsa; identical to SEQ ID NO: 83633

SEQ ID NO: 196186 - RNA, 64 nt, hsa; identical to SEQ ID NO: 83634

SEQ ID NO: 196187 - RNA, 64 nt, hsa; identical to SEQ ID NO: 83635

SEQ ID NO: 196188 - RNA, 64 nt, hsa; identical to SEQ ID NO: 83636

SEQ ID NO: 196189 - RNA, 64 nt, hsa; identical to SEQ ID NO: 83637

SEQ ID NO: 196190 - RNA, 64 nt, hsa; identical to SEQ ID NO: 83638

SEQ ID NO: 196191 - RNA, 64 nt, hsa; identical to SEQ ID NO: 83639

SEQ ID NO: 196192 - RNA, 64 nt, hsa; identical to SEQ ID NO: 83640

SEQ ID NO: 196193 - RNA, 64 nt, hsa; identical to SEQ ID NO: 83641

SEQ ID NO: 196194 - RNA, 64 nt, hsa; identical to SEQ ID NO: 83642

SEQ ID NO: 196195 - RNA, 64 nt, hsa; identical to SEQ ID NO: 83643

SEQ ID NO: 196196 - RNA, 64 nt, hsa; identical to SEQ ID NO: 83644

SEQ ID NO: 196197 - RNA, 64 nt, hsa; identical to SEQ ID NO: 83645

SEQ ID NO: 196198 - RNA, 64 nt, hsa; identical to SEQ ID NO: 83646

SEQ ID NO: 196199 - RNA, 64 nt, hsa; identical to SEQ ID NO: 83647

SEQ ID NO: 196200 - RNA, 64 nt, hsa; identical to SEQ ID NO: 83648

SEQ ID NO: 196201 - RNA, 64 nt, hsa; identical to SEQ ID NO: 83649

SEQ ID NO: 196202 - RNA, 64 nt, hsa; identical to SEQ ID NO: 83650

SEQ ID NO: 196203 - RNA, 54 nt, hsa; identical to SEQ ID NO: 83651

SEQ ID NO: 196204 - RNA, 64 nt, hsa; identical to SEQ ID NO: 83652

SEQ ID NO: 196205 - RNA, 64 nt, hsa; identical to SEQ ID NO: 83653

SEQ ID NO: 196206 - RNA, 64 nt, hsa; identical to SEQ ID NO: 83654

SEQ ID NO: 196207 - RNA, 64 nt, hsa; identical to SEQ ID NO: 83655

SEQ ID NO: 196208 - RNA, 64 nt, hsa; identical to SEQ ID NO: 83656

SEQ ID NO: 196209 - RNA, 64 nt, hsa; identical to SEQ ID NO: 83657

SEQ ID NO: 196210 - RNA, 59 nt, hsa; identical to SEQ ID NO: 83658

SEQ ID NO: 196211 - RNA, 64 nt, hsa; identical to SEQ ID NO: 83659

SEQ ID NO: 196212 - RNA, 64 nt, hsa; identical to SEQ ID NO: 83660

SEQ ID NO: 196213 - RNA, 64 nt, hsa; identical to SEQ ID NO: 83661

SEQ ID NO: 196214 - RNA, 64 nt, hsa; identical to SEQ ID NO: 83662

SEQ ID NO: 196215 - RNA, 64 nt, hsa; identical to SEQ ID NO: 83663

SEQ ID NO: 196216 - RNA, 64 nt, hsa; identical to SEQ ID NO: 83664

SEQ ID NO: 196217 - RNA, 64 nt, hsa; identical to SEQ ID NO: 83665

SEQ ID NO: 196218 - RNA, 64 nt, hsa; identical to SEQ ID NO: 83666

SEQ ID NO: 196219 - RNA, 64 nt, hsa; identical to SEQ ID NO: 83667

SEQ ID NO: 196220 - RNA, 64 nt, hsa; identical to SEQ ID NO: 83668

SEQ ID NO: 196221 - RNA, 64 nt, hsa
cccacucugccgugcucacacagacacacccagcugcacacaugaggcaucccacaugacacgg

SEQ ID NO: 196222 - RNA, 64 nt, hsa
ccccuucccacggcgugucccacggccagacacaugcacacacaucacacccucaaacacccag

SEQ ID NO: 196223 - RNA, 64 nt, hsa
aagccauauggagcaucuacccagacucccacucugcacacacucacucccaccucucaagccu

SEQ ID NO: 196224 - RNA, 64 nt, hsa
gcaaggaauucuuauccuggccacauguccuccgugcacacacccaauggaguuaaccuuggaa

SEQ ID NO: 196225 - RNA, 64 nt, hsa
guauguacacacacacacacgugugcacacacaaugcacacaacuccuaugacuggcuccuacu

SEQ ID NO: 196226 - RNA, 64 nt, hsa
aauguguguauguauguacacacacacacacgugugcacacacaaugcacacaacuccuaugac

SEQ ID NO: 196227 - RNA, 64 nt, hsa
ugucauuucaguguuacuggaguuuucuucauugugcacacaggacaaaucugaucucuuuggg

SEQ ID NO: 196228 - RNA, 64 nt, hsa
agugaggaguucugauauuaagcacacacacacaugcacacaaauggacuucucugaagcugug

SEQ ID NO: 196229 - RNA, 64 nt, hsa
uauaacuggaggaccuggcaaaccugccgcaugcugcacacaucuaccuacguacacauauaca

SEQ ID NO: 196230 - RNA, 64 nt, hsa
uugauguccccaaaugcaaacacaggcacacacaugcacacacccauaaacacacacacagugc

SEQ ID NO: 196231 - RNA, 64 nt, hsa
ugcuugcacacaugcacccccucacucucacacuugcacacauacacacacacacacacgaaau

SEQ ID NO: 196232 - RNA, 64 nt, hsa
cguuggucuucucuugucaggaaugaaggaugcuugcacacaugcacccccucacucucacacu

SEQ ID NO: 196233 - RNA, 64 nt, hsa
uguggugauggcccuaaguuaagcaaaaugcuucugcacacaaaacucucugguuuacuucaaa

SEQ ID NO: 196234 - RNA, 64 nt, hsa
cccacagaaggacacuagccugugcacgcgcgcgugcacacacacacacacacacacgaguuca

SEQ ID NO: 196235 - RNA, 64 nt, hsa
acacacagacacacacacugccuggaugcauguaugcacacacaugcgcgcacacgugcucccu

SEQ ID NO: 196236 - RNA, 64 nt, hsa
acacacacaugugcacagauaugcugucuggacaugcacacacgugcagauaugcuguccggau

SEQ ID NO: 196237 - RNA, 64 nt, hsa
auaugcugccugggcacacacuuccggacacacaugcacacacaggugcagauaugcugccugg

SEQ ID NO: 196238 - RNA, 64 nt, hsa
gucuccaagccaugugcacagcacacacgugcagugcacacaaagaaaugacauggaaauagau

SEQ ID NO: 196239 - RNA, 64 nt, hsa
uaccccaucccccacccccacacacacacacacaugcacacaacacauacacacacacgcacag

SEQ ID NO: 196240 - RNA, 64 nt, hsa
cuuccuuaccuacucaagggcuuuuucuaaggcaugcacacauaucuccuguucucugagagua

SEQ ID NO: 196241 - RNA, 64 nt, hsa
caugcauguacagaaagacuguaugugugugccuugcacacacacccauaccucucagaaaaag

SEQ ID NO: 196242 - RNA, 64 nt, hsa
aaaauuauuuuaaauuucuaaguuauaauaaauuugcacacagauaacaugcaugcuauuuaug

SEQ ID NO: 196243 - RNA, 64 nt, hsa
caccacaccugauggaaaaauguaauugcuuaccugcacacaguuuuuuuuccuuuucuaaauu

SEQ ID NO: 196244 - RNA, 64 nt, hsa
agaauaccuccuuauaggaaaguuaauuuccaauugcacacauaagcaaaaaggcauuuucuuc

SEQ ID NO: 196245 - RNA, 64 nt, hsa
agcuuuuugccucccucucuucucuuugccuguaugcacacaguaugcuuaugugucauuucac

SEQ ID NO: 196246 - RNA, 64 nt, hsa
gccguccccauccccugcccucagcacacacaucugcacacacgcagcuuuguucucaccucua

SEQ ID NO: 196247 - RNA, 64 nt, hsa
gcugggguaagggcaagcacuggggucaagagccugcacacaugagccuuccgggcuggaaggc

SEQ ID NO: 196248 - RNA, 64 nt, hsa
aagcugugagauccacaguuacaagugacacgcaugcacacauggaguuccacaugggguacug

SEQ ID NO: 196249 - RNA, 64 nt, hsa
cccucccccaaaaaacuuauaaaaugcaauagaaugcacacaaagacagcaacuuuuguacaga

SEQ ID NO: 196250 - RNA, 64 nt, hsa
gaaagcagccccuccucacacauacaugugcacaugcacacacaugcaugcacacacaugcaca

SEQ ID NO: 196251 - RNA, 64 nt, hsa
cucacacauacaugugcacaugcacacacaugcaugcacacacaugcacacauacacgcacaug

SEQ ID NO: 196252 - RNA, 64 nt, hsa
caugugcacaugcacacacaugcaugcacacacaugcacacauacacgcacaugcacacauaca

SEQ ID NO: 196253 - RNA, 64 nt, hsa
caugcaugcacacacaugcacacauacacgcacaugcacacauacacaugcaugcacacauaca

SEQ ID NO: 196254 - RNA, 64 nt, hsa
cacacauacacgcacaugcacacauacacaugcaugcacacauacacaggcauacaugcaugca

SEQ ID NO: 196255 - RNA, 64 nt, hsa
cacaugcaugcacacauacacaggcauacaugcaugcacacacacaugcacgcacacacacaug

SEQ ID NO: 196256 - RNA, 64 nt, hsa
caugcaugcacacacacaugcacgcacacacacaugcacacauacacgugcacacauacacagg

SEQ ID NO: 196257 - RNA, 64 nt, hsa
cacaugcacgcacacacacaugcacacauacacgugcacacauacacaggcacacaugcaugca

SEQ ID NO: 196258 - RNA, 64 nt, hsa
cauacacgugcacacauacacaggcacacaugcaugcacacauacacaugcacacacacaugca

SEQ ID NO: 196259 - RNA, 64 nt, hsa
cauacacaggcacacaugcaugcacacauacacaugcacacacacaugcacacauauaugcaca

SEQ ID NO: 196260 - RNA, 64 nt, hsa
cacaugcaugcacacauacacaugcacacacacaugcacacauauaugcacaggcacacacaug

SEQ ID NO: 196261 - RNA, 64 nt, hsa
acaggcacacacauguacgcacacacacaugcacugcacacauauccaugcacacaaacacaua

SEQ ID NO: 196262 - RNA, 64 nt, hsa
guacgcacacacacaugcacugcacacauauccaugcacacaaacacauauauacacaugcaca

SEQ ID NO: 196263 - RNA, 64 nt, hsa
acaguggggccacgaggcugacauucucuggccuugcacacagugcccccugagaaguucaaca

SEQ ID NO: 196264 - RNA, 64 nt, hsa
cucugucaucacuccuuggcacccaccaacuuccugcacacacuggcagagaggggcgcuggga

SEQ ID NO: 196265 - RNA, 64 nt, hsa
ggaggagagcuggaccugagggccaccgcagcggugcacacauuccucugggcugacggcauga

SEQ ID NO: 196266 - RNA, 64 nt, hsa
gacacccaaccccugaaccccacacacucugccaugcacacaggaggagagcuggaccugaggg

SEQ ID NO: 196267 - RNA, 64 nt, hsa
cccgccucugguccuuuacaugugcauaaccacaugcacacacacucacgcaugagcaaacgug

SEQ ID NO: 196268 - RNA, 64 nt, hsa
gcugucuacccgugcacaggcacacgugcuggucugcacacaccugcacacaccugcacacucg

SEQ ID NO: 196269 - RNA, 64 nt, hsa
cgugcacaggcacacgugcuggucugcacacaccugcacacaccugcacacucgcuaugccagg

SEQ ID NO: 196270 - RNA, 64 nt, hsa
uauauagauaucuguauauacacacacacauaugugcacacacacacucucucuccauuaucga

SEQ ID NO: 196271 - RNA, 64 nt, hsa
aaagaaauauguuuuuguaagugguaggaacaugugcacacaauagaacaugaaauaaguuuuu

SEQ ID NO: 196272 - RNA, 64 nt, hsa
ccuucauacacacacgcacgcacgcacacaaacaugcacacacgcaugcacacacacaaagccu

SEQ ID NO: 196273 - RNA, 64 nt, hsa
cacgcacgcacgcacacaaacaugcacacacgcaugcacacacacaaagccuuaagcagaagaa

SEQ ID NO: 196274 - RNA, 64 nt, hsa
cuccuagcccugguugcuucugauacacagccacugcacacacacacucacacucacacucccu

SEQ ID NO: 196275 - RNA, 64 nt, hsa
cuuacucccucguacaugcacaaauacacacucaugcacacacacacucacacacaugcauaca

SEQ ID NO: 196276 - RNA, 64 nt, hsa
cacgcucacucauagccauguccacaugggggcuugcacacaggaucacucacauauguacaug

SEQ ID NO: 196277 - RNA, 64 nt, hsa
auguacauguacccaccacaaacgugcaagcuccugcacacaugcaugcacacaaacguguaca

SEQ ID NO: 196278 - RNA, 64 nt, hsa
ccaccacaaacgugcaagcuccugcacacaugcaugcacacaaacguguacacaagugugagcu

SEQ ID NO: 196279 - RNA, 64 nt, hsa
uguaugcacagcagagagacguaugagcuucuacugcacacaugcacacacacacgcacacgua

SEQ ID NO: 196280 - RNA, 64 nt, hsa
cagcagagagacguaugagcuucuacugcacacaugcacacacacacgcacacguacauucacu

SEQ ID NO: 196281 - RNA, 64 nt, hsa
accacaaaugaguucccagacguguaaacacacgugcacacaucguacacaugugagcucccac

SEQ ID NO: 196282 - RNA, 64 nt, hsa
acacaccccaaacacgcacaggcuccuacacacaugcacacacguguacaccacaaacgagcuc

SEQ ID NO: 196283 - RNA, 64 nt, hsa
caugcgcaggcuccugcaggcgugaauacacacaugcacacacauauacacacaugugccacaa

SEQ ID NO: 196284 - RNA, 64 nt, hsa
ugcuggagacaguagaggcaugaacacacauggaugcacacacacacacgccaaugcacacaca

SEQ ID NO: 196285 - RNA, 64 nt, hsa
ugaacacacauggaugcacacacacacacgccaaugcacacacacagagauaugcacacacacg

SEQ ID NO: 196286 - RNA, 64 nt, hsa
cacacacacacgccaaugcacacacacagagauaugcacacacacggaugcacacacagauggu

SEQ ID NO: 196287 - RNA, 64 nt, hsa
aaugcacacacacagagauaugcacacacacggaugcacacacagauggucacacagagauacg

SEQ ID NO: 196288 - RNA, 64 nt, hsa
cgcaaacacaccgaugcacacgcacauagagauaugcacacacagaugcacacacagauauaca

SEQ ID NO: 196289 - RNA, 64 nt, hsa
gaugcacacgcacauagagauaugcacacacagaugcacacacagauauacacauggaugcacg

SEQ ID NO: 196290 - RNA, 64 nt, hsa
cgcacacaucagugcacacggaugcacagagauaugcacacaccgaugugcgcacacacagaua

SEQ ID NO: 196291 - RNA, 64 nt, hsa
gauaugcacacaccgaugugcgcacacacagauaugcacacacauggaugagcacacacacacc

SEQ ID NO: 196292 - RNA, 64 nt, hsa
ccaaugcgcacacacaccgauguacacacacagaugcacacacagaugcacacacaccgaugcu

SEQ ID NO: 196293 - RNA, 64 nt, hsa
cacaccgauguacacacacagaugcacacacagaugcacacacaccgaugcugacuccaugugu

SEQ ID NO: 196294 - RNA, 64 nt, hsa
acauuuuauaaacuaugcacaugcauuacacacaugcacacacauaugcacacacaugugcaaa

SEQ ID NO: 196295 - RNA, 64 nt, hsa
cuaugcacaugcauuacacacaugcacacacauaugcacacacaugugcaaacauagccacuuu

SEQ ID NO: 196296 - RNA, 64 nt, hsa
cauauguguaugcauguauacgcccauacagacaugcacacacagacuccuacuccauuagcua

SEQ ID NO: 196297 - RNA, 64 nt, hsa
ggaaagcaaucauugguguguauguguaugugcaugcacacacgugcauauacacauuugugua

SEQ ID NO: 196298 - RNA, 64 nt, hsa
cgacucccuggcuuuggcauucagugagacgcccugcacacacagaaagccaaagcgaucggug

SEQ ID NO: 196299 - RNA, 64 nt, hsa
gcgagaacccucugggaccuuccgcggcccucucugcacacauccucaagugaccccgcacggc

SEQ ID NO: 196300 - RNA, 64 nt, hsa
ucaugcacacaacccaguguacacaccaccuacgugcacacagcauccuuccacacuguguaug

SEQ ID NO: 196301 - RNA, 64 nt, hsa
uguguugugugcucacgugccacacagugucucaugcacacaacccaguguacacaccaccuac

SEQ ID NO: 196302 - RNA, 64 nt, hsa
cacacacauccaccccagggccaagagaaaggccugcacacaagcccacagcacagcucccugc

SEQ ID NO: 196303 - RNA, 64 nt, hsa
gacacccgugagcgccugugcacacacacacacaugcacacacacgcgcgcgcacacacacaca

SEQ ID NO: 196304 - RNA, 64 nt, hsa
caccuaccacucacaugacacccgugagcgccugugcacacacacacacaugcacacacacgcg

SEQ ID NO: 196305 - RNA, 64 nt, hsa
gcuggcccggaacagccccugcaacuguggggccugcacacagcccuuccacaguuggcacugc

SEQ ID NO: 196306 - RNA, 64 nt, hsa
aaaaaagcagcuaaaaaagaguggaccaaaacacugcacacagugaaguguuccaguuuccacu

SEQ ID NO: 196307 - RNA, 64 nt, hsa
uuagguucuggugaagggagacaaucagugcacaugcacacaccccacacgcauacacacauga

SEQ ID NO: 196308 - RNA, 64 nt, hsa
cccacacgcauacacacaugaacacaugcacaugugcacacacaaguaagauggcuucagagag

SEQ ID NO: 196309 - RNA, 64 nt, hsa
uuugccucugcacgugcacacaccugcacaccccugcacacaccugcacaccgucccucucccc

SEQ ID NO: 196310 - RNA, 64 nt, hsa
caggcuuccugcccuagcaguuugccucugcacgugcacacaccugcacaccccugcacacacc

SEQ ID NO: 196311 - RNA, 64 nt, hsa
ggacacgcugggggagggcuccucccaugccuccugcacacagccgucugagcagggcaggugc

SEQ ID NO: 196312 - RNA, 64 nt, hsa
agcacacacaagugcacagagcacacugcacacaugcacacacacacgcgugcaugcacacucc

SEQ ID NO: 196313 - RNA, 64 nt, hsa
gaccacacagcacacacaagugcacagagcacacugcacacaugcacacacacacgcgugcaug

SEQ ID NO: 196314 - RNA, 64 nt, hsa
augcacacacaaagugcauaggccacacagcacaugcacacaggugcacagaccacacagcaca

SEQ ID NO: 196315 - RNA, 64 nt, hsa
cacaagugcacagaccacacacagcacuaacacaugcacacacaaagugcauaggccacacagc

SEQ ID NO: 196316 - RNA, 64 nt, hsa
acgcuuacauguacacgugcacagaucacacacaugcacacacguguagcucacacacaguaua

SEQ ID NO: 196317 - RNA, 64 nt, hsa
cgcauacaggcguacacaugcacgcuugcacacaugcacacagaccacauagcacacaugugca

SEQ ID NO: 196318 - RNA, 64 nt, hsa
uacauguccgcauacaggcguacacaugcacgcuugcacacaugcacacagaccacauagcaca

SEQ ID NO: 196319 - RNA, 64 nt, hsa
cggauagauugcuagguagauagacacacacacaugcacacacacacaucuggagauggcaaaa

SEQ ID NO: 196320 - RNA, 64 nt, hsa
ccagugcagggucugugcaccuucccugcuggccugcacacagcugcucagcaccacuuucauu

SEQ ID NO: 196321 - RNA, 64 nt, hsa
aguccuauccgaucugaaaacacacauacacaaaugcacacacaugcacacacacauuuaaggg

SEQ ID NO: 196322 - RNA, 64 nt, hsa
gaucugaaaacacacauacacaaaugcacacacaugcacacacacauuuaagggacauagcagu

SEQ ID NO: 196323 - RNA, 64 nt, hsa
ccgggucgugucuuuuaaaaacuccuguuuucacaccuuacaaagccagcucugagcagacagg

SEQ ID NO: 196324 - RNA, 64 nt, hsa
cgggccagggcguggcuuggcauugaccuucaugaccuuacauagcuuuagagaagccauaacg

SEQ ID NO: 196325 - RNA, 64 nt, hsa
uugcaugucaucauagacuucauacuggagagaaaccuuacaaaugugaagcaugugacaaagu

SEQ ID NO: 196326 - RNA, 64 nt, hsa
uuaaaagacauaggagaauucauacuggagagaaaccuuacaaguguaaugaguguggcaaagc

SEQ ID NO: 196327 - RNA, 64 nt, hsa
uugcaguucaucagugaacucauacuggagagaaaccuuacaaaugucaugacuguggcaaggu

SEQ ID NO: 196328 - RNA, 64 nt, hsa
uugcaggucaucggugaacucauacuggagagaaaccuuacaaaugucaugacugugccaaggu

SEQ ID NO: 196329 - RNA, 64 nt, hsa
uggaacaacauacuggacuucacacuggagagaaaccuuacaaguguaaugaguguggcaaagc

SEQ ID NO: 196330 - RNA, 64 nt, hsa
uggcacaccauacuagaauucacacuggagagaaaccuuacaagugcaaugaguguggcaaagc

SEQ ID NO: 196331 - RNA, 64 nt, hsa
uggcaaaacauauuagaauucaaacuggagagaaaccuuacaaaugugaugaguguggcaacac

SEQ ID NO: 196332 - RNA, 64 nt, hsa
uggcaccccauacuagaauucacacuggagagaaaccuuacaagugcaaugaguguggcaaacc

SEQ ID NO: 196333 - RNA, 64 nt, hsa
aaaauucacaccuuguaauucauaguggagagaaaccuuacaagcacaaugaaugugacauggu

SEQ ID NO: 196334 - RNA, 64 nt, hsa
uugcacaucaccauagacuucauacuggagagaaaccuuacaaaugggaggaaugugacaaaag

SEQ ID NO: 196335 - RNA, 64 nt, hsa
cuguaagucauaaggcaauucauacuggagagaaaccuuacaagcauaaugaauguggcaaggu

SEQ ID NO: 196336 - RNA, 64 nt, hsa
cuccaucuccaaaaaaaaaaaaaaaaaaaaaguaaccuuacaaaggagugcggccaguuuuuca

SEQ ID NO: 196337 - RNA, 52 nt, hsa
gaagaauucauaguggauagaaaccuuacaaaggacgccgggcgugguggcu

SEQ ID NO: 196338 - RNA, 64 nt, hsa; identical to SEQ ID NO: 21289

SEQ ID NO: 196339 - RNA, 64 nt, hsa; identical to SEQ ID NO: 21290

SEQ ID NO: 196340 - RNA, 64 nt, hsa; identical to SEQ ID NO: 21291

SEQ ID NO: 196341 - RNA, 64 nt, hsa; identical to SEQ ID NO: 21292

SEQ ID NO: 196342 - RNA, 64 nt, hsa; identical to SEQ ID NO: 21293

SEQ ID NO: 196343 - RNA, 64 nt, hsa; identical to SEQ ID NO: 21294

SEQ ID NO: 196344 - RNA, 64 nt, hsa; identical to SEQ ID NO: 21295

SEQ ID NO: 196345 - RNA, 64 nt, hsa; identical to SEQ ID NO: 21296

SEQ ID NO: 196346 - RNA, 64 nt, hsa; identical to SEQ ID NO: 21297

SEQ ID NO: 196347 - RNA, 64 nt, hsa; identical to SEQ ID NO: 21298

SEQ ID NO: 196348 - RNA, 64 nt, hsa; identical to SEQ ID NO: 21299

SEQ ID NO: 196349 - RNA, 64 nt, hsa; identical to SEQ ID NO: 21300

SEQ ID NO: 196350 - RNA, 64 nt, hsa; identical to SEQ ID NO: 21301

SEQ ID NO: 196351 - RNA, 64 nt, hsa; identical to SEQ ID NO: 21302

SEQ ID NO: 196352 - RNA, 64 nt, hsa; identical to SEQ ID NO: 21303

SEQ ID NO: 196353 - RNA, 64 nt, hsa; identical to SEQ ID NO: 85822

SEQ ID NO: 196354 - RNA, 64 nt, hsa; identical to SEQ ID NO: 85823

SEQ ID NO: 196355 - RNA, 64 nt, hsa; identical to SEQ ID NO: 85824

SEQ ID NO: 196356 - RNA, 64 nt, hsa; identical to SEQ ID NO: 85825

SEQ ID NO: 196357 - RNA, 64 nt, hsa; identical to SEQ ID NO: 85826

SEQ ID NO: 196358 - RNA, 64 nt, hsa; identical to SEQ ID NO: 85827

SEQ ID NO: 196359 - RNA, 64 nt, hsa; identical to SEQ ID NO: 85828

SEQ ID NO: 196360 - RNA, 64 nt, hsa; identical to SEQ ID NO: 85829

SEQ ID NO: 196361 - RNA, 64 nt, hsa; identical to SEQ ID NO: 85830

SEQ ID NO: 196362 - RNA, 64 nt, hsa; identical to SEQ ID NO: 85831

SEQ ID NO: 196363 - RNA, 64 nt, hsa; identical to SEQ ID NO: 85832

SEQ ID NO: 196364 - RNA, 64 nt, hsa; identical to SEQ ID NO: 85833

SEQ ID NO: 196365 - RNA, 64 nt, hsa; identical to SEQ ID NO: 85834

SEQ ID NO: 196366 - RNA, 64 nt, hsa; identical to SEQ ID NO: 85835

SEQ ID NO: 196367 - RNA, 64 nt, hsa; identical to SEQ ID NO: 85836

SEQ ID NO: 196368 - RNA, 64 nt, hsa; identical to SEQ ID NO: 85837

SEQ ID NO: 196369 - RNA, 64 nt, hsa; identical to SEQ ID NO: 85838

SEQ ID NO: 196370 - RNA, 64 nt, hsa; identical to SEQ ID NO: 85839

SEQ ID NO: 196371 - RNA, 64 nt, hsa; identical to SEQ ID NO: 85840

SEQ ID NO: 196372 - RNA, 64 nt, hsa; identical to SEQ ID NO: 85841

SEQ ID NO: 196373 - RNA, 64 nt, hsa; identical to SEQ ID NO: 85842

SEQ ID NO: 196374 - RNA, 64 nt, hsa; identical to SEQ ID NO: 85843

SEQ ID NO: 196375 - RNA, 64 nt, hsa; identical to SEQ ID NO: 85844

SEQ ID NO: 196376 - RNA, 64 nt, hsa; identical to SEQ ID NO: 85845

SEQ ID NO: 196377 - RNA, 64 nt, hsa; identical to SEQ ID NO: 85846

SEQ ID NO: 196378 - RNA, 64 nt, hsa; identical to SEQ ID NO: 85847

SEQ ID NO: 196379 - RNA, 64 nt, hsa; identical to SEQ ID NO: 85848

SEQ ID NO: 196380 - RNA, 64 nt, hsa; identical to SEQ ID NO: 85849

SEQ ID NO: 196381 - RNA, 64 nt, hsa; identical to SEQ ID NO: 85850

SEQ ID NO: 196382 - RNA, 64 nt, hsa; identical to SEQ ID NO: 85851

SEQ ID NO: 196383 - RNA, 64 nt, hsa; identical to SEQ ID NO: 85852

SEQ ID NO: 196384 - RNA, 64 nt, hsa; identical to SEQ ID NO: 85853

SEQ ID NO: 196385 - RNA, 64 nt, hsa; identical to SEQ ID NO: 85854

SEQ ID NO: 196386 - RNA, 64 nt, hsa; identical to SEQ ID NO: 85855

SEQ ID NO: 196387 - RNA, 64 nt, hsa; identical to SEQ ID NO: 85856

SEQ ID NO: 196388 - RNA, 64 nt, hsa; identical to SEQ ID NO: 85857

SEQ ID NO: 196389 - RNA, 64 nt, hsa; identical to SEQ ID NO: 85858

SEQ ID NO: 196390 - RNA, 64 nt, hsa; identical to SEQ ID NO: 106200

SEQ ID NO: 196391 - RNA, 64 nt, hsa; identical to SEQ ID NO: 106201

SEQ ID NO: 196392 - RNA, 64 nt, hsa; identical to SEQ ID NO: 106202

SEQ ID NO: 196393 - RNA, 64 nt, hsa; identical to SEQ ID NO: 106203

SEQ ID NO: 196394 - RNA, 64 nt, hsa; identical to SEQ ID NO: 106204

SEQ ID NO: 196395 - RNA, 64 nt, hsa; identical to SEQ ID NO: 106205

SEQ ID NO: 196396 - RNA, 64 nt, hsa; identical to SEQ ID NO: 106206

SEQ ID NO: 196397 - RNA, 64 nt, hsa; identical to SEQ ID NO: 106207

SEQ ID NO: 196398 - RNA, 64 nt, hsa
gcucagagaaggguuuuucuuuuuugaccuuucuucucucaacaggaaccugccugaggacacc

SEQ ID NO: 196399 - RNA, 64 nt, hsa
gaucucagccccaggcugguuguuucuacaaaucucucucaaauguauuauuuuggugacaaaa

SEQ ID NO: 196400 - RNA, 64 nt, hsa
auuauuaaauuuauaucccuaaaauuuuuagaaaucucucaaaaucuuuccaaauguucuggua

SEQ ID NO: 196401 - RNA, 64 nt, hsa
guguacauuaaaucuagaaaccauuaguuugagaucucucaaaaauaaaaauaaaaauugcuuu

SEQ ID NO: 196402 - RNA, 64 nt, hsa
uaauauggauuuguuacagccaagugccaaaugcucucucaaauugucagcaauuuaacuagac

SEQ ID NO: 196403 - RNA, 64 nt, hsa
augaaauccuuuuccuguucauacacuaaccaaaucucucaaaucuguuaucccaaucauuguu

SEQ ID NO: 196404 - RNA, 64 nt, hsa
gaguguuaagugucaaggugagaaagccucacauucucucaagacaguugcucuaggagcugag

SEQ ID NO: 196405 - RNA, 64 nt, hsa
cugguuuggaaguguggagauugcauuucuggcuucucucaauggcuuguguugaggacucugg

SEQ ID NO: 196406 - RNA, 64 nt, hsa
ccagcacuccagccugggugacagagcaagacucucucucaaaaaaaaaaaaaaaaaaaaauuc

SEQ ID NO: 196407 - RNA, 64 nt, hsa
cugauguuuacagaacccaaaugaugucuuccucucucucaaaauaaacuaaccuauucauauu

SEQ ID NO: 196408 - RNA, 64 nt, hsa
ggcuacuuaagucugcucugaugaaacccaauaaucucucaauaccuuccuauuucucaauagu

SEQ ID NO: 196409 - RNA, 64 nt, hsa
ccagguuacuuaaguccgcucugaugaaacccagucucucaauaccuuccuauuucucaauagu

SEQ ID NO: 196410 - RNA, 64 nt, hsa
uuaaucuaaaacacuacaagagaauuuaacaccaucucucaaaugcuuuuuuggagagcuuaau

SEQ ID NO: 196411 - RNA, 64 nt, hsa
uccgccccgaucucacgucagugagggucuccugucucucaaguguguuuccuuuggcuguucc

SEQ ID NO: 196412 - RNA, 64 nt, hsa; identical to SEQ ID NO: 193394

SEQ ID NO: 196413 - RNA, 64 nt, hsa; identical to SEQ ID NO: 193395

SEQ ID NO: 196414 - RNA, 64 nt, hsa; identical to SEQ ID NO: 193396

SEQ ID NO: 196415 - RNA, 64 nt, hsa; identical to SEQ ID NO: 193397

SEQ ID NO: 196416 - RNA, 64 nt, hsa; identical to SEQ ID NO: 193398

SEQ ID NO: 196417 - RNA, 64 nt, hsa; identical to SEQ ID NO: 193399

SEQ ID NO: 196418 - RNA, 64 nt, hsa; identical to SEQ ID NO: 193400

SEQ ID NO: 196419 - RNA, 64 nt, hsa; identical to SEQ ID NO: 193401

SEQ ID NO: 196420 - RNA, 64 nt, hsa; identical to SEQ ID NO: 193402

SEQ ID NO: 196421 - RNA, 64 nt, hsa; identical to SEQ ID NO: 193403

SEQ ID NO: 196422 - RNA, 64 nt, hsa; identical to SEQ ID NO: 193404

SEQ ID NO: 196423 - RNA, 64 nt, hsa; identical to SEQ ID NO: 193405

SEQ ID NO: 196424 - RNA, 64 nt, hsa; identical to SEQ ID NO: 193406

SEQ ID NO: 196425 - RNA, 64 nt, hsa; identical to SEQ ID NO: 193407

SEQ ID NO: 196426 - RNA, 64 nt, hsa; identical to SEQ ID NO: 193408

SEQ ID NO: 196427 - RNA, 64 nt, hsa
aucuauauuuuaaacuagaaauuauauuagaacucaaauucaauguuauacauacuugguaaac

SEQ ID NO: 196428 - RNA, 64 nt, hsa
uaagcauuuuaagaaacauuuuuaaagugugcuacaaauucauuugguguacuaacaucaaaau

SEQ ID NO: 196429 - RNA, 64 nt, hsa
aagcuuaaucuccaauaaacaucuauguuaaauccaaauucagcauuugcuguuagcuauucag

SEQ ID NO: 196430 - RNA, 64 nt, hsa
caacuaacaacugacaaaucagaguuugccaguucaaauucagcauggcugcagcugauuaaga

SEQ ID NO: 196431 - RNA, 64 nt, hsa
guugugaaugaugcuuuuuuguauuuauuaauaucaaauucacuuaugaauaaacuugauaaug

SEQ ID NO: 196432 - RNA, 64 nt, hsa
cucagucugcauguaacuuuuaugauaguuauuccaaauucaagaagaagcaguauuaacauca

SEQ ID NO: 196433 - RNA, 64 nt, hsa
gcuuuuuaaaaucauauuuaccugugaaucaaaacaaauucaagaaugcaguauccgcgagccu

SEQ ID NO: 196434 - RNA, 64 nt, hsa
uuuagcugugcagaaggugaaauggaggaaaccacaaauucaugcaaaguccuuucccgaugcg

SEQ ID NO: 196435 - RNA, 64 nt, hsa
cucaugaauguaaugaagaugggaagauauuuaucaaauucaggcuucauucagcaucugagag

SEQ ID NO: 196436 - RNA, 64 nt, hsa
agccaucagucaaagaaacuaccuuguuuaguaucaaauucacgccaugcaaaaagauuauaaa

SEQ ID NO: 196437 - RNA, 64 nt, hsa
auggcugcgauuguuagcacuucaucuacacagucaaauucacaggacgcuaagauagacuucg

SEQ ID NO: 196438 - RNA, 64 nt, hsa
uguggaucaagaggaaacucugacaugaugauuccaaauucagaaagauuuccaucauuaucca

SEQ ID NO: 196439 - RNA, 64 nt, hsa
auggacauggucuuaaucaauggaguuaaauaaacaaauucagcaaguuauuaaaucugacaug

SEQ ID NO: 196440 - RNA, 64 nt, hsa
uucauguuugcuucauaaaugaagcagcuuuaaacaaauucauauucugucuggagugacagac

SEQ ID NO: 196441 - RNA, 64 nt, hsa
cugaaacuaauaauuaggcaaugucaagugaacacaaauucaggaugacagacugcaaaguaac

SEQ ID NO: 196442 - RNA, 57 nt, hsa
cuggagccagaacguggugaacacagucaaauucaguguacuugauaauaucaacug

SEQ ID NO: 196443 - RNA, 64 nt, hsa
agcugcagguggagcuggagcaagaauaccaagacaaauucaaaagacugccccucgagauuuu

SEQ ID NO: 196444 - RNA, 64 nt, hsa
cauguaugugagauuuuuguuuucuuuccaauagcaaauucaaagcaagcaacuugcaggcucc

SEQ ID NO: 196445 - RNA, 64 nt, hsa
caaugacccaaaucucuuccacaagacuuaaaaccaaauucagggacaaauggauagagaagaa

SEQ ID NO: 196446 - RNA, 64 nt, hsa
guugaaaugcuggucaccaaaaaaggaaacugagcaaauucauuucaacaacaucaaaacuuca

SEQ ID NO: 196447 - RNA, 64 nt, hsa
guaacugccauauuauauaacaaauuuacauucacaaauucaguauccuguuaagugucauauu

SEQ ID NO: 196448 - RNA, 64 nt, hsa
auauuccagaggugggaggugggaggggaagggagaaauccaaaacaaaguguucuugcucuga

SEQ ID NO: 196449 - RNA, 64 nt, hsa
cuucuauugcuacacaucuccuucuggcucaggugaaauccaugcccuucugcuuauagaccua

SEQ ID NO: 196450 - RNA, 64 nt, hsa
cuccucucccaagaaauccaggcuccucucccaagaaauccaggugcuuuccagacuccaaagg

SEQ ID NO: 196451 - RNA, 64 nt, hsa
acugauuggggcuuccacagcccuccucucccaagaaauccaggcuccucucccaagaaaucca

SEQ ID NO: 196452 - RNA, 64 nt, hsa
ggucccguuguguauaugcagauauuccaaaccugaaauccaaaacacuucuggucccuagcau

SEQ ID NO: 196453 - RNA, 64 nt, hsa
uacuacaaguugagcaucucuaauucaaaaaucugaaauccagaagcuucaaaaucugaaucuu

SEQ ID NO: 196454 - RNA, 64 nt, hsa
auuagaucucauaauuugacaaguuaaccuuuuagaaauccacauauaucucaaaucuggcuac

SEQ ID NO: 196455 - RNA, 64 nt, hsa
ccaaagacuauugcagggaggaacuuccagagaggaaauccaaugacaaugguacuggcauaca

SEQ ID NO: 196456 - RNA, 64 nt, hsa
uuagcuccccgcuccacaagacaccugugcuuuggaaauccaccaccaaucccgaucggcucuu

SEQ ID NO: 196457 - RNA, 64 nt, hsa
aggaaagaacuucagcugacuccacggggaucuggaaauccacgaccaaucccgaucggcucuu

SEQ ID NO: 196458 - RNA, 64 nt, hsa
uugagaacugugaaauguuuaggaacaaacuguugaaauccauuggaagggaaaaaagaaagug

SEQ ID NO: 196459 - RNA, 64 nt, hsa
auauuuagauuaauuuuuuuagucagaacuucaugaaauccacaccaaaggaaagguaaacuga

SEQ ID NO: 196460 - RNA, 64 nt, hsa
uucucagccucauuuggacuaaaaaaagaaagcagaaauccaugaacacauugcuucucggccu

SEQ ID NO: 196461 - RNA, 64 nt, hsa
uugcuucucggccuuuuggcuaagaucaaguguagaaauccaugaacacuaaaggacuucauug

SEQ ID NO: 196462 - RNA, 64 nt, hsa
uagacuagccaaaaaugccguggcaaagagcucagaaauccaauuuggauaccaaagguuucuc

SEQ ID NO: 196463 - RNA, 64 nt, hsa
agguggggaaggaggugaugaaacauuaguuugugaaauccaaggcccuggcuugcuuucuuuc

SEQ ID NO: 196464 - RNA, 64 nt, hsa
aagaaaaaaaaagcauucccaaucuugacacggugaaauccaggucucggguccgauuaauuua

SEQ ID NO: 196465 - RNA, 64 nt, hsa
uggggagacgguguugcagagacgcaagggagaagaaauccauaacacccccaccccaacaccc

SEQ ID NO: 196466 - RNA, 64 nt, hsa
gauggagaaaaaucugggacagugucuucucagaaaccaccagccuugacgguaaugaaacacu

SEQ ID NO: 196467 - RNA, 64 nt, hsa
gauggagaaauaucuaggaaagugucuucucagaaaccaccaaccuugaagguaaugaaacucc

SEQ ID NO: 196468 - RNA, 64 nt, hsa
ucagaaaccaccaaccuugaagugucuucugagaaaccaccaggcuugaagguaaugaaacugu

SEQ ID NO: 196469 - RNA, 64 nt, hsa
gauggagaaauaucuaggaaagugucuucucagaaaccaccagccuugaagguaaugaaacucc

SEQ ID NO: 196470 - RNA, 64 nt, hsa
gauggagaaaaaucuaggacagugucuucugagaaaccaccaggcuugaagguaaugaaacugu

SEQ ID NO: 196471 - RNA, 64 nt, hsa
ugaguaguaaucucacacuucauccuauagagucaaccaccacagauaggaauuccuuauucuu

SEQ ID NO: 196472 - RNA, 64 nt, hsa
cuuggccucccaaagugcugggauuacagacaugaaccaccacgccuggcuggaauacuuacuc

SEQ ID NO: 196473 - RNA, 64 nt, hsa
uacucuccauuccuuccuuccuccagcccccagcaaccaccaaucugcuuucugucucuaugga

SEQ ID NO: 196474 - RNA, 64 nt, hsa
ucagugccacuuaguauuguuaacaauguugcauaaccaccaccuuuauuuaaaguuccaaaaa

SEQ ID NO: 196475 - RNA, 64 nt, hsa
uguacaagguuuugaaaaaucuauacaccuguguaaccaccaccaccuguguaaccaccaccgc

SEQ ID NO: 196476 - RNA, 64 nt, hsa
aucuauacaccuguguaaccaccaccaccuguguaaccaccaccgccagaaccaaaaacguuuc

SEQ ID NO: 196477 - RNA, 64 nt, hsa
gcuauccgcaagcucaagagaucccagagauucuaaccaccaugccuacuuguuugcuugcuac

SEQ ID NO: 196478 - RNA, 64 nt, hsa
acagauggauucucuccaggccaugggauuugggaaccaccaugccaaucuacaggcacucauu

SEQ ID NO: 196479 - RNA, 64 nt, hsa
uccuaucaacccauggggcuagagacugccaugcaaccaccaccacgacagcccuuccuccauc

SEQ ID NO: 196480 - RNA, 64 nt, hsa
accuugggaagaggcaucagccaucuugcuugagaaccaccaagccaaaagcaaaagcuuuuau

SEQ ID NO: 196481 - RNA, 64 nt, hsa
ugcacuccagccugggcaacagagacccugucucaaccaccaccaccaccaccaccccuacuac

SEQ ID NO: 196482 - RNA, 64 nt, hsa
auaucacagacaccccucacacaaggaauauaaaaaccaccacccuccagccugggcaacguag

SEQ ID NO: 196483 - RNA, 64 nt, hsa
uucccagaaauucacgcuuaaacaaccaaccgguaaccaccacuuccccacaccgccgcccggu

SEQ ID NO: 196484 - RNA, 64 nt, hsa
uucugguugcuguuaguuucccugagguauuugcaaccaccauggcuggguaaccaccgaucag

SEQ ID NO: 196485 - RNA, 64 nt, hsa
cccacuggaggcgccgccccacccggcccacuggcagacacagacccaggcagcaccaggcccc

SEQ ID NO: 196486 - RNA, 64 nt, hsa
aggucccaggagcagacccugcccccagcccccacagacacaccccaaucugaaagccaugcgu

SEQ ID NO: 196487 - RNA, 64 nt, hsa
ugugcugugagccccccacucugccgugcucacacagacacacccagcugcacacaugaggcau

SEQ ID NO: 196488 - RNA, 64 nt, hsa
uauccccaccccuucccacggcgugucccacggccagacacaugcacacacaucacacccucaa

SEQ ID NO: 196489 - RNA, 64 nt, hsa
auacaucuuugaugugcgaaagugaguucaucuucagacacauuugguacauccagaaauagau

SEQ ID NO: 196490 - RNA, 64 nt, hsa
ccccacguguaucugaacauuaagcagauuggcucagacacaaugaaaaggauaauccaaugua

SEQ ID NO: 196491 - RNA, 64 nt, hsa
gcaccccccugggccuggagggagagggccaauccagacacacucacacucucaucucuuuccu

SEQ ID NO: 196492 - RNA, 64 nt, hsa
uggccagaggaaagugagaggcguccauuuccagcagacacaauggaggcugacagaggcagga

SEQ ID NO: 196493 - RNA, 64 nt, hsa
cacaaggcuggcagagauuuauguaugacuugcacagacacaaaaauauacagacaaucaaaac

SEQ ID NO: 196494 - RNA, 64 nt, hsa
uauuagguaugucuugugcggucagucagcaucacagacacauagaugcucaccagccuggcuu

SEQ ID NO: 196495 - RNA, 64 nt, hsa
guguauauuggguucagacuugggggcagaaguucagacacaccgugcucaggagggacccaga

SEQ ID NO: 196496 - RNA, 64 nt, hsa
ucacagggaacacgggacagacgccggcgacgcgcagacacacggacacgcggaagccaagcac

SEQ ID NO: 196497 - RNA, 64 nt, hsa
cuugugggcacaugggcacauacagacucacauacagacacacacauauauguacagacaugua

SEQ ID NO: 196498 - RNA, 64 nt, hsa
agagagcugcuuaaacucacacaacaaugaacugcagacacagcuguucucucccucucuccuu

SEQ ID NO: 196499 - RNA, 64 nt, hsa
ugcaguaccagugagccaagccugaugggcagcacagacacagacacacaccgcagggcccgac

SEQ ID NO: 196500 - RNA, 64 nt, hsa
accagugagccaagccugaugggcagcacagacacagacacacaccgcagggcccgacccuccu

SEQ ID NO: 196501 - RNA, 64 nt, hsa
ggaggaguuuucuguguggucuccagcuccucuccagacacagagacaugggaguggggagcgg

SEQ ID NO: 196502 - RNA, 64 nt, hsa
caagcacacacacacaguccucacacacggaggccagacacaggccgugggacccaggcuccca

SEQ ID NO: 196503 - RNA, 64 nt, hsa
guugacauauggccaucccauuggccagaauccacagacacaccuaagccuguggcacugggac

SEQ ID NO: 196504 - RNA, 64 nt, hsa
uguggucugaaggaccccgaccggcauggccacucagacacaaguccacaccacagcacuaccg

SEQ ID NO: 196505 - RNA, 64 nt, hsa
ugugugugaggcauagccccuggacacacacacacagacacacacacugccuggaugcauguau

SEQ ID NO: 196506 - RNA, 64 nt, hsa
acacaugcagauaugcugccuggacacacacuuccagacacacgugcacaggcgcagauaugcu

SEQ ID NO: 196507 - RNA, 64 nt, hsa
uaaucccccgaccccccgcaucugccaaacugcacagacacacgcauuguaaggccgcuugugg

SEQ ID NO: 196508 - RNA, 64 nt, hsa
gagcagcaggcucccuggugugucccugccccagcagacacaggcugccagucccuccagccuc

SEQ ID NO: 196509 - RNA, 64 nt, hsa
cuucuuccaaugaugcuuacuacagaaagcaaaucagacacaauuagagaagccuuuuccauaa

SEQ ID NO: 196510 - RNA, 64 nt, hsa
cacacacacgcagacacacacacacacacaaaugcagacacacaacaucaagaaaacagcaagg

SEQ ID NO: 196511 - RNA, 64 nt, hsa
uucaggagaugaugugauggaacacacacacacgcagacacacacacacacacaaaugcagaca

SEQ ID NO: 196512 - RNA, 64 nt, hsa
cauguguccgcccccgauggaggacuccaggcagcagacacaugccagggccaugucagacaca

SEQ ID NO: 196513 - RNA, 64 nt, hsa
gacuccaggcagcagacacaugccagggccaugucagacacagauuggccagaaaccuuccugc

SEQ ID NO: 196514 - RNA, 64 nt, hsa
aagacccugcuuaaagggccccacaccacagacccagacacagccaagggagagugcucccgac

SEQ ID NO: 196515 - RNA, 64 nt, hsa
aaggaaaacuacagguccauaucccucauuaacacagacacaaaaauucuaaauaaaauuuuaa

SEQ ID NO: 196516 - RNA, 64 nt, hsa
agccauggugacacacagcagcacugcagauagccagacacauggcuauccuagagaggcuggc

SEQ ID NO: 196517 - RNA, 64 nt, hsa
uuaaauggugggaacccuccccaaaaccuuuccccagacacauucuccugugccccucagagag

SEQ ID NO: 196518 - RNA, 64 nt, hsa
caaaaggugacuuaauuaauaaagggcauuugggcagacacacuguguuggaccaacaaaguag

SEQ ID NO: 196519 - RNA, 64 nt, hsa
gccugaaaagaggggcugcccuccugcgccaaggcagacacaagcugcgggcugugcgguccua

SEQ ID NO: 196520 - RNA, 64 nt, hsa
agcugcagcucggaugguggauuuucagugccaacagacacaucugccgugaacucgcagaugc

SEQ ID NO: 196521 - RNA, 64 nt, hsa
caggauuugcucgaucucagcccagcaggccaggcagacacaccccgcugugccuuaggaaggu

SEQ ID NO: 196522 - RNA, 64 nt, hsa
gccccuguauucugcuggccagacacacauggcacagacacagcugaccauaacccaggaaucc

SEQ ID NO: 196523 - RNA, 64 nt, hsa
gaagagcagcccugagccccuguauucugcuggccagacacacauggcacagacacagcugacc

SEQ ID NO: 196524 - RNA, 64 nt, hsa
cccuccccgccacagagacacaccauuacauacacagacacacacagaaagacacacacagaca

SEQ ID NO: 196525 - RNA, 64 nt, hsa
caccauuacacacacauacacagaaagacacacacagacacacaaucacacgcagccccucccc

SEQ ID NO: 196526 - RNA, 64 nt, hsa
caccauuacauacacagacacacacagaaagacacagacacaaaaucacacacacacccucccc

SEQ ID NO: 196527 - RNA, 64 nt, hsa
cacccuccccgccacagagacaccauuacauacacagacacacacagaaagacacagacacaaa

SEQ ID NO: 196528 - RNA, 64 nt, hsa
auuacauacacagacacacacagaaagacacacacagacacaaaaucacacacacacccucccc

SEQ ID NO: 196529 - RNA, 64 nt, hsa
cccccuccccaccacagagacaccauuacauacacagacacacacagaaagacacacacagaca

SEQ ID NO: 196530 - RNA, 64 nt, hsa
aacacacacacauacacaccccugaacacacacacagacacacauacacccaugaugugagcaa

SEQ ID NO: 196531 - RNA, 64 nt, hsa
ggcccucuccacaugcacacccugaaaacacacacagacacacaacacacacacauacacaccc

SEQ ID NO: 196532 - RNA, 64 nt, hsa
auaugaaaaucucuuaacacccacccuacauacacagacacacacacacacacacacacacaca

SEQ ID NO: 196533 - RNA, 64 nt, hsa
aaguccccccaguuaugccuuccaagaggaacuucagacacaaaaguccacugaugcaaauugg

SEQ ID NO: 196534 - RNA, 64 nt, hsa
agcuccuugcagauguagcccuugcccaucuucacagacacauacacccaucuuggcacccuga

SEQ ID NO: 196535 - RNA, 64 nt, hsa
cuuccagcagaguccugccuccucccaauccccacagacacacacauugauccuccuccucagc

SEQ ID NO: 196536 - RNA, 64 nt, hsa
aguuuuuauaccuguacacacacagacacacaagcagacacacacauauauacauacgcaauug

SEQ ID NO: 196537 - RNA, 64 nt, hsa
cucugccugucaaguuuuuauaccuguacacacacagacacacaagcagacacacacauauaua

SEQ ID NO: 196538 - RNA, 64 nt, hsa
auuucuggcugggucaccagaaauaucgcugaugcagacacagauuauguuccugcuguauuuc

SEQ ID NO: 196539 - RNA, 64 nt, hsa
uacaaauacugcagaaaugacaccaauaauggggcagacacaacagcguggcuuagauugugcc

SEQ ID NO: 196540 - RNA, 64 nt, hsa
guuggcuucuuuggaccugcacuggaggauuucucagacacaugcaccagauucuggcucgaag

SEQ ID NO: 196541 - RNA, 64 nt, hsa
accaaguaauuacuggugucauuuuguuuuaugacagacacacguaucuaacaaacaaacaaac

SEQ ID NO: 196542 - RNA, 64 nt, hsa
uccuucagucuucuagaaacagagacaagaaaggcagacacaccgcggccaggcacccaugugg

SEQ ID NO: 196543 - RNA, 64 nt, hsa
uaccacagacuugcacugaagccggacagcugcccagacacaugggcuugugacauucgugaaa

SEQ ID NO: 196544 - RNA, 64 nt, hsa
gggccugacugaggcccacgcaggaaccgacacucagacacaaggcaaagagggccacaggacc

SEQ ID NO: 196545 - RNA, 64 nt, hsa
aaauacacacagagccaggagcagaagcaaagagcagacacacauacagccugaaacagaccug

SEQ ID NO: 196546 - RNA, 64 nt, hsa
gacacacauacagccugaaacagaccuggacagacagacacagccugaaacagacccggacaga

SEQ ID NO: 196547 - RNA, 64 nt, hsa
cagacagacacagccugaaacagacccggacagacagacacagccugaaacagacccagacaaa

SEQ ID NO: 196548 - RNA, 64 nt, hsa
cacagccugaaacagacccagacaaacagacagacagacacagccugaaacagacccagacaga

SEQ ID NO: 196549 - RNA, 64 nt, hsa
cccagacagacagacagacagccugaaacagacccagacacagccugaaacagauccggacaga

SEQ ID NO: 196550 - RNA, 64 nt, hsa
cagaaacagccugaaacagacccagacagacagacagacacagccugaaacagacccggacaga

SEQ ID NO: 196551 - RNA, 64 nt, hsa
cagacacagccugaaacagacccggacagacagacagacacagccugaaacagacccggacaga

SEQ ID NO: 196552 - RNA, 64 nt, hsa; identical to SEQ ID NO: 196551

SEQ ID NO: 196553 - RNA, 64 nt, hsa
cagacacagccugaaacagacccggacagacagacagacacagccugaaacagaccuagacaga

SEQ ID NO: 196554 - RNA, 64 nt, hsa
cagacagacacagccugaaacagaccuagacagacagacacagauugaaacagacccagacaaa

SEQ ID NO: 196555 - RNA, 64 nt, hsa
cagacacagauugaaacagacccagacaaacagacagacacagccugaaacagacccagacaca

SEQ ID NO: 196556 - RNA, 64 nt, hsa
cagacaaacagacagacacagccugaaacagacccagacacagccugaaacagacccggacaga

SEQ ID NO: 196557 - RNA, 64 nt, hsa
cagacacagccugaaacagacccggacagacagacagacacagccugaaacagacccagacaga

SEQ ID NO: 196558 - RNA, 64 nt, hsa
cagacacagccugaaacagacccagacagacagacagacacagccugaaacagacccagacaga

SEQ ID NO: 196559 - RNA, 64 nt, hsa
cgcagccugaaagagacccagacagagagacaggcagacacagccuaaaacagaccuggacaga

SEQ ID NO: 196560 - RNA, 64 nt, hsa
ccucugaagacgaugggcagaggagugacagccgcagacacacgacagccggcagcaacuggaa

SEQ ID NO: 196561 - RNA, 64 nt, hsa
cgcacacagcccacacagacaacacgcacccacacagacacagagggaagggguugggaugggg

SEQ ID NO: 196562 - RNA, 64 nt, hsa
accacacacacacacacacacacacacacacacacagacacacagacacauacgcacacacgug

SEQ ID NO: 196563 - RNA, 64 nt, hsa
cacacacacacacacacacacacacacagacacacagacacauacgcacacacgugcacacaug

SEQ ID NO: 196564 - RNA, 64 nt, hsa
ucgcacagauuacuucagggcuggaaaagucacacagacacacaaaaugucacaauccuguccc

SEQ ID NO: 196565 - RNA, 64 nt, hsa
gccccgguccuggccccagcccccaccuccgccccagacacaccccccagucgagcccugcagc

SEQ ID NO: 196566 - RNA, 64 nt, hsa
cacacaaacacacacacacagacacacacacacacagacacaccaaguaccaguauaagcaucu

SEQ ID NO: 196567 - RNA, 64 nt, hsa
gcauuuacacaccagacacacaaacacacacacacagacacacacacacacagacacaccaagu

SEQ ID NO: 196568 - RNA, 64 nt, hsa
uuaauuuccgauuuuccccucugcauuuacacaccagacacacaaacacacacacacagacaca

SEQ ID NO: 196569 - RNA, 64 nt, hsa
ggucaccuauacaguguguuucccugugagcuagcagacacaaugaccaggaaaaaaccuauga

SEQ ID NO: 196570 - RNA, 64 nt, hsa
ugggugagccuuggagacaugugggaaacaccugcagacacaaaaugaguagucauccugucuc

SEQ ID NO: 196571 - RNA, 64 nt, hsa
acagguguccuuccaagagacagaagaggagacacagacacagagcaggaggacacguggagac

SEQ ID NO: 196572 - RNA, 64 nt, hsa
uccagugucccuaugagagacggaagaggagacacagacacaaagcaggaggccacauaaagac

SEQ ID NO: 196573 - RNA, 64 nt, hsa
aaugaguaguugcaauagagaugguaaagccuacaaagccuaauuauuuacugucugguuuuug

SEQ ID NO: 196574 - RNA, 64 nt, hsa
cugcuuugaaaugaguaguugcaauagagaugguaaagccuacaaagccuaauuauuuacuguc

SEQ ID NO: 196575 - RNA, 64 nt, hsa
uugaccaauaaauaaaaauaccacuuucuuuaaaaaagccuagggaauugaagcucuguacaua

SEQ ID NO: 196576 - RNA, 64 nt, hsa
acucugacaaaggcuuuuccuuauagaauaacccaaagccuaggugaggguugauauauaaugu

SEQ ID NO: 196577 - RNA, 64 nt, hsa; identical to SEQ ID NO: 161670

SEQ ID NO: 196578 - RNA, 64 nt, hsa; identical to SEQ ID NO: 161671

SEQ ID NO: 196579 - RNA, 64 nt, hsa; identical to SEQ ID NO: 161672

SEQ ID NO: 196580 - RNA, 64 nt, hsa; identical to SEQ ID NO: 161673

SEQ ID NO: 196581 - RNA, 64 nt, hsa; identical to SEQ ID NO: 161674

SEQ ID NO: 196582 - RNA, 64 nt, hsa; identical to SEQ ID NO: 161675

SEQ ID NO: 196583 - RNA, 64 nt, hsa; identical to SEQ ID NO: 161676

SEQ ID NO: 196584 - RNA, 64 nt, hsa; identical to SEQ ID NO: 161677

SEQ ID NO: 196585 - RNA, 64 nt, hsa; identical to SEQ ID NO: 161678

SEQ ID NO: 196586 - RNA, 64 nt, hsa; identical to SEQ ID NO: 161679

SEQ ID NO: 196587 - RNA, 64 nt, hsa; identical to SEQ ID NO: 161680

SEQ ID NO: 196588 - RNA, 64 nt, hsa; identical to SEQ ID NO: 161681

SEQ ID NO: 196589 - RNA, 64 nt, hsa; identical to SEQ ID NO: 161682

SEQ ID NO: 196590 - RNA, 64 nt, hsa; identical to SEQ ID NO: 161683

SEQ ID NO: 196591 - RNA, 64 nt, hsa; identical to SEQ ID NO: 161684

SEQ ID NO: 196592 - RNA, 64 nt, hsa; identical to SEQ ID NO: 161685

SEQ ID NO: 196593 - RNA, 64 nt, hsa; identical to SEQ ID NO: 161686

SEQ ID NO: 196594 - RNA, 64 nt, hsa; identical to SEQ ID NO: 161687

SEQ ID NO: 196595 - RNA, 64 nt, hsa; identical to SEQ ID NO: 161688

SEQ ID NO: 196596 - RNA, 64 nt, hsa; identical to SEQ ID NO: 161689

SEQ ID NO: 196597 - RNA, 64 nt, hsa; identical to SEQ ID NO: 161690

SEQ ID NO: 196598 - RNA, 64 nt, hsa; identical to SEQ ID NO: 161691

SEQ ID NO: 196599 - RNA, 64 nt, hsa; identical to SEQ ID NO: 161692

SEQ ID NO: 196600 - RNA, 64 nt, hsa; identical to SEQ ID NO: 161693

SEQ ID NO: 196601 - RNA, 64 nt, hsa; identical to SEQ ID NO: 161694

SEQ ID NO: 196602 - RNA, 64 nt, hsa; identical to SEQ ID NO: 161695

SEQ ID NO: 196603 - RNA, 64 nt, hsa; identical to SEQ ID NO: 161696

SEQ ID NO: 196604 - RNA, 64 nt, hsa; identical to SEQ ID NO: 161697

SEQ ID NO: 196605 - RNA, 64 nt, hsa; identical to SEQ ID NO: 161698

SEQ ID NO: 196606 - RNA, 64 nt, hsa; identical to SEQ ID NO: 161699

SEQ ID NO: 196607 - RNA, 64 nt, hsa; identical to SEQ ID NO: 161700

SEQ ID NO: 196608 - RNA, 64 nt, hsa; identical to SEQ ID NO: 161701

SEQ ID NO: 196609 - RNA, 64 nt, hsa; identical to SEQ ID NO: 161702

SEQ ID NO: 196610 - RNA, 64 nt, hsa; identical to SEQ ID NO: 161703

SEQ ID NO: 196611 - RNA, 64 nt, hsa; identical to SEQ ID NO: 161704

SEQ ID NO: 196612 - RNA, 64 nt, hsa; identical to SEQ ID NO: 161705

SEQ ID NO: 196613 - RNA, 64 nt, hsa; identical to SEQ ID NO: 161706

SEQ ID NO: 196614 - RNA, 64 nt, hsa; identical to SEQ ID NO: 161707

SEQ ID NO: 196615 - RNA, 64 nt, hsa; identical to SEQ ID NO: 161708

SEQ ID NO: 196616 - RNA, 64 nt, hsa; identical to SEQ ID NO: 161709

SEQ ID NO: 196617 - RNA, 64 nt, hsa; identical to SEQ ID NO: 87177

SEQ ID NO: 196618 - RNA, 64 nt, hsa; identical to SEQ ID NO: 87178

SEQ ID NO: 196619 - RNA, 64 nt, hsa; identical to SEQ ID NO: 87179

SEQ ID NO: 196620 - RNA, 64 nt, hsa; identical to SEQ ID NO: 87180

SEQ ID NO: 196621 - RNA, 64 nt, hsa; identical to SEQ ID NO: 87181

SEQ ID NO: 196622 - RNA, 64 nt, hsa; identical to SEQ ID NO: 87182

SEQ ID NO: 196623 - RNA, 64 nt, hsa; identical to SEQ ID NO: 87183

SEQ ID NO: 196624 - RNA, 64 nt, hsa; identical to SEQ ID NO: 87184

SEQ ID NO: 196625 - RNA, 64 nt, hsa; identical to SEQ ID NO: 87185

SEQ ID NO: 196626 - RNA, 64 nt, hsa; identical to SEQ ID NO: 87186

SEQ ID NO: 196627 - RNA, 64 nt, hsa; identical to SEQ ID NO: 87187

SEQ ID NO: 196628 - RNA, 64 nt, hsa; identical to SEQ ID NO: 87188

SEQ ID NO: 196629 - RNA, 64 nt, hsa; identical to SEQ ID NO: 87189

SEQ ID NO: 196630 - RNA, 64 nt, hsa; identical to SEQ ID NO: 87190

SEQ ID NO: 196631 - RNA, 64 nt, hsa; identical to SEQ ID NO: 87191

SEQ ID NO: 196632 - RNA, 64 nt, hsa; identical to SEQ ID NO: 87192

SEQ ID NO: 196633 - RNA, 64 nt, hsa; identical to SEQ ID NO: 87193

SEQ ID NO: 196634 - RNA, 64 nt, hsa; identical to SEQ ID NO: 87194

SEQ ID NO: 196635 - RNA, 64 nt, hsa; identical to SEQ ID NO: 87195

SEQ ID NO: 196636 - RNA, 64 nt, hsa; identical to SEQ ID NO: 87196

SEQ ID NO: 196637 - RNA, 64 nt, hsa; identical to SEQ ID NO: 87197

SEQ ID NO: 196638 - RNA, 64 nt, hsa; identical to SEQ ID NO: 87198

SEQ ID NO: 196639 - RNA, 64 nt, hsa; identical to SEQ ID NO: 87199

SEQ ID NO: 196640 - RNA, 64 nt, hsa; identical to SEQ ID NO: 87200

SEQ ID NO: 196641 - RNA, 64 nt, hsa; identical to SEQ ID NO: 87201

SEQ ID NO: 196642 - RNA, 64 nt, hsa; identical to SEQ ID NO: 87202

SEQ ID NO: 196643 - RNA, 64 nt, hsa; identical to SEQ ID NO: 87203

SEQ ID NO: 196644 - RNA, 64 nt, hsa; identical to SEQ ID NO: 87204

SEQ ID NO: 196645 - RNA, 64 nt, hsa; identical to SEQ ID NO: 87205

SEQ ID NO: 196646 - RNA, 64 nt, hsa; identical to SEQ ID NO: 87206

SEQ ID NO: 196647 - RNA, 64 nt, hsa; identical to SEQ ID NO: 87207

SEQ ID NO: 196648 - RNA, 64 nt, hsa; identical to SEQ ID NO: 87208

SEQ ID NO: 196649 - RNA, 64 nt, hsa; identical to SEQ ID NO: 87209

SEQ ID NO: 196650 - RNA, 64 nt, hsa; identical to SEQ ID NO: 87210

SEQ ID NO: 196651 - RNA, 64 nt, hsa; identical to SEQ ID NO: 87211

SEQ ID NO: 196652 - RNA, 64 nt, hsa; identical to SEQ ID NO: 87212

SEQ ID NO: 196653 - RNA, 64 nt, hsa; identical to SEQ ID NO: 87213

SEQ ID NO: 196654 - RNA, 64 nt, hsa; identical to SEQ ID NO: 87214

SEQ ID NO: 196655 - RNA, 64 nt, hsa; identical to SEQ ID NO: 87215

SEQ ID NO: 196656 - RNA, 64 nt, hsa; identical to SEQ ID NO: 87216

SEQ ID NO: 196657 - RNA, 64 nt, hsa; identical to SEQ ID NO: 87217

SEQ ID NO: 196658 - RNA, 64 nt, hsa; identical to SEQ ID NO: 87218

SEQ ID NO: 196659 - RNA, 64 nt, hsa; identical to SEQ ID NO: 87219

SEQ ID NO: 196660 - RNA, 64 nt, hsa; identical to SEQ ID NO: 87220

SEQ ID NO: 196661 - RNA, 64 nt, hsa; identical to SEQ ID NO: 87221

SEQ ID NO: 196662 - RNA, 64 nt, hsa; identical to SEQ ID NO: 87222

SEQ ID NO: 196663 - RNA, 64 nt, hsa; identical to SEQ ID NO: 87223

SEQ ID NO: 196664 - RNA, 64 nt, hsa; identical to SEQ ID NO: 87224

SEQ ID NO: 196665 - RNA, 64 nt, hsa; identical to SEQ ID NO: 87225

SEQ ID NO: 196666 - RNA, 64 nt, hsa; identical to SEQ ID NO: 87226

SEQ ID NO: 196667 - RNA, 64 nt, hsa; identical to SEQ ID NO: 87227

SEQ ID NO: 196668 - RNA, 64 nt, hsa; identical to SEQ ID NO: 87228

SEQ ID NO: 196669 - RNA, 64 nt, hsa; identical to SEQ ID NO: 87229

SEQ ID NO: 196670 - RNA, 64 nt, hsa; identical to SEQ ID NO: 87230

SEQ ID NO: 196671 - RNA, 64 nt, hsa; identical to SEQ ID NO: 87231

SEQ ID NO: 196672 - RNA, 64 nt, hsa; identical to SEQ ID NO: 87232

SEQ ID NO: 196673 - RNA, 64 nt, hsa; identical to SEQ ID NO: 87233

SEQ ID NO: 196674 - RNA, 64 nt, hsa; identical to SEQ ID NO: 87234

SEQ ID NO: 196675 - RNA, 64 nt, hsa; identical to SEQ ID NO: 87235

SEQ ID NO: 196676 - RNA, 64 nt, hsa; identical to SEQ ID NO: 87236

SEQ ID NO: 196677 - RNA, 64 nt, hsa; identical to SEQ ID NO: 87237

SEQ ID NO: 196678 - RNA, 64 nt, hsa; identical to SEQ ID NO: 87238

SEQ ID NO: 196679 - RNA, 62 nt, hsa; identical to SEQ ID NO: 87239

SEQ ID NO: 196680 - RNA, 64 nt, hsa; identical to SEQ ID NO: 87240

SEQ ID NO: 196681 - RNA, 64 nt, hsa; identical to SEQ ID NO: 87241

SEQ ID NO: 196682 - RNA, 64 nt, hsa; identical to SEQ ID NO: 87242

SEQ ID NO: 196683 - RNA, 64 nt, hsa; identical to SEQ ID NO: 87243

SEQ ID NO: 196684 - RNA, 64 nt, hsa; identical to SEQ ID NO: 87244

SEQ ID NO: 196685 - RNA, 64 nt, hsa; identical to SEQ ID NO: 87245

SEQ ID NO: 196686 - RNA, 64 nt, hsa; identical to SEQ ID NO: 87246

SEQ ID NO: 196687 - RNA, 64 nt, hsa; identical to SEQ ID NO: 87247

SEQ ID NO: 196688 - RNA, 64 nt, hsa; identical to SEQ ID NO: 87248

SEQ ID NO: 196689 - RNA, 64 nt, hsa; identical to SEQ ID NO: 87249

SEQ ID NO: 196690 - RNA, 64 nt, hsa; identical to SEQ ID NO: 87250

SEQ ID NO: 196691 - RNA, 64 nt, hsa; identical to SEQ ID NO: 87251

SEQ ID NO: 196692 - RNA, 64 nt, hsa; identical to SEQ ID NO: 87252

SEQ ID NO: 196693 - RNA, 64 nt, hsa; identical to SEQ ID NO: 87253

SEQ ID NO: 196694 - RNA, 64 nt, hsa; identical to SEQ ID NO: 87254

SEQ ID NO: 196695 - RNA, 64 nt, hsa; identical to SEQ ID NO: 87255

SEQ ID NO: 196696 - RNA, 64 nt, hsa; identical to SEQ ID NO: 87256

SEQ ID NO: 196697 - RNA, 64 nt, hsa; identical to SEQ ID NO: 87257

SEQ ID NO: 196698 - RNA, 64 nt, hsa; identical to SEQ ID NO: 87258

SEQ ID NO: 196699 - RNA, 64 nt, hsa; identical to SEQ ID NO: 87259

SEQ ID NO: 196700 - RNA, 64 nt, hsa; identical to SEQ ID NO: 87260

SEQ ID NO: 196701 - RNA, 64 nt, hsa; identical to SEQ ID NO: 87261

SEQ ID NO: 196702 - RNA, 64 nt, hsa; identical to SEQ ID NO: 87262

SEQ ID NO: 196703 - RNA, 64 nt, hsa; identical to SEQ ID NO: 87263

SEQ ID NO: 196704 - RNA, 64 nt, hsa; identical to SEQ ID NO: 87264

SEQ ID NO: 196705 - RNA, 64 nt, hsa; identical to SEQ ID NO: 87265

SEQ ID NO: 196706 - RNA, 64 nt, hsa; identical to SEQ ID NO: 87266

SEQ ID NO: 196707 - RNA, 64 nt, hsa; identical to SEQ ID NO: 87267

SEQ ID NO: 196708 - RNA, 64 nt, hsa; identical to SEQ ID NO: 87268

SEQ ID NO: 196709 - RNA, 64 nt, hsa; identical to SEQ ID NO: 87269

SEQ ID NO: 196710 - RNA, 64 nt, hsa; identical to SEQ ID NO: 87270

SEQ ID NO: 196711 - RNA, 64 nt, hsa; identical to SEQ ID NO: 87271

SEQ ID NO: 196712 - RNA, 64 nt, hsa; identical to SEQ ID NO: 87272

SEQ ID NO: 196713 - RNA, 64 nt, hsa; identical to SEQ ID NO: 87273

SEQ ID NO: 196714 - RNA, 64 nt, hsa; identical to SEQ ID NO: 87274

SEQ ID NO: 196715 - RNA, 64 nt, hsa; identical to SEQ ID NO: 87275

SEQ ID NO: 196716 - RNA, 64 nt, hsa; identical to SEQ ID NO: 87276

SEQ ID NO: 196717 - RNA, 64 nt, hsa; identical to SEQ ID NO: 87277

SEQ ID NO: 196718 - RNA, 64 nt, hsa; identical to SEQ ID NO: 87278

SEQ ID NO: 196719 - RNA, 64 nt, hsa; identical to SEQ ID NO: 87279

SEQ ID NO: 196720 - RNA, 64 nt, hsa; identical to SEQ ID NO: 87280

SEQ ID NO: 196721 - RNA, 64 nt, hsa; identical to SEQ ID NO: 87281

SEQ ID NO: 196722 - RNA, 64 nt, hsa; identical to SEQ ID NO: 87282

SEQ ID NO: 196723 - RNA, 64 nt, hsa; identical to SEQ ID NO: 87283

SEQ ID NO: 196724 - RNA, 64 nt, hsa; identical to SEQ ID NO: 87284

SEQ ID NO: 196725 - RNA, 64 nt, hsa; identical to SEQ ID NO: 87285

SEQ ID NO: 196726 - RNA, 64 nt, hsa; identical to SEQ ID NO: 87286

SEQ ID NO: 196727 - RNA, 64 nt, hsa; identical to SEQ ID NO: 87287

SEQ ID NO: 196728 - RNA, 64 nt, hsa; identical to SEQ ID NO: 87288

SEQ ID NO: 196729 - RNA, 64 nt, hsa; identical to SEQ ID NO: 87289

SEQ ID NO: 196730 - RNA, 64 nt, hsa; identical to SEQ ID NO: 87290

SEQ ID NO: 196731 - RNA, 64 nt, hsa; identical to SEQ ID NO: 87291

SEQ ID NO: 196732 - RNA, 64 nt, hsa; identical to SEQ ID NO: 87292

SEQ ID NO: 196733 - RNA, 64 nt, hsa; identical to SEQ ID NO: 87293

SEQ ID NO: 196734 - RNA, 64 nt, hsa; identical to SEQ ID NO: 87294

SEQ ID NO: 196735 - RNA, 64 nt, hsa; identical to SEQ ID NO: 87295

SEQ ID NO: 196736 - RNA, 64 nt, hsa; identical to SEQ ID NO: 87296

SEQ ID NO: 196737 - RNA, 64 nt, hsa; identical to SEQ ID NO: 87297

SEQ ID NO: 196738 - RNA, 64 nt, hsa; identical to SEQ ID NO: 87298

SEQ ID NO: 196739 - RNA, 64 nt, hsa; identical to SEQ ID NO: 87299

SEQ ID NO: 196740 - RNA, 64 nt, hsa; identical to SEQ ID NO: 87300

SEQ ID NO: 196741 - RNA, 64 nt, hsa; identical to SEQ ID NO: 87301

SEQ ID NO: 196742 - RNA, 64 nt, hsa; identical to SEQ ID NO: 87302

SEQ ID NO: 196743 - RNA, 64 nt, hsa; identical to SEQ ID NO: 87303

SEQ ID NO: 196744 - RNA, 64 nt, hsa; identical to SEQ ID NO: 87304

SEQ ID NO: 196745 - RNA, 64 nt, hsa; identical to SEQ ID NO: 87305

SEQ ID NO: 196746 - RNA, 64 nt, hsa; identical to SEQ ID NO: 87306

SEQ ID NO: 196747 - RNA, 64 nt, hsa; identical to SEQ ID NO: 87307

SEQ ID NO: 196748 - RNA, 64 nt, hsa; identical to SEQ ID NO: 87308

SEQ ID NO: 196749 - RNA, 64 nt, hsa; identical to SEQ ID NO: 87309

SEQ ID NO: 196750 - RNA, 64 nt, hsa; identical to SEQ ID NO: 87310

SEQ ID NO: 196751 - RNA, 64 nt, hsa; identical to SEQ ID NO: 87311

SEQ ID NO: 196752 - RNA, 64 nt, hsa; identical to SEQ ID NO: 87312

SEQ ID NO: 196753 - RNA, 64 nt, hsa; identical to SEQ ID NO: 87313

SEQ ID NO: 196754 - RNA, 64 nt, hsa; identical to SEQ ID NO: 87314

SEQ ID NO: 196755 - RNA, 64 nt, hsa; identical to SEQ ID NO: 87315

SEQ ID NO: 196756 - RNA, 64 nt, hsa; identical to SEQ ID NO: 87316

SEQ ID NO: 196757 - RNA, 64 nt, hsa; identical to SEQ ID NO: 87317

SEQ ID NO: 196758 - RNA, 64 nt, hsa; identical to SEQ ID NO: 87318

SEQ ID NO: 196759 - RNA, 64 nt, hsa; identical to SEQ ID NO: 87319

SEQ ID NO: 196760 - RNA, 64 nt, hsa; identical to SEQ ID NO: 87320

SEQ ID NO: 196761 - RNA, 64 nt, hsa; identical to SEQ ID NO: 87321

SEQ ID NO: 196762 - RNA, 64 nt, hsa; identical to SEQ ID NO: 87322

SEQ ID NO: 196763 - RNA, 64 nt, hsa; identical to SEQ ID NO: 87323

SEQ ID NO: 196764 - RNA, 64 nt, hsa; identical to SEQ ID NO: 87324

SEQ ID NO: 196765 - RNA, 64 nt, hsa; identical to SEQ ID NO: 87325

SEQ ID NO: 196766 - RNA, 64 nt, hsa; identical to SEQ ID NO: 87326

SEQ ID NO: 196767 - RNA, 64 nt, hsa; identical to SEQ ID NO: 87327

SEQ ID NO: 196768 - RNA, 64 nt, hsa; identical to SEQ ID NO: 87328

SEQ ID NO: 196769 - RNA, 64 nt, hsa; identical to SEQ ID NO: 87329

SEQ ID NO: 196770 - RNA, 64 nt, hsa; identical to SEQ ID NO: 87330

SEQ ID NO: 196771 - RNA, 64 nt, hsa; identical to SEQ ID NO: 87331

SEQ ID NO: 196772 - RNA, 64 nt, hsa; identical to SEQ ID NO: 87332

SEQ ID NO: 196773 - RNA, 64 nt, hsa; identical to SEQ ID NO: 87333

SEQ ID NO: 196774 - RNA, 64 nt, hsa; identical to SEQ ID NO: 87334

SEQ ID NO: 196775 - RNA, 64 nt, hsa; identical to SEQ ID NO: 87335

SEQ ID NO: 196776 - RNA, 64 nt, hsa; identical to SEQ ID NO: 87336

SEQ ID NO: 196777 - RNA, 64 nt, hsa; identical to SEQ ID NO: 87337

SEQ ID NO: 196778 - RNA, 64 nt, hsa; identical to SEQ ID NO: 87338

SEQ ID NO: 196779 - RNA, 64 nt, hsa; identical to SEQ ID NO: 128854

SEQ ID NO: 196780 - RNA, 64 nt, hsa; identical to SEQ ID NO: 128855

SEQ ID NO: 196781 - RNA, 64 nt, hsa; identical to SEQ ID NO: 128856

SEQ ID NO: 196782 - RNA, 64 nt, hsa; identical to SEQ ID NO: 128857

SEQ ID NO: 196783 - RNA, 64 nt, hsa; identical to SEQ ID NO: 128858

SEQ ID NO: 196784 - RNA, 64 nt, hsa; identical to SEQ ID NO: 128859

SEQ ID NO: 196785 - RNA, 64 nt, hsa; identical to SEQ ID NO: 128860

SEQ ID NO: 196786 - RNA, 64 nt, hsa; identical to SEQ ID NO: 128861

SEQ ID NO: 196787 - RNA, 64 nt, hsa; identical to SEQ ID NO: 128862

SEQ ID NO: 196788 - RNA, 64 nt, hsa; identical to SEQ ID NO: 128863

SEQ ID NO: 196789 - RNA, 64 nt, hsa; identical to SEQ ID NO: 128864

SEQ ID NO: 196790 - RNA, 64 nt, hsa; identical to SEQ ID NO: 128865

SEQ ID NO: 196791 - RNA, 64 nt, hsa; identical to SEQ ID NO: 128866

SEQ ID NO: 196792 - RNA, 64 nt, hsa; identical to SEQ ID NO: 128867

SEQ ID NO: 196793 - RNA, 64 nt, hsa; identical to SEQ ID NO: 128868

SEQ ID NO: 196794 - RNA, 64 nt, hsa; identical to SEQ ID NO: 128869

SEQ ID NO: 196795 - RNA, 64 nt, hsa; identical to SEQ ID NO: 128870

SEQ ID NO: 196796 - RNA, 64 nt, hsa; identical to SEQ ID NO: 128871

SEQ ID NO: 196797 - RNA, 64 nt, hsa; identical to SEQ ID NO: 128872

SEQ ID NO: 196798 - RNA, 64 nt, hsa; identical to SEQ ID NO: 128873

SEQ ID NO: 196799 - RNA, 64 nt, hsa; identical to SEQ ID NO: 128874

SEQ ID NO: 196800 - RNA, 64 nt, hsa; identical to SEQ ID NO: 128875

SEQ ID NO: 196801 - RNA, 64 nt, hsa; identical to SEQ ID NO: 128876

SEQ ID NO: 196802 - RNA, 64 nt, hsa; identical to SEQ ID NO: 128877

SEQ ID NO: 196803 - RNA, 64 nt, hsa; identical to SEQ ID NO: 128878

SEQ ID NO: 196804 - RNA, 64 nt, hsa; identical to SEQ ID NO: 128879

SEQ ID NO: 196805 - RNA, 64 nt, hsa; identical to SEQ ID NO: 128880

SEQ ID NO: 196806 - RNA, 64 nt, hsa; identical to SEQ ID NO: 128881

SEQ ID NO: 196807 - RNA, 64 nt, hsa; identical to SEQ ID NO: 128882

SEQ ID NO: 196808 - RNA, 64 nt, hsa; identical to SEQ ID NO: 128883

SEQ ID NO: 196809 - RNA, 64 nt, hsa; identical to SEQ ID NO: 128884

SEQ ID NO: 196810 - RNA, 64 nt, hsa; identical to SEQ ID NO: 128885

SEQ ID NO: 196811 - RNA, 64 nt, hsa; identical to SEQ ID NO: 128886

SEQ ID NO: 196812 - RNA, 64 nt, hsa; identical to SEQ ID NO: 104452

SEQ ID NO: 196813 - RNA, 64 nt, hsa; identical to SEQ ID NO: 104453

SEQ ID NO: 196814 - RNA, 64 nt, hsa; identical to SEQ ID NO: 104454

SEQ ID NO: 196815 - RNA, 64 nt, hsa; identical to SEQ ID NO: 104455

SEQ ID NO: 196816 - RNA, 64 nt, hsa; identical to SEQ ID NO: 104456

SEQ ID NO: 196817 - RNA, 64 nt, hsa; identical to SEQ ID NO: 104457

SEQ ID NO: 196818 - RNA, 64 nt, hsa; identical to SEQ ID NO: 104458

SEQ ID NO: 196819 - RNA, 64 nt, hsa; identical to SEQ ID NO: 104459

SEQ ID NO: 196820 - RNA, 64 nt, hsa; identical to SEQ ID NO: 104460

SEQ ID NO: 196821 - RNA, 64 nt, hsa; identical to SEQ ID NO: 104461

SEQ ID NO: 196822 - RNA, 64 nt, hsa; identical to SEQ ID NO: 104462

SEQ ID NO: 196823 - RNA, 64 nt, hsa; identical to SEQ ID NO: 104463

SEQ ID NO: 196824 - RNA, 64 nt, hsa; identical to SEQ ID NO: 104464

SEQ ID NO: 196825 - RNA, 64 nt, hsa; identical to SEQ ID NO: 104465

SEQ ID NO: 196826 - RNA, 64 nt, hsa; identical to SEQ ID NO: 104466

SEQ ID NO: 196827 - RNA, 64 nt, hsa; identical to SEQ ID NO: 104467

SEQ ID NO: 196828 - RNA, 64 nt, hsa; identical to SEQ ID NO: 104468

SEQ ID NO: 196829 - RNA, 64 nt, hsa; identical to SEQ ID NO: 104469

SEQ ID NO: 196830 - RNA, 64 nt, hsa; identical to SEQ ID NO: 104470

SEQ ID NO: 196831 - RNA, 64 nt, hsa; identical to SEQ ID NO: 104471

SEQ ID NO: 196832 - RNA, 64 nt, hsa; identical to SEQ ID NO: 104472

SEQ ID NO: 196833 - RNA, 64 nt, hsa; identical to SEQ ID NO: 104473

SEQ ID NO: 196834 - RNA, 64 nt, hsa; identical to SEQ ID NO: 104474

SEQ ID NO: 196835 - RNA, 64 nt, hsa; identical to SEQ ID NO: 104475

SEQ ID NO: 196836 - RNA, 64 nt, hsa; identical to SEQ ID NO: 104476

SEQ ID NO: 196837 - RNA, 64 nt, hsa; identical to SEQ ID NO: 104477

SEQ ID NO: 196838 - RNA, 64 nt, hsa; identical to SEQ ID NO: 104478

SEQ ID NO: 196839 - RNA, 64 nt, hsa; identical to SEQ ID NO: 104479

SEQ ID NO: 196840 - RNA, 64 nt, hsa; identical to SEQ ID NO: 104480

SEQ ID NO: 196841 - RNA, 64 nt, hsa; identical to SEQ ID NO: 133463

SEQ ID NO: 196842 - RNA, 64 nt, hsa; identical to SEQ ID NO: 133464

SEQ ID NO: 196843 - RNA, 64 nt, hsa; identical to SEQ ID NO: 133465

SEQ ID NO: 196844 - RNA, 64 nt, hsa; identical to SEQ ID NO: 133466

SEQ ID NO: 196845 - RNA, 64 nt, hsa; identical to SEQ ID NO: 133467

SEQ ID NO: 196846 - RNA, 64 nt, hsa; identical to SEQ ID NO: 133468

SEQ ID NO: 196847 - RNA, 64 nt, hsa; identical to SEQ ID NO: 133469

SEQ ID NO: 196848 - RNA, 64 nt, hsa; identical to SEQ ID NO: 133470

SEQ ID NO: 196849 - RNA, 64 nt, hsa; identical to SEQ ID NO: 133471

SEQ ID NO: 196850 - RNA, 64 nt, hsa; identical to SEQ ID NO: 133472

SEQ ID NO: 196851 - RNA, 64 nt, hsa; identical to SEQ ID NO: 133473

SEQ ID NO: 196852 - RNA, 64 nt, hsa; identical to SEQ ID NO: 133474

SEQ ID NO: 196853 - RNA, 64 nt, hsa; identical to SEQ ID NO: 133475

SEQ ID NO: 196854 - RNA, 64 nt, hsa; identical to SEQ ID NO: 133476

SEQ ID NO: 196855 - RNA, 64 nt, hsa; identical to SEQ ID NO: 133477

SEQ ID NO: 196856 - RNA, 64 nt, hsa; identical to SEQ ID NO: 133478

SEQ ID NO: 196857 - RNA, 64 nt, hsa; identical to SEQ ID NO: 133479

SEQ ID NO: 196858 - RNA, 64 nt, hsa; identical to SEQ ID NO: 133480

SEQ ID NO: 196859 - RNA, 64 nt, hsa; identical to SEQ ID NO: 133481

SEQ ID NO: 196860 - RNA, 64 nt, hsa; identical to SEQ ID NO: 133482

SEQ ID NO: 196861 - RNA, 64 nt, hsa; identical to SEQ ID NO: 133483

SEQ ID NO: 196862 - RNA, 64 nt, hsa; identical to SEQ ID NO: 133484

SEQ ID NO: 196863 - RNA, 64 nt, hsa
guguauuucuccacagugcuugcuuugcccuguugguaaggauuuuaaauaaccaugcucaaaa

SEQ ID NO: 196864 - RNA, 64 nt, hsa
ucauuccauuuaauugggggaacaaaaggccucagguaaggaugaggaacucugaaaucagaug

SEQ ID NO: 196865 - RNA, 64 nt, hsa
ugaaaacuuuucaaacuuuucuaguuacaauccaauuuuucagauuugauaaugcuuuuccaaa

SEQ ID NO: 196866 - RNA, 64 nt, hsa
cacacaggcauacuccaaaugcuucuuccaguucauuuuucagccaucaguucaagagccaaug

SEQ ID NO: 196867 - RNA, 64 nt, hsa
agaguguauaaaauucugucuuucauuuccaaccauuuuucaagagaagcugcuacuaucuuga

SEQ ID NO: 196868 - RNA, 64 nt, hsa
guuccugguaaaacucuguuuucauuaauuuguuauuuuucaaaaaccgagccacaccuuugga

SEQ ID NO: 196869 - RNA, 64 nt, hsa
uguaguauuguuuaaacaucauuuguucuucaguauuuuucauuuggaaguccaauagggcaaa

SEQ ID NO: 196870 - RNA, 64 nt, hsa
aaugcuauaugagaaacacuuuuagaauggauuuauuuuucauuuuugccaguuauuuuuauuu

SEQ ID NO: 196871 - RNA, 64 nt, hsa
ugcuguuuuaugcuaauucugcuuauuuuagaguauuuuucauuaaaaggugagcaaagugaaa

SEQ ID NO: 196872 - RNA, 64 nt, hsa
ucauguaacaaaauauuuuguagauuacauauugauuuuucaaaaauuaaaaauguauuucaaa

SEQ ID NO: 196873 - RNA, 64 nt, hsa
uagaucucaaaaccacuauuuuuauuauuucauuauuuuucagaggccuuaaaauucuggauaa

SEQ ID NO: 196874 - RNA, 64 nt, hsa
gguuuuauucuuuuauuuuacgaauaaaaaauguauuuuucaguauccuugagauuuagaacau

SEQ ID NO: 196875 - RNA, 64 nt, hsa
guggaaaagguagcauucuuuuuuuaggaguguuauuuuucacuauguguggcacggauacaau

SEQ ID NO: 196876 - RNA, 64 nt, hsa
gaaaugguucuccuuucccucucaauaaauaucuauuuuucauuuuuuuacuuuguaguuuauu

SEQ ID NO: 196877 - RNA, 64 nt, hsa
cauccuggagaagacaguucuaaaucggggcuugauuuuucaucuaugauccuagauguucucc

SEQ ID NO: 196878 - RNA, 64 nt, hsa
accuagauaauucugaaauaauuuggauucuuucauuuuucaggauuugagcucaucaauuaug

SEQ ID NO: 196879 - RNA, 64 nt, hsa
augcuaucaaauuaucuucacccucauccuuuacauuuuucaacauuuuuuuuucuccauaaau

SEQ ID NO: 196880 - RNA, 64 nt, hsa
uauacaaucuuuaaaauaagaaagggaggcuaauauuuuucaugcuaucaaauuaucuucaccc

SEQ ID NO: 196881 - RNA, 64 nt, hsa
acuuuauucuacuguaagcaauaauuugcuugcaauuuuucauguaauuuuuaaauuaguaugu

SEQ ID NO: 196882 - RNA, 64 nt, hsa
ggucauagaauauccuaaaguaucacauaguuaaauuuuucagucagugaagaccgggagggaa

SEQ ID NO: 196883 - RNA, 64 nt, hsa
uuuauagacuuguuuuauuagauuuuaccaaugaauuuuucaaaauacaaaaaaaaguaguuuu

SEQ ID NO: 196884 - RNA, 64 nt, hsa
auuaaggugaaaucauggaucagauauuccuuacauuuuucaaaacuacugcauguuuaaaacu

SEQ ID NO: 196885 - RNA, 64 nt, hsa
aagauguguaaacucauuguccuugauaguuuuuauuuuucauuauaaaauuauaccaggagau

SEQ ID NO: 196886 - RNA, 64 nt, hsa
uaaauaagguauuuuuccuuuucccucuuacuggauuuuucaauuuucaaaccauauggccuag

SEQ ID NO: 196887 - RNA, 64 nt, hsa
gagugucuuuuuuauuucauucaugaacuuuuguauuuuucauuuuucauuugauuuguaaauu

SEQ ID NO: 196888 - RNA, 64 nt, hsa
uuuuuuauuucauucaugaacuuuuguauuuuucauuuuucauuugauuuguaaauuuacuuau

SEQ ID NO: 196889 - RNA, 64 nt, hsa
auaaacuguuacacaaaauauaaaccuaacguguauuuuucaggacugcgugaucgugcacuuu

SEQ ID NO: 196890 - RNA, 64 nt, hsa
ucaagguauuuuauauuuuuagucagaaaaaauaauuuuucauuucaguuuuccauaaacuguu

SEQ ID NO: 196891 - RNA, 64 nt, hsa
aauucaacaaagguuuucacauuuuauaagguugauuuuucaauuaaaugcaaauuuguguggc

SEQ ID NO: 196892 - RNA, 64 nt, hsa
uauaauguuuuaaaacauaaggcauuugucugccauuuuucaauuacaugcugacuucccuuac

SEQ ID NO: 196893 - RNA, 64 nt, hsa
gcuguuucccuuucuauucugaacaacugucuccauuuuucaagugugagagauaagggcuaau

SEQ ID NO: 196894 - RNA, 64 nt, hsa
uagcuaaguuuuuuuuuuuuagcauuucuuuuuuauuuuucaaucuauauucacaggcccauac

SEQ ID NO: 196895 - RNA, 64 nt, hsa
aaaaucacaggguuggaaagaacuuugaaaggucauuuuucaauaaucucaccuuaaaagugac

SEQ ID NO: 196896 - RNA, 64 nt, hsa
auagaaaagaagugauaguaguuaauuggcaucgauuuuucagauauugcacuaccuuauaaug

SEQ ID NO: 196897 - RNA, 64 nt, hsa
acauuuauuuagagucugacaacauauucaaaauauuuuucagccucuacugauaguggauaac

SEQ ID NO: 196898 - RNA, 64 nt, hsa
ucaccugagugauguacauuguacccaauagguaauuuuucauccauuacccuccuuccgcccu

SEQ ID NO: 196899 - RNA, 64 nt, hsa
aucugaaaauaaaauauacuaguccugacacugaauuuuucaaguauacuaagaguaaagcaac

SEQ ID NO: 196900 - RNA, 64 nt, hsa
uaauuuucuaaaaccauguaacuccauugaacacauuuuucaacuuaaggucugcauagcagac

SEQ ID NO: 196901 - RNA, 64 nt, hsa
auucucaauuuucuuuaugcuagacauauaaauuauuuuucaaacuguauagauuugggguaaa

SEQ ID NO: 196902 - RNA, 64 nt, hsa
ucuuacauggguugcuguauuuagaauuauaaacauuuuucauuauuggaaaguguaacgggga

SEQ ID NO: 196903 - RNA, 64 nt, hsa
ucucuuuuuuuuguaaauuuuauguacagauuugauuuuucauaguuuuaacuagauuuccaag

SEQ ID NO: 196904 - RNA, 64 nt, hsa
uagauucaaaauggaaaaccuauucauggcucagauuuuucauuguggguuaaaaauggguguc

SEQ ID NO: 196905 - RNA, 64 nt, hsa
uguacugaugaaaguaccuauuuguguauauuggauuuuucacuugguuagcuaaagaagaugu

SEQ ID NO: 196906 - RNA, 64 nt, hsa
acugauuuuauaauuggagaaugcguaaagauucauuuuucaaggagaagagccugcaaauggc

SEQ ID NO: 196907 - RNA, 64 nt, hsa
gauccacagccuggcagagccgagccgucaccugauuuuucaguguuucuaccugugugcugga

SEQ ID NO: 196908 - RNA, 64 nt, hsa
augaauuuaauuuuauaaauauaauggaaaacagauuuuucaucauaucaugaauaaaauauag

SEQ ID NO: 196909 - RNA, 64 nt, hsa
aauauuuaauucuaaauuccagauuuuaaggaagauuuuucaagaaacugcaaguuuuugacuu

SEQ ID NO: 196910 - RNA, 64 nt, hsa
uauguaaauaaauaaauguaauauuucauccuuuauuuuucagguaaaaggucaugcuguuaca

SEQ ID NO: 196911 - RNA, 64 nt, hsa
ugaaccuaggucagagcucuaaauugguccuucuauuuuucaacaaauuuaaaguaauauuucu

SEQ ID NO: 196912 - RNA, 64 nt, hsa
aaaaagacauaaaaccuuagagaaagccacuaccauuuuucaaguuaucuuuuccccaacauca

SEQ ID NO: 196913 - RNA, 64 nt, hsa
acaugccauaguuaacaaaugauaaggaugccacauuuuucaugcagaaaagaaccacagguau

SEQ ID NO: 196914 - RNA, 64 nt, hsa
auuuuuaaccugauauucuuuuuaauuguuuuaaauuuuucauaggggaguuuuggacaaaaca

SEQ ID NO: 196915 - RNA, 64 nt, hsa
cccccaacacuuucucuucuuagucucucucuuuauuuuucaaucucugaauauuuuagucucu

SEQ ID NO: 196916 - RNA, 64 nt, hsa
cuugcucauauuucuggccaauguacagccucauauuuuucagaguaauacagauacuuguucu

SEQ ID NO: 196917 - RNA, 64 nt, hsa
acauauucugaaaauggaguguuuguucccugccauuuuucacaccucucuuaauuuuaguucu

SEQ ID NO: 196918 - RNA, 64 nt, hsa
aggcuuuccuuguuuugauuuauggcuguuccugauuuuucauauguggaaauauaccuaccuc

SEQ ID NO: 196919 - RNA, 64 nt, hsa
cccccuguucacauccaguugucuaaaggaugagauuuuucauguaucuuauagucacucauuc

SEQ ID NO: 196920 - RNA, 64 nt, hsa
gaucccugggauuacuuagccaaggcuuaaauuuauuuuucaaagucaagaacauuagccuaga

SEQ ID NO: 196921 - RNA, 64 nt, hsa
aucuugugggaaaaaaauggggcaugcauucauaauuuuucauuuucuuccccaccccaacccc

SEQ ID NO: 196922 - RNA, 64 nt, hsa
uuuuacacaugagggaccgaaggauagaaaaguuauuuuucaaaggucuugcaguuaauaaaug

SEQ ID NO: 196923 - RNA, 64 nt, hsa
cuagagacauauaaucauacagauuauucauaaaauuuuucagugcuguccuuccacauuuaau

SEQ ID NO: 196924 - RNA, 64 nt, hsa
cauauuuaaauaugaaucuauucaugcuaacauuauuuuucaaaacauacauggaaauuuagcc

SEQ ID NO: 196925 - RNA, 64 nt, hsa
cacuugccuccucuuuuguccugauuuaaccagcauuuuucaacccugggaaaauuugcagaau

SEQ ID NO: 196926 - RNA, 64 nt, hsa
agugccaauauucaaaacuuuuggauuaaaauguauuuuucaccgugcauuuacuuuggaugua

SEQ ID NO: 196927 - RNA, 64 nt, hsa
aauucuagaugacuuuaauuuucuuuauaucaguauuuuucagauuuucuauaugcuuuccuuu

SEQ ID NO: 196928 - RNA, 64 nt, hsa
uuuaaguaugcaaaauguuuaagucacauuauuuauuuuucauugugagacacuaaaaacuguu

SEQ ID NO: 196929 - RNA, 64 nt, hsa
uuauacaaagcacuuuaaugauagaugcaaccuuauuuuucaguuccuauuuuuuuaaagacca

SEQ ID NO: 196930 - RNA, 64 nt, hsa
aagcugcaguucauuuucaugcauggaucauuacauuuuucacuuguaaauguagguuuuuaug

SEQ ID NO: 196931 - RNA, 64 nt, hsa
ugaaggagauguuuugcaaagauucagagaacuaauuuuucacuggauaagaccugaguaaccc

SEQ ID NO: 196932 - RNA, 64 nt, hsa
gccauaagccauaaagagucaaucucuuaauuauauuuuucaucauguaaacaaguuucccauu

SEQ ID NO: 196933 - RNA, 64 nt, hsa
uuugauauuuuuuacgauaauuagcugcaugugaauuuuucaugaccuucuuuacauuuuuuau

SEQ ID NO: 196934 - RNA, 64 nt, hsa
cuguuuacaauuuggggacaaaaaggcaggcuucauuuuucauauguuugaugaaaacuggcuc

SEQ ID NO: 196935 - RNA, 64 nt, hsa
aauaauauaaaacacuuauuugagauuaaauuaaauuuuucaugagccccucuuuggcaggaac

SEQ ID NO: 196936 - RNA, 64 nt, hsa
augaaaguuugcugguaucaacacagccugccauauuuuucacagcaugcaacaauggugcuag

SEQ ID NO: 196937 - RNA, 64 nt, hsa
uugcaaguauguucaacgauuuaaauuuuuuuuuauuuuucaaaguauuguuccuuuaaagaau

SEQ ID NO: 196938 - RNA, 64 nt, hsa
gggaagccuuaaauugaucuggaaagaauucuucauuuuucauuugugcuuuuuuaaaaaaaaa

SEQ ID NO: 196939 - RNA, 64 nt, hsa
uguacaaccuuaaggcucuucacaguauaaauuaauuuuucaaaccagagcuguucacaugaaa

SEQ ID NO: 196940 - RNA, 64 nt, hsa
guuuauuucagaauaucaauacaguuuugucuucauuuuucaacaguaauuucaauugguucau

SEQ ID NO: 196941 - RNA, 64 nt, hsa
gcaacauuaggaauguccugcacuuaauagaauuauuuuucaccgcuacaguuugaagaaugua

SEQ ID NO: 196942 - RNA, 64 nt, hsa
caagacuuuuuugaccaaacaguagauauuuucuauuuuucaccagaacacauaaaaacacuuu

SEQ ID NO: 196943 - RNA, 64 nt, hsa
uugagugacaucaagaaaagaugauaucagguucauuuuucaacuaaucuuauguggaauugaa

SEQ ID NO: 196944 - RNA, 64 nt, hsa
cauucccaaauucuaaauagcugacccuaaauucauuuuucaugcuuaaaaauaauagaacaaa

SEQ ID NO: 196945 - RNA, 64 nt, hsa
ucuccccauuugucaaaguugaccucaagauaacauuuuucauuaaagcaucugagaucuaaga

SEQ ID NO: 196946 - RNA, 64 nt, hsa
uguuuuccuccuaucaaggcagcuauuuuauuaaauuuuucacuuagucugagaaauagcagau

SEQ ID NO: 196947 - RNA, 64 nt, hsa
uuuuucaacuucaccacaguaacuuugcaacaucauuuuucauuugugggguaguaaaauucau

SEQ ID NO: 196948 - RNA, 64 nt, hsa
aaaauuaauacuaaauuauaaucauuuuagugauauuuuucaacuucaccacaguaacuuugca

SEQ ID NO: 196949 - RNA, 64 nt, hsa
acagaauuuauagaauaauuucuccucauuuaauauuuuucaaaaucaaaguuaugguuuccuc

SEQ ID NO: 196950 - RNA, 64 nt, hsa
aaauauaaaaacaacaaauacuuccauauggagcauuuuucagaguuuucuaacccagucuuau

SEQ ID NO: 196951 - RNA, 64 nt, hsa
auauuggauaccccauuaaaucugacagucucaaauuuuucaucucuucaaucacuagucaaga

SEQ ID NO: 196952 - RNA, 64 nt, hsa
uucgcuuucuccucggcucacuuucucccuuuuuauuuuucaccaaaccauuuguagagcuaca

SEQ ID NO: 196953 - RNA, 64 nt, hsa
uaaaucuaacccuaguuguaucccuccuuucaguauuuuucacuuguugccccaaaugugaaag

SEQ ID NO: 196954 - RNA, 64 nt, hsa
augaaaugugcauucugaauguugcauauuuuaaauuuuucaugugcaguauggcucggaauau

SEQ ID NO: 196955 - RNA, 64 nt, hsa
aaauuggaaagccaucuuauacaaaauuauucacauuuuucaucuacgauucaacuaaucgaag

SEQ ID NO: 196956 - RNA, 64 nt, hsa
uuuuugcaagaauaagcaaagcccauggaauuuaauuuuucauugugaucagauuaaaauuacu

SEQ ID NO: 196957 - RNA, 64 nt, hsa
agccagcccauauacagaaacuaucacuaucuacauuuuucauauguguucagacagagccuau

SEQ ID NO: 196958 - RNA, 64 nt, hsa
uuacugcaauugaaaaaaucauacucuauuaccaauuuuucagaacucauagauaaauaugaau

SEQ ID NO: 196959 - RNA, 64 nt, hsa
aagauauuuuucaugauuuugaaaccaugaagagauuuuucaugauuuugaaaucaugaagaua

SEQ ID NO: 196960 - RNA, 64 nt, hsa
uaagaaauuuuugcccaucccaaaaucauaagauauuuuucaugauuuugaaaccaugaagaga

SEQ ID NO: 196961 - RNA, 64 nt, hsa
gcaauguuauaaaaauauugcuaaucuucugcuuauuuuucagccuuuaaagucugaaauacua

SEQ ID NO: 196962 - RNA, 64 nt, hsa
cuucagaaguacgugaguuguuccucaggaauagauuuuucauaaagcagaauugauccugugg

SEQ ID NO: 196963 - RNA, 64 nt, hsa
ugggauuacaggccugagccaccgcgcccggccuauuuuucacuuuaauuuggcagcugagaau

SEQ ID NO: 196964 - RNA, 64 nt, hsa
ggccaccagcagaucaucuuuaagcuaaguuacuauuuuucaccuuuuuuuuuagacggaguuu

SEQ ID NO: 196965 - RNA, 64 nt, hsa
ucauucagcuaacaaacuagaaaagguuauguucauuuuucaaaaagggaaguaagcaaacaaa

SEQ ID NO: 196966 - RNA, 64 nt, hsa
acacacuacuaccucuuaagucccaguauaccucauuuuucauacugaaaaaaaaagcuugugg

SEQ ID NO: 196967 - RNA, 64 nt, hsa
ucuauguccuaacuaaauuucucaacuguuaugaauuuuucaucuacuucuugaacaguggucu

SEQ ID NO: 196968 - RNA, 64 nt, hsa
auauaagcaaguaauaccuauuagucauaccuaaauuuuucagcacuucauucaauuaaaauac

SEQ ID NO: 196969 - RNA, 64 nt, hsa
ccaauggcauuaagaugguguuuuuguucuacauauuuuucaauaauuuauucuuucuaauguu

SEQ ID NO: 196970 - RNA, 64 nt, hsa
aagcccggcagaugugucuccugguugaacaugcauuuuucauggaguuuggguucuaaauuua

SEQ ID NO: 196971 - RNA, 64 nt, hsa
aauugcaaauaagggaagggaaaaaugcuuuucuauuuuucaguaacuggauugucuuaagaaa

SEQ ID NO: 196972 - RNA, 64 nt, hsa
gguguuauccuucaggauuguuccacuaaaauuuauuuuucaaaaaauuuacuucacauuauuc

SEQ ID NO: 196973 - RNA, 64 nt, hsa
aaggcagauaugcuguauuugccuacuuuaacccauuuuucaaccuguuuguuuuuuaaaaggc

SEQ ID NO: 196974 - RNA, 64 nt, hsa
guggaaaagugggccuaggguggccacagcuuugauuuuucaagagacaagaaaccuagauguu

SEQ ID NO: 196975 - RNA, 64 nt, hsa
accacuuacagcuuucucacaugaguugcuucacauuuuucaucaucuuuaaggacuucuuaua

SEQ ID NO: 196976 - RNA, 64 nt, hsa
aaacucccugccuauggcugaaacuauaaaugaaauuuuucauaaaacauuuucuugagagagu

SEQ ID NO: 196977 - RNA, 64 nt, hsa
agagcauuugagcugccacucuuggagcacauugauuuuucaaaagccagcucugucaggaaag

SEQ ID NO: 196978 - RNA, 64 nt, hsa
auguacauuacauggcuuaagauuaaacaaaaacauuuuucaagucucuaacuagagugaacuc

SEQ ID NO: 196979 - RNA, 64 nt, hsa
augucccuggacauaaaaguuuaguuaguauuaaauuuuucacuaauacaaaauaaaaaaauau

SEQ ID NO: 196980 - RNA, 64 nt, hsa
uaaaugaagcagagccaggaaaaacagacuacauauuuuucaugucuaaagaaauuggguauuu

SEQ ID NO: 196981 - RNA, 64 nt, hsa
caauaaaaauuuaaguuuuuuuaacaacuaccuuauuuuucacuguacagacacuaauucauua

SEQ ID NO: 196982 - RNA, 64 nt, hsa
ucuagcauauguauaaugcuauaguuaaaauacuauuuuucaaaaucauacagauuaguacauu

SEQ ID NO: 196983 - RNA, 64 nt, hsa
uuaaaguucagccucucaguuuuaauauagcuuuauuuuucaguggagaucauuguuuaggaug

SEQ ID NO: 196984 - RNA, 64 nt, hsa
aguaaaagucccagugauguauucccauagaaauauuuuucaguuguuuaugucguuuacuaca

SEQ ID NO: 196985 - RNA, 64 nt, hsa
aagaauuacuuauucugaugaugcacuuuuauguauuuuucauuagaaaguagaacuaauuuua

SEQ ID NO: 196986 - RNA, 64 nt, hsa
aauccuccauugugcuccauucuaucacaugugcauuuuucauguuaaacugcaauuacuuaau

SEQ ID NO: 196987 - RNA, 64 nt, hsa
guuugcuuuguuuuauaguaucuguacuccuuguauuuuucaagagcuauuuuguaaacagaug

SEQ ID NO: 196988 - RNA, 64 nt, hsa
guuaacuaccuccuguccagcuugacagagacuaauuuuucaucuuuuugcugucaauuuguuu

SEQ ID NO: 196989 - RNA, 64 nt, hsa
ucacccgcuucaugacuaaaucacagguggcagaauuuuucaguucuuuuuuuuuuuuuugagg

SEQ ID NO: 196990 - RNA, 64 nt, hsa
aaccauauguguaacugauacuuggcaccauggaauuuuucauugaguuauuuccucauucuuu

SEQ ID NO: 196991 - RNA, 64 nt, hsa
uaguauaauuagauuuuuuccauauuuuugaaagauuuuucagaugugaacauuaaaaauaggg

SEQ ID NO: 196992 - RNA, 64 nt, hsa
aauaauuuuuauaguaaauaauuguuuugggcugauuuuucaguaaauccaaagugacuuaggu

SEQ ID NO: 196993 - RNA, 64 nt, hsa
uugcuucacuuuguauuuaaaguuaaaaguuacuauuuuucauuugcuauuguacuuucauugu

SEQ ID NO: 196994 - RNA, 64 nt, hsa
uuaauacuucuguuaaauuugaugucaggucaacauuuuucagaaauguauuuauucucagaaa

SEQ ID NO: 196995 - RNA, 64 nt, hsa
uuaacauuuauuuaauaauuauauuuauuaaaccauuuuucaauaagguauauagcuuauuugu

SEQ ID NO: 196996 - RNA, 64 nt, hsa
uuuuuccccccaaacuucuguuuuauaauauguaauuuuucaugaaaagaaagggcucagaaaa

SEQ ID NO: 196997 - RNA, 64 nt, hsa
gauuuguuuccucuuacacaacuagaauuaauguauuuuucaccaguuuuccauauaccuuagg

SEQ ID NO: 196998 - RNA, 64 nt, hsa
cuuauugacuuuauuacauuuucuguuuagcagcauuuuucacugcaauguuaaaauaaauaug

SEQ ID NO: 196999 - RNA, 64 nt, hsa
aaaacagaauuaggaauuugagauaucugauuauauuuuucauaugaaucacagcuguugacaa

SEQ ID NO: 197000 - RNA, 64 nt, hsa
cuauaagucacucugcuuuaucuugcuaaagacaauuuuucaagcaauccuuuaguuuuaguuu

SEQ ID NO: 197001 - RNA, 64 nt, hsa
uuaaauaacugucaacuguuucauugcuuuuuaaauuuuucacgugcauaacccccuuuagaag

SEQ ID NO: 197002 - RNA, 64 nt, hsa
uuccuuuacauguuuacacuuuuauaaaaaucagauuuuucaguggucucuccagauauuaaca

SEQ ID NO: 197003 - RNA, 64 nt, hsa
gacagaauguguucuuuucuccuuuaccaguccuauuuuucaaugggaagacucaggagucugc

SEQ ID NO: 197004 - RNA, 64 nt, hsa
cugccacuugucaaagaaggugcugauccuaagaauuuuucauucucagaauucggugugcugc

SEQ ID NO: 197005 - RNA, 64 nt, hsa
auuauacacuggaauauucagguagucaucuuugauuuuucauucaaguaaauauagccauaag

SEQ ID NO: 197006 - RNA, 64 nt, hsa
aaaaaugaacucuuucaauugagauuaaguccauauuuuucaaacaucacguucucuauuggcu

SEQ ID NO: 197007 - RNA, 64 nt, hsa
guuguacuuuaucuuuuuguaauauuauuuuugaauuuuucauuauuauguugcuuuugaaauu

SEQ ID NO: 197008 - RNA, 64 nt, hsa
uuaaaacagagucuuauuugagauguauugcuuuauuuuucaauuaaaagugguuuucuccuac

SEQ ID NO: 197009 - RNA, 64 nt, hsa
guagaauuguagaaaaugucaauuuuucaaacucauuuuucauugcuaggauuucuuuuaaaaa

SEQ ID NO: 197010 - RNA, 64 nt, hsa
uauuuuucaaaauguagaauuguagaaaaugucaauuuuucaaacucauuuuucauugcuagga

SEQ ID NO: 197011 - RNA, 64 nt, hsa
ugaauuguguucuguaaaaaaguauuagucaauuauuuuucaaaauguagaauuguagaaaaug

SEQ ID NO: 197012 - RNA, 64 nt, hsa
ggcaugagaauucaacauaaaauugugagcucugauuuuucaaauugaucauaaaaccuuuagg

SEQ ID NO: 197013 - RNA, 64 nt, hsa
ucauaaucauguauucaauggacuguaauuuaugauuuuucaaaaucauguuacaagauagaca

SEQ ID NO: 197014 - RNA, 64 nt, hsa
gugggaaaugauuagauucugaacauauguaauuauuuuucagucuuuuucaaagauacaaaua

SEQ ID NO: 197015 - RNA, 64 nt, hsa
caucucaaaaaaaaggagacuucaugugcccccaauuuuucacuauuguuauuugaaaaaauau

SEQ ID NO: 197016 - RNA, 64 nt, hsa
acgcuacauguauucagcuuuuaaaacuccacaaauuuuucauacuccuuaaauaugaaaaauu

SEQ ID NO: 197017 - RNA, 64 nt, hsa
uucauaugagauccuuguaguauaagcacaggccauuuuucacuuugguauuaauaaaauguaa

SEQ ID NO: 197018 - RNA, 64 nt, hsa
cuuuaaaauaaauccuaccugguuuuuaaauuuuauuuuucaugaaaaugcuccuuucucuaca

SEQ ID NO: 197019 - RNA, 64 nt, hsa
gguauuccauuuucaugguuuacuaugaaaagucauuuuucauauuauguaauauauuguuaga

SEQ ID NO: 197020 - RNA, 64 nt, hsa
accuguuaacuuuuuuccacaaacucauuauaauauuuuucauaggcaaguuuccucucaguag

SEQ ID NO: 197021 - RNA, 64 nt, hsa
aaaauacuguguaacuauuucucaaacuugugggauuuuucaaaagcucaguauaugaaucauc

SEQ ID NO: 197022 - RNA, 64 nt, hsa
uguuaccuuauuaaaaugaccaccauucuaaaccauuuuucaguggucuggauacgaaguuuac

SEQ ID NO: 197023 - RNA, 64 nt, hsa
ggacccauuaauuuccugagccaaucagaaauauauuuuucaauaaugcuaaaauuagcuacaa

SEQ ID NO: 197024 - RNA, 64 nt, hsa
auaucacuguugauagugcagagaaacccuccacauuuuucagugcauaauugaguuuucuaua

SEQ ID NO: 197025 - RNA, 64 nt, hsa
uuaggagagaacauuuaagccacucagguaugcaauuuuucagacuacugaaaucccuguagca

SEQ ID NO: 197026 - RNA, 64 nt, hsa
guauggguaaauuuacauuggugguauugcaggaauuuuucaaaaacauuacuguaaugaauaa

SEQ ID NO: 197027 - RNA, 64 nt, hsa
ucucuuuuuacuaagucaguugauaaucuugauuauuuuucagaaagcagacugauacuaaauu

SEQ ID NO: 197028 - RNA, 64 nt, hsa
uucauuccuuguucauuacuguucuauuuuucauauuuuucaaaugaagaagcaacacauaagu

SEQ ID NO: 197029 - RNA, 64 nt, hsa
cauuuuuucuucauuccuuguucauuacuguucuauuuuucauauuuuucaaaugaagaagcaa

SEQ ID NO: 197030 - RNA, 64 nt, hsa
uuuuucagcuugcaaaaugggacugcaauauuacauuuuucacuuaagcaguuuuuuacaucua

SEQ ID NO: 197031 - RNA, 64 nt, hsa
uaaaugugcagauuuuaugcguguugacaaaaucauuuuucagcuugcaaaaugggacugcaau

SEQ ID NO: 197032 - RNA, 64 nt, hsa
aaaagguucuucuggugagugcaagagccugagacuggaaaagguggacuugucucccagucga

SEQ ID NO: 197033 - RNA, 64 nt, hsa
accugcaucauuccccgacacugccaagccaacccuggaaaaggaguucgcuggccauuggcua

SEQ ID NO: 197034 - RNA, 64 nt, hsa
cagagcugugucaugccauccuuugggcccucugcuggaaaaguagaaucaagucucaaauaau

SEQ ID NO: 197035 - RNA, 64 nt, hsa
ugucucuauaauuuuauucagaugacugcagaaccuggaaaagcuguugcugcuauugaugcau

SEQ ID NO: 197036 - RNA, 64 nt, hsa
gucucuguuuucuuuuccuuuugaaaaagagucccuggaaaagaaagaauaaguggauucuccc

SEQ ID NO: 197037 - RNA, 64 nt, hsa
ccuugucaguugcugagcugggcuuggcuccuuucuggaaaaugacaguauuuuuggcagggag

SEQ ID NO: 197038 - RNA, 64 nt, hsa
aaccuuguagaggagcagggucuuccugcagugccuggaaaacaggcgcuguuuuuuugggacc

SEQ ID NO: 197039 - RNA, 64 nt, hsa
auguucauaguuacauauuuauaauaguuaauaacuggaaaaagugaaauguaugucugucuac

SEQ ID NO: 197040 - RNA, 64 nt, hsa
aaaggugggaagagagccuggaaaagaaccaggccuggaaaagaaccagaaggaggcugggcag

SEQ ID NO: 197041 - RNA, 64 nt, hsa
cucuucugucauuguucaaaggugggaagagagccuggaaaagaaccaggccuggaaaagaacc

SEQ ID NO: 197042 - RNA, 64 nt, hsa
gguuuccaggaauuuuuuucaaauggggcuguuucuggaaaaaugaaaaauucuauuggacaau

SEQ ID NO: 197043 - RNA, 64 nt, hsa
uaaauaagaaaaaaaucaaaucgaagucagccugcuggaaaagugaucacauggcaguugcagu

SEQ ID NO: 197044 - RNA, 64 nt, hsa
caccuuuuuuauagaugauuuguuuaaauuauaucuggaaaauagaguugauuuacuuucagac

SEQ ID NO: 197045 - RNA, 64 nt, hsa
uugaaauuaaacuaugaaauuaaaggcagaaaaacuggaaaaccuacugcagguccagagacuu

SEQ ID NO: 197046 - RNA, 64 nt, hsa
ugggauugcaggcaugagccacugcacccaaccccuggaaaacuaaauuuuuaagugcuuauuu

SEQ ID NO: 197047 - RNA, 64 nt, hsa
uuaaaauauaauugcgaauaucagaaaacucauacuggaaaacuaaauuuuuuuuuucucuuga

SEQ ID NO: 197048 - RNA, 64 nt, hsa
uuuagggacauaaaaugaucuugcaggucguaaacuggaaaacaguauuuugguugucuuagga

SEQ ID NO: 197049 - RNA, 64 nt, hsa
cucuuccugggauucauuuuuucaaaacacaaugcuggaaaaaaaagauuuguuucugaaagac

SEQ ID NO: 197050 - RNA, 64 nt, hsa
uaaaaguacuuacuauaaccacaucauaagaauucuggaaaaauagagaacaaaaggaaaagau

SEQ ID NO: 197051 - RNA, 64 nt, hsa
aaaggcaccuucuuuacagcagggcucuggggaacuggaaaaggggguuuguuucauuaucugg

SEQ ID NO: 197052 - RNA, 64 nt, hsa
gcuccauuugccaguuuaaggaaggaaacacuaucuggaaaaguaccuuauugauaguggaauu

SEQ ID NO: 197053 - RNA, 64 nt, hsa
uauauguagcacugugcuguguagauaguuccuacuggaaaaagaguggaaauuuauuaaaauc

SEQ ID NO: 197054 - RNA, 64 nt, hsa
auuuagauuuuaagugccuuuucacugggagaaucuggaaaaaccuccauaagguauauagcaa

SEQ ID NO: 197055 - RNA, 64 nt, hsa
uuauuauaauaaauuauauuaguaaaagucuuaacuggaaaaaagaaucuaaaucagaauagug

SEQ ID NO: 197056 - RNA, 64 nt, hsa
augagggacuggaaccagggagaccgagcgcuuucuggaaaagaggaguuucgagguagaguuu

SEQ ID NO: 197057 - RNA, 64 nt, hsa
agaggcuggugcuguggccagggugagagcugcucuggaaaaugugacccagauccucacaacc

SEQ ID NO: 197058 - RNA, 64 nt, hsa
uuguccuuuuucuuucuagcuguuaaccuacuuccuggaaaaaguaguagcucucuguagcauu

SEQ ID NO: 197059 - RNA, 64 nt, hsa
cucuaauuuuuuggaauuuuuguagacuuuacaccuggaaaaaaagauuuguaaaaucaccgga

SEQ ID NO: 197060 - RNA, 64 nt, hsa
gauacagcucuggcuuucugagcacacuacggaucuggaaaauacuggaaaaugugauacuuag

SEQ ID NO: 197061 - RNA, 64 nt, hsa
uggcuuucugagcacacuacggaucuggaaaauacuggaaaaugugauacuuagaauacuuugg

SEQ ID NO: 197062 - RNA, 64 nt, hsa
auucagaauucuuaggcaaccuucauaccuuuaucuggaaaaugccuucucuccagacaauaag

SEQ ID NO: 197063 - RNA, 64 nt, hsa
gcaggaauuuauacauuggguaccagagcuaaaucuggaaaacacauuuggaaugagcuuccac

SEQ ID NO: 197064 - RNA, 64 nt, hsa
ccauugacuuugccacauagcugaacuguguuuacuggaaaaauucagaggccuaaaguuuaaa

SEQ ID NO: 197065 - RNA, 64 nt, hsa
uaaaaagagggccaaggagguaugagccaucagacuggaaaaaaggaugacuauaugaugagga

SEQ ID NO: 197066 - RNA, 64 nt, hsa
agggccuugauuuccagccgcaaucuggcuccuccuggaaaauuucccccaccugcagcgcugg

SEQ ID NO: 197067 - RNA, 64 nt, hsa
gucaaccagagaacagcuccccuagacauggccucuggaaaaaggaaaucuuugguggccaaag

SEQ ID NO: 197068 - RNA, 64 nt, hsa
uuguuugcauaggaauucaugaaggcgacccaaccuggaaaaagaacuauucacuuuggccaug

SEQ ID NO: 197069 - RNA, 64 nt, hsa
auauuaauaccagaccaaagacauuuucuguuuccuggaaaaaaaaaaugaaucauguuaggcu

SEQ ID NO: 197070 - RNA, 64 nt, hsa
cucugaaaggugacuuuuauuaccaacacacuggcuggaaaagggacaaaccacaucacgggug

SEQ ID NO: 197071 - RNA, 64 nt, hsa
gugggcuggggcagaggucuuuuuucauuuaauacuggaaaaauauugaagagcauccauguuc

SEQ ID NO: 197072 - RNA, 64 nt, hsa
agggcccaugauggcagacauucuaccccuuuuccuggaaaaacuggaagaaugaaaauaauuu

SEQ ID NO: 197073 - RNA, 63 nt, hsa
aacuuccuuuaaaggaucuaugcauuuauuaaaucuggaaaacuauauguacacuguaggugg

SEQ ID NO: 197074 - RNA, 64 nt, hsa
uugagcaacauggggcuagugggaucacagaaaucuggaaaaaaaaaaaaaaggcuuuggcuua

SEQ ID NO: 197075 - RNA, 64 nt, hsa
cugccuggcugauucuuccuuaaaacuaaaaucucuggaaaauggauuugcuucuuacccugug

SEQ ID NO: 197076 - RNA, 64 nt, hsa
cgccuucuugagugauaccuauuacggaugaguucuggaaaagacccagcuaugauucauaaaa

SEQ ID NO: 197077 - RNA, 64 nt, hsa
uuuuuucagaaaaacguggagugcuaggggcagccuggaaaagauggggaaccugcuagugaac

SEQ ID NO: 197078 - RNA, 64 nt, hsa
ccuccuuggcgcugccaccugccccacccaguuucuggaaaaaguugaugcuaaugaggccaac

SEQ ID NO: 197079 - RNA, 64 nt, hsa
gguggugcuggggcuggccugcaggcugcagucccuggaaaaacagucacugacucaagacacu

SEQ ID NO: 197080 - RNA, 64 nt, hsa
agaggcauccuugagcuuuaaagcauugaacaaacuggaaaaugcaacauaccacauaacugaa

SEQ ID NO: 197081 - RNA, 64 nt, hsa
guugcagaacaagcaauuggcuuagauauacaaucuggaaaaauauuccugugcccauauuuua

SEQ ID NO: 197082 - RNA, 64 nt, hsa
aacaagcaaaagcuggaagcauuccccuugagaacuggaaaaugacagggaugaccacucucac

SEQ ID NO: 197083 - RNA, 64 nt, hsa
gaaaacccaggaaaugccauucuggacauaagugcuggaaaagacuuaaugaugaacaccccaa

SEQ ID NO: 197084 - RNA, 64 nt, hsa
aauuuaaagguugcuguaguguuuagaacuuaggcuggaaaaccauauuuuagugcaucauuuu

SEQ ID NO: 197085 - RNA, 64 nt, hsa
cagcccucuguuaauugugugucucaaauuuguucuggaaaagaaagggggaaagucuaugaac

SEQ ID NO: 197086 - RNA, 64 nt, hsa
cuaguuggccagcgucuugcucuguucacagucucuggaaaagcugggguaguuggugagcaga

SEQ ID NO: 197087 - RNA, 64 nt, hsa
cuaauuguagcaucuaaugaauguuccaccauugcuggaaaaauugagauggaaaacaaaccau

SEQ ID NO: 197088 - RNA, 64 nt, hsa
aaaaaaaaaaaggggagcagggaggcagaaaguccuggaaaaguaaauuguuuauuuuacaaua

SEQ ID NO: 197089 - RNA, 64 nt, hsa
cggugguucuuaaucagggauguucauuaaaaugcuggaaaacuguaaagacuuccagguccca

SEQ ID NO: 197090 - RNA, 64 nt, hsa
auggcauaaagaguaaauaaguuuuagaguuguucuggaaaaugucagaauaagucaguacuug

SEQ ID NO: 197091 - RNA, 64 nt, hsa
auuuuuuuuuuuuuugcaaaggaaaaaauugauacuggaaaagauuguugugcauaguuauuag

SEQ ID NO: 197092 - RNA, 64 nt, hsa
aagguaucuucuggaguuuuugggaggagagaaacuggaaaauuaaauuguauuuuugccagaa

SEQ ID NO: 197093 - RNA, 64 nt, hsa
caaacaagcacucagcccagcuccucaauacuaccuggaaaaagcauuggcauuauuuucaaua

SEQ ID NO: 197094 - RNA, 64 nt, hsa
cuacagacuaccaccuuucgagaucaggaccaaccuggaaaaugccagaguuggcuaugccuuu

SEQ ID NO: 197095 - RNA, 64 nt, hsa; identical to SEQ ID NO: 65415

SEQ ID NO: 197096 - RNA, 64 nt, hsa; identical to SEQ ID NO: 65416

SEQ ID NO: 197097 - RNA, 64 nt, hsa; identical to SEQ ID NO: 65417

SEQ ID NO: 197098 - RNA, 64 nt, hsa; identical to SEQ ID NO: 65418

SEQ ID NO: 197099 - RNA, 64 nt, hsa; identical to SEQ ID NO: 61352

SEQ ID NO: 197100 - RNA, 64 nt, hsa; identical to SEQ ID NO: 61353

SEQ ID NO: 197101 - RNA, 64 nt, hsa; identical to SEQ ID NO: 65421

SEQ ID NO: 197102 - RNA, 64 nt, hsa; identical to SEQ ID NO: 65422

SEQ ID NO: 197103 - RNA, 64 nt, hsa; identical to SEQ ID NO: 65423

SEQ ID NO: 197104 - RNA, 64 nt, hsa; identical to SEQ ID NO: 65424

SEQ ID NO: 197105 - RNA, 64 nt, hsa; identical to SEQ ID NO: 65425

SEQ ID NO: 197106 - RNA, 64 nt, hsa; identical to SEQ ID NO: 65426

SEQ ID NO: 197107 - RNA, 64 nt, hsa; identical to SEQ ID NO: 61354

SEQ ID NO: 197108 - RNA, 64 nt, hsa; identical to SEQ ID NO: 61355

SEQ ID NO: 197109 - RNA, 64 nt, hsa; identical to SEQ ID NO: 65429

SEQ ID NO: 197110 - RNA, 64 nt, hsa; identical to SEQ ID NO: 65430

SEQ ID NO: 197111 - RNA, 64 nt, hsa; identical to SEQ ID NO: 65431

SEQ ID NO: 197112 - RNA, 64 nt, hsa; identical to SEQ ID NO: 65432

SEQ ID NO: 197113 - RNA, 64 nt, hsa; identical to SEQ ID NO: 65433

SEQ ID NO: 197114 - RNA, 64 nt, hsa; identical to SEQ ID NO: 65434

SEQ ID NO: 197115 - RNA, 64 nt, hsa; identical to SEQ ID NO: 65435

SEQ ID NO: 197116 - RNA, 64 nt, hsa; identical to SEQ ID NO: 65436

SEQ ID NO: 197117 - RNA, 64 nt, hsa; identical to SEQ ID NO: 65437

SEQ ID NO: 197118 - RNA, 64 nt, hsa; identical to SEQ ID NO: 65438

SEQ ID NO: 197119 - RNA, 64 nt, hsa; identical to SEQ ID NO: 65439

SEQ ID NO: 197120 - RNA, 64 nt, hsa; identical to SEQ ID NO: 65440

SEQ ID NO: 197121 - RNA, 64 nt, hsa; identical to SEQ ID NO: 61356

SEQ ID NO: 197122 - RNA, 64 nt, hsa; identical to SEQ ID NO: 61357

SEQ ID NO: 197123 - RNA, 64 nt, hsa; identical to SEQ ID NO: 65443

SEQ ID NO: 197124 - RNA, 64 nt, hsa; identical to SEQ ID NO: 65444

SEQ ID NO: 197125 - RNA, 64 nt, hsa; identical to SEQ ID NO: 65445

SEQ ID NO: 197126 - RNA, 64 nt, hsa; identical to SEQ ID NO: 65446

SEQ ID NO: 197127 - RNA, 64 nt, hsa; identical to SEQ ID NO: 65447

SEQ ID NO: 197128 - RNA, 64 nt, hsa; identical to SEQ ID NO: 65448

SEQ ID NO: 197129 - RNA, 64 nt, hsa; identical to SEQ ID NO: 65449

SEQ ID NO: 197130 - RNA, 64 nt, hsa; identical to SEQ ID NO: 65450

SEQ ID NO: 197131 - RNA, 64 nt, hsa; identical to SEQ ID NO: 65451

SEQ ID NO: 197132 - RNA, 64 nt, hsa; identical to SEQ ID NO: 65452

SEQ ID NO: 197133 - RNA, 64 nt, hsa; identical to SEQ ID NO: 65453

SEQ ID NO: 197134 - RNA, 64 nt, hsa; identical to SEQ ID NO: 65454

SEQ ID NO: 197135 - RNA, 64 nt, hsa; identical to SEQ ID NO: 65455

SEQ ID NO: 197136 - RNA, 64 nt, hsa; identical to SEQ ID NO: 65456

SEQ ID NO: 197137 - RNA, 64 nt, hsa; identical to SEQ ID NO: 65457

SEQ ID NO: 197138 - RNA, 64 nt, hsa; identical to SEQ ID NO: 65458

SEQ ID NO: 197139 - RNA, 64 nt, hsa; identical to SEQ ID NO: 65459

SEQ ID NO: 197140 - RNA, 64 nt, hsa; identical to SEQ ID NO: 65460

SEQ ID NO: 197141 - RNA, 64 nt, hsa; identical to SEQ ID NO: 65461

SEQ ID NO: 197142 - RNA, 64 nt, hsa; identical to SEQ ID NO: 65462

SEQ ID NO: 197143 - RNA, 64 nt, hsa; identical to SEQ ID NO: 65463

SEQ ID NO: 197144 - RNA, 64 nt, hsa; identical to SEQ ID NO: 65464

SEQ ID NO: 197145 - RNA, 64 nt, hsa; identical to SEQ ID NO: 61358

SEQ ID NO: 197146 - RNA, 64 nt, hsa; identical to SEQ ID NO: 61359

SEQ ID NO: 197147 - RNA, 64 nt, hsa; identical to SEQ ID NO: 65467

SEQ ID NO: 197148 - RNA, 64 nt, hsa; identical to SEQ ID NO: 65468

SEQ ID NO: 197149 - RNA, 64 nt, hsa; identical to SEQ ID NO: 65469

SEQ ID NO: 197150 - RNA, 64 nt, hsa; identical to SEQ ID NO: 65470

SEQ ID NO: 197151 - RNA, 64 nt, hsa; identical to SEQ ID NO: 65471

SEQ ID NO: 197152 - RNA, 64 nt, hsa; identical to SEQ ID NO: 65472

SEQ ID NO: 197153 - RNA, 64 nt, hsa; identical to SEQ ID NO: 65473

SEQ ID NO: 197154 - RNA, 64 nt, hsa; identical to SEQ ID NO: 65474

SEQ ID NO: 197155 - RNA, 64 nt, hsa; identical to SEQ ID NO: 65475

SEQ ID NO: 197156 - RNA, 64 nt, hsa; identical to SEQ ID NO: 65476

SEQ ID NO: 197157 - RNA, 64 nt, hsa; identical to SEQ ID NO: 65477

SEQ ID NO: 197158 - RNA, 64 nt, hsa; identical to SEQ ID NO: 65478

SEQ ID NO: 197159 - RNA, 64 nt, hsa; identical to SEQ ID NO: 65479

SEQ ID NO: 197160 - RNA, 64 nt, hsa; identical to SEQ ID NO: 65480

SEQ ID NO: 197161 - RNA, 64 nt, hsa; identical to SEQ ID NO: 65481

SEQ ID NO: 197162 - RNA, 64 nt, hsa; identical to SEQ ID NO: 65482

SEQ ID NO: 197163 - RNA, 64 nt, hsa; identical to SEQ ID NO: 65483

SEQ ID NO: 197164 - RNA, 64 nt, hsa; identical to SEQ ID NO: 65484

SEQ ID NO: 197165 - RNA, 64 nt, hsa; identical to SEQ ID NO: 65485

SEQ ID NO: 197166 - RNA, 64 nt, hsa; identical to SEQ ID NO: 65486

SEQ ID NO: 197167 - RNA, 64 nt, hsa; identical to SEQ ID NO: 65487

SEQ ID NO: 197168 - RNA, 64 nt, hsa; identical to SEQ ID NO: 65488

SEQ ID NO: 197169 - RNA, 64 nt, hsa; identical to SEQ ID NO: 65489

SEQ ID NO: 197170 - RNA, 64 nt, hsa; identical to SEQ ID NO: 65490

SEQ ID NO: 197171 - RNA, 64 nt, hsa; identical to SEQ ID NO: 65491

SEQ ID NO: 197172 - RNA, 64 nt, hsa; identical to SEQ ID NO: 65492

SEQ ID NO: 197173 - RNA, 64 nt, hsa; identical to SEQ ID NO: 65493

SEQ ID NO: 197174 - RNA, 64 nt, hsa; identical to SEQ ID NO: 65494

SEQ ID NO: 197175 - RNA, 64 nt, hsa; identical to SEQ ID NO: 65495

SEQ ID NO: 197176 - RNA, 64 nt, hsa; identical to SEQ ID NO: 65496

SEQ ID NO: 197177 - RNA, 64 nt, hsa; identical to SEQ ID NO: 65497

SEQ ID NO: 197178 - RNA, 64 nt, hsa; identical to SEQ ID NO: 65498

SEQ ID NO: 197179 - RNA, 64 nt, hsa; identical to SEQ ID NO: 65499

SEQ ID NO: 197180 - RNA, 64 nt, hsa; identical to SEQ ID NO: 65500

SEQ ID NO: 197181 - RNA, 64 nt, hsa; identical to SEQ ID NO: 65501

SEQ ID NO: 197182 - RNA, 64 nt, hsa; identical to SEQ ID NO: 65502

SEQ ID NO: 197183 - RNA, 64 nt, hsa; identical to SEQ ID NO: 65503

SEQ ID NO: 197184 - RNA, 64 nt, hsa; identical to SEQ ID NO: 65504

SEQ ID NO: 197185 - RNA, 64 nt, hsa; identical to SEQ ID NO: 65505

SEQ ID NO: 197186 - RNA, 64 nt, hsa; identical to SEQ ID NO: 65506

SEQ ID NO: 197187 - RNA, 64 nt, hsa; identical to SEQ ID NO: 65507

SEQ ID NO: 197188 - RNA, 64 nt, hsa; identical to SEQ ID NO: 65508

SEQ ID NO: 197189 - RNA, 64 nt, hsa; identical to SEQ ID NO: 61360

SEQ ID NO: 197190 - RNA, 64 nt, hsa; identical to SEQ ID NO: 61361

SEQ ID NO: 197191 - RNA, 64 nt, hsa; identical to SEQ ID NO: 65511

SEQ ID NO: 197192 - RNA, 64 nt, hsa; identical to SEQ ID NO: 65512

SEQ ID NO: 197193 - RNA, 64 nt, hsa; identical to SEQ ID NO: 65513

SEQ ID NO: 197194 - RNA, 64 nt, hsa; identical to SEQ ID NO: 65514

SEQ ID NO: 197195 - RNA, 64 nt, hsa; identical to SEQ ID NO: 65515

SEQ ID NO: 197196 - RNA, 64 nt, hsa; identical to SEQ ID NO: 65516

SEQ ID NO: 197197 - RNA, 64 nt, hsa; identical to SEQ ID NO: 65517

SEQ ID NO: 197198 - RNA, 64 nt, hsa; identical to SEQ ID NO: 65518

SEQ ID NO: 197199 - RNA, 64 nt, hsa; identical to SEQ ID NO: 65519

SEQ ID NO: 197200 - RNA, 64 nt, hsa; identical to SEQ ID NO: 65520

SEQ ID NO: 197201 - RNA, 64 nt, hsa; identical to SEQ ID NO: 65521

SEQ ID NO: 197202 - RNA, 64 nt, hsa; identical to SEQ ID NO: 65522

SEQ ID NO: 197203 - RNA, 64 nt, hsa; identical to SEQ ID NO: 65523

SEQ ID NO: 197204 - RNA, 64 nt, hsa; identical to SEQ ID NO: 65524

SEQ ID NO: 197205 - RNA, 64 nt, hsa; identical to SEQ ID NO: 65525

SEQ ID NO: 197206 - RNA, 64 nt, hsa; identical to SEQ ID NO: 65526

SEQ ID NO: 197207 - RNA, 64 nt, hsa; identical to SEQ ID NO: 65527

SEQ ID NO: 197208 - RNA, 64 nt, hsa; identical to SEQ ID NO: 65528

SEQ ID NO: 197209 - RNA, 64 nt, hsa; identical to SEQ ID NO: 61362

SEQ ID NO: 197210 - RNA, 64 nt, hsa; identical to SEQ ID NO: 61363

SEQ ID NO: 197211 - RNA, 64 nt, hsa; identical to SEQ ID NO: 61364

SEQ ID NO: 197212 - RNA, 64 nt, hsa; identical to SEQ ID NO: 61365

SEQ ID NO: 197213 - RNA, 64 nt, hsa; identical to SEQ ID NO: 65533

SEQ ID NO: 197214 - RNA, 64 nt, hsa; identical to SEQ ID NO: 65534

SEQ ID NO: 197215 - RNA, 64 nt, hsa; identical to SEQ ID NO: 65535

SEQ ID NO: 197216 - RNA, 64 nt, hsa; identical to SEQ ID NO: 65536

SEQ ID NO: 197217 - RNA, 64 nt, hsa; identical to SEQ ID NO: 65537

SEQ ID NO: 197218 - RNA, 64 nt, hsa; identical to SEQ ID NO: 65538

SEQ ID NO: 197219 - RNA, 64 nt, hsa; identical to SEQ ID NO: 65539

SEQ ID NO: 197220 - RNA, 64 nt, hsa; identical to SEQ ID NO: 65540

SEQ ID NO: 197221 - RNA, 64 nt, hsa; identical to SEQ ID NO: 65541

SEQ ID NO: 197222 - RNA, 64 nt, hsa; identical to SEQ ID NO: 65542

SEQ ID NO: 197223 - RNA, 64 nt, hsa; identical to SEQ ID NO: 65543

SEQ ID NO: 197224 - RNA, 64 nt, hsa; identical to SEQ ID NO: 65544

SEQ ID NO: 197225 - RNA, 64 nt, hsa; identical to SEQ ID NO: 65545

SEQ ID NO: 197226 - RNA, 64 nt, hsa; identical to SEQ ID NO: 65546

SEQ ID NO: 197227 - RNA, 64 nt, hsa; identical to SEQ ID NO: 65547

SEQ ID NO: 197228 - RNA, 64 nt, hsa; identical to SEQ ID NO: 61366

SEQ ID NO: 197229 - RNA, 64 nt, hsa; identical to SEQ ID NO: 61367

SEQ ID NO: 197230 - RNA, 64 nt, hsa; identical to SEQ ID NO: 65550

SEQ ID NO: 197231 - RNA, 64 nt, hsa; identical to SEQ ID NO: 65551

SEQ ID NO: 197232 - RNA, 64 nt, hsa; identical to SEQ ID NO: 61368

SEQ ID NO: 197233 - RNA, 56 nt, hsa; identical to SEQ ID NO: 61369

SEQ ID NO: 197234 - RNA, 64 nt, hsa; identical to SEQ ID NO: 65554

SEQ ID NO: 197235 - RNA, 64 nt, hsa; identical to SEQ ID NO: 65555

SEQ ID NO: 197236 - RNA, 64 nt, hsa; identical to SEQ ID NO: 65556

SEQ ID NO: 197237 - RNA, 64 nt, hsa; identical to SEQ ID NO: 65557

SEQ ID NO: 197238 - RNA, 64 nt, hsa; identical to SEQ ID NO: 65558

SEQ ID NO: 197239 - RNA, 64 nt, hsa; identical to SEQ ID NO: 65559

SEQ ID NO: 197240 - RNA, 64 nt, hsa; identical to SEQ ID NO: 65560

SEQ ID NO: 197241 - RNA, 64 nt, hsa; identical to SEQ ID NO: 65561

SEQ ID NO: 197242 - RNA, 64 nt, hsa; identical to SEQ ID NO: 65562

SEQ ID NO: 197243 - RNA, 64 nt, hsa; identical to SEQ ID NO: 65563

SEQ ID NO: 197244 - RNA, 64 nt, hsa; identical to SEQ ID NO: 65564

SEQ ID NO: 197245 - RNA, 64 nt, hsa; identical to SEQ ID NO: 65565

SEQ ID NO: 197246 - RNA, 64 nt, hsa; identical to SEQ ID NO: 65566

SEQ ID NO: 197247 - RNA, 64 nt, hsa; identical to SEQ ID NO: 65567

SEQ ID NO: 197248 - RNA, 64 nt, hsa; identical to SEQ ID NO: 65568

SEQ ID NO: 197249 - RNA, 64 nt, hsa; identical to SEQ ID NO: 65569

SEQ ID NO: 197250 - RNA, 64 nt, hsa; identical to SEQ ID NO: 65570

SEQ ID NO: 197251 - RNA, 64 nt, hsa; identical to SEQ ID NO: 65571

SEQ ID NO: 197252 - RNA, 64 nt, hsa; identical to SEQ ID NO: 65572

SEQ ID NO: 197253 - RNA, 64 nt, hsa; identical to SEQ ID NO: 65573

SEQ ID NO: 197254 - RNA, 64 nt, hsa; identical to SEQ ID NO: 61370

SEQ ID NO: 197255 - RNA, 64 nt, hsa; identical to SEQ ID NO: 61371

SEQ ID NO: 197256 - RNA, 64 nt, hsa; identical to SEQ ID NO: 65576

SEQ ID NO: 197257 - RNA, 64 nt, hsa; identical to SEQ ID NO: 65577

SEQ ID NO: 197258 - RNA, 64 nt, hsa; identical to SEQ ID NO: 65578

SEQ ID NO: 197259 - RNA, 64 nt, hsa; identical to SEQ ID NO: 65579

SEQ ID NO: 197260 - RNA, 64 nt, hsa; identical to SEQ ID NO: 65580

SEQ ID NO: 197261 - RNA, 64 nt, hsa; identical to SEQ ID NO: 65581

SEQ ID NO: 197262 - RNA, 64 nt, hsa; identical to SEQ ID NO: 65582

SEQ ID NO: 197263 - RNA, 64 nt, hsa; identical to SEQ ID NO: 65583

SEQ ID NO: 197264 - RNA, 64 nt, hsa; identical to SEQ ID NO: 65584

SEQ ID NO: 197265 - RNA, 64 nt, hsa; identical to SEQ ID NO: 65585

SEQ ID NO: 197266 - RNA, 64 nt, hsa; identical to SEQ ID NO: 65586

SEQ ID NO: 197267 - RNA, 64 nt, hsa; identical to SEQ ID NO: 65587

SEQ ID NO: 197268 - RNA, 64 nt, hsa; identical to SEQ ID NO: 65588

SEQ ID NO: 197269 - RNA, 64 nt, hsa; identical to SEQ ID NO: 65589

SEQ ID NO: 197270 - RNA, 64 nt, hsa; identical to SEQ ID NO: 65590

SEQ ID NO: 197271 - RNA, 64 nt, hsa; identical to SEQ ID NO: 65591

SEQ ID NO: 197272 - RNA, 64 nt, hsa; identical to SEQ ID NO: 65592

SEQ ID NO: 197273 - RNA, 64 nt, hsa; identical to SEQ ID NO: 65593

SEQ ID NO: 197274 - RNA, 64 nt, hsa; identical to SEQ ID NO: 65594

SEQ ID NO: 197275 - RNA, 64 nt, hsa; identical to SEQ ID NO: 65595

SEQ ID NO: 197276 - RNA, 64 nt, hsa; identical to SEQ ID NO: 65596

SEQ ID NO: 197277 - RNA, 64 nt, hsa; identical to SEQ ID NO: 65597

SEQ ID NO: 197278 - RNA, 64 nt, hsa; identical to SEQ ID NO: 65598

SEQ ID NO: 197279 - RNA, 64 nt, hsa; identical to SEQ ID NO: 65599

SEQ ID NO: 197280 - RNA, 64 nt, hsa; identical to SEQ ID NO: 65600

SEQ ID NO: 197281 - RNA, 64 nt, hsa; identical to SEQ ID NO: 65601

SEQ ID NO: 197282 - RNA, 64 nt, hsa; identical to SEQ ID NO: 65602

SEQ ID NO: 197283 - RNA, 64 nt, hsa; identical to SEQ ID NO: 65603

SEQ ID NO: 197284 - RNA, 64 nt, hsa; identical to SEQ ID NO: 65604

SEQ ID NO: 197285 - RNA, 64 nt, hsa; identical to SEQ ID NO: 65605

SEQ ID NO: 197286 - RNA, 64 nt, hsa; identical to SEQ ID NO: 65606

SEQ ID NO: 197287 - RNA, 64 nt, hsa; identical to SEQ ID NO: 65607

SEQ ID NO: 197288 - RNA, 64 nt, hsa; identical to SEQ ID NO: 65608

SEQ ID NO: 197289 - RNA, 64 nt, hsa; identical to SEQ ID NO: 65609

SEQ ID NO: 197290 - RNA, 64 nt, hsa; identical to SEQ ID NO: 65610

SEQ ID NO: 197291 - RNA, 64 nt, hsa; identical to SEQ ID NO: 65611

SEQ ID NO: 197292 - RNA, 64 nt, hsa; identical to SEQ ID NO: 61372

SEQ ID NO: 197293 - RNA, 64 nt, hsa; identical to SEQ ID NO: 61373

SEQ ID NO: 197294 - RNA, 64 nt, hsa; identical to SEQ ID NO: 65614

SEQ ID NO: 197295 - RNA, 64 nt, hsa; identical to SEQ ID NO: 65615

SEQ ID NO: 197296 - RNA, 64 nt, hsa; identical to SEQ ID NO: 65616

SEQ ID NO: 197297 - RNA, 64 nt, hsa; identical to SEQ ID NO: 61374

SEQ ID NO: 197298 - RNA, 64 nt, hsa; identical to SEQ ID NO: 61375

SEQ ID NO: 197299 - RNA, 64 nt, hsa; identical to SEQ ID NO: 65619

SEQ ID NO: 197300 - RNA, 64 nt, hsa; identical to SEQ ID NO: 65620

SEQ ID NO: 197301 - RNA, 64 nt, hsa; identical to SEQ ID NO: 65621

SEQ ID NO: 197302 - RNA, 64 nt, hsa; identical to SEQ ID NO: 65622

SEQ ID NO: 197303 - RNA, 64 nt, hsa; identical to SEQ ID NO: 65623

SEQ ID NO: 197304 - RNA, 64 nt, hsa; identical to SEQ ID NO: 65624

SEQ ID NO: 197305 - RNA, 64 nt, hsa; identical to SEQ ID NO: 65625

SEQ ID NO: 197306 - RNA, 64 nt, hsa; identical to SEQ ID NO: 65626

SEQ ID NO: 197307 - RNA, 64 nt, hsa; identical to SEQ ID NO: 65627

SEQ ID NO: 197308 - RNA, 64 nt, hsa; identical to SEQ ID NO: 65628

SEQ ID NO: 197309 - RNA, 64 nt, hsa; identical to SEQ ID NO: 65629

SEQ ID NO: 197310 - RNA, 64 nt, hsa; identical to SEQ ID NO: 65630

SEQ ID NO: 197311 - RNA, 64 nt, hsa; identical to SEQ ID NO: 65631

SEQ ID NO: 197312 - RNA, 64 nt, hsa; identical to SEQ ID NO: 65632

SEQ ID NO: 197313 - RNA, 64 nt, hsa; identical to SEQ ID NO: 65633

SEQ ID NO: 197314 - RNA, 64 nt, hsa; identical to SEQ ID NO: 65634

SEQ ID NO: 197315 - RNA, 64 nt, hsa; identical to SEQ ID NO: 65635

SEQ ID NO: 197316 - RNA, 64 nt, hsa; identical to SEQ ID NO: 65636

SEQ ID NO: 197317 - RNA, 64 nt, hsa; identical to SEQ ID NO: 65637

SEQ ID NO: 197318 - RNA, 64 nt, hsa; identical to SEQ ID NO: 65638

SEQ ID NO: 197319 - RNA, 64 nt, hsa; identical to SEQ ID NO: 65639

SEQ ID NO: 197320 - RNA, 64 nt, hsa; identical to SEQ ID NO: 65640

SEQ ID NO: 197321 - RNA, 64 nt, hsa; identical to SEQ ID NO: 65641

SEQ ID NO: 197322 - RNA, 64 nt, hsa; identical to SEQ ID NO: 65642

SEQ ID NO: 197323 - RNA, 64 nt, hsa; identical to SEQ ID NO: 65643

SEQ ID NO: 197324 - RNA, 64 nt, hsa; identical to SEQ ID NO: 65644

SEQ ID NO: 197325 - RNA, 60 nt, hsa; identical to SEQ ID NO: 65087

SEQ ID NO: 197326 - RNA, 64 nt, hsa; identical to SEQ ID NO: 65646

SEQ ID NO: 197327 - RNA, 64 nt, hsa; identical to SEQ ID NO: 65647

SEQ ID NO: 197328 - RNA, 64 nt, hsa; identical to SEQ ID NO: 65648

SEQ ID NO: 197329 - RNA, 64 nt, hsa; identical to SEQ ID NO: 65649

SEQ ID NO: 197330 - RNA, 64 nt, hsa; identical to SEQ ID NO: 65650

SEQ ID NO: 197331 - RNA, 64 nt, hsa; identical to SEQ ID NO: 65651

SEQ ID NO: 197332 - RNA, 51 nt, hsa; identical to SEQ ID NO: 65094

SEQ ID NO: 197333 - RNA, 64 nt, hsa; identical to SEQ ID NO: 65653

SEQ ID NO: 197334 - RNA, 64 nt, hsa; identical to SEQ ID NO: 65654

SEQ ID NO: 197335 - RNA, 64 nt, hsa; identical to SEQ ID NO: 65655

SEQ ID NO: 197336 - RNA, 64 nt, hsa; identical to SEQ ID NO: 65656

SEQ ID NO: 197337 - RNA, 64 nt, hsa; identical to SEQ ID NO: 65657

SEQ ID NO: 197338 - RNA, 64 nt, hsa; identical to SEQ ID NO: 65658

SEQ ID NO: 197339 - RNA, 64 nt, hsa; identical to SEQ ID NO: 65659

SEQ ID NO: 197340 - RNA, 64 nt, hsa; identical to SEQ ID NO: 65660

SEQ ID NO: 197341 - RNA, 64 nt, hsa; identical to SEQ ID NO: 65661

SEQ ID NO: 197342 - RNA, 64 nt, hsa; identical to SEQ ID NO: 65662

SEQ ID NO: 197343 - RNA, 64 nt, hsa; identical to SEQ ID NO: 65663

SEQ ID NO: 197344 - RNA, 64 nt, hsa; identical to SEQ ID NO: 65664

SEQ ID NO: 197345 - RNA, 64 nt, hsa; identical to SEQ ID NO: 65665

SEQ ID NO: 197346 - RNA, 64 nt, hsa; identical to SEQ ID NO: 65666

SEQ ID NO: 197347 - RNA, 64 nt, hsa; identical to SEQ ID NO: 65667

SEQ ID NO: 197348 - RNA, 64 nt, hsa; identical to SEQ ID NO: 65668

SEQ ID NO: 197349 - RNA, 64 nt, hsa; identical to SEQ ID NO: 65669

SEQ ID NO: 197350 - RNA, 64 nt, hsa; identical to SEQ ID NO: 65670

SEQ ID NO: 197351 - RNA, 64 nt, hsa; identical to SEQ ID NO: 65671

SEQ ID NO: 197352 - RNA, 64 nt, hsa; identical to SEQ ID NO: 65672

SEQ ID NO: 197353 - RNA, 64 nt, hsa; identical to SEQ ID NO: 65673

SEQ ID NO: 197354 - RNA, 64 nt, hsa; identical to SEQ ID NO: 65674

SEQ ID NO: 197355 - RNA, 64 nt, hsa; identical to SEQ ID NO: 65675

SEQ ID NO: 197356 - RNA, 64 nt, hsa; identical to SEQ ID NO: 65676

SEQ ID NO: 197357 - RNA, 64 nt, hsa; identical to SEQ ID NO: 65677

SEQ ID NO: 197358 - RNA, 64 nt, hsa; identical to SEQ ID NO: 65678

SEQ ID NO: 197359 - RNA, 64 nt, hsa; identical to SEQ ID NO: 65679

SEQ ID NO: 197360 - RNA, 64 nt, hsa; identical to SEQ ID NO: 65680

SEQ ID NO: 197361 - RNA, 64 nt, hsa; identical to SEQ ID NO: 65681

SEQ ID NO: 197362 - RNA, 64 nt, hsa; identical to SEQ ID NO: 65682

SEQ ID NO: 197363 - RNA, 64 nt, hsa; identical to SEQ ID NO: 65683

SEQ ID NO: 197364 - RNA, 64 nt, hsa; identical to SEQ ID NO: 65684

SEQ ID NO: 197365 - RNA, 64 nt, hsa; identical to SEQ ID NO: 65685

SEQ ID NO: 197366 - RNA, 64 nt, hsa; identical to SEQ ID NO: 65686

SEQ ID NO: 197367 - RNA, 64 nt, hsa; identical to SEQ ID NO: 65687

SEQ ID NO: 197368 - RNA, 64 nt, hsa; identical to SEQ ID NO: 65688

SEQ ID NO: 197369 - RNA, 64 nt, hsa; identical to SEQ ID NO: 65689

SEQ ID NO: 197370 - RNA, 64 nt, hsa; identical to SEQ ID NO: 65690

SEQ ID NO: 197371 - RNA, 64 nt, hsa; identical to SEQ ID NO: 65691

SEQ ID NO: 197372 - RNA, 64 nt, hsa; identical to SEQ ID NO: 65692

SEQ ID NO: 197373 - RNA, 64 nt, hsa; identical to SEQ ID NO: 65693

SEQ ID NO: 197374 - RNA, 64 nt, hsa
ugaagcacccagucucguaccauuuugagcccuccagcacuacuuauuuucccccaccuuugcc

SEQ ID NO: 197375 - RNA, 64 nt, hsa
gucagagguauuuauuaaguaccuacugugugcucagcacuaaagguuuguugauaaaaugaca

SEQ ID NO: 197376 - RNA, 63 nt, hsa
ucucguuuaaacaacaacaacaaaauaaauuuaucagcacuagauauuagauuugaaauaagu

SEQ ID NO: 197377 - RNA, 64 nt, hsa
guacacacucuugugggacguaucauauaaaugucagcacuaaguaaugucuuguuuguggcug

SEQ ID NO: 197378 - RNA, 64 nt, hsa
uauuuuuuaaaaucauuauauugaguuguguuuucagcacuauauuggucaagauagccaagca

SEQ ID NO: 197379 - RNA, 64 nt, hsa
uggauguauuaauuggcucuauaaacuaugugcccagcacuaugcugagcuuacacuaauuggu

SEQ ID NO: 197380 - RNA, 64 nt, hsa
gaaaucuuugcaaaggucgguucuauucagcgaacagcacuauagcaaaagaagaucguuccau

SEQ ID NO: 197381 - RNA, 64 nt, hsa
ccuccuucaucacauccugcaguaucuccagaagcagcacuaggguuugaguuucauacuucag

SEQ ID NO: 197382 - RNA, 64 nt, hsa
acuaaucaguuggggaaaaaaauacuauagcagacagcacuaaugucaucaacaaacauuguuc

SEQ ID NO: 197383 - RNA, 64 nt, hsa
uugauugacucagagagcacuauggugguggguccagcacuauggugcucucuguaaugccucu

SEQ ID NO: 197384 - RNA, 64 nt, hsa
ggguucucugcagauggucccaguaauagauacucagcacuagacuaacauaacaggucacuac

SEQ ID NO: 197385 - RNA, 64 nt, hsa
aagcagacagcuuuacuuuguaagguuggaacagcagcacuauacaugaaauauaaaccaaaaa

SEQ ID NO: 197386 - RNA, 64 nt, hsa
auuacucuguguugcuauuuucuaagaaagaauacagcacuagacuucauccuagaguuucagg

SEQ ID NO: 197387 - RNA, 64 nt, hsa
uccaucaauguacuuugaacuaccugacucauuccagcacuacagaaguguguuuuacucauuu

SEQ ID NO: 197388 - RNA, 64 nt, hsa
cagucucugcccaggucacagcacaagugcacaucagcacuauggggccuauguccugcccaga

SEQ ID NO: 197389 - RNA, 64 nt, hsa
aagagcagacagcguaacagcagccuaugccaaacagcacuaaggaugucaguguacgagacgg

SEQ ID NO: 197390 - RNA, 64 nt, hsa
uuauaugcagauuccuaguagcaugccuuaccuacagcacuaugugcauuugcugucacaauaa

SEQ ID NO: 197391 - RNA, 64 nt, hsa
uuuuguggccauggcagacauugcuaaucaaucacagcacuauuuccuauuaagcccacugauu

SEQ ID NO: 197392 - RNA, 64 nt, hsa
uuuuaauuuaguaaaccaauccuaugcaugguuucagcacuagccaaaccucaccaacuccuag

SEQ ID NO: 197393 - RNA, 64 nt, hsa
acuggccaggugcaguggcucaugccuguaaucccagcacuaugggaggcugaggcgggcagau

SEQ ID NO: 197394 - RNA, 64 nt, hsa
agaugagcuuccggagacugcucuccucaccacacagcacuaguccauccucagcaccugagcc

SEQ ID NO: 197395 - RNA, 64 nt, hsa
cacagagcucaggguggcagaucuccgguauccucagcacuacccacccccgccagcuccccag

SEQ ID NO: 197396 - RNA, 64 nt, hsa
cgacuguggccuggccucagugguacccacacaucagcacuaccacaagaaccaacacugagcc

SEQ ID NO: 197397 - RNA, 64 nt, hsa
ggaaagccuuugcaaucuugcaagauuuguagaccagcacuacaaagaucgcauagaucaaaua

SEQ ID NO: 197398 - RNA, 64 nt, hsa
aaaggaagcccuuuagaauuagagucuugagggacagcacuaacaggccuuuauuaaguaugau

SEQ ID NO: 197399 - RNA, 64 nt, hsa
ggugaacucagcaaggcagacuggcugcuuacuucagcacuauuggaauuauuucccgcuguug

SEQ ID NO: 197400 - RNA, 64 nt, hsa
ccuacauuuuaacuggaaaucuacuugaagacuccagcacuacauguuaugaagcuguaaauaa

SEQ ID NO: 197401 - RNA, 64 nt, hsa
uaauggucugacacaaaagcaaguuugauuuuugcagcacuagcaauggacuuuguuguuuuuc

SEQ ID NO: 197402 - RNA, 64 nt, hsa
auuuuaauugaagggugagcauaaccuugugaaccagcacuagcuuguuccaagcuggaauuua

SEQ ID NO: 197403 - RNA, 64 nt, hsa
ccguccucuacgcuugggcuuuucuguuaccaaacagcacuaucccaggaacuauugucugccu

SEQ ID NO: 197404 - RNA, 64 nt, hsa
aaugccuaccaucagcuccugaaucagggauuuucagcacuaccucugagccaugggguuggcu

SEQ ID NO: 197405 - RNA, 64 nt, hsa
aaaaauguauagagugugauguccaauugguauucagcacuauaaauguguuuuuaaccucccg

SEQ ID NO: 197406 - RNA, 64 nt, hsa
accuagcagguucugugaacucucaggccuuggccagcacuaguuaggggaggucaggugguca

SEQ ID NO: 197407 - RNA, 64 nt, hsa
cuaagaugcccaugagaacagaccaagauguguacagcacuaugagcauuaaaaaaccuuccag

SEQ ID NO: 197408 - RNA, 64 nt, hsa
ccauguccccuucuaaauuccaaagacuccaacgcagcacuagcaagcagguucgggacagccc

SEQ ID NO: 197409 - RNA, 64 nt, hsa
gugagaaaaggugguuauuuuuuccccaagacaacagcacuaguaaucccacuuaauaagagcu

SEQ ID NO: 197410 - RNA, 64 nt, hsa
auuagacugacuggauucauucucauaauuccuacagcacuacugggugucauuucauuccauu

SEQ ID NO: 197411 - RNA, 64 nt, hsa
accggcauggccacucagacacaaguccacaccacagcacuaccgucccauccguucucaugaa

SEQ ID NO: 197412 - RNA, 64 nt, hsa
uuuggccgggcacgguggcucacaccuauaaucccagcacuaugggaggcugaggcaagcaggu

SEQ ID NO: 197413 - RNA, 64 nt, hsa
gcugugguuaugggcauuuagaaaacuugaaagucagcacuaaaggaugggcagagguucaacc

SEQ ID NO: 197414 - RNA, 64 nt, hsa
auuaaggaugaccugugcaaaauuauacccacaccagcacuagugguaauuauucuaaauuauu

SEQ ID NO: 197415 - RNA, 64 nt, hsa
uugggccaggugcgguggcucaugccuguaaucccagcacuaugggaggccagggagggaggau

SEQ ID NO: 197416 - RNA, 64 nt, hsa
auaacuuugcuauuacgaauagugcugcgauaaacagcacuauuaugaauagugcugcgauaaa

SEQ ID NO: 197417 - RNA, 64 nt, hsa
cuugaaaguuagauuaauaucaaaauaagaauagcagcacuaugaagaguuaauaaaaugcaau

SEQ ID NO: 197418 - RNA, 64 nt, hsa
ugcugagccaguggcugccccgugcccuccuucccagcacuaucaugugucacguuucccggac

SEQ ID NO: 197419 - RNA, 64 nt, hsa
ugagaguaauaaaacuuggcuucucucuaccucucagcacuaaugauggucaaaugccuuacau

SEQ ID NO: 197420 - RNA, 64 nt, hsa
gauuuugccuccccgaucagugugugccuguuuacagcacuaucuaucuuucucucuccaaaug

SEQ ID NO: 197421 - RNA, 64 nt, hsa
auugaucuaauuuacauauucugcguguuguauucagcacuaaaaaauggugggagcuggggga

SEQ ID NO: 197422 - RNA, 64 nt, hsa
gaauacuugguuucuuuucuuacuuaucaaaagacagcacuacagauaucauauugaggauuaa

SEQ ID NO: 197423 - RNA, 64 nt, hsa
uguguuagacucucuccuuuuguguuuuuacaugcagcacuacucuugguuuuauuucagucug

SEQ ID NO: 197424 - RNA, 64 nt, hsa
auauuaaagagacauuugaacccuauguuuacugcagcacuauucacaauagccaagauauagg

SEQ ID NO: 197425 - RNA, 64 nt, hsa
ucagucagcauuuaaugaccaccuacugugugcacagcacuacugguaaaauuuugaagacauu

SEQ ID NO: 197426 - RNA, 64 nt, hsa
uguagauacagauccgcaugugucuguauucauacagcacuacuuacuuagagaugcuacuguc

SEQ ID NO: 197427 - RNA, 64 nt, hsa
ucuaauuucuuacucuauuguacguuuacagucgcagcacuaaaaauggaugacaucaaacauu

SEQ ID NO: 197428 - RNA, 64 nt, hsa
ggguccuguauuuuuccaaacaacugugcuucuucagcacuaauauuucugggauuuaaauagu

SEQ ID NO: 197429 - RNA, 64 nt, hsa
uaauauguaauuugaaaaauaaaaucuuaucuugcagcacuaucaguauguugaauuuauuaug

SEQ ID NO: 197430 - RNA, 64 nt, hsa
uggaauuuuuuauucuugugaauauguacauaggcagcacuagcgacauugcagucugcuucug

SEQ ID NO: 197431 - RNA, 64 nt, hsa
uaauuucucauuugcaggaaaugcuggcauagagcagcacuaaaugacaccacuaaagaaacga

SEQ ID NO: 197432 - RNA, 64 nt, hsa; identical to SEQ ID NO: 197431

SEQ ID NO: 197433 - RNA, 64 nt, hsa
uacauauugcaaccuaauuuguuaaaacuaacuccagcacuaaagcugaaaugccacaaacacu

SEQ ID NO: 197434 - RNA, 64 nt, hsa
cacuuggagccaaggguucagagacucagggccccagcacuaaagcaguggacaccaggagucc

SEQ ID NO: 197435 - RNA, 64 nt, hsa
caaaugacuagcuuugcacagacaccucuaccuucagcacuaugggauucuagauuaauggggg

SEQ ID NO: 197436 - RNA, 64 nt, hsa
caacuuugcaauagaaauacuggugccugcagagcagcacuaacaguggcaggugcuguacuag

SEQ ID NO: 197437 - RNA, 64 nt, hsa
uaugcucugguacacagaugucauuuuguugucacagcacuacagugaaauacacaaaaaauga

SEQ ID NO: 197438 - RNA, 64 nt, hsa
caacaggaugaaaauccaucagaaucucagacuacagcacuaaauaugcuuugaugcuacauca

SEQ ID NO: 197439 - RNA, 64 nt, hsa
aauaagucggacuuauuaacucugagugccuugccagcacuaacauucuagaguauuccaggug

SEQ ID NO: 197440 - RNA, 64 nt, hsa
ggguggagggaagcugaggauagagcuccagaaacagcacuagggucccaggagaggggcauuu

SEQ ID NO: 197441 - RNA, 64 nt, hsa
uccugacccuucccagcccccuccagggccaaugcagcacuaaaucccucucuccuccagcauu

SEQ ID NO: 197442 - RNA, 64 nt, hsa
cuuucucaguguccguggcauuuuugugacuucccagcacuagaauaaguuuuccugccaaaau

SEQ ID NO: 197443 - RNA, 64 nt, hsa
acugcaaaucugccugauaggacccauauucccacagcacuaauucaacauauaccuuacugag

SEQ ID NO: 197444 - RNA, 64 nt, hsa
cauuucuaagccuuugagacuguuccugagccuucagcacuaaccuaugagggugagcuggucc

SEQ ID NO: 197445 - RNA, 64 nt, hsa
cacacauucuugcucuacccaaagcucuggcuggcagcacuaaaugcuuuggugguguuugcac

SEQ ID NO: 197446 - RNA, 64 nt, hsa
ccuacagguaagucuacauccucucugacagccacagcacuacaucaaucccugacguuaggga

SEQ ID NO: 197447 - RNA, 64 nt, hsa
ucauauauaauaaauuaagggacaauggggcugacagcacuaaacuuggugcuuauugauauuc

SEQ ID NO: 197448 - RNA, 64 nt, hsa
auacaggugguuuuaaauauauagaugcaaauugcagcacuacuuuaaauauuagauuaugucu

SEQ ID NO: 197449 - RNA, 64 nt, hsa
cucagcauuuaauccaaacagggguucuuagucucagcacuaugacauuuugggcugacuacuu

SEQ ID NO: 197450 - RNA, 64 nt, hsa
gcauaacuaggauuauaaugcugccucauuuucacagcacuacuugcuuauauugacaacaaau

SEQ ID NO: 197451 - RNA, 64 nt, hsa
uuuaauugggggaaauaagcacuauuaacagauucagcacuacaaguauuuugaauguuguugc

SEQ ID NO: 197452 - RNA, 64 nt, hsa
uauuuuguaauucauauaguaagaguauucuaaacagcacuacauuaauaucauuugauaggua

SEQ ID NO: 197453 - RNA, 64 nt, hsa
caaaaauacggagcagugccuaguaucuggagagcagcacuaccauuuauucuuucauuuauag

SEQ ID NO: 197454 - RNA, 64 nt, hsa
aaguuagagaauuuuuuuccaacugcauucuguacagcacuaguuacauuaugacaggaaguaa

SEQ ID NO: 197455 - RNA, 64 nt, hsa
gacgugugaccuccauacugggcuaaggaaguaucagcacuagaaauugggcagucuuaauguu

SEQ ID NO: 197456 - RNA, 53 nt, hsa
agucugucaaaaagaaguaaccucagcacuacuauucucucuuaaaagauaag

SEQ ID NO: 197457 - RNA, 64 nt, hsa
cauguuucaguccucuaccauccugcacugugagcagcacuauaccugugcguugucugaaagc

SEQ ID NO: 197458 - RNA, 64 nt, hsa
cuccaccugccuccaggccacgaaaugggaauuccagcacuaagccaggcaccgggcagaagcu

SEQ ID NO: 197459 - RNA, 64 nt, hsa
uguuaccuuuuuaaucaagggcaacuuccuuuuccagcacuaccauuguaagguuuuuuucagg

SEQ ID NO: 197460 - RNA, 64 nt, hsa
gcagaccgaguggcagucuggcuaaaggcccauccagcacuauugugcccaagagccuuaccgg

SEQ ID NO: 197461 - RNA, 64 nt, hsa
uauuguuugucuguuuaguauuuuagaaauauaccagcacuacuaauuaacuaaugucuuuuau

SEQ ID NO: 197462 - RNA, 64 nt, hsa
uauucugccuuuggcuaauugaguaauuccccuccagcacuagagaccgcucagugcucuuacu

SEQ ID NO: 197463 - RNA, 64 nt, hsa
ucacacaaucgaagacugcacaacuccuagaaggcagcacuaugcugcaaacccagacggccac

SEQ ID NO: 197464 - RNA, 64 nt, hsa
gggcucucacagauacccauccaacuccucuagucagcacuagaucaugggauccuaaaauaaa

SEQ ID NO: 197465 - RNA, 64 nt, hsa
aauggguaagcagacaggccaugauuuaguuggccagcacuaacuccaccucuguucuccuuga

SEQ ID NO: 197466 - RNA, 64 nt, hsa
cacaaaaccacccauucauucauuuauucauucacagcacuagcaagugcugccuaugcugaga

SEQ ID NO: 197467 - RNA, 64 nt, hsa
augcugcaauguauaaucugguguguuauuuaaacagcacuaguacuguacacugguuuuuuuc

SEQ ID NO: 197468 - RNA, 64 nt, hsa
ugagacuugcauguuccucgcaugugucuaaugucagcacuagaaagcaguuuuaggagguucc

SEQ ID NO: 197469 - RNA, 64 nt, hsa
uuggaaaccaucagguacugccugcagacuucuccagcacuaaauauauuuguucccucuauaa

SEQ ID NO: 197470 - RNA, 64 nt, hsa
gcauauaaaacuaucagaaguuaguaaaucauaccagcacuaaaaauaagacaauuggaauaua

SEQ ID NO: 197471 - RNA, 64 nt, hsa
ucauaauuaaugcguuacuguaugaaccacaaaacagcacuauuuauuuagccuuacuucuacu

SEQ ID NO: 197472 - RNA, 64 nt, hsa
uuagauucuuggucacuucucuaccacaagccaccagcacuauaaccaguuuugcguggguucu

SEQ ID NO: 197473 - RNA, 64 nt, hsa
ucaaaucuuucuaauuuuuuguaucuuuagagggcagcacuagaagaaaucagcaggucuaauc

SEQ ID NO: 197474 - RNA, 64 nt, hsa
cacccucaacaaacaccagcgcuuuggguacgugcagcacuacggccugggcagugccugugac

SEQ ID NO: 197475 - RNA, 64 nt, hsa
caacuucccaguucaggagucccaaggaaagccccagcacuaacguaaauacacaacacacaca

SEQ ID NO: 197476 - RNA, 64 nt, hsa
aucuauuccugguagaauagauauccacuugagacagcacuauguaggaaagaccauuuuuccu

SEQ ID NO: 197477 - RNA, 64 nt, hsa
auuauaauaguguuuaccaaacauaccaauaauucagcacuacaauucagaccuuugaaaaucu

SEQ ID NO: 197478 - RNA, 64 nt, hsa
uccaaauaaaacaguuuccauaaggugucagcaacagcacuaaaaaucucaaaucacacugaac

SEQ ID NO: 197479 - RNA, 64 nt, hsa
auucaauguuauaaaacaagcagaauuuuaaaagcagcacuauauagcuguuuuguauuauagu

SEQ ID NO: 197480 - RNA, 64 nt, hsa
cuuauacagggagagagucuucaauaaauguagucagcacuauuuucugcauccagugugguug

SEQ ID NO: 197481 - RNA, 64 nt, hsa
acgauuucagugaccaaaugcucagcuguaaccacagcacuaacuggccuucuuuccagauugg

SEQ ID NO: 197482 - RNA, 64 nt, hsa
auuagugugauaaugugcugcaaaaaauauccaacagcacuacacauaaguacagaguauucac

SEQ ID NO: 197483 - RNA, 64 nt, hsa
agcucuccaguggcuuuuaaagaaagcugguccucagcacuaacaaaaucacuacaauagccua

SEQ ID NO: 197484 - RNA, 64 nt, hsa
gaaagaacaccucuggguccuucuguccaguuuucagcacuagucuuacucagcuauccauuau

SEQ ID NO: 197485 - RNA, 64 nt, hsa
ugggugugccaaaauaugcccaggguccugcccucagcacuagauuuaauggggccaagagggu

SEQ ID NO: 197486 - RNA, 64 nt, hsa
cccuccaggaaccaaggaguggcccuccagguggcagcacuaaggacacccccccacaacaaga

SEQ ID NO: 197487 - RNA, 64 nt, hsa
aagaaauggucauucuacuucaaagaaauugagccagcacuaucuguacuccaacauuaccgga

SEQ ID NO: 197488 - RNA, 64 nt, hsa
agcgcugcuguaacgacuucaggagucacugauucagcacuaauuuccugcugugaaaacucau

SEQ ID NO: 197489 - RNA, 64 nt, hsa
cucagggccuucuguaucugugccuggccaguggcagcacuagcagugguauuagcuuaugcca

SEQ ID NO: 197490 - RNA, 64 nt, hsa
aggugccugcuuacaaggaaucccagaguucuggcagcacuaguguuagaacaccaaggagguu

SEQ ID NO: 197491 - RNA, 64 nt, hsa
uccaguuagcuaccucuucaagguaccaggcccgcagcacuaacagaucacaucugaagaaacu

SEQ ID NO: 197492 - RNA, 64 nt, hsa
uccuuguggccucaagaaauuuagacgcccacgacagcacuacacagcaucuccaggugaugcc

SEQ ID NO: 197493 - RNA, 64 nt, hsa
aaauugaggagaguccuuucagugucgaggaauccagcacuacgcccugcccucuacugacugg

SEQ ID NO: 197494 - RNA, 64 nt, hsa
accaugcagagauggcaguugcuuccuccugaaccagcacuaaucccccucugcccuccugugu

SEQ ID NO: 197495 - RNA, 64 nt, hsa
agauugguaguaaagguauuauguuaccuccuaacagcacuacaaaguaccuuuuuuuaucaga

SEQ ID NO: 197496 - RNA, 64 nt, hsa
uucacugucagcaguuuuaaaggugaaaucagagcagcacuaccccucccaccuccaaagcauc

SEQ ID NO: 197497 - RNA, 64 nt, hsa
uguauucucaugugguuugcacagcccagccucacagcacuauuguaaacccugcucuuucugu

SEQ ID NO: 197498 - RNA, 64 nt, hsa
uagacuauuucaggcuuaauuuuccuaacuuguucagcacuagugcuuuaccucucauuuuuaa

SEQ ID NO: 197499 - RNA, 64 nt, hsa
cuuaccaugaccugguuuuccagugugguucugacagcacuacugauaaccaaacuggagucag

SEQ ID NO: 197500 - RNA, 64 nt, hsa
uugacacuuuauuaaaggaaggcuuucauuuggucagcacuagaacaguaucuucugaagacaa

SEQ ID NO: 197501 - RNA, 64 nt, hsa
aauuuaaagauugauaugcuaaaaacaauuugcacagcacuaaagcaugagcuacuuucaucua

SEQ ID NO: 197502 - RNA, 64 nt, hsa
ugaaacuguuuauacagcaaaagucagguauuagcagcacuaaagcaaauaucacucagaugaa

SEQ ID NO: 197503 - RNA, 64 nt, hsa
accaaaugccuuucuagcaauugcuucucuaaaacagcacuaucgagguauuugguaacuugcu

SEQ ID NO: 197504 - RNA, 64 nt, hsa
cagcagcucugaaugucaccugcccuggggcuuacagcacuauaugaguuccuggccuauccug

SEQ ID NO: 197505 - RNA, 64 nt, hsa
acuuccugguuuuauuuuuagucauugggucauacagcacuaaagucugcuauuuauggaaacu

SEQ ID NO: 197506 - RNA, 64 nt, hsa
ccccccucaaugagagaggcaggcagaucucacccagcacuaggacaccaggaggccagguaac

SEQ ID NO: 197507 - RNA, 64 nt, hsa
acagcuugucacaguagccaggcuuggguggguucagcacuagcucgggacggugugucacacg

SEQ ID NO: 197508 - RNA, 64 nt, hsa
gucaggauaaaaaccaaaucugggugccagaucccagcacuacuuuuuauuacuggagaaaugg

SEQ ID NO: 197509 - RNA, 64 nt, hsa
cagaaaccaaaugugaacuuccugucucccaccucagcacuaguccaugccaggacaccagcug

SEQ ID NO: 197510 - RNA, 64 nt, hsa
gucuucagccucuuucugucccuucugucccucacagcacuaguauuucauguugcacacccac

SEQ ID NO: 197511 - RNA, 64 nt, hsa
cucuccuggggguggcaggcacacagcagccccccagcacuaaggccgugucucugaggacguc

SEQ ID NO: 197512 - RNA, 64 nt, hsa
auuacugcuugucucucaaggcugcugucuuuaucagcacuaacuaaauaaauuuguugguuca

SEQ ID NO: 197513 - RNA, 64 nt, hsa
uuuauugagagucucauauucaugcuuuucuucacagcacuauaaaguuggacuuggaaaauuu

SEQ ID NO: 197514 - RNA, 64 nt, hsa
acugcccucacccucagccgucccaaggagugcccagcacuacucagcauguaguccaggaccu

SEQ ID NO: 197515 - RNA, 64 nt, hsa
cagaggagucaucacagaccgaggagguggaucacagcacuauccugaggagcgacaugugguu

SEQ ID NO: 197516 - RNA, 64 nt, hsa
uuggucacuugcuuuuauagacuauuuuaauacucagcacuagagggagggagggggagggagg

SEQ ID NO: 197517 - RNA, 64 nt, hsa
aucuuuuccuccagagguggggcugcaccagacucagcacuagcacuccaucagcacuagcacc

SEQ ID NO: 197518 - RNA, 64 nt, hsa
uggggcugcaccagacucagcacuagcacuccaucagcacuagcaccucacuccaucagcacua

SEQ ID NO: 197519 - RNA, 64 nt, hsa
cuagcacuccaucagcacuagcaccucacuccaucagcacuagcaccucacuccaucggccccg

SEQ ID NO: 197520 - RNA, 64 nt, hsa
cggcacuaaugccccacucggcgccccacuccaucagcacuaaugcuccacuccauuggcacua

SEQ ID NO: 197521 - RNA, 64 nt, hsa
gacccgcuccuuugacauuggugccccacuccaucagcacuaacgcccugcuccaucggcacug

SEQ ID NO: 197522 - RNA, 64 nt, hsa
cuuucucagaggggccagcuaacccgugcagaaccagcacuaagguggacagcagacaagaggg

SEQ ID NO: 197523 - RNA, 64 nt, hsa
gugcucaccccaggcuucccugacggggaugacucagcacuaccccucaacagagaugacuuug

SEQ ID NO: 197524 - RNA, 64 nt, hsa
uucuuuugguggcucgauguuacccucauauuuucagcacuaauuuuagggugaguuccucauu

SEQ ID NO: 197525 - RNA, 64 nt, hsa
ugcauucauuuaaacuaauagagcagacagaauucagcacuacuuaauaguuuauaaaucagug

SEQ ID NO: 197526 - RNA, 64 nt, hsa
uucagcguccaagacuggggcccacccuucucaccagcacuaaaugcacuaacaaggacuccag

SEQ ID NO: 197527 - RNA, 64 nt, hsa
aaggauacuguugaccugucacuguuuauuauuucagcacuaaaacugaggagccucaacugcu

SEQ ID NO: 197528 - RNA, 64 nt, hsa
guggacauggccaucgcaugggaggagcucaaaccagcacuaaugaacagcauguggaagaaga

SEQ ID NO: 197529 - RNA, 64 nt, hsa
ugucauaaagacauauauacacaaauguucacggcagcacuauacacaaucgcaaagucaggga

SEQ ID NO: 197530 - RNA, 64 nt, hsa
cauuuuauguuagucacagucuugaauguauaaacagcacuaagacucucaggucagguaccuu

SEQ ID NO: 197531 - RNA, 64 nt, hsa
gcuaugaugcugcauggcagaggcagguauaacacagcacuacauauuggaaauuuuuuauuuu

SEQ ID NO: 197532 - RNA, 64 nt, hsa
cagaagucaggugucaucaucagacuugcggccacagcacuagagucacccccccaggccucca

SEQ ID NO: 197533 - RNA, 64 nt, hsa
agaaaggaguuauuaaaguaauuuacaaaccucucagcacuaauuaguguccaacuccaagugg

SEQ ID NO: 197534 - RNA, 64 nt, hsa
ggaaaugugcuucuacuuugccaguuauuucagacagcacuaccaagaggagguggucagcacu

SEQ ID NO: 197535 - RNA, 64 nt, hsa
ucucugcaaacaaguugccaucugguuugccuuccagcacuaaaguaauggaacuuugaugaug

SEQ ID NO: 197536 - RNA, 64 nt, hsa
ccuugguuggauucuucaacacagccaaugaaaacagcacuauauuucugaucugucacuguug

SEQ ID NO: 197537 - RNA, 64 nt, hsa
gagguggcguguaaggaaugcagcccccugaagacagcacuacaagucugggggagccaguuuu

SEQ ID NO: 197538 - RNA, 64 nt, hsa
ucaggccugcugguucccacuccauacuuucccacagcacuacgauguguugaaugcuuaccaa

SEQ ID NO: 197539 - RNA, 64 nt, hsa
cauauuggagaugaccccaucaaccccagggcuccagcacuaccaaguuggaauuccacgcccg

SEQ ID NO: 197540 - RNA, 64 nt, hsa
gaagagacugcauuguggccccagacuuuuaaaacagcacuaaauaacuugggggaaacggggg

SEQ ID NO: 197541 - RNA, 64 nt, hsa
agggacguuuccaucauucacagugcccuccccacagcacuaccucaccccgacccccacccuc

SEQ ID NO: 197542 - RNA, 64 nt, hsa
ggagggugagacccagccaauccuugggagcaagcagcacuaaaucacaucagggagugauuag

SEQ ID NO: 197543 - RNA, 64 nt, hsa
auggcugcuuggucuuggccacagugcucucagccagcacuaagggcugaggucaauaccgcag

SEQ ID NO: 197544 - RNA, 64 nt, hsa
gugggggaaguggcuccuggcaggagauuucucccagcacuaauauccugguguucuauaaaau

SEQ ID NO: 197545 - RNA, 64 nt, hsa
auuccuauaaggaagauuuggaagcucuucuucccagcacuaugcuuuccuucuuugggauaga

SEQ ID NO: 197546 - RNA, 64 nt, hsa
cugcagcuggccacaccacaggcccccgugccugcagcacuacuggugccugaaacaccuggcc

SEQ ID NO: 197547 - RNA, 64 nt, hsa
cgcacugaccacacccaccgcaaccucauccccucagcacuaaccacauccacucucaaccccg

SEQ ID NO: 197548 - RNA, 64 nt, hsa
gcgggccaggcacaguggcucacaccuguaaucccagcacuaugggaggcccaggugagcagau

SEQ ID NO: 197549 - RNA, 64 nt, hsa
uccaccauaaagacaaacacuuguauguucauugcagcacuauucucaauagcaaagaugugga

SEQ ID NO: 197550 - RNA, 64 nt, hsa
ggcauccauuuccauacaggaacaaaauaggaggcagcacuacagacccuacacacagcuuuac

SEQ ID NO: 197551 - RNA, 64 nt, hsa
guaaggcugggcgugguggcucacgccuguaacccagcacuaugggaggucgaggugggcagau

SEQ ID NO: 197552 - RNA, 64 nt, hsa
gaggccagggacacaugaagggauguccccaccccagcacuaucagggccuccccaggcuucca

SEQ ID NO: 197553 - RNA, 64 nt, hsa
ccacaccgacaacuccccggcuuccagacccuaccagcacuacccuaacccucagccgacaguc

SEQ ID NO: 197554 - RNA, 52 nt, hsa
ugcgaguccgucuguccuaguccagcacuacccuucuugcaagacagccuga

SEQ ID NO: 197555 - RNA, 64 nt, hsa
guuggccaggcacggugguucaugccuguaaucccagcacuaugggaggccgagacgggcggau

SEQ ID NO: 197556 - RNA, 64 nt, hsa
cacccuuugggcugccuugcucaucuuuaugccccagcacuagguacggggcccaacacguggu

SEQ ID NO: 197557 - RNA, 64 nt, hsa
gaacccaaaagauuggagccuuaacaauaaacaucagcacuaagugaccuguuccuccuuuuuu

SEQ ID NO: 197558 - RNA, 64 nt, hsa
uccuggcuggaacccagcacccucugugggaagccagcacuagcucucaucccccauccgggag

SEQ ID NO: 197559 - RNA, 64 nt, hsa
cugcagauccgcauguggaccaugagccggcugccagcacuagguccugggcagcuuuguuugu

SEQ ID NO: 197560 - RNA, 64 nt, hsa
uuguccaugugcugcucccacauuccguggacaucagcacuacucuccugaggacucuucagug

SEQ ID NO: 197561 - RNA, 64 nt, hsa
ucacgaugggaggccuggggcccugcccgcuggacagcacuaucucuaccagcggugguuccag

SEQ ID NO: 197562 - RNA, 64 nt, hsa
uguacugacagcgagagcauguccaucuguuggacagcacuauucuagagaacuaaacuggcuu

SEQ ID NO: 197563 - RNA, 64 nt, hsa
caguauacacauacacaagugcacagaccacacacagcacuaacacaugcacacacaaagugca

SEQ ID NO: 197564 - RNA, 64 nt, hsa
guucuaaaaagaaagugguauguugugugaugaucagcacuaaguccugcauuccuguuaaagc

SEQ ID NO: 197565 - RNA, 64 nt, hsa
ccucuuagaucaguucuuuuguacuacuuguggucagcacuaucauggaaugugccuggauaca

SEQ ID NO: 197566 - RNA, 64 nt, hsa
ucacaaagggcuucagguagauuaucagagcugucagcacuaccucuccccgcugaaaccagca

SEQ ID NO: 197567 - RNA, 64 nt, hsa
ucauucuggaccugggaccuuaggagccgggugacagcacuaaccagaccuccagccacucaca

SEQ ID NO: 197568 - RNA, 64 nt, hsa
ucagccacaccuuuuccaggaguucugaagcugacagcacuacaaaggagacgggggagcagca

SEQ ID NO: 197569 - RNA, 64 nt, hsa
cuucugaaagugugacaguguccagccgguucugcagcacuaggggagggggcagauggugguu

SEQ ID NO: 197570 - RNA, 64 nt, hsa
cagauaucgagcaaaugguuugaguuacaucuagcagcacuaaaacuuauucaacuuuggccaa

SEQ ID NO: 197571 - RNA, 64 nt, hsa
aaaauuagccagcucuuccugucagggaucagggcagcacuaacaggcgcaaaaguagagcugu

SEQ ID NO: 197572 - RNA, 64 nt, hsa
ugccccggcugugugaauucaagacagggcagugcagcacuaggcaggugugaggagcccugcu

SEQ ID NO: 197573 - RNA, 64 nt, hsa
gacagcccaguguagagauuggcacuucccuguccagcacuacaacuuaauugcucuaugccuc

SEQ ID NO: 197574 - RNA, 64 nt, hsa
aaaacaaguauugucagguauucucuccauagaacagcacuacccuccucucuccccagaugug

SEQ ID NO: 197575 - RNA, 64 nt, hsa
aaaacaaguauugucagguauucucuccauagaacagcacuauccucaucucuccccagaugug

SEQ ID NO: 197576 - RNA, 64 nt, hsa
aaaacaaguauugucauguauucucugcauagaacagcacuauccucaucucuccccagaugug

SEQ ID NO: 197577 - RNA, 64 nt, hsa
cucauauggcccagugucaaguugugcuuguuuacagcacuacucugugccagccacacaaacg

SEQ ID NO: 197578 - RNA, 64 nt, hsa
gcuguggacauguggguggagaagggaggguggccagcacuaguaaaggaggaauagugcuugc

SEQ ID NO: 197579 - RNA, 64 nt, hsa
ucaaauaaauccacaaguuaaugccuaaccucuucagcacuagccaaagguugucaagacacac

SEQ ID NO: 197580 - RNA, 64 nt, hsa
gauuugaagcaugaaaguucuggcagguuaugagcagcacuagggauaaaguaugguuuuauuu

SEQ ID NO: 197581 - RNA, 64 nt, hsa
aggugaacuguaagaugagaacaagaucacaagucagcacuaccuccucccuucuugaguucuc

SEQ ID NO: 197582 - RNA, 64 nt, hsa
uuuaacuuguaaaugaaaaaauucucuuaaaccacagcacuauugagugaaacauugaacucau

SEQ ID NO: 197583 - RNA, 64 nt, hsa
uuugcucuccaggacaucagcacauggcccugaucagcacuaccacauccaaacauaagucacu

SEQ ID NO: 197584 - RNA, 64 nt, hsa
uagagauguuauaaaaauguauaggcaguauacacagcacuacucaagaagccaaagaaacacu

SEQ ID NO: 197585 - RNA, 64 nt, hsa
aaaacaaguauagucagguauucucuccauagaacagcacuaccuuccucucuccccacaugug

SEQ ID NO: 197586 - RNA, 64 nt, hsa; identical to SEQ ID NO: 197574

SEQ ID NO: 197587 - RNA, 64 nt, hsa
aaagcaaguauagucagguauucucuccauagaacagcacuacccuccucucuccccagaugug

SEQ ID NO: 197588 - RNA, 64 nt, hsa
uccaagauucucagauccagguuaggaaaggauucagcacuacagcauaccccucuacaacaua

SEQ ID NO: 197589 - RNA, 64 nt, hsa
acauuaauguuguuacuggugaaaggcaugagagcagcacuaaguccucuguguaacugccauu

SEQ ID NO: 197590 - RNA, 64 nt, hsa
uauacuuuggggaugauaauccaaaaguauuucacagcacuaaugcugaucaaaauuugcucuc

SEQ ID NO: 197591 - RNA, 64 nt, hsa
uauguaaguguggcaaugugaacugaagcugaugggcugagaacauggacugagcuuguggugu

SEQ ID NO: 197592 - RNA, 64 nt, hsa
ucacccaugaagacaggacagugcuucagccugaggcugagacugcgggaugguccuggggcuc

SEQ ID NO: 197593 - RNA, 64 nt, hsa
acagggcaccccagcugaccugguacugagguugggcugagacccugcuucucuucccccauca

SEQ ID NO: 197594 - RNA, 64 nt, hsa; identical to SEQ ID NO: 197593

SEQ ID NO: 197595 - RNA, 64 nt, hsa
cugaucguaggaauugaggagugucccgccuuguggcugagaacuggacaguggcaggggcugg

SEQ ID NO: 197596 - RNA, 64 nt, hsa
cuaguccugagauggaaacagcaacuuguacaguggcugagaaaauaggauauaguuuugauuu

SEQ ID NO: 197597 - RNA, 64 nt, hsa
cagcugugugaguguugagaucucugccaucucuggcugagauacugcuguccugugaaguguu

SEQ ID NO: 197598 - RNA, 64 nt, hsa
gguggugcaugccuguagucccaguuacucgggaggcugagacaggagaaucgcuugaacccag

SEQ ID NO: 197599 - RNA, 64 nt, hsa
gagaggaggucuuccagcagcagcaggucuggagggcugagaaugaaccugacuagagguucug

SEQ ID NO: 197600 - RNA, 64 nt, hsa
cugcaacauggggacauuugccaacucgaacaaaggcugagaagcagccacaccguuguuuagg

SEQ ID NO: 197601 - RNA, 64 nt, hsa
gcuuggcucugaccccacggccccagcuggagcuggcugagagcaguccugcagguaaauguac

SEQ ID NO: 197602 - RNA, 64 nt, hsa
cugaacaggugaaugaagaaggaagaggauuccaggcugagagcacuggacguggcaacuguuc

SEQ ID NO: 197603 - RNA, 64 nt, hsa
accaguggccccuuguuugccaaaggcagaguggggcugagaaacaggcugcggugauugcaau

SEQ ID NO: 197604 - RNA, 64 nt, hsa
guccagagcuucagggcugggcagguccuggggaggcugagacugcagaggagccaccugggcu

SEQ ID NO: 197605 - RNA, 64 nt, hsa
ugcuucaguggauucacugguuagauuaaaaagaggcugagaugagcagugaacuaagaggcca

SEQ ID NO: 197606 - RNA, 64 nt, hsa
cgauaacucccuaggggcuccugccugcccaagcggcugagaaccagcgccccgaugccugagg

SEQ ID NO: 197607 - RNA, 64 nt, hsa
ugggaguuaugcuggggguuguaaauaaugacaaggcugagauuuuuaugauguuuaaauuggg

SEQ ID NO: 197608 - RNA, 64 nt, hsa
agauuagggcggggagaagagcauccggcaugagggcugagaugcgcaaagagugugcucggga

SEQ ID NO: 197609 - RNA, 64 nt, hsa
gugaagacauuucucaacuucucggccggaguuuggcugagaucgcgguauuaaaucugugaaa

SEQ ID NO: 197610 - RNA, 64 nt, hsa
gcugaccccucggagcaagcgccgcacaggugguggcugagacagcuggcgcggggggccccaa

SEQ ID NO: 197611 - RNA, 64 nt, hsa
agagaguucauacggacuaagcuguaauuaugauggcugagaaaugauucauuugaagauacaa

SEQ ID NO: 197612 - RNA, 64 nt, hsa; identical to SEQ ID NO: 64824

SEQ ID NO: 197613 - RNA, 64 nt, hsa; identical to SEQ ID NO: 64825

SEQ ID NO: 197614 - RNA, 64 nt, hsa; identical to SEQ ID NO: 64826

SEQ ID NO: 197615 - RNA, 64 nt, hsa; identical to SEQ ID NO: 64827

SEQ ID NO: 197616 - RNA, 64 nt, hsa
ucacucacccuaccuccagggcauagucagucugggcugagauccccaugaucagauauuugau

SEQ ID NO: 197617 - RNA, 64 nt, hsa
gguggccggcgccuguaaucccagcuacuagggaggcugagacacacgaaucccuugagcccag

SEQ ID NO: 197618 - RNA, 64 nt, hsa; identical to SEQ ID NO: 64828

SEQ ID NO: 197619 - RNA, 64 nt, hsa; identical to SEQ ID NO: 64829

SEQ ID NO: 197620 - RNA, 64 nt, hsa; identical to SEQ ID NO: 64830

SEQ ID NO: 197621 - RNA, 64 nt, hsa
uccauuuguaaaacaaguggcugcaguagaugauggcugagagcccuuccuguucccagaugcc

SEQ ID NO: 197622 - RNA, 64 nt, hsa
aaguugaaaaccuuuggaaaaugagucaggaaaaggcugagaccucaaucgguaacaauucccc

SEQ ID NO: 197623 - RNA, 64 nt, hsa
agaauuauugucauuuuacacaugaggaaagugaggcugagagaauccaauuagcuuguacgau

SEQ ID NO: 197624 - RNA, 64 nt, hsa
uuuccuacuuuuccaggcucagcagggagcugcuggcugagaaagagccugaagucuugcagga

SEQ ID NO: 197625 - RNA, 64 nt, hsa
uacuuggcccagcugcuuggaggaccgaccccauggcugagaauaugacggcaagaggaacaga

SEQ ID NO: 197626 - RNA, 64 nt, hsa
cucuuaacuuacgaucucuugacauaugguuucuggcugagaggccuggcccgcuaaggugaaa

SEQ ID NO: 197627 - RNA, 64 nt, hsa
ucucuaggugcugagcccucaccucccuguuccaggcugagaacucaaaugguuacccugcuuc

SEQ ID NO: 197628 - RNA, 64 nt, hsa
gguggcacacaucuguagucccagcuacucuggaggcugagacaggagaaucgcuugaacccag

SEQ ID NO: 197629 - RNA, 64 nt, hsa
gaugcacauugaagggagggcucaggcagcugagggcugagaaugaggcaguuggaaucuagac

SEQ ID NO: 197630 - RNA, 64 nt, hsa
gaucuagggaauucagugggaccaaugaaagcauggcugagaaauagcagguaguccaggauag

SEQ ID NO: 197631 - RNA, 64 nt, hsa
ccacccucaugacugggaaggaagccugugaugaggcugagauaaagcacagggugguuucacu

SEQ ID NO: 197632 - RNA, 64 nt, hsa
gcuaaggugaggccuuccuccaacauggggcccuggcugagaguggagggauagggugcuacuu

SEQ ID NO: 197633 - RNA, 64 nt, hsa
ccccaccucccaggaccugcaucccagcucagaaggcugagaggguuugcaguggagcccugag

SEQ ID NO: 197634 - RNA, 64 nt, hsa
aauggcucaugccuguaaucccagcacuuugggaggcugagaugggaggaucacuugaagccag

SEQ ID NO: 197635 - RNA, 64 nt, hsa
ggugguacaugccuguaaucccagcuacucaggaggcugagacaggagaaucacuugaaccugg

SEQ ID NO: 197636 - RNA, 64 nt, hsa
uuuccagaccugcuccugcugcacagagccgcagggcugagaccacguccaugcuggcugccuu

SEQ ID NO: 197637 - RNA, 64 nt, hsa
ucacaccugcuucccaaugagcacucagcagcauggcugagaccuggggcuugacaggccugcg

SEQ ID NO: 197638 - RNA, 64 nt, hsa
agaaugccagcccaaagcuggagccaauggugagggcugagagggcuguggcuggguggucagc

SEQ ID NO: 197639 - RNA, 64 nt, hsa
guauuuuuuauuccauuucaauauuaaccaaauaggcugagaaauucauagcaauugaauuaag

SEQ ID NO: 197640 - RNA, 64 nt, hsa
cucugucuauagcuuucccaugguagccugauaaggcugagagagaaaaauaugugcaguaucu

SEQ ID NO: 197641 - RNA, 64 nt, hsa
ugcugaaguugcuuaucagcuuaaggagauuuugggcugagacaaugggguuuucuagauauac

SEQ ID NO: 197642 - RNA, 64 nt, hsa
ggcggcgagcaccuguaaucccagcuacucgggaggcugagacaggagaaucucuugaauccag

SEQ ID NO: 197643 - RNA, 64 nt, hsa
uccagucuaauuuuacgcuguagcagaaccagauggcugagaaaauucuggaacuauggaucuu

SEQ ID NO: 197644 - RNA, 64 nt, hsa
gguggugagugccuguaaucacagcuacuugggaggcugagaugggagaaucacuugaacccgg

SEQ ID NO: 197645 - RNA, 64 nt, hsa
uuuagcuaaagucccgcggguuccggcauggcuaggcugagagcagggaucuaccuggcuucuc

SEQ ID NO: 197646 - RNA, 64 nt, hsa
accagccaaguucaugccccucucgggccuuuguggcugagaagugggacagaaagaugauuaa

SEQ ID NO: 197647 - RNA, 64 nt, hsa
gauggugguggccuguaaucccagcuacuugggaggcugagacaggagaaucgcuugaacccag

SEQ ID NO: 197648 - RNA, 64 nt, hsa
aguaguauccgccuguagucccagcuacucaggaggcugagacaggaggauugcuuaagcccag

SEQ ID NO: 197649 - RNA, 64 nt, hsa
gcacuugccauuccaaaauauuaugccccaccaaggcugagacagugaauuugggcugcuguag

SEQ ID NO: 197650 - RNA, 64 nt, hsa
ccuuccaggccccaggcuggaugcuggguucuggggcugagaguggggcuagacugggcuggcu

SEQ ID NO: 197651 - RNA, 64 nt, hsa
uaaacugaaaagcuuaauucagauaguagcuuuuggcugagaaaaggaauccaaaauauuaaua

SEQ ID NO: 197652 - RNA, 64 nt, hsa
ccuuccugaggggccucagggcuugugggggguaggcugagaccccaccaccaaagguuaagug

SEQ ID NO: 197653 - RNA, 64 nt, hsa
ccgcgugagcaguguuaccugcauuauuacauuaggcugagagguaaaauaauuugcccgaaga

SEQ ID NO: 197654 - RNA, 64 nt, hsa
ggguauaggaaaauauaccuaaaagcgaauuuguggcugagaggauaaacagaagcuguuugcu

SEQ ID NO: 197655 - RNA, 64 nt, hsa
uacagggaugaggcagaccugacucucuuaaggaggcugagagcccaaacugcugucccaaaca

SEQ ID NO: 197656 - RNA, 64 nt, hsa; identical to SEQ ID NO: 64831

SEQ ID NO: 197657 - RNA, 64 nt, hsa; identical to SEQ ID NO: 64832

SEQ ID NO: 197658 - RNA, 64 nt, hsa
agaauuaccccucccaaaaugucagaagugcugaggcugagaaacccugauguaaagaucaguc

SEQ ID NO: 197659 - RNA, 64 nt, hsa
ccgggugagccugucuggcgccuuccucgccccgggcugagagcugggucccgggagauggaag

SEQ ID NO: 197660 - RNA, 64 nt, hsa
cauggcacacaccuguagucccagcuacuuaggaggcugagaugggaggauugaucgaucgcuu

SEQ ID NO: 197661 - RNA, 64 nt, hsa
gguggcucaugccuguaaucccagcacuuugggaggcugagacggguggauuaccugaggucag

SEQ ID NO: 197662 - RNA, 64 nt, hsa
aaggagggugaggcggugggggauugcagggggcggcugagagaaaaccuccuugggggccagg

SEQ ID NO: 197663 - RNA, 64 nt, hsa
cacagcauauccaggcugccacagguggggacgaggcugagagagucagcaggcagagccagau

SEQ ID NO: 197664 - RNA, 64 nt, hsa
aaggaugcuccggggccauuguuaguggguuuggggcugagaugagugauccugccucuggucc

SEQ ID NO: 197665 - RNA, 64 nt, hsa
cuggccuccaagucgugaggaaauggguaugcaaggcugagauuucuacagcaauaaaggagac

SEQ ID NO: 197666 - RNA, 64 nt, hsa
cuagugcuggagaaaguaccgggaagaaggagguggcugagaagagccagaucaaccucauuga

SEQ ID NO: 197667 - RNA, 64 nt, hsa
cuacagccugaguaggccugaguggccguggccaggcugagaccugucaggccauacugacaag

SEQ ID NO: 197668 - RNA, 64 nt, hsa
gggggcacacaccgguaaucccagcuacucaggaggcugagacaggagagucgcuugaaccugg

SEQ ID NO: 197669 - RNA, 64 nt, hsa
ugugaaucuuggugucuacguuaccaggcaggaaggcugagaggagagagacuccagcuggguu

SEQ ID NO: 197670 - RNA, 64 nt, hsa
agaugacuucaccucacucagccuuggcuucuaaggcugagaaaugggacuuaaugcuuuauuu

SEQ ID NO: 197671 - RNA, 54 nt, hsa
ccagcagcaagcccaaguaguuauggcugagaagacagagcacugacaaugagc

SEQ ID NO: 197672 - RNA, 64 nt, hsa
uggagaaucuuaagaaaugcaagcuuguucagggggcugagaagauccugaguacacuaggugc

SEQ ID NO: 197673 - RNA, 64 nt, hsa
ggugccucacaucuguaaucccaacacuuugggaggcugagauggguggauugcuugagcccag

SEQ ID NO: 197674 - RNA, 64 nt, hsa
gcucaagugauccucccgucucagccucccaaagggcugagauuacaggugugagcuaccucac

SEQ ID NO: 197675 - RNA, 64 nt, hsa
augaauggaaggaggcuuaggacuuuccacuccuggcugagagaggaagagcugcaacggaauu

SEQ ID NO: 197676 - RNA, 64 nt, hsa
aacuagcugcagagggaugagugaccaccauccaggcugagacugaaaggagcagaggcuggaa

SEQ ID NO: 197677 - RNA, 64 nt, hsa
gguggcucacgucuguaaucccagcacuuugggaggcugagacagguggaucacuugaggucgg

SEQ ID NO: 197678 - RNA, 64 nt, hsa
cucugaaagccuccugcugcccacuguuucccugggcugagaggggaagugcauauguguagcg

SEQ ID NO: 197679 - RNA, 64 nt, hsa
aagcauucuccuguuuuuacagauuguauccugaggcugagagaguuaagugaaugucuaaggu

SEQ ID NO: 197680 - RNA, 64 nt, hsa
ggugacucacacuuguaaucccagcaauuugggaggcugagacaggaggauugccugaggccag

SEQ ID NO: 197681 - RNA, 64 nt, hsa
uugggguuucugauaauguguggagucucauuauggcugagaguuuaguguuuucacagugaag

SEQ ID NO: 197682 - RNA, 64 nt, hsa
ucuuuggcuauuuguaugguuuaagaacacugguggcugagaugcuauaaaaacagcucggccc

SEQ ID NO: 197683 - RNA, 64 nt, hsa
ccagacgccagaaggucagccguugaucaauggaggcugagaccaugaugcuugggcuuaggau

SEQ ID NO: 197684 - RNA, 64 nt, hsa; identical to SEQ ID NO: 64833

SEQ ID NO: 197685 - RNA, 64 nt, hsa; identical to SEQ ID NO: 64834

SEQ ID NO: 197686 - RNA, 64 nt, hsa
agcacacuaggacccaggugguacccuacucaguggcugagaauuggauaaagucuugggaaau

SEQ ID NO: 197687 - RNA, 59 nt, hsa
gcugcugccaccugaccugacagggaggaggcugagaacucaguuuugugaccaugaca

SEQ ID NO: 197688 - RNA, 64 nt, hsa
gacuaucuuccaguugcugcucaacagaguuguuggcugagaccugcuugggagucucugcugg

SEQ ID NO: 197689 - RNA, 64 nt, hsa
aaacuagagaaacacaauaagcaaaucacaugaaggcugagaugauugagaugaaaguuaacau

SEQ ID NO: 197690 - RNA, 64 nt, hsa
ugaaugacuggcaugaacacgucuuugaaguuguggcugagaagaugagaggaauauuuaaaua

SEQ ID NO: 197691 - RNA, 64 nt, hsa
acuaugccuauguagugucuuuauuugcucagcuggcugagacacugaagaagucacugaacaa

SEQ ID NO: 197692 - RNA, 64 nt, hsa
gcaugagcauuuucaggauaagcgacuucugugaggcugagagaggaagaaaacacggagccuu

SEQ ID NO: 197693 - RNA, 57 nt, hsa
gccuugaagcacaucuguaggcaagauggcugagaaauacaggagaggcgucugcuu

SEQ ID NO: 197694 - RNA, 64 nt, hsa
ugcgaccuuaauuuaacuuuccagucuuagcugaggcugagaaagcuaaaguuugguuuugaca

SEQ ID NO: 197695 - RNA, 64 nt, hsa
ggcacaugccuguagucccagauacuugggagugggcugagaugggagaaucgcuugagcccag

SEQ ID NO: 197696 - RNA, 64 nt, hsa
aaaauguagaaacuuaaacacaccuuccuguggaggcugagaugaaaacuagggcucauuuucc

SEQ ID NO: 197697 - RNA, 64 nt, hsa
uugggaggcugaggugggaggguugaucacuugaggcugagaggucaagguugcagugagccau

SEQ ID NO: 197698 - RNA, 64 nt, hsa
caguuacagaaugcuacacacuuaccuuuuuauuggcugagaaaucugguuauuucaucuuaau

SEQ ID NO: 197699 - RNA, 64 nt, hsa
agaagaccuaggccauagagcacaguggaacgcaggcugagaacgcagggaaggagaaauaaag

SEQ ID NO: 197700 - RNA, 64 nt, hsa
guuuuugcgugugucggaaucacugguaaauguuggcugagaacaaucccuccccuugcacuug

SEQ ID NO: 197701 - RNA, 64 nt, hsa
uucugguuaucuaugaauaauaaugaauaauuuuggcugagaaugguaccuuuauauaacucuu

SEQ ID NO: 197702 - RNA, 64 nt, hsa
ucagaaaccuugugaugucuugacuguugcaccaggcugagaaagcagcaauauugauauuaua

SEQ ID NO: 197703 - RNA, 64 nt, hsa
uagccccaggaacccuugagguucuucuucacaaggcugagagugcuuccuucuugaagacgag

SEQ ID NO: 197704 - RNA, 64 nt, hsa
aggaaaccaagaaaaagaagccaagcaaaaaucaggcugagaaaaagcaaaagaaaagcaaaaa

SEQ ID NO: 197705 - RNA, 64 nt, hsa
gccacugaaacuugagccaucugugccucuaagaggcugagaauggaagaguuucagauaauaa

SEQ ID NO: 197706 - RNA, 64 nt, hsa
gauggcggacgccuguagucccagcuacucgggaggcugagacagaagaacugcuugaaaccag

SEQ ID NO: 197707 - RNA, 64 nt, hsa
acccccuuuacucagagauaacauagauuauccaggcugagauggaaaacaagcccuuuauuga

SEQ ID NO: 197708 - RNA, 64 nt, hsa
gguggcucacgccuguaaucccagcacuuugggaggcugagaagggcggaucacgaggucagga

SEQ ID NO: 197709 - RNA, 64 nt, hsa
aguggcucauguguguaaucccagcacucugggaggcugagacagguagaucauuugaggucag

SEQ ID NO: 197710 - RNA, 64 nt, hsa
uguggcuaccgcggguaugcgagugccagauauuggcugagacgagccagcuuagacuaauugg

SEQ ID NO: 197711 - RNA, 64 nt, hsa
gguggugcaugccuguaaucccagcuacuugggaggcugagacaggagaaucacuugaacuagg

SEQ ID NO: 197712 - RNA, 64 nt, hsa
auuugauauuuuuugagaugacacucaagcaucaggcugagauuugcacacaugggauguaaaa

SEQ ID NO: 197713 - RNA, 64 nt, hsa
gaguugugcaugaacucgguaauacacaucacacggcugagaguccccuuuccaggcagggcca

SEQ ID NO: 197714 - RNA, 64 nt, hsa
gggagucaggggaagccugucccgggaaggcccaggcugagaggcccuggcucuggccaggcug

SEQ ID NO: 197715 - RNA, 64 nt, hsa
cucccauuuuucuaauuagaaaaaggcuuggugaggcugagaaaccagcccacaauuacacaaa

SEQ ID NO: 197716 - RNA, 64 nt, hsa
caaaaggagcauuuauaauuaucucauuuguuaaggcugagaagguuguuuuuauaauagguaa

SEQ ID NO: 197717 - RNA, 64 nt, hsa
gguggcacaugccuguagucccagccacuagggcggcugagacgcaagacuugcuugaacccgg

SEQ ID NO: 197718 - RNA, 64 nt, hsa
uucacucacacagcucccgacugcuucuugcagaggcugagagucccccccccaccuuuuuuuu

SEQ ID NO: 197719 - RNA, 64 nt, hsa
gccccuagguggaugaggccaaagucaaauccaaggcugagacagucgugcgacuccuacuccc

SEQ ID NO: 197720 - RNA, 64 nt, hsa
ucuaaaauauaaguaaagccaaccuuuuuuuuaaggcugagauucccaaaaugagaauacuacu

SEQ ID NO: 197721 - RNA, 64 nt, hsa
aggacagucuggagaagguauuagcaaagcaaaaggcugagaaggaacagggaacauuggagcu

SEQ ID NO: 197722 - RNA, 64 nt, hsa
ucugucuacaaggaaaugggagguggagccuccuggcugagaaauuguuuugcaaauggaucua

SEQ ID NO: 197723 - RNA, 64 nt, hsa
gcucugagucuuuuggaggacagggacgguuuguggcugagauaaguguuuccuggcaaaacau

SEQ ID NO: 197724 - RNA, 64 nt, hsa
agugccagagaaguggaggcagaucgcuaccccaggcugagauggcccccacugugaaggccac

SEQ ID NO: 197725 - RNA, 64 nt, hsa
ugcacgguguggccagagccucagcuggaugagaggcugagauggguggccagcuuguacacca

SEQ ID NO: 197726 - RNA, 64 nt, hsa
ggagcucuagagggcugcguggcauccuccuaggggcugagaggugagcagcaggggagcgggc

SEQ ID NO: 197727 - RNA, 64 nt, hsa
aacuucaaaguuaaugggauggucggaucucacaggcugagaacucguucaccuccaagcauuu

SEQ ID NO: 197728 - RNA, 64 nt, hsa
uucuuuugucucccuuaugaagacugcccugcagggcugagauguggcaggagcucccagggaa

SEQ ID NO: 197729 - RNA, 50 nt, hsa
agucuguaacuguggaaugaggcugagaccgugacaagaccaucaccacc

SEQ ID NO: 197730 - RNA, 64 nt, hsa
gcuucucucucccugucacacacuggaccccacuggcugagaaucugggggugaggaggacaag

SEQ ID NO: 197731 - RNA, 64 nt, hsa
ggccgggaggggacuagaagagcugcaugaugguggcugagacagggucaccuugggaaggcuu

SEQ ID NO: 197732 - RNA, 64 nt, hsa
cccugcugcaaaggacagugggcaggaggccccaggcugagagccagaugccuccccaagacug

SEQ ID NO: 197733 - RNA, 64 nt, hsa
ggggagcacaucaccugaaggugccaaggaggaaggcugagaggggggccaccccauuucuggu

SEQ ID NO: 197734 - RNA, 64 nt, hsa
uucaugagucuauauaaaggcuuuuuaccaucuuggcugagaaugguaaaguuagguuuacuuc

SEQ ID NO: 197735 - RNA, 64 nt, hsa
gagguuuuugagcauaguacuugacuacucuagaggcugagacgggagcaucucuugagccuga

SEQ ID NO: 197736 - RNA, 64 nt, hsa
ccacauuaccaagcgcaauuccccauucuccaagggcugagaacuucggugacuucauccaccu

SEQ ID NO: 197737 - RNA, 64 nt, hsa
ugcacccugcgcaucaggacugcuucaucgucuuggcugagaaagggaaaagacacacaagucg

SEQ ID NO: 197738 - RNA, 64 nt, hsa
guuggcauaugccuguaaucccagcuacucgagaggcugagacacgaaaauugcuugaaccugg

SEQ ID NO: 197739 - RNA, 64 nt, hsa
cuagaauuugccucuuugggacugaagucuaaggggcugagaccaagaagggagagcacaagac

SEQ ID NO: 197740 - RNA, 64 nt, hsa
acuauacaucaucggguauuagaaaauguagucuggcugagacgaugaguuaucuucuacauuc

SEQ ID NO: 197741 - RNA, 64 nt, hsa
cggacuucggagcauagaguggcgcugagugaguggcugagaccgaccacgguucuugacuuag

SEQ ID NO: 197742 - RNA, 64 nt, hsa
uuuuggucaauaggcucugucuucgugagagacgggcugagagucagaaauaaaucaaccauuu

SEQ ID NO: 197743 - RNA, 64 nt, hsa
cagccuccugggaggaucccgaaguagggacuggggcugagagcagagaggagggucgggcagc

SEQ ID NO: 197744 - RNA, 64 nt, hsa
cccagcagccuccaggaaguccauacccugggguggcugagaccuuggcucuguauggaggcug

SEQ ID NO: 197745 - RNA, 64 nt, hsa
uggauaaucacugggacuagagccagacagccugggcugagaugcuggaucugcugcuuccugc

SEQ ID NO: 197746 - RNA, 64 nt, hsa
ggugguaagugccuguaguccuagcuacuugggaggcugagaugggaggaugucuugagcccgg

SEQ ID NO: 197747 - RNA, 64 nt, hsa
ggugguguaccccuguaaucccagcuacucgggaggcugagacaggagaaucacuugaacccag

SEQ ID NO: 197748 - RNA, 64 nt, hsa
auuugaggaugggauuauucuaauguacaaccacggcugagaaccacugccgcugacguuucaa

SEQ ID NO: 197749 - RNA, 64 nt, hsa
ucuuaauguucauuuaaaaacaaucauuuuggagggcugagaugggaaauaaaaguaguuaaau

SEQ ID NO: 197750 - RNA, 64 nt, hsa
agacuaaacauaauucuuuaaguucaaccuaaagggcugagaucaauaaauuuaacacuagacg

SEQ ID NO: 197751 - RNA, 57 nt, hsa
cccgcacugccaucuucuaguggccauggcugagacccaaucccugggcgccccugg

SEQ ID NO: 197752 - RNA, 64 nt, hsa
gguggugcacgccuguagucccugcuacuuggaaggcugagacaggaaaauugcuugaacccag

SEQ ID NO: 197753 - RNA, 64 nt, hsa
ccugaggacccaggguccaucugagcuggcugugggcugagauccuggcuggggcccugcuguc

SEQ ID NO: 197754 - RNA, 64 nt, hsa
acugcuaccuuccuagauguuuccccagaccgcuggcugagauucccucaccugucgcuuccua

SEQ ID NO: 197755 - RNA, 64 nt, hsa
ggugcaugugugccuguaguccaagcuacuugaaggcugagacaggaggaucgguugagcccag

SEQ ID NO: 197756 - RNA, 64 nt, hsa
gcaugcgccuguagucccagcuacucccuccagaggcugagaauugcuugaaccugggaagugc

SEQ ID NO: 197757 - RNA, 64 nt, hsa
guuugagggaagcagucuccugcgguucaguucaggcugagauuuucuccuucaguggacuguc

SEQ ID NO: 197758 - RNA, 64 nt, hsa; identical to SEQ ID NO: 64835

SEQ ID NO: 197759 - RNA, 64 nt, hsa; identical to SEQ ID NO: 64836

SEQ ID NO: 197760 - RNA, 64 nt, hsa
uuuuauuugcauguggaucaaccaucgcuuuauuggcugagauaugaacauauuguugaaaggu

SEQ ID NO: 197761 - RNA, 64 nt, hsa
gguggcgggcgccuguagucccagccacucgggaggcugagacaggagaaucgcuuaaaccugg

SEQ ID NO: 197762 - RNA, 64 nt, hsa
cuuuugaaaaucugcugagcggccaccauaugcaggcugagagcugggcacaggcgaagccauu

SEQ ID NO: 197763 - RNA, 64 nt, hsa
gcacgaugucugagacggugggcggggccguguuggcugagagagggcugggguccuucguggu

SEQ ID NO: 197764 - RNA, 64 nt, hsa
gggcugcacaggcggcagagauacagggucugagggcugagacgccauggggccgcugcugcuu

SEQ ID NO: 197765 - RNA, 64 nt, hsa
ccuaacuuucucauccucggucucuggaaagucaggcugagaaauccuuucccaggccaggccg

SEQ ID NO: 197766 - RNA, 64 nt, hsa
gguggugcacaccuguagucccagcuacucgggaggcugagacaggagauuugcuugaacccgg

SEQ ID NO: 197767 - RNA, 64 nt, hsa
ugaguaauauacaaaaagguuuucauguauuuguggcugagagggcgggaaauaauuguguaca

SEQ ID NO: 197768 - RNA, 64 nt, hsa
agugacgggugcccguaaucccagcuacucaggaggcugagacaggagaaucaccugaacccca

SEQ ID NO: 197769 - RNA, 64 nt, hsa
caggagggcacguucgcgccgcgccgcggagggaggcugagagggccgggccgggcggcgggga

SEQ ID NO: 197770 - RNA, 64 nt, hsa
uccuguccuuuguugcucaugcuguuuaagugcaggcugagacccagccucuuuguaaguacag

SEQ ID NO: 197771 - RNA, 64 nt, hsa
uagcaaaggcagugagugucaacuaucugcaucuggcugagagagacccguuuccuuucaggga

SEQ ID NO: 197772 - RNA, 64 nt, hsa
aauguuuguuuauucuguuacagcucaaaauggaggcugagaaucucuaccaccauucccuucu

SEQ ID NO: 197773 - RNA, 64 nt, hsa
gcggcgggaggcccacgguucggggcuucugcggggcugagacgccggcuuccuccuuccagau

SEQ ID NO: 197774 - RNA, 64 nt, hsa
uguuggcuuuggaaugguagcaaaagccuuuccuggcugagaugaugcuuaaaacacaccucac

SEQ ID NO: 197775 - RNA, 64 nt, hsa
gcuugguucuacuguaagcaacagcuccuucaugggcugagaaggggaaaccaggaucucccca

SEQ ID NO: 197776 - RNA, 64 nt, hsa
aagaguaugaugugaacaaguaaagacugaauggggcugagaugaaggcaauguuuccaaggaa

SEQ ID NO: 197777 - RNA, 64 nt, hsa
auauucauuccaacugcugccccucugucugccuggcugagaugcaugugggcagcaggaagcc

SEQ ID NO: 197778 - RNA, 64 nt, hsa
guggcuucucagaagcagcucauugccaaggccaggcugagaggggaccugcuugcuguggugg

SEQ ID NO: 197779 - RNA, 64 nt, hsa
ugaaaccccgucucuacuaaaaauacaaaaauuaggcugagacaggagaauugcuugaacccag

SEQ ID NO: 197780 - RNA, 64 nt, hsa
agcaggggacaggcacucaggagggcccgguaaaggcugagaugaaguggacugaguagaacug

SEQ ID NO: 197781 - RNA, 64 nt, hsa
ccuccagucaggcuggacgggaggguagccuuguggcugagaggggucagacuagguggcacag

SEQ ID NO: 197782 - RNA, 64 nt, hsa
gaggugacggcuggugacugauggauggguagugggcugagaagaggggacuaggaagggcuau

SEQ ID NO: 197783 - RNA, 64 nt, hsa
auuagacagaacaccuaugcaaagaugaacccgaggcugagaaucagacugacaguuuacagac

SEQ ID NO: 197784 - RNA, 64 nt, hsa
gccguagcaugaugcuguccaucuuuagcgcaugggcugagaacaccucuucccugaggcuucu

SEQ ID NO: 197785 - RNA, 64 nt, hsa
aucagccuuuaggucuuuaguccgggggacuuggggcugagagaguauaaauaacccugggcug

SEQ ID NO: 197786 - RNA, 64 nt, hsa
ugagaccuuaguguucuccaggcucuguggcccaggcugagagcagcaggguagaaaagaccaa

SEQ ID NO: 197787 - RNA, 64 nt, hsa
accacagugagccugagagagacggcgauuuucgggcugagaaggcaguaguuuucaaaacaca

SEQ ID NO: 197788 - RNA, 64 nt, hsa
acaaaaauuagcugggugugauggccacuugggaggcugagauaggagaaucgcuugaaccugg

SEQ ID NO: 197789 - RNA, 64 nt, hsa
aagauaguucuguaaaguuguuucaguuaaacugggcugagagagcuugaaaguccuuuucaua

SEQ ID NO: 197790 - RNA, 64 nt, hsa
ccgcugauuugaaacaucuggcugcguugccauuggcugagacccaccagguccaguuuugguu

SEQ ID NO: 197791 - RNA, 64 nt, hsa
cggggugggggugggaacucacguggggagcgguggcugagaaaauguaaggauucuggaauac

SEQ ID NO: 197792 - RNA, 64 nt, hsa
gagcaugaagcaaagaauuccaggaaacccaagaggcugagaauucuuuugucuaccauagaau

SEQ ID NO: 197793 - RNA, 64 nt, hsa
gucggguggucccggggccuuugcggucccgcccggcugagacgcucgccccgacgcauggacc

SEQ ID NO: 197794 - RNA, 64 nt, hsa
agauguaagugcuaguagaauauaagauaaaagaggcugagaauuaccauacaaggguauuaca

SEQ ID NO: 197795 - RNA, 64 nt, hsa
gguggcauauacuuguggucccagauacuugggaggcugagauaggaucacuugggcccaggag

SEQ ID NO: 197796 - RNA, 64 nt, hsa
ugaacagugaugaaaaagugggagggcuggcuugggcugagaagggagggacagaaaagagaag

SEQ ID NO: 197797 - RNA, 64 nt, hsa; identical to SEQ ID NO: 64837

SEQ ID NO: 197798 - RNA, 64 nt, hsa; identical to SEQ ID NO: 64838

SEQ ID NO: 197799 - RNA, 64 nt, hsa; identical to SEQ ID NO: 64839

SEQ ID NO: 197800 - RNA, 64 nt, hsa; identical to SEQ ID NO: 64840

SEQ ID NO: 197801 - RNA, 64 nt, hsa
ugaccacacuuagugagaaggagccacaaguuguggcugagaguucccugugaacuugaguagu

SEQ ID NO: 197802 - RNA, 64 nt, hsa; identical to SEQ ID NO: 64841

SEQ ID NO: 197803 - RNA, 64 nt, hsa; identical to SEQ ID NO: 64842

SEQ ID NO: 197804 - RNA, 64 nt, hsa
uuaaggcucugugccuuggucucuccuuccucuuggcugagauagcagaggggcuccccggguc

SEQ ID NO: 197805 - RNA, 64 nt, hsa
ggccugacaguuucuaccaguccugcugucccucggcugagaauaaaacccauuucuggaugau

SEQ ID NO: 197806 - RNA, 64 nt, hsa
cgucuucugggcugggcaggcccucugguucccaggcugagacugacggguuuucucaggauga

SEQ ID NO: 197807 - RNA, 64 nt, hsa
gggucuggggcagggaacgaacaugguggcuuugggcugagaggaugagggaggucuuucccag

SEQ ID NO: 197808 - RNA, 64 nt, hsa
caauccagccuucuucccccaggguccccugcauggcugagagggugugggugcccuguugacc

SEQ ID NO: 197809 - RNA, 64 nt, hsa
aagaggcagagggacuugggaccugggagaauggggcugagaggaggcuucggguuggggccca

SEQ ID NO: 197810 - RNA, 64 nt, hsa
cuggcauaaagaauguauauauauuuugaaauauggcugagaacaugucauugguuugugaggc

SEQ ID NO: 197811 - RNA, 64 nt, hsa
ucuguagugggggaaagguggcuggaccucuguuggcugagaagagcaucccuucagcuucccc

SEQ ID NO: 197812 - RNA, 64 nt, hsa
aagaugaauagguguucucaggagguagggaucuggcugagagggaauaaucugagcaaaggua

SEQ ID NO: 197813 - RNA, 64 nt, hsa
uaagcuguaguuagauaacaccuagugauuaauuggcugagaaaacccuggaguggagggaggc

SEQ ID NO: 197814 - RNA, 64 nt, hsa
guacgugcgugccuguagucccagcuacucgggaggcugagaugggagaaucacuugaaccugg

SEQ ID NO: 197815 - RNA, 64 nt, hsa
ucagaaggcaccagcaccagggcccagguauuaaggcugagagugaaggcugccaaugucagcu

SEQ ID NO: 197816 - RNA, 64 nt, hsa
agagaagugaauaaucuuucuuugguagaaaauaggcugagauauaaggugauauugcuauuga

SEQ ID NO: 197817 - RNA, 64 nt, hsa
aaucgcuugaaccugggagguggagguugcagugggcugagaucacgccauugcacuccagccu

SEQ ID NO: 197818 - RNA, 64 nt, hsa
agggucuuguguugcuucuggucucuccaggcuuggcugagacggacgguagacuuccaccaug

SEQ ID NO: 197819 - RNA, 64 nt, hsa
ggggagcugcugccuuuggggacccacgcuccaaggcugagaccaguucccuggaggccaccca

SEQ ID NO: 197820 - RNA, 64 nt, hsa
cagacaugaggcagcauuuccuccacacuaggguggcugagagggguccugggguguuucagac

SEQ ID NO: 197821 - RNA, 64 nt, hsa
gcugauucuuucaacaacugucacagaauggcugggcugagaacgcugcccagggcccugcagc

SEQ ID NO: 197822 - RNA, 64 nt, hsa
cgagucaucuccggugauccuuaaaugaacugcaggcugagaaaagaaggaaaaaggucacagc

SEQ ID NO: 197823 - RNA, 64 nt, hsa
ugcggcuugcgccuguaaucucagcacuuugggaggcugagauggguggaucaccugagguugg

SEQ ID NO: 197824 - RNA, 64 nt, hsa
aguggcucccuccuguagucccagcuacuugggaggcugagaugggaggaccauuugagccugg

SEQ ID NO: 197825 - RNA, 64 nt, hsa
gguggcauaugccuguagucccaguuacuugggaggcugagacaggauugcuuaagcccaggag

SEQ ID NO: 197826 - RNA, 64 nt, hsa
acuggcauugacgaaaaucauuugaaucucuucuggcugagauaauuugccaaugcaaaauaca

SEQ ID NO: 197827 - RNA, 64 nt, hsa
gucauacuaggagcaauuaggagccauaugccugggcugagaagagcuaggcaguagugaccuu

SEQ ID NO: 197828 - RNA, 64 nt, hsa
aucguguacugcagaguugagcuggcaggggaggggcugagagggugggggcuggaaccccucc

SEQ ID NO: 197829 - RNA, 64 nt, hsa; identical to SEQ ID NO: 64843

SEQ ID NO: 197830 - RNA, 64 nt, hsa; identical to SEQ ID NO: 64844

SEQ ID NO: 197831 - RNA, 64 nt, hsa
gaccugagugucggucacagcccccuacacucaaggcugagaggccucaggaaagucauuccuu

SEQ ID NO: 197832 - RNA, 64 nt, hsa
uaagagaacuuguauugugucauuucagauuguaggcugagaguuguaaauagugaaaauuuga

SEQ ID NO: 197833 - RNA, 64 nt, hsa
ucaugggcugccugggacccaggacccaugagggggcugagagguuucuacacucgaggagcag

SEQ ID NO: 197834 - RNA, 64 nt, hsa
uguucccuggagucagggugaacugcaaagcuuuggcugagaccugggauuugagauaccacaa

SEQ ID NO: 197835 - RNA, 64 nt, hsa
acaggcugcagagggcuccagguucugggccccuggcugagaaggggaggauccuguccuggcu

SEQ ID NO: 197836 - RNA, 64 nt, hsa; identical to SEQ ID NO: 64845

SEQ ID NO: 197837 - RNA, 64 nt, hsa; identical to SEQ ID NO: 64846

SEQ ID NO: 197838 - RNA, 64 nt, hsa
agagagguggauccuguaggcuaaaaggcuuccaggcugagagccggccguggaaggagggaug

SEQ ID NO: 197839 - RNA, 64 nt, hsa
uggugaaagcauguggcuaugguauagcccacagggcugagauugcuguguugcaguauugaug

SEQ ID NO: 197840 - RNA, 64 nt, hsa
ugaucaguauuuuuuuauaccaguuuuggagacuggcugagaugaaaggaaauguggaauaaaa

SEQ ID NO: 197841 - RNA, 64 nt, hsa
cccccucuaccucaguagcccccaggccugagauggcugagaagggaaggguauccuuuuccca

SEQ ID NO: 197842 - RNA, 64 nt, hsa
ucaacaaaggaguguguucagaaaaggagagagaggcugagaucauucaggaguuuguugggca

SEQ ID NO: 197843 - RNA, 64 nt, hsa
agcucgugugggcgcucguccacaaacacuccguggcugagaggcagcggauccaggcagcgau

SEQ ID NO: 197844 - RNA, 64 nt, hsa
gcucaagugccuuaggcccguggaccacagucuuggcugagaucaaagggaugagcaacaggga

SEQ ID NO: 197845 - RNA, 64 nt, hsa
gcucuggucucugggcauucauuucccucauagaggcugagaauaaaacaaggacuuauucaca

SEQ ID NO: 197846 - RNA, 64 nt, hsa
gguuuuccacuccuucuagauauucccaaaaagaggcugagacaggagguuauuuucaauuuua

SEQ ID NO: 197847 - RNA, 64 nt, hsa
auagagaucaucuggccaccccuagaggcagaugggcugagauaaaagacuguuggggccaccu

SEQ ID NO: 197848 - RNA, 64 nt, hsa
ccuccacucccacuucccugacacugcggggcuuggcugagagaguggcauuggcagcaggugc

SEQ ID NO: 197849 - RNA, 64 nt, hsa
acuuuccaucgccuuuuccuuccaucaguugaguggcugagagagaagugccucaucccugagc

SEQ ID NO: 197850 - RNA, 64 nt, hsa
ccuagucucuggauuuggggagcuugucuucaguggcugagacugugagcugggagcaguucuc

SEQ ID NO: 197851 - RNA, 54 nt, hsa
gccugcagucaagugagugacucgggcugagaggcugcuuuugauuuuagccau

SEQ ID NO: 197852 - RNA, 64 nt, hsa
gugaaggcuguccuuacccaucugcaccccccugggcugagagaaccucacgcaccucccaucc

SEQ ID NO: 197853 - RNA, 64 nt, hsa
uagcugaagcccauugguuuccacgauuucaauuggcugagaaggcagagagcuagcuccuccc

SEQ ID NO: 197854 - RNA, 62 nt, hsa
agucaucguuugugaucugagacccgcgguguggcugagagcgcacagagcgcacgugcaca

SEQ ID NO: 197855 - RNA, 64 nt, hsa
uguauuucuacuucuggacugccucaauaucaagggcugagacuuuugaauuuugaauauucgu

SEQ ID NO: 197856 - RNA, 64 nt, hsa
cccuuccuugugaccuggacccuccauuguaccuggcugagacugucagccuccuggaggagug

SEQ ID NO: 197857 - RNA, 64 nt, hsa
ugaggcccugcguggagaugcugcaccagcggaaggcugagacccgcuuaccuuaguucaucug

SEQ ID NO: 197858 - RNA, 64 nt, hsa
ucugcagcugaccucuguuguccuccccuugggcggcugagagccccagcugacauggaaauac

SEQ ID NO: 197859 - RNA, 64 nt, hsa
ccugggucacaguuaccgagaggaaaagugggcuggcugagauuucaucccaggcugccugcua

SEQ ID NO: 197860 - RNA, 64 nt, hsa
ggggguguggguaaagacagggaugaaggauagaggcugagagaagaaggaagaaucagcccag

SEQ ID NO: 197861 - RNA, 64 nt, hsa
gucagaaacagaagagcugcaguugcuggagcugggcugagaacugggcugccuccugccaucc

SEQ ID NO: 197862 - RNA, 64 nt, hsa
cuggaggacugagcaccuguggggaagggaggugggcugagagguagaggguggaugcccaggg

SEQ ID NO: 197863 - RNA, 64 nt, hsa
gggagucugugguggccaguuuaccugggcaucuggcugagaggaagaaaggccaaccugaucc

SEQ ID NO: 197864 - RNA, 64 nt, hsa
cacggggagggagcucuuggcugagcuucuacagggcugagagcugcgcuuuggggacuucagc

SEQ ID NO: 197865 - RNA, 64 nt, hsa
gaggcugaggcaggagaauugcuugaaccuaggaggcugagauugcagugagccgaaaucacgc

SEQ ID NO: 197866 - RNA, 64 nt, hsa
gcuugugucuguccagccucuggcuccacugcuuggcugagauccuggcccauaguagaaucug

SEQ ID NO: 197867 - RNA, 64 nt, hsa
uaggugggcuaagugccucccuagaggacuccauggcugagaggcuccugggcagaugggguca

SEQ ID NO: 197868 - RNA, 64 nt, hsa; identical to SEQ ID NO: 64847

SEQ ID NO: 197869 - RNA, 64 nt, hsa; identical to SEQ ID NO: 64848

SEQ ID NO: 197870 - RNA, 64 nt, hsa
accaccuaggcuuccaccuggugagcccuagcagggcugagacccccagggcggcagccugucu

SEQ ID NO: 197871 - RNA, 64 nt, hsa
uggcuuccgugaaagaccaugccuggucuguccuggcugagaagggaccagggagguugcauca

SEQ ID NO: 197872 - RNA, 64 nt, hsa
agaaugaaaccaggaauggacuuggaguucaacaggcugagaggaugccuccaauggaccagag

SEQ ID NO: 197873 - RNA, 64 nt, hsa
ugcagccauccugcagugggggugagcgggcacaggcugagaacugcucuugggugguggaagc

SEQ ID NO: 197874 - RNA, 64 nt, hsa
uuggaacuaaacgucaccaagguggcuucuccuuggcugagagauggaaggcguggugggauuu

SEQ ID NO: 197875 - RNA, 64 nt, hsa
ucuuccagacucauagcaucaguggauaccauguggcugagaaaagaacuguuugagugccauu

SEQ ID NO: 197876 - RNA, 64 nt, hsa
cuccuggaauagaaucuuucuuuccauccugcauggcugagagccaggcuuccuuccuggucuc

SEQ ID NO: 197877 - RNA, 64 nt, hsa
ucauuuguuuuucauauacugguaccuucuuuuuggcugagaucuuucuuuuacuugugauaua

SEQ ID NO: 197878 - RNA, 64 nt, hsa
aguugaugagcagaucuguggaagaacaauccagggcugagaaaucguagagcagugaggcagg

SEQ ID NO: 197879 - RNA, 64 nt, hsa
gcucaugccuguaaucccagccagcacuuugggaggcugagaugggaagaucacuugagcccag

SEQ ID NO: 197880 - RNA, 64 nt, hsa
guaaaaacuuggccccagaugcuugucccuucugggcugagauuucgcagcccccuucucaucu

SEQ ID NO: 197881 - RNA, 64 nt, hsa
ugggaggaugacgcagaugucugcugcagagcugggcugagaguucugcagucuagcucugacu

SEQ ID NO: 197882 - RNA, 64 nt, hsa
auggugcgggcaccuguaguccuagcuaucaagaggcugagacaggagaaacacuugaaccugg

SEQ ID NO: 197883 - RNA, 64 nt, hsa
cuaaaggaaaguuugcaucuaugaaaagccaauaggcugagacauccaauugcugcauggaaau

SEQ ID NO: 197884 - RNA, 64 nt, hsa
agcgggaguuaguauaggaauguccaucucauaaggcugagagcuauuuuuuccuguggcugca

SEQ ID NO: 197885 - RNA, 64 nt, hsa
ggggcuagaccuccuuuuauuugaagggggcaagggcugagaugugguccccaaggggccagaa

SEQ ID NO: 197886 - RNA, 64 nt, hsa; identical to SEQ ID NO: 64849

SEQ ID NO: 197887 - RNA, 64 nt, hsa; identical to SEQ ID NO: 64850

SEQ ID NO: 197888 - RNA, 64 nt, hsa
gguggcaugcgccuguaaucccagcuacucaggaggcugagacagaagaaucgcuugaaccugu

SEQ ID NO: 197889 - RNA, 64 nt, hsa
aaccucgaagcgcccgaggaaacgagggccugcuggcugagauauggggcugugggcagcagac

SEQ ID NO: 197890 - RNA, 64 nt, hsa
ggaggauagggcuggccuuugugaagccagcagaggcugagaaccucaggcuucccuagaucca

SEQ ID NO: 197891 - RNA, 64 nt, hsa
aguuuuauuuaucaaaauguaauggauuuuuaaaggcugagaaauuuuccuuauaccuaccuuu

SEQ ID NO: 197892 - RNA, 64 nt, hsa
agcuuggcugccggcuucauuuauuccugcugauggcugagaagcaucugucuuccaucccacu

SEQ ID NO: 197893 - RNA, 64 nt, hsa
gagcaguagaaucccaggcucuuucacggauuuaggcugagaaacuucagcagcaguauuggac

SEQ ID NO: 197894 - RNA, 64 nt, hsa
cugauacguguaugagacuaugcaaaaguacaagggcugagauucuucguguauagcuguguga

SEQ ID NO: 197895 - RNA, 64 nt, hsa
gccauuccucacccccgugaccucucccagccagggcugagaggauucgagguggcugggaggg

SEQ ID NO: 197896 - RNA, 64 nt, hsa
gguggcgggcaccuguaaucgcagccuuucaggaggcugagacaggagaaucgcuugaacccua

SEQ ID NO: 197897 - RNA, 64 nt, hsa
aguacugggauuacaggcgugagccaccgugccuggcugagaagauggauuuaagacauauuuu

SEQ ID NO: 197898 - RNA, 64 nt, hsa
cucagggaccccucauaugggcuagucccgggagggcugagaugugaauuugugaauuaccuug

SEQ ID NO: 197899 - RNA, 64 nt, hsa
ucuuuuuucuuuuuucuuuuuccuuucuuucgugggcugagaaaggggcaggcaaaaugaagcu

SEQ ID NO: 197900 - RNA, 64 nt, hsa
cugccugcccuuucucccaaaaggacaaagagguggcugagagaguuuuggaauuugacauugg

SEQ ID NO: 197901 - RNA, 64 nt, hsa
ggcugugcaccuaaaugucugucugggaggagcaggcugagaagucuugcagucugcaggacac

SEQ ID NO: 197902 - RNA, 64 nt, hsa
agauguggcaaauccaguguuaacacauauuucuggcugagauuuuggaacuagcuaguaacug

SEQ ID NO: 197903 - RNA, 64 nt, hsa
uuucuuuuuuuucuuuucucuaguuuuucuuucuggcugagauuuccgugcaagacagcaccca

SEQ ID NO: 197904 - RNA, 64 nt, hsa; identical to SEQ ID NO: 64851

SEQ ID NO: 197905 - RNA, 64 nt, hsa; identical to SEQ ID NO: 64852

SEQ ID NO: 197906 - RNA, 64 nt, hsa
aaagauccuuuaggacaugagacugguagaagcuggcugagauaaaauaaguauuuauuuaaac

SEQ ID NO: 197907 - RNA, 64 nt, hsa
cccgccacccacuguggcagcuugaauuucuugaggcugagacaaacuaggauccaguagccua

SEQ ID NO: 197908 - RNA, 64 nt, hsa
aggguuuugggggggugggggaggguguuguuggggcugagaagaaagagauuuauaugcugua

SEQ ID NO: 197909 - RNA, 64 nt, hsa
agaugcucaggaaaguuauuugaguuaaauugcuggcugagagagcuuggaaguccuuuucaua

SEQ ID NO: 197910 - RNA, 64 nt, hsa
gaauacuguuaucuaugugacggggcagucgugaggcugagaugagaaugcggauuaaaaugcc

SEQ ID NO: 197911 - RNA, 64 nt, hsa
ugacuccauuuugaauagggguugaguaaaauaaggcugagaccuacugggcugcauucccaug

SEQ ID NO: 197912 - RNA, 64 nt, hsa
caauaggcuuaaugaaagaggucuuucuugcuuuggcugagagcagccucuuuuuaaaguguga

SEQ ID NO: 197913 - RNA, 64 nt, hsa
acauuuccaaaugugauuucuaauagcucaguguggcugagaaagugcggaacuccacuaaaaa

SEQ ID NO: 197914 - RNA, 64 nt, hsa
gguggcgggcgcccauagucccagcuacucgggaggcugagacaggagacuugcuugaacccgg

SEQ ID NO: 197915 - RNA, 64 nt, hsa
cuccaucucccaccugcccuugagcgcgcucucaggcugagaacacggucucaucaggcgccuu

SEQ ID NO: 197916 - RNA, 64 nt, hsa
gccuggagcccacaaccuucggcuccgggcaaauggcugagauggagguuuccuuuuggaacau

SEQ ID NO: 197917 - RNA, 64 nt, hsa
aguggugggugccuguaaucccagcuacuugggaggcugagacaggagaaucacuugaacccgg

SEQ ID NO: 197918 - RNA, 64 nt, hsa
uccacaagggcauaccccugggggcaggggcuggggcugagaacugcagcccugggucuucccu

SEQ ID NO: 197919 - RNA, 64 nt, hsa
gguggcaugugccuguaaucccagcuacucaggaggcugagacaggagaauugcuugaaccugg

SEQ ID NO: 197920 - RNA, 64 nt, hsa
cuuagugaaauagcaacagauuggaaguugaaauggcugagauuuggugaucuccccacagcug

SEQ ID NO: 197921 - RNA, 64 nt, hsa
aucugagaugaggccucguccuccuggaagcugaggcugagaaggguggagcuuggcccugggg

SEQ ID NO: 197922 - RNA, 64 nt, hsa
cgcaggggaaacguuuucuguuuggaggagcaaaggcugagaacacugugaaaacauuuugcgc

SEQ ID NO: 197923 - RNA, 64 nt, hsa
caggcagaagcugugcucugaagcuaggacagcuggcugagaaguggguucaggcgaaggguga

SEQ ID NO: 197924 - RNA, 64 nt, hsa
ggugguaugugccuguagucucagcuacucaggaggcugagacaggagaaucacuugaacccug

SEQ ID NO: 197925 - RNA, 50 nt, hsa
cugugcuggcccagagcuagggcugagaaguggcccugccuugggcauug

SEQ ID NO: 197926 - RNA, 64 nt, hsa
ugacauuugagggaggaggaggcugggauccucuggcugagaaucuccucagagcccagugcag

SEQ ID NO: 197927 - RNA, 64 nt, hsa
ugcugcucagcacagcccuggauugcagccccgaggcugagaccagacaaagcccgggaggcag

SEQ ID NO: 197928 - RNA, 64 nt, hsa
gguggcaggugccuguagucccagguacucgggaggcugagacaggagaaucgcuugaaccugg

SEQ ID NO: 197929 - RNA, 64 nt, hsa
cugcugggccccagguggcgcacggauggugaggggcugagaaugagggcaccgacugugaagc

SEQ ID NO: 197930 - RNA, 64 nt, hsa
accacugcaaggggugggagccuggcuuggguguggcugagacucuggacagaggcuggggucc

SEQ ID NO: 197931 - RNA, 64 nt, hsa
uuggugcugcccuguggcauggaggggugggaggggcugagauggcugcuggcccggccuccaa

SEQ ID NO: 197932 - RNA, 63 nt, hsa
uggaaacccagguguugugacuggcacugcccaggcugagacucuucaagucccgcugacguc

SEQ ID NO: 197933 - RNA, 64 nt, hsa
gguggugcaugccuguaguuccagcuacuugggaggcugagacaggcgaauugcuugaaccugg

SEQ ID NO: 197934 - RNA, 64 nt, hsa
ucggguacuacgcagcaacacucacaacuguccaggcugagauaaaucccgggaccugaacuau

SEQ ID NO: 197935 - RNA, 64 nt, hsa
gauggugcaugccuguaaucccagcuccucaguaggcugagacaggagcaucacuugaacgugg

SEQ ID NO: 197936 - RNA, 64 nt, hsa
guccuuugaacagaagggccuggaaggccccuggggcugagaaaggguccgcccgguggccugg

SEQ ID NO: 197937 - RNA, 64 nt, hsa
caugguggcacccgccuguaguccagcuacuugaggcugagaugggaggaugagggaggucggg

SEQ ID NO: 197938 - RNA, 64 nt, hsa
ugggguggugagaugaugauuagaucaggggugaggcugagagacucuggguuuagggcuagcc

SEQ ID NO: 197939 - RNA, 64 nt, hsa
gaggccuuccuccuccagggcccucugcagaccaggcugagauggaggaaccugcuaaaaucga

SEQ ID NO: 197940 - RNA, 64 nt, hsa
guggacgggggaaggguuguggcggguguucugaggcugagaggacaccuauaugcguauuucc

SEQ ID NO: 197941 - RNA, 64 nt, hsa
ugagcacacgcgugcuggggugguuuggggagagggcugagauuugucaccagugagcccuugg

SEQ ID NO: 197942 - RNA, 64 nt, hsa
ggggccugugcacuguugcguccaugcucagaguggcugagacuuguguccugaccaggcccug

SEQ ID NO: 197943 - RNA, 64 nt, hsa
guccgccccaaaacccggccuuggucccuggccaggcugagagaauugggcagggagagggcgg

SEQ ID NO: 197944 - RNA, 64 nt, hsa
cugugcuguccugucucccagauccugagacccuggcugagaacuuggcccagccugcugcuua

SEQ ID NO: 197945 - RNA, 64 nt, hsa
gaacacuuucugggcuaacauaguccucacacagggcugagaaagaaagugucuccuuuccugg

SEQ ID NO: 197946 - RNA, 64 nt, hsa
gucucggccuucuuugugcuucucugagcuaugaggcugagaagaucuucaaguggauuuuuag

SEQ ID NO: 197947 - RNA, 64 nt, hsa
uuggccugaugggugggagaaggaaccugagccuggcugagauggcuaggcggagggcuuugaa

SEQ ID NO: 197948 - RNA, 63 nt, hsa
gauccggcaggugcgccuagagcggauccgccaggcugagacccuggagcaagugcgcagcau

SEQ ID NO: 197949 - RNA, 64 nt, hsa
gucuuggccuucuuugugcuucucugagcuaugaggcugagaagaucuucaaguggauuuuuag

SEQ ID NO: 197950 - RNA, 64 nt, hsa; identical to SEQ ID NO: 64853

SEQ ID NO: 197951 - RNA, 64 nt, hsa; identical to SEQ ID NO: 64854

SEQ ID NO: 197952 - RNA, 64 nt, hsa
guccggaucuugucuccuaguccugaggagcggaggcugagaacucagugcugguuuguaaaug

SEQ ID NO: 197953 - RNA, 64 nt, hsa
ucuuuucagaggccgcagggugggugauggagaaggcugagaaccuuucagacccucugugugg

SEQ ID NO: 197954 - RNA, 64 nt, hsa
augaggacgggugccugagcuuagguuguggaguggcugagagggcccaggagggcucgggaca

SEQ ID NO: 197955 - RNA, 64 nt, hsa
gucaccagcagcucuugggaaggacuugcugggaggcugagagaggcuuugggcacagccugcu

SEQ ID NO: 197956 - RNA, 64 nt, hsa
gucagcuccaugacaacaugaccagcucagcaaaggcugagacugcccaugaccugaaggcucc

SEQ ID NO: 197957 - RNA, 64 nt, hsa
ugauaucgcugcuacaucagacucuagaaaaaagggcugagaggaagcaagacguaaagaauuu

SEQ ID NO: 197958 - RNA, 64 nt, hsa
ucugaaggaacagcuccugaaaccagucucccugggcugagacaaccugggcucuucuuaggaa

SEQ ID NO: 197959 - RNA, 64 nt, hsa
gguggcucacaccuguaaucucggcacuuuggggggcugagacaggcggaucaccugaggccag

SEQ ID NO: 197960 - RNA, 64 nt, hsa
ugcuggcccuggugaaggaccugccgagucagcuggcugagauuggggcagcggcucagcaguc

SEQ ID NO: 197961 - RNA, 64 nt, hsa
uuucuuucuagaagauugagaagugcauaugacaggcugagagcaccuccccaaacacacaagc

SEQ ID NO: 197962 - RNA, 64 nt, hsa
ccauuuuccucugugccaaagacagacagacagaggcugagagaggcuguuccugaaucaaagc

SEQ ID NO: 197963 - RNA, 64 nt, hsa
aaaucucacuuuucuccaugaguuuuuucucuugggcugagacuggauacugcccggggcagcu

SEQ ID NO: 197964 - RNA, 64 nt, hsa
aucaguguggacagccugucaacuuaggauggauggcugagagggcuuccuaggagccagucag

SEQ ID NO: 197965 - RNA, 64 nt, hsa
gguggcucaugccuguaaucccagcacuuugggaggcugagacaggcggaucaucugaagucag

SEQ ID NO: 197966 - RNA, 64 nt, hsa
gggcugguggggugccacccucccacaagggcugggcugagacccagcugagugcagcguggcg

SEQ ID NO: 197967 - RNA, 64 nt, hsa
cauagcacuggaagccagagaaaauguuggaagaggcugagacauucuucaccuccuuggcgcu

SEQ ID NO: 197968 - RNA, 64 nt, hsa
gaugcuggaugccgccugauagacaugcuggccuggcugagaaaccccugagcagguaacccag

SEQ ID NO: 197969 - RNA, 64 nt, hsa
gcaacgugagaacaggcuaugggaaggcugcaaaggcugagaaaugcaaaggcucauauuuaua

SEQ ID NO: 197970 - RNA, 64 nt, hsa
caucuuuugcagcccacucugacuuccaucugggggcugagaccacccuugccugcccccuucu

SEQ ID NO: 197971 - RNA, 64 nt, hsa
cuguucagagacagcaacucccucccguaacucaggcugagaaggaaccagccagcucuuaccu

SEQ ID NO: 197972 - RNA, 64 nt, hsa
cugcccagaccggggcccagcagagcucucaggaggcugagaaaccuccagggcagacagaaag

SEQ ID NO: 197973 - RNA, 64 nt, hsa
gggccaagacacugccuaaggugugggagggacuggcugagauugcagcccaugguaggagcug

SEQ ID NO: 197974 - RNA, 64 nt, hsa
ccucugccagcugccuucccugccagagaacaaaggcugagauggcagugcacacacccucccc

SEQ ID NO: 197975 - RNA, 64 nt, hsa
agugacuuuuccuggccucucccagcaugcccugggcugagaugagauggugguuuauggcucc

SEQ ID NO: 197976 - RNA, 64 nt, hsa
acgguuaugauuucagcccugggccugcaggagaggcugagaccagcccacccagccagugguc

SEQ ID NO: 197977 - RNA, 64 nt, hsa
acuuccucuuucgcauucucucucggcucgagcuggcugagauuuuucuaaauugaaaacacgc

SEQ ID NO: 197978 - RNA, 64 nt, hsa
auuucauuguaaaugccugcaacccagggcagggggcugagaccuuccaggcccugaggaaucc

SEQ ID NO: 197979 - RNA, 64 nt, hsa
ucacacuccucacagccuacuuccccuuccccggggcugagagggugaaaguguguggggaagg

SEQ ID NO: 197980 - RNA, 64 nt, hsa
aacuuaaaaucacaaacaugacauugcugauaguggcugagaaauucagaugagaagacaaauu

SEQ ID NO: 197981 - RNA, 64 nt, hsa
gugugugaccgaguggccaucauggugucaggaaggcugagauguauugguuccauccaacacc

SEQ ID NO: 197982 - RNA, 50 nt, hsa
uggacguuggccugggcuagggcugagacgcuucggaccccgggaaaggc

SEQ ID NO: 197983 - RNA, 64 nt, hsa
ggacguaaaucccuaaucuuuaagcccgacuugaggcugagagcagcuggaaguuuggguuugg

SEQ ID NO: 197984 - RNA, 64 nt, hsa
agugggauuugagacccagguuaggcacgacccaggcugagaagggacguuuccaucauucaca

SEQ ID NO: 197985 - RNA, 64 nt, hsa
cacugacgggggcuccauacggaccuggggacugggcugagaggguggacgaguucagguuugu

SEQ ID NO: 197986 - RNA, 64 nt, hsa
gguggcacuucucuguaaucucagcuucucaggaggcugagacaggagaaucgcuugaacccgg

SEQ ID NO: 197987 - RNA, 64 nt, hsa
uuauccagauagauccaaagcucaugucucuucaggcugagacuggcgcugucaccuccaccca

SEQ ID NO: 197988 - RNA, 64 nt, hsa
ggagaacaucugugccaacgguuggacuuuuuauggcugagauucgggaggaagugugacacca

SEQ ID NO: 197989 - RNA, 64 nt, hsa
ggguuuuuuuguacaaauuuagcuaauagcuacaggcugagagaauuguaacauagcaugacaa

SEQ ID NO: 197990 - RNA, 64 nt, hsa
cauaucauucagaaugugcaaagcaguauguacaggcugagacacagcccagagacugaacggc

SEQ ID NO: 197991 - RNA, 64 nt, hsa
ccccagcuguaagacagggacggggcggcccaguggcugagaggagccggcuguggagccccgc

SEQ ID NO: 197992 - RNA, 64 nt, hsa
ccaguggccggggcggccucuggccccugacgcuggcugagacaggcccguggggcgggguuuu

SEQ ID NO: 197993 - RNA, 64 nt, hsa
gaccuaugcacuuuauuucugaccccguggcuucggcugagaccuguguaaccugcugcccccu

SEQ ID NO: 197994 - RNA, 64 nt, hsa
auuucuguagcagccaaguccugcggcucccuggggcugagaucucccuuuguggaacuccgag

SEQ ID NO: 197995 - RNA, 64 nt, hsa
gguggcucacaccuguaaucccagcacuuugggaggcugagacgggugaauuacaugagguugg

SEQ ID NO: 197996 - RNA, 64 nt, hsa
uguaccuguuuccucauuccuuggcugagggagaggcugagaacugggcagacaccccuggagc

SEQ ID NO: 197997 - RNA, 64 nt, hsa
ugguggugcgugcccagguucccagguacucggaggcugagaggugggaggaugccuugagcuu

SEQ ID NO: 197998 - RNA, 64 nt, hsa
ucuuguaagugaguuaauuuaaaaaagaaaauuaggcugagagcaguggcucacgccuguaauc

SEQ ID NO: 197999 - RNA, 64 nt, hsa
aaguuuugagacuggcagguagugaaacucauuaggcugagaaccuuguggaaugcagcugacc

SEQ ID NO: 198000 - RNA, 64 nt, hsa
cacaggcagagagggccacauaucgugugccagaggcugagagacugagagggaugacaggcuu

SEQ ID NO: 198001 - RNA, 64 nt, hsa
ugccccagggacccaggcucaugcucugaacucuggcugagaggaugcugcucaggagccagca

SEQ ID NO: 198002 - RNA, 64 nt, hsa
caaacuucgggcaucuacccugcaauucccgcuuggcugagaggagggggagaaggaggggaag

SEQ ID NO: 198003 - RNA, 64 nt, hsa
caguacaaguuuucuaauuuuugcauuauggauaggcugagaauuuuccaaaucuccaaguucu

SEQ ID NO: 198004 - RNA, 64 nt, hsa
caguacaaguuuucuaauuuuugcaguauggauaggcugagaauuuuccaaaucuccaaguucu

SEQ ID NO: 198005 - RNA, 64 nt, hsa
aguggcucacaucuguaaccccagcacuuugggaggcugagaugggcagaucacuugaggucag

SEQ ID NO: 198006 - RNA, 64 nt, hsa
auagcagggaauuccucuacuacaggaagaagguggcugagauaagaaaggaagcacagaaguc

SEQ ID NO: 198007 - RNA, 64 nt, hsa
caacuccaucuggaauaggagcugaauaaaaugaggcugagaccuacugggcugcauucucaga

SEQ ID NO: 198008 - RNA, 64 nt, hsa
ggccgaaaagcauacacugagagaacauguauaaggcugagauagccugauaaacucauccuau

SEQ ID NO: 198009 - RNA, 64 nt, hsa
uguggcucaggccuguaaucccauaauuuucagaggcugagacaguugggucacgugggccccg

SEQ ID NO: 198010 - RNA, 64 nt, hsa
agccagguucucauaucccagggguucagacuuuggcugagaacagccccuggagaacaugggg

SEQ ID NO: 198011 - RNA, 64 nt, hsa
uuucuuucugccccguugaagaggugcagccucaggcugagaaacacugauagaccaagaggug

SEQ ID NO: 198012 - RNA, 64 nt, hsa
gcgcggcccccgcgcgcgucccccugccggccggggcugagacuccggggagcgcccgcgcccg

SEQ ID NO: 198013 - RNA, 64 nt, hsa
ggcucccugccugagggucacaguaccuugaaugggcugagaacagaccaaacuugauucccau

SEQ ID NO: 198014 - RNA, 64 nt, hsa
uggcaggacaagugggagcagauggccugccuuuggcugagagggcuaccugcccagccccucc

SEQ ID NO: 198015 - RNA, 64 nt, hsa
uucccuacccugcccuagacccaaaagugguggaggcugagaagaagccccacugcccucgcuc

SEQ ID NO: 198016 - RNA, 64 nt, hsa
cacacaugacccacaccgcccucacgugaagcugggcugagagcccuuucucccauccauugga

SEQ ID NO: 198017 - RNA, 64 nt, hsa
gcuggggaagggggcuccaugcugguguggccaaggcugagagcucucucuucucuguuacaaa

SEQ ID NO: 198018 - RNA, 64 nt, hsa
ccuugugugugugcauggugucagcccaaagccaggcugagacaguccucauauccucuugagc

SEQ ID NO: 198019 - RNA, 64 nt, hsa
uaauacaagauauuuauuuaaccaaugaccuuauggcugagaguugaauugugguucaguauuc

SEQ ID NO: 198020 - RNA, 64 nt, hsa
uuuagaaucuggacacuuucuaugaauguaauucggcugagaaacauguugcugagaugcaauc

SEQ ID NO: 198021 - RNA, 64 nt, hsa
acaccucaaucuagaaagaacuugcuuuguacagggcugagauggaggagaaaaaaaugccccc

SEQ ID NO: 198022 - RNA, 64 nt, hsa
cucacucaacaacaucuuuguguugcuuucaccaggcugagacccuacccuaugggguauaugg

SEQ ID NO: 198023 - RNA, 64 nt, hsa
aaguuuuacugcucuuugccaugugguaaaaagaggcugagacauauuuaagaauuccaagagg

SEQ ID NO: 198024 - RNA, 64 nt, hsa
gaaacagugccuuuuucaucaguugcauuuuccaggcugagagcuguauaaaacauuuuggacu

SEQ ID NO: 198025 - RNA, 64 nt, hsa
gugaucagggcaagcuguggagggccagggguggggcugagacugggcugacaucuagaaucac

SEQ ID NO: 198026 - RNA, 64 nt, hsa
ggugguucaugccuguaauaccagcguuuugggaggcugagaugggaggauugcuugagcccag

SEQ ID NO: 198027 - RNA, 64 nt, hsa
ccuggcaccaugcacaugucugaggcugagcaagggcugagaggagaggcuugggccucaguuu

SEQ ID NO: 198028 - RNA, 64 nt, hsa
ccaccucauguuuucaaacuuaauacuggagacuggcugagaacuuacggacaacauccuuucu

SEQ ID NO: 198029 - RNA, 64 nt, hsa
uguacagggcacuuacuacgaauggagcuugcagggcugagaguugcuccagaugagucaguga

SEQ ID NO: 198030 - RNA, 64 nt, hsa; identical to SEQ ID NO: 64855

SEQ ID NO: 198031 - RNA, 64 nt, hsa; identical to SEQ ID NO: 64856

SEQ ID NO: 198032 - RNA, 64 nt, hsa
gcucucugccaugauacuuccuugggacugacuuggcugagaacguguucugucagaggauuug

SEQ ID NO: 198033 - RNA, 64 nt, hsa
cuaggauggcugcugucugagccaugagugccagggcugagagaggccucuucauuuccucucc

SEQ ID NO: 198034 - RNA, 64 nt, hsa
gacaggaaccucuuucccuguucccagagaaugcggcugagaaugagaacgcugaagaugaucc

SEQ ID NO: 198035 - RNA, 64 nt, hsa
cugugcccggagcuggccgugucucccacucaggggcugagaguagcuuugaggagccucauug

SEQ ID NO: 198036 - RNA, 64 nt, hsa
gguggcucacgccuguaaucccagcacuuugggaggcugagacaggcagaucacuugaggucag

SEQ ID NO: 198037 - RNA, 64 nt, hsa
ccuggccaggcgggaggcuucucuucugacccagggcugagacagguuaaggggugaaucuccu

SEQ ID NO: 198038 - RNA, 64 nt, hsa
uaggaucagggacagaucuggaggcccaggacauggcugagagguggucagcaggcugggggca

SEQ ID NO: 198039 - RNA, 64 nt, hsa
aguggcucacgccuguaaucccagcacuuugggaggcugagauggguggaucaccugagaucag

SEQ ID NO: 198040 - RNA, 64 nt, hsa
gguggcgugcaccuguaaucccagcuacucaggaggcugagacaggacacuugcuugaacccgg

SEQ ID NO: 198041 - RNA, 64 nt, hsa
caaagauucgucaacuuucuuagcucaagagagaggcugagaaaugcagagaagaauaagacau

SEQ ID NO: 198042 - RNA, 64 nt, hsa
gacaguugggaagugccuguaggaaaauggcgauggcugagaaaagcccggaggagaugcuccu

SEQ ID NO: 198043 - RNA, 64 nt, hsa
agaacaggcuguaaauggguugccaacauaagcuggcugagaaauaaaagaaaacaagacaguu

SEQ ID NO: 198044 - RNA, 64 nt, hsa
cccuuugacuaaagauaaugugcugucauaucuuggcugagaaacuguugagucaggcuagagg

SEQ ID NO: 198045 - RNA, 64 nt, hsa
auugcacuucacugcagcuuuagagaucgguuuaggcugagacauugcgccugccuuagguugc

SEQ ID NO: 198046 - RNA, 64 nt, hsa
uugguuuuuaccagagaggcuuugaauggaagcaggcugagaguagccaaagaggcaaggggua

SEQ ID NO: 198047 - RNA, 64 nt, hsa
ccuggcugcugcgaagcuggaggaggacugcgugggcugagaugccacccuuugaagggugaac

SEQ ID NO: 198048 - RNA, 64 nt, hsa
gguggcacgugaguguagucucagcuacucaggaggcugagaugagaggaucacuugagccugg

SEQ ID NO: 198049 - RNA, 64 nt, hsa
ugcguccuuccuggguugggcuggagucuggacuggcugagauaagagccuggcaaccagcaag

SEQ ID NO: 198050 - RNA, 64 nt, hsa
auccuaccugguuucugcauaugagaaugcagagggcugagagagggcaaaauuguugucauuu

SEQ ID NO: 198051 - RNA, 64 nt, hsa
uagggcugagggcucggcuguaggggcuuccuuaggcugagagugcccccaggcugacaucugu

SEQ ID NO: 198052 - RNA, 64 nt, hsa
ggcuggggucuuuuuaauuccagugagaagcucuggcugagaagaaaaucaccacuauuaaaaa

SEQ ID NO: 198053 - RNA, 64 nt, hsa; identical to SEQ ID NO: 198046

SEQ ID NO: 198054 - RNA, 64 nt, hsa
gguggagcaugccuguagucucagcuacucaggaggcugagaugagaggaucacuugagccuga

SEQ ID NO: 198055 - RNA, 65 nt, hsa
gggcaaacaaaaugugaaauucugcccucagcugagcugaguaagggcuccuggggguuggcugg

SEQ ID NO: 198056 - RNA, 65 nt, hsa
ugaagaucaaggagaugcuuuguacaugaacagaugcugaguaucuguuaucauuguauuguuua

SEQ ID NO: 198057 - RNA, 65 nt, hsa
cuuuguucccuacccgugcccccagugucuucccugcugaguaccaggagagguccugccccauc

SEQ ID NO: 198058 - RNA, 65 nt, hsa
ggcauggaauaguuuuguaucgggaauuucucagagcugaguaaaaugaaggaaaagcauguuau

SEQ ID NO: 198059 - RNA, 65 nt, hsa
cugcgauuggaaauuuccagccacuuuaagccagugcugaguagggcuucugcagagccauguuu

SEQ ID NO: 198060 - RNA, 65 nt, hsa
agugaaugccagugugcugaugggcguacgcuggugcugaguagaugcgcagccccaucugugca

SEQ ID NO: 198061 - RNA, 50 nt, hsa
uguggaaaauuaaaucauaagcugaguaaaugccuggacucuccccuggc

SEQ ID NO: 198062 - RNA, 65 nt, hsa
aagaggaagaaggguaaacugagcuagccccuggggcugaguacuccugcagggcuggaggaaca

SEQ ID NO: 198063 - RNA, 65 nt, hsa
ccucucaggcucaagcaaaccucucaccucagccugcugaguagcugggacuacaggcacaugcc

SEQ ID NO: 198064 - RNA, 65 nt, hsa
uuguaaaaauugacaacuuuagauucugaggcuaggcugaguacuuauuauacggcuacauuuac

SEQ ID NO: 198065 - RNA, 65 nt, hsa
cccuggguaugcaggacccacuauaccuugcauuugcugaguacaccuagagagcuuggcuguuu

SEQ ID NO: 198066 - RNA, 65 nt, hsa
augguuuuugugcucuuguacguuggaugucuuaagcugaguacaguuuaggggauccuuucuaa

SEQ ID NO: 198067 - RNA, 65 nt, hsa
ggaaaggaguucuuccgggggacacgaauugccuggcugaguagcaagaaagacacacucuuaag

SEQ ID NO: 198068 - RNA, 65 nt, hsa
guaugcauuagccuucccauuuugcaguugaggaggcugaguagccucagaaggguuuaggcgac

SEQ ID NO: 198069 - RNA, 65 nt, hsa
uagggagaacaagaugucauuuguguucaguguaagcugaguaaacaggcccuuccuagaguguc

SEQ ID NO: 198070 - RNA, 65 nt, hsa
cuuccagcccccgcgggaacggggguacacggugggcugaguacagucauucuguugggcugugg

SEQ ID NO: 198071 - RNA, 65 nt, hsa
aaguugcuuucgaaguaacuguggucuuagguucggcugaguaaagaaaaaggauuuuucuucga

SEQ ID NO: 198072 - RNA, 65 nt, hsa
agaaauauggaggcuuuaaaccgcaaacugaaaaagcugaguagaacaaaggcaguggagcauac

SEQ ID NO: 198073 - RNA, 65 nt, hsa
uuauacuaagguagugacugagauuuggugaucuggcugaguauuuugaaacacauuuugaauaa

SEQ ID NO: 198074 - RNA, 65 nt, hsa
uauuguugcauuuaugaauaaaucauuuaucugcugcugaguagaacugcauuuuaugaauauau

SEQ ID NO: 198075 - RNA, 65 nt, hsa
ucagucacguccacgggggacgagccguggguucugcugaguagguggagcucauugcuuucucc

SEQ ID NO: 198076 - RNA, 65 nt, hsa
guuuaauuuuucaguccaaagagaggaaaucagucgcugaguauuauuugacuccggucuccuug

SEQ ID NO: 198077 - RNA, 65 nt, hsa
aggugagugcacagccugugacgcuacagggagaggcugaguaaaccgagauccagcguucugua

SEQ ID NO: 198078 - RNA, 65 nt, hsa
uaucagcauccuuucaagaauauuagauaauuggagcugaguacucaggaacuugacuguaguag

SEQ ID NO: 198079 - RNA, 65 nt, hsa
ccuccuaucuuccuggguagaugcccugguguagggcugaguacugaauggucuuccauccccag

SEQ ID NO: 198080 - RNA, 65 nt, hsa
uuagagaugacuuuaaucuugaaugauuucgacuugcugaguaaaauggaaauaucuccaucuug

SEQ ID NO: 198081 - RNA, 65 nt, hsa
uuaugaggcuuugaaaucuugccuuccugaagauagcugaguaggaugguucuaaggaaagccuu

SEQ ID NO: 198082 - RNA, 65 nt, hsa
cuguuucuaugaaccacagaccaccuaagcaagcugcugaguaagggcucacuggaaacuugcag

SEQ ID NO: 198083 - RNA, 65 nt, hsa
gacaucauuuccuuguuccuauuucuuguuggcuggcugaguagagaaagcauauuuuacuacuu

SEQ ID NO: 198084 - RNA, 65 nt, hsa
accuaggcaggaaucaucucuugaaauaaauacuagcugaguaaaggcaagcaggugugaagagc

SEQ ID NO: 198085 - RNA, 65 nt, hsa
ggggaccaccucuccuugcauucaggggcugugaagcugaguaauuuucggucacagggcaggcc

SEQ ID NO: 198086 - RNA, 65 nt, hsa
acacagcagcacaggaccgcgcuuccuuuagcagugcugaguaagcaggcagcggcacucugaga

SEQ ID NO: 198087 - RNA, 65 nt, hsa
cggacaccccgagcgagcaccccaaagugcacaaagcugaguaaaaagcugcccccuucaaacag

SEQ ID NO: 198088 - RNA, 65 nt, hsa
aaaaagaaaaucucauuagugaacuuaucuuugcagcugaguacuuaaauucuuuuuaaaaagau

SEQ ID NO: 198089 - RNA, 65 nt, hsa
ccccauggggugugccagucuugcaguccgccccagcugaguagcgugagccagaugacgccaca

SEQ ID NO: 198090 - RNA, 65 nt, hsa
cugauggaucccgaagaauggagaggaacacaggcgcugaguauggagcagccuggagacccacc

SEQ ID NO: 198091 - RNA, 65 nt, hsa
augugucacgaguuuuuguuuuuauguuuuucauugcugaguacugcuucauugaauagauuugu

SEQ ID NO: 198092 - RNA, 65 nt, hsa
gguccugggaauuuauuuucauggcuguugucauggcugaguaguuuuuugaugaauucaaucaa

SEQ ID NO: 198093 - RNA, 65 nt, hsa
agacagagagccaugagacuuucccgagaauugcagcugaguaugcucgaaauaguucauccagg

SEQ ID NO: 198094 - RNA, 65 nt, hsa
uguugcaaaagauaagauuucauuauuuuuuuuuggcugaguaguauucugugguguguaugugu

SEQ ID NO: 198095 - RNA, 65 nt, hsa
gguuacuuuguuauucagcuuuucauaauaucuaugcugaguauuuucacguaucuuccaaguac

SEQ ID NO: 198096 - RNA, 65 nt, hsa
acagcaaacagaucacuaggccucugaccacaggugcugaguacucagcagcccucauauaauag

SEQ ID NO: 198097 - RNA, 65 nt, hsa
auauuacccugugacuuacguaggaaaccuaauaugcugaguaucuggcacuugaauuccugcuu

SEQ ID NO: 198098 - RNA, 65 nt, hsa
aauaagacaaaaauaauaguuuuagugaggauggugcugaguaaacauaaaaacugauuugcucu

SEQ ID NO: 198099 - RNA, 65 nt, hsa
uaauuuuuaccuuauuuuggcucuaauuugaauaagcugaguaaaaccaccaaagaucaguuaua

SEQ ID NO: 198100 - RNA, 65 nt, hsa
cuuaaugguccuuuuggccccuuggauaguuaacagcugaguaauucuaaucucuucuguguuuu

SEQ ID NO: 198101 - RNA, 65 nt, hsa
gugcaagugguucaggggccagcgcagagcagagugcugaguaaagaugucagaaaaggaaagca

SEQ ID NO: 198102 - RNA, 65 nt, hsa
ccaaguugcugcaaaauacauuauucuucuuuauggcugaguaauaguccaugguacauauauac

SEQ ID NO: 198103 - RNA, 65 nt, hsa
acaugacauguggcugccuccccuuucagaaacaagcugaguaacccagccugccguuuguaugu

SEQ ID NO: 198104 - RNA, 65 nt, hsa
gggacaggccuggaguuacuaggacaggccuuugugcugaguagcaauguauacaccauuugggc

SEQ ID NO: 198105 - RNA, 65 nt, hsa
ggacccaucuuugcucauggcaacaguuagcuggagcugaguagcagcugccugauuagaugacu

SEQ ID NO: 198106 - RNA, 65 nt, hsa
agauugugugacuuuaggcaaacauacuucuccuagcugaguauuuuuuaucaguaaguacaaau

SEQ ID NO: 198107 - RNA, 65 nt, hsa
uugaauacaauacucaucuaggauguaacagugaagcugaguaaacuauaacuguuaaacuuaag

SEQ ID NO: 198108 - RNA, 65 nt, hsa
ugaucccugugugucaguugugcauuuuuuuuguugcugaguaguauguucuaucuuaugucaga

SEQ ID NO: 198109 - RNA, 65 nt, hsa
ccacccuuagacccugugauccauccucucuccuagcugaguaaauccgggucucuaggaugcca

SEQ ID NO: 198110 - RNA, 65 nt, hsa
accccugaguucaagcgauucuccugccucagccugcugaguaguugggauuacaggcgcccacc

SEQ ID NO: 198111 - RNA, 65 nt, hsa
uuuuuuaaaacucaucacagaagauuggugaaaaugcugaguaugacacuuuucuucuugcaugc

SEQ ID NO: 198112 - RNA, 65 nt, hsa
acuagaugggacauccagucccuuugauagauaaugcugaguaaaaaaugagaugaaagacauuu

SEQ ID NO: 198113 - RNA, 65 nt, hsa
ucucucugccauuuucucuaucagaaaacauuaaagcugaguagaaacuucaagaugaucauucu

SEQ ID NO: 198114 - RNA, 65 nt, hsa
agacguuuacucuggaggcacaagcuggcugccaugcugaguaaguccucuuuguagaugaugua

SEQ ID NO: 198115 - RNA, 64 nt, hsa
acauggcuugcaaaaaguaaaccacgaucguuaugcugaguauguuaagcucuuuaugacuguu

SEQ ID NO: 198116 - RNA, 65 nt, hsa
guagaaauaucuaagguacugacacuucagacauugcugaguauagaaucagaaugcugaguaua

SEQ ID NO: 198117 - RNA, 65 nt, hsa
gacacuucagacauugcugaguauagaaucagaaugcugaguauagaaaauaauuuaaaacuaaa

SEQ ID NO: 198118 - RNA, 65 nt, hsa
auacugacacuucagacauuacacaaaaucagagugcugaguacagaaaguuauccaaaacaaaa

SEQ ID NO: 198119 - RNA, 65 nt, hsa
cuuauuucagaauggaaauauuuuugagaaaaguagcugaguauacugguuuaagaaaaugcuug

SEQ ID NO: 198120 - RNA, 65 nt, hsa
ugagggucacugguggaccaugcuaguauuuuggugcugaguaauuagauuauguauagggguaa

SEQ ID NO: 198121 - RNA, 65 nt, hsa
uccacuuauccccuccgugauauggcucuucgcaugcugaguacuggaccucggaccagagccau

SEQ ID NO: 198122 - RNA, 65 nt, hsa
acaaugaaaacucaauucuauuuacaaguauaaaugcugaguaugucuguugaagacgagcagag

SEQ ID NO: 198123 - RNA, 65 nt, hsa
uauaccugaauuacaguuuugugauauaaaauaaagcugaguauaaaauaaaaccaaucaaacac

SEQ ID NO: 198124 - RNA, 65 nt, hsa
uuuuucugagacggaguuucgcccuuuucgcccaggcugaguacaguggugcaaucucacugcaa

SEQ ID NO: 198125 - RNA, 65 nt, hsa
ggcuucuccucugcuaggcuacccuccucuagaaggcugaguaccaugggcuacagugucuggcc

SEQ ID NO: 198126 - RNA, 65 nt, hsa
ccccugucuaauuaagacaaagcagaugcuugugggcugaguaauuggcacaacucuaucuaagg

SEQ ID NO: 198127 - RNA, 65 nt, hsa
ugcaggugagcaaagcuaccacgcugcagaagacagcugaguacauccuuaugcuacagcaggag

SEQ ID NO: 198128 - RNA, 65 nt, hsa
gcagguuuuguaacuauuuaugaagaaauauuuuagcugaguacuauauaauuuacaaucuuaag

SEQ ID NO: 198129 - RNA, 65 nt, hsa
ccuccuaaguucaaacgauucuuguaccucagccugcugaguagcugguauacaggcacaucgcc

SEQ ID NO: 198130 - RNA, 65 nt, hsa
aagcauguuuagcuucgaaguuuuacuuuuuuaaagcugaguaguuaagaauucccuguaaaaac

SEQ ID NO: 198131 - RNA, 65 nt, hsa
uaaaaagaaggcuucucuguuuggguagcguaagagcugaguauaguaaguccucuuccaaagag

SEQ ID NO: 198132 - RNA, 65 nt, hsa
auguauuuauaauuuaaaugauauuuagguuuuuggcugaguacuggaauaaacagugagcauau

SEQ ID NO: 198133 - RNA, 65 nt, hsa
cuugaguagaaaagucggggaucggggcaagagaggcugaguacggaugggaaacuauugugcac

SEQ ID NO: 198134 - RNA, 65 nt, hsa
uaaagaauugugguuuauauauuuaaaagugucaagcugaguauuaaaauguaugcauguugucu

SEQ ID NO: 198135 - RNA, 65 nt, hsa
ugcacagagcuagacucgggcagccagagcggcgagcugaguaacagggguaacaccucccugcu

SEQ ID NO: 198136 - RNA, 65 nt, hsa
cguucccuacacagaaaucuuggaaaccaaaugcugcugaguaaggaugaagcuuugagccuccu

SEQ ID NO: 198137 - RNA, 65 nt, hsa
aacuaaaaaagugaagauaagaaaauacucuuaaagcugaguauuuccuaauuguauagaaucuu

SEQ ID NO: 198138 - RNA, 65 nt, hsa
ggaggcaggaaccaggauaaggguggcuucucccagcugaguaauguggccaccauguccaaggu

SEQ ID NO: 198139 - RNA, 65 nt, hsa
gaggaggccugcaccccaguauaagggccuccccagcugaguaagaagcugcuuccccuccucuc

SEQ ID NO: 198140 - RNA, 65 nt, hsa
uauguguggcugugggugugggugggagugugucugcugaguaaggaacacgauuuucaagauuc

SEQ ID NO: 198141 - RNA, 65 nt, hsa
ucucucagccacugcuauagucuaacuucuuguuugcugaguaauuguuucuaaugucucugaac

SEQ ID NO: 198142 - RNA, 65 nt, hsa
cauucugacguguaaccgcauauaggagcccacuggcugaguagcuaccaucaucgcuggugggg

SEQ ID NO: 198143 - RNA, 65 nt, hsa
uuaaaaaugucauguuuaugucaugucugugaauugcugaguacuaauugauuccuccauccuug

SEQ ID NO: 198144 - RNA, 65 nt, hsa
augucuaggacuaaagcaguggcuuuguauagcaagcugaguaaagguugacauauuccaaaacc

SEQ ID NO: 198145 - RNA, 65 nt, hsa
uggaaggaaagcaacuuuaaaacauuuagaguuuugcugaguauagccaaaugccuguucugaaa

SEQ ID NO: 198146 - RNA, 65 nt, hsa
gaacagaaggacagauggacccaggagggagggcagcugaguaacuggguaacuuauuggggcug

SEQ ID NO: 198147 - RNA, 65 nt, hsa
ccauauguaaucacuguguuuguagguuagaaacagcugaguaucguaguuucauauaugguucc

SEQ ID NO: 198148 - RNA, 65 nt, hsa
uaaccaaagaaagugggucaccugaccucugaagagcugaguacucaggccacuccaaucacccu

SEQ ID NO: 198149 - RNA, 65 nt, hsa
uuaaaaaaacaaucccaaguaaaaauuucuucugggcugaguagauaaaaaacaucaucgcuccc

SEQ ID NO: 198150 - RNA, 65 nt, hsa
aagguuccaaagggauuuagcagugaggcagcaaugcugaguagguaggauaauuauuucauuca

SEQ ID NO: 198151 - RNA, 65 nt, hsa
uuuauuacuguuuaugauuucagauaaaaauaguugcugaguaaauuuuacuuguaaucuacaau

SEQ ID NO: 198152 - RNA, 65 nt, hsa
guuuauuuuccaucuuguuuguuuuccuaccuuaugcugaguaguccagagaguuaaaaaaauuc

SEQ ID NO: 198153 - RNA, 65 nt, hsa
cuagggagauuuauuucuguuaaauaguuaacucugcugaguaugacaaauagugucuacuaucu

SEQ ID NO: 198154 - RNA, 65 nt, hsa
uuacuaaaaaaagaguuguauauaauauuuaagaugcugaguauuucauaggaaagcugaaugcu

SEQ ID NO: 198155 - RNA, 65 nt, hsa
gugucaagacuuuuaacccgacagccccaagcacugcugaguaaagucaucagaugaguaguccc

SEQ ID NO: 198156 - RNA, 65 nt, hsa
gacagaaauuguauguauuguggaucugcaugugugcugaguauucccuauuucuuugaucccuu

SEQ ID NO: 198157 - RNA, 65 nt, hsa
uuuuauuucugaaacacucaaacaccuuacaaagugcugaguagguaauagugacccaacuuguu

SEQ ID NO: 198158 - RNA, 65 nt, hsa
gacccacuguaacuuagccacugaugaaccuuaaagcugaguauuuuauuaacaccugauuugua

SEQ ID NO: 198159 - RNA, 65 nt, hsa
ggccaagaaagcaacuugagccuugggcuaaucuggcugaguagucaguuauaaaagcauaauug

SEQ ID NO: 198160 - RNA, 65 nt, hsa
cuuuaauuaauaguauguaugaugagcuauguuuggcugaguacuuguaacugucagaagaagga

SEQ ID NO: 198161 - RNA, 65 nt, hsa
acaggaugggcagagaaaggguagugugugagggagcugaguaggccagguaggcgauuggaaga

SEQ ID NO: 198162 - RNA, 65 nt, hsa
auauaguuccuugggauuagcucuuggccaagaaggcugaguaugguucccaauuuuuaaaucca

SEQ ID NO: 198163 - RNA, 65 nt, hsa
gcaaaaguagcuuuugaacugauauaaaaaaaaaugcugaguaacagaaaaguauuaaugugcuu

SEQ ID NO: 198164 - RNA, 65 nt, hsa
auccugcuuuagccugagacuugccauaagaaacugcugaguacuuggcaaacccuuucauaguu

SEQ ID NO: 198165 - RNA, 65 nt, hsa
acagguagccccucaugcugggcucuggaccaugagcugaguaggaaggauagcagaggccaacc

SEQ ID NO: 198166 - RNA, 65 nt, hsa
gcaucguggugaagugggggcaguuccuuuugauugcugaguaguauuccaugguauggauguac

SEQ ID NO: 198167 - RNA, 65 nt, hsa
gcuccauacuucuuucacuacucaaauggcauugggcugaguaaguaaccauaucaccucucuuc

SEQ ID NO: 198168 - RNA, 65 nt, hsa
aaccacugagaaaagacgaaaauggcaccagcguugcugaguaucccaugagugcuucgcagagc

SEQ ID NO: 198169 - RNA, 65 nt, hsa
auugcuguucagccuuuguuuuuacgucauuacaagcugaguaaaauuccuucugaugauguuau

SEQ ID NO: 198170 - RNA, 65 nt, hsa
uuccuuaguucaaggaacagcugagacagaccucugcugaguagcucugugaugacaaagccuug

SEQ ID NO: 198171 - RNA, 65 nt, hsa
aaaaaacaaaagcccuggaaguugaggccaagccugcugaguauugcagcugcauuugcccaaag

SEQ ID NO: 198172 - RNA, 65 nt, hsa
cugguaacagcagcccgcauuagcagagagcuguagcugaguagcugccaccucguugggagacu

SEQ ID NO: 198173 - RNA, 65 nt, hsa
cuguuguguguaucagcaguuuguuccuuuucauugcugaguaguauucuauuguagagauguac

SEQ ID NO: 198174 - RNA, 65 nt, hsa
agagaaucucuguguagaauuugaauaugacccaagcugaguauuaucuaaacagguugguggaa

SEQ ID NO: 198175 - RNA, 65 nt, hsa
uguccaggguauugcuccccugaguguauaugagugcugaguaguauugcagagaaugugaugag

SEQ ID NO: 198176 - RNA, 65 nt, hsa
gcaauccguucuuagggacuggauacuucuggcuggcugaguauaguacuagcugccuccccacc

SEQ ID NO: 198177 - RNA, 65 nt, hsa
uuuuuuuuuaauagcuguuuaacaaauuagucuuugcugaguaaaaggggaaauuucuaaaccua

SEQ ID NO: 198178 - RNA, 65 nt, hsa
ggaggacugaccgcuucauaagccaguacgucugagcugaguauguuucaauaaaccuuuugaua

SEQ ID NO: 198179 - RNA, 65 nt, hsa
aaccugcugaagggcagagguggaggguggggggcgcugaguagggacucagggccaugccugcc

SEQ ID NO: 198180 - RNA, 65 nt, hsa
gcuuucguaaaggucugaacacuguuaaggagaaagcugaguaucaacuugccuuucugauagaa

SEQ ID NO: 198181 - RNA, 65 nt, hsa
agugcuggaauuacaggugugagccacugugcccagcugaguaaauuucuugauugcacagaaug

SEQ ID NO: 198182 - RNA, 65 nt, hsa
agaccaggguggguacauacuggagacagccaagagcugaguauauaaaggagagggaaugugca

SEQ ID NO: 198183 - RNA, 65 nt, hsa
uugaccacggacuccagucuguguguagggagagagcugaguaggaggccuccacuccggaucga

SEQ ID NO: 198184 - RNA, 65 nt, hsa
cagugggugcaaggcgccauacuugcugugagagagcugaguagaguguugguuuuuccauaacu

SEQ ID NO: 198185 - RNA, 65 nt, hsa
ucugcuggaucaacagaaucccgaugaggacuucagcugaguauaguucaacaguuuugcugaca

SEQ ID NO: 198186 - RNA, 65 nt, hsa
uccuggacaccgaggauuggaaauaagggccuggagcugaguaguagccagucugcugugaccac

SEQ ID NO: 198187 - RNA, 65 nt, hsa
aauggaaauaagaggauauugaucacgagugugaugcugaguaccuuucugcauauacuggauug

SEQ ID NO: 198188 - RNA, 65 nt, hsa
agaauuucacaagcuauucccucaaaucugagggagcugaguaacaccaucgaucaugauguaga

SEQ ID NO: 198189 - RNA, 65 nt, hsa
gcauucaagcuuuagacauuacacuaaaucagagugcugaguauagaaaauaauacaaacagauu

SEQ ID NO: 198190 - RNA, 65 nt, hsa
ccaccaaggacagcuacacgcugacggaggagcuagcugaguaugcugaaauccgggucaaguga

SEQ ID NO: 198191 - RNA, 65 nt, hsa
cucccgucucuagggcugcauggggagcccggggagcugaguaguggggauccagagaggacccc

SEQ ID NO: 198192 - RNA, 65 nt, hsa
gcacugaugcuucagguauuuuacuaaaucagagugcugaguauagaaaauaaucuaaaacuaaa

SEQ ID NO: 198193 - RNA, 65 nt, hsa
aauaucauuuccacaguuccaauuccuccuacauugcugaguacuagccaaggcuccucuuuaug

SEQ ID NO: 198194 - RNA, 65 nt, hsa
ccuggccgcagugaggcauguaucuguaguuccuugcugaguaacaagaaguaaaauacauguuu

SEQ ID NO: 198195 - RNA, 65 nt, hsa
uaaaagggcaugauuaugaauguuagaaucaauuugcugaguaugaaauaagaaaaguuagggca

SEQ ID NO: 198196 - RNA, 65 nt, hsa
ugucccccucccacccuacacaguagcuggucagggcugaguacaguccuggggguaaggggaug

SEQ ID NO: 198197 - RNA, 65 nt, hsa
cuuguggauccuguugggaccagccacucaccaaggcugaguagguccacaaauaauggggacuu

SEQ ID NO: 198198 - RNA, 65 nt, hsa
ccgggaagaagccagcaaagucccccgugucccuugcugaguauucugucacagacaagccucca

SEQ ID NO: 198199 - RNA, 65 nt, hsa
ggggagagguuggggcuggcaggccacuggcaugugcugaguagcgcagagcuacccagugagag

SEQ ID NO: 198200 - RNA, 65 nt, hsa
aagaucuaugggcaugggaggugggcguuggaaaggcugaguaggaauggugccuggcaccccug

SEQ ID NO: 198201 - RNA, 65 nt, hsa
ucagagaccugaggccuaguggggaucuguccuaagcugaguacagcagccaggggaccagaacu

SEQ ID NO: 198202 - RNA, 65 nt, hsa
uacuagaagggcauuggccauucuauuguggcaaggcugaguagaagauccuaccccaauuccuu

SEQ ID NO: 198203 - RNA, 65 nt, hsa
ugccaguaggcucaacuagggagugagugcaaaaagcugaguauggugagagaagccugugcccu

SEQ ID NO: 198204 - RNA, 65 nt, hsa
cuaagaauauaggcuugaugggaaauugaagguaggcugaguauugggaauccaaauugaauuuu

SEQ ID NO: 198205 - RNA, 65 nt, hsa
cauucaaaggccacuggugcuuuauuuuucuaucugcugaguaaacugaaaugagauggguccca

SEQ ID NO: 198206 - RNA, 65 nt, hsa
uuugauaugauuuuaaagucagaauaguacagauugcugaguauuauacuuuaggcuagauuaau

SEQ ID NO: 198207 - RNA, 65 nt, hsa
aauguuuugauucucuaaucauguuuucgucacaugcugaguaaaagugccuuacaauguaaaaa

SEQ ID NO: 198208 - RNA, 65 nt, hsa
cgcucccccauaucaauuuuccuuuugucuccggggcugaguaaauaaacauguucugucacaaa

SEQ ID NO: 198209 - RNA, 65 nt, hsa
ggaccagcagucugccuggaggccagggagcaguggcugaguagcucugccuuugcucuggucua

SEQ ID NO: 198210 - RNA, 65 nt, hsa
uugucagugauguugccuagaaucuucuuacacacgcugaguacagaagauauuucaaauuguuu

SEQ ID NO: 198211 - RNA, 65 nt, hsa
gacucauguguuuuggggaaaggaagaaguucuuggcugaguacuauuuugaacuuuccagaacc

SEQ ID NO: 198212 - RNA, 65 nt, hsa
cagauaccuaacagguuuuucuccgugaaucuuaugcugaguaguuuuuccucauaaccaagcau

SEQ ID NO: 198213 - RNA, 65 nt, hsa
aaucaacuuauagugcugacagauuccacuagcaugcugaguaggauaguaaaucaggaugcuca

SEQ ID NO: 198214 - RNA, 64 nt, hsa
caggggcuucuaauuaaauuuaggggauccugaugccacuuagcagugggauuucagaggaccu

SEQ ID NO: 198215 - RNA, 64 nt, hsa
agggcauggacugcuugaguucagugccagcuaugccacuuaccagcugugggaccuugggcaa

SEQ ID NO: 198216 - RNA, 64 nt, hsa
aaauuuucagguagucugaguaauagauuguuuugccacuuagaauagcauuugccacuuagua

SEQ ID NO: 198217 - RNA, 64 nt, hsa
guaauagauuguuuugccacuuagaauagcauuugccacuuaguauuuuaaaaaauaauuguug

SEQ ID NO: 198218 - RNA, 64 nt, hsa
ugcaguugaguuguucaagugagaguuuugauaagccacuuaugggccgcguugugaaucacuu

SEQ ID NO: 198219 - RNA, 64 nt, hsa
uacuuugauauuugaaauguuauguacuggaaaggccacuuauauuucuagaacagauuggauu

SEQ ID NO: 198220 - RNA, 64 nt, hsa
uaugcugccauaacacuugaaaaccaauuuaguuguuagucauucauuaaacauuaacaucacu

SEQ ID NO: 198221 - RNA, 64 nt, hsa
uuuuguauuuuuaguagagaugggguuucaccguguuagucaggauggucucgaucuccugacc

SEQ ID NO: 198222 - RNA, 64 nt, hsa
ccgggaaccccaacaguugguugucuugucuuccagggugcaggucacugagugacuuccccag

SEQ ID NO: 198223 - RNA, 64 nt, hsa
ucuuccagggugcaggucacugagugacuuccccagggugcacagcgaguaacagaucaggacc

SEQ ID NO: 198224 - RNA, 64 nt, hsa
ugcauucucuuuaggccacugguucucaaacauuagggugcacuguaaccauuacagagcuugu

SEQ ID NO: 198225 - RNA, 64 nt, hsa
ugaggcaagagaaucacuugaacccgggaggcagagggugcaguaagccgagauugcaccacug

SEQ ID NO: 198226 - RNA, 64 nt, hsa
gggcacagcgcucgaggugugcuguuaggcuaagagggugcagggcuagacacgaagcuuaaac

SEQ ID NO: 198227 - RNA, 64 nt, hsa
guagagccugaagcugugaucacuccaguggugaagggugcagcucugguucuuccagagagac

SEQ ID NO: 198228 - RNA, 64 nt, hsa
gugaggaugggcuucugccuggcacuggggguggagggugcacacgaauggcccgccuugaggg

SEQ ID NO: 198229 - RNA, 64 nt, hsa
acaccacccuggguggaucgaggagucuggguccagggugcaacagagaaaaacuucaugcaug

SEQ ID NO: 198230 - RNA, 63 nt, hsa
uuccuuaaguuuugaucuccgucuuccugaugaagcaggcagagcucagaggaucuuggcauc

SEQ ID NO: 198231 - RNA, 63 nt, hsa
aucuucccccaccuucuacaugguauuagucccagcaggcaucccuggggcagacgugcuuug

SEQ ID NO: 198232 - RNA, 63 nt, hsa
guuggcuacaugaguauuuagaggaaguaagguagcaggcaguccagcccugauguggagaca

SEQ ID NO: 198233 - RNA, 63 nt, hsa
ugucuucaggcugccaggggaggaggagaagccagcaggcaccacuuuucugcucccuuucuc

SEQ ID NO: 198234 - RNA, 63 nt, hsa
aggccugggauugagcuaaccugaaacaaagguagcaggcaggaccuaaugaccagagguuaa

SEQ ID NO: 198235 - RNA, 63 nt, hsa
gccaacauuggugucccuguccccagagggaggagcaggcaggagagagaggggaaggaggua

SEQ ID NO: 198236 - RNA, 63 nt, hsa
auaaauacaaagcagcuuccaucaggaacauggagcaggcagggacuccauuuuacagaauua

SEQ ID NO: 198237 - RNA, 63 nt, hsa
caggggccggagugagggggcugcuggcuuaacagcaggcaucugggcaggccaguccucaaa

SEQ ID NO: 198238 - RNA, 63 nt, hsa
ugcagccucagaaaccaggccucucacuccagcagcaggcagaaccgugucuguggucgggug

SEQ ID NO: 198239 - RNA, 63 nt, hsa
ugugggagcagacccgugggccucagggcagccagcaggcaggucuuguugccaauuuacaaa

SEQ ID NO: 198240 - RNA, 63 nt, hsa
aaggcgcuggagccugcggggcagcaggggccaagcaggcacucuggggcuggcaccagcagg

SEQ ID NO: 198241 - RNA, 63 nt, hsa
caggggccaagcaggcacucuggggcuggcaccagcaggcacugaagcugcggcccugaucuc

SEQ ID NO: 198242 - RNA, 63 nt, hsa
cuguuaauaugcucauugaaaacauggcauugaagcaggcacuugcguggauguuucucacuu

SEQ ID NO: 198243 - RNA, 63 nt, hsa
accuuuggaucugugagaaggugaauacaaagcagcaggcagaguaaaaucugcugggacugc

SEQ ID NO: 198244 - RNA, 63 nt, hsa
ucauccacuugagggcgccugagggccaggagcagcaggcaaggagccugggucuaggcuaag

SEQ ID NO: 198245 - RNA, 63 nt, hsa
cgggggggacucaacagcagagcucugagcagcagcaggcaacuucgagaacggauccagaaa

SEQ ID NO: 198246 - RNA, 63 nt, hsa
aaggcucuccguggaguggacucgagucccuggagcaggcaguguggaggcagccauccccug

SEQ ID NO: 198247 - RNA, 63 nt, hsa
ggagccaugaggaggggcugggacuggagcuggagcaggcacuugcagccgggaaagccaggg

SEQ ID NO: 198248 - RNA, 63 nt, hsa
ccugaccucuucccaggcagugccuagcuccagagcaggcacagccugccucagcaugcuucg

SEQ ID NO: 198249 - RNA, 63 nt, hsa
aagugguggagccucagggccagggcaggcaggagcaggcacugaugcuagagggugaugacc

SEQ ID NO: 198250 - RNA, 63 nt, hsa
uucuaagacaggaaggaaagugaaggcagagugagcaggcaaaguagaaaauucgaaaagguc

SEQ ID NO: 198251 - RNA, 63 nt, hsa
uuguugcaaugacuugggagugccauagcaccuagcaggcagaagccagaaacaccaaauguc

SEQ ID NO: 198252 - RNA, 63 nt, hsa
ugccggagagacagccccuugugcugugagcagagcaggcaguggcucuggaggcugccugug

SEQ ID NO: 198253 - RNA, 63 nt, hsa
aagguuuccucucuucccccaggaccugggcagagcaggcaugagcugggcuguggugcagag

SEQ ID NO: 198254 - RNA, 63 nt, hsa
caggugauuuccuagggagagguucccagucccagcaggcagaaugcccaaaaccaggagcac

SEQ ID NO: 198255 - RNA, 63 nt, hsa
cucccugguuucuuccuggcaugguguuugggcagcaggcaucauuuuccuuuucuagcuuca

SEQ ID NO: 198256 - RNA, 63 nt, hsa
aguaauaagaaucuaggaggaauuccaaaccgaagcaggcagggucuggaacccaaaggacag

SEQ ID NO: 198257 - RNA, 63 nt, hsa
ucagcacgcucacuaacccagcaugccacuuccagcaggcaugcaguccuggcccagcucuau

SEQ ID NO: 198258 - RNA, 63 nt, hsa
guucuugcaagagcgcguggggacaguucuuccagcaggcacugguuuuguugccccagggcu

SEQ ID NO: 198259 - RNA, 63 nt, hsa
cgugcaugcuuuaaaaaacacagucacgcaccaagcaggcaaauagcuuuaguccuucucacc

SEQ ID NO: 198260 - RNA, 63 nt, hsa
cggauaguaagaaaacaaacagcccaagugaaaagcaggcaaaagacuugaauagacacuuca

SEQ ID NO: 198261 - RNA, 63 nt, hsa
gccauuuuggcugcuguucuuuaaucuuccucuagcaggcaugcaguccaaggaauaucaaaa

SEQ ID NO: 198262 - RNA, 63 nt, hsa
accauuuuggcugcugcucuuuaauuuuccucuagcaggcaugcaguccaaggaauaucaaaa

SEQ ID NO: 198263 - RNA, 63 nt, hsa
cccugacgucccccagcaaaggaagacguugcaagcaggcaaaaugcgucgauuuuuuuuuuu

SEQ ID NO: 198264 - RNA, 63 nt, hsa
cucagccauggcaaguccaucuggaguccaggaagcaggcaacuggccugacccaugagaccg

SEQ ID NO: 198265 - RNA, 64 nt, hsa
cgguaaaggcacuaaagucacuuuaaagcuuuuggagaagcaggagggcauuggcuuaaccaag

SEQ ID NO: 198266 - RNA, 64 nt, hsa
uuggcuccucagcaaggaagcaaacgccuuggaggagaagcacaugguugcccuuuuguccuug

SEQ ID NO: 198267 - RNA, 50 nt, hsa
ucggcuuauauaagcucuaagagaagcacuuugggauucuuuccauuaug

SEQ ID NO: 198268 - RNA, 64 nt, hsa
agaacauagaacucugggcugccaugugaagagggagaagcaugaaaaagcagcuaccaggugu

SEQ ID NO: 198269 - RNA, 64 nt, hsa
acacacacacacacucuuuuaggggacuaagagagagaagcauguuauuacauuuuacucaucc

SEQ ID NO: 198270 - RNA, 64 nt, hsa
uaacucagacagugcaugaggucaguuucuucuugagaagcagugccuuggucuuguuucugug

SEQ ID NO: 198271 - RNA, 64 nt, hsa
aggcaguuuugauuugaggagguuugcacauguagagaagcauacuggagaagcauauccagag

SEQ ID NO: 198272 - RNA, 64 nt, hsa
uugaggagguuugcacauguagagaagcauacuggagaagcauauccagagggcgaaagauauc

SEQ ID NO: 198273 - RNA, 64 nt, hsa
gguucaaagagaaagguuggagaugauagugggugagaagcaggcuggugagacugggcugagg

SEQ ID NO: 198274 - RNA, 64 nt, hsa
agaaaaaucugcuauuuuucuaaguaagagucucgagaagcagaguuuuugucuugucauugag

SEQ ID NO: 198275 - RNA, 64 nt, hsa
cagaaucaucuucagaaagugaacuugaacaugagagaagcagaaggaggaaacauaagaggag

SEQ ID NO: 198276 - RNA, 64 nt, hsa
aaguguucaggccacacagucagcccaggaaaaagagaagcagggccaaauggaaagaacacau

SEQ ID NO: 198277 - RNA, 64 nt, hsa
augguuuacuauuuuggcugcucuuggggacugcgagaagcagagagaaugagagaccaguggc

SEQ ID NO: 198278 - RNA, 64 nt, hsa
uuccaagugguuuucaagugucaggcaguguucugagaagcagcagccuauaacuguaugugug

SEQ ID NO: 198279 - RNA, 64 nt, hsa
ugaagauuuacuuucugagaagcaggaaucgcuagagaagcaaaucaaugaucugaagagugaa

SEQ ID NO: 198280 - RNA, 64 nt, hsa
aauagaaaagaaaucgcuugaagauuuacuuucugagaagcaggaaucgcuagaggugggugaa

SEQ ID NO: 198281 - RNA, 64 nt, hsa
gacagcaucucacuauguugccaaggcucaucuugagaagcaggcggguugggugggaggagga

SEQ ID NO: 198282 - RNA, 64 nt, hsa
guagcaugaugagcaacuugaguuuguugccacugagaagcaggcggguugggugggaggagga

SEQ ID NO: 198283 - RNA, 64 nt, hsa
uauaaauguaaauauauuuuguauauuuuucuaugagaagcacuucauagggagaagcacuuau

SEQ ID NO: 198284 - RNA, 64 nt, hsa
uuuguauauuuuucuaugagaagcacuucauagggagaagcacuuaugacaaggcuauuuuuua

SEQ ID NO: 198285 - RNA, 64 nt, hsa
gaguaugagagacagguacaugguccaguaggaagagaagcagcccugauucuaccacuuaagg

SEQ ID NO: 198286 - RNA, 64 nt, hsa
ggggacacauuuuuuauguguuaucuucagccaugagaagcagugaugacuaucccauaucaca

SEQ ID NO: 198287 - RNA, 64 nt, hsa
ugcagcuuaucaacgaccgcuguguggacaugcagagaagcagagaagaagaaaggagcugagg

SEQ ID NO: 198288 - RNA, 64 nt, hsa
agcugaggaggagaagccaaagaggaggaggcaggagaagcaggcagccugccccuucuacaac

SEQ ID NO: 198289 - RNA, 64 nt, hsa
aauccucuugggaagcuguguggaaauaagcacagagaagcagaacucuaauugcuuaauccac

SEQ ID NO: 198290 - RNA, 64 nt, hsa
acuucugggaauuggcucaucauaaauuauccaagagaagcacaaaguuaugggcacaaagguu

SEQ ID NO: 198291 - RNA, 64 nt, hsa
uucagugggcagcagaaaggagaggcuccuugaagcugcucagucagaggcccccgucccuccu

SEQ ID NO: 198292 - RNA, 64 nt, hsa
gcagacucaugcacgcacacaggagggaggccuagcugcucagaggcugcagggagggcccagg

SEQ ID NO: 198293 - RNA, 64 nt, hsa
ucccucccaaugccacccucaucuuugacguggagcugcucaacuuagagugaaggcaggaagg

SEQ ID NO: 198294 - RNA, 64 nt, hsa
ggcaggaaggaacucaagguggcuggagauggcugcugcucacccuccuagccugcucugccac

SEQ ID NO: 198295 - RNA, 64 nt, hsa
uuugcugucacuuucucucuuauaaauucuguuagcugcucacuuaaacaauguccucuuugag

SEQ ID NO: 198296 - RNA, 64 nt, hsa
cagguucgggacagcccuggacgauuucccgaccgcugcucaggcugcucauuccugcucaccc

SEQ ID NO: 198297 - RNA, 64 nt, hsa
gacagcccuggacgauuucccgaccgcugcucaggcugcucauuccugcucacccucagucucc

SEQ ID NO: 198298 - RNA, 64 nt, hsa
accucuucacaauuuaguucguaccuggcuugaagcugcucacugcucacacgcugccuccuca

SEQ ID NO: 198299 - RNA, 64 nt, hsa
ucacagcccaaccugaacaaccugacugcugugggcugcucacuggcuuuagcugcugucuucc

SEQ ID NO: 198300 - RNA, 64 nt, hsa
aucuggggagugugaggagaggguggcaucaggagcugcucaggcuuggcggagggagcggcau

SEQ ID NO: 198301 - RNA, 64 nt, hsa
gggaaucauucuggcuuaaacaacaccuccuccugcugcucacucccgcugagcccacucuacu

SEQ ID NO: 198302 - RNA, 64 nt, hsa
ugugacacucgggaggaacgauguccuauccugggcugcucaguguucccaggcccugugugcc

SEQ ID NO: 198303 - RNA, 64 nt, hsa
augaggaagcugccuaaggagcccgaagaauucugcugcucaccaggacccagcucugggagug

SEQ ID NO: 198304 - RNA, 64 nt, hsa
aaaaaacuuaaaaaugggauguccuaaaaugaaagcugcucaaagucacagaacaaccgaggga

SEQ ID NO: 198305 - RNA, 64 nt, hsa
uggucccgccauccuccuuugccuucccaggccagcugcucaggcucggcaggucugcagcuca

SEQ ID NO: 198306 - RNA, 64 nt, hsa
uugcgauguccucgguuucccauuuguugcugcugcugcucauuccacacuguugagaccuugu

SEQ ID NO: 198307 - RNA, 64 nt, hsa
cuauuuugagaacuccagcuggugcccccagacagcugcucagagccaagggggcagagggcuu

SEQ ID NO: 198308 - RNA, 64 nt, hsa
ccggugaacagcagcaggaggagccgcuagagcagcugcucaugggcagagcagcccuugggca

SEQ ID NO: 198309 - RNA, 64 nt, hsa
gggcuuaucugggggagcugcugauggaguccucgcugcucaugcccacagcccucccagagug

SEQ ID NO: 198310 - RNA, 64 nt, hsa
ccucgaggcaccggcgcugcagguacuuccuccugauggccaagagcaucgugacccuucaggg

SEQ ID NO: 198311 - RNA, 64 nt, hsa
agaugggcuguuucguguaguggaagagcagccugauggccaaggggguggacgcaauuguggg

SEQ ID NO: 198312 - RNA, 64 nt, hsa
gcaaaggcaacgcccucagggucccuuccuccaagauggccauguaggguaauggagaugacca

SEQ ID NO: 198313 - RNA, 64 nt, hsa
ggcuguucaugggaagucuucaguggccuucauggauggccauccaguccugaguggucacccu

SEQ ID NO: 198314 - RNA, 64 nt, hsa
uauguggcaggccuacucaugggugggaagggaggauggccacuuggcuggaccuuguaucccc

SEQ ID NO: 198315 - RNA, 64 nt, hsa
ucaucccuccugaccugugaggggcccugcuguagauggccacaggugccugacuaggagcccc

SEQ ID NO: 198316 - RNA, 64 nt, hsa
guagccuaggugucucaggccccugggccccgcagauggccauuuccggugccugcccaguggc

SEQ ID NO: 198317 - RNA, 64 nt, hsa
gaagacagggauuggccugugcuucagcgaccaggauggccaggccagagcugcagcugggggc

SEQ ID NO: 198318 - RNA, 64 nt, hsa
cccugugucccacuacacacagaaaacccugugagauggccagucuucauaauagcaacguacc

SEQ ID NO: 198319 - RNA, 64 nt, hsa
ccccucuagugaaggguaggagagcucagccucggauggccaacauucaguuguucagguucau

SEQ ID NO: 198320 - RNA, 64 nt, hsa
ggacucuaguccacuuccucccaugagacagagugauggccagcuuggggacauuugcuuuaaa

SEQ ID NO: 198321 - RNA, 64 nt, hsa
auccucaguaacucucauugacuggauuagaggugauggccacagcaaaugggagagcaaaaug

SEQ ID NO: 198322 - RNA, 64 nt, hsa
gagaugaacggagugucggcuaggccacgggacagauggccaggaagggcccuggccucuaaac

SEQ ID NO: 198323 - RNA, 64 nt, hsa
cucugacucucugagugguguccucggccccccugauggccaggccaugcaggaaaggccaggg

SEQ ID NO: 198324 - RNA, 64 nt, hsa
aaucagaaaaaggacaaggacaugagacaguggugauggccaucagacagagacuucaaaugcu

SEQ ID NO: 198325 - RNA, 64 nt, hsa
ggcagaagaugaaggacaaaaggaagggaaaacugauggccaaccuagagcagcaaggagcagg

SEQ ID NO: 198326 - RNA, 64 nt, hsa
gggaacuuugcucggccaauggaaaugcagccaagauggccauauacucccuaggaacccaaga

SEQ ID NO: 198327 - RNA, 64 nt, hsa
agccaagauggccauauacucccuaggaacccaagauggccaccaucuugauuuuacuuuccuu

SEQ ID NO: 198328 - RNA, 64 nt, hsa
uagugagcucuucaaaaugaaaacagaaugaccggauggccaucuguccuggaaacuguagaau

SEQ ID NO: 198329 - RNA, 64 nt, hsa
gccagcggagcauggacuguuccagcacgggccagauggccagcugucgagagcagcccugccc

SEQ ID NO: 198330 - RNA, 64 nt, hsa
aaaaggauaaacaucucccacgggagaggccacagauggccacuuccagagcuugcccauugcc

SEQ ID NO: 198331 - RNA, 64 nt, hsa
cccugacauccagcaaauugugaauuugaaaaaugauggccaguuuucagaagugcugacaaau

SEQ ID NO: 198332 - RNA, 64 nt, hsa
uucaacaacccagggcuuauuuucuucugacuucuuggcuaacuuccagacuaugggaaaauaa

SEQ ID NO: 198333 - RNA, 64 nt, hsa
uaauggguuaacuuuuuaauuuuggcuauuguaauuggcuaacuuguuacugauauugacauaa

SEQ ID NO: 198334 - RNA, 64 nt, hsa
acuuuuagagauugucuauucaucugauaaucuuuuggcuaaaggguaaugauuagcacuaauu

SEQ ID NO: 198335 - RNA, 64 nt, hsa
guguuguuguuguuguuuuguuguuguucuuuuuuuggcuaagauucuuagaaucaaugaaugc

SEQ ID NO: 198336 - RNA, 64 nt, hsa
aucuuggauuauuugugauaguaaucacaaauuuuuggcuaauuuuuaaccugagguuuuguuu

SEQ ID NO: 198337 - RNA, 64 nt, hsa
ucuagagugcuucaaaaugauguagucccucaacuuggcuaaagaaucucaaucucuugaaauu

SEQ ID NO: 198338 - RNA, 64 nt, hsa
uguucaguuuuaacuaaaacuaaauuuauguuauuuggcuaaauguuaugaugcagucuaguac

SEQ ID NO: 198339 - RNA, 64 nt, hsa
caacaguuaaagacuauggugguuuuuucagaguuuggcuaagaauguuguuaccaucuucuuu

SEQ ID NO: 198340 - RNA, 64 nt, hsa
gaguagcugggacuacaggugcccuccaccacgcuuggcuaauuuuuuuguauauuuaauagag

SEQ ID NO: 198341 - RNA, 64 nt, hsa
auagcaaacaaccuacauguuugcugauaaaagauuggcuaaacaaauuuuuuuuuuuuuuuuu

SEQ ID NO: 198342 - RNA, 64 nt, hsa
gggauggggacauuccugcccauaaaggauuuggggaaagaagauuaauccuaaaauacaggug

SEQ ID NO: 198343 - RNA, 64 nt, hsa
caagauuuguuguuuuuguaagaaaugagaugcaggaaagaaaaccaaaucccauuccugcacc

SEQ ID NO: 198344 - RNA, 64 nt, hsa
aacuguccaaguaggcuaggcuccagauuuaugaggaaagaaagggacagcauuugcugccccc

SEQ ID NO: 198345 - RNA, 64 nt, hsa
caaaaccagccuuuaaaauaucauguccaggccuggaaagaauacaaauccagugcaaaauuaa

SEQ ID NO: 198346 - RNA, 64 nt, hsa
uuuggcaccaggcaaacgaauaaagauaggauugggaaagaaguugcuaagugugcuuaguuuu

SEQ ID NO: 198347 - RNA, 64 nt, hsa
uuugaggagggaaugauugguagcaaaggaugggggaaagaaguagguucuguuuuguuuuguu

SEQ ID NO: 198348 - RNA, 64 nt, hsa
uaggcucuuuuugcugccugugagcagucccucuggaaagaaacaugugaguaagugagagaga

SEQ ID NO: 198349 - RNA, 64 nt, hsa
ccacuguuugccuuggauaguauggcuuguuuuuggaaagaaauucugaagagaguggaggaga

SEQ ID NO: 198350 - RNA, 64 nt, hsa
aauuuuuaacacuaaaauucaaggaagcaguggaggaaagaaugcauuacuaccacagauagaa

SEQ ID NO: 198351 - RNA, 64 nt, hsa
gucuuuuggaggguuccucaugaagugugcuugaggaaagaaauucugauucuaggcagaggaa

SEQ ID NO: 198352 - RNA, 64 nt, hsa
ucacaguagaagaauggcugcuuuugaauggggaggaaagaagacauuuuucuuaauauccuuu

SEQ ID NO: 198353 - RNA, 64 nt, hsa
agagugcauuagucugaagaguauacauuggauaggaaagaauuuccuucuuuuguuucuccaa

SEQ ID NO: 198354 - RNA, 64 nt, hsa
gugcuuaaaugaugcuauguaaaaugucaugaguggaaagaauauuuguaguaguaacaagaau

SEQ ID NO: 198355 - RNA, 64 nt, hsa
uaaaacuuacugauauauuggacuuugagccaagggaaagaaugaguacuaucuuuccagauau

SEQ ID NO: 198356 - RNA, 64 nt, hsa
ugacuggauugcucuuuauccagcccacagcaggggaaagaaaggcaacucgcaaagaugagau

SEQ ID NO: 198357 - RNA, 64 nt, hsa
auauccugccugaauggggaagucuucuaaaaugggaaagaagugguuucaucuccacacagug

SEQ ID NO: 198358 - RNA, 64 nt, hsa
uuggcaggacacagagagguaggugaacauuccaggaaagaagcagcuuagagaaaauguggag

SEQ ID NO: 198359 - RNA, 64 nt, hsa
aaugcuaugcuggauaugaacuuuuggggccucaggaaagaaaaaccaggaacuaguuucaaua

SEQ ID NO: 198360 - RNA, 64 nt, hsa
cccuggggaccccugacccaucccaaaacacuguggaaagaagggccucuucuccguggggacc

SEQ ID NO: 198361 - RNA, 64 nt, hsa
cucuccccauuuuccuguucgacugggagguucuggaaagaaagagagagagagaaaagaggua

SEQ ID NO: 198362 - RNA, 64 nt, hsa
acaaaacaagugcaagacugaaaacuacaaaauuggaaagaaauuaaagaaggcuuaaauaaau

SEQ ID NO: 198363 - RNA, 64 nt, hsa
aauguuuaagaagcuaauguuuaagaagcauuugggaaagaaaaagaaauaaauguauccagau

SEQ ID NO: 198364 - RNA, 64 nt, hsa
ccacaaccuuucagaugcugauguagagcuauugggaaagaacuuccaaacucaggaaguuugc

SEQ ID NO: 198365 - RNA, 64 nt, hsa
gaaauggagaauuucaggucuccacgucugcccaggaaagaacuucagcugacuccacggggau

SEQ ID NO: 198366 - RNA, 64 nt, hsa
ucacaauaauguagauagaacaaauuacagacaaggaaagaaaaaacuugaaugaaauggauuu

SEQ ID NO: 198367 - RNA, 64 nt, hsa
ugcagaggggaacuacuucuuuaaacacauggagggaaagaagaugaugccacuggcaccagag

SEQ ID NO: 198368 - RNA, 64 nt, hsa
ggaaaaacuaagagaaugaaaaguauuugccucuggaaagaacaacuggcaggacuguuguuuu

SEQ ID NO: 198369 - RNA, 64 nt, hsa
aaaauaauaacuuauugccagauuuggggcauuuggaaagaaguucauugaagauaaagcaaaa

SEQ ID NO: 198370 - RNA, 64 nt, hsa
cuaauuuuuaaaaauagcuuucguuuugaguucuggaaagaaaacugucaaaaucaguauauac

SEQ ID NO: 198371 - RNA, 64 nt, hsa
ucaugucuuuaaaucagauaccaaauauuuuuuaggaaagaaaaauguuauuacugucauuagg

SEQ ID NO: 198372 - RNA, 64 nt, hsa
aauuguguuuauuccaaccacguggaaagcuccuggaaagaaauuuuacauucgguuguucugu

SEQ ID NO: 198373 - RNA, 64 nt, hsa
gugaauucuaagaaggaaggaaggaagaaaggaaggaaagaagggagggaaacagggagaaagg

SEQ ID NO: 198374 - RNA, 64 nt, hsa
cauguaauauaagugaacaacuggaaauaaaguaggaaagaauuuguaucauguuuuacuacau

SEQ ID NO: 198375 - RNA, 64 nt, hsa
uuucauauguggaaauauaccuaccucuuccguuggaaagaacauuuaaaauuaaauaaauuuu

SEQ ID NO: 198376 - RNA, 64 nt, hsa
uaggaaaauuaucuaguuaaucauaauauuugauggaaagaaaaagacaauaaaauuguaauau

SEQ ID NO: 198377 - RNA, 64 nt, hsa
ggacuccagaagaaacuugauucaucgcugcaaaggaaagaacaaccuuaaaacuuuuaacaga

SEQ ID NO: 198378 - RNA, 64 nt, hsa
uuaacccuuaacuguagauaagaaaauucauacuggaaagaaacccuacaaaugugaagucugu

SEQ ID NO: 198379 - RNA, 64 nt, hsa
cucaacucuuacuacauguaagaguauuuauacuggaaagaaacccuacaaauguaaaaaacgu

SEQ ID NO: 198380 - RNA, 64 nt, hsa
gggccaugaaagccacagaggaugggcugaggaaggaaagaaaugggguuacugcucccagugc

SEQ ID NO: 198381 - RNA, 64 nt, hsa
uaccuuagaugcauccugguuaucuggaagcaugggaaagaaggcuacuuaucucuuuguaugu

SEQ ID NO: 198382 - RNA, 64 nt, hsa
cauuucuguuaaccucuuaucacuaagaaagaaaggaaagaaggagaugaauagaagaaagaaa

SEQ ID NO: 198383 - RNA, 64 nt, hsa
aaggaaagaaggagaugaauagaagaaagaaaauggaaagaaggaaaaaaggaggauagaaaaa

SEQ ID NO: 198384 - RNA, 64 nt, hsa
gaagaagaaauggaaaaaugaaagaaggcaggaaggaaagaaaggauauaggaagagagggaag

SEQ ID NO: 198385 - RNA, 64 nt, hsa
aaauaaauuaguagauuggaaaaacuaguguuagggaaagaaaucacauguucagagccuaauu

SEQ ID NO: 198386 - RNA, 64 nt, hsa
uuuaucuuuuagguaagagaaaagaaaaagauaaggaaagaagagagaagagagacaaagauca

SEQ ID NO: 198387 - RNA, 64 nt, hsa
ucacugauuugugaugucaauaggauggcaccuuggaaagaaaaaugaagaacaacuuuaucaa

SEQ ID NO: 198388 - RNA, 64 nt, hsa
acuuaagcaaagccuuuuucauauuugaaaauguggaaagaaaagauguuccuaaaagguuaga

SEQ ID NO: 198389 - RNA, 64 nt, hsa
gucacuuuuuguuuuaauaucuugcucucugacaggaaagaaacaauucacuuaccagccuccu

SEQ ID NO: 198390 - RNA, 64 nt, hsa
uuuuuuacuucagaaagaauuuuacagguuaaagggaaagaaauggugggaaacucuccccgua

SEQ ID NO: 198391 - RNA, 64 nt, hsa
cuccucacacccagaccugggcaucuucauugagggaaagaaaacagucauugugcaaaauucu

SEQ ID NO: 198392 - RNA, 64 nt, hsa
aguuuaugcaguaucugacugcaaaucauauucaggaaagaagugcagaauuucuuccccaagc

SEQ ID NO: 198393 - RNA, 64 nt, hsa
auguuggcauuuaguagaaauagugauaaguugaggaaagaaauaauacaaauuggcuuucaag

SEQ ID NO: 198394 - RNA, 64 nt, hsa
ucucucuuagaauuggaggauuugccauuguccaggaaagaaacuugcagcuuuaaccugcugg

SEQ ID NO: 198395 - RNA, 64 nt, hsa
uaugcaaaucuuagggcgcucgcucccugcacacggaaagaacucuguuuaaaugcucaguuca

SEQ ID NO: 198396 - RNA, 64 nt, hsa
acaccugugccugccggugagaccacuccaggguggaaagaagccacgcccagcagagcugccu

SEQ ID NO: 198397 - RNA, 64 nt, hsa
ugaagaacccuugugaaguaaccaggaggaauggggaaagaagcaaguugggcaggauauggcc

SEQ ID NO: 198398 - RNA, 64 nt, hsa
aguccucccaaucccacaccuccuguuugccaggggaaagaaccuaaagacuucgugugauugg

SEQ ID NO: 198399 - RNA, 64 nt, hsa
uugaaagagcaagaggaaagaaaaaagaaaagaaggaaagaagaauaaagaagagaaacgugua

SEQ ID NO: 198400 - RNA, 64 nt, hsa
uuaguuccaagaggugguuuuugaaagagcaagaggaaagaaaaaagaaaagaaggaaagaaga

SEQ ID NO: 198401 - RNA, 64 nt, hsa
caaaugacuauccugaacaggguggaggggugugggaaagaaaccagccauauugguuuugguu

SEQ ID NO: 198402 - RNA, 64 nt, hsa
uucccuagaaauuggcucaccuugggaaacccagggaaagaaucagcagguucucugcccuccc

SEQ ID NO: 198403 - RNA, 64 nt, hsa
aaagaaguauaaugccuuacuucagagaacucuuggaaagaagccuuaugugaaagugaugacu

SEQ ID NO: 198404 - RNA, 64 nt, hsa
gagucccuuacuuuacguguguaaauuccuaccaggaaagaauacauauccaauagauuggaga

SEQ ID NO: 198405 - RNA, 64 nt, hsa
ugccauucauugucuuucucuccuagcccccucaggaaagaaggacuauauuuguacuguaccc

SEQ ID NO: 198406 - RNA, 64 nt, hsa
aaccucacuuccuuacuccuccaaaaagaaguggggaaagaaccaucaaaccuuuccuccugac

SEQ ID NO: 198407 - RNA, 64 nt, hsa
cuguguugacucuggcauuuaguggcuuugugaaggaaagaaaccauuaaaugaccugacaaaa

SEQ ID NO: 198408 - RNA, 64 nt, hsa
agacaguucuuugccuucacuucccugcuagcugggaaagaagaguggagcagagacucugccu

SEQ ID NO: 198409 - RNA, 64 nt, hsa
cauuuuucucuuguagauuuuaauuuuuuaagugggaaagaacucaccuugccuuccuccccca

SEQ ID NO: 198410 - RNA, 64 nt, hsa
guuaaaaaagcaccguggagaauggcccucuucaggaaagaaaaauaagcaaaugaauggucca

SEQ ID NO: 198411 - RNA, 64 nt, hsa
uaugaauguaaggaauguggaaaagccuucagcaggaaagaaaaucucauuacacaucagaaaa

SEQ ID NO: 198412 - RNA, 64 nt, hsa
auacuuuguuaaaagguguaagacuggaauaaauggaaagaaauaccauauacauagauggaaa

SEQ ID NO: 198413 - RNA, 64 nt, hsa
ccaccacuaggucaguguaagaauuaaagaaagaggaaagaaacacaaaaaguggcuugauggu

SEQ ID NO: 198414 - RNA, 64 nt, hsa
ggaaaaucugaacaaucuuugagccaucuagaggggaaagaaaagacuuuguucuguguguuuc

SEQ ID NO: 198415 - RNA, 64 nt, hsa
gguuuauuuuuccagcauaaaccucagaauuuaaggaaagaaaaugaugucuguuguuauaguu

SEQ ID NO: 198416 - RNA, 64 nt, hsa
aaauuggcuuugaccaaaguucucuuguuuucagggaaagaacauaaaagcuuuuugaacuaca

SEQ ID NO: 198417 - RNA, 64 nt, hsa
uagccaccgggagaggcuuccuuuguuacagcugggaaagaacaguucugugaaugcaaacacc

SEQ ID NO: 198418 - RNA, 64 nt, hsa
aauaacagccacauaaccuugcggcaagucugauggaaagaaaaagauaaaccauccguggggu

SEQ ID NO: 198419 - RNA, 64 nt, hsa
gauguggaggagguggagagcaguuaugagacugggaaagaacggggcacucaaagagccacac

SEQ ID NO: 198420 - RNA, 64 nt, hsa
uggaagugaagacuguaauguccaaguaauccuuggaaagaaaagaacgugcccuuaacuaacu

SEQ ID NO: 198421 - RNA, 64 nt, hsa
auuauauuuguaaaagaaccacagcagcuauuuuggaaagaagcuguuguucucaaaggaaaga

SEQ ID NO: 198422 - RNA, 64 nt, hsa
gcagcuauuuuggaaagaagcuguuguucucaaaggaaagaaggauuuuuuugcauaauuaaac

SEQ ID NO: 198423 - RNA, 64 nt, hsa
cacugguaaucaguacugcauagcaaacucuuugggaaagaaaacgaaaauguuauugcacaug

SEQ ID NO: 198424 - RNA, 64 nt, hsa
caaaaggauguuauuucauuaaauuugguuuaauggaaagaauaaaaguaaaugaaaaacacac

SEQ ID NO: 198425 - RNA, 64 nt, hsa
cuaaauauuuuuuuccuaaaggaauaaagggugaggaaagaaaaauauuaaaaaagcuaauauu

SEQ ID NO: 198426 - RNA, 64 nt, hsa
gaaaagaaaagcagagucagcuacugagagcucuggaaagaaggaugucaagaaggugaaaucc

SEQ ID NO: 198427 - RNA, 64 nt, hsa; identical to SEQ ID NO: 128601

SEQ ID NO: 198428 - RNA, 64 nt, hsa; identical to SEQ ID NO: 128602

SEQ ID NO: 198429 - RNA, 64 nt, hsa; identical to SEQ ID NO: 128603

SEQ ID NO: 198430 - RNA, 64 nt, hsa; identical to SEQ ID NO: 128604

SEQ ID NO: 198431 - RNA, 64 nt, hsa; identical to SEQ ID NO: 128605

SEQ ID NO: 198432 - RNA, 64 nt, hsa; identical to SEQ ID NO: 128606

SEQ ID NO: 198433 - RNA, 64 nt, hsa; identical to SEQ ID NO: 128607

SEQ ID NO: 198434 - RNA, 64 nt, hsa; identical to SEQ ID NO: 128608

SEQ ID NO: 198435 - RNA, 64 nt, hsa; identical to SEQ ID NO: 128609

SEQ ID NO: 198436 - RNA, 64 nt, hsa; identical to SEQ ID NO: 128610

SEQ ID NO: 198437 - RNA, 64 nt, hsa; identical to SEQ ID NO: 128611

SEQ ID NO: 198438 - RNA, 64 nt, hsa; identical to SEQ ID NO: 128612

SEQ ID NO: 198439 - RNA, 64 nt, hsa; identical to SEQ ID NO: 128613

SEQ ID NO: 198440 - RNA, 64 nt, hsa; identical to SEQ ID NO: 128614

SEQ ID NO: 198441 - RNA, 64 nt, hsa; identical to SEQ ID NO: 128615

SEQ ID NO: 198442 - RNA, 64 nt, hsa; identical to SEQ ID NO: 128616

SEQ ID NO: 198443 - RNA, 64 nt, hsa; identical to SEQ ID NO: 128617

SEQ ID NO: 198444 - RNA, 64 nt, hsa; identical to SEQ ID NO: 128618

SEQ ID NO: 198445 - RNA, 64 nt, hsa; identical to SEQ ID NO: 128619

SEQ ID NO: 198446 - RNA, 64 nt, hsa; identical to SEQ ID NO: 128620

SEQ ID NO: 198447 - RNA, 64 nt, hsa; identical to SEQ ID NO: 128621

SEQ ID NO: 198448 - RNA, 64 nt, hsa; identical to SEQ ID NO: 128622

SEQ ID NO: 198449 - RNA, 64 nt, hsa; identical to SEQ ID NO: 128623

SEQ ID NO: 198450 - RNA, 64 nt, hsa; identical to SEQ ID NO: 128624

SEQ ID NO: 198451 - RNA, 64 nt, hsa; identical to SEQ ID NO: 128625

SEQ ID NO: 198452 - RNA, 64 nt, hsa; identical to SEQ ID NO: 128626

SEQ ID NO: 198453 - RNA, 64 nt, hsa; identical to SEQ ID NO: 128627

SEQ ID NO: 198454 - RNA, 64 nt, hsa; identical to SEQ ID NO: 128628

SEQ ID NO: 198455 - RNA, 64 nt, hsa; identical to SEQ ID NO: 128629

SEQ ID NO: 198456 - RNA, 64 nt, hsa; identical to SEQ ID NO: 128630

SEQ ID NO: 198457 - RNA, 64 nt, hsa; identical to SEQ ID NO: 128631

SEQ ID NO: 198458 - RNA, 64 nt, hsa; identical to SEQ ID NO: 128632

SEQ ID NO: 198459 - RNA, 64 nt, hsa; identical to SEQ ID NO: 128633

SEQ ID NO: 198460 - RNA, 64 nt, hsa; identical to SEQ ID NO: 128634

SEQ ID NO: 198461 - RNA, 64 nt, hsa; identical to SEQ ID NO: 128635

SEQ ID NO: 198462 - RNA, 64 nt, hsa; identical to SEQ ID NO: 128636

SEQ ID NO: 198463 - RNA, 64 nt, hsa; identical to SEQ ID NO: 128637

SEQ ID NO: 198464 - RNA, 64 nt, hsa; identical to SEQ ID NO: 128638

SEQ ID NO: 198465 - RNA, 64 nt, hsa; identical to SEQ ID NO: 128639

SEQ ID NO: 198466 - RNA, 64 nt, hsa; identical to SEQ ID NO: 128640

SEQ ID NO: 198467 - RNA, 64 nt, hsa; identical to SEQ ID NO: 128641

SEQ ID NO: 198468 - RNA, 64 nt, hsa; identical to SEQ ID NO: 128642

SEQ ID NO: 198469 - RNA, 64 nt, hsa; identical to SEQ ID NO: 128643

SEQ ID NO: 198470 - RNA, 64 nt, hsa; identical to SEQ ID NO: 128644

SEQ ID NO: 198471 - RNA, 64 nt, hsa; identical to SEQ ID NO: 128645

SEQ ID NO: 198472 - RNA, 64 nt, hsa; identical to SEQ ID NO: 128646

SEQ ID NO: 198473 - RNA, 64 nt, hsa; identical to SEQ ID NO: 128647

SEQ ID NO: 198474 - RNA, 64 nt, hsa
uguuucuguguuuuagaggaauccuaaagucaaaacaccagagacuugaagaacuugcaaacug

SEQ ID NO: 198475 - RNA, 64 nt, hsa
uacccguuagacaaggauauuuuacuucuuccagacaccagaagaaauggccuucaauuauuug

SEQ ID NO: 198476 - RNA, 64 nt, hsa
aauuuccugggcaguugaugcaucucugggaaaaacaccagaaagcuugcugaaauggaaaacu

SEQ ID NO: 198477 - RNA, 64 nt, hsa
auuuaccuccuuuccuuuucccuuuccccuuaaaacaccagacaaaucgauaacaacuuauaua

SEQ ID NO: 198478 - RNA, 64 nt, hsa
ccaagcucaggcauaauucagcauaagaaaauucacaccagagccaaaucuuacaaauguagca

SEQ ID NO: 198479 - RNA, 64 nt, hsa
cauagcucagccauugcucagcaucagauaauucacaccagagagaaacccucugaaugugacg

SEQ ID NO: 198480 - RNA, 64 nt, hsa
ugugguaugacauacacacaccagagcaaccgccacaccagauaucgacagaguggucuucucu

SEQ ID NO: 198481 - RNA, 64 nt, hsa
gugccaucagugcgugaugugguaugacauacacacaccagagcaaccgccacaccagauaucg

SEQ ID NO: 198482 - RNA, 64 nt, hsa
cuuaaucuucagaggugcuaaauugucugccauuacaccagaaggaugccucugauaggaggac

SEQ ID NO: 198483 - RNA, 64 nt, hsa
guauuuuaggugcuguuauguuuuuucaugguuaacaccagaggggaaaaaaucauauucuaac

SEQ ID NO: 198484 - RNA, 64 nt, hsa
uccuuuucuucugccucgccugaaucccccauaaacaccagaugauugagucuaccuucuuucc

SEQ ID NO: 198485 - RNA, 64 nt, hsa
ccuuuuucuucugccucacuugaaucccccguaaacaccagacgauugagucuaccuucuuuuc

SEQ ID NO: 198486 - RNA, 64 nt, hsa
cgcgggccagccucucucuuuugcccugcucuccacaccagaaaugcccccaggugcuuggcug

SEQ ID NO: 198487 - RNA, 64 nt, hsa
ggagaugcucuuuaagaaguucgcaccccugcugacaccagaacagcccaaaucagaguuccca

SEQ ID NO: 198488 - RNA, 64 nt, hsa
gugcuuccaaccuccugccaaccuggaguucacaacaccagagccccacggccucgcacacuga

SEQ ID NO: 198489 - RNA, 64 nt, hsa
aaaaagacgucaauaucugcucacaucuuacuaaacaccagagaguucaugcuuaauaaaagca

SEQ ID NO: 198490 - RNA, 64 nt, hsa
ggaaaacaaauuuucaaaaacuacagcuuagaaaacaccagaguuuauacgaaaauauauuuuc

SEQ ID NO: 198491 - RNA, 64 nt, hsa
ugaaauccuuuagccagcguuucaaccucauucaacaccagaaaguucacaguggaaaaaaucu

SEQ ID NO: 198492 - RNA, 64 nt, hsa
aaaaagguuucagccaaaggccuaacccuauucaacaccagaaaguuuacacuggagaaaggcc

SEQ ID NO: 198493 - RNA, 64 nt, hsa
uugauucaaaccucacaaggcaauauucugaauuguuaacuagguauuucaaaacaggaauuaa

SEQ ID NO: 198494 - RNA, 64 nt, hsa
cuacaaauuaccuccauguauauuauuggccauaguuaacuagaaaguuauaaauagacacuua

SEQ ID NO: 198495 - RNA, 64 nt, hsa; identical to SEQ ID NO: 160525

SEQ ID NO: 198496 - RNA, 64 nt, hsa; identical to SEQ ID NO: 160526

SEQ ID NO: 198497 - RNA, 64 nt, hsa; identical to SEQ ID NO: 160527

SEQ ID NO: 198498 - RNA, 64 nt, hsa; identical to SEQ ID NO: 160528

SEQ ID NO: 198499 - RNA, 64 nt, hsa; identical to SEQ ID NO: 160529

SEQ ID NO: 198500 - RNA, 64 nt, hsa; identical to SEQ ID NO: 160530

SEQ ID NO: 198501 - RNA, 64 nt, hsa; identical to SEQ ID NO: 160531

SEQ ID NO: 198502 - RNA, 64 nt, hsa; identical to SEQ ID NO: 160532

SEQ ID NO: 198503 - RNA, 64 nt, hsa; identical to SEQ ID NO: 160533

SEQ ID NO: 198504 - RNA, 64 nt, hsa; identical to SEQ ID NO: 160534

SEQ ID NO: 198505 - RNA, 64 nt, hsa; identical to SEQ ID NO: 160535

SEQ ID NO: 198506 - RNA, 64 nt, hsa; identical to SEQ ID NO: 160536

SEQ ID NO: 198507 - RNA, 64 nt, hsa; identical to SEQ ID NO: 160537

SEQ ID NO: 198508 - RNA, 64 nt, hsa; identical to SEQ ID NO: 160538

SEQ ID NO: 198509 - RNA, 64 nt, hsa; identical to SEQ ID NO: 160539

SEQ ID NO: 198510 - RNA, 64 nt, hsa; identical to SEQ ID NO: 160540

SEQ ID NO: 198511 - RNA, 64 nt, hsa; identical to SEQ ID NO: 160541

SEQ ID NO: 198512 - RNA, 64 nt, hsa; identical to SEQ ID NO: 160542

SEQ ID NO: 198513 - RNA, 64 nt, hsa; identical to SEQ ID NO: 160543

SEQ ID NO: 198514 - RNA, 64 nt, hsa; identical to SEQ ID NO: 160544

SEQ ID NO: 198515 - RNA, 64 nt, hsa; identical to SEQ ID NO: 160545

SEQ ID NO: 198516 - RNA, 64 nt, hsa; identical to SEQ ID NO: 160546

SEQ ID NO: 198517 - RNA, 64 nt, hsa; identical to SEQ ID NO: 160547

SEQ ID NO: 198518 - RNA, 64 nt, hsa; identical to SEQ ID NO: 160548

SEQ ID NO: 198519 - RNA, 64 nt, hsa; identical to SEQ ID NO: 160549

SEQ ID NO: 198520 - RNA, 64 nt, hsa; identical to SEQ ID NO: 160550

SEQ ID NO: 198521 - RNA, 64 nt, hsa; identical to SEQ ID NO: 160551

SEQ ID NO: 198522 - RNA, 64 nt, hsa; identical to SEQ ID NO: 160552

SEQ ID NO: 198523 - RNA, 64 nt, hsa; identical to SEQ ID NO: 160553

SEQ ID NO: 198524 - RNA, 55 nt, hsa; identical to SEQ ID NO: 113265

SEQ ID NO: 198525 - RNA, 64 nt, hsa; identical to SEQ ID NO: 113266

SEQ ID NO: 198526 - RNA, 64 nt, hsa; identical to SEQ ID NO: 113267

SEQ ID NO: 198527 - RNA, 64 nt, hsa; identical to SEQ ID NO: 113268

SEQ ID NO: 198528 - RNA, 64 nt, hsa; identical to SEQ ID NO: 113269

SEQ ID NO: 198529 - RNA, 64 nt, hsa; identical to SEQ ID NO: 113270

SEQ ID NO: 198530 - RNA, 64 nt, hsa; identical to SEQ ID NO: 113271

SEQ ID NO: 198531 - RNA, 64 nt, hsa; identical to SEQ ID NO: 113272

SEQ ID NO: 198532 - RNA, 64 nt, hsa; identical to SEQ ID NO: 113273

SEQ ID NO: 198533 - RNA, 64 nt, hsa; identical to SEQ ID NO: 113274

SEQ ID NO: 198534 - RNA, 64 nt, hsa; identical to SEQ ID NO: 113275

SEQ ID NO: 198535 - RNA, 64 nt, hsa; identical to SEQ ID NO: 113276

SEQ ID NO: 198536 - RNA, 64 nt, hsa; identical to SEQ ID NO: 113277

SEQ ID NO: 198537 - RNA, 64 nt, hsa; identical to SEQ ID NO: 113278

SEQ ID NO: 198538 - RNA, 64 nt, hsa; identical to SEQ ID NO: 46370

SEQ ID NO: 198539 - RNA, 64 nt, hsa; identical to SEQ ID NO: 46371

SEQ ID NO: 198540 - RNA, 64 nt, hsa; identical to SEQ ID NO: 46372

SEQ ID NO: 198541 - RNA, 64 nt, hsa; identical to SEQ ID NO: 46373

SEQ ID NO: 198542 - RNA, 64 nt, hsa; identical to SEQ ID NO: 46374

SEQ ID NO: 198543 - RNA, 64 nt, hsa; identical to SEQ ID NO: 46375

SEQ ID NO: 198544 - RNA, 64 nt, hsa; identical to SEQ ID NO: 46376

SEQ ID NO: 198545 - RNA, 64 nt, hsa; identical to SEQ ID NO: 46377

SEQ ID NO: 198546 - RNA, 64 nt, hsa; identical to SEQ ID NO: 46378

SEQ ID NO: 198547 - RNA, 64 nt, hsa; identical to SEQ ID NO: 46379

SEQ ID NO: 198548 - RNA, 64 nt, hsa; identical to SEQ ID NO: 46380

SEQ ID NO: 198549 - RNA, 64 nt, hsa; identical to SEQ ID NO: 46381

SEQ ID NO: 198550 - RNA, 64 nt, hsa; identical to SEQ ID NO: 46382

SEQ ID NO: 198551 - RNA, 64 nt, hsa; identical to SEQ ID NO: 46383

SEQ ID NO: 198552 - RNA, 64 nt, hsa; identical to SEQ ID NO: 46384

SEQ ID NO: 198553 - RNA, 64 nt, hsa; identical to SEQ ID NO: 46385

SEQ ID NO: 198554 - RNA, 64 nt, hsa; identical to SEQ ID NO: 46386

SEQ ID NO: 198555 - RNA, 64 nt, hsa; identical to SEQ ID NO: 46387

SEQ ID NO: 198556 - RNA, 64 nt, hsa; identical to SEQ ID NO: 46388

SEQ ID NO: 198557 - RNA, 64 nt, hsa; identical to SEQ ID NO: 46389

SEQ ID NO: 198558 - RNA, 64 nt, hsa; identical to SEQ ID NO: 46390

SEQ ID NO: 198559 - RNA, 64 nt, hsa; identical to SEQ ID NO: 46391

SEQ ID NO: 198560 - RNA, 64 nt, hsa; identical to SEQ ID NO: 46392

SEQ ID NO: 198561 - RNA, 64 nt, hsa; identical to SEQ ID NO: 46393

SEQ ID NO: 198562 - RNA, 64 nt, hsa; identical to SEQ ID NO: 46394

SEQ ID NO: 198563 - RNA, 64 nt, hsa; identical to SEQ ID NO: 46395

SEQ ID NO: 198564 - RNA, 64 nt, hsa; identical to SEQ ID NO: 46396

SEQ ID NO: 198565 - RNA, 64 nt, hsa; identical to SEQ ID NO: 46397

SEQ ID NO: 198566 - RNA, 64 nt, hsa; identical to SEQ ID NO: 46398

SEQ ID NO: 198567 - RNA, 64 nt, hsa; identical to SEQ ID NO: 46399

SEQ ID NO: 198568 - RNA, 64 nt, hsa; identical to SEQ ID NO: 46400

SEQ ID NO: 198569 - RNA, 64 nt, hsa; identical to SEQ ID NO: 46401

SEQ ID NO: 198570 - RNA, 64 nt, hsa; identical to SEQ ID NO: 46402

SEQ ID NO: 198571 - RNA, 64 nt, hsa; identical to SEQ ID NO: 46403

SEQ ID NO: 198572 - RNA, 64 nt, hsa; identical to SEQ ID NO: 46404

SEQ ID NO: 198573 - RNA, 64 nt, hsa; identical to SEQ ID NO: 46405

SEQ ID NO: 198574 - RNA, 64 nt, hsa; identical to SEQ ID NO: 46406

SEQ ID NO: 198575 - RNA, 64 nt, hsa; identical to SEQ ID NO: 46407

SEQ ID NO: 198576 - RNA, 64 nt, hsa; identical to SEQ ID NO: 46408

SEQ ID NO: 198577 - RNA, 64 nt, hsa; identical to SEQ ID NO: 46409

SEQ ID NO: 198578 - RNA, 64 nt, hsa; identical to SEQ ID NO: 46410

SEQ ID NO: 198579 - RNA, 64 nt, hsa; identical to SEQ ID NO: 46411

SEQ ID NO: 198580 - RNA, 64 nt, hsa; identical to SEQ ID NO: 46412

SEQ ID NO: 198581 - RNA, 64 nt, hsa; identical to SEQ ID NO: 46413

SEQ ID NO: 198582 - RNA, 64 nt, hsa; identical to SEQ ID NO: 46414

SEQ ID NO: 198583 - RNA, 64 nt, hsa; identical to SEQ ID NO: 46415

SEQ ID NO: 198584 - RNA, 64 nt, hsa; identical to SEQ ID NO: 46416

SEQ ID NO: 198585 - RNA, 64 nt, hsa; identical to SEQ ID NO: 46417

SEQ ID NO: 198586 - RNA, 64 nt, hsa; identical to SEQ ID NO: 46418

SEQ ID NO: 198587 - RNA, 64 nt, hsa; identical to SEQ ID NO: 46419

SEQ ID NO: 198588 - RNA, 64 nt, hsa; identical to SEQ ID NO: 46420

SEQ ID NO: 198589 - RNA, 64 nt, hsa; identical to SEQ ID NO: 46421

SEQ ID NO: 198590 - RNA, 64 nt, hsa; identical to SEQ ID NO: 46422

SEQ ID NO: 198591 - RNA, 64 nt, hsa; identical to SEQ ID NO: 46423

SEQ ID NO: 198592 - RNA, 64 nt, hsa; identical to SEQ ID NO: 46424

SEQ ID NO: 198593 - RNA, 64 nt, hsa; identical to SEQ ID NO: 46425

SEQ ID NO: 198594 - RNA, 64 nt, hsa; identical to SEQ ID NO: 46426

SEQ ID NO: 198595 - RNA, 64 nt, hsa; identical to SEQ ID NO: 46427

SEQ ID NO: 198596 - RNA, 64 nt, hsa; identical to SEQ ID NO: 46428

SEQ ID NO: 198597 - RNA, 64 nt, hsa; identical to SEQ ID NO: 46429

SEQ ID NO: 198598 - RNA, 64 nt, hsa; identical to SEQ ID NO: 46430

SEQ ID NO: 198599 - RNA, 64 nt, hsa; identical to SEQ ID NO: 46431

SEQ ID NO: 198600 - RNA, 64 nt, hsa; identical to SEQ ID NO: 46432

SEQ ID NO: 198601 - RNA, 64 nt, hsa; identical to SEQ ID NO: 46433

SEQ ID NO: 198602 - RNA, 64 nt, hsa; identical to SEQ ID NO: 46434

SEQ ID NO: 198603 - RNA, 64 nt, hsa; identical to SEQ ID NO: 46435

SEQ ID NO: 198604 - RNA, 64 nt, hsa; identical to SEQ ID NO: 46436

SEQ ID NO: 198605 - RNA, 64 nt, hsa; identical to SEQ ID NO: 46437

SEQ ID NO: 198606 - RNA, 64 nt, hsa; identical to SEQ ID NO: 46438

SEQ ID NO: 198607 - RNA, 64 nt, hsa; identical to SEQ ID NO: 46439

SEQ ID NO: 198608 - RNA, 64 nt, hsa; identical to SEQ ID NO: 46440

SEQ ID NO: 198609 - RNA, 64 nt, hsa; identical to SEQ ID NO: 46441

SEQ ID NO: 198610 - RNA, 64 nt, hsa; identical to SEQ ID NO: 46442

SEQ ID NO: 198611 - RNA, 64 nt, hsa; identical to SEQ ID NO: 46443

SEQ ID NO: 198612 - RNA, 64 nt, hsa; identical to SEQ ID NO: 46444

SEQ ID NO: 198613 - RNA, 64 nt, hsa; identical to SEQ ID NO: 46445

SEQ ID NO: 198614 - RNA, 64 nt, hsa; identical to SEQ ID NO: 46446

SEQ ID NO: 198615 - RNA, 64 nt, hsa; identical to SEQ ID NO: 46447

SEQ ID NO: 198616 - RNA, 64 nt, hsa; identical to SEQ ID NO: 46448

SEQ ID NO: 198617 - RNA, 64 nt, hsa; identical to SEQ ID NO: 46449

SEQ ID NO: 198618 - RNA, 64 nt, hsa; identical to SEQ ID NO: 46450

SEQ ID NO: 198619 - RNA, 64 nt, hsa; identical to SEQ ID NO: 46451

SEQ ID NO: 198620 - RNA, 64 nt, hsa; identical to SEQ ID NO: 46452

SEQ ID NO: 198621 - RNA, 64 nt, hsa; identical to SEQ ID NO: 46453

SEQ ID NO: 198622 - RNA, 64 nt, hsa; identical to SEQ ID NO: 46454

SEQ ID NO: 198623 - RNA, 64 nt, hsa; identical to SEQ ID NO: 46455

SEQ ID NO: 198624 - RNA, 64 nt, hsa; identical to SEQ ID NO: 46456

SEQ ID NO: 198625 - RNA, 64 nt, hsa; identical to SEQ ID NO: 46457

SEQ ID NO: 198626 - RNA, 64 nt, hsa; identical to SEQ ID NO: 46458

SEQ ID NO: 198627 - RNA, 64 nt, hsa; identical to SEQ ID NO: 46459

SEQ ID NO: 198628 - RNA, 64 nt, hsa; identical to SEQ ID NO: 46460

SEQ ID NO: 198629 - RNA, 64 nt, hsa; identical to SEQ ID NO: 46461

SEQ ID NO: 198630 - RNA, 64 nt, hsa; identical to SEQ ID NO: 46462

SEQ ID NO: 198631 - RNA, 64 nt, hsa; identical to SEQ ID NO: 46463

SEQ ID NO: 198632 - RNA, 64 nt, hsa; identical to SEQ ID NO: 46464

SEQ ID NO: 198633 - RNA, 64 nt, hsa; identical to SEQ ID NO: 46465

SEQ ID NO: 198634 - RNA, 64 nt, hsa; identical to SEQ ID NO: 46466

SEQ ID NO: 198635 - RNA, 64 nt, hsa; identical to SEQ ID NO: 46467

SEQ ID NO: 198636 - RNA, 64 nt, hsa; identical to SEQ ID NO: 46468

SEQ ID NO: 198637 - RNA, 64 nt, hsa; identical to SEQ ID NO: 46469

SEQ ID NO: 198638 - RNA, 64 nt, hsa; identical to SEQ ID NO: 46470

SEQ ID NO: 198639 - RNA, 64 nt, hsa; identical to SEQ ID NO: 46471

SEQ ID NO: 198640 - RNA, 64 nt, hsa; identical to SEQ ID NO: 46472

SEQ ID NO: 198641 - RNA, 64 nt, hsa; identical to SEQ ID NO: 46473

SEQ ID NO: 198642 - RNA, 64 nt, hsa; identical to SEQ ID NO: 46474

SEQ ID NO: 198643 - RNA, 60 nt, hsa; identical to SEQ ID NO: 46475

SEQ ID NO: 198644 - RNA, 64 nt, hsa; identical to SEQ ID NO: 46476

SEQ ID NO: 198645 - RNA, 64 nt, hsa; identical to SEQ ID NO: 46477

SEQ ID NO: 198646 - RNA, 64 nt, hsa; identical to SEQ ID NO: 46478

SEQ ID NO: 198647 - RNA, 64 nt, hsa; identical to SEQ ID NO: 46479

SEQ ID NO: 198648 - RNA, 64 nt, hsa; identical to SEQ ID NO: 46480

SEQ ID NO: 198649 - RNA, 64 nt, hsa; identical to SEQ ID NO: 46481

SEQ ID NO: 198650 - RNA, 64 nt, hsa; identical to SEQ ID NO: 46482

SEQ ID NO: 198651 - RNA, 64 nt, hsa; identical to SEQ ID NO: 46483

SEQ ID NO: 198652 - RNA, 64 nt, hsa; identical to SEQ ID NO: 46484

SEQ ID NO: 198653 - RNA, 64 nt, hsa; identical to SEQ ID NO: 46485

SEQ ID NO: 198654 - RNA, 64 nt, hsa; identical to SEQ ID NO: 46486

SEQ ID NO: 198655 - RNA, 64 nt, hsa; identical to SEQ ID NO: 46487

SEQ ID NO: 198656 - RNA, 64 nt, hsa; identical to SEQ ID NO: 46488

SEQ ID NO: 198657 - RNA, 64 nt, hsa; identical to SEQ ID NO: 46489

SEQ ID NO: 198658 - RNA, 64 nt, hsa; identical to SEQ ID NO: 46490

SEQ ID NO: 198659 - RNA, 64 nt, hsa; identical to SEQ ID NO: 46491

SEQ ID NO: 198660 - RNA, 64 nt, hsa; identical to SEQ ID NO: 46492

SEQ ID NO: 198661 - RNA, 64 nt, hsa; identical to SEQ ID NO: 46493

SEQ ID NO: 198662 - RNA, 64 nt, hsa; identical to SEQ ID NO: 46494

SEQ ID NO: 198663 - RNA, 64 nt, hsa; identical to SEQ ID NO: 46495

SEQ ID NO: 198664 - RNA, 64 nt, hsa; identical to SEQ ID NO: 46496

SEQ ID NO: 198665 - RNA, 64 nt, hsa; identical to SEQ ID NO: 46497

SEQ ID NO: 198666 - RNA, 64 nt, hsa; identical to SEQ ID NO: 46498

SEQ ID NO: 198667 - RNA, 64 nt, hsa; identical to SEQ ID NO: 46499

SEQ ID NO: 198668 - RNA, 64 nt, hsa; identical to SEQ ID NO: 46500

SEQ ID NO: 198669 - RNA, 64 nt, hsa; identical to SEQ ID NO: 46501

SEQ ID NO: 198670 - RNA, 64 nt, hsa; identical to SEQ ID NO: 46502

SEQ ID NO: 198671 - RNA, 64 nt, hsa; identical to SEQ ID NO: 46503

SEQ ID NO: 198672 - RNA, 64 nt, hsa; identical to SEQ ID NO: 46504

SEQ ID NO: 198673 - RNA, 64 nt, hsa; identical to SEQ ID NO: 46505

SEQ ID NO: 198674 - RNA, 64 nt, hsa; identical to SEQ ID NO: 46506

SEQ ID NO: 198675 - RNA, 64 nt, hsa; identical to SEQ ID NO: 46507

SEQ ID NO: 198676 - RNA, 64 nt, hsa; identical to SEQ ID NO: 46508

SEQ ID NO: 198677 - RNA, 64 nt, hsa; identical to SEQ ID NO: 46509

SEQ ID NO: 198678 - RNA, 64 nt, hsa; identical to SEQ ID NO: 46510

SEQ ID NO: 198679 - RNA, 64 nt, hsa; identical to SEQ ID NO: 46511

SEQ ID NO: 198680 - RNA, 64 nt, hsa; identical to SEQ ID NO: 46512

SEQ ID NO: 198681 - RNA, 64 nt, hsa; identical to SEQ ID NO: 46513

SEQ ID NO: 198682 - RNA, 64 nt, hsa; identical to SEQ ID NO: 46514

SEQ ID NO: 198683 - RNA, 64 nt, hsa; identical to SEQ ID NO: 46515

SEQ ID NO: 198684 - RNA, 64 nt, hsa; identical to SEQ ID NO: 46516

SEQ ID NO: 198685 - RNA, 64 nt, hsa; identical to SEQ ID NO: 46517

SEQ ID NO: 198686 - RNA, 64 nt, hsa; identical to SEQ ID NO: 46518

SEQ ID NO: 198687 - RNA, 64 nt, hsa; identical to SEQ ID NO: 46519

SEQ ID NO: 198688 - RNA, 64 nt, hsa; identical to SEQ ID NO: 46520

SEQ ID NO: 198689 - RNA, 64 nt, hsa; identical to SEQ ID NO: 46521

SEQ ID NO: 198690 - RNA, 64 nt, hsa; identical to SEQ ID NO: 46522

SEQ ID NO: 198691 - RNA, 64 nt, hsa; identical to SEQ ID NO: 46523

SEQ ID NO: 198692 - RNA, 64 nt, hsa; identical to SEQ ID NO: 46524

SEQ ID NO: 198693 - RNA, 64 nt, hsa; identical to SEQ ID NO: 46525

SEQ ID NO: 198694 - RNA, 64 nt, hsa; identical to SEQ ID NO: 46526

SEQ ID NO: 198695 - RNA, 64 nt, hsa; identical to SEQ ID NO: 46527

SEQ ID NO: 198696 - RNA, 64 nt, hsa; identical to SEQ ID NO: 46528

SEQ ID NO: 198697 - RNA, 64 nt, hsa; identical to SEQ ID NO: 46529

SEQ ID NO: 198698 - RNA, 50 nt, hsa; identical to SEQ ID NO: 46530

SEQ ID NO: 198699 - RNA, 64 nt, hsa; identical to SEQ ID NO: 46531

SEQ ID NO: 198700 - RNA, 64 nt, hsa
cagagcaccucucguuuggcccucugaacaaggugcacgcgagcugggggaugaagacggcucc

SEQ ID NO: 198701 - RNA, 64 nt, hsa
caccgcaaaugcuucuagacacacuccaccuccagcacgcgacuucucaggacgacgaaucuuc

SEQ ID NO: 198702 - RNA, 64 nt, hsa
auauuuauaagaagagaagaucuugagugaagcagcacgcgacccaggugugugugaauugaau

SEQ ID NO: 198703 - RNA, 64 nt, hsa
aaagauuuucuguagcguagauauuuccccagaggcacgcgaacugucagucuuuccuaaggcc

SEQ ID NO: 198704 - RNA, 64 nt, hsa
uuuuuucuuucucccuuccucccgcucucugcuggcacgcgaggcuuccccuuccaccccaugu

SEQ ID NO: 198705 - RNA, 64 nt, hsa
auccuccccugcacuccagacugaucugccuaaagcacgcgagaugcaggcgaaaagcagccac

SEQ ID NO: 198706 - RNA, 54 nt, hsa
cgccgauccaccucagcugaacuggcacgcgacgaggacgcauuccaaaucaua

SEQ ID NO: 198707 - RNA, 64 nt, hsa
agaggcagaucagcugaagcaggaccugcaggaagcacgcgaggcggagcgaagagccaagcag

SEQ ID NO: 198708 - RNA, 64 nt, hsa
gcaaaaagauugucaaaauaaaaacaauaauucaaguaacaaugcccggaauauacguccuaac

SEQ ID NO: 198709 - RNA, 64 nt, hsa
aguaaaauaaguaaauuucuuuuggaauauuuuuaguaacaaauagccacuauaauucuguagg

SEQ ID NO: 198710 - RNA, 64 nt, hsa
cagucuguugcaguaacaaacuccagucuguugcaguaacaaacucuagaauauugacauucuc

SEQ ID NO: 198711 - RNA, 64 nt, hsa
cugucguuugcaguaacaaacuccagucuguugcaguaacaaacuccagucuguugcaguaaca

SEQ ID NO: 198712 - RNA, 64 nt, hsa
gcaccucgugaagaacucuuucccugucguuugcaguaacaaacuccagucuguugcaguaaca

SEQ ID NO: 198713 - RNA, 64 nt, hsa
aagguuauugcagcaaaaaucaguaacaaaaaauaguaacaauaccuugcagaggaaagguggg

SEQ ID NO: 198714 - RNA, 64 nt, hsa
ugacugaaacaagaagguuauugcagcaaaaaucaguaacaaaaaauaguaacaauaccuugca

SEQ ID NO: 198715 - RNA, 64 nt, hsa
aaagcugucucagaaauggccaauuuaacuuuacaguaacaauagacagcacaacacaaacucu

SEQ ID NO: 198716 - RNA, 64 nt, hsa
uguuauucaaaagggauugccauuucugagacacaguaacaaaaaaaugaggaaauuauuuugc

SEQ ID NO: 198717 - RNA, 64 nt, hsa
gcuggcaagggaauggauaaagcuguuuuguucuaguaacaauuuuggaaugaauacugacaau

SEQ ID NO: 198718 - RNA, 64 nt, hsa
auucuaaugguaucugaaauaucagcucauagaaaguaacaaaauuugcugucaccuuaaauaa

SEQ ID NO: 198719 - RNA, 64 nt, hsa
cuccacgugguaagauccuccaagcugcuuuagaaguaacaaugaagaacguggacguuuuuaa

SEQ ID NO: 198720 - RNA, 64 nt, hsa
uaaaaaaaaaaucaaugguggggaacuauaaagaaguaacaaaagaagugacaucuucagcaaa

SEQ ID NO: 198721 - RNA, 64 nt, hsa
agaacugagaaaacugcuuuuugugagccaacauaguaacaaacacaccaaacaaaguacaaag

SEQ ID NO: 198722 - RNA, 64 nt, hsa
uuauguccacuuuuugagugguacuuaaauguaaaguaacaaccugaauugagucauugcuuuc

SEQ ID NO: 198723 - RNA, 64 nt, hsa
caucuucagacacauuugguacauccagaaauagauccaagaaauggggugguugagugggucc

SEQ ID NO: 198724 - RNA, 64 nt, hsa
gaguuuuaaaggaagaaauauuuucaaauucuuaauccaagaaaauacugaguuggaaucuuag

SEQ ID NO: 198725 - RNA, 64 nt, hsa
gucucugggguccuguuccuuccugcaaagcccaauccaagacuggcauggcucagagguugug

SEQ ID NO: 198726 - RNA, 64 nt, hsa
agcuuggaagaaaucccagaagcggacuccaucaauccaagaaagaguugcuuuguggaaggug

SEQ ID NO: 198727 - RNA, 64 nt, hsa
ucauuuauguggagauccacaaccuuuaacagggauccaagaucuuugcaguucaaucgaccac

SEQ ID NO: 198728 - RNA, 64 nt, hsa
uugcuuccuugacaaagaagccaucaugggugugauccaagaucccugucguaguguugaugau

SEQ ID NO: 198729 - RNA, 64 nt, hsa
aaacuucccugugcaaggcaaguuuacaucacaaauccaagaauguuugcauccuaaaugcuag

SEQ ID NO: 198730 - RNA, 64 nt, hsa
uaaaagucuuuuuaauuaauagaaagauuuuaauauccaagaguagucaaauuaaggauauaaa

SEQ ID NO: 198731 - RNA, 64 nt, hsa
aaggacuugccaugguucacagcaaugugcuacgauccaagauaucagccaaggagcccacuua

SEQ ID NO: 198732 - RNA, 64 nt, hsa
cugagccacuugucagauuguauucaaagcaucaauccaagaaggagguuauguguacuucauu

SEQ ID NO: 198733 - RNA, 64 nt, hsa
gccuagccugcagcccucccuugcagggagccuucccuugcacugugcugcucucacagaucgg

SEQ ID NO: 198734 - RNA, 64 nt, hsa
acuacccugaagggccagccuagccugcagcccucccuugcagggagccuucccuugcacugug

SEQ ID NO: 198735 - RNA, 64 nt, hsa
uuucuuaguuucauaauaaucugcacuguucauccccuugcauucuaagugauagaagagcaac

SEQ ID NO: 198736 - RNA, 64 nt, hsa
uauugcaacacauguucuuuggguuuuuugucuccccuugcagcugaugacacaucugaggaac

SEQ ID NO: 198737 - RNA, 64 nt, hsa
acuucuaccaaggaaaaauaaguaaaauuuccaacccuugcauggccagucacuuacuuaauuc

SEQ ID NO: 198738 - RNA, 64 nt, hsa
aucacaagagacagaacaguucugucacauggaucccuugcacugcccuuuuacagccgcagcc

SEQ ID NO: 198739 - RNA, 64 nt, hsa
uggccuccucauucucuuuugccauuggaauguccccuugcaguucucuucucuuuuuuuuuuu

SEQ ID NO: 198740 - RNA, 64 nt, hsa
cugagauuacaggcgugagccuccgcgcccggcccccuugcaguucucucugauuugguuuguu

SEQ ID NO: 198741 - RNA, 64 nt, hsa
cuacaggaagcaccccaugccaaagcuaggguggcccuugcaguucagcaccacccuagucccu

SEQ ID NO: 198742 - RNA, 64 nt, hsa
accugcccaucacaggguugggcccagaucuggucccuugcagcuaguuuucuagaauuuauca

SEQ ID NO: 198743 - RNA, 64 nt, hsa
cuauccuccuccugcccuuccgccuuccacuccucccuugcacccauccugcacacaucucccu

SEQ ID NO: 198744 - RNA, 64 nt, hsa
ggccucugagaauagcagcugcauuucccagacucccuugcagcuagcaagguugugugacuaa

SEQ ID NO: 198745 - RNA, 62 nt, hsa
auggagucccuuuggcaaaacuuaggcaugcacagcuguaguaccccaagaagaaaauguua

SEQ ID NO: 198746 - RNA, 62 nt, hsa
gauccccaaaacaggccaggugugguugcucacagcuguaauaacaacaccuucagaggcug

SEQ ID NO: 198747 - RNA, 62 nt, hsa
cauccauauggaaagcaaaggcagaauuaucccagcuguauuauuuugaucuuuuggaugca

SEQ ID NO: 198748 - RNA, 62 nt, hsa
uuuaccuucaggggugggagcuaagucaguugcagcuguaaucaauugugcgcaguugggaa

SEQ ID NO: 198749 - RNA, 62 nt, hsa
aagccuuucagccaguugcuucugagccagaccagcuguaagcugaaaccucaaugaauaac

SEQ ID NO: 198750 - RNA, 62 nt, hsa
aaaaugcacaauuuguagggguuuggaugaagcagcuguaacugcccuaguguaguuugacc

SEQ ID NO: 198751 - RNA, 62 nt, hsa
aacuuuaaacaauauaguauuuauggcgaggacagcuguagucuguugugauauuucacauu

SEQ ID NO: 198752 - RNA, 62 nt, hsa
uucaggcuagcuucuuucacauaaugcugucucagcuguauuuccaguaacacagcaucauc

SEQ ID NO: 198753 - RNA, 64 nt, hsa
gacuugugguggaguuaugguacucuagggcagucuuucucaaacuauguaugguaaaggacca

SEQ ID NO: 198754 - RNA, 64 nt, hsa
gaaggcaucccuuuuggggcaugcacuuucuuuccuuucucaaaauaauguuauauguggccac

SEQ ID NO: 198755 - RNA, 64 nt, hsa
acuugugaauucccagacucugccuccugguuuccuuucucauuucuuucuaacuguagcuauc

SEQ ID NO: 198756 - RNA, 64 nt, hsa
accuaucuuuaaagccgugcucuuuuaaaauaagcuuucucagaauguuggcaaaucacuucaa

SEQ ID NO: 198757 - RNA, 64 nt, hsa
cuuacuuaccuaaauguaacacaaugaauuccagcuuucucauuuguucuauaccagaauggga

SEQ ID NO: 198758 - RNA, 64 nt, hsa
agauacgcaacuuuguuuuugcagcuacaauacacuuucucaaucucauauguuuuugucuugu

SEQ ID NO: 198759 - RNA, 64 nt, hsa
aucuucacaccugccaccucauguucacaccuaucuuucucaccuuuuuuuugagauggagucu

SEQ ID NO: 198760 - RNA, 64 nt, hsa
ugggauuacaggcgugagccaccaugcccggccucuuucucaccuuuacaccugucuucuuauc

SEQ ID NO: 198761 - RNA, 64 nt, hsa
cagccaaauagucccaugcugacuuucuaucuuccuuucucaaacugucuuaggaaggaccuuc

SEQ ID NO: 198762 - RNA, 64 nt, hsa
cguuguccguggaagaacacauggaucucucuggcuuucucacccaaguuggccacuuacgcua

SEQ ID NO: 198763 - RNA, 64 nt, hsa
cagaccagccccucauaccacagccaagaggggccuuucucaccuggagagaaauuuccagacc

SEQ ID NO: 198764 - RNA, 64 nt, hsa
cagaccagccccucauaccacagccaagaggggccuuucucaccuggagagaaacuuccagacc

SEQ ID NO: 198765 - RNA, 64 nt, hsa
ccauacaaaaauuccuuuucccgaaggaaaagggcuuucucaauaagccucagcuuucuaagau

SEQ ID NO: 198766 - RNA, 64 nt, hsa
ccugucauaugcucugauuuaucugagucaacuccuuucucaucuuguccccaacaccccacag

SEQ ID NO: 198767 - RNA, 64 nt, hsa
acugggaacgcccccucuuuauaaagcugggcuucuuucucaucucucucccaaauguuguauc

SEQ ID NO: 198768 - RNA, 64 nt, hsa
uccugucaccccaauuucuccaagccagagguagcuuucucagagccccuuggugguucugucc

SEQ ID NO: 198769 - RNA, 64 nt, hsa
cauuugguacaucugugucugcuaauacaguuagcuuucucacuuuucugcuuguuuguucagu

SEQ ID NO: 198770 - RNA, 64 nt, hsa
aaggcuagaacauuauucugcuuuauuuauauggcuuucucacuuuuauuuuguagcauggguu

SEQ ID NO: 198771 - RNA, 64 nt, hsa
guauacucaucuuuuuuggcccauuacaauacugcuuucucagguucuuaacagccugugcaaa

SEQ ID NO: 198772 - RNA, 64 nt, hsa
uugagcacuuacuaugugcccaacccuguuaugccuuucucaggcucaugauaaauguauuagu

SEQ ID NO: 198773 - RNA, 64 nt, hsa
ugauacaaguaaccuccccucugcuuaggugucacuuucucagcauaucaaguuuaggcagcaa

SEQ ID NO: 198774 - RNA, 64 nt, hsa
ggacuugugaguccuaggugaccacacugcuucccuuucucaguuccugaccuuccucugagcc

SEQ ID NO: 198775 - RNA, 64 nt, hsa
ugguugcacagucacacugauaugcugauuugcucuuucucauuguaugucuaugcuuugucau

SEQ ID NO: 198776 - RNA, 64 nt, hsa
cacaaaugccuaugauuuagguuaccaauguauucuuucucauuugggguuuugcuucugucug

SEQ ID NO: 198777 - RNA, 64 nt, hsa
ccuggccugcccuuucucagcugccuccccugcccuuucucagcugccuccccugcccucagaa

SEQ ID NO: 198778 - RNA, 64 nt, hsa
gaugcaaggagcugccugugacaccuggccugcccuuucucagcugccuccccugcccuuucuc

SEQ ID NO: 198779 - RNA, 64 nt, hsa
aggauccuacuuccuaaaaucuggcuuugccucccuuucucagacuagagccuucugccuaucc

SEQ ID NO: 198780 - RNA, 64 nt, hsa
uguuggagcucccuguccuuguccuguucuuguucuuucucaucgcucuccuugccagcuuucu

SEQ ID NO: 198781 - RNA, 64 nt, hsa
gcgggagaggcaccagaacauuucucuccacugacuuucucacccgguucccacccuccuccac

SEQ ID NO: 198782 - RNA, 64 nt, hsa
cacacuguccugcauccagucuguguccuccugucuuucucauccaggucaggcauugacacuu

SEQ ID NO: 198783 - RNA, 64 nt, hsa
agaggcugcuagagcagaagcggaaggccgcuuccuuucucagcugaaccccuacucccggagc

SEQ ID NO: 198784 - RNA, 64 nt, hsa
agagccugcuagagcagaagcggaaggccgcuuccuuucucagcugaaccccuacccggagccc

SEQ ID NO: 198785 - RNA, 64 nt, hsa
ugaguuuugaaugauuuugcaguaaagaccugaucuuucucaucacuggucuggcuucugaauu

SEQ ID NO: 198786 - RNA, 64 nt, hsa
ccaccccagugcgucucgccugcugagcccaccgcuuucucagcgucagagccccuagcucuuc

SEQ ID NO: 198787 - RNA, 64 nt, hsa
gcuaccuccccaagacuuuacuagugccgauaaacuuucucaaagagcaaccaguaucacuucc

SEQ ID NO: 198788 - RNA, 64 nt, hsa
ucauacuuuuuccuaggcuuggcacugccuuuuccuuucucaggccaauggcaacugccauuug

SEQ ID NO: 198789 - RNA, 64 nt, hsa
uggccucaggaggcaggcagaguuuaaaauaaaacuuucucaugauuucuugaacaucuuuccc

SEQ ID NO: 198790 - RNA, 64 nt, hsa
ucccaggguucauucuucccaagaacucaaauuccuuucucauuggagccuagugaaaccaaau

SEQ ID NO: 198791 - RNA, 64 nt, hsa
cccucuccuccccuugcgcucgcgcucgcgcucgcuuucucacuggcgugcucucuuucucucu

SEQ ID NO: 198792 - RNA, 64 nt, hsa
cgugcucucuuucucucucucucucccucuguaccuuucucauaguugcuucagaucuuagguc

SEQ ID NO: 198793 - RNA, 64 nt, hsa
ggcauagauagggaugugagaguggaguaccuuccuuucucaagucucgagaugccagugaaac

SEQ ID NO: 198794 - RNA, 64 nt, hsa
uuuugcuuaugguagugggcuaacauaacagccccuuucucaagcagagaccuggccccugggc

SEQ ID NO: 198795 - RNA, 64 nt, hsa
aucccagcuuucucaccaccguuccccuuugauucuuucucaauugucuuuuugccuuuagcuc

SEQ ID NO: 198796 - RNA, 64 nt, hsa
gccucuuucuauugaaaugucaauucaaucccagcuuucucaccaccguuccccuuugauucuu

SEQ ID NO: 198797 - RNA, 64 nt, hsa
ugaccaaguacauccuggugcaggaugccuuguucuuucucacaguaucuaucccacuccucuu

SEQ ID NO: 198798 - RNA, 64 nt, hsa
uauuuccagguuuaacuaguuggaguuuuucucccuuucucaauaaucaacuuauagugcugac

SEQ ID NO: 198799 - RNA, 64 nt, hsa
ggggcccuggguucugccauauacccagaggagccuuucucaguguguuucuaaauggccuuac

SEQ ID NO: 198800 - RNA, 64 nt, hsa; identical to SEQ ID NO: 61495

SEQ ID NO: 198801 - RNA, 64 nt, hsa; identical to SEQ ID NO: 61496

SEQ ID NO: 198802 - RNA, 64 nt, hsa; identical to SEQ ID NO: 61497

SEQ ID NO: 198803 - RNA, 64 nt, hsa; identical to SEQ ID NO: 61498

SEQ ID NO: 198804 - RNA, 64 nt, hsa; identical to SEQ ID NO: 61499

SEQ ID NO: 198805 - RNA, 64 nt, hsa; identical to SEQ ID NO: 61500

SEQ ID NO: 198806 - RNA, 64 nt, hsa; identical to SEQ ID NO: 61501

SEQ ID NO: 198807 - RNA, 64 nt, hsa; identical to SEQ ID NO: 61502

SEQ ID NO: 198808 - RNA, 64 nt, hsa; identical to SEQ ID NO: 61503

SEQ ID NO: 198809 - RNA, 64 nt, hsa; identical to SEQ ID NO: 61504

SEQ ID NO: 198810 - RNA, 64 nt, hsa; identical to SEQ ID NO: 61505

SEQ ID NO: 198811 - RNA, 64 nt, hsa; identical to SEQ ID NO: 61506

SEQ ID NO: 198812 - RNA, 64 nt, hsa; identical to SEQ ID NO: 61507

SEQ ID NO: 198813 - RNA, 64 nt, hsa; identical to SEQ ID NO: 61508

SEQ ID NO: 198814 - RNA, 64 nt, hsa; identical to SEQ ID NO: 61509

SEQ ID NO: 198815 - RNA, 64 nt, hsa; identical to SEQ ID NO: 61510

SEQ ID NO: 198816 - RNA, 64 nt, hsa; identical to SEQ ID NO: 61511

SEQ ID NO: 198817 - RNA, 64 nt, hsa; identical to SEQ ID NO: 61512

SEQ ID NO: 198818 - RNA, 64 nt, hsa; identical to SEQ ID NO: 61513

SEQ ID NO: 198819 - RNA, 64 nt, hsa; identical to SEQ ID NO: 61514

SEQ ID NO: 198820 - RNA, 64 nt, hsa; identical to SEQ ID NO: 61515

SEQ ID NO: 198821 - RNA, 64 nt, hsa; identical to SEQ ID NO: 61516

SEQ ID NO: 198822 - RNA, 64 nt, hsa; identical to SEQ ID NO: 61517

SEQ ID NO: 198823 - RNA, 64 nt, hsa; identical to SEQ ID NO: 167088

SEQ ID NO: 198824 - RNA, 64 nt, hsa; identical to SEQ ID NO: 167089

SEQ ID NO: 198825 - RNA, 64 nt, hsa; identical to SEQ ID NO: 167090

SEQ ID NO: 198826 - RNA, 64 nt, hsa; identical to SEQ ID NO: 167091

SEQ ID NO: 198827 - RNA, 64 nt, hsa; identical to SEQ ID NO: 167092

SEQ ID NO: 198828 - RNA, 64 nt, hsa; identical to SEQ ID NO: 167093

SEQ ID NO: 198829 - RNA, 64 nt, hsa; identical to SEQ ID NO: 167094

SEQ ID NO: 198830 - RNA, 64 nt, hsa; identical to SEQ ID NO: 167095

SEQ ID NO: 198831 - RNA, 64 nt, hsa; identical to SEQ ID NO: 167096

SEQ ID NO: 198832 - RNA, 64 nt, hsa; identical to SEQ ID NO: 167097

SEQ ID NO: 198833 - RNA, 64 nt, hsa; identical to SEQ ID NO: 167098

SEQ ID NO: 198834 - RNA, 64 nt, hsa; identical to SEQ ID NO: 167099

SEQ ID NO: 198835 - RNA, 64 nt, hsa; identical to SEQ ID NO: 167100

SEQ ID NO: 198836 - RNA, 64 nt, hsa; identical to SEQ ID NO: 167101

SEQ ID NO: 198837 - RNA, 64 nt, hsa; identical to SEQ ID NO: 167102

SEQ ID NO: 198838 - RNA, 64 nt, hsa; identical to SEQ ID NO: 167103

SEQ ID NO: 198839 - RNA, 64 nt, hsa; identical to SEQ ID NO: 167104

SEQ ID NO: 198840 - RNA, 64 nt, hsa; identical to SEQ ID NO: 167105

SEQ ID NO: 198841 - RNA, 64 nt, hsa; identical to SEQ ID NO: 167106

SEQ ID NO: 198842 - RNA, 64 nt, hsa; identical to SEQ ID NO: 167107

SEQ ID NO: 198843 - RNA, 64 nt, hsa; identical to SEQ ID NO: 167108

SEQ ID NO: 198844 - RNA, 64 nt, hsa; identical to SEQ ID NO: 167109

SEQ ID NO: 198845 - RNA, 64 nt, hsa; identical to SEQ ID NO: 167110

SEQ ID NO: 198846 - RNA, 64 nt, hsa; identical to SEQ ID NO: 167111

SEQ ID NO: 198847 - RNA, 64 nt, hsa; identical to SEQ ID NO: 167112

SEQ ID NO: 198848 - RNA, 64 nt, hsa; identical to SEQ ID NO: 167113

SEQ ID NO: 198849 - RNA, 64 nt, hsa; identical to SEQ ID NO: 167114

SEQ ID NO: 198850 - RNA, 64 nt, hsa; identical to SEQ ID NO: 167115

SEQ ID NO: 198851 - RNA, 64 nt, hsa; identical to SEQ ID NO: 167116

SEQ ID NO: 198852 - RNA, 64 nt, hsa; identical to SEQ ID NO: 167117

SEQ ID NO: 198853 - RNA, 64 nt, hsa; identical to SEQ ID NO: 167118

SEQ ID NO: 198854 - RNA, 64 nt, hsa; identical to SEQ ID NO: 167119

SEQ ID NO: 198855 - RNA, 64 nt, hsa; identical to SEQ ID NO: 167120

SEQ ID NO: 198856 - RNA, 64 nt, hsa; identical to SEQ ID NO: 167121

SEQ ID NO: 198857 - RNA, 64 nt, hsa; identical to SEQ ID NO: 167122

SEQ ID NO: 198858 - RNA, 64 nt, hsa; identical to SEQ ID NO: 167123

SEQ ID NO: 198859 - RNA, 64 nt, hsa; identical to SEQ ID NO: 167124

SEQ ID NO: 198860 - RNA, 64 nt, hsa; identical to SEQ ID NO: 167125

SEQ ID NO: 198861 - RNA, 64 nt, hsa; identical to SEQ ID NO: 167126

SEQ ID NO: 198862 - RNA, 64 nt, hsa; identical to SEQ ID NO: 167127

SEQ ID NO: 198863 - RNA, 64 nt, hsa; identical to SEQ ID NO: 167128

SEQ ID NO: 198864 - RNA, 64 nt, hsa; identical to SEQ ID NO: 167129

SEQ ID NO: 198865 - RNA, 64 nt, hsa; identical to SEQ ID NO: 167130

SEQ ID NO: 198866 - RNA, 64 nt, hsa; identical to SEQ ID NO: 167131

SEQ ID NO: 198867 - RNA, 64 nt, hsa; identical to SEQ ID NO: 167132

SEQ ID NO: 198868 - RNA, 64 nt, hsa; identical to SEQ ID NO: 167133

SEQ ID NO: 198869 - RNA, 64 nt, hsa; identical to SEQ ID NO: 167134

SEQ ID NO: 198870 - RNA, 64 nt, hsa; identical to SEQ ID NO: 167135

SEQ ID NO: 198871 - RNA, 64 nt, hsa; identical to SEQ ID NO: 167136

SEQ ID NO: 198872 - RNA, 64 nt, hsa; identical to SEQ ID NO: 167137

SEQ ID NO: 198873 - RNA, 64 nt, hsa; identical to SEQ ID NO: 167138

SEQ ID NO: 198874 - RNA, 64 nt, hsa; identical to SEQ ID NO: 167139

SEQ ID NO: 198875 - RNA, 64 nt, hsa; identical to SEQ ID NO: 167140

SEQ ID NO: 198876 - RNA, 64 nt, hsa; identical to SEQ ID NO: 167141

SEQ ID NO: 198877 - RNA, 64 nt, hsa; identical to SEQ ID NO: 167142

SEQ ID NO: 198878 - RNA, 64 nt, hsa; identical to SEQ ID NO: 167143

SEQ ID NO: 198879 - RNA, 64 nt, hsa; identical to SEQ ID NO: 167144

SEQ ID NO: 198880 - RNA, 64 nt, hsa; identical to SEQ ID NO: 167145

SEQ ID NO: 198881 - RNA, 64 nt, hsa; identical to SEQ ID NO: 167146

SEQ ID NO: 198882 - RNA, 64 nt, hsa; identical to SEQ ID NO: 167147

SEQ ID NO: 198883 - RNA, 64 nt, hsa; identical to SEQ ID NO: 167148

SEQ ID NO: 198884 - RNA, 64 nt, hsa; identical to SEQ ID NO: 167149

SEQ ID NO: 198885 - RNA, 64 nt, hsa; identical to SEQ ID NO: 167150

SEQ ID NO: 198886 - RNA, 64 nt, hsa; identical to SEQ ID NO: 167151

SEQ ID NO: 198887 - RNA, 64 nt, hsa; identical to SEQ ID NO: 167152

SEQ ID NO: 198888 - RNA, 64 nt, hsa; identical to SEQ ID NO: 167153

SEQ ID NO: 198889 - RNA, 64 nt, hsa; identical to SEQ ID NO: 167154

SEQ ID NO: 198890 - RNA, 64 nt, hsa; identical to SEQ ID NO: 167155

SEQ ID NO: 198891 - RNA, 64 nt, hsa; identical to SEQ ID NO: 167156

SEQ ID NO: 198892 - RNA, 64 nt, hsa; identical to SEQ ID NO: 167157

SEQ ID NO: 198893 - RNA, 64 nt, hsa; identical to SEQ ID NO: 167158

SEQ ID NO: 198894 - RNA, 64 nt, hsa; identical to SEQ ID NO: 167159

SEQ ID NO: 198895 - RNA, 64 nt, hsa; identical to SEQ ID NO: 167160

SEQ ID NO: 198896 - RNA, 64 nt, hsa; identical to SEQ ID NO: 167161

SEQ ID NO: 198897 - RNA, 64 nt, hsa; identical to SEQ ID NO: 167162

SEQ ID NO: 198898 - RNA, 64 nt, hsa; identical to SEQ ID NO: 167163

SEQ ID NO: 198899 - RNA, 64 nt, hsa; identical to SEQ ID NO: 167164

SEQ ID NO: 198900 - RNA, 64 nt, hsa; identical to SEQ ID NO: 167165

SEQ ID NO: 198901 - RNA, 64 nt, hsa; identical to SEQ ID NO: 167166

SEQ ID NO: 198902 - RNA, 64 nt, hsa; identical to SEQ ID NO: 167167

SEQ ID NO: 198903 - RNA, 64 nt, hsa; identical to SEQ ID NO: 167168

SEQ ID NO: 198904 - RNA, 62 nt, hsa
ucauuccuuauugaacuuauuuugcacaauaguguuuacaaaucuuauacaucuuacuuuga

SEQ ID NO: 198905 - RNA, 62 nt, hsa
gggggucuugacaaagcagaguaaaaauaugcuguuuacauuguuuacuuacaaguaaggag

SEQ ID NO: 198906 - RNA, 62 nt, hsa
uuuuauuaauucuucauuuuuuguaaaacuuauguuuacaagaagaaaacaaaucaaaacau

SEQ ID NO: 198907 - RNA, 62 nt, hsa
gccuaaaagaaaggacugacaagugugcaaaauguuuacaaucuuuugugaaauuguaguuu

SEQ ID NO: 198908 - RNA, 62 nt, hsa
aucuuagcucacuuuccaauaacagaaggaguuguuuacagaugaauaguaucacaucauua

SEQ ID NO: 198909 - RNA, 62 nt, hsa
gucuuuuguaaaacaaaaauuacaaaaaaauuuguuuacauuccacugguaccuuaauuuaa

SEQ ID NO: 198910 - RNA, 62 nt, hsa
uuccccaacuacaaaaauguuuggcaacuuuguguuuacauuuaaagaucauuugcaccuuu

SEQ ID NO: 198911 - RNA, 62 nt, hsa
uuuucaaggaaaaaaaguauugaguaaacaauuguuuacauauaucauuuaugcuuuuuucu

SEQ ID NO: 198912 - RNA, 62 nt, hsa
uucuucuguuuuauacaagcucuguuaaguuauguuuacaguaucuuguaucgcuguuuaca

SEQ ID NO: 198913 - RNA, 62 nt, hsa
uguuaaguuauguuuacaguaucuuguaucgcuguuuacaaaucuugcauggacuccugcca

SEQ ID NO: 198914 - RNA, 62 nt, hsa
ccaaguugauuuuugugucuacagcuaaauuuuguuuacaauuaggcuauuuuuuaauauag

SEQ ID NO: 198915 - RNA, 62 nt, hsa
aagacuagccugggcaauguggcaaaaccgcguguuuacaaaaaauacaaaaauuagccagg

SEQ ID NO: 198916 - RNA, 62 nt, hsa
uucuuucaugguaagcucaauggacuuugaauuguuuacagugcuguauguccaauuguuaa

SEQ ID NO: 198917 - RNA, 62 nt, hsa
acuccaacggagggagccuguugguguuaaauuguuuacauuucuuuauacaaauaaugugc

SEQ ID NO: 198918 - RNA, 62 nt, hsa
aggcucaauaacaaauacaacaaauguaaauauguuuacauuuuaagacauaugcagugguu

SEQ ID NO: 198919 - RNA, 62 nt, hsa
cugcaaauuucaugaauuugugaugucuuugcuguuuacaugcagucccaagaaauggauug

SEQ ID NO: 198920 - RNA, 62 nt, hsa
guacaucuaccccagccccucaaaagaaaaacuguuuacauagaaauuccuacacauacguu

SEQ ID NO: 198921 - RNA, 62 nt, hsa
uaaaacauaauugccaauugaaacccuaaauauguuuacauaccauuaagauaugauucaug

SEQ ID NO: 198922 - RNA, 62 nt, hsa
aacaccagccccugccccagcccaaguccaaauguuuacagggagccuccugcccagucccc

SEQ ID NO: 198923 - RNA, 62 nt, hsa
ccaagugacuccgugccuugagugugucugcguguuuacacccgucccucugcuggccgccc

SEQ ID NO: 198924 - RNA, 62 nt, hsa
auacuuacaauuuuuagcagguagcuuuuuaauguuuacagaaauuuuaauuuuuuucuauu

SEQ ID NO: 198925 - RNA, 62 nt, hsa
uuuaauuuuuuucuauuuugaaauuugaggcuuguuuacauugcuuagauaauuuagaauuu

SEQ ID NO: 198926 - RNA, 62 nt, hsa
aacauaagugucucuggccaucaaagugaucuuguuuacagcagugcuuuugugaaacaauu

SEQ ID NO: 198927 - RNA, 62 nt, hsa
guuuacaacucaaaacuuugaguuuuacacuuuguuuacaguagauaauuuuuuuuccuuug

SEQ ID NO: 198928 - RNA, 62 nt, hsa
uacaaguccagauucaaaaaauguuuuuacuuuguuuacaacucaaaacuuugaguuuuaca

SEQ ID NO: 198929 - RNA, 62 nt, hsa
guccagaacugaagacuuuaaaauuuuguuacuguuuacaaguccagauucaaaaaauguuu

SEQ ID NO: 198930 - RNA, 62 nt, hsa
aagacccagaauguaggugccacugccuccuauguuuacaggauccuccguggcccuaggca

SEQ ID NO: 198931 - RNA, 62 nt, hsa
gcuguggggugcugguggagcagcugaugucguguuuacagagcaaggcuucccugucuccc

SEQ ID NO: 198932 - RNA, 62 nt, hsa
uaugagaaaguucucauuuaaaaugagaucguuguuuacaguguauguacuaagcaguaagc

SEQ ID NO: 198933 - RNA, 62 nt, hsa
uccuaaugucagaguagaagauuuuaugcugcuguuuacaaaagcccaauguaaugcauagg

SEQ ID NO: 198934 - RNA, 62 nt, hsa
gcaagaugccauuuuccccaugacuuugguuuuguuuacauuuuucccuuucaguuaguaua

SEQ ID NO: 198935 - RNA, 62 nt, hsa
acuauuuuuaaaauuccuguugaguuucuuuguguuuacaaggaaaggacugaacuuuuucu

SEQ ID NO: 198936 - RNA, 62 nt, hsa
gauuuuacaauaacauuaucaucugcaguuacuguuuacaagacugcuuuuaccuuaaacuu

SEQ ID NO: 198937 - RNA, 62 nt, hsa
uacaagacugcuuuuaccuuaaacuuuguagauguuuacaucuuuuuguuguguuuuaagau

SEQ ID NO: 198938 - RNA, 62 nt, hsa
cagcuggucugacacuacgcgcagugcucgguuguuuacaaucaguggggaaaagggcagaa

SEQ ID NO: 198939 - RNA, 62 nt, hsa
uuuuuggaagugcaaaaaucucaauuugugucuguuuacagcucucucuccucacugcucac

SEQ ID NO: 198940 - RNA, 62 nt, hsa
uccgcgagccugcuugcugauauugcaguuuuuguuuacaagaauaauuagcaauacugagu

SEQ ID NO: 198941 - RNA, 62 nt, hsa
aacaacaaagcagaagacuccucucuucugacuguuuacaccuuuccgugccgggagcgcac

SEQ ID NO: 198942 - RNA, 62 nt, hsa
ucauauccauuucuaauccaucaaacagcuuauguuuacauaaaauuuuaucauucacaagg

SEQ ID NO: 198943 - RNA, 62 nt, hsa
agguuuugauaggaaguauguuuguuucuuaguguuuacaaauauuaaguacucuugauaca

SEQ ID NO: 198944 - RNA, 62 nt, hsa
ucuuaaacuuuaauaaauucgcauuuuaaagguguuuacagauuauuuuuuauaucuguagc

SEQ ID NO: 198945 - RNA, 62 nt, hsa
uaaacauucugcauuggguauaaucuaagaauuguuuacaaaaagauuauuuuguauuuacc

SEQ ID NO: 198946 - RNA, 62 nt, hsa
auaaccuguauguguuccgagcuuuaauuuuuuguuuacaaauugaacaguguuacaugggc

SEQ ID NO: 198947 - RNA, 62 nt, hsa
aacaaaccuguuuuaugaaaauucacuggugcuguuuacauuggaauaaaaagcucuauaag

SEQ ID NO: 198948 - RNA, 62 nt, hsa
aagaauauuauccugguuuaacaacagugcccuguuuacaacagauugugcccuaucucauc

SEQ ID NO: 198949 - RNA, 62 nt, hsa
guguuaacaucuguuucaggaacauggcaguauguuuacaugucagaaguuuuguuuaauuc

SEQ ID NO: 198950 - RNA, 62 nt, hsa
uuacaaguauaugaguauuauuuauagguaguuguuuacauaugagucgggaccaaagagaa

SEQ ID NO: 198951 - RNA, 62 nt, hsa
uaugaacaugaagaaacuuuaguaaauguacuuguuuacauaguuaugugaauagauuagau

SEQ ID NO: 198952 - RNA, 62 nt, hsa
aauaaauauuuauuuauuuauuuauaaguagauguuuacauaugcccaggauuuugaagagc

SEQ ID NO: 198953 - RNA, 62 nt, hsa
uggaaaaacuuuaggaaaugcacuuauuaggcuguuuacauggguugccuggauacaaauca

SEQ ID NO: 198954 - RNA, 62 nt, hsa
gauaaaauuuaguugaguuuuuaauguuuacauguuuacaucucuaaauaaaauuugcuuau

SEQ ID NO: 198955 - RNA, 62 nt, hsa
auaauaaagauaaaauuuaguugaguuuuuaauguuuacauguuuacaucucuaaauaaaau

SEQ ID NO: 198956 - RNA, 62 nt, hsa
gcaauuugguucuugaaaauuaaauuuaaacuuguuuacaaagguuuaguuuuguaauaagg

SEQ ID NO: 198957 - RNA, 62 nt, hsa
ccuauguuagcuguuaaagaaacagcaggacuuguuuacaaagaugucuucauucccaaggu

SEQ ID NO: 198958 - RNA, 62 nt, hsa
ggaagaaugggacauggccccaugcuuauuuuuguuuacaacguaacauggcaugagagagg

SEQ ID NO: 198959 - RNA, 62 nt, hsa
auaccaggcacaagauaaaacuccaaaauuucuguuuacauugaccuuuacauuuaaagcug

SEQ ID NO: 198960 - RNA, 62 nt, hsa
accuggcuccuaccuggaggacucaguuguucuguuuacauccugguggcaccucucacccu

SEQ ID NO: 198961 - RNA, 62 nt, hsa
uuuccccuugcucguuucucccuuguuguaaguguuuacaacuggcaugugcuuuuaaacau

SEQ ID NO: 198962 - RNA, 62 nt, hsa
cugauuugggguuaaacuaggcggcuggaggauguuuacagcuuugaggcuucaaauaaguu

SEQ ID NO: 198963 - RNA, 62 nt, hsa
aauuaccucccauguguggacauccugggacuuguuuacauuuuaucuguaauaagauaacu

SEQ ID NO: 198964 - RNA, 62 nt, hsa
caaaggcaucacuauuuuuaaauguuuacauauguuuacauguuugugugcaacugcuucau

SEQ ID NO: 198965 - RNA, 62 nt, hsa
ccuuacauuucaaaggcaucacuauuuuuaaauguuuacauauguuuacauguuugugugca

SEQ ID NO: 198966 - RNA, 62 nt, hsa
agaguauuuauguuggaauaauuuuuaaauaauguuuacauaacuguaaguccuguuugguu

SEQ ID NO: 198967 - RNA, 62 nt, hsa
uggcacuuguucuagagaaguguagaggaugauguuuacauaauuuuagcaccucaagguau

SEQ ID NO: 198968 - RNA, 62 nt, hsa
caaucagaauacggugguugagaaggaaccaguguuuacaaguaauaucagaaaguugaagg

SEQ ID NO: 198969 - RNA, 62 nt, hsa
uacaaguaauaucagaaaguugaaggaaccaguguuuacaaguaauaccagaaaguugccaa

SEQ ID NO: 198970 - RNA, 62 nt, hsa
agcauucaaucaggcugagcugaauguagugauguuuacauuguuuacauucuuuguacugu

SEQ ID NO: 198971 - RNA, 62 nt, hsa
ucaggcugagcugaauguagugauguuuacauuguuuacauucuuuguacugucuuccugcu

SEQ ID NO: 198972 - RNA, 62 nt, hsa
cuuucuuucuuucugccaacuuuguuuuccaguguuuacaaggugacaaauguuugacuuug

SEQ ID NO: 198973 - RNA, 62 nt, hsa
cuuuagcacaggacaacuuuacaaaacaugauuguuuacagcugcucuuccccucuuuucug

SEQ ID NO: 198974 - RNA, 62 nt, hsa
cccaggacuaaaaauggacaggcugaccucaguguuuacaaauucagaauuuugauaggggu

SEQ ID NO: 198975 - RNA, 62 nt, hsa
agugcugggugcagcuccaucacccucuuguguguuuacaugucucuuucuaugauaagagg

SEQ ID NO: 198976 - RNA, 62 nt, hsa
uaugccugucuagacaucaaauuguugguuauuguuuacaaucuagaaaugaugaagcucuu

SEQ ID NO: 198977 - RNA, 62 nt, hsa
cuagggugauugugucuggagacccuuaauuauguuuacaaagacccauguuccaaguaagu

SEQ ID NO: 198978 - RNA, 62 nt, hsa
cucacugcuguucugggccauccccauagccauguuuacaugauuugaugugcaauagggug

SEQ ID NO: 198979 - RNA, 62 nt, hsa
gggugacugggucuagccccugaucccaaaucuguuuacacaucaaucugccucacugcugu

SEQ ID NO: 198980 - RNA, 62 nt, hsa
cuuggggggucagggugcuguccccuccccucuguuuacaucuccccucuaccccgcuguau

SEQ ID NO: 198981 - RNA, 62 nt, hsa
ccagaggaagccucuauuuauuuauuagcuuuuguuuacaccguggaauugaccccuuccuc

SEQ ID NO: 198982 - RNA, 62 nt, hsa
aacaauugagaugcuaacagggaggauuacaguguuuacagaacaaccuucagcgccgaccu

SEQ ID NO: 198983 - RNA, 62 nt, hsa
agguagaauaaccgaguaugacaauucuuaauuguuuacauuuuauaacuuccuguccuuca

SEQ ID NO: 198984 - RNA, 62 nt, hsa
cccuugcagggcuuugcagcugcucaucuguuuguuuacaguuuguucuuucccuccuuccc

SEQ ID NO: 198985 - RNA, 62 nt, hsa
uuguguuuuacuugaccaaaaccaaguguauauguuuacauguuuuuauccuguuuagcuug

SEQ ID NO: 198986 - RNA, 62 nt, hsa
cuccuuccuugcaguguuuacaacauagccaguguuuacagcauagcagaugcugcugcuga

SEQ ID NO: 198987 - RNA, 62 nt, hsa
cuggcccuuguuucuagccuccuuccuugcaguguuuacaacauagccaguguuuacagcau

SEQ ID NO: 198988 - RNA, 62 nt, hsa
auguaguaaauguauguuuacaggguuuaucauguuuacagauuaagcuaauuucuguaguc

SEQ ID NO: 198989 - RNA, 62 nt, hsa
cuuuacacuuguacaauuauguaguaaauguauguuuacaggguuuaucauguuuacagauu

SEQ ID NO: 198990 - RNA, 62 nt, hsa
gggcuugcgcugggccguggugggaggcacaguguuuacaggcucugguggcagagcaguug

SEQ ID NO: 198991 - RNA, 62 nt, hsa
auauauauuuuuugcaacuuggauuuccaguuuguuuacagaguagucuuagguaguagcaa

SEQ ID NO: 198992 - RNA, 62 nt, hsa
cuuugaaaggcauugugggucugucuuuaaaguguuuacaaaaaaaaauuauauaaaaaaaa

SEQ ID NO: 198993 - RNA, 62 nt, hsa
agucuagugucgacugguguuuucccucgugauguuuacagcuugcuguuugcugcccagcc

SEQ ID NO: 198994 - RNA, 62 nt, hsa
ugcucccacggaggggagcaggaaugcugcacuguuuacacccugacugugcuuaaaaacac

SEQ ID NO: 198995 - RNA, 62 nt, hsa
acauauccacgguaaccggucccuggcaauucuguuuacaugaaauggggagaaagucaccg

SEQ ID NO: 198996 - RNA, 62 nt, hsa
gacaauaaaauggcuuuuaauuauuuguuauuuguuuacacccuauuccucaguuauuauua

SEQ ID NO: 198997 - RNA, 62 nt, hsa
caaaacuauuuguucaaagaacccguuaguguuguuuacaggguuacaguuucucucacaug

SEQ ID NO: 198998 - RNA, 62 nt, hsa
aaccauuugguaccugguguuaacuggaguccuguuuacaagguggagucggggcuugcuga

SEQ ID NO: 198999 - RNA, 62 nt, hsa
gcuguuagccuuagagugauugcagugaacacuguuuacacaccgugaauccauucccauca

SEQ ID NO: 199000 - RNA, 62 nt, hsa
aguucacaagcauaauuuggagguguguucuguguuuacacaguaguuuggauguacaauua

SEQ ID NO: 199001 - RNA, 62 nt, hsa
cuugguuuccauaacauagagcauugguugacuguuuacagaagacucacucaccaggauaa

SEQ ID NO: 199002 - RNA, 62 nt, hsa
aaggaaaauuaauaaaucauuaauaguuaaaauguuuacauugagcacuagaacauguuugg

SEQ ID NO: 199003 - RNA, 62 nt, hsa
uucuauaguaguuacaacaauuucacaaccuauguuuacagauucuucauaaauacaugcau

SEQ ID NO: 199004 - RNA, 62 nt, hsa
uuauaggucuuuaaaaauuacuuuuauuauauuguuuacaaauauauuucaugcaagaaaca

SEQ ID NO: 199005 - RNA, 62 nt, hsa
aagaugcuguacccacuugaacaguccucagguguuuacauaaauacuauguuuuacaguuu

SEQ ID NO: 199006 - RNA, 64 nt, hsa
uaagcauguuuuaucaugaaaaauuauugugaacaauuuagaucuuuaagaacuuauuaauaau

SEQ ID NO: 199007 - RNA, 64 nt, hsa
aaaaaguugcccuuccuccacaggugauuuaguaaauuuagacaguaguuaaacucuuguuagu

SEQ ID NO: 199008 - RNA, 64 nt, hsa
gcaaccugagaaagagaacugcuccuucaucguaaauuuagaagaccaaguagauaauggaacc

SEQ ID NO: 199009 - RNA, 64 nt, hsa
auauccucuuauuguugaucaaaggaggcaaaagaauuuagaggcaaaugacaagcgauaggcu

SEQ ID NO: 199010 - RNA, 64 nt, hsa
ucugcauaagucugauucuauuucuaugacuuugaauuuagaaucacuuaaagcuuuuauaaag

SEQ ID NO: 199011 - RNA, 64 nt, hsa
aacuauaaaauaugaaagcucuaaauuuaaaauaaauuuagagauagaaucaugguacauuauu

SEQ ID NO: 199012 - RNA, 64 nt, hsa
uauuuugacauaaaguugauaaagauuuuuuaauaauuuagacuucaagcauggcuauuuuaua

SEQ ID NO: 199013 - RNA, 64 nt, hsa
uuguuuuaucugaauuuuuaaacaaguauuuguuaauuuagaaaacuuuaaagcguuugcacag

SEQ ID NO: 199014 - RNA, 64 nt, hsa
gcaagcauucagaagaaaaagaagcaaccucaguaauuuagaaaucauuuugcaaucccuuaau

SEQ ID NO: 199015 - RNA, 64 nt, hsa
aucauuuauauuuauuuggagagaaaacuguccuaauuuagaauuucccucaaaucugagggac

SEQ ID NO: 199016 - RNA, 64 nt, hsa
cuuuuaagaaaugcuaacagauuuuucuggaggaaauuuagacaaaacaaugucauuuaguaga

SEQ ID NO: 199017 - RNA, 64 nt, hsa
ggguacuuagaggauaaagcuucguggucguauaaauuuagaucauuuggauugauuuuuauac

SEQ ID NO: 199018 - RNA, 64 nt, hsa
uguuauucaguaguuuugcagacuuaaaaguguaaauuuagaauuagaagaugaagcuauagua

SEQ ID NO: 199019 - RNA, 64 nt, hsa
uaugauuucuaaagaaaaccuauuaaauauuuggaauuuagaugcaagcuacucauucacacag

SEQ ID NO: 199020 - RNA, 64 nt, hsa
aggucuccauauacuauuuuuuucuacugaaaacaauuuagaaagaagcuauugggcagaaaca

SEQ ID NO: 199021 - RNA, 64 nt, hsa
aacuaaugucaucuuuucauuaaagacuaauagaaauuuagaaaucauuguguuaaagagagcu

SEQ ID NO: 199022 - RNA, 64 nt, hsa
uuuucuuccccaccccaacccccaugagcucuuaaauuuagauuucuaucucuuguaagucacu

SEQ ID NO: 199023 - RNA, 64 nt, hsa
uaauaaauuuaauuuuaccaauaaauauucccauaauuuagaaaaggaugucgacuugcuaauu

SEQ ID NO: 199024 - RNA, 64 nt, hsa
cuaagaaaacugagaacuaacauuaaaaaaauuaaauuuagaauaagaaugauuucuuuaauuu

SEQ ID NO: 199025 - RNA, 64 nt, hsa
uaaacuaccacuuuuuuuaaccauuauuaugcaaaauuuagaagaaaaguuauuggcaugguug

SEQ ID NO: 199026 - RNA, 64 nt, hsa
uaaacuuguacauggaauuuuuugaauaugccuuaauuuagaaacugaaaaauaucugguuaua

SEQ ID NO: 199027 - RNA, 64 nt, hsa
gucugaaauccagcaucuauacguaauuuaaacaaauuuagaagaaaaaaccaccccauuaaaa

SEQ ID NO: 199028 - RNA, 64 nt, hsa
aaaaacacacguagacugauggaacagaauagagaauuuagaaaugagaccacacaccuauaau

SEQ ID NO: 199029 - RNA, 64 nt, hsa
agagggagcauggccauaaaauaaaauaaaauaaaauuuagauuuaagucgagcucaguggcuc

SEQ ID NO: 199030 - RNA, 64 nt, hsa
auaaacacaacaauacuuggacuuauuuauuuaaaauuuagauuuauuagagggagcauggcca

SEQ ID NO: 199031 - RNA, 64 nt, hsa
agaaaggacuguggaccucuaucaucugcuaaguaauuuagaagauauuauuugucuuaaaaaa

SEQ ID NO: 199032 - RNA, 64 nt, hsa
aguuuugaguaauucaagccucuaaacagacaggaauuuagaaaaagucaauguacuuguuuga

SEQ ID NO: 199033 - RNA, 64 nt, hsa
gaggucaucugcugucauggauuuuucaauaaugaauuuagaauacaccuguuagcuacaguua

SEQ ID NO: 199034 - RNA, 64 nt, hsa
uaugauucuuuauuuuuacuuuuucauuucaagaaauuuagaguuuccaaauuuagagcuucug

SEQ ID NO: 199035 - RNA, 64 nt, hsa
uuacuuuuucauuucaagaaauuuagaguuuccaaauuuagagcuucugcauacagucuuaaag

SEQ ID NO: 199036 - RNA, 64 nt, hsa
aagaaaagagucuccuuucgaaugugaagaaguaaauuuagaggaaaucaaacaagcaucacuu

SEQ ID NO: 199037 - RNA, 64 nt, hsa
ccgagaggcagggcaacuaauaacuggucagaaaaauuuagacggucuucauuuuaaaauuggc

SEQ ID NO: 199038 - RNA, 64 nt, hsa
guguaauuuuuucccuuuuugauuaggguuacaaaauuuagagaccaguaugauuaaguugaag

SEQ ID NO: 199039 - RNA, 64 nt, hsa
uacacuggcagcucuaugaguagaaagucuucggaauuuagaacccaucuaugagagaaaguuc

SEQ ID NO: 199040 - RNA, 64 nt, hsa
gucaggaagacuaccugucaugaagguauaaaauaauuuagaagugaauguuuuucuguaccau

SEQ ID NO: 199041 - RNA, 64 nt, hsa
agaauaauuguggguugacagauuuuuaaaauagaauuuagaguauuugggguuuuguuuguuu

SEQ ID NO: 199042 - RNA, 64 nt, hsa
agguacagucuggaucauggcauguagaaauagaaauuuagaauuuuacugcagcuuugaugug

SEQ ID NO: 199043 - RNA, 64 nt, hsa
aacaacuagaaaggaaagugugacacaguuuuuaaauuuagauguagaaaauaaugaauuaaug

SEQ ID NO: 199044 - RNA, 64 nt, hsa
aguagcaguaaaauuauauacugaaaacaccaaaaauuuagaugccuuaauaguauauacguga

SEQ ID NO: 199045 - RNA, 64 nt, hsa
uuuucuguguguucucagauuauauauuucccucaauuuagaguuugcuaagugaaauaaacug

SEQ ID NO: 199046 - RNA, 64 nt, hsa
aauauucaauacaauuguaauguagaaauauaagaauuuagaaaaaaguaaacuugccauuugg

SEQ ID NO: 199047 - RNA, 64 nt, hsa
ucuaaacuucaaggcuugcucuaucuccuagagcaauuuagagcuaaaaccaguaauaagcaaa

SEQ ID NO: 199048 - RNA, 64 nt, hsa
uuucuuuuuucuuuuauauuacgugaagugaugaaauuuagaaugaccucuaacacuccuguaa

SEQ ID NO: 199049 - RNA, 64 nt, hsa
ccguaauuuugauacaucugugauuuaggucauuaauuuagauaaacuagcucauuauuuccau

SEQ ID NO: 199050 - RNA, 64 nt, hsa
cagugcuuacugcgacacauuaauuagcuugauuaauuuagauuagaaucauuaacaucaugaa

SEQ ID NO: 199051 - RNA, 64 nt, hsa
ucuaugguucuuacagaaauuuuucaaaggaaucaauuuagagauagaguuuucauauacuuac

SEQ ID NO: 199052 - RNA, 64 nt, hsa
uaaagcccaaacauuuguaacaaacucccuaauaaauuuagagaaagucacucuguuaccauuu

SEQ ID NO: 199053 - RNA, 64 nt, hsa
aaauguauauacaguugccuuauaaaacaacauaaauuuagaccauaacuuuuauagagaaagg

SEQ ID NO: 199054 - RNA, 64 nt, hsa
cacuaugcaaacuuaccccagucucuaaaaaaguaauuuagauuuaaaguucuuugauguauuu

SEQ ID NO: 199055 - RNA, 64 nt, hsa
auacuugaaaagaggugaccauaaagaucacaccaauuuagaaugaauauuaaagucugagaaa

SEQ ID NO: 199056 - RNA, 64 nt, hsa
aaucuuaaccuucaaauacauucuaaaucacuuuaauuuagaagauaggugagcaacuugagug

SEQ ID NO: 199057 - RNA, 64 nt, hsa
cugaucucuaaucagaaauauuuuuaaaaaauacaauuuagaucucugaaaauuggaaccacuc

SEQ ID NO: 199058 - RNA, 64 nt, hsa
aauuuccccuuuaaguuaugauggcugccuauagaauuuagacuguuucucacccugauccauc

SEQ ID NO: 199059 - RNA, 64 nt, hsa
uucauuugcucagucggggaucacucaaaacuacuagacaaaaaagugagaggauagauuuaga

SEQ ID NO: 199060 - RNA, 64 nt, hsa
gcaauucaaugucaauagacauuaagcaacauaauagacaaacaucuccuaagggaacauuugu

SEQ ID NO: 199061 - RNA, 64 nt, hsa
cuguacuaguucauuucauaaggaaaugauacuguagacaaauguaaauaaagccugugaguca

SEQ ID NO: 199062 - RNA, 64 nt, hsa
uuaaauaaaaauuacgacauuuuaagauauuucauagacaaaccaaacaaaaauauauguuuuu

SEQ ID NO: 199063 - RNA, 64 nt, hsa
uaggucacugaaagaacuugauuugaauuacguuuagacaaaaaugauuuaauuguaaauucuu

SEQ ID NO: 199064 - RNA, 64 nt, hsa
ugcugauuguugcuugagaaauaauuacuaauucuagacaaaacucaauccuguaucuuccauc

SEQ ID NO: 199065 - RNA, 64 nt, hsa
uuagugugugcauaauagcuacagugcauaguuguagacaaaguacauucuggggaaacaacau

SEQ ID NO: 199066 - RNA, 64 nt, hsa
ugggaauccaagauuggucucccauaugcagaaauagacaaaaaguauauuaaacaaaguuuca

SEQ ID NO: 199067 - RNA, 64 nt, hsa
aaguaucagugcaaauuucucaaccuuucuggguuagacaaagauccuuuuuuguguguucuuu

SEQ ID NO: 199068 - RNA, 64 nt, hsa
uuuuugggggaaagugcugcugauaugauacaaguagacaaaauuuaaaugaaauuuugucaca

SEQ ID NO: 199069 - RNA, 64 nt, hsa
uucuguggccaaguaaguuugggaaauaguggguuagacaaaguugaguuacuguuggccuuuc

SEQ ID NO: 199070 - RNA, 64 nt, hsa
aaaugugauagaagauuauucagaacaaaauaaguagacaaaauaacaaaagacaggaaaauaa

SEQ ID NO: 199071 - RNA, 64 nt, hsa
gcucuguuuauaauuguuaauauuagacaaacaguagacaaaugcagcagcaagucaauuguau

SEQ ID NO: 199072 - RNA, 64 nt, hsa
cuaguugcacugcucuguuuauaauuguuaauauuagacaaacaguagacaaaugcagcagcaa

SEQ ID NO: 199073 - RNA, 64 nt, hsa
uacuugauacauuuauaucaaguucuaaaguauuuagacaaauccaaauacuuuguuuuuaguu

SEQ ID NO: 199074 - RNA, 64 nt, hsa
agcugaacucaccggccacuucucuguuugccuauagacaaagacuguguguguguguguguau

SEQ ID NO: 199075 - RNA, 64 nt, hsa
acucauauaucagucucucacauggccacaauucuagacaaaaaccaaagacccagaggccaga

SEQ ID NO: 199076 - RNA, 64 nt, hsa
uguuacacauaguuuuugacuugaauuaaaauacuagacaaagcagaaauguacaauuucuggu

SEQ ID NO: 199077 - RNA, 64 nt, hsa
auuaauugaggaaaucagcuaagaaaauggacuuuagacaaaagcaagaggaucagaugaagaa

SEQ ID NO: 199078 - RNA, 64 nt, hsa
cauaaaaggaaaaagaguuaugaagauacagauuuagacaaagacaagagcaucagacaaagga

SEQ ID NO: 199079 - RNA, 64 nt, hsa; identical to SEQ ID NO: 199006

SEQ ID NO: 199080 - RNA, 64 nt, hsa; identical to SEQ ID NO: 199007

SEQ ID NO: 199081 - RNA, 64 nt, hsa; identical to SEQ ID NO: 199008

SEQ ID NO: 199082 - RNA, 64 nt, hsa; identical to SEQ ID NO: 199009

SEQ ID NO: 199083 - RNA, 64 nt, hsa; identical to SEQ ID NO: 199010

SEQ ID NO: 199084 - RNA, 64 nt, hsa; identical to SEQ ID NO: 199011

SEQ ID NO: 199085 - RNA, 64 nt, hsa; identical to SEQ ID NO: 199012

SEQ ID NO: 199086 - RNA, 64 nt, hsa; identical to SEQ ID NO: 199013

SEQ ID NO: 199087 - RNA, 64 nt, hsa; identical to SEQ ID NO: 199014

SEQ ID NO: 199088 - RNA, 64 nt, hsa; identical to SEQ ID NO: 199015

SEQ ID NO: 199089 - RNA, 64 nt, hsa; identical to SEQ ID NO: 199016

SEQ ID NO: 199090 - RNA, 64 nt, hsa; identical to SEQ ID NO: 199017

SEQ ID NO: 199091 - RNA, 64 nt, hsa; identical to SEQ ID NO: 199018

SEQ ID NO: 199092 - RNA, 64 nt, hsa; identical to SEQ ID NO: 199019

SEQ ID NO: 199093 - RNA, 64 nt, hsa; identical to SEQ ID NO: 199020

SEQ ID NO: 199094 - RNA, 64 nt, hsa; identical to SEQ ID NO: 199021

SEQ ID NO: 199095 - RNA, 64 nt, hsa; identical to SEQ ID NO: 199022

SEQ ID NO: 199096 - RNA, 64 nt, hsa; identical to SEQ ID NO: 199023

SEQ ID NO: 199097 - RNA, 64 nt, hsa; identical to SEQ ID NO: 199024

SEQ ID NO: 199098 - RNA, 64 nt, hsa; identical to SEQ ID NO: 199025

SEQ ID NO: 199099 - RNA, 64 nt, hsa; identical to SEQ ID NO: 199026

SEQ ID NO: 199100 - RNA, 64 nt, hsa; identical to SEQ ID NO: 199027

SEQ ID NO: 199101 - RNA, 64 nt, hsa; identical to SEQ ID NO: 199028

SEQ ID NO: 199102 - RNA, 64 nt, hsa; identical to SEQ ID NO: 199029

SEQ ID NO: 199103 - RNA, 64 nt, hsa; identical to SEQ ID NO: 199030

SEQ ID NO: 199104 - RNA, 64 nt, hsa; identical to SEQ ID NO: 199031

SEQ ID NO: 199105 - RNA, 64 nt, hsa; identical to SEQ ID NO: 199032

SEQ ID NO: 199106 - RNA, 64 nt, hsa; identical to SEQ ID NO: 199033

SEQ ID NO: 199107 - RNA, 64 nt, hsa; identical to SEQ ID NO: 199034

SEQ ID NO: 199108 - RNA, 64 nt, hsa; identical to SEQ ID NO: 199035

SEQ ID NO: 199109 - RNA, 64 nt, hsa; identical to SEQ ID NO: 199036

SEQ ID NO: 199110 - RNA, 64 nt, hsa; identical to SEQ ID NO: 199037

SEQ ID NO: 199111 - RNA, 64 nt, hsa; identical to SEQ ID NO: 199038

SEQ ID NO: 199112 - RNA, 64 nt, hsa; identical to SEQ ID NO: 199039

SEQ ID NO: 199113 - RNA, 64 nt, hsa; identical to SEQ ID NO: 199040

SEQ ID NO: 199114 - RNA, 64 nt, hsa; identical to SEQ ID NO: 199041

SEQ ID NO: 199115 - RNA, 64 nt, hsa; identical to SEQ ID NO: 199042

SEQ ID NO: 199116 - RNA, 64 nt, hsa; identical to SEQ ID NO: 199043

SEQ ID NO: 199117 - RNA, 64 nt, hsa; identical to SEQ ID NO: 199044

SEQ ID NO: 199118 - RNA, 64 nt, hsa; identical to SEQ ID NO: 199045

SEQ ID NO: 199119 - RNA, 64 nt, hsa; identical to SEQ ID NO: 199046

SEQ ID NO: 199120 - RNA, 64 nt, hsa; identical to SEQ ID NO: 199047

SEQ ID NO: 199121 - RNA, 64 nt, hsa; identical to SEQ ID NO: 199048

SEQ ID NO: 199122 - RNA, 64 nt, hsa; identical to SEQ ID NO: 199049

SEQ ID NO: 199123 - RNA, 64 nt, hsa; identical to SEQ ID NO: 199050

SEQ ID NO: 199124 - RNA, 64 nt, hsa; identical to SEQ ID NO: 199051

SEQ ID NO: 199125 - RNA, 64 nt, hsa; identical to SEQ ID NO: 199052

SEQ ID NO: 199126 - RNA, 64 nt, hsa; identical to SEQ ID NO: 199053

SEQ ID NO: 199127 - RNA, 64 nt, hsa; identical to SEQ ID NO: 199054

SEQ ID NO: 199128 - RNA, 64 nt, hsa; identical to SEQ ID NO: 199055

SEQ ID NO: 199129 - RNA, 64 nt, hsa; identical to SEQ ID NO: 199056

SEQ ID NO: 199130 - RNA, 64 nt, hsa; identical to SEQ ID NO: 199057

SEQ ID NO: 199131 - RNA, 64 nt, hsa; identical to SEQ ID NO: 199058

SEQ ID NO: 199132 - RNA, 64 nt, hsa; identical to SEQ ID NO: 199059

SEQ ID NO: 199133 - RNA, 64 nt, hsa; identical to SEQ ID NO: 199060

SEQ ID NO: 199134 - RNA, 64 nt, hsa; identical to SEQ ID NO: 199061

SEQ ID NO: 199135 - RNA, 64 nt, hsa; identical to SEQ ID NO: 199062

SEQ ID NO: 199136 - RNA, 64 nt, hsa; identical to SEQ ID NO: 199063

SEQ ID NO: 199137 - RNA, 64 nt, hsa; identical to SEQ ID NO: 199064

SEQ ID NO: 199138 - RNA, 64 nt, hsa; identical to SEQ ID NO: 199065

SEQ ID NO: 199139 - RNA, 64 nt, hsa; identical to SEQ ID NO: 199066

SEQ ID NO: 199140 - RNA, 64 nt, hsa; identical to SEQ ID NO: 199067

SEQ ID NO: 199141 - RNA, 64 nt, hsa; identical to SEQ ID NO: 199068

SEQ ID NO: 199142 - RNA, 64 nt, hsa; identical to SEQ ID NO: 199069

SEQ ID NO: 199143 - RNA, 64 nt, hsa; identical to SEQ ID NO: 199070

SEQ ID NO: 199144 - RNA, 64 nt, hsa; identical to SEQ ID NO: 199071

SEQ ID NO: 199145 - RNA, 64 nt, hsa; identical to SEQ ID NO: 199072

SEQ ID NO: 199146 - RNA, 64 nt, hsa; identical to SEQ ID NO: 199073

SEQ ID NO: 199147 - RNA, 64 nt, hsa; identical to SEQ ID NO: 199074

SEQ ID NO: 199148 - RNA, 64 nt, hsa; identical to SEQ ID NO: 199075

SEQ ID NO: 199149 - RNA, 64 nt, hsa; identical to SEQ ID NO: 199076

SEQ ID NO: 199150 - RNA, 64 nt, hsa; identical to SEQ ID NO: 199077

SEQ ID NO: 199151 - RNA, 64 nt, hsa; identical to SEQ ID NO: 199078

SEQ ID NO: 199152 - RNA, 64 nt, hsa; identical to SEQ ID NO: 199006

SEQ ID NO: 199153 - RNA, 64 nt, hsa; identical to SEQ ID NO: 199007

SEQ ID NO: 199154 - RNA, 64 nt, hsa; identical to SEQ ID NO: 199008

SEQ ID NO: 199155 - RNA, 64 nt, hsa; identical to SEQ ID NO: 199009

SEQ ID NO: 199156 - RNA, 64 nt, hsa; identical to SEQ ID NO: 199010

SEQ ID NO: 199157 - RNA, 64 nt, hsa; identical to SEQ ID NO: 199011

SEQ ID NO: 199158 - RNA, 64 nt, hsa; identical to SEQ ID NO: 199012

SEQ ID NO: 199159 - RNA, 64 nt, hsa; identical to SEQ ID NO: 199013

SEQ ID NO: 199160 - RNA, 64 nt, hsa; identical to SEQ ID NO: 199014

SEQ ID NO: 199161 - RNA, 64 nt, hsa; identical to SEQ ID NO: 199015

SEQ ID NO: 199162 - RNA, 64 nt, hsa; identical to SEQ ID NO: 199016

SEQ ID NO: 199163 - RNA, 64 nt, hsa; identical to SEQ ID NO: 199017

SEQ ID NO: 199164 - RNA, 64 nt, hsa; identical to SEQ ID NO: 199018

SEQ ID NO: 199165 - RNA, 64 nt, hsa; identical to SEQ ID NO: 199019

SEQ ID NO: 199166 - RNA, 64 nt, hsa; identical to SEQ ID NO: 199020

SEQ ID NO: 199167 - RNA, 64 nt, hsa; identical to SEQ ID NO: 199021

SEQ ID NO: 199168 - RNA, 64 nt, hsa; identical to SEQ ID NO: 199022

SEQ ID NO: 199169 - RNA, 64 nt, hsa; identical to SEQ ID NO: 199023

SEQ ID NO: 199170 - RNA, 64 nt, hsa; identical to SEQ ID NO: 199024

SEQ ID NO: 199171 - RNA, 64 nt, hsa; identical to SEQ ID NO: 199025

SEQ ID NO: 199172 - RNA, 64 nt, hsa; identical to SEQ ID NO: 199026

SEQ ID NO: 199173 - RNA, 64 nt, hsa; identical to SEQ ID NO: 199027

SEQ ID NO: 199174 - RNA, 64 nt, hsa; identical to SEQ ID NO: 199028

SEQ ID NO: 199175 - RNA, 64 nt, hsa; identical to SEQ ID NO: 199029

SEQ ID NO: 199176 - RNA, 64 nt, hsa; identical to SEQ ID NO: 199030

SEQ ID NO: 199177 - RNA, 64 nt, hsa; identical to SEQ ID NO: 199031

SEQ ID NO: 199178 - RNA, 64 nt, hsa; identical to SEQ ID NO: 199032

SEQ ID NO: 199179 - RNA, 64 nt, hsa; identical to SEQ ID NO: 199033

SEQ ID NO: 199180 - RNA, 64 nt, hsa; identical to SEQ ID NO: 199034

SEQ ID NO: 199181 - RNA, 64 nt, hsa; identical to SEQ ID NO: 199035

SEQ ID NO: 199182 - RNA, 64 nt, hsa; identical to SEQ ID NO: 199036

SEQ ID NO: 199183 - RNA, 64 nt, hsa; identical to SEQ ID NO: 199037

SEQ ID NO: 199184 - RNA, 64 nt, hsa; identical to SEQ ID NO: 199038

SEQ ID NO: 199185 - RNA, 64 nt, hsa; identical to SEQ ID NO: 199039

SEQ ID NO: 199186 - RNA, 64 nt, hsa; identical to SEQ ID NO: 199040

SEQ ID NO: 199187 - RNA, 64 nt, hsa; identical to SEQ ID NO: 199041

SEQ ID NO: 199188 - RNA, 64 nt, hsa; identical to SEQ ID NO: 199042

SEQ ID NO: 199189 - RNA, 64 nt, hsa; identical to SEQ ID NO: 199043

SEQ ID NO: 199190 - RNA, 64 nt, hsa; identical to SEQ ID NO: 199044

SEQ ID NO: 199191 - RNA, 64 nt, hsa; identical to SEQ ID NO: 199045

SEQ ID NO: 199192 - RNA, 64 nt, hsa; identical to SEQ ID NO: 199046

SEQ ID NO: 199193 - RNA, 64 nt, hsa; identical to SEQ ID NO: 199047

SEQ ID NO: 199194 - RNA, 64 nt, hsa; identical to SEQ ID NO: 199048

SEQ ID NO: 199195 - RNA, 64 nt, hsa; identical to SEQ ID NO: 199049

SEQ ID NO: 199196 - RNA, 64 nt, hsa; identical to SEQ ID NO: 199050

SEQ ID NO: 199197 - RNA, 64 nt, hsa; identical to SEQ ID NO: 199051

SEQ ID NO: 199198 - RNA, 64 nt, hsa; identical to SEQ ID NO: 199052

SEQ ID NO: 199199 - RNA, 64 nt, hsa; identical to SEQ ID NO: 199053

SEQ ID NO: 199200 - RNA, 64 nt, hsa; identical to SEQ ID NO: 199054

SEQ ID NO: 199201 - RNA, 64 nt, hsa; identical to SEQ ID NO: 199055

SEQ ID NO: 199202 - RNA, 64 nt, hsa; identical to SEQ ID NO: 199056

SEQ ID NO: 199203 - RNA, 64 nt, hsa; identical to SEQ ID NO: 199057

SEQ ID NO: 199204 - RNA, 64 nt, hsa; identical to SEQ ID NO: 199058

SEQ ID NO: 199205 - RNA, 64 nt, hsa; identical to SEQ ID NO: 199059

SEQ ID NO: 199206 - RNA, 64 nt, hsa; identical to SEQ ID NO: 199060

SEQ ID NO: 199207 - RNA, 64 nt, hsa; identical to SEQ ID NO: 199061

SEQ ID NO: 199208 - RNA, 64 nt, hsa; identical to SEQ ID NO: 199062

SEQ ID NO: 199209 - RNA, 64 nt, hsa; identical to SEQ ID NO: 199063

SEQ ID NO: 199210 - RNA, 64 nt, hsa; identical to SEQ ID NO: 199064

SEQ ID NO: 199211 - RNA, 64 nt, hsa; identical to SEQ ID NO: 199065

SEQ ID NO: 199212 - RNA, 64 nt, hsa; identical to SEQ ID NO: 199066

SEQ ID NO: 199213 - RNA, 64 nt, hsa; identical to SEQ ID NO: 199067

SEQ ID NO: 199214 - RNA, 64 nt, hsa; identical to SEQ ID NO: 199068

SEQ ID NO: 199215 - RNA, 64 nt, hsa; identical to SEQ ID NO: 199069

SEQ ID NO: 199216 - RNA, 64 nt, hsa; identical to SEQ ID NO: 199070

SEQ ID NO: 199217 - RNA, 64 nt, hsa; identical to SEQ ID NO: 199071

SEQ ID NO: 199218 - RNA, 64 nt, hsa; identical to SEQ ID NO: 199072

SEQ ID NO: 199219 - RNA, 64 nt, hsa; identical to SEQ ID NO: 199073

SEQ ID NO: 199220 - RNA, 64 nt, hsa; identical to SEQ ID NO: 199074

SEQ ID NO: 199221 - RNA, 64 nt, hsa; identical to SEQ ID NO: 199075

SEQ ID NO: 199222 - RNA, 64 nt, hsa; identical to SEQ ID NO: 199076

SEQ ID NO: 199223 - RNA, 64 nt, hsa; identical to SEQ ID NO: 199077

SEQ ID NO: 199224 - RNA, 64 nt, hsa; identical to SEQ ID NO: 199078

SEQ ID NO: 199225 - RNA, 64 nt, hsa; identical to SEQ ID NO: 199006

SEQ ID NO: 199226 - RNA, 64 nt, hsa; identical to SEQ ID NO: 199007

SEQ ID NO: 199227 - RNA, 64 nt, hsa; identical to SEQ ID NO: 199008

SEQ ID NO: 199228 - RNA, 64 nt, hsa; identical to SEQ ID NO: 199009

SEQ ID NO: 199229 - RNA, 64 nt, hsa; identical to SEQ ID NO: 199010

SEQ ID NO: 199230 - RNA, 64 nt, hsa; identical to SEQ ID NO: 199011

SEQ ID NO: 199231 - RNA, 64 nt, hsa; identical to SEQ ID NO: 199012

SEQ ID NO: 199232 - RNA, 64 nt, hsa; identical to SEQ ID NO: 199013

SEQ ID NO: 199233 - RNA, 64 nt, hsa; identical to SEQ ID NO: 199014

SEQ ID NO: 199234 - RNA, 64 nt, hsa; identical to SEQ ID NO: 199015

SEQ ID NO: 199235 - RNA, 64 nt, hsa; identical to SEQ ID NO: 199016

SEQ ID NO: 199236 - RNA, 64 nt, hsa; identical to SEQ ID NO: 199017

SEQ ID NO: 199237 - RNA, 64 nt, hsa; identical to SEQ ID NO: 199018

SEQ ID NO: 199238 - RNA, 64 nt, hsa; identical to SEQ ID NO: 199019

SEQ ID NO: 199239 - RNA, 64 nt, hsa; identical to SEQ ID NO: 199020

SEQ ID NO: 199240 - RNA, 64 nt, hsa; identical to SEQ ID NO: 199021

SEQ ID NO: 199241 - RNA, 64 nt, hsa; identical to SEQ ID NO: 199022

SEQ ID NO: 199242 - RNA, 64 nt, hsa; identical to SEQ ID NO: 199023

SEQ ID NO: 199243 - RNA, 64 nt, hsa; identical to SEQ ID NO: 199024

SEQ ID NO: 199244 - RNA, 64 nt, hsa; identical to SEQ ID NO: 199025

SEQ ID NO: 199245 - RNA, 64 nt, hsa; identical to SEQ ID NO: 199026

SEQ ID NO: 199246 - RNA, 64 nt, hsa; identical to SEQ ID NO: 199027

SEQ ID NO: 199247 - RNA, 64 nt, hsa; identical to SEQ ID NO: 199028

SEQ ID NO: 199248 - RNA, 64 nt, hsa; identical to SEQ ID NO: 199029

SEQ ID NO: 199249 - RNA, 64 nt, hsa; identical to SEQ ID NO: 199030

SEQ ID NO: 199250 - RNA, 64 nt, hsa; identical to SEQ ID NO: 199031

SEQ ID NO: 199251 - RNA, 64 nt, hsa; identical to SEQ ID NO: 199032

SEQ ID NO: 199252 - RNA, 64 nt, hsa; identical to SEQ ID NO: 199033

SEQ ID NO: 199253 - RNA, 64 nt, hsa; identical to SEQ ID NO: 199034

SEQ ID NO: 199254 - RNA, 64 nt, hsa; identical to SEQ ID NO: 199035

SEQ ID NO: 199255 - RNA, 64 nt, hsa; identical to SEQ ID NO: 199036

SEQ ID NO: 199256 - RNA, 64 nt, hsa; identical to SEQ ID NO: 199037

SEQ ID NO: 199257 - RNA, 64 nt, hsa; identical to SEQ ID NO: 199038

SEQ ID NO: 199258 - RNA, 64 nt, hsa; identical to SEQ ID NO: 199039

SEQ ID NO: 199259 - RNA, 64 nt, hsa; identical to SEQ ID NO: 199040

SEQ ID NO: 199260 - RNA, 64 nt, hsa; identical to SEQ ID NO: 199041

SEQ ID NO: 199261 - RNA, 64 nt, hsa; identical to SEQ ID NO: 199042

SEQ ID NO: 199262 - RNA, 64 nt, hsa; identical to SEQ ID NO: 199043

SEQ ID NO: 199263 - RNA, 64 nt, hsa; identical to SEQ ID NO: 199044

SEQ ID NO: 199264 - RNA, 64 nt, hsa; identical to SEQ ID NO: 199045

SEQ ID NO: 199265 - RNA, 64 nt, hsa; identical to SEQ ID NO: 199046

SEQ ID NO: 199266 - RNA, 64 nt, hsa; identical to SEQ ID NO: 199047

SEQ ID NO: 199267 - RNA, 64 nt, hsa; identical to SEQ ID NO: 199048

SEQ ID NO: 199268 - RNA, 64 nt, hsa; identical to SEQ ID NO: 199049

SEQ ID NO: 199269 - RNA, 64 nt, hsa; identical to SEQ ID NO: 199050

SEQ ID NO: 199270 - RNA, 64 nt, hsa; identical to SEQ ID NO: 199051

SEQ ID NO: 199271 - RNA, 64 nt, hsa; identical to SEQ ID NO: 199052

SEQ ID NO: 199272 - RNA, 64 nt, hsa; identical to SEQ ID NO: 199053

SEQ ID NO: 199273 - RNA, 64 nt, hsa; identical to SEQ ID NO: 199054

SEQ ID NO: 199274 - RNA, 64 nt, hsa; identical to SEQ ID NO: 199055

SEQ ID NO: 199275 - RNA, 64 nt, hsa; identical to SEQ ID NO: 199056

SEQ ID NO: 199276 - RNA, 64 nt, hsa; identical to SEQ ID NO: 199057

SEQ ID NO: 199277 - RNA, 64 nt, hsa; identical to SEQ ID NO: 199058

SEQ ID NO: 199278 - RNA, 64 nt, hsa; identical to SEQ ID NO: 199059

SEQ ID NO: 199279 - RNA, 64 nt, hsa; identical to SEQ ID NO: 199060

SEQ ID NO: 199280 - RNA, 64 nt, hsa; identical to SEQ ID NO: 199061

SEQ ID NO: 199281 - RNA, 64 nt, hsa; identical to SEQ ID NO: 199062

SEQ ID NO: 199282 - RNA, 64 nt, hsa; identical to SEQ ID NO: 199063

SEQ ID NO: 199283 - RNA, 64 nt, hsa; identical to SEQ ID NO: 199064

SEQ ID NO: 199284 - RNA, 64 nt, hsa; identical to SEQ ID NO: 199065

SEQ ID NO: 199285 - RNA, 64 nt, hsa; identical to SEQ ID NO: 199066

SEQ ID NO: 199286 - RNA, 64 nt, hsa; identical to SEQ ID NO: 199067

SEQ ID NO: 199287 - RNA, 64 nt, hsa; identical to SEQ ID NO: 199068

SEQ ID NO: 199288 - RNA, 64 nt, hsa; identical to SEQ ID NO: 199069

SEQ ID NO: 199289 - RNA, 64 nt, hsa; identical to SEQ ID NO: 199070

SEQ ID NO: 199290 - RNA, 64 nt, hsa; identical to SEQ ID NO: 199071

SEQ ID NO: 199291 - RNA, 64 nt, hsa; identical to SEQ ID NO: 199072

SEQ ID NO: 199292 - RNA, 64 nt, hsa; identical to SEQ ID NO: 199073

SEQ ID NO: 199293 - RNA, 64 nt, hsa; identical to SEQ ID NO: 199074

SEQ ID NO: 199294 - RNA, 64 nt, hsa; identical to SEQ ID NO: 199075

SEQ ID NO: 199295 - RNA, 64 nt, hsa; identical to SEQ ID NO: 199076

SEQ ID NO: 199296 - RNA, 64 nt, hsa; identical to SEQ ID NO: 199077

SEQ ID NO: 199297 - RNA, 64 nt, hsa; identical to SEQ ID NO: 199078

SEQ ID NO: 199298 - RNA, 64 nt, hsa
gaucccuccccaacccacuccauauuugggucauggacaguaaaggcaguuggauucucauaga

SEQ ID NO: 199299 - RNA, 64 nt, hsa
ccucaugggcauugucucuguuucccagugggguggacaguauaucagauggucagaacaaaua

SEQ ID NO: 199300 - RNA, 64 nt, hsa
acauuauuugaaagacugggaauuuaaugguuagggacaguaaaucuacuucuuuuuccaggga

SEQ ID NO: 199301 - RNA, 64 nt, hsa
aaguuacacguaaaguagaagaaucuagugcgugggacaguaaaggauccuuucucguacagaa

SEQ ID NO: 199302 - RNA, 64 nt, hsa
gacacacacacagccaggaguggguagauuucagggagacaagagggaauaguauagacaauaa

SEQ ID NO: 199303 - RNA, 64 nt, hsa
aggauacgcugcucucauacuugggcuguaguuuggagacaaaauauuuuccugccacugugua

SEQ ID NO: 199304 - RNA, 64 nt, hsa
aaaaagugaaggcuggguuuuuccccucuaaucuggagacaagcugcugcucucguacuaacug

SEQ ID NO: 199305 - RNA, 64 nt, hsa
augaaugacaaugagauaacauacagaugucaguggagacaaaguuguggguuccuccucccac

SEQ ID NO: 199306 - RNA, 64 nt, hsa
aaauucccaacucgguucucauggaggaguggguggagacaaggagggaguaagucguaggagu

SEQ ID NO: 199307 - RNA, 64 nt, hsa
agucugugccugaagucuguguuuguguugucguggagacaaggccuuugagccccacccuugu

SEQ ID NO: 199308 - RNA, 64 nt, hsa
caccugcagagguccccagacccaaagcaggacgggagacaacugcuuggaggagcgaagagcc

SEQ ID NO: 199309 - RNA, 64 nt, hsa
gcugauucacaggaggaggggagguuggggggcgggagacaaaaaccacaccucuuuuuauaua

SEQ ID NO: 199310 - RNA, 64 nt, hsa
agaggcaucgcauggacguucucuggucuguaguggagacaagcaguuaaccuagcaccauccu

SEQ ID NO: 199311 - RNA, 64 nt, hsa
ucccuccacccacccuuccauauccucuggagcaggagacaaugugggugcccagaagugcccu

SEQ ID NO: 199312 - RNA, 64 nt, hsa; identical to SEQ ID NO: 115857

SEQ ID NO: 199313 - RNA, 64 nt, hsa; identical to SEQ ID NO: 115858

SEQ ID NO: 199314 - RNA, 64 nt, hsa; identical to SEQ ID NO: 115859

SEQ ID NO: 199315 - RNA, 64 nt, hsa; identical to SEQ ID NO: 115860

SEQ ID NO: 199316 - RNA, 64 nt, hsa
ucuuuggauuugggguggggguccuggccaagaacucagucauuuuucuguguaccagguugcc

SEQ ID NO: 199317 - RNA, 64 nt, hsa
ugaguggaaauaacugcauuauggcugcuuuaaccucagucaucaaaagaaacuugcuguuuuu

SEQ ID NO: 199318 - RNA, 64 nt, hsa
caguccugccccccaggagcacaagcaggguccccucagucaaggcagugggaugggcggcuga

SEQ ID NO: 199319 - RNA, 64 nt, hsa
gggcggcugaggaacggggcaggcaaggucacugcucagucacguccacgggggacgagccgug

SEQ ID NO: 199320 - RNA, 64 nt, hsa
ccugggcccccacugccaggcugggcccagcuugcucagucaaggggcugccaggcccccagaa

SEQ ID NO: 199321 - RNA, 64 nt, hsa
auuugucccccacucaaauuaucaaagcuuucugcucagucaguuguguggggauggugaggga

SEQ ID NO: 199322 - RNA, 64 nt, hsa
gaaguguucccuaaggaacagcauuucucugcuccucagucaacccccguagccuagagcagug

SEQ ID NO: 199323 - RNA, 64 nt, hsa
gucacugugguaggcauuuggcauauuuuguggacucagucaagcaaccacagucuguuaauca

SEQ ID NO: 199324 - RNA, 64 nt, hsa
auugagacaauucuauuuuucauauacucguugcucauuaaauaguaaaggguugauuugcugc

SEQ ID NO: 199325 - RNA, 64 nt, hsa
ggucuuuacuagugcuaaguauuauggugagcuaucauuaaagugugccaucuuggauaaaggc

SEQ ID NO: 199326 - RNA, 64 nt, hsa
aauuagguuuuguacaauugaacuuaaauaaaugucauuaaaauaaauaaaugcaauauguauu

SEQ ID NO: 199327 - RNA, 64 nt, hsa
gcauaguucccauguuaaaucccauucauaacuuucauuaaagcauuuacuuugaauuucucca

SEQ ID NO: 199328 - RNA, 64 nt, hsa
cacagcuagcauguucacagauuugaaagaaguuucauuaaaagcaccauugcuuucuguacug

SEQ ID NO: 199329 - RNA, 64 nt, hsa
cacuaggccuuugaugcuuuaauucuucuucaguucauuaaaaguaacuacuaaggaaagguua

SEQ ID NO: 199330 - RNA, 64 nt, hsa
aaaugucccuaauuuaacccagcucauuauaaugucauuaaacaugacauuagcauugugguuu

SEQ ID NO: 199331 - RNA, 64 nt, hsa
ugggcuagccaauagaguugggacaauugcuuacucauuaaaaauaauagagccccacuugaca

SEQ ID NO: 199332 - RNA, 64 nt, hsa
ccuaacuuaguaaaguagaauaauuucaugguauucauuaaaaagcauaaaagucuuccucuug

SEQ ID NO: 199333 - RNA, 64 nt, hsa
guuuagugauacaaaugauugcaauuuuucuaaaucauuaaauuauuugguuugguggagugag

SEQ ID NO: 199334 - RNA, 64 nt, hsa
agacauccccaaagcuugucugccugugggucuuucauuaaaggugacgggcaaggguuuucuc

SEQ ID NO: 199335 - RNA, 64 nt, hsa
uguguguacaguguccacaggcaucacaccuucuucauuaaaaacccaguuuccuggucauuuc

SEQ ID NO: 199336 - RNA, 64 nt, hsa
uuuuaugcuaauucugcuuauuuuagaguauuuuucauuaaaaggugagcaaagugaaagauac

SEQ ID NO: 199337 - RNA, 64 nt, hsa
uugauguagaguagggcaaaucuguguguguaugucauuaaaaaaauucuaccaucuuucuuua

SEQ ID NO: 199338 - RNA, 64 nt, hsa
ugaaggauuauuaagcaaccuuaaagcaauaaguucauuaaacagaagguaauaggaagaacag

SEQ ID NO: 199339 - RNA, 64 nt, hsa
acauuugaugucuagauaacauucaugagauuggucauuaaauacuauuuugcuccuuuucugg

SEQ ID NO: 199340 - RNA, 64 nt, hsa
uaauugucucaaagcaucaaauaauacaucuuuaucauuaaacaugaauuuaaugucuaggaua

SEQ ID NO: 199341 - RNA, 64 nt, hsa
guauugauugaaaaaagagaaaggggcaagaaauucauuaaagaaaaaccacagauacugaaac

SEQ ID NO: 199342 - RNA, 64 nt, hsa
auaaacagaauuagguaguauauugaagacagcaucauuaaacaguuauguuguucuccuugca

SEQ ID NO: 199343 - RNA, 64 nt, hsa
aaauuuuuuucucacagugucaagguaacugaauucauuaaaaaaucuugaagggaguagggag

SEQ ID NO: 199344 - RNA, 64 nt, hsa
cuagguuugcguuuauagucagguuccauuuagcucauuaaaggucacugcugcuucaaaggac

SEQ ID NO: 199345 - RNA, 64 nt, hsa
cauggaccuauguauauauaucuaagaccucugaucauuaaaaccuauaaaggguugagcuguc

SEQ ID NO: 199346 - RNA, 64 nt, hsa
gcauagcccuucucuauguaagcagccauggcagucauuaaagagaaaggaguagcuuugacau

SEQ ID NO: 199347 - RNA, 64 nt, hsa
cagcaucugauaaucuguugguuuauuucacuuuucauuaaaugaacauugaugagagaagaug

SEQ ID NO: 199348 - RNA, 64 nt, hsa
uucagucugaugguucuguucuucauugugauugucauuaaaaagugguaaauugcucaaugua

SEQ ID NO: 199349 - RNA, 64 nt, hsa
ucuagaggaugugaucuaauuucuuucuagcucaucauuaaaaaggaaauuguaucaggaccca

SEQ ID NO: 199350 - RNA, 64 nt, hsa
cagggggaagaaaggagggcugugaggagauaccucauuaaacuuggcuuagugaagaagagag

SEQ ID NO: 199351 - RNA, 64 nt, hsa
cccacucucagccugggagacuccugccaagcccucauuaaagaugccacccugggcugcccug

SEQ ID NO: 199352 - RNA, 64 nt, hsa
caugauaacugguaccuuaucuacuguaaauauuucauuaaaaaugaugcacacauagauauau

SEQ ID NO: 199353 - RNA, 64 nt, hsa
uuuuaauguuuuauuggcaacguaugcugcuuuuucauuaaaauaugcuauuaaaauuaaaugg

SEQ ID NO: 199354 - RNA, 64 nt, hsa
ugaaacuaaaucuguguucaaagaugaagaccccucauuaaaagccaaggacguucuuaagauu

SEQ ID NO: 199355 - RNA, 64 nt, hsa
agauuggaacugacauaauuagucuugacuuacuucauuaaagcaagauucaauuccuuguuca

SEQ ID NO: 199356 - RNA, 64 nt, hsa
ugagaaagucaauuaagugugaguaaaguuaguaucauuaaacaaauugucuauuaaaugcaag

SEQ ID NO: 199357 - RNA, 64 nt, hsa
gaucaguuuuuauacagguugcaaaacauaguauucauuaaagacaugaauuuagaauugauuu

SEQ ID NO: 199358 - RNA, 64 nt, hsa
uggaauuucaguauacuguacuauccuuuauaagucauuaaaauaauguuucaucaaaugguua

SEQ ID NO: 199359 - RNA, 64 nt, hsa
uuguacagagguuacugcaauaaaggaaguggauucauuaaaccuauuuaauguccauucuuau

SEQ ID NO: 199360 - RNA, 64 nt, hsa
auaacacuugaaaaccaauuuaguuguuagucauucauuaaacauuaacaucacuaucauuuau

SEQ ID NO: 199361 - RNA, 64 nt, hsa
uucuuucaaaacuugaguggucucugagcuccugucauuaaaccuaucuauaucugucuaucag

SEQ ID NO: 199362 - RNA, 64 nt, hsa
ucauaauguucuguuauacauaacauuaaaauguucauuaaaaucaauguugaacugcuuuuuc

SEQ ID NO: 199363 - RNA, 64 nt, hsa
ccuuuuacuaccacucuugaguccauauaugaaaucauuaaaguuggaugaucaguuuuuuaua

SEQ ID NO: 199364 - RNA, 64 nt, hsa
gacauuugcacaaucuaaaauguaagcaaaguagucauuaaaaauacacccucuacuugggcuu

SEQ ID NO: 199365 - RNA, 64 nt, hsa
aacuaaaaauacgaggaaaggagagugaggauuuucauuaaaagucucagcaguggguuucuug

SEQ ID NO: 199366 - RNA, 64 nt, hsa
ucuaaauaaauggcuuucaaacaaagcaacugggucauuaaaaccagcucaaaggggguuuaaa

SEQ ID NO: 199367 - RNA, 64 nt, hsa
cuuugccgucuuguauguagaggcuauuuuuaaaucauuaaauuuuuagaucucuguuuucaua

SEQ ID NO: 199368 - RNA, 64 nt, hsa
ucauguuuguuuguagauguuugucugaugcauuucauuaaaaaaaaaaccaugaauuacgaag

SEQ ID NO: 199369 - RNA, 64 nt, hsa
uuaugagaacugguucuugccuuccccuugaaccucauuaaauggugauuucuugcuaagcucc

SEQ ID NO: 199370 - RNA, 64 nt, hsa
aucauguaccaagugcuuggcacauagugggccuucauuaaauguuuguugaauaaaagaggga

SEQ ID NO: 199371 - RNA, 64 nt, hsa
ugcauagaauaaugaagaucuuuguuuuuuguuuucauuaaagagccauucuggcacuuuaaug

SEQ ID NO: 199372 - RNA, 64 nt, hsa
auuuugagaacauucccuggaauugccacauaauucauuaaaaacauuuuuuuaagcaacacuu

SEQ ID NO: 199373 - RNA, 64 nt, hsa
caagcuacuggaugcacugucagauuaacuuauuucauuaaagaaguugggagaacaaauagga

SEQ ID NO: 199374 - RNA, 64 nt, hsa
gacugacaguugguauauguaccagccaaucccuucauuaaauguauacagauuuaguuaagua

SEQ ID NO: 199375 - RNA, 64 nt, hsa
ugcuuucugaacucuaaugugccuucauugauuaucauuaaaauuaucauuaaaauugccuuau

SEQ ID NO: 199376 - RNA, 64 nt, hsa
ucuaaugugccuucauugauuaucauuaaaauuaucauuaaaauugccuuauuucuauggacuc

SEQ ID NO: 199377 - RNA, 64 nt, hsa
cagaggacuugcuauuugccaggugcuuuauguaucauuaaauuuuucucauaguucagaaaaa

SEQ ID NO: 199378 - RNA, 64 nt, hsa
uuuuccuuuuaaauuuaguucuaucauuaauuuaucauuaaauuuaguucuaucauuugguacu

SEQ ID NO: 199379 - RNA, 64 nt, hsa
accuaacauaugucucuaccuagaacggaugguuucauuaaagaauguggauuuauugaugugu

SEQ ID NO: 199380 - RNA, 64 nt, hsa
uacagaucagaauguggcaccagaggacugugucucauuaaagugauugcugggagcaaaaacu

SEQ ID NO: 199381 - RNA, 64 nt, hsa
ggcacuuuggcauaccgaaaaaacaugaaauuuuucauuaaaaugccaugaaucaagccagggc

SEQ ID NO: 199382 - RNA, 64 nt, hsa
uuucauguaauuuacccuuugcaauaaaaaugauucauuaaauauauaacuaaaugugauuugg

SEQ ID NO: 199383 - RNA, 64 nt, hsa
guuucuuuucugguuuuaguuugggaauaaucauucauuaaaaaaaauguauugugguuuaugc

SEQ ID NO: 199384 - RNA, 64 nt, hsa
ucauaauacaaggaaccucagagcccccauuuguucauuaaagaggcaacuacagccaaaauca

SEQ ID NO: 199385 - RNA, 64 nt, hsa
caacuaccuuauuuuucacuguacagacacuaauucauuaaauacuaauugauuguuuaaaaga

SEQ ID NO: 199386 - RNA, 64 nt, hsa
cacuguauuucauuuucuuuauauuggaccgaagucauuaaaacaaaaugaaacauuugccaaa

SEQ ID NO: 199387 - RNA, 64 nt, hsa
cuuuuuugaauauugcaggguucagucuagauugucauuaaauugaagagucuacauucagaac

SEQ ID NO: 199388 - RNA, 62 nt, hsa
uauccuaagcacaaaauaaaccuuucuaaccacuucauuaaagcugaagaccaguaugauuu

SEQ ID NO: 199389 - RNA, 64 nt, hsa
agcauuuauuuaagggcuuuuucuuaaauaagaaucauuaaagucauuaaaaaaauuuacugaa

SEQ ID NO: 199390 - RNA, 64 nt, hsa
uuaagggcuuuuucuuaaauaagaaucauuaaagucauuaaaaaaauuuacugaaaugcccauc

SEQ ID NO: 199391 - RNA, 64 nt, hsa
acuacauuucugaauuuuugaaaaauguauuuuaucauuaaauggcauuauuuuaaagggugaa

SEQ ID NO: 199392 - RNA, 64 nt, hsa
ggaguguguuuaaauuguuacaaacaauaaugcgucauuaaaggccaugcugaucuugcauaac

SEQ ID NO: 199393 - RNA, 64 nt, hsa
guuugcaaaaaauguuuuuggucuuuuauaauucucauuaaaagaauaucuggcaaauuaaaaa

SEQ ID NO: 199394 - RNA, 64 nt, hsa
uguguauuugcuaauuuuuauuaauuuuaguuuuucauuaaauaaauuugacuuuucuguaauu

SEQ ID NO: 199395 - RNA, 64 nt, hsa
auaugcuguauuucuuuguagaauaaaugguuucucauuaaacucuaaagauuagggaaaaugg

SEQ ID NO: 199396 - RNA, 64 nt, hsa
guccuucagcugacuccaguauaaucuccucugcucauuaaacugauuccaggagauuggauuu

SEQ ID NO: 199397 - RNA, 64 nt, hsa
aguuuucauagugcuuucaaauacaccuuuuugaucauuaaaauaaaaaaauaaaucuugcucu

SEQ ID NO: 199398 - RNA, 64 nt, hsa
uauauacccagucauaaaguauaagcaucaguugucauuaaaaguuuucagaaaaucuugaggu

SEQ ID NO: 199399 - RNA, 64 nt, hsa
aaaauauuaccuaaauugguuagauacaaagaaaucauuaaaauuauuaauguauauaugaaaa

SEQ ID NO: 199400 - RNA, 64 nt, hsa
augcuuuaugaagcuuuagaaaugagcucaugacucauuaaaaaauaauaaacgaugcuauuuu

SEQ ID NO: 199401 - RNA, 64 nt, hsa
gggcggggagcugggccuggaggauccuggagucucauuaaaugccugauugugaaccaugucc

SEQ ID NO: 199402 - RNA, 64 nt, hsa
ccagccuuguuucucauguaaugcagugacgcugucauuaaacacguggauucauguguggccg

SEQ ID NO: 199403 - RNA, 64 nt, hsa
agcuauucucaugccucagccucucaaguagcugggacuacagaugugggccaccaugucuggc

SEQ ID NO: 199404 - RNA, 64 nt, hsa
caccauucuccugccucacccucccaaguagcugggacuacaggcgccugccagcacgccuggc

SEQ ID NO: 199405 - RNA, 64 nt, hsa
ggugauccucccaccucagccuccugaguagcuaggacuacagaugcucgccaccacaccuggc

SEQ ID NO: 199406 - RNA, 64 nt, hsa
aaugauucuccugcuuuagccucccaaguagcugggacuacagguguacgccaccacacccagc

SEQ ID NO: 199407 - RNA, 64 nt, hsa
ggcuugauuucuugaauaugcugagacccaauuuggacuacauuuggcagaaaugauggaguaa

SEQ ID NO: 199408 - RNA, 64 nt, hsa
agcaauucuccugccucagccucccgaguagcugggacuacaggcacccgccaccauuccgagc

SEQ ID NO: 199409 - RNA, 64 nt, hsa
cgccauucuccugccucagcuucccgaguagcugggacuacaggggcccgccaccacgcccggc

SEQ ID NO: 199410 - RNA, 64 nt, hsa
cgccauucuccugccucagccucccaaguagcucggacuacaggcguccuccaccaugccuggc

SEQ ID NO: 199411 - RNA, 64 nt, hsa
cgccauucuccugccucagccucccgaguagcugggacuacaggagcucgccaccacacccagc

SEQ ID NO: 199412 - RNA, 64 nt, hsa
cgccauucuccugccucagccucccguguagcugggacuacaggcacgcgccaccaugcccggc

SEQ ID NO: 199413 - RNA, 64 nt, hsa
uccaccucccaggcucaagccucccgaauagcugggacuacaggcgcacaccaccauccccggc

SEQ ID NO: 199414 - RNA, 64 nt, hsa
aauagaaagaacucggggaaacaucccaucaacaggacuacacacuuguauauacauucuugag

SEQ ID NO: 199415 - RNA, 64 nt, hsa
agcgauucuucugcuucagccucccgaguagcugggacuacaggcacccaccaucaugucuggc

SEQ ID NO: 199416 - RNA, 64 nt, hsa
agugauccucccaccucagccucccgaauagcugggacuacaggugugagucaccaagcccagu

SEQ ID NO: 199417 - RNA, 64 nt, hsa
ugccauucuccugucucagccucccgaguagcugggacuacaggcacccgccaacacgcccggc

SEQ ID NO: 199418 - RNA, 64 nt, hsa
agcaguucuccugccucagccuccugaguagcugggacuacaggcacccgccaccaugcccagc

SEQ ID NO: 199419 - RNA, 64 nt, hsa
agugauccucccaccucagccucucaaguagcugggacuacaggcaugugccaccacaccuaau

SEQ ID NO: 199420 - RNA, 64 nt, hsa
agcaguccaucugccucagccucccaaagugcugggacuacagacaugagccauugugccugac

SEQ ID NO: 199421 - RNA, 64 nt, hsa
ucaugccauucugccucagccuccugaguagcugggacuacaggcgcccgccaccacgcccggc

SEQ ID NO: 199422 - RNA, 64 nt, hsa
agcgauucuccugucucagccuccugaguagaugggacuacaggcacaggccauuaugccuggc

SEQ ID NO: 199423 - RNA, 64 nt, hsa
agcgauucuugugccucagccuccuaagcagcugggacuacaggcgcaugcaaccauacccagc

SEQ ID NO: 199424 - RNA, 64 nt, hsa
guggggaguguuuuuguaucacaaagauuagagaggacuacacaucagggcuugauuuauuguu

SEQ ID NO: 199425 - RNA, 64 nt, hsa
agcaauucuccugccucagccucccaaguagcugggacuacaggcaugcaccaccacacuuggc

SEQ ID NO: 199426 - RNA, 64 nt, hsa
agagauucuccugccucagccucccgaguagcugggacuacaggcgugugccaccaugccuggc

SEQ ID NO: 199427 - RNA, 64 nt, hsa
auagugguauuuuaacauagcagcugguuaaccgggacuacagaaguggaaggauaaugagaug

SEQ ID NO: 199428 - RNA, 64 nt, hsa
gaugguagaaacuuuggaaguuuuacuugauuaaggacuacagaauugggcccuuagaauguga

SEQ ID NO: 199429 - RNA, 64 nt, hsa
cgcacucuuaagacugaaaauuggcguugaguguuauagugaaaauuuuccaguuugauaauug

SEQ ID NO: 199430 - RNA, 64 nt, hsa
auauguugaaggagguauaauaaacucagucauauauagugaacaguucaaaugggaaaguguu

SEQ ID NO: 199431 - RNA, 64 nt, hsa
ugcucuguaagagcuuuacauuucugagauuuuguauagugauugagaugucuauuuuauuauu

SEQ ID NO: 199432 - RNA, 64 nt, hsa
aaaaaacagguuuuagaaaugaucuuagaucuaauauagugauuuuaagcaucccgucaaaggc

SEQ ID NO: 199433 - RNA, 64 nt, hsa
acuuaauuuucuuaauuuauucuuuccuuucaauuauagugacauagaguaguuggccuuauaa

SEQ ID NO: 199434 - RNA, 64 nt, hsa
gcuuuuuucuucguuguucccaagucauguaauguauagugaauuuauccaaaacgccauugua

SEQ ID NO: 199435 - RNA, 64 nt, hsa
guccuugauacugaguugggaccagacuggcuuuuauagugacaggcaaagaggaauuuauuga

SEQ ID NO: 199436 - RNA, 64 nt, hsa
cuuucuuaauuuacgauuuuuuauuauaaaaauguauagugauacaaugggacaugugaagaau

SEQ ID NO: 199437 - RNA, 62 nt, hsa
acauaaaagugcucuccugccugggcagcaacaaccaagaacaaagccccgggacuguuuuc

SEQ ID NO: 199438 - RNA, 62 nt, hsa
auuaaaaagcugcguugguaaguuuuucauggaaccaagauuugacaaaggcaucucuuauc

SEQ ID NO: 199439 - RNA, 62 nt, hsa
auguucacauugcuuuaccaguuuggcacuggaaccaagagcacaugucguggcuggcuaca

SEQ ID NO: 199440 - RNA, 62 nt, hsa
gugauuuagauaucuaucuaucuagauuucugaaccaagauauauuuauaguucacuuuugg

SEQ ID NO: 199441 - RNA, 62 nt, hsa
cccuggcucagaggauagcgguuuccaucauaaaccaagaugaugaguucagccuuuauccc

SEQ ID NO: 199442 - RNA, 62 nt, hsa
cccugggucagaggauagcgguuuccaucauaaaccaagaugaugaguucagccuuuauccc

SEQ ID NO: 199443 - RNA, 62 nt, hsa
gucagccugucugacauccagguugugcuauuaaccaagaaggaaacagauacuuggaggcu

SEQ ID NO: 199444 - RNA, 62 nt, hsa
uugcuugaacccgggagguggagguugcagugaaccaagaucgcggcgcugcacucuagccu

SEQ ID NO: 199445 - RNA, 62 nt, hsa
ucauucagaaaacuuuauaaucgucauuguucaaccaagauuuugaauguaauaagaugaau

SEQ ID NO: 199446 - RNA, 62 nt, hsa
ggaggggucuggggaccaugguauaaagaggaaaccaagaaaaagaagccaagcaaaaauca

SEQ ID NO: 199447 - RNA, 62 nt, hsa
cagguuuucuugucuugacaagaugcuugaaaaaccaagaggauaugaaaaucugucucugg

SEQ ID NO: 199448 - RNA, 62 nt, hsa
uuacuucuuauaaauugaagucuuaaaugugaaaccaagaaauguaaucaagcaguaaaaac

SEQ ID NO: 199449 - RNA, 62 nt, hsa
gacaggagggagaagaaaaaacaaaacacuugaaccaagaaacucaaauguaauccuacgau

SEQ ID NO: 199450 - RNA, 62 nt, hsa
ccccaaauaaacauugcuuuauuucuaauaauaaccaagacuuuucaagcuucuagaucuca

SEQ ID NO: 199451 - RNA, 62 nt, hsa
augugcaagaaaaugagggcuugagucgccugaaccaagagcaggaagagguugcuggagca

SEQ ID NO: 199452 - RNA, 58 nt, hsa
ggaagaaaaugagggcuugagucaccugaaccaagagcaggaagagguugcucagguu

SEQ ID NO: 199453 - RNA, 62 nt, hsa
gagaaagcucaugggcaagaaacucuaugaauaaccaagauggagccgggugcaguugccaa

SEQ ID NO: 199454 - RNA, 62 nt, hsa
ugugagagauugagacacucuaaauaaauaauaaccaagaugggaaauuucccugccagacc

SEQ ID NO: 199455 - RNA, 62 nt, hsa
ugccuuuccccagggaauccucuccagaucuuaaccaagagccccuugcaaacuucuucgac

SEQ ID NO: 199456 - RNA, 62 nt, hsa
gauauuuccuccaggaaucguguuucaauuguaaccaagaaauuuccauuugugcuucauga

SEQ ID NO: 199457 - RNA, 55 nt, hsa
uaggugaagggcaacuauagguuuaaaccaagacaaaugaagacugaaaccaaga

SEQ ID NO: 199458 - RNA, 62 nt, hsa
uauagguuuaaaccaagacaaaugaagacugaaaccaagaauauuguucuuaugcuggaaau

SEQ ID NO: 199459 - RNA, 64 nt, hsa; identical to SEQ ID NO: 76092

SEQ ID NO: 199460 - RNA, 64 nt, hsa; identical to SEQ ID NO: 76093

SEQ ID NO: 199461 - RNA, 64 nt, hsa; identical to SEQ ID NO: 76094

SEQ ID NO: 199462 - RNA, 64 nt, hsa; identical to SEQ ID NO: 76095

SEQ ID NO: 199463 - RNA, 64 nt, hsa; identical to SEQ ID NO: 76096

SEQ ID NO: 199464 - RNA, 64 nt, hsa; identical to SEQ ID NO: 76097

SEQ ID NO: 199465 - RNA, 64 nt, hsa; identical to SEQ ID NO: 76098

SEQ ID NO: 199466 - RNA, 64 nt, hsa; identical to SEQ ID NO: 76099

SEQ ID NO: 199467 - RNA, 64 nt, hsa; identical to SEQ ID NO: 76100

SEQ ID NO: 199468 - RNA, 64 nt, hsa; identical to SEQ ID NO: 76101

SEQ ID NO: 199469 - RNA, 64 nt, hsa; identical to SEQ ID NO: 76102

SEQ ID NO: 199470 - RNA, 64 nt, hsa; identical to SEQ ID NO: 76103

SEQ ID NO: 199471 - RNA, 53 nt, hsa; identical to SEQ ID NO: 76104

SEQ ID NO: 199472 - RNA, 64 nt, hsa; identical to SEQ ID NO: 76105

SEQ ID NO: 199473 - RNA, 64 nt, hsa; identical to SEQ ID NO: 76106

SEQ ID NO: 199474 - RNA, 64 nt, hsa; identical to SEQ ID NO: 76107

SEQ ID NO: 199475 - RNA, 64 nt, hsa; identical to SEQ ID NO: 76108

SEQ ID NO: 199476 - RNA, 64 nt, hsa; identical to SEQ ID NO: 76109

SEQ ID NO: 199477 - RNA, 64 nt, hsa; identical to SEQ ID NO: 76110

SEQ ID NO: 199478 - RNA, 64 nt, hsa; identical to SEQ ID NO: 76111

SEQ ID NO: 199479 - RNA, 64 nt, hsa
ggauggacucuucucggcucaggcucugcugguggaaagcgauucacuguauaaacuuuuuuuu

SEQ ID NO: 199480 - RNA, 64 nt, hsa
ggaggguggggucccuuuguugccaagacguuaggaaagcgaggaaagugcuuggauuaggaga

SEQ ID NO: 199481 - RNA, 64 nt, hsa
uggggagcagggcugugacucuggcugagcccaggaaagcgacaagggugaacugggagaggac

SEQ ID NO: 199482 - RNA, 64 nt, hsa
uuucacaagacuuauuuuaaugacaauguagcuugaaagcgaugaagaaugucucuagaagaga

SEQ ID NO: 199483 - RNA, 64 nt, hsa
acaugaaaggaaaauuaguuguguauuucacgacgaaagcgacggaccaaaagaaauuuccugc

SEQ ID NO: 199484 - RNA, 64 nt, hsa
uuauuggcaagauugcaaugauuauggaaaaauagaaagcgaauacucaguuuaagccaaggaa

SEQ ID NO: 199485 - RNA, 64 nt, hsa
auguuccuauauauuacaacaucggcgaggaaaugaaagcgauucuccuugaguucugaugaau

SEQ ID NO: 199486 - RNA, 64 nt, hsa
ucauaguaagacacacgagaccaggcuuuaccaugaaagcgaccugucacggacuccacuuuua

SEQ ID NO: 199487 - RNA, 64 nt, hsa
cguuuuaaaucugcucaagauaaaauguaacuuggaaagcgaggaaacacuaaacauguuuuua

SEQ ID NO: 199488 - RNA, 64 nt, hsa
gguucauaccaugggggaaaaaaaaguccuaggagaaagcgacguggcucauuaguguugccuc

SEQ ID NO: 199489 - RNA, 64 nt, hsa
aaaugaguggugaaauaauguuuggagacauaaugaaagcgauuaacauuuggcaaaauauaau

SEQ ID NO: 199490 - RNA, 64 nt, hsa
aauaugacauuuuauguagcacuuuauaaaaagugaaagcgacaaauuccaccgcugcuuaaua

SEQ ID NO: 199491 - RNA, 64 nt, hsa
uaaauauugguguuuguuucugacauuuuaacuugaaagcgauaugcugcaagauaauguauuu

SEQ ID NO: 199492 - RNA, 64 nt, hsa
uuauaaauacuggaacaaauccugcugcaaaaaugaaagcgaucagacugucuucuguucaaga

SEQ ID NO: 199493 - RNA, 64 nt, hsa
uguuuucacacgugucucuucucuucgacuuccugaaagcgaaagcuuuaccuccugcaaaugu

SEQ ID NO: 199494 - RNA, 64 nt, hsa
agaaaacuauuaucaguuguuauuguuaucccuugaaagcgagggugacaaaaacaacaaaaca

SEQ ID NO: 199495 - RNA, 64 nt, hsa
gguuggcuuuauuuaaaagcuagugaccuaaauagaaagcgaacuucaagagaaguuguaagua

SEQ ID NO: 199496 - RNA, 64 nt, hsa
uaguuucuguuaagggaauucucucaaacaaaaggaaagcgauuuuucucaaugcuucuaauau

SEQ ID NO: 199497 - RNA, 64 nt, hsa
uugaagccaaaaugguacaccgauauuuaagaaggaaagcgaauccaaacgguugugaucuaaa

SEQ ID NO: 199498 - RNA, 64 nt, hsa
gaauacauuucuaauuaaaaucuucaaugaacaggaaagcgacaucuccauucuccaagggcaa

SEQ ID NO: 199499 - RNA, 64 nt, hsa
uuggcuucacuccugcagcacaaugcuggcccuagaaagcgagcauuuucauucuucccauggc

SEQ ID NO: 199500 - RNA, 64 nt, hsa
aaagagagaaagaaagaaacagaaaaaccuaaaagaaagcgaaugaauuugacaccuguugguu

SEQ ID NO: 199501 - RNA, 64 nt, hsa
gcccccgcgagacggguuagggaaagcggaggaggaaagcgaggggguggggggcuucccggga

SEQ ID NO: 199502 - RNA, 64 nt, hsa
cagcugucuccugggguggguugguauuaaagaggaaagcgauuuuuuggauaaugugucugga

SEQ ID NO: 199503 - RNA, 64 nt, hsa
cuuguuguuuuucucuuugcaaagacauagcuaggaaagcgaaugauaagggaaaaguucucag

SEQ ID NO: 199504 - RNA, 64 nt, hsa
acuugaaagguugccuggacucgcuggagcaaaggaaagcgauuuuguuuguauaauuaaauga

SEQ ID NO: 199505 - RNA, 64 nt, hsa
ggaguacgguguacuggcccagcuuacagaugcagaaagcgagacguucugccaucagauaaag

SEQ ID NO: 199506 - RNA, 64 nt, hsa
ugucugcagguguuaguggugugcuaaaagcaaggaaagcgaguuagucuuuucagugucuuuu

SEQ ID NO: 199507 - RNA, 64 nt, hsa
uccugugauuaauuuugugaugacuaaaaugcuggaaagcgagugaguugcccauuaauuauga

SEQ ID NO: 199508 - RNA, 64 nt, hsa
aaagaaacagggcguggggcgcacuuuuaaaagagaaagcgagacaggcccguggacagugauu

SEQ ID NO: 199509 - RNA, 64 nt, hsa
ugcuguugaucggucuccuaggcuaaaugagaaugaaagcgacuucaggucagguggcuguggg

SEQ ID NO: 199510 - RNA, 64 nt, hsa
acacgaggcuccuugugucaagcuuccugugauggaaagcgaccucuccaaccaccacacuccc

SEQ ID NO: 199511 - RNA, 64 nt, hsa
cccgaaaaacacaagaccgacccaaaaucuagaggaaagcgaaaagcugcuccccacccccuuu

SEQ ID NO: 199512 - RNA, 64 nt, hsa
caccucauguaccuacgccacagacagccagagggaaagcgacccagacagcagccccuccucg

SEQ ID NO: 199513 - RNA, 64 nt, hsa
caaggaaggaggcaaagagcuacugaguaacgaugaaagcgaggcugcaggacugaagaagucg

SEQ ID NO: 199514 - RNA, 64 nt, hsa
ugggggcggggccucuucauuggcccagcuuggcgaaagcgaggcacacugcuuacugccuugg

SEQ ID NO: 199515 - RNA, 64 nt, hsa
gaugaggguuagccauaguauucuuugcaaaugugaaagcgagacauuauaucuucucuugcuu

SEQ ID NO: 199516 - RNA, 64 nt, hsa
uccucagcaaugugaagaaucaaagucagggcaagaaagcgaaagcuuggacuucuauucaaag

SEQ ID NO: 199517 - RNA, 64 nt, hsa
agccuucuuuggacuugauuuggaacuuagccuggaaagcgaaaguggacuguccaacagaaag

SEQ ID NO: 199518 - RNA, 64 nt, hsa
aaagugacgaguguggcagagagugugcaugugagaaagcgagagaaagaggaacugaaggacg

SEQ ID NO: 199519 - RNA, 64 nt, hsa
ggcaagaacaguugcuuaaagaguuaaggacauugaaagcgacauaaauagucacuuuaaaaag

SEQ ID NO: 199520 - RNA, 56 nt, hsa
gucucacggcagcacgaugaagacuggaaagcgacggguaaugcggcauugaugcu

SEQ ID NO: 199521 - RNA, 64 nt, hsa
cuguuuugcugcuuguugcaugcacacaggaauggaaagcgagcuccuuuuccccuuccccagc

SEQ ID NO: 199522 - RNA, 63 nt, hsa
ggcugccagcuggaaccugaaguugucagcucagaaagcgaccuugcccccgccugggucccu

SEQ ID NO: 199523 - RNA, 64 nt, hsa
agcaucccccagauccaagccugggggaucccgggaaagcgauggacagacagacgauggggcc

SEQ ID NO: 199524 - RNA, 64 nt, hsa
uauuuaaauuuccuagguuuucaugaaaaagcuggaaagcgaucagcaucaagggcuuugcuuc

SEQ ID NO: 199525 - RNA, 64 nt, hsa
gaucuagugccauuauuucuaccauuaaaaucuugaaagcgaaauacuugaaaagaggugacca

SEQ ID NO: 199526 - RNA, 64 nt, hsa
aaaggucuuaucugaaagguaagaaauaaacaaugaaagcgaugaggggaccauuuacauaaaa

SEQ ID NO: 199527 - RNA, 64 nt, hsa
agaguucuccccaaaacccuagcucuuuacccuuccauuuuagccuuccacccagcuuccacaa

SEQ ID NO: 199528 - RNA, 64 nt, hsa
gggauuacaggcaugagccaccaugccagacuucccauuuuacuuucugcaagcuguuucccua

SEQ ID NO: 199529 - RNA, 64 nt, hsa
uuuccaauuucauugguuuucucuaaacagugcuccauuuuauuuuguugguguuucagauggg

SEQ ID NO: 199530 - RNA, 64 nt, hsa
gacauacguugguuuugagggcuauucagccauuccauuuuacucucuauuuaaaggccgugag

SEQ ID NO: 199531 - RNA, 64 nt, hsa
uucaacuuguagauacaucaacuuugaaauuauuccauuuuauaccugaccaaaacauguucug

SEQ ID NO: 199532 - RNA, 64 nt, hsa
aucaaauauuuacauauugcuuaucacuuuuucuccauuuuaauaauggaaugaacuaaaauaa

SEQ ID NO: 199533 - RNA, 64 nt, hsa
uaugaaaacuuaaagguauauauucaauuuuuuaccauuuuauggaaaauauuuaaaaucuguu

SEQ ID NO: 199534 - RNA, 64 nt, hsa
gguaacauauacauagccacauuuacaguuuuaaccauuuuaaggcauguaauucagugggguu

SEQ ID NO: 199535 - RNA, 64 nt, hsa
gacaagugggcagcauaaagucacucauuucuuaccauuuuauuccccucaauucucaauauau

SEQ ID NO: 199536 - RNA, 64 nt, hsa
ucagggaaauaugaauuaggaccacaaugagauuccauuuuauauccauaagauuugcaaaggu

SEQ ID NO: 199537 - RNA, 64 nt, hsa
aacaaaauacaggacaucaaauauuagccauuucccauuuuauuuuauuuuucuauguagguuc

SEQ ID NO: 199538 - RNA, 64 nt, hsa
cagagcaaccauaugagcauuguaauuaauauucccauuuuacagaugaggaaacugaagcuaa

SEQ ID NO: 199539 - RNA, 64 nt, hsa
uugccuuuaacuuuucuuauccaggggaaaauugccauuuuagggucagcaugaacagcucuuu

SEQ ID NO: 199540 - RNA, 64 nt, hsa
cuccagggguccugaugcugucaugcucagugagccauuuuacaguucuccaaagucuagcccu

SEQ ID NO: 199541 - RNA, 64 nt, hsa
gacugaaggcucucagacugggaaagaaacuuacccauuuuaaaauucagcauugcucaacuua

SEQ ID NO: 199542 - RNA, 64 nt, hsa
cauguaaauacaaguugguacaaaucaauagaaaccauuuuaccuacauaggcaaaguaaaugu

SEQ ID NO: 199543 - RNA, 64 nt, hsa
uuucgauuagaagaagcugcaaaagaaaggcagcccauuuuaccauugccagccaggccgggga

SEQ ID NO: 199544 - RNA, 64 nt, hsa
agauugaggugauucagauagguuugcgaauauaccauuuuauauuguugagaaagaacaaaaa

SEQ ID NO: 199545 - RNA, 64 nt, hsa
aaaggccaucugcuuggagcacagaaagauauugccauuuuacagcuuaagagaguaaggccuu

SEQ ID NO: 199546 - RNA, 64 nt, hsa
aaguaaagcccuuccgggucgcucuccuucgauuccauuuuaccuccucuucugaucacuucca

SEQ ID NO: 199547 - RNA, 64 nt, hsa
cuugacuucuuaggauggguagcugaaaagaccaccauuuuaagcauuugagaauucuuaaaua

SEQ ID NO: 199548 - RNA, 64 nt, hsa
auuauuaguuuugcaagaucacacacuaauguaaccauuuuaugaagguugaaguggauuuaug

SEQ ID NO: 199549 - RNA, 64 nt, hsa
ggugugcaguguuuuuccuguguauuaaaccuuuccauuuuacguuuuagaaaauuuuauguau

SEQ ID NO: 199550 - RNA, 64 nt, hsa
auuaaaggugaaaauuguauaaauuacuuugauuccauuuuaaguggagacauauuucagugau

SEQ ID NO: 199551 - RNA, 64 nt, hsa
gggauaacagugugccugguuaauauuaauauucccauuuuauuaauaauauuuauguuggguc

SEQ ID NO: 199552 - RNA, 64 nt, hsa
gggaagauuuuaguucacacuuagucuaacucccccauuuuacagauuucucacuauauauauu

SEQ ID NO: 199553 - RNA, 64 nt, hsa
cguauuucuuuuuccuuguaaauguaaucagaugccauuuuauauguggacguauuuauacugg

SEQ ID NO: 199554 - RNA, 64 nt, hsa
uuuuuuuuuuuuuugguaguuguuguuacccacgccauuuuacgucuccuucacugaagggcua

SEQ ID NO: 199555 - RNA, 64 nt, hsa
aauuauuuuguuguuacguuuuggugaguuauacccauuuuauuuauuuagaaaaauaguaucu

SEQ ID NO: 199556 - RNA, 64 nt, hsa
aauuguuuuugagauauaaagacccugaaaaagcccauuuuagaaccuguuuaauaagagcaaa

SEQ ID NO: 199557 - RNA, 64 nt, hsa
ucucaguuagaaguguucuauauuucuuuuugcuccauuuuagugcgcugugcuuuguauaagu

SEQ ID NO: 199558 - RNA, 64 nt, hsa
uguuuggaaagaugugugaauacuuaauuuuuauccauuuuauggaaauuagcuuagcaauuuu

SEQ ID NO: 199559 - RNA, 64 nt, hsa
gauacaagauuucuuacaugcauguauuaaauggccauuuuaaaauuagcuaguuucaugcuca

SEQ ID NO: 199560 - RNA, 64 nt, hsa
uuguuuuuuguuuguuuguuuguuuuuuuaauggccauuuuauuuuauuuguauuuauaguuuu

SEQ ID NO: 199561 - RNA, 64 nt, hsa
uauauaaauacauauuugccauuuuaaacauuuaccauuuuaaccauuuuuaaguguacaguuc

SEQ ID NO: 199562 - RNA, 64 nt, hsa
cucuauugugguaaaauauauaaauacauauuugccauuuuaaacauuuaccauuuuaaccauu

SEQ ID NO: 199563 - RNA, 64 nt, hsa
uauuuaugaacauauuucuuaauaagaaaaauauccauuuuauuaccauuuucuaucuuuuuca

SEQ ID NO: 199564 - RNA, 64 nt, hsa
gcucugcucuauuuauuauuauuuugcaaaauaaccauuuuaacauuugauaaagcauauuuau

SEQ ID NO: 199565 - RNA, 64 nt, hsa
cucaguacuuugcagaaaacaccaaacaaaaaugccauuuuaaaaaagguguauuuuuucuuuu

SEQ ID NO: 199566 - RNA, 64 nt, hsa
gcugcagaaguguuccuuuagacaaaguugugacccauuuuacucuggauaagggcagaaacgg

SEQ ID NO: 199567 - RNA, 64 nt, hsa
ggauuacaggcgugagccacugcgccuggccagaccauuuuagaauugggaaauuuuagugaga

SEQ ID NO: 199568 - RNA, 64 nt, hsa
ggauuuacugaauaagguguugaccaaauccagaccauuuuauuuuauuuuuuuauuuauuuau

SEQ ID NO: 199569 - RNA, 64 nt, hsa
uucagaguaacgucaguggcuuaggguuaaacggccauuuuauucaaaugcuugcuauacaauc

SEQ ID NO: 199570 - RNA, 64 nt, hsa
gaaauuuuguauuuuuguauaacuugauugugugccauuuuauauaacagguccuguuuuacaa

SEQ ID NO: 199571 - RNA, 64 nt, hsa
cucccaagccccaagagguguaccuuuucagaugccauuuuacaggcggaaaugcuccaugaaa

SEQ ID NO: 199572 - RNA, 64 nt, hsa
cccgcuuacagcagcaacacaggagaucaucuguccauuuuagaaccauuaaucucuuuaucca

SEQ ID NO: 199573 - RNA, 64 nt, hsa
cugggauuacaggcgugagccaccgcgcccagccccauuuuauuuuuuacuuuaaaugccugcc

SEQ ID NO: 199574 - RNA, 64 nt, hsa
ugggauuacagacaugagccacugugcccggcccccauuuuauuuuaguuuuauuuugagacag

SEQ ID NO: 199575 - RNA, 64 nt, hsa
cuagacuggcaagggccuccacaguguggaggucccauuuuauuauuuuuuuuuuucgagacac

SEQ ID NO: 199576 - RNA, 64 nt, hsa
aagccugagaagucacuuuggaacuaaauugccuccauuuuauuuuguacgaguaaggguuuga

SEQ ID NO: 199577 - RNA, 64 nt, hsa
aacaugcaaacagccuacuucuucaugaacaauuccauuuuauugacugaacuuuucucauauu

SEQ ID NO: 199578 - RNA, 64 nt, hsa
gcuccaggagcaugagaauugauccccagaagaaccauuuuaacuccaucugauacuccauugc

SEQ ID NO: 199579 - RNA, 64 nt, hsa
agcagggagaaauauuaacuuuuuuaacccuuuaccauuuuaaauacuaacugggucuuucaga

SEQ ID NO: 199580 - RNA, 64 nt, hsa
auuuccauugaagcuuguuuucuuuuuuuucuucccauuuuagcuacugcagugcuuuuguuuc

SEQ ID NO: 199581 - RNA, 64 nt, hsa
uguaaaaauuuuauauauauguauuuaaaaugugccauuuuauugcuaagugaaguauguccug

SEQ ID NO: 199582 - RNA, 64 nt, hsa
uuucuaucagcuagauaauuugcauauuuuauccccauuuuacugcaaaguugacaagcucagg

SEQ ID NO: 199583 - RNA, 64 nt, hsa
aaccacucuugagaaguaauuuuuauuuucagaaccauuuuacagauuuaaaauaaacagguuu

SEQ ID NO: 199584 - RNA, 64 nt, hsa
aaguuucuuuuuaaaaauuuuccaaaacuuuucuccauuuuaaaaagcccuguuauaaacguug

SEQ ID NO: 199585 - RNA, 64 nt, hsa
ugaauggauuuuuccauacucaucuacaauuccuccauuuuaaaugacuacuuuuauuuuuuaa

SEQ ID NO: 199586 - RNA, 64 nt, hsa
guaguuuaaguuuccuugugauuagucaaaaauaccauuuuaguaugaagcaaugaagucuauu

SEQ ID NO: 199587 - RNA, 64 nt, hsa
uauuuuacacaugucaagggauuacuuauaacuuccauuuuauuacuaauagcuugaacccuuu

SEQ ID NO: 199588 - RNA, 64 nt, hsa
gauuguuuacuuuccuuuuauaaaauuauacucuccauuuuagcaaaacagcuuucccucauca

SEQ ID NO: 199589 - RNA, 64 nt, hsa
cccuuaauauuuuuugucuguaaauauguuguuaccauuuuauuggcuuuauaguauucaccug

SEQ ID NO: 199590 - RNA, 64 nt, hsa
cugacuccaacuucucuuucacccucuaugagucccauuuuacuucuacaccugcaaguccugg

SEQ ID NO: 199591 - RNA, 64 nt, hsa
cugcuucaccuuugaccucugccccccaugaaucccauuuuaccucuagaccuauaaguucugg

SEQ ID NO: 199592 - RNA, 64 nt, hsa
uuaacacuuuaauuacagaucuuagugauacauaccauuuuaucugucucaagcucuaccuucc

SEQ ID NO: 199593 - RNA, 64 nt, hsa
gacaaccuugacuguucuguucugucuucucuguccauuuuagguggcacaauguaaguggcag

SEQ ID NO: 199594 - RNA, 64 nt, hsa
uaguagagauuucauagcuauuuagagauauuuuccauuuuaagaaaacccgacaacauuucug

SEQ ID NO: 199595 - RNA, 64 nt, hsa
aauguuugggaauggugcccuuggaggcaaccucccauuuuagauguuuaaaggacccuauaug

SEQ ID NO: 199596 - RNA, 64 nt, hsa
cccacaucucugggauuugaauggggauuguaucccauuuuacugucuuuuagguuuacauuua

SEQ ID NO: 199597 - RNA, 64 nt, hsa
uuguggccuuuuagacuuuuguugcccuaaaauuccauuuuauugggaacccauuuuccaccug

SEQ ID NO: 199598 - RNA, 64 nt, hsa
auggauagcucagagguauccucuuuuugcucccccauuuuaacuugccacaucccagucacag

SEQ ID NO: 199599 - RNA, 64 nt, hsa
guaacacagucuggcaguugcuaaauuuguguucccauuuuaaauugaccaauuuuggggugug

SEQ ID NO: 199600 - RNA, 64 nt, hsa
auguacucuuagaggaggccaguaaugaucagaaccauuuuacuuuaaaauuaauaauauugua

SEQ ID NO: 199601 - RNA, 64 nt, hsa
uaaauaauuuacucucuacuuuuauccauuuuauccauuuuaacucauguaauccucaugugag

SEQ ID NO: 199602 - RNA, 64 nt, hsa
gauaaaguuuaaauaauuuacucucuacuuuuauccauuuuauccauuuuaacucauguaaucc

SEQ ID NO: 199603 - RNA, 64 nt, hsa
uuuuaacagcaagaauuuuaagaaaagauaaacaccauuuuauuuauuuauaaaaacaaaauua

SEQ ID NO: 199604 - RNA, 64 nt, hsa
ucggcugauguuacucucacuugaugugguuaaaccauuuuagagguagagaagacagacaguu

SEQ ID NO: 199605 - RNA, 64 nt, hsa
uugcaaauugagauuaaaauuauuugggguuuuguaacaauauaauuuugcuuuuguauuauag

SEQ ID NO: 199606 - RNA, 64 nt, hsa
uuaggaaacuaacuagaucucaauugagagcacauaacaauagaugauaccaaauacuuuuugu

SEQ ID NO: 199607 - RNA, 64 nt, hsa
cguaaauacucaggauuggagcugcuuguaaguauaacaauauacagaauaacuuuauuuuauc

SEQ ID NO: 199608 - RNA, 64 nt, hsa
aaauuaaaccuaugcucucaauucuuuuauauucuaacaauaaauaaaaaagaaaagauuacug

SEQ ID NO: 199609 - RNA, 64 nt, hsa
aaagagcaauugauaaaguaaaugagguaaaauuuaacaauaaucugagcaaaagguauaugug

SEQ ID NO: 199610 - RNA, 64 nt, hsa
agagagcaauugauaaggcaaauaagguaacauuuaacaauaaucugauacacauaaauagaga

SEQ ID NO: 199611 - RNA, 64 nt, hsa
aaacaaauuuguuuuuuaagguuaaggccaaauguaacaauaaaacccugucgaugguuuuagc

SEQ ID NO: 199612 - RNA, 64 nt, hsa
cuucuaaacaguauauucuaaaaagucaaaacguuaacaauaguuuuuaucuaauaaaagcacu

SEQ ID NO: 199613 - RNA, 64 nt, hsa
ggcaggggauuacguuaugaaaacuaaccauguguaacaauaaaucuaccuuagcagaaaaagu

SEQ ID NO: 199614 - RNA, 64 nt, hsa
cuccaacagacccgucugaagggguauuuuuuuuuaacaauaauguuuguaacauuuuguugug

SEQ ID NO: 199615 - RNA, 64 nt, hsa
uucaaaaccaaggaagcagccucagaguggucgagugacacaccucacgcaggcugaguccaga

SEQ ID NO: 199616 - RNA, 64 nt, hsa
gcuuguaaucaagccuuuauggcugcugggcugagugacacaagcacuuuaauggccuggaggg

SEQ ID NO: 199617 - RNA, 64 nt, hsa
cacuuuggaccuuacgaucaggcacaggucaggggugacacagacucauccugaacagcauggc

SEQ ID NO: 199618 - RNA, 64 nt, hsa
cccuccagcacaaacacaaggucauggccacacugugacacacuacaccacacacaacagccaa

SEQ ID NO: 199619 - RNA, 64 nt, hsa
gcagcuccccugccuccaggacccuguugcuauggugacacagcguuucuaggacagaggggcc

SEQ ID NO: 199620 - RNA, 64 nt, hsa
guucuuugcacgccaagucucuugguuguaccaugugacacacccugugcacuggucgcugucu

SEQ ID NO: 199621 - RNA, 64 nt, hsa
uauuuuaacaaaccuguccuugauauuaguuaaggugacacauaagggugacacagaaugugua

SEQ ID NO: 199622 - RNA, 64 nt, hsa
cuguccuugauauuaguuaaggugacacauaagggugacacagaauguguaaugcaaauuucau

SEQ ID NO: 199623 - RNA, 64 nt, hsa
aguggaggugauuuacugcugaauuaaaacucaagugacacaaguuacaaguugauaucguuga

SEQ ID NO: 199624 - RNA, 64 nt, hsa
aggguaccuuuuuggggagaugggguggccugcagugacacagaaaggaagaaacuagcggugu

SEQ ID NO: 199625 - RNA, 64 nt, hsa
acggguaucccaucccgaucugccucccagaacugugacacacugggcucugcccucauuuucu

SEQ ID NO: 199626 - RNA, 64 nt, hsa
gaucaugccaccaugccacugcacuccagccugggugacacagccaaaaaaaaaaccacuaagu

SEQ ID NO: 199627 - RNA, 64 nt, hsa
acuuuggaccaucacacacauuucagcauuugaagugacacaagcuaccugguaacugcccaug

SEQ ID NO: 199628 - RNA, 64 nt, hsa
uuggaggaauguacuguauuuaaaaaaaccuucugugacacauucaaaaauuucaucugagcug

SEQ ID NO: 199629 - RNA, 64 nt, hsa; identical to SEQ ID NO: 161976

SEQ ID NO: 199630 - RNA, 64 nt, hsa; identical to SEQ ID NO: 161977

SEQ ID NO: 199631 - RNA, 64 nt, hsa; identical to SEQ ID NO: 161978

SEQ ID NO: 199632 - RNA, 64 nt, hsa; identical to SEQ ID NO: 161979

SEQ ID NO: 199633 - RNA, 64 nt, hsa; identical to SEQ ID NO: 161980

SEQ ID NO: 199634 - RNA, 64 nt, hsa; identical to SEQ ID NO: 161981

SEQ ID NO: 199635 - RNA, 64 nt, hsa; identical to SEQ ID NO: 161982

SEQ ID NO: 199636 - RNA, 64 nt, hsa; identical to SEQ ID NO: 161983

SEQ ID NO: 199637 - RNA, 64 nt, hsa; identical to SEQ ID NO: 161984

SEQ ID NO: 199638 - RNA, 64 nt, hsa; identical to SEQ ID NO: 161985

SEQ ID NO: 199639 - RNA, 64 nt, hsa; identical to SEQ ID NO: 161986

SEQ ID NO: 199640 - RNA, 64 nt, hsa; identical to SEQ ID NO: 161987

SEQ ID NO: 199641 - RNA, 64 nt, hsa; identical to SEQ ID NO: 161988

SEQ ID NO: 199642 - RNA, 64 nt, hsa; identical to SEQ ID NO: 161989

SEQ ID NO: 199643 - RNA, 64 nt, hsa; identical to SEQ ID NO: 161990

SEQ ID NO: 199644 - RNA, 64 nt, hsa; identical to SEQ ID NO: 161991

SEQ ID NO: 199645 - RNA, 64 nt, hsa; identical to SEQ ID NO: 161992

SEQ ID NO: 199646 - RNA, 64 nt, hsa; identical to SEQ ID NO: 161993

SEQ ID NO: 199647 - RNA, 64 nt, hsa; identical to SEQ ID NO: 161994

SEQ ID NO: 199648 - RNA, 64 nt, hsa; identical to SEQ ID NO: 161995

SEQ ID NO: 199649 - RNA, 64 nt, hsa; identical to SEQ ID NO: 161996

SEQ ID NO: 199650 - RNA, 64 nt, hsa; identical to SEQ ID NO: 161997

SEQ ID NO: 199651 - RNA, 64 nt, hsa; identical to SEQ ID NO: 161998

SEQ ID NO: 199652 - RNA, 64 nt, hsa; identical to SEQ ID NO: 161999

SEQ ID NO: 199653 - RNA, 64 nt, hsa; identical to SEQ ID NO: 162000

SEQ ID NO: 199654 - RNA, 64 nt, hsa; identical to SEQ ID NO: 162001

SEQ ID NO: 199655 - RNA, 64 nt, hsa; identical to SEQ ID NO: 162002

SEQ ID NO: 199656 - RNA, 64 nt, hsa; identical to SEQ ID NO: 162003

SEQ ID NO: 199657 - RNA, 64 nt, hsa; identical to SEQ ID NO: 162004

SEQ ID NO: 199658 - RNA, 64 nt, hsa; identical to SEQ ID NO: 162005

SEQ ID NO: 199659 - RNA, 64 nt, hsa; identical to SEQ ID NO: 162006

SEQ ID NO: 199660 - RNA, 64 nt, hsa; identical to SEQ ID NO: 162007

SEQ ID NO: 199661 - RNA, 64 nt, hsa; identical to SEQ ID NO: 162008

SEQ ID NO: 199662 - RNA, 64 nt, hsa; identical to SEQ ID NO: 199006

SEQ ID NO: 199663 - RNA, 64 nt, hsa; identical to SEQ ID NO: 199007

SEQ ID NO: 199664 - RNA, 64 nt, hsa; identical to SEQ ID NO: 199008

SEQ ID NO: 199665 - RNA, 64 nt, hsa; identical to SEQ ID NO: 199009

SEQ ID NO: 199666 - RNA, 64 nt, hsa; identical to SEQ ID NO: 199010

SEQ ID NO: 199667 - RNA, 64 nt, hsa; identical to SEQ ID NO: 199011

SEQ ID NO: 199668 - RNA, 64 nt, hsa; identical to SEQ ID NO: 199012

SEQ ID NO: 199669 - RNA, 64 nt, hsa; identical to SEQ ID NO: 199013

SEQ ID NO: 199670 - RNA, 64 nt, hsa; identical to SEQ ID NO: 199014

SEQ ID NO: 199671 - RNA, 64 nt, hsa; identical to SEQ ID NO: 199015

SEQ ID NO: 199672 - RNA, 64 nt, hsa; identical to SEQ ID NO: 199016

SEQ ID NO: 199673 - RNA, 64 nt, hsa; identical to SEQ ID NO: 199017

SEQ ID NO: 199674 - RNA, 64 nt, hsa; identical to SEQ ID NO: 199018

SEQ ID NO: 199675 - RNA, 64 nt, hsa; identical to SEQ ID NO: 199019

SEQ ID NO: 199676 - RNA, 64 nt, hsa; identical to SEQ ID NO: 199020

SEQ ID NO: 199677 - RNA, 64 nt, hsa; identical to SEQ ID NO: 199021

SEQ ID NO: 199678 - RNA, 64 nt, hsa; identical to SEQ ID NO: 199022

SEQ ID NO: 199679 - RNA, 64 nt, hsa; identical to SEQ ID NO: 199023

SEQ ID NO: 199680 - RNA, 64 nt, hsa; identical to SEQ ID NO: 199024

SEQ ID NO: 199681 - RNA, 64 nt, hsa; identical to SEQ ID NO: 199025

SEQ ID NO: 199682 - RNA, 64 nt, hsa; identical to SEQ ID NO: 199026

SEQ ID NO: 199683 - RNA, 64 nt, hsa; identical to SEQ ID NO: 199027

SEQ ID NO: 199684 - RNA, 64 nt, hsa; identical to SEQ ID NO: 199028

SEQ ID NO: 199685 - RNA, 64 nt, hsa; identical to SEQ ID NO: 199029

SEQ ID NO: 199686 - RNA, 64 nt, hsa; identical to SEQ ID NO: 199030

SEQ ID NO: 199687 - RNA, 64 nt, hsa; identical to SEQ ID NO: 199031

SEQ ID NO: 199688 - RNA, 64 nt, hsa; identical to SEQ ID NO: 199032

SEQ ID NO: 199689 - RNA, 64 nt, hsa; identical to SEQ ID NO: 199033

SEQ ID NO: 199690 - RNA, 64 nt, hsa; identical to SEQ ID NO: 199034

SEQ ID NO: 199691 - RNA, 64 nt, hsa; identical to SEQ ID NO: 199035

SEQ ID NO: 199692 - RNA, 64 nt, hsa; identical to SEQ ID NO: 199036

SEQ ID NO: 199693 - RNA, 64 nt, hsa; identical to SEQ ID NO: 199037

SEQ ID NO: 199694 - RNA, 64 nt, hsa; identical to SEQ ID NO: 199038

SEQ ID NO: 199695 - RNA, 64 nt, hsa; identical to SEQ ID NO: 199039

SEQ ID NO: 199696 - RNA, 64 nt, hsa; identical to SEQ ID NO: 199040

SEQ ID NO: 199697 - RNA, 64 nt, hsa; identical to SEQ ID NO: 199041

SEQ ID NO: 199698 - RNA, 64 nt, hsa; identical to SEQ ID NO: 199042

SEQ ID NO: 199699 - RNA, 64 nt, hsa; identical to SEQ ID NO: 199043

SEQ ID NO: 199700 - RNA, 64 nt, hsa; identical to SEQ ID NO: 199044

SEQ ID NO: 199701 - RNA, 64 nt, hsa; identical to SEQ ID NO: 199045

SEQ ID NO: 199702 - RNA, 64 nt, hsa; identical to SEQ ID NO: 199046

SEQ ID NO: 199703 - RNA, 64 nt, hsa; identical to SEQ ID NO: 199047

SEQ ID NO: 199704 - RNA, 64 nt, hsa; identical to SEQ ID NO: 199048

SEQ ID NO: 199705 - RNA, 64 nt, hsa; identical to SEQ ID NO: 199049

SEQ ID NO: 199706 - RNA, 64 nt, hsa; identical to SEQ ID NO: 199050

SEQ ID NO: 199707 - RNA, 64 nt, hsa; identical to SEQ ID NO: 199051

SEQ ID NO: 199708 - RNA, 64 nt, hsa; identical to SEQ ID NO: 199052

SEQ ID NO: 199709 - RNA, 64 nt, hsa; identical to SEQ ID NO: 199053

SEQ ID NO: 199710 - RNA, 64 nt, hsa; identical to SEQ ID NO: 199054

SEQ ID NO: 199711 - RNA, 64 nt, hsa; identical to SEQ ID NO: 199055

SEQ ID NO: 199712 - RNA, 64 nt, hsa; identical to SEQ ID NO: 199056

SEQ ID NO: 199713 - RNA, 64 nt, hsa; identical to SEQ ID NO: 199057

SEQ ID NO: 199714 - RNA, 64 nt, hsa; identical to SEQ ID NO: 199058

SEQ ID NO: 199715 - RNA, 64 nt, hsa
aagcccagagagagcacuggguuuguucaggaccacccagaaggugucacacgggguuucccca

SEQ ID NO: 199716 - RNA, 64 nt, hsa
caaggaccaagggccauaucccaagugacuuuguacccagaaaauaacagcuguucaauaaaug

SEQ ID NO: 199717 - RNA, 64 nt, hsa
uggcuguuucuuuggaucccucugucccagagccacccagaacccugacucuugagaaucaaga

SEQ ID NO: 199718 - RNA, 64 nt, hsa
acccagaacccugacucuugagaaucaagaaaacacccagaaaggccuuaaugaccucauaggc

SEQ ID NO: 199719 - RNA, 64 nt, hsa
agcucaaagaagggguuaaugaugcuaacuagagacccagaacgucugaaaacguccugauauu

SEQ ID NO: 199720 - RNA, 64 nt, hsa
aucugaugccucuacuaucauuaccucuauugggacccagaaaccaauaccccaaaauauggug

SEQ ID NO: 199721 - RNA, 64 nt, hsa
uaauuauccuuucuuuuucaaucccauugcuaacacccagaacauauuuucuguucaaugcaaa

SEQ ID NO: 199722 - RNA, 64 nt, hsa
agagugaauugcguauaaaaagggugauuuaaaaacccagaaacaaaagguagaauagggcuga

SEQ ID NO: 199723 - RNA, 64 nt, hsa
ggcuggacagcaccagcagcgcaucccggcgggaacccagaaaaggcuucuuacacagcagccu

SEQ ID NO: 199724 - RNA, 64 nt, hsa
cugagaugacuaggacagucuguacccagaggccacccagaagcccucagauguacauacacag

SEQ ID NO: 199725 - RNA, 64 nt, hsa
agcaggcgggcugaggagaguggaaaaggaagcgacccagaaauggcagggacacuucucuugc

SEQ ID NO: 199726 - RNA, 64 nt, hsa
ccaggauacaaaaaaaaacauuuaaaaauccgagacccagaacacuucuggucccaagcauuuc

SEQ ID NO: 199727 - RNA, 64 nt, hsa
acugucuuuauugcagaagacaguguguugccuuacccagaaugagauugaauuguuuugcuuc

SEQ ID NO: 199728 - RNA, 64 nt, hsa
acacacacuauuucagaagacaguguguugccuuacccagaaugagugcuaggauuacaggcgu

SEQ ID NO: 199729 - RNA, 64 nt, hsa
uuucaauuuggcuaaugaagggcaaccacccagaacccagaaaaugcagauucacucaguuuaa

SEQ ID NO: 199730 - RNA, 62 nt, hsa
ucuuuuuucaauuuggcuaaugaagggcaaccacccagaacccagaaaaugcagauucacuc

SEQ ID NO: 199731 - RNA, 64 nt, hsa
ggaugcgaggccacggcucagugaugggcucaccacccagaaguggggagagacuuugggccuc

SEQ ID NO: 199732 - RNA, 64 nt, hsa
ggcagccuccuccaaaucccuccuggaggggccuacccagaagccuccuugaaccagucugcaa

SEQ ID NO: 199733 - RNA, 64 nt, hsa; identical to SEQ ID NO: 87364

SEQ ID NO: 199734 - RNA, 64 nt, hsa; identical to SEQ ID NO: 87365

SEQ ID NO: 199735 - RNA, 64 nt, hsa; identical to SEQ ID NO: 87366

SEQ ID NO: 199736 - RNA, 64 nt, hsa; identical to SEQ ID NO: 87367

SEQ ID NO: 199737 - RNA, 64 nt, hsa; identical to SEQ ID NO: 87368

SEQ ID NO: 199738 - RNA, 64 nt, hsa; identical to SEQ ID NO: 87369

SEQ ID NO: 199739 - RNA, 64 nt, hsa; identical to SEQ ID NO: 87370

SEQ ID NO: 199740 - RNA, 64 nt, hsa; identical to SEQ ID NO: 87371

SEQ ID NO: 199741 - RNA, 64 nt, hsa; identical to SEQ ID NO: 87372

SEQ ID NO: 199742 - RNA, 64 nt, hsa; identical to SEQ ID NO: 87373

SEQ ID NO: 199743 - RNA, 64 nt, hsa; identical to SEQ ID NO: 87374

SEQ ID NO: 199744 - RNA, 64 nt, hsa; identical to SEQ ID NO: 87375

SEQ ID NO: 199745 - RNA, 64 nt, hsa; identical to SEQ ID NO: 87376

SEQ ID NO: 199746 - RNA, 64 nt, hsa; identical to SEQ ID NO: 87377

SEQ ID NO: 199747 - RNA, 64 nt, hsa; identical to SEQ ID NO: 87378

SEQ ID NO: 199748 - RNA, 64 nt, hsa; identical to SEQ ID NO: 87379

SEQ ID NO: 199749 - RNA, 64 nt, hsa; identical to SEQ ID NO: 87380

SEQ ID NO: 199750 - RNA, 64 nt, hsa; identical to SEQ ID NO: 87381

SEQ ID NO: 199751 - RNA, 64 nt, hsa; identical to SEQ ID NO: 87382

SEQ ID NO: 199752 - RNA, 64 nt, hsa; identical to SEQ ID NO: 87383

SEQ ID NO: 199753 - RNA, 64 nt, hsa; identical to SEQ ID NO: 87384

SEQ ID NO: 199754 - RNA, 64 nt, hsa; identical to SEQ ID NO: 87385

SEQ ID NO: 199755 - RNA, 64 nt, hsa; identical to SEQ ID NO: 87386

SEQ ID NO: 199756 - RNA, 64 nt, hsa; identical to SEQ ID NO: 87387

SEQ ID NO: 199757 - RNA, 64 nt, hsa; identical to SEQ ID NO: 87388

SEQ ID NO: 199758 - RNA, 64 nt, hsa; identical to SEQ ID NO: 87389

SEQ ID NO: 199759 - RNA, 64 nt, hsa; identical to SEQ ID NO: 87390

SEQ ID NO: 199760 - RNA, 64 nt, hsa; identical to SEQ ID NO: 87391

SEQ ID NO: 199761 - RNA, 64 nt, hsa; identical to SEQ ID NO: 87392

SEQ ID NO: 199762 - RNA, 64 nt, hsa; identical to SEQ ID NO: 87393

SEQ ID NO: 199763 - RNA, 64 nt, hsa; identical to SEQ ID NO: 87394

SEQ ID NO: 199764 - RNA, 64 nt, hsa; identical to SEQ ID NO: 87395

SEQ ID NO: 199765 - RNA, 64 nt, hsa; identical to SEQ ID NO: 87396

SEQ ID NO: 199766 - RNA, 64 nt, hsa; identical to SEQ ID NO: 87397

SEQ ID NO: 199767 - RNA, 64 nt, hsa; identical to SEQ ID NO: 87398

SEQ ID NO: 199768 - RNA, 64 nt, hsa; identical to SEQ ID NO: 87399

SEQ ID NO: 199769 - RNA, 64 nt, hsa; identical to SEQ ID NO: 87400

SEQ ID NO: 199770 - RNA, 64 nt, hsa; identical to SEQ ID NO: 87401

SEQ ID NO: 199771 - RNA, 64 nt, hsa; identical to SEQ ID NO: 87402

SEQ ID NO: 199772 - RNA, 64 nt, hsa; identical to SEQ ID NO: 87403

SEQ ID NO: 199773 - RNA, 64 nt, hsa; identical to SEQ ID NO: 87404

SEQ ID NO: 199774 - RNA, 64 nt, hsa; identical to SEQ ID NO: 87405

SEQ ID NO: 199775 - RNA, 64 nt, hsa; identical to SEQ ID NO: 87406

SEQ ID NO: 199776 - RNA, 64 nt, hsa
uucauauuuuauacauuuauuuuccgaauguaucauugaauaauuuuauugaguuauaaaagua

SEQ ID NO: 199777 - RNA, 64 nt, hsa
uagaaacuuucugaaauaauuucuguuuaaaaauauugaauauuugcuucauuucaaauacucc

SEQ ID NO: 199778 - RNA, 64 nt, hsa
agugaaacauaggcuaauauagauuaaauugaauauugaauaaaaaauauauuuauuuauccac

SEQ ID NO: 199779 - RNA, 64 nt, hsa
ccuauaaagugaaacauaggcuaauauagauuaaauugaauauugaauaaaaaauauauuuauu

SEQ ID NO: 199780 - RNA, 64 nt, hsa
aaaaucacagcaaucucugauucuguguaauaauauugaauaauuuuuuagaagguuacugaaa

SEQ ID NO: 199781 - RNA, 64 nt, hsa
auucuuacuaguuucauucuaaucaagaugucaaauugaauaaaaaucacagcaaucucugauu

SEQ ID NO: 199782 - RNA, 64 nt, hsa
cuucuaaugaaguauggaauaucucauguaauuuauugaauacuguacugaaggugaaaaccag

SEQ ID NO: 199783 - RNA, 64 nt, hsa
aucguaaguccaaaauauuggaaguugaaaaugcauugaauacacccaaccuacugaacaucgu

SEQ ID NO: 199784 - RNA, 64 nt, hsa
aagguaugcuauaggcaucauucauuaucucuauauugaauaggugaaagauaacuguagucag

SEQ ID NO: 199785 - RNA, 64 nt, hsa
ucaaccuguauuugaacaagcauuaccaaauaucauugaauauuaauaucuuuugcguaaaaac

SEQ ID NO: 199786 - RNA, 64 nt, hsa
caugaaugaaguaguuuguuucauagcuugucucauugaauaguauuauugaagauacuaaaug

SEQ ID NO: 199787 - RNA, 64 nt, hsa
aaaaagucccacugucagauuauauuaucuaacaauugaauauuguaaauauacuugucuuacc

SEQ ID NO: 199788 - RNA, 64 nt, hsa
uauaagaauugucccaaaaguaccuguacagaaaauugaauauugaaaaauugacaaauugugu

SEQ ID NO: 199789 - RNA, 64 nt, hsa
gugagaaacaauucuuuuuaauuuacagcaaaauauugaauaaccauugacaaaaacacuauua

SEQ ID NO: 199790 - RNA, 64 nt, hsa
cacggggacuugucucacuagcauccuguuacguauugaauauagaaaucauucuaacaaccca

SEQ ID NO: 199791 - RNA, 64 nt, hsa
uaaauuuguauauaaucuaaugucuucauuauuaauugaauaguacauguuaacauuuuaaucu

SEQ ID NO: 199792 - RNA, 64 nt, hsa
agccaguuguggagaauuguuugaauauuaucccauugaauacccagagccacuaaaucuuuuu

SEQ ID NO: 199793 - RNA, 64 nt, hsa
cuuaaacuauguaaacccuuguccuaaggaaguaauugaauaauugcccaaagauuguauguau

SEQ ID NO: 199794 - RNA, 64 nt, hsa
ccuuccucagggucugcuuggagcagcuccucugcaggcacagccuggacuauucccaggcaca

SEQ ID NO: 199795 - RNA, 64 nt, hsa
gcagcuccucugcaggcacagccuggacuauucccaggcacagcugugggcccaggagccagcu

SEQ ID NO: 199796 - RNA, 64 nt, hsa
agggcaauacaggcauuuaaaaaauuaaaaugaccaggcacaguggcucacgccuguaaucucg

SEQ ID NO: 199797 - RNA, 64 nt, hsa
uauccugccucagccucccgaguagcugggacugcaggcacacacugccacgcccagcuaauuu

SEQ ID NO: 199798 - RNA, 64 nt, hsa
ugcagaaugcgcuuuagaaagcauuguuuuaguccaggcacaguggcucacgccuguaauccca

SEQ ID NO: 199799 - RNA, 64 nt, hsa
caaagcuucugucccucccacaccucucaccucacaggcacaucaggcugcagaaugcgcuuua

SEQ ID NO: 199800 - RNA, 64 nt, hsa
ccuuuugcuucagccucccaagcagcuaggacuacaggcacaugccaccacacuuggguaauua

SEQ ID NO: 199801 - RNA, 64 nt, hsa
cuucaagcgcuguaaagcaccaacccggaaguggcaggcacagaaggaagggcuggauugggcc

SEQ ID NO: 199802 - RNA, 64 nt, hsa
ggcauggccuguggcccgagggccaaccaccgagcaggcacagcacagcagugacucggugagg

SEQ ID NO: 199803 - RNA, 64 nt, hsa
gggaaggucacaaggccugggguuguucacaccacaggcacaauacagagcuguccacucuuga

SEQ ID NO: 199804 - RNA, 64 nt, hsa
uucuuguaccucagccugcugaguagcugguauacaggcacaucgccgccacacccagcucauu

SEQ ID NO: 199805 - RNA, 55 nt, hsa
ccucagucccaauuggcuaggacugcaggcacacaccaccagacccagcuaaugu

SEQ ID NO: 199806 - RNA, 64 nt, hsa
cacacacaugcacacauacacgugcacacauacacaggcacacaugcaugcacacauacacaug

SEQ ID NO: 199807 - RNA, 64 nt, hsa
uacacaugcacacacacaugcacacauauaugcacaggcacacacauguacgcacacacacaug

SEQ ID NO: 199808 - RNA, 64 nt, hsa
cuccacccugcaggggcccagacugccugcaggucaggcacaggggcaucuaccuagacaggac

SEQ ID NO: 199809 - RNA, 64 nt, hsa
gagagagaagggcccggagggugucuccccaagccaggcacaccugcacaaacccagagccgac

SEQ ID NO: 199810 - RNA, 64 nt, hsa
ugaccacugggacuucaggcaagaagcucaccaccaggcacacagcaaagggacugaacugacc

SEQ ID NO: 199811 - RNA, 51 nt, hsa
cuggggcagggcaccagugaacaggcacaggucccaggaccaaggagaggu

SEQ ID NO: 199812 - RNA, 64 nt, hsa
uagcuacugacagccuccugcugcccuacccuggcaggcacaggcgcagcuggcuggggggccc

SEQ ID NO: 199813 - RNA, 64 nt, hsa
caccauggcaugaggaagaaacaaggucccugagcaggcacaaguccugacagucaagggacug

SEQ ID NO: 199814 - RNA, 64 nt, hsa
gaucuggcauuuucugcuuuacguggagggagaacaggcacauuagccuugaagcugaagcuca

SEQ ID NO: 199815 - RNA, 64 nt, hsa
aggagagaaggcuggggagggcugggcagcaagccaggcacagugaguggcagagcaagagggg

SEQ ID NO: 199816 - RNA, 64 nt, hsa
cuccagaggucuguacaucacauacauaugcacacaggcacacauggcaaaacucggaagugaa

SEQ ID NO: 199817 - RNA, 64 nt, hsa
ccucccaugaccaggcaguggucaccccaugggacaggcacagcuacuuacgcgaacacagcag

SEQ ID NO: 199818 - RNA, 64 nt, hsa
gcggccagaagacaagcagggaagugaaaggucccaggcacacacccugcccauugcagguggc

SEQ ID NO: 199819 - RNA, 64 nt, hsa
ucagugggugguggggugauggauacacaucuaucaggcacagggcggaggugggcaccacuga

SEQ ID NO: 199820 - RNA, 64 nt, hsa
agaaaaaugagaucagaaguggagauguuggggccaggcacaguggcccaggccuguaauccca

SEQ ID NO: 199821 - RNA, 64 nt, hsa
aaacaaccguaugagcgcauuggcuugucugccgcaggcacagaaggguagaaagccacagcag

SEQ ID NO: 199822 - RNA, 64 nt, hsa
acgacagccuuuaguuuuccugaaaucaccaggucaggcacaaggagaaaagguuccuggauac

SEQ ID NO: 199823 - RNA, 64 nt, hsa
gugugaucccuggcacgcacugacuuugauauuccaggcacacggacuggcuauuuaucaccac

SEQ ID NO: 199824 - RNA, 64 nt, hsa
gcacccauccugcacacaucucccugaaaacacacaggcacauacacucauauacauagacaca

SEQ ID NO: 199825 - RNA, 64 nt, hsa; identical to SEQ ID NO: 145515

SEQ ID NO: 199826 - RNA, 64 nt, hsa; identical to SEQ ID NO: 145516

SEQ ID NO: 199827 - RNA, 64 nt, hsa; identical to SEQ ID NO: 145517

SEQ ID NO: 199828 - RNA, 64 nt, hsa; identical to SEQ ID NO: 145518

SEQ ID NO: 199829 - RNA, 64 nt, hsa; identical to SEQ ID NO: 145519

SEQ ID NO: 199830 - RNA, 64 nt, hsa; identical to SEQ ID NO: 145520

SEQ ID NO: 199831 - RNA, 64 nt, hsa; identical to SEQ ID NO: 145521

SEQ ID NO: 199832 - RNA, 64 nt, hsa; identical to SEQ ID NO: 145522

SEQ ID NO: 199833 - RNA, 64 nt, hsa; identical to SEQ ID NO: 145523

SEQ ID NO: 199834 - RNA, 64 nt, hsa; identical to SEQ ID NO: 145524

SEQ ID NO: 199835 - RNA, 64 nt, hsa; identical to SEQ ID NO: 145525

SEQ ID NO: 199836 - RNA, 64 nt, hsa; identical to SEQ ID NO: 145526

SEQ ID NO: 199837 - RNA, 64 nt, hsa; identical to SEQ ID NO: 145527

SEQ ID NO: 199838 - RNA, 64 nt, hsa; identical to SEQ ID NO: 145528

SEQ ID NO: 199839 - RNA, 64 nt, hsa; identical to SEQ ID NO: 145529

SEQ ID NO: 199840 - RNA, 64 nt, hsa; identical to SEQ ID NO: 145530

SEQ ID NO: 199841 - RNA, 64 nt, hsa; identical to SEQ ID NO: 145531

SEQ ID NO: 199842 - RNA, 64 nt, hsa; identical to SEQ ID NO: 145532

SEQ ID NO: 199843 - RNA, 64 nt, hsa; identical to SEQ ID NO: 145533

SEQ ID NO: 199844 - RNA, 64 nt, hsa; identical to SEQ ID NO: 145534

SEQ ID NO: 199845 - RNA, 64 nt, hsa; identical to SEQ ID NO: 145535

SEQ ID NO: 199846 - RNA, 64 nt, hsa; identical to SEQ ID NO: 145536

SEQ ID NO: 199847 - RNA, 64 nt, hsa
guggcuguggcuuuuugggagguggggcaugggaggaccagagacgaagggcuuggaaggagac

SEQ ID NO: 199848 - RNA, 64 nt, hsa
accacaugugagcuucuuuuaggucccagugaugggaccagaagcaucuaaagcaaaaaaaaaa

SEQ ID NO: 199849 - RNA, 64 nt, hsa
uuuggccagaugugugauucugugacuugucccaggaccagaauguaccuaagucagauccaua

SEQ ID NO: 199850 - RNA, 64 nt, hsa
agucagauccauagacgcauguugguaggucacuggaccagagcuugugaagcaggcaaccucu

SEQ ID NO: 199851 - RNA, 64 nt, hsa
cuccccugggagcagagagagaaacccucuucauggaccagacucugcacccggugagugagga

SEQ ID NO: 199852 - RNA, 64 nt, hsa
ccagggucuggcuggcugguagccaagcacuuauggaccagaguggcccaggccagcugggcgc

SEQ ID NO: 199853 - RNA, 64 nt, hsa
uagucagggcaaaaagcauacgcaugcuucccauggaccagagaaaccuggccuggguugucuc

SEQ ID NO: 199854 - RNA, 64 nt, hsa
gaaucccggcuccugguccucacagcccugauuuggaccagaaucucagaugcucagaagaaag

SEQ ID NO: 199855 - RNA, 55 nt, hsa
accaagauauucugccaaaauaucaggaccagaauuuucuaccuaaggaccagaa

SEQ ID NO: 199856 - RNA, 64 nt, hsa
ugccaaaauaucaggaccagaauuuucuaccuaaggaccagaauuuuuuaucuagagaccagca

SEQ ID NO: 199857 - RNA, 64 nt, hsa
uccccaaagaccaagauauucugccaaaauaucaggaccagaauuuucuaccuaaggaccagaa

SEQ ID NO: 199858 - RNA, 64 nt, hsa
ugccaaaauaucaggaccagaauuuucuaccuaaggaccagaauuuuuugucuagagaccagca

SEQ ID NO: 199859 - RNA, 64 nt, hsa
aagagcccuuauuuguggggugagauuggggguuggaccagagugauguccucucucagcuauc

SEQ ID NO: 199860 - RNA, 64 nt, hsa
augacuuucagucucucugaaaaugaaaagcuuaggaccagaagagagaauuggagcuguacga

SEQ ID NO: 199861 - RNA, 64 nt, hsa
augcuauugaaaaaguucagaaaacauacaccguggaccagaggucuuaauccuaucuauggau

SEQ ID NO: 199862 - RNA, 64 nt, hsa
uagaauauaaacaggacuuguuuuuuucaguaagggaccagaagugacuagccuucauguaauu

SEQ ID NO: 199863 - RNA, 64 nt, hsa
acagcuacaccuuccagcaggugcaggagcacacggaccagauuuggaaguuccagcgccauga

SEQ ID NO: 199864 - RNA, 64 nt, hsa
ggaucgagacgguggccgucagcguccacuuccaggaccagaaugacguggagcugaacaggcu

SEQ ID NO: 199865 - RNA, 64 nt, hsa
uuuaaguugaggaaguggaggcugguaaagagcaggaccagaggaagaauccagauuuccuuau

SEQ ID NO: 199866 - RNA, 64 nt, hsa
uuaacaguuaugcuugcauuaauaauuucaauguggaccagacauucuaauuauauuuuaaaug

SEQ ID NO: 199867 - RNA, 64 nt, hsa
ugagcaccacuguaccuggcuagcuacuucuuuguuagaggauugagaaugaaauuucugcaaa

SEQ ID NO: 199868 - RNA, 64 nt, hsa
aaaugcaccaggauggugucugugcacgugacuauuagaggagcgucuguagaaguaccugguu

SEQ ID NO: 199869 - RNA, 64 nt, hsa
acaaaucagacauacacacauuagauagauaaauuuagaggacaaaauaaggaacaugaaaagc

SEQ ID NO: 199870 - RNA, 64 nt, hsa
aaauggacaguacuaggguagaggggaagucagauuagaggaaagaaagagcaucaggaacagu

SEQ ID NO: 199871 - RNA, 64 nt, hsa
aguugucagugaaacuacuuuggauuuuaaccucuuagaggaagaaaaaagguuagggaagugu

SEQ ID NO: 199872 - RNA, 64 nt, hsa
caaagugccuucuguuucacagcugccaccaccuuuagaggaauuucgucagaaaaauguggag

SEQ ID NO: 199873 - RNA, 64 nt, hsa
agaacccacuccugagaacagcggagccaggcgcuuagaggaagaccaaaugcugccaggacac

SEQ ID NO: 199874 - RNA, 64 nt, hsa
acggauuguccagggauuacauuccagcaucuuauuagaggacggaagcagagggugcuguuuc

SEQ ID NO: 199875 - RNA, 64 nt, hsa
aaagauuguagguggcuuggggaauguggguggcuuagaggaucuaaaccgauucacuuccugg

SEQ ID NO: 199876 - RNA, 64 nt, hsa
gguugagaagcaacgagggcuugcucuaaaucguuuagaggauaacaggaucuagagaugcucu

SEQ ID NO: 199877 - RNA, 64 nt, hsa
ccugcuggcuacagcauggggugcccuauaggcacaagcccagcugaagaacagaauggagggc

SEQ ID NO: 199878 - RNA, 64 nt, hsa
cuccuugacugcagaagaccaagaaccuguuccccaagcccagagauguccaccugggcuggac

SEQ ID NO: 199879 - RNA, 64 nt, hsa
ugaagggggaggaugacaagccgcugcccaccuccaagcccaggaaacaguacaagauggcuaa

SEQ ID NO: 199880 - RNA, 64 nt, hsa
auaaagguggcuccagaaagggcauccucuaccccaagcccaaagccugcugggugucccccau

SEQ ID NO: 199881 - RNA, 64 nt, hsa
gcuccugccccuuucaggccuacagccacauccccaagcccaccaggugucaggauagucacag

SEQ ID NO: 199882 - RNA, 64 nt, hsa
ccugccucagcugacccggccucucugccccacccaagcccaaacuugguuucugugagaauag

SEQ ID NO: 199883 - RNA, 64 nt, hsa
ccccaccuccccgcaagcuggucccaucgaccagcaagcccagccccagggcgcuuagggagaa

SEQ ID NO: 199884 - RNA, 64 nt, hsa
uggcuguaaccagggcacaucacccaccucaagacaagcccacgcccuugucagcuuaggggga

SEQ ID NO: 199885 - RNA, 64 nt, hsa
cucaucuaaagacaccuuccuuuccacuggcugucaagcccacagggcaccagugccacccagg

SEQ ID NO: 199886 - RNA, 64 nt, hsa
caaccaggccuugccuucugagagcccccguggccaagcccaggucacagaucuucccccgacc

SEQ ID NO: 199887 - RNA, 64 nt, hsa
uccuucucagugcagggacgucaccccugccaggcaagcccagggcacagaugccaggauggcu

SEQ ID NO: 199888 - RNA, 64 nt, hsa
cucccucucagugcgaggcuucaccccugccaggcaagcccagggcauagaugcugagacagcc

SEQ ID NO: 199889 - RNA, 64 nt, hsa
ucccucucagugcagggacgucaccccugccaggcaagcccagggcacagaggccgggacggcc

SEQ ID NO: 199890 - RNA, 64 nt, hsa
cucccucucagugugaggcuucacccaugcuaggcaagcccagggcacagaugccgggauggcc

SEQ ID NO: 199891 - RNA, 64 nt, hsa
ucccucucagugcgggaacgucaccccugccaggcaagcccagggcacagaugcugcgauggcc

SEQ ID NO: 199892 - RNA, 64 nt, hsa
gaagagccaagcagaagcuccuggagauugccaccaagcccacguacccggugagccugggggc

SEQ ID NO: 199893 - RNA, 64 nt, hsa
uggcagcagcaagcacaauaccauuaaaaagccucaagcccaaggcagaagaccuaucugcauu

SEQ ID NO: 199894 - RNA, 64 nt, hsa
uugggcugagggagagggggccgggagggguugucaagcccacccgggaaacugagcccuggag

SEQ ID NO: 199895 - RNA, 64 nt, hsa
ugggggcagguagaccuguggggauggcucgguccaagcccaacacugcccgcuccagagagcc

SEQ ID NO: 199896 - RNA, 64 nt, hsa
guggagacagaggcagacuggagugaugcggccacaagcccagggacaccuggagcccccagga

SEQ ID NO: 199897 - RNA, 64 nt, hsa
aaagacagaggcagagacugaagugaugcugccccaagcccagggaugccuggaguccccagga

SEQ ID NO: 199898 - RNA, 64 nt, hsa
cuccugguccacaaugugagaaccacuaaguuggaguacugacucauagagauaaaauucuuug

SEQ ID NO: 199899 - RNA, 64 nt, hsa
ugguuacucauccaucagacuaucuguauauauaaguacugaaucaguauuuauuaaguaaaug

SEQ ID NO: 199900 - RNA, 64 nt, hsa
gaaaugggagcacaguacugggaaaugggcauacaguacugagaaaugggagcacacaguacug

SEQ ID NO: 199901 - RNA, 64 nt, hsa
gaagugggagcacaguacugagaagugggagcacaguacugagaaaugggaguacacuacugag

SEQ ID NO: 199902 - RNA, 64 nt, hsa
gaaaugggagcacaguacugggaagugggagcacaguacugagaagugggagcacaguacugag

SEQ ID NO: 199903 - RNA, 64 nt, hsa
ggauucuugaugggcugagcagcuggcuggagcuaguacugacugacauucauugugaugaggg

SEQ ID NO: 199904 - RNA, 64 nt, hsa
caauagguuuuuuuuuuuuuuuuuggccugaggaaguacugaccaugcccacagccaccggcug

SEQ ID NO: 199905 - RNA, 64 nt, hsa
uuguaauuaacucugggggcuuacuuguuuuggcaguacugaaaucaaaggagcugguucuucu

SEQ ID NO: 199906 - RNA, 64 nt, hsa
gaucaagguuuccuuaaauuuagcauugcauuucaguacugacuguguaagcuaaauugcugau

SEQ ID NO: 199907 - RNA, 64 nt, hsa
aacccagaccucagaugaggacuuaaugucuucuuccucucaagccaaauucgccuccacccac

SEQ ID NO: 199908 - RNA, 64 nt, hsa
uucacagacauuaaagugacgauucccacuccccuccucucagccucccugaugaagaguugac

SEQ ID NO: 199909 - RNA, 64 nt, hsa
cugggcuguaacaauucaggguuuucccuuguuuuccucucauugcauguuucccuccaauauu

SEQ ID NO: 199910 - RNA, 64 nt, hsa
aauuuucagaaagggaacaacgaaggcccucucuuccucucauaccacguuuugcucaagaagc

SEQ ID NO: 199911 - RNA, 64 nt, hsa
uacaugucauugaucuugcccccaauccugcuccuccucucauguuuccucuuugacuaaaugg

SEQ ID NO: 199912 - RNA, 64 nt, hsa
uaauuauaaacaggacccaauuuauauucauagauccucucaaguauuauacaauuuaaaaacu

SEQ ID NO: 199913 - RNA, 64 nt, hsa
uuuggccugagcuugugggucuguucagacugucuccucucaugguuugaaacugcaucugaau

SEQ ID NO: 199914 - RNA, 64 nt, hsa
uaugauuaguucacauuuacuggugcauccuugauccucucacagauagaggucuuaaagguug

SEQ ID NO: 199915 - RNA, 64 nt, hsa
gggcugucuuuacuuguggaaaccaggaaauugcuccucucagccaaccaagguugaccacaca

SEQ ID NO: 199916 - RNA, 64 nt, hsa
ccccccccgccacgccuuagagcagagcagccccuccucucauuuggugcagaaacagucaaga

SEQ ID NO: 199917 - RNA, 64 nt, hsa
ucaccugagaagaaaguguacgaagagaguguccuccucucacaugagccagaucagccagaaa

SEQ ID NO: 199918 - RNA, 64 nt, hsa
auguagaguguggaaaggaguugcugauugcauuuccucucauuaacaauuggguguguaauaa

SEQ ID NO: 199919 - RNA, 64 nt, hsa
ggucuuggaugccauccugcucaucuccagcauuuccucucaccuccguguucucggggagugc

SEQ ID NO: 199920 - RNA, 64 nt, hsa
ggugucagaucccauccugcucaucuccagcauuuccucucaccucuguguucucggggagugc

SEQ ID NO: 199921 - RNA, 64 nt, hsa
ggugucagaucccauccugcuccucuccagcauuuccucucaccuccguguucucggggagugc

SEQ ID NO: 199922 - RNA, 64 nt, hsa
ggugucagaucccauccugcuccucuccagaguuuccucucaccuccguguucucggggagugc

SEQ ID NO: 199923 - RNA, 64 nt, hsa
uaugcaggugacauuuguucauucucuaaucccauccucucacccauccauuuccucacucagu

SEQ ID NO: 199924 - RNA, 64 nt, hsa
ggccucugccuugggccucgccucuguccucagguccucucagaggcagauaccuaggggagcu

SEQ ID NO: 199925 - RNA, 64 nt, hsa
cccaaaucuccuccuuccacaccugcugccagucuccucucaagcaagccuccugaaccacugg

SEQ ID NO: 199926 - RNA, 64 nt, hsa
agaggaaggcaggggauuuaggaucgcccucccauccucucacccacuggaccccguaggaguc

SEQ ID NO: 199927 - RNA, 64 nt, hsa
uuaggcaccccucuuccuuaaugaaauguggcaguccucucagggguaccccaccuacuuaggg

SEQ ID NO: 199928 - RNA, 64 nt, hsa
agagggacucuaagaaccuaagguggaaacacuguccucucaucuugggaccgagggggugggg

SEQ ID NO: 199929 - RNA, 64 nt, hsa
auuuaugaaagcaauugguuaggaccucuuuuuuuccucucagggaacuaaugcucugaaaagg

SEQ ID NO: 199930 - RNA, 64 nt, hsa
ggagagaggaguuuuauuuccuccuucgauguuuuccucucaguuguaaaagaugaacucuuug

SEQ ID NO: 199931 - RNA, 64 nt, hsa
ggcaaaugaaacgguauauuauuucuuugcagucuccucucagucauucaucaauguggccagc

SEQ ID NO: 199932 - RNA, 64 nt, hsa
gucugucugcagaacuuucaggaugacuauuaauuccucucagaugucauuuuugaguggucca

SEQ ID NO: 199933 - RNA, 64 nt, hsa
accccuagagcaggaaagagggaagguacagggguccucucagccuugaaggagcccacugcuc

SEQ ID NO: 199934 - RNA, 64 nt, hsa
cuucucaucugcagguuggcuagaagugguggcauccucucacucuguaauuguaaucucagcu

SEQ ID NO: 199935 - RNA, 64 nt, hsa
aucucucuuguuuccucucacucugaauuauucuuccucucaugacugaccaaacacauggaac

SEQ ID NO: 199936 - RNA, 64 nt, hsa
gcuucccugagggcugccuagaaucucucuuguuuccucucacucugaauuauucuuccucuca

SEQ ID NO: 199937 - RNA, 64 nt, hsa
cacacaucccaaauaccaccaccaaccaccuucuuccucucaacucugucccacaggccugucu

SEQ ID NO: 199938 - RNA, 64 nt, hsa
ugaaggccauuucaagcgcugcuucucacuccauuccucucagcuguuauugcugcagggccaa

SEQ ID NO: 199939 - RNA, 64 nt, hsa
gcuaaggacuucagacaccauguccgaaaccuguuccucucaagugcccuguuguguggaacac

SEQ ID NO: 199940 - RNA, 64 nt, hsa
auaaggaaugcauuaugggucaaaaaucaaacauuccucucauguuauguauauuuuguuccug

SEQ ID NO: 199941 - RNA, 64 nt, hsa
aaauauuuuuccccacaauugucugauguaugaguccucucagaagcacaagugcauacuagga

SEQ ID NO: 199942 - RNA, 64 nt, hsa
ggcuuccaaaccucacugagcauguucagagaauuccucucauuaaggaaauauuuuuccccac

SEQ ID NO: 199943 - RNA, 64 nt, hsa
caaaaguguuauuuguaaguuaauuuuuuuacaagucaaacaauguuggaagugguauuuaggu

SEQ ID NO: 199944 - RNA, 64 nt, hsa
cuaaacauucuucagugaaaauaauuuuauuucagucaaacauuuaugaggaaaugagaucaca

SEQ ID NO: 199945 - RNA, 64 nt, hsa
ugcauuccacagagauucagaaggcaccucuucggucaaacauggccccucuauaaccccacua

SEQ ID NO: 199946 - RNA, 64 nt, hsa
agagggaagucaaguagugacuaacucacuauaugucaaacacaucauuacucuucucuuuucc

SEQ ID NO: 199947 - RNA, 64 nt, hsa; identical to SEQ ID NO: 154890

SEQ ID NO: 199948 - RNA, 64 nt, hsa; identical to SEQ ID NO: 154891

SEQ ID NO: 199949 - RNA, 64 nt, hsa; identical to SEQ ID NO: 154892

SEQ ID NO: 199950 - RNA, 64 nt, hsa; identical to SEQ ID NO: 154893

SEQ ID NO: 199951 - RNA, 64 nt, hsa; identical to SEQ ID NO: 154894

SEQ ID NO: 199952 - RNA, 64 nt, hsa; identical to SEQ ID NO: 154895

SEQ ID NO: 199953 - RNA, 64 nt, hsa; identical to SEQ ID NO: 154896

SEQ ID NO: 199954 - RNA, 64 nt, hsa; identical to SEQ ID NO: 154897

SEQ ID NO: 199955 - RNA, 64 nt, hsa; identical to SEQ ID NO: 154898

SEQ ID NO: 199956 - RNA, 64 nt, hsa; identical to SEQ ID NO: 154899

SEQ ID NO: 199957 - RNA, 64 nt, hsa; identical to SEQ ID NO: 154900

SEQ ID NO: 199958 - RNA, 55 nt, hsa; identical to SEQ ID NO: 154901

SEQ ID NO: 199959 - RNA, 64 nt, hsa; identical to SEQ ID NO: 154902

SEQ ID NO: 199960 - RNA, 64 nt, hsa; identical to SEQ ID NO: 154903

SEQ ID NO: 199961 - RNA, 64 nt, hsa; identical to SEQ ID NO: 154904

SEQ ID NO: 199962 - RNA, 64 nt, hsa; identical to SEQ ID NO: 154905

SEQ ID NO: 199963 - RNA, 64 nt, hsa; identical to SEQ ID NO: 154906

SEQ ID NO: 199964 - RNA, 64 nt, hsa; identical to SEQ ID NO: 154907

SEQ ID NO: 199965 - RNA, 64 nt, hsa; identical to SEQ ID NO: 154908

SEQ ID NO: 199966 - RNA, 64 nt, hsa; identical to SEQ ID NO: 154909

SEQ ID NO: 199967 - RNA, 64 nt, hsa; identical to SEQ ID NO: 154910

SEQ ID NO: 199968 - RNA, 64 nt, hsa; identical to SEQ ID NO: 154911

SEQ ID NO: 199969 - RNA, 64 nt, hsa
ggggggcgacaagucagacccgaaccuuaauaaccccgcggacgaggaccaugccuaugcucug

SEQ ID NO: 199970 - RNA, 64 nt, hsa
caagaccggcugcgugauccagccugugccaaaacccgcggagaaggcugccauggcaccgugc

SEQ ID NO: 199971 - RNA, 64 nt, hsa; identical to SEQ ID NO: 95035

SEQ ID NO: 199972 - RNA, 64 nt, hsa; identical to SEQ ID NO: 95036

SEQ ID NO: 199973 - RNA, 64 nt, hsa; identical to SEQ ID NO: 95037

SEQ ID NO: 199974 - RNA, 64 nt, hsa; identical to SEQ ID NO: 95038

SEQ ID NO: 199975 - RNA, 64 nt, hsa; identical to SEQ ID NO: 95039

SEQ ID NO: 199976 - RNA, 64 nt, hsa; identical to SEQ ID NO: 95040

SEQ ID NO: 199977 - RNA, 64 nt, hsa; identical to SEQ ID NO: 95041

SEQ ID NO: 199978 - RNA, 64 nt, hsa; identical to SEQ ID NO: 95042

SEQ ID NO: 199979 - RNA, 64 nt, hsa; identical to SEQ ID NO: 95043

SEQ ID NO: 199980 - RNA, 64 nt, hsa; identical to SEQ ID NO: 95044

SEQ ID NO: 199981 - RNA, 64 nt, hsa; identical to SEQ ID NO: 95045

SEQ ID NO: 199982 - RNA, 64 nt, hsa; identical to SEQ ID NO: 95046

SEQ ID NO: 199983 - RNA, 64 nt, hsa; identical to SEQ ID NO: 95047

SEQ ID NO: 199984 - RNA, 64 nt, hsa; identical to SEQ ID NO: 95048

SEQ ID NO: 199985 - RNA, 64 nt, hsa; identical to SEQ ID NO: 95049

SEQ ID NO: 199986 - RNA, 64 nt, hsa; identical to SEQ ID NO: 95050

SEQ ID NO: 199987 - RNA, 64 nt, hsa; identical to SEQ ID NO: 95051

SEQ ID NO: 199988 - RNA, 64 nt, hsa; identical to SEQ ID NO: 95052

SEQ ID NO: 199989 - RNA, 64 nt, hsa; identical to SEQ ID NO: 160465

SEQ ID NO: 199990 - RNA, 64 nt, hsa; identical to SEQ ID NO: 160466

SEQ ID NO: 199991 - RNA, 64 nt, hsa; identical to SEQ ID NO: 160467

SEQ ID NO: 199992 - RNA, 64 nt, hsa; identical to SEQ ID NO: 160468

SEQ ID NO: 199993 - RNA, 64 nt, hsa; identical to SEQ ID NO: 160469

SEQ ID NO: 199994 - RNA, 64 nt, hsa; identical to SEQ ID NO: 160470

SEQ ID NO: 199995 - RNA, 64 nt, hsa; identical to SEQ ID NO: 160471

SEQ ID NO: 199996 - RNA, 64 nt, hsa; identical to SEQ ID NO: 160472

SEQ ID NO: 199997 - RNA, 64 nt, hsa; identical to SEQ ID NO: 160473

SEQ ID NO: 199998 - RNA, 64 nt, hsa; identical to SEQ ID NO: 160474

SEQ ID NO: 199999 - RNA, 64 nt, hsa; identical to SEQ ID NO: 160475

SEQ ID NO: 200000 - RNA, 63 nt, hsa
gggcccuccaccuguggcucacaucucgccagccccacagagcauccucaggccucuccaagg

SEQ ID NO: 200001 - RNA, 63 nt, hsa
ccucaaccuccggaguccaggagaacccguacccccacagagccuuaagcaacuacuucugug

SEQ ID NO: 200002 - RNA, 63 nt, hsa
gcgucagcccgaguucugaauuaaaacaugccucccacagaaucuauuucugaugaauaugaa

SEQ ID NO: 200003 - RNA, 63 nt, hsa
cugaggccuccccagaagcagaagcauguaaagcccacagaaccgugaguugauuaaaucucu

SEQ ID NO: 200004 - RNA, 63 nt, hsa
cucucggaccucgcuguguuucacugccuccugcccacagacccaggccugccggcccggacc

SEQ ID NO: 200005 - RNA, 63 nt, hsa
ccaaguggacacauggcugugcaggccaggaggcccacagauggacugagugcugggaagggg

SEQ ID NO: 200006 - RNA, 63 nt, hsa
acugccacauggagucuugccaugccugugugccccacagaccuaauauauguccggacagcu

SEQ ID NO: 200007 - RNA, 63 nt, hsa
cacugucaugcaggucauaucagaucugagugccccacagagucacagugugucuggacagcc

SEQ ID NO: 200008 - RNA, 63 nt, hsa
acaagaugguguucugcuaauguuaaaugucagcccacagagcuaauaauaccucaguauaau

SEQ ID NO: 200009 - RNA, 63 nt, hsa
gaacaacaagguuaagcuucaucugcuuggugucccacagaacuugcacaagcaguuguuauu

SEQ ID NO: 200010 - RNA, 63 nt, hsa
cugagaccuuggcucuguauggaggcugcucaccccacagacacugguggggagaccauggcu

SEQ ID NO: 200011 - RNA, 63 nt, hsa
ggaggagaggaaacagugacuaaaagcuggggacccacagagggguuggcagcuucucuuguc

SEQ ID NO: 200012 - RNA, 63 nt, hsa
aggccccacagaccccacagaggaugaagccaccccacagaggaugcagcccccagcugcaug

SEQ ID NO: 200013 - RNA, 63 nt, hsa
gaaugcugaugacuuggagcaggccccacagaccccacagaggaugaagccaccccacagagg

SEQ ID NO: 200014 - RNA, 63 nt, hsa
gugggcauggaaugcugaugacuuggagcaggccccacagaccccacagaggaugaagccacc

SEQ ID NO: 200015 - RNA, 63 nt, hsa
gacacugaaagcugaguccugccgucugucucacccacagaugucuguagucggucgguguga

SEQ ID NO: 200016 - RNA, 63 nt, hsa
cccagauucucaagcagaugcccaagggagguccccacagagccagagugccugaggcuuccu

SEQ ID NO: 200017 - RNA, 63 nt, hsa
uaaaugauugauaauaggaaugaguuaccucuucccacagacauuuguuuuuaaguaugacag

SEQ ID NO: 200018 - RNA, 63 nt, hsa
auauuuuccagagucucuaaacucucaucuucccccacagauacacauccaagcucacaaaua

SEQ ID NO: 200019 - RNA, 63 nt, hsa
ggacccccagagccaagguggcugggaucuggccccacagauggggaaagauggggaagggug

SEQ ID NO: 200020 - RNA, 63 nt, hsa
acuccauaugcaaucaguagcgagcagccgggccccacagacccucaugcacucucuuacgug

SEQ ID NO: 200021 - RNA, 63 nt, hsa
cgaauccugacugcaaggcccaccugccccucccccacagagccuccagagcuagcugaggcc

SEQ ID NO: 200022 - RNA, 63 nt, hsa
ggggcaacggcuccccauuuuucccgagccccgcccacagagcucuuagccaauccuaugcag

SEQ ID NO: 200023 - RNA, 63 nt, hsa
acaaauuugcugggagagggaaagacauucagacccacagaaaggaggcagcacacagagaaa

SEQ ID NO: 200024 - RNA, 63 nt, hsa
uggggagguuggucagggaagagagggguucuacccacagaucaacuguguaaucuuuuacua

SEQ ID NO: 200025 - RNA, 63 nt, hsa
ugcaggagcauagaauaguuuggguaccaggaacccacagaggcacacaugaaaagccaaauu

SEQ ID NO: 200026 - RNA, 63 nt, hsa
uuagucuccauuucauagaugaaaauagugaagcccacagaaaauaaguagcuccuccacagg

SEQ ID NO: 200027 - RNA, 63 nt, hsa
cagggaccacccuccccacaguaugcacucagccccacagaacccaccagucuuucugggaac

SEQ ID NO: 200028 - RNA, 63 nt, hsa
agaguccccagccucccucagguuacucugcaccccacagaugguuugauggcugugcuguau

SEQ ID NO: 200029 - RNA, 63 nt, hsa
ccugcuccccacacggacuccaggcgguccccacccacagaagcagaccuucagcucagguaa

SEQ ID NO: 200030 - RNA, 63 nt, hsa
gggguggcccuggaggccccugaccccaccccacccacagagcacgagggccccgucagcuca

SEQ ID NO: 200031 - RNA, 63 nt, hsa
aacgggaugcuuugaagauaccaugaaauaaaacccacagagguauuugauguauuuaauugu

SEQ ID NO: 200032 - RNA, 63 nt, hsa
cagggacuugcaguggauucuuggucaggugugcccacagaugcggaggcgaggugagugauu

SEQ ID NO: 200033 - RNA, 63 nt, hsa
aaagguggugagggcggaggggccgcuccaggccccacagagcaggagacccccagagaaagc

SEQ ID NO: 200034 - RNA, 63 nt, hsa
ggugaguuuggugcaugcaaaccugugugcucacccacagagcaugggguaaugguguguaga

SEQ ID NO: 200035 - RNA, 63 nt, hsa
cucagcccaacugcaggugguaggauaggggugcccacagagggcaaagaaacugcccauggu

SEQ ID NO: 200036 - RNA, 63 nt, hsa
ccugugcuggccugugcucaacacgggccccuccccacagaaagcugcuccuggaugccccug

SEQ ID NO: 200037 - RNA, 64 nt, hsa; identical to SEQ ID NO: 125667

SEQ ID NO: 200038 - RNA, 64 nt, hsa; identical to SEQ ID NO: 125668

SEQ ID NO: 200039 - RNA, 64 nt, hsa; identical to SEQ ID NO: 125669

SEQ ID NO: 200040 - RNA, 64 nt, hsa; identical to SEQ ID NO: 125670

SEQ ID NO: 200041 - RNA, 64 nt, hsa; identical to SEQ ID NO: 125671

SEQ ID NO: 200042 - RNA, 64 nt, hsa; identical to SEQ ID NO: 125672

SEQ ID NO: 200043 - RNA, 64 nt, hsa; identical to SEQ ID NO: 125673

SEQ ID NO: 200044 - RNA, 64 nt, hsa; identical to SEQ ID NO: 125674

SEQ ID NO: 200045 - RNA, 64 nt, hsa; identical to SEQ ID NO: 125675

SEQ ID NO: 200046 - RNA, 64 nt, hsa; identical to SEQ ID NO: 125676

SEQ ID NO: 200047 - RNA, 64 nt, hsa; identical to SEQ ID NO: 125677

SEQ ID NO: 200048 - RNA, 64 nt, hsa; identical to SEQ ID NO: 125678

SEQ ID NO: 200049 - RNA, 64 nt, hsa; identical to SEQ ID NO: 125679

SEQ ID NO: 200050 - RNA, 64 nt, hsa; identical to SEQ ID NO: 125680

SEQ ID NO: 200051 - RNA, 64 nt, hsa; identical to SEQ ID NO: 125681

SEQ ID NO: 200052 - RNA, 64 nt, hsa; identical to SEQ ID NO: 125682

SEQ ID NO: 200053 - RNA, 64 nt, hsa; identical to SEQ ID NO: 125683

SEQ ID NO: 200054 - RNA, 64 nt, hsa; identical to SEQ ID NO: 125684

SEQ ID NO: 200055 - RNA, 64 nt, hsa; identical to SEQ ID NO: 125685

SEQ ID NO: 200056 - RNA, 64 nt, hsa; identical to SEQ ID NO: 125686

SEQ ID NO: 200057 - RNA, 64 nt, hsa; identical to SEQ ID NO: 125687

SEQ ID NO: 200058 - RNA, 64 nt, hsa; identical to SEQ ID NO: 125688

SEQ ID NO: 200059 - RNA, 64 nt, hsa; identical to SEQ ID NO: 125689

SEQ ID NO: 200060 - RNA, 64 nt, hsa; identical to SEQ ID NO: 125690

SEQ ID NO: 200061 - RNA, 64 nt, hsa; identical to SEQ ID NO: 125691

SEQ ID NO: 200062 - RNA, 64 nt, hsa; identical to SEQ ID NO: 125692

SEQ ID NO: 200063 - RNA, 64 nt, hsa; identical to SEQ ID NO: 125693

SEQ ID NO: 200064 - RNA, 64 nt, hsa; identical to SEQ ID NO: 125694

SEQ ID NO: 200065 - RNA, 64 nt, hsa; identical to SEQ ID NO: 125695

SEQ ID NO: 200066 - RNA, 64 nt, hsa; identical to SEQ ID NO: 125696

SEQ ID NO: 200067 - RNA, 64 nt, hsa; identical to SEQ ID NO: 125697

SEQ ID NO: 200068 - RNA, 64 nt, hsa; identical to SEQ ID NO: 125698

SEQ ID NO: 200069 - RNA, 64 nt, hsa; identical to SEQ ID NO: 125699

SEQ ID NO: 200070 - RNA, 64 nt, hsa; identical to SEQ ID NO: 125700

SEQ ID NO: 200071 - RNA, 64 nt, hsa; identical to SEQ ID NO: 108992

SEQ ID NO: 200072 - RNA, 64 nt, hsa; identical to SEQ ID NO: 108993

SEQ ID NO: 200073 - RNA, 64 nt, hsa; identical to SEQ ID NO: 108994

SEQ ID NO: 200074 - RNA, 64 nt, hsa; identical to SEQ ID NO: 108995

SEQ ID NO: 200075 - RNA, 64 nt, hsa; identical to SEQ ID NO: 108996

SEQ ID NO: 200076 - RNA, 64 nt, hsa; identical to SEQ ID NO: 108997

SEQ ID NO: 200077 - RNA, 64 nt, hsa; identical to SEQ ID NO: 108998

SEQ ID NO: 200078 - RNA, 64 nt, hsa; identical to SEQ ID NO: 108999

SEQ ID NO: 200079 - RNA, 64 nt, hsa; identical to SEQ ID NO: 109000

SEQ ID NO: 200080 - RNA, 64 nt, hsa; identical to SEQ ID NO: 109001

SEQ ID NO: 200081 - RNA, 64 nt, hsa; identical to SEQ ID NO: 109002

SEQ ID NO: 200082 - RNA, 64 nt, hsa; identical to SEQ ID NO: 109003

SEQ ID NO: 200083 - RNA, 64 nt, hsa; identical to SEQ ID NO: 109004

SEQ ID NO: 200084 - RNA, 64 nt, hsa; identical to SEQ ID NO: 109005

SEQ ID NO: 200085 - RNA, 64 nt, hsa; identical to SEQ ID NO: 109006

SEQ ID NO: 200086 - RNA, 64 nt, hsa; identical to SEQ ID NO: 109007

SEQ ID NO: 200087 - RNA, 64 nt, hsa; identical to SEQ ID NO: 109008

SEQ ID NO: 200088 - RNA, 64 nt, hsa; identical to SEQ ID NO: 109009

SEQ ID NO: 200089 - RNA, 64 nt, hsa; identical to SEQ ID NO: 109010

SEQ ID NO: 200090 - RNA, 64 nt, hsa; identical to SEQ ID NO: 109011

SEQ ID NO: 200091 - RNA, 64 nt, hsa; identical to SEQ ID NO: 109012

SEQ ID NO: 200092 - RNA, 64 nt, hsa; identical to SEQ ID NO: 109013

SEQ ID NO: 200093 - RNA, 64 nt, hsa; identical to SEQ ID NO: 109014

SEQ ID NO: 200094 - RNA, 64 nt, hsa; identical to SEQ ID NO: 109015

SEQ ID NO: 200095 - RNA, 64 nt, hsa; identical to SEQ ID NO: 109016

SEQ ID NO: 200096 - RNA, 64 nt, hsa; identical to SEQ ID NO: 109017

SEQ ID NO: 200097 - RNA, 64 nt, hsa; identical to SEQ ID NO: 109018

SEQ ID NO: 200098 - RNA, 64 nt, hsa; identical to SEQ ID NO: 109019

SEQ ID NO: 200099 - RNA, 64 nt, hsa; identical to SEQ ID NO: 109020

SEQ ID NO: 200100 - RNA, 64 nt, hsa; identical to SEQ ID NO: 109021

SEQ ID NO: 200101 - RNA, 64 nt, hsa; identical to SEQ ID NO: 109022

SEQ ID NO: 200102 - RNA, 64 nt, hsa; identical to SEQ ID NO: 109023

SEQ ID NO: 200103 - RNA, 64 nt, hsa; identical to SEQ ID NO: 109024

SEQ ID NO: 200104 - RNA, 64 nt, hsa; identical to SEQ ID NO: 109025

SEQ ID NO: 200105 - RNA, 64 nt, hsa; identical to SEQ ID NO: 109026

SEQ ID NO: 200106 - RNA, 64 nt, hsa; identical to SEQ ID NO: 109027

SEQ ID NO: 200107 - RNA, 64 nt, hsa; identical to SEQ ID NO: 109028

SEQ ID NO: 200108 - RNA, 64 nt, hsa; identical to SEQ ID NO: 109029

SEQ ID NO: 200109 - RNA, 64 nt, hsa; identical to SEQ ID NO: 109030

SEQ ID NO: 200110 - RNA, 64 nt, hsa; identical to SEQ ID NO: 109031

SEQ ID NO: 200111 - RNA, 64 nt, hsa; identical to SEQ ID NO: 109032

SEQ ID NO: 200112 - RNA, 64 nt, hsa; identical to SEQ ID NO: 109033

SEQ ID NO: 200113 - RNA, 64 nt, hsa; identical to SEQ ID NO: 109034

SEQ ID NO: 200114 - RNA, 64 nt, hsa; identical to SEQ ID NO: 109035

SEQ ID NO: 200115 - RNA, 64 nt, hsa; identical to SEQ ID NO: 109036

SEQ ID NO: 200116 - RNA, 64 nt, hsa; identical to SEQ ID NO: 109037

SEQ ID NO: 200117 - RNA, 64 nt, hsa; identical to SEQ ID NO: 109038

SEQ ID NO: 200118 - RNA, 64 nt, hsa; identical to SEQ ID NO: 109039

SEQ ID NO: 200119 - RNA, 64 nt, hsa; identical to SEQ ID NO: 109040

SEQ ID NO: 200120 - RNA, 64 nt, hsa; identical to SEQ ID NO: 109041

SEQ ID NO: 200121 - RNA, 64 nt, hsa; identical to SEQ ID NO: 109042

SEQ ID NO: 200122 - RNA, 64 nt, hsa; identical to SEQ ID NO: 109043

SEQ ID NO: 200123 - RNA, 64 nt, hsa; identical to SEQ ID NO: 109044

SEQ ID NO: 200124 - RNA, 64 nt, hsa; identical to SEQ ID NO: 109045

SEQ ID NO: 200125 - RNA, 64 nt, hsa; identical to SEQ ID NO: 109046

SEQ ID NO: 200126 - RNA, 64 nt, hsa; identical to SEQ ID NO: 109047

SEQ ID NO: 200127 - RNA, 64 nt, hsa; identical to SEQ ID NO: 109048

SEQ ID NO: 200128 - RNA, 64 nt, hsa; identical to SEQ ID NO: 109049

SEQ ID NO: 200129 - RNA, 64 nt, hsa; identical to SEQ ID NO: 109050

SEQ ID NO: 200130 - RNA, 64 nt, hsa; identical to SEQ ID NO: 109051

SEQ ID NO: 200131 - RNA, 64 nt, hsa; identical to SEQ ID NO: 109052

SEQ ID NO: 200132 - RNA, 64 nt, hsa; identical to SEQ ID NO: 109053

SEQ ID NO: 200133 - RNA, 64 nt, hsa; identical to SEQ ID NO: 109054

SEQ ID NO: 200134 - RNA, 64 nt, hsa; identical to SEQ ID NO: 109055

SEQ ID NO: 200135 - RNA, 64 nt, hsa; identical to SEQ ID NO: 109056

SEQ ID NO: 200136 - RNA, 64 nt, hsa; identical to SEQ ID NO: 109057

SEQ ID NO: 200137 - RNA, 64 nt, hsa; identical to SEQ ID NO: 109058

SEQ ID NO: 200138 - RNA, 64 nt, hsa; identical to SEQ ID NO: 109059

SEQ ID NO: 200139 - RNA, 64 nt, hsa; identical to SEQ ID NO: 109060

SEQ ID NO: 200140 - RNA, 64 nt, hsa; identical to SEQ ID NO: 109061

SEQ ID NO: 200141 - RNA, 64 nt, hsa; identical to SEQ ID NO: 109062

SEQ ID NO: 200142 - RNA, 64 nt, hsa; identical to SEQ ID NO: 109063

SEQ ID NO: 200143 - RNA, 64 nt, hsa; identical to SEQ ID NO: 109064

SEQ ID NO: 200144 - RNA, 64 nt, hsa; identical to SEQ ID NO: 109065

SEQ ID NO: 200145 - RNA, 64 nt, hsa; identical to SEQ ID NO: 109066

SEQ ID NO: 200146 - RNA, 64 nt, hsa; identical to SEQ ID NO: 109067

SEQ ID NO: 200147 - RNA, 64 nt, hsa; identical to SEQ ID NO: 109068

SEQ ID NO: 200148 - RNA, 64 nt, hsa; identical to SEQ ID NO: 109069

SEQ ID NO: 200149 - RNA, 64 nt, hsa; identical to SEQ ID NO: 109070

SEQ ID NO: 200150 - RNA, 64 nt, hsa; identical to SEQ ID NO: 109071

SEQ ID NO: 200151 - RNA, 64 nt, hsa; identical to SEQ ID NO: 109072

SEQ ID NO: 200152 - RNA, 64 nt, hsa; identical to SEQ ID NO: 109073

SEQ ID NO: 200153 - RNA, 64 nt, hsa; identical to SEQ ID NO: 109074

SEQ ID NO: 200154 - RNA, 64 nt, hsa; identical to SEQ ID NO: 109075

SEQ ID NO: 200155 - RNA, 64 nt, hsa; identical to SEQ ID NO: 109076

SEQ ID NO: 200156 - RNA, 64 nt, hsa; identical to SEQ ID NO: 109077

SEQ ID NO: 200157 - RNA, 64 nt, hsa; identical to SEQ ID NO: 109078

SEQ ID NO: 200158 - RNA, 64 nt, hsa; identical to SEQ ID NO: 109079

SEQ ID NO: 200159 - RNA, 64 nt, hsa; identical to SEQ ID NO: 109080

SEQ ID NO: 200160 - RNA, 64 nt, hsa; identical to SEQ ID NO: 109081

SEQ ID NO: 200161 - RNA, 64 nt, hsa; identical to SEQ ID NO: 109082

SEQ ID NO: 200162 - RNA, 64 nt, hsa; identical to SEQ ID NO: 109083

SEQ ID NO: 200163 - RNA, 64 nt, hsa; identical to SEQ ID NO: 109084

SEQ ID NO: 200164 - RNA, 64 nt, hsa; identical to SEQ ID NO: 109085

SEQ ID NO: 200165 - RNA, 64 nt, hsa; identical to SEQ ID NO: 109086

SEQ ID NO: 200166 - RNA, 64 nt, hsa; identical to SEQ ID NO: 109087

SEQ ID NO: 200167 - RNA, 64 nt, hsa; identical to SEQ ID NO: 109088

SEQ ID NO: 200168 - RNA, 64 nt, hsa; identical to SEQ ID NO: 109089

SEQ ID NO: 200169 - RNA, 64 nt, hsa; identical to SEQ ID NO: 109090

SEQ ID NO: 200170 - RNA, 64 nt, hsa; identical to SEQ ID NO: 109091

SEQ ID NO: 200171 - RNA, 64 nt, hsa; identical to SEQ ID NO: 109092

SEQ ID NO: 200172 - RNA, 64 nt, hsa; identical to SEQ ID NO: 109093

SEQ ID NO: 200173 - RNA, 64 nt, hsa; identical to SEQ ID NO: 109094

SEQ ID NO: 200174 - RNA, 64 nt, hsa; identical to SEQ ID NO: 109095

SEQ ID NO: 200175 - RNA, 64 nt, hsa; identical to SEQ ID NO: 109096

SEQ ID NO: 200176 - RNA, 64 nt, hsa; identical to SEQ ID NO: 109097

SEQ ID NO: 200177 - RNA, 64 nt, hsa; identical to SEQ ID NO: 109098

SEQ ID NO: 200178 - RNA, 64 nt, hsa; identical to SEQ ID NO: 109099

SEQ ID NO: 200179 - RNA, 64 nt, hsa; identical to SEQ ID NO: 109100

SEQ ID NO: 200180 - RNA, 64 nt, hsa; identical to SEQ ID NO: 109101

SEQ ID NO: 200181 - RNA, 64 nt, hsa; identical to SEQ ID NO: 109102

SEQ ID NO: 200182 - RNA, 64 nt, hsa; identical to SEQ ID NO: 109103

SEQ ID NO: 200183 - RNA, 64 nt, hsa; identical to SEQ ID NO: 109104

SEQ ID NO: 200184 - RNA, 64 nt, hsa; identical to SEQ ID NO: 109105

SEQ ID NO: 200185 - RNA, 64 nt, hsa; identical to SEQ ID NO: 109106

SEQ ID NO: 200186 - RNA, 64 nt, hsa; identical to SEQ ID NO: 109107

SEQ ID NO: 200187 - RNA, 64 nt, hsa; identical to SEQ ID NO: 109108

SEQ ID NO: 200188 - RNA, 64 nt, hsa; identical to SEQ ID NO: 109109

SEQ ID NO: 200189 - RNA, 64 nt, hsa; identical to SEQ ID NO: 109110

SEQ ID NO: 200190 - RNA, 64 nt, hsa; identical to SEQ ID NO: 109111

SEQ ID NO: 200191 - RNA, 64 nt, hsa; identical to SEQ ID NO: 109112

SEQ ID NO: 200192 - RNA, 64 nt, hsa; identical to SEQ ID NO: 109113

SEQ ID NO: 200193 - RNA, 64 nt, hsa; identical to SEQ ID NO: 109114

SEQ ID NO: 200194 - RNA, 64 nt, hsa; identical to SEQ ID NO: 109115

SEQ ID NO: 200195 - RNA, 64 nt, hsa; identical to SEQ ID NO: 109116

SEQ ID NO: 200196 - RNA, 64 nt, hsa; identical to SEQ ID NO: 109117

SEQ ID NO: 200197 - RNA, 64 nt, hsa; identical to SEQ ID NO: 109118

SEQ ID NO: 200198 - RNA, 64 nt, hsa; identical to SEQ ID NO: 109119

SEQ ID NO: 200199 - RNA, 64 nt, hsa; identical to SEQ ID NO: 109120

SEQ ID NO: 200200 - RNA, 64 nt, hsa; identical to SEQ ID NO: 109121

SEQ ID NO: 200201 - RNA, 64 nt, hsa; identical to SEQ ID NO: 109122

SEQ ID NO: 200202 - RNA, 64 nt, hsa; identical to SEQ ID NO: 109123

SEQ ID NO: 200203 - RNA, 64 nt, hsa; identical to SEQ ID NO: 109124

SEQ ID NO: 200204 - RNA, 64 nt, hsa; identical to SEQ ID NO: 109125

SEQ ID NO: 200205 - RNA, 64 nt, hsa; identical to SEQ ID NO: 109126

SEQ ID NO: 200206 - RNA, 64 nt, hsa; identical to SEQ ID NO: 109127

SEQ ID NO: 200207 - RNA, 64 nt, hsa; identical to SEQ ID NO: 109128

SEQ ID NO: 200208 - RNA, 64 nt, hsa; identical to SEQ ID NO: 109129

SEQ ID NO: 200209 - RNA, 64 nt, hsa; identical to SEQ ID NO: 109130

SEQ ID NO: 200210 - RNA, 64 nt, hsa; identical to SEQ ID NO: 109131

SEQ ID NO: 200211 - RNA, 64 nt, hsa; identical to SEQ ID NO: 109132

SEQ ID NO: 200212 - RNA, 64 nt, hsa; identical to SEQ ID NO: 109133

SEQ ID NO: 200213 - RNA, 64 nt, hsa; identical to SEQ ID NO: 109134

SEQ ID NO: 200214 - RNA, 64 nt, hsa; identical to SEQ ID NO: 109135

SEQ ID NO: 200215 - RNA, 64 nt, hsa; identical to SEQ ID NO: 109136

SEQ ID NO: 200216 - RNA, 64 nt, hsa; identical to SEQ ID NO: 109137

SEQ ID NO: 200217 - RNA, 64 nt, hsa; identical to SEQ ID NO: 109138

SEQ ID NO: 200218 - RNA, 64 nt, hsa; identical to SEQ ID NO: 109139

SEQ ID NO: 200219 - RNA, 64 nt, hsa; identical to SEQ ID NO: 109140

SEQ ID NO: 200220 - RNA, 64 nt, hsa; identical to SEQ ID NO: 109141

SEQ ID NO: 200221 - RNA, 64 nt, hsa; identical to SEQ ID NO: 109142

SEQ ID NO: 200222 - RNA, 64 nt, hsa; identical to SEQ ID NO: 109143

SEQ ID NO: 200223 - RNA, 64 nt, hsa; identical to SEQ ID NO: 109144

SEQ ID NO: 200224 - RNA, 64 nt, hsa; identical to SEQ ID NO: 109145

SEQ ID NO: 200225 - RNA, 64 nt, hsa; identical to SEQ ID NO: 109146

SEQ ID NO: 200226 - RNA, 64 nt, hsa; identical to SEQ ID NO: 109147

SEQ ID NO: 200227 - RNA, 64 nt, hsa; identical to SEQ ID NO: 109148

SEQ ID NO: 200228 - RNA, 64 nt, hsa; identical to SEQ ID NO: 109149

SEQ ID NO: 200229 - RNA, 64 nt, hsa; identical to SEQ ID NO: 109150

SEQ ID NO: 200230 - RNA, 64 nt, hsa; identical to SEQ ID NO: 109151

SEQ ID NO: 200231 - RNA, 64 nt, hsa; identical to SEQ ID NO: 109152

SEQ ID NO: 200232 - RNA, 64 nt, hsa; identical to SEQ ID NO: 109153

SEQ ID NO: 200233 - RNA, 64 nt, hsa; identical to SEQ ID NO: 109154

SEQ ID NO: 200234 - RNA, 64 nt, hsa; identical to SEQ ID NO: 109155

SEQ ID NO: 200235 - RNA, 64 nt, hsa; identical to SEQ ID NO: 109156

SEQ ID NO: 200236 - RNA, 64 nt, hsa; identical to SEQ ID NO: 109157

SEQ ID NO: 200237 - RNA, 64 nt, hsa; identical to SEQ ID NO: 109158

SEQ ID NO: 200238 - RNA, 64 nt, hsa; identical to SEQ ID NO: 109159

SEQ ID NO: 200239 - RNA, 64 nt, hsa; identical to SEQ ID NO: 109160

SEQ ID NO: 200240 - RNA, 64 nt, hsa; identical to SEQ ID NO: 109161

SEQ ID NO: 200241 - RNA, 64 nt, hsa; identical to SEQ ID NO: 109162

SEQ ID NO: 200242 - RNA, 64 nt, hsa; identical to SEQ ID NO: 109163

SEQ ID NO: 200243 - RNA, 64 nt, hsa; identical to SEQ ID NO: 109164

SEQ ID NO: 200244 - RNA, 64 nt, hsa; identical to SEQ ID NO: 109165

SEQ ID NO: 200245 - RNA, 64 nt, hsa; identical to SEQ ID NO: 109166

SEQ ID NO: 200246 - RNA, 64 nt, hsa; identical to SEQ ID NO: 109167

SEQ ID NO: 200247 - RNA, 64 nt, hsa; identical to SEQ ID NO: 109168

SEQ ID NO: 200248 - RNA, 64 nt, hsa; identical to SEQ ID NO: 109169

SEQ ID NO: 200249 - RNA, 64 nt, hsa; identical to SEQ ID NO: 109170

SEQ ID NO: 200250 - RNA, 64 nt, hsa; identical to SEQ ID NO: 109171

SEQ ID NO: 200251 - RNA, 64 nt, hsa; identical to SEQ ID NO: 109172

SEQ ID NO: 200252 - RNA, 63 nt, hsa; identical to SEQ ID NO: 109173

SEQ ID NO: 200253 - RNA, 64 nt, hsa; identical to SEQ ID NO: 109174

SEQ ID NO: 200254 - RNA, 64 nt, hsa; identical to SEQ ID NO: 109175

SEQ ID NO: 200255 - RNA, 64 nt, hsa; identical to SEQ ID NO: 109176

SEQ ID NO: 200256 - RNA, 64 nt, hsa; identical to SEQ ID NO: 109177

SEQ ID NO: 200257 - RNA, 64 nt, hsa; identical to SEQ ID NO: 109178

SEQ ID NO: 200258 - RNA, 64 nt, hsa; identical to SEQ ID NO: 109179

SEQ ID NO: 200259 - RNA, 64 nt, hsa; identical to SEQ ID NO: 109180

SEQ ID NO: 200260 - RNA, 64 nt, hsa; identical to SEQ ID NO: 109181

SEQ ID NO: 200261 - RNA, 64 nt, hsa; identical to SEQ ID NO: 109182

SEQ ID NO: 200262 - RNA, 64 nt, hsa; identical to SEQ ID NO: 109183

SEQ ID NO: 200263 - RNA, 64 nt, hsa; identical to SEQ ID NO: 109184

SEQ ID NO: 200264 - RNA, 64 nt, hsa; identical to SEQ ID NO: 109185

SEQ ID NO: 200265 - RNA, 64 nt, hsa; identical to SEQ ID NO: 109186

SEQ ID NO: 200266 - RNA, 64 nt, hsa; identical to SEQ ID NO: 109187

SEQ ID NO: 200267 - RNA, 64 nt, hsa; identical to SEQ ID NO: 109188

SEQ ID NO: 200268 - RNA, 64 nt, hsa; identical to SEQ ID NO: 109189

SEQ ID NO: 200269 - RNA, 64 nt, hsa; identical to SEQ ID NO: 109190

SEQ ID NO: 200270 - RNA, 64 nt, hsa; identical to SEQ ID NO: 109191

SEQ ID NO: 200271 - RNA, 64 nt, hsa; identical to SEQ ID NO: 109192

SEQ ID NO: 200272 - RNA, 64 nt, hsa; identical to SEQ ID NO: 109193

SEQ ID NO: 200273 - RNA, 64 nt, hsa; identical to SEQ ID NO: 109194

SEQ ID NO: 200274 - RNA, 64 nt, hsa; identical to SEQ ID NO: 109195

SEQ ID NO: 200275 - RNA, 64 nt, hsa; identical to SEQ ID NO: 109196

SEQ ID NO: 200276 - RNA, 64 nt, hsa; identical to SEQ ID NO: 109197

SEQ ID NO: 200277 - RNA, 64 nt, hsa; identical to SEQ ID NO: 109198

SEQ ID NO: 200278 - RNA, 64 nt, hsa; identical to SEQ ID NO: 109199

SEQ ID NO: 200279 - RNA, 64 nt, hsa; identical to SEQ ID NO: 109200

SEQ ID NO: 200280 - RNA, 64 nt, hsa; identical to SEQ ID NO: 109201

SEQ ID NO: 200281 - RNA, 64 nt, hsa; identical to SEQ ID NO: 109202

SEQ ID NO: 200282 - RNA, 64 nt, hsa; identical to SEQ ID NO: 109203

SEQ ID NO: 200283 - RNA, 64 nt, hsa; identical to SEQ ID NO: 109204

SEQ ID NO: 200284 - RNA, 64 nt, hsa; identical to SEQ ID NO: 109205

SEQ ID NO: 200285 - RNA, 64 nt, hsa; identical to SEQ ID NO: 109206

SEQ ID NO: 200286 - RNA, 64 nt, hsa; identical to SEQ ID NO: 109207

SEQ ID NO: 200287 - RNA, 64 nt, hsa; identical to SEQ ID NO: 109208

SEQ ID NO: 200288 - RNA, 64 nt, hsa; identical to SEQ ID NO: 109209

SEQ ID NO: 200289 - RNA, 64 nt, hsa; identical to SEQ ID NO: 109210

SEQ ID NO: 200290 - RNA, 64 nt, hsa; identical to SEQ ID NO: 109211

SEQ ID NO: 200291 - RNA, 64 nt, hsa; identical to SEQ ID NO: 109212

SEQ ID NO: 200292 - RNA, 64 nt, hsa; identical to SEQ ID NO: 109213

SEQ ID NO: 200293 - RNA, 64 nt, hsa; identical to SEQ ID NO: 109214

SEQ ID NO: 200294 - RNA, 64 nt, hsa; identical to SEQ ID NO: 109215

SEQ ID NO: 200295 - RNA, 64 nt, hsa; identical to SEQ ID NO: 109216

SEQ ID NO: 200296 - RNA, 64 nt, hsa; identical to SEQ ID NO: 109217

SEQ ID NO: 200297 - RNA, 64 nt, hsa; identical to SEQ ID NO: 109218

SEQ ID NO: 200298 - RNA, 64 nt, hsa; identical to SEQ ID NO: 109219

SEQ ID NO: 200299 - RNA, 64 nt, hsa; identical to SEQ ID NO: 109220

SEQ ID NO: 200300 - RNA, 64 nt, hsa; identical to SEQ ID NO: 109221

SEQ ID NO: 200301 - RNA, 64 nt, hsa; identical to SEQ ID NO: 109222

SEQ ID NO: 200302 - RNA, 64 nt, hsa; identical to SEQ ID NO: 109223

SEQ ID NO: 200303 - RNA, 64 nt, hsa; identical to SEQ ID NO: 109224

SEQ ID NO: 200304 - RNA, 64 nt, hsa; identical to SEQ ID NO: 109225

SEQ ID NO: 200305 - RNA, 64 nt, hsa; identical to SEQ ID NO: 109226

SEQ ID NO: 200306 - RNA, 64 nt, hsa; identical to SEQ ID NO: 109227

SEQ ID NO: 200307 - RNA, 64 nt, hsa; identical to SEQ ID NO: 109228

SEQ ID NO: 200308 - RNA, 64 nt, hsa; identical to SEQ ID NO: 109229

SEQ ID NO: 200309 - RNA, 64 nt, hsa; identical to SEQ ID NO: 109230

SEQ ID NO: 200310 - RNA, 64 nt, hsa; identical to SEQ ID NO: 109231

SEQ ID NO: 200311 - RNA, 64 nt, hsa; identical to SEQ ID NO: 109232

SEQ ID NO: 200312 - RNA, 64 nt, hsa; identical to SEQ ID NO: 109233

SEQ ID NO: 200313 - RNA, 64 nt, hsa; identical to SEQ ID NO: 109234

SEQ ID NO: 200314 - RNA, 64 nt, hsa
aaaagagaaaaaaaaaaucaggcggucaaacuuagagcaacauugucuuauuaaagcauaguuu

SEQ ID NO: 200315 - RNA, 64 nt, hsa
auuuaugugucugcauauugcagaacagcucugagagcaacaguuucccauuaacucuuucuga

SEQ ID NO: 200316 - RNA, 64 nt, hsa
aaauaaccagugguuaaagagguaaucacagucugagcaacauggcaaaacccugugucuacaa

SEQ ID NO: 200317 - RNA, 64 nt, hsa
agugagcugugacugugccacugcacuccagcuugagcaacacagugauacugucucaauaaau

SEQ ID NO: 200318 - RNA, 64 nt, hsa
agacaguaccucugugucuaugagaaagcggggagagcaacaccccagcuucuagcagcucuac

SEQ ID NO: 200319 - RNA, 64 nt, hsa
caccuugcguggaaugaaaacgccaaaggcucaugagcaacauuaggcuagaggggucuuguuc

SEQ ID NO: 200320 - RNA, 64 nt, hsa
ccguuuugugaaaaccagccauaggaaaacaugugagcaacaacccccaugaacauuuguccua

SEQ ID NO: 200321 - RNA, 64 nt, hsa
ggaauugugccacugcacuccaaccugagugacagagcaacacucugucuuaaaagaaaaaaaa

SEQ ID NO: 200322 - RNA, 64 nt, hsa
agugagccaagacagcaccauugcaccccagccugagcaacaagagcgaaacuccaucucagga

SEQ ID NO: 200323 - RNA, 64 nt, hsa
gaauggcuugagcccaggaguucaagaccggccugagcaacauagugaggaucccaucucuacg

SEQ ID NO: 200324 - RNA, 56 nt, hsa
cgacugcacagaauggcugacuugaagagcaacaucauagagugugaauuucuauu

SEQ ID NO: 200325 - RNA, 64 nt, hsa
uguugcuuccagacauacuucucugcaacuuguugagcaacauuuuaagauguuggacuucugc

SEQ ID NO: 200326 - RNA, 64 nt, hsa
guuuuccacugcuaaaacugaagcaccacugugugagcaacaggaagggagagcgcacgaggga

SEQ ID NO: 200327 - RNA, 64 nt, hsa
acaguuuaaacaagccagcgcuacuggagaagaggagcaacaccugugccgcggccggaggagu

SEQ ID NO: 200328 - RNA, 61 nt, hsa
ccaguagauugucugucagugaccuucuguaguaauaaaguuuuugccacuguaaauaaaa

SEQ ID NO: 200329 - RNA, 61 nt, hsa
uaacuuuuuauauuaaugacuauugaaagugguaauaaaaauuuauauuauaggcuucaau

SEQ ID NO: 200330 - RNA, 61 nt, hsa
caguugugagcuuuaguuuaauguaauauuuguaauaaaaacguuuggccaggcaccaugg

SEQ ID NO: 200331 - RNA, 61 nt, hsa
cuucauuccuugccugcuuugauaaauuuuaguaauaaauucccaaaacuaucauguugau

SEQ ID NO: 200332 - RNA, 61 nt, hsa
uauuacugaggaaagggaggagaggacaaguguaauaaaucaaaauugaccucaaaagaaa

SEQ ID NO: 200333 - RNA, 61 nt, hsa
agauuuccuuuggcaauaucauauucuaaaaguaauaaauuccaauacaaguuacauacau

SEQ ID NO: 200334 - RNA, 61 nt, hsa
aaaacaauagaacucauaaaacuuagaaaugguaauaaaucuuggcuccugucucuagccc

SEQ ID NO: 200335 - RNA, 61 nt, hsa
uuuucuagaauccucauuacagcuaacgcugguaauaaagguaggaaaacaauagaacuca

SEQ ID NO: 200336 - RNA, 61 nt, hsa
guuauuccaagggaauauugccaaugcuacaguaauaaaugaaugucacuucuggauauag

SEQ ID NO: 200337 - RNA, 61 nt, hsa
aaguagaucaugcauagagugugauguauguguaauaaauauguuucacacaaacaaggcc

SEQ ID NO: 200338 - RNA, 61 nt, hsa
uaggcuugucagguuaguaauaaacugaacaguaauaaaacuguggaaguaauuggaucug

SEQ ID NO: 200339 - RNA, 61 nt, hsa
gaaauguuacccaauuaggcuugucagguuaguaauaaacugaacaguaauaaaacugugg

SEQ ID NO: 200340 - RNA, 61 nt, hsa
accuucuaacaacuaucuuucaaaaguaaauguaauaaaaaugcacaacauaaaauguuua

SEQ ID NO: 200341 - RNA, 61 nt, hsa
auucauuugugugcccuggaauuuccaacuaguaauaaacaacuacuguugauguaguuuu

SEQ ID NO: 200342 - RNA, 61 nt, hsa
gaguuuguccauugcuagggagagacuuccaguaauaaaauuuacuauucuagaugcuucu

SEQ ID NO: 200343 - RNA, 61 nt, hsa
aucuugguuauaagggaguuaaaacaaugcuguaauaaauaaagugcuucaugugaucaaa

SEQ ID NO: 200344 - RNA, 61 nt, hsa
cagauuuuacucaacauuagagaguuaguacguaauaaaagcauuauaaaugcaauuuuug

SEQ ID NO: 200345 - RNA, 61 nt, hsa
uaguauaucauuuuacuauuuguacuuuuauguaauaaaaugcaauguguuuaaaaauuuu

SEQ ID NO: 200346 - RNA, 61 nt, hsa
ggaauuuguauuggagaaaaacccugcaaauguaauaaauauggaaaaacauuuuuucaaa

SEQ ID NO: 200347 - RNA, 61 nt, hsa
uuaauuaucauuuuguugauugugcuuuuauguaauaaaaugcaguacuuuaaaacauuua

SEQ ID NO: 200348 - RNA, 61 nt, hsa
uuuuuauuuucuaugauuucuagaaacaaauguaauaaauauuuuuaaaaucuccuuucua

SEQ ID NO: 200349 - RNA, 61 nt, hsa
guucagacucauauauggauuucaaaucuuuguaauaaaaauuauuuguauuuuuaaguuu

SEQ ID NO: 200350 - RNA, 61 nt, hsa
auugcauuuccucucauuaacaauuggguguguaauaaaaagcauuguacuucaucuuaaa

SEQ ID NO: 200351 - RNA, 61 nt, hsa
acagggacucuuuuuggaucucuauugacaaguaauaaaagucuggcccucauaacuuguu

SEQ ID NO: 200352 - RNA, 61 nt, hsa
gauggcauaaaauaaucauuuuugaaccuguguaauaaagcuugaaagcagggaaaagaau

SEQ ID NO: 200353 - RNA, 61 nt, hsa
uuauugggugccuuuguuuguaaaccaaaaaguaauaaaugaaucccuauauuuccauuau

SEQ ID NO: 200354 - RNA, 61 nt, hsa
ccugggaaaaccuucagcugcuuuauuuuuaguaauaaauuucucuugucaauucuguuua

SEQ ID NO: 200355 - RNA, 61 nt, hsa
aggacaacacaaaugggauugguacuuuauaguaauaaaucugaccagcagagggagggau

SEQ ID NO: 200356 - RNA, 61 nt, hsa
cuguauaaaugugaaauuuuuauuuguauuaguaauaaaacauuaguaguuuaaacaauuu

SEQ ID NO: 200357 - RNA, 61 nt, hsa
uuuauuguaaucauaaauacugcuguauaagguaauaaaacucugcaccuaauccccauaa

SEQ ID NO: 200358 - RNA, 61 nt, hsa
cauuuaagcaguaccaagacugaaaaaaaagguaauaaaugaaauguuuugaaauauacuu

SEQ ID NO: 200359 - RNA, 61 nt, hsa
gauucuaaguaguugccaucuugaauccuuuguaauaaagccauacuuuugugugugugug

SEQ ID NO: 200360 - RNA, 61 nt, hsa
cguaaaguaauauuuacagauguggggagauguaauaaaacaauauuaacuugguuucuug

SEQ ID NO: 200361 - RNA, 61 nt, hsa
ucugcucuuuuuuuuuuuuacggauauuuuaguaauaaauaugcuggauaaauauuagucc

SEQ ID NO: 200362 - RNA, 61 nt, hsa
gagucccgguuuguuucauuuuaaugggaggguaauaaagaugaaagaccaacauuuuaac

SEQ ID NO: 200363 - RNA, 61 nt, hsa
acaggaaaugacugguaauggaaaaaauguuguaauaaaauaaucuaaucaaagaauauua

SEQ ID NO: 200364 - RNA, 61 nt, hsa
caguacuaaaaaaacuguugucaaagaggauguaauaaauuguaguaauaaauaugaccac

SEQ ID NO: 200365 - RNA, 61 nt, hsa
acuguugucaaagaggauguaauaaauuguaguaauaaauaugaccacaagccauaaauga

SEQ ID NO: 200366 - RNA, 61 nt, hsa
aaaugacagaugugacuuuggaaccaaacuuguaauaaaaggaauuccaaauggacaagca

SEQ ID NO: 200367 - RNA, 61 nt, hsa
ugucauguauugacuuuaauauuguauuuugguaauaaauuuuuuguuaaaaaaaacuugg

SEQ ID NO: 200368 - RNA, 61 nt, hsa
uaguacguuauuuuacuauuuguacuuuuauguaauaaaaugcaguacauuuuuaaauuuu

SEQ ID NO: 200369 - RNA, 61 nt, hsa
ggaauucagauuggagaaaaacccugcaaauguaauaaauuugaaaaaaaaguuuuccaaa

SEQ ID NO: 200370 - RNA, 61 nt, hsa
caaggaauuugcauucuagaaaguagaagauguaauaaauguacugugggacauguuaaua

SEQ ID NO: 200371 - RNA, 61 nt, hsa
gaagaauucaaauauaaauaaaaaauugugaguaauaaaaugaacucacaguuucaacaau

SEQ ID NO: 200372 - RNA, 61 nt, hsa
ggcaucuucaccugaauucuucaaugccaggguaauaaaccaaaauaguccuaaucaguau

SEQ ID NO: 200373 - RNA, 61 nt, hsa
aaaaggucaucuuagauuuaucuuaguaaauguaauaaauuauuuuuuagaucuugaaauu

SEQ ID NO: 200374 - RNA, 61 nt, hsa
gauggauuuuauuucacucacacuccaguuuguaauaaaaugccaaauucugucagcuauc

SEQ ID NO: 200375 - RNA, 61 nt, hsa
ucuaagaugcugcgaucccguucugcugcccguaauaaaaaugcucucagacacugguuag

SEQ ID NO: 200376 - RNA, 61 nt, hsa
agguguuuucaaugugauuuuaguauuuacaguaauaaauaaaauuuauacaaaguuucag

SEQ ID NO: 200377 - RNA, 61 nt, hsa
ucaaaggaaauaaaucaguguccguuugccaguaauaaauuuaauauucuguuuuauacua

SEQ ID NO: 200378 - RNA, 64 nt, hsa; identical to SEQ ID NO: 158250

SEQ ID NO: 200379 - RNA, 64 nt, hsa; identical to SEQ ID NO: 158251

SEQ ID NO: 200380 - RNA, 64 nt, hsa; identical to SEQ ID NO: 158252

SEQ ID NO: 200381 - RNA, 64 nt, hsa; identical to SEQ ID NO: 158253

SEQ ID NO: 200382 - RNA, 64 nt, hsa; identical to SEQ ID NO: 158254

SEQ ID NO: 200383 - RNA, 64 nt, hsa; identical to SEQ ID NO: 158255

SEQ ID NO: 200384 - RNA, 64 nt, hsa; identical to SEQ ID NO: 158256

SEQ ID NO: 200385 - RNA, 64 nt, hsa; identical to SEQ ID NO: 158257

SEQ ID NO: 200386 - RNA, 58 nt, hsa; identical to SEQ ID NO: 158258

SEQ ID NO: 200387 - RNA, 64 nt, hsa; identical to SEQ ID NO: 158259

SEQ ID NO: 200388 - RNA, 64 nt, hsa; identical to SEQ ID NO: 158260

SEQ ID NO: 200389 - RNA, 64 nt, hsa; identical to SEQ ID NO: 158261

SEQ ID NO: 200390 - RNA, 64 nt, hsa; identical to SEQ ID NO: 158262

SEQ ID NO: 200391 - RNA, 64 nt, hsa; identical to SEQ ID NO: 158263

SEQ ID NO: 200392 - RNA, 61 nt, hsa; identical to SEQ ID NO: 158264

SEQ ID NO: 200393 - RNA, 64 nt, hsa; identical to SEQ ID NO: 158265

SEQ ID NO: 200394 - RNA, 64 nt, hsa; identical to SEQ ID NO: 158266

SEQ ID NO: 200395 - RNA, 64 nt, hsa; identical to SEQ ID NO: 158267

SEQ ID NO: 200396 - RNA, 64 nt, hsa; identical to SEQ ID NO: 158268

SEQ ID NO: 200397 - RNA, 64 nt, hsa; identical to SEQ ID NO: 158269

SEQ ID NO: 200398 - RNA, 64 nt, hsa; identical to SEQ ID NO: 158270

SEQ ID NO: 200399 - RNA, 64 nt, hsa; identical to SEQ ID NO: 158271

SEQ ID NO: 200400 - RNA, 64 nt, hsa; identical to SEQ ID NO: 158272

SEQ ID NO: 200401 - RNA, 64 nt, hsa; identical to SEQ ID NO: 158273

SEQ ID NO: 200402 - RNA, 64 nt, hsa; identical to SEQ ID NO: 158274

SEQ ID NO: 200403 - RNA, 64 nt, hsa; identical to SEQ ID NO: 158275

SEQ ID NO: 200404 - RNA, 64 nt, hsa; identical to SEQ ID NO: 158276

SEQ ID NO: 200405 - RNA, 64 nt, hsa; identical to SEQ ID NO: 158277

SEQ ID NO: 200406 - RNA, 64 nt, hsa; identical to SEQ ID NO: 158278

SEQ ID NO: 200407 - RNA, 64 nt, hsa; identical to SEQ ID NO: 158279

SEQ ID NO: 200408 - RNA, 64 nt, hsa; identical to SEQ ID NO: 158280

SEQ ID NO: 200409 - RNA, 64 nt, hsa; identical to SEQ ID NO: 158281

SEQ ID NO: 200410 - RNA, 64 nt, hsa; identical to SEQ ID NO: 158282

SEQ ID NO: 200411 - RNA, 64 nt, hsa; identical to SEQ ID NO: 158283

SEQ ID NO: 200412 - RNA, 64 nt, hsa; identical to SEQ ID NO: 158284

SEQ ID NO: 200413 - RNA, 64 nt, hsa; identical to SEQ ID NO: 158285

SEQ ID NO: 200414 - RNA, 64 nt, hsa; identical to SEQ ID NO: 158286

SEQ ID NO: 200415 - RNA, 64 nt, hsa; identical to SEQ ID NO: 158287

SEQ ID NO: 200416 - RNA, 64 nt, hsa; identical to SEQ ID NO: 158288

SEQ ID NO: 200417 - RNA, 64 nt, hsa; identical to SEQ ID NO: 158289

SEQ ID NO: 200418 - RNA, 64 nt, hsa; identical to SEQ ID NO: 158290

SEQ ID NO: 200419 - RNA, 64 nt, hsa; identical to SEQ ID NO: 158291

SEQ ID NO: 200420 - RNA, 64 nt, hsa; identical to SEQ ID NO: 158292

SEQ ID NO: 200421 - RNA, 64 nt, hsa; identical to SEQ ID NO: 158293

SEQ ID NO: 200422 - RNA, 64 nt, hsa; identical to SEQ ID NO: 158294

SEQ ID NO: 200423 - RNA, 64 nt, hsa; identical to SEQ ID NO: 158295

SEQ ID NO: 200424 - RNA, 64 nt, hsa; identical to SEQ ID NO: 158296

SEQ ID NO: 200425 - RNA, 64 nt, hsa; identical to SEQ ID NO: 158297

SEQ ID NO: 200426 - RNA, 64 nt, hsa; identical to SEQ ID NO: 158298

SEQ ID NO: 200427 - RNA, 64 nt, hsa; identical to SEQ ID NO: 158299

SEQ ID NO: 200428 - RNA, 64 nt, hsa; identical to SEQ ID NO: 158300

SEQ ID NO: 200429 - RNA, 64 nt, hsa; identical to SEQ ID NO: 158301

SEQ ID NO: 200430 - RNA, 64 nt, hsa; identical to SEQ ID NO: 158302

SEQ ID NO: 200431 - RNA, 64 nt, hsa; identical to SEQ ID NO: 158303

SEQ ID NO: 200432 - RNA, 64 nt, hsa; identical to SEQ ID NO: 158304

SEQ ID NO: 200433 - RNA, 64 nt, hsa; identical to SEQ ID NO: 158305

SEQ ID NO: 200434 - RNA, 64 nt, hsa; identical to SEQ ID NO: 158306

SEQ ID NO: 200435 - RNA, 64 nt, hsa; identical to SEQ ID NO: 158307

SEQ ID NO: 200436 - RNA, 64 nt, hsa; identical to SEQ ID NO: 158308

SEQ ID NO: 200437 - RNA, 64 nt, hsa; identical to SEQ ID NO: 158309

SEQ ID NO: 200438 - RNA, 64 nt, hsa; identical to SEQ ID NO: 158310

SEQ ID NO: 200439 - RNA, 64 nt, hsa; identical to SEQ ID NO: 158311

SEQ ID NO: 200440 - RNA, 64 nt, hsa; identical to SEQ ID NO: 158312

SEQ ID NO: 200441 - RNA, 64 nt, hsa; identical to SEQ ID NO: 158313

SEQ ID NO: 200442 - RNA, 64 nt, hsa; identical to SEQ ID NO: 158314

SEQ ID NO: 200443 - RNA, 64 nt, hsa; identical to SEQ ID NO: 158315

SEQ ID NO: 200444 - RNA, 64 nt, hsa; identical to SEQ ID NO: 158316

SEQ ID NO: 200445 - RNA, 64 nt, hsa; identical to SEQ ID NO: 158317

SEQ ID NO: 200446 - RNA, 64 nt, hsa; identical to SEQ ID NO: 158318

SEQ ID NO: 200447 - RNA, 64 nt, hsa; identical to SEQ ID NO: 158319

SEQ ID NO: 200448 - RNA, 64 nt, hsa; identical to SEQ ID NO: 158320

SEQ ID NO: 200449 - RNA, 64 nt, hsa; identical to SEQ ID NO: 158321

SEQ ID NO: 200450 - RNA, 64 nt, hsa; identical to SEQ ID NO: 158322

SEQ ID NO: 200451 - RNA, 64 nt, hsa; identical to SEQ ID NO: 158323

SEQ ID NO: 200452 - RNA, 64 nt, hsa; identical to SEQ ID NO: 158324

SEQ ID NO: 200453 - RNA, 64 nt, hsa; identical to SEQ ID NO: 158325

SEQ ID NO: 200454 - RNA, 64 nt, hsa; identical to SEQ ID NO: 158326

SEQ ID NO: 200455 - RNA, 64 nt, hsa; identical to SEQ ID NO: 158327

SEQ ID NO: 200456 - RNA, 64 nt, hsa; identical to SEQ ID NO: 158328

SEQ ID NO: 200457 - RNA, 64 nt, hsa; identical to SEQ ID NO: 158329

SEQ ID NO: 200458 - RNA, 64 nt, hsa; identical to SEQ ID NO: 158330

SEQ ID NO: 200459 - RNA, 64 nt, hsa; identical to SEQ ID NO: 158331

SEQ ID NO: 200460 - RNA, 64 nt, hsa; identical to SEQ ID NO: 158332

SEQ ID NO: 200461 - RNA, 64 nt, hsa; identical to SEQ ID NO: 158333

SEQ ID NO: 200462 - RNA, 64 nt, hsa; identical to SEQ ID NO: 158334

SEQ ID NO: 200463 - RNA, 64 nt, hsa; identical to SEQ ID NO: 158335

SEQ ID NO: 200464 - RNA, 64 nt, hsa; identical to SEQ ID NO: 158336

SEQ ID NO: 200465 - RNA, 64 nt, hsa; identical to SEQ ID NO: 158337

SEQ ID NO: 200466 - RNA, 64 nt, hsa; identical to SEQ ID NO: 158338

SEQ ID NO: 200467 - RNA, 64 nt, hsa; identical to SEQ ID NO: 158339

SEQ ID NO: 200468 - RNA, 64 nt, hsa; identical to SEQ ID NO: 158340

SEQ ID NO: 200469 - RNA, 64 nt, hsa; identical to SEQ ID NO: 158341

SEQ ID NO: 200470 - RNA, 64 nt, hsa; identical to SEQ ID NO: 158342

SEQ ID NO: 200471 - RNA, 64 nt, hsa; identical to SEQ ID NO: 158343

SEQ ID NO: 200472 - RNA, 64 nt, hsa; identical to SEQ ID NO: 158344

SEQ ID NO: 200473 - RNA, 64 nt, hsa; identical to SEQ ID NO: 158345

SEQ ID NO: 200474 - RNA, 64 nt, hsa; identical to SEQ ID NO: 158346

SEQ ID NO: 200475 - RNA, 64 nt, hsa; identical to SEQ ID NO: 158347

SEQ ID NO: 200476 - RNA, 64 nt, hsa; identical to SEQ ID NO: 158348

SEQ ID NO: 200477 - RNA, 64 nt, hsa; identical to SEQ ID NO: 158349

SEQ ID NO: 200478 - RNA, 64 nt, hsa; identical to SEQ ID NO: 158350

SEQ ID NO: 200479 - RNA, 64 nt, hsa; identical to SEQ ID NO: 158351

SEQ ID NO: 200480 - RNA, 64 nt, hsa; identical to SEQ ID NO: 158352

SEQ ID NO: 200481 - RNA, 64 nt, hsa; identical to SEQ ID NO: 158353

SEQ ID NO: 200482 - RNA, 64 nt, hsa; identical to SEQ ID NO: 158354

SEQ ID NO: 200483 - RNA, 64 nt, hsa; identical to SEQ ID NO: 158355

SEQ ID NO: 200484 - RNA, 64 nt, hsa; identical to SEQ ID NO: 158356

SEQ ID NO: 200485 - RNA, 64 nt, hsa; identical to SEQ ID NO: 158357

SEQ ID NO: 200486 - RNA, 64 nt, hsa; identical to SEQ ID NO: 158358

SEQ ID NO: 200487 - RNA, 64 nt, hsa; identical to SEQ ID NO: 158359

SEQ ID NO: 200488 - RNA, 64 nt, hsa; identical to SEQ ID NO: 158360

SEQ ID NO: 200489 - RNA, 64 nt, hsa; identical to SEQ ID NO: 158361

SEQ ID NO: 200490 - RNA, 64 nt, hsa; identical to SEQ ID NO: 158362

SEQ ID NO: 200491 - RNA, 64 nt, hsa; identical to SEQ ID NO: 158363

SEQ ID NO: 200492 - RNA, 64 nt, hsa; identical to SEQ ID NO: 158364

SEQ ID NO: 200493 - RNA, 64 nt, hsa; identical to SEQ ID NO: 158365

SEQ ID NO: 200494 - RNA, 64 nt, hsa; identical to SEQ ID NO: 158366

SEQ ID NO: 200495 - RNA, 64 nt, hsa; identical to SEQ ID NO: 158367

SEQ ID NO: 200496 - RNA, 64 nt, hsa; identical to SEQ ID NO: 158368

SEQ ID NO: 200497 - RNA, 64 nt, hsa; identical to SEQ ID NO: 158369

SEQ ID NO: 200498 - RNA, 64 nt, hsa; identical to SEQ ID NO: 158370

SEQ ID NO: 200499 - RNA, 64 nt, hsa; identical to SEQ ID NO: 158371

SEQ ID NO: 200500 - RNA, 64 nt, hsa; identical to SEQ ID NO: 158372

SEQ ID NO: 200501 - RNA, 64 nt, hsa; identical to SEQ ID NO: 158373

SEQ ID NO: 200502 - RNA, 64 nt, hsa; identical to SEQ ID NO: 158374

SEQ ID NO: 200503 - RNA, 64 nt, hsa; identical to SEQ ID NO: 158375

SEQ ID NO: 200504 - RNA, 64 nt, hsa; identical to SEQ ID NO: 158376

SEQ ID NO: 200505 - RNA, 64 nt, hsa; identical to SEQ ID NO: 158377

SEQ ID NO: 200506 - RNA, 64 nt, hsa; identical to SEQ ID NO: 158378

SEQ ID NO: 200507 - RNA, 64 nt, hsa; identical to SEQ ID NO: 158379

SEQ ID NO: 200508 - RNA, 64 nt, hsa; identical to SEQ ID NO: 158380

SEQ ID NO: 200509 - RNA, 64 nt, hsa; identical to SEQ ID NO: 158381

SEQ ID NO: 200510 - RNA, 64 nt, hsa; identical to SEQ ID NO: 158382

SEQ ID NO: 200511 - RNA, 64 nt, hsa; identical to SEQ ID NO: 158383

SEQ ID NO: 200512 - RNA, 64 nt, hsa; identical to SEQ ID NO: 158384

SEQ ID NO: 200513 - RNA, 64 nt, hsa; identical to SEQ ID NO: 158385

SEQ ID NO: 200514 - RNA, 64 nt, hsa; identical to SEQ ID NO: 158386

SEQ ID NO: 200515 - RNA, 64 nt, hsa; identical to SEQ ID NO: 158387

SEQ ID NO: 200516 - RNA, 64 nt, hsa; identical to SEQ ID NO: 158388

SEQ ID NO: 200517 - RNA, 64 nt, hsa; identical to SEQ ID NO: 158389

SEQ ID NO: 200518 - RNA, 64 nt, hsa; identical to SEQ ID NO: 158390

SEQ ID NO: 200519 - RNA, 64 nt, hsa; identical to SEQ ID NO: 158391

SEQ ID NO: 200520 - RNA, 64 nt, hsa; identical to SEQ ID NO: 158392

SEQ ID NO: 200521 - RNA, 64 nt, hsa; identical to SEQ ID NO: 158393

SEQ ID NO: 200522 - RNA, 64 nt, hsa; identical to SEQ ID NO: 158394

SEQ ID NO: 200523 - RNA, 64 nt, hsa; identical to SEQ ID NO: 158395

SEQ ID NO: 200524 - RNA, 64 nt, hsa; identical to SEQ ID NO: 158396

SEQ ID NO: 200525 - RNA, 64 nt, hsa; identical to SEQ ID NO: 158397

SEQ ID NO: 200526 - RNA, 64 nt, hsa; identical to SEQ ID NO: 158398

SEQ ID NO: 200527 - RNA, 64 nt, hsa; identical to SEQ ID NO: 158399

SEQ ID NO: 200528 - RNA, 64 nt, hsa; identical to SEQ ID NO: 158400

SEQ ID NO: 200529 - RNA, 64 nt, hsa; identical to SEQ ID NO: 158401

SEQ ID NO: 200530 - RNA, 64 nt, hsa; identical to SEQ ID NO: 158402

SEQ ID NO: 200531 - RNA, 64 nt, hsa; identical to SEQ ID NO: 158403

SEQ ID NO: 200532 - RNA, 64 nt, hsa; identical to SEQ ID NO: 158404

SEQ ID NO: 200533 - RNA, 64 nt, hsa; identical to SEQ ID NO: 158405

SEQ ID NO: 200534 - RNA, 64 nt, hsa; identical to SEQ ID NO: 158406

SEQ ID NO: 200535 - RNA, 64 nt, hsa; identical to SEQ ID NO: 158407

SEQ ID NO: 200536 - RNA, 64 nt, hsa; identical to SEQ ID NO: 158408

SEQ ID NO: 200537 - RNA, 64 nt, hsa; identical to SEQ ID NO: 158409

SEQ ID NO: 200538 - RNA, 64 nt, hsa; identical to SEQ ID NO: 158410

SEQ ID NO: 200539 - RNA, 64 nt, hsa; identical to SEQ ID NO: 158411

SEQ ID NO: 200540 - RNA, 64 nt, hsa; identical to SEQ ID NO: 158412

SEQ ID NO: 200541 - RNA, 64 nt, hsa; identical to SEQ ID NO: 158413

SEQ ID NO: 200542 - RNA, 64 nt, hsa; identical to SEQ ID NO: 158414

SEQ ID NO: 200543 - RNA, 64 nt, hsa; identical to SEQ ID NO: 158415

SEQ ID NO: 200544 - RNA, 64 nt, hsa; identical to SEQ ID NO: 158416

SEQ ID NO: 200545 - RNA, 64 nt, hsa; identical to SEQ ID NO: 158417

SEQ ID NO: 200546 - RNA, 64 nt, hsa; identical to SEQ ID NO: 158418

SEQ ID NO: 200547 - RNA, 64 nt, hsa; identical to SEQ ID NO: 158419

SEQ ID NO: 200548 - RNA, 64 nt, hsa; identical to SEQ ID NO: 158420

SEQ ID NO: 200549 - RNA, 64 nt, hsa; identical to SEQ ID NO: 158421

SEQ ID NO: 200550 - RNA, 64 nt, hsa; identical to SEQ ID NO: 158422

SEQ ID NO: 200551 - RNA, 64 nt, hsa; identical to SEQ ID NO: 158423

SEQ ID NO: 200552 - RNA, 64 nt, hsa; identical to SEQ ID NO: 158424

SEQ ID NO: 200553 - RNA, 64 nt, hsa; identical to SEQ ID NO: 158425

SEQ ID NO: 200554 - RNA, 64 nt, hsa; identical to SEQ ID NO: 158426

SEQ ID NO: 200555 - RNA, 64 nt, hsa; identical to SEQ ID NO: 158427

SEQ ID NO: 200556 - RNA, 64 nt, hsa; identical to SEQ ID NO: 158428

SEQ ID NO: 200557 - RNA, 64 nt, hsa; identical to SEQ ID NO: 158429

SEQ ID NO: 200558 - RNA, 64 nt, hsa; identical to SEQ ID NO: 158430

SEQ ID NO: 200559 - RNA, 64 nt, hsa; identical to SEQ ID NO: 158431

SEQ ID NO: 200560 - RNA, 64 nt, hsa; identical to SEQ ID NO: 158432

SEQ ID NO: 200561 - RNA, 64 nt, hsa; identical to SEQ ID NO: 158433

SEQ ID NO: 200562 - RNA, 64 nt, hsa; identical to SEQ ID NO: 158434

SEQ ID NO: 200563 - RNA, 64 nt, hsa; identical to SEQ ID NO: 158435

SEQ ID NO: 200564 - RNA, 64 nt, hsa; identical to SEQ ID NO: 158436

SEQ ID NO: 200565 - RNA, 64 nt, hsa; identical to SEQ ID NO: 158437

SEQ ID NO: 200566 - RNA, 64 nt, hsa; identical to SEQ ID NO: 158438

SEQ ID NO: 200567 - RNA, 64 nt, hsa; identical to SEQ ID NO: 158439

SEQ ID NO: 200568 - RNA, 64 nt, hsa; identical to SEQ ID NO: 158440

SEQ ID NO: 200569 - RNA, 64 nt, hsa; identical to SEQ ID NO: 158441

SEQ ID NO: 200570 - RNA, 64 nt, hsa; identical to SEQ ID NO: 158442

SEQ ID NO: 200571 - RNA, 64 nt, hsa; identical to SEQ ID NO: 158443

SEQ ID NO: 200572 - RNA, 64 nt, hsa; identical to SEQ ID NO: 158444

SEQ ID NO: 200573 - RNA, 64 nt, hsa; identical to SEQ ID NO: 158445

SEQ ID NO: 200574 - RNA, 64 nt, hsa; identical to SEQ ID NO: 158446

SEQ ID NO: 200575 - RNA, 64 nt, hsa; identical to SEQ ID NO: 158447

SEQ ID NO: 200576 - RNA, 64 nt, hsa; identical to SEQ ID NO: 158448

SEQ ID NO: 200577 - RNA, 64 nt, hsa; identical to SEQ ID NO: 158449

SEQ ID NO: 200578 - RNA, 64 nt, hsa; identical to SEQ ID NO: 158450

SEQ ID NO: 200579 - RNA, 64 nt, hsa; identical to SEQ ID NO: 158451

SEQ ID NO: 200580 - RNA, 64 nt, hsa; identical to SEQ ID NO: 158452

SEQ ID NO: 200581 - RNA, 64 nt, hsa; identical to SEQ ID NO: 158453

SEQ ID NO: 200582 - RNA, 64 nt, hsa; identical to SEQ ID NO: 158454

SEQ ID NO: 200583 - RNA, 64 nt, hsa; identical to SEQ ID NO: 158455

SEQ ID NO: 200584 - RNA, 64 nt, hsa; identical to SEQ ID NO: 158456

SEQ ID NO: 200585 - RNA, 64 nt, hsa; identical to SEQ ID NO: 158457

SEQ ID NO: 200586 - RNA, 64 nt, hsa; identical to SEQ ID NO: 158458

SEQ ID NO: 200587 - RNA, 64 nt, hsa; identical to SEQ ID NO: 158459

SEQ ID NO: 200588 - RNA, 64 nt, hsa; identical to SEQ ID NO: 106478

SEQ ID NO: 200589 - RNA, 64 nt, hsa; identical to SEQ ID NO: 106479

SEQ ID NO: 200590 - RNA, 64 nt, hsa; identical to SEQ ID NO: 106480

SEQ ID NO: 200591 - RNA, 64 nt, hsa; identical to SEQ ID NO: 106481

SEQ ID NO: 200592 - RNA, 64 nt, hsa; identical to SEQ ID NO: 106482

SEQ ID NO: 200593 - RNA, 64 nt, hsa; identical to SEQ ID NO: 106483

SEQ ID NO: 200594 - RNA, 64 nt, hsa; identical to SEQ ID NO: 106484

SEQ ID NO: 200595 - RNA, 64 nt, hsa; identical to SEQ ID NO: 106485

SEQ ID NO: 200596 - RNA, 64 nt, hsa; identical to SEQ ID NO: 106486

SEQ ID NO: 200597 - RNA, 64 nt, hsa; identical to SEQ ID NO: 106487

SEQ ID NO: 200598 - RNA, 64 nt, hsa; identical to SEQ ID NO: 106488

SEQ ID NO: 200599 - RNA, 64 nt, hsa; identical to SEQ ID NO: 106489

SEQ ID NO: 200600 - RNA, 64 nt, hsa; identical to SEQ ID NO: 106490

SEQ ID NO: 200601 - RNA, 64 nt, hsa; identical to SEQ ID NO: 106491

SEQ ID NO: 200602 - RNA, 64 nt, hsa; identical to SEQ ID NO: 106492

SEQ ID NO: 200603 - RNA, 64 nt, hsa; identical to SEQ ID NO: 106493

SEQ ID NO: 200604 - RNA, 64 nt, hsa; identical to SEQ ID NO: 106494

SEQ ID NO: 200605 - RNA, 64 nt, hsa; identical to SEQ ID NO: 51918

SEQ ID NO: 200606 - RNA, 64 nt, hsa; identical to SEQ ID NO: 51919

SEQ ID NO: 200607 - RNA, 64 nt, hsa; identical to SEQ ID NO: 51920

SEQ ID NO: 200608 - RNA, 64 nt, hsa; identical to SEQ ID NO: 51921

SEQ ID NO: 200609 - RNA, 64 nt, hsa; identical to SEQ ID NO: 51922

SEQ ID NO: 200610 - RNA, 64 nt, hsa; identical to SEQ ID NO: 51923

SEQ ID NO: 200611 - RNA, 64 nt, hsa; identical to SEQ ID NO: 51924

SEQ ID NO: 200612 - RNA, 64 nt, hsa; identical to SEQ ID NO: 51925

SEQ ID NO: 200613 - RNA, 64 nt, hsa; identical to SEQ ID NO: 51926

SEQ ID NO: 200614 - RNA, 64 nt, hsa; identical to SEQ ID NO: 51927

SEQ ID NO: 200615 - RNA, 64 nt, hsa; identical to SEQ ID NO: 51928

SEQ ID NO: 200616 - RNA, 64 nt, hsa; identical to SEQ ID NO: 51929

SEQ ID NO: 200617 - RNA, 64 nt, hsa; identical to SEQ ID NO: 51930

SEQ ID NO: 200618 - RNA, 64 nt, hsa; identical to SEQ ID NO: 51931

SEQ ID NO: 200619 - RNA, 64 nt, hsa; identical to SEQ ID NO: 51932

SEQ ID NO: 200620 - RNA, 64 nt, hsa; identical to SEQ ID NO: 51933

SEQ ID NO: 200621 - RNA, 64 nt, hsa; identical to SEQ ID NO: 51934

SEQ ID NO: 200622 - RNA, 64 nt, hsa; identical to SEQ ID NO: 51935

SEQ ID NO: 200623 - RNA, 64 nt, hsa; identical to SEQ ID NO: 51936

SEQ ID NO: 200624 - RNA, 64 nt, hsa; identical to SEQ ID NO: 51937

SEQ ID NO: 200625 - RNA, 64 nt, hsa; identical to SEQ ID NO: 51938

SEQ ID NO: 200626 - RNA, 64 nt, hsa; identical to SEQ ID NO: 51939

SEQ ID NO: 200627 - RNA, 64 nt, hsa; identical to SEQ ID NO: 51940

SEQ ID NO: 200628 - RNA, 64 nt, hsa; identical to SEQ ID NO: 51941

SEQ ID NO: 200629 - RNA, 64 nt, hsa; identical to SEQ ID NO: 51942

SEQ ID NO: 200630 - RNA, 64 nt, hsa; identical to SEQ ID NO: 51943

SEQ ID NO: 200631 - RNA, 64 nt, hsa; identical to SEQ ID NO: 51944

SEQ ID NO: 200632 - RNA, 64 nt, hsa; identical to SEQ ID NO: 108616

SEQ ID NO: 200633 - RNA, 64 nt, hsa; identical to SEQ ID NO: 108617

SEQ ID NO: 200634 - RNA, 64 nt, hsa; identical to SEQ ID NO: 108618

SEQ ID NO: 200635 - RNA, 64 nt, hsa; identical to SEQ ID NO: 108619

SEQ ID NO: 200636 - RNA, 64 nt, hsa; identical to SEQ ID NO: 108620

SEQ ID NO: 200637 - RNA, 64 nt, hsa; identical to SEQ ID NO: 108621

SEQ ID NO: 200638 - RNA, 64 nt, hsa; identical to SEQ ID NO: 108622

SEQ ID NO: 200639 - RNA, 64 nt, hsa; identical to SEQ ID NO: 108623

SEQ ID NO: 200640 - RNA, 61 nt, hsa; identical to SEQ ID NO: 108624

SEQ ID NO: 200641 - RNA, 64 nt, hsa; identical to SEQ ID NO: 108625

SEQ ID NO: 200642 - RNA, 64 nt, hsa; identical to SEQ ID NO: 108626

SEQ ID NO: 200643 - RNA, 64 nt, hsa; identical to SEQ ID NO: 108627

SEQ ID NO: 200644 - RNA, 64 nt, hsa; identical to SEQ ID NO: 108628

SEQ ID NO: 200645 - RNA, 64 nt, hsa; identical to SEQ ID NO: 108629

SEQ ID NO: 200646 - RNA, 64 nt, hsa; identical to SEQ ID NO: 108630

SEQ ID NO: 200647 - RNA, 64 nt, hsa; identical to SEQ ID NO: 108631

SEQ ID NO: 200648 - RNA, 64 nt, hsa; identical to SEQ ID NO: 108632

SEQ ID NO: 200649 - RNA, 64 nt, hsa; identical to SEQ ID NO: 108633

SEQ ID NO: 200650 - RNA, 64 nt, hsa; identical to SEQ ID NO: 108634

SEQ ID NO: 200651 - RNA, 64 nt, hsa; identical to SEQ ID NO: 108635

SEQ ID NO: 200652 - RNA, 64 nt, hsa; identical to SEQ ID NO: 108636

SEQ ID NO: 200653 - RNA, 64 nt, hsa; identical to SEQ ID NO: 108637

SEQ ID NO: 200654 - RNA, 64 nt, hsa; identical to SEQ ID NO: 108638

SEQ ID NO: 200655 - RNA, 64 nt, hsa; identical to SEQ ID NO: 108639

SEQ ID NO: 200656 - RNA, 64 nt, hsa; identical to SEQ ID NO: 108640

SEQ ID NO: 200657 - RNA, 64 nt, hsa; identical to SEQ ID NO: 108641

SEQ ID NO: 200658 - RNA, 64 nt, hsa; identical to SEQ ID NO: 108642

SEQ ID NO: 200659 - RNA, 64 nt, hsa; identical to SEQ ID NO: 108643

SEQ ID NO: 200660 - RNA, 64 nt, hsa; identical to SEQ ID NO: 108644

SEQ ID NO: 200661 - RNA, 64 nt, hsa; identical to SEQ ID NO: 108645

SEQ ID NO: 200662 - RNA, 64 nt, hsa; identical to SEQ ID NO: 108646

SEQ ID NO: 200663 - RNA, 64 nt, hsa; identical to SEQ ID NO: 108647

SEQ ID NO: 200664 - RNA, 64 nt, hsa; identical to SEQ ID NO: 108648

SEQ ID NO: 200665 - RNA, 64 nt, hsa; identical to SEQ ID NO: 108649

SEQ ID NO: 200666 - RNA, 64 nt, hsa; identical to SEQ ID NO: 108650

SEQ ID NO: 200667 - RNA, 64 nt, hsa; identical to SEQ ID NO: 108651

SEQ ID NO: 200668 - RNA, 64 nt, hsa; identical to SEQ ID NO: 108652

SEQ ID NO: 200669 - RNA, 64 nt, hsa; identical to SEQ ID NO: 108653

SEQ ID NO: 200670 - RNA, 64 nt, hsa; identical to SEQ ID NO: 108654

SEQ ID NO: 200671 - RNA, 64 nt, hsa; identical to SEQ ID NO: 108655

SEQ ID NO: 200672 - RNA, 64 nt, hsa; identical to SEQ ID NO: 108656

SEQ ID NO: 200673 - RNA, 64 nt, hsa; identical to SEQ ID NO: 108657

SEQ ID NO: 200674 - RNA, 64 nt, hsa; identical to SEQ ID NO: 108658

SEQ ID NO: 200675 - RNA, 64 nt, hsa; identical to SEQ ID NO: 108659

SEQ ID NO: 200676 - RNA, 64 nt, hsa; identical to SEQ ID NO: 108660

SEQ ID NO: 200677 - RNA, 64 nt, hsa; identical to SEQ ID NO: 108661

SEQ ID NO: 200678 - RNA, 64 nt, hsa; identical to SEQ ID NO: 108662

SEQ ID NO: 200679 - RNA, 64 nt, hsa; identical to SEQ ID NO: 108663

SEQ ID NO: 200680 - RNA, 64 nt, hsa; identical to SEQ ID NO: 108664

SEQ ID NO: 200681 - RNA, 64 nt, hsa; identical to SEQ ID NO: 108665

SEQ ID NO: 200682 - RNA, 64 nt, hsa; identical to SEQ ID NO: 108666

SEQ ID NO: 200683 - RNA, 64 nt, hsa; identical to SEQ ID NO: 108667

SEQ ID NO: 200684 - RNA, 64 nt, hsa; identical to SEQ ID NO: 108668

SEQ ID NO: 200685 - RNA, 64 nt, hsa; identical to SEQ ID NO: 108669

SEQ ID NO: 200686 - RNA, 64 nt, hsa; identical to SEQ ID NO: 108670

SEQ ID NO: 200687 - RNA, 64 nt, hsa; identical to SEQ ID NO: 108671

SEQ ID NO: 200688 - RNA, 64 nt, hsa; identical to SEQ ID NO: 108672

SEQ ID NO: 200689 - RNA, 64 nt, hsa; identical to SEQ ID NO: 108673

SEQ ID NO: 200690 - RNA, 64 nt, hsa; identical to SEQ ID NO: 108674

SEQ ID NO: 200691 - RNA, 64 nt, hsa; identical to SEQ ID NO: 108675

SEQ ID NO: 200692 - RNA, 64 nt, hsa; identical to SEQ ID NO: 108676

SEQ ID NO: 200693 - RNA, 64 nt, hsa; identical to SEQ ID NO: 108677

SEQ ID NO: 200694 - RNA, 64 nt, hsa; identical to SEQ ID NO: 108678

SEQ ID NO: 200695 - RNA, 64 nt, hsa; identical to SEQ ID NO: 108679

SEQ ID NO: 200696 - RNA, 64 nt, hsa; identical to SEQ ID NO: 108680

SEQ ID NO: 200697 - RNA, 64 nt, hsa; identical to SEQ ID NO: 108681

SEQ ID NO: 200698 - RNA, 64 nt, hsa; identical to SEQ ID NO: 108682

SEQ ID NO: 200699 - RNA, 64 nt, hsa; identical to SEQ ID NO: 108683

SEQ ID NO: 200700 - RNA, 64 nt, hsa; identical to SEQ ID NO: 108684

SEQ ID NO: 200701 - RNA, 64 nt, hsa; identical to SEQ ID NO: 108685

SEQ ID NO: 200702 - RNA, 64 nt, hsa; identical to SEQ ID NO: 108686

SEQ ID NO: 200703 - RNA, 64 nt, hsa; identical to SEQ ID NO: 108687

SEQ ID NO: 200704 - RNA, 64 nt, hsa; identical to SEQ ID NO: 108688

SEQ ID NO: 200705 - RNA, 64 nt, hsa; identical to SEQ ID NO: 108689

SEQ ID NO: 200706 - RNA, 64 nt, hsa; identical to SEQ ID NO: 108690

SEQ ID NO: 200707 - RNA, 64 nt, hsa; identical to SEQ ID NO: 108691

SEQ ID NO: 200708 - RNA, 64 nt, hsa; identical to SEQ ID NO: 108692

SEQ ID NO: 200709 - RNA, 64 nt, hsa; identical to SEQ ID NO: 108693

SEQ ID NO: 200710 - RNA, 64 nt, hsa; identical to SEQ ID NO: 108694

SEQ ID NO: 200711 - RNA, 64 nt, hsa; identical to SEQ ID NO: 108695

SEQ ID NO: 200712 - RNA, 64 nt, hsa; identical to SEQ ID NO: 108696

SEQ ID NO: 200713 - RNA, 64 nt, hsa; identical to SEQ ID NO: 108697

SEQ ID NO: 200714 - RNA, 64 nt, hsa; identical to SEQ ID NO: 108698

SEQ ID NO: 200715 - RNA, 64 nt, hsa; identical to SEQ ID NO: 108699

SEQ ID NO: 200716 - RNA, 64 nt, hsa; identical to SEQ ID NO: 108700

SEQ ID NO: 200717 - RNA, 64 nt, hsa; identical to SEQ ID NO: 108701

SEQ ID NO: 200718 - RNA, 64 nt, hsa; identical to SEQ ID NO: 108702

SEQ ID NO: 200719 - RNA, 64 nt, hsa; identical to SEQ ID NO: 108703

SEQ ID NO: 200720 - RNA, 64 nt, hsa; identical to SEQ ID NO: 108704

SEQ ID NO: 200721 - RNA, 64 nt, hsa; identical to SEQ ID NO: 108705

SEQ ID NO: 200722 - RNA, 64 nt, hsa; identical to SEQ ID NO: 108706

SEQ ID NO: 200723 - RNA, 64 nt, hsa; identical to SEQ ID NO: 108707

SEQ ID NO: 200724 - RNA, 64 nt, hsa; identical to SEQ ID NO: 108708

SEQ ID NO: 200725 - RNA, 64 nt, hsa; identical to SEQ ID NO: 108709

SEQ ID NO: 200726 - RNA, 64 nt, hsa; identical to SEQ ID NO: 108710

SEQ ID NO: 200727 - RNA, 64 nt, hsa; identical to SEQ ID NO: 108711

SEQ ID NO: 200728 - RNA, 64 nt, hsa; identical to SEQ ID NO: 108712

SEQ ID NO: 200729 - RNA, 64 nt, hsa; identical to SEQ ID NO: 108713

SEQ ID NO: 200730 - RNA, 64 nt, hsa; identical to SEQ ID NO: 108714

SEQ ID NO: 200731 - RNA, 64 nt, hsa; identical to SEQ ID NO: 108715

SEQ ID NO: 200732 - RNA, 64 nt, hsa; identical to SEQ ID NO: 108716

SEQ ID NO: 200733 - RNA, 64 nt, hsa; identical to SEQ ID NO: 108717

SEQ ID NO: 200734 - RNA, 64 nt, hsa; identical to SEQ ID NO: 108718

SEQ ID NO: 200735 - RNA, 64 nt, hsa; identical to SEQ ID NO: 108719

SEQ ID NO: 200736 - RNA, 64 nt, hsa; identical to SEQ ID NO: 108720

SEQ ID NO: 200737 - RNA, 64 nt, hsa; identical to SEQ ID NO: 108721

SEQ ID NO: 200738 - RNA, 64 nt, hsa; identical to SEQ ID NO: 108722

SEQ ID NO: 200739 - RNA, 64 nt, hsa; identical to SEQ ID NO: 108723

SEQ ID NO: 200740 - RNA, 64 nt, hsa; identical to SEQ ID NO: 108724

SEQ ID NO: 200741 - RNA, 64 nt, hsa; identical to SEQ ID NO: 108725

SEQ ID NO: 200742 - RNA, 64 nt, hsa; identical to SEQ ID NO: 108726

SEQ ID NO: 200743 - RNA, 64 nt, hsa; identical to SEQ ID NO: 108727

SEQ ID NO: 200744 - RNA, 64 nt, hsa; identical to SEQ ID NO: 108728

SEQ ID NO: 200745 - RNA, 64 nt, hsa; identical to SEQ ID NO: 108729

SEQ ID NO: 200746 - RNA, 64 nt, hsa; identical to SEQ ID NO: 108730

SEQ ID NO: 200747 - RNA, 64 nt, hsa; identical to SEQ ID NO: 108731

SEQ ID NO: 200748 - RNA, 64 nt, hsa; identical to SEQ ID NO: 108732

SEQ ID NO: 200749 - RNA, 64 nt, hsa; identical to SEQ ID NO: 108733

SEQ ID NO: 200750 - RNA, 64 nt, hsa; identical to SEQ ID NO: 108734

SEQ ID NO: 200751 - RNA, 64 nt, hsa; identical to SEQ ID NO: 108735

SEQ ID NO: 200752 - RNA, 64 nt, hsa; identical to SEQ ID NO: 108736

SEQ ID NO: 200753 - RNA, 64 nt, hsa; identical to SEQ ID NO: 108737

SEQ ID NO: 200754 - RNA, 64 nt, hsa; identical to SEQ ID NO: 108738

SEQ ID NO: 200755 - RNA, 64 nt, hsa; identical to SEQ ID NO: 108739

SEQ ID NO: 200756 - RNA, 64 nt, hsa; identical to SEQ ID NO: 108740

SEQ ID NO: 200757 - RNA, 64 nt, hsa; identical to SEQ ID NO: 108741

SEQ ID NO: 200758 - RNA, 64 nt, hsa; identical to SEQ ID NO: 108742

SEQ ID NO: 200759 - RNA, 64 nt, hsa; identical to SEQ ID NO: 108743

SEQ ID NO: 200760 - RNA, 64 nt, hsa; identical to SEQ ID NO: 108744

SEQ ID NO: 200761 - RNA, 64 nt, hsa; identical to SEQ ID NO: 108745

SEQ ID NO: 200762 - RNA, 64 nt, hsa; identical to SEQ ID NO: 108746

SEQ ID NO: 200763 - RNA, 64 nt, hsa; identical to SEQ ID NO: 108747

SEQ ID NO: 200764 - RNA, 64 nt, hsa; identical to SEQ ID NO: 108748

SEQ ID NO: 200765 - RNA, 64 nt, hsa; identical to SEQ ID NO: 108749

SEQ ID NO: 200766 - RNA, 64 nt, hsa; identical to SEQ ID NO: 108750

SEQ ID NO: 200767 - RNA, 64 nt, hsa; identical to SEQ ID NO: 108751

SEQ ID NO: 200768 - RNA, 64 nt, hsa; identical to SEQ ID NO: 108752

SEQ ID NO: 200769 - RNA, 64 nt, hsa; identical to SEQ ID NO: 108753

SEQ ID NO: 200770 - RNA, 64 nt, hsa; identical to SEQ ID NO: 108754

SEQ ID NO: 200771 - RNA, 64 nt, hsa; identical to SEQ ID NO: 108755

SEQ ID NO: 200772 - RNA, 64 nt, hsa; identical to SEQ ID NO: 108756

SEQ ID NO: 200773 - RNA, 64 nt, hsa; identical to SEQ ID NO: 108757

SEQ ID NO: 200774 - RNA, 64 nt, hsa; identical to SEQ ID NO: 108758

SEQ ID NO: 200775 - RNA, 64 nt, hsa; identical to SEQ ID NO: 108759

SEQ ID NO: 200776 - RNA, 64 nt, hsa; identical to SEQ ID NO: 108760

SEQ ID NO: 200777 - RNA, 64 nt, hsa; identical to SEQ ID NO: 108761

SEQ ID NO: 200778 - RNA, 64 nt, hsa; identical to SEQ ID NO: 108762

SEQ ID NO: 200779 - RNA, 64 nt, hsa; identical to SEQ ID NO: 108763

SEQ ID NO: 200780 - RNA, 64 nt, hsa; identical to SEQ ID NO: 108764

SEQ ID NO: 200781 - RNA, 64 nt, hsa; identical to SEQ ID NO: 108765

SEQ ID NO: 200782 - RNA, 64 nt, hsa
acugaucugccauuuucaccucuaaauccccaugucugaccauuaguuuucuucucuuuccuuc

SEQ ID NO: 200783 - RNA, 64 nt, hsa
cuuauuguuuuuguaacuugcauuuuacaagaguucugaccagcaccagauaagcuucagugcu

SEQ ID NO: 200784 - RNA, 64 nt, hsa
uuugaucaaaccaaaagcaacauuugucauguggucugaccauguggagauguuucuggacuug

SEQ ID NO: 200785 - RNA, 64 nt, hsa
acaaagaauuaaaaacugguaacaccacaggcuuucugaccauccauucguuggguuuugcauu

SEQ ID NO: 200786 - RNA, 64 nt, hsa
cagcucuugguuaauuuagguucauggggaacccucugaccaccugaaugggaugucauagcuu

SEQ ID NO: 200787 - RNA, 64 nt, hsa
auuggguaucuuggugcugccuguauuggucccuucugaccacucuccugccuccagagaaagc

SEQ ID NO: 200788 - RNA, 64 nt, hsa
uuuuuucccuacaucucuuuuggccaaaagaauaucugaccaucacagagauccagagaacaga

SEQ ID NO: 200789 - RNA, 64 nt, hsa
gccuucucugauucauucacaaaacuguggugguucugaccaccugugacgaggggggucauaa

SEQ ID NO: 200790 - RNA, 64 nt, hsa
ucucaguuguuaaaaguauacccuggaccacccaucugaccaucuccuuaagguuucacccaaa

SEQ ID NO: 200791 - RNA, 64 nt, hsa
acauucuggaacucucuccuuuccuggcuggggcucugaccacaaacuccccuccaggcugccc

SEQ ID NO: 200792 - RNA, 64 nt, hsa
cccuauagaggggcugcuuuaugggaaguuuuucucugaccagguacaacaccugacuuuaaag

SEQ ID NO: 200793 - RNA, 64 nt, hsa
ugggcucagaaaugucugugguauugggucagacucugaccacagguuuuaugcuguuuagcac

SEQ ID NO: 200794 - RNA, 64 nt, hsa
auauucaaacagaaagaauaagaacagccacugcucugaccacuucaaucuuagaugagguaaa

SEQ ID NO: 200795 - RNA, 64 nt, hsa
ugccuuagaucuuuucagugaucuggauaaguguucugaccagggagugacagguuaugacauu

SEQ ID NO: 200796 - RNA, 64 nt, hsa
cuugaauaaaauguuacauuuauacuuugagaacucugaccaaaucuuucauacagauacaggu

SEQ ID NO: 200797 - RNA, 64 nt, hsa
aggucuuggcgccuuugcaaagugauagaaaagaucugaccaagugcaaaaaaaugcuuuuuaa

SEQ ID NO: 200798 - RNA, 64 nt, hsa; identical to SEQ ID NO: 48749

SEQ ID NO: 200799 - RNA, 64 nt, hsa; identical to SEQ ID NO: 48750

SEQ ID NO: 200800 - RNA, 64 nt, hsa; identical to SEQ ID NO: 48751

SEQ ID NO: 200801 - RNA, 64 nt, hsa; identical to SEQ ID NO: 48752

SEQ ID NO: 200802 - RNA, 64 nt, hsa; identical to SEQ ID NO: 48753

SEQ ID NO: 200803 - RNA, 64 nt, hsa; identical to SEQ ID NO: 48754

SEQ ID NO: 200804 - RNA, 64 nt, hsa; identical to SEQ ID NO: 48755

SEQ ID NO: 200805 - RNA, 64 nt, hsa; identical to SEQ ID NO: 48756

SEQ ID NO: 200806 - RNA, 64 nt, hsa; identical to SEQ ID NO: 48757

SEQ ID NO: 200807 - RNA, 64 nt, hsa; identical to SEQ ID NO: 48758

SEQ ID NO: 200808 - RNA, 64 nt, hsa
auauauuauuuuagguauaauuuacaaaugucacaccuaauaaucuuuuauaauauaccauauu

SEQ ID NO: 200809 - RNA, 64 nt, hsa
auuacuauuuuguuauauggaaugguuaauuuuuaccuaauaaaaacauagaugaaauacauug

SEQ ID NO: 200810 - RNA, 64 nt, hsa
cuguggagcacccagggacgugguuuuagagucuaccuaauauguuaaggacaaggaaaccucu

SEQ ID NO: 200811 - RNA, 64 nt, hsa
cuaauauguuaaggacaaggaaaccucugagucuaccuaauauguuaaggacaaggaaaccucu

SEQ ID NO: 200812 - RNA, 64 nt, hsa
uuugucuaaauuuaauaauuaguauaaggauaugaccuaauaaaugucuccuuaccuaaagauu

SEQ ID NO: 200813 - RNA, 64 nt, hsa
augaccuauuuaucugaaguuuauaauuguuuauaccuaauacaguucuuuuuggaguaagaau

SEQ ID NO: 200814 - RNA, 64 nt, hsa
agacacauuauuuucuucugaacuuggcaauauaaccuaauaaggcagaauaaguuucuguuaa

SEQ ID NO: 200815 - RNA, 64 nt, hsa
guacuuuuauuacauuucuuaauccauuguuuuuaccuaauaaaauuuccuccucuauauucca

SEQ ID NO: 200816 - RNA, 64 nt, hsa
auuuucaaagaaaaacgagggaaaugggaggggugcaaaagaggagaguaagaaacagcaugga

SEQ ID NO: 200817 - RNA, 64 nt, hsa
aaaaaaaucccaucacccacagcaaaugacagcugcaaaagagaacaccaaucccauccacacu

SEQ ID NO: 200818 - RNA, 64 nt, hsa
agaaaauuaauaaaaaauuuauauauaggcagcagcaaaagagccauguucaaaauagucauua

SEQ ID NO: 200819 - RNA, 64 nt, hsa
auauucacauccccucaguugcagugaauugugagcaaaagaucuugaaagcaaaaagcacuaa

SEQ ID NO: 200820 - RNA, 64 nt, hsa
caguaauuuccacaccuuaauuaucauucaacuugcaaaagagacaacugauaagaagaaaauu

SEQ ID NO: 200821 - RNA, 64 nt, hsa
uaauuaggaaaaggcauauauuaacauaaaaauugcaaaagaaaugucgcuguaaauaagauuu

SEQ ID NO: 200822 - RNA, 64 nt, hsa
ugacccaagaucgugccacuucacuccagccugggcaaaagagcaaaacgccaucucaaaaaau

SEQ ID NO: 200823 - RNA, 64 nt, hsa
ccaaacaguuguagaauccgauagaugacugauggcaaaagauugugaacauguggaagaaaau

SEQ ID NO: 200824 - RNA, 64 nt, hsa
uaauuguagggaucuuuaaaaguugaagagggaggcaaaagaggaggucagagugauccuguau

SEQ ID NO: 200825 - RNA, 64 nt, hsa
auucucaggaacugugaauauguuaugccacauugcaaaagaauuuugcagaagugauuaauuu

SEQ ID NO: 200826 - RNA, 64 nt, hsa
cagauuucccuccaugauuugggaaccagcuuaggcaaaagaguccccacaagaugaaaauaaa

SEQ ID NO: 200827 - RNA, 64 nt, hsa
ucuccuacuuaauauaugaccaugacuuugaaaggcaaaagaggaaucaagaauaaauaaaaca

SEQ ID NO: 200828 - RNA, 64 nt, hsa
aguguucucaacugaguaacuuuuaaguggaaaccaaguuuagauuuggggagugguaaaggaa

SEQ ID NO: 200829 - RNA, 64 nt, hsa
guacugcccaaguuaaauauugauagccuaaagacaaguuuauguaguacuuaauguacaugau

SEQ ID NO: 200830 - RNA, 64 nt, hsa
aaaaugaauaagcuaucaauauauaauuuaaguacaaguuuaggcugggcgugguggcucacgc

SEQ ID NO: 200831 - RNA, 64 nt, hsa
aucucaaaaaaagaaagaaagaaaaaagaaaguacaaguuuauaaaguauuauagugaaaaauu

SEQ ID NO: 200832 - RNA, 64 nt, hsa
ucaaggaaaugaauauauuguuagaccagguaagcaaguuuauuuuuguuaaagagcacuuggu

SEQ ID NO: 200833 - RNA, 64 nt, hsa
uguccuuuuaauuuuugcuuagaauagaauggaacaaguuuaaauuucaaggaaauaugaaggc

SEQ ID NO: 200834 - RNA, 64 nt, hsa
uauaggucuuaaacaugaugaauuuuuucuauuacaaguuuauuuaaaacugcuuucucaaguc

SEQ ID NO: 200835 - RNA, 64 nt, hsa
auuauugccaaaaaguuuuuuuuaaucugucuuucaaguuuacagaaaagaaagcaguaaaugc

SEQ ID NO: 200836 - RNA, 64 nt, hsa
caauaaggucuuuuuuaaauauacaaauuuuacucaaguuuaaauuguauaaaacugcuuagaa

SEQ ID NO: 200837 - RNA, 64 nt, hsa
uuaauccauuguuuaaauuuacaacuuaacuuuccaaguuuauauccuagucaaacaaaauuua

SEQ ID NO: 200838 - RNA, 64 nt, hsa
aauuguaucuuauuauaaaauggacacaaauuuucaaguuuacacuucauauagcauugauaau

SEQ ID NO: 200839 - RNA, 64 nt, hsa
ggaggguggggggauuuguagcauaacuguagcucaaguuuaaaagccauguauaaccaagugu

SEQ ID NO: 200840 - RNA, 64 nt, hsa
gaucaaacagccaaacaccuggaaguauuagauacaaguuuaaaauaucuuuuauagguuuuau

SEQ ID NO: 200841 - RNA, 64 nt, hsa
aauuuaaugauauguuagugccucuguuauaugucaaguuuaaagcagggcacauuguugcagc

SEQ ID NO: 200842 - RNA, 64 nt, hsa
ggcacucccuggagagaggacccagugacuuguccaaguuuacacacgacacuaaucuccccug

SEQ ID NO: 200843 - RNA, 64 nt, hsa
gggcaagcagggcccaucuuacauccucucucuccaaguuuaucucauccuuuauuuuuaauca

SEQ ID NO: 200844 - RNA, 64 nt, hsa
accuguuuuagucaguugggaggaagggaaaaaucaaguuuaauucccuuuaucuggguuaauu

SEQ ID NO: 200845 - RNA, 64 nt, hsa
gacuuauacucuugagaaugaauucaguuucaaucaaguuuacauuauguugcuuaaaaaaaua

SEQ ID NO: 200846 - RNA, 64 nt, hsa
cugguuuucaauaccaccaagaggaaaauauugacaaguuuaaaggcugugucauugggccaug

SEQ ID NO: 200847 - RNA, 64 nt, hsa
gggaauuaacaauugccagggaaaccagccaacccaaguuuauuauaucauuaaccuuaucaua

SEQ ID NO: 200848 - RNA, 64 nt, hsa
aaguuuuggaaaguuauaaagguguauguuuuagccauaugauuuuaauuuuaauuuugcuucu

SEQ ID NO: 200849 - RNA, 64 nt, hsa
aggagugcaccucucuacuugggagguacaauugccauaugauuucuagcugccauggugguua

SEQ ID NO: 200850 - RNA, 64 nt, hsa
auacauaugcuauuucucuuaaaccucagagcaaccauaugagcauuguaauuaauauucccau

SEQ ID NO: 200851 - RNA, 64 nt, hsa
acaucucuuucauccauaccacacugccuacaugccauaugacaggauguguaaugggcuaacg

SEQ ID NO: 200852 - RNA, 64 nt, hsa
ucaaaaucaugagacaacucauaugggagagaagccauaugaauguaaauaaugugggaaagca

SEQ ID NO: 200853 - RNA, 64 nt, hsa
ucaaacccacaaaauuucucacacaggacacaaaccauaugauuguaaggaauguaggaagucc

SEQ ID NO: 200854 - RNA, 64 nt, hsa; identical to SEQ ID NO: 156991

SEQ ID NO: 200855 - RNA, 64 nt, hsa; identical to SEQ ID NO: 156992

SEQ ID NO: 200856 - RNA, 64 nt, hsa; identical to SEQ ID NO: 156993

SEQ ID NO: 200857 - RNA, 64 nt, hsa; identical to SEQ ID NO: 156994

SEQ ID NO: 200858 - RNA, 64 nt, hsa; identical to SEQ ID NO: 156995

SEQ ID NO: 200859 - RNA, 64 nt, hsa; identical to SEQ ID NO: 156996

SEQ ID NO: 200860 - RNA, 64 nt, hsa; identical to SEQ ID NO: 156997

SEQ ID NO: 200861 - RNA, 64 nt, hsa; identical to SEQ ID NO: 156998

SEQ ID NO: 200862 - RNA, 64 nt, hsa; identical to SEQ ID NO: 156999

SEQ ID NO: 200863 - RNA, 64 nt, hsa; identical to SEQ ID NO: 157000

SEQ ID NO: 200864 - RNA, 64 nt, hsa; identical to SEQ ID NO: 157001

SEQ ID NO: 200865 - RNA, 64 nt, hsa; identical to SEQ ID NO: 157002

SEQ ID NO: 200866 - RNA, 64 nt, hsa; identical to SEQ ID NO: 157003

SEQ ID NO: 200867 - RNA, 64 nt, hsa; identical to SEQ ID NO: 157004

SEQ ID NO: 200868 - RNA, 64 nt, hsa; identical to SEQ ID NO: 157005

SEQ ID NO: 200869 - RNA, 64 nt, hsa; identical to SEQ ID NO: 157006

SEQ ID NO: 200870 - RNA, 64 nt, hsa; identical to SEQ ID NO: 157007

SEQ ID NO: 200871 - RNA, 64 nt, hsa; identical to SEQ ID NO: 157008

SEQ ID NO: 200872 - RNA, 64 nt, hsa; identical to SEQ ID NO: 157009

SEQ ID NO: 200873 - RNA, 64 nt, hsa; identical to SEQ ID NO: 157010

SEQ ID NO: 200874 - RNA, 64 nt, hsa; identical to SEQ ID NO: 157011

SEQ ID NO: 200875 - RNA, 64 nt, hsa; identical to SEQ ID NO: 157012

SEQ ID NO: 200876 - RNA, 64 nt, hsa; identical to SEQ ID NO: 157013

SEQ ID NO: 200877 - RNA, 64 nt, hsa; identical to SEQ ID NO: 157014

SEQ ID NO: 200878 - RNA, 64 nt, hsa; identical to SEQ ID NO: 157015

SEQ ID NO: 200879 - RNA, 64 nt, hsa; identical to SEQ ID NO: 157016

SEQ ID NO: 200880 - RNA, 64 nt, hsa; identical to SEQ ID NO: 157017

SEQ ID NO: 200881 - RNA, 64 nt, hsa; identical to SEQ ID NO: 157018

SEQ ID NO: 200882 - RNA, 64 nt, hsa; identical to SEQ ID NO: 157019

SEQ ID NO: 200883 - RNA, 64 nt, hsa; identical to SEQ ID NO: 157020

SEQ ID NO: 200884 - RNA, 64 nt, hsa; identical to SEQ ID NO: 157021

SEQ ID NO: 200885 - RNA, 64 nt, hsa; identical to SEQ ID NO: 157022

SEQ ID NO: 200886 - RNA, 64 nt, hsa; identical to SEQ ID NO: 157023

SEQ ID NO: 200887 - RNA, 64 nt, hsa; identical to SEQ ID NO: 157024

SEQ ID NO: 200888 - RNA, 64 nt, hsa; identical to SEQ ID NO: 157025

SEQ ID NO: 200889 - RNA, 64 nt, hsa; identical to SEQ ID NO: 157026

SEQ ID NO: 200890 - RNA, 64 nt, hsa; identical to SEQ ID NO: 157027

SEQ ID NO: 200891 - RNA, 64 nt, hsa; identical to SEQ ID NO: 157028

SEQ ID NO: 200892 - RNA, 64 nt, hsa; identical to SEQ ID NO: 157029

SEQ ID NO: 200893 - RNA, 64 nt, hsa; identical to SEQ ID NO: 157030

SEQ ID NO: 200894 - RNA, 64 nt, hsa; identical to SEQ ID NO: 157031

SEQ ID NO: 200895 - RNA, 64 nt, hsa; identical to SEQ ID NO: 157032

SEQ ID NO: 200896 - RNA, 64 nt, hsa; identical to SEQ ID NO: 157033

SEQ ID NO: 200897 - RNA, 64 nt, hsa; identical to SEQ ID NO: 157034

SEQ ID NO: 200898 - RNA, 64 nt, hsa; identical to SEQ ID NO: 157035

SEQ ID NO: 200899 - RNA, 64 nt, hsa; identical to SEQ ID NO: 157036

SEQ ID NO: 200900 - RNA, 64 nt, hsa; identical to SEQ ID NO: 157037

SEQ ID NO: 200901 - RNA, 64 nt, hsa; identical to SEQ ID NO: 157038

SEQ ID NO: 200902 - RNA, 64 nt, hsa; identical to SEQ ID NO: 157039

SEQ ID NO: 200903 - RNA, 64 nt, hsa; identical to SEQ ID NO: 157040

SEQ ID NO: 200904 - RNA, 64 nt, hsa; identical to SEQ ID NO: 157041

SEQ ID NO: 200905 - RNA, 64 nt, hsa; identical to SEQ ID NO: 157042

SEQ ID NO: 200906 - RNA, 64 nt, hsa; identical to SEQ ID NO: 157043

SEQ ID NO: 200907 - RNA, 64 nt, hsa; identical to SEQ ID NO: 157044

SEQ ID NO: 200908 - RNA, 64 nt, hsa; identical to SEQ ID NO: 157045

SEQ ID NO: 200909 - RNA, 64 nt, hsa; identical to SEQ ID NO: 157046

SEQ ID NO: 200910 - RNA, 64 nt, hsa; identical to SEQ ID NO: 157047

SEQ ID NO: 200911 - RNA, 64 nt, hsa; identical to SEQ ID NO: 157048

SEQ ID NO: 200912 - RNA, 64 nt, hsa; identical to SEQ ID NO: 157049

SEQ ID NO: 200913 - RNA, 64 nt, hsa; identical to SEQ ID NO: 157050

SEQ ID NO: 200914 - RNA, 64 nt, hsa; identical to SEQ ID NO: 157051

SEQ ID NO: 200915 - RNA, 64 nt, hsa; identical to SEQ ID NO: 157052

SEQ ID NO: 200916 - RNA, 64 nt, hsa; identical to SEQ ID NO: 157053

SEQ ID NO: 200917 - RNA, 64 nt, hsa; identical to SEQ ID NO: 157054

SEQ ID NO: 200918 - RNA, 64 nt, hsa; identical to SEQ ID NO: 157055

SEQ ID NO: 200919 - RNA, 64 nt, hsa; identical to SEQ ID NO: 157056

SEQ ID NO: 200920 - RNA, 64 nt, hsa; identical to SEQ ID NO: 157057

SEQ ID NO: 200921 - RNA, 64 nt, hsa; identical to SEQ ID NO: 157058

SEQ ID NO: 200922 - RNA, 64 nt, hsa; identical to SEQ ID NO: 157059

SEQ ID NO: 200923 - RNA, 64 nt, hsa; identical to SEQ ID NO: 157060

SEQ ID NO: 200924 - RNA, 64 nt, hsa; identical to SEQ ID NO: 157061

SEQ ID NO: 200925 - RNA, 64 nt, hsa; identical to SEQ ID NO: 157062

SEQ ID NO: 200926 - RNA, 64 nt, hsa; identical to SEQ ID NO: 157063

SEQ ID NO: 200927 - RNA, 64 nt, hsa; identical to SEQ ID NO: 157064

SEQ ID NO: 200928 - RNA, 64 nt, hsa; identical to SEQ ID NO: 157065

SEQ ID NO: 200929 - RNA, 64 nt, hsa; identical to SEQ ID NO: 157066

SEQ ID NO: 200930 - RNA, 64 nt, hsa; identical to SEQ ID NO: 157067

SEQ ID NO: 200931 - RNA, 64 nt, hsa; identical to SEQ ID NO: 157068

SEQ ID NO: 200932 - RNA, 64 nt, hsa; identical to SEQ ID NO: 157069

SEQ ID NO: 200933 - RNA, 64 nt, hsa; identical to SEQ ID NO: 157070

SEQ ID NO: 200934 - RNA, 64 nt, hsa; identical to SEQ ID NO: 157071

SEQ ID NO: 200935 - RNA, 64 nt, hsa; identical to SEQ ID NO: 157072

SEQ ID NO: 200936 - RNA, 64 nt, hsa; identical to SEQ ID NO: 157073

SEQ ID NO: 200937 - RNA, 64 nt, hsa; identical to SEQ ID NO: 157074

SEQ ID NO: 200938 - RNA, 64 nt, hsa; identical to SEQ ID NO: 157075

SEQ ID NO: 200939 - RNA, 64 nt, hsa; identical to SEQ ID NO: 157076

SEQ ID NO: 200940 - RNA, 64 nt, hsa; identical to SEQ ID NO: 157077

SEQ ID NO: 200941 - RNA, 64 nt, hsa; identical to SEQ ID NO: 157078

SEQ ID NO: 200942 - RNA, 64 nt, hsa; identical to SEQ ID NO: 157079

SEQ ID NO: 200943 - RNA, 64 nt, hsa; identical to SEQ ID NO: 157080

SEQ ID NO: 200944 - RNA, 64 nt, hsa; identical to SEQ ID NO: 157081

SEQ ID NO: 200945 - RNA, 64 nt, hsa; identical to SEQ ID NO: 157082

SEQ ID NO: 200946 - RNA, 64 nt, hsa; identical to SEQ ID NO: 157083

SEQ ID NO: 200947 - RNA, 64 nt, hsa; identical to SEQ ID NO: 157084

SEQ ID NO: 200948 - RNA, 64 nt, hsa; identical to SEQ ID NO: 157085

SEQ ID NO: 200949 - RNA, 64 nt, hsa; identical to SEQ ID NO: 157086

SEQ ID NO: 200950 - RNA, 64 nt, hsa; identical to SEQ ID NO: 157087

SEQ ID NO: 200951 - RNA, 64 nt, hsa; identical to SEQ ID NO: 157088

SEQ ID NO: 200952 - RNA, 64 nt, hsa; identical to SEQ ID NO: 157089

SEQ ID NO: 200953 - RNA, 64 nt, hsa; identical to SEQ ID NO: 157090

SEQ ID NO: 200954 - RNA, 64 nt, hsa; identical to SEQ ID NO: 157091

SEQ ID NO: 200955 - RNA, 64 nt, hsa; identical to SEQ ID NO: 157092

SEQ ID NO: 200956 - RNA, 64 nt, hsa; identical to SEQ ID NO: 157093

SEQ ID NO: 200957 - RNA, 64 nt, hsa; identical to SEQ ID NO: 157094

SEQ ID NO: 200958 - RNA, 64 nt, hsa; identical to SEQ ID NO: 157095

SEQ ID NO: 200959 - RNA, 64 nt, hsa; identical to SEQ ID NO: 157096

SEQ ID NO: 200960 - RNA, 64 nt, hsa; identical to SEQ ID NO: 157097

SEQ ID NO: 200961 - RNA, 64 nt, hsa; identical to SEQ ID NO: 157098

SEQ ID NO: 200962 - RNA, 64 nt, hsa; identical to SEQ ID NO: 157099

SEQ ID NO: 200963 - RNA, 64 nt, hsa; identical to SEQ ID NO: 157100

SEQ ID NO: 200964 - RNA, 64 nt, hsa; identical to SEQ ID NO: 157101

SEQ ID NO: 200965 - RNA, 64 nt, hsa; identical to SEQ ID NO: 157102

SEQ ID NO: 200966 - RNA, 64 nt, hsa; identical to SEQ ID NO: 157103

SEQ ID NO: 200967 - RNA, 64 nt, hsa; identical to SEQ ID NO: 157104

SEQ ID NO: 200968 - RNA, 64 nt, hsa; identical to SEQ ID NO: 157105

SEQ ID NO: 200969 - RNA, 64 nt, hsa; identical to SEQ ID NO: 157106

SEQ ID NO: 200970 - RNA, 64 nt, hsa; identical to SEQ ID NO: 157107

SEQ ID NO: 200971 - RNA, 64 nt, hsa; identical to SEQ ID NO: 157108

SEQ ID NO: 200972 - RNA, 64 nt, hsa; identical to SEQ ID NO: 157109

SEQ ID NO: 200973 - RNA, 64 nt, hsa; identical to SEQ ID NO: 157110

SEQ ID NO: 200974 - RNA, 64 nt, hsa; identical to SEQ ID NO: 157111

SEQ ID NO: 200975 - RNA, 64 nt, hsa; identical to SEQ ID NO: 157112

SEQ ID NO: 200976 - RNA, 64 nt, hsa; identical to SEQ ID NO: 157113

SEQ ID NO: 200977 - RNA, 64 nt, hsa; identical to SEQ ID NO: 157114

SEQ ID NO: 200978 - RNA, 64 nt, hsa; identical to SEQ ID NO: 157115

SEQ ID NO: 200979 - RNA, 64 nt, hsa; identical to SEQ ID NO: 157116

SEQ ID NO: 200980 - RNA, 64 nt, hsa; identical to SEQ ID NO: 157117

SEQ ID NO: 200981 - RNA, 64 nt, hsa; identical to SEQ ID NO: 157118

SEQ ID NO: 200982 - RNA, 64 nt, hsa; identical to SEQ ID NO: 157119

SEQ ID NO: 200983 - RNA, 64 nt, hsa; identical to SEQ ID NO: 157120

SEQ ID NO: 200984 - RNA, 50 nt, hsa; identical to SEQ ID NO: 157121

SEQ ID NO: 200985 - RNA, 52 nt, hsa; identical to SEQ ID NO: 157122

SEQ ID NO: 200986 - RNA, 54 nt, hsa; identical to SEQ ID NO: 157123

SEQ ID NO: 200987 - RNA, 56 nt, hsa; identical to SEQ ID NO: 157124

SEQ ID NO: 200988 - RNA, 58 nt, hsa; identical to SEQ ID NO: 157125

SEQ ID NO: 200989 - RNA, 60 nt, hsa; identical to SEQ ID NO: 157126

SEQ ID NO: 200990 - RNA, 62 nt, hsa; identical to SEQ ID NO: 157127

SEQ ID NO: 200991 - RNA, 64 nt, hsa; identical to SEQ ID NO: 157128

SEQ ID NO: 200992 - RNA, 64 nt, hsa; identical to SEQ ID NO: 157129

SEQ ID NO: 200993 - RNA, 64 nt, hsa; identical to SEQ ID NO: 157130

SEQ ID NO: 200994 - RNA, 64 nt, hsa; identical to SEQ ID NO: 157131

SEQ ID NO: 200995 - RNA, 64 nt, hsa; identical to SEQ ID NO: 157132

SEQ ID NO: 200996 - RNA, 64 nt, hsa; identical to SEQ ID NO: 157133

SEQ ID NO: 200997 - RNA, 64 nt, hsa; identical to SEQ ID NO: 157134

SEQ ID NO: 200998 - RNA, 64 nt, hsa; identical to SEQ ID NO: 157135

SEQ ID NO: 200999 - RNA, 64 nt, hsa; identical to SEQ ID NO: 157136

SEQ ID NO: 201000 - RNA, 64 nt, hsa; identical to SEQ ID NO: 157137

SEQ ID NO: 201001 - RNA, 64 nt, hsa; identical to SEQ ID NO: 157138

SEQ ID NO: 201002 - RNA, 64 nt, hsa; identical to SEQ ID NO: 157139

SEQ ID NO: 201003 - RNA, 64 nt, hsa; identical to SEQ ID NO: 157140

SEQ ID NO: 201004 - RNA, 64 nt, hsa; identical to SEQ ID NO: 157141

SEQ ID NO: 201005 - RNA, 64 nt, hsa; identical to SEQ ID NO: 157142

SEQ ID NO: 201006 - RNA, 64 nt, hsa; identical to SEQ ID NO: 157143

SEQ ID NO: 201007 - RNA, 64 nt, hsa; identical to SEQ ID NO: 157144

SEQ ID NO: 201008 - RNA, 64 nt, hsa; identical to SEQ ID NO: 157145

SEQ ID NO: 201009 - RNA, 64 nt, hsa; identical to SEQ ID NO: 157146

SEQ ID NO: 201010 - RNA, 64 nt, hsa; identical to SEQ ID NO: 157147

SEQ ID NO: 201011 - RNA, 64 nt, hsa; identical to SEQ ID NO: 157148

SEQ ID NO: 201012 - RNA, 64 nt, hsa; identical to SEQ ID NO: 157149

SEQ ID NO: 201013 - RNA, 64 nt, hsa; identical to SEQ ID NO: 157150

SEQ ID NO: 201014 - RNA, 64 nt, hsa; identical to SEQ ID NO: 157151

SEQ ID NO: 201015 - RNA, 64 nt, hsa; identical to SEQ ID NO: 157152

SEQ ID NO: 201016 - RNA, 64 nt, hsa; identical to SEQ ID NO: 157153

SEQ ID NO: 201017 - RNA, 64 nt, hsa; identical to SEQ ID NO: 157154

SEQ ID NO: 201018 - RNA, 64 nt, hsa; identical to SEQ ID NO: 157155

SEQ ID NO: 201019 - RNA, 64 nt, hsa; identical to SEQ ID NO: 157156

SEQ ID NO: 201020 - RNA, 64 nt, hsa; identical to SEQ ID NO: 157157

SEQ ID NO: 201021 - RNA, 64 nt, hsa; identical to SEQ ID NO: 157158

SEQ ID NO: 201022 - RNA, 64 nt, hsa; identical to SEQ ID NO: 157159

SEQ ID NO: 201023 - RNA, 64 nt, hsa; identical to SEQ ID NO: 157160

SEQ ID NO: 201024 - RNA, 64 nt, hsa; identical to SEQ ID NO: 157161

SEQ ID NO: 201025 - RNA, 64 nt, hsa; identical to SEQ ID NO: 157162

SEQ ID NO: 201026 - RNA, 64 nt, hsa; identical to SEQ ID NO: 157163

SEQ ID NO: 201027 - RNA, 64 nt, hsa; identical to SEQ ID NO: 157164

SEQ ID NO: 201028 - RNA, 64 nt, hsa; identical to SEQ ID NO: 157165

SEQ ID NO: 201029 - RNA, 64 nt, hsa; identical to SEQ ID NO: 157166

SEQ ID NO: 201030 - RNA, 64 nt, hsa; identical to SEQ ID NO: 157167

SEQ ID NO: 201031 - RNA, 64 nt, hsa; identical to SEQ ID NO: 157168

SEQ ID NO: 201032 - RNA, 64 nt, hsa; identical to SEQ ID NO: 157169

SEQ ID NO: 201033 - RNA, 64 nt, hsa; identical to SEQ ID NO: 157170

SEQ ID NO: 201034 - RNA, 64 nt, hsa; identical to SEQ ID NO: 157171

SEQ ID NO: 201035 - RNA, 64 nt, hsa; identical to SEQ ID NO: 157172

SEQ ID NO: 201036 - RNA, 64 nt, hsa; identical to SEQ ID NO: 157173

SEQ ID NO: 201037 - RNA, 64 nt, hsa; identical to SEQ ID NO: 157174

SEQ ID NO: 201038 - RNA, 64 nt, hsa; identical to SEQ ID NO: 157175

SEQ ID NO: 201039 - RNA, 64 nt, hsa; identical to SEQ ID NO: 157176

SEQ ID NO: 201040 - RNA, 64 nt, hsa; identical to SEQ ID NO: 157177

SEQ ID NO: 201041 - RNA, 64 nt, hsa; identical to SEQ ID NO: 157178

SEQ ID NO: 201042 - RNA, 64 nt, hsa; identical to SEQ ID NO: 157179

SEQ ID NO: 201043 - RNA, 64 nt, hsa; identical to SEQ ID NO: 157180

SEQ ID NO: 201044 - RNA, 64 nt, hsa; identical to SEQ ID NO: 157181

SEQ ID NO: 201045 - RNA, 64 nt, hsa; identical to SEQ ID NO: 157182

SEQ ID NO: 201046 - RNA, 64 nt, hsa; identical to SEQ ID NO: 157183

SEQ ID NO: 201047 - RNA, 64 nt, hsa; identical to SEQ ID NO: 157184

SEQ ID NO: 201048 - RNA, 64 nt, hsa; identical to SEQ ID NO: 157185

SEQ ID NO: 201049 - RNA, 64 nt, hsa; identical to SEQ ID NO: 157186

SEQ ID NO: 201050 - RNA, 64 nt, hsa; identical to SEQ ID NO: 157187

SEQ ID NO: 201051 - RNA, 64 nt, hsa; identical to SEQ ID NO: 157188

SEQ ID NO: 201052 - RNA, 64 nt, hsa; identical to SEQ ID NO: 157189

SEQ ID NO: 201053 - RNA, 64 nt, hsa; identical to SEQ ID NO: 157190

SEQ ID NO: 201054 - RNA, 64 nt, hsa; identical to SEQ ID NO: 157191

SEQ ID NO: 201055 - RNA, 64 nt, hsa; identical to SEQ ID NO: 157192

SEQ ID NO: 201056 - RNA, 64 nt, hsa; identical to SEQ ID NO: 157193

SEQ ID NO: 201057 - RNA, 64 nt, hsa; identical to SEQ ID NO: 157194

SEQ ID NO: 201058 - RNA, 64 nt, hsa; identical to SEQ ID NO: 157195

SEQ ID NO: 201059 - RNA, 64 nt, hsa; identical to SEQ ID NO: 157196

SEQ ID NO: 201060 - RNA, 64 nt, hsa; identical to SEQ ID NO: 157197

SEQ ID NO: 201061 - RNA, 64 nt, hsa; identical to SEQ ID NO: 157198

SEQ ID NO: 201062 - RNA, 64 nt, hsa; identical to SEQ ID NO: 157199

SEQ ID NO: 201063 - RNA, 64 nt, hsa; identical to SEQ ID NO: 157200

SEQ ID NO: 201064 - RNA, 64 nt, hsa; identical to SEQ ID NO: 157201

SEQ ID NO: 201065 - RNA, 64 nt, hsa; identical to SEQ ID NO: 157202

SEQ ID NO: 201066 - RNA, 64 nt, hsa; identical to SEQ ID NO: 157203

SEQ ID NO: 201067 - RNA, 64 nt, hsa; identical to SEQ ID NO: 157204

SEQ ID NO: 201068 - RNA, 64 nt, hsa; identical to SEQ ID NO: 157205

SEQ ID NO: 201069 - RNA, 64 nt, hsa; identical to SEQ ID NO: 157206

SEQ ID NO: 201070 - RNA, 64 nt, hsa; identical to SEQ ID NO: 157207

SEQ ID NO: 201071 - RNA, 64 nt, hsa; identical to SEQ ID NO: 157208

SEQ ID NO: 201072 - RNA, 64 nt, hsa; identical to SEQ ID NO: 157209

SEQ ID NO: 201073 - RNA, 64 nt, hsa; identical to SEQ ID NO: 157210

SEQ ID NO: 201074 - RNA, 64 nt, hsa; identical to SEQ ID NO: 157211

SEQ ID NO: 201075 - RNA, 64 nt, hsa; identical to SEQ ID NO: 157212

SEQ ID NO: 201076 - RNA, 64 nt, hsa; identical to SEQ ID NO: 157213

SEQ ID NO: 201077 - RNA, 64 nt, hsa; identical to SEQ ID NO: 157214

SEQ ID NO: 201078 - RNA, 64 nt, hsa; identical to SEQ ID NO: 157215

SEQ ID NO: 201079 - RNA, 64 nt, hsa; identical to SEQ ID NO: 157216

SEQ ID NO: 201080 - RNA, 64 nt, hsa; identical to SEQ ID NO: 157217

SEQ ID NO: 201081 - RNA, 64 nt, hsa; identical to SEQ ID NO: 157218

SEQ ID NO: 201082 - RNA, 64 nt, hsa; identical to SEQ ID NO: 157219

SEQ ID NO: 201083 - RNA, 64 nt, hsa; identical to SEQ ID NO: 157220

SEQ ID NO: 201084 - RNA, 64 nt, hsa; identical to SEQ ID NO: 157221

SEQ ID NO: 201085 - RNA, 64 nt, hsa; identical to SEQ ID NO: 157222

SEQ ID NO: 201086 - RNA, 64 nt, hsa; identical to SEQ ID NO: 157223

SEQ ID NO: 201087 - RNA, 64 nt, hsa; identical to SEQ ID NO: 157224

SEQ ID NO: 201088 - RNA, 64 nt, hsa; identical to SEQ ID NO: 157225

SEQ ID NO: 201089 - RNA, 64 nt, hsa; identical to SEQ ID NO: 157226

SEQ ID NO: 201090 - RNA, 64 nt, hsa; identical to SEQ ID NO: 157227

SEQ ID NO: 201091 - RNA, 64 nt, hsa; identical to SEQ ID NO: 157228

SEQ ID NO: 201092 - RNA, 64 nt, hsa; identical to SEQ ID NO: 157229

SEQ ID NO: 201093 - RNA, 64 nt, hsa; identical to SEQ ID NO: 157230

SEQ ID NO: 201094 - RNA, 64 nt, hsa; identical to SEQ ID NO: 157231

SEQ ID NO: 201095 - RNA, 63 nt, hsa; identical to SEQ ID NO: 157232

SEQ ID NO: 201096 - RNA, 64 nt, hsa; identical to SEQ ID NO: 157233

SEQ ID NO: 201097 - RNA, 64 nt, hsa; identical to SEQ ID NO: 157234

SEQ ID NO: 201098 - RNA, 64 nt, hsa; identical to SEQ ID NO: 157235

SEQ ID NO: 201099 - RNA, 64 nt, hsa; identical to SEQ ID NO: 157236

SEQ ID NO: 201100 - RNA, 64 nt, hsa; identical to SEQ ID NO: 157237

SEQ ID NO: 201101 - RNA, 64 nt, hsa; identical to SEQ ID NO: 157238

SEQ ID NO: 201102 - RNA, 64 nt, hsa; identical to SEQ ID NO: 157239

SEQ ID NO: 201103 - RNA, 64 nt, hsa; identical to SEQ ID NO: 157240

SEQ ID NO: 201104 - RNA, 64 nt, hsa; identical to SEQ ID NO: 157241

SEQ ID NO: 201105 - RNA, 64 nt, hsa; identical to SEQ ID NO: 157242

SEQ ID NO: 201106 - RNA, 64 nt, hsa; identical to SEQ ID NO: 157243

SEQ ID NO: 201107 - RNA, 64 nt, hsa; identical to SEQ ID NO: 157244

SEQ ID NO: 201108 - RNA, 64 nt, hsa; identical to SEQ ID NO: 157245

SEQ ID NO: 201109 - RNA, 64 nt, hsa; identical to SEQ ID NO: 157246

SEQ ID NO: 201110 - RNA, 64 nt, hsa; identical to SEQ ID NO: 157247

SEQ ID NO: 201111 - RNA, 64 nt, hsa; identical to SEQ ID NO: 157248

SEQ ID NO: 201112 - RNA, 64 nt, hsa; identical to SEQ ID NO: 157249

SEQ ID NO: 201113 - RNA, 64 nt, hsa; identical to SEQ ID NO: 157250

SEQ ID NO: 201114 - RNA, 64 nt, hsa; identical to SEQ ID NO: 157251

SEQ ID NO: 201115 - RNA, 64 nt, hsa; identical to SEQ ID NO: 157252

SEQ ID NO: 201116 - RNA, 64 nt, hsa; identical to SEQ ID NO: 157253

SEQ ID NO: 201117 - RNA, 64 nt, hsa; identical to SEQ ID NO: 157254

SEQ ID NO: 201118 - RNA, 64 nt, hsa; identical to SEQ ID NO: 157255

SEQ ID NO: 201119 - RNA, 64 nt, hsa; identical to SEQ ID NO: 157256

SEQ ID NO: 201120 - RNA, 64 nt, hsa; identical to SEQ ID NO: 157257

SEQ ID NO: 201121 - RNA, 64 nt, hsa; identical to SEQ ID NO: 157258

SEQ ID NO: 201122 - RNA, 64 nt, hsa; identical to SEQ ID NO: 157259

SEQ ID NO: 201123 - RNA, 64 nt, hsa; identical to SEQ ID NO: 157260

SEQ ID NO: 201124 - RNA, 64 nt, hsa; identical to SEQ ID NO: 157261

SEQ ID NO: 201125 - RNA, 64 nt, hsa; identical to SEQ ID NO: 157262

SEQ ID NO: 201126 - RNA, 64 nt, hsa; identical to SEQ ID NO: 157263

SEQ ID NO: 201127 - RNA, 64 nt, hsa; identical to SEQ ID NO: 157264

SEQ ID NO: 201128 - RNA, 64 nt, hsa; identical to SEQ ID NO: 157265

SEQ ID NO: 201129 - RNA, 64 nt, hsa; identical to SEQ ID NO: 157266

SEQ ID NO: 201130 - RNA, 64 nt, hsa; identical to SEQ ID NO: 157267

SEQ ID NO: 201131 - RNA, 64 nt, hsa; identical to SEQ ID NO: 157268

SEQ ID NO: 201132 - RNA, 64 nt, hsa; identical to SEQ ID NO: 157269

SEQ ID NO: 201133 - RNA, 64 nt, hsa; identical to SEQ ID NO: 157270

SEQ ID NO: 201134 - RNA, 64 nt, hsa; identical to SEQ ID NO: 157271

SEQ ID NO: 201135 - RNA, 64 nt, hsa; identical to SEQ ID NO: 157272

SEQ ID NO: 201136 - RNA, 64 nt, hsa; identical to SEQ ID NO: 157273

SEQ ID NO: 201137 - RNA, 64 nt, hsa; identical to SEQ ID NO: 157274

SEQ ID NO: 201138 - RNA, 64 nt, hsa; identical to SEQ ID NO: 157275

SEQ ID NO: 201139 - RNA, 64 nt, hsa; identical to SEQ ID NO: 157276

SEQ ID NO: 201140 - RNA, 64 nt, hsa; identical to SEQ ID NO: 157277

SEQ ID NO: 201141 - RNA, 64 nt, hsa; identical to SEQ ID NO: 157278

SEQ ID NO: 201142 - RNA, 64 nt, hsa; identical to SEQ ID NO: 157279

SEQ ID NO: 201143 - RNA, 64 nt, hsa; identical to SEQ ID NO: 157280

SEQ ID NO: 201144 - RNA, 64 nt, hsa; identical to SEQ ID NO: 157281

SEQ ID NO: 201145 - RNA, 64 nt, hsa; identical to SEQ ID NO: 157282

SEQ ID NO: 201146 - RNA, 64 nt, hsa; identical to SEQ ID NO: 157283

SEQ ID NO: 201147 - RNA, 64 nt, hsa; identical to SEQ ID NO: 157284

SEQ ID NO: 201148 - RNA, 64 nt, hsa; identical to SEQ ID NO: 157285

SEQ ID NO: 201149 - RNA, 64 nt, hsa; identical to SEQ ID NO: 157286

SEQ ID NO: 201150 - RNA, 64 nt, hsa; identical to SEQ ID NO: 157287

SEQ ID NO: 201151 - RNA, 64 nt, hsa; identical to SEQ ID NO: 157288

SEQ ID NO: 201152 - RNA, 64 nt, hsa; identical to SEQ ID NO: 157289

SEQ ID NO: 201153 - RNA, 64 nt, hsa; identical to SEQ ID NO: 157290

SEQ ID NO: 201154 - RNA, 64 nt, hsa; identical to SEQ ID NO: 157291

SEQ ID NO: 201155 - RNA, 64 nt, hsa; identical to SEQ ID NO: 157292

SEQ ID NO: 201156 - RNA, 64 nt, hsa; identical to SEQ ID NO: 157293

SEQ ID NO: 201157 - RNA, 64 nt, hsa; identical to SEQ ID NO: 157294

SEQ ID NO: 201158 - RNA, 64 nt, hsa; identical to SEQ ID NO: 157295

SEQ ID NO: 201159 - RNA, 64 nt, hsa; identical to SEQ ID NO: 157296

SEQ ID NO: 201160 - RNA, 64 nt, hsa; identical to SEQ ID NO: 157297

SEQ ID NO: 201161 - RNA, 64 nt, hsa; identical to SEQ ID NO: 157298

SEQ ID NO: 201162 - RNA, 64 nt, hsa; identical to SEQ ID NO: 157299

SEQ ID NO: 201163 - RNA, 64 nt, hsa; identical to SEQ ID NO: 157300

SEQ ID NO: 201164 - RNA, 64 nt, hsa; identical to SEQ ID NO: 157301

SEQ ID NO: 201165 - RNA, 64 nt, hsa; identical to SEQ ID NO: 157302

SEQ ID NO: 201166 - RNA, 64 nt, hsa; identical to SEQ ID NO: 157303

SEQ ID NO: 201167 - RNA, 64 nt, hsa; identical to SEQ ID NO: 157304

SEQ ID NO: 201168 - RNA, 64 nt, hsa; identical to SEQ ID NO: 157305

SEQ ID NO: 201169 - RNA, 64 nt, hsa; identical to SEQ ID NO: 157306

SEQ ID NO: 201170 - RNA, 64 nt, hsa; identical to SEQ ID NO: 157307

SEQ ID NO: 201171 - RNA, 64 nt, hsa; identical to SEQ ID NO: 157308

SEQ ID NO: 201172 - RNA, 64 nt, hsa; identical to SEQ ID NO: 157309

SEQ ID NO: 201173 - RNA, 64 nt, hsa; identical to SEQ ID NO: 157310

SEQ ID NO: 201174 - RNA, 64 nt, hsa; identical to SEQ ID NO: 157311

SEQ ID NO: 201175 - RNA, 64 nt, hsa; identical to SEQ ID NO: 157312

SEQ ID NO: 201176 - RNA, 64 nt, hsa; identical to SEQ ID NO: 157313

SEQ ID NO: 201177 - RNA, 64 nt, hsa; identical to SEQ ID NO: 157314

SEQ ID NO: 201178 - RNA, 64 nt, hsa; identical to SEQ ID NO: 157315

SEQ ID NO: 201179 - RNA, 64 nt, hsa; identical to SEQ ID NO: 157316

SEQ ID NO: 201180 - RNA, 64 nt, hsa; identical to SEQ ID NO: 157317

SEQ ID NO: 201181 - RNA, 64 nt, hsa; identical to SEQ ID NO: 157318

SEQ ID NO: 201182 - RNA, 64 nt, hsa; identical to SEQ ID NO: 157319

SEQ ID NO: 201183 - RNA, 64 nt, hsa; identical to SEQ ID NO: 157320

SEQ ID NO: 201184 - RNA, 64 nt, hsa; identical to SEQ ID NO: 157321

SEQ ID NO: 201185 - RNA, 64 nt, hsa; identical to SEQ ID NO: 157322

SEQ ID NO: 201186 - RNA, 64 nt, hsa; identical to SEQ ID NO: 157323

SEQ ID NO: 201187 - RNA, 64 nt, hsa; identical to SEQ ID NO: 157324

SEQ ID NO: 201188 - RNA, 64 nt, hsa; identical to SEQ ID NO: 157325

SEQ ID NO: 201189 - RNA, 64 nt, hsa; identical to SEQ ID NO: 157326

SEQ ID NO: 201190 - RNA, 64 nt, hsa; identical to SEQ ID NO: 157327

SEQ ID NO: 201191 - RNA, 64 nt, hsa; identical to SEQ ID NO: 157328

SEQ ID NO: 201192 - RNA, 64 nt, hsa; identical to SEQ ID NO: 157329

SEQ ID NO: 201193 - RNA, 64 nt, hsa; identical to SEQ ID NO: 157330

SEQ ID NO: 201194 - RNA, 64 nt, hsa; identical to SEQ ID NO: 157331

SEQ ID NO: 201195 - RNA, 64 nt, hsa; identical to SEQ ID NO: 157332

SEQ ID NO: 201196 - RNA, 64 nt, hsa; identical to SEQ ID NO: 157333

SEQ ID NO: 201197 - RNA, 64 nt, hsa; identical to SEQ ID NO: 157334

SEQ ID NO: 201198 - RNA, 64 nt, hsa; identical to SEQ ID NO: 157335

SEQ ID NO: 201199 - RNA, 64 nt, hsa; identical to SEQ ID NO: 157336

SEQ ID NO: 201200 - RNA, 64 nt, hsa; identical to SEQ ID NO: 157337

SEQ ID NO: 201201 - RNA, 64 nt, hsa; identical to SEQ ID NO: 157338

SEQ ID NO: 201202 - RNA, 64 nt, hsa; identical to SEQ ID NO: 157339

SEQ ID NO: 201203 - RNA, 64 nt, hsa; identical to SEQ ID NO: 157340

SEQ ID NO: 201204 - RNA, 64 nt, hsa; identical to SEQ ID NO: 157341

SEQ ID NO: 201205 - RNA, 64 nt, hsa; identical to SEQ ID NO: 157342

SEQ ID NO: 201206 - RNA, 64 nt, hsa; identical to SEQ ID NO: 157343

SEQ ID NO: 201207 - RNA, 64 nt, hsa; identical to SEQ ID NO: 157344

SEQ ID NO: 201208 - RNA, 64 nt, hsa; identical to SEQ ID NO: 157345

SEQ ID NO: 201209 - RNA, 64 nt, hsa; identical to SEQ ID NO: 157346

SEQ ID NO: 201210 - RNA, 64 nt, hsa; identical to SEQ ID NO: 157347

SEQ ID NO: 201211 - RNA, 64 nt, hsa; identical to SEQ ID NO: 157348

SEQ ID NO: 201212 - RNA, 64 nt, hsa; identical to SEQ ID NO: 157349

SEQ ID NO: 201213 - RNA, 64 nt, hsa; identical to SEQ ID NO: 157350

SEQ ID NO: 201214 - RNA, 64 nt, hsa; identical to SEQ ID NO: 157351

SEQ ID NO: 201215 - RNA, 64 nt, hsa; identical to SEQ ID NO: 157352

SEQ ID NO: 201216 - RNA, 64 nt, hsa; identical to SEQ ID NO: 157353

SEQ ID NO: 201217 - RNA, 64 nt, hsa; identical to SEQ ID NO: 157354

SEQ ID NO: 201218 - RNA, 64 nt, hsa; identical to SEQ ID NO: 157355

SEQ ID NO: 201219 - RNA, 64 nt, hsa; identical to SEQ ID NO: 157356

SEQ ID NO: 201220 - RNA, 64 nt, hsa; identical to SEQ ID NO: 157357

SEQ ID NO: 201221 - RNA, 64 nt, hsa; identical to SEQ ID NO: 157358

SEQ ID NO: 201222 - RNA, 64 nt, hsa; identical to SEQ ID NO: 157359

SEQ ID NO: 201223 - RNA, 64 nt, hsa; identical to SEQ ID NO: 157360

SEQ ID NO: 201224 - RNA, 64 nt, hsa; identical to SEQ ID NO: 157361

SEQ ID NO: 201225 - RNA, 64 nt, hsa; identical to SEQ ID NO: 157362

SEQ ID NO: 201226 - RNA, 64 nt, hsa; identical to SEQ ID NO: 157363

SEQ ID NO: 201227 - RNA, 64 nt, hsa; identical to SEQ ID NO: 157364

SEQ ID NO: 201228 - RNA, 64 nt, hsa; identical to SEQ ID NO: 157365

SEQ ID NO: 201229 - RNA, 64 nt, hsa; identical to SEQ ID NO: 157366

SEQ ID NO: 201230 - RNA, 64 nt, hsa; identical to SEQ ID NO: 157367

SEQ ID NO: 201231 - RNA, 64 nt, hsa; identical to SEQ ID NO: 157368

SEQ ID NO: 201232 - RNA, 64 nt, hsa; identical to SEQ ID NO: 157369

SEQ ID NO: 201233 - RNA, 64 nt, hsa; identical to SEQ ID NO: 157370

SEQ ID NO: 201234 - RNA, 64 nt, hsa; identical to SEQ ID NO: 157371

SEQ ID NO: 201235 - RNA, 64 nt, hsa; identical to SEQ ID NO: 157372

SEQ ID NO: 201236 - RNA, 64 nt, hsa; identical to SEQ ID NO: 157373

SEQ ID NO: 201237 - RNA, 64 nt, hsa; identical to SEQ ID NO: 157374

SEQ ID NO: 201238 - RNA, 64 nt, hsa; identical to SEQ ID NO: 157375

SEQ ID NO: 201239 - RNA, 64 nt, hsa; identical to SEQ ID NO: 157376

SEQ ID NO: 201240 - RNA, 64 nt, hsa; identical to SEQ ID NO: 157377

SEQ ID NO: 201241 - RNA, 64 nt, hsa; identical to SEQ ID NO: 157378

SEQ ID NO: 201242 - RNA, 64 nt, hsa; identical to SEQ ID NO: 157379

SEQ ID NO: 201243 - RNA, 64 nt, hsa; identical to SEQ ID NO: 157380

SEQ ID NO: 201244 - RNA, 64 nt, hsa; identical to SEQ ID NO: 157381

SEQ ID NO: 201245 - RNA, 64 nt, hsa; identical to SEQ ID NO: 157382

SEQ ID NO: 201246 - RNA, 64 nt, hsa; identical to SEQ ID NO: 157383

SEQ ID NO: 201247 - RNA, 64 nt, hsa; identical to SEQ ID NO: 157384

SEQ ID NO: 201248 - RNA, 64 nt, hsa; identical to SEQ ID NO: 157385

SEQ ID NO: 201249 - RNA, 64 nt, hsa; identical to SEQ ID NO: 157386

SEQ ID NO: 201250 - RNA, 64 nt, hsa; identical to SEQ ID NO: 157387

SEQ ID NO: 201251 - RNA, 64 nt, hsa; identical to SEQ ID NO: 157388

SEQ ID NO: 201252 - RNA, 64 nt, hsa; identical to SEQ ID NO: 157389

SEQ ID NO: 201253 - RNA, 64 nt, hsa; identical to SEQ ID NO: 157390

SEQ ID NO: 201254 - RNA, 64 nt, hsa; identical to SEQ ID NO: 157391

SEQ ID NO: 201255 - RNA, 64 nt, hsa; identical to SEQ ID NO: 157392

SEQ ID NO: 201256 - RNA, 64 nt, hsa; identical to SEQ ID NO: 157393

SEQ ID NO: 201257 - RNA, 64 nt, hsa; identical to SEQ ID NO: 157394

SEQ ID NO: 201258 - RNA, 64 nt, hsa; identical to SEQ ID NO: 157395

SEQ ID NO: 201259 - RNA, 64 nt, hsa; identical to SEQ ID NO: 157396

SEQ ID NO: 201260 - RNA, 64 nt, hsa; identical to SEQ ID NO: 157397

SEQ ID NO: 201261 - RNA, 64 nt, hsa; identical to SEQ ID NO: 157398

SEQ ID NO: 201262 - RNA, 64 nt, hsa; identical to SEQ ID NO: 157399

SEQ ID NO: 201263 - RNA, 64 nt, hsa; identical to SEQ ID NO: 157400

SEQ ID NO: 201264 - RNA, 64 nt, hsa; identical to SEQ ID NO: 157401

SEQ ID NO: 201265 - RNA, 64 nt, hsa; identical to SEQ ID NO: 157402

SEQ ID NO: 201266 - RNA, 64 nt, hsa; identical to SEQ ID NO: 157403

SEQ ID NO: 201267 - RNA, 64 nt, hsa; identical to SEQ ID NO: 157404

SEQ ID NO: 201268 - RNA, 64 nt, hsa; identical to SEQ ID NO: 157405

SEQ ID NO: 201269 - RNA, 64 nt, hsa; identical to SEQ ID NO: 157406

SEQ ID NO: 201270 - RNA, 64 nt, hsa; identical to SEQ ID NO: 157407

SEQ ID NO: 201271 - RNA, 64 nt, hsa; identical to SEQ ID NO: 157408

SEQ ID NO: 201272 - RNA, 64 nt, hsa; identical to SEQ ID NO: 157409

SEQ ID NO: 201273 - RNA, 64 nt, hsa; identical to SEQ ID NO: 157410

SEQ ID NO: 201274 - RNA, 64 nt, hsa; identical to SEQ ID NO: 157411

SEQ ID NO: 201275 - RNA, 64 nt, hsa; identical to SEQ ID NO: 157412

SEQ ID NO: 201276 - RNA, 64 nt, hsa; identical to SEQ ID NO: 157413

SEQ ID NO: 201277 - RNA, 64 nt, hsa; identical to SEQ ID NO: 157414

SEQ ID NO: 201278 - RNA, 64 nt, hsa; identical to SEQ ID NO: 157415

SEQ ID NO: 201279 - RNA, 64 nt, hsa; identical to SEQ ID NO: 157416

SEQ ID NO: 201280 - RNA, 64 nt, hsa; identical to SEQ ID NO: 157417

SEQ ID NO: 201281 - RNA, 64 nt, hsa; identical to SEQ ID NO: 157418

SEQ ID NO: 201282 - RNA, 64 nt, hsa; identical to SEQ ID NO: 157419

SEQ ID NO: 201283 - RNA, 64 nt, hsa; identical to SEQ ID NO: 157420

SEQ ID NO: 201284 - RNA, 64 nt, hsa; identical to SEQ ID NO: 157421

SEQ ID NO: 201285 - RNA, 64 nt, hsa; identical to SEQ ID NO: 157422

SEQ ID NO: 201286 - RNA, 64 nt, hsa; identical to SEQ ID NO: 157423

SEQ ID NO: 201287 - RNA, 64 nt, hsa; identical to SEQ ID NO: 157424

SEQ ID NO: 201288 - RNA, 64 nt, hsa; identical to SEQ ID NO: 157425

SEQ ID NO: 201289 - RNA, 64 nt, hsa; identical to SEQ ID NO: 157426

SEQ ID NO: 201290 - RNA, 64 nt, hsa; identical to SEQ ID NO: 157427

SEQ ID NO: 201291 - RNA, 64 nt, hsa; identical to SEQ ID NO: 157428

SEQ ID NO: 201292 - RNA, 64 nt, hsa; identical to SEQ ID NO: 157429

SEQ ID NO: 201293 - RNA, 64 nt, hsa; identical to SEQ ID NO: 157430

SEQ ID NO: 201294 - RNA, 64 nt, hsa; identical to SEQ ID NO: 157431

SEQ ID NO: 201295 - RNA, 64 nt, hsa; identical to SEQ ID NO: 157432

SEQ ID NO: 201296 - RNA, 64 nt, hsa; identical to SEQ ID NO: 157433

SEQ ID NO: 201297 - RNA, 64 nt, hsa; identical to SEQ ID NO: 157434

SEQ ID NO: 201298 - RNA, 64 nt, hsa; identical to SEQ ID NO: 157435

SEQ ID NO: 201299 - RNA, 64 nt, hsa; identical to SEQ ID NO: 157436

SEQ ID NO: 201300 - RNA, 64 nt, hsa; identical to SEQ ID NO: 157437

SEQ ID NO: 201301 - RNA, 64 nt, hsa; identical to SEQ ID NO: 157438

SEQ ID NO: 201302 - RNA, 64 nt, hsa; identical to SEQ ID NO: 157439

SEQ ID NO: 201303 - RNA, 64 nt, hsa; identical to SEQ ID NO: 157440

SEQ ID NO: 201304 - RNA, 64 nt, hsa; identical to SEQ ID NO: 157441

SEQ ID NO: 201305 - RNA, 64 nt, hsa; identical to SEQ ID NO: 157442

SEQ ID NO: 201306 - RNA, 64 nt, hsa; identical to SEQ ID NO: 157443

SEQ ID NO: 201307 - RNA, 64 nt, hsa; identical to SEQ ID NO: 157444

SEQ ID NO: 201308 - RNA, 64 nt, hsa; identical to SEQ ID NO: 157445

SEQ ID NO: 201309 - RNA, 64 nt, hsa; identical to SEQ ID NO: 157446

SEQ ID NO: 201310 - RNA, 64 nt, hsa; identical to SEQ ID NO: 157447

SEQ ID NO: 201311 - RNA, 64 nt, hsa; identical to SEQ ID NO: 157448

SEQ ID NO: 201312 - RNA, 64 nt, hsa; identical to SEQ ID NO: 157449

SEQ ID NO: 201313 - RNA, 64 nt, hsa; identical to SEQ ID NO: 157450

SEQ ID NO: 201314 - RNA, 64 nt, hsa; identical to SEQ ID NO: 157451

SEQ ID NO: 201315 - RNA, 64 nt, hsa; identical to SEQ ID NO: 157452

SEQ ID NO: 201316 - RNA, 64 nt, hsa; identical to SEQ ID NO: 157453

SEQ ID NO: 201317 - RNA, 64 nt, hsa; identical to SEQ ID NO: 157454

SEQ ID NO: 201318 - RNA, 64 nt, hsa; identical to SEQ ID NO: 157455

SEQ ID NO: 201319 - RNA, 64 nt, hsa; identical to SEQ ID NO: 157456

SEQ ID NO: 201320 - RNA, 64 nt, hsa; identical to SEQ ID NO: 157457

SEQ ID NO: 201321 - RNA, 64 nt, hsa; identical to SEQ ID NO: 157458

SEQ ID NO: 201322 - RNA, 64 nt, hsa; identical to SEQ ID NO: 157459

SEQ ID NO: 201323 - RNA, 64 nt, hsa; identical to SEQ ID NO: 157460

SEQ ID NO: 201324 - RNA, 64 nt, hsa; identical to SEQ ID NO: 157461

SEQ ID NO: 201325 - RNA, 64 nt, hsa; identical to SEQ ID NO: 157462

SEQ ID NO: 201326 - RNA, 64 nt, hsa; identical to SEQ ID NO: 157463

SEQ ID NO: 201327 - RNA, 64 nt, hsa; identical to SEQ ID NO: 157464

SEQ ID NO: 201328 - RNA, 64 nt, hsa; identical to SEQ ID NO: 157465

SEQ ID NO: 201329 - RNA, 64 nt, hsa; identical to SEQ ID NO: 157466

SEQ ID NO: 201330 - RNA, 64 nt, hsa; identical to SEQ ID NO: 157467

SEQ ID NO: 201331 - RNA, 64 nt, hsa; identical to SEQ ID NO: 157468

SEQ ID NO: 201332 - RNA, 64 nt, hsa; identical to SEQ ID NO: 157469

SEQ ID NO: 201333 - RNA, 64 nt, hsa; identical to SEQ ID NO: 157470

SEQ ID NO: 201334 - RNA, 64 nt, hsa; identical to SEQ ID NO: 157471

SEQ ID NO: 201335 - RNA, 64 nt, hsa; identical to SEQ ID NO: 157472

SEQ ID NO: 201336 - RNA, 64 nt, hsa; identical to SEQ ID NO: 157473

SEQ ID NO: 201337 - RNA, 64 nt, hsa; identical to SEQ ID NO: 157474

SEQ ID NO: 201338 - RNA, 64 nt, hsa; identical to SEQ ID NO: 157475

SEQ ID NO: 201339 - RNA, 64 nt, hsa; identical to SEQ ID NO: 157476

SEQ ID NO: 201340 - RNA, 64 nt, hsa; identical to SEQ ID NO: 157477

SEQ ID NO: 201341 - RNA, 64 nt, hsa; identical to SEQ ID NO: 157478

SEQ ID NO: 201342 - RNA, 64 nt, hsa; identical to SEQ ID NO: 157479

SEQ ID NO: 201343 - RNA, 64 nt, hsa; identical to SEQ ID NO: 157480

SEQ ID NO: 201344 - RNA, 64 nt, hsa; identical to SEQ ID NO: 157481

SEQ ID NO: 201345 - RNA, 64 nt, hsa; identical to SEQ ID NO: 157482

SEQ ID NO: 201346 - RNA, 64 nt, hsa; identical to SEQ ID NO: 157483

SEQ ID NO: 201347 - RNA, 64 nt, hsa; identical to SEQ ID NO: 157484

SEQ ID NO: 201348 - RNA, 64 nt, hsa; identical to SEQ ID NO: 157485

SEQ ID NO: 201349 - RNA, 64 nt, hsa; identical to SEQ ID NO: 157486

SEQ ID NO: 201350 - RNA, 64 nt, hsa; identical to SEQ ID NO: 157487

SEQ ID NO: 201351 - RNA, 64 nt, hsa; identical to SEQ ID NO: 157488

SEQ ID NO: 201352 - RNA, 64 nt, hsa; identical to SEQ ID NO: 157489

SEQ ID NO: 201353 - RNA, 64 nt, hsa; identical to SEQ ID NO: 157490

SEQ ID NO: 201354 - RNA, 64 nt, hsa; identical to SEQ ID NO: 157491

SEQ ID NO: 201355 - RNA, 64 nt, hsa; identical to SEQ ID NO: 157492

SEQ ID NO: 201356 - RNA, 64 nt, hsa; identical to SEQ ID NO: 157493

SEQ ID NO: 201357 - RNA, 64 nt, hsa; identical to SEQ ID NO: 157494

SEQ ID NO: 201358 - RNA, 64 nt, hsa; identical to SEQ ID NO: 157495

SEQ ID NO: 201359 - RNA, 64 nt, hsa; identical to SEQ ID NO: 157496

SEQ ID NO: 201360 - RNA, 64 nt, hsa; identical to SEQ ID NO: 157497

SEQ ID NO: 201361 - RNA, 64 nt, hsa; identical to SEQ ID NO: 157498

SEQ ID NO: 201362 - RNA, 64 nt, hsa; identical to SEQ ID NO: 157499

SEQ ID NO: 201363 - RNA, 64 nt, hsa; identical to SEQ ID NO: 157500

SEQ ID NO: 201364 - RNA, 64 nt, hsa; identical to SEQ ID NO: 157501

SEQ ID NO: 201365 - RNA, 64 nt, hsa; identical to SEQ ID NO: 157502

SEQ ID NO: 201366 - RNA, 64 nt, hsa; identical to SEQ ID NO: 157503

SEQ ID NO: 201367 - RNA, 64 nt, hsa; identical to SEQ ID NO: 157504

SEQ ID NO: 201368 - RNA, 64 nt, hsa; identical to SEQ ID NO: 157505

SEQ ID NO: 201369 - RNA, 64 nt, hsa; identical to SEQ ID NO: 157506

SEQ ID NO: 201370 - RNA, 64 nt, hsa; identical to SEQ ID NO: 157507

SEQ ID NO: 201371 - RNA, 64 nt, hsa; identical to SEQ ID NO: 157508

SEQ ID NO: 201372 - RNA, 64 nt, hsa; identical to SEQ ID NO: 157509

SEQ ID NO: 201373 - RNA, 64 nt, hsa; identical to SEQ ID NO: 157510

SEQ ID NO: 201374 - RNA, 64 nt, hsa; identical to SEQ ID NO: 157511

SEQ ID NO: 201375 - RNA, 64 nt, hsa; identical to SEQ ID NO: 157512

SEQ ID NO: 201376 - RNA, 64 nt, hsa; identical to SEQ ID NO: 157513

SEQ ID NO: 201377 - RNA, 64 nt, hsa; identical to SEQ ID NO: 157514

SEQ ID NO: 201378 - RNA, 64 nt, hsa; identical to SEQ ID NO: 157515

SEQ ID NO: 201379 - RNA, 64 nt, hsa; identical to SEQ ID NO: 157516

SEQ ID NO: 201380 - RNA, 64 nt, hsa; identical to SEQ ID NO: 157517

SEQ ID NO: 201381 - RNA, 64 nt, hsa; identical to SEQ ID NO: 157518

SEQ ID NO: 201382 - RNA, 64 nt, hsa; identical to SEQ ID NO: 157519

SEQ ID NO: 201383 - RNA, 64 nt, hsa; identical to SEQ ID NO: 157520

SEQ ID NO: 201384 - RNA, 64 nt, hsa; identical to SEQ ID NO: 157521

SEQ ID NO: 201385 - RNA, 64 nt, hsa; identical to SEQ ID NO: 157522

SEQ ID NO: 201386 - RNA, 64 nt, hsa; identical to SEQ ID NO: 157523

SEQ ID NO: 201387 - RNA, 64 nt, hsa; identical to SEQ ID NO: 157524

SEQ ID NO: 201388 - RNA, 64 nt, hsa; identical to SEQ ID NO: 157525

SEQ ID NO: 201389 - RNA, 64 nt, hsa; identical to SEQ ID NO: 157526

SEQ ID NO: 201390 - RNA, 64 nt, hsa; identical to SEQ ID NO: 157527

SEQ ID NO: 201391 - RNA, 64 nt, hsa; identical to SEQ ID NO: 157528

SEQ ID NO: 201392 - RNA, 64 nt, hsa; identical to SEQ ID NO: 157529

SEQ ID NO: 201393 - RNA, 64 nt, hsa; identical to SEQ ID NO: 157530

SEQ ID NO: 201394 - RNA, 64 nt, hsa; identical to SEQ ID NO: 157531

SEQ ID NO: 201395 - RNA, 64 nt, hsa; identical to SEQ ID NO: 157532

SEQ ID NO: 201396 - RNA, 64 nt, hsa; identical to SEQ ID NO: 157533

SEQ ID NO: 201397 - RNA, 64 nt, hsa; identical to SEQ ID NO: 157534

SEQ ID NO: 201398 - RNA, 64 nt, hsa; identical to SEQ ID NO: 157535

SEQ ID NO: 201399 - RNA, 64 nt, hsa; identical to SEQ ID NO: 157536

SEQ ID NO: 201400 - RNA, 64 nt, hsa; identical to SEQ ID NO: 157537

SEQ ID NO: 201401 - RNA, 64 nt, hsa; identical to SEQ ID NO: 157538

SEQ ID NO: 201402 - RNA, 64 nt, hsa; identical to SEQ ID NO: 157539

SEQ ID NO: 201403 - RNA, 64 nt, hsa; identical to SEQ ID NO: 157540

SEQ ID NO: 201404 - RNA, 64 nt, hsa; identical to SEQ ID NO: 157541

SEQ ID NO: 201405 - RNA, 64 nt, hsa; identical to SEQ ID NO: 157542

SEQ ID NO: 201406 - RNA, 64 nt, hsa; identical to SEQ ID NO: 157543

SEQ ID NO: 201407 - RNA, 64 nt, hsa; identical to SEQ ID NO: 157544

SEQ ID NO: 201408 - RNA, 64 nt, hsa; identical to SEQ ID NO: 157545

SEQ ID NO: 201409 - RNA, 64 nt, hsa; identical to SEQ ID NO: 157546

SEQ ID NO: 201410 - RNA, 64 nt, hsa; identical to SEQ ID NO: 157547

SEQ ID NO: 201411 - RNA, 64 nt, hsa; identical to SEQ ID NO: 157548

SEQ ID NO: 201412 - RNA, 64 nt, hsa; identical to SEQ ID NO: 157549

SEQ ID NO: 201413 - RNA, 64 nt, hsa; identical to SEQ ID NO: 157550

SEQ ID NO: 201414 - RNA, 64 nt, hsa; identical to SEQ ID NO: 157551

SEQ ID NO: 201415 - RNA, 64 nt, hsa; identical to SEQ ID NO: 157552

SEQ ID NO: 201416 - RNA, 64 nt, hsa; identical to SEQ ID NO: 157553

SEQ ID NO: 201417 - RNA, 64 nt, hsa; identical to SEQ ID NO: 157554

SEQ ID NO: 201418 - RNA, 64 nt, hsa; identical to SEQ ID NO: 157555

SEQ ID NO: 201419 - RNA, 64 nt, hsa; identical to SEQ ID NO: 157556

SEQ ID NO: 201420 - RNA, 64 nt, hsa; identical to SEQ ID NO: 157557

SEQ ID NO: 201421 - RNA, 64 nt, hsa; identical to SEQ ID NO: 157558

SEQ ID NO: 201422 - RNA, 64 nt, hsa; identical to SEQ ID NO: 157559

SEQ ID NO: 201423 - RNA, 64 nt, hsa; identical to SEQ ID NO: 157560

SEQ ID NO: 201424 - RNA, 64 nt, hsa; identical to SEQ ID NO: 157561

SEQ ID NO: 201425 - RNA, 64 nt, hsa; identical to SEQ ID NO: 157562

SEQ ID NO: 201426 - RNA, 64 nt, hsa; identical to SEQ ID NO: 157563

SEQ ID NO: 201427 - RNA, 64 nt, hsa; identical to SEQ ID NO: 157564

SEQ ID NO: 201428 - RNA, 64 nt, hsa; identical to SEQ ID NO: 157565

SEQ ID NO: 201429 - RNA, 64 nt, hsa; identical to SEQ ID NO: 157566

SEQ ID NO: 201430 - RNA, 64 nt, hsa; identical to SEQ ID NO: 157567

SEQ ID NO: 201431 - RNA, 64 nt, hsa; identical to SEQ ID NO: 157568

SEQ ID NO: 201432 - RNA, 64 nt, hsa; identical to SEQ ID NO: 157569

SEQ ID NO: 201433 - RNA, 64 nt, hsa; identical to SEQ ID NO: 157570

SEQ ID NO: 201434 - RNA, 64 nt, hsa; identical to SEQ ID NO: 157571

SEQ ID NO: 201435 - RNA, 64 nt, hsa; identical to SEQ ID NO: 157572

SEQ ID NO: 201436 - RNA, 64 nt, hsa; identical to SEQ ID NO: 157573

SEQ ID NO: 201437 - RNA, 64 nt, hsa; identical to SEQ ID NO: 157574

SEQ ID NO: 201438 - RNA, 64 nt, hsa; identical to SEQ ID NO: 157575

SEQ ID NO: 201439 - RNA, 64 nt, hsa; identical to SEQ ID NO: 157576

SEQ ID NO: 201440 - RNA, 64 nt, hsa; identical to SEQ ID NO: 157577

SEQ ID NO: 201441 - RNA, 64 nt, hsa; identical to SEQ ID NO: 157578

SEQ ID NO: 201442 - RNA, 64 nt, hsa; identical to SEQ ID NO: 157579

SEQ ID NO: 201443 - RNA, 64 nt, hsa; identical to SEQ ID NO: 157580

SEQ ID NO: 201444 - RNA, 64 nt, hsa; identical to SEQ ID NO: 157581

SEQ ID NO: 201445 - RNA, 64 nt, hsa; identical to SEQ ID NO: 157582

SEQ ID NO: 201446 - RNA, 64 nt, hsa; identical to SEQ ID NO: 157583

SEQ ID NO: 201447 - RNA, 64 nt, hsa; identical to SEQ ID NO: 157584

SEQ ID NO: 201448 - RNA, 64 nt, hsa; identical to SEQ ID NO: 157585

SEQ ID NO: 201449 - RNA, 64 nt, hsa; identical to SEQ ID NO: 157586

SEQ ID NO: 201450 - RNA, 64 nt, hsa; identical to SEQ ID NO: 157587

SEQ ID NO: 201451 - RNA, 64 nt, hsa; identical to SEQ ID NO: 157588

SEQ ID NO: 201452 - RNA, 64 nt, hsa; identical to SEQ ID NO: 157589

SEQ ID NO: 201453 - RNA, 64 nt, hsa; identical to SEQ ID NO: 157590

SEQ ID NO: 201454 - RNA, 64 nt, hsa; identical to SEQ ID NO: 157591

SEQ ID NO: 201455 - RNA, 64 nt, hsa; identical to SEQ ID NO: 157592

SEQ ID NO: 201456 - RNA, 64 nt, hsa; identical to SEQ ID NO: 157593

SEQ ID NO: 201457 - RNA, 64 nt, hsa; identical to SEQ ID NO: 157594

SEQ ID NO: 201458 - RNA, 64 nt, hsa; identical to SEQ ID NO: 157595

SEQ ID NO: 201459 - RNA, 64 nt, hsa; identical to SEQ ID NO: 157596

SEQ ID NO: 201460 - RNA, 64 nt, hsa; identical to SEQ ID NO: 157597

SEQ ID NO: 201461 - RNA, 64 nt, hsa; identical to SEQ ID NO: 157598

SEQ ID NO: 201462 - RNA, 64 nt, hsa; identical to SEQ ID NO: 157599

SEQ ID NO: 201463 - RNA, 64 nt, hsa; identical to SEQ ID NO: 157600

SEQ ID NO: 201464 - RNA, 64 nt, hsa; identical to SEQ ID NO: 157601

SEQ ID NO: 201465 - RNA, 64 nt, hsa; identical to SEQ ID NO: 157602

SEQ ID NO: 201466 - RNA, 64 nt, hsa; identical to SEQ ID NO: 157603

SEQ ID NO: 201467 - RNA, 64 nt, hsa; identical to SEQ ID NO: 157604

SEQ ID NO: 201468 - RNA, 64 nt, hsa; identical to SEQ ID NO: 157605

SEQ ID NO: 201469 - RNA, 64 nt, hsa; identical to SEQ ID NO: 157606

SEQ ID NO: 201470 - RNA, 64 nt, hsa
uauuuuuuaaaauuaaguaauuuuuuaaagaaggcacuuuuaaaauuaacacacacaugaacug

SEQ ID NO: 201471 - RNA, 64 nt, hsa
uuuugcccuugaaagucaccugaggaaguuuccccacuuuuauuuuuuaaaauuaaguaauuuu

SEQ ID NO: 201472 - RNA, 64 nt, hsa
uucuaaaaguaggacagugguuuuggggguuauccacuuuuauuuuuuugaaacuagcucucau

SEQ ID NO: 201473 - RNA, 64 nt, hsa
guauauguguuguggaagugaguacacuaucauccacuuuuaaugacagaaaguuauaaacuua

SEQ ID NO: 201474 - RNA, 64 nt, hsa
auaaauagaagaaaucaugaguaaaauuggaaaacacuuuuaacugaaaaaaacaaaagcacaa

SEQ ID NO: 201475 - RNA, 64 nt, hsa
caauacaugucuucauguaccuguauguaaaucccacuuuuauucuaaaauucuuugaauauuu

SEQ ID NO: 201476 - RNA, 64 nt, hsa
aauauuuauaaaaaguguauaugcaguaugauaccacuuuuaaaaaaagauaaauuuauagaaa

SEQ ID NO: 201477 - RNA, 64 nt, hsa
augcuucagagucaucucuguccugcccgggaugcacuuuuaaaugaagaguuagaauauuuua

SEQ ID NO: 201478 - RNA, 64 nt, hsa
cuuuauccuuuuugaugccauauuuucaguguuacacuuuuauggcuuuuaauuuucgauuuga

SEQ ID NO: 201479 - RNA, 64 nt, hsa
cuuaagagaugaaaucacuuuuaccuauaaaaaccacuuuuauugcgguuugacugcauugagc

SEQ ID NO: 201480 - RNA, 64 nt, hsa
aaguucucgacauucagaucuuaagagaugaaaucacuuuuaccuauaaaaaccacuuuuauug

SEQ ID NO: 201481 - RNA, 64 nt, hsa
uuaagcuuauuuuuauaaaccacauuguacgugucacuuuuauuuggcauuuuauacuuaacua

SEQ ID NO: 201482 - RNA, 64 nt, hsa
cucagaggugcaaaaagauacuuaucuaacuggacacuuuuacuguuuucuucucacuuccaau

SEQ ID NO: 201483 - RNA, 64 nt, hsa
auguuauugcauaauuuauaaaagaauaaaauugcacuuuuaaaccucucuucuaccuuaaaau

SEQ ID NO: 201484 - RNA, 64 nt, hsa
ugauaacugcaauuuuaauugauuauucugauuccacuuuuauucauuugaguuauuuuaauua

SEQ ID NO: 201485 - RNA, 64 nt, hsa
ucggcuugaguucaccaucucuucauucaaacugcacuuuuagccagagaugcaauauaucccc

SEQ ID NO: 201486 - RNA, 64 nt, hsa
gugcaccgagugauuuccaucucugguaaaguuacacuuuuauuuccuguauguuguacaauca

SEQ ID NO: 201487 - RNA, 64 nt, hsa
gacuucucaaacuuuucaaggguuggggcagcugcacuuuuagguugccuauaggaaauauugc

SEQ ID NO: 201488 - RNA, 64 nt, hsa
ccugcugugccaguuaccaucuggcauuaggcagcacuuuuaucuacucuuuccccuuugaccu

SEQ ID NO: 201489 - RNA, 64 nt, hsa
aaaaacugacucaugucuuuaaaguaguugaagccacuuuuagaauguuacucucgguugcuuu

SEQ ID NO: 201490 - RNA, 64 nt, hsa
auaagucugggcagcucuaugggaugauaaauuacacuuuuaaguucuugcuggagguuuuaaa

SEQ ID NO: 201491 - RNA, 64 nt, hsa
ccauagaguuuaguaaccguccagcaagugucaucacuuuuacagaaaacaagguccaguaaua

SEQ ID NO: 201492 - RNA, 64 nt, hsa
caagguccaguaauagcaagucuuaguacauccucacuuuuauuauaaauggguguuuuuucau

SEQ ID NO: 201493 - RNA, 64 nt, hsa
agacaugucuugugaaggaagguuucuuggagaccacuuuuauuuacucaugagaaguggaagc

SEQ ID NO: 201494 - RNA, 64 nt, hsa
cauucuggaaaugauuucuguggauuugaaauugcacuuuuaauuuuauauaugacagcauuua

SEQ ID NO: 201495 - RNA, 64 nt, hsa
ugcaauuuaugaaaacauauaaacaauuauuuaucacuuuuaugacccaaaucacaauaaaauu

SEQ ID NO: 201496 - RNA, 64 nt, hsa
uuuauucugccauaugguuuauuucauauacacucacuuuuacacucacuuccaauuauagcau

SEQ ID NO: 201497 - RNA, 64 nt, hsa
uguuaguuucauucaaacuauauuuuguuuuuuucacuuuuaagagauuauaucucugguguua

SEQ ID NO: 201498 - RNA, 64 nt, hsa
uacuguguauuuuuuuuaaauucacggugaacagcacuuuuauuauuuccaguucagaagagcc

SEQ ID NO: 201499 - RNA, 64 nt, hsa
auugaggaaaacauuaacuccuggauuucagcuucacuuuuaaccugcagacuaaauuucuuuc

SEQ ID NO: 201500 - RNA, 64 nt, hsa
cucugcauaaccaguauuagcauuagaaauuagccacuuuuaaaaugagaaaacugugucacuc

SEQ ID NO: 201501 - RNA, 64 nt, hsa; identical to SEQ ID NO: 53018

SEQ ID NO: 201502 - RNA, 64 nt, hsa; identical to SEQ ID NO: 53019

SEQ ID NO: 201503 - RNA, 64 nt, hsa; identical to SEQ ID NO: 53020

SEQ ID NO: 201504 - RNA, 64 nt, hsa; identical to SEQ ID NO: 53021

SEQ ID NO: 201505 - RNA, 64 nt, hsa; identical to SEQ ID NO: 53022

SEQ ID NO: 201506 - RNA, 64 nt, hsa; identical to SEQ ID NO: 53023

SEQ ID NO: 201507 - RNA, 64 nt, hsa; identical to SEQ ID NO: 53024

SEQ ID NO: 201508 - RNA, 64 nt, hsa; identical to SEQ ID NO: 53025

SEQ ID NO: 201509 - RNA, 64 nt, hsa; identical to SEQ ID NO: 53026

SEQ ID NO: 201510 - RNA, 64 nt, hsa; identical to SEQ ID NO: 53027

SEQ ID NO: 201511 - RNA, 64 nt, hsa; identical to SEQ ID NO: 53028

SEQ ID NO: 201512 - RNA, 64 nt, hsa; identical to SEQ ID NO: 53029

SEQ ID NO: 201513 - RNA, 64 nt, hsa; identical to SEQ ID NO: 53030

SEQ ID NO: 201514 - RNA, 64 nt, hsa; identical to SEQ ID NO: 53031

SEQ ID NO: 201515 - RNA, 64 nt, hsa; identical to SEQ ID NO: 53032

SEQ ID NO: 201516 - RNA, 64 nt, hsa; identical to SEQ ID NO: 53033

SEQ ID NO: 201517 - RNA, 64 nt, hsa; identical to SEQ ID NO: 53034

SEQ ID NO: 201518 - RNA, 64 nt, hsa; identical to SEQ ID NO: 53035

SEQ ID NO: 201519 - RNA, 64 nt, hsa; identical to SEQ ID NO: 53036

SEQ ID NO: 201520 - RNA, 64 nt, hsa; identical to SEQ ID NO: 53037

SEQ ID NO: 201521 - RNA, 64 nt, hsa; identical to SEQ ID NO: 53038

SEQ ID NO: 201522 - RNA, 64 nt, hsa; identical to SEQ ID NO: 53039

SEQ ID NO: 201523 - RNA, 64 nt, hsa; identical to SEQ ID NO: 53040

SEQ ID NO: 201524 - RNA, 64 nt, hsa; identical to SEQ ID NO: 53041

SEQ ID NO: 201525 - RNA, 64 nt, hsa; identical to SEQ ID NO: 53042

SEQ ID NO: 201526 - RNA, 64 nt, hsa; identical to SEQ ID NO: 53043

SEQ ID NO: 201527 - RNA, 64 nt, hsa; identical to SEQ ID NO: 53044

SEQ ID NO: 201528 - RNA, 64 nt, hsa; identical to SEQ ID NO: 53045

SEQ ID NO: 201529 - RNA, 64 nt, hsa; identical to SEQ ID NO: 53046

SEQ ID NO: 201530 - RNA, 64 nt, hsa; identical to SEQ ID NO: 53047

SEQ ID NO: 201531 - RNA, 64 nt, hsa; identical to SEQ ID NO: 53048

SEQ ID NO: 201532 - RNA, 64 nt, hsa; identical to SEQ ID NO: 53049

SEQ ID NO: 201533 - RNA, 64 nt, hsa; identical to SEQ ID NO: 53050

SEQ ID NO: 201534 - RNA, 64 nt, hsa; identical to SEQ ID NO: 53051

SEQ ID NO: 201535 - RNA, 64 nt, hsa; identical to SEQ ID NO: 53052

SEQ ID NO: 201536 - RNA, 64 nt, hsa; identical to SEQ ID NO: 53053

SEQ ID NO: 201537 - RNA, 64 nt, hsa; identical to SEQ ID NO: 53054

SEQ ID NO: 201538 - RNA, 64 nt, hsa; identical to SEQ ID NO: 53055

SEQ ID NO: 201539 - RNA, 64 nt, hsa; identical to SEQ ID NO: 53056

SEQ ID NO: 201540 - RNA, 64 nt, hsa; identical to SEQ ID NO: 53057

SEQ ID NO: 201541 - RNA, 64 nt, hsa; identical to SEQ ID NO: 53058

SEQ ID NO: 201542 - RNA, 64 nt, hsa; identical to SEQ ID NO: 53059

SEQ ID NO: 201543 - RNA, 64 nt, hsa
cggauggauggaagguuggauggauggguggauggccguggauggccguggaugcgcagugccu

SEQ ID NO: 201544 - RNA, 64 nt, hsa
gaagguuggauggauggguggauggccguggauggccguggaugcgcagugccuugcauaccca

SEQ ID NO: 201545 - RNA, 64 nt, hsa
ggugggagagagauggcucaugaggcuuggaccugccguggagggugcccagcagacgugguau

SEQ ID NO: 201546 - RNA, 64 nt, hsa
gacgugagagggacgguucacaaagcucggaccugccguggagggugcccggcagacguggcgu

SEQ ID NO: 201547 - RNA, 64 nt, hsa
gagcuguaacaugcaggccuggaaguccuacagcgccguggaugugcugcagacccucgaacau

SEQ ID NO: 201548 - RNA, 64 nt, hsa
uaguggcgcauuccacacccgccucauggagccagccguggagccccugacgcaagcuuuaaag

SEQ ID NO: 201549 - RNA, 64 nt, hsa
gggucggagcucuuccuuccccucuguggagucacuuuuguauucuuuuuaaccagauuucuua

SEQ ID NO: 201550 - RNA, 64 nt, hsa
guuguuguuuugugaauccugacauugguucuuacuuuuguaugcugccuccucugugcccucc

SEQ ID NO: 201551 - RNA, 64 nt, hsa
aaccacugcaaguccuuuuguaaagugaagaauccuuuuguagaaugaaccacugccccuucau

SEQ ID NO: 201552 - RNA, 64 nt, hsa
ccuucaucuuuuaaagaaauaaccacugcaaguccuuuuguaaagugaagaauccuuuuguaga

SEQ ID NO: 201553 - RNA, 64 nt, hsa
auuuccucuugauuugucuggguuaaaaccauuccuuuuguaugaaauguuuugacuuaggaau

SEQ ID NO: 201554 - RNA, 64 nt, hsa
gcuuguuuugugaaagaauguuuugacagggccucuuuuguauaggacugccaaaucauggguu

SEQ ID NO: 201555 - RNA, 64 nt, hsa
aaguauaaaaggaggccuauucuuuucaguugaccuuuuguaauauuugauuuagaguauuuug

SEQ ID NO: 201556 - RNA, 64 nt, hsa
aguuuuaacuagauguuuuucaagguaaguucaccuuuuguacuuuacuauuuauuucagaaau

SEQ ID NO: 201557 - RNA, 64 nt, hsa
ggaacauuucuguaaauaccauugacacauccgccuuuuguauacauccuggguaaugagaggu

SEQ ID NO: 201558 - RNA, 64 nt, hsa
uagauauuacuuuaucacuuuuugaacuaagaaacuuuuguaaagaaauuuacuauauauauau

SEQ ID NO: 201559 - RNA, 64 nt, hsa
aauccuaccuuccacucaacucccauacaacuuucuuuuguacauuuugauacuuucuaccuaa

SEQ ID NO: 201560 - RNA, 64 nt, hsa
ugccccuuuaaggauuucucucuugccaccauaccuuuuguacuuuccccuauacaagauguau

SEQ ID NO: 201561 - RNA, 64 nt, hsa
uugcuuuauucugcaaaagugaacaaguugaagacuuuuguauuuuugacuuugcuaguuugug

SEQ ID NO: 201562 - RNA, 64 nt, hsa
aaagcuaacauacgguuuugaagcagcauugaaacuuuuguagcaaucuggucuauagacuuuu

SEQ ID NO: 201563 - RNA, 64 nt, hsa
guggaccagacuucugaauagagaauauuuauaacuuuuguaugagagagaauucacacucaac

SEQ ID NO: 201564 - RNA, 64 nt, hsa
cccgugucgaugucuucagccaguggugacccugcuuuuguaaccgcguuaaccugacaaaacc

SEQ ID NO: 201565 - RNA, 64 nt, hsa
caauuaacacugagaaauuaagguuaagauucuccuuuuguacugggaaacaggcuggaggacu

SEQ ID NO: 201566 - RNA, 64 nt, hsa
uagcagggaaagagcugggcaaggccaagaccaucuuuuguaccguugguacaguaggcuaaag

SEQ ID NO: 201567 - RNA, 64 nt, hsa
augguguuuuuaaacuguuucuguuuuuauucaucuuuuguaacuaugacagaaaugugcuauu

SEQ ID NO: 201568 - RNA, 64 nt, hsa
ucuauuccuuuguuuuuccuuugaugcacuccagcuuuuguauagguuucuguuuagaagcacc

SEQ ID NO: 201569 - RNA, 64 nt, hsa
gaccccuuccucaaccucuucacgcuggcauguccuuuuguagcagucuguaacuuaacuauag

SEQ ID NO: 201570 - RNA, 64 nt, hsa
ugucaugcacauaauguauauuuguuaugcacuacuuuuguauaucuuguuuuuccaacaguga

SEQ ID NO: 201571 - RNA, 64 nt, hsa
gcucaugauuugcacucuuaggguuuuguuagcccuuuuguacuacuuucuuuuuaaauugaga

SEQ ID NO: 201572 - RNA, 64 nt, hsa
acuguuuaacauuugugagaauuuuaugaaaaugcuuuuguaugagcuguggcuuuuucccauu

SEQ ID NO: 201573 - RNA, 64 nt, hsa
aguauacuacacaguucaaaagauguuuaaaaugcuuuuguauuuacugccauguaauugaaau

SEQ ID NO: 201574 - RNA, 64 nt, hsa
uugauuauugcuuauuugaaaacaguauucccaacuuuuguaaaguuguguauguuuuugcuuc

SEQ ID NO: 201575 - RNA, 64 nt, hsa
aguguaaaauuguuguagcuugaauaagaaaccacuuuuguaguuuuaaccagacuuucucuua

SEQ ID NO: 201576 - RNA, 64 nt, hsa
aauaagaauguuuugauuuugaucauacaaauaacuuuuguagauuuuuguuuacuuuuggggg

SEQ ID NO: 201577 - RNA, 64 nt, hsa
ucccuucuugugcccuuaaaaccaaacccuaugccuuuuguagcugucauggugcaauuugucu

SEQ ID NO: 201578 - RNA, 64 nt, hsa
gguauuuuauaagcacagacaauucuaaugguaacuuuuguagucuuaugaauagacauaaauu

SEQ ID NO: 201579 - RNA, 64 nt, hsa
uaagagugaggccacaguucccaccacacgagggcuuuuguauuguucuacuuuuucagcccuu

SEQ ID NO: 201580 - RNA, 64 nt, hsa
auuaaauugguuucuuuaaaaugcuuugguggcacuuuuguaaacagauugcuucuagauuguu

SEQ ID NO: 201581 - RNA, 64 nt, hsa
agaagaaagaauuggcagucaaaaaaaaaaauaccuuuuguaauguuugaaaaauaaagcuguu

SEQ ID NO: 201582 - RNA, 64 nt, hsa
ggacuacaggcacgcaccaccaugccuagcuauucuuuuguauuuuugguagagacaggguuuu

SEQ ID NO: 201583 - RNA, 64 nt, hsa
cccagaagugaauucuuuuguaaaguaaagcacccuuuuguaaugcaauuaauuaucccuuaau

SEQ ID NO: 201584 - RNA, 64 nt, hsa
aagcuggcuguuuaagggaacccagaagugaauucuuuuguaaaguaaagcacccuuuuguaau

SEQ ID NO: 201585 - RNA, 64 nt, hsa
cuuccucugagcccuugagacacuuuguaaugcucuuuuguaacuaucgacaaaggugugggga

SEQ ID NO: 201586 - RNA, 64 nt, hsa
ugcuaauacaugugacuaucguccaauuugcuuucuuuuguagugacauuaaauuuggcuauaa

SEQ ID NO: 201587 - RNA, 64 nt, hsa
accguuuauuuuacugacuuguuuaaaugauucgcuuuuguaagaaucagauggcauuaugcuu

SEQ ID NO: 201588 - RNA, 64 nt, hsa
guuacaagucaggagcccuguagggagaccccuccuuuuguacaaguaccugaaugcugcgaca

SEQ ID NO: 201589 - RNA, 64 nt, hsa
cgacucgguuccuggggcugcagccagccugggacuuuuguaagaauuuuugggugacucacuu

SEQ ID NO: 201590 - RNA, 64 nt, hsa
gaagcgaacauaaagcgggucaaguguagugcaucuuuuguaucucaggcguggcuucuucagu

SEQ ID NO: 201591 - RNA, 64 nt, hsa
aaugcauauaaugaaaucaauauuguaaggccugcuuuuguaaugaaaauggagagaaugaaga

SEQ ID NO: 201592 - RNA, 64 nt, hsa
uuuugaacacuuaacaguuucuuugagacaaugacuuuuguaaggauugguacuaucuaucauu

SEQ ID NO: 201593 - RNA, 64 nt, hsa
agccucuugguguagcaagcucacauacaaaauacuuuuguauaugcauaauauaaaucaucuc

SEQ ID NO: 201594 - RNA, 64 nt, hsa
uuaauguucuuuauaccuuuguauguaugaccuacuuuuguaacagaccaugguuguguccaag

SEQ ID NO: 201595 - RNA, 64 nt, hsa
guaaauguccccuuaugcuuuugaaauaaauuuccuuuuguaauuuuguuuugugucuugaugu

SEQ ID NO: 201596 - RNA, 64 nt, hsa
agucacugcaaaucuuuuaauucuucccuaucaccuuuuguauuuuaaugcaauuauuuugguc

SEQ ID NO: 201597 - RNA, 64 nt, hsa
auuucugguguucaaccuuggucucaaauagcugcuuuuguauaugauucacgagcuuuuuuag

SEQ ID NO: 201598 - RNA, 64 nt, hsa
uugaaauggaauuuugugauuuguagucagguaucuuuuguauuugauugcaaacauuuggauu

SEQ ID NO: 201599 - RNA, 64 nt, hsa
cuguuuacagucaauuauaaccugacaaacgagacuuuuguaacauauuauuguuacaucuuuc

SEQ ID NO: 201600 - RNA, 64 nt, hsa
uuuacucuuuauacauacuuuucagacugccuuucuuuuguaauuuauggacgguuuauaaaug

SEQ ID NO: 201601 - RNA, 64 nt, hsa
acaaaguugcuggcagauguauuugaugguuacucuuuuguaauucuuguccacuuguaaauug

SEQ ID NO: 201602 - RNA, 64 nt, hsa
caaauagugguauucuaaucccguagcauagcaccuuuuguauaaacaaugugauauugcuucu

SEQ ID NO: 201603 - RNA, 64 nt, hsa
gcaacuuuuaaagucuuacuugucuuucuuguugcuuuuguauuaggaguuccccguguggguc

SEQ ID NO: 201604 - RNA, 64 nt, hsa
gcuuuguguuaucacucgguguauauaguucauacuuuuguaaucugucaaaauacuaccuuca

SEQ ID NO: 201605 - RNA, 64 nt, hsa
guuucagcaguggcucaaaaaauuucagaaauuacuuuuguaauuauuugcaauuaauuguucu

SEQ ID NO: 201606 - RNA, 64 nt, hsa
cgcccggcucccgccccgccccggcgcggcguggcuuuuguacagacguucccacauucuuguc

SEQ ID NO: 201607 - RNA, 64 nt, hsa
aaaaaagucaaaacgaggcgagaggcgaagcccacuuuuguauaccggccggcgcgcucacuuu

SEQ ID NO: 201608 - RNA, 64 nt, hsa
uugauuuaaaauaaauaaaaauagauuauuacgucuuuuguauugagacuguauuguuaugagc

SEQ ID NO: 201609 - RNA, 64 nt, hsa
acagggaaagacugaugaaaaguaaaauggacuacuuuuguaacuuaccuguuuguuaggaaau

SEQ ID NO: 201610 - RNA, 64 nt, hsa
uguuguaauucaccauucauacuaauguuauugacuuuuguaacuuacuaauagggauguuaaa

SEQ ID NO: 201611 - RNA, 64 nt, hsa
aaaagucucauacuaccucaucuuuauuguggcgcuuuuguagaucacugagaagcuuaucuua

SEQ ID NO: 201612 - RNA, 64 nt, hsa
caaucuucgcugugugugguagaagcaguagucacuuuuguaagccagucucuucaugccuaaa

SEQ ID NO: 201613 - RNA, 64 nt, hsa
agaggagauguugacacuaugagcuaaggguuggcuuuuguaauuaccugaaucugaaaggaau

SEQ ID NO: 201614 - RNA, 64 nt, hsa
ggugggguuuuuuuguuuguucagacagucuguucuuuuguaaacauuuuuaguuggaaaaaca

SEQ ID NO: 201615 - RNA, 64 nt, hsa
uugcguuuuuaaucagaaaacaaaauagaggcagcuuuuguagauuuuaaauggguugugcaag

SEQ ID NO: 201616 - RNA, 64 nt, hsa
uaaacuuuucuuuaucuuauaaaggcauaucucgcuuuuguaucgaccuguuccuuaaaaaaug

SEQ ID NO: 201617 - RNA, 64 nt, hsa
ucccucgaggccaagaguucaugaccagccuggucuuuuguagagacccugucucuacaaaaau

SEQ ID NO: 201618 - RNA, 64 nt, hsa
uaucaugaugaauugaaaugaagauaaaauugcucuuuuguaacuuuaucuuaguaauguaaag

SEQ ID NO: 201619 - RNA, 64 nt, hsa
uuaauuuuacuaugcuccaacauuaaucaugacucuuuuguaaauuacaguuauuucaguauug

SEQ ID NO: 201620 - RNA, 64 nt, hsa
uguuuguaaacauuugucagauucuaauuuuuuucuuuuguauuaaaauucaacuauggaugua

SEQ ID NO: 201621 - RNA, 64 nt, hsa
uuuaacaaauuguggcaaauucuaaacagcaauucuuuuguacguaauaggacauuucauccua

SEQ ID NO: 201622 - RNA, 64 nt, hsa
gaucuuuuguacuuuaggacauuaaauuguacaacuuuuguauauauaaaagcuuaggaacuuu

SEQ ID NO: 201623 - RNA, 64 nt, hsa
auaguacuuaguguaaaauaauuuuauaaaugaucuuuuguacuuuaggacauuaaauuguaca

SEQ ID NO: 201624 - RNA, 64 nt, hsa
uaacuuugauuuuauagcuuuugagcuaacguaacuuuuguaaagauuaagcucauuuaguguu

SEQ ID NO: 201625 - RNA, 64 nt, hsa
gguuugaaaaacagugaaauggguaaacgcaaaacuuuuguacuuuauuacgaguaaaguguaa

SEQ ID NO: 201626 - RNA, 64 nt, hsa
acucugguuauaagugaauugagcauuaauguuucuuuuguauaaauuccuguccugaaauauu

SEQ ID NO: 201627 - RNA, 64 nt, hsa
uuaauauuucuuuuugugaaauuuccuguacagccuuuuguaggauuacuacagguuaauguga

SEQ ID NO: 201628 - RNA, 64 nt, hsa
ucugaggagcagcagagucccuuguaaaagacugcuuuuguacagaaugcgcuauaaauuauac

SEQ ID NO: 201629 - RNA, 64 nt, hsa
guugggaggaagaugaaaucgagcugucuuuuaacuuuuguauguguuuuaucagaauuugcug

SEQ ID NO: 201630 - RNA, 64 nt, hsa
caaugauugugcaaaaagucacguguaaauugaacuuuuguaaaucaaauuguauuuuaaaugc

SEQ ID NO: 201631 - RNA, 64 nt, hsa
uuuauaauacaaauaaccauucucugauuuaucucuuuuguauguuuggauuuucaauaucgac

SEQ ID NO: 201632 - RNA, 64 nt, hsa
cgggaccgugagcgggagcgcagagagcggagccgggagcgagacaaggagcgagaacggcgac

SEQ ID NO: 201633 - RNA, 64 nt, hsa
gacgguccagaggaaaagggccgggaucgugaccgggagcgacggcggagccaccggagcgagc

SEQ ID NO: 201634 - RNA, 64 nt, hsa
uugucucuaacuguacaggagacuucucugccugggcugggaaaggggccuuucuuuuguuuug

SEQ ID NO: 201635 - RNA, 64 nt, hsa
ccugggacccucuagagguuggaaagagaagagaggcugggagcggauggaaagcaugacugca

SEQ ID NO: 201636 - RNA, 64 nt, hsa
accuggauguccugggcuagggggccggcccaggggcugggagugguuagccggaauacugggg

SEQ ID NO: 201637 - RNA, 64 nt, hsa
auucacccucagcaugugggaagggacaggugggggcugggaguagaggauguuccugcuucuc

SEQ ID NO: 201638 - RNA, 64 nt, hsa
gcaaccuccaccaggaccaggauccugggccacaggcugggaugguccuuccaagaaaggguca

SEQ ID NO: 201639 - RNA, 64 nt, hsa
aguuccugcccccauucucuuggggucagggaggggcugggaagggcuacugaaggccccauuc

SEQ ID NO: 201640 - RNA, 64 nt, hsa
cuacugaaggccccauucucccacaggauggugaggcugggaggaggaagacugagguagagau

SEQ ID NO: 201641 - RNA, 64 nt, hsa
cugcagccaggauugccucagcuccucccccucaggcugggaggauagcacaggcuaggggcuc

SEQ ID NO: 201642 - RNA, 64 nt, hsa
gcugcucagaggcugcagggagggcccaggagccggcugggaggguggggucccuuuguugcca

SEQ ID NO: 201643 - RNA, 64 nt, hsa
cuagagggacugugcagaaccaggcugggagaagggcugggaaaacugggaguggaggguggau

SEQ ID NO: 201644 - RNA, 64 nt, hsa
agaggacacaggcuagagggacugugcagaaccaggcugggagaagggcugggaaaacugggag

SEQ ID NO: 201645 - RNA, 64 nt, hsa
caggcucaagcccuagagaugggcagggccuaggggcugggagcugccugcugccauagcagca

SEQ ID NO: 201646 - RNA, 64 nt, hsa
cgcagccuaguuccuuccuggccccucucucacuggcugggaaacccuagaccaugucagauag

SEQ ID NO: 201647 - RNA, 64 nt, hsa
acacugguccccccaucacacucaccccuaagugggcugggagccaggcagggccagggcagcu

SEQ ID NO: 201648 - RNA, 64 nt, hsa
aguaacagaucaggacccaaacuugggcagucugggcugggagcccacaccccacucaccaguu

SEQ ID NO: 201649 - RNA, 64 nt, hsa
ggaggcaggcccuccacagaagcucugcagcaggggcugggagagcagaagggcaggcccugca

SEQ ID NO: 201650 - RNA, 64 nt, hsa
gcugggagagcagaagggcaggcccugcaacucaggcugggaguaucgaacccucugccuaggg

SEQ ID NO: 201651 - RNA, 64 nt, hsa
cuuguccuugucguguugccaugggguucugagaggcugggaguucacagaccucagacacagc

SEQ ID NO: 201652 - RNA, 64 nt, hsa
ccugcgggccugggaagcauugcucaggguggggggcugggaccauggcccgcagaggcacugc

SEQ ID NO: 201653 - RNA, 64 nt, hsa
uccuacuacuuuaaucccuaaaagaacgcuguguggcugggaccuuuaggaaagugaaaugcag

SEQ ID NO: 201654 - RNA, 64 nt, hsa
uuccuaagaaugcaaacugccuuuuccacacaaaggcugggaauaaaauucuggguauucucgu

SEQ ID NO: 201655 - RNA, 64 nt, hsa
ccugcaggcagagcuggagcccccagcagaggcaggcugggacggaccagcaucuggaagaugu

SEQ ID NO: 201656 - RNA, 64 nt, hsa
agggagccuccccaucuguccagcuggggccagaggcugggagucccuaccugcuucacguugg

SEQ ID NO: 201657 - RNA, 64 nt, hsa
ccaguccgcaaauauuuauugggggccagcccagggcugggacugggcaugagguggucaccag

SEQ ID NO: 201658 - RNA, 64 nt, hsa
aggacauggcacuggauggcuggcagagagcccuggcugggaguuagggagcccuggguuggaa

SEQ ID NO: 201659 - RNA, 64 nt, hsa
guguuugccgcagcauggaaaacagggcgccuaaggcugggagcuggaagaaggggcauugggu

SEQ ID NO: 201660 - RNA, 64 nt, hsa
augguguccuucccuggccuucucuuggcucaaaggcugggagggagggaaggagagaagaguu

SEQ ID NO: 201661 - RNA, 64 nt, hsa
ugggcugccuuaguuaguuaugagaacagggaagggcugggaagagacagccuccaaggucaac

SEQ ID NO: 201662 - RNA, 64 nt, hsa
ucaccccuccucacugccucuccucucugggacaggcugggaccuuugaggaagauaaagccuu

SEQ ID NO: 201663 - RNA, 64 nt, hsa
agcugccaucugggcuauucugggguagaaggaaggcugggaguggugggaauuuuauaaauau

SEQ ID NO: 201664 - RNA, 64 nt, hsa
cucuguguaggucacuggaaagugauugccauagggcugggagagaagcauugcacucuugagg

SEQ ID NO: 201665 - RNA, 64 nt, hsa
cccuaccucagcuuaggacccccagagccaagguggcugggaucuggccccacagauggggaaa

SEQ ID NO: 201666 - RNA, 64 nt, hsa
gagaccucuguccacugcccagggaggggccuggggcugggagcagucccgguuuagccugagg

SEQ ID NO: 201667 - RNA, 64 nt, hsa
gaaauacugugcuaccuuccagaguucccacaugggcugggauuuuuuuuucuuuuucuuuuuu

SEQ ID NO: 201668 - RNA, 64 nt, hsa
gggauuacaggugugagccaccgcgccuggccugggcugggaaucuuuguugacuucuuuggga

SEQ ID NO: 201669 - RNA, 64 nt, hsa
ccaggaauuagaaguggcaggagagaacaacaggggcugggaauggaggggagaauuucuaggg

SEQ ID NO: 201670 - RNA, 64 nt, hsa
augacugcuucucugagagaacuugcccaucaggggcugggacauggggguguggguaaagaca

SEQ ID NO: 201671 - RNA, 64 nt, hsa
gugggauaagcccaggugcaaggggaggagggcaggcugggaacagagcggagaaugcccaugg

SEQ ID NO: 201672 - RNA, 64 nt, hsa
uagaaaaccuggccacugguaggagcuagggaggggcugggaagauggcagcucacucaguacu

SEQ ID NO: 201673 - RNA, 64 nt, hsa
aaggaggcccagaaguuggaaagagauggaauguggcugggaacauugcaucccaaagagcuuc

SEQ ID NO: 201674 - RNA, 64 nt, hsa
gucuugauggccuacgagaggccaaguuccacugggcugggaaaagucacuuugucugucuugu

SEQ ID NO: 201675 - RNA, 64 nt, hsa
ggguagggagugcuaaggaucuggggaaaccaugggcugggaagcugcucuugcucuccucgug

SEQ ID NO: 201676 - RNA, 64 nt, hsa
ggaccagggagaaugaccauagggcacuaaguaaggcugggauuggaucagcagaaauccaacc

SEQ ID NO: 201677 - RNA, 64 nt, hsa
ggcccugcuuccugcuugccaaggcagaggccugggcugggaaaaacuuuggaaccagacucuu

SEQ ID NO: 201678 - RNA, 64 nt, hsa
ccucccgagcuccucuuccaugcugugcgcccagggcugggaggaaggacuucccuguguaguu

SEQ ID NO: 201679 - RNA, 64 nt, hsa
uggcaucagcuggcgucaugcaaagucaugcaaaggcugggaccacgugagaucauucacucau

SEQ ID NO: 201680 - RNA, 64 nt, hsa
agaucauucacucauacaucuggccguugauguuggcugggaacucaccuggggcugcuggccu

SEQ ID NO: 201681 - RNA, 64 nt, hsa
guuuguuucugaaagggacgcuacccgggaagggggcugggacaugggaaaggggaaguuguag

SEQ ID NO: 201682 - RNA, 64 nt, hsa
agugggcccaaugcacuuuguucuggcucuuccaggcugggagagccuuccaggggugggacac

SEQ ID NO: 201683 - RNA, 64 nt, hsa
ggcccguccggagggagccaucucuugcucccgaggcugggacaguccuuucugugggggcucu

SEQ ID NO: 201684 - RNA, 64 nt, hsa
accugacugacuucccaguggaacugccuucuugggcugggacagccccuuuccucugucccuu

SEQ ID NO: 201685 - RNA, 64 nt, hsa
gggggccugcuccucggacucugguuaccucugaggcugggaaaggccuggcugcccacugccu

SEQ ID NO: 201686 - RNA, 64 nt, hsa
uccagacccucaccgaccaccuguccugggaccaggcugggaggggaguguggcagggaggagg

SEQ ID NO: 201687 - RNA, 64 nt, hsa
cccuuucccacaccuuuguuccucaauagcugggggcugggacugaggccuccugcagguaccu

SEQ ID NO: 201688 - RNA, 64 nt, hsa
ccacuuuucuccugggggcugggcuggggguuagggcugggacugugcccccacacugcgccuc

SEQ ID NO: 201689 - RNA, 64 nt, hsa
cggagaggcagguguggcguaaggccucacucccggcugggaaggucucugaucacacagaagc

SEQ ID NO: 201690 - RNA, 64 nt, hsa
aaugugccuuuuucagaguuggccaggagcuccuggcugggacacggagaggcagguguggcgu

SEQ ID NO: 201691 - RNA, 64 nt, hsa
uccuggccccaccgccagggggcagcgcaggccgggcugggaggcggcggcggcggcucgggcu

SEQ ID NO: 201692 - RNA, 64 nt, hsa
gccccgggggccgagguagggucgggggcuuagaggcugggauggcuccuggccccaccgccag

SEQ ID NO: 201693 - RNA, 64 nt, hsa
agaggcucccggagacugcagccuccugugguugggcugggagccggcaggguuuggggugugg

SEQ ID NO: 201694 - RNA, 64 nt, hsa
cgcccaguguguuuuaagcaugaggcauccgcguggcugggagaggcuuugaccauccuuggcu

SEQ ID NO: 201695 - RNA, 64 nt, hsa
uguuguagauuucaucugcuuccuccuuagggaaggcugggauaugaugagagauuccagccca

SEQ ID NO: 201696 - RNA, 64 nt, hsa
cccagaguuaagcacuggaugucuccugaucccaggcugggaccccuacccccacccccuuuga

SEQ ID NO: 201697 - RNA, 64 nt, hsa
gugaaccucaccuccuggggcuuccgagcuacagggcugggaccaggucaugcagcugaaaguc

SEQ ID NO: 201698 - RNA, 64 nt, hsa
agccugacugugccuuccagggccugggaccauuggcugggaccccucauuaaccaaccaagca

SEQ ID NO: 201699 - RNA, 64 nt, hsa
cccagccuuccaaggugaggccaucucaucugcaggcugggaggcagggcuggacucaggaacc

SEQ ID NO: 201700 - RNA, 64 nt, hsa
ggugccaugcccugaagaggcaggguacacauggggcugggagggcaaagauggggcggggccu

SEQ ID NO: 201701 - RNA, 64 nt, hsa
cgcgcagcucaguuagagacggagaaagggaagaggcugggauggucucugcugcucuugccuc

SEQ ID NO: 201702 - RNA, 64 nt, hsa
agugugcccaggagucugaucugcugggguacagggcugggagaaccccuagcucucccggggu

SEQ ID NO: 201703 - RNA, 64 nt, hsa
ccuugucguccuggacaccacaggggcaccugcaggcugggagaccagguccucugugcauggg

SEQ ID NO: 201704 - RNA, 64 nt, hsa
gauuccaggccugggguuagcagccugugcccccggcugggagaucagacccgguguugguccu

SEQ ID NO: 201705 - RNA, 64 nt, hsa
cuuacccucuggggccucagcuuucccuccggaaggcugggaggaggugggcuagaugaucuuu

SEQ ID NO: 201706 - RNA, 64 nt, hsa
uaacuauuucaguugugagccuucuagggccccaggcugggaggcucagaggacugaaucuggg

SEQ ID NO: 201707 - RNA, 64 nt, hsa
gagaacagaggggacaugaacuccuuggaggcagggcugggaagggacccugggcugugucucc

SEQ ID NO: 201708 - RNA, 64 nt, hsa
agcaaugaaaccuguucaugucuaagagcagcugggcugggaaucuuccccuuuguucaaggcc

SEQ ID NO: 201709 - RNA, 64 nt, hsa
cccacucccucugcccucugcuccguucccugggggcugggacuaaagaaauggguguccccca

SEQ ID NO: 201710 - RNA, 64 nt, hsa
cuaaccccgccuuccagcacuuucugucauuccaggcugggaaagucuagagcccccuuuggcc

SEQ ID NO: 201711 - RNA, 64 nt, hsa
ccauccuggggcagggaaggacagaguguuggauggcugggacggggccuugcucuugucggcc

SEQ ID NO: 201712 - RNA, 64 nt, hsa
ucaaauugagguggugacuuuuguuggaaaauugggcugggaucacguccuguuuuguaauaaa

SEQ ID NO: 201713 - RNA, 64 nt, hsa
caaaguaauauucaaaggggauguuuggggguggggcugggaccggguggcuuuauauugauaa

SEQ ID NO: 201714 - RNA, 64 nt, hsa
ucaugauuagaauuagacugcaaagcacgucaugggcugggauugagaacuccauguugcucug

SEQ ID NO: 201715 - RNA, 64 nt, hsa; identical to SEQ ID NO: 45461

SEQ ID NO: 201716 - RNA, 64 nt, hsa; identical to SEQ ID NO: 45462

SEQ ID NO: 201717 - RNA, 64 nt, hsa
aagaauaaaaaaaugagcuaggcgugguagugcacaccuguaguccuagcuacuugggaggcug

SEQ ID NO: 201718 - RNA, 64 nt, hsa
ccuaucucuucaucucuucuugccagugauguugcaccuguaaccaucuuuuuauggguggagc

SEQ ID NO: 201719 - RNA, 64 nt, hsa
auuaagaaccuaugcggcccggcaugguggcucacaccuguaaucccagcacuuugggaggcca

SEQ ID NO: 201720 - RNA, 64 nt, hsa
aaagauacaaaaauuugcugagcgugguggugugcaccuguaaucccagcuacucgagaggcca

SEQ ID NO: 201721 - RNA, 64 nt, hsa
cauaaaaacaaaauuacuggggccccauggcacacaccuguagucccagcugcucgggaagcug

SEQ ID NO: 201722 - RNA, 64 nt, hsa
uauucggccauuaaaaaaaaaaaagaguggcugacaccuguaaucucagcacuuugagaggcca

SEQ ID NO: 201723 - RNA, 64 nt, hsa
aaaauaagaaaaauuagcugggcgugguggcgggcaccuguaaucccagcuacuugggagacug

SEQ ID NO: 201724 - RNA, 64 nt, hsa
gauuuuuggguccugagccagccgugguggcucacaccuguaaucccagcacuuugggaggcug

SEQ ID NO: 201725 - RNA, 64 nt, hsa
uaaaauguucucuucggccggguguggugacucacaccuguaaccucagcacuuugggaggcag

SEQ ID NO: 201726 - RNA, 64 nt, hsa
aaaaaaugcuguccaggccaggcacaguggcucacaccuguaaucccaggacuucgggaggcug

SEQ ID NO: 201727 - RNA, 64 nt, hsa
gaaaacacaaaaauuagacgggcaugguggcgcacaccuguaaucccagcuacuugggaggcug

SEQ ID NO: 201728 - RNA, 64 nt, hsa
cauugaaauuauguuggcugagcaugguggcucacaccuguaauccuagcacuuugggaggccg

SEQ ID NO: 201729 - RNA, 64 nt, hsa
aaaaaaaaaaaaaaaagccaggcaugguggcacacaccuguaaucccagcuacucgggaggcug

SEQ ID NO: 201730 - RNA, 64 nt, hsa
aaaauguuuugaauaggccaggcgcaguggcucacaccuguaaucccagcacguugggaggcca

SEQ ID NO: 201731 - RNA, 64 nt, hsa
aaaaaaaaaaaaauuagcugggcaugguggcacacaccuguagucccagcuacuugggaggcug

SEQ ID NO: 201732 - RNA, 64 nt, hsa
aaacacaauuuauuuggccgggcacgguggcucacaccuguaaucucagcacuuuggcaggcca

SEQ ID NO: 201733 - RNA, 64 nt, hsa
aaaaauacaaaaauuagccaggcaugguggcgggcaccuguaaucccaguuacuugggaagcug

SEQ ID NO: 201734 - RNA, 64 nt, hsa
aaaaaaaacaaaauuagccgggcgugguugcgggcaccuguagucccagcuacucaggaggcug

SEQ ID NO: 201735 - RNA, 64 nt, hsa
aaaauuacggugauuggccaggugcaguggcucacaccuguaaucccagcacuuugggaggcca

SEQ ID NO: 201736 - RNA, 64 nt, hsa
aaaaacacaaaaauuagcugggcauuguggcgcacaccuguauucccaucuagucaggaagcug

SEQ ID NO: 201737 - RNA, 64 nt, hsa
aauaaaagaaaaaccagccaggcacaguggcucacaccuguaaucccagcgcuuugggaggcua

SEQ ID NO: 201738 - RNA, 64 nt, hsa
uuagaacaggaccuaggcccugugcaauggcucacaccuguaauuccaacacuuugggaggcag

SEQ ID NO: 201739 - RNA, 64 nt, hsa
gaauugugaaaauuggguugggcgccguggcucacaccuguaauccuagcgcuuugggaggccg

SEQ ID NO: 201740 - RNA, 64 nt, hsa
aagaguaaacuagauaacugggcgucguggugcacaccuguagucccagccacucugaggcagg

SEQ ID NO: 201741 - RNA, 64 nt, hsa
aaaaacauaaaaauuagccaggugugguggugggcaccuguaaucucagcuacuugggaggcug

SEQ ID NO: 201742 - RNA, 64 nt, hsa
aaaaaaaugcagacuggccaggcacaguggcucacaccuguaauccgacuguaagcucaucacc

SEQ ID NO: 201743 - RNA, 64 nt, hsa
cuuguuaaaaaugcaggccaggugcgguggcucacaccuguaaucccagcgcuuugggaggcug

SEQ ID NO: 201744 - RNA, 64 nt, hsa
aucuuggcgcagauguuuguguugccuccucaggcaccuguagauauaauuuacaccaugauau

SEQ ID NO: 201745 - RNA, 64 nt, hsa
aagaugguuuggauuauugauauggacagauucccaccuguauguagcacgccaugcugggcca

SEQ ID NO: 201746 - RNA, 64 nt, hsa
guggucauuucccuuggccgggcgcgguggcucacaccuguaaucccagcacuuugggaggcca

SEQ ID NO: 201747 - RNA, 64 nt, hsa
aaaaauagaaauauuagccgggcauggugucaggcaccuguaaucccagcuacuugggaggcug

SEQ ID NO: 201748 - RNA, 64 nt, hsa
uguccaaccucccaggauuguuuuauccuaaugucaccuguauauucauuugaaaggacuuggc

SEQ ID NO: 201749 - RNA, 64 nt, hsa
uuagaagucaaacauggccaggcacaguggcucacaccuguaaucuucaggauuucaagaccag

SEQ ID NO: 201750 - RNA, 64 nt, hsa
acugaaaauagaaaaaaaaaauuagccaggcuugcaccuguaaucccaguuaccugggaggcug

SEQ ID NO: 201751 - RNA, 64 nt, hsa
uacagagccuucaggcucucgacaggcaagagaacaccuguaaauagauggucccgacauugag

SEQ ID NO: 201752 - RNA, 64 nt, hsa
cagaccagaugaugcucugguacuccacagugcucaccuguaucacugcagggcuuucugcacu

SEQ ID NO: 201753 - RNA, 64 nt, hsa
aagucugccuauccuggccaggugugguggcucacaccuguaaucccagcacuuugggagacca

SEQ ID NO: 201754 - RNA, 64 nt, hsa
uaaaaauacaaaaauuagcugggcauggugcgggcaccuguaguccuagcuaucaagaggcuga

SEQ ID NO: 201755 - RNA, 64 nt, hsa
aaaaauacaaaaauuagccgggcgugguggcaggcaccuguaaucccagcuacuugggaggcug

SEQ ID NO: 201756 - RNA, 64 nt, hsa
ucucuacuaaauauuagcggggugugguggcgggcaccuguaaucgcagccuuucaggaggcug

SEQ ID NO: 201757 - RNA, 64 nt, hsa
auaauuacuuaauguggccgggcacgguggcucacaccuguaaucccagcacuuugggaggucg

SEQ ID NO: 201758 - RNA, 64 nt, hsa
cuaaaaauaugaaauuagccagggugguggugcacaccuguaaucccagcuaccugggaggcug

SEQ ID NO: 201759 - RNA, 64 nt, hsa
aaaaauacaaaaauuagcugggcgugguggcgugcaccuguagucccagcuacucaggauccug

SEQ ID NO: 201760 - RNA, 64 nt, hsa
aaaaauagaaaaauuagccagguguaguggugugcaccuguagucccagcucuucaggaggcug

SEQ ID NO: 201761 - RNA, 64 nt, hsa
aagaagguucugccaggccgggcgcgguggcucacaccuguaaucccagcacuuugggaggccg

SEQ ID NO: 201762 - RNA, 64 nt, hsa
aaauacaaaaaaauuagucggacaugguggcaggcaccuguagucccagcuacucgggaggcug

SEQ ID NO: 201763 - RNA, 64 nt, hsa
cucuaccgaaaaauuagcagggugugguggcacgcaccuguaguccccgcuacgcagguggcug

SEQ ID NO: 201764 - RNA, 64 nt, hsa
auauucaugaccacuggccaggcgagguggcucacaccuguaaucccagcacuuugggaggcca

SEQ ID NO: 201765 - RNA, 64 nt, hsa
cuuuaaucuuaguuccgccaggcacgguggcucacaccuguaaucccagcacuuugggaggcca

SEQ ID NO: 201766 - RNA, 64 nt, hsa
aauaccaaaaaaauuagcugggcaugguggcacacaccuguaguccccuguagucccagcuacu

SEQ ID NO: 201767 - RNA, 64 nt, hsa
uguguagguucugcaggcccaguguagaggcucacaccuguaaucccaguacuuugagacgcug

SEQ ID NO: 201768 - RNA, 64 nt, hsa
aaaauacaaaaaacuagccaggcgugguggugggcaccuguaaucccagcuacuugggaggcug

SEQ ID NO: 201769 - RNA, 64 nt, hsa
aaaaauacaaaaauuagccaggcaugauggugugcaccuguagucccagcuacucaggaggcug

SEQ ID NO: 201770 - RNA, 64 nt, hsa
aagaagagggucgugggcugggcgcgguggcucacaccuguaaucucaacgcuuugggagggga

SEQ ID NO: 201771 - RNA, 64 nt, hsa
aaaaauacaaaaauuagccaggcaugguggcacacaccuguaaucguagcugaggcaggagaau

SEQ ID NO: 201772 - RNA, 64 nt, hsa
uaaaaacuuaagaugggccaggugcgguggcucacaccuguaaucccagcauuuugggaggcca

SEQ ID NO: 201773 - RNA, 64 nt, hsa
aaugcaauaauaaugggccaggugaaguggcucacaccuguaaucccagcacuguggaaagaca

SEQ ID NO: 201774 - RNA, 64 nt, hsa
aauaaauaaaaugcgggccaggcacaguggcucacaccuguaaucccagcacuaugggaggccc

SEQ ID NO: 201775 - RNA, 64 nt, hsa
acaaucgaagguaaaacaacauauuguguugggccaccuguacugaacgcugaaucguuuuucc

SEQ ID NO: 201776 - RNA, 64 nt, hsa
uggaaauaaacucagggcccggagcgguggcucacaccuguaaucccagcacuuugagaggcca

SEQ ID NO: 201777 - RNA, 64 nt, hsa
aaaaauacaaaauuuagccaggcaugguggcacacaccuguagucccaggcugaggugggagga

SEQ ID NO: 201778 - RNA, 64 nt, hsa
aaauucaaaugaauuuggccuggcacaggggucacaccuguaaucccagcacuuugggaggaca

SEQ ID NO: 201779 - RNA, 64 nt, hsa
aaaaauacaaaaguuagccagguacaguaguacacaccuguaguccaagcuacuugggaggcug

SEQ ID NO: 201780 - RNA, 64 nt, hsa
aaaagaaaaaguuuggaucaggcaggguggcucacaccuguaaucccugcacuuugggaggcca

SEQ ID NO: 201781 - RNA, 64 nt, hsa
aaaauccaaaaaauuagccgggcuugguggugugcaccuguaauuccagcuacucgggaggcug

SEQ ID NO: 201782 - RNA, 64 nt, hsa
ugaaagugaugcacaggacaggugugguggcucacaccuguaaucccagcacuuugggaggccg

SEQ ID NO: 201783 - RNA, 64 nt, hsa
auguuaagaggauugggccaggcguggugucucacaccuguaaucccagcacuuugagaggcca

SEQ ID NO: 201784 - RNA, 64 nt, hsa
gagaaauauaaaucaggccaggcacgguggcucacaccuguaaucccaguacuuugggaggcca

SEQ ID NO: 201785 - RNA, 64 nt, hsa
gaaauugaagagagaggccaggcgcgguggcucacaccuguaaucccagcacuuugggaggcug

SEQ ID NO: 201786 - RNA, 64 nt, hsa
cacuccaaggccucgcguggagcauccuuagucccaccuguagcugaauccacagacccaaagc

SEQ ID NO: 201787 - RNA, 64 nt, hsa
aaaacagagcuuuuaggccaggugugguggcucacaccuguaaucccagcacuuugggaggccg

SEQ ID NO: 201788 - RNA, 64 nt, hsa
guuagaaauagacuuagcugggugcaguggcucacaccuguaauccuagcaucuugggaggccc

SEQ ID NO: 201789 - RNA, 64 nt, hsa
aaaaauuuaaaaauuagccaagugugguggugugcaccuguagucccagcuacucgggaagcug

SEQ ID NO: 201790 - RNA, 64 nt, hsa
agguggucuccguuuauacccuuucuucuuuuggcaccuguaaguuccgguaguggccaucuua

SEQ ID NO: 201791 - RNA, 64 nt, hsa
aaagauagaaaaauuagcuggacaugguggcaggcaccuguaaucccagcuacucggaaggcug

SEQ ID NO: 201792 - RNA, 64 nt, hsa
aaaaauacaaaaauuagcugggcgugguggcgugcaccuguaaucccagcuacucaggaggcug

SEQ ID NO: 201793 - RNA, 64 nt, hsa
gaaaauccuaucaauggcugggcgcgguggcucacaccuguaaucccagcacuuugggagaccg

SEQ ID NO: 201794 - RNA, 64 nt, hsa
uuucuucucucugggaaaaugaacguccaggacacaccuguaucccagagagcaaagugaugag

SEQ ID NO: 201795 - RNA, 64 nt, hsa
aaugaaggagggacucaggaucauuguuaucagugggccaaaguuagauuuugcuuucaagauu

SEQ ID NO: 201796 - RNA, 64 nt, hsa
uuacugcagucagaugccaucucauccccugugggggccaaaguuuuuaugugggcagaugcug

SEQ ID NO: 201797 - RNA, 64 nt, hsa
ccaauggcuuucuagaugaguggccauucauuugcuugcucaguucuuaguggcacaucuucug

SEQ ID NO: 201798 - RNA, 64 nt, hsa
cagaaacuggauacaguucugaggcacagccagacuugcucaggguggcccugccacaggcugc

SEQ ID NO: 201799 - RNA, 64 nt, hsa
uuuuaguuggucuuuccaucuaucacugcauuaucuugcucauucuucaguucucuacucccuc

SEQ ID NO: 201800 - RNA, 64 nt, hsa
agcugguccugaccaggauggagcaagcucuucccuugcucaugagcuccugaucagaggcauu

SEQ ID NO: 201801 - RNA, 64 nt, hsa
cacugucccuaccacugagcccuugcacaggccacuugcucagacgagacacccuaacucuugc

SEQ ID NO: 201802 - RNA, 64 nt, hsa
cacaggccacuugcucagacgagacacccuaacucuugcucacucccuaaagcccucuucaggg

SEQ ID NO: 201803 - RNA, 64 nt, hsa
uuccuggaggcugccaacccagcccucauccucccuugcucacaaaguuacaggguaggcaccu

SEQ ID NO: 201804 - RNA, 64 nt, hsa
ugcccacccucuuccugucuccaccuggacacaacuugcucaaaggcuggugacuugugggcca

SEQ ID NO: 201805 - RNA, 64 nt, hsa
cccuuccugccuccucccagggcucugccagggccuugcucagucccuuccaccaaagucaucu

SEQ ID NO: 201806 - RNA, 64 nt, hsa
gugcuauguucucuuuaccccuucccccucuucucuugcucaggccugcaccacugcagccacc

SEQ ID NO: 201807 - RNA, 64 nt, hsa
guugauuucuauggccaacuuucucucuuuguaaaacaaagauugauugauuuucuuguaugcu

SEQ ID NO: 201808 - RNA, 64 nt, hsa
cguagguguaagagaaauggaaaugaaugguuucaacaaagaucauuuaauacagcagagcaug

SEQ ID NO: 201809 - RNA, 64 nt, hsa
cuucugcuggcuucuccggcuuucagagcccugaaacaaagagaaacaggaucugucccuaccc

SEQ ID NO: 201810 - RNA, 64 nt, hsa
cugcaacuccucccccuuuuauuuccccaauuuaaacaaagauucugccaacuguggaaacuuc

SEQ ID NO: 201811 - RNA, 64 nt, hsa
cagaagcuuccugagcuucaaggugaucaagguuaacaaagaaugcguccgaggacuuugggcc

SEQ ID NO: 201812 - RNA, 64 nt, hsa
ucccuggauguggauuucacaccccauucucaaaaacaaagaguaucaucaacgggaagugaga

SEQ ID NO: 201813 - RNA, 64 nt, hsa
gaauguccugaaaaggguguugggagggugguucaacaaagaaacaaagauguuaugguguuua

SEQ ID NO: 201814 - RNA, 64 nt, hsa
ugaaaaggguguugggagggugguucaacaaagaaacaaagauguuaugguguuuagauuuaug

SEQ ID NO: 201815 - RNA, 64 nt, hsa
auuuugaauuuguucaaaccuguaauggcuuguaaacaaagaugaccaucagcuguuucucaca

SEQ ID NO: 201816 - RNA, 64 nt, hsa
agacaggaaaacuaaauaauaaguuaauuaauauaacaaagaugcagguuccugcucauuccag

SEQ ID NO: 201817 - RNA, 64 nt, hsa
cuucaucacagucacauucaaaauagugacucuaaacaaagaagaaagcagcacugucaucaga

SEQ ID NO: 201818 - RNA, 64 nt, hsa
ucauuguuaguucuugucuaguuuucauuaaaagaacaaagaucuuuuauauggauaucuuaua

SEQ ID NO: 201819 - RNA, 64 nt, hsa
cuuagcaaaggcucaugcugaaauuugccaguaaaacaaagaaguuuaaagacuggcagguaca

SEQ ID NO: 201820 - RNA, 64 nt, hsa
aaaaaaagaaaaaaaagaaaaaaaggaaaagaagaacaaagaaacaugacugucucaaagagua

SEQ ID NO: 201821 - RNA, 64 nt, hsa
gccugggaacgaggccaucagcugccaugcacauaacaaagagacaaugcauuccuucuuauuu

SEQ ID NO: 201822 - RNA, 64 nt, hsa
uuuuaaaaaucgaugaaucauuugugaugcuuuuaacaaagauuaaaugaauuugaucagcuuu

SEQ ID NO: 201823 - RNA, 64 nt, hsa
aaguuucugggaacacauaauauguagccaguuuaacaaagaagcugucaggugcacagcccuu

SEQ ID NO: 201824 - RNA, 64 nt, hsa
cccucaaucugcccauuuaaaaauugguggagugaacaaagagcaugaaaauguugaagaccac

SEQ ID NO: 201825 - RNA, 64 nt, hsa
cuuuugcucugcaacagcagagucgagucauugcaacaaagagcauauggccccacagugccua

SEQ ID NO: 201826 - RNA, 64 nt, hsa
uuuuaaaaauacucuuuucagauucacguucucuaacaaagagucucauguucaagaucaauau

SEQ ID NO: 201827 - RNA, 64 nt, hsa
aagaaccugauuugcacucuguaguguuuaaagaaacaaagaaacucuaauauugaaucucuua

SEQ ID NO: 201828 - RNA, 64 nt, hsa
cacuggcauaugaccaugcaagacugucagugccaacaaagacaacacuaaucagcacaucgua

SEQ ID NO: 201829 - RNA, 64 nt, hsa
caauccuagucucugauaaaacagaauuuaaaccaacaaagaucaaaagagacaaggccauuau

SEQ ID NO: 201830 - RNA, 64 nt, hsa
ggcaggaauaaagauguucuuugaaacccaugagaacaaagacacaacauaccagaaucucugg

SEQ ID NO: 201831 - RNA, 64 nt, hsa
agaauggguuccuguggagaaaaauggugaagaaaacaaagaugaugauaauguuuucagcagc

SEQ ID NO: 201832 - RNA, 64 nt, hsa
aaugggcuggagagaaggagaaggauuaggaaaaaacaaagaaggcaauaaggaacccauccua

SEQ ID NO: 201833 - RNA, 64 nt, hsa
ccaccuacucugcccuuuuggcaaaguuaccuugaacaaagaaucuuaaggguuuauuaagaac

SEQ ID NO: 201834 - RNA, 64 nt, hsa
ucugugcuuuaaauuucucauuacuggguuagaaaacaaagagggauugcccugcacauuuucu

SEQ ID NO: 201835 - RNA, 64 nt, hsa
uucuuaccugguaacuugagacuuuaaaagaagaaacaaagaggggaagauaugggagcgaauu

SEQ ID NO: 201836 - RNA, 64 nt, hsa
caugcuagaaacaggaagauuggaaucugccuggaacaaagaacugcaccuaagcagaccagaa

SEQ ID NO: 201837 - RNA, 64 nt, hsa
acuacauagguaaagaaaagauaaacuaacuuguaacaaagaccacaacugcauguuggauuag

SEQ ID NO: 201838 - RNA, 64 nt, hsa
aaaaguuucacaauggggacaauuagcauaacuaaacaaagauuaugagcucuacuuauuccgu

SEQ ID NO: 201839 - RNA, 64 nt, hsa
uagcuugaaaaagggaggacagucuuuccccagcaggggucaggggggccccucaggaagccua

SEQ ID NO: 201840 - RNA, 64 nt, hsa
ugcucagucaguuguguggggauggugagggaagaggggucacaugagggaggaaacuguaucc

SEQ ID NO: 201841 - RNA, 64 nt, hsa
gucagauaaugcuggcaaauccuccuacccaaaaaggggucaauuguccagagaccuagacugg

SEQ ID NO: 201842 - RNA, 64 nt, hsa
gcaaugaagaugucuaggagaugaacuagaaauaaggggucagauaaugcuggcaaauccuccu

SEQ ID NO: 201843 - RNA, 64 nt, hsa
ucaggcuggacgggaggguagccuuguggcugagaggggucagacuagguggcacaggggcucc

SEQ ID NO: 201844 - RNA, 64 nt, hsa
ucccagagagggggugccccaucuagcugggugcaggggucacugcuugucagcucagggcccu

SEQ ID NO: 201845 - RNA, 64 nt, hsa
gagcagccaggggugguggaaggagcacugggcuaggggucaggggucagagauucuguccugc

SEQ ID NO: 201846 - RNA, 64 nt, hsa
caggggugguggaaggagcacugggcuaggggucaggggucagagauucuguccugcuccuggg

SEQ ID NO: 201847 - RNA, 59 nt, hsa
ugcucuccuccaggggcagaacauggggaggggacuagaugggcaaggggcagcacugc

SEQ ID NO: 201848 - RNA, 59 nt, hsa
cccacagcuuaguggccaguaaacacccuggggacuaggaaaaggaaccaacuguaggc

SEQ ID NO: 201849 - RNA, 59 nt, hsa
agggauaauaauuuaauuguucuagacaaggggacuauagggacugacuguuauuaaaa

SEQ ID NO: 201850 - RNA, 59 nt, hsa
caacccucauccccaucuucucaggggcaggggacuaccuuccagugucucccuccagc

SEQ ID NO: 201851 - RNA, 59 nt, hsa
acacacacacacacacacacacucuuuuaggggacuaagagagagaagcauguuauuac

SEQ ID NO: 201852 - RNA, 59 nt, hsa
aguugaaaucucuggaagagggaacauguggggacuacucagaggcaaagaggagcugc

SEQ ID NO: 201853 - RNA, 59 nt, hsa
uuuuguauaauuuaaggaagguaaaguuaggggacuagaagacucuaaauuggcuucua

SEQ ID NO: 201854 - RNA, 59 nt, hsa
aauugaagguucuuaucagaugggauacuggggacuauaaacaauggaaauaaagccac

SEQ ID NO: 201855 - RNA, 59 nt, hsa
uaagucuucauggauguucugcaugucauggggacuaaaacucacccaacagaucuuuc

SEQ ID NO: 201856 - RNA, 59 nt, hsa
ucuuccuuggguguuuggugcuggcuccuggggacuacaaaucccagagugcggugugc

SEQ ID NO: 201857 - RNA, 59 nt, hsa
aggagagagaaagccaggcagguagccagggggacuagccccuguggagacuggggggc

SEQ ID NO: 201858 - RNA, 59 nt, hsa
uugguaaaccccugauucgggguggggugggggacuaggcucagccggaaccagcaccu

SEQ ID NO: 201859 - RNA, 59 nt, hsa
gagaguguucuugucucuagcagcugguuggggacuauauucugucacuggaguuuuga

SEQ ID NO: 201860 - RNA, 59 nt, hsa
aaagguagucaucaaaugagacuauuugaggggacuauuugaaaugauucugguauuuc

SEQ ID NO: 201861 - RNA, 59 nt, hsa
aaaagacaugauagagaaaagaugagagaggggacuaauuauuuuguuuaugaaaaugg

SEQ ID NO: 201862 - RNA, 59 nt, hsa
guuuuggggcauuuguggaacuuacccauggggacuaauauggaaaaggucuguccaua

SEQ ID NO: 201863 - RNA, 59 nt, hsa
uuaugagagagauccuggacuucuuuuugggggacuauuuuuguacagagaaaaccugg

SEQ ID NO: 201864 - RNA, 59 nt, hsa
gacccugugacaccggucugcagggaguuggggacuaagggcuuccagagaguggcugg

SEQ ID NO: 201865 - RNA, 59 nt, hsa
cuuguugcuggcaucccggccaggugggcggggacuaacaaagacagcuguuuaggguc

SEQ ID NO: 201866 - RNA, 59 nt, hsa
agugguuguggaacaguagaaaaccauauggggacuauagugcaaccuauuuggguaaa

SEQ ID NO: 201867 - RNA, 59 nt, hsa
uucuugggauacuaagacuugaauuuuuuggggacuauuaaggguguuagucuuggaga

SEQ ID NO: 201868 - RNA, 59 nt, hsa
uuguuauauguaccccaguuguuguuaguggggacuaugauacuguaauaauauuuuua

SEQ ID NO: 201869 - RNA, 59 nt, hsa
cuucggaucuaugaaagaaaauauaguagggggacuaaggaacauagaauuuuauuagc

SEQ ID NO: 201870 - RNA, 59 nt, hsa
ucuuguucugaacaacacacugugauaaaggggacuagaguggaagauucccuauuuaa

SEQ ID NO: 201871 - RNA, 59 nt, hsa
uggccaacuugcuaucuggugggugacuuggggacuagaaagaauaaagccuuuucuaa

SEQ ID NO: 201872 - RNA, 59 nt, hsa
ggagcuugggggaugacuagaggcagggaggggacuauuuaugaaggcaaaaaaauuaa

SEQ ID NO: 201873 - RNA, 59 nt, hsa
auugcucagcuccucagagugggccgggaggggacuagaagagcugcaugaugguggcu

SEQ ID NO: 201874 - RNA, 59 nt, hsa
cugcuuacacuuuagaauguuuauuuuauggggacuaagggauuaggagugugaacuaa

SEQ ID NO: 201875 - RNA, 59 nt, hsa
aaccaaggaaagugaaacuuuggauaaguggggacuaguguauuuauauauuuaauuga

SEQ ID NO: 201876 - RNA, 59 nt, hsa
ggcgaagcuuuggugacagacggagagugggggacuagcugugcauggcaccugcucug

SEQ ID NO: 201877 - RNA, 59 nt, hsa
cucaaaugcuguccccggcagcuuuccugggggacuagagcuccuucuggccauguuau

SEQ ID NO: 201878 - RNA, 59 nt, hsa
uuuaugucuucaagugaccuguacugcuuggggacuauuggagaaaauaagguggaguc

SEQ ID NO: 201879 - RNA, 59 nt, hsa
auuguuaggauuuuggaguauuuggggagggggacuacuggaaugcuguccaaguuuua

SEQ ID NO: 201880 - RNA, 59 nt, hsa
aaggccccaccuccuaauaccaucacucuggggacuaggugucagcaugugaauuuugg

SEQ ID NO: 201881 - RNA, 59 nt, hsa
agcaaagaagcugcuuuaaaaaauaaaaaggggacuaaaaauuuguuuuguauaaagag

SEQ ID NO: 201882 - RNA, 59 nt, hsa
caacuaggcaggcacaaaucuugggucuuggggacuaacccaaugccugugaagcaguc

SEQ ID NO: 201883 - RNA, 59 nt, hsa
acugauggauggguagugggcugagaagaggggacuaggaagggcuauuccaggcucag

SEQ ID NO: 201884 - RNA, 59 nt, hsa
ucacauggccaagucuagagucagaaugaggggacuacacaagcugacagcggauggua

SEQ ID NO: 201885 - RNA, 51 nt, hsa
cucggauaccaugguccuagaggggacuacccaaggauggagcuccguggg

SEQ ID NO: 201886 - RNA, 59 nt, hsa
caauaaauauucuagcaucccuaacuaaaggggacuagacaguuagagacucugucacc

SEQ ID NO: 201887 - RNA, 59 nt, hsa
ccugcaccccaaagugagccgcacucucaggggacuagccaccuccuucuuaagagggu

SEQ ID NO: 201888 - RNA, 59 nt, hsa
cuggggcuuugauuuggaggaauggggcaggggacuaucugaagcgcuuccauccuaaa

SEQ ID NO: 201889 - RNA, 59 nt, hsa
gcagcggcuucgggaacaaguuagcgcugggggacuaucugggcucgucucucucugcu

SEQ ID NO: 201890 - RNA, 59 nt, hsa
aaguugccuuuugccacuguagcugaccaggggacuagguuguagaggugggaaggccc

SEQ ID NO: 201891 - RNA, 59 nt, hsa
aguacccccagcccaagagaugaacaucuggggacuaauaucauagacccaucuggagg

SEQ ID NO: 201892 - RNA, 59 nt, hsa
cacuaaucagauuucaaggcccacaacuuggggacuagaccaccuuauguugagggaac

SEQ ID NO: 201893 - RNA, 59 nt, hsa
uuuaaauaagauggagaauaaauuauugaggggacuaggcuauaugcauuugccuucau

SEQ ID NO: 201894 - RNA, 59 nt, hsa
uccaaucuucugccucccagucacucccuggggacuaugggaucacuguccccccaccu

SEQ ID NO: 201895 - RNA, 59 nt, hsa
agugagagaaaugaaguuuauauuaucaaggggacuaaagucacacggcuugugggcac

SEQ ID NO: 201896 - RNA, 59 nt, hsa
gaggacagggacuucggcauuuacuaaugggggacuacugugggguaagggggcgccug

SEQ ID NO: 201897 - RNA, 59 nt, hsa
gucaggccagaccauguuucgucagccuuggggacuaggccaguguugggcaccuccag

SEQ ID NO: 201898 - RNA, 59 nt, hsa
ucuguuaucuccugcguaguaccaagguaggggacuaguggaucuuaucauaguuuugg

SEQ ID NO: 201899 - RNA, 59 nt, hsa
aguucuacaaaagaauggccagcacgagcggggacuagaggguccugauuuugugucug

SEQ ID NO: 201900 - RNA, 59 nt, hsa
ggaacgggggcucuugaagccagguagcuggggacuauggugucugcccuuccaaucac

SEQ ID NO: 201901 - RNA, 59 nt, hsa
aggaagggugggucuguaagaccuugguaggggacuaauucacuggcgaggugcggcca

SEQ ID NO: 201902 - RNA, 59 nt, hsa
cagcuugcccagcucuugaguacagugguggggacuaaaaaugugggcauguggagagg

SEQ ID NO: 201903 - RNA, 59 nt, hsa
agucucagacugauuucuugcgggaggagggggacuaaacucaaccuaacacauuaaau

SEQ ID NO: 201904 - RNA, 59 nt, hsa
gaacuuccaaggaaggagccugagccacuggggacuaagugggcagaagaaacccuugg

SEQ ID NO: 201905 - RNA, 59 nt, hsa
acauuuugaaaaggaaaucuagcaugugaggggacuaaguguucucagagugauguuuu

SEQ ID NO: 201906 - RNA, 59 nt, hsa
aucugcagagguauucaguuccuggcacaggggacuaggggcauguagaguauaugagg

SEQ ID NO: 201907 - RNA, 59 nt, hsa
cucuauuuucagguuugcagagcaugccaggggacuacguuucucagggugguccuaug

SEQ ID NO: 201908 - RNA, 59 nt, hsa
augauguucccagccauacuccagucaacggggacuacuagucccucacucuuagguuu

SEQ ID NO: 201909 - RNA, 59 nt, hsa
cucccgggcugggcuuuugaauuggccuuggggacuacucggcucucacucagcuccca

SEQ ID NO: 201910 - RNA, 59 nt, hsa
cugaaagcuaaauccucaaaaccuaguaaggggacuaaugauucauuaaaguaaauuga

SEQ ID NO: 201911 - RNA, 59 nt, hsa
caauaagucaguucuaguggcugucgccuggggacuagugagaaagcuacucuucuccc

SEQ ID NO: 201912 - RNA, 59 nt, hsa
acuauggacucuuguuguguggaauggaaggggacuagccagcucucugcauggcacau

SEQ ID NO: 201913 - RNA, 59 nt, hsa
ucggaggagguggacauuucggaagugguggggacuaagggaagaacucucuaguuccc

SEQ ID NO: 201914 - RNA, 59 nt, hsa
gauaguucuguguacuccuuuagggagugggggacuagaacugggaugucuuggcuugu

SEQ ID NO: 201915 - RNA, 59 nt, hsa
aaauuucugcucaacugacucaucuuuugggggacuaauuuaauuugcugcugacagcc

SEQ ID NO: 201916 - RNA, 59 nt, hsa
aacuuucugcucaacugacuuaucuuuugggggacuaauuuaauuugcugcugacagcc

SEQ ID NO: 201917 - RNA, 59 nt, hsa
aagagggaaagccagaguucccuguucuaggggacuagccaaaugccuacaucagcugu

SEQ ID NO: 201918 - RNA, 59 nt, hsa
ccacgucaugauggauggggcaaggugguggggacuaggggagccugguauacaugcgg

SEQ ID NO: 201919 - RNA, 59 nt, hsa
gcagagcugccaggcucccaggagagcauggggacuaggaggaaggguguggcauggcu

SEQ ID NO: 201920 - RNA, 59 nt, hsa
gccaccaccuucucuucucuugucacuagggggacuaggggguccccaaaguggcccac

SEQ ID NO: 201921 - RNA, 59 nt, hsa
ucugcccaccaccacugccaggcugaacaggggacuagugcccaggugacacugcacac

SEQ ID NO: 201922 - RNA, 59 nt, hsa
ucuucucauguuaaacccaccaaaauaaaggggacuaaauagguaaugauuuuccuagu

SEQ ID NO: 201923 - RNA, 59 nt, hsa
ccucauuauagcaaaggguuacuggugcaggggacuaggaaaaacccguccaguguggu

SEQ ID NO: 201924 - RNA, 54 nt, hsa
ucggugaggcaccccuguaacccuggggacuaggaggaagggggcagagagagu

SEQ ID NO: 201925 - RNA, 59 nt, hsa
ccagcccugucccugccaccccuccuaguggggacuagugaaugacuugaccugugacc

SEQ ID NO: 201926 - RNA, 59 nt, hsa
cgccugggggcugggguaggcgaggccguggggacuacccauuuuauagcuggggaaac

SEQ ID NO: 201927 - RNA, 59 nt, hsa
gggacagaggucagccuaaggugacacacggggacuacugugcuuccggaggcucccug

SEQ ID NO: 201928 - RNA, 59 nt, hsa
cuuuuauuucuuuuucucuuugauugaaaggggacuacgucuuagcaggaaaaaaaacu

SEQ ID NO: 201929 - RNA, 59 nt, hsa
uccugccucagccuccugaguacccuccuggggacuacaggugcgugcuaccauaccca

SEQ ID NO: 201930 - RNA, 59 nt, hsa
cccaccugugguucuggccucugagguugggggacuacuuguuucccaccccagguucc

SEQ ID NO: 201931 - RNA, 59 nt, hsa
gcccauucuccauuucugugugugucaaaggggacuaacagcagaaucuaccucccaac

SEQ ID NO: 201932 - RNA, 59 nt, hsa
uugacucuggggguccacauccacuccaaggggacuauucccccgaccccaccccaguc

SEQ ID NO: 201933 - RNA, 59 nt, hsa
uggccccgucugaaccuucucugggcacuggggacuaagguugcaggccuuagccucgu

SEQ ID NO: 201934 - RNA, 59 nt, hsa
uggauaaacuaguacgagauauuuauggaggggacuaugagagguuuggacugccaggc

SEQ ID NO: 201935 - RNA, 59 nt, hsa
ugugccuucugccaccugacuuuccgugaggggacuaaaauuuacuaauuguaguugcu

SEQ ID NO: 201936 - RNA, 59 nt, hsa
uuucauagaccuaauuugcaaacucaaucggggacuaaaauuucccacugaaaauguua

SEQ ID NO: 201937 - RNA, 59 nt, hsa
acuggcggcuucccuucuuggcucuugggggggacuagauccuguggagaagaugacuu

SEQ ID NO: 201938 - RNA, 59 nt, hsa
ugcuuacuucugggguauuggaaauguuuggggacuagguagaggugaauguacuaaau

SEQ ID NO: 201939 - RNA, 59 nt, hsa
caaacagucacaagcaaaggaagaggcugggggacuagaaagaggcccugcccucuaga

SEQ ID NO: 201940 - RNA, 59 nt, hsa
gaggcaggcugcagcuucagccacagaauggggacuauggaagacagcaggagcucauu

SEQ ID NO: 201941 - RNA, 59 nt, hsa
ccaugugggaacccagccuccgaugccccggggacuaggggaaacaguuggagguucgu

SEQ ID NO: 201942 - RNA, 59 nt, hsa
cacaugucuuacuuucagaauuuccacggggggacuaggagggcagcauugcuggggag

SEQ ID NO: 201943 - RNA, 59 nt, hsa
aucuguuuauucuuugggcucugggaacaggggacuacuuuggggcuuucuccagacuu

SEQ ID NO: 201944 - RNA, 59 nt, hsa
accccuggguuccuugagagccuuucaggggggacuaugagaucaaaauauuuuuauua

SEQ ID NO: 201945 - RNA, 59 nt, hsa
gcccgccauccccaguugcagggggaucuggggacuaccagagacucugggaaauggac

SEQ ID NO: 201946 - RNA, 59 nt, hsa
uaagagccacaauaagccacugguaucugggggacuagaacacaaauccaacgcuuuuc

SEQ ID NO: 201947 - RNA, 64 nt, hsa
gcaauggugauaauggauuaauuccucaaaggaagagcagaacaccugaaaaucagcaauuucc

SEQ ID NO: 201948 - RNA, 64 nt, hsa
gcaauggugaugauggauuaauuccuccaaggaagagcagaacaccugaaagccagcaauuucc

SEQ ID NO: 201949 - RNA, 64 nt, hsa
gccacggcagggaggaaaggagccggagaagccggagcagaaguccugguaguuacaagcaaag

SEQ ID NO: 201950 - RNA, 64 nt, hsa
agaaaaaagauagaaaaaagaaaaaguuucagaagagcagaaguaaacacaaaaaacauaaguc

SEQ ID NO: 201951 - RNA, 64 nt, hsa
ucagagacaaauaggcuucaucauggaaacuucugagcagaacauugaguuugagaauccugaa

SEQ ID NO: 201952 - RNA, 64 nt, hsa
gaccaagaacaaagacaaccacaaccuaugacuggagcagaauaagucuaaaggcagagcccca

SEQ ID NO: 201953 - RNA, 64 nt, hsa
guauuaaauagccaugagcuucacugcuuagagggagcagaaaggucaacaucuaaaagcaccu

SEQ ID NO: 201954 - RNA, 64 nt, hsa
aagaggaggagaaacagggugagucaagguaaaggagcagaaauguaguuacaagccaggucgu

SEQ ID NO: 201955 - RNA, 64 nt, hsa
aggguucucaggcaggcaguucugcuucagcuuagagcagaacccauaaaauacucaaguacug

SEQ ID NO: 201956 - RNA, 64 nt, hsa
uauuuugaaaguuggaaggagaagggagggaagagagcagaagggaagaagguguaagucaagc

SEQ ID NO: 201957 - RNA, 64 nt, hsa
cugguuucugggaagggaacguuuauuuaguaaagagcagaacacccuugcguuuuguugggac

SEQ ID NO: 201958 - RNA, 64 nt, hsa
ugagcaggcggagacuccaagcugggcugagccagagcagaaggcgagggauucccagccggac

SEQ ID NO: 201959 - RNA, 64 nt, hsa
gguaaauauugaaaacuccaggcaucgaaaacaagagcagaagcaccuucagccacagccuuau

SEQ ID NO: 201960 - RNA, 64 nt, hsa
caagaaaaggaugauucacaucccaugugggauggagcagaacugcauuauuucauuacauuac

SEQ ID NO: 201961 - RNA, 64 nt, hsa
ggagagguugcuggagcugcaggagaggcugcuagagcagaagcggaaggccgcuuccuuucuc

SEQ ID NO: 201962 - RNA, 64 nt, hsa
ggagaggcuacuggagcugcaggagagccugcuagagcagaagcggaaggccgcuuccuuucuc

SEQ ID NO: 201963 - RNA, 64 nt, hsa
uauaggaagacauaauuccagugccuuuaugguggagcagaauucgacaacacauguccauuca

SEQ ID NO: 201964 - RNA, 64 nt, hsa
cccuccuccccacguaccauugcgcgugcagcuggagcagaauacccucauuuuuaggaaucua

SEQ ID NO: 201965 - RNA, 64 nt, hsa
agggcaugaccggggacugaccauucugugaaaggagcagaaugugaggagcacgcgugagcuu

SEQ ID NO: 201966 - RNA, 64 nt, hsa
uuugacauauuucaguuuccaccucacguuuuuagagcagaaccacacugucucccuggagggg

SEQ ID NO: 201967 - RNA, 64 nt, hsa
cuaggguuuuacagaggaccaguuaguucugguggagcagaacacacugaugguggaagagcgg

SEQ ID NO: 201968 - RNA, 64 nt, hsa
auguguauaugcuauuuuuuuagcagccaugucugagcagaauguuaacauaauuuuuggaaaa

SEQ ID NO: 201969 - RNA, 64 nt, hsa
gccuccagggcaggaccuuggagggaggaacaacgagcagaaggcccuggcgacugggcugagc

SEQ ID NO: 201970 - RNA, 64 nt, hsa
aacccaagauggaagagccagagggcucuggagugagcagaaccucaccccauucccccaggga

SEQ ID NO: 201971 - RNA, 64 nt, hsa
gaaaagggacucagguaagcccagccugggaugagagcagaaaagcauucaagauuugcaggcc

SEQ ID NO: 201972 - RNA, 64 nt, hsa
auuauugucacuuuuaaaauguuaaugucauucugagcagaaauagauauauuuucagauuuuu

SEQ ID NO: 201973 - RNA, 64 nt, hsa
uugcucaauuuuuccucuucacuggcacaauguaucugaauaccuccuucccucccuucuagaa

SEQ ID NO: 201974 - RNA, 64 nt, hsa
uuuuaagaaaaacaguauuuuauuuauaauaaaaucugaauauuuguaacccuuuauauuuggu

SEQ ID NO: 201975 - RNA, 64 nt, hsa
uguaaggaccgauuugagcacuaacuauagguacucugaauauauauuucccuugauuauucac

SEQ ID NO: 201976 - RNA, 64 nt, hsa
guuuacuuggauugauaauuagguuuacucuuuaucugaauaagaaccaauuccauuuguuuga

SEQ ID NO: 201977 - RNA, 64 nt, hsa
gguuuaucagacucggaaucuauuuucucauugcucugaauaugucaucacucuagguuuuaca

SEQ ID NO: 201978 - RNA, 64 nt, hsa
uaguuucucuuagaaaagcuaagagaagauaaggucugaauaauagcagaaaaaccaacaucua

SEQ ID NO: 201979 - RNA, 64 nt, hsa
ucucugaagucagaucucaauuuuuagaaaacucucugaauauaaugaauauggggaauccaau

SEQ ID NO: 201980 - RNA, 64 nt, hsa
gguguuuacaggaaagaucucagaggcuaugagcucugaauaaaucuucauuguauaaaaugaa

SEQ ID NO: 201981 - RNA, 64 nt, hsa
uaguacuuucaaauguuuucaauuugacuuucccucugaauaugcaugguguguuuccugucug

SEQ ID NO: 201982 - RNA, 64 nt, hsa
ucccauggaguuuugcuaaggcacaagacaauaaucugaauaagacaauaugugaugaauauaa

SEQ ID NO: 201983 - RNA, 64 nt, hsa
uagucaucaaaauggcuuaucaaaaagcuuaaacucugaauauaacaagggcugguuaauauaa

SEQ ID NO: 201984 - RNA, 64 nt, hsa
ugauguaagggggaaaauucucuucuucagaauuucugaauagucaucaaaauggcuuaucaaa

SEQ ID NO: 201985 - RNA, 64 nt, hsa
gcccaguagucuuguggaugccagagacauccuuucugaauacuucuugauggguacaggcuga

SEQ ID NO: 201986 - RNA, 64 nt, hsa
caaauguguaccauuggugagacacauacaaugcucugaauacacuacgaauuuguauuaaaca

SEQ ID NO: 201987 - RNA, 64 nt, hsa
agaaugaaaauauuaauuuaagagacucugggagucugaauaaaguagcuuuauauuaacuaca

SEQ ID NO: 201988 - RNA, 64 nt, hsa
uuugauucaagaaucgucuuauucuggaaguagaucugaauaggcuaccggagccuuguuuuuc

SEQ ID NO: 201989 - RNA, 64 nt, hsa
ugcugacuuguuuucuugugaaauuuuuugcacaucugaauaucguggaagaaacaauaaaacu

SEQ ID NO: 201990 - RNA, 64 nt, hsa
agcuucauuuuuuaccuuugaaauacuuaaucuuucugaauaaauauaaugugucuauaaaaua

SEQ ID NO: 201991 - RNA, 64 nt, hsa
uuaagauaaaaugauuaauaaaacaauugguaauucugaauaaggaucugaauaaauccagauc

SEQ ID NO: 201992 - RNA, 64 nt, hsa
gauuaauaaaacaauugguaauucugaauaaggaucugaauaaauccagaucacagacuguucc

SEQ ID NO: 201993 - RNA, 64 nt, hsa
uaaugcucuuggacacauuuuguauuauucaugaucugaauaguaguuaguuaaaagaucauuu

SEQ ID NO: 201994 - RNA, 64 nt, hsa
gauuccauuuccaguuuuauaauguauuucagguucugaauaacaauauuuuuccaaauugaaa

SEQ ID NO: 201995 - RNA, 64 nt, hsa
uacccgugguauuugaaaaaaaucaagguaacugucugaauacuuuaauaucagcuuguuuugu

SEQ ID NO: 201996 - RNA, 64 nt, hsa
ugaauacuuuaauaucagcuuguuuugugaauucucugaauacugucaacacucuuaucuaagu

SEQ ID NO: 201997 - RNA, 64 nt, hsa
gggagcagaaagagaagguuuuuaaggaggggcuucugaauacuugggagauacggaacggacc

SEQ ID NO: 201998 - RNA, 64 nt, hsa
cuuagaauguaaaauugauuguuaaaaguuuuguucugaauaaauauuuaucuuuuguauugcu

SEQ ID NO: 201999 - RNA, 64 nt, hsa
guacuuuagacauacgcuugucuccugaauguccucugaauauuuauaguuaaaugauuuauau

SEQ ID NO: 202000 - RNA, 64 nt, hsa
cauagaugcuuugcauuuucucugugcuuuggcaucugaauauguucuuuaaauguguguuuag

SEQ ID NO: 202001 - RNA, 64 nt, hsa
ucuggacucucuuguauuauaggauuuuucuuguucugaauauccuugacauuacagcugucaa

SEQ ID NO: 202002 - RNA, 64 nt, hsa
cuuugggaaaagcgauuuuuuuucauguauucauucugaauaguugaaauguauauuuguacag

SEQ ID NO: 202003 - RNA, 64 nt, hsa
ccaggaacuaauucuauaauggaaaacuauccauucugaauaauagguauguaauuauuugcug

SEQ ID NO: 202004 - RNA, 64 nt, hsa
uaauuauuugcugcugcugcugugcucuguaaauucugaauaugacauuuaaacucugugccua

SEQ ID NO: 202005 - RNA, 64 nt, hsa
cuuccauguuguuuaccuaaucagcauauuuuugucugaauacuugaacauuuuaacaguaacg

SEQ ID NO: 202006 - RNA, 64 nt, hsa
ucauacacacuuucuaguucuuaauauuugucuuucugaauaauaguuuaaagcaauauuuguu

SEQ ID NO: 202007 - RNA, 64 nt, hsa; identical to SEQ ID NO: 39347

SEQ ID NO: 202008 - RNA, 64 nt, hsa; identical to SEQ ID NO: 39348

SEQ ID NO: 202009 - RNA, 64 nt, hsa; identical to SEQ ID NO: 39349

SEQ ID NO: 202010 - RNA, 64 nt, hsa; identical to SEQ ID NO: 39350

SEQ ID NO: 202011 - RNA, 64 nt, hsa; identical to SEQ ID NO: 39351

SEQ ID NO: 202012 - RNA, 64 nt, hsa; identical to SEQ ID NO: 39352

SEQ ID NO: 202013 - RNA, 64 nt, hsa; identical to SEQ ID NO: 39353

SEQ ID NO: 202014 - RNA, 64 nt, hsa; identical to SEQ ID NO: 39354

SEQ ID NO: 202015 - RNA, 64 nt, hsa; identical to SEQ ID NO: 39355

SEQ ID NO: 202016 - RNA, 64 nt, hsa; identical to SEQ ID NO: 39356

SEQ ID NO: 202017 - RNA, 64 nt, hsa; identical to SEQ ID NO: 39357

SEQ ID NO: 202018 - RNA, 64 nt, hsa; identical to SEQ ID NO: 39358

SEQ ID NO: 202019 - RNA, 64 nt, hsa; identical to SEQ ID NO: 39359

SEQ ID NO: 202020 - RNA, 64 nt, hsa; identical to SEQ ID NO: 39360

SEQ ID NO: 202021 - RNA, 64 nt, hsa; identical to SEQ ID NO: 39361

SEQ ID NO: 202022 - RNA, 64 nt, hsa; identical to SEQ ID NO: 39362

SEQ ID NO: 202023 - RNA, 64 nt, hsa; identical to SEQ ID NO: 39363

SEQ ID NO: 202024 - RNA, 64 nt, hsa; identical to SEQ ID NO: 39364

SEQ ID NO: 202025 - RNA, 64 nt, hsa; identical to SEQ ID NO: 39365

SEQ ID NO: 202026 - RNA, 64 nt, hsa; identical to SEQ ID NO: 39366

SEQ ID NO: 202027 - RNA, 64 nt, hsa; identical to SEQ ID NO: 39367

SEQ ID NO: 202028 - RNA, 64 nt, hsa; identical to SEQ ID NO: 39368

SEQ ID NO: 202029 - RNA, 64 nt, hsa; identical to SEQ ID NO: 39369

SEQ ID NO: 202030 - RNA, 64 nt, hsa; identical to SEQ ID NO: 39370

SEQ ID NO: 202031 - RNA, 64 nt, hsa; identical to SEQ ID NO: 39371

SEQ ID NO: 202032 - RNA, 64 nt, hsa; identical to SEQ ID NO: 39372

SEQ ID NO: 202033 - RNA, 64 nt, hsa; identical to SEQ ID NO: 39373

SEQ ID NO: 202034 - RNA, 64 nt, hsa; identical to SEQ ID NO: 39374

SEQ ID NO: 202035 - RNA, 64 nt, hsa; identical to SEQ ID NO: 39375

SEQ ID NO: 202036 - RNA, 64 nt, hsa; identical to SEQ ID NO: 39376

SEQ ID NO: 202037 - RNA, 64 nt, hsa; identical to SEQ ID NO: 39377

SEQ ID NO: 202038 - RNA, 64 nt, hsa; identical to SEQ ID NO: 39378

SEQ ID NO: 202039 - RNA, 64 nt, hsa; identical to SEQ ID NO: 39379

SEQ ID NO: 202040 - RNA, 64 nt, hsa; identical to SEQ ID NO: 39380

SEQ ID NO: 202041 - RNA, 64 nt, hsa; identical to SEQ ID NO: 39381

SEQ ID NO: 202042 - RNA, 64 nt, hsa; identical to SEQ ID NO: 39382

SEQ ID NO: 202043 - RNA, 64 nt, hsa; identical to SEQ ID NO: 39383

SEQ ID NO: 202044 - RNA, 64 nt, hsa; identical to SEQ ID NO: 39384

SEQ ID NO: 202045 - RNA, 64 nt, hsa; identical to SEQ ID NO: 39385

SEQ ID NO: 202046 - RNA, 64 nt, hsa; identical to SEQ ID NO: 39386

SEQ ID NO: 202047 - RNA, 64 nt, hsa; identical to SEQ ID NO: 39387

SEQ ID NO: 202048 - RNA, 64 nt, hsa; identical to SEQ ID NO: 39388

SEQ ID NO: 202049 - RNA, 64 nt, hsa; identical to SEQ ID NO: 39389

SEQ ID NO: 202050 - RNA, 64 nt, hsa; identical to SEQ ID NO: 39390

SEQ ID NO: 202051 - RNA, 64 nt, hsa; identical to SEQ ID NO: 39391

SEQ ID NO: 202052 - RNA, 64 nt, hsa; identical to SEQ ID NO: 39392

SEQ ID NO: 202053 - RNA, 64 nt, hsa; identical to SEQ ID NO: 39393

SEQ ID NO: 202054 - RNA, 64 nt, hsa; identical to SEQ ID NO: 39394

SEQ ID NO: 202055 - RNA, 64 nt, hsa; identical to SEQ ID NO: 39395

SEQ ID NO: 202056 - RNA, 64 nt, hsa; identical to SEQ ID NO: 39396

SEQ ID NO: 202057 - RNA, 64 nt, hsa; identical to SEQ ID NO: 39397

SEQ ID NO: 202058 - RNA, 64 nt, hsa; identical to SEQ ID NO: 39398

SEQ ID NO: 202059 - RNA, 64 nt, hsa; identical to SEQ ID NO: 39399

SEQ ID NO: 202060 - RNA, 64 nt, hsa; identical to SEQ ID NO: 39400

SEQ ID NO: 202061 - RNA, 64 nt, hsa; identical to SEQ ID NO: 39401

SEQ ID NO: 202062 - RNA, 64 nt, hsa; identical to SEQ ID NO: 39402

SEQ ID NO: 202063 - RNA, 64 nt, hsa; identical to SEQ ID NO: 39403

SEQ ID NO: 202064 - RNA, 64 nt, hsa; identical to SEQ ID NO: 39404

SEQ ID NO: 202065 - RNA, 64 nt, hsa; identical to SEQ ID NO: 39405

SEQ ID NO: 202066 - RNA, 64 nt, hsa; identical to SEQ ID NO: 39406

SEQ ID NO: 202067 - RNA, 64 nt, hsa; identical to SEQ ID NO: 39407

SEQ ID NO: 202068 - RNA, 64 nt, hsa; identical to SEQ ID NO: 39408

SEQ ID NO: 202069 - RNA, 64 nt, hsa; identical to SEQ ID NO: 39409

SEQ ID NO: 202070 - RNA, 64 nt, hsa; identical to SEQ ID NO: 39410

SEQ ID NO: 202071 - RNA, 64 nt, hsa; identical to SEQ ID NO: 39411

SEQ ID NO: 202072 - RNA, 64 nt, hsa; identical to SEQ ID NO: 39412

SEQ ID NO: 202073 - RNA, 64 nt, hsa; identical to SEQ ID NO: 39413

SEQ ID NO: 202074 - RNA, 64 nt, hsa; identical to SEQ ID NO: 39414

SEQ ID NO: 202075 - RNA, 64 nt, hsa; identical to SEQ ID NO: 39415

SEQ ID NO: 202076 - RNA, 64 nt, hsa; identical to SEQ ID NO: 39416

SEQ ID NO: 202077 - RNA, 64 nt, hsa; identical to SEQ ID NO: 39417

SEQ ID NO: 202078 - RNA, 64 nt, hsa; identical to SEQ ID NO: 39418

SEQ ID NO: 202079 - RNA, 64 nt, hsa; identical to SEQ ID NO: 39419

SEQ ID NO: 202080 - RNA, 64 nt, hsa; identical to SEQ ID NO: 39420

SEQ ID NO: 202081 - RNA, 64 nt, hsa; identical to SEQ ID NO: 39421

SEQ ID NO: 202082 - RNA, 64 nt, hsa; identical to SEQ ID NO: 39422

SEQ ID NO: 202083 - RNA, 64 nt, hsa; identical to SEQ ID NO: 39423

SEQ ID NO: 202084 - RNA, 64 nt, hsa; identical to SEQ ID NO: 39424

SEQ ID NO: 202085 - RNA, 64 nt, hsa; identical to SEQ ID NO: 39425

SEQ ID NO: 202086 - RNA, 64 nt, hsa; identical to SEQ ID NO: 39426

SEQ ID NO: 202087 - RNA, 64 nt, hsa; identical to SEQ ID NO: 39427

SEQ ID NO: 202088 - RNA, 64 nt, hsa; identical to SEQ ID NO: 39428

SEQ ID NO: 202089 - RNA, 64 nt, hsa; identical to SEQ ID NO: 39429

SEQ ID NO: 202090 - RNA, 64 nt, hsa; identical to SEQ ID NO: 39430

SEQ ID NO: 202091 - RNA, 64 nt, hsa; identical to SEQ ID NO: 39431

SEQ ID NO: 202092 - RNA, 64 nt, hsa; identical to SEQ ID NO: 39432

SEQ ID NO: 202093 - RNA, 64 nt, hsa; identical to SEQ ID NO: 39433

SEQ ID NO: 202094 - RNA, 64 nt, hsa; identical to SEQ ID NO: 39434

SEQ ID NO: 202095 - RNA, 64 nt, hsa; identical to SEQ ID NO: 39435

SEQ ID NO: 202096 - RNA, 64 nt, hsa; identical to SEQ ID NO: 39436

SEQ ID NO: 202097 - RNA, 64 nt, hsa; identical to SEQ ID NO: 39437

SEQ ID NO: 202098 - RNA, 64 nt, hsa; identical to SEQ ID NO: 39438

SEQ ID NO: 202099 - RNA, 64 nt, hsa; identical to SEQ ID NO: 39439

SEQ ID NO: 202100 - RNA, 64 nt, hsa; identical to SEQ ID NO: 39440

SEQ ID NO: 202101 - RNA, 64 nt, hsa; identical to SEQ ID NO: 39441

SEQ ID NO: 202102 - RNA, 64 nt, hsa; identical to SEQ ID NO: 39442

SEQ ID NO: 202103 - RNA, 64 nt, hsa; identical to SEQ ID NO: 39443

SEQ ID NO: 202104 - RNA, 64 nt, hsa; identical to SEQ ID NO: 39444

SEQ ID NO: 202105 - RNA, 64 nt, hsa; identical to SEQ ID NO: 39445

SEQ ID NO: 202106 - RNA, 64 nt, hsa; identical to SEQ ID NO: 39446

SEQ ID NO: 202107 - RNA, 64 nt, hsa; identical to SEQ ID NO: 39447

SEQ ID NO: 202108 - RNA, 64 nt, hsa; identical to SEQ ID NO: 39448

SEQ ID NO: 202109 - RNA, 64 nt, hsa; identical to SEQ ID NO: 39449

SEQ ID NO: 202110 - RNA, 64 nt, hsa; identical to SEQ ID NO: 39450

SEQ ID NO: 202111 - RNA, 64 nt, hsa; identical to SEQ ID NO: 39451

SEQ ID NO: 202112 - RNA, 64 nt, hsa; identical to SEQ ID NO: 39452

SEQ ID NO: 202113 - RNA, 64 nt, hsa; identical to SEQ ID NO: 39453

SEQ ID NO: 202114 - RNA, 64 nt, hsa; identical to SEQ ID NO: 39454

SEQ ID NO: 202115 - RNA, 64 nt, hsa; identical to SEQ ID NO: 39455

SEQ ID NO: 202116 - RNA, 64 nt, hsa; identical to SEQ ID NO: 39456

SEQ ID NO: 202117 - RNA, 64 nt, hsa; identical to SEQ ID NO: 39457

SEQ ID NO: 202118 - RNA, 64 nt, hsa; identical to SEQ ID NO: 39458

SEQ ID NO: 202119 - RNA, 64 nt, hsa; identical to SEQ ID NO: 39459

SEQ ID NO: 202120 - RNA, 64 nt, hsa; identical to SEQ ID NO: 39460

SEQ ID NO: 202121 - RNA, 64 nt, hsa; identical to SEQ ID NO: 39461

SEQ ID NO: 202122 - RNA, 64 nt, hsa; identical to SEQ ID NO: 39462

SEQ ID NO: 202123 - RNA, 64 nt, hsa; identical to SEQ ID NO: 39463

SEQ ID NO: 202124 - RNA, 64 nt, hsa; identical to SEQ ID NO: 39464

SEQ ID NO: 202125 - RNA, 64 nt, hsa; identical to SEQ ID NO: 39465

SEQ ID NO: 202126 - RNA, 64 nt, hsa; identical to SEQ ID NO: 39466

SEQ ID NO: 202127 - RNA, 64 nt, hsa; identical to SEQ ID NO: 39467

SEQ ID NO: 202128 - RNA, 64 nt, hsa; identical to SEQ ID NO: 39468

SEQ ID NO: 202129 - RNA, 64 nt, hsa; identical to SEQ ID NO: 39469

SEQ ID NO: 202130 - RNA, 64 nt, hsa; identical to SEQ ID NO: 39470

SEQ ID NO: 202131 - RNA, 64 nt, hsa; identical to SEQ ID NO: 39471

SEQ ID NO: 202132 - RNA, 64 nt, hsa; identical to SEQ ID NO: 39472

SEQ ID NO: 202133 - RNA, 64 nt, hsa; identical to SEQ ID NO: 39473

SEQ ID NO: 202134 - RNA, 64 nt, hsa; identical to SEQ ID NO: 39474

SEQ ID NO: 202135 - RNA, 64 nt, hsa; identical to SEQ ID NO: 39475

SEQ ID NO: 202136 - RNA, 64 nt, hsa; identical to SEQ ID NO: 39476

SEQ ID NO: 202137 - RNA, 64 nt, hsa; identical to SEQ ID NO: 39477

SEQ ID NO: 202138 - RNA, 64 nt, hsa; identical to SEQ ID NO: 39478

SEQ ID NO: 202139 - RNA, 64 nt, hsa; identical to SEQ ID NO: 39479

SEQ ID NO: 202140 - RNA, 64 nt, hsa; identical to SEQ ID NO: 39480

SEQ ID NO: 202141 - RNA, 64 nt, hsa; identical to SEQ ID NO: 39481

SEQ ID NO: 202142 - RNA, 64 nt, hsa; identical to SEQ ID NO: 39482

SEQ ID NO: 202143 - RNA, 64 nt, hsa; identical to SEQ ID NO: 39483

SEQ ID NO: 202144 - RNA, 64 nt, hsa; identical to SEQ ID NO: 39484

SEQ ID NO: 202145 - RNA, 64 nt, hsa; identical to SEQ ID NO: 39485

SEQ ID NO: 202146 - RNA, 64 nt, hsa; identical to SEQ ID NO: 39486

SEQ ID NO: 202147 - RNA, 64 nt, hsa; identical to SEQ ID NO: 39487

SEQ ID NO: 202148 - RNA, 64 nt, hsa; identical to SEQ ID NO: 39488

SEQ ID NO: 202149 - RNA, 64 nt, hsa; identical to SEQ ID NO: 39489

SEQ ID NO: 202150 - RNA, 64 nt, hsa; identical to SEQ ID NO: 39490

SEQ ID NO: 202151 - RNA, 64 nt, hsa; identical to SEQ ID NO: 39491

SEQ ID NO: 202152 - RNA, 64 nt, hsa; identical to SEQ ID NO: 39492

SEQ ID NO: 202153 - RNA, 64 nt, hsa; identical to SEQ ID NO: 39493

SEQ ID NO: 202154 - RNA, 64 nt, hsa; identical to SEQ ID NO: 39494

SEQ ID NO: 202155 - RNA, 64 nt, hsa; identical to SEQ ID NO: 39495

SEQ ID NO: 202156 - RNA, 64 nt, hsa; identical to SEQ ID NO: 39496

SEQ ID NO: 202157 - RNA, 64 nt, hsa; identical to SEQ ID NO: 39497

SEQ ID NO: 202158 - RNA, 64 nt, hsa; identical to SEQ ID NO: 39498

SEQ ID NO: 202159 - RNA, 64 nt, hsa; identical to SEQ ID NO: 39499

SEQ ID NO: 202160 - RNA, 64 nt, hsa; identical to SEQ ID NO: 39500

SEQ ID NO: 202161 - RNA, 64 nt, hsa; identical to SEQ ID NO: 39501

SEQ ID NO: 202162 - RNA, 64 nt, hsa; identical to SEQ ID NO: 39502

SEQ ID NO: 202163 - RNA, 64 nt, hsa; identical to SEQ ID NO: 39503

SEQ ID NO: 202164 - RNA, 64 nt, hsa; identical to SEQ ID NO: 39504

SEQ ID NO: 202165 - RNA, 64 nt, hsa; identical to SEQ ID NO: 39505

SEQ ID NO: 202166 - RNA, 64 nt, hsa; identical to SEQ ID NO: 39506

SEQ ID NO: 202167 - RNA, 64 nt, hsa; identical to SEQ ID NO: 39507

SEQ ID NO: 202168 - RNA, 64 nt, hsa; identical to SEQ ID NO: 39508

SEQ ID NO: 202169 - RNA, 64 nt, hsa; identical to SEQ ID NO: 39509

SEQ ID NO: 202170 - RNA, 64 nt, hsa; identical to SEQ ID NO: 39510

SEQ ID NO: 202171 - RNA, 64 nt, hsa; identical to SEQ ID NO: 39511

SEQ ID NO: 202172 - RNA, 64 nt, hsa; identical to SEQ ID NO: 39512

SEQ ID NO: 202173 - RNA, 64 nt, hsa; identical to SEQ ID NO: 39513

SEQ ID NO: 202174 - RNA, 64 nt, hsa; identical to SEQ ID NO: 39514

SEQ ID NO: 202175 - RNA, 64 nt, hsa; identical to SEQ ID NO: 39515

SEQ ID NO: 202176 - RNA, 64 nt, hsa; identical to SEQ ID NO: 39516

SEQ ID NO: 202177 - RNA, 64 nt, hsa; identical to SEQ ID NO: 39517

SEQ ID NO: 202178 - RNA, 64 nt, hsa; identical to SEQ ID NO: 39518

SEQ ID NO: 202179 - RNA, 64 nt, hsa; identical to SEQ ID NO: 39519

SEQ ID NO: 202180 - RNA, 64 nt, hsa; identical to SEQ ID NO: 39520

SEQ ID NO: 202181 - RNA, 64 nt, hsa; identical to SEQ ID NO: 39521

SEQ ID NO: 202182 - RNA, 64 nt, hsa; identical to SEQ ID NO: 39522

SEQ ID NO: 202183 - RNA, 64 nt, hsa; identical to SEQ ID NO: 39523

SEQ ID NO: 202184 - RNA, 64 nt, hsa; identical to SEQ ID NO: 39524

SEQ ID NO: 202185 - RNA, 64 nt, hsa; identical to SEQ ID NO: 39525

SEQ ID NO: 202186 - RNA, 64 nt, hsa; identical to SEQ ID NO: 39526

SEQ ID NO: 202187 - RNA, 64 nt, hsa; identical to SEQ ID NO: 39527

SEQ ID NO: 202188 - RNA, 64 nt, hsa; identical to SEQ ID NO: 39528

SEQ ID NO: 202189 - RNA, 64 nt, hsa; identical to SEQ ID NO: 39529

SEQ ID NO: 202190 - RNA, 64 nt, hsa; identical to SEQ ID NO: 39530

SEQ ID NO: 202191 - RNA, 64 nt, hsa; identical to SEQ ID NO: 39531

SEQ ID NO: 202192 - RNA, 64 nt, hsa; identical to SEQ ID NO: 39532

SEQ ID NO: 202193 - RNA, 64 nt, hsa; identical to SEQ ID NO: 39533

SEQ ID NO: 202194 - RNA, 64 nt, hsa; identical to SEQ ID NO: 39534

SEQ ID NO: 202195 - RNA, 64 nt, hsa; identical to SEQ ID NO: 39535

SEQ ID NO: 202196 - RNA, 64 nt, hsa; identical to SEQ ID NO: 39536

SEQ ID NO: 202197 - RNA, 64 nt, hsa; identical to SEQ ID NO: 39537

SEQ ID NO: 202198 - RNA, 64 nt, hsa; identical to SEQ ID NO: 39538

SEQ ID NO: 202199 - RNA, 64 nt, hsa; identical to SEQ ID NO: 39539

SEQ ID NO: 202200 - RNA, 64 nt, hsa; identical to SEQ ID NO: 39540

SEQ ID NO: 202201 - RNA, 64 nt, hsa; identical to SEQ ID NO: 39541

SEQ ID NO: 202202 - RNA, 64 nt, hsa; identical to SEQ ID NO: 39542

SEQ ID NO: 202203 - RNA, 64 nt, hsa; identical to SEQ ID NO: 39543

SEQ ID NO: 202204 - RNA, 64 nt, hsa; identical to SEQ ID NO: 39544

SEQ ID NO: 202205 - RNA, 64 nt, hsa; identical to SEQ ID NO: 39545

SEQ ID NO: 202206 - RNA, 64 nt, hsa; identical to SEQ ID NO: 39546

SEQ ID NO: 202207 - RNA, 64 nt, hsa; identical to SEQ ID NO: 39547

SEQ ID NO: 202208 - RNA, 64 nt, hsa; identical to SEQ ID NO: 39548

SEQ ID NO: 202209 - RNA, 64 nt, hsa; identical to SEQ ID NO: 39549

SEQ ID NO: 202210 - RNA, 64 nt, hsa; identical to SEQ ID NO: 39550

SEQ ID NO: 202211 - RNA, 64 nt, hsa; identical to SEQ ID NO: 39551

SEQ ID NO: 202212 - RNA, 64 nt, hsa; identical to SEQ ID NO: 39552

SEQ ID NO: 202213 - RNA, 64 nt, hsa; identical to SEQ ID NO: 39553

SEQ ID NO: 202214 - RNA, 64 nt, hsa; identical to SEQ ID NO: 39554

SEQ ID NO: 202215 - RNA, 64 nt, hsa; identical to SEQ ID NO: 39555

SEQ ID NO: 202216 - RNA, 64 nt, hsa; identical to SEQ ID NO: 39556

SEQ ID NO: 202217 - RNA, 64 nt, hsa; identical to SEQ ID NO: 39557

SEQ ID NO: 202218 - RNA, 64 nt, hsa; identical to SEQ ID NO: 39558

SEQ ID NO: 202219 - RNA, 64 nt, hsa; identical to SEQ ID NO: 39559

SEQ ID NO: 202220 - RNA, 64 nt, hsa; identical to SEQ ID NO: 39560

SEQ ID NO: 202221 - RNA, 64 nt, hsa; identical to SEQ ID NO: 39561

SEQ ID NO: 202222 - RNA, 64 nt, hsa; identical to SEQ ID NO: 39562

SEQ ID NO: 202223 - RNA, 64 nt, hsa; identical to SEQ ID NO: 39563

SEQ ID NO: 202224 - RNA, 64 nt, hsa; identical to SEQ ID NO: 39564

SEQ ID NO: 202225 - RNA, 64 nt, hsa; identical to SEQ ID NO: 39565

SEQ ID NO: 202226 - RNA, 64 nt, hsa; identical to SEQ ID NO: 39566

SEQ ID NO: 202227 - RNA, 64 nt, hsa; identical to SEQ ID NO: 39567

SEQ ID NO: 202228 - RNA, 64 nt, hsa; identical to SEQ ID NO: 39568

SEQ ID NO: 202229 - RNA, 64 nt, hsa; identical to SEQ ID NO: 39569

SEQ ID NO: 202230 - RNA, 64 nt, hsa; identical to SEQ ID NO: 39570

SEQ ID NO: 202231 - RNA, 64 nt, hsa; identical to SEQ ID NO: 39571

SEQ ID NO: 202232 - RNA, 64 nt, hsa; identical to SEQ ID NO: 39572

SEQ ID NO: 202233 - RNA, 64 nt, hsa; identical to SEQ ID NO: 39573

SEQ ID NO: 202234 - RNA, 64 nt, hsa; identical to SEQ ID NO: 39574

SEQ ID NO: 202235 - RNA, 64 nt, hsa; identical to SEQ ID NO: 39575

SEQ ID NO: 202236 - RNA, 64 nt, hsa; identical to SEQ ID NO: 39576

SEQ ID NO: 202237 - RNA, 64 nt, hsa; identical to SEQ ID NO: 39577

SEQ ID NO: 202238 - RNA, 64 nt, hsa; identical to SEQ ID NO: 39578

SEQ ID NO: 202239 - RNA, 64 nt, hsa; identical to SEQ ID NO: 39579

SEQ ID NO: 202240 - RNA, 64 nt, hsa; identical to SEQ ID NO: 39580

SEQ ID NO: 202241 - RNA, 64 nt, hsa; identical to SEQ ID NO: 39581

SEQ ID NO: 202242 - RNA, 64 nt, hsa; identical to SEQ ID NO: 39582

SEQ ID NO: 202243 - RNA, 64 nt, hsa; identical to SEQ ID NO: 39583

SEQ ID NO: 202244 - RNA, 64 nt, hsa; identical to SEQ ID NO: 39584

SEQ ID NO: 202245 - RNA, 64 nt, hsa; identical to SEQ ID NO: 39585

SEQ ID NO: 202246 - RNA, 64 nt, hsa; identical to SEQ ID NO: 39586

SEQ ID NO: 202247 - RNA, 64 nt, hsa; identical to SEQ ID NO: 39587

SEQ ID NO: 202248 - RNA, 64 nt, hsa; identical to SEQ ID NO: 39588

SEQ ID NO: 202249 - RNA, 64 nt, hsa; identical to SEQ ID NO: 39589

SEQ ID NO: 202250 - RNA, 64 nt, hsa; identical to SEQ ID NO: 39590

SEQ ID NO: 202251 - RNA, 64 nt, hsa; identical to SEQ ID NO: 39591

SEQ ID NO: 202252 - RNA, 64 nt, hsa; identical to SEQ ID NO: 39592

SEQ ID NO: 202253 - RNA, 64 nt, hsa; identical to SEQ ID NO: 39593

SEQ ID NO: 202254 - RNA, 64 nt, hsa; identical to SEQ ID NO: 39594

SEQ ID NO: 202255 - RNA, 64 nt, hsa; identical to SEQ ID NO: 39595

SEQ ID NO: 202256 - RNA, 64 nt, hsa; identical to SEQ ID NO: 39596

SEQ ID NO: 202257 - RNA, 64 nt, hsa; identical to SEQ ID NO: 39597

SEQ ID NO: 202258 - RNA, 64 nt, hsa; identical to SEQ ID NO: 39598

SEQ ID NO: 202259 - RNA, 64 nt, hsa; identical to SEQ ID NO: 39599

SEQ ID NO: 202260 - RNA, 64 nt, hsa; identical to SEQ ID NO: 39600

SEQ ID NO: 202261 - RNA, 64 nt, hsa; identical to SEQ ID NO: 39601

SEQ ID NO: 202262 - RNA, 64 nt, hsa; identical to SEQ ID NO: 39602

SEQ ID NO: 202263 - RNA, 64 nt, hsa; identical to SEQ ID NO: 39603

SEQ ID NO: 202264 - RNA, 64 nt, hsa; identical to SEQ ID NO: 39604

SEQ ID NO: 202265 - RNA, 64 nt, hsa; identical to SEQ ID NO: 39605

SEQ ID NO: 202266 - RNA, 64 nt, hsa; identical to SEQ ID NO: 39606

SEQ ID NO: 202267 - RNA, 64 nt, hsa; identical to SEQ ID NO: 39607

SEQ ID NO: 202268 - RNA, 64 nt, hsa; identical to SEQ ID NO: 39608

SEQ ID NO: 202269 - RNA, 64 nt, hsa; identical to SEQ ID NO: 39609

SEQ ID NO: 202270 - RNA, 64 nt, hsa; identical to SEQ ID NO: 39610

SEQ ID NO: 202271 - RNA, 64 nt, hsa; identical to SEQ ID NO: 39611

SEQ ID NO: 202272 - RNA, 64 nt, hsa; identical to SEQ ID NO: 39612

SEQ ID NO: 202273 - RNA, 64 nt, hsa; identical to SEQ ID NO: 39613

SEQ ID NO: 202274 - RNA, 64 nt, hsa; identical to SEQ ID NO: 39614

SEQ ID NO: 202275 - RNA, 64 nt, hsa; identical to SEQ ID NO: 39615

SEQ ID NO: 202276 - RNA, 64 nt, hsa; identical to SEQ ID NO: 39616

SEQ ID NO: 202277 - RNA, 64 nt, hsa; identical to SEQ ID NO: 39617

SEQ ID NO: 202278 - RNA, 64 nt, hsa; identical to SEQ ID NO: 39618

SEQ ID NO: 202279 - RNA, 64 nt, hsa; identical to SEQ ID NO: 39619

SEQ ID NO: 202280 - RNA, 64 nt, hsa; identical to SEQ ID NO: 39620

SEQ ID NO: 202281 - RNA, 64 nt, hsa; identical to SEQ ID NO: 39621

SEQ ID NO: 202282 - RNA, 64 nt, hsa; identical to SEQ ID NO: 39622

SEQ ID NO: 202283 - RNA, 64 nt, hsa; identical to SEQ ID NO: 39623

SEQ ID NO: 202284 - RNA, 64 nt, hsa; identical to SEQ ID NO: 39624

SEQ ID NO: 202285 - RNA, 64 nt, hsa; identical to SEQ ID NO: 39625

SEQ ID NO: 202286 - RNA, 64 nt, hsa; identical to SEQ ID NO: 39626

SEQ ID NO: 202287 - RNA, 64 nt, hsa; identical to SEQ ID NO: 39627

SEQ ID NO: 202288 - RNA, 64 nt, hsa; identical to SEQ ID NO: 39628

SEQ ID NO: 202289 - RNA, 64 nt, hsa; identical to SEQ ID NO: 39629

SEQ ID NO: 202290 - RNA, 64 nt, hsa; identical to SEQ ID NO: 39630

SEQ ID NO: 202291 - RNA, 64 nt, hsa; identical to SEQ ID NO: 39631

SEQ ID NO: 202292 - RNA, 64 nt, hsa; identical to SEQ ID NO: 39632

SEQ ID NO: 202293 - RNA, 64 nt, hsa; identical to SEQ ID NO: 39633

SEQ ID NO: 202294 - RNA, 64 nt, hsa; identical to SEQ ID NO: 39634

SEQ ID NO: 202295 - RNA, 64 nt, hsa; identical to SEQ ID NO: 39635

SEQ ID NO: 202296 - RNA, 64 nt, hsa; identical to SEQ ID NO: 39636

SEQ ID NO: 202297 - RNA, 64 nt, hsa; identical to SEQ ID NO: 39637

SEQ ID NO: 202298 - RNA, 64 nt, hsa; identical to SEQ ID NO: 39638

SEQ ID NO: 202299 - RNA, 64 nt, hsa; identical to SEQ ID NO: 39639

SEQ ID NO: 202300 - RNA, 64 nt, hsa; identical to SEQ ID NO: 39640

SEQ ID NO: 202301 - RNA, 64 nt, hsa; identical to SEQ ID NO: 39641

SEQ ID NO: 202302 - RNA, 64 nt, hsa; identical to SEQ ID NO: 39642

SEQ ID NO: 202303 - RNA, 64 nt, hsa; identical to SEQ ID NO: 39643

SEQ ID NO: 202304 - RNA, 64 nt, hsa; identical to SEQ ID NO: 39644

SEQ ID NO: 202305 - RNA, 64 nt, hsa; identical to SEQ ID NO: 39645

SEQ ID NO: 202306 - RNA, 64 nt, hsa; identical to SEQ ID NO: 39646

SEQ ID NO: 202307 - RNA, 64 nt, hsa; identical to SEQ ID NO: 39647

SEQ ID NO: 202308 - RNA, 64 nt, hsa; identical to SEQ ID NO: 39648

SEQ ID NO: 202309 - RNA, 64 nt, hsa; identical to SEQ ID NO: 39649

SEQ ID NO: 202310 - RNA, 64 nt, hsa; identical to SEQ ID NO: 39650

SEQ ID NO: 202311 - RNA, 64 nt, hsa; identical to SEQ ID NO: 39651

SEQ ID NO: 202312 - RNA, 64 nt, hsa; identical to SEQ ID NO: 39652

SEQ ID NO: 202313 - RNA, 64 nt, hsa; identical to SEQ ID NO: 39653

SEQ ID NO: 202314 - RNA, 64 nt, hsa; identical to SEQ ID NO: 39654

SEQ ID NO: 202315 - RNA, 64 nt, hsa; identical to SEQ ID NO: 39655

SEQ ID NO: 202316 - RNA, 64 nt, hsa; identical to SEQ ID NO: 39656

SEQ ID NO: 202317 - RNA, 64 nt, hsa; identical to SEQ ID NO: 39657

SEQ ID NO: 202318 - RNA, 64 nt, hsa; identical to SEQ ID NO: 39658

SEQ ID NO: 202319 - RNA, 64 nt, hsa; identical to SEQ ID NO: 39659

SEQ ID NO: 202320 - RNA, 64 nt, hsa; identical to SEQ ID NO: 39660

SEQ ID NO: 202321 - RNA, 64 nt, hsa; identical to SEQ ID NO: 39661

SEQ ID NO: 202322 - RNA, 64 nt, hsa; identical to SEQ ID NO: 39662

SEQ ID NO: 202323 - RNA, 64 nt, hsa; identical to SEQ ID NO: 39663

SEQ ID NO: 202324 - RNA, 64 nt, hsa; identical to SEQ ID NO: 39664

SEQ ID NO: 202325 - RNA, 64 nt, hsa; identical to SEQ ID NO: 39665

SEQ ID NO: 202326 - RNA, 64 nt, hsa; identical to SEQ ID NO: 39666

SEQ ID NO: 202327 - RNA, 64 nt, hsa; identical to SEQ ID NO: 39667

SEQ ID NO: 202328 - RNA, 64 nt, hsa; identical to SEQ ID NO: 39668

SEQ ID NO: 202329 - RNA, 64 nt, hsa; identical to SEQ ID NO: 39669

SEQ ID NO: 202330 - RNA, 64 nt, hsa; identical to SEQ ID NO: 39670

SEQ ID NO: 202331 - RNA, 64 nt, hsa; identical to SEQ ID NO: 39671

SEQ ID NO: 202332 - RNA, 64 nt, hsa; identical to SEQ ID NO: 39672

SEQ ID NO: 202333 - RNA, 64 nt, hsa; identical to SEQ ID NO: 39673

SEQ ID NO: 202334 - RNA, 64 nt, hsa; identical to SEQ ID NO: 39674

SEQ ID NO: 202335 - RNA, 64 nt, hsa; identical to SEQ ID NO: 39675

SEQ ID NO: 202336 - RNA, 64 nt, hsa; identical to SEQ ID NO: 39676

SEQ ID NO: 202337 - RNA, 64 nt, hsa; identical to SEQ ID NO: 39677

SEQ ID NO: 202338 - RNA, 64 nt, hsa; identical to SEQ ID NO: 39678

SEQ ID NO: 202339 - RNA, 64 nt, hsa; identical to SEQ ID NO: 39679

SEQ ID NO: 202340 - RNA, 64 nt, hsa; identical to SEQ ID NO: 39680

SEQ ID NO: 202341 - RNA, 64 nt, hsa; identical to SEQ ID NO: 39681

SEQ ID NO: 202342 - RNA, 64 nt, hsa; identical to SEQ ID NO: 39682

SEQ ID NO: 202343 - RNA, 64 nt, hsa; identical to SEQ ID NO: 39683

SEQ ID NO: 202344 - RNA, 64 nt, hsa; identical to SEQ ID NO: 39684

SEQ ID NO: 202345 - RNA, 64 nt, hsa; identical to SEQ ID NO: 39685

SEQ ID NO: 202346 - RNA, 64 nt, hsa; identical to SEQ ID NO: 39686

SEQ ID NO: 202347 - RNA, 64 nt, hsa; identical to SEQ ID NO: 39687

SEQ ID NO: 202348 - RNA, 64 nt, hsa; identical to SEQ ID NO: 39688

SEQ ID NO: 202349 - RNA, 64 nt, hsa; identical to SEQ ID NO: 39689

SEQ ID NO: 202350 - RNA, 64 nt, hsa; identical to SEQ ID NO: 39690

SEQ ID NO: 202351 - RNA, 64 nt, hsa; identical to SEQ ID NO: 39691

SEQ ID NO: 202352 - RNA, 64 nt, hsa; identical to SEQ ID NO: 39692

SEQ ID NO: 202353 - RNA, 64 nt, hsa; identical to SEQ ID NO: 39693

SEQ ID NO: 202354 - RNA, 64 nt, hsa; identical to SEQ ID NO: 39694

SEQ ID NO: 202355 - RNA, 64 nt, hsa; identical to SEQ ID NO: 39695

SEQ ID NO: 202356 - RNA, 64 nt, hsa; identical to SEQ ID NO: 39696

SEQ ID NO: 202357 - RNA, 64 nt, hsa; identical to SEQ ID NO: 39697

SEQ ID NO: 202358 - RNA, 64 nt, hsa; identical to SEQ ID NO: 39698

SEQ ID NO: 202359 - RNA, 64 nt, hsa; identical to SEQ ID NO: 39699

SEQ ID NO: 202360 - RNA, 64 nt, hsa; identical to SEQ ID NO: 39700

SEQ ID NO: 202361 - RNA, 64 nt, hsa; identical to SEQ ID NO: 39701

SEQ ID NO: 202362 - RNA, 64 nt, hsa; identical to SEQ ID NO: 39702

SEQ ID NO: 202363 - RNA, 64 nt, hsa; identical to SEQ ID NO: 39703

SEQ ID NO: 202364 - RNA, 64 nt, hsa; identical to SEQ ID NO: 39704

SEQ ID NO: 202365 - RNA, 64 nt, hsa; identical to SEQ ID NO: 39705

SEQ ID NO: 202366 - RNA, 64 nt, hsa; identical to SEQ ID NO: 39706

SEQ ID NO: 202367 - RNA, 64 nt, hsa; identical to SEQ ID NO: 39707

SEQ ID NO: 202368 - RNA, 64 nt, hsa; identical to SEQ ID NO: 39708

SEQ ID NO: 202369 - RNA, 64 nt, hsa; identical to SEQ ID NO: 39709

SEQ ID NO: 202370 - RNA, 64 nt, hsa; identical to SEQ ID NO: 39710

SEQ ID NO: 202371 - RNA, 64 nt, hsa; identical to SEQ ID NO: 39711

SEQ ID NO: 202372 - RNA, 64 nt, hsa; identical to SEQ ID NO: 39712

SEQ ID NO: 202373 - RNA, 64 nt, hsa; identical to SEQ ID NO: 39713

SEQ ID NO: 202374 - RNA, 64 nt, hsa; identical to SEQ ID NO: 39714

SEQ ID NO: 202375 - RNA, 64 nt, hsa; identical to SEQ ID NO: 39715

SEQ ID NO: 202376 - RNA, 64 nt, hsa; identical to SEQ ID NO: 39716

SEQ ID NO: 202377 - RNA, 64 nt, hsa; identical to SEQ ID NO: 39717

SEQ ID NO: 202378 - RNA, 64 nt, hsa; identical to SEQ ID NO: 39718

SEQ ID NO: 202379 - RNA, 64 nt, hsa; identical to SEQ ID NO: 39719

SEQ ID NO: 202380 - RNA, 64 nt, hsa; identical to SEQ ID NO: 39720

SEQ ID NO: 202381 - RNA, 64 nt, hsa; identical to SEQ ID NO: 39721

SEQ ID NO: 202382 - RNA, 64 nt, hsa; identical to SEQ ID NO: 39722

SEQ ID NO: 202383 - RNA, 64 nt, hsa; identical to SEQ ID NO: 39723

SEQ ID NO: 202384 - RNA, 64 nt, hsa; identical to SEQ ID NO: 39724

SEQ ID NO: 202385 - RNA, 64 nt, hsa; identical to SEQ ID NO: 39725

SEQ ID NO: 202386 - RNA, 64 nt, hsa; identical to SEQ ID NO: 39726

SEQ ID NO: 202387 - RNA, 64 nt, hsa; identical to SEQ ID NO: 39727

SEQ ID NO: 202388 - RNA, 64 nt, hsa; identical to SEQ ID NO: 39728

SEQ ID NO: 202389 - RNA, 64 nt, hsa; identical to SEQ ID NO: 39729

SEQ ID NO: 202390 - RNA, 64 nt, hsa; identical to SEQ ID NO: 39730

SEQ ID NO: 202391 - RNA, 64 nt, hsa; identical to SEQ ID NO: 39731

SEQ ID NO: 202392 - RNA, 64 nt, hsa; identical to SEQ ID NO: 39732

SEQ ID NO: 202393 - RNA, 64 nt, hsa; identical to SEQ ID NO: 39733

SEQ ID NO: 202394 - RNA, 64 nt, hsa; identical to SEQ ID NO: 39734

SEQ ID NO: 202395 - RNA, 64 nt, hsa; identical to SEQ ID NO: 39735

SEQ ID NO: 202396 - RNA, 64 nt, hsa; identical to SEQ ID NO: 39736

SEQ ID NO: 202397 - RNA, 64 nt, hsa; identical to SEQ ID NO: 39737

SEQ ID NO: 202398 - RNA, 64 nt, hsa; identical to SEQ ID NO: 39738

SEQ ID NO: 202399 - RNA, 64 nt, hsa; identical to SEQ ID NO: 39739

SEQ ID NO: 202400 - RNA, 64 nt, hsa; identical to SEQ ID NO: 39740

SEQ ID NO: 202401 - RNA, 64 nt, hsa; identical to SEQ ID NO: 39741

SEQ ID NO: 202402 - RNA, 64 nt, hsa; identical to SEQ ID NO: 39742

SEQ ID NO: 202403 - RNA, 64 nt, hsa; identical to SEQ ID NO: 39743

SEQ ID NO: 202404 - RNA, 64 nt, hsa; identical to SEQ ID NO: 39744

SEQ ID NO: 202405 - RNA, 64 nt, hsa; identical to SEQ ID NO: 39745

SEQ ID NO: 202406 - RNA, 64 nt, hsa; identical to SEQ ID NO: 39746

SEQ ID NO: 202407 - RNA, 64 nt, hsa; identical to SEQ ID NO: 39747

SEQ ID NO: 202408 - RNA, 64 nt, hsa; identical to SEQ ID NO: 39748

SEQ ID NO: 202409 - RNA, 64 nt, hsa; identical to SEQ ID NO: 39749

SEQ ID NO: 202410 - RNA, 64 nt, hsa; identical to SEQ ID NO: 39750

SEQ ID NO: 202411 - RNA, 64 nt, hsa; identical to SEQ ID NO: 39751

SEQ ID NO: 202412 - RNA, 64 nt, hsa; identical to SEQ ID NO: 39752

SEQ ID NO: 202413 - RNA, 64 nt, hsa; identical to SEQ ID NO: 39753

SEQ ID NO: 202414 - RNA, 64 nt, hsa; identical to SEQ ID NO: 39754

SEQ ID NO: 202415 - RNA, 64 nt, hsa; identical to SEQ ID NO: 39755

SEQ ID NO: 202416 - RNA, 64 nt, hsa; identical to SEQ ID NO: 39756

SEQ ID NO: 202417 - RNA, 64 nt, hsa; identical to SEQ ID NO: 39757

SEQ ID NO: 202418 - RNA, 64 nt, hsa; identical to SEQ ID NO: 39758

SEQ ID NO: 202419 - RNA, 64 nt, hsa; identical to SEQ ID NO: 39759

SEQ ID NO: 202420 - RNA, 64 nt, hsa; identical to SEQ ID NO: 39760

SEQ ID NO: 202421 - RNA, 64 nt, hsa; identical to SEQ ID NO: 39761

SEQ ID NO: 202422 - RNA, 64 nt, hsa; identical to SEQ ID NO: 39762

SEQ ID NO: 202423 - RNA, 64 nt, hsa; identical to SEQ ID NO: 39763

SEQ ID NO: 202424 - RNA, 64 nt, hsa; identical to SEQ ID NO: 39764

SEQ ID NO: 202425 - RNA, 64 nt, hsa; identical to SEQ ID NO: 39765

SEQ ID NO: 202426 - RNA, 64 nt, hsa; identical to SEQ ID NO: 39766

SEQ ID NO: 202427 - RNA, 64 nt, hsa; identical to SEQ ID NO: 39767

SEQ ID NO: 202428 - RNA, 64 nt, hsa; identical to SEQ ID NO: 39768

SEQ ID NO: 202429 - RNA, 64 nt, hsa; identical to SEQ ID NO: 39769

SEQ ID NO: 202430 - RNA, 64 nt, hsa; identical to SEQ ID NO: 39770

SEQ ID NO: 202431 - RNA, 64 nt, hsa; identical to SEQ ID NO: 39771

SEQ ID NO: 202432 - RNA, 64 nt, hsa; identical to SEQ ID NO: 39772

SEQ ID NO: 202433 - RNA, 64 nt, hsa; identical to SEQ ID NO: 39773

SEQ ID NO: 202434 - RNA, 64 nt, hsa; identical to SEQ ID NO: 39774

SEQ ID NO: 202435 - RNA, 64 nt, hsa; identical to SEQ ID NO: 39775

SEQ ID NO: 202436 - RNA, 64 nt, hsa; identical to SEQ ID NO: 39776

SEQ ID NO: 202437 - RNA, 64 nt, hsa; identical to SEQ ID NO: 39777

SEQ ID NO: 202438 - RNA, 64 nt, hsa; identical to SEQ ID NO: 39778

SEQ ID NO: 202439 - RNA, 64 nt, hsa; identical to SEQ ID NO: 39779

SEQ ID NO: 202440 - RNA, 64 nt, hsa; identical to SEQ ID NO: 39780

SEQ ID NO: 202441 - RNA, 64 nt, hsa; identical to SEQ ID NO: 39781

SEQ ID NO: 202442 - RNA, 64 nt, hsa; identical to SEQ ID NO: 39782

SEQ ID NO: 202443 - RNA, 64 nt, hsa; identical to SEQ ID NO: 39783

SEQ ID NO: 202444 - RNA, 64 nt, hsa; identical to SEQ ID NO: 39784

SEQ ID NO: 202445 - RNA, 64 nt, hsa; identical to SEQ ID NO: 39785

SEQ ID NO: 202446 - RNA, 64 nt, hsa; identical to SEQ ID NO: 39786

SEQ ID NO: 202447 - RNA, 64 nt, hsa; identical to SEQ ID NO: 39787

SEQ ID NO: 202448 - RNA, 64 nt, hsa; identical to SEQ ID NO: 39788

SEQ ID NO: 202449 - RNA, 64 nt, hsa; identical to SEQ ID NO: 39789

SEQ ID NO: 202450 - RNA, 64 nt, hsa; identical to SEQ ID NO: 39790

SEQ ID NO: 202451 - RNA, 64 nt, hsa; identical to SEQ ID NO: 39791

SEQ ID NO: 202452 - RNA, 64 nt, hsa; identical to SEQ ID NO: 39792

SEQ ID NO: 202453 - RNA, 64 nt, hsa; identical to SEQ ID NO: 39793

SEQ ID NO: 202454 - RNA, 64 nt, hsa; identical to SEQ ID NO: 39794

SEQ ID NO: 202455 - RNA, 64 nt, hsa; identical to SEQ ID NO: 39795

SEQ ID NO: 202456 - RNA, 64 nt, hsa; identical to SEQ ID NO: 39796

SEQ ID NO: 202457 - RNA, 64 nt, hsa; identical to SEQ ID NO: 39797

SEQ ID NO: 202458 - RNA, 64 nt, hsa; identical to SEQ ID NO: 39798

SEQ ID NO: 202459 - RNA, 64 nt, hsa; identical to SEQ ID NO: 39799

SEQ ID NO: 202460 - RNA, 64 nt, hsa; identical to SEQ ID NO: 39800

SEQ ID NO: 202461 - RNA, 64 nt, hsa; identical to SEQ ID NO: 39801

SEQ ID NO: 202462 - RNA, 64 nt, hsa; identical to SEQ ID NO: 39802

SEQ ID NO: 202463 - RNA, 64 nt, hsa; identical to SEQ ID NO: 39803

SEQ ID NO: 202464 - RNA, 64 nt, hsa; identical to SEQ ID NO: 39804

SEQ ID NO: 202465 - RNA, 64 nt, hsa; identical to SEQ ID NO: 39805

SEQ ID NO: 202466 - RNA, 64 nt, hsa; identical to SEQ ID NO: 39806

SEQ ID NO: 202467 - RNA, 64 nt, hsa; identical to SEQ ID NO: 39807

SEQ ID NO: 202468 - RNA, 64 nt, hsa; identical to SEQ ID NO: 39808

SEQ ID NO: 202469 - RNA, 64 nt, hsa; identical to SEQ ID NO: 39809

SEQ ID NO: 202470 - RNA, 64 nt, hsa; identical to SEQ ID NO: 39810

SEQ ID NO: 202471 - RNA, 64 nt, hsa; identical to SEQ ID NO: 39811

SEQ ID NO: 202472 - RNA, 64 nt, hsa; identical to SEQ ID NO: 39812

SEQ ID NO: 202473 - RNA, 64 nt, hsa; identical to SEQ ID NO: 39813

SEQ ID NO: 202474 - RNA, 64 nt, hsa; identical to SEQ ID NO: 39814

SEQ ID NO: 202475 - RNA, 64 nt, hsa; identical to SEQ ID NO: 39815

SEQ ID NO: 202476 - RNA, 64 nt, hsa; identical to SEQ ID NO: 39816

SEQ ID NO: 202477 - RNA, 64 nt, hsa; identical to SEQ ID NO: 39817

SEQ ID NO: 202478 - RNA, 64 nt, hsa; identical to SEQ ID NO: 39818

SEQ ID NO: 202479 - RNA, 64 nt, hsa; identical to SEQ ID NO: 39819

SEQ ID NO: 202480 - RNA, 64 nt, hsa; identical to SEQ ID NO: 39820

SEQ ID NO: 202481 - RNA, 64 nt, hsa; identical to SEQ ID NO: 39821

SEQ ID NO: 202482 - RNA, 64 nt, hsa; identical to SEQ ID NO: 39822

SEQ ID NO: 202483 - RNA, 64 nt, hsa; identical to SEQ ID NO: 39823

SEQ ID NO: 202484 - RNA, 64 nt, hsa; identical to SEQ ID NO: 39824

SEQ ID NO: 202485 - RNA, 64 nt, hsa; identical to SEQ ID NO: 39825

SEQ ID NO: 202486 - RNA, 64 nt, hsa; identical to SEQ ID NO: 39826

SEQ ID NO: 202487 - RNA, 64 nt, hsa; identical to SEQ ID NO: 39827

SEQ ID NO: 202488 - RNA, 64 nt, hsa; identical to SEQ ID NO: 39828

SEQ ID NO: 202489 - RNA, 64 nt, hsa; identical to SEQ ID NO: 39829

SEQ ID NO: 202490 - RNA, 64 nt, hsa; identical to SEQ ID NO: 39830

SEQ ID NO: 202491 - RNA, 64 nt, hsa; identical to SEQ ID NO: 39831

SEQ ID NO: 202492 - RNA, 64 nt, hsa; identical to SEQ ID NO: 39832

SEQ ID NO: 202493 - RNA, 64 nt, hsa; identical to SEQ ID NO: 39833

SEQ ID NO: 202494 - RNA, 64 nt, hsa; identical to SEQ ID NO: 39834

SEQ ID NO: 202495 - RNA, 64 nt, hsa; identical to SEQ ID NO: 39835

SEQ ID NO: 202496 - RNA, 64 nt, hsa; identical to SEQ ID NO: 39836

SEQ ID NO: 202497 - RNA, 64 nt, hsa; identical to SEQ ID NO: 39837

SEQ ID NO: 202498 - RNA, 64 nt, hsa; identical to SEQ ID NO: 39838

SEQ ID NO: 202499 - RNA, 64 nt, hsa; identical to SEQ ID NO: 39839

SEQ ID NO: 202500 - RNA, 64 nt, hsa; identical to SEQ ID NO: 39840

SEQ ID NO: 202501 - RNA, 64 nt, hsa; identical to SEQ ID NO: 39841

SEQ ID NO: 202502 - RNA, 64 nt, hsa; identical to SEQ ID NO: 39842

SEQ ID NO: 202503 - RNA, 64 nt, hsa; identical to SEQ ID NO: 39843

SEQ ID NO: 202504 - RNA, 64 nt, hsa; identical to SEQ ID NO: 39844

SEQ ID NO: 202505 - RNA, 64 nt, hsa; identical to SEQ ID NO: 39845

SEQ ID NO: 202506 - RNA, 64 nt, hsa; identical to SEQ ID NO: 39846

SEQ ID NO: 202507 - RNA, 64 nt, hsa; identical to SEQ ID NO: 39847

SEQ ID NO: 202508 - RNA, 64 nt, hsa; identical to SEQ ID NO: 39848

SEQ ID NO: 202509 - RNA, 64 nt, hsa; identical to SEQ ID NO: 39849

SEQ ID NO: 202510 - RNA, 64 nt, hsa; identical to SEQ ID NO: 39850

SEQ ID NO: 202511 - RNA, 64 nt, hsa; identical to SEQ ID NO: 39851

SEQ ID NO: 202512 - RNA, 64 nt, hsa; identical to SEQ ID NO: 39852

SEQ ID NO: 202513 - RNA, 64 nt, hsa; identical to SEQ ID NO: 39853

SEQ ID NO: 202514 - RNA, 64 nt, hsa; identical to SEQ ID NO: 39854

SEQ ID NO: 202515 - RNA, 64 nt, hsa; identical to SEQ ID NO: 39855

SEQ ID NO: 202516 - RNA, 64 nt, hsa; identical to SEQ ID NO: 39856

SEQ ID NO: 202517 - RNA, 64 nt, hsa; identical to SEQ ID NO: 39857

SEQ ID NO: 202518 - RNA, 64 nt, hsa; identical to SEQ ID NO: 39858

SEQ ID NO: 202519 - RNA, 64 nt, hsa; identical to SEQ ID NO: 39859

SEQ ID NO: 202520 - RNA, 64 nt, hsa; identical to SEQ ID NO: 39860

SEQ ID NO: 202521 - RNA, 64 nt, hsa; identical to SEQ ID NO: 39861

SEQ ID NO: 202522 - RNA, 64 nt, hsa; identical to SEQ ID NO: 39862

SEQ ID NO: 202523 - RNA, 64 nt, hsa; identical to SEQ ID NO: 39863

SEQ ID NO: 202524 - RNA, 64 nt, hsa; identical to SEQ ID NO: 39864

SEQ ID NO: 202525 - RNA, 64 nt, hsa; identical to SEQ ID NO: 39865

SEQ ID NO: 202526 - RNA, 64 nt, hsa; identical to SEQ ID NO: 39866

SEQ ID NO: 202527 - RNA, 64 nt, hsa; identical to SEQ ID NO: 39867

SEQ ID NO: 202528 - RNA, 64 nt, hsa; identical to SEQ ID NO: 39868

SEQ ID NO: 202529 - RNA, 64 nt, hsa; identical to SEQ ID NO: 39869

SEQ ID NO: 202530 - RNA, 64 nt, hsa; identical to SEQ ID NO: 39870

SEQ ID NO: 202531 - RNA, 64 nt, hsa; identical to SEQ ID NO: 39871

SEQ ID NO: 202532 - RNA, 64 nt, hsa; identical to SEQ ID NO: 39872

SEQ ID NO: 202533 - RNA, 64 nt, hsa; identical to SEQ ID NO: 39873

SEQ ID NO: 202534 - RNA, 64 nt, hsa; identical to SEQ ID NO: 39874

SEQ ID NO: 202535 - RNA, 64 nt, hsa; identical to SEQ ID NO: 39875

SEQ ID NO: 202536 - RNA, 64 nt, hsa; identical to SEQ ID NO: 39876

SEQ ID NO: 202537 - RNA, 64 nt, hsa; identical to SEQ ID NO: 39877

SEQ ID NO: 202538 - RNA, 64 nt, hsa; identical to SEQ ID NO: 39878

SEQ ID NO: 202539 - RNA, 64 nt, hsa; identical to SEQ ID NO: 39879

SEQ ID NO: 202540 - RNA, 64 nt, hsa; identical to SEQ ID NO: 39880

SEQ ID NO: 202541 - RNA, 64 nt, hsa; identical to SEQ ID NO: 39881

SEQ ID NO: 202542 - RNA, 64 nt, hsa; identical to SEQ ID NO: 39882

SEQ ID NO: 202543 - RNA, 64 nt, hsa; identical to SEQ ID NO: 39883

SEQ ID NO: 202544 - RNA, 64 nt, hsa; identical to SEQ ID NO: 39884

SEQ ID NO: 202545 - RNA, 64 nt, hsa; identical to SEQ ID NO: 39885

SEQ ID NO: 202546 - RNA, 64 nt, hsa; identical to SEQ ID NO: 39886

SEQ ID NO: 202547 - RNA, 64 nt, hsa; identical to SEQ ID NO: 39887

SEQ ID NO: 202548 - RNA, 64 nt, hsa; identical to SEQ ID NO: 39888

SEQ ID NO: 202549 - RNA, 64 nt, hsa; identical to SEQ ID NO: 39889

SEQ ID NO: 202550 - RNA, 64 nt, hsa; identical to SEQ ID NO: 39890

SEQ ID NO: 202551 - RNA, 64 nt, hsa; identical to SEQ ID NO: 39891

SEQ ID NO: 202552 - RNA, 64 nt, hsa; identical to SEQ ID NO: 39892

SEQ ID NO: 202553 - RNA, 64 nt, hsa; identical to SEQ ID NO: 39893

SEQ ID NO: 202554 - RNA, 64 nt, hsa; identical to SEQ ID NO: 39894

SEQ ID NO: 202555 - RNA, 64 nt, hsa; identical to SEQ ID NO: 39895

SEQ ID NO: 202556 - RNA, 64 nt, hsa; identical to SEQ ID NO: 39896

SEQ ID NO: 202557 - RNA, 64 nt, hsa; identical to SEQ ID NO: 39897

SEQ ID NO: 202558 - RNA, 64 nt, hsa; identical to SEQ ID NO: 39898

SEQ ID NO: 202559 - RNA, 64 nt, hsa; identical to SEQ ID NO: 39899

SEQ ID NO: 202560 - RNA, 64 nt, hsa; identical to SEQ ID NO: 39900

SEQ ID NO: 202561 - RNA, 64 nt, hsa; identical to SEQ ID NO: 39901

SEQ ID NO: 202562 - RNA, 64 nt, hsa; identical to SEQ ID NO: 39902

SEQ ID NO: 202563 - RNA, 64 nt, hsa; identical to SEQ ID NO: 39903

SEQ ID NO: 202564 - RNA, 64 nt, hsa; identical to SEQ ID NO: 39904

SEQ ID NO: 202565 - RNA, 64 nt, hsa; identical to SEQ ID NO: 39905

SEQ ID NO: 202566 - RNA, 64 nt, hsa; identical to SEQ ID NO: 39906

SEQ ID NO: 202567 - RNA, 64 nt, hsa; identical to SEQ ID NO: 39907

SEQ ID NO: 202568 - RNA, 64 nt, hsa; identical to SEQ ID NO: 39908

SEQ ID NO: 202569 - RNA, 64 nt, hsa; identical to SEQ ID NO: 39909

SEQ ID NO: 202570 - RNA, 64 nt, hsa; identical to SEQ ID NO: 39910

SEQ ID NO: 202571 - RNA, 64 nt, hsa; identical to SEQ ID NO: 39911

SEQ ID NO: 202572 - RNA, 64 nt, hsa; identical to SEQ ID NO: 39912

SEQ ID NO: 202573 - RNA, 64 nt, hsa; identical to SEQ ID NO: 39913

SEQ ID NO: 202574 - RNA, 64 nt, hsa; identical to SEQ ID NO: 39914

SEQ ID NO: 202575 - RNA, 64 nt, hsa; identical to SEQ ID NO: 39915

SEQ ID NO: 202576 - RNA, 64 nt, hsa; identical to SEQ ID NO: 39916

SEQ ID NO: 202577 - RNA, 64 nt, hsa; identical to SEQ ID NO: 39917

SEQ ID NO: 202578 - RNA, 64 nt, hsa; identical to SEQ ID NO: 39918

SEQ ID NO: 202579 - RNA, 64 nt, hsa; identical to SEQ ID NO: 39919

SEQ ID NO: 202580 - RNA, 64 nt, hsa; identical to SEQ ID NO: 39920

SEQ ID NO: 202581 - RNA, 64 nt, hsa; identical to SEQ ID NO: 39921

SEQ ID NO: 202582 - RNA, 64 nt, hsa; identical to SEQ ID NO: 39922

SEQ ID NO: 202583 - RNA, 64 nt, hsa; identical to SEQ ID NO: 39923

SEQ ID NO: 202584 - RNA, 64 nt, hsa; identical to SEQ ID NO: 39924

SEQ ID NO: 202585 - RNA, 64 nt, hsa; identical to SEQ ID NO: 39925

SEQ ID NO: 202586 - RNA, 64 nt, hsa; identical to SEQ ID NO: 39926

SEQ ID NO: 202587 - RNA, 64 nt, hsa; identical to SEQ ID NO: 39927

SEQ ID NO: 202588 - RNA, 64 nt, hsa; identical to SEQ ID NO: 39928

SEQ ID NO: 202589 - RNA, 64 nt, hsa; identical to SEQ ID NO: 39929

SEQ ID NO: 202590 - RNA, 64 nt, hsa; identical to SEQ ID NO: 39930

SEQ ID NO: 202591 - RNA, 64 nt, hsa; identical to SEQ ID NO: 39931

SEQ ID NO: 202592 - RNA, 64 nt, hsa; identical to SEQ ID NO: 39932

SEQ ID NO: 202593 - RNA, 64 nt, hsa; identical to SEQ ID NO: 39933

SEQ ID NO: 202594 - RNA, 64 nt, hsa; identical to SEQ ID NO: 39934

SEQ ID NO: 202595 - RNA, 64 nt, hsa; identical to SEQ ID NO: 39935

SEQ ID NO: 202596 - RNA, 64 nt, hsa; identical to SEQ ID NO: 39936

SEQ ID NO: 202597 - RNA, 64 nt, hsa; identical to SEQ ID NO: 39937

SEQ ID NO: 202598 - RNA, 64 nt, hsa; identical to SEQ ID NO: 39938

SEQ ID NO: 202599 - RNA, 64 nt, hsa; identical to SEQ ID NO: 39939

SEQ ID NO: 202600 - RNA, 64 nt, hsa; identical to SEQ ID NO: 39940

SEQ ID NO: 202601 - RNA, 64 nt, hsa; identical to SEQ ID NO: 39941

SEQ ID NO: 202602 - RNA, 64 nt, hsa; identical to SEQ ID NO: 39942

SEQ ID NO: 202603 - RNA, 64 nt, hsa; identical to SEQ ID NO: 39943

SEQ ID NO: 202604 - RNA, 64 nt, hsa; identical to SEQ ID NO: 39944

SEQ ID NO: 202605 - RNA, 64 nt, hsa; identical to SEQ ID NO: 39945

SEQ ID NO: 202606 - RNA, 64 nt, hsa; identical to SEQ ID NO: 39946

SEQ ID NO: 202607 - RNA, 64 nt, hsa; identical to SEQ ID NO: 39947

SEQ ID NO: 202608 - RNA, 64 nt, hsa; identical to SEQ ID NO: 39948

SEQ ID NO: 202609 - RNA, 64 nt, hsa; identical to SEQ ID NO: 39949

SEQ ID NO: 202610 - RNA, 64 nt, hsa; identical to SEQ ID NO: 39950

SEQ ID NO: 202611 - RNA, 64 nt, hsa; identical to SEQ ID NO: 39951

SEQ ID NO: 202612 - RNA, 64 nt, hsa; identical to SEQ ID NO: 39952

SEQ ID NO: 202613 - RNA, 64 nt, hsa; identical to SEQ ID NO: 39953

SEQ ID NO: 202614 - RNA, 64 nt, hsa; identical to SEQ ID NO: 39954

SEQ ID NO: 202615 - RNA, 64 nt, hsa; identical to SEQ ID NO: 39955

SEQ ID NO: 202616 - RNA, 64 nt, hsa; identical to SEQ ID NO: 39956

SEQ ID NO: 202617 - RNA, 64 nt, hsa; identical to SEQ ID NO: 39957

SEQ ID NO: 202618 - RNA, 64 nt, hsa; identical to SEQ ID NO: 39958

SEQ ID NO: 202619 - RNA, 64 nt, hsa; identical to SEQ ID NO: 39959

SEQ ID NO: 202620 - RNA, 64 nt, hsa; identical to SEQ ID NO: 39960

SEQ ID NO: 202621 - RNA, 64 nt, hsa; identical to SEQ ID NO: 39961

SEQ ID NO: 202622 - RNA, 64 nt, hsa; identical to SEQ ID NO: 39962

SEQ ID NO: 202623 - RNA, 64 nt, hsa; identical to SEQ ID NO: 39963

SEQ ID NO: 202624 - RNA, 64 nt, hsa; identical to SEQ ID NO: 39964

SEQ ID NO: 202625 - RNA, 64 nt, hsa; identical to SEQ ID NO: 39965

SEQ ID NO: 202626 - RNA, 64 nt, hsa; identical to SEQ ID NO: 39966

SEQ ID NO: 202627 - RNA, 64 nt, hsa; identical to SEQ ID NO: 39967

SEQ ID NO: 202628 - RNA, 64 nt, hsa; identical to SEQ ID NO: 39968

SEQ ID NO: 202629 - RNA, 64 nt, hsa; identical to SEQ ID NO: 39969

SEQ ID NO: 202630 - RNA, 64 nt, hsa; identical to SEQ ID NO: 39970

SEQ ID NO: 202631 - RNA, 64 nt, hsa; identical to SEQ ID NO: 39971

SEQ ID NO: 202632 - RNA, 64 nt, hsa; identical to SEQ ID NO: 39972

SEQ ID NO: 202633 - RNA, 64 nt, hsa; identical to SEQ ID NO: 39973

SEQ ID NO: 202634 - RNA, 64 nt, hsa; identical to SEQ ID NO: 39974

SEQ ID NO: 202635 - RNA, 64 nt, hsa; identical to SEQ ID NO: 39975

SEQ ID NO: 202636 - RNA, 64 nt, hsa; identical to SEQ ID NO: 39976

SEQ ID NO: 202637 - RNA, 64 nt, hsa; identical to SEQ ID NO: 39977

SEQ ID NO: 202638 - RNA, 64 nt, hsa; identical to SEQ ID NO: 39978

SEQ ID NO: 202639 - RNA, 64 nt, hsa; identical to SEQ ID NO: 39979

SEQ ID NO: 202640 - RNA, 64 nt, hsa; identical to SEQ ID NO: 39980

SEQ ID NO: 202641 - RNA, 64 nt, hsa; identical to SEQ ID NO: 39981

SEQ ID NO: 202642 - RNA, 64 nt, hsa; identical to SEQ ID NO: 39982

SEQ ID NO: 202643 - RNA, 64 nt, hsa; identical to SEQ ID NO: 39983

SEQ ID NO: 202644 - RNA, 64 nt, hsa; identical to SEQ ID NO: 39984

SEQ ID NO: 202645 - RNA, 64 nt, hsa; identical to SEQ ID NO: 39985

SEQ ID NO: 202646 - RNA, 64 nt, hsa; identical to SEQ ID NO: 39986

SEQ ID NO: 202647 - RNA, 64 nt, hsa; identical to SEQ ID NO: 39987

SEQ ID NO: 202648 - RNA, 64 nt, hsa; identical to SEQ ID NO: 39988

SEQ ID NO: 202649 - RNA, 64 nt, hsa; identical to SEQ ID NO: 39989

SEQ ID NO: 202650 - RNA, 64 nt, hsa; identical to SEQ ID NO: 39990

SEQ ID NO: 202651 - RNA, 64 nt, hsa; identical to SEQ ID NO: 39991

SEQ ID NO: 202652 - RNA, 64 nt, hsa; identical to SEQ ID NO: 39992

SEQ ID NO: 202653 - RNA, 64 nt, hsa; identical to SEQ ID NO: 39993

SEQ ID NO: 202654 - RNA, 64 nt, hsa; identical to SEQ ID NO: 39994

SEQ ID NO: 202655 - RNA, 64 nt, hsa; identical to SEQ ID NO: 39995

SEQ ID NO: 202656 - RNA, 64 nt, hsa; identical to SEQ ID NO: 39996

SEQ ID NO: 202657 - RNA, 64 nt, hsa; identical to SEQ ID NO: 39997

SEQ ID NO: 202658 - RNA, 64 nt, hsa; identical to SEQ ID NO: 39998

SEQ ID NO: 202659 - RNA, 64 nt, hsa; identical to SEQ ID NO: 39999

SEQ ID NO: 202660 - RNA, 64 nt, hsa; identical to SEQ ID NO: 40000

SEQ ID NO: 202661 - RNA, 64 nt, hsa; identical to SEQ ID NO: 40001

SEQ ID NO: 202662 - RNA, 64 nt, hsa; identical to SEQ ID NO: 40002

SEQ ID NO: 202663 - RNA, 64 nt, hsa; identical to SEQ ID NO: 40003

SEQ ID NO: 202664 - RNA, 64 nt, hsa; identical to SEQ ID NO: 40004

SEQ ID NO: 202665 - RNA, 64 nt, hsa; identical to SEQ ID NO: 40005

SEQ ID NO: 202666 - RNA, 64 nt, hsa; identical to SEQ ID NO: 40006

SEQ ID NO: 202667 - RNA, 64 nt, hsa; identical to SEQ ID NO: 40007

SEQ ID NO: 202668 - RNA, 64 nt, hsa; identical to SEQ ID NO: 40008

SEQ ID NO: 202669 - RNA, 64 nt, hsa; identical to SEQ ID NO: 40009

SEQ ID NO: 202670 - RNA, 64 nt, hsa; identical to SEQ ID NO: 40010

SEQ ID NO: 202671 - RNA, 64 nt, hsa; identical to SEQ ID NO: 40011

SEQ ID NO: 202672 - RNA, 64 nt, hsa; identical to SEQ ID NO: 40012

SEQ ID NO: 202673 - RNA, 64 nt, hsa; identical to SEQ ID NO: 40013

SEQ ID NO: 202674 - RNA, 64 nt, hsa; identical to SEQ ID NO: 40014

SEQ ID NO: 202675 - RNA, 64 nt, hsa; identical to SEQ ID NO: 40015

SEQ ID NO: 202676 - RNA, 64 nt, hsa; identical to SEQ ID NO: 40016

SEQ ID NO: 202677 - RNA, 64 nt, hsa; identical to SEQ ID NO: 40017

SEQ ID NO: 202678 - RNA, 64 nt, hsa; identical to SEQ ID NO: 40018

SEQ ID NO: 202679 - RNA, 64 nt, hsa; identical to SEQ ID NO: 40019

SEQ ID NO: 202680 - RNA, 64 nt, hsa; identical to SEQ ID NO: 40020

SEQ ID NO: 202681 - RNA, 64 nt, hsa; identical to SEQ ID NO: 40021

SEQ ID NO: 202682 - RNA, 64 nt, hsa; identical to SEQ ID NO: 40022

SEQ ID NO: 202683 - RNA, 64 nt, hsa; identical to SEQ ID NO: 40023

SEQ ID NO: 202684 - RNA, 64 nt, hsa; identical to SEQ ID NO: 40024

SEQ ID NO: 202685 - RNA, 64 nt, hsa; identical to SEQ ID NO: 40025

SEQ ID NO: 202686 - RNA, 64 nt, hsa; identical to SEQ ID NO: 40026

SEQ ID NO: 202687 - RNA, 64 nt, hsa; identical to SEQ ID NO: 40027

SEQ ID NO: 202688 - RNA, 64 nt, hsa; identical to SEQ ID NO: 40028

SEQ ID NO: 202689 - RNA, 64 nt, hsa; identical to SEQ ID NO: 40029

SEQ ID NO: 202690 - RNA, 64 nt, hsa; identical to SEQ ID NO: 40030

SEQ ID NO: 202691 - RNA, 64 nt, hsa; identical to SEQ ID NO: 40031

SEQ ID NO: 202692 - RNA, 64 nt, hsa; identical to SEQ ID NO: 40032

SEQ ID NO: 202693 - RNA, 64 nt, hsa; identical to SEQ ID NO: 40033

SEQ ID NO: 202694 - RNA, 64 nt, hsa; identical to SEQ ID NO: 40034

SEQ ID NO: 202695 - RNA, 64 nt, hsa; identical to SEQ ID NO: 40035

SEQ ID NO: 202696 - RNA, 64 nt, hsa; identical to SEQ ID NO: 40036

SEQ ID NO: 202697 - RNA, 64 nt, hsa; identical to SEQ ID NO: 40037

SEQ ID NO: 202698 - RNA, 64 nt, hsa; identical to SEQ ID NO: 40038

SEQ ID NO: 202699 - RNA, 64 nt, hsa; identical to SEQ ID NO: 40039

SEQ ID NO: 202700 - RNA, 64 nt, hsa; identical to SEQ ID NO: 40040

SEQ ID NO: 202701 - RNA, 64 nt, hsa; identical to SEQ ID NO: 40041

SEQ ID NO: 202702 - RNA, 64 nt, hsa; identical to SEQ ID NO: 40042

SEQ ID NO: 202703 - RNA, 64 nt, hsa; identical to SEQ ID NO: 40043

SEQ ID NO: 202704 - RNA, 64 nt, hsa; identical to SEQ ID NO: 40044

SEQ ID NO: 202705 - RNA, 64 nt, hsa; identical to SEQ ID NO: 40045

SEQ ID NO: 202706 - RNA, 64 nt, hsa; identical to SEQ ID NO: 40046

SEQ ID NO: 202707 - RNA, 64 nt, hsa; identical to SEQ ID NO: 40047

SEQ ID NO: 202708 - RNA, 64 nt, hsa; identical to SEQ ID NO: 40048

SEQ ID NO: 202709 - RNA, 64 nt, hsa; identical to SEQ ID NO: 40049

SEQ ID NO: 202710 - RNA, 64 nt, hsa; identical to SEQ ID NO: 40050

SEQ ID NO: 202711 - RNA, 64 nt, hsa; identical to SEQ ID NO: 40051

SEQ ID NO: 202712 - RNA, 64 nt, hsa; identical to SEQ ID NO: 40052

SEQ ID NO: 202713 - RNA, 64 nt, hsa; identical to SEQ ID NO: 40053

SEQ ID NO: 202714 - RNA, 64 nt, hsa; identical to SEQ ID NO: 40054

SEQ ID NO: 202715 - RNA, 64 nt, hsa; identical to SEQ ID NO: 40055

SEQ ID NO: 202716 - RNA, 64 nt, hsa; identical to SEQ ID NO: 40056

SEQ ID NO: 202717 - RNA, 64 nt, hsa; identical to SEQ ID NO: 40057

SEQ ID NO: 202718 - RNA, 64 nt, hsa; identical to SEQ ID NO: 40058

SEQ ID NO: 202719 - RNA, 64 nt, hsa; identical to SEQ ID NO: 40059

SEQ ID NO: 202720 - RNA, 64 nt, hsa; identical to SEQ ID NO: 40060

SEQ ID NO: 202721 - RNA, 64 nt, hsa; identical to SEQ ID NO: 40061

SEQ ID NO: 202722 - RNA, 64 nt, hsa; identical to SEQ ID NO: 40062

SEQ ID NO: 202723 - RNA, 64 nt, hsa; identical to SEQ ID NO: 40063

SEQ ID NO: 202724 - RNA, 64 nt, hsa; identical to SEQ ID NO: 40064

SEQ ID NO: 202725 - RNA, 64 nt, hsa; identical to SEQ ID NO: 40065

SEQ ID NO: 202726 - RNA, 64 nt, hsa; identical to SEQ ID NO: 40066

SEQ ID NO: 202727 - RNA, 64 nt, hsa; identical to SEQ ID NO: 40067

SEQ ID NO: 202728 - RNA, 64 nt, hsa; identical to SEQ ID NO: 40068

SEQ ID NO: 202729 - RNA, 64 nt, hsa; identical to SEQ ID NO: 40069

SEQ ID NO: 202730 - RNA, 64 nt, hsa; identical to SEQ ID NO: 40070

SEQ ID NO: 202731 - RNA, 64 nt, hsa; identical to SEQ ID NO: 40071

SEQ ID NO: 202732 - RNA, 64 nt, hsa; identical to SEQ ID NO: 40072

SEQ ID NO: 202733 - RNA, 64 nt, hsa; identical to SEQ ID NO: 40073

SEQ ID NO: 202734 - RNA, 64 nt, hsa; identical to SEQ ID NO: 40074

SEQ ID NO: 202735 - RNA, 64 nt, hsa; identical to SEQ ID NO: 40075

SEQ ID NO: 202736 - RNA, 64 nt, hsa; identical to SEQ ID NO: 40076

SEQ ID NO: 202737 - RNA, 64 nt, hsa; identical to SEQ ID NO: 40077

SEQ ID NO: 202738 - RNA, 64 nt, hsa; identical to SEQ ID NO: 40078

SEQ ID NO: 202739 - RNA, 64 nt, hsa; identical to SEQ ID NO: 40079

SEQ ID NO: 202740 - RNA, 64 nt, hsa; identical to SEQ ID NO: 40080

SEQ ID NO: 202741 - RNA, 64 nt, hsa; identical to SEQ ID NO: 40081

SEQ ID NO: 202742 - RNA, 64 nt, hsa; identical to SEQ ID NO: 40082

SEQ ID NO: 202743 - RNA, 64 nt, hsa; identical to SEQ ID NO: 40083

SEQ ID NO: 202744 - RNA, 64 nt, hsa; identical to SEQ ID NO: 40084

SEQ ID NO: 202745 - RNA, 64 nt, hsa; identical to SEQ ID NO: 40085

SEQ ID NO: 202746 - RNA, 64 nt, hsa; identical to SEQ ID NO: 40086

SEQ ID NO: 202747 - RNA, 64 nt, hsa; identical to SEQ ID NO: 40087

SEQ ID NO: 202748 - RNA, 64 nt, hsa; identical to SEQ ID NO: 40088

SEQ ID NO: 202749 - RNA, 64 nt, hsa; identical to SEQ ID NO: 40089

SEQ ID NO: 202750 - RNA, 64 nt, hsa; identical to SEQ ID NO: 40090

SEQ ID NO: 202751 - RNA, 64 nt, hsa; identical to SEQ ID NO: 40091

SEQ ID NO: 202752 - RNA, 64 nt, hsa; identical to SEQ ID NO: 40092

SEQ ID NO: 202753 - RNA, 64 nt, hsa; identical to SEQ ID NO: 40093

SEQ ID NO: 202754 - RNA, 64 nt, hsa; identical to SEQ ID NO: 40094

SEQ ID NO: 202755 - RNA, 64 nt, hsa; identical to SEQ ID NO: 40095

SEQ ID NO: 202756 - RNA, 64 nt, hsa; identical to SEQ ID NO: 40096

SEQ ID NO: 202757 - RNA, 64 nt, hsa; identical to SEQ ID NO: 40097

SEQ ID NO: 202758 - RNA, 64 nt, hsa; identical to SEQ ID NO: 40098

SEQ ID NO: 202759 - RNA, 64 nt, hsa; identical to SEQ ID NO: 40099

SEQ ID NO: 202760 - RNA, 64 nt, hsa; identical to SEQ ID NO: 40100

SEQ ID NO: 202761 - RNA, 64 nt, hsa; identical to SEQ ID NO: 40101

SEQ ID NO: 202762 - RNA, 64 nt, hsa; identical to SEQ ID NO: 40102

SEQ ID NO: 202763 - RNA, 64 nt, hsa; identical to SEQ ID NO: 40103

SEQ ID NO: 202764 - RNA, 64 nt, hsa; identical to SEQ ID NO: 40104

SEQ ID NO: 202765 - RNA, 64 nt, hsa; identical to SEQ ID NO: 40105

SEQ ID NO: 202766 - RNA, 64 nt, hsa; identical to SEQ ID NO: 40106

SEQ ID NO: 202767 - RNA, 64 nt, hsa; identical to SEQ ID NO: 40107

SEQ ID NO: 202768 - RNA, 64 nt, hsa; identical to SEQ ID NO: 40108

SEQ ID NO: 202769 - RNA, 64 nt, hsa; identical to SEQ ID NO: 40109

SEQ ID NO: 202770 - RNA, 64 nt, hsa; identical to SEQ ID NO: 40110

SEQ ID NO: 202771 - RNA, 64 nt, hsa; identical to SEQ ID NO: 40111

SEQ ID NO: 202772 - RNA, 64 nt, hsa; identical to SEQ ID NO: 40112

SEQ ID NO: 202773 - RNA, 64 nt, hsa; identical to SEQ ID NO: 40113

SEQ ID NO: 202774 - RNA, 64 nt, hsa; identical to SEQ ID NO: 40114

SEQ ID NO: 202775 - RNA, 64 nt, hsa; identical to SEQ ID NO: 40115

SEQ ID NO: 202776 - RNA, 64 nt, hsa; identical to SEQ ID NO: 40116

SEQ ID NO: 202777 - RNA, 64 nt, hsa; identical to SEQ ID NO: 40117

SEQ ID NO: 202778 - RNA, 64 nt, hsa; identical to SEQ ID NO: 40118

SEQ ID NO: 202779 - RNA, 64 nt, hsa; identical to SEQ ID NO: 40119

SEQ ID NO: 202780 - RNA, 64 nt, hsa; identical to SEQ ID NO: 40120

SEQ ID NO: 202781 - RNA, 64 nt, hsa; identical to SEQ ID NO: 40121

SEQ ID NO: 202782 - RNA, 64 nt, hsa; identical to SEQ ID NO: 40122

SEQ ID NO: 202783 - RNA, 64 nt, hsa; identical to SEQ ID NO: 40123

SEQ ID NO: 202784 - RNA, 64 nt, hsa; identical to SEQ ID NO: 40124

SEQ ID NO: 202785 - RNA, 64 nt, hsa; identical to SEQ ID NO: 40125

SEQ ID NO: 202786 - RNA, 64 nt, hsa; identical to SEQ ID NO: 40126

SEQ ID NO: 202787 - RNA, 64 nt, hsa; identical to SEQ ID NO: 40127

SEQ ID NO: 202788 - RNA, 64 nt, hsa; identical to SEQ ID NO: 40128

SEQ ID NO: 202789 - RNA, 64 nt, hsa; identical to SEQ ID NO: 40129

SEQ ID NO: 202790 - RNA, 64 nt, hsa; identical to SEQ ID NO: 40130

SEQ ID NO: 202791 - RNA, 64 nt, hsa; identical to SEQ ID NO: 40131

SEQ ID NO: 202792 - RNA, 64 nt, hsa; identical to SEQ ID NO: 40132

SEQ ID NO: 202793 - RNA, 64 nt, hsa; identical to SEQ ID NO: 40133

SEQ ID NO: 202794 - RNA, 64 nt, hsa; identical to SEQ ID NO: 40134

SEQ ID NO: 202795 - RNA, 64 nt, hsa; identical to SEQ ID NO: 40135

SEQ ID NO: 202796 - RNA, 64 nt, hsa; identical to SEQ ID NO: 40136

SEQ ID NO: 202797 - RNA, 64 nt, hsa; identical to SEQ ID NO: 40137

SEQ ID NO: 202798 - RNA, 64 nt, hsa; identical to SEQ ID NO: 40138

SEQ ID NO: 202799 - RNA, 64 nt, hsa; identical to SEQ ID NO: 40139

SEQ ID NO: 202800 - RNA, 64 nt, hsa; identical to SEQ ID NO: 40140

SEQ ID NO: 202801 - RNA, 64 nt, hsa; identical to SEQ ID NO: 40141

SEQ ID NO: 202802 - RNA, 64 nt, hsa; identical to SEQ ID NO: 40142

SEQ ID NO: 202803 - RNA, 64 nt, hsa; identical to SEQ ID NO: 40143

SEQ ID NO: 202804 - RNA, 64 nt, hsa; identical to SEQ ID NO: 40144

SEQ ID NO: 202805 - RNA, 64 nt, hsa; identical to SEQ ID NO: 40145

SEQ ID NO: 202806 - RNA, 64 nt, hsa; identical to SEQ ID NO: 40146

SEQ ID NO: 202807 - RNA, 64 nt, hsa; identical to SEQ ID NO: 40147

SEQ ID NO: 202808 - RNA, 64 nt, hsa; identical to SEQ ID NO: 40148

SEQ ID NO: 202809 - RNA, 64 nt, hsa; identical to SEQ ID NO: 40149

SEQ ID NO: 202810 - RNA, 64 nt, hsa; identical to SEQ ID NO: 40150

SEQ ID NO: 202811 - RNA, 64 nt, hsa; identical to SEQ ID NO: 40151

SEQ ID NO: 202812 - RNA, 64 nt, hsa; identical to SEQ ID NO: 40152

SEQ ID NO: 202813 - RNA, 64 nt, hsa; identical to SEQ ID NO: 40153

SEQ ID NO: 202814 - RNA, 64 nt, hsa; identical to SEQ ID NO: 40154

SEQ ID NO: 202815 - RNA, 64 nt, hsa; identical to SEQ ID NO: 40155

SEQ ID NO: 202816 - RNA, 64 nt, hsa; identical to SEQ ID NO: 40156

SEQ ID NO: 202817 - RNA, 64 nt, hsa; identical to SEQ ID NO: 40157

SEQ ID NO: 202818 - RNA, 64 nt, hsa; identical to SEQ ID NO: 40158

SEQ ID NO: 202819 - RNA, 64 nt, hsa; identical to SEQ ID NO: 40159

SEQ ID NO: 202820 - RNA, 64 nt, hsa; identical to SEQ ID NO: 40160

SEQ ID NO: 202821 - RNA, 64 nt, hsa; identical to SEQ ID NO: 40161

SEQ ID NO: 202822 - RNA, 64 nt, hsa; identical to SEQ ID NO: 40162

SEQ ID NO: 202823 - RNA, 64 nt, hsa; identical to SEQ ID NO: 40163

SEQ ID NO: 202824 - RNA, 64 nt, hsa; identical to SEQ ID NO: 40164

SEQ ID NO: 202825 - RNA, 64 nt, hsa; identical to SEQ ID NO: 40165

SEQ ID NO: 202826 - RNA, 64 nt, hsa; identical to SEQ ID NO: 40166

SEQ ID NO: 202827 - RNA, 64 nt, hsa; identical to SEQ ID NO: 40167

SEQ ID NO: 202828 - RNA, 64 nt, hsa; identical to SEQ ID NO: 40168

SEQ ID NO: 202829 - RNA, 64 nt, hsa; identical to SEQ ID NO: 40169

SEQ ID NO: 202830 - RNA, 64 nt, hsa; identical to SEQ ID NO: 40170

SEQ ID NO: 202831 - RNA, 64 nt, hsa; identical to SEQ ID NO: 40171

SEQ ID NO: 202832 - RNA, 64 nt, hsa; identical to SEQ ID NO: 40172

SEQ ID NO: 202833 - RNA, 64 nt, hsa; identical to SEQ ID NO: 40173

SEQ ID NO: 202834 - RNA, 64 nt, hsa; identical to SEQ ID NO: 40174

SEQ ID NO: 202835 - RNA, 64 nt, hsa; identical to SEQ ID NO: 40175

SEQ ID NO: 202836 - RNA, 64 nt, hsa; identical to SEQ ID NO: 40176

SEQ ID NO: 202837 - RNA, 64 nt, hsa; identical to SEQ ID NO: 40177

SEQ ID NO: 202838 - RNA, 64 nt, hsa; identical to SEQ ID NO: 40178

SEQ ID NO: 202839 - RNA, 64 nt, hsa; identical to SEQ ID NO: 40179

SEQ ID NO: 202840 - RNA, 64 nt, hsa; identical to SEQ ID NO: 40180

SEQ ID NO: 202841 - RNA, 64 nt, hsa; identical to SEQ ID NO: 40181

SEQ ID NO: 202842 - RNA, 64 nt, hsa; identical to SEQ ID NO: 40182

SEQ ID NO: 202843 - RNA, 64 nt, hsa; identical to SEQ ID NO: 40183

SEQ ID NO: 202844 - RNA, 64 nt, hsa; identical to SEQ ID NO: 40184

SEQ ID NO: 202845 - RNA, 64 nt, hsa; identical to SEQ ID NO: 40185

SEQ ID NO: 202846 - RNA, 64 nt, hsa; identical to SEQ ID NO: 40186

SEQ ID NO: 202847 - RNA, 64 nt, hsa; identical to SEQ ID NO: 40187

SEQ ID NO: 202848 - RNA, 64 nt, hsa; identical to SEQ ID NO: 40188

SEQ ID NO: 202849 - RNA, 64 nt, hsa; identical to SEQ ID NO: 40189

SEQ ID NO: 202850 - RNA, 64 nt, hsa; identical to SEQ ID NO: 40190

SEQ ID NO: 202851 - RNA, 64 nt, hsa; identical to SEQ ID NO: 40191

SEQ ID NO: 202852 - RNA, 64 nt, hsa; identical to SEQ ID NO: 40192

SEQ ID NO: 202853 - RNA, 64 nt, hsa; identical to SEQ ID NO: 40193

SEQ ID NO: 202854 - RNA, 64 nt, hsa; identical to SEQ ID NO: 40194

SEQ ID NO: 202855 - RNA, 64 nt, hsa; identical to SEQ ID NO: 40195

SEQ ID NO: 202856 - RNA, 64 nt, hsa; identical to SEQ ID NO: 40196

SEQ ID NO: 202857 - RNA, 64 nt, hsa; identical to SEQ ID NO: 40197

SEQ ID NO: 202858 - RNA, 64 nt, hsa; identical to SEQ ID NO: 40198

SEQ ID NO: 202859 - RNA, 64 nt, hsa; identical to SEQ ID NO: 40199

SEQ ID NO: 202860 - RNA, 64 nt, hsa; identical to SEQ ID NO: 40200

SEQ ID NO: 202861 - RNA, 64 nt, hsa; identical to SEQ ID NO: 40201

SEQ ID NO: 202862 - RNA, 64 nt, hsa; identical to SEQ ID NO: 40202

SEQ ID NO: 202863 - RNA, 64 nt, hsa; identical to SEQ ID NO: 40203

SEQ ID NO: 202864 - RNA, 64 nt, hsa; identical to SEQ ID NO: 40204

SEQ ID NO: 202865 - RNA, 64 nt, hsa; identical to SEQ ID NO: 40205

SEQ ID NO: 202866 - RNA, 64 nt, hsa; identical to SEQ ID NO: 40206

SEQ ID NO: 202867 - RNA, 64 nt, hsa; identical to SEQ ID NO: 40207

SEQ ID NO: 202868 - RNA, 64 nt, hsa; identical to SEQ ID NO: 40208

SEQ ID NO: 202869 - RNA, 64 nt, hsa; identical to SEQ ID NO: 40209

SEQ ID NO: 202870 - RNA, 64 nt, hsa; identical to SEQ ID NO: 40210

SEQ ID NO: 202871 - RNA, 64 nt, hsa; identical to SEQ ID NO: 40211

SEQ ID NO: 202872 - RNA, 64 nt, hsa; identical to SEQ ID NO: 40212

SEQ ID NO: 202873 - RNA, 64 nt, hsa; identical to SEQ ID NO: 40213

SEQ ID NO: 202874 - RNA, 64 nt, hsa; identical to SEQ ID NO: 40214

SEQ ID NO: 202875 - RNA, 64 nt, hsa; identical to SEQ ID NO: 40215

SEQ ID NO: 202876 - RNA, 64 nt, hsa; identical to SEQ ID NO: 40216

SEQ ID NO: 202877 - RNA, 64 nt, hsa; identical to SEQ ID NO: 40217

SEQ ID NO: 202878 - RNA, 64 nt, hsa; identical to SEQ ID NO: 40218

SEQ ID NO: 202879 - RNA, 64 nt, hsa; identical to SEQ ID NO: 40219

SEQ ID NO: 202880 - RNA, 64 nt, hsa; identical to SEQ ID NO: 40220

SEQ ID NO: 202881 - RNA, 64 nt, hsa; identical to SEQ ID NO: 40221

SEQ ID NO: 202882 - RNA, 64 nt, hsa; identical to SEQ ID NO: 40222

SEQ ID NO: 202883 - RNA, 64 nt, hsa; identical to SEQ ID NO: 40223

SEQ ID NO: 202884 - RNA, 64 nt, hsa; identical to SEQ ID NO: 40224

SEQ ID NO: 202885 - RNA, 64 nt, hsa; identical to SEQ ID NO: 40225

SEQ ID NO: 202886 - RNA, 64 nt, hsa; identical to SEQ ID NO: 40226

SEQ ID NO: 202887 - RNA, 64 nt, hsa; identical to SEQ ID NO: 40227

SEQ ID NO: 202888 - RNA, 64 nt, hsa; identical to SEQ ID NO: 40228

SEQ ID NO: 202889 - RNA, 64 nt, hsa; identical to SEQ ID NO: 40229

SEQ ID NO: 202890 - RNA, 64 nt, hsa; identical to SEQ ID NO: 40230

SEQ ID NO: 202891 - RNA, 64 nt, hsa; identical to SEQ ID NO: 40231

SEQ ID NO: 202892 - RNA, 64 nt, hsa; identical to SEQ ID NO: 40232

SEQ ID NO: 202893 - RNA, 64 nt, hsa; identical to SEQ ID NO: 40233

SEQ ID NO: 202894 - RNA, 64 nt, hsa; identical to SEQ ID NO: 40234

SEQ ID NO: 202895 - RNA, 64 nt, hsa; identical to SEQ ID NO: 40235

SEQ ID NO: 202896 - RNA, 64 nt, hsa; identical to SEQ ID NO: 40236

SEQ ID NO: 202897 - RNA, 64 nt, hsa; identical to SEQ ID NO: 40237

SEQ ID NO: 202898 - RNA, 64 nt, hsa; identical to SEQ ID NO: 40238

SEQ ID NO: 202899 - RNA, 64 nt, hsa; identical to SEQ ID NO: 40239

SEQ ID NO: 202900 - RNA, 64 nt, hsa; identical to SEQ ID NO: 40240

SEQ ID NO: 202901 - RNA, 64 nt, hsa; identical to SEQ ID NO: 40241

SEQ ID NO: 202902 - RNA, 64 nt, hsa; identical to SEQ ID NO: 40242

SEQ ID NO: 202903 - RNA, 64 nt, hsa; identical to SEQ ID NO: 40243

SEQ ID NO: 202904 - RNA, 64 nt, hsa; identical to SEQ ID NO: 40244

SEQ ID NO: 202905 - RNA, 64 nt, hsa; identical to SEQ ID NO: 40245

SEQ ID NO: 202906 - RNA, 64 nt, hsa; identical to SEQ ID NO: 40246

SEQ ID NO: 202907 - RNA, 64 nt, hsa; identical to SEQ ID NO: 40247

SEQ ID NO: 202908 - RNA, 64 nt, hsa; identical to SEQ ID NO: 40248

SEQ ID NO: 202909 - RNA, 64 nt, hsa; identical to SEQ ID NO: 40249

SEQ ID NO: 202910 - RNA, 64 nt, hsa; identical to SEQ ID NO: 40250

SEQ ID NO: 202911 - RNA, 64 nt, hsa; identical to SEQ ID NO: 40251

SEQ ID NO: 202912 - RNA, 64 nt, hsa; identical to SEQ ID NO: 40252

SEQ ID NO: 202913 - RNA, 64 nt, hsa; identical to SEQ ID NO: 40253

SEQ ID NO: 202914 - RNA, 64 nt, hsa; identical to SEQ ID NO: 40254

SEQ ID NO: 202915 - RNA, 64 nt, hsa; identical to SEQ ID NO: 40255

SEQ ID NO: 202916 - RNA, 64 nt, hsa; identical to SEQ ID NO: 40256

SEQ ID NO: 202917 - RNA, 64 nt, hsa; identical to SEQ ID NO: 40257

SEQ ID NO: 202918 - RNA, 64 nt, hsa; identical to SEQ ID NO: 40258

SEQ ID NO: 202919 - RNA, 64 nt, hsa; identical to SEQ ID NO: 40259

SEQ ID NO: 202920 - RNA, 64 nt, hsa; identical to SEQ ID NO: 40260

SEQ ID NO: 202921 - RNA, 64 nt, hsa; identical to SEQ ID NO: 40261

SEQ ID NO: 202922 - RNA, 64 nt, hsa; identical to SEQ ID NO: 40262

SEQ ID NO: 202923 - RNA, 64 nt, hsa; identical to SEQ ID NO: 40263

SEQ ID NO: 202924 - RNA, 64 nt, hsa; identical to SEQ ID NO: 40264

SEQ ID NO: 202925 - RNA, 64 nt, hsa; identical to SEQ ID NO: 40265

SEQ ID NO: 202926 - RNA, 64 nt, hsa; identical to SEQ ID NO: 40266

SEQ ID NO: 202927 - RNA, 64 nt, hsa; identical to SEQ ID NO: 40267

SEQ ID NO: 202928 - RNA, 64 nt, hsa; identical to SEQ ID NO: 40268

SEQ ID NO: 202929 - RNA, 64 nt, hsa; identical to SEQ ID NO: 40269

SEQ ID NO: 202930 - RNA, 64 nt, hsa; identical to SEQ ID NO: 40270

SEQ ID NO: 202931 - RNA, 64 nt, hsa; identical to SEQ ID NO: 40271

SEQ ID NO: 202932 - RNA, 64 nt, hsa; identical to SEQ ID NO: 40272

SEQ ID NO: 202933 - RNA, 64 nt, hsa; identical to SEQ ID NO: 40273

SEQ ID NO: 202934 - RNA, 64 nt, hsa; identical to SEQ ID NO: 40274

SEQ ID NO: 202935 - RNA, 64 nt, hsa; identical to SEQ ID NO: 40275

SEQ ID NO: 202936 - RNA, 64 nt, hsa; identical to SEQ ID NO: 40276

SEQ ID NO: 202937 - RNA, 64 nt, hsa; identical to SEQ ID NO: 40277

SEQ ID NO: 202938 - RNA, 64 nt, hsa; identical to SEQ ID NO: 40278

SEQ ID NO: 202939 - RNA, 64 nt, hsa; identical to SEQ ID NO: 40279

SEQ ID NO: 202940 - RNA, 64 nt, hsa; identical to SEQ ID NO: 40280

SEQ ID NO: 202941 - RNA, 64 nt, hsa; identical to SEQ ID NO: 40281

SEQ ID NO: 202942 - RNA, 64 nt, hsa; identical to SEQ ID NO: 40282

SEQ ID NO: 202943 - RNA, 64 nt, hsa; identical to SEQ ID NO: 40283

SEQ ID NO: 202944 - RNA, 64 nt, hsa; identical to SEQ ID NO: 40284

SEQ ID NO: 202945 - RNA, 64 nt, hsa; identical to SEQ ID NO: 40285

SEQ ID NO: 202946 - RNA, 64 nt, hsa; identical to SEQ ID NO: 40286

SEQ ID NO: 202947 - RNA, 64 nt, hsa; identical to SEQ ID NO: 40287

SEQ ID NO: 202948 - RNA, 64 nt, hsa; identical to SEQ ID NO: 40288

SEQ ID NO: 202949 - RNA, 64 nt, hsa; identical to SEQ ID NO: 40289

SEQ ID NO: 202950 - RNA, 64 nt, hsa; identical to SEQ ID NO: 40290

SEQ ID NO: 202951 - RNA, 64 nt, hsa; identical to SEQ ID NO: 40291

SEQ ID NO: 202952 - RNA, 64 nt, hsa; identical to SEQ ID NO: 40292

SEQ ID NO: 202953 - RNA, 64 nt, hsa; identical to SEQ ID NO: 40293

SEQ ID NO: 202954 - RNA, 64 nt, hsa; identical to SEQ ID NO: 40294

SEQ ID NO: 202955 - RNA, 64 nt, hsa; identical to SEQ ID NO: 40295

SEQ ID NO: 202956 - RNA, 64 nt, hsa; identical to SEQ ID NO: 40296

SEQ ID NO: 202957 - RNA, 64 nt, hsa; identical to SEQ ID NO: 40297

SEQ ID NO: 202958 - RNA, 64 nt, hsa; identical to SEQ ID NO: 40298

SEQ ID NO: 202959 - RNA, 64 nt, hsa; identical to SEQ ID NO: 40299

SEQ ID NO: 202960 - RNA, 64 nt, hsa; identical to SEQ ID NO: 40300

SEQ ID NO: 202961 - RNA, 64 nt, hsa; identical to SEQ ID NO: 40301

SEQ ID NO: 202962 - RNA, 64 nt, hsa; identical to SEQ ID NO: 40302

SEQ ID NO: 202963 - RNA, 64 nt, hsa; identical to SEQ ID NO: 40303

SEQ ID NO: 202964 - RNA, 64 nt, hsa; identical to SEQ ID NO: 40304

SEQ ID NO: 202965 - RNA, 64 nt, hsa; identical to SEQ ID NO: 40305

SEQ ID NO: 202966 - RNA, 64 nt, hsa; identical to SEQ ID NO: 40306

SEQ ID NO: 202967 - RNA, 64 nt, hsa; identical to SEQ ID NO: 40307

SEQ ID NO: 202968 - RNA, 64 nt, hsa; identical to SEQ ID NO: 40308

SEQ ID NO: 202969 - RNA, 64 nt, hsa; identical to SEQ ID NO: 40309

SEQ ID NO: 202970 - RNA, 64 nt, hsa; identical to SEQ ID NO: 40310

SEQ ID NO: 202971 - RNA, 64 nt, hsa; identical to SEQ ID NO: 40311

SEQ ID NO: 202972 - RNA, 64 nt, hsa; identical to SEQ ID NO: 40312

SEQ ID NO: 202973 - RNA, 64 nt, hsa; identical to SEQ ID NO: 40313

SEQ ID NO: 202974 - RNA, 64 nt, hsa; identical to SEQ ID NO: 40314

SEQ ID NO: 202975 - RNA, 64 nt, hsa; identical to SEQ ID NO: 40315

SEQ ID NO: 202976 - RNA, 64 nt, hsa; identical to SEQ ID NO: 40316

SEQ ID NO: 202977 - RNA, 64 nt, hsa; identical to SEQ ID NO: 40317

SEQ ID NO: 202978 - RNA, 64 nt, hsa; identical to SEQ ID NO: 40318

SEQ ID NO: 202979 - RNA, 64 nt, hsa; identical to SEQ ID NO: 40319

SEQ ID NO: 202980 - RNA, 64 nt, hsa; identical to SEQ ID NO: 40320

SEQ ID NO: 202981 - RNA, 64 nt, hsa; identical to SEQ ID NO: 40321

SEQ ID NO: 202982 - RNA, 64 nt, hsa; identical to SEQ ID NO: 40322

SEQ ID NO: 202983 - RNA, 64 nt, hsa; identical to SEQ ID NO: 40323

SEQ ID NO: 202984 - RNA, 64 nt, hsa; identical to SEQ ID NO: 40324

SEQ ID NO: 202985 - RNA, 64 nt, hsa; identical to SEQ ID NO: 40325

SEQ ID NO: 202986 - RNA, 64 nt, hsa; identical to SEQ ID NO: 40326

SEQ ID NO: 202987 - RNA, 64 nt, hsa; identical to SEQ ID NO: 40327

SEQ ID NO: 202988 - RNA, 64 nt, hsa; identical to SEQ ID NO: 40328

SEQ ID NO: 202989 - RNA, 64 nt, hsa; identical to SEQ ID NO: 40329

SEQ ID NO: 202990 - RNA, 64 nt, hsa; identical to SEQ ID NO: 40330

SEQ ID NO: 202991 - RNA, 64 nt, hsa; identical to SEQ ID NO: 40331

SEQ ID NO: 202992 - RNA, 64 nt, hsa; identical to SEQ ID NO: 40332

SEQ ID NO: 202993 - RNA, 64 nt, hsa; identical to SEQ ID NO: 40333

SEQ ID NO: 202994 - RNA, 64 nt, hsa; identical to SEQ ID NO: 40334

SEQ ID NO: 202995 - RNA, 64 nt, hsa; identical to SEQ ID NO: 40335

SEQ ID NO: 202996 - RNA, 64 nt, hsa; identical to SEQ ID NO: 40336

SEQ ID NO: 202997 - RNA, 64 nt, hsa; identical to SEQ ID NO: 40337

SEQ ID NO: 202998 - RNA, 64 nt, hsa; identical to SEQ ID NO: 40338

SEQ ID NO: 202999 - RNA, 64 nt, hsa; identical to SEQ ID NO: 40339

SEQ ID NO: 203000 - RNA, 64 nt, hsa; identical to SEQ ID NO: 40340

SEQ ID NO: 203001 - RNA, 64 nt, hsa; identical to SEQ ID NO: 40341

SEQ ID NO: 203002 - RNA, 64 nt, hsa; identical to SEQ ID NO: 40342

SEQ ID NO: 203003 - RNA, 64 nt, hsa; identical to SEQ ID NO: 40343

SEQ ID NO: 203004 - RNA, 64 nt, hsa; identical to SEQ ID NO: 40344

SEQ ID NO: 203005 - RNA, 64 nt, hsa; identical to SEQ ID NO: 40345

SEQ ID NO: 203006 - RNA, 64 nt, hsa; identical to SEQ ID NO: 40346

SEQ ID NO: 203007 - RNA, 64 nt, hsa; identical to SEQ ID NO: 40347

SEQ ID NO: 203008 - RNA, 64 nt, hsa; identical to SEQ ID NO: 40348

SEQ ID NO: 203009 - RNA, 64 nt, hsa; identical to SEQ ID NO: 40349

SEQ ID NO: 203010 - RNA, 64 nt, hsa; identical to SEQ ID NO: 40350

SEQ ID NO: 203011 - RNA, 64 nt, hsa; identical to SEQ ID NO: 40351

SEQ ID NO: 203012 - RNA, 64 nt, hsa; identical to SEQ ID NO: 40352

SEQ ID NO: 203013 - RNA, 64 nt, hsa; identical to SEQ ID NO: 40353

SEQ ID NO: 203014 - RNA, 64 nt, hsa; identical to SEQ ID NO: 40354

SEQ ID NO: 203015 - RNA, 64 nt, hsa; identical to SEQ ID NO: 40355

SEQ ID NO: 203016 - RNA, 64 nt, hsa; identical to SEQ ID NO: 40356

SEQ ID NO: 203017 - RNA, 64 nt, hsa; identical to SEQ ID NO: 40357

SEQ ID NO: 203018 - RNA, 64 nt, hsa; identical to SEQ ID NO: 40358

SEQ ID NO: 203019 - RNA, 64 nt, hsa; identical to SEQ ID NO: 40359

SEQ ID NO: 203020 - RNA, 64 nt, hsa; identical to SEQ ID NO: 40360

SEQ ID NO: 203021 - RNA, 64 nt, hsa; identical to SEQ ID NO: 40361

SEQ ID NO: 203022 - RNA, 64 nt, hsa; identical to SEQ ID NO: 40362

SEQ ID NO: 203023 - RNA, 64 nt, hsa; identical to SEQ ID NO: 40363

SEQ ID NO: 203024 - RNA, 64 nt, hsa; identical to SEQ ID NO: 40364

SEQ ID NO: 203025 - RNA, 64 nt, hsa; identical to SEQ ID NO: 40365

SEQ ID NO: 203026 - RNA, 64 nt, hsa; identical to SEQ ID NO: 40366

SEQ ID NO: 203027 - RNA, 64 nt, hsa; identical to SEQ ID NO: 40367

SEQ ID NO: 203028 - RNA, 64 nt, hsa; identical to SEQ ID NO: 40368

SEQ ID NO: 203029 - RNA, 64 nt, hsa; identical to SEQ ID NO: 40369

SEQ ID NO: 203030 - RNA, 64 nt, hsa; identical to SEQ ID NO: 40370

SEQ ID NO: 203031 - RNA, 64 nt, hsa; identical to SEQ ID NO: 40371

SEQ ID NO: 203032 - RNA, 64 nt, hsa; identical to SEQ ID NO: 40372

SEQ ID NO: 203033 - RNA, 64 nt, hsa; identical to SEQ ID NO: 40373

SEQ ID NO: 203034 - RNA, 64 nt, hsa; identical to SEQ ID NO: 40374

SEQ ID NO: 203035 - RNA, 64 nt, hsa; identical to SEQ ID NO: 40375

SEQ ID NO: 203036 - RNA, 64 nt, hsa; identical to SEQ ID NO: 40376

SEQ ID NO: 203037 - RNA, 64 nt, hsa; identical to SEQ ID NO: 40377

SEQ ID NO: 203038 - RNA, 64 nt, hsa; identical to SEQ ID NO: 40378

SEQ ID NO: 203039 - RNA, 64 nt, hsa; identical to SEQ ID NO: 40379

SEQ ID NO: 203040 - RNA, 64 nt, hsa; identical to SEQ ID NO: 40380

SEQ ID NO: 203041 - RNA, 64 nt, hsa; identical to SEQ ID NO: 40381

SEQ ID NO: 203042 - RNA, 64 nt, hsa; identical to SEQ ID NO: 40382

SEQ ID NO: 203043 - RNA, 64 nt, hsa; identical to SEQ ID NO: 40383

SEQ ID NO: 203044 - RNA, 64 nt, hsa; identical to SEQ ID NO: 40384

SEQ ID NO: 203045 - RNA, 64 nt, hsa; identical to SEQ ID NO: 40385

SEQ ID NO: 203046 - RNA, 64 nt, hsa; identical to SEQ ID NO: 40386

SEQ ID NO: 203047 - RNA, 64 nt, hsa; identical to SEQ ID NO: 40387

SEQ ID NO: 203048 - RNA, 64 nt, hsa; identical to SEQ ID NO: 40388

SEQ ID NO: 203049 - RNA, 64 nt, hsa; identical to SEQ ID NO: 40389

SEQ ID NO: 203050 - RNA, 64 nt, hsa; identical to SEQ ID NO: 40390

SEQ ID NO: 203051 - RNA, 64 nt, hsa; identical to SEQ ID NO: 40391

SEQ ID NO: 203052 - RNA, 64 nt, hsa; identical to SEQ ID NO: 40392

SEQ ID NO: 203053 - RNA, 64 nt, hsa; identical to SEQ ID NO: 40393

SEQ ID NO: 203054 - RNA, 64 nt, hsa; identical to SEQ ID NO: 40394

SEQ ID NO: 203055 - RNA, 64 nt, hsa; identical to SEQ ID NO: 40395

SEQ ID NO: 203056 - RNA, 64 nt, hsa; identical to SEQ ID NO: 40396

SEQ ID NO: 203057 - RNA, 64 nt, hsa; identical to SEQ ID NO: 40397

SEQ ID NO: 203058 - RNA, 64 nt, hsa; identical to SEQ ID NO: 40398

SEQ ID NO: 203059 - RNA, 64 nt, hsa; identical to SEQ ID NO: 40399

SEQ ID NO: 203060 - RNA, 64 nt, hsa; identical to SEQ ID NO: 40400

SEQ ID NO: 203061 - RNA, 64 nt, hsa; identical to SEQ ID NO: 40401

SEQ ID NO: 203062 - RNA, 64 nt, hsa; identical to SEQ ID NO: 40402

SEQ ID NO: 203063 - RNA, 64 nt, hsa; identical to SEQ ID NO: 40403

SEQ ID NO: 203064 - RNA, 64 nt, hsa; identical to SEQ ID NO: 40404

SEQ ID NO: 203065 - RNA, 64 nt, hsa; identical to SEQ ID NO: 40405

SEQ ID NO: 203066 - RNA, 64 nt, hsa; identical to SEQ ID NO: 40406

SEQ ID NO: 203067 - RNA, 64 nt, hsa; identical to SEQ ID NO: 40407

SEQ ID NO: 203068 - RNA, 64 nt, hsa; identical to SEQ ID NO: 40408

SEQ ID NO: 203069 - RNA, 64 nt, hsa; identical to SEQ ID NO: 40409

SEQ ID NO: 203070 - RNA, 64 nt, hsa; identical to SEQ ID NO: 40410

SEQ ID NO: 203071 - RNA, 64 nt, hsa; identical to SEQ ID NO: 40411

SEQ ID NO: 203072 - RNA, 64 nt, hsa; identical to SEQ ID NO: 40412

SEQ ID NO: 203073 - RNA, 64 nt, hsa; identical to SEQ ID NO: 40413

SEQ ID NO: 203074 - RNA, 64 nt, hsa; identical to SEQ ID NO: 40414

SEQ ID NO: 203075 - RNA, 64 nt, hsa; identical to SEQ ID NO: 40415

SEQ ID NO: 203076 - RNA, 64 nt, hsa; identical to SEQ ID NO: 40416

SEQ ID NO: 203077 - RNA, 64 nt, hsa; identical to SEQ ID NO: 40417

SEQ ID NO: 203078 - RNA, 64 nt, hsa; identical to SEQ ID NO: 40418

SEQ ID NO: 203079 - RNA, 64 nt, hsa; identical to SEQ ID NO: 40419

SEQ ID NO: 203080 - RNA, 64 nt, hsa; identical to SEQ ID NO: 40420

SEQ ID NO: 203081 - RNA, 64 nt, hsa; identical to SEQ ID NO: 40421

SEQ ID NO: 203082 - RNA, 64 nt, hsa; identical to SEQ ID NO: 40422

SEQ ID NO: 203083 - RNA, 64 nt, hsa; identical to SEQ ID NO: 40423

SEQ ID NO: 203084 - RNA, 64 nt, hsa; identical to SEQ ID NO: 40424

SEQ ID NO: 203085 - RNA, 64 nt, hsa; identical to SEQ ID NO: 40425

SEQ ID NO: 203086 - RNA, 64 nt, hsa; identical to SEQ ID NO: 40426

SEQ ID NO: 203087 - RNA, 64 nt, hsa; identical to SEQ ID NO: 40427

SEQ ID NO: 203088 - RNA, 64 nt, hsa; identical to SEQ ID NO: 40428

SEQ ID NO: 203089 - RNA, 64 nt, hsa; identical to SEQ ID NO: 40429

SEQ ID NO: 203090 - RNA, 64 nt, hsa; identical to SEQ ID NO: 40430

SEQ ID NO: 203091 - RNA, 64 nt, hsa; identical to SEQ ID NO: 40431

SEQ ID NO: 203092 - RNA, 64 nt, hsa; identical to SEQ ID NO: 40432

SEQ ID NO: 203093 - RNA, 64 nt, hsa; identical to SEQ ID NO: 40433

SEQ ID NO: 203094 - RNA, 64 nt, hsa; identical to SEQ ID NO: 40434

SEQ ID NO: 203095 - RNA, 64 nt, hsa; identical to SEQ ID NO: 40435

SEQ ID NO: 203096 - RNA, 64 nt, hsa; identical to SEQ ID NO: 40436

SEQ ID NO: 203097 - RNA, 64 nt, hsa; identical to SEQ ID NO: 40437

SEQ ID NO: 203098 - RNA, 64 nt, hsa; identical to SEQ ID NO: 40438

SEQ ID NO: 203099 - RNA, 64 nt, hsa; identical to SEQ ID NO: 40439

SEQ ID NO: 203100 - RNA, 64 nt, hsa; identical to SEQ ID NO: 40440

SEQ ID NO: 203101 - RNA, 64 nt, hsa; identical to SEQ ID NO: 40441

SEQ ID NO: 203102 - RNA, 64 nt, hsa; identical to SEQ ID NO: 40442

SEQ ID NO: 203103 - RNA, 64 nt, hsa; identical to SEQ ID NO: 40443

SEQ ID NO: 203104 - RNA, 64 nt, hsa; identical to SEQ ID NO: 40444

SEQ ID NO: 203105 - RNA, 64 nt, hsa; identical to SEQ ID NO: 40445

SEQ ID NO: 203106 - RNA, 64 nt, hsa; identical to SEQ ID NO: 40446

SEQ ID NO: 203107 - RNA, 64 nt, hsa; identical to SEQ ID NO: 40447

SEQ ID NO: 203108 - RNA, 64 nt, hsa; identical to SEQ ID NO: 40448

SEQ ID NO: 203109 - RNA, 64 nt, hsa; identical to SEQ ID NO: 40449

SEQ ID NO: 203110 - RNA, 64 nt, hsa; identical to SEQ ID NO: 40450

SEQ ID NO: 203111 - RNA, 64 nt, hsa; identical to SEQ ID NO: 40451

SEQ ID NO: 203112 - RNA, 64 nt, hsa; identical to SEQ ID NO: 40452

SEQ ID NO: 203113 - RNA, 64 nt, hsa; identical to SEQ ID NO: 40453

SEQ ID NO: 203114 - RNA, 64 nt, hsa; identical to SEQ ID NO: 40454

SEQ ID NO: 203115 - RNA, 64 nt, hsa; identical to SEQ ID NO: 40455

SEQ ID NO: 203116 - RNA, 64 nt, hsa; identical to SEQ ID NO: 40456

SEQ ID NO: 203117 - RNA, 64 nt, hsa; identical to SEQ ID NO: 40457

SEQ ID NO: 203118 - RNA, 64 nt, hsa; identical to SEQ ID NO: 40458

SEQ ID NO: 203119 - RNA, 64 nt, hsa; identical to SEQ ID NO: 40459

SEQ ID NO: 203120 - RNA, 64 nt, hsa; identical to SEQ ID NO: 40460

SEQ ID NO: 203121 - RNA, 64 nt, hsa; identical to SEQ ID NO: 40461

SEQ ID NO: 203122 - RNA, 64 nt, hsa; identical to SEQ ID NO: 40462

SEQ ID NO: 203123 - RNA, 64 nt, hsa; identical to SEQ ID NO: 40463

SEQ ID NO: 203124 - RNA, 64 nt, hsa; identical to SEQ ID NO: 40464

SEQ ID NO: 203125 - RNA, 64 nt, hsa; identical to SEQ ID NO: 40465

SEQ ID NO: 203126 - RNA, 64 nt, hsa; identical to SEQ ID NO: 40466

SEQ ID NO: 203127 - RNA, 64 nt, hsa; identical to SEQ ID NO: 40467

SEQ ID NO: 203128 - RNA, 64 nt, hsa; identical to SEQ ID NO: 40468

SEQ ID NO: 203129 - RNA, 64 nt, hsa; identical to SEQ ID NO: 40469

SEQ ID NO: 203130 - RNA, 64 nt, hsa; identical to SEQ ID NO: 40470

SEQ ID NO: 203131 - RNA, 64 nt, hsa; identical to SEQ ID NO: 40471

SEQ ID NO: 203132 - RNA, 64 nt, hsa; identical to SEQ ID NO: 40472

SEQ ID NO: 203133 - RNA, 64 nt, hsa; identical to SEQ ID NO: 40473

SEQ ID NO: 203134 - RNA, 64 nt, hsa; identical to SEQ ID NO: 40474

SEQ ID NO: 203135 - RNA, 64 nt, hsa; identical to SEQ ID NO: 40475

SEQ ID NO: 203136 - RNA, 64 nt, hsa; identical to SEQ ID NO: 40476

SEQ ID NO: 203137 - RNA, 64 nt, hsa; identical to SEQ ID NO: 40477

SEQ ID NO: 203138 - RNA, 64 nt, hsa; identical to SEQ ID NO: 40478

SEQ ID NO: 203139 - RNA, 64 nt, hsa; identical to SEQ ID NO: 40479

SEQ ID NO: 203140 - RNA, 64 nt, hsa; identical to SEQ ID NO: 40480

SEQ ID NO: 203141 - RNA, 64 nt, hsa; identical to SEQ ID NO: 40481

SEQ ID NO: 203142 - RNA, 64 nt, hsa; identical to SEQ ID NO: 40482

SEQ ID NO: 203143 - RNA, 64 nt, hsa; identical to SEQ ID NO: 40483

SEQ ID NO: 203144 - RNA, 64 nt, hsa; identical to SEQ ID NO: 40484

SEQ ID NO: 203145 - RNA, 64 nt, hsa; identical to SEQ ID NO: 40485

SEQ ID NO: 203146 - RNA, 64 nt, hsa; identical to SEQ ID NO: 40486

SEQ ID NO: 203147 - RNA, 64 nt, hsa; identical to SEQ ID NO: 40487

SEQ ID NO: 203148 - RNA, 64 nt, hsa; identical to SEQ ID NO: 40488

SEQ ID NO: 203149 - RNA, 64 nt, hsa; identical to SEQ ID NO: 40489

SEQ ID NO: 203150 - RNA, 64 nt, hsa; identical to SEQ ID NO: 40490

SEQ ID NO: 203151 - RNA, 64 nt, hsa; identical to SEQ ID NO: 40491

SEQ ID NO: 203152 - RNA, 64 nt, hsa; identical to SEQ ID NO: 40492

SEQ ID NO: 203153 - RNA, 64 nt, hsa; identical to SEQ ID NO: 40493

SEQ ID NO: 203154 - RNA, 64 nt, hsa; identical to SEQ ID NO: 40494

SEQ ID NO: 203155 - RNA, 64 nt, hsa; identical to SEQ ID NO: 40495

SEQ ID NO: 203156 - RNA, 64 nt, hsa; identical to SEQ ID NO: 40496

SEQ ID NO: 203157 - RNA, 64 nt, hsa; identical to SEQ ID NO: 40497

SEQ ID NO: 203158 - RNA, 64 nt, hsa; identical to SEQ ID NO: 40498

SEQ ID NO: 203159 - RNA, 64 nt, hsa; identical to SEQ ID NO: 40499

SEQ ID NO: 203160 - RNA, 64 nt, hsa; identical to SEQ ID NO: 40500

SEQ ID NO: 203161 - RNA, 64 nt, hsa; identical to SEQ ID NO: 40501

SEQ ID NO: 203162 - RNA, 64 nt, hsa; identical to SEQ ID NO: 40502

SEQ ID NO: 203163 - RNA, 64 nt, hsa; identical to SEQ ID NO: 40503

SEQ ID NO: 203164 - RNA, 64 nt, hsa; identical to SEQ ID NO: 40504

SEQ ID NO: 203165 - RNA, 64 nt, hsa; identical to SEQ ID NO: 40505

SEQ ID NO: 203166 - RNA, 64 nt, hsa; identical to SEQ ID NO: 40506

SEQ ID NO: 203167 - RNA, 64 nt, hsa; identical to SEQ ID NO: 40507

SEQ ID NO: 203168 - RNA, 64 nt, hsa; identical to SEQ ID NO: 40508

SEQ ID NO: 203169 - RNA, 64 nt, hsa; identical to SEQ ID NO: 40509

SEQ ID NO: 203170 - RNA, 64 nt, hsa; identical to SEQ ID NO: 40510

SEQ ID NO: 203171 - RNA, 64 nt, hsa; identical to SEQ ID NO: 40511

SEQ ID NO: 203172 - RNA, 64 nt, hsa; identical to SEQ ID NO: 40512

SEQ ID NO: 203173 - RNA, 64 nt, hsa; identical to SEQ ID NO: 40513

SEQ ID NO: 203174 - RNA, 64 nt, hsa; identical to SEQ ID NO: 40514

SEQ ID NO: 203175 - RNA, 64 nt, hsa; identical to SEQ ID NO: 40515

SEQ ID NO: 203176 - RNA, 64 nt, hsa; identical to SEQ ID NO: 40516

SEQ ID NO: 203177 - RNA, 64 nt, hsa; identical to SEQ ID NO: 40517

SEQ ID NO: 203178 - RNA, 64 nt, hsa; identical to SEQ ID NO: 40518

SEQ ID NO: 203179 - RNA, 64 nt, hsa; identical to SEQ ID NO: 40519

SEQ ID NO: 203180 - RNA, 64 nt, hsa; identical to SEQ ID NO: 40520

SEQ ID NO: 203181 - RNA, 64 nt, hsa; identical to SEQ ID NO: 40521

SEQ ID NO: 203182 - RNA, 64 nt, hsa; identical to SEQ ID NO: 40522

SEQ ID NO: 203183 - RNA, 64 nt, hsa; identical to SEQ ID NO: 40523

SEQ ID NO: 203184 - RNA, 64 nt, hsa; identical to SEQ ID NO: 40524

SEQ ID NO: 203185 - RNA, 64 nt, hsa; identical to SEQ ID NO: 40525

SEQ ID NO: 203186 - RNA, 64 nt, hsa; identical to SEQ ID NO: 40526

SEQ ID NO: 203187 - RNA, 64 nt, hsa; identical to SEQ ID NO: 40527

SEQ ID NO: 203188 - RNA, 64 nt, hsa; identical to SEQ ID NO: 40528

SEQ ID NO: 203189 - RNA, 64 nt, hsa; identical to SEQ ID NO: 40529

SEQ ID NO: 203190 - RNA, 64 nt, hsa; identical to SEQ ID NO: 40530

SEQ ID NO: 203191 - RNA, 64 nt, hsa; identical to SEQ ID NO: 40531

SEQ ID NO: 203192 - RNA, 64 nt, hsa; identical to SEQ ID NO: 40532

SEQ ID NO: 203193 - RNA, 64 nt, hsa; identical to SEQ ID NO: 40533

SEQ ID NO: 203194 - RNA, 64 nt, hsa; identical to SEQ ID NO: 40534

SEQ ID NO: 203195 - RNA, 64 nt, hsa; identical to SEQ ID NO: 40535

SEQ ID NO: 203196 - RNA, 64 nt, hsa; identical to SEQ ID NO: 40536

SEQ ID NO: 203197 - RNA, 64 nt, hsa; identical to SEQ ID NO: 40537

SEQ ID NO: 203198 - RNA, 64 nt, hsa; identical to SEQ ID NO: 40538

SEQ ID NO: 203199 - RNA, 64 nt, hsa; identical to SEQ ID NO: 40539

SEQ ID NO: 203200 - RNA, 64 nt, hsa; identical to SEQ ID NO: 40540

SEQ ID NO: 203201 - RNA, 64 nt, hsa; identical to SEQ ID NO: 40541

SEQ ID NO: 203202 - RNA, 64 nt, hsa; identical to SEQ ID NO: 40542

SEQ ID NO: 203203 - RNA, 64 nt, hsa; identical to SEQ ID NO: 40543

SEQ ID NO: 203204 - RNA, 64 nt, hsa; identical to SEQ ID NO: 40544

SEQ ID NO: 203205 - RNA, 64 nt, hsa; identical to SEQ ID NO: 40545

SEQ ID NO: 203206 - RNA, 64 nt, hsa; identical to SEQ ID NO: 40546

SEQ ID NO: 203207 - RNA, 64 nt, hsa; identical to SEQ ID NO: 40547

SEQ ID NO: 203208 - RNA, 64 nt, hsa; identical to SEQ ID NO: 40548

SEQ ID NO: 203209 - RNA, 64 nt, hsa; identical to SEQ ID NO: 40549

SEQ ID NO: 203210 - RNA, 64 nt, hsa; identical to SEQ ID NO: 40550

SEQ ID NO: 203211 - RNA, 64 nt, hsa; identical to SEQ ID NO: 40551

SEQ ID NO: 203212 - RNA, 64 nt, hsa; identical to SEQ ID NO: 40552

SEQ ID NO: 203213 - RNA, 64 nt, hsa; identical to SEQ ID NO: 40553

SEQ ID NO: 203214 - RNA, 64 nt, hsa; identical to SEQ ID NO: 40554

SEQ ID NO: 203215 - RNA, 64 nt, hsa; identical to SEQ ID NO: 40555

SEQ ID NO: 203216 - RNA, 64 nt, hsa; identical to SEQ ID NO: 40556

SEQ ID NO: 203217 - RNA, 64 nt, hsa; identical to SEQ ID NO: 40557

SEQ ID NO: 203218 - RNA, 64 nt, hsa; identical to SEQ ID NO: 40558

SEQ ID NO: 203219 - RNA, 64 nt, hsa; identical to SEQ ID NO: 40559

SEQ ID NO: 203220 - RNA, 64 nt, hsa; identical to SEQ ID NO: 40560

SEQ ID NO: 203221 - RNA, 64 nt, hsa; identical to SEQ ID NO: 40561

SEQ ID NO: 203222 - RNA, 64 nt, hsa; identical to SEQ ID NO: 40562

SEQ ID NO: 203223 - RNA, 64 nt, hsa; identical to SEQ ID NO: 40563

SEQ ID NO: 203224 - RNA, 64 nt, hsa; identical to SEQ ID NO: 40564

SEQ ID NO: 203225 - RNA, 64 nt, hsa; identical to SEQ ID NO: 40565

SEQ ID NO: 203226 - RNA, 64 nt, hsa; identical to SEQ ID NO: 40566

SEQ ID NO: 203227 - RNA, 64 nt, hsa; identical to SEQ ID NO: 40567

SEQ ID NO: 203228 - RNA, 64 nt, hsa; identical to SEQ ID NO: 40568

SEQ ID NO: 203229 - RNA, 64 nt, hsa; identical to SEQ ID NO: 40569

SEQ ID NO: 203230 - RNA, 64 nt, hsa; identical to SEQ ID NO: 40570

SEQ ID NO: 203231 - RNA, 64 nt, hsa; identical to SEQ ID NO: 40571

SEQ ID NO: 203232 - RNA, 64 nt, hsa; identical to SEQ ID NO: 40572

SEQ ID NO: 203233 - RNA, 64 nt, hsa; identical to SEQ ID NO: 40573

SEQ ID NO: 203234 - RNA, 64 nt, hsa; identical to SEQ ID NO: 40574

SEQ ID NO: 203235 - RNA, 64 nt, hsa; identical to SEQ ID NO: 40575

SEQ ID NO: 203236 - RNA, 64 nt, hsa; identical to SEQ ID NO: 40576

SEQ ID NO: 203237 - RNA, 64 nt, hsa; identical to SEQ ID NO: 40577

SEQ ID NO: 203238 - RNA, 64 nt, hsa; identical to SEQ ID NO: 40578

SEQ ID NO: 203239 - RNA, 64 nt, hsa; identical to SEQ ID NO: 40579

SEQ ID NO: 203240 - RNA, 64 nt, hsa; identical to SEQ ID NO: 40580

SEQ ID NO: 203241 - RNA, 64 nt, hsa; identical to SEQ ID NO: 40581

SEQ ID NO: 203242 - RNA, 64 nt, hsa; identical to SEQ ID NO: 40582

SEQ ID NO: 203243 - RNA, 64 nt, hsa; identical to SEQ ID NO: 40583

SEQ ID NO: 203244 - RNA, 64 nt, hsa; identical to SEQ ID NO: 40584

SEQ ID NO: 203245 - RNA, 64 nt, hsa; identical to SEQ ID NO: 40585

SEQ ID NO: 203246 - RNA, 64 nt, hsa; identical to SEQ ID NO: 40586

SEQ ID NO: 203247 - RNA, 64 nt, hsa; identical to SEQ ID NO: 40587

SEQ ID NO: 203248 - RNA, 64 nt, hsa; identical to SEQ ID NO: 40588

SEQ ID NO: 203249 - RNA, 64 nt, hsa; identical to SEQ ID NO: 40589

SEQ ID NO: 203250 - RNA, 64 nt, hsa; identical to SEQ ID NO: 40590

SEQ ID NO: 203251 - RNA, 64 nt, hsa; identical to SEQ ID NO: 40591

SEQ ID NO: 203252 - RNA, 64 nt, hsa; identical to SEQ ID NO: 40592

SEQ ID NO: 203253 - RNA, 64 nt, hsa; identical to SEQ ID NO: 40593

SEQ ID NO: 203254 - RNA, 64 nt, hsa; identical to SEQ ID NO: 40594

SEQ ID NO: 203255 - RNA, 64 nt, hsa; identical to SEQ ID NO: 40595

SEQ ID NO: 203256 - RNA, 64 nt, hsa; identical to SEQ ID NO: 40596

SEQ ID NO: 203257 - RNA, 64 nt, hsa; identical to SEQ ID NO: 40597

SEQ ID NO: 203258 - RNA, 64 nt, hsa; identical to SEQ ID NO: 40598

SEQ ID NO: 203259 - RNA, 64 nt, hsa; identical to SEQ ID NO: 40599

SEQ ID NO: 203260 - RNA, 64 nt, hsa; identical to SEQ ID NO: 40600

SEQ ID NO: 203261 - RNA, 64 nt, hsa; identical to SEQ ID NO: 40601

SEQ ID NO: 203262 - RNA, 64 nt, hsa; identical to SEQ ID NO: 40602

SEQ ID NO: 203263 - RNA, 64 nt, hsa; identical to SEQ ID NO: 40603

SEQ ID NO: 203264 - RNA, 64 nt, hsa; identical to SEQ ID NO: 40604

SEQ ID NO: 203265 - RNA, 64 nt, hsa; identical to SEQ ID NO: 40605

SEQ ID NO: 203266 - RNA, 64 nt, hsa; identical to SEQ ID NO: 40606

SEQ ID NO: 203267 - RNA, 64 nt, hsa; identical to SEQ ID NO: 40607

SEQ ID NO: 203268 - RNA, 64 nt, hsa; identical to SEQ ID NO: 40608

SEQ ID NO: 203269 - RNA, 64 nt, hsa; identical to SEQ ID NO: 40609

SEQ ID NO: 203270 - RNA, 64 nt, hsa; identical to SEQ ID NO: 40610

SEQ ID NO: 203271 - RNA, 64 nt, hsa; identical to SEQ ID NO: 40611

SEQ ID NO: 203272 - RNA, 64 nt, hsa; identical to SEQ ID NO: 40612

SEQ ID NO: 203273 - RNA, 64 nt, hsa; identical to SEQ ID NO: 40613

SEQ ID NO: 203274 - RNA, 64 nt, hsa; identical to SEQ ID NO: 40614

SEQ ID NO: 203275 - RNA, 64 nt, hsa; identical to SEQ ID NO: 40615

SEQ ID NO: 203276 - RNA, 64 nt, hsa; identical to SEQ ID NO: 40616

SEQ ID NO: 203277 - RNA, 64 nt, hsa; identical to SEQ ID NO: 40617

SEQ ID NO: 203278 - RNA, 64 nt, hsa; identical to SEQ ID NO: 40618

SEQ ID NO: 203279 - RNA, 64 nt, hsa; identical to SEQ ID NO: 40619

SEQ ID NO: 203280 - RNA, 64 nt, hsa; identical to SEQ ID NO: 40620

SEQ ID NO: 203281 - RNA, 64 nt, hsa; identical to SEQ ID NO: 40621

SEQ ID NO: 203282 - RNA, 64 nt, hsa; identical to SEQ ID NO: 40622

SEQ ID NO: 203283 - RNA, 64 nt, hsa; identical to SEQ ID NO: 40623

SEQ ID NO: 203284 - RNA, 64 nt, hsa; identical to SEQ ID NO: 40624

SEQ ID NO: 203285 - RNA, 64 nt, hsa; identical to SEQ ID NO: 40625

SEQ ID NO: 203286 - RNA, 64 nt, hsa; identical to SEQ ID NO: 40626

SEQ ID NO: 203287 - RNA, 64 nt, hsa; identical to SEQ ID NO: 40627

SEQ ID NO: 203288 - RNA, 64 nt, hsa; identical to SEQ ID NO: 40628

SEQ ID NO: 203289 - RNA, 64 nt, hsa; identical to SEQ ID NO: 40629

SEQ ID NO: 203290 - RNA, 64 nt, hsa; identical to SEQ ID NO: 40630

SEQ ID NO: 203291 - RNA, 64 nt, hsa; identical to SEQ ID NO: 40631

SEQ ID NO: 203292 - RNA, 64 nt, hsa; identical to SEQ ID NO: 40632

SEQ ID NO: 203293 - RNA, 64 nt, hsa; identical to SEQ ID NO: 40633

SEQ ID NO: 203294 - RNA, 64 nt, hsa; identical to SEQ ID NO: 40634

SEQ ID NO: 203295 - RNA, 64 nt, hsa; identical to SEQ ID NO: 40635

SEQ ID NO: 203296 - RNA, 64 nt, hsa; identical to SEQ ID NO: 40636

SEQ ID NO: 203297 - RNA, 64 nt, hsa; identical to SEQ ID NO: 40637

SEQ ID NO: 203298 - RNA, 64 nt, hsa; identical to SEQ ID NO: 40638

SEQ ID NO: 203299 - RNA, 64 nt, hsa; identical to SEQ ID NO: 40639

SEQ ID NO: 203300 - RNA, 64 nt, hsa; identical to SEQ ID NO: 40640

SEQ ID NO: 203301 - RNA, 64 nt, hsa; identical to SEQ ID NO: 40641

SEQ ID NO: 203302 - RNA, 64 nt, hsa; identical to SEQ ID NO: 40642

SEQ ID NO: 203303 - RNA, 64 nt, hsa; identical to SEQ ID NO: 40643

SEQ ID NO: 203304 - RNA, 64 nt, hsa; identical to SEQ ID NO: 40644

SEQ ID NO: 203305 - RNA, 64 nt, hsa; identical to SEQ ID NO: 40645

SEQ ID NO: 203306 - RNA, 64 nt, hsa; identical to SEQ ID NO: 40646

SEQ ID NO: 203307 - RNA, 64 nt, hsa; identical to SEQ ID NO: 40647

SEQ ID NO: 203308 - RNA, 64 nt, hsa; identical to SEQ ID NO: 40648

SEQ ID NO: 203309 - RNA, 64 nt, hsa; identical to SEQ ID NO: 40649

SEQ ID NO: 203310 - RNA, 64 nt, hsa; identical to SEQ ID NO: 40650

SEQ ID NO: 203311 - RNA, 64 nt, hsa; identical to SEQ ID NO: 40651

SEQ ID NO: 203312 - RNA, 64 nt, hsa; identical to SEQ ID NO: 40652

SEQ ID NO: 203313 - RNA, 64 nt, hsa; identical to SEQ ID NO: 40653

SEQ ID NO: 203314 - RNA, 64 nt, hsa; identical to SEQ ID NO: 40654

SEQ ID NO: 203315 - RNA, 64 nt, hsa; identical to SEQ ID NO: 40655

SEQ ID NO: 203316 - RNA, 64 nt, hsa; identical to SEQ ID NO: 40656

SEQ ID NO: 203317 - RNA, 64 nt, hsa; identical to SEQ ID NO: 40657

SEQ ID NO: 203318 - RNA, 64 nt, hsa; identical to SEQ ID NO: 40658

SEQ ID NO: 203319 - RNA, 64 nt, hsa; identical to SEQ ID NO: 40659

SEQ ID NO: 203320 - RNA, 64 nt, hsa; identical to SEQ ID NO: 40660

SEQ ID NO: 203321 - RNA, 64 nt, hsa; identical to SEQ ID NO: 40661

SEQ ID NO: 203322 - RNA, 64 nt, hsa; identical to SEQ ID NO: 40662

SEQ ID NO: 203323 - RNA, 64 nt, hsa; identical to SEQ ID NO: 40663

SEQ ID NO: 203324 - RNA, 64 nt, hsa; identical to SEQ ID NO: 40664

SEQ ID NO: 203325 - RNA, 64 nt, hsa; identical to SEQ ID NO: 40665

SEQ ID NO: 203326 - RNA, 64 nt, hsa; identical to SEQ ID NO: 40666

SEQ ID NO: 203327 - RNA, 64 nt, hsa; identical to SEQ ID NO: 40667

SEQ ID NO: 203328 - RNA, 64 nt, hsa; identical to SEQ ID NO: 40668

SEQ ID NO: 203329 - RNA, 64 nt, hsa; identical to SEQ ID NO: 40669

SEQ ID NO: 203330 - RNA, 64 nt, hsa; identical to SEQ ID NO: 40670

SEQ ID NO: 203331 - RNA, 64 nt, hsa; identical to SEQ ID NO: 40671

SEQ ID NO: 203332 - RNA, 64 nt, hsa; identical to SEQ ID NO: 40672

SEQ ID NO: 203333 - RNA, 64 nt, hsa; identical to SEQ ID NO: 40673

SEQ ID NO: 203334 - RNA, 64 nt, hsa; identical to SEQ ID NO: 40674

SEQ ID NO: 203335 - RNA, 64 nt, hsa; identical to SEQ ID NO: 40675

SEQ ID NO: 203336 - RNA, 64 nt, hsa; identical to SEQ ID NO: 40676

SEQ ID NO: 203337 - RNA, 64 nt, hsa; identical to SEQ ID NO: 40677

SEQ ID NO: 203338 - RNA, 64 nt, hsa; identical to SEQ ID NO: 40678

SEQ ID NO: 203339 - RNA, 64 nt, hsa; identical to SEQ ID NO: 40679

SEQ ID NO: 203340 - RNA, 64 nt, hsa; identical to SEQ ID NO: 40680

SEQ ID NO: 203341 - RNA, 64 nt, hsa; identical to SEQ ID NO: 40681

SEQ ID NO: 203342 - RNA, 64 nt, hsa; identical to SEQ ID NO: 40682

SEQ ID NO: 203343 - RNA, 64 nt, hsa; identical to SEQ ID NO: 40683

SEQ ID NO: 203344 - RNA, 64 nt, hsa; identical to SEQ ID NO: 40684

SEQ ID NO: 203345 - RNA, 64 nt, hsa; identical to SEQ ID NO: 40685

SEQ ID NO: 203346 - RNA, 64 nt, hsa; identical to SEQ ID NO: 40686

SEQ ID NO: 203347 - RNA, 64 nt, hsa; identical to SEQ ID NO: 40687

SEQ ID NO: 203348 - RNA, 64 nt, hsa; identical to SEQ ID NO: 40688

SEQ ID NO: 203349 - RNA, 64 nt, hsa; identical to SEQ ID NO: 40689

SEQ ID NO: 203350 - RNA, 64 nt, hsa; identical to SEQ ID NO: 40690

SEQ ID NO: 203351 - RNA, 64 nt, hsa; identical to SEQ ID NO: 40691

SEQ ID NO: 203352 - RNA, 64 nt, hsa; identical to SEQ ID NO: 40692

SEQ ID NO: 203353 - RNA, 64 nt, hsa; identical to SEQ ID NO: 40693

SEQ ID NO: 203354 - RNA, 64 nt, hsa; identical to SEQ ID NO: 40694

SEQ ID NO: 203355 - RNA, 64 nt, hsa; identical to SEQ ID NO: 40695

SEQ ID NO: 203356 - RNA, 64 nt, hsa; identical to SEQ ID NO: 40696

SEQ ID NO: 203357 - RNA, 64 nt, hsa; identical to SEQ ID NO: 40697

SEQ ID NO: 203358 - RNA, 64 nt, hsa; identical to SEQ ID NO: 40698

SEQ ID NO: 203359 - RNA, 64 nt, hsa; identical to SEQ ID NO: 40699

SEQ ID NO: 203360 - RNA, 64 nt, hsa; identical to SEQ ID NO: 40700

SEQ ID NO: 203361 - RNA, 64 nt, hsa; identical to SEQ ID NO: 40701

SEQ ID NO: 203362 - RNA, 64 nt, hsa; identical to SEQ ID NO: 40702

SEQ ID NO: 203363 - RNA, 64 nt, hsa; identical to SEQ ID NO: 40703

SEQ ID NO: 203364 - RNA, 64 nt, hsa; identical to SEQ ID NO: 40704

SEQ ID NO: 203365 - RNA, 64 nt, hsa; identical to SEQ ID NO: 40705

SEQ ID NO: 203366 - RNA, 64 nt, hsa; identical to SEQ ID NO: 40706

SEQ ID NO: 203367 - RNA, 64 nt, hsa; identical to SEQ ID NO: 40707

SEQ ID NO: 203368 - RNA, 64 nt, hsa; identical to SEQ ID NO: 40708

SEQ ID NO: 203369 - RNA, 64 nt, hsa; identical to SEQ ID NO: 40709

SEQ ID NO: 203370 - RNA, 64 nt, hsa; identical to SEQ ID NO: 40710

SEQ ID NO: 203371 - RNA, 64 nt, hsa; identical to SEQ ID NO: 40711

SEQ ID NO: 203372 - RNA, 64 nt, hsa; identical to SEQ ID NO: 40712

SEQ ID NO: 203373 - RNA, 64 nt, hsa; identical to SEQ ID NO: 40713

SEQ ID NO: 203374 - RNA, 64 nt, hsa; identical to SEQ ID NO: 40714

SEQ ID NO: 203375 - RNA, 64 nt, hsa; identical to SEQ ID NO: 40715

SEQ ID NO: 203376 - RNA, 64 nt, hsa; identical to SEQ ID NO: 40716

SEQ ID NO: 203377 - RNA, 64 nt, hsa; identical to SEQ ID NO: 40717

SEQ ID NO: 203378 - RNA, 64 nt, hsa; identical to SEQ ID NO: 40718

SEQ ID NO: 203379 - RNA, 64 nt, hsa; identical to SEQ ID NO: 40719

SEQ ID NO: 203380 - RNA, 64 nt, hsa; identical to SEQ ID NO: 40720

SEQ ID NO: 203381 - RNA, 64 nt, hsa; identical to SEQ ID NO: 40721

SEQ ID NO: 203382 - RNA, 64 nt, hsa; identical to SEQ ID NO: 40722

SEQ ID NO: 203383 - RNA, 64 nt, hsa; identical to SEQ ID NO: 40723

SEQ ID NO: 203384 - RNA, 64 nt, hsa; identical to SEQ ID NO: 40724

SEQ ID NO: 203385 - RNA, 64 nt, hsa; identical to SEQ ID NO: 40725

SEQ ID NO: 203386 - RNA, 64 nt, hsa; identical to SEQ ID NO: 40726

SEQ ID NO: 203387 - RNA, 64 nt, hsa; identical to SEQ ID NO: 40727

SEQ ID NO: 203388 - RNA, 64 nt, hsa; identical to SEQ ID NO: 40728

SEQ ID NO: 203389 - RNA, 64 nt, hsa; identical to SEQ ID NO: 40729

SEQ ID NO: 203390 - RNA, 64 nt, hsa; identical to SEQ ID NO: 40730

SEQ ID NO: 203391 - RNA, 64 nt, hsa; identical to SEQ ID NO: 40731

SEQ ID NO: 203392 - RNA, 64 nt, hsa; identical to SEQ ID NO: 40732

SEQ ID NO: 203393 - RNA, 64 nt, hsa; identical to SEQ ID NO: 40733

SEQ ID NO: 203394 - RNA, 64 nt, hsa; identical to SEQ ID NO: 40734

SEQ ID NO: 203395 - RNA, 64 nt, hsa; identical to SEQ ID NO: 40735

SEQ ID NO: 203396 - RNA, 64 nt, hsa; identical to SEQ ID NO: 40736

SEQ ID NO: 203397 - RNA, 64 nt, hsa; identical to SEQ ID NO: 40737

SEQ ID NO: 203398 - RNA, 64 nt, hsa; identical to SEQ ID NO: 40738

SEQ ID NO: 203399 - RNA, 64 nt, hsa; identical to SEQ ID NO: 40739

SEQ ID NO: 203400 - RNA, 64 nt, hsa; identical to SEQ ID NO: 40740

SEQ ID NO: 203401 - RNA, 64 nt, hsa; identical to SEQ ID NO: 40741

SEQ ID NO: 203402 - RNA, 64 nt, hsa; identical to SEQ ID NO: 40742

SEQ ID NO: 203403 - RNA, 64 nt, hsa; identical to SEQ ID NO: 40743

SEQ ID NO: 203404 - RNA, 64 nt, hsa; identical to SEQ ID NO: 40744

SEQ ID NO: 203405 - RNA, 64 nt, hsa; identical to SEQ ID NO: 40745

SEQ ID NO: 203406 - RNA, 64 nt, hsa; identical to SEQ ID NO: 40746

SEQ ID NO: 203407 - RNA, 64 nt, hsa; identical to SEQ ID NO: 40747

SEQ ID NO: 203408 - RNA, 64 nt, hsa; identical to SEQ ID NO: 40748

SEQ ID NO: 203409 - RNA, 64 nt, hsa; identical to SEQ ID NO: 40749

SEQ ID NO: 203410 - RNA, 64 nt, hsa; identical to SEQ ID NO: 40750

SEQ ID NO: 203411 - RNA, 64 nt, hsa; identical to SEQ ID NO: 40751

SEQ ID NO: 203412 - RNA, 64 nt, hsa; identical to SEQ ID NO: 40752

SEQ ID NO: 203413 - RNA, 64 nt, hsa; identical to SEQ ID NO: 40753

SEQ ID NO: 203414 - RNA, 64 nt, hsa; identical to SEQ ID NO: 40754

SEQ ID NO: 203415 - RNA, 64 nt, hsa; identical to SEQ ID NO: 40755

SEQ ID NO: 203416 - RNA, 64 nt, hsa; identical to SEQ ID NO: 40756

SEQ ID NO: 203417 - RNA, 64 nt, hsa; identical to SEQ ID NO: 40757

SEQ ID NO: 203418 - RNA, 64 nt, hsa; identical to SEQ ID NO: 40758

SEQ ID NO: 203419 - RNA, 64 nt, hsa; identical to SEQ ID NO: 40759

SEQ ID NO: 203420 - RNA, 64 nt, hsa; identical to SEQ ID NO: 40760

SEQ ID NO: 203421 - RNA, 64 nt, hsa; identical to SEQ ID NO: 40761

SEQ ID NO: 203422 - RNA, 64 nt, hsa; identical to SEQ ID NO: 40762

SEQ ID NO: 203423 - RNA, 64 nt, hsa; identical to SEQ ID NO: 40763

SEQ ID NO: 203424 - RNA, 64 nt, hsa; identical to SEQ ID NO: 40764

SEQ ID NO: 203425 - RNA, 64 nt, hsa; identical to SEQ ID NO: 40765

SEQ ID NO: 203426 - RNA, 64 nt, hsa; identical to SEQ ID NO: 40766

SEQ ID NO: 203427 - RNA, 64 nt, hsa; identical to SEQ ID NO: 40767

SEQ ID NO: 203428 - RNA, 64 nt, hsa; identical to SEQ ID NO: 40768

SEQ ID NO: 203429 - RNA, 64 nt, hsa; identical to SEQ ID NO: 40769

SEQ ID NO: 203430 - RNA, 64 nt, hsa; identical to SEQ ID NO: 40770

SEQ ID NO: 203431 - RNA, 64 nt, hsa; identical to SEQ ID NO: 40771

SEQ ID NO: 203432 - RNA, 64 nt, hsa; identical to SEQ ID NO: 40772

SEQ ID NO: 203433 - RNA, 64 nt, hsa; identical to SEQ ID NO: 40773

SEQ ID NO: 203434 - RNA, 64 nt, hsa; identical to SEQ ID NO: 40774

SEQ ID NO: 203435 - RNA, 64 nt, hsa; identical to SEQ ID NO: 40775

SEQ ID NO: 203436 - RNA, 64 nt, hsa; identical to SEQ ID NO: 40776

SEQ ID NO: 203437 - RNA, 64 nt, hsa; identical to SEQ ID NO: 40777

SEQ ID NO: 203438 - RNA, 64 nt, hsa; identical to SEQ ID NO: 40778

SEQ ID NO: 203439 - RNA, 64 nt, hsa; identical to SEQ ID NO: 40779

SEQ ID NO: 203440 - RNA, 64 nt, hsa; identical to SEQ ID NO: 40780

SEQ ID NO: 203441 - RNA, 64 nt, hsa; identical to SEQ ID NO: 40781

SEQ ID NO: 203442 - RNA, 64 nt, hsa; identical to SEQ ID NO: 40782

SEQ ID NO: 203443 - RNA, 64 nt, hsa; identical to SEQ ID NO: 40783

SEQ ID NO: 203444 - RNA, 64 nt, hsa; identical to SEQ ID NO: 40784

SEQ ID NO: 203445 - RNA, 64 nt, hsa; identical to SEQ ID NO: 40785

SEQ ID NO: 203446 - RNA, 64 nt, hsa; identical to SEQ ID NO: 40786

SEQ ID NO: 203447 - RNA, 64 nt, hsa; identical to SEQ ID NO: 40787

SEQ ID NO: 203448 - RNA, 64 nt, hsa; identical to SEQ ID NO: 40788

SEQ ID NO: 203449 - RNA, 64 nt, hsa; identical to SEQ ID NO: 40789

SEQ ID NO: 203450 - RNA, 64 nt, hsa; identical to SEQ ID NO: 40790

SEQ ID NO: 203451 - RNA, 64 nt, hsa; identical to SEQ ID NO: 40791

SEQ ID NO: 203452 - RNA, 64 nt, hsa; identical to SEQ ID NO: 40792

SEQ ID NO: 203453 - RNA, 64 nt, hsa; identical to SEQ ID NO: 40793

SEQ ID NO: 203454 - RNA, 64 nt, hsa; identical to SEQ ID NO: 40794

SEQ ID NO: 203455 - RNA, 64 nt, hsa; identical to SEQ ID NO: 40795

SEQ ID NO: 203456 - RNA, 64 nt, hsa; identical to SEQ ID NO: 40796

SEQ ID NO: 203457 - RNA, 64 nt, hsa; identical to SEQ ID NO: 40797

SEQ ID NO: 203458 - RNA, 64 nt, hsa; identical to SEQ ID NO: 40798

SEQ ID NO: 203459 - RNA, 64 nt, hsa; identical to SEQ ID NO: 40799

SEQ ID NO: 203460 - RNA, 64 nt, hsa; identical to SEQ ID NO: 40800

SEQ ID NO: 203461 - RNA, 64 nt, hsa; identical to SEQ ID NO: 40801

SEQ ID NO: 203462 - RNA, 64 nt, hsa; identical to SEQ ID NO: 40802

SEQ ID NO: 203463 - RNA, 64 nt, hsa; identical to SEQ ID NO: 40803

SEQ ID NO: 203464 - RNA, 64 nt, hsa; identical to SEQ ID NO: 40804

SEQ ID NO: 203465 - RNA, 64 nt, hsa; identical to SEQ ID NO: 40805

SEQ ID NO: 203466 - RNA, 64 nt, hsa; identical to SEQ ID NO: 40806

SEQ ID NO: 203467 - RNA, 64 nt, hsa; identical to SEQ ID NO: 40807

SEQ ID NO: 203468 - RNA, 64 nt, hsa; identical to SEQ ID NO: 40808

SEQ ID NO: 203469 - RNA, 64 nt, hsa; identical to SEQ ID NO: 40809

SEQ ID NO: 203470 - RNA, 64 nt, hsa; identical to SEQ ID NO: 40810

SEQ ID NO: 203471 - RNA, 64 nt, hsa; identical to SEQ ID NO: 40811

SEQ ID NO: 203472 - RNA, 64 nt, hsa; identical to SEQ ID NO: 40812

SEQ ID NO: 203473 - RNA, 64 nt, hsa; identical to SEQ ID NO: 40813

SEQ ID NO: 203474 - RNA, 64 nt, hsa; identical to SEQ ID NO: 40814

SEQ ID NO: 203475 - RNA, 64 nt, hsa; identical to SEQ ID NO: 40815

SEQ ID NO: 203476 - RNA, 64 nt, hsa; identical to SEQ ID NO: 40816

SEQ ID NO: 203477 - RNA, 64 nt, hsa; identical to SEQ ID NO: 40817

SEQ ID NO: 203478 - RNA, 64 nt, hsa; identical to SEQ ID NO: 40818

SEQ ID NO: 203479 - RNA, 64 nt, hsa; identical to SEQ ID NO: 40819

SEQ ID NO: 203480 - RNA, 64 nt, hsa; identical to SEQ ID NO: 40820

SEQ ID NO: 203481 - RNA, 64 nt, hsa; identical to SEQ ID NO: 40821

SEQ ID NO: 203482 - RNA, 64 nt, hsa; identical to SEQ ID NO: 40822

SEQ ID NO: 203483 - RNA, 64 nt, hsa; identical to SEQ ID NO: 40823

SEQ ID NO: 203484 - RNA, 64 nt, hsa; identical to SEQ ID NO: 40824

SEQ ID NO: 203485 - RNA, 64 nt, hsa; identical to SEQ ID NO: 40825

SEQ ID NO: 203486 - RNA, 64 nt, hsa; identical to SEQ ID NO: 40826

SEQ ID NO: 203487 - RNA, 64 nt, hsa; identical to SEQ ID NO: 40827

SEQ ID NO: 203488 - RNA, 64 nt, hsa; identical to SEQ ID NO: 40828

SEQ ID NO: 203489 - RNA, 64 nt, hsa; identical to SEQ ID NO: 40829

SEQ ID NO: 203490 - RNA, 64 nt, hsa; identical to SEQ ID NO: 40830

SEQ ID NO: 203491 - RNA, 64 nt, hsa; identical to SEQ ID NO: 40831

SEQ ID NO: 203492 - RNA, 64 nt, hsa; identical to SEQ ID NO: 40832

SEQ ID NO: 203493 - RNA, 64 nt, hsa; identical to SEQ ID NO: 40833

SEQ ID NO: 203494 - RNA, 64 nt, hsa; identical to SEQ ID NO: 40834

SEQ ID NO: 203495 - RNA, 64 nt, hsa; identical to SEQ ID NO: 40835

SEQ ID NO: 203496 - RNA, 64 nt, hsa; identical to SEQ ID NO: 40836

SEQ ID NO: 203497 - RNA, 64 nt, hsa; identical to SEQ ID NO: 40837

SEQ ID NO: 203498 - RNA, 64 nt, hsa; identical to SEQ ID NO: 40838

SEQ ID NO: 203499 - RNA, 64 nt, hsa; identical to SEQ ID NO: 40839

SEQ ID NO: 203500 - RNA, 64 nt, hsa; identical to SEQ ID NO: 40840

SEQ ID NO: 203501 - RNA, 64 nt, hsa; identical to SEQ ID NO: 40841

SEQ ID NO: 203502 - RNA, 64 nt, hsa; identical to SEQ ID NO: 40842

SEQ ID NO: 203503 - RNA, 64 nt, hsa; identical to SEQ ID NO: 40843

SEQ ID NO: 203504 - RNA, 64 nt, hsa; identical to SEQ ID NO: 40844

SEQ ID NO: 203505 - RNA, 64 nt, hsa; identical to SEQ ID NO: 40845

SEQ ID NO: 203506 - RNA, 64 nt, hsa; identical to SEQ ID NO: 40846

SEQ ID NO: 203507 - RNA, 64 nt, hsa; identical to SEQ ID NO: 40847

SEQ ID NO: 203508 - RNA, 64 nt, hsa; identical to SEQ ID NO: 40848

SEQ ID NO: 203509 - RNA, 64 nt, hsa; identical to SEQ ID NO: 40849

SEQ ID NO: 203510 - RNA, 64 nt, hsa; identical to SEQ ID NO: 40850

SEQ ID NO: 203511 - RNA, 64 nt, hsa; identical to SEQ ID NO: 40851

SEQ ID NO: 203512 - RNA, 64 nt, hsa; identical to SEQ ID NO: 40852

SEQ ID NO: 203513 - RNA, 64 nt, hsa; identical to SEQ ID NO: 40853

SEQ ID NO: 203514 - RNA, 64 nt, hsa; identical to SEQ ID NO: 40854

SEQ ID NO: 203515 - RNA, 64 nt, hsa; identical to SEQ ID NO: 40855

SEQ ID NO: 203516 - RNA, 64 nt, hsa; identical to SEQ ID NO: 40856

SEQ ID NO: 203517 - RNA, 64 nt, hsa; identical to SEQ ID NO: 40857

SEQ ID NO: 203518 - RNA, 64 nt, hsa; identical to SEQ ID NO: 40858

SEQ ID NO: 203519 - RNA, 64 nt, hsa; identical to SEQ ID NO: 40859

SEQ ID NO: 203520 - RNA, 64 nt, hsa; identical to SEQ ID NO: 40860

SEQ ID NO: 203521 - RNA, 64 nt, hsa; identical to SEQ ID NO: 40861

SEQ ID NO: 203522 - RNA, 64 nt, hsa; identical to SEQ ID NO: 40862

SEQ ID NO: 203523 - RNA, 64 nt, hsa; identical to SEQ ID NO: 40863

SEQ ID NO: 203524 - RNA, 64 nt, hsa; identical to SEQ ID NO: 40864

SEQ ID NO: 203525 - RNA, 64 nt, hsa; identical to SEQ ID NO: 40865

SEQ ID NO: 203526 - RNA, 64 nt, hsa; identical to SEQ ID NO: 40866

SEQ ID NO: 203527 - RNA, 64 nt, hsa; identical to SEQ ID NO: 40867

SEQ ID NO: 203528 - RNA, 64 nt, hsa; identical to SEQ ID NO: 40868

SEQ ID NO: 203529 - RNA, 64 nt, hsa; identical to SEQ ID NO: 40869

SEQ ID NO: 203530 - RNA, 64 nt, hsa; identical to SEQ ID NO: 40870

SEQ ID NO: 203531 - RNA, 64 nt, hsa; identical to SEQ ID NO: 40871

SEQ ID NO: 203532 - RNA, 64 nt, hsa; identical to SEQ ID NO: 40872

SEQ ID NO: 203533 - RNA, 64 nt, hsa; identical to SEQ ID NO: 40873

SEQ ID NO: 203534 - RNA, 64 nt, hsa; identical to SEQ ID NO: 40874

SEQ ID NO: 203535 - RNA, 64 nt, hsa; identical to SEQ ID NO: 40875

SEQ ID NO: 203536 - RNA, 64 nt, hsa; identical to SEQ ID NO: 40876

SEQ ID NO: 203537 - RNA, 64 nt, hsa; identical to SEQ ID NO: 40877

SEQ ID NO: 203538 - RNA, 64 nt, hsa; identical to SEQ ID NO: 40878

SEQ ID NO: 203539 - RNA, 64 nt, hsa; identical to SEQ ID NO: 40879

SEQ ID NO: 203540 - RNA, 64 nt, hsa; identical to SEQ ID NO: 40880

SEQ ID NO: 203541 - RNA, 64 nt, hsa; identical to SEQ ID NO: 40881

SEQ ID NO: 203542 - RNA, 64 nt, hsa; identical to SEQ ID NO: 40882

SEQ ID NO: 203543 - RNA, 64 nt, hsa; identical to SEQ ID NO: 40883

SEQ ID NO: 203544 - RNA, 64 nt, hsa; identical to SEQ ID NO: 40884

SEQ ID NO: 203545 - RNA, 64 nt, hsa; identical to SEQ ID NO: 40885

SEQ ID NO: 203546 - RNA, 64 nt, hsa; identical to SEQ ID NO: 40886

SEQ ID NO: 203547 - RNA, 64 nt, hsa; identical to SEQ ID NO: 40887

SEQ ID NO: 203548 - RNA, 64 nt, hsa; identical to SEQ ID NO: 40888

SEQ ID NO: 203549 - RNA, 64 nt, hsa; identical to SEQ ID NO: 40889

SEQ ID NO: 203550 - RNA, 64 nt, hsa; identical to SEQ ID NO: 40890

SEQ ID NO: 203551 - RNA, 64 nt, hsa; identical to SEQ ID NO: 40891

SEQ ID NO: 203552 - RNA, 64 nt, hsa; identical to SEQ ID NO: 40892

SEQ ID NO: 203553 - RNA, 64 nt, hsa; identical to SEQ ID NO: 40893

SEQ ID NO: 203554 - RNA, 64 nt, hsa; identical to SEQ ID NO: 40894

SEQ ID NO: 203555 - RNA, 64 nt, hsa; identical to SEQ ID NO: 40895

SEQ ID NO: 203556 - RNA, 64 nt, hsa; identical to SEQ ID NO: 40896

SEQ ID NO: 203557 - RNA, 64 nt, hsa; identical to SEQ ID NO: 40897

SEQ ID NO: 203558 - RNA, 64 nt, hsa; identical to SEQ ID NO: 40898

SEQ ID NO: 203559 - RNA, 64 nt, hsa; identical to SEQ ID NO: 40899

SEQ ID NO: 203560 - RNA, 64 nt, hsa; identical to SEQ ID NO: 40900

SEQ ID NO: 203561 - RNA, 64 nt, hsa; identical to SEQ ID NO: 40901

SEQ ID NO: 203562 - RNA, 64 nt, hsa; identical to SEQ ID NO: 40902

SEQ ID NO: 203563 - RNA, 64 nt, hsa; identical to SEQ ID NO: 40903

SEQ ID NO: 203564 - RNA, 64 nt, hsa; identical to SEQ ID NO: 40904

SEQ ID NO: 203565 - RNA, 64 nt, hsa; identical to SEQ ID NO: 40905

SEQ ID NO: 203566 - RNA, 64 nt, hsa; identical to SEQ ID NO: 40906

SEQ ID NO: 203567 - RNA, 64 nt, hsa; identical to SEQ ID NO: 40907

SEQ ID NO: 203568 - RNA, 64 nt, hsa; identical to SEQ ID NO: 40908

SEQ ID NO: 203569 - RNA, 64 nt, hsa; identical to SEQ ID NO: 40909

SEQ ID NO: 203570 - RNA, 64 nt, hsa; identical to SEQ ID NO: 40910

SEQ ID NO: 203571 - RNA, 64 nt, hsa; identical to SEQ ID NO: 40911

SEQ ID NO: 203572 - RNA, 64 nt, hsa; identical to SEQ ID NO: 40912

SEQ ID NO: 203573 - RNA, 64 nt, hsa; identical to SEQ ID NO: 40913

SEQ ID NO: 203574 - RNA, 64 nt, hsa; identical to SEQ ID NO: 40914

SEQ ID NO: 203575 - RNA, 64 nt, hsa; identical to SEQ ID NO: 40915

SEQ ID NO: 203576 - RNA, 64 nt, hsa; identical to SEQ ID NO: 40916

SEQ ID NO: 203577 - RNA, 64 nt, hsa; identical to SEQ ID NO: 40917

SEQ ID NO: 203578 - RNA, 64 nt, hsa; identical to SEQ ID NO: 40918

SEQ ID NO: 203579 - RNA, 64 nt, hsa; identical to SEQ ID NO: 40919

SEQ ID NO: 203580 - RNA, 64 nt, hsa; identical to SEQ ID NO: 40920

SEQ ID NO: 203581 - RNA, 64 nt, hsa; identical to SEQ ID NO: 40921

SEQ ID NO: 203582 - RNA, 64 nt, hsa; identical to SEQ ID NO: 40922

SEQ ID NO: 203583 - RNA, 64 nt, hsa; identical to SEQ ID NO: 40923

SEQ ID NO: 203584 - RNA, 64 nt, hsa; identical to SEQ ID NO: 40924

SEQ ID NO: 203585 - RNA, 64 nt, hsa; identical to SEQ ID NO: 40925

SEQ ID NO: 203586 - RNA, 64 nt, hsa; identical to SEQ ID NO: 40926

SEQ ID NO: 203587 - RNA, 64 nt, hsa; identical to SEQ ID NO: 40927

SEQ ID NO: 203588 - RNA, 64 nt, hsa; identical to SEQ ID NO: 40928

SEQ ID NO: 203589 - RNA, 64 nt, hsa; identical to SEQ ID NO: 40929

SEQ ID NO: 203590 - RNA, 64 nt, hsa; identical to SEQ ID NO: 40930

SEQ ID NO: 203591 - RNA, 64 nt, hsa; identical to SEQ ID NO: 40931

SEQ ID NO: 203592 - RNA, 64 nt, hsa; identical to SEQ ID NO: 40932

SEQ ID NO: 203593 - RNA, 64 nt, hsa; identical to SEQ ID NO: 40933

SEQ ID NO: 203594 - RNA, 64 nt, hsa; identical to SEQ ID NO: 40934

SEQ ID NO: 203595 - RNA, 64 nt, hsa; identical to SEQ ID NO: 40935

SEQ ID NO: 203596 - RNA, 64 nt, hsa; identical to SEQ ID NO: 40936

SEQ ID NO: 203597 - RNA, 64 nt, hsa; identical to SEQ ID NO: 40937

SEQ ID NO: 203598 - RNA, 64 nt, hsa; identical to SEQ ID NO: 40938

SEQ ID NO: 203599 - RNA, 64 nt, hsa; identical to SEQ ID NO: 40939

SEQ ID NO: 203600 - RNA, 64 nt, hsa; identical to SEQ ID NO: 40940

SEQ ID NO: 203601 - RNA, 64 nt, hsa; identical to SEQ ID NO: 40941

SEQ ID NO: 203602 - RNA, 64 nt, hsa; identical to SEQ ID NO: 40942

SEQ ID NO: 203603 - RNA, 64 nt, hsa; identical to SEQ ID NO: 40943

SEQ ID NO: 203604 - RNA, 64 nt, hsa; identical to SEQ ID NO: 40944

SEQ ID NO: 203605 - RNA, 64 nt, hsa; identical to SEQ ID NO: 40945

SEQ ID NO: 203606 - RNA, 64 nt, hsa; identical to SEQ ID NO: 40946

SEQ ID NO: 203607 - RNA, 64 nt, hsa; identical to SEQ ID NO: 40947

SEQ ID NO: 203608 - RNA, 64 nt, hsa; identical to SEQ ID NO: 40948

SEQ ID NO: 203609 - RNA, 64 nt, hsa; identical to SEQ ID NO: 40949

SEQ ID NO: 203610 - RNA, 64 nt, hsa; identical to SEQ ID NO: 40950

SEQ ID NO: 203611 - RNA, 64 nt, hsa; identical to SEQ ID NO: 40951

SEQ ID NO: 203612 - RNA, 64 nt, hsa; identical to SEQ ID NO: 40952

SEQ ID NO: 203613 - RNA, 64 nt, hsa; identical to SEQ ID NO: 40953

SEQ ID NO: 203614 - RNA, 64 nt, hsa; identical to SEQ ID NO: 40954

SEQ ID NO: 203615 - RNA, 64 nt, hsa; identical to SEQ ID NO: 40955

SEQ ID NO: 203616 - RNA, 64 nt, hsa; identical to SEQ ID NO: 40956

SEQ ID NO: 203617 - RNA, 64 nt, hsa; identical to SEQ ID NO: 40957

SEQ ID NO: 203618 - RNA, 64 nt, hsa; identical to SEQ ID NO: 40958

SEQ ID NO: 203619 - RNA, 64 nt, hsa; identical to SEQ ID NO: 40959

SEQ ID NO: 203620 - RNA, 64 nt, hsa; identical to SEQ ID NO: 40960

SEQ ID NO: 203621 - RNA, 64 nt, hsa; identical to SEQ ID NO: 40961

SEQ ID NO: 203622 - RNA, 64 nt, hsa; identical to SEQ ID NO: 40962

SEQ ID NO: 203623 - RNA, 64 nt, hsa; identical to SEQ ID NO: 40963

SEQ ID NO: 203624 - RNA, 64 nt, hsa; identical to SEQ ID NO: 40964

SEQ ID NO: 203625 - RNA, 64 nt, hsa; identical to SEQ ID NO: 40965

SEQ ID NO: 203626 - RNA, 64 nt, hsa; identical to SEQ ID NO: 40966

SEQ ID NO: 203627 - RNA, 64 nt, hsa; identical to SEQ ID NO: 40967

SEQ ID NO: 203628 - RNA, 64 nt, hsa; identical to SEQ ID NO: 40968

SEQ ID NO: 203629 - RNA, 64 nt, hsa; identical to SEQ ID NO: 40969

SEQ ID NO: 203630 - RNA, 64 nt, hsa; identical to SEQ ID NO: 40970

SEQ ID NO: 203631 - RNA, 64 nt, hsa; identical to SEQ ID NO: 40971

SEQ ID NO: 203632 - RNA, 64 nt, hsa; identical to SEQ ID NO: 40972

SEQ ID NO: 203633 - RNA, 64 nt, hsa; identical to SEQ ID NO: 40973

SEQ ID NO: 203634 - RNA, 64 nt, hsa; identical to SEQ ID NO: 40974

SEQ ID NO: 203635 - RNA, 64 nt, hsa; identical to SEQ ID NO: 40975

SEQ ID NO: 203636 - RNA, 64 nt, hsa; identical to SEQ ID NO: 40976

SEQ ID NO: 203637 - RNA, 64 nt, hsa; identical to SEQ ID NO: 40977

SEQ ID NO: 203638 - RNA, 64 nt, hsa; identical to SEQ ID NO: 40978

SEQ ID NO: 203639 - RNA, 64 nt, hsa; identical to SEQ ID NO: 40979

SEQ ID NO: 203640 - RNA, 64 nt, hsa; identical to SEQ ID NO: 40980

SEQ ID NO: 203641 - RNA, 64 nt, hsa; identical to SEQ ID NO: 40981

SEQ ID NO: 203642 - RNA, 64 nt, hsa; identical to SEQ ID NO: 40982

SEQ ID NO: 203643 - RNA, 64 nt, hsa; identical to SEQ ID NO: 40983

SEQ ID NO: 203644 - RNA, 64 nt, hsa; identical to SEQ ID NO: 40984

SEQ ID NO: 203645 - RNA, 64 nt, hsa; identical to SEQ ID NO: 40985

SEQ ID NO: 203646 - RNA, 64 nt, hsa; identical to SEQ ID NO: 40986

SEQ ID NO: 203647 - RNA, 64 nt, hsa; identical to SEQ ID NO: 40987

SEQ ID NO: 203648 - RNA, 64 nt, hsa; identical to SEQ ID NO: 40988

SEQ ID NO: 203649 - RNA, 64 nt, hsa; identical to SEQ ID NO: 40989

SEQ ID NO: 203650 - RNA, 64 nt, hsa; identical to SEQ ID NO: 40990

SEQ ID NO: 203651 - RNA, 64 nt, hsa; identical to SEQ ID NO: 40991

SEQ ID NO: 203652 - RNA, 64 nt, hsa; identical to SEQ ID NO: 40992

SEQ ID NO: 203653 - RNA, 64 nt, hsa; identical to SEQ ID NO: 40993

SEQ ID NO: 203654 - RNA, 64 nt, hsa; identical to SEQ ID NO: 40994

SEQ ID NO: 203655 - RNA, 64 nt, hsa; identical to SEQ ID NO: 40995

SEQ ID NO: 203656 - RNA, 64 nt, hsa; identical to SEQ ID NO: 40996

SEQ ID NO: 203657 - RNA, 64 nt, hsa; identical to SEQ ID NO: 40997

SEQ ID NO: 203658 - RNA, 64 nt, hsa; identical to SEQ ID NO: 40998

SEQ ID NO: 203659 - RNA, 64 nt, hsa; identical to SEQ ID NO: 40999

SEQ ID NO: 203660 - RNA, 64 nt, hsa; identical to SEQ ID NO: 41000

SEQ ID NO: 203661 - RNA, 64 nt, hsa; identical to SEQ ID NO: 41001

SEQ ID NO: 203662 - RNA, 64 nt, hsa; identical to SEQ ID NO: 41002

SEQ ID NO: 203663 - RNA, 64 nt, hsa; identical to SEQ ID NO: 41003

SEQ ID NO: 203664 - RNA, 64 nt, hsa; identical to SEQ ID NO: 41004

SEQ ID NO: 203665 - RNA, 64 nt, hsa; identical to SEQ ID NO: 41005

SEQ ID NO: 203666 - RNA, 64 nt, hsa; identical to SEQ ID NO: 41006

SEQ ID NO: 203667 - RNA, 63 nt, hsa; identical to SEQ ID NO: 41007

SEQ ID NO: 203668 - RNA, 64 nt, hsa; identical to SEQ ID NO: 41008

SEQ ID NO: 203669 - RNA, 64 nt, hsa; identical to SEQ ID NO: 41009

SEQ ID NO: 203670 - RNA, 64 nt, hsa; identical to SEQ ID NO: 41010

SEQ ID NO: 203671 - RNA, 64 nt, hsa; identical to SEQ ID NO: 41011

SEQ ID NO: 203672 - RNA, 64 nt, hsa; identical to SEQ ID NO: 41012

SEQ ID NO: 203673 - RNA, 64 nt, hsa; identical to SEQ ID NO: 41013

SEQ ID NO: 203674 - RNA, 64 nt, hsa; identical to SEQ ID NO: 41014

SEQ ID NO: 203675 - RNA, 64 nt, hsa; identical to SEQ ID NO: 41015

SEQ ID NO: 203676 - RNA, 64 nt, hsa; identical to SEQ ID NO: 41016

SEQ ID NO: 203677 - RNA, 64 nt, hsa; identical to SEQ ID NO: 41017

SEQ ID NO: 203678 - RNA, 64 nt, hsa; identical to SEQ ID NO: 41018

SEQ ID NO: 203679 - RNA, 64 nt, hsa; identical to SEQ ID NO: 41019

SEQ ID NO: 203680 - RNA, 64 nt, hsa; identical to SEQ ID NO: 41020

SEQ ID NO: 203681 - RNA, 64 nt, hsa; identical to SEQ ID NO: 41021

SEQ ID NO: 203682 - RNA, 64 nt, hsa; identical to SEQ ID NO: 41022

SEQ ID NO: 203683 - RNA, 64 nt, hsa; identical to SEQ ID NO: 41023

SEQ ID NO: 203684 - RNA, 64 nt, hsa; identical to SEQ ID NO: 41024

SEQ ID NO: 203685 - RNA, 64 nt, hsa; identical to SEQ ID NO: 41025

SEQ ID NO: 203686 - RNA, 64 nt, hsa; identical to SEQ ID NO: 41026

SEQ ID NO: 203687 - RNA, 64 nt, hsa; identical to SEQ ID NO: 41027

SEQ ID NO: 203688 - RNA, 64 nt, hsa; identical to SEQ ID NO: 41028

SEQ ID NO: 203689 - RNA, 64 nt, hsa; identical to SEQ ID NO: 41029

SEQ ID NO: 203690 - RNA, 64 nt, hsa; identical to SEQ ID NO: 41030

SEQ ID NO: 203691 - RNA, 64 nt, hsa; identical to SEQ ID NO: 41031

SEQ ID NO: 203692 - RNA, 64 nt, hsa; identical to SEQ ID NO: 41032

SEQ ID NO: 203693 - RNA, 64 nt, hsa; identical to SEQ ID NO: 41033

SEQ ID NO: 203694 - RNA, 64 nt, hsa; identical to SEQ ID NO: 41034

SEQ ID NO: 203695 - RNA, 64 nt, hsa; identical to SEQ ID NO: 41035

SEQ ID NO: 203696 - RNA, 64 nt, hsa; identical to SEQ ID NO: 41036

SEQ ID NO: 203697 - RNA, 64 nt, hsa; identical to SEQ ID NO: 41037

SEQ ID NO: 203698 - RNA, 64 nt, hsa; identical to SEQ ID NO: 41038

SEQ ID NO: 203699 - RNA, 64 nt, hsa; identical to SEQ ID NO: 41039

SEQ ID NO: 203700 - RNA, 64 nt, hsa; identical to SEQ ID NO: 41040

SEQ ID NO: 203701 - RNA, 64 nt, hsa; identical to SEQ ID NO: 41041

SEQ ID NO: 203702 - RNA, 64 nt, hsa; identical to SEQ ID NO: 41042

SEQ ID NO: 203703 - RNA, 64 nt, hsa; identical to SEQ ID NO: 41043

SEQ ID NO: 203704 - RNA, 64 nt, hsa; identical to SEQ ID NO: 41044

SEQ ID NO: 203705 - RNA, 64 nt, hsa; identical to SEQ ID NO: 41045

SEQ ID NO: 203706 - RNA, 64 nt, hsa; identical to SEQ ID NO: 41046

SEQ ID NO: 203707 - RNA, 64 nt, hsa; identical to SEQ ID NO: 41047

SEQ ID NO: 203708 - RNA, 64 nt, hsa; identical to SEQ ID NO: 41048

SEQ ID NO: 203709 - RNA, 64 nt, hsa; identical to SEQ ID NO: 41049

SEQ ID NO: 203710 - RNA, 64 nt, hsa; identical to SEQ ID NO: 41050

SEQ ID NO: 203711 - RNA, 64 nt, hsa; identical to SEQ ID NO: 41051

SEQ ID NO: 203712 - RNA, 64 nt, hsa; identical to SEQ ID NO: 41052

SEQ ID NO: 203713 - RNA, 64 nt, hsa; identical to SEQ ID NO: 41053

SEQ ID NO: 203714 - RNA, 64 nt, hsa; identical to SEQ ID NO: 41054

SEQ ID NO: 203715 - RNA, 64 nt, hsa; identical to SEQ ID NO: 41055

SEQ ID NO: 203716 - RNA, 64 nt, hsa; identical to SEQ ID NO: 41056

SEQ ID NO: 203717 - RNA, 64 nt, hsa; identical to SEQ ID NO: 41057

SEQ ID NO: 203718 - RNA, 64 nt, hsa; identical to SEQ ID NO: 41058

SEQ ID NO: 203719 - RNA, 64 nt, hsa; identical to SEQ ID NO: 41059

SEQ ID NO: 203720 - RNA, 64 nt, hsa; identical to SEQ ID NO: 41060

SEQ ID NO: 203721 - RNA, 64 nt, hsa; identical to SEQ ID NO: 41061

SEQ ID NO: 203722 - RNA, 64 nt, hsa; identical to SEQ ID NO: 41062

SEQ ID NO: 203723 - RNA, 64 nt, hsa; identical to SEQ ID NO: 41063

SEQ ID NO: 203724 - RNA, 64 nt, hsa; identical to SEQ ID NO: 41064

SEQ ID NO: 203725 - RNA, 64 nt, hsa; identical to SEQ ID NO: 41065

SEQ ID NO: 203726 - RNA, 64 nt, hsa; identical to SEQ ID NO: 41066

SEQ ID NO: 203727 - RNA, 64 nt, hsa; identical to SEQ ID NO: 41067

SEQ ID NO: 203728 - RNA, 64 nt, hsa; identical to SEQ ID NO: 41068

SEQ ID NO: 203729 - RNA, 64 nt, hsa; identical to SEQ ID NO: 41069

SEQ ID NO: 203730 - RNA, 64 nt, hsa; identical to SEQ ID NO: 41070

SEQ ID NO: 203731 - RNA, 64 nt, hsa; identical to SEQ ID NO: 41071

SEQ ID NO: 203732 - RNA, 64 nt, hsa; identical to SEQ ID NO: 41072

SEQ ID NO: 203733 - RNA, 64 nt, hsa; identical to SEQ ID NO: 41073

SEQ ID NO: 203734 - RNA, 64 nt, hsa; identical to SEQ ID NO: 41074

SEQ ID NO: 203735 - RNA, 64 nt, hsa; identical to SEQ ID NO: 41075

SEQ ID NO: 203736 - RNA, 64 nt, hsa; identical to SEQ ID NO: 41076

SEQ ID NO: 203737 - RNA, 64 nt, hsa; identical to SEQ ID NO: 41077

SEQ ID NO: 203738 - RNA, 64 nt, hsa; identical to SEQ ID NO: 41078

SEQ ID NO: 203739 - RNA, 64 nt, hsa; identical to SEQ ID NO: 41079

SEQ ID NO: 203740 - RNA, 64 nt, hsa; identical to SEQ ID NO: 41080

SEQ ID NO: 203741 - RNA, 64 nt, hsa; identical to SEQ ID NO: 41081

SEQ ID NO: 203742 - RNA, 64 nt, hsa; identical to SEQ ID NO: 41082

SEQ ID NO: 203743 - RNA, 64 nt, hsa; identical to SEQ ID NO: 41083

SEQ ID NO: 203744 - RNA, 64 nt, hsa; identical to SEQ ID NO: 41084

SEQ ID NO: 203745 - RNA, 64 nt, hsa; identical to SEQ ID NO: 41085

SEQ ID NO: 203746 - RNA, 64 nt, hsa; identical to SEQ ID NO: 41086

SEQ ID NO: 203747 - RNA, 64 nt, hsa; identical to SEQ ID NO: 41087

SEQ ID NO: 203748 - RNA, 64 nt, hsa; identical to SEQ ID NO: 41088

SEQ ID NO: 203749 - RNA, 64 nt, hsa; identical to SEQ ID NO: 41089

SEQ ID NO: 203750 - RNA, 64 nt, hsa; identical to SEQ ID NO: 41090

SEQ ID NO: 203751 - RNA, 64 nt, hsa; identical to SEQ ID NO: 41091

SEQ ID NO: 203752 - RNA, 64 nt, hsa; identical to SEQ ID NO: 41092

SEQ ID NO: 203753 - RNA, 64 nt, hsa; identical to SEQ ID NO: 41093

SEQ ID NO: 203754 - RNA, 64 nt, hsa; identical to SEQ ID NO: 41094

SEQ ID NO: 203755 - RNA, 64 nt, hsa; identical to SEQ ID NO: 41095

SEQ ID NO: 203756 - RNA, 64 nt, hsa; identical to SEQ ID NO: 41096

SEQ ID NO: 203757 - RNA, 64 nt, hsa; identical to SEQ ID NO: 41097

SEQ ID NO: 203758 - RNA, 64 nt, hsa; identical to SEQ ID NO: 41098

SEQ ID NO: 203759 - RNA, 64 nt, hsa; identical to SEQ ID NO: 41099

SEQ ID NO: 203760 - RNA, 64 nt, hsa; identical to SEQ ID NO: 41100

SEQ ID NO: 203761 - RNA, 64 nt, hsa; identical to SEQ ID NO: 41101

SEQ ID NO: 203762 - RNA, 64 nt, hsa; identical to SEQ ID NO: 41102

SEQ ID NO: 203763 - RNA, 64 nt, hsa; identical to SEQ ID NO: 41103

SEQ ID NO: 203764 - RNA, 64 nt, hsa; identical to SEQ ID NO: 41104

SEQ ID NO: 203765 - RNA, 64 nt, hsa; identical to SEQ ID NO: 41105

SEQ ID NO: 203766 - RNA, 64 nt, hsa; identical to SEQ ID NO: 41106

SEQ ID NO: 203767 - RNA, 64 nt, hsa; identical to SEQ ID NO: 41107

SEQ ID NO: 203768 - RNA, 64 nt, hsa; identical to SEQ ID NO: 41108

SEQ ID NO: 203769 - RNA, 64 nt, hsa; identical to SEQ ID NO: 41109

SEQ ID NO: 203770 - RNA, 64 nt, hsa; identical to SEQ ID NO: 41110

SEQ ID NO: 203771 - RNA, 64 nt, hsa; identical to SEQ ID NO: 41111

SEQ ID NO: 203772 - RNA, 64 nt, hsa; identical to SEQ ID NO: 41112

SEQ ID NO: 203773 - RNA, 64 nt, hsa; identical to SEQ ID NO: 41113

SEQ ID NO: 203774 - RNA, 64 nt, hsa; identical to SEQ ID NO: 41114

SEQ ID NO: 203775 - RNA, 64 nt, hsa; identical to SEQ ID NO: 41115

SEQ ID NO: 203776 - RNA, 64 nt, hsa; identical to SEQ ID NO: 41116

SEQ ID NO: 203777 - RNA, 64 nt, hsa; identical to SEQ ID NO: 41117

SEQ ID NO: 203778 - RNA, 64 nt, hsa; identical to SEQ ID NO: 41118

SEQ ID NO: 203779 - RNA, 64 nt, hsa; identical to SEQ ID NO: 41119

SEQ ID NO: 203780 - RNA, 64 nt, hsa; identical to SEQ ID NO: 41120

SEQ ID NO: 203781 - RNA, 64 nt, hsa; identical to SEQ ID NO: 41121

SEQ ID NO: 203782 - RNA, 64 nt, hsa; identical to SEQ ID NO: 41122

SEQ ID NO: 203783 - RNA, 64 nt, hsa; identical to SEQ ID NO: 41123

SEQ ID NO: 203784 - RNA, 64 nt, hsa; identical to SEQ ID NO: 41124

SEQ ID NO: 203785 - RNA, 64 nt, hsa; identical to SEQ ID NO: 41125

SEQ ID NO: 203786 - RNA, 64 nt, hsa; identical to SEQ ID NO: 41126

SEQ ID NO: 203787 - RNA, 64 nt, hsa; identical to SEQ ID NO: 41127

SEQ ID NO: 203788 - RNA, 64 nt, hsa; identical to SEQ ID NO: 41128

SEQ ID NO: 203789 - RNA, 64 nt, hsa; identical to SEQ ID NO: 41129

SEQ ID NO: 203790 - RNA, 64 nt, hsa; identical to SEQ ID NO: 41130

SEQ ID NO: 203791 - RNA, 64 nt, hsa; identical to SEQ ID NO: 41131

SEQ ID NO: 203792 - RNA, 64 nt, hsa; identical to SEQ ID NO: 41132

SEQ ID NO: 203793 - RNA, 64 nt, hsa; identical to SEQ ID NO: 41133

SEQ ID NO: 203794 - RNA, 64 nt, hsa; identical to SEQ ID NO: 41134

SEQ ID NO: 203795 - RNA, 64 nt, hsa; identical to SEQ ID NO: 41135

SEQ ID NO: 203796 - RNA, 64 nt, hsa; identical to SEQ ID NO: 41136

SEQ ID NO: 203797 - RNA, 64 nt, hsa; identical to SEQ ID NO: 41137

SEQ ID NO: 203798 - RNA, 64 nt, hsa; identical to SEQ ID NO: 41138

SEQ ID NO: 203799 - RNA, 64 nt, hsa; identical to SEQ ID NO: 41139

SEQ ID NO: 203800 - RNA, 64 nt, hsa; identical to SEQ ID NO: 41140

SEQ ID NO: 203801 - RNA, 64 nt, hsa; identical to SEQ ID NO: 41141

SEQ ID NO: 203802 - RNA, 64 nt, hsa; identical to SEQ ID NO: 41142

SEQ ID NO: 203803 - RNA, 64 nt, hsa; identical to SEQ ID NO: 41143

SEQ ID NO: 203804 - RNA, 64 nt, hsa; identical to SEQ ID NO: 41144

SEQ ID NO: 203805 - RNA, 64 nt, hsa; identical to SEQ ID NO: 41145

SEQ ID NO: 203806 - RNA, 64 nt, hsa; identical to SEQ ID NO: 41146

SEQ ID NO: 203807 - RNA, 64 nt, hsa; identical to SEQ ID NO: 41147

SEQ ID NO: 203808 - RNA, 64 nt, hsa; identical to SEQ ID NO: 41148

SEQ ID NO: 203809 - RNA, 64 nt, hsa; identical to SEQ ID NO: 41149

SEQ ID NO: 203810 - RNA, 64 nt, hsa; identical to SEQ ID NO: 41150

SEQ ID NO: 203811 - RNA, 64 nt, hsa; identical to SEQ ID NO: 41151

SEQ ID NO: 203812 - RNA, 64 nt, hsa; identical to SEQ ID NO: 41152

SEQ ID NO: 203813 - RNA, 64 nt, hsa; identical to SEQ ID NO: 41153

SEQ ID NO: 203814 - RNA, 64 nt, hsa; identical to SEQ ID NO: 41154

SEQ ID NO: 203815 - RNA, 64 nt, hsa; identical to SEQ ID NO: 41155

SEQ ID NO: 203816 - RNA, 64 nt, hsa; identical to SEQ ID NO: 41156

SEQ ID NO: 203817 - RNA, 64 nt, hsa; identical to SEQ ID NO: 41157

SEQ ID NO: 203818 - RNA, 64 nt, hsa; identical to SEQ ID NO: 41158

SEQ ID NO: 203819 - RNA, 64 nt, hsa; identical to SEQ ID NO: 41159

SEQ ID NO: 203820 - RNA, 64 nt, hsa; identical to SEQ ID NO: 41160

SEQ ID NO: 203821 - RNA, 64 nt, hsa; identical to SEQ ID NO: 41161

SEQ ID NO: 203822 - RNA, 64 nt, hsa; identical to SEQ ID NO: 41162

SEQ ID NO: 203823 - RNA, 64 nt, hsa; identical to SEQ ID NO: 41163

SEQ ID NO: 203824 - RNA, 64 nt, hsa; identical to SEQ ID NO: 41164

SEQ ID NO: 203825 - RNA, 64 nt, hsa; identical to SEQ ID NO: 41165

SEQ ID NO: 203826 - RNA, 64 nt, hsa; identical to SEQ ID NO: 41166

SEQ ID NO: 203827 - RNA, 64 nt, hsa; identical to SEQ ID NO: 41167

SEQ ID NO: 203828 - RNA, 64 nt, hsa; identical to SEQ ID NO: 41168

SEQ ID NO: 203829 - RNA, 64 nt, hsa; identical to SEQ ID NO: 41169

SEQ ID NO: 203830 - RNA, 64 nt, hsa; identical to SEQ ID NO: 41170

SEQ ID NO: 203831 - RNA, 64 nt, hsa; identical to SEQ ID NO: 41171

SEQ ID NO: 203832 - RNA, 64 nt, hsa; identical to SEQ ID NO: 41172

SEQ ID NO: 203833 - RNA, 64 nt, hsa; identical to SEQ ID NO: 41173

SEQ ID NO: 203834 - RNA, 64 nt, hsa; identical to SEQ ID NO: 41174

SEQ ID NO: 203835 - RNA, 64 nt, hsa; identical to SEQ ID NO: 41175

SEQ ID NO: 203836 - RNA, 64 nt, hsa; identical to SEQ ID NO: 41176

SEQ ID NO: 203837 - RNA, 64 nt, hsa; identical to SEQ ID NO: 41177

SEQ ID NO: 203838 - RNA, 64 nt, hsa; identical to SEQ ID NO: 41178

SEQ ID NO: 203839 - RNA, 64 nt, hsa; identical to SEQ ID NO: 41179

SEQ ID NO: 203840 - RNA, 64 nt, hsa; identical to SEQ ID NO: 41180

SEQ ID NO: 203841 - RNA, 64 nt, hsa; identical to SEQ ID NO: 41181

SEQ ID NO: 203842 - RNA, 64 nt, hsa; identical to SEQ ID NO: 41182

SEQ ID NO: 203843 - RNA, 64 nt, hsa; identical to SEQ ID NO: 41183

SEQ ID NO: 203844 - RNA, 64 nt, hsa; identical to SEQ ID NO: 41184

SEQ ID NO: 203845 - RNA, 64 nt, hsa; identical to SEQ ID NO: 41185

SEQ ID NO: 203846 - RNA, 64 nt, hsa; identical to SEQ ID NO: 41186

SEQ ID NO: 203847 - RNA, 64 nt, hsa; identical to SEQ ID NO: 41187

SEQ ID NO: 203848 - RNA, 64 nt, hsa; identical to SEQ ID NO: 41188

SEQ ID NO: 203849 - RNA, 64 nt, hsa; identical to SEQ ID NO: 41189

SEQ ID NO: 203850 - RNA, 64 nt, hsa; identical to SEQ ID NO: 41190

SEQ ID NO: 203851 - RNA, 64 nt, hsa; identical to SEQ ID NO: 41191

SEQ ID NO: 203852 - RNA, 64 nt, hsa; identical to SEQ ID NO: 41192

SEQ ID NO: 203853 - RNA, 64 nt, hsa; identical to SEQ ID NO: 41193

SEQ ID NO: 203854 - RNA, 64 nt, hsa; identical to SEQ ID NO: 41194

SEQ ID NO: 203855 - RNA, 64 nt, hsa; identical to SEQ ID NO: 41195

SEQ ID NO: 203856 - RNA, 64 nt, hsa; identical to SEQ ID NO: 41196

SEQ ID NO: 203857 - RNA, 64 nt, hsa; identical to SEQ ID NO: 41197

SEQ ID NO: 203858 - RNA, 64 nt, hsa; identical to SEQ ID NO: 41198

SEQ ID NO: 203859 - RNA, 64 nt, hsa; identical to SEQ ID NO: 41199

SEQ ID NO: 203860 - RNA, 64 nt, hsa; identical to SEQ ID NO: 41200

SEQ ID NO: 203861 - RNA, 64 nt, hsa; identical to SEQ ID NO: 41201

SEQ ID NO: 203862 - RNA, 64 nt, hsa; identical to SEQ ID NO: 41202

SEQ ID NO: 203863 - RNA, 64 nt, hsa; identical to SEQ ID NO: 41203

SEQ ID NO: 203864 - RNA, 64 nt, hsa; identical to SEQ ID NO: 41204

SEQ ID NO: 203865 - RNA, 64 nt, hsa; identical to SEQ ID NO: 41205

SEQ ID NO: 203866 - RNA, 64 nt, hsa; identical to SEQ ID NO: 41206

SEQ ID NO: 203867 - RNA, 64 nt, hsa; identical to SEQ ID NO: 41207

SEQ ID NO: 203868 - RNA, 64 nt, hsa; identical to SEQ ID NO: 41208

SEQ ID NO: 203869 - RNA, 64 nt, hsa; identical to SEQ ID NO: 41209

SEQ ID NO: 203870 - RNA, 64 nt, hsa; identical to SEQ ID NO: 41210

SEQ ID NO: 203871 - RNA, 64 nt, hsa; identical to SEQ ID NO: 41211

SEQ ID NO: 203872 - RNA, 64 nt, hsa; identical to SEQ ID NO: 41212

SEQ ID NO: 203873 - RNA, 64 nt, hsa; identical to SEQ ID NO: 41213

SEQ ID NO: 203874 - RNA, 64 nt, hsa; identical to SEQ ID NO: 41214

SEQ ID NO: 203875 - RNA, 64 nt, hsa; identical to SEQ ID NO: 41215

SEQ ID NO: 203876 - RNA, 64 nt, hsa; identical to SEQ ID NO: 41216

SEQ ID NO: 203877 - RNA, 64 nt, hsa; identical to SEQ ID NO: 41217

SEQ ID NO: 203878 - RNA, 64 nt, hsa; identical to SEQ ID NO: 41218

SEQ ID NO: 203879 - RNA, 64 nt, hsa; identical to SEQ ID NO: 41219

SEQ ID NO: 203880 - RNA, 64 nt, hsa; identical to SEQ ID NO: 41220

SEQ ID NO: 203881 - RNA, 64 nt, hsa; identical to SEQ ID NO: 41221

SEQ ID NO: 203882 - RNA, 64 nt, hsa; identical to SEQ ID NO: 41222

SEQ ID NO: 203883 - RNA, 64 nt, hsa; identical to SEQ ID NO: 41223

SEQ ID NO: 203884 - RNA, 64 nt, hsa; identical to SEQ ID NO: 41224

SEQ ID NO: 203885 - RNA, 64 nt, hsa; identical to SEQ ID NO: 41225

SEQ ID NO: 203886 - RNA, 64 nt, hsa; identical to SEQ ID NO: 41226

SEQ ID NO: 203887 - RNA, 64 nt, hsa; identical to SEQ ID NO: 41227

SEQ ID NO: 203888 - RNA, 64 nt, hsa; identical to SEQ ID NO: 41228

SEQ ID NO: 203889 - RNA, 64 nt, hsa; identical to SEQ ID NO: 41229

SEQ ID NO: 203890 - RNA, 64 nt, hsa; identical to SEQ ID NO: 41230

SEQ ID NO: 203891 - RNA, 64 nt, hsa; identical to SEQ ID NO: 41231

SEQ ID NO: 203892 - RNA, 64 nt, hsa; identical to SEQ ID NO: 41232

SEQ ID NO: 203893 - RNA, 64 nt, hsa; identical to SEQ ID NO: 41233

SEQ ID NO: 203894 - RNA, 64 nt, hsa; identical to SEQ ID NO: 41234

SEQ ID NO: 203895 - RNA, 64 nt, hsa; identical to SEQ ID NO: 41235

SEQ ID NO: 203896 - RNA, 62 nt, hsa; identical to SEQ ID NO: 41236

SEQ ID NO: 203897 - RNA, 60 nt, hsa; identical to SEQ ID NO: 41237

SEQ ID NO: 203898 - RNA, 58 nt, hsa; identical to SEQ ID NO: 41238

SEQ ID NO: 203899 - RNA, 56 nt, hsa; identical to SEQ ID NO: 41239

SEQ ID NO: 203900 - RNA, 54 nt, hsa; identical to SEQ ID NO: 41240

SEQ ID NO: 203901 - RNA, 64 nt, hsa; identical to SEQ ID NO: 41241

SEQ ID NO: 203902 - RNA, 64 nt, hsa; identical to SEQ ID NO: 41242

SEQ ID NO: 203903 - RNA, 64 nt, hsa; identical to SEQ ID NO: 41243

SEQ ID NO: 203904 - RNA, 64 nt, hsa; identical to SEQ ID NO: 41244

SEQ ID NO: 203905 - RNA, 64 nt, hsa; identical to SEQ ID NO: 41245

SEQ ID NO: 203906 - RNA, 64 nt, hsa; identical to SEQ ID NO: 41246

SEQ ID NO: 203907 - RNA, 64 nt, hsa; identical to SEQ ID NO: 41247

SEQ ID NO: 203908 - RNA, 64 nt, hsa; identical to SEQ ID NO: 41248

SEQ ID NO: 203909 - RNA, 64 nt, hsa; identical to SEQ ID NO: 41249

SEQ ID NO: 203910 - RNA, 64 nt, hsa; identical to SEQ ID NO: 41250

SEQ ID NO: 203911 - RNA, 64 nt, hsa; identical to SEQ ID NO: 41251

SEQ ID NO: 203912 - RNA, 64 nt, hsa; identical to SEQ ID NO: 41252

SEQ ID NO: 203913 - RNA, 64 nt, hsa; identical to SEQ ID NO: 41253

SEQ ID NO: 203914 - RNA, 64 nt, hsa; identical to SEQ ID NO: 41254

SEQ ID NO: 203915 - RNA, 64 nt, hsa; identical to SEQ ID NO: 41255

SEQ ID NO: 203916 - RNA, 64 nt, hsa; identical to SEQ ID NO: 41256

SEQ ID NO: 203917 - RNA, 64 nt, hsa; identical to SEQ ID NO: 41257

SEQ ID NO: 203918 - RNA, 64 nt, hsa; identical to SEQ ID NO: 41258

SEQ ID NO: 203919 - RNA, 64 nt, hsa; identical to SEQ ID NO: 41259

SEQ ID NO: 203920 - RNA, 64 nt, hsa; identical to SEQ ID NO: 41260

SEQ ID NO: 203921 - RNA, 64 nt, hsa; identical to SEQ ID NO: 41261

SEQ ID NO: 203922 - RNA, 64 nt, hsa; identical to SEQ ID NO: 41262

SEQ ID NO: 203923 - RNA, 64 nt, hsa; identical to SEQ ID NO: 41263

SEQ ID NO: 203924 - RNA, 64 nt, hsa; identical to SEQ ID NO: 41264

SEQ ID NO: 203925 - RNA, 64 nt, hsa; identical to SEQ ID NO: 41265

SEQ ID NO: 203926 - RNA, 64 nt, hsa; identical to SEQ ID NO: 41266

SEQ ID NO: 203927 - RNA, 64 nt, hsa; identical to SEQ ID NO: 41267

SEQ ID NO: 203928 - RNA, 64 nt, hsa; identical to SEQ ID NO: 41268

SEQ ID NO: 203929 - RNA, 64 nt, hsa; identical to SEQ ID NO: 41269

SEQ ID NO: 203930 - RNA, 64 nt, hsa; identical to SEQ ID NO: 41270

SEQ ID NO: 203931 - RNA, 64 nt, hsa; identical to SEQ ID NO: 41271

SEQ ID NO: 203932 - RNA, 64 nt, hsa; identical to SEQ ID NO: 41272

SEQ ID NO: 203933 - RNA, 64 nt, hsa; identical to SEQ ID NO: 41273

SEQ ID NO: 203934 - RNA, 64 nt, hsa; identical to SEQ ID NO: 41274

SEQ ID NO: 203935 - RNA, 64 nt, hsa; identical to SEQ ID NO: 41275

SEQ ID NO: 203936 - RNA, 64 nt, hsa; identical to SEQ ID NO: 41276

SEQ ID NO: 203937 - RNA, 64 nt, hsa; identical to SEQ ID NO: 41277

SEQ ID NO: 203938 - RNA, 64 nt, hsa; identical to SEQ ID NO: 41278

SEQ ID NO: 203939 - RNA, 64 nt, hsa; identical to SEQ ID NO: 41279

SEQ ID NO: 203940 - RNA, 64 nt, hsa; identical to SEQ ID NO: 41280

SEQ ID NO: 203941 - RNA, 64 nt, hsa; identical to SEQ ID NO: 41281

SEQ ID NO: 203942 - RNA, 64 nt, hsa; identical to SEQ ID NO: 41282

SEQ ID NO: 203943 - RNA, 64 nt, hsa; identical to SEQ ID NO: 41283

SEQ ID NO: 203944 - RNA, 64 nt, hsa; identical to SEQ ID NO: 41284

SEQ ID NO: 203945 - RNA, 64 nt, hsa; identical to SEQ ID NO: 41285

SEQ ID NO: 203946 - RNA, 64 nt, hsa; identical to SEQ ID NO: 41286

SEQ ID NO: 203947 - RNA, 64 nt, hsa; identical to SEQ ID NO: 41287

SEQ ID NO: 203948 - RNA, 64 nt, hsa; identical to SEQ ID NO: 41288

SEQ ID NO: 203949 - RNA, 64 nt, hsa; identical to SEQ ID NO: 41289

SEQ ID NO: 203950 - RNA, 64 nt, hsa; identical to SEQ ID NO: 41290

SEQ ID NO: 203951 - RNA, 64 nt, hsa; identical to SEQ ID NO: 41291

SEQ ID NO: 203952 - RNA, 64 nt, hsa; identical to SEQ ID NO: 41292

SEQ ID NO: 203953 - RNA, 64 nt, hsa; identical to SEQ ID NO: 41293

SEQ ID NO: 203954 - RNA, 64 nt, hsa; identical to SEQ ID NO: 41294

SEQ ID NO: 203955 - RNA, 64 nt, hsa; identical to SEQ ID NO: 41295

SEQ ID NO: 203956 - RNA, 64 nt, hsa; identical to SEQ ID NO: 41296

SEQ ID NO: 203957 - RNA, 64 nt, hsa; identical to SEQ ID NO: 41297

SEQ ID NO: 203958 - RNA, 64 nt, hsa; identical to SEQ ID NO: 41298

SEQ ID NO: 203959 - RNA, 64 nt, hsa; identical to SEQ ID NO: 41299

SEQ ID NO: 203960 - RNA, 64 nt, hsa; identical to SEQ ID NO: 41300

SEQ ID NO: 203961 - RNA, 64 nt, hsa; identical to SEQ ID NO: 41301

SEQ ID NO: 203962 - RNA, 64 nt, hsa; identical to SEQ ID NO: 41302

SEQ ID NO: 203963 - RNA, 64 nt, hsa; identical to SEQ ID NO: 41303

SEQ ID NO: 203964 - RNA, 64 nt, hsa; identical to SEQ ID NO: 41304

SEQ ID NO: 203965 - RNA, 64 nt, hsa; identical to SEQ ID NO: 41305

SEQ ID NO: 203966 - RNA, 64 nt, hsa; identical to SEQ ID NO: 41306

SEQ ID NO: 203967 - RNA, 64 nt, hsa; identical to SEQ ID NO: 41307

SEQ ID NO: 203968 - RNA, 64 nt, hsa; identical to SEQ ID NO: 41308

SEQ ID NO: 203969 - RNA, 64 nt, hsa; identical to SEQ ID NO: 41309

SEQ ID NO: 203970 - RNA, 64 nt, hsa; identical to SEQ ID NO: 41310

SEQ ID NO: 203971 - RNA, 64 nt, hsa; identical to SEQ ID NO: 41311

SEQ ID NO: 203972 - RNA, 64 nt, hsa; identical to SEQ ID NO: 41312

SEQ ID NO: 203973 - RNA, 64 nt, hsa; identical to SEQ ID NO: 41313

SEQ ID NO: 203974 - RNA, 64 nt, hsa; identical to SEQ ID NO: 41314

SEQ ID NO: 203975 - RNA, 64 nt, hsa; identical to SEQ ID NO: 41315

SEQ ID NO: 203976 - RNA, 64 nt, hsa; identical to SEQ ID NO: 41316

SEQ ID NO: 203977 - RNA, 64 nt, hsa; identical to SEQ ID NO: 41317

SEQ ID NO: 203978 - RNA, 64 nt, hsa; identical to SEQ ID NO: 41318

SEQ ID NO: 203979 - RNA, 64 nt, hsa; identical to SEQ ID NO: 41319

SEQ ID NO: 203980 - RNA, 64 nt, hsa; identical to SEQ ID NO: 41320

SEQ ID NO: 203981 - RNA, 64 nt, hsa; identical to SEQ ID NO: 41321

SEQ ID NO: 203982 - RNA, 64 nt, hsa; identical to SEQ ID NO: 41322

SEQ ID NO: 203983 - RNA, 64 nt, hsa; identical to SEQ ID NO: 41323

SEQ ID NO: 203984 - RNA, 64 nt, hsa; identical to SEQ ID NO: 41324

SEQ ID NO: 203985 - RNA, 64 nt, hsa; identical to SEQ ID NO: 41325

SEQ ID NO: 203986 - RNA, 64 nt, hsa; identical to SEQ ID NO: 41326

SEQ ID NO: 203987 - RNA, 64 nt, hsa; identical to SEQ ID NO: 41327

SEQ ID NO: 203988 - RNA, 64 nt, hsa; identical to SEQ ID NO: 41328

SEQ ID NO: 203989 - RNA, 64 nt, hsa; identical to SEQ ID NO: 41329

SEQ ID NO: 203990 - RNA, 64 nt, hsa; identical to SEQ ID NO: 41330

SEQ ID NO: 203991 - RNA, 64 nt, hsa; identical to SEQ ID NO: 41331

SEQ ID NO: 203992 - RNA, 64 nt, hsa; identical to SEQ ID NO: 41332

SEQ ID NO: 203993 - RNA, 64 nt, hsa; identical to SEQ ID NO: 41333

SEQ ID NO: 203994 - RNA, 64 nt, hsa; identical to SEQ ID NO: 41334

SEQ ID NO: 203995 - RNA, 64 nt, hsa; identical to SEQ ID NO: 41335

SEQ ID NO: 203996 - RNA, 64 nt, hsa; identical to SEQ ID NO: 41336

SEQ ID NO: 203997 - RNA, 64 nt, hsa; identical to SEQ ID NO: 41337

SEQ ID NO: 203998 - RNA, 64 nt, hsa; identical to SEQ ID NO: 41338

SEQ ID NO: 203999 - RNA, 64 nt, hsa; identical to SEQ ID NO: 41339

SEQ ID NO: 204000 - RNA, 64 nt, hsa; identical to SEQ ID NO: 41340

SEQ ID NO: 204001 - RNA, 64 nt, hsa; identical to SEQ ID NO: 41341

SEQ ID NO: 204002 - RNA, 64 nt, hsa; identical to SEQ ID NO: 41342

SEQ ID NO: 204003 - RNA, 64 nt, hsa; identical to SEQ ID NO: 41343

SEQ ID NO: 204004 - RNA, 64 nt, hsa; identical to SEQ ID NO: 41344

SEQ ID NO: 204005 - RNA, 64 nt, hsa; identical to SEQ ID NO: 41345

SEQ ID NO: 204006 - RNA, 64 nt, hsa; identical to SEQ ID NO: 41346

SEQ ID NO: 204007 - RNA, 64 nt, hsa; identical to SEQ ID NO: 41347

SEQ ID NO: 204008 - RNA, 64 nt, hsa; identical to SEQ ID NO: 41348

SEQ ID NO: 204009 - RNA, 64 nt, hsa; identical to SEQ ID NO: 41349

SEQ ID NO: 204010 - RNA, 64 nt, hsa; identical to SEQ ID NO: 41350

SEQ ID NO: 204011 - RNA, 64 nt, hsa; identical to SEQ ID NO: 41351

SEQ ID NO: 204012 - RNA, 64 nt, hsa; identical to SEQ ID NO: 41352

SEQ ID NO: 204013 - RNA, 64 nt, hsa; identical to SEQ ID NO: 41353

SEQ ID NO: 204014 - RNA, 64 nt, hsa; identical to SEQ ID NO: 41354

SEQ ID NO: 204015 - RNA, 64 nt, hsa; identical to SEQ ID NO: 41355

SEQ ID NO: 204016 - RNA, 64 nt, hsa; identical to SEQ ID NO: 41356

SEQ ID NO: 204017 - RNA, 64 nt, hsa; identical to SEQ ID NO: 41357

SEQ ID NO: 204018 - RNA, 64 nt, hsa; identical to SEQ ID NO: 41358

SEQ ID NO: 204019 - RNA, 64 nt, hsa; identical to SEQ ID NO: 41359

SEQ ID NO: 204020 - RNA, 64 nt, hsa; identical to SEQ ID NO: 41360

SEQ ID NO: 204021 - RNA, 64 nt, hsa; identical to SEQ ID NO: 41361

SEQ ID NO: 204022 - RNA, 64 nt, hsa; identical to SEQ ID NO: 41362

SEQ ID NO: 204023 - RNA, 64 nt, hsa; identical to SEQ ID NO: 41363

SEQ ID NO: 204024 - RNA, 64 nt, hsa; identical to SEQ ID NO: 41364

SEQ ID NO: 204025 - RNA, 64 nt, hsa; identical to SEQ ID NO: 41365

SEQ ID NO: 204026 - RNA, 64 nt, hsa; identical to SEQ ID NO: 41366

SEQ ID NO: 204027 - RNA, 64 nt, hsa; identical to SEQ ID NO: 41367

SEQ ID NO: 204028 - RNA, 64 nt, hsa; identical to SEQ ID NO: 41368

SEQ ID NO: 204029 - RNA, 64 nt, hsa; identical to SEQ ID NO: 41369

SEQ ID NO: 204030 - RNA, 64 nt, hsa; identical to SEQ ID NO: 41370

SEQ ID NO: 204031 - RNA, 64 nt, hsa; identical to SEQ ID NO: 41371

SEQ ID NO: 204032 - RNA, 64 nt, hsa; identical to SEQ ID NO: 41372

SEQ ID NO: 204033 - RNA, 64 nt, hsa; identical to SEQ ID NO: 41373

SEQ ID NO: 204034 - RNA, 64 nt, hsa; identical to SEQ ID NO: 41374

SEQ ID NO: 204035 - RNA, 64 nt, hsa; identical to SEQ ID NO: 41375

SEQ ID NO: 204036 - RNA, 64 nt, hsa; identical to SEQ ID NO: 41376

SEQ ID NO: 204037 - RNA, 64 nt, hsa; identical to SEQ ID NO: 41377

SEQ ID NO: 204038 - RNA, 64 nt, hsa; identical to SEQ ID NO: 41378

SEQ ID NO: 204039 - RNA, 64 nt, hsa; identical to SEQ ID NO: 41379

SEQ ID NO: 204040 - RNA, 64 nt, hsa; identical to SEQ ID NO: 41380

SEQ ID NO: 204041 - RNA, 64 nt, hsa; identical to SEQ ID NO: 41381

SEQ ID NO: 204042 - RNA, 64 nt, hsa; identical to SEQ ID NO: 41382

SEQ ID NO: 204043 - RNA, 64 nt, hsa; identical to SEQ ID NO: 41383

SEQ ID NO: 204044 - RNA, 64 nt, hsa; identical to SEQ ID NO: 41384

SEQ ID NO: 204045 - RNA, 64 nt, hsa; identical to SEQ ID NO: 41385

SEQ ID NO: 204046 - RNA, 64 nt, hsa; identical to SEQ ID NO: 41386

SEQ ID NO: 204047 - RNA, 64 nt, hsa; identical to SEQ ID NO: 41387

SEQ ID NO: 204048 - RNA, 64 nt, hsa; identical to SEQ ID NO: 41388

SEQ ID NO: 204049 - RNA, 64 nt, hsa; identical to SEQ ID NO: 41389

SEQ ID NO: 204050 - RNA, 64 nt, hsa; identical to SEQ ID NO: 41390

SEQ ID NO: 204051 - RNA, 64 nt, hsa; identical to SEQ ID NO: 41391

SEQ ID NO: 204052 - RNA, 64 nt, hsa; identical to SEQ ID NO: 41392

SEQ ID NO: 204053 - RNA, 64 nt, hsa; identical to SEQ ID NO: 41393

SEQ ID NO: 204054 - RNA, 64 nt, hsa; identical to SEQ ID NO: 41394

SEQ ID NO: 204055 - RNA, 64 nt, hsa; identical to SEQ ID NO: 41395

SEQ ID NO: 204056 - RNA, 64 nt, hsa; identical to SEQ ID NO: 41396

SEQ ID NO: 204057 - RNA, 64 nt, hsa; identical to SEQ ID NO: 41397

SEQ ID NO: 204058 - RNA, 64 nt, hsa; identical to SEQ ID NO: 41398

SEQ ID NO: 204059 - RNA, 64 nt, hsa; identical to SEQ ID NO: 41399

SEQ ID NO: 204060 - RNA, 64 nt, hsa; identical to SEQ ID NO: 41400

SEQ ID NO: 204061 - RNA, 64 nt, hsa; identical to SEQ ID NO: 41401

SEQ ID NO: 204062 - RNA, 64 nt, hsa; identical to SEQ ID NO: 41402

SEQ ID NO: 204063 - RNA, 64 nt, hsa; identical to SEQ ID NO: 41403

SEQ ID NO: 204064 - RNA, 64 nt, hsa; identical to SEQ ID NO: 41404

SEQ ID NO: 204065 - RNA, 64 nt, hsa; identical to SEQ ID NO: 41405

SEQ ID NO: 204066 - RNA, 64 nt, hsa; identical to SEQ ID NO: 41406

SEQ ID NO: 204067 - RNA, 64 nt, hsa; identical to SEQ ID NO: 41407

SEQ ID NO: 204068 - RNA, 64 nt, hsa; identical to SEQ ID NO: 41408

SEQ ID NO: 204069 - RNA, 64 nt, hsa; identical to SEQ ID NO: 41409

SEQ ID NO: 204070 - RNA, 64 nt, hsa; identical to SEQ ID NO: 41410

SEQ ID NO: 204071 - RNA, 64 nt, hsa; identical to SEQ ID NO: 41411

SEQ ID NO: 204072 - RNA, 64 nt, hsa; identical to SEQ ID NO: 41412

SEQ ID NO: 204073 - RNA, 64 nt, hsa; identical to SEQ ID NO: 41413

SEQ ID NO: 204074 - RNA, 64 nt, hsa; identical to SEQ ID NO: 41414

SEQ ID NO: 204075 - RNA, 64 nt, hsa; identical to SEQ ID NO: 41415

SEQ ID NO: 204076 - RNA, 64 nt, hsa; identical to SEQ ID NO: 41416

SEQ ID NO: 204077 - RNA, 64 nt, hsa; identical to SEQ ID NO: 41417

SEQ ID NO: 204078 - RNA, 64 nt, hsa; identical to SEQ ID NO: 41418

SEQ ID NO: 204079 - RNA, 64 nt, hsa; identical to SEQ ID NO: 41419

SEQ ID NO: 204080 - RNA, 64 nt, hsa; identical to SEQ ID NO: 41420

SEQ ID NO: 204081 - RNA, 64 nt, hsa; identical to SEQ ID NO: 41421

SEQ ID NO: 204082 - RNA, 64 nt, hsa; identical to SEQ ID NO: 41422

SEQ ID NO: 204083 - RNA, 64 nt, hsa; identical to SEQ ID NO: 41423

SEQ ID NO: 204084 - RNA, 64 nt, hsa; identical to SEQ ID NO: 41424

SEQ ID NO: 204085 - RNA, 64 nt, hsa; identical to SEQ ID NO: 41425

SEQ ID NO: 204086 - RNA, 64 nt, hsa; identical to SEQ ID NO: 41426

SEQ ID NO: 204087 - RNA, 64 nt, hsa; identical to SEQ ID NO: 41427

SEQ ID NO: 204088 - RNA, 64 nt, hsa; identical to SEQ ID NO: 41428

SEQ ID NO: 204089 - RNA, 64 nt, hsa; identical to SEQ ID NO: 41429

SEQ ID NO: 204090 - RNA, 64 nt, hsa; identical to SEQ ID NO: 41430

SEQ ID NO: 204091 - RNA, 64 nt, hsa; identical to SEQ ID NO: 41431

SEQ ID NO: 204092 - RNA, 64 nt, hsa; identical to SEQ ID NO: 41432

SEQ ID NO: 204093 - RNA, 64 nt, hsa; identical to SEQ ID NO: 41433

SEQ ID NO: 204094 - RNA, 64 nt, hsa; identical to SEQ ID NO: 41434

SEQ ID NO: 204095 - RNA, 64 nt, hsa; identical to SEQ ID NO: 41435

SEQ ID NO: 204096 - RNA, 64 nt, hsa; identical to SEQ ID NO: 41436

SEQ ID NO: 204097 - RNA, 64 nt, hsa; identical to SEQ ID NO: 41437

SEQ ID NO: 204098 - RNA, 64 nt, hsa; identical to SEQ ID NO: 41438

SEQ ID NO: 204099 - RNA, 64 nt, hsa; identical to SEQ ID NO: 41439

SEQ ID NO: 204100 - RNA, 64 nt, hsa; identical to SEQ ID NO: 41440

SEQ ID NO: 204101 - RNA, 64 nt, hsa; identical to SEQ ID NO: 41441

SEQ ID NO: 204102 - RNA, 64 nt, hsa; identical to SEQ ID NO: 41442

SEQ ID NO: 204103 - RNA, 64 nt, hsa; identical to SEQ ID NO: 41443

SEQ ID NO: 204104 - RNA, 64 nt, hsa; identical to SEQ ID NO: 41444

SEQ ID NO: 204105 - RNA, 64 nt, hsa; identical to SEQ ID NO: 41445

SEQ ID NO: 204106 - RNA, 64 nt, hsa; identical to SEQ ID NO: 41446

SEQ ID NO: 204107 - RNA, 64 nt, hsa; identical to SEQ ID NO: 41447

SEQ ID NO: 204108 - RNA, 64 nt, hsa; identical to SEQ ID NO: 41448

SEQ ID NO: 204109 - RNA, 64 nt, hsa; identical to SEQ ID NO: 41449

SEQ ID NO: 204110 - RNA, 64 nt, hsa; identical to SEQ ID NO: 41450

SEQ ID NO: 204111 - RNA, 64 nt, hsa; identical to SEQ ID NO: 41451

SEQ ID NO: 204112 - RNA, 64 nt, hsa; identical to SEQ ID NO: 41452

SEQ ID NO: 204113 - RNA, 64 nt, hsa; identical to SEQ ID NO: 41453

SEQ ID NO: 204114 - RNA, 64 nt, hsa; identical to SEQ ID NO: 41454

SEQ ID NO: 204115 - RNA, 64 nt, hsa; identical to SEQ ID NO: 41455

SEQ ID NO: 204116 - RNA, 64 nt, hsa; identical to SEQ ID NO: 41456

SEQ ID NO: 204117 - RNA, 64 nt, hsa; identical to SEQ ID NO: 41457

SEQ ID NO: 204118 - RNA, 64 nt, hsa; identical to SEQ ID NO: 41458

SEQ ID NO: 204119 - RNA, 64 nt, hsa; identical to SEQ ID NO: 41459

SEQ ID NO: 204120 - RNA, 64 nt, hsa; identical to SEQ ID NO: 41460

SEQ ID NO: 204121 - RNA, 64 nt, hsa; identical to SEQ ID NO: 41461

SEQ ID NO: 204122 - RNA, 64 nt, hsa; identical to SEQ ID NO: 41462

SEQ ID NO: 204123 - RNA, 64 nt, hsa; identical to SEQ ID NO: 41463

SEQ ID NO: 204124 - RNA, 64 nt, hsa; identical to SEQ ID NO: 41464

SEQ ID NO: 204125 - RNA, 64 nt, hsa; identical to SEQ ID NO: 41465

SEQ ID NO: 204126 - RNA, 64 nt, hsa; identical to SEQ ID NO: 41466

SEQ ID NO: 204127 - RNA, 64 nt, hsa; identical to SEQ ID NO: 41467

SEQ ID NO: 204128 - RNA, 64 nt, hsa; identical to SEQ ID NO: 41468

SEQ ID NO: 204129 - RNA, 64 nt, hsa; identical to SEQ ID NO: 41469

SEQ ID NO: 204130 - RNA, 64 nt, hsa; identical to SEQ ID NO: 41470

SEQ ID NO: 204131 - RNA, 64 nt, hsa; identical to SEQ ID NO: 41471

SEQ ID NO: 204132 - RNA, 64 nt, hsa; identical to SEQ ID NO: 41472

SEQ ID NO: 204133 - RNA, 64 nt, hsa; identical to SEQ ID NO: 41473

SEQ ID NO: 204134 - RNA, 64 nt, hsa; identical to SEQ ID NO: 41474

SEQ ID NO: 204135 - RNA, 64 nt, hsa; identical to SEQ ID NO: 41475

SEQ ID NO: 204136 - RNA, 64 nt, hsa; identical to SEQ ID NO: 41476

SEQ ID NO: 204137 - RNA, 64 nt, hsa; identical to SEQ ID NO: 41477

SEQ ID NO: 204138 - RNA, 64 nt, hsa; identical to SEQ ID NO: 41478

SEQ ID NO: 204139 - RNA, 64 nt, hsa; identical to SEQ ID NO: 41479

SEQ ID NO: 204140 - RNA, 64 nt, hsa; identical to SEQ ID NO: 41480

SEQ ID NO: 204141 - RNA, 64 nt, hsa; identical to SEQ ID NO: 41481

SEQ ID NO: 204142 - RNA, 64 nt, hsa; identical to SEQ ID NO: 41482

SEQ ID NO: 204143 - RNA, 64 nt, hsa; identical to SEQ ID NO: 41483

SEQ ID NO: 204144 - RNA, 64 nt, hsa; identical to SEQ ID NO: 41484

SEQ ID NO: 204145 - RNA, 64 nt, hsa; identical to SEQ ID NO: 41485

SEQ ID NO: 204146 - RNA, 64 nt, hsa; identical to SEQ ID NO: 41486

SEQ ID NO: 204147 - RNA, 64 nt, hsa; identical to SEQ ID NO: 41487

SEQ ID NO: 204148 - RNA, 64 nt, hsa; identical to SEQ ID NO: 41488

SEQ ID NO: 204149 - RNA, 64 nt, hsa; identical to SEQ ID NO: 41489

SEQ ID NO: 204150 - RNA, 64 nt, hsa; identical to SEQ ID NO: 41490

SEQ ID NO: 204151 - RNA, 64 nt, hsa; identical to SEQ ID NO: 41491

SEQ ID NO: 204152 - RNA, 64 nt, hsa; identical to SEQ ID NO: 41492

SEQ ID NO: 204153 - RNA, 64 nt, hsa; identical to SEQ ID NO: 41493

SEQ ID NO: 204154 - RNA, 64 nt, hsa; identical to SEQ ID NO: 41494

SEQ ID NO: 204155 - RNA, 64 nt, hsa; identical to SEQ ID NO: 41495

SEQ ID NO: 204156 - RNA, 64 nt, hsa; identical to SEQ ID NO: 41496

SEQ ID NO: 204157 - RNA, 64 nt, hsa; identical to SEQ ID NO: 41497

SEQ ID NO: 204158 - RNA, 64 nt, hsa; identical to SEQ ID NO: 41498

SEQ ID NO: 204159 - RNA, 64 nt, hsa; identical to SEQ ID NO: 41499

SEQ ID NO: 204160 - RNA, 64 nt, hsa; identical to SEQ ID NO: 41500

SEQ ID NO: 204161 - RNA, 64 nt, hsa; identical to SEQ ID NO: 41501

SEQ ID NO: 204162 - RNA, 64 nt, hsa; identical to SEQ ID NO: 41502

SEQ ID NO: 204163 - RNA, 64 nt, hsa; identical to SEQ ID NO: 41503

SEQ ID NO: 204164 - RNA, 64 nt, hsa; identical to SEQ ID NO: 41504

SEQ ID NO: 204165 - RNA, 64 nt, hsa; identical to SEQ ID NO: 41505

SEQ ID NO: 204166 - RNA, 64 nt, hsa; identical to SEQ ID NO: 41506

SEQ ID NO: 204167 - RNA, 64 nt, hsa; identical to SEQ ID NO: 41507

SEQ ID NO: 204168 - RNA, 64 nt, hsa; identical to SEQ ID NO: 41508

SEQ ID NO: 204169 - RNA, 64 nt, hsa; identical to SEQ ID NO: 41509

SEQ ID NO: 204170 - RNA, 64 nt, hsa; identical to SEQ ID NO: 41510

SEQ ID NO: 204171 - RNA, 64 nt, hsa; identical to SEQ ID NO: 41511

SEQ ID NO: 204172 - RNA, 64 nt, hsa; identical to SEQ ID NO: 41512

SEQ ID NO: 204173 - RNA, 64 nt, hsa; identical to SEQ ID NO: 41513

SEQ ID NO: 204174 - RNA, 64 nt, hsa; identical to SEQ ID NO: 41514

SEQ ID NO: 204175 - RNA, 64 nt, hsa; identical to SEQ ID NO: 41515

SEQ ID NO: 204176 - RNA, 64 nt, hsa; identical to SEQ ID NO: 41516

SEQ ID NO: 204177 - RNA, 64 nt, hsa; identical to SEQ ID NO: 41517

SEQ ID NO: 204178 - RNA, 64 nt, hsa; identical to SEQ ID NO: 41518

SEQ ID NO: 204179 - RNA, 64 nt, hsa; identical to SEQ ID NO: 41519

SEQ ID NO: 204180 - RNA, 64 nt, hsa; identical to SEQ ID NO: 41520

SEQ ID NO: 204181 - RNA, 64 nt, hsa; identical to SEQ ID NO: 41521

SEQ ID NO: 204182 - RNA, 64 nt, hsa; identical to SEQ ID NO: 41522

SEQ ID NO: 204183 - RNA, 64 nt, hsa; identical to SEQ ID NO: 41523

SEQ ID NO: 204184 - RNA, 64 nt, hsa; identical to SEQ ID NO: 41524

SEQ ID NO: 204185 - RNA, 64 nt, hsa; identical to SEQ ID NO: 41525

SEQ ID NO: 204186 - RNA, 64 nt, hsa; identical to SEQ ID NO: 41526

SEQ ID NO: 204187 - RNA, 64 nt, hsa; identical to SEQ ID NO: 41527

SEQ ID NO: 204188 - RNA, 64 nt, hsa; identical to SEQ ID NO: 41528

SEQ ID NO: 204189 - RNA, 64 nt, hsa; identical to SEQ ID NO: 41529

SEQ ID NO: 204190 - RNA, 64 nt, hsa; identical to SEQ ID NO: 41530

SEQ ID NO: 204191 - RNA, 64 nt, hsa; identical to SEQ ID NO: 41531

SEQ ID NO: 204192 - RNA, 64 nt, hsa; identical to SEQ ID NO: 41532

SEQ ID NO: 204193 - RNA, 64 nt, hsa; identical to SEQ ID NO: 41533

SEQ ID NO: 204194 - RNA, 64 nt, hsa; identical to SEQ ID NO: 41534

SEQ ID NO: 204195 - RNA, 64 nt, hsa; identical to SEQ ID NO: 41535

SEQ ID NO: 204196 - RNA, 64 nt, hsa; identical to SEQ ID NO: 41536

SEQ ID NO: 204197 - RNA, 64 nt, hsa; identical to SEQ ID NO: 41537

SEQ ID NO: 204198 - RNA, 64 nt, hsa; identical to SEQ ID NO: 41538

SEQ ID NO: 204199 - RNA, 64 nt, hsa; identical to SEQ ID NO: 41539

SEQ ID NO: 204200 - RNA, 64 nt, hsa; identical to SEQ ID NO: 41540

SEQ ID NO: 204201 - RNA, 64 nt, hsa; identical to SEQ ID NO: 41541

SEQ ID NO: 204202 - RNA, 64 nt, hsa; identical to SEQ ID NO: 41542

SEQ ID NO: 204203 - RNA, 64 nt, hsa; identical to SEQ ID NO: 41543

SEQ ID NO: 204204 - RNA, 64 nt, hsa; identical to SEQ ID NO: 41544

SEQ ID NO: 204205 - RNA, 64 nt, hsa; identical to SEQ ID NO: 41545

SEQ ID NO: 204206 - RNA, 64 nt, hsa; identical to SEQ ID NO: 41546

SEQ ID NO: 204207 - RNA, 64 nt, hsa; identical to SEQ ID NO: 41547

SEQ ID NO: 204208 - RNA, 64 nt, hsa; identical to SEQ ID NO: 41548

SEQ ID NO: 204209 - RNA, 64 nt, hsa; identical to SEQ ID NO: 41549

SEQ ID NO: 204210 - RNA, 64 nt, hsa; identical to SEQ ID NO: 41550

SEQ ID NO: 204211 - RNA, 64 nt, hsa; identical to SEQ ID NO: 41551

SEQ ID NO: 204212 - RNA, 64 nt, hsa; identical to SEQ ID NO: 41552

SEQ ID NO: 204213 - RNA, 64 nt, hsa; identical to SEQ ID NO: 41553

SEQ ID NO: 204214 - RNA, 64 nt, hsa; identical to SEQ ID NO: 41554

SEQ ID NO: 204215 - RNA, 64 nt, hsa; identical to SEQ ID NO: 41555

SEQ ID NO: 204216 - RNA, 64 nt, hsa; identical to SEQ ID NO: 41556

SEQ ID NO: 204217 - RNA, 64 nt, hsa; identical to SEQ ID NO: 41557

SEQ ID NO: 204218 - RNA, 64 nt, hsa; identical to SEQ ID NO: 41558

SEQ ID NO: 204219 - RNA, 64 nt, hsa; identical to SEQ ID NO: 41559

SEQ ID NO: 204220 - RNA, 64 nt, hsa; identical to SEQ ID NO: 41560

SEQ ID NO: 204221 - RNA, 64 nt, hsa; identical to SEQ ID NO: 41561

SEQ ID NO: 204222 - RNA, 64 nt, hsa; identical to SEQ ID NO: 41562

SEQ ID NO: 204223 - RNA, 64 nt, hsa; identical to SEQ ID NO: 41563

SEQ ID NO: 204224 - RNA, 64 nt, hsa; identical to SEQ ID NO: 41564

SEQ ID NO: 204225 - RNA, 64 nt, hsa; identical to SEQ ID NO: 41565

SEQ ID NO: 204226 - RNA, 64 nt, hsa; identical to SEQ ID NO: 41566

SEQ ID NO: 204227 - RNA, 64 nt, hsa; identical to SEQ ID NO: 41567

SEQ ID NO: 204228 - RNA, 64 nt, hsa; identical to SEQ ID NO: 41568

SEQ ID NO: 204229 - RNA, 64 nt, hsa; identical to SEQ ID NO: 41569

SEQ ID NO: 204230 - RNA, 64 nt, hsa; identical to SEQ ID NO: 41570

SEQ ID NO: 204231 - RNA, 64 nt, hsa; identical to SEQ ID NO: 41571

SEQ ID NO: 204232 - RNA, 64 nt, hsa; identical to SEQ ID NO: 41572

SEQ ID NO: 204233 - RNA, 64 nt, hsa; identical to SEQ ID NO: 41573

SEQ ID NO: 204234 - RNA, 64 nt, hsa; identical to SEQ ID NO: 41574

SEQ ID NO: 204235 - RNA, 64 nt, hsa; identical to SEQ ID NO: 41575

SEQ ID NO: 204236 - RNA, 64 nt, hsa; identical to SEQ ID NO: 41576

SEQ ID NO: 204237 - RNA, 64 nt, hsa; identical to SEQ ID NO: 41577

SEQ ID NO: 204238 - RNA, 64 nt, hsa; identical to SEQ ID NO: 41578

SEQ ID NO: 204239 - RNA, 64 nt, hsa; identical to SEQ ID NO: 41579

SEQ ID NO: 204240 - RNA, 64 nt, hsa; identical to SEQ ID NO: 41580

SEQ ID NO: 204241 - RNA, 64 nt, hsa; identical to SEQ ID NO: 41581

SEQ ID NO: 204242 - RNA, 64 nt, hsa; identical to SEQ ID NO: 41582

SEQ ID NO: 204243 - RNA, 64 nt, hsa; identical to SEQ ID NO: 41583

SEQ ID NO: 204244 - RNA, 64 nt, hsa; identical to SEQ ID NO: 41584

SEQ ID NO: 204245 - RNA, 64 nt, hsa; identical to SEQ ID NO: 41585

SEQ ID NO: 204246 - RNA, 64 nt, hsa; identical to SEQ ID NO: 41586

SEQ ID NO: 204247 - RNA, 64 nt, hsa; identical to SEQ ID NO: 41587

SEQ ID NO: 204248 - RNA, 64 nt, hsa; identical to SEQ ID NO: 41588

SEQ ID NO: 204249 - RNA, 64 nt, hsa; identical to SEQ ID NO: 41589

SEQ ID NO: 204250 - RNA, 64 nt, hsa; identical to SEQ ID NO: 41590

SEQ ID NO: 204251 - RNA, 64 nt, hsa; identical to SEQ ID NO: 41591

SEQ ID NO: 204252 - RNA, 64 nt, hsa; identical to SEQ ID NO: 41592

SEQ ID NO: 204253 - RNA, 64 nt, hsa; identical to SEQ ID NO: 41593

SEQ ID NO: 204254 - RNA, 64 nt, hsa; identical to SEQ ID NO: 41594

SEQ ID NO: 204255 - RNA, 64 nt, hsa; identical to SEQ ID NO: 41595

SEQ ID NO: 204256 - RNA, 64 nt, hsa; identical to SEQ ID NO: 41596

SEQ ID NO: 204257 - RNA, 64 nt, hsa; identical to SEQ ID NO: 41597

SEQ ID NO: 204258 - RNA, 64 nt, hsa; identical to SEQ ID NO: 41598

SEQ ID NO: 204259 - RNA, 64 nt, hsa; identical to SEQ ID NO: 41599

SEQ ID NO: 204260 - RNA, 64 nt, hsa; identical to SEQ ID NO: 41600

SEQ ID NO: 204261 - RNA, 64 nt, hsa; identical to SEQ ID NO: 41601

SEQ ID NO: 204262 - RNA, 64 nt, hsa; identical to SEQ ID NO: 41602

SEQ ID NO: 204263 - RNA, 64 nt, hsa; identical to SEQ ID NO: 41603

SEQ ID NO: 204264 - RNA, 64 nt, hsa; identical to SEQ ID NO: 41604

SEQ ID NO: 204265 - RNA, 64 nt, hsa; identical to SEQ ID NO: 41605

SEQ ID NO: 204266 - RNA, 64 nt, hsa; identical to SEQ ID NO: 41606

SEQ ID NO: 204267 - RNA, 64 nt, hsa; identical to SEQ ID NO: 41607

SEQ ID NO: 204268 - RNA, 64 nt, hsa; identical to SEQ ID NO: 41608

SEQ ID NO: 204269 - RNA, 64 nt, hsa; identical to SEQ ID NO: 41609

SEQ ID NO: 204270 - RNA, 64 nt, hsa; identical to SEQ ID NO: 41610

SEQ ID NO: 204271 - RNA, 64 nt, hsa; identical to SEQ ID NO: 41611

SEQ ID NO: 204272 - RNA, 64 nt, hsa; identical to SEQ ID NO: 41612

SEQ ID NO: 204273 - RNA, 64 nt, hsa; identical to SEQ ID NO: 41613

SEQ ID NO: 204274 - RNA, 64 nt, hsa; identical to SEQ ID NO: 41614

SEQ ID NO: 204275 - RNA, 64 nt, hsa; identical to SEQ ID NO: 41615

SEQ ID NO: 204276 - RNA, 64 nt, hsa; identical to SEQ ID NO: 41616

SEQ ID NO: 204277 - RNA, 64 nt, hsa; identical to SEQ ID NO: 41617

SEQ ID NO: 204278 - RNA, 64 nt, hsa; identical to SEQ ID NO: 41618

SEQ ID NO: 204279 - RNA, 64 nt, hsa; identical to SEQ ID NO: 41619

SEQ ID NO: 204280 - RNA, 64 nt, hsa; identical to SEQ ID NO: 41620

SEQ ID NO: 204281 - RNA, 64 nt, hsa; identical to SEQ ID NO: 41621

SEQ ID NO: 204282 - RNA, 63 nt, hsa; identical to SEQ ID NO: 41622

SEQ ID NO: 204283 - RNA, 64 nt, hsa; identical to SEQ ID NO: 41623

SEQ ID NO: 204284 - RNA, 64 nt, hsa; identical to SEQ ID NO: 41624

SEQ ID NO: 204285 - RNA, 64 nt, hsa; identical to SEQ ID NO: 41625

SEQ ID NO: 204286 - RNA, 64 nt, hsa; identical to SEQ ID NO: 41626

SEQ ID NO: 204287 - RNA, 64 nt, hsa; identical to SEQ ID NO: 41627

SEQ ID NO: 204288 - RNA, 64 nt, hsa; identical to SEQ ID NO: 41628

SEQ ID NO: 204289 - RNA, 64 nt, hsa; identical to SEQ ID NO: 41629

SEQ ID NO: 204290 - RNA, 64 nt, hsa; identical to SEQ ID NO: 41630

SEQ ID NO: 204291 - RNA, 64 nt, hsa; identical to SEQ ID NO: 41631

SEQ ID NO: 204292 - RNA, 64 nt, hsa; identical to SEQ ID NO: 41632

SEQ ID NO: 204293 - RNA, 64 nt, hsa; identical to SEQ ID NO: 41633

SEQ ID NO: 204294 - RNA, 64 nt, hsa; identical to SEQ ID NO: 41634

SEQ ID NO: 204295 - RNA, 64 nt, hsa; identical to SEQ ID NO: 41635

SEQ ID NO: 204296 - RNA, 64 nt, hsa; identical to SEQ ID NO: 41636

SEQ ID NO: 204297 - RNA, 64 nt, hsa; identical to SEQ ID NO: 41637

SEQ ID NO: 204298 - RNA, 64 nt, hsa; identical to SEQ ID NO: 41638

SEQ ID NO: 204299 - RNA, 64 nt, hsa; identical to SEQ ID NO: 41639

SEQ ID NO: 204300 - RNA, 64 nt, hsa; identical to SEQ ID NO: 41640

SEQ ID NO: 204301 - RNA, 64 nt, hsa; identical to SEQ ID NO: 41641

SEQ ID NO: 204302 - RNA, 64 nt, hsa; identical to SEQ ID NO: 41642

SEQ ID NO: 204303 - RNA, 64 nt, hsa; identical to SEQ ID NO: 41643

SEQ ID NO: 204304 - RNA, 64 nt, hsa; identical to SEQ ID NO: 41644

SEQ ID NO: 204305 - RNA, 64 nt, hsa; identical to SEQ ID NO: 41645

SEQ ID NO: 204306 - RNA, 64 nt, hsa; identical to SEQ ID NO: 41646

SEQ ID NO: 204307 - RNA, 64 nt, hsa; identical to SEQ ID NO: 41647

SEQ ID NO: 204308 - RNA, 64 nt, hsa; identical to SEQ ID NO: 41648

SEQ ID NO: 204309 - RNA, 64 nt, hsa; identical to SEQ ID NO: 41649

SEQ ID NO: 204310 - RNA, 64 nt, hsa; identical to SEQ ID NO: 41650

SEQ ID NO: 204311 - RNA, 64 nt, hsa; identical to SEQ ID NO: 41651

SEQ ID NO: 204312 - RNA, 64 nt, hsa; identical to SEQ ID NO: 41652

SEQ ID NO: 204313 - RNA, 64 nt, hsa; identical to SEQ ID NO: 41653

SEQ ID NO: 204314 - RNA, 64 nt, hsa; identical to SEQ ID NO: 41654

SEQ ID NO: 204315 - RNA, 64 nt, hsa; identical to SEQ ID NO: 41655

SEQ ID NO: 204316 - RNA, 64 nt, hsa; identical to SEQ ID NO: 41656

SEQ ID NO: 204317 - RNA, 64 nt, hsa; identical to SEQ ID NO: 41657

SEQ ID NO: 204318 - RNA, 64 nt, hsa; identical to SEQ ID NO: 41658

SEQ ID NO: 204319 - RNA, 64 nt, hsa; identical to SEQ ID NO: 41659

SEQ ID NO: 204320 - RNA, 64 nt, hsa; identical to SEQ ID NO: 41660

SEQ ID NO: 204321 - RNA, 64 nt, hsa; identical to SEQ ID NO: 41661

SEQ ID NO: 204322 - RNA, 64 nt, hsa; identical to SEQ ID NO: 41662

SEQ ID NO: 204323 - RNA, 64 nt, hsa; identical to SEQ ID NO: 41663

SEQ ID NO: 204324 - RNA, 64 nt, hsa; identical to SEQ ID NO: 41664

SEQ ID NO: 204325 - RNA, 64 nt, hsa; identical to SEQ ID NO: 41665

SEQ ID NO: 204326 - RNA, 64 nt, hsa; identical to SEQ ID NO: 41666

SEQ ID NO: 204327 - RNA, 64 nt, hsa; identical to SEQ ID NO: 41667

SEQ ID NO: 204328 - RNA, 64 nt, hsa; identical to SEQ ID NO: 41668

SEQ ID NO: 204329 - RNA, 64 nt, hsa; identical to SEQ ID NO: 41669

SEQ ID NO: 204330 - RNA, 64 nt, hsa; identical to SEQ ID NO: 41670

SEQ ID NO: 204331 - RNA, 64 nt, hsa; identical to SEQ ID NO: 41671

SEQ ID NO: 204332 - RNA, 64 nt, hsa; identical to SEQ ID NO: 41672

SEQ ID NO: 204333 - RNA, 64 nt, hsa; identical to SEQ ID NO: 41673

SEQ ID NO: 204334 - RNA, 64 nt, hsa; identical to SEQ ID NO: 41674

SEQ ID NO: 204335 - RNA, 64 nt, hsa; identical to SEQ ID NO: 41675

SEQ ID NO: 204336 - RNA, 64 nt, hsa; identical to SEQ ID NO: 41676

SEQ ID NO: 204337 - RNA, 64 nt, hsa; identical to SEQ ID NO: 41677

SEQ ID NO: 204338 - RNA, 64 nt, hsa; identical to SEQ ID NO: 41678

SEQ ID NO: 204339 - RNA, 64 nt, hsa; identical to SEQ ID NO: 41679

SEQ ID NO: 204340 - RNA, 64 nt, hsa; identical to SEQ ID NO: 41680

SEQ ID NO: 204341 - RNA, 64 nt, hsa; identical to SEQ ID NO: 41681

SEQ ID NO: 204342 - RNA, 64 nt, hsa; identical to SEQ ID NO: 41682

SEQ ID NO: 204343 - RNA, 64 nt, hsa; identical to SEQ ID NO: 41683

SEQ ID NO: 204344 - RNA, 64 nt, hsa; identical to SEQ ID NO: 41684

SEQ ID NO: 204345 - RNA, 64 nt, hsa; identical to SEQ ID NO: 41685

SEQ ID NO: 204346 - RNA, 64 nt, hsa; identical to SEQ ID NO: 41686

SEQ ID NO: 204347 - RNA, 64 nt, hsa; identical to SEQ ID NO: 41687

SEQ ID NO: 204348 - RNA, 64 nt, hsa; identical to SEQ ID NO: 41688

SEQ ID NO: 204349 - RNA, 64 nt, hsa; identical to SEQ ID NO: 41689

SEQ ID NO: 204350 - RNA, 64 nt, hsa; identical to SEQ ID NO: 41690

SEQ ID NO: 204351 - RNA, 64 nt, hsa; identical to SEQ ID NO: 41691

SEQ ID NO: 204352 - RNA, 64 nt, hsa; identical to SEQ ID NO: 41692

SEQ ID NO: 204353 - RNA, 64 nt, hsa; identical to SEQ ID NO: 41693

SEQ ID NO: 204354 - RNA, 64 nt, hsa; identical to SEQ ID NO: 41694

SEQ ID NO: 204355 - RNA, 64 nt, hsa; identical to SEQ ID NO: 41695

SEQ ID NO: 204356 - RNA, 64 nt, hsa; identical to SEQ ID NO: 41696

SEQ ID NO: 204357 - RNA, 64 nt, hsa; identical to SEQ ID NO: 41697

SEQ ID NO: 204358 - RNA, 64 nt, hsa; identical to SEQ ID NO: 41698

SEQ ID NO: 204359 - RNA, 64 nt, hsa; identical to SEQ ID NO: 41699

SEQ ID NO: 204360 - RNA, 64 nt, hsa; identical to SEQ ID NO: 41700

SEQ ID NO: 204361 - RNA, 64 nt, hsa; identical to SEQ ID NO: 41701

SEQ ID NO: 204362 - RNA, 64 nt, hsa; identical to SEQ ID NO: 41702

SEQ ID NO: 204363 - RNA, 64 nt, hsa; identical to SEQ ID NO: 41703

SEQ ID NO: 204364 - RNA, 64 nt, hsa; identical to SEQ ID NO: 41704

SEQ ID NO: 204365 - RNA, 64 nt, hsa; identical to SEQ ID NO: 41705

SEQ ID NO: 204366 - RNA, 64 nt, hsa; identical to SEQ ID NO: 41706

SEQ ID NO: 204367 - RNA, 64 nt, hsa; identical to SEQ ID NO: 41707

SEQ ID NO: 204368 - RNA, 64 nt, hsa; identical to SEQ ID NO: 41708

SEQ ID NO: 204369 - RNA, 64 nt, hsa; identical to SEQ ID NO: 41709

SEQ ID NO: 204370 - RNA, 64 nt, hsa; identical to SEQ ID NO: 41710

SEQ ID NO: 204371 - RNA, 64 nt, hsa; identical to SEQ ID NO: 41711

SEQ ID NO: 204372 - RNA, 64 nt, hsa; identical to SEQ ID NO: 41712

SEQ ID NO: 204373 - RNA, 64 nt, hsa; identical to SEQ ID NO: 41713

SEQ ID NO: 204374 - RNA, 64 nt, hsa; identical to SEQ ID NO: 41714

SEQ ID NO: 204375 - RNA, 64 nt, hsa; identical to SEQ ID NO: 41715

SEQ ID NO: 204376 - RNA, 64 nt, hsa; identical to SEQ ID NO: 41716

SEQ ID NO: 204377 - RNA, 64 nt, hsa; identical to SEQ ID NO: 41717

SEQ ID NO: 204378 - RNA, 64 nt, hsa; identical to SEQ ID NO: 41718

SEQ ID NO: 204379 - RNA, 64 nt, hsa; identical to SEQ ID NO: 41719

SEQ ID NO: 204380 - RNA, 64 nt, hsa; identical to SEQ ID NO: 41720

SEQ ID NO: 204381 - RNA, 64 nt, hsa; identical to SEQ ID NO: 41721

SEQ ID NO: 204382 - RNA, 64 nt, hsa; identical to SEQ ID NO: 41722

SEQ ID NO: 204383 - RNA, 64 nt, hsa; identical to SEQ ID NO: 41723

SEQ ID NO: 204384 - RNA, 64 nt, hsa; identical to SEQ ID NO: 41724

SEQ ID NO: 204385 - RNA, 64 nt, hsa; identical to SEQ ID NO: 41725

SEQ ID NO: 204386 - RNA, 64 nt, hsa; identical to SEQ ID NO: 41726

SEQ ID NO: 204387 - RNA, 64 nt, hsa; identical to SEQ ID NO: 41727

SEQ ID NO: 204388 - RNA, 64 nt, hsa; identical to SEQ ID NO: 41728

SEQ ID NO: 204389 - RNA, 64 nt, hsa; identical to SEQ ID NO: 41729

SEQ ID NO: 204390 - RNA, 64 nt, hsa; identical to SEQ ID NO: 41730

SEQ ID NO: 204391 - RNA, 64 nt, hsa; identical to SEQ ID NO: 41731

SEQ ID NO: 204392 - RNA, 64 nt, hsa; identical to SEQ ID NO: 41732

SEQ ID NO: 204393 - RNA, 64 nt, hsa; identical to SEQ ID NO: 41733

SEQ ID NO: 204394 - RNA, 64 nt, hsa; identical to SEQ ID NO: 41734

SEQ ID NO: 204395 - RNA, 64 nt, hsa; identical to SEQ ID NO: 41735

SEQ ID NO: 204396 - RNA, 64 nt, hsa; identical to SEQ ID NO: 41736

SEQ ID NO: 204397 - RNA, 64 nt, hsa; identical to SEQ ID NO: 41737

SEQ ID NO: 204398 - RNA, 64 nt, hsa; identical to SEQ ID NO: 41738

SEQ ID NO: 204399 - RNA, 64 nt, hsa; identical to SEQ ID NO: 41739

SEQ ID NO: 204400 - RNA, 64 nt, hsa; identical to SEQ ID NO: 41740

SEQ ID NO: 204401 - RNA, 64 nt, hsa; identical to SEQ ID NO: 41741

SEQ ID NO: 204402 - RNA, 64 nt, hsa; identical to SEQ ID NO: 41742

SEQ ID NO: 204403 - RNA, 64 nt, hsa; identical to SEQ ID NO: 41743

SEQ ID NO: 204404 - RNA, 64 nt, hsa; identical to SEQ ID NO: 41744

SEQ ID NO: 204405 - RNA, 64 nt, hsa; identical to SEQ ID NO: 41745

SEQ ID NO: 204406 - RNA, 64 nt, hsa; identical to SEQ ID NO: 41746

SEQ ID NO: 204407 - RNA, 64 nt, hsa; identical to SEQ ID NO: 41747

SEQ ID NO: 204408 - RNA, 64 nt, hsa; identical to SEQ ID NO: 41748

SEQ ID NO: 204409 - RNA, 64 nt, hsa; identical to SEQ ID NO: 41749

SEQ ID NO: 204410 - RNA, 64 nt, hsa; identical to SEQ ID NO: 41750

SEQ ID NO: 204411 - RNA, 64 nt, hsa; identical to SEQ ID NO: 41751

SEQ ID NO: 204412 - RNA, 64 nt, hsa; identical to SEQ ID NO: 41752

SEQ ID NO: 204413 - RNA, 64 nt, hsa; identical to SEQ ID NO: 41753

SEQ ID NO: 204414 - RNA, 64 nt, hsa; identical to SEQ ID NO: 41754

SEQ ID NO: 204415 - RNA, 64 nt, hsa; identical to SEQ ID NO: 41755

SEQ ID NO: 204416 - RNA, 64 nt, hsa; identical to SEQ ID NO: 41756

SEQ ID NO: 204417 - RNA, 64 nt, hsa; identical to SEQ ID NO: 41757

SEQ ID NO: 204418 - RNA, 64 nt, hsa; identical to SEQ ID NO: 41758

SEQ ID NO: 204419 - RNA, 64 nt, hsa; identical to SEQ ID NO: 41759

SEQ ID NO: 204420 - RNA, 64 nt, hsa; identical to SEQ ID NO: 41760

SEQ ID NO: 204421 - RNA, 64 nt, hsa; identical to SEQ ID NO: 41761

SEQ ID NO: 204422 - RNA, 64 nt, hsa; identical to SEQ ID NO: 41762

SEQ ID NO: 204423 - RNA, 64 nt, hsa; identical to SEQ ID NO: 41763

SEQ ID NO: 204424 - RNA, 64 nt, hsa; identical to SEQ ID NO: 41764

SEQ ID NO: 204425 - RNA, 64 nt, hsa; identical to SEQ ID NO: 41765

SEQ ID NO: 204426 - RNA, 64 nt, hsa; identical to SEQ ID NO: 41766

SEQ ID NO: 204427 - RNA, 64 nt, hsa; identical to SEQ ID NO: 41767

SEQ ID NO: 204428 - RNA, 64 nt, hsa; identical to SEQ ID NO: 41768

SEQ ID NO: 204429 - RNA, 64 nt, hsa; identical to SEQ ID NO: 41769

SEQ ID NO: 204430 - RNA, 64 nt, hsa; identical to SEQ ID NO: 41770

SEQ ID NO: 204431 - RNA, 64 nt, hsa; identical to SEQ ID NO: 41771

SEQ ID NO: 204432 - RNA, 64 nt, hsa; identical to SEQ ID NO: 41772

SEQ ID NO: 204433 - RNA, 64 nt, hsa; identical to SEQ ID NO: 41773

SEQ ID NO: 204434 - RNA, 64 nt, hsa; identical to SEQ ID NO: 41774

SEQ ID NO: 204435 - RNA, 64 nt, hsa; identical to SEQ ID NO: 41775

SEQ ID NO: 204436 - RNA, 64 nt, hsa; identical to SEQ ID NO: 41776

SEQ ID NO: 204437 - RNA, 64 nt, hsa; identical to SEQ ID NO: 41777

SEQ ID NO: 204438 - RNA, 64 nt, hsa; identical to SEQ ID NO: 41778

SEQ ID NO: 204439 - RNA, 64 nt, hsa; identical to SEQ ID NO: 41779

SEQ ID NO: 204440 - RNA, 64 nt, hsa; identical to SEQ ID NO: 41780

SEQ ID NO: 204441 - RNA, 64 nt, hsa; identical to SEQ ID NO: 41781

SEQ ID NO: 204442 - RNA, 64 nt, hsa; identical to SEQ ID NO: 41782

SEQ ID NO: 204443 - RNA, 64 nt, hsa; identical to SEQ ID NO: 41783

SEQ ID NO: 204444 - RNA, 64 nt, hsa; identical to SEQ ID NO: 41784

SEQ ID NO: 204445 - RNA, 64 nt, hsa; identical to SEQ ID NO: 41785

SEQ ID NO: 204446 - RNA, 64 nt, hsa; identical to SEQ ID NO: 41786

SEQ ID NO: 204447 - RNA, 64 nt, hsa; identical to SEQ ID NO: 41787

SEQ ID NO: 204448 - RNA, 64 nt, hsa; identical to SEQ ID NO: 41788

SEQ ID NO: 204449 - RNA, 64 nt, hsa; identical to SEQ ID NO: 41789

SEQ ID NO: 204450 - RNA, 64 nt, hsa; identical to SEQ ID NO: 41790

SEQ ID NO: 204451 - RNA, 64 nt, hsa; identical to SEQ ID NO: 41791

SEQ ID NO: 204452 - RNA, 64 nt, hsa; identical to SEQ ID NO: 41792

SEQ ID NO: 204453 - RNA, 64 nt, hsa; identical to SEQ ID NO: 41793

SEQ ID NO: 204454 - RNA, 64 nt, hsa; identical to SEQ ID NO: 41794

SEQ ID NO: 204455 - RNA, 64 nt, hsa; identical to SEQ ID NO: 41795

SEQ ID NO: 204456 - RNA, 64 nt, hsa; identical to SEQ ID NO: 41796

SEQ ID NO: 204457 - RNA, 64 nt, hsa; identical to SEQ ID NO: 41797

SEQ ID NO: 204458 - RNA, 64 nt, hsa; identical to SEQ ID NO: 41798

SEQ ID NO: 204459 - RNA, 64 nt, hsa; identical to SEQ ID NO: 41799

SEQ ID NO: 204460 - RNA, 64 nt, hsa; identical to SEQ ID NO: 41800

SEQ ID NO: 204461 - RNA, 64 nt, hsa; identical to SEQ ID NO: 41801

SEQ ID NO: 204462 - RNA, 64 nt, hsa; identical to SEQ ID NO: 41802

SEQ ID NO: 204463 - RNA, 64 nt, hsa; identical to SEQ ID NO: 41803

SEQ ID NO: 204464 - RNA, 64 nt, hsa; identical to SEQ ID NO: 41804

SEQ ID NO: 204465 - RNA, 64 nt, hsa; identical to SEQ ID NO: 41805

SEQ ID NO: 204466 - RNA, 64 nt, hsa; identical to SEQ ID NO: 41806

SEQ ID NO: 204467 - RNA, 64 nt, hsa; identical to SEQ ID NO: 41807

SEQ ID NO: 204468 - RNA, 64 nt, hsa; identical to SEQ ID NO: 41808

SEQ ID NO: 204469 - RNA, 64 nt, hsa; identical to SEQ ID NO: 41809
